United States Patent 11,640,849 (METHODS FOR HISTOLOGICAL DIAGNOSIS AND TREATMENT OF DISEASES) - sequence listing, part 4

SEQ ID NO: 118013 - protein, 25 aa, Mycobacterium avium
TRVRFTITVEPWVPLPEFWVRRARK

SEQ ID NO: 118014 - protein, 28 aa, Mycobacterium avium
TRWRHGGSPLLRRLLDAGTVELLGGPLA

SEQ ID NO: 118015 - protein, 28 aa, Mycobacterium avium
TSAGMFGFSPFLDITAESWSRIIDVNLT

SEQ ID NO: 118016 - protein, 17 aa, Mycobacterium avium
TSALRPEFAQQYAQLRK

SEQ ID NO: 118017 - protein, 28 aa, Mycobacterium avium
TSDGKPFHQLPFALTPGPPIPTTALRDS

SEQ ID NO: 118018 - protein, 25 aa, Mycobacterium avium
TSDQEVRWCPGCGDYVILNTIRNFL

SEQ ID NO: 118019 - protein, 23 aa, Mycobacterium avium
TSDSPLWPVRSAVIICGGGEIQQ

SEQ ID NO: 118020 - protein, 29 aa, Mycobacterium avium
TSFSMVMENRWLPMKQTALALNHLVCTRF

SEQ ID NO: 118021 - protein, 18 aa, Mycobacterium avium
TSFYDWYADLPVASPQVF

SEQ ID NO: 118022 - protein, 24 aa, Mycobacterium avium
TSGQRALYELGMTGIPIVNVNNNC

SEQ ID NO: 118023 - protein, 17 aa, Mycobacterium avium
TSIDPEILLLDEGLGAV

SEQ ID NO: 118024 - protein, 20 aa, Mycobacterium avium
TSLEVIPDHIPWEVAALNEP

SEQ ID NO: 118025 - protein, 22 aa, Mycobacterium avium
TSPNVLIYAAMDGWRRQMVQHG

SEQ ID NO: 118026 - protein, 22 aa, Mycobacterium avium
TSSPGFSWQPLHTMPGISTFYT

SEQ ID NO: 118027 - protein, 21 aa, Mycobacterium avium
TSTGVFDLLLGDAGPAVVGDE

SEQ ID NO: 118028 - protein, 19 aa, Mycobacterium avium
TTALLSRTEPHRRPMQLIA

SEQ ID NO: 118029 - protein, 25 aa, Mycobacterium avium
TTATVLAQALVKGGLRLVAAGANPI

SEQ ID NO: 118030 - protein, 18 aa, Mycobacterium avium
TTCGSKILQGWRSPYDAT

SEQ ID NO: 118031 - protein, 33 aa, Mycobacterium avium
TTDLMAINFLGHRYLIERLLERNQLPSGSAICF

SEQ ID NO: 118032 - protein, 25 aa, Mycobacterium avium
TTETPLDARYWRRHSRQPVQFAESV

SEQ ID NO: 118033 - protein, 17 aa, Mycobacterium avium
TTFTLWGSGVVDLRYAD

SEQ ID NO: 118034 - protein, 24 aa, Mycobacterium avium
TTGRLIMQYASQNLIPVTLELGGK

SEQ ID NO: 118035 - protein, 34 aa, Mycobacterium avium
TTIGGYAERMLLSAPLLLPIPNGLDVKHAALTEP

SEQ ID NO: 118036 - protein, 30 aa, Mycobacterium avium
TTLGRVLFNELLPVGYPFVNKQMHKKVQAS

SEQ ID NO: 118037 - protein, 31 aa, Mycobacterium avium
TTMSHLLKDLDLLEPLRGLLADGLPAYGACA

SEQ ID NO: 118038 - protein, 27 aa, Mycobacterium avium
TTMTTADLFVRYLRPVRQGSAFAVPRM

SEQ ID NO: 118039 - protein, 29 aa, Mycobacterium avium
TTRQRYVEPYRAELQRLGRPVFGPTFEVD

SEQ ID NO: 118040 - protein, 17 aa, Mycobacterium avium
TTSLIDYNRAGVPLIEI

SEQ ID NO: 118041 - protein, 23 aa, Mycobacterium avium
TTTGVLRLYQFAAAGDLAFPAIN

SEQ ID NO: 118042 - protein, 29 aa, Mycobacterium avium
TTTKDLHLDYAYYNPLSLVIRDQQLLEKK

SEQ ID NO: 118043 - protein, 23 aa, Mycobacterium avium
TTTTERILYYTGISYKIGEVHDG

SEQ ID NO: 118044 - protein, 31 aa, Mycobacterium avium
TTVNTVLQAAWAQLLMMLTGQHDVAFGTAVS

SEQ ID NO: 118045 - protein, 24 aa, Mycobacterium avium
TTYPLLLHEAYVRLYPAQVIKQAD

SEQ ID NO: 118046 - protein, 20 aa, Mycobacterium avium
TVADMMIYMAWSMAGRGAQE

SEQ ID NO: 118047 - protein, 27 aa, Mycobacterium avium
TVADTALGLILMTLRRLGAADRYVRAG

SEQ ID NO: 118048 - protein, 22 aa, Mycobacterium avium
TVALGLLHRLTATVAKVGVFRP

SEQ ID NO: 118049 - protein, 20 aa, Mycobacterium avium
TVAQRRLPLLIASGADVHVI

SEQ ID NO: 118050 - protein, 26 aa, Mycobacterium avium
TVARRGGLVILPQDLPITAVQQTVQF

SEQ ID NO: 118051 - protein, 31 aa, Mycobacterium avium
TVAVMPLYHGHGLLAALLATLASGGAVLLPA

SEQ ID NO: 118052 - protein, 26 aa, Mycobacterium avium
TVDFPPVNAIPSRGWFDLADTVTAAG

SEQ ID NO: 118053 - protein, 25 aa, Mycobacterium avium
TVDLRRSYPFYGQPHQGGIDTPPQR

SEQ ID NO: 118054 - protein, 32 aa, Mycobacterium avium
TVDRAAFHWWLVLATLRWGVICRYQAERHLSG

SEQ ID NO: 118055 - protein, 30 aa, Mycobacterium avium
TVEMLRRTTPLRLFWARDYSDYHPEEPGGS

SEQ ID NO: 118056 - protein, 22 aa, Mycobacterium avium
TVFQDFRLLQQKTVYENVAFAL

SEQ ID NO: 118057 - protein, 19 aa, Mycobacterium avium
TVFQGILRPMHEKIVGRIA

SEQ ID NO: 118058 - protein, 33 aa, Mycobacterium avium
TVFTSARWHVSIWPDVPILLVCAHPQTRREITT

SEQ ID NO: 118059 - protein, 29 aa, Mycobacterium avium
TVGDPLTDIGWLEMLWMQPVGINSHPAAL

SEQ ID NO: 118060 - protein, 17 aa, Mycobacterium avium
TVGRTLAALTLNLPTRN

SEQ ID NO: 118061 - protein, 23 aa, Mycobacterium avium
TVHYPKIVLVTGACRFLGGYLTA

SEQ ID NO: 118062 - protein, 17 aa, Mycobacterium avium
TVIINRPAARNAVNGPT

SEQ ID NO: 118063 - protein, 17 aa, Mycobacterium avium
TVIVKPAPETPLDALWL

SEQ ID NO: 118064 - protein, 22 aa, Mycobacterium avium
TVKALPSTWWNAGMAGSDTRPV

SEQ ID NO: 118065 - protein, 18 aa, Mycobacterium avium
TVKRVFLELGGKSAAIIL

SEQ ID NO: 118066 - protein, 17 aa, Mycobacterium avium
TVLVAAPPGYRLNIPDD

SEQ ID NO: 118067 - protein, 22 aa, Mycobacterium avium
TVMLRMPLHPVAIELLREVGPM

SEQ ID NO: 118068 - protein, 32 aa, Mycobacterium avium
TVNEEVAPWLDLVRKLGLLAATLSDGPPVSLS

SEQ ID NO: 118069 - protein, 27 aa, Mycobacterium avium
TVPAARARLLAPIPRPPSIRDSLCFLD

SEQ ID NO: 118070 - protein, 18 aa, Mycobacterium avium
TVPAGSAMLLLFGAANRD

SEQ ID NO: 118071 - protein, 31 aa, Mycobacterium avium
TVPPAVVTANRALFAQLVASNILGQNTAAIG

SEQ ID NO: 118072 - protein, 20 aa, Mycobacterium avium
TVQMGFSDAGAHLRNMAFYN

SEQ ID NO: 118073 - protein, 28 aa, Mycobacterium avium
TVRHLEVIALTPARLLMVVITDSGRVDQ

SEQ ID NO: 118074 - protein, 20 aa, Mycobacterium avium
TVRPDFWELVDYATAHHVGV

SEQ ID NO: 118075 - protein, 25 aa, Mycobacterium avium
TVRRDPMAMLPFLGYHVGDYFQHWI

SEQ ID NO: 118076 - protein, 24 aa, Mycobacterium avium
TVTTKVGFLPPPYFEATTIEEFMD

SEQ ID NO: 118077 - protein, 23 aa, Mycobacterium avium
TVVELYNLVVWNERNIELARELL

SEQ ID NO: 118078 - protein, 18 aa, Mycobacterium avium
TVVHRLLRRYRLELARPG

SEQ ID NO: 118079 - protein, 38 aa, Mycobacterium avium
TVVIYGDKSNWWAAYALWVFTLFGHPDVRLLNGGRDLW

SEQ ID NO: 118080 - protein, 19 aa, Mycobacterium avium
TVWFELHEELIVAVGLTRQ

SEQ ID NO: 118081 - protein, 26 aa, Mycobacterium avium
TWAEAQPLLRPVLRPQSYANRLVNDG

SEQ ID NO: 118082 - protein, 18 aa, Mycobacterium avium
TWMLQRAVGPQVARAALL

SEQ ID NO: 118083 - protein, 26 aa, Mycobacterium avium
TWTEEQTYFFRLSAYTDKLLAHYEAN

SEQ ID NO: 118084 - protein, 17 aa, Mycobacterium avium
TYERAFSAAYDALDVLP

SEQ ID NO: 118085 - protein, 20 aa, Mycobacterium avium
TYKEFELLKYLAQHAGRVFT

SEQ ID NO: 118086 - protein, 24 aa, Mycobacterium avium
TYQNAMRWYSFDPFTHISREQATV

SEQ ID NO: 118087 - protein, 25 aa, Mycobacterium avium
TYSLNRFPELVAAAPKGLFLTGTAV

SEQ ID NO: 118088 - protein, 21 aa, Mycobacterium avium
TYVRKPPYFEGMPAEPEPVAD

SEQ ID NO: 118089 - protein, 20 aa, Mycobacterium avium
VAADLRADWSRPLEAAGFDV

SEQ ID NO: 118090 - protein, 26 aa, Mycobacterium avium
VAAEVARLALFLTSPAARHITGQTLH

SEQ ID NO: 118091 - protein, 18 aa, Mycobacterium avium
VAAGEKLVFAQDDIELRG

SEQ ID NO: 118092 - protein, 24 aa, Mycobacterium avium
VAAGRWPAVRFAVRNTAVQGPNAV

SEQ ID NO: 118093 - protein, 18 aa, Mycobacterium avium
VAALATPHRFGSAIGALA

SEQ ID NO: 118094 - protein, 25 aa, Mycobacterium avium
VAALEVRLQAWALILEAVAGRDVSA

SEQ ID NO: 118095 - protein, 19 aa, Mycobacterium avium
VAALFSRRGFNIESLAVGA

SEQ ID NO: 118096 - protein, 17 aa, Mycobacterium avium
VAALHWDGDITGLVRSH

SEQ ID NO: 118097 - protein, 24 aa, Mycobacterium avium
VAALRSIGITPDALILRCDRDVPE

SEQ ID NO: 118098 - protein, 28 aa, Mycobacterium avium
VAANRARLAMLLATNFFGINYPAIAETE

SEQ ID NO: 118099 - protein, 21 aa, Mycobacterium avium
VAATLVVRYLGPAYPPVTETR

SEQ ID NO: 118100 - protein, 19 aa, Mycobacterium avium
VADRFYRAPELVGTFTVLL

SEQ ID NO: 118101 - protein, 18 aa, Mycobacterium avium
VADRGAMFDPSAVFYMNK

SEQ ID NO: 118102 - protein, 26 aa, Mycobacterium avium
VAEHLAPGARLWWQAGHRSTEPGHAL

SEQ ID NO: 118103 - protein, 25 aa, Mycobacterium avium
VAEIEVLPVTKFFPATDVVTLSRLG

SEQ ID NO: 118104 - protein, 26 aa, Mycobacterium avium
VAEIVELGQLFRLPIAALGNGSTIRD

SEQ ID NO: 118105 - protein, 24 aa, Mycobacterium avium
VAELARLDLGSVLIPMPEAGQLQV

SEQ ID NO: 118106 - protein, 27 aa, Mycobacterium avium
VAELDRGTWTPAPVFAMIAQRGRVTRE

SEQ ID NO: 118107 - protein, 24 aa, Mycobacterium avium
VAELDRHLLRPLRDVIWGDDENVL

SEQ ID NO: 118108 - protein, 27 aa, Mycobacterium avium
VAGAAHFLEHLLFKSTPTRTAVDIAQA

SEQ ID NO: 118109 - protein, 21 aa, Mycobacterium avium
VAGALNLPLGSPVLVLERTSY

SEQ ID NO: 118110 - protein, 20 aa, Mycobacterium avium
VAGLLLLDPAIGLDGAWMRE

SEQ ID NO: 118111 - protein, 24 aa, Mycobacterium avium
VAHGTFFFHFPTKEHVLLELERRE

SEQ ID NO: 118112 - protein, 19 aa, Mycobacterium avium
VAHLARLSRLALTDAELDS

SEQ ID NO: 118113 - protein, 21 aa, Mycobacterium avium
VAIHVLIHALNQWLDEVWGFN

SEQ ID NO: 118114 - protein, 33 aa, Mycobacterium avium
VAIILRTEKSVMFVIPWGSHWIIGTTDTDWDLD

SEQ ID NO: 118115 - protein, 22 aa, Mycobacterium avium
VAINYLGPVHVCSAFLPGMIET

SEQ ID NO: 118116 - protein, 23 aa, Mycobacterium avium
VAIPRWHMVGHIQRNKARSVARW

SEQ ID NO: 118117 - protein, 21 aa, Mycobacterium avium
VAIQRPIFVTGLVRTGTTALH

SEQ ID NO: 118118 - protein, 24 aa, Mycobacterium avium
VAKPDLLQLITTDSAVIITRASAR

SEQ ID NO: 118119 - protein, 17 aa, Mycobacterium avium
VALAHHSGYRTMMSHRS

SEQ ID NO: 118120 - protein, 18 aa, Mycobacterium avium
VALLDYRMPGMDGAQVAA

SEQ ID NO: 118121 - protein, 19 aa, Mycobacterium avium
VALLRLACEAADAALTALV

SEQ ID NO: 118122 - protein, 24 aa, Mycobacterium avium
VALVNSWSAAFARYGRTVGQVLLS

SEQ ID NO: 118123 - protein, 19 aa, Mycobacterium avium
VALYAYYSQGRRAVSMVPV

SEQ ID NO: 118124 - protein, 26 aa, Mycobacterium avium
VAMAGAAAPYFAWLAEAGTQAEEAAG

SEQ ID NO: 118125 - protein, 18 aa, Mycobacterium avium
VAMIARRYMHLSGATSRD

SEQ ID NO: 118126 - protein, 19 aa, Mycobacterium avium
VAMPLRLTSPAPCTNCHGS

SEQ ID NO: 118127 - protein, 23 aa, Mycobacterium avium
VANRLCAQILLLAAEDPTKDISL

SEQ ID NO: 118128 - protein, 26 aa, Mycobacterium avium
VAPAIISLTLLPKLSARAAARYYLTG

SEQ ID NO: 118129 - protein, 18 aa, Mycobacterium avium
VAPSTLWSLTVDPQRPGS

SEQ ID NO: 118130 - protein, 20 aa, Mycobacterium avium
VAQFTFVPAAGAILADWGAD

SEQ ID NO: 118131 - protein, 19 aa, Mycobacterium avium
VAQLTQPVRWDLCTATLRE

SEQ ID NO: 118132 - protein, 24 aa, Mycobacterium avium
VAQRAAFITEFLQREVQGFLRLAQ

SEQ ID NO: 118133 - protein, 28 aa, Mycobacterium avium
VAQTVARWLVLYLRRPGGQTQFAAPVWM

SEQ ID NO: 118134 - protein, 27 aa, Mycobacterium avium
VARAGKLPVTLFTAGGIATPADAAMMM

SEQ ID NO: 118135 - protein, 24 aa, Mycobacterium avium
VARAQLRAIFSELFRQLPGIQAGE

SEQ ID NO: 118136 - protein, 23 aa, Mycobacterium avium
VARAVGIGDLKFFSQIGYGGGAA

SEQ ID NO: 118137 - protein, 25 aa, Mycobacterium avium
VAREALDRGIPVLRPARPNSPEFVA

SEQ ID NO: 118138 - protein, 20 aa, Mycobacterium avium
VARIKFPTPAACGRTPLTAT

SEQ ID NO: 118139 - protein, 23 aa, Mycobacterium avium
VARKLSFIAATVYALDAVLELSA

SEQ ID NO: 118140 - protein, 22 aa, Mycobacterium avium
VARRGLPLITDSFQYPIEGFTD

SEQ ID NO: 118141 - protein, 25 aa, Mycobacterium avium
VASATPLPVIGVPVPLGRLDGLDSL

SEQ ID NO: 118142 - protein, 26 aa, Mycobacterium avium
VASRQMHVLPIPYVEPADISNAILFL

SEQ ID NO: 118143 - protein, 18 aa, Mycobacterium avium
VASYLLADGLFQQRLHGC

SEQ ID NO: 118144 - protein, 26 aa, Mycobacterium avium
VATETFAPILYVLTYDRLDDAIALNN

SEQ ID NO: 118145 - protein, 26 aa, Mycobacterium avium
VATVSIWMGILLTEKLRAAFGADPAA

SEQ ID NO: 118146 - protein, 19 aa, Mycobacterium avium
VAVAFPRSPFVTAAVAWEL

SEQ ID NO: 118147 - protein, 28 aa, Mycobacterium avium
VAVARQLRILPFAPANRASGSAAGIADL

SEQ ID NO: 118148 - protein, 31 aa, Mycobacterium avium
VAVLSQRPRMLYDYFQQLFAQVTNPPLDAIR

SEQ ID NO: 118149 - protein, 26 aa, Mycobacterium avium
VAVRPRKPLLPPPQQPPGREPTHRRA

SEQ ID NO: 118150 - protein, 32 aa, Mycobacterium avium
VAVRYPAGIDWVLAFWGTVLAGGVAVAVNTRS

SEQ ID NO: 118151 - protein, 24 aa, Mycobacterium avium
VAVSDWMRAVPEQIRPWVPGTYVT

SEQ ID NO: 118152 - protein, 25 aa, Mycobacterium avium
VAVTREVLGAGIPLFGICFGNQILG

SEQ ID NO: 118153 - protein, 28 aa, Mycobacterium avium
VCAAEGIAWVPYFPLGSAFPGLPKVTDN

SEQ ID NO: 118154 - protein, 21 aa, Mycobacterium avium
VCALLSDWLPATTGTIIYADG

SEQ ID NO: 118155 - protein, 30 aa, Mycobacterium avium
VCEQLAAAEPWWEPGTAQGYHMTTFGFIMG

SEQ ID NO: 118156 - protein, 29 aa, Mycobacterium avium
VDAADWAEMLMRMYIRWAEQHKYPVEVFD

SEQ ID NO: 118157 - protein, 23 aa, Mycobacterium avium
VDAFLAVCRKWDVLATVIGEVTD

SEQ ID NO: 118158 - protein, 25 aa, Mycobacterium avium
VDDADEWLIARWGCLRAANLAWGCG

SEQ ID NO: 118159 - protein, 20 aa, Mycobacterium avium
VDDMLRAWRIGVEVVVECAR

SEQ ID NO: 118160 - protein, 25 aa, Mycobacterium avium
VDDQDLVRSGLRRILRRKDGFVIVA

SEQ ID NO: 118161 - protein, 29 aa, Mycobacterium avium
VDEAAALMIDLFWYGLKGSPEEREAAAAQ

SEQ ID NO: 118162 - protein, 30 aa, Mycobacterium avium; identical to SEQ ID NO: 85505

SEQ ID NO: 118163 - protein, 24 aa, Mycobacterium avium
VDFLPAGLAVHRRGRRLRFMIKAE

SEQ ID NO: 118164 - protein, 25 aa, Mycobacterium avium
VDGDLLRFWVGDNLVKTAARTSRGE

SEQ ID NO: 118165 - protein, 22 aa, Mycobacterium avium
VDGFRFDLAATLAREFYDVDRL

SEQ ID NO: 118166 - protein, 24 aa, Mycobacterium avium
VDGGTFDWTQGRFPGFTTPDPSYH

SEQ ID NO: 118167 - protein, 51 aa, Mycobacterium avium
VDGQHISTLLLTLLFRFMRPLIEHGHVFLAQPPLYKLKWQRSDPEFAYSDR

SEQ ID NO: 118168 - protein, 18 aa, Mycobacterium avium
VDHLFGSIWTRPGLSMRD

SEQ ID NO: 118169 - protein, 25 aa, Mycobacterium avium
VDHWADALAGLLRAPAPAAAAMSRA

SEQ ID NO: 118170 - protein, 25 aa, Mycobacterium avium
VDICPWALREGLILRKLDSEADGTA

SEQ ID NO: 118171 - protein, 26 aa, Mycobacterium avium
VDKALLARIGDAFLALPEGFTAHPRV

SEQ ID NO: 118172 - protein, 26 aa, Mycobacterium avium
VDLAREKLLAEVLRAASRDGLVSAAH

SEQ ID NO: 118173 - protein, 27 aa, Mycobacterium avium
VDLATRRSIFIPILRVAAIDPNAVTLS

SEQ ID NO: 118174 - protein, 29 aa, Mycobacterium avium
VDLGPIALALLKRGLPADTALATGPQAAV

SEQ ID NO: 118175 - protein, 29 aa, Mycobacterium avium
VDNKLAEFEEFLNGTLRSVGRGRHQLRTA

SEQ ID NO: 118176 - protein, 24 aa, Mycobacterium avium
VDPERYHWFLGDGMVHGIRIRDGK

SEQ ID NO: 118177 - protein, 18 aa, Mycobacterium avium
VDPWFIAQIGELVALRGE

SEQ ID NO: 118178 - protein, 23 aa, Mycobacterium avium
VDRHIFESTLYFVPPRNARERLA

SEQ ID NO: 118179 - protein, 21 aa, Mycobacterium avium
VDRLRRWSVLLRGRGACATLD

SEQ ID NO: 118180 - protein, 32 aa, Mycobacterium avium
VDRYGALPEPALRLVAVARLRLLCRAAGITEV

SEQ ID NO: 118181 - protein, 27 aa, Mycobacterium avium
VDTRRWAGVPFYLRTGKRLGRRVTEIA

SEQ ID NO: 118182 - protein, 25 aa, Mycobacterium avium
VDVFKEKLIRRDISMKAFDAGEPQA

SEQ ID NO: 118183 - protein, 25 aa, Mycobacterium avium
VDVVRFAGGWIFDRSMAGWDVTVLL

SEQ ID NO: 118184 - protein, 32 aa, Mycobacterium avium
VDWVRINGFGTPWWADDLTALAGTPVGGVMLA

SEQ ID NO: 118185 - protein, 18 aa, Mycobacterium avium
VEALDRHRLLSDVTRVLA

SEQ ID NO: 118186 - protein, 32 aa, Mycobacterium avium
VEARRRGIPVILRPAVLAKLMDGRTTLMVTGT

SEQ ID NO: 118187 - protein, 27 aa, Mycobacterium avium
VEDVANLAMFLLSDAAGWITGQCINVD

SEQ ID NO: 118188 - protein, 26 aa, Mycobacterium avium
VEDVFPLPRELVGDGTLFLLKVVGDS

SEQ ID NO: 118189 - protein, 25 aa, Mycobacterium avium
VEDVLLELVGWLRDRTDGDALCLAG

SEQ ID NO: 118190 - protein, 33 aa, Mycobacterium avium
VEEILAWLYAQVLGLPRRVGVQESFFDLGGDSL

SEQ ID NO: 118191 - protein, 26 aa, Mycobacterium avium
VEEMGGMNIFFVFGSGGSARLVTPEL

SEQ ID NO: 118192 - protein, 26 aa, Mycobacterium avium
VEHFILEDYWGRWLGRWTAEEHLHAI

SEQ ID NO: 118193 - protein, 27 aa, Mycobacterium avium
VEHVLATQTLPLRPFKTMAVNVDGELP

SEQ ID NO: 118194 - protein, 24 aa, Mycobacterium avium
VEKANFELWCFAVSAINGCPDCVA

SEQ ID NO: 118195 - protein, 18 aa, Mycobacterium avium
VELLWKLIEQSPGLEITA

SEQ ID NO: 118196 - protein, 26 aa, Mycobacterium avium
VELRRRIGHAPLWLPGITAVTIRGRK

SEQ ID NO: 118197 - protein, 18 aa, Mycobacterium avium
VEMFRKLLDQGQAGDNVG

SEQ ID NO: 118198 - protein, 19 aa, Mycobacterium avium
VENMFPFRADRFFGAGQSL

SEQ ID NO: 118199 - protein, 24 aa, Mycobacterium avium
VENPAGFHQPRPPWLMSACAPAPV

SEQ ID NO: 118200 - protein, 17 aa, Mycobacterium avium
VEPPLLDAGGHIVKRMG

SEQ ID NO: 118201 - protein, 23 aa, Mycobacterium avium
VEQVVIRHRLTLGVLVCCPADVA

SEQ ID NO: 118202 - protein, 18 aa, Mycobacterium avium
VERIYRDVRLLRLYEGTS

SEQ ID NO: 118203 - protein, 24 aa, Mycobacterium avium
VERLRQRFPKLQDPPSDDICYATQ

SEQ ID NO: 118204 - protein, 24 aa, Mycobacterium avium
VESFGFKYGLPMDADMVMDVRFLP

SEQ ID NO: 118205 - protein, 30 aa, Mycobacterium avium
VETDEVVGIVLLLRDVLARSLFEKYQTEFE

SEQ ID NO: 118206 - protein, 27 aa, Mycobacterium avium
VETEPRTWLLLVTGKLAFADARRTGAL

SEQ ID NO: 118207 - protein, 24 aa, Mycobacterium avium
VETLTGFKWLARADAEVPGGTLVY

SEQ ID NO: 118208 - protein, 24 aa, Mycobacterium avium
VEVAVKMALQYWRSRHRPAKHRLM

SEQ ID NO: 118209 - protein, 20 aa, Mycobacterium avium
VEVPNYKPFWAITKHADVMD

SEQ ID NO: 118210 - protein, 21 aa, Mycobacterium avium
VEVVYYLVHAIGQPGFRDADK

SEQ ID NO: 118211 - protein, 17 aa, Mycobacterium avium
VFAMIGVDLSRLAEDVI

SEQ ID NO: 118212 - protein, 18 aa, Mycobacterium avium
VFCRRWGVPLIDGGTVRL

SEQ ID NO: 118213 - protein, 24 aa, Mycobacterium avium
VFDDPFTFNILRDPNPHVGFGGTG

SEQ ID NO: 118214 - protein, 20 aa, Mycobacterium avium
VFDGFLVHSRFGPAAPLDGT

SEQ ID NO: 118215 - protein, 22 aa, Mycobacterium avium
VFGLPELALGLIPGAGGTVSIT

SEQ ID NO: 118216 - protein, 22 aa, Mycobacterium avium
VFGNGMLLSKHIRLLAAFDHRH

SEQ ID NO: 118217 - protein, 26 aa, Mycobacterium avium
VFIMGDCDQLMPEYLRFVKGVVDAQD

SEQ ID NO: 118218 - protein, 18 aa, Mycobacterium avium
VFITPFHPVGQSPTVALE

SEQ ID NO: 118219 - protein, 19 aa, Mycobacterium avium
VFLRLGPPPDEPNAFVVEG

SEQ ID NO: 118220 - protein, 18 aa, Mycobacterium avium
VFMVLRDPAADMSLTVTC

SEQ ID NO: 118221 - protein, 25 aa, Mycobacterium avium
VFPEATMCRFGVPLAPIAEPVDGPW

SEQ ID NO: 118222 - protein, 18 aa, Mycobacterium avium
VFPLSNWTEFDIWSYIGA

SEQ ID NO: 118223 - protein, 20 aa, Mycobacterium avium
VFREHFLTCFISDKVGVALR

SEQ ID NO: 118224 - protein, 20 aa, Mycobacterium avium
VFSGYRFVRHAAARGIPIAI

SEQ ID NO: 118225 - protein, 18 aa, Mycobacterium avium
VFVALSWTKHPPPQTYQE

SEQ ID NO: 118226 - protein, 36 aa, Mycobacterium avium
VGAIVPWNVPQFLIMPKLIPALIAGCTVIVKPAPET

SEQ ID NO: 118227 - protein, 18 aa, Mycobacterium avium
VGDWLPSILVRRRERLGL

SEQ ID NO: 118228 - protein, 18 aa, Mycobacterium avium
VGDYLPGPTVWRSEDHYL

SEQ ID NO: 118229 - protein, 29 aa, Mycobacterium avium
VGEAEFGPLLRRLGRFLPTDVRVVDITRA

SEQ ID NO: 118230 - protein, 21 aa, Mycobacterium avium
VGEFAVHLALAAGGKCFYTTP

SEQ ID NO: 118231 - protein, 26 aa, Mycobacterium avium
VGEHLDAIRYVEAPLIFPVVPDGHAE

SEQ ID NO: 118232 - protein, 24 aa, Mycobacterium avium
VGETMPQRAPALTAPLLVVHGSDD

SEQ ID NO: 118233 - protein, 29 aa, Mycobacterium avium
VGETVYKHGWWLPERPLTPIGAQMNIGYA

SEQ ID NO: 118234 - protein, 20 aa, Mycobacterium avium
VGFGPPRPLTRLSESYRMAA

SEQ ID NO: 118235 - protein, 24 aa, Mycobacterium avium
VGFSLALGEYLGYGPAAVCARLAE

SEQ ID NO: 118236 - protein, 27 aa, Mycobacterium avium
VGGADSLLVFPFDVAIDGGFPGTATSF

SEQ ID NO: 118237 - protein, 24 aa, Mycobacterium avium
VGGHLTALRRTRVGRFGLEQAYGL

SEQ ID NO: 118238 - protein, 19 aa, Mycobacterium avium
VGGRITGVFTPAGIDSCGT

SEQ ID NO: 118239 - protein, 19 aa, Mycobacterium avium
VGHRLSAFVAITPLDPSQP

SEQ ID NO: 118240 - protein, 23 aa, Mycobacterium avium
VGKAAIYRRWSSKAALMTDALIY

SEQ ID NO: 118241 - protein, 24 aa, Mycobacterium avium
VGLDTTLWLLDREAAAKLPPGTAV

SEQ ID NO: 118242 - protein, 18 aa, Mycobacterium avium
VGLGGLGHMGVKLGAAMG

SEQ ID NO: 118243 - protein, 26 aa, Mycobacterium avium
VGLILTQWAHLLGARVITTVSTPEKA

SEQ ID NO: 118244 - protein, 19 aa, Mycobacterium avium
VGLLNVQYALKDDVLYVLE

SEQ ID NO: 118245 - protein, 22 aa, Mycobacterium avium
VGLRIVIELKRDAVAKVVLNNL

SEQ ID NO: 118246 - protein, 31 aa, Mycobacterium avium
VGLRSSYVASWYAAPLLVAGGRGLIAFTSSP

SEQ ID NO: 118247 - protein, 18 aa, Mycobacterium avium
VGLTFRSPNKLPVTFAPA

SEQ ID NO: 118248 - protein, 26 aa, Mycobacterium avium
VGMGRALIGPLRIGLQRAGVPVVLNT

SEQ ID NO: 118249 - protein, 17 aa, Mycobacterium avium
VGMVGLSGIPFTNVFNA

SEQ ID NO: 118250 - protein, 24 aa, Mycobacterium avium
VGNIYESFLDAFRRFFADAAADPL

SEQ ID NO: 118251 - protein, 27 aa, Mycobacterium avium
VGPPELYAWLHYDPIPTRDDLAKALLA

SEQ ID NO: 118252 - protein, 20 aa, Mycobacterium avium
VGQPFLLTAGFFETHRPYPE

SEQ ID NO: 118253 - protein, 23 aa, Mycobacterium avium
VGQRFPIDPPFGLVAMAWRDDDA

SEQ ID NO: 118254 - protein, 27 aa, Mycobacterium avium
VGRATLYRRFPTKAALVDAVVLAEARR

SEQ ID NO: 118255 - protein, 24 aa, Mycobacterium avium
VGRATRWRLSGLGLRVIAHDPYHP

SEQ ID NO: 118256 - protein, 18 aa, Mycobacterium avium
VGTFSWPGAYGTWWQADP

SEQ ID NO: 118257 - protein, 27 aa, Mycobacterium avium
VGTGRWASIIPQTWIHSLRPPAGARIL

SEQ ID NO: 118258 - protein, 23 aa, Mycobacterium avium
VGVIFLEIHLTYAALVSGGRPLP

SEQ ID NO: 118259 - protein, 30 aa, Mycobacterium avium
VGVRRAIGMVFQRPNPFPAMSIRDNVVAGL

SEQ ID NO: 118260 - protein, 22 aa, Mycobacterium avium
VHAALRQVLGPNAVQAGSLNRP

SEQ ID NO: 118261 - protein, 22 aa, Mycobacterium avium
VHGDLYGTVLFVGSAAPGITDI

SEQ ID NO: 118262 - protein, 26 aa, Mycobacterium avium
VHLTPRAVQYLFRRQLDTTPTEYMRR

SEQ ID NO: 118263 - protein, 28 aa, Mycobacterium avium
VHPIQPGRPCRLLGLLFDDADGCAGHSD

SEQ ID NO: 118264 - protein, 19 aa, Mycobacterium avium
VHPPFRWQRRYAEGFTEQV

SEQ ID NO: 118265 - protein, 17 aa, Mycobacterium avium
VHPYIRRRNGVDPVLYD

SEQ ID NO: 118266 - protein, 17 aa, Mycobacterium avium
VHRFLGASYRPGGERDS

SEQ ID NO: 118267 - protein, 24 aa, Mycobacterium avium
VHRVPSRMFPKVTTLPLGVPTPRL

SEQ ID NO: 118268 - protein, 17 aa, Mycobacterium avium
VHRYTDIDPARPTILAI

SEQ ID NO: 118269 - protein, 19 aa, Mycobacterium avium
VHYPFPIKDLVAIDDALKF

SEQ ID NO: 118270 - protein, 17 aa, Mycobacterium avium
VIAAVDPQWRRGATQGH

SEQ ID NO: 118271 - protein, 24 aa, Mycobacterium avium
VIADRTKRPPAFPEDIWVPERDPG

SEQ ID NO: 118272 - protein, 19 aa, Mycobacterium avium
VIAIGPSAPYEGPPPGPGD

SEQ ID NO: 118273 - protein, 24 aa, Mycobacterium avium
VIAYARNFLDQAVPLESGSWADAT

SEQ ID NO: 118274 - protein, 22 aa, Mycobacterium avium
VIDLNLIATFNISRLAAAHMAK

SEQ ID NO: 118275 - protein, 19 aa, Mycobacterium avium
VIDPLPNLVFTRDSSIWIG

SEQ ID NO: 118276 - protein, 28 aa, Mycobacterium avium
VIDPVNQVEFFFLRPKDIAIYVGSGELD

SEQ ID NO: 118277 - protein, 19 aa, Mycobacterium avium
VIHGALYRHPKLKVAIVEA

SEQ ID NO: 118278 - protein, 17 aa, Mycobacterium avium
VIKHFFVHYKDLEPGKF

SEQ ID NO: 118279 - protein, 18 aa, Mycobacterium avium
VIKVVREIVSGLGLKEAK

SEQ ID NO: 118280 - protein, 25 aa, Mycobacterium avium
VILDRKGNRHFSFGLGIHRCIGSNV

SEQ ID NO: 118281 - protein, 20 aa, Mycobacterium avium
VIMGRRTWESLPAKVRPLPG

SEQ ID NO: 118282 - protein, 24 aa, Mycobacterium avium
VINYRAERWSDVVKLLTPIVNDTD

SEQ ID NO: 118283 - protein, 19 aa, Mycobacterium avium
VIPPELRPMVQLDGGRFAT

SEQ ID NO: 118284 - protein, 22 aa, Mycobacterium avium
VITELDLRLHPTPTHTVTAICG

SEQ ID NO: 118285 - protein, 34 aa, Mycobacterium avium
VITIFKGLQLDIGAPPQFMDFRYTVHDRWHGEFQ

SEQ ID NO: 118286 - protein, 20 aa, Mycobacterium avium
VIVEFWLMGTHRGYLGKVPP

SEQ ID NO: 118287 - protein, 32 aa, Mycobacterium avium
VIVLTCGMFGNIIRLLPPLTISDELLAEGIDI

SEQ ID NO: 118288 - protein, 24 aa, Mycobacterium avium
VKAELNIGKLLAKRARVIGTTLRG

SEQ ID NO: 118289 - protein, 31 aa, Mycobacterium avium
VKAPSDLTIVSWLPFYHDMGLVLGVCAPVLG

SEQ ID NO: 118290 - protein, 28 aa, Mycobacterium avium
VKDGYGRNFLLPRGLAIVASRGAQKQAD

SEQ ID NO: 118291 - protein, 25 aa, Mycobacterium avium
VKDVFVPRHRFLSYKAMNDGTAGGY

SEQ ID NO: 118292 - protein, 20 aa, Mycobacterium avium
VKDYVAFPALTSLSPGATFL

SEQ ID NO: 118293 - protein, 26 aa, Mycobacterium avium
VKEFTFDYPSRIIAGLLGLPEQDYPQ

SEQ ID NO: 118294 - protein, 19 aa, Mycobacterium avium
VKHPLYGKIIRTTKKVKAH

SEQ ID NO: 118295 - protein, 26 aa, Mycobacterium avium
VKNNLQTVAALLRLQARRTTNPEGRE

SEQ ID NO: 118296 - protein, 27 aa, Mycobacterium avium
VKPALVHYYFPTMDELYLDVFRRGAAA

SEQ ID NO: 118297 - protein, 27 aa, Mycobacterium avium
VKQASTLMNSPFWRAGEGGPGDLNPGI

SEQ ID NO: 118298 - protein, 26 aa, Mycobacterium avium
VKRADLVIGAVLLPGAKAPNLISNSL

SEQ ID NO: 118299 - protein, 26 aa, Mycobacterium avium
VKTVPPRWLPGPRELRAWTLAAGNPE

SEQ ID NO: 118300 - protein, 34 aa, Mycobacterium avium
VKVKPTSVPAFRPGAQFKAVVSGAQRLPSEGPAV

SEQ ID NO: 118301 - protein, 26 aa, Mycobacterium avium
VLADDEWPHLFLPFREGAAHESDLPA

SEQ ID NO: 118302 - protein, 24 aa, Mycobacterium avium
VLATLSMLPRLAGPTVNVAWDAPQ

SEQ ID NO: 118303 - protein, 20 aa, Mycobacterium avium
VLAVLGREPFLDDVLASGGL

SEQ ID NO: 118304 - protein, 22 aa, Mycobacterium avium
VLDLIAARRIPVVSTLAPDAEG

SEQ ID NO: 118305 - protein, 24 aa, Mycobacterium avium
VLDMLAPWEVLESVARLLIPGGVL

SEQ ID NO: 118306 - protein, 24 aa, Mycobacterium avium
VLEVAMYGFVPSAGAVLAEWGAEV

SEQ ID NO: 118307 - protein, 17 aa, Mycobacterium avium
VLFEEIGPFFADRNGGY

SEQ ID NO: 118308 - protein, 17 aa, Mycobacterium avium
VLFLCRSGNRSIGAAEV

SEQ ID NO: 118309 - protein, 27 aa, Mycobacterium avium
VLGSKMNRFFLRGALVARLLSESAWKQ

SEQ ID NO: 118310 - protein, 39 aa, Mycobacterium avium
VLHEMAHMWFGDLVTMAWWDDLWLNESFATFASVLCQSE

SEQ ID NO: 118311 - protein, 24 aa, Mycobacterium avium
VLIPELPGIHPGVLALGNHLVDNG

SEQ ID NO: 118312 - protein, 21 aa, Mycobacterium avium
VLLDALRERGALRRYVPFDVD

SEQ ID NO: 118313 - protein, 21 aa, Mycobacterium avium
VLLGALINHVLTNDLWFSEYV

SEQ ID NO: 118314 - protein, 20 aa, Mycobacterium avium
VLLLDSEVPWVPAQLAPPAT

SEQ ID NO: 118315 - protein, 28 aa, Mycobacterium avium
VLLMAVERIELFAEALLKGGRPADTPVL

SEQ ID NO: 118316 - protein, 17 aa, Mycobacterium avium
VLLQVLFHARIAEDAPQ

SEQ ID NO: 118317 - protein, 20 aa, Mycobacterium avium
VLLRECVEFFAPYLAAARLT

SEQ ID NO: 118318 - protein, 17 aa, Mycobacterium avium
VLPDCMAHWTLPQLTNL

SEQ ID NO: 118319 - protein, 26 aa, Mycobacterium avium
VLPGSLNWRVVVPPGGRWQTEVMVQP

SEQ ID NO: 118320 - protein, 21 aa, Mycobacterium avium
VLPTYAVICCPAFGAAGLVGK

SEQ ID NO: 118321 - protein, 19 aa, Mycobacterium avium
VLQCPFHGWQWSAEGRNVC

SEQ ID NO: 118322 - protein, 17 aa, Mycobacterium avium
VLQVLRLPDDRLDDLLA

SEQ ID NO: 118323 - protein, 22 aa, Mycobacterium avium
VLRALDGRFIPAGPSGSPLRGL

SEQ ID NO: 118324 - protein, 33 aa, Mycobacterium avium
VLRELGIGFVAYSPLGRGFLTGAIRSAHELPDT

SEQ ID NO: 118325 - protein, 25 aa, Mycobacterium avium
VLRGYTLPNGLQLRQQRVPLGVVGM

SEQ ID NO: 118326 - protein, 17 aa, Mycobacterium avium
VLRPLLDELGLVGYPKT

SEQ ID NO: 118327 - protein, 25 aa, Mycobacterium avium
VLSRNTFHWVLAFADGELLTRKVFA

SEQ ID NO: 118328 - protein, 19 aa, Mycobacterium avium
VLTLAMLGIPLKKWKMYSE

SEQ ID NO: 118329 - protein, 17 aa, Mycobacterium avium
VLTQCRPELIERTFAAC

SEQ ID NO: 118330 - protein, 28 aa, Mycobacterium avium
VLVEVVLPRLEIPRLLVELVRPTSPDGS

SEQ ID NO: 118331 - protein, 17 aa, Mycobacterium avium
VLVGSWHTIEGLVYTMP

SEQ ID NO: 118332 - protein, 19 aa, Mycobacterium avium
VLVIAGKDKGAKGKVLKAY

SEQ ID NO: 118333 - protein, 26 aa, Mycobacterium avium
VLVSIENALWPDLFIAGGGISRKADK

SEQ ID NO: 118334 - protein, 18 aa, Mycobacterium avium
VLVSWLPQHHDMGLISAY

SEQ ID NO: 118335 - protein, 28 aa, Mycobacterium avium
VLVTGYDILFFWVARMMMFGTFVGDDDA

SEQ ID NO: 118336 - protein, 31 aa, Mycobacterium avium
VLVVQRMLASRFRPHALLGTERRLAELRDDL

SEQ ID NO: 118337 - protein, 17 aa, Mycobacterium avium
VLVWQDMAGMSSGKSAR

SEQ ID NO: 118338 - protein, 20 aa, Mycobacterium avium
VMADLQRPQGILLHGGVLYV

SEQ ID NO: 118339 - protein, 21 aa, Mycobacterium avium
VMARVVGFHLNRGVLAAARRV

SEQ ID NO: 118340 - protein, 18 aa, Mycobacterium avium
VMCRAGYGRIVLTSSIGG

SEQ ID NO: 118341 - protein, 21 aa, Mycobacterium avium
VMDVRFLPNPHWVDELRPRTG

SEQ ID NO: 118342 - protein, 18 aa, Mycobacterium avium
VMERGVAIVVSYLEHQMA

SEQ ID NO: 118343 - protein, 19 aa, Mycobacterium avium
VMIGSWFAGTYESPGDLMR

SEQ ID NO: 118344 - protein, 19 aa, Mycobacterium avium
VMIVGRNPDRLAGAVEEIA

SEQ ID NO: 118345 - protein, 25 aa, Mycobacterium avium
VMKKAVAYLLPFIEAEKEESGVSGS

SEQ ID NO: 118346 - protein, 19 aa, Mycobacterium avium
VMPMDAWREGEHFVVEFDL

SEQ ID NO: 118347 - protein, 22 aa, Mycobacterium avium
VMPVLKKWRIFEREDFTGEAAA

SEQ ID NO: 118348 - protein, 17 aa, Mycobacterium avium
VMRVPLEGGGRLVVELT

SEQ ID NO: 118349 - protein, 26 aa, Mycobacterium avium
VMSQLRTALRMQILAGYPIAEALEAV

SEQ ID NO: 118350 - protein, 24 aa, Mycobacterium avium
VMTQELLEFPGGVLGVALNLDEHS

SEQ ID NO: 118351 - protein, 30 aa, Mycobacterium avium
VMVAELNFMLIGAAFYRDTYRRTERGWKIS

SEQ ID NO: 118352 - protein, 21 aa, Mycobacterium avium
VNAIDWVCRAPQGLIGVEDIP

SEQ ID NO: 118353 - protein, 18 aa, Mycobacterium avium
VNFGAFVDLGGVDGLVHV

SEQ ID NO: 118354 - protein, 22 aa, Mycobacterium avium
VNHFIPNPTFDPIIVPGCLDLL

SEQ ID NO: 118355 - protein, 17 aa, Mycobacterium avium
VNKLRGRHIPKLRQVIG

SEQ ID NO: 118356 - protein, 25 aa, Mycobacterium avium
VNLIGTFNVLRLAAERIAKTEPIGP

SEQ ID NO: 118357 - protein, 25 aa, Mycobacterium avium
VNLSSAFGLIAVPYQGAYSTSKFAV

SEQ ID NO: 118358 - protein, 26 aa, Mycobacterium avium
VNLTGTFLMTRQALPALLDSGRGVVV

SEQ ID NO: 118359 - protein, 17 aa, Mycobacterium avium
VNNAAIFGGMKLDFLLT

SEQ ID NO: 118360 - protein, 19 aa, Mycobacterium avium
VNSDPYGAGWLLDVQVSDA

SEQ ID NO: 118361 - protein, 33 aa, Mycobacterium avium
VNSFSKYYAMTGWRLGWLLVPVELRRAVECLTG

SEQ ID NO: 118362 - protein, 20 aa, Mycobacterium avium
VNTPIEWLIGVIRSLRVPVD

SEQ ID NO: 118363 - protein, 23 aa, Mycobacterium avium
VPADPVIFLKPNTAIIGPNVPIR

SEQ ID NO: 118364 - protein, 24 aa, Mycobacterium avium
VPARRPELAGLPPALITCAEIDPF

SEQ ID NO: 118365 - protein, 17 aa, Mycobacterium avium
VPAYFNDAQRQATKEAG

SEQ ID NO: 118366 - protein, 25 aa, Mycobacterium avium
VPDGRGLALFISGDNLRKGAALNTI

SEQ ID NO: 118367 - protein, 26 aa, Mycobacterium avium
VPDPHPYFDYLRSQNPVLRLPHYGVV

SEQ ID NO: 118368 - protein, 28 aa, Mycobacterium avium
VPDSPPPLPPEQPPPPPLASDHPLFEGY

SEQ ID NO: 118369 - protein, 17 aa, Mycobacterium avium
VPEARLVVIKPYEASQV

SEQ ID NO: 118370 - protein, 25 aa, Mycobacterium avium
VPEVDLFPTWLRIATRMAGWSKRTA

SEQ ID NO: 118371 - protein, 17 aa, Mycobacterium avium
VPFVDPLTTILDPSLPL

SEQ ID NO: 118372 - protein, 20 aa, Mycobacterium avium
VPFVEFAYIAPEMRAFYDYI

SEQ ID NO: 118373 - protein, 18 aa, Mycobacterium avium
VPFYDHMLTALGSHASFD

SEQ ID NO: 118374 - protein, 26 aa, Mycobacterium avium
VPGGPRPLVFFPGDGSLVLGTDAPDG

SEQ ID NO: 118375 - protein, 22 aa, Mycobacterium avium
VPGNPRLLLSAYDLATVGYVAE

SEQ ID NO: 118376 - protein, 24 aa, Mycobacterium avium
VPGPFEFLRVIGAYYTPGFHPSQL

SEQ ID NO: 118377 - protein, 26 aa, Mycobacterium avium
VPHGRDEIWRFTPLRRLRGLHDGSAP

SEQ ID NO: 118378 - protein, 24 aa, Mycobacterium avium
VPHLHVHVFPTRSLSDFGFANVDR

SEQ ID NO: 118379 - protein, 20 aa, Mycobacterium avium
VPISGILFGARRKTTVPLVT

SEQ ID NO: 118380 - protein, 18 aa, Mycobacterium avium
VPLSEMFGYVGDLRSKTQ

SEQ ID NO: 118381 - protein, 28 aa, Mycobacterium avium
VPLSFAQSRLWFIGQLHGPSPVYNMVAA

SEQ ID NO: 118382 - protein, 23 aa, Mycobacterium avium
VPMVFPVWFENLQVKYLNSAIKP

SEQ ID NO: 118383 - protein, 27 aa, Mycobacterium avium
VPPDQELAFLRPLPVRRLWGVGAVTAE

SEQ ID NO: 118384 - protein, 17 aa, Mycobacterium avium
VPSLPGRRRPPTVAVIN

SEQ ID NO: 118385 - protein, 24 aa, Mycobacterium avium
VPSNPADAYWLLRHAIACPDPVMY

SEQ ID NO: 118386 - protein, 25 aa, Mycobacterium avium
VPSPQLQDQLFAEALRVLQPGGTFA

SEQ ID NO: 118387 - protein, 17 aa, Mycobacterium avium
VPTVLMTFDPHPMEVVY

SEQ ID NO: 118388 - protein, 23 aa, Mycobacterium avium
VPVGQLIRKPPELSWEVAGSLYV

SEQ ID NO: 118389 - protein, 18 aa, Mycobacterium avium
VQAALAALNTWVTAGQPA

SEQ ID NO: 118390 - protein, 19 aa, Mycobacterium avium
VQAAQLPLALLTPDMRDRQ

SEQ ID NO: 118391 - protein, 25 aa, Mycobacterium avium
VQAENLVMRYVAEAGLPAVAMCVST

SEQ ID NO: 118392 - protein, 24 aa, Mycobacterium avium
VQASALLDRHWRNLRTLFSHNPTV

SEQ ID NO: 118393 - protein, 18 aa, Mycobacterium avium
VQAWLRRVTPRLTRTEIA

SEQ ID NO: 118394 - protein, 23 aa, Mycobacterium avium
VQDFSGPFPVEVITRMAGVPEEY

SEQ ID NO: 118395 - protein, 23 aa, Mycobacterium avium
VQEPTVLPSRFPNLLANGSGGIA

SEQ ID NO: 118396 - protein, 24 aa, Mycobacterium avium
VQFHPTGMVWPPSVKGILVTEGVR

SEQ ID NO: 118397 - protein, 18 aa, Mycobacterium avium
VQQLPHSLGLLYESLTEH

SEQ ID NO: 118398 - protein, 23 aa, Mycobacterium avium
VQRAPLRLTAPVLRISPHLDTTA

SEQ ID NO: 118399 - protein, 23 aa, Mycobacterium avium
VQRARALAYFAALTIAADDPRRR

SEQ ID NO: 118400 - protein, 26 aa, Mycobacterium avium
VQSDACDGFILVPHLTPHGLDEFVDK

SEQ ID NO: 118401 - protein, 26 aa, Mycobacterium avium
VRAEVALLKILALQFIMSDPRHQQTQ

SEQ ID NO: 118402 - protein, 20 aa, Mycobacterium avium
VRAGARILLSPDGPDLRVQP

SEQ ID NO: 118403 - protein, 17 aa, Mycobacterium avium
VRAYANASAAMNLVRAL

SEQ ID NO: 118404 - protein, 17 aa, Mycobacterium avium
VRCELWGGCAWINLDDD

SEQ ID NO: 118405 - protein, 24 aa, Mycobacterium avium
VRDGDRLVLTPRGRLLADGVVRTL

SEQ ID NO: 118406 - protein, 22 aa, Mycobacterium avium
VRDGMATLNPLAAQIIGQLSSL

SEQ ID NO: 118407 - protein, 23 aa, Mycobacterium avium
VRDGYGWLQPRLSPVARSALPPH

SEQ ID NO: 118408 - protein, 23 aa, Mycobacterium avium
VRDTVLDRLLSNPAVRTMRADVE

SEQ ID NO: 118409 - protein, 20 aa, Mycobacterium avium
VREDGTVPRLAFPTPSGRAV

SEQ ID NO: 118410 - protein, 18 aa, Mycobacterium avium
VRERIPILVAALGPKNVE

SEQ ID NO: 118411 - protein, 31 aa, Mycobacterium avium
VRGDYLNVFTTFDLTLRRLGETFFTTAYFDP

SEQ ID NO: 118412 - protein, 25 aa, Mycobacterium avium
VRGLPQLSSAPVWCSDIRAGAGLVL

SEQ ID NO: 118413 - protein, 18 aa, Mycobacterium avium
VRGPYPTMYVNQPWTIRQ

SEQ ID NO: 118414 - protein, 30 aa, Mycobacterium avium
VRHDPSWSVLRSFKRLLNDAGPQTRVKLAG

SEQ ID NO: 118415 - protein, 30 aa, Mycobacterium avium
VRIDAPIALEFLLQLLVPLDVATRGFIDGN

SEQ ID NO: 118416 - protein, 29 aa, Mycobacterium avium
VRLCDAFGIPLVVIVDVPGYLPGVDQEWG

SEQ ID NO: 118417 - protein, 18 aa, Mycobacterium avium
VRLLITPASQAVYREALR

SEQ ID NO: 118418 - protein, 22 aa, Mycobacterium avium
VRLLNMVPYFQANPRVTRAKAA

SEQ ID NO: 118419 - protein, 19 aa, Mycobacterium avium
VRLLVNNAGIEQFGYLWDT

SEQ ID NO: 118420 - protein, 18 aa, Mycobacterium avium
VRLPRLIGHSRAMDMILT

SEQ ID NO: 118421 - protein, 21 aa, Mycobacterium avium
VRMIEAYHRLSKLNEYSAIDF

SEQ ID NO: 118422 - protein, 17 aa, Mycobacterium avium
VRMLLGDGTIDGVRVLS

SEQ ID NO: 118423 - protein, 31 aa, Mycobacterium avium
VRNRRLYDAIDQWAFCALNTSPGARLFYDRR

SEQ ID NO: 118424 - protein, 29 aa, Mycobacterium avium
VRPSLGIAEWILPSVIRAAPKDLQEKLIP

SEQ ID NO: 118425 - protein, 19 aa, Mycobacterium avium
VRPWGLYLARPTPGRVQFH

SEQ ID NO: 118426 - protein, 22 aa, Mycobacterium avium
VRQFRASVCVLGPLVGRCKRAR

SEQ ID NO: 118427 - protein, 20 aa, Mycobacterium avium
VRQMLRRVTIIDSGSTEFLP

SEQ ID NO: 118428 - protein, 22 aa, Mycobacterium avium
VRRSNFVYGSTKAGLDGFYLGL

SEQ ID NO: 118429 - protein, 29 aa, Mycobacterium avium
VRSGLGVALLPMIGKFPDGLGPAEGLPPA

SEQ ID NO: 118430 - protein, 21 aa, Mycobacterium avium
VRSHLAPFLPGHPHAPELPQG

SEQ ID NO: 118431 - protein, 21 aa, Mycobacterium avium
VRSVGAQWLDLGIDAAGEGGY

SEQ ID NO: 118432 - protein, 32 aa, Mycobacterium avium
VRTQLLVTPALLWLFIRGVRFMYSVDPHLPPG

SEQ ID NO: 118433 - protein, 27 aa, Mycobacterium avium
VRVALIDGTWVAFPTVEQLERAVFDMV

SEQ ID NO: 118434 - protein, 31 aa, Mycobacterium avium
VRVGHHCALPLHRRFGLAATARASFAVYNTA

SEQ ID NO: 118435 - protein, 17 aa, Mycobacterium avium
VRVLYGRDPHHITEAQY

SEQ ID NO: 118436 - protein, 26 aa, Mycobacterium avium
VRVSMGHALLVPYARATDWPAELKTL

SEQ ID NO: 118437 - protein, 18 aa, Mycobacterium avium
VRWEPPLLTITRVATRDT

SEQ ID NO: 118438 - protein, 20 aa, Mycobacterium avium
VRYVSGAPQLWVAGTRPFGP

SEQ ID NO: 118439 - protein, 26 aa, Mycobacterium avium
VSADAALGLLRRNKIEKLPIVDGHGR

SEQ ID NO: 118440 - protein, 21 aa, Mycobacterium avium
VSALTFHAAAHRQLRYFWPRV

SEQ ID NO: 118441 - protein, 23 aa, Mycobacterium avium
VSDAMALIHKRAHGVAVVAFEGR

SEQ ID NO: 118442 - protein, 25 aa, Mycobacterium avium
VSDEAGSHPLYWTQKRIIGGADPIE

SEQ ID NO: 118443 - protein, 18 aa, Mycobacterium avium
VSGPLLSGGYWNLPEETA

SEQ ID NO: 118444 - protein, 18 aa, Mycobacterium avium
VSGSDVRIATWRWAGGEP

SEQ ID NO: 118445 - protein, 35 aa, Mycobacterium avium
VSIQAGIINLLLDLQAQFQLSYLFVSHDLSVVKHL

SEQ ID NO: 118446 - protein, 25 aa, Mycobacterium avium
VSLDSPPFYDPWFAKARTSGAIQAR

SEQ ID NO: 118447 - protein, 20 aa, Mycobacterium avium
VSLPVVRAFVTRIKERAKGA

SEQ ID NO: 118448 - protein, 27 aa, Mycobacterium avium
VSMTMNGAVLPILALYVVAAEEQGVPP

SEQ ID NO: 118449 - protein, 24 aa, Mycobacterium avium
VSNWARRDFPALAPAVRVPVHFSI

SEQ ID NO: 118450 - protein, 20 aa, Mycobacterium avium
VSPPFKQAEFDILYGRGISR

SEQ ID NO: 118451 - protein, 23 aa, Mycobacterium avium
VSPPVMLQTWTMPSPKLEGIGER

SEQ ID NO: 118452 - protein, 18 aa, Mycobacterium avium
VSPQLYIALGISGAIQHR

SEQ ID NO: 118453 - protein, 23 aa, Mycobacterium avium
VSPSTFFRYFGSKESLLLADDLD

SEQ ID NO: 118454 - protein, 31 aa, Mycobacterium avium
VSQAADRPWRLWLPGRPEVSAYRRSPRAPAP

SEQ ID NO: 118455 - protein, 26 aa, Mycobacterium avium
VSQLHAKLFYQPLLESIGPAGLEIRH

SEQ ID NO: 118456 - protein, 26 aa, Mycobacterium avium
VSRALMYHYFPDKRAFFAAVVKDEAD

SEQ ID NO: 118457 - protein, 19 aa, Mycobacterium avium
VSRAMFNELWPGFDSNEVP

SEQ ID NO: 118458 - protein, 17 aa, Mycobacterium avium
VSRKCGVPYLYRFELMG

SEQ ID NO: 118459 - protein, 25 aa, Mycobacterium avium
VSRKTVYRYFPSTTALLRAVATEGT

SEQ ID NO: 118460 - protein, 18 aa, Mycobacterium avium
VSSFQMPGGIYAPMIHPW

SEQ ID NO: 118461 - protein, 24 aa, Mycobacterium avium
VSSIFLMCLPDRVLAYGDCAIIPN

SEQ ID NO: 118462 - protein, 24 aa, Mycobacterium avium
VSSKYALVIYAAKRARQINDYYNQ

SEQ ID NO: 118463 - protein, 23 aa, Mycobacterium avium
VSSLMLEPPFGLRVQSYAPRRQK

SEQ ID NO: 118464 - protein, 24 aa, Mycobacterium avium
VSSNLARFDAMRYGLRIGDDGSHS

SEQ ID NO: 118465 - protein, 26 aa, Mycobacterium avium
VSVHPVFNLYNKRWPIRGESENLAPA

SEQ ID NO: 118466 - protein, 23 aa, Mycobacterium avium
VSVPELLVVRRAPGVWHLVSTVS

SEQ ID NO: 118467 - protein, 19 aa, Mycobacterium avium
VTAFPYRLVDFWRDHRAPS

SEQ ID NO: 118468 - protein, 25 aa, Mycobacterium avium
VTAGYLARRAGRIPKRFWAQASSPP

SEQ ID NO: 118469 - protein, 33 aa, Mycobacterium avium
VTAHKFGGPPAVGALLLRRDVACVPLAHGGGQE

SEQ ID NO: 118470 - protein, 18 aa, Mycobacterium avium
VTAIPIYDEDFVLALPPG

SEQ ID NO: 118471 - protein, 24 aa, Mycobacterium avium
VTAKDIILALIAKIGTGGGQGHVI

SEQ ID NO: 118472 - protein, 20 aa, Mycobacterium avium
VTANPLFSRLHQPGLGDYFA

SEQ ID NO: 118473 - protein, 24 aa, Mycobacterium avium
VTCNGAPAVLLYLGDRLEGVITVE

SEQ ID NO: 118474 - protein, 20 aa, Mycobacterium avium
VTDAGPLLPRLHKLVRADCT

SEQ ID NO: 118475 - protein, 31 aa, Mycobacterium avium
VTDAPYLGFQLGSLWYISLDYINHQTSLNNT

SEQ ID NO: 118476 - protein, 24 aa, Mycobacterium avium
VTDDGRLLARIYSESDLLVAECLR

SEQ ID NO: 118477 - protein, 17 aa, Mycobacterium avium
VTDLARAIPLPTQFEFM

SEQ ID NO: 118478 - protein, 25 aa, Mycobacterium avium
VTEVRMFLHHVPGFSFLPNRRPPEP

SEQ ID NO: 118479 - protein, 27 aa, Mycobacterium avium
VTFIGQPLWGSIGYTLPAALGAAVAHP

SEQ ID NO: 118480 - protein, 32 aa, Mycobacterium avium
VTGNILRDYLTDLFPILELGTSAKMLSIVPLM

SEQ ID NO: 118481 - protein, 21 aa, Mycobacterium avium
VTGWFMVGWSPEFPIGEVRPL

SEQ ID NO: 118482 - protein, 17 aa, Mycobacterium avium
VTGYWNMFKQNIGIMIA

SEQ ID NO: 118483 - protein, 27 aa, Mycobacterium avium
VTHAQFVPTMFVRMLKLPEAVRDRYDV

SEQ ID NO: 118484 - protein, 26 aa, Mycobacterium avium
VTHDRYFLDNVAQWILELDRGRAYPY

SEQ ID NO: 118485 - protein, 25 aa, Mycobacterium avium
VTKDVNFVLRWASLPLGSEAIALLR

SEQ ID NO: 118486 - protein, 31 aa, Mycobacterium avium
VTRAFDVAKGLPWPARFPSRVLANDFVERWT

SEQ ID NO: 118487 - protein, 17 aa, Mycobacterium avium
VTRLHQTWTGEGAAAHA

SEQ ID NO: 118488 - protein, 17 aa, Mycobacterium avium
VTRLTRAAAPDWEYPPD

SEQ ID NO: 118489 - protein, 24 aa, Mycobacterium avium
VTRQTVYRYFPGTQALLVASAMRS

SEQ ID NO: 118490 - protein, 17 aa, Mycobacterium avium
VTRRVVHRFIAGETIDS

SEQ ID NO: 118491 - protein, 25 aa, Mycobacterium avium
VTVARFPRFDWPRIDAPHLRCGADI

SEQ ID NO: 118492 - protein, 20 aa, Mycobacterium avium
VTVDETQMFFFSAATYNGHR

SEQ ID NO: 118493 - protein, 18 aa, Mycobacterium avium
VTVLYPRKGVSELTRFTP

SEQ ID NO: 118494 - protein, 20 aa, Mycobacterium avium
VTVPVSFTELALGSTISVPT

SEQ ID NO: 118495 - protein, 18 aa, Mycobacterium avium
VTVVDPRWVLPVSDSILE

SEQ ID NO: 118496 - protein, 31 aa, Mycobacterium avium
VTYELSVDLAMPMIGLLKRKAERRLTDTALK

SEQ ID NO: 118497 - protein, 26 aa, Mycobacterium avium
VVAANRIQLATLIATNFFGQNAPAIA

SEQ ID NO: 118498 - protein, 23 aa, Mycobacterium avium
VVADLAALIREAALRAASRASSD

SEQ ID NO: 118499 - protein, 18 aa, Mycobacterium avium
VVADLPFGSYEAGPAAAL

SEQ ID NO: 118500 - protein, 23 aa, Mycobacterium avium
VVAEPFAMWVLEDDFADGRPPLD

SEQ ID NO: 118501 - protein, 24 aa, Mycobacterium avium
VVAEWGEGLVERLAPRHLDIRLER

SEQ ID NO: 118502 - protein, 31 aa, Mycobacterium avium
VVAGITPFNFPAMIPLWKAGPALACGNAFVL

SEQ ID NO: 118503 - protein, 27 aa, Mycobacterium avium
VVAKMGEMGLFGLPFPEEYGGMGGDYF

SEQ ID NO: 118504 - protein, 25 aa, Mycobacterium avium
VVDAFEWTGPLGVTYPGVVTHGVVQ

SEQ ID NO: 118505 - protein, 26 aa, Mycobacterium avium
VVDSGLTLSWLLRNLSTRHPRSLRVC

SEQ ID NO: 118506 - protein, 29 aa, Mycobacterium avium
VVEQKLYERGIRSYLLDGDNVRYGLNAGP

SEQ ID NO: 118507 - protein, 31 aa, Mycobacterium avium
VVERRARWVVRVITSLLLFPGHDEADERAMI

SEQ ID NO: 118508 - protein, 29 aa, Mycobacterium avium
VVGAITPWNFPHQINLAKLGPALAAGNTV

SEQ ID NO: 118509 - protein, 32 aa, Mycobacterium avium
VVGAIVAWNVPLFLAVNKLGPALLAGCTVVLK

SEQ ID NO: 118510 - protein, 24 aa, Mycobacterium avium
VVGRVRSVIRSRLPVYRSVADEAL

SEQ ID NO: 118511 - protein, 18 aa, Mycobacterium avium
VVIDHRGSGTLADNVEFV

SEQ ID NO: 118512 - protein, 18 aa, Mycobacterium avium
VVIRGQTPHFEYVCDAVT

SEQ ID NO: 118513 - protein, 26 aa, Mycobacterium avium
VVKETLRLHPPLIILMRVAKGEFEVE

SEQ ID NO: 118514 - protein, 19 aa, Mycobacterium avium
VVKGGRRFSFTALVIVGDG

SEQ ID NO: 118515 - protein, 25 aa, Mycobacterium avium
VVLKPSPLTPLAGLALARLIDEHTD

SEQ ID NO: 118516 - protein, 31 aa, Mycobacterium avium
VVNDGRGFFTTRVFSTYLLEAFNMLAEGIDP

SEQ ID NO: 118517 - protein, 26 aa, Mycobacterium avium
VVNKFRGDPALLQPGLRRLHDITGRP

SEQ ID NO: 118518 - protein, 18 aa, Mycobacterium avium
VVPDALSVLVRLLASLHD

SEQ ID NO: 118519 - protein, 25 aa, Mycobacterium avium
VVPGKPAVIVLPGPPRELQPMWHTA

SEQ ID NO: 118520 - protein, 27 aa, Mycobacterium avium
VVPGNPDYGMRLSWDFLARSTAGLRDW

SEQ ID NO: 118521 - protein, 22 aa, Mycobacterium avium
VVQNHLLQVLALVAMEPPVGAG

SEQ ID NO: 118522 - protein, 20 aa, Mycobacterium avium
VVRFIVPRYVQDDPSLAGVL

SEQ ID NO: 118523 - protein, 18 aa, Mycobacterium avium
VVRFLPYFTDVIVPDLRS

SEQ ID NO: 118524 - protein, 25 aa, Mycobacterium avium
VVRRLNLPFRDVDWTEWDDLLRRVH

SEQ ID NO: 118525 - protein, 18 aa, Mycobacterium avium
VVRVLGAIEIPVVAQELA

SEQ ID NO: 118526 - protein, 23 aa, Mycobacterium avium
VVSWYDNEWGYSNRLVDLVALVG

SEQ ID NO: 118527 - protein, 25 aa, Mycobacterium avium
VVVIGRGVTVGRPLGLLLTRRSENA

SEQ ID NO: 118528 - protein, 18 aa, Mycobacterium avium
VVVRLGFVPAPCRVVYVV

SEQ ID NO: 118529 - protein, 34 aa, Mycobacterium avium
VVYDDWNRAGSARAWWLLRAAGLDNVRILDGGLA

SEQ ID NO: 118530 - protein, 17 aa, Mycobacterium avium
VVYPHHGAALVEAIETR

SEQ ID NO: 118531 - protein, 18 aa, Mycobacterium avium
VYALIHTYRVALPLHPEY

SEQ ID NO: 118532 - protein, 18 aa, Mycobacterium avium
VYAVLNLYPYNPGHLMVV

SEQ ID NO: 118533 - protein, 17 aa, Mycobacterium avium
VYMMADCFDLTLDEVTF

SEQ ID NO: 118534 - protein, 18 aa, Mycobacterium avium
VYQINYLRCIGCGLCVEA

SEQ ID NO: 118535 - protein, 22 aa, Mycobacterium avium
VYRGAEYSVDFVPKVRIEVVVD

SEQ ID NO: 118536 - protein, 17 aa, Mycobacterium avium
VYRLITDLPTLASLAEE

SEQ ID NO: 118537 - protein, 19 aa, Mycobacterium avium
VYRSARARLQRLLDEHRAG

SEQ ID NO: 118538 - protein, 18 aa, Mycobacterium avium
VYVRATRVPPITAGATTV

SEQ ID NO: 118539 - protein, 24 aa, Mycobacterium avium
WAAEGLLGFLPPQAQDRLLDNVTA

SEQ ID NO: 118540 - protein, 21 aa, Mycobacterium avium
WAAYPAGVMWALRTAGHPVPG

SEQ ID NO: 118541 - protein, 23 aa, Mycobacterium avium
WAIRREAAKPGSYRWLKGGQRVP

SEQ ID NO: 118542 - protein, 23 aa, Mycobacterium avium
WAMAPSPAVARLLRLCDPDGTLP

SEQ ID NO: 118543 - protein, 24 aa, Mycobacterium avium
WANADAYTVSLLKAWWGEAATADN

SEQ ID NO: 118544 - protein, 18 aa, Mycobacterium avium
WARTAIGLARRAAELFAE

SEQ ID NO: 118545 - protein, 22 aa, Mycobacterium avium
WATLRGVVLAQMVIGTTVDWSL

SEQ ID NO: 118546 - protein, 17 aa, Mycobacterium avium
WAVAYKYPPQEAQTKLL

SEQ ID NO: 118547 - protein, 24 aa, Mycobacterium avium
WDDGRAFVLTDTVGFVRHLPTQLV

SEQ ID NO: 118548 - protein, 22 aa, Mycobacterium avium
WDLLRQRRALRESGGDPREAQV

SEQ ID NO: 118549 - protein, 18 aa, Mycobacterium avium
WDVLGGPVALPFGIAPTG

SEQ ID NO: 118550 - protein, 22 aa, Mycobacterium avium
WDVPKHEGLTMFLVPINHPGIT

SEQ ID NO: 118551 - protein, 26 aa, Mycobacterium avium
WEHDAHLHLRRAVVTAALFGGDAPAA

SEQ ID NO: 118552 - protein, 32 aa, Mycobacterium avium
WEHDAHLYLKRLLGYSAFLGGPDRYLTEVGAR

SEQ ID NO: 118553 - protein, 25 aa, Mycobacterium avium
WEHDAHLYVRHAWQTAALLGDSRAL

SEQ ID NO: 118554 - protein, 18 aa, Mycobacterium avium
WEHGRRNFGLRDDGVLAV

SEQ ID NO: 118555 - protein, 34 aa, Mycobacterium avium
WEMCTIGDPLLDLGWLLATWRQPDGSAVFSHALG

SEQ ID NO: 118556 - protein, 36 aa, Mycobacterium avium
WEQDPDVLDTWFSSALWPFSTLGWPEKTPELEKFYP

SEQ ID NO: 118557 - protein, 21 aa, Mycobacterium avium
WETVQARIKWLMADKSRDYDD

SEQ ID NO: 118558 - protein, 24 aa, Mycobacterium avium
WFDPGSFWSGDKLPLTPGYALGDE

SEQ ID NO: 118559 - protein, 19 aa, Mycobacterium avium
WFQVAPTIRYEFHGAKPEV

SEQ ID NO: 118560 - protein, 21 aa, Mycobacterium avium
WFRSYFGVPSSITAPDGRPVN

SEQ ID NO: 118561 - protein, 17 aa, Mycobacterium avium
WFTSAPMCDIFLVLAQA

SEQ ID NO: 118562 - protein, 26 aa, Mycobacterium avium
WGGSYYVEWLTHHLARKARAHIAEVA

SEQ ID NO: 118563 - protein, 18 aa, Mycobacterium avium
WGKSWLETCQQAFAGLAV

SEQ ID NO: 118564 - protein, 39 aa, Mycobacterium avium
WGLDSFQLFPNFVILFWGQGWYLTYHYWPTSYHSHVFEG

SEQ ID NO: 118565 - protein, 21 aa, Mycobacterium avium
WGNQMRSYVLHPYQMVKDLRT

SEQ ID NO: 118566 - protein, 17 aa, Mycobacterium avium
WGPMPDLPRAIPRFTRE

SEQ ID NO: 118567 - protein, 19 aa, Mycobacterium avium
WGRRRLAYEIAKHAEGIYV

SEQ ID NO: 118568 - protein, 23 aa, Mycobacterium avium
WGSDAYTPLAWWGSSTSRVRLGT

SEQ ID NO: 118569 - protein, 20 aa, Mycobacterium avium
WIADGTAPVYFGFGSTPVSS

SEQ ID NO: 118570 - protein, 17 aa, Mycobacterium avium
WIRVRARMGPEYTELKS

SEQ ID NO: 118571 - protein, 24 aa, Mycobacterium avium
WISTEYLFYRDDDGDYWLAGRRGS

SEQ ID NO: 118572 - protein, 24 aa, Mycobacterium avium
WKGDKAGNLVYRKTARNFNPMIAT

SEQ ID NO: 118573 - protein, 38 aa, Mycobacterium avium
WLAAVRASPLLGPPPVLRFFGDLLYFDRYWLEEEQVCT

SEQ ID NO: 118574 - protein, 17 aa, Mycobacterium avium
WLAMIAVAATHLGRGVW

SEQ ID NO: 118575 - protein, 28 aa, Mycobacterium avium
WLATSRELPWRRPIASLNYLLTSHVWRQ

SEQ ID NO: 118576 - protein, 25 aa, Mycobacterium avium
WLDDQPSYLPPVQLGEVIRAAGIGE

SEQ ID NO: 118577 - protein, 18 aa, Mycobacterium avium
WLEVSADPEVRQLILLDA

SEQ ID NO: 118578 - protein, 17 aa, Mycobacterium avium
WLFTRDPSLTVTRDGSR

SEQ ID NO: 118579 - protein, 17 aa, Mycobacterium avium
WLHPGQRAFQLATQIAL

SEQ ID NO: 118580 - protein, 20 aa, Mycobacterium avium
WLLKQAFYYSLTTINEAMRE

SEQ ID NO: 118581 - protein, 19 aa, Mycobacterium avium
WLYSNYYGLAKVGINGLTQ

SEQ ID NO: 118582 - protein, 20 aa, Mycobacterium avium
WNEITPCNLSLDRLAKAVKE

SEQ ID NO: 118583 - protein, 26 aa, Mycobacterium avium
WNHLVKSYVLGAARPAPPPRGTRTTT

SEQ ID NO: 118584 - protein, 18 aa, Mycobacterium avium
WNMFKQNIGIMIAVAQLA

SEQ ID NO: 118585 - protein, 19 aa, Mycobacterium avium
WNRYVIGGHLPLPKIPGAP

SEQ ID NO: 118586 - protein, 17 aa, Mycobacterium avium
WNVEYTPVPLHQLDAVA

SEQ ID NO: 118587 - protein, 17 aa, Mycobacterium avium
WPAGGAEVQWWFDLPWS

SEQ ID NO: 118588 - protein, 36 aa, Mycobacterium avium
WPGAYGTWWQADPTAELILIYLIQNLPDLTVDAATA

SEQ ID NO: 118589 - protein, 18 aa, Mycobacterium avium
WPGLLESQRKYLDNFWDC

SEQ ID NO: 118590 - protein, 18 aa, Mycobacterium avium
WPQARLTLALSPATLPKM

SEQ ID NO: 118591 - protein, 17 aa, Mycobacterium avium
WQAGPGEGSIGFTDSKI

SEQ ID NO: 118592 - protein, 18 aa, Mycobacterium avium
WREHSMAAMKPRTGDGPL

SEQ ID NO: 118593 - protein, 24 aa, Mycobacterium avium
WRITGQKVWTSYALMASWCVLAAC

SEQ ID NO: 118594 - protein, 28 aa, Mycobacterium avium
WRMYTRARFAPYVEKLLLDGARSKLTRA

SEQ ID NO: 118595 - protein, 19 aa, Mycobacterium avium
WRNLPTPSGNTFEWSPDST

SEQ ID NO: 118596 - protein, 18 aa, Mycobacterium avium
WRWGIDVNVLGVIHGLKA

SEQ ID NO: 118597 - protein, 25 aa, Mycobacterium avium
WSERKRYIWWDPDQRRWVGYDVPDF

SEQ ID NO: 118598 - protein, 26 aa, Mycobacterium avium
WTDPTRPLWTFPRLAWERELLPGAQV

SEQ ID NO: 118599 - protein, 29 aa, Mycobacterium avium
WTFDPVRRQFYWHRFFSHQPDLNYDNPAV

SEQ ID NO: 118600 - protein, 26 aa, Mycobacterium avium
WTPVTLLEGGTPLIPARRLSEKTGCT

SEQ ID NO: 118601 - protein, 20 aa, Mycobacterium avium
WTTRHAVAAWPALCSGLRAE

SEQ ID NO: 118602 - protein, 28 aa, Mycobacterium avium
WTTSPLRPWPGFAPMLYERYSQPFFDGD

SEQ ID NO: 118603 - protein, 27 aa, Mycobacterium avium
WVDGSPWIGNIALSFPYLDTEATRTIG

SEQ ID NO: 118604 - protein, 17 aa, Mycobacterium avium
WVGIANLPSSFAAAAYL

SEQ ID NO: 118605 - protein, 18 aa, Mycobacterium avium
WVPHLFKGLKGVYKKMPQ

SEQ ID NO: 118606 - protein, 26 aa, Mycobacterium avium
WVRDSTFALWGLYTLGLDREADDFFA

SEQ ID NO: 118607 - protein, 32 aa, Mycobacterium avium
WVRTDEQWRWLAHTLTVERLTELLPEAAEFAV

SEQ ID NO: 118608 - protein, 18 aa, Mycobacterium avium
WVYIDHRVTPGPPRPGYL

SEQ ID NO: 118609 - protein, 25 aa, Mycobacterium avium
YAAAGINPRRFLAELRLDNPDAAAE

SEQ ID NO: 118610 - protein, 29 aa, Mycobacterium avium
YAADPLDPAWLLDTLGLTDAARTTYRRLS

SEQ ID NO: 118611 - protein, 23 aa, Mycobacterium avium
YACAPVYSHLKYDIIPGAKHVVR

SEQ ID NO: 118612 - protein, 32 aa, Mycobacterium avium
YAGYAPIMGTPWLTSFAQRSPFAEAFRSAGQG

SEQ ID NO: 118613 - protein, 22 aa, Mycobacterium avium
YANRLLHAYVHTELHVIAATFN

SEQ ID NO: 118614 - protein, 18 aa, Mycobacterium avium
YAPVPWLPDRVYRDIVHR

SEQ ID NO: 118615 - protein, 18 aa, Mycobacterium avium
YARLALGIGVHDITAGYR

SEQ ID NO: 118616 - protein, 22 aa, Mycobacterium avium
YARVLSPLHRLIRDIVGQGITE

SEQ ID NO: 118617 - protein, 24 aa, Mycobacterium avium
YATFFKKYYDLLPDDGRMLLHSIV

SEQ ID NO: 118618 - protein, 31 aa, Mycobacterium avium
YATHNEPMIPIYIFYSMFGFQRTGDGLWAAA

SEQ ID NO: 118619 - protein, 18 aa, Mycobacterium avium
YAVPRLLARNGLSLQDFD

SEQ ID NO: 118620 - protein, 31 aa, Mycobacterium avium
YAYLGITVPEFPNFFIIYGPGTHLAHGGSLI

SEQ ID NO: 118621 - protein, 24 aa, Mycobacterium avium
YAYSKLAIVLFTKELHRRYHARGL

SEQ ID NO: 118622 - protein, 22 aa, Mycobacterium avium
YCLDGMHHWLANWRLRAMEAAS

SEQ ID NO: 118623 - protein, 25 aa, Mycobacterium avium
YDESLWRLLCEQVGAAALVIPEELG

SEQ ID NO: 118624 - protein, 23 aa, Mycobacterium avium
YDFDKPTLIAWSADDVFFAQEDG

SEQ ID NO: 118625 - protein, 18 aa, Mycobacterium avium
YDLRIWAGEVMAAAAAAG

SEQ ID NO: 118626 - protein, 26 aa, Mycobacterium avium
YDLSDEFFALFLDPTRTYSCAYFERD

SEQ ID NO: 118627 - protein, 20 aa, Mycobacterium avium
YDMTAFWCRAGTAATITPAG

SEQ ID NO: 118628 - protein, 18 aa, Mycobacterium avium
YDQIWKEQVLPLSGAYQM

SEQ ID NO: 118629 - protein, 24 aa, Mycobacterium avium
YDRFMRYLTGCAELFRKGISNVAQ

SEQ ID NO: 118630 - protein, 17 aa, Mycobacterium avium
YDTYFFVGALPQGQRAD

SEQ ID NO: 118631 - protein, 25 aa, Mycobacterium avium
YDVIGARFAVWPQISELLQKLFAGQ

SEQ ID NO: 118632 - protein, 27 aa, Mycobacterium avium
YEDRSFTFALKTPPAAKLLLKAAGVGK

SEQ ID NO: 118633 - protein, 18 aa, Mycobacterium avium
YEELGAFGLLKRFAKGWV

SEQ ID NO: 118634 - protein, 32 aa, Mycobacterium avium
YEIKVICDKGFPSYFLIVADLINYARSVDIRV

SEQ ID NO: 118635 - protein, 24 aa, Mycobacterium avium
YEPGTLIWRNRWITRDGIVECREA

SEQ ID NO: 118636 - protein, 20 aa, Mycobacterium avium
YESGASIRSLVARTGRSYGS

SEQ ID NO: 118637 - protein, 18 aa, Mycobacterium avium
YFDGALRAGIRQVVILAA

SEQ ID NO: 118638 - protein, 23 aa, Mycobacterium avium
YFEVLHELKLIVDLMYEGGIARM

SEQ ID NO: 118639 - protein, 18 aa, Mycobacterium avium
YFVHSYAAQQWEGSPEAV

SEQ ID NO: 118640 - protein, 25 aa, Mycobacterium avium
YGGMGGDYFALSLALEELGKVDQSV

SEQ ID NO: 118641 - protein, 19 aa, Mycobacterium avium
YGHFGQAGGFIWADPDIER

SEQ ID NO: 118642 - protein, 26 aa, Mycobacterium avium
YGIEPQQLLAYLQENNQLPAMFADVR

SEQ ID NO: 118643 - protein, 17 aa, Mycobacterium avium
YGLAFRLLSSAHENVLT

SEQ ID NO: 118644 - protein, 27 aa, Mycobacterium avium
YGLIEWKMDLELGAHYYVKFANPDVVT

SEQ ID NO: 118645 - protein, 17 aa, Mycobacterium avium
YGLPELPGARERLRGAR

SEQ ID NO: 118646 - protein, 27 aa, Mycobacterium avium
YGSASILPISWAYIRMMGADGLRAASL

SEQ ID NO: 118647 - protein, 31 aa, Mycobacterium avium
YGSDIAGLDPLWLRRRVGMCFQRPTPFPGTV

SEQ ID NO: 118648 - protein, 17 aa, Mycobacterium avium
YGVRVLVIRPGQVRTRM

SEQ ID NO: 118649 - protein, 17 aa, Mycobacterium avium
YHMTTFGFIMGEVFRRV

SEQ ID NO: 118650 - protein, 17 aa, Mycobacterium avium
YHPTRPLGKAMLYGPGD

SEQ ID NO: 118651 - protein, 24 aa, Mycobacterium avium
YHVDFVHNTWRFGIDRILAGVAMS

SEQ ID NO: 118652 - protein, 24 aa, Mycobacterium avium
YIDRDKLHYIDFAGKYFSVKGPSI

SEQ ID NO: 118653 - protein, 31 aa, Mycobacterium avium
YIDRLERRDGTWKIALRRCTVEWTLQGDGSA

SEQ ID NO: 118654 - protein, 31 aa, Mycobacterium avium
YIPEDADWSLFSRLLPVLPTTVESSGTGMAE

SEQ ID NO: 118655 - protein, 22 aa, Mycobacterium avium
YITKWDLPVRIGGHLKEPIDER

SEQ ID NO: 118656 - protein, 17 aa, Mycobacterium avium
YKAELIYGPARSRPWKT

SEQ ID NO: 118657 - protein, 20 aa, Mycobacterium avium
YKDFPVLLYQIQNKYRDEAR

SEQ ID NO: 118658 - protein, 25 aa, Mycobacterium avium
YKKLRDILGLLRDAYCRHIGVEYTH

SEQ ID NO: 118659 - protein, 18 aa, Mycobacterium avium
YKPVAGEAPLWDFPDGTL

SEQ ID NO: 118660 - protein, 29 aa, Mycobacterium avium
YLATQLRAMQFLRGGRRWLLKSPQHLEQV

SEQ ID NO: 118661 - protein, 20 aa, Mycobacterium avium
YLDLTGCMALGITGPILRAT

SEQ ID NO: 118662 - protein, 17 aa, Mycobacterium avium
YLIVRAGEFSRISDVLL

SEQ ID NO: 118663 - protein, 21 aa, Mycobacterium avium
YLLADGLFQQRLHGCGADLVS

SEQ ID NO: 118664 - protein, 17 aa, Mycobacterium avium
YLLDVALAKAIDAGWID

SEQ ID NO: 118665 - protein, 38 aa, Mycobacterium avium
YLNRIYDYLMVSLRSLPLVMVIGRPEVRIPVVSFALHG

SEQ ID NO: 118666 - protein, 18 aa, Mycobacterium avium
YLRAMSRLLALTAGANEA

SEQ ID NO: 118667 - protein, 18 aa, Mycobacterium avium
YLRTLVDVGLGYVRLGQP

SEQ ID NO: 118668 - protein, 17 aa, Mycobacterium avium
YLSIIQTGQRRIAIEDI

SEQ ID NO: 118669 - protein, 24 aa, Mycobacterium avium
YLTPQALIDLVASRSYCITSPTEV

SEQ ID NO: 118670 - protein, 21 aa, Mycobacterium avium
YLYRRGEFADAPRPDLILLDL

SEQ ID NO: 118671 - protein, 20 aa, Mycobacterium avium
YMDFWDQVLNTLTGSPLAGT

SEQ ID NO: 118672 - protein, 33 aa, Mycobacterium avium
YNDWHIDEWCAAYPGRFIPCGILPLFDVAEAAK

SEQ ID NO: 118673 - protein, 29 aa, Mycobacterium avium
YNHYPIGWAMAFNTPYKLYKRYASHEGGI

SEQ ID NO: 118674 - protein, 20 aa, Mycobacterium avium
YNKLFEERIIFLGVQVDDAS

SEQ ID NO: 118675 - protein, 19 aa, Mycobacterium avium
YNLPFRRRRPTGPPSGSGA

SEQ ID NO: 118676 - protein, 24 aa, Mycobacterium avium
YNVANCLVALALLDAVGVSPEQAA

SEQ ID NO: 118677 - protein, 18 aa, Mycobacterium avium
YPELESQQIFQMFDRVYQ

SEQ ID NO: 118678 - protein, 18 aa, Mycobacterium avium
YPGDAGVLAALLLNRVSL

SEQ ID NO: 118679 - protein, 25 aa, Mycobacterium avium
YPLGKDFRPKVWPPVRRIDGAYGDR

SEQ ID NO: 118680 - protein, 19 aa, Mycobacterium avium
YPQAWFVGELIHGDYAAVV

SEQ ID NO: 118681 - protein, 17 aa, Mycobacterium avium
YPVLIKPSAGGGGKGMR

SEQ ID NO: 118682 - protein, 24 aa, Mycobacterium avium
YQAVRTHFFDTYFADAVAAGIRQI

SEQ ID NO: 118683 - protein, 21 aa, Mycobacterium avium
YQMMYELRDFGFSTSIGIGGD

SEQ ID NO: 118684 - protein, 20 aa, Mycobacterium avium
YQQEIFGPVVAILPFDDEDE

SEQ ID NO: 118685 - protein, 17 aa, Mycobacterium avium
YQRFRGGEIAGLTAGLV

SEQ ID NO: 118686 - protein, 23 aa, Mycobacterium avium
YQRIREILGRRPTDTELAMYSVM

SEQ ID NO: 118687 - protein, 17 aa, Mycobacterium avium
YQRYMRYLTGCADAFRA

SEQ ID NO: 118688 - protein, 21 aa, Mycobacterium avium
YQVHSLHGYFLRPGDAKERTV

SEQ ID NO: 118689 - protein, 18 aa, Mycobacterium avium
YQYTVRLLDQIAANPEGA

SEQ ID NO: 118690 - protein, 22 aa, Mycobacterium avium
YRAPLSYPYRDGLLDKELATDG

SEQ ID NO: 118691 - protein, 25 aa, Mycobacterium avium
YRCELYDLPTLWQIASHNPWLSVSP

SEQ ID NO: 118692 - protein, 28 aa, Mycobacterium avium
YREIADRLAYVVRLILTGTTQASPETEA

SEQ ID NO: 118693 - protein, 19 aa, Mycobacterium avium
YRFRARPFDLVSSPSVCEH

SEQ ID NO: 118694 - protein, 21 aa, Mycobacterium avium
YRGAYLEQLLAGLLGDLGVRT

SEQ ID NO: 118695 - protein, 24 aa, Mycobacterium avium
YRHLVGSSLPHPFVDRQLLIVADE

SEQ ID NO: 118696 - protein, 44 aa, Mycobacterium avium
YRISGFAEILGFYGLNYWYPFQVTALGLGPIWMSGNDEAKRKAA

SEQ ID NO: 118697 - protein, 32 aa, Mycobacterium avium
YRLFGQGYYNPAPALRWYWDCYVPSTRDRAHP

SEQ ID NO: 118698 - protein, 17 aa, Mycobacterium avium
YRQPGFVAAMRDIMALQ

SEQ ID NO: 118699 - protein, 31 aa, Mycobacterium avium
YRRLYAILERVVPLKFLYLPIAVEGFKREGV

SEQ ID NO: 118700 - protein, 24 aa, Mycobacterium avium
YRSSGNLLYLLLTHPEQLAMVYRD

SEQ ID NO: 118701 - protein, 25 aa, Mycobacterium avium
YRVPAWSEFVEVHWSRWGEAYVTPV

SEQ ID NO: 118702 - protein, 19 aa, Mycobacterium avium
YRVSGPIRWASNLYPDSTM

SEQ ID NO: 118703 - protein, 36 aa, Mycobacterium avium
YSDDVTLLAAQRRTPPPPLNLTLDATIHAARTVRTR

SEQ ID NO: 118704 - protein, 24 aa, Mycobacterium avium
YSEAIALSRLGWAALTVGTSHAVL

SEQ ID NO: 118705 - protein, 20 aa, Mycobacterium avium
YSGIGFGLHNDIVAPYLLAL

SEQ ID NO: 118706 - protein, 26 aa, Mycobacterium avium
YSKEYEIERLMRDAPFLLIGEGTSEI

SEQ ID NO: 118707 - protein, 24 aa, Mycobacterium avium
YSQGGLFPIAYTKGTDFRPAKRLP

SEQ ID NO: 118708 - protein, 26 aa, Mycobacterium avium
YTGIDPYFDDLFLMAADKRFLSVERV

SEQ ID NO: 118709 - protein, 20 aa, Mycobacterium avium
YTGLIYRALGFPTRMFTVLF

SEQ ID NO: 118710 - protein, 19 aa, Mycobacterium avium
YTVAPLWPDSISMAGLQAR

SEQ ID NO: 118711 - protein, 19 aa, Mycobacterium avium
YVASKWGVRGLAKSAALEL

SEQ ID NO: 118712 - protein, 26 aa, Mycobacterium avium
YVAVKEPWFRDAYRRAWDWADSTGWK

SEQ ID NO: 118713 - protein, 17 aa, Mycobacterium avium
YVFLITNTDPDAPKHKS

SEQ ID NO: 118714 - protein, 24 aa, Mycobacterium avium
YVGAYFLDDRAAVTALLNAARMLR

SEQ ID NO: 118715 - protein, 20 aa, Mycobacterium avium
YVMECLQLMALRRATTVEVT

SEQ ID NO: 118716 - protein, 17 aa, Mycobacterium avium
YVNQRWLGGMLTNFSTV

SEQ ID NO: 118717 - protein, 23 aa, Mycobacterium avium
YVPGVPRLGVPPLLMSDAGLGVT

SEQ ID NO: 118718 - protein, 17 aa, Mycobacterium avium
YVRHVDGDLLCFVHGGA

SEQ ID NO: 118719 - protein, 19 aa, Mycobacterium avium
YVSMPLFHSNAVVAGWAPA

SEQ ID NO: 118720 - protein, 17 aa, Mycobacterium avium
YWAITKHKDVKEISVRS

SEQ ID NO: 118721 - protein, 17 aa, Mycobacterium avium
YYADFEGVLAFLQRKMA

SEQ ID NO: 118722 - protein, 19 aa, Mycobacterium avium
YYGLHELARIGAGDRVLIH

SEQ ID NO: 118723 - protein, 21 aa, Mycobacterium avium
YYKKFMSVNLDGALWCTRAVY

SEQ ID NO: 118724 - protein, 18 aa, Mycobacterium avium
YYNAIVWQDTRTDRIASA

SEQ ID NO: 118725 - protein, 18 aa, Mycobacterium avium
YYVGMFEQMKRQALAGKA

SEQ ID NO: 118726 - protein, 26 aa, Mycobacterium avium
AAAAGASLFILVFAKGAFPAEMQPKP

SEQ ID NO: 118727 - protein, 18 aa, Mycobacterium avium
AAAALWKAAGIKSPIDEI

SEQ ID NO: 118728 - protein, 24 aa, Mycobacterium avium
AAAAPYVQWLIIAAAQAEVAALQA

SEQ ID NO: 118729 - protein, 18 aa, Mycobacterium avium
AAAGWADAALLRVDSRNQ

SEQ ID NO: 118730 - protein, 33 aa, Mycobacterium avium
AAAIITRGLAEIMRLGIALGAKGATLAGLAGVG

SEQ ID NO: 118731 - protein, 29 aa, Mycobacterium avium
AAALTEWFTVDWHRAIVDKWRAAGVRMAD

SEQ ID NO: 118732 - protein, 26 aa, Mycobacterium avium
AAANSWLDAFARWRHARGAPATAIAW

SEQ ID NO: 118733 - protein, 24 aa, Mycobacterium avium
AAAPIERILLRHTAINRVAVYAVP

SEQ ID NO: 118734 - protein, 18 aa, Mycobacterium avium
AAAPYVAWLQATGAQAEQ

SEQ ID NO: 118735 - protein, 20 aa, Mycobacterium avium
AAATALLTRALQIGLEKDDV

SEQ ID NO: 118736 - protein, 17 aa, Mycobacterium avium
AADAAEPVLLWGDARVG

SEQ ID NO: 118737 - protein, 17 aa, Mycobacterium avium
AADFFDIDGIPGAPPGL

SEQ ID NO: 118738 - protein, 18 aa, Mycobacterium avium
AADFSVGMLAAGAARRVP

SEQ ID NO: 118739 - protein, 19 aa, Mycobacterium avium
AADLPWPAAGDWLAAVRAS

SEQ ID NO: 118740 - protein, 26 aa, Mycobacterium avium
AADPNLSGPFAGVPFLLKDLGQEYRG

SEQ ID NO: 118741 - protein, 24 aa, Mycobacterium avium
AADRLGFTRYWVAEHHNMPSVGAT

SEQ ID NO: 118742 - protein, 20 aa, Mycobacterium avium
AAEKVTGIFLVPAQWQAVCA

SEQ ID NO: 118743 - protein, 35 aa, Mycobacterium avium
AAFDTELFGHWWYEGPTWLARVLRALPEAGVRVGT

SEQ ID NO: 118744 - protein, 21 aa, Mycobacterium avium
AAFEMLRAWNQTMADAGWAAV

SEQ ID NO: 118745 - protein, 24 aa, Mycobacterium avium
AAFFAKNMLPRLSGLRGIIEAIDD

SEQ ID NO: 118746 - protein, 27 aa, Mycobacterium avium
AAFGREDYWLARIAPAAATTTLDSLVV

SEQ ID NO: 118747 - protein, 21 aa, Mycobacterium avium
AAGHLFTRGHRLDWAGVFAGL

SEQ ID NO: 118748 - protein, 17 aa, Mycobacterium avium
AAGLAFQGWLRNSPYYP

SEQ ID NO: 118749 - protein, 25 aa, Mycobacterium avium
AAGLDARAYRLDWPAGAVVYEVDQP

SEQ ID NO: 118750 - protein, 25 aa, Mycobacterium avium
AAGLDARAYRLSWPAGTVVFEVDQP

SEQ ID NO: 118751 - protein, 24 aa, Mycobacterium avium
AAGLDSLIWQCPVVLLGEVRSVGV

SEQ ID NO: 118752 - protein, 18 aa, Mycobacterium avium
AAGPERVALVTDALAAAG

SEQ ID NO: 118753 - protein, 21 aa, Mycobacterium avium
AAGRHAQWPMVLAASPHVADP

SEQ ID NO: 118754 - protein, 19 aa, Mycobacterium avium
AAGRLIAEGLSLPEAARAA

SEQ ID NO: 118755 - protein, 29 aa, Mycobacterium avium
AAGTRLVNPPLLVPVLRAGLGMVDPAQAA

SEQ ID NO: 118756 - protein, 25 aa, Mycobacterium avium
AAHPEDWHMMQPQWLADLPDSTRAR

SEQ ID NO: 118757 - protein, 23 aa, Mycobacterium avium
AAIAELIRVLKVGGTLAVSVPRW

SEQ ID NO: 118758 - protein, 23 aa, Mycobacterium avium
AAINILVLRVGAIILHPYIELHL

SEQ ID NO: 118759 - protein, 19 aa, Mycobacterium avium
AAKAFLCSEVARWIDEEGL

SEQ ID NO: 118760 - protein, 27 aa, Mycobacterium avium
AAKWREIFGADNFFLELMDHGLSIEQR

SEQ ID NO: 118761 - protein, 19 aa, Mycobacterium avium
AALALLRQVARAVEPPLLD

SEQ ID NO: 118762 - protein, 20 aa, Mycobacterium avium
AALEDVSIPTLLLSLVHITG

SEQ ID NO: 118763 - protein, 18 aa, Mycobacterium avium
AALHRRGPHRVLRGDLAF

SEQ ID NO: 118764 - protein, 18 aa, Mycobacterium avium
AALIFLDIHLTYQELAHT

SEQ ID NO: 118765 - protein, 25 aa, Mycobacterium avium
AALLEYPVWMWHWAVPGDPAVPWDR

SEQ ID NO: 118766 - protein, 25 aa, Mycobacterium avium
AALPEKVGVAAIPLSPFCDPAGAHG

SEQ ID NO: 118767 - protein, 23 aa, Mycobacterium avium
AALPKPQRYPRFGPWGQLDRWRR

SEQ ID NO: 118768 - protein, 18 aa, Mycobacterium avium
AALQPPALRAICPWEGFT

SEQ ID NO: 118769 - protein, 21 aa, Mycobacterium avium
AALTRAIHKLPIKARIVTRED

SEQ ID NO: 118770 - protein, 42 aa, Mycobacterium avium
AALVLGDWPADPPAPQPAPAGALWALDLIDAPERLRGAITAM

SEQ ID NO: 118771 - protein, 25 aa, Mycobacterium avium
AAMGVIAPWLLSEYDRFALLHGDYR

SEQ ID NO: 118772 - protein, 17 aa, Mycobacterium avium
AAMLAADPPLCALAADG

SEQ ID NO: 118773 - protein, 18 aa, Mycobacterium avium
AAMWSDDIAVWRVGSRRD

SEQ ID NO: 118774 - protein, 35 aa, Mycobacterium avium
AANPHVLTISPPINMNPRWLGAHPAYTLSKYGMTL

SEQ ID NO: 118775 - protein, 32 aa, Mycobacterium avium
AANRWITHYQNLLYGLQITTVGDFKAVLPALT

SEQ ID NO: 118776 - protein, 26 aa, Mycobacterium avium
AAPDRSLDWLVTKFAREVPGVAHALL

SEQ ID NO: 118777 - protein, 31 aa, Mycobacterium avium
AAPLLCAGITLFSPLRHWKAGPGTRLAIVGL

SEQ ID NO: 118778 - protein, 21 aa, Mycobacterium avium
AAPVLWSQQVVTTGALRAVIL

SEQ ID NO: 118779 - protein, 24 aa, Mycobacterium avium
AAQLAYWQDALAGMPERLALPTDR

SEQ ID NO: 118780 - protein, 19 aa, Mycobacterium avium
AARAARLKWWTTDLQVRTA

SEQ ID NO: 118781 - protein, 23 aa, Mycobacterium avium
AARALIAVRGLHRFLAAEGLAEL

SEQ ID NO: 118782 - protein, 23 aa, Mycobacterium avium
AARAVWQALPGEPWTDRFAEAAA

SEQ ID NO: 118783 - protein, 23 aa, Mycobacterium avium
AARTGIIELAGRFLERVCPPDAD

SEQ ID NO: 118784 - protein, 19 aa, Mycobacterium avium
AARTRYFDEFYADAAAAGI

SEQ ID NO: 118785 - protein, 27 aa, Mycobacterium avium
AASALLKGLTAHYLLKSVYPVQAGDTV

SEQ ID NO: 118786 - protein, 19 aa, Mycobacterium avium
AASFTRSFARYEPMPESAA

SEQ ID NO: 118787 - protein, 26 aa, Mycobacterium avium
AASKHGIVGLMRTLANALAPLNIRVN

SEQ ID NO: 118788 - protein, 31 aa, Mycobacterium avium
AATGSNPIDILAWLLGFNGQSSGGLGGMFGL

SEQ ID NO: 118789 - protein, 24 aa, Mycobacterium avium
AATQAAIWFFTNGLALDTRPLNVP

SEQ ID NO: 118790 - protein, 24 aa, Mycobacterium avium
AATRLGHSVAFFIGTAYGSTETAE

SEQ ID NO: 118791 - protein, 18 aa, Mycobacterium avium
AATVIRIAISHYIVRSDD

SEQ ID NO: 118792 - protein, 26 aa, Mycobacterium avium
AATVPPPVIAANRALLATLVATNILG

SEQ ID NO: 118793 - protein, 24 aa, Mycobacterium avium
AATVPPPVIAANRSLLMTLIATNI

SEQ ID NO: 118794 - protein, 20 aa, Mycobacterium avium
AAVAGRPWRRWVTGRAAQLG

SEQ ID NO: 118795 - protein, 24 aa, Mycobacterium avium
AAVAVRVPRLLFLGSSCIYPKYAP

SEQ ID NO: 118796 - protein, 17 aa, Mycobacterium avium
AAVCPHVEWALSSTLGA

SEQ ID NO: 118797 - protein, 25 aa, Mycobacterium avium
AAVGAAFPIAVLNLKGGVGKTAVVE

SEQ ID NO: 118798 - protein, 22 aa, Mycobacterium avium
AAVGLPTPRLVVEPGRAIAGPG

SEQ ID NO: 118799 - protein, 25 aa, Mycobacterium avium
AAVGVDAWPWVLTGGEDHALVACFP

SEQ ID NO: 118800 - protein, 23 aa, Mycobacterium avium
AAVHDRLIRLLADRGARVDAAYH

SEQ ID NO: 118801 - protein, 19 aa, Mycobacterium avium
AAVLWRYALRLTGDASQSE

SEQ ID NO: 118802 - protein, 27 aa, Mycobacterium avium
AAVRKLPIFGGPFRWEDLEWLRSRTSL

SEQ ID NO: 118803 - protein, 25 aa, Mycobacterium avium
AAVYDKWRTLGPLVDKFGLTTKGVT

SEQ ID NO: 118804 - protein, 20 aa, Mycobacterium avium
AAYAKARLYWERSESTVEGF

SEQ ID NO: 118805 - protein, 23 aa, Mycobacterium avium
AAYAVMMALYHRDVHGGPGQLID

SEQ ID NO: 118806 - protein, 25 aa, Mycobacterium avium
AAYGRFLPAWHRVGAAESSRAPGHS

SEQ ID NO: 118807 - protein, 18 aa, Mycobacterium avium
AAYLPIDPALPAARIEFL

SEQ ID NO: 118808 - protein, 19 aa, Mycobacterium avium
ACDGPRFRWVQGTQVSCEN

SEQ ID NO: 118809 - protein, 20 aa, Mycobacterium avium
ACILCECNCGIVVQVEDRRL

SEQ ID NO: 118810 - protein, 17 aa, Mycobacterium avium
ACMPPRPGERELVSRAR

SEQ ID NO: 118811 - protein, 21 aa, Mycobacterium avium
ACNPSRPVSVWAAHGTADPLV

SEQ ID NO: 118812 - protein, 24 aa, Mycobacterium avium
ACSALKRAYRDRLRAHCPDVAFLH

SEQ ID NO: 118813 - protein, 26 aa, Mycobacterium avium
ADAGLIGPFRVRIPLLLSADDGHQLV

SEQ ID NO: 118814 - protein, 17 aa, Mycobacterium avium
ADAMNRVYVRCGMVPAG

SEQ ID NO: 118815 - protein, 25 aa, Mycobacterium avium
ADAVMILPVSYWKLTEREIFHHYRS

SEQ ID NO: 118816 - protein, 24 aa, Mycobacterium avium
ADAVQRMAEFQRYAEDMIAEIDSR

SEQ ID NO: 118817 - protein, 26 aa, Mycobacterium avium
ADDERAMLPTLPLPRARTLANYLAAK

SEQ ID NO: 118818 - protein, 30 aa, Mycobacterium avium
ADDLLTATLLTARCPVLFAPAMHTEMWLHP

SEQ ID NO: 118819 - protein, 17 aa, Mycobacterium avium
ADDVCYLAMPLFHSNGV

SEQ ID NO: 118820 - protein, 23 aa, Mycobacterium avium
ADEERIVWLAEPLVADNLPDGHP

SEQ ID NO: 118821 - protein, 18 aa, Mycobacterium avium
ADEIGYPVLIKPSAGGGG

SEQ ID NO: 118822 - protein, 26 aa, Mycobacterium avium
ADESAVLLLRFTAGPPTSVASRRSID

SEQ ID NO: 118823 - protein, 28 aa, Mycobacterium avium
ADEVCLQMHLLYLSFAIAVRKRAADDAE

SEQ ID NO: 118824 - protein, 26 aa, Mycobacterium avium
ADGKTMGIPILYPWANRLGGNTYAAE

SEQ ID NO: 118825 - protein, 24 aa, Mycobacterium avium
ADGNPLAGAPFYVNPNSAAMRAAQ

SEQ ID NO: 118826 - protein, 18 aa, Mycobacterium avium
ADLAAWPPAGATKVDIAD

SEQ ID NO: 118827 - protein, 17 aa, Mycobacterium avium
ADLDAVVAAGRTFRDVD

SEQ ID NO: 118828 - protein, 26 aa, Mycobacterium avium
ADLEYHLTTLFPPVRPRQWLEIRYLD

SEQ ID NO: 118829 - protein, 23 aa, Mycobacterium avium
ADLPGELWRLSPDSLSLSGAAAA

SEQ ID NO: 118830 - protein, 25 aa, Mycobacterium avium
ADPALPRDRGAFARLLRACGEIDGL

SEQ ID NO: 118831 - protein, 36 aa, Mycobacterium avium
ADPHSLIRLGHARLTRFLIRHSRGAWREPHATLLLT

SEQ ID NO: 118832 - protein, 17 aa, Mycobacterium avium
ADPLGELLGRYARTHTP

SEQ ID NO: 118833 - protein, 19 aa, Mycobacterium avium
ADPLTPLAAAALPDDVPTS

SEQ ID NO: 118834 - protein, 25 aa, Mycobacterium avium
ADPNTWKQNWPQHLAGAYIDAGMAD

SEQ ID NO: 118835 - protein, 34 aa, Mycobacterium avium
ADQLRKFLADKVVRWWLPERWTFVDEIPRTSVGK

SEQ ID NO: 118836 - protein, 26 aa, Mycobacterium avium
ADRDTLLLLAELLTVSLRDVLVVGAH

SEQ ID NO: 118837 - protein, 23 aa, Mycobacterium avium
ADRFGIQDAIWRGVYYTPNGAQT

SEQ ID NO: 118838 - protein, 23 aa, Mycobacterium avium
ADRLLKIATDRGLSPQPAALGAF

SEQ ID NO: 118839 - protein, 17 aa, Mycobacterium avium
ADRLMLLDHLTHGRIIG

SEQ ID NO: 118840 - protein, 22 aa, Mycobacterium avium
ADRLRARLVERINNLRVGHSLD

SEQ ID NO: 118841 - protein, 23 aa, Mycobacterium avium
ADRNTWFHQWLDADAAVVRRNAK

SEQ ID NO: 118842 - protein, 22 aa, Mycobacterium avium
ADRRRLAADSFGAHLLVDPREE

SEQ ID NO: 118843 - protein, 23 aa, Mycobacterium avium
ADRYRRLHVIIGDANLAETSTYL

SEQ ID NO: 118844 - protein, 29 aa, Mycobacterium avium
ADSDVTAWPATLDRLLALGGPGARYVPGH

SEQ ID NO: 118845 - protein, 25 aa, Mycobacterium avium
ADTDLLDQAWWSPGLTHPDGRSAFA

SEQ ID NO: 118846 - protein, 27 aa, Mycobacterium avium
ADTEIARLVPFIEWLRDAYPDQLISAD

SEQ ID NO: 118847 - protein, 27 aa, Mycobacterium avium
ADVNLHLVLGAWRILGAVQQSLRIVTD

SEQ ID NO: 118848 - protein, 23 aa, Mycobacterium avium
ADVRRREWLAGRRDRVADQREQI

SEQ ID NO: 118849 - protein, 31 aa, Mycobacterium avium
AEAADLGPRRALTGEPLPPLLPATAAAQRDG

SEQ ID NO: 118850 - protein, 26 aa, Mycobacterium avium
AEAAQPLYARYWLHNRGPAPLGGLPA

SEQ ID NO: 118851 - protein, 23 aa, Mycobacterium avium
AEADHIASFALPIDDLDLTVRSY

SEQ ID NO: 118852 - protein, 25 aa, Mycobacterium avium
AEAFSRYGAHLPKINVLPIYGGSSY

SEQ ID NO: 118853 - protein, 29 aa, Mycobacterium avium
AEAREKFGFLLEAFTFGAPPHGGIAFGWD

SEQ ID NO: 118854 - protein, 22 aa, Mycobacterium avium
AEARLFALAQFMGDIYGGALLV

SEQ ID NO: 118855 - protein, 20 aa, Mycobacterium avium
AECPRLSYSLDEACLLIFGR

SEQ ID NO: 118856 - protein, 17 aa, Mycobacterium avium
AEDARVLYHAALAHASN

SEQ ID NO: 118857 - protein, 29 aa, Mycobacterium avium
AEDWDLDALWTALKTLYPVGIDHATLTRR

SEQ ID NO: 118858 - protein, 24 aa, Mycobacterium avium
AEETAFALLALQAPVATDLRAVVS

SEQ ID NO: 118859 - protein, 22 aa, Mycobacterium avium
AEEVRRYFGSKVLRTVIPRSVK

SEQ ID NO: 118860 - protein, 17 aa, Mycobacterium avium
AEFALGGATGQLRRIGR

SEQ ID NO: 118861 - protein, 25 aa, Mycobacterium avium
AEFDSRRTGFTPPPPRYKTGVLAKY

SEQ ID NO: 118862 - protein, 27 aa, Mycobacterium avium
AEFVTPGWFASFIPVTVPVAGASFGDA

SEQ ID NO: 118863 - protein, 23 aa, Mycobacterium avium
AEGHAAKVLNLRSTLLTLAGGDA

SEQ ID NO: 118864 - protein, 18 aa, Mycobacterium avium
AEGLISQQPRRGFVVLPV

SEQ ID NO: 118865 - protein, 18 aa, Mycobacterium avium
AEGRRYANTPRGARLRDG

SEQ ID NO: 118866 - protein, 20 aa, Mycobacterium avium
AEHGLWYPPDPSSFEICSIG

SEQ ID NO: 118867 - protein, 26 aa, Mycobacterium avium
AEINGYPRLLCMTRMSTFAEDEVVTV

SEQ ID NO: 118868 - protein, 18 aa, Mycobacterium avium
AEITALTSGPWVGPSAAA

SEQ ID NO: 118869 - protein, 23 aa, Mycobacterium avium
AEKPPLRVFFGSSPLETAKADYE

SEQ ID NO: 118870 - protein, 18 aa, Mycobacterium avium
AELAARIESLGYGAAWIG

SEQ ID NO: 118871 - protein, 26 aa, Mycobacterium avium
AELAGFGYAVLLPDVYYRSGEWAPFD

SEQ ID NO: 118872 - protein, 33 aa, Mycobacterium avium
AELDAVAEALRGFPQRCYVLPDEPLLSAPTVAE

SEQ ID NO: 118873 - protein, 23 aa, Mycobacterium avium
AELGADFFVFSGHKIYGPTGIGA

SEQ ID NO: 118874 - protein, 23 aa, Mycobacterium avium
AELGEWLHPFEKFWRTRLRRLAE

SEQ ID NO: 118875 - protein, 22 aa, Mycobacterium avium
AELMLRKATWLYDNGKPCGREA

SEQ ID NO: 118876 - protein, 27 aa, Mycobacterium avium
AELRKSAPIYWMDVPGGTGGFGDKGYW

SEQ ID NO: 118877 - protein, 29 aa, Mycobacterium avium
AELSDGTLRFLLWAAALLSPQPPSLMVLN

SEQ ID NO: 118878 - protein, 17 aa, Mycobacterium avium
AELSWVDPALAGTTSLH

SEQ ID NO: 118879 - protein, 21 aa, Mycobacterium avium
AEMIAEKWGFDRTALDEFSLA

SEQ ID NO: 118880 - protein, 24 aa, Mycobacterium avium
AENRALLAQLVATNIFGQNTAAIA

SEQ ID NO: 118881 - protein, 21 aa, Mycobacterium avium
AEPVFPLVQAMPVPYVEPEDI

SEQ ID NO: 118882 - protein, 27 aa, Mycobacterium avium
AEQGLLPDVLYTSLLRRAITTAHLALD

SEQ ID NO: 118883 - protein, 27 aa, Mycobacterium avium
AEQLPRKVAMRLLLTGEPLSAAAARDW

SEQ ID NO: 118884 - protein, 18 aa, Mycobacterium avium
AEQRLGDEKGVIGNSLQL

SEQ ID NO: 118885 - protein, 28 aa, Mycobacterium avium
AEQRPDLVPIFLNALPAPLIEASDVSNA

SEQ ID NO: 118886 - protein, 26 aa, Mycobacterium avium
AEREQWWRRAVQAYPPYAEYQTKTAR

SEQ ID NO: 118887 - protein, 24 aa, Mycobacterium avium
AERFVANPFGGPGERMYRTGDLVR

SEQ ID NO: 118888 - protein, 24 aa, Mycobacterium avium
AERHGLALDPRFSNSNPRIAPEYH

SEQ ID NO: 118889 - protein, 40 aa, Mycobacterium avium
AERHWRELGKPLHLHRILLQRSWIAIFWSRFADAVELIAQ

SEQ ID NO: 118890 - protein, 17 aa, Mycobacterium avium
AERLGLIVSAAMGYEPE

SEQ ID NO: 118891 - protein, 19 aa, Mycobacterium avium
AERVTFATWAIVTGKSAGG

SEQ ID NO: 118892 - protein, 23 aa, Mycobacterium avium
AERYERDLGALPPELVRGPVRER

SEQ ID NO: 118893 - protein, 25 aa, Mycobacterium avium
AESRGYFDLAWAHAGGLPRPLMVVT

SEQ ID NO: 118894 - protein, 25 aa, Mycobacterium avium
AETRDLFLTLLSVSGVGPRLAMATL

SEQ ID NO: 118895 - protein, 26 aa, Mycobacterium avium
AETSWDLRKFLWAPKLGCYGIQRIHP

SEQ ID NO: 118896 - protein, 18 aa, Mycobacterium avium
AEVDGHHVFWTVHARNKR

SEQ ID NO: 118897 - protein, 18 aa, Mycobacterium avium
AEVLPLLEEVLGGGVAEA

SEQ ID NO: 118898 - protein, 27 aa, Mycobacterium avium
AEVLRPGLLVLPVRGAARYFGSEEAAA

SEQ ID NO: 118899 - protein, 26 aa, Mycobacterium avium
AEVNGQVFIVYGPQVTLVAAPTAEHK

SEQ ID NO: 118900 - protein, 26 aa, Mycobacterium avium
AEYKKLLLAMLQRREAWEIIDYVNRL

SEQ ID NO: 118901 - protein, 30 aa, Mycobacterium avium
AEYLAALQAPLVITPWRSVLVGDLREEVAD

SEQ ID NO: 118902 - protein, 20 aa, Mycobacterium avium
AFAFSHRSYLDGMLLPEVIL

SEQ ID NO: 118903 - protein, 17 aa, Mycobacterium avium
AFCADLALRTRRIDVDY

SEQ ID NO: 118904 - protein, 20 aa, Mycobacterium avium
AFDHGPWPRMSHAERMAKVE

SEQ ID NO: 118905 - protein, 21 aa, Mycobacterium avium
AFGITPALARLYRASGQDIPV

SEQ ID NO: 118906 - protein, 25 aa, Mycobacterium avium
AFGPHSRRPMWRRGRRAEKATALRW

SEQ ID NO: 118907 - protein, 18 aa, Mycobacterium avium
AFLGKDEDLYVFSSVADL

SEQ ID NO: 118908 - protein, 26 aa, Mycobacterium avium
AFMETLDPSIYWMGMHHSRLIKRDSN

SEQ ID NO: 118909 - protein, 19 aa, Mycobacterium avium
AFTDADYWRARLASSGVDV

SEQ ID NO: 118910 - protein, 19 aa, Mycobacterium avium
AFVDALIDGAQRLARPRGG

SEQ ID NO: 118911 - protein, 25 aa, Mycobacterium avium
AFVELSAHPSLLYPLSGIIDDESAV

SEQ ID NO: 118912 - protein, 26 aa, Mycobacterium avium
AFVGRIQPLKAPDIVLRAAAKLPGVR

SEQ ID NO: 118913 - protein, 19 aa, Mycobacterium avium
AFYRGKIATAAFFAKNMLP

SEQ ID NO: 118914 - protein, 28 aa, Mycobacterium avium
AGAGGLLLPVGVRRLRNYHSTRNAHYCL

SEQ ID NO: 118915 - protein, 22 aa, Mycobacterium avium
AGAGWAGVRWRNLTGGIVALHA

SEQ ID NO: 118916 - protein, 18 aa, Mycobacterium avium
AGAPVRAVTRRSGPAGFP

SEQ ID NO: 118917 - protein, 22 aa, Mycobacterium avium
AGATPFLQQLLSAAANAGTRLP

SEQ ID NO: 118918 - protein, 34 aa, Mycobacterium avium
AGAVPVPTLRPPQARVLLIAALAAGLPAADVLGR

SEQ ID NO: 118919 - protein, 17 aa, Mycobacterium avium
AGAYEQWRWTQDSFVPW

SEQ ID NO: 118920 - protein, 29 aa, Mycobacterium avium
AGCDRIRFTPYQKLVLLDIPDDKLDEVVA

SEQ ID NO: 118921 - protein, 23 aa, Mycobacterium avium
AGDAAFRSWWDAAGNRAASPSMA

SEQ ID NO: 118922 - protein, 18 aa, Mycobacterium avium
AGDLLYLDALGPDGDYRT

SEQ ID NO: 118923 - protein, 17 aa, Mycobacterium avium
AGDWLRAGAPAIDAVLC

SEQ ID NO: 118924 - protein, 18 aa, Mycobacterium avium
AGDYLFATASRLVSRLGP

SEQ ID NO: 118925 - protein, 26 aa, Mycobacterium avium
AGEGKLTQLPPLLAAPPVKTRYVTSD

SEQ ID NO: 118926 - protein, 28 aa, Mycobacterium avium
AGEGRVSWLFVPRLRADGWLRIGGADHR

SEQ ID NO: 118927 - protein, 27 aa, Mycobacterium avium
AGEIDFRLFATIVYRTDLITDRRVLAA

SEQ ID NO: 118928 - protein, 34 aa, Mycobacterium avium
AGEPQWVPPPPFTWDYRLFAGPHPAPVAPPDHTI

SEQ ID NO: 118929 - protein, 28 aa, Mycobacterium avium
AGEPWTVSKLYYNHGFLRARMQLLHDEA

SEQ ID NO: 118930 - protein, 31 aa, Mycobacterium avium
AGGAIIRQPIPPFKWWRGLRARQLLEDYFSE

SEQ ID NO: 118931 - protein, 29 aa, Mycobacterium avium
AGGLIGAALRPWRLARVLPATALTLAETV

SEQ ID NO: 118932 - protein, 21 aa, Mycobacterium avium
AGGRCLDVVRLLRITTDSPAV

SEQ ID NO: 118933 - protein, 25 aa, Mycobacterium avium
AGHALGGGCELAMMCDVLIAADTAK

SEQ ID NO: 118934 - protein, 21 aa, Mycobacterium avium
AGHDRFRFYLNVEVGKHLSHA

SEQ ID NO: 118935 - protein, 19 aa, Mycobacterium avium
AGIALLACMPPRPGERELV

SEQ ID NO: 118936 - protein, 26 aa, Mycobacterium avium
AGIDRPLRLTSPEATGLLVALRALAD

SEQ ID NO: 118937 - protein, 26 aa, Mycobacterium avium
AGIDSVIINLPFYTPGIVQAAGEALR

SEQ ID NO: 118938 - protein, 32 aa, Mycobacterium avium
AGIGNMLTGLLLGIPTVIYPLGAFEPGQLLDV

SEQ ID NO: 118939 - protein, 20 aa, Mycobacterium avium
AGIKPIIGVEAYIAPGSRFD

SEQ ID NO: 118940 - protein, 21 aa, Mycobacterium avium
AGIPPFYVMDVWLAAAERQRS

SEQ ID NO: 118941 - protein, 20 aa, Mycobacterium avium
AGIYIGDGMMIHSSTYGVPV

SEQ ID NO: 118942 - protein, 17 aa, Mycobacterium avium
AGKTVFVFPGQGSQWLG

SEQ ID NO: 118943 - protein, 24 aa, Mycobacterium avium
AGLLFNDLTVYFALTVRGRLQRGE

SEQ ID NO: 118944 - protein, 20 aa, Mycobacterium avium
AGLPGSPWHERAKKLAPKGT

SEQ ID NO: 118945 - protein, 19 aa, Mycobacterium avium
AGMAAALWALSEQLTKTEF

SEQ ID NO: 118946 - protein, 18 aa, Mycobacterium avium
AGNADFAIAIRTALMRGG

SEQ ID NO: 118947 - protein, 24 aa, Mycobacterium avium
AGNRAFFDWMNHGKLCYGIDFDRD

SEQ ID NO: 118948 - protein, 39 aa, Mycobacterium avium
AGPASRVAILLPAHWQTAAVLFGVWWIGAEAVLAGPADL

SEQ ID NO: 118949 - protein, 23 aa, Mycobacterium avium
AGPQLHANWTWARSVLTDEQLNR

SEQ ID NO: 118950 - protein, 23 aa, Mycobacterium avium
AGPTPRVNPWSTPIPKVYLCSAA

SEQ ID NO: 118951 - protein, 18 aa, Mycobacterium avium
AGQKLSGSHRLGHACVLA

SEQ ID NO: 118952 - protein, 19 aa, Mycobacterium avium
AGQWRALALVTTTADLVGV

SEQ ID NO: 118953 - protein, 23 aa, Mycobacterium avium
AGRDWAIREIPLGDVVKAVVQVE

SEQ ID NO: 118954 - protein, 20 aa, Mycobacterium avium
AGRPAQIASLARAFHDAGMS

SEQ ID NO: 118955 - protein, 21 aa, Mycobacterium avium
AGRPMILKRFVKGITQEAVFQ

SEQ ID NO: 118956 - protein, 28 aa, Mycobacterium avium
AGRREPIPLPLKTSYAWAAARYGGDDPV

SEQ ID NO: 118957 - protein, 18 aa, Mycobacterium avium
AGRTLTSYPSIRTDLRNA

SEQ ID NO: 118958 - protein, 21 aa, Mycobacterium avium
AGSCVLFVGTLWHGGGANTTD

SEQ ID NO: 118959 - protein, 18 aa, Mycobacterium avium
AGSKLHLVGQRPPGPVPT

SEQ ID NO: 118960 - protein, 24 aa, Mycobacterium avium
AGTRRARLFYANRSRDAVIFDEDL

SEQ ID NO: 118961 - protein, 24 aa, Mycobacterium avium
AGVDRLGYRLIRLSGQVSGPAELP

SEQ ID NO: 118962 - protein, 20 aa, Mycobacterium avium
AGVLQRQVDLAPGALGFRYD

SEQ ID NO: 118963 - protein, 25 aa, Mycobacterium avium
AGVQLAVHPLASRALFGLPSAELPV

SEQ ID NO: 118964 - protein, 26 aa, Mycobacterium avium
AGYAPRLWRYWAEHLDPDRARRDDPR

SEQ ID NO: 118965 - protein, 26 aa, Mycobacterium avium
AHDEGWLAEHMLILKLISPENKAYYF

SEQ ID NO: 118966 - protein, 18 aa, Mycobacterium avium
AHGPRILHTVRGIGYRLQ

SEQ ID NO: 118967 - protein, 23 aa, Mycobacterium avium
AHHEGRVVFVRYALPGERVRVRV

SEQ ID NO: 118968 - protein, 25 aa, Mycobacterium avium
AHLIDAARTFIFDTGLAPAAVGAAR

SEQ ID NO: 118969 - protein, 36 aa, Mycobacterium avium
AHLVERGHRRIAFAYTGIARWRPLGDYWFEGVSRAA

SEQ ID NO: 118970 - protein, 19 aa, Mycobacterium avium
AHNVAFDYAFLAAEAELAG

SEQ ID NO: 118971 - protein, 24 aa, Mycobacterium avium
AHPCPMCLGALYYCSPREVIFLTT

SEQ ID NO: 118972 - protein, 19 aa, Mycobacterium avium
AHSPLEFLYGLFSDYVRDR

SEQ ID NO: 118973 - protein, 23 aa, Mycobacterium avium
AIARRFAHLTYRGEVELDTRFGN

SEQ ID NO: 118974 - protein, 28 aa, Mycobacterium avium
AIDADVPIIPLIVWGAHRIWTKDHPRTL

SEQ ID NO: 118975 - protein, 19 aa, Mycobacterium avium
AIDILRWTDEHFGPVDGPR

SEQ ID NO: 118976 - protein, 36 aa, Mycobacterium avium
AIDRLLLETDQLFGWIAFEFGVYRYGLQQRLAPGTA

SEQ ID NO: 118977 - protein, 26 aa, Mycobacterium avium
AIEIGIKWLSLYAFSTENWKRSPEEV

SEQ ID NO: 118978 - protein, 20 aa, Mycobacterium avium
AIGALSFAYTGPGPLTERVN

SEQ ID NO: 118979 - protein, 20 aa, Mycobacterium avium
AIGAVLSMHFAKQAARFFDS

SEQ ID NO: 118980 - protein, 19 aa, Mycobacterium avium
AIGPYRRLIVLGGDAELAL

SEQ ID NO: 118981 - protein, 24 aa, Mycobacterium avium
AIHYLAVFDEHTGRPLYLGRQKRV

SEQ ID NO: 118982 - protein, 18 aa, Mycobacterium avium
AIITGWDYPSCEAIGLLK

SEQ ID NO: 118983 - protein, 25 aa, Mycobacterium avium
AILAMERVEYRILGPQYKSPRLVKP

SEQ ID NO: 118984 - protein, 18 aa, Mycobacterium avium
AILDEWKTITGLDRRVDD

SEQ ID NO: 118985 - protein, 22 aa, Mycobacterium avium
AILIGASWQRCRVHFLRNVLAQ

SEQ ID NO: 118986 - protein, 18 aa, Mycobacterium avium
AIPLNLVLLKDICVRGME

SEQ ID NO: 118987 - protein, 23 aa, Mycobacterium avium
AIQALDFFFRKIVRDRGQALQFV

SEQ ID NO: 118988 - protein, 17 aa, Mycobacterium avium
AIRAAGYTRVSLGMQSV

SEQ ID NO: 118989 - protein, 19 aa, Mycobacterium avium
AIRAGMSLGIMHDLAVGVH

SEQ ID NO: 118990 - protein, 20 aa, Mycobacterium avium
AIRIGFVARTILEPGPDGRE

SEQ ID NO: 118991 - protein, 29 aa, Mycobacterium avium
AISDELWDLLPGYLIFRSIVPTRPPSRRT

SEQ ID NO: 118992 - protein, 25 aa, Mycobacterium avium
AISKAPLVPSMLEWLHTARTSMVMD

SEQ ID NO: 118993 - protein, 20 aa, Mycobacterium avium
AIVRLLLESGSITAGEIGDR

SEQ ID NO: 118994 - protein, 22 aa, Mycobacterium avium
AIYHMAARYLGLAPRQIMMVAS

SEQ ID NO: 118995 - protein, 20 aa, Mycobacterium avium
AKLGPFLVPATLSAPEGTVP

SEQ ID NO: 118996 - protein, 19 aa, Mycobacterium avium
AKLLDLQPYLDRKPKDLSG

SEQ ID NO: 118997 - protein, 26 aa, Mycobacterium avium
AKMSAAVTPYLEWLHSTATQAEQAGA

SEQ ID NO: 118998 - protein, 23 aa, Mycobacterium avium
AKNRKIIAFVNSSVILNADDQRT

SEQ ID NO: 118999 - protein, 23 aa, Mycobacterium avium
AKQAHWNIVGINFRDLHLQLDEL

SEQ ID NO: 119000 - protein, 18 aa, Mycobacterium avium
AKRKLIPGLAYLDQSELA

SEQ ID NO: 119001 - protein, 25 aa, Mycobacterium avium
AKSPVSFFAYPGMPSDLVPAGCEVH

SEQ ID NO: 119002 - protein, 28 aa, Mycobacterium avium
AKSWRVSPALASALWLKCNILAERNTRG

SEQ ID NO: 119003 - protein, 40 aa, Mycobacterium avium
AKVSGSRFYFLTGKGALLQLGLLQLALRLAVENGFVPMIP

SEQ ID NO: 119004 - protein, 29 aa, Mycobacterium avium
AKVWRMLTEPELMKLWWAEGQVAAVVGHR

SEQ ID NO: 119005 - protein, 26 aa, Mycobacterium avium
AKYQQALLELLPHITLINGYGSSETG

SEQ ID NO: 119006 - protein, 28 aa, Mycobacterium avium
ALAEGGWVLPYLPKPWGRGAGPVEQIII

SEQ ID NO: 119007 - protein, 20 aa, Mycobacterium avium
ALAILTARHLDCWVLGTVGK

SEQ ID NO: 119008 - protein, 23 aa, Mycobacterium avium
ALALLYHTKRLASPAQRIVLYAK

SEQ ID NO: 119009 - protein, 22 aa, Mycobacterium avium
ALALYHTKRLASPGQRIVLYAK

SEQ ID NO: 119010 - protein, 24 aa, Mycobacterium avium
ALAPTHTLLLAGRPSDRLDAVAQR

SEQ ID NO: 119011 - protein, 18 aa, Mycobacterium avium
ALARQPSVLLLDEPLAAL

SEQ ID NO: 119012 - protein, 19 aa, Mycobacterium avium
ALASILSWQGWETLFELAH

SEQ ID NO: 119013 - protein, 33 aa, Mycobacterium avium
ALDDTNLRRLISLFELLRARSQLIIITHQKPTM

SEQ ID NO: 119014 - protein, 23 aa, Mycobacterium avium
ALDIYFNLANYRNNWKRLGFTDD

SEQ ID NO: 119015 - protein, 20 aa, Mycobacterium avium
ALDPQRVVLLPDGTEDYWSD

SEQ ID NO: 119016 - protein, 24 aa, Mycobacterium avium
ALDPRWTVRQILDGPLRSYRVDDR

SEQ ID NO: 119017 - protein, 26 aa, Mycobacterium avium
ALEAHLISPWGTWDWMGPAAVGAVLP

SEQ ID NO: 119018 - protein, 19 aa, Mycobacterium avium
ALENTRFWAPLSLTAEQKH

SEQ ID NO: 119019 - protein, 28 aa, Mycobacterium avium
ALENYHRLTMPSTWLEALVKTYVGDALA

SEQ ID NO: 119020 - protein, 25 aa, Mycobacterium avium
ALERPRFDALGRWPLARTAEVSAER

SEQ ID NO: 119021 - protein, 17 aa, Mycobacterium avium
ALFDRHGRRLSLNTYGR

SEQ ID NO: 119022 - protein, 35 aa, Mycobacterium avium
ALFHAFAVQMNLIGPLWFAIRAYRQMQTQDGMGCI

SEQ ID NO: 119023 - protein, 21 aa, Mycobacterium avium
ALGDMFLGALFGDHPVGRPVI

SEQ ID NO: 119024 - protein, 19 aa, Mycobacterium avium
ALGDYRWRDLLDNHDRIVR

SEQ ID NO: 119025 - protein, 18 aa, Mycobacterium avium
ALGPFPTDRGWAVSELLA

SEQ ID NO: 119026 - protein, 26 aa, Mycobacterium avium
ALGRNDEALQWFLHAAAADLDGVTDA

SEQ ID NO: 119027 - protein, 26 aa, Mycobacterium avium
ALGTALARLGMFAPALSYLEEPDGPV

SEQ ID NO: 119028 - protein, 22 aa, Mycobacterium avium
ALGTGFFLTWLTTYTDQNGEVL

SEQ ID NO: 119029 - protein, 34 aa, Mycobacterium avium
ALGYFDAGALLRLQSPRRPLFTPLAPVAGVPDSL

SEQ ID NO: 119030 - protein, 26 aa, Mycobacterium avium
ALHAGWRALGWWLVGTSRAMLTLGRR

SEQ ID NO: 119031 - protein, 18 aa, Mycobacterium avium
ALHHCVVGFAAVGWQARV

SEQ ID NO: 119032 - protein, 17 aa, Mycobacterium avium
ALICHRIGDVYNALASG

SEQ ID NO: 119033 - protein, 17 aa, Mycobacterium avium
ALIPHRLGGWLDGHPAR

SEQ ID NO: 119034 - protein, 22 aa, Mycobacterium avium
ALIVGVPMDFRLGFGAVFGPHT

SEQ ID NO: 119035 - protein, 21 aa, Mycobacterium avium
ALKGAHFIELCDKRKVPLLFL

SEQ ID NO: 119036 - protein, 17 aa, Mycobacterium avium
ALKLGVPPLTMKPDVCW

SEQ ID NO: 119037 - protein, 22 aa, Mycobacterium avium
ALKPRQWYDDNDITLRLGSAAR

SEQ ID NO: 119038 - protein, 24 aa, Mycobacterium avium
ALKTALIDGLGLKPRKAFGPIRVG

SEQ ID NO: 119039 - protein, 18 aa, Mycobacterium avium
ALLDWLRAAHRTATWTTS

SEQ ID NO: 119040 - protein, 24 aa, Mycobacterium avium
ALLFAKRPLMAEAMLRVFFEAYEI

SEQ ID NO: 119041 - protein, 20 aa, Mycobacterium avium
ALLVDLDPWGGGIELLLGGE

SEQ ID NO: 119042 - protein, 28 aa, Mycobacterium avium
ALLVTDLINVRYLSGFTGSNGALLVFAD

SEQ ID NO: 119043 - protein, 20 aa, Mycobacterium avium
ALMLPNLQMMAKLRTGQPLG

SEQ ID NO: 119044 - protein, 20 aa, Mycobacterium avium
ALMQVLLTGNRFKPAKAQQV

SEQ ID NO: 119045 - protein, 20 aa, Mycobacterium avium
ALNAISGRVAFALGLEGPAV

SEQ ID NO: 119046 - protein, 25 aa, Mycobacterium avium
ALNRRTPIFGGWVTGPTLLGPEEFA

SEQ ID NO: 119047 - protein, 17 aa, Mycobacterium avium
ALPHLRTSGHEAKVDWI

SEQ ID NO: 119048 - protein, 19 aa, Mycobacterium avium
ALPSPPRGFTPAPPPEWAD

SEQ ID NO: 119049 - protein, 17 aa, Mycobacterium avium
ALQPLVGQPPRLVAAAV

SEQ ID NO: 119050 - protein, 18 aa, Mycobacterium avium
ALQQAQFVRITAAGLRES

SEQ ID NO: 119051 - protein, 19 aa, Mycobacterium avium
ALQVIRAVWTGDDISFEGR

SEQ ID NO: 119052 - protein, 17 aa, Mycobacterium avium
ALQYFHVTPWVAWSDAS

SEQ ID NO: 119053 - protein, 21 aa, Mycobacterium avium
ALRDELGDVLLQVLFHARIAE

SEQ ID NO: 119054 - protein, 21 aa, Mycobacterium avium
ALREELVTALIRSLPKDLRRN

SEQ ID NO: 119055 - protein, 17 aa, Mycobacterium avium
ALRESNPVFRSPQAVVL

SEQ ID NO: 119056 - protein, 27 aa, Mycobacterium avium
ALRHKVPVFAMAWALVHLAGAGQQTPS

SEQ ID NO: 119057 - protein, 18 aa, Mycobacterium avium
ALRKTLGVPLFQEQLMQL

SEQ ID NO: 119058 - protein, 35 aa, Mycobacterium avium
ALRLDRLLRLKVFPLAISLPWGIAPAALPQLPLPA

SEQ ID NO: 119059 - protein, 33 aa, Mycobacterium avium
ALRPYDLSFSRYELLRLLAFSRTGALPITKASD

SEQ ID NO: 119060 - protein, 30 aa, Mycobacterium avium
ALTAVAMLVAIFRARPSPFYIMDEVEAALD

SEQ ID NO: 119061 - protein, 18 aa, Mycobacterium avium
ALTEDDLLRTELFRTKAG

SEQ ID NO: 119062 - protein, 25 aa, Mycobacterium avium
ALTPRMRRIRFSGPRLHGLGWTPGQ

SEQ ID NO: 119063 - protein, 17 aa, Mycobacterium avium
ALTVTAIETHPARRLLP

SEQ ID NO: 119064 - protein, 25 aa, Mycobacterium avium
ALVAGLRLRLPIVATALGTYDTASA

SEQ ID NO: 119065 - protein, 19 aa, Mycobacterium avium
ALVDGLLAILAVGGSLVQV

SEQ ID NO: 119066 - protein, 25 aa, Mycobacterium avium
ALVETLLVVMCGVGLYAGYVETYQE

SEQ ID NO: 119067 - protein, 27 aa, Mycobacterium avium
ALVNLVRSLGVPAWLSYTIDGAHTRAG

SEQ ID NO: 119068 - protein, 17 aa, Mycobacterium avium
ALWHATTLLREQRGDAH

SEQ ID NO: 119069 - protein, 18 aa, Mycobacterium avium
ALWLAEMIEQLELPPGVV

SEQ ID NO: 119070 - protein, 19 aa, Mycobacterium avium
AMAGWEVTVLLPHGCNTRS

SEQ ID NO: 119071 - protein, 21 aa, Mycobacterium avium
AMDAFRVLCRTEGIIPAIESA

SEQ ID NO: 119072 - protein, 25 aa, Mycobacterium avium
AMDPDPINSFLQPSGLFGPGQLMSV

SEQ ID NO: 119073 - protein, 29 aa, Mycobacterium avium
AMESRARLFPQGLARFIGLRDQRCRTPYC

SEQ ID NO: 119074 - protein, 17 aa, Mycobacterium avium
AMGTRFLLTSDSTVPDA

SEQ ID NO: 119075 - protein, 29 aa, Mycobacterium avium
AMGYEPEDLPWEVPLIELGLDSLMAVRIK

SEQ ID NO: 119076 - protein, 18 aa, Mycobacterium avium
AMHGFIRGAAALGARRGD

SEQ ID NO: 119077 - protein, 26 aa, Mycobacterium avium
AMIEHPILIERPFVVTPKGTRLARPI

SEQ ID NO: 119078 - protein, 23 aa, Mycobacterium avium
AMPREWFHDLLDPDGRPFRDSEI

SEQ ID NO: 119079 - protein, 21 aa, Mycobacterium avium
AMRGLPITVIHAVAPVVVGWP

SEQ ID NO: 119080 - protein, 21 aa, Mycobacterium avium
AMRRRVMRLRTQHAHVVSAAA

SEQ ID NO: 119081 - protein, 23 aa, Mycobacterium avium
AMTLARIDFAANTLTWAGVGNVT

SEQ ID NO: 119082 - protein, 28 aa, Mycobacterium avium
ANALALQFGWRLFAPILRAATGIEELTD

SEQ ID NO: 119083 - protein, 19 aa, Mycobacterium avium
ANFTVPVNRLLTAAMPRAA

SEQ ID NO: 119084 - protein, 28 aa, Mycobacterium avium
ANGGRKPWLPHFYLGHGIGTYPAEAPMI

SEQ ID NO: 119085 - protein, 26 aa, Mycobacterium avium
ANLSDALLALLPLVGVWRGEGEGRGH

SEQ ID NO: 119086 - protein, 23 aa, Mycobacterium avium
APADLIAEYGPHIALPPSELEMA

SEQ ID NO: 119087 - protein, 20 aa, Mycobacterium avium
APAHDWLTLTGGAIGYGIPA

SEQ ID NO: 119088 - protein, 26 aa, Mycobacterium avium
APAMPAECLLDRNALIMGYSGVYSSF

SEQ ID NO: 119089 - protein, 20 aa, Mycobacterium avium
APAWTRIDDFGGWRAHVRAM

SEQ ID NO: 119090 - protein, 29 aa, Mycobacterium avium
APAYDELKPDAWLANIFREEMCRLGRQPV

SEQ ID NO: 119091 - protein, 25 aa, Mycobacterium avium
APDRTALVSGLLRELGRRIVSWQAA

SEQ ID NO: 119092 - protein, 24 aa, Mycobacterium avium
APDTMTYLTALLPVAQGVSVYAAL

SEQ ID NO: 119093 - protein, 18 aa, Mycobacterium avium
APFEVPAEFRRAAELPHT

SEQ ID NO: 119094 - protein, 24 aa, Mycobacterium avium
APFNDIILFTQDWGFRLDQVKVPV

SEQ ID NO: 119095 - protein, 24 aa, Mycobacterium avium
APGFGDRRKAMLQDMAILTGGQVI

SEQ ID NO: 119096 - protein, 29 aa, Mycobacterium avium
APGGFDCSGLVMWAFQQAGISLPHSSQAL

SEQ ID NO: 119097 - protein, 31 aa, Mycobacterium avium
APGGGPCLLTPPPWYPILRGTTQQALFEVAR

SEQ ID NO: 119098 - protein, 25 aa, Mycobacterium avium
APGGRLVFNTFLARDGYVPDAAAVQ

SEQ ID NO: 119099 - protein, 22 aa, Mycobacterium avium
APGLPHDGYLADALMRTKGFIG

SEQ ID NO: 119100 - protein, 24 aa, Mycobacterium avium
APGSRLAFDFVPDTAVFADPRWRA

SEQ ID NO: 119101 - protein, 23 aa, Mycobacterium avium
APHASWMFEYYPMRDVRELPDGS

SEQ ID NO: 119102 - protein, 21 aa, Mycobacterium avium
APIGAFGFDSPLPPGVDQHIA

SEQ ID NO: 119103 - protein, 20 aa, Mycobacterium avium
APKHNGITYFLLDMSSDGVD

SEQ ID NO: 119104 - protein, 18 aa, Mycobacterium avium
APLGSLYHFFPGGKQDLA

SEQ ID NO: 119105 - protein, 18 aa, Mycobacterium avium
APNQLWVTDLTFVPTWAG

SEQ ID NO: 119106 - protein, 35 aa, Mycobacterium avium
APPDTTIVSWLPFYHDMGLILGVCAPVLGGIPAVL

SEQ ID NO: 119107 - protein, 38 aa, Mycobacterium avium
APPPEFVDWRQQPGLRRALFQGNPVWVVSRYHDIRAAL

SEQ ID NO: 119108 - protein, 17 aa, Mycobacterium avium
APRGIRQAGLAGDWLRA

SEQ ID NO: 119109 - protein, 19 aa, Mycobacterium avium
APRVLREYALLADGERGAL

SEQ ID NO: 119110 - protein, 18 aa, Mycobacterium avium
APSWRKGPRHIAGRGPRD

SEQ ID NO: 119111 - protein, 28 aa, Mycobacterium avium
APTALLRIYGDALPPRYAKALQRYTFGP

SEQ ID NO: 119112 - protein, 26 aa, Mycobacterium avium
APTGLLDQLAALYGRPAAAVLIDFAD

SEQ ID NO: 119113 - protein, 25 aa, Mycobacterium avium
APVLADLVHGLPLPRRSPPADAPDE

SEQ ID NO: 119114 - protein, 23 aa, Mycobacterium avium
APYLAGHGWRLNSVTIRDLFAAN

SEQ ID NO: 119115 - protein, 24 aa, Mycobacterium avium
APYTDIPSNLLFFDKTGRTKEIWY

SEQ ID NO: 119116 - protein, 20 aa, Mycobacterium avium
AQALPLGAFIGLLGDAMSEP

SEQ ID NO: 119117 - protein, 19 aa, Mycobacterium avium
AQDAAAMYGYAASSATAGK

SEQ ID NO: 119118 - protein, 25 aa, Mycobacterium avium
AQIERLLVPLLRGDEWWALGMSEPE

SEQ ID NO: 119119 - protein, 18 aa, Mycobacterium avium
AQLDFWTDALAGLPERLQ

SEQ ID NO: 119120 - protein, 24 aa, Mycobacterium avium
AQLRTMLRRISGVDAVLAEIGALG

SEQ ID NO: 119121 - protein, 35 aa, Mycobacterium avium
AQNAFGDKVLPLYLPTGLPACTGLIGLLSQQRYAY

SEQ ID NO: 119122 - protein, 26 aa, Mycobacterium avium
AQQHYPMQPGAYWVPRRLGGTAPTPA

SEQ ID NO: 119123 - protein, 24 aa, Mycobacterium avium
AQRALHRVISLLAAGRAVLTHCFA

SEQ ID NO: 119124 - protein, 29 aa, Mycobacterium avium
AQRCESLRDNLWYLIDAKAATAIAVDDRT

SEQ ID NO: 119125 - protein, 21 aa, Mycobacterium avium
AQREWISYPVDRRRDLLFGLA

SEQ ID NO: 119126 - protein, 23 aa, Mycobacterium avium
AQRLLTLDAYVAAGFHVVALLNE

SEQ ID NO: 119127 - protein, 23 aa, Mycobacterium avium
AQRRDMMWICRDGDRAKNHLLEA

SEQ ID NO: 119128 - protein, 23 aa, Mycobacterium avium
AQRRPDAIAIRYGERQWSWAEWS

SEQ ID NO: 119129 - protein, 26 aa, Mycobacterium avium
AQSGPLLFDPLRERLAHYAGLDFLSG

SEQ ID NO: 119130 - protein, 18 aa, Mycobacterium avium
AQSRLRTVFGQLGNDHGA

SEQ ID NO: 119131 - protein, 31 aa, Mycobacterium avium
AQVEPTLPLRIRAAWLWSGRTAVIAGAAAAA

SEQ ID NO: 119132 - protein, 18 aa, Mycobacterium avium
AQVLLYPGLDRDMSVASI

SEQ ID NO: 119133 - protein, 19 aa, Mycobacterium avium
AQWRAVRVPALLIEAGNSV

SEQ ID NO: 119134 - protein, 21 aa, Mycobacterium avium
ARAAALAARLFGRAAPVPEVP

SEQ ID NO: 119135 - protein, 22 aa, Mycobacterium avium
ARAAWAWFRHLHTLADRTLAPS

SEQ ID NO: 119136 - protein, 20 aa, Mycobacterium avium
ARAVRVIDWFIGATARRRYQ

SEQ ID NO: 119137 - protein, 17 aa, Mycobacterium avium
ARDLGVRRTLTGEPLPP

SEQ ID NO: 119138 - protein, 24 aa, Mycobacterium avium
ARDLRYTLLDDVPVATLISGHALS

SEQ ID NO: 119139 - protein, 17 aa, Mycobacterium avium
AREFLIRVVNDAIEHGE

SEQ ID NO: 119140 - protein, 26 aa, Mycobacterium avium
ARERDIWLPVHPVTRRRWPNGRVTHD

SEQ ID NO: 119141 - protein, 27 aa, Mycobacterium avium
AREVDDALWRRFKQAQDVFFTARNAAT

SEQ ID NO: 119142 - protein, 21 aa, Mycobacterium avium
ARGFLTSQKARWAARSLLDAT

SEQ ID NO: 119143 - protein, 21 aa, Mycobacterium avium
ARGRLLISAMAAGAAAAAAHT

SEQ ID NO: 119144 - protein, 24 aa, Mycobacterium avium
ARGTPTRLLLLRHGQTELSVQRRY

SEQ ID NO: 119145 - protein, 33 aa, Mycobacterium avium
ARHITAVLPGRPPLATLFLPHNRGKKSVLADLR

SEQ ID NO: 119146 - protein, 20 aa, Mycobacterium avium
ARIDLRGAELTAARLRSALP

SEQ ID NO: 119147 - protein, 18 aa, Mycobacterium avium
ARLAKRLPEYMVPAAVVV

SEQ ID NO: 119148 - protein, 25 aa, Mycobacterium avium
ARLDPRLRMLVPVNDYPLIDAAGRR

SEQ ID NO: 119149 - protein, 28 aa, Mycobacterium avium
ARLELNVAFQMLYARYPDITAAGEPVML

SEQ ID NO: 119150 - protein, 26 aa, Mycobacterium avium
ARLGAQITIFRLGSDPGLARFIDQVA

SEQ ID NO: 119151 - protein, 25 aa, Mycobacterium avium
ARLGEALALLGWNMSLSNLRWDGDY

SEQ ID NO: 119152 - protein, 24 aa, Mycobacterium avium
ARLGRLTRPERWSGFGDLGDLADV

SEQ ID NO: 119153 - protein, 24 aa, Mycobacterium avium
ARLGRPPVMVPSYGPPGSASLMSS

SEQ ID NO: 119154 - protein, 25 aa, Mycobacterium avium
ARLQDLGFYTGLVDGYFGLQTHNAL

SEQ ID NO: 119155 - protein, 18 aa, Mycobacterium avium
ARLVDLYAKRPQVQERLT

SEQ ID NO: 119156 - protein, 17 aa, Mycobacterium avium
ARMYRTGDLVCWRSDGQ

SEQ ID NO: 119157 - protein, 26 aa, Mycobacterium avium
ARPGAFERLSPPWSPIRLLTEAASLK

SEQ ID NO: 119158 - protein, 19 aa, Mycobacterium avium
ARPPILDLVLPSAVGEASG

SEQ ID NO: 119159 - protein, 23 aa, Mycobacterium avium
ARPQTVFMYLDYIHHWRHPIRDG

SEQ ID NO: 119160 - protein, 22 aa, Mycobacterium avium
ARQGFSIALIPDGDDPRREIVP

SEQ ID NO: 119161 - protein, 17 aa, Mycobacterium avium
ARQLLDCKARPLVEVEI

SEQ ID NO: 119162 - protein, 17 aa, Mycobacterium avium
ARQRLYLSRAIVRSSWG

SEQ ID NO: 119163 - protein, 17 aa, Mycobacterium avium
ARRAYDVRPIVTAILDD

SEQ ID NO: 119164 - protein, 23 aa, Mycobacterium avium
ARRLRLDVLAQRDFRRPFDLSKD

SEQ ID NO: 119165 - protein, 28 aa, Mycobacterium avium
ARRRSQLVDWTWQMVRDTVLDRLLSNPA

SEQ ID NO: 119166 - protein, 28 aa, Mycobacterium avium
ARRSADTHLLRYPLPSAWAGDADVALYL

SEQ ID NO: 119167 - protein, 29 aa, Mycobacterium avium
ARRVADVLGIPFYVWDFAEKFQADVIDEF

SEQ ID NO: 119168 - protein, 26 aa, Mycobacterium avium
ARRVALPNIVRLLPPARAAGVRIVHC

SEQ ID NO: 119169 - protein, 25 aa, Mycobacterium avium
ARRVPLQHLLGTAAFGPVLLHVGPG

SEQ ID NO: 119170 - protein, 19 aa, Mycobacterium avium
ARTALTMFLGRADQPDRVR

SEQ ID NO: 119171 - protein, 18 aa, Mycobacterium avium
ARTGWSSLFEDLSRRGRP

SEQ ID NO: 119172 - protein, 22 aa, Mycobacterium avium
ARTRALLGWNPSHHTLLEDLEH

SEQ ID NO: 119173 - protein, 19 aa, Mycobacterium avium
ARTWAAPQWLQLGYELAGS

SEQ ID NO: 119174 - protein, 24 aa, Mycobacterium avium
ARVASRVLALLPTVAKDQALRSAA

SEQ ID NO: 119175 - protein, 30 aa, Mycobacterium avium
ARVEYKLRDWLFARQRYWGEPFPIVYDSDG

SEQ ID NO: 119176 - protein, 24 aa, Mycobacterium avium
ARVGAPVLFGMGRFLGHDRLADLD

SEQ ID NO: 119177 - protein, 25 aa, Mycobacterium avium
ARVLAGRVLIGAFAGFAVPRAARVP

SEQ ID NO: 119178 - protein, 18 aa, Mycobacterium avium
ARVLGSRAVGALLVPPED

SEQ ID NO: 119179 - protein, 34 aa, Mycobacterium avium
ARVVRQLIASGYIGFFLCPGAAELSFRAGIGVKV

SEQ ID NO: 119180 - protein, 27 aa, Mycobacterium avium
ARYLDTGGMYRMVTLAVLRAGIDPADA

SEQ ID NO: 119181 - protein, 19 aa, Mycobacterium avium
ARYWAEICAIPISFIAESV

SEQ ID NO: 119182 - protein, 17 aa, Mycobacterium avium
ASAFYGPFREAVSSSLS

SEQ ID NO: 119183 - protein, 24 aa, Mycobacterium avium
ASAGYMLMKPLVESATAAGARALY

SEQ ID NO: 119184 - protein, 17 aa, Mycobacterium avium
ASALEPLVLAPRVRDYS

SEQ ID NO: 119185 - protein, 37 aa, Mycobacterium avium
ASDDVPAYQRWLGTRLPYYANWIRLKSYWGTADTNYP

SEQ ID NO: 119186 - protein, 24 aa, Mycobacterium avium
ASDRAIAAWLWSGRRAVVAGNSAA

SEQ ID NO: 119187 - protein, 21 aa, Mycobacterium avium
ASDRLGLRPLATIRSWASVGV

SEQ ID NO: 119188 - protein, 17 aa, Mycobacterium avium
ASDRLRLEAYRRLAAAG

SEQ ID NO: 119189 - protein, 32 aa, Mycobacterium avium
ASDVIAIRGQRLFLGRTRFFGREQGPGAFHSE

SEQ ID NO: 119190 - protein, 18 aa, Mycobacterium avium
ASELYATLEQRAAQIDTV

SEQ ID NO: 119191 - protein, 23 aa, Mycobacterium avium
ASGAPIPPAYFGSLSDLIACEAE

SEQ ID NO: 119192 - protein, 28 aa, Mycobacterium avium
ASGGFVVPFLHPELKWDFRLPRVVSINV

SEQ ID NO: 119193 - protein, 27 aa, Mycobacterium avium
ASGLDARAYRLPWPAGTTVFEIDQPRV

SEQ ID NO: 119194 - protein, 27 aa, Mycobacterium avium
ASGLDARAYRLPWPAGTVVYEVDMPDV

SEQ ID NO: 119195 - protein, 26 aa, Mycobacterium avium
ASGLDSRAYRLPWPAGTVVYEIDQPR

SEQ ID NO: 119196 - protein, 24 aa, Mycobacterium avium
ASGLDTRAYRLAWPAGTVVYEIDQ

SEQ ID NO: 119197 - protein, 30 aa, Mycobacterium avium
ASIIEAIYPITAALRPFFAAVTGAYSPIGA

SEQ ID NO: 119198 - protein, 21 aa, Mycobacterium avium
ASKIMPVAPFPAVVRQRARAS

SEQ ID NO: 119199 - protein, 25 aa, Mycobacterium avium
ASLRAGIPTLALWSSADQPYWAAQI

SEQ ID NO: 119200 - protein, 23 aa, Mycobacterium avium
ASMLEPIWQVMPPSKAEGVWTTH

SEQ ID NO: 119201 - protein, 18 aa, Mycobacterium avium
ASNFAVCWAARDAAMRNV

SEQ ID NO: 119202 - protein, 20 aa, Mycobacterium avium
ASRFVACPFGGPGARMYRTG

SEQ ID NO: 119203 - protein, 20 aa, Mycobacterium avium
ASRRVVELAPIPLAELGRPR

SEQ ID NO: 119204 - protein, 17 aa, Mycobacterium avium
ASRSRLGLAQFAAPRPG

SEQ ID NO: 119205 - protein, 21 aa, Mycobacterium avium
ASRVDLPLLSPEQARAYCRTV

SEQ ID NO: 119206 - protein, 25 aa, Mycobacterium avium
ASSVRIYYYVFDLLHLDGKSTVAVP

SEQ ID NO: 119207 - protein, 20 aa, Mycobacterium avium
ASSWHILMKGAIVLAAVGDL

SEQ ID NO: 119208 - protein, 27 aa, Mycobacterium avium
ASVLAYPRVVWIAGGLLKGASVDAVVA

SEQ ID NO: 119209 - protein, 19 aa, Mycobacterium avium
ASVTGGNPFFLIQALHHVD

SEQ ID NO: 119210 - protein, 26 aa, Mycobacterium avium
ASYAAYYEQWAQPWEIQALLRAHAVA

SEQ ID NO: 119211 - protein, 20 aa, Mycobacterium avium
ATAFRIPYAPVANGANVTSF

SEQ ID NO: 119212 - protein, 23 aa, Mycobacterium avium
ATAMDPQHRLLLETSWEAMEHAG

SEQ ID NO: 119213 - protein, 25 aa, Mycobacterium avium
ATAPSWLPEAPSVADLGWSDAPAPD

SEQ ID NO: 119214 - protein, 24 aa, Mycobacterium avium
ATAVDPQHRLLLETSWDAIEHAGL

SEQ ID NO: 119215 - protein, 18 aa, Mycobacterium avium
ATDFVVGDALYLGFLFLN

SEQ ID NO: 119216 - protein, 23 aa, Mycobacterium avium
ATEEFLRYFTPAPGDARTISADM

SEQ ID NO: 119217 - protein, 26 aa, Mycobacterium avium
ATGGCFDLLHTGHIRLLRQARELGDA

SEQ ID NO: 119218 - protein, 23 aa, Mycobacterium avium
ATGRLLMVGLGPGTDLMFLPAAV

SEQ ID NO: 119219 - protein, 25 aa, Mycobacterium avium
ATGTAALFAFGTRLDPRFGSDSSAR

SEQ ID NO: 119220 - protein, 22 aa, Mycobacterium avium
ATLIPHLTFDPLRALQAIEQHR

SEQ ID NO: 119221 - protein, 18 aa, Mycobacterium avium
ATLLGRFYERFADHAVEI

SEQ ID NO: 119222 - protein, 24 aa, Mycobacterium avium
ATLRRAALVVPRYGVRITVMARPP

SEQ ID NO: 119223 - protein, 17 aa, Mycobacterium avium
ATLVEVFRRVDALGLEL

SEQ ID NO: 119224 - protein, 21 aa, Mycobacterium avium
ATLYDLMLEADATNMLMLPLF

SEQ ID NO: 119225 - protein, 21 aa, Mycobacterium avium
ATMRFEFNSLPFTLGMKEPAE

SEQ ID NO: 119226 - protein, 27 aa, Mycobacterium avium
ATMRRARLLAPMRPDRYLRIAAAMRRE

SEQ ID NO: 119227 - protein, 25 aa, Mycobacterium avium
ATNKQRPVSLFLRALARDLNASTPG

SEQ ID NO: 119228 - protein, 21 aa, Mycobacterium avium
ATNPDAWFYQRPITLEDHQNS

SEQ ID NO: 119229 - protein, 19 aa, Mycobacterium avium
ATPRLADIPGVRLIGTAQE

SEQ ID NO: 119230 - protein, 20 aa, Mycobacterium avium
ATQQLTPFTPPRPDTTANGI

SEQ ID NO: 119231 - protein, 25 aa, Mycobacterium avium
ATRGAHLALFRFAFASQEHEPEAFQ

SEQ ID NO: 119232 - protein, 20 aa, Mycobacterium avium
ATRVARPDLLALGALLHDIG

SEQ ID NO: 119233 - protein, 29 aa, Mycobacterium avium
ATTKRPAPWWWRPSGALFDQFLGAAETEP

SEQ ID NO: 119234 - protein, 19 aa, Mycobacterium avium
ATTQYIGATWAINQARDRT

SEQ ID NO: 119235 - protein, 17 aa, Mycobacterium avium
ATVPSIVRKGRGGSVVL

SEQ ID NO: 119236 - protein, 17 aa, Mycobacterium avium
ATWAIVTGKSAGGIFNP

SEQ ID NO: 119237 - protein, 25 aa, Mycobacterium avium
AVADIHLVIGDRQVSLPAGQSWSIT

SEQ ID NO: 119238 - protein, 26 aa, Mycobacterium avium
AVAESLRYVAAWNAAFLPSKDLTEGI

SEQ ID NO: 119239 - protein, 23 aa, Mycobacterium avium
AVAIEYLYTQRPSWPGGIAVGKT

SEQ ID NO: 119240 - protein, 22 aa, Mycobacterium avium
AVAKARFVRVSPRKARRVIDLV

SEQ ID NO: 119241 - protein, 24 aa, Mycobacterium avium
AVAKLPPWNEVLQNLGFSNASTAV

SEQ ID NO: 119242 - protein, 20 aa, Mycobacterium avium
AVALGWIASRWPGLLPEVQR

SEQ ID NO: 119243 - protein, 20 aa, Mycobacterium avium
AVAPWIHRGLTSQDVLDTAL

SEQ ID NO: 119244 - protein, 17 aa, Mycobacterium avium
AVAPYVGWMSTTAAQAE

SEQ ID NO: 119245 - protein, 26 aa, Mycobacterium avium
AVDDLGLPDMLLLLATDLAAVDHHEG

SEQ ID NO: 119246 - protein, 21 aa, Mycobacterium avium
AVDGSLRRLATDHIDLYYQHR

SEQ ID NO: 119247 - protein, 30 aa, Mycobacterium avium
AVEETMRLPKTILMYPMTLASQAAHIVMRF

SEQ ID NO: 119248 - protein, 18 aa, Mycobacterium avium
AVERPAVVPLSFAQQRLW

SEQ ID NO: 119249 - protein, 19 aa, Mycobacterium avium
AVFAAYELMQRVCPDMIGA

SEQ ID NO: 119250 - protein, 20 aa, Mycobacterium avium
AVFDTGFFHDLPPAAATYAI

SEQ ID NO: 119251 - protein, 20 aa, Mycobacterium avium
AVFELTVTLLPGGRSRLHVD

SEQ ID NO: 119252 - protein, 18 aa, Mycobacterium avium
AVFKAAYRQGLALVLKGP

SEQ ID NO: 119253 - protein, 20 aa, Mycobacterium avium
AVGLDFFRRLVDGEVAPADP

SEQ ID NO: 119254 - protein, 39 aa, Mycobacterium avium
AVGMALFVVLDTLPPAERLAFVLHDVFAVPFAQIAAIVD

SEQ ID NO: 119255 - protein, 19 aa, Mycobacterium avium
AVGQDYLKAIWNAQEWSPE

SEQ ID NO: 119256 - protein, 17 aa, Mycobacterium avium
AVHRDDAAALFRLALEQ

SEQ ID NO: 119257 - protein, 20 aa, Mycobacterium avium
AVILAPQSLDYIAAFLGSMQ

SEQ ID NO: 119258 - protein, 30 aa, Mycobacterium avium
AVKAQVLAEALPWLKQLHGKIVVIKYGGNA

SEQ ID NO: 119259 - protein, 24 aa, Mycobacterium avium
AVKHGHEPPFKKWLEHWDPAHDPF

SEQ ID NO: 119260 - protein, 20 aa, Mycobacterium avium
AVLAALAKLARAVAAELVAG

SEQ ID NO: 119261 - protein, 20 aa, Mycobacterium avium
AVLAALLNRERHGVADVVRV

SEQ ID NO: 119262 - protein, 17 aa, Mycobacterium avium
AVLGRTKVPWRDGFRRM

SEQ ID NO: 119263 - protein, 18 aa, Mycobacterium avium
AVLPSHYEPFGIVALEAA

SEQ ID NO: 119264 - protein, 25 aa, Mycobacterium avium
AVLPVYDPLFDSKKLRHVLVRHEQG

SEQ ID NO: 119265 - protein, 18 aa, Mycobacterium avium
AVLRSLPLHAWLQVDTTT

SEQ ID NO: 119266 - protein, 32 aa, Mycobacterium avium
AVLTSPVSFLQRPARWMQLLAKESHTFSAAPN

SEQ ID NO: 119267 - protein, 18 aa, Mycobacterium avium
AVLVCDLVAGLIARGGSV

SEQ ID NO: 119268 - protein, 26 aa, Mycobacterium avium
AVMPPSLLHTWFELLSPEQIVMAYGM

SEQ ID NO: 119269 - protein, 17 aa, Mycobacterium avium
AVMVRRGLALRSTLLPS

SEQ ID NO: 119270 - protein, 17 aa, Mycobacterium avium
AVNGTAFALTPALREAY

SEQ ID NO: 119271 - protein, 26 aa, Mycobacterium avium
AVPSRDIPRFVELWRAGRLPVESLVS

SEQ ID NO: 119272 - protein, 17 aa, Mycobacterium avium
AVPTIWNAVLHHLEDDP

SEQ ID NO: 119273 - protein, 39 aa, Mycobacterium avium
AVRDADYAGFIWYPELPALDLWRDLYRRVARANRGEPDA

SEQ ID NO: 119274 - protein, 19 aa, Mycobacterium avium
AVRDALPRVWQAGRDYFAG

SEQ ID NO: 119275 - protein, 18 aa, Mycobacterium avium
AVRGGILDVFPPTAEHPV

SEQ ID NO: 119276 - protein, 22 aa, Mycobacterium avium
AVRLAGLVAHQEILFGTEGETL

SEQ ID NO: 119277 - protein, 29 aa, Mycobacterium avium
AVRLHKQAHLPYLVYLRNPTTGGVFASWG

SEQ ID NO: 119278 - protein, 25 aa, Mycobacterium avium
AVRPEPFGALLYHFGTRKLSFLKNR

SEQ ID NO: 119279 - protein, 20 aa, Mycobacterium avium
AVRPPWASELYATLEQRAAQ

SEQ ID NO: 119280 - protein, 24 aa, Mycobacterium avium
AVRTRFFDDFFTGAARDGIRQSVI

SEQ ID NO: 119281 - protein, 37 aa, Mycobacterium avium
AVTGAYSPIGAIILPGGWWLLSLQALGLAQNAPGVAE

SEQ ID NO: 119282 - protein, 17 aa, Mycobacterium avium
AVTIPVMAKARIGHFVE

SEQ ID NO: 119283 - protein, 34 aa, Mycobacterium avium
AVVARDGLVLAELPPGSLVGTSSPRRAAQLRALG

SEQ ID NO: 119284 - protein, 20 aa, Mycobacterium avium
AVWPPARLAPVLRGADLDPS

SEQ ID NO: 119285 - protein, 18 aa, Mycobacterium avium
AWAAQQPGFRGERLVNSM

SEQ ID NO: 119286 - protein, 20 aa, Mycobacterium avium
AWAAVWTPHEPGQFEWLGVD

SEQ ID NO: 119287 - protein, 24 aa, Mycobacterium avium
AWATQLRMMQAQLLAKIAAAVGNG

SEQ ID NO: 119288 - protein, 28 aa, Mycobacterium avium
AWDQGDHLWMIYLMRVVDAQTVLDKPGS

SEQ ID NO: 119289 - protein, 17 aa, Mycobacterium avium
AWPTLLQGEASWGDVTT

SEQ ID NO: 119290 - protein, 19 aa, Mycobacterium avium
AWSMMRRQDQFRSALASRD

SEQ ID NO: 119291 - protein, 17 aa, Mycobacterium avium
AYDRLFTALDWVSDRLA

SEQ ID NO: 119292 - protein, 20 aa, Mycobacterium avium
AYDVRPIVTAILDDETPFDE

SEQ ID NO: 119293 - protein, 18 aa, Mycobacterium avium
AYERVTLYGLPLVSRRRV

SEQ ID NO: 119294 - protein, 22 aa, Mycobacterium avium
AYGSSVLILPDASLDAVHVNAS

SEQ ID NO: 119295 - protein, 20 aa, Mycobacterium avium
AYLIDQPLMRNVLADLAVEA

SEQ ID NO: 119296 - protein, 24 aa, Mycobacterium avium
AYVDKVVFRVIGEPGLRAGAVQSH

SEQ ID NO: 119297 - protein, 23 aa, Mycobacterium avium
AYYEHGLKVWDRAAGALIAAEAG

SEQ ID NO: 119298 - protein, 19 aa, Mycobacterium avium
CAAKVRGLALMADVWPLRP

SEQ ID NO: 119299 - protein, 18 aa, Mycobacterium avium
CAFPDFEFPSYRSISEAQ

SEQ ID NO: 119300 - protein, 25 aa, Mycobacterium avium
CAILALELLVHAWDYARAVGRDARA

SEQ ID NO: 119301 - protein, 27 aa, Mycobacterium avium
CALVENSPVIFLGGQRARVTERRVRRG

SEQ ID NO: 119302 - protein, 18 aa, Mycobacterium avium
CAQAAAPLWSFQLEARLR

SEQ ID NO: 119303 - protein, 17 aa, Mycobacterium avium
CDKILLYSSDYPHWTFD

SEQ ID NO: 119304 - protein, 19 aa, Mycobacterium avium
CDLVPVYRSARARLQRLLD

SEQ ID NO: 119305 - protein, 25 aa, Mycobacterium avium
CETSYVRLGLAEHLARQLGAPAVRL

SEQ ID NO: 119306 - protein, 29 aa, Mycobacterium avium
CFGEGPRWFEGLLWFSDMLGEAVHTTTMG

SEQ ID NO: 119307 - protein, 21 aa, Mycobacterium avium
CGAEPLFLQDYIAVGRTVPER

SEQ ID NO: 119308 - protein, 27 aa, Mycobacterium avium
CGCGGLIRPDIVWFGEQLPDEPWRRAV

SEQ ID NO: 119309 - protein, 19 aa, Mycobacterium avium
CGHDVHVTCLLGAASLLAG

SEQ ID NO: 119310 - protein, 27 aa, Mycobacterium avium
CGRLRDRLLFAVLYDTGMRIGEALGLR

SEQ ID NO: 119311 - protein, 20 aa, Mycobacterium avium
CIRTLANIYYRAIYGREEEP

SEQ ID NO: 119312 - protein, 26 aa, Mycobacterium avium
CLDKYARLFAHLRTWDSHTELAVIPA

SEQ ID NO: 119313 - protein, 24 aa, Mycobacterium avium
CMDARLDVYRILGLREGEAHVIRN

SEQ ID NO: 119314 - protein, 27 aa, Mycobacterium avium
CMDNGMPILVFNLLTNGNIARAVAGEK

SEQ ID NO: 119315 - protein, 22 aa, Mycobacterium avium
CNPNKLLLDPYSKAIDGTFEWN

SEQ ID NO: 119316 - protein, 18 aa, Mycobacterium avium
CPDQFLGAHVRRMTGREN

SEQ ID NO: 119317 - protein, 22 aa, Mycobacterium avium
CPELGLRPLLPRLDTPERALRH

SEQ ID NO: 119318 - protein, 17 aa, Mycobacterium avium
CPLPAEISAVPGALRIL

SEQ ID NO: 119319 - protein, 22 aa, Mycobacterium avium
CPLWNVYETFANPGKILVQIAQ

SEQ ID NO: 119320 - protein, 17 aa, Mycobacterium avium
CPRQAISVLTEQPPYAP

SEQ ID NO: 119321 - protein, 22 aa, Mycobacterium avium
CPRTKMVLGGYSQGAAVMGFVT

SEQ ID NO: 119322 - protein, 17 aa, Mycobacterium avium
CQDLHTRTLRRAAWEAY

SEQ ID NO: 119323 - protein, 18 aa, Mycobacterium avium
CQFAVGLSRQLYGRTIAS

SEQ ID NO: 119324 - protein, 17 aa, Mycobacterium avium
CQNSIPLAGPSTPLRWV

SEQ ID NO: 119325 - protein, 21 aa, Mycobacterium avium
CQQVWCPVCALAALATGDQHP

SEQ ID NO: 119326 - protein, 23 aa, Mycobacterium avium
CRDHNMQWDFWTLSPESAHQVTM

SEQ ID NO: 119327 - protein, 19 aa, Mycobacterium avium
CRDLTCRFPGCSRPAVICD

SEQ ID NO: 119328 - protein, 22 aa, Mycobacterium avium
CRGTVRVRVLLAPAAEFGKHGP

SEQ ID NO: 119329 - protein, 20 aa, Mycobacterium avium
CSIKHRMASVIFSLEMSKSE

SEQ ID NO: 119330 - protein, 24 aa, Mycobacterium avium
CSVRGWAVGFGCNLALAADFTVAA

SEQ ID NO: 119331 - protein, 40 aa, Mycobacterium avium
CTGAELAAFPRYHPRWAWWLTSVPVLREFLVSNLVLVLQP

SEQ ID NO: 119332 - protein, 20 aa, Mycobacterium avium
CTIRNDLLVLLRQLHRRDDV

SEQ ID NO: 119333 - protein, 17 aa, Mycobacterium avium
CTLLVTGGDWQGAPTRL

SEQ ID NO: 119334 - protein, 26 aa, Mycobacterium avium
CTPQEYVLFLRQTPIFEQMLIDDGIL

SEQ ID NO: 119335 - protein, 32 aa, Mycobacterium avium; identical to SEQ ID NO: 23527

SEQ ID NO: 119336 - protein, 25 aa, Mycobacterium avium
CVGQTLLDFMFRHIQPYFTEDINQL

SEQ ID NO: 119337 - protein, 25 aa, Mycobacterium avium
CVPHNYMIGAFVFGDLAGTHAASTL

SEQ ID NO: 119338 - protein, 21 aa, Mycobacterium avium
CYLAMPLFHSNGVAAGWAVAV

SEQ ID NO: 119339 - protein, 17 aa, Mycobacterium avium
CYPTAALLALLPAMAED

SEQ ID NO: 119340 - protein, 17 aa, Mycobacterium avium
CYVKPHGALYNTIVTHP

SEQ ID NO: 119341 - protein, 30 aa, Mycobacterium avium
DAAGFTDVVILAYAAKFASAFYGPFREAVS

SEQ ID NO: 119342 - protein, 42 aa, Mycobacterium avium
DAAVPVPHDIPWFPKDLQAWSVRWVILHVINELARHAGHADI

SEQ ID NO: 119343 - protein, 20 aa, Mycobacterium avium
DACVQLLDTLSGLAAQDNGK

SEQ ID NO: 119344 - protein, 30 aa, Mycobacterium avium
DADARARWATTIAAPILAGAFAVAWEWENT

SEQ ID NO: 119345 - protein, 28 aa, Mycobacterium avium
DADIVISQPFWPAYITKERFAKARNLKL

SEQ ID NO: 119346 - protein, 23 aa, Mycobacterium avium
DADLFTFGKVMSGGLPAAAFGGR

SEQ ID NO: 119347 - protein, 24 aa, Mycobacterium avium
DAENARMICRYSRRARFLQTGLAA

SEQ ID NO: 119348 - protein, 22 aa, Mycobacterium avium
DAEVAAFFVLLSVAGNDTTRQT

SEQ ID NO: 119349 - protein, 17 aa, Mycobacterium avium
DAFGRLILLYDPEGADA

SEQ ID NO: 119350 - protein, 17 aa, Mycobacterium avium
DAFTFNVATAHALTVAA

SEQ ID NO: 119351 - protein, 30 aa, Mycobacterium avium
DAGFVVVAPHTYFPRLRLELDKGLGWKAEV

SEQ ID NO: 119352 - protein, 28 aa, Mycobacterium avium
DAGGPAPVLQWLIYPRTDFTARTRSLSL

SEQ ID NO: 119353 - protein, 19 aa, Mycobacterium avium
DAGRPPYTPPLYVMSRVEG

SEQ ID NO: 119354 - protein, 31 aa, Mycobacterium avium
DAGRVVEFMLLYRLFPRSVFYSLRLAEHNLD

SEQ ID NO: 119355 - protein, 24 aa, Mycobacterium avium
DAHANFVYLPPDPQGRAWQRVFAR

SEQ ID NO: 119356 - protein, 22 aa, Mycobacterium avium
DAKVSALRWGSTDARIVFVHGG

SEQ ID NO: 119357 - protein, 35 aa, Mycobacterium avium
DALAAHRRAHGLPAISLAWGLWDQASAMTGGLDAA

SEQ ID NO: 119358 - protein, 24 aa, Mycobacterium avium
DALALDTLALLEARWRDVVAALDR

SEQ ID NO: 119359 - protein, 19 aa, Mycobacterium avium
DALGAYRRLKTALAEGLGI

SEQ ID NO: 119360 - protein, 25 aa, Mycobacterium avium
DALGYRGFWMGYFAARSAPLGAVPR

SEQ ID NO: 119361 - protein, 28 aa, Mycobacterium avium
DALLAPLCTRLPLPCLIGAPVLFGRGSV

SEQ ID NO: 119362 - protein, 17 aa, Mycobacterium avium
DALLLAEMISEADLPPG

SEQ ID NO: 119363 - protein, 21 aa, Mycobacterium avium
DALQRVWRPLADKLDVHAYIE

SEQ ID NO: 119364 - protein, 34 aa, Mycobacterium avium
DAPRYAELIKRTQWWGRQMLIWGVHVHVGISSPN

SEQ ID NO: 119365 - protein, 22 aa, Mycobacterium avium
DARIELWPQLRAAFTPPDEQAS

SEQ ID NO: 119366 - protein, 23 aa, Mycobacterium avium
DASLVKLLAPVLPGLHTVHTVIV

SEQ ID NO: 119367 - protein, 27 aa, Mycobacterium avium
DASRREWTLPAWSPMPVSELLLGRAHR

SEQ ID NO: 119368 - protein, 25 aa, Mycobacterium avium
DASTFLGRLALIRIYNGKLCKGQQV

SEQ ID NO: 119369 - protein, 22 aa, Mycobacterium avium
DASTWVVFFTDHGPAFPRAKST

SEQ ID NO: 119370 - protein, 28 aa, Mycobacterium avium
DATERPHYMPLFVAPQPLESSDDDGDAD

SEQ ID NO: 119371 - protein, 20 aa, Mycobacterium avium
DAVAEMTVALLLAATRHLLP

SEQ ID NO: 119372 - protein, 21 aa, Mycobacterium avium
DAVVNLNLKGPFRLSALVGER

SEQ ID NO: 119373 - protein, 20 aa, Mycobacterium avium
DAVWAAGMRAKLGLPAQVDA

SEQ ID NO: 119374 - protein, 18 aa, Mycobacterium avium
DCHLDPRSLVRMVEDLRP

SEQ ID NO: 119375 - protein, 19 aa, Mycobacterium avium
DCIRTLSALALLDTEVLLP

SEQ ID NO: 119376 - protein, 27 aa, Mycobacterium avium
DCPIPDPLDLLAFLAGHTTRLGLATGV

SEQ ID NO: 119377 - protein, 21 aa, Mycobacterium avium
DCYTALTWLAGLPSVDRYRIA

SEQ ID NO: 119378 - protein, 18 aa, Mycobacterium avium
DDAFDRIAAALPAAARAA

SEQ ID NO: 119379 - protein, 25 aa, Mycobacterium avium
DDAPLGYLLYRVGAALRPEVSGALG

SEQ ID NO: 119380 - protein, 26 aa, Mycobacterium avium
DDAVREYLYPIAANRIRGVWLPGPVR

SEQ ID NO: 119381 - protein, 18 aa, Mycobacterium avium
DDDGVVVLLNPHPTAEQA

SEQ ID NO: 119382 - protein, 25 aa, Mycobacterium avium
DDDYLAILDIRPFTRGHTLVLPKRH

SEQ ID NO: 119383 - protein, 25 aa, Mycobacterium avium
DDEQLVLDLLLQEKILVTQGTGFNW

SEQ ID NO: 119384 - protein, 30 aa, Mycobacterium avium
DDETLDYFLNLMLRAPFRLAREVLPHLPPG

SEQ ID NO: 119385 - protein, 18 aa, Mycobacterium avium
DDFGWTWGTILPAGPDDP

SEQ ID NO: 119386 - protein, 23 aa, Mycobacterium avium
DDHDPLELPGMTGIIAAAAIRAP

SEQ ID NO: 119387 - protein, 20 aa, Mycobacterium avium
DDISDAVLWLASDLARTVTG

SEQ ID NO: 119388 - protein, 23 aa, Mycobacterium avium
DDLDFLRLAVLDALLVLQADVQP

SEQ ID NO: 119389 - protein, 23 aa, Mycobacterium avium
DDLIRESLGWVPYTQLANLTGRP

SEQ ID NO: 119390 - protein, 18 aa, Mycobacterium avium
DDLWAALRTLAADPAACL

SEQ ID NO: 119391 - protein, 37 aa, Mycobacterium avium
DDPAKLALPQWYANNGQFVTTKFFGMKANKYIHDHNI

SEQ ID NO: 119392 - protein, 23 aa, Mycobacterium avium
DDPDDVHFFELPGADLSGEELSV

SEQ ID NO: 119393 - protein, 24 aa, Mycobacterium avium
DDPEIRAPWTLPKRSRKAGPSSRL

SEQ ID NO: 119394 - protein, 23 aa, Mycobacterium avium
DDPLQALWLMNSDTALTALNAEF

SEQ ID NO: 119395 - protein, 25 aa, Mycobacterium avium
DDPYLQAVLQRRLPVVVVDQPKGLT

SEQ ID NO: 119396 - protein, 17 aa, Mycobacterium avium
DDRDMGLMIEGLRIGRK

SEQ ID NO: 119397 - protein, 25 aa, Mycobacterium avium
DDRQSMLFSATMPDPIITLARTFMN

SEQ ID NO: 119398 - protein, 25 aa, Mycobacterium avium
DDSAADGLLLPFNRSLRNADGTVKE

SEQ ID NO: 119399 - protein, 17 aa, Mycobacterium avium
DDVILHTYFTPETLQRS

SEQ ID NO: 119400 - protein, 30 aa, Mycobacterium avium
DDVRRYLSYFPPSAWSYPPSLPAGDAAMPR

SEQ ID NO: 119401 - protein, 25 aa, Mycobacterium avium
DDVSQLVYLHLRFHGYGDGKWTDSA

SEQ ID NO: 119402 - protein, 29 aa, Mycobacterium avium
DDVSTFDLYSCFPVPVFNFCDGTGLATDD

SEQ ID NO: 119403 - protein, 18 aa, Mycobacterium avium
DDWAVHVALWQRPTNGRR

SEQ ID NO: 119404 - protein, 32 aa, Mycobacterium avium
DDYLVKPFVLAELVARVKALLRRRGATATSSS

SEQ ID NO: 119405 - protein, 25 aa, Mycobacterium avium
DECSDLFYSIWWPRVPGDTADVPEG

SEQ ID NO: 119406 - protein, 22 aa, Mycobacterium avium
DEELRGWALADLAAVFGLDVRP

SEQ ID NO: 119407 - protein, 23 aa, Mycobacterium avium
DEELRLNRRFSPQVYLGVVDITE

SEQ ID NO: 119408 - protein, 20 aa, Mycobacterium avium
DEGRATLRRLGITDVADLRA

SEQ ID NO: 119409 - protein, 23 aa, Mycobacterium avium
DEIEVGLRYYAAAFFKVIPQVNA

SEQ ID NO: 119410 - protein, 19 aa, Mycobacterium avium
DEILARFTAVPSQELILPY

SEQ ID NO: 119411 - protein, 23 aa, Mycobacterium avium
DELERRNARRALITLCIGGGMGV

SEQ ID NO: 119412 - protein, 30 aa, Mycobacterium avium
DELFERSAGNLLLLRGFLTAGVESGALVHT

SEQ ID NO: 119413 - protein, 26 aa, Mycobacterium avium
DELHRRLLSVLMDPAWTPGVAAAVDA

SEQ ID NO: 119414 - protein, 30 aa, Mycobacterium avium
DELLQRSSGNPLLLRGFLTAGRDTGALFRT

SEQ ID NO: 119415 - protein, 18 aa, Mycobacterium avium
DELRRQLAATGRARLWVP

SEQ ID NO: 119416 - protein, 21 aa, Mycobacterium avium
DELRTAWVDIPEVFSAATVTG

SEQ ID NO: 119417 - protein, 24 aa, Mycobacterium avium
DELVRVCRPGGRIGLISWTPEGFF

SEQ ID NO: 119418 - protein, 22 aa, Mycobacterium avium
DEQFWLVEHSPARTRVLDAALD

SEQ ID NO: 119419 - protein, 23 aa, Mycobacterium avium
DERLAFYRGLYRDHARYGAALWV

SEQ ID NO: 119420 - protein, 23 aa, Mycobacterium avium
DEVFAGYHWYPPMGDPAAATLDG

SEQ ID NO: 119421 - protein, 32 aa, Mycobacterium avium
DEVNTRLLQRLTVAEFFSLIRQFGEGSGQPLD

SEQ ID NO: 119422 - protein, 17 aa, Mycobacterium avium
DEVRLRLPWDPSNVTIG

SEQ ID NO: 119423 - protein, 20 aa, Mycobacterium avium
DEYLEVCYKLWEGSWEAGAV

SEQ ID NO: 119424 - protein, 18 aa, Mycobacterium avium
DFAIAIRTALMRGGTAYV

SEQ ID NO: 119425 - protein, 25 aa, Mycobacterium avium
DFENMHPLMVPFLEQFVLKARYADD

SEQ ID NO: 119426 - protein, 21 aa, Mycobacterium avium
DFFEGVMMPELFMADAVGATG

SEQ ID NO: 119427 - protein, 19 aa, Mycobacterium avium
DFHLRVRPGTDAWCLAALA

SEQ ID NO: 119428 - protein, 24 aa, Mycobacterium avium
DFLTPFMWRMDTFGRPHLEQTPWA

SEQ ID NO: 119429 - protein, 29 aa, Mycobacterium avium
DFRDQYPVPAKLWTIADLGGWSAADPQLF

SEQ ID NO: 119430 - protein, 18 aa, Mycobacterium avium
DFRLFWDNAYAVHTLTHD

SEQ ID NO: 119431 - protein, 24 aa, Mycobacterium avium
DFSLTERYVVFYDLPVTFDAAVGA

SEQ ID NO: 119432 - protein, 19 aa, Mycobacterium avium
DFSYWTLYTRAACDKDTLR

SEQ ID NO: 119433 - protein, 18 aa, Mycobacterium avium
DFVSTWRVLEEFARDGRA

SEQ ID NO: 119434 - protein, 17 aa, Mycobacterium avium
DFWHTDPALLQSQLDVN

SEQ ID NO: 119435 - protein, 23 aa, Mycobacterium avium
DGAGVKRVPLARARRAAQRHDYL

SEQ ID NO: 119436 - protein, 24 aa, Mycobacterium avium
DGALGLVLGIRRLRAYGAARNAHY

SEQ ID NO: 119437 - protein, 32 aa, Mycobacterium avium
DGALHTVGMLFSPGYPGFLRGVAASGPGEFVV

SEQ ID NO: 119438 - protein, 26 aa, Mycobacterium avium
DGATRRWPECILFERGGDGLISHISV

SEQ ID NO: 119439 - protein, 25 aa, Mycobacterium avium
DGAYIITGGLGGLGLFLAGEMASRD

SEQ ID NO: 119440 - protein, 17 aa, Mycobacterium avium
DGDAFGRLILLYDPEGA

SEQ ID NO: 119441 - protein, 39 aa, Mycobacterium avium
DGDRMQAFWDQAMRLRDLLKFDFYFADSATFRDNIAEEM

SEQ ID NO: 119442 - protein, 18 aa, Mycobacterium avium
DGEAIWPGILGFDDTVLP

SEQ ID NO: 119443 - protein, 20 aa, Mycobacterium avium
DGFLAGLRYDALLPAIHKTN

SEQ ID NO: 119444 - protein, 19 aa, Mycobacterium avium
DGHRAVVPALPLHDTVKAV

SEQ ID NO: 119445 - protein, 17 aa, Mycobacterium avium
DGIGVNCLWPQTYIATA

SEQ ID NO: 119446 - protein, 19 aa, Mycobacterium avium
DGIKRPLIVFTPKSMLRNK

SEQ ID NO: 119447 - protein, 20 aa, Mycobacterium avium
DGLKYPARLIDEYAWETDLG

SEQ ID NO: 119448 - protein, 24 aa, Mycobacterium avium
DGLTYGLLRYLNPDVDLGGSDPVI

SEQ ID NO: 119449 - protein, 17 aa, Mycobacterium avium
DGMGIALVGRRIAAVYT

SEQ ID NO: 119450 - protein, 22 aa, Mycobacterium avium
DGMSRLSGWLTPEARAGWEAVL

SEQ ID NO: 119451 - protein, 26 aa, Mycobacterium avium
DGPMGKYPILFLDPDFNEDIRLALVA

SEQ ID NO: 119452 - protein, 23 aa, Mycobacterium avium
DGPRVVLLGIPTRGVTLADRLAR

SEQ ID NO: 119453 - protein, 29 aa, Mycobacterium avium
DGQRRYNPGWNLALDLRNMLLVSECVAKA

SEQ ID NO: 119454 - protein, 21 aa, Mycobacterium avium
DGQWRLSPKAMRRLGETALRD

SEQ ID NO: 119455 - protein, 24 aa, Mycobacterium avium
DGRAPFVLFRMPDAVRVRKLLHDK

SEQ ID NO: 119456 - protein, 21 aa, Mycobacterium avium
DGRARWYRNRWVRTAHVCAAL

SEQ ID NO: 119457 - protein, 21 aa, Mycobacterium avium
DGREYVAQFLISGAGALHIPS

SEQ ID NO: 119458 - protein, 17 aa, Mycobacterium avium
DGRKFLAYYERDGALVG

SEQ ID NO: 119459 - protein, 19 aa, Mycobacterium avium
DGRMLLHTILTYTQKQQHE

SEQ ID NO: 119460 - protein, 35 aa, Mycobacterium avium
DGRPLFAANLALPWPEDPLAALWHATTLLREQRGD

SEQ ID NO: 119461 - protein, 23 aa, Mycobacterium avium
DGRVRARREISVKIPAGVGDGMR

SEQ ID NO: 119462 - protein, 26 aa, Mycobacterium avium
DGRWSCVRWGTLTPPFYPEAAEIPAT

SEQ ID NO: 119463 - protein, 23 aa, Mycobacterium avium
DGSAIPVVAFRLAKNRGYTEFDV

SEQ ID NO: 119464 - protein, 26 aa, Mycobacterium avium
DGSDTVTLVWLGQRRIPGIDSGRTLR

SEQ ID NO: 119465 - protein, 34 aa, Mycobacterium avium
DGSGTWAVAVDRNGQLRWFGLDGVEHTGGPMVDF

SEQ ID NO: 119466 - protein, 25 aa, Mycobacterium avium
DGTCPVRLFFPDGSGPWPGVVMYPD

SEQ ID NO: 119467 - protein, 25 aa, Mycobacterium avium
DGTDALLLPGGFPEQFTAELSANEV

SEQ ID NO: 119468 - protein, 25 aa, Mycobacterium avium
DGTIKIEMNFLPDVYVPCEVCHGAR

SEQ ID NO: 119469 - protein, 25 aa, Mycobacterium avium
DGTRPYGIAKALWEVLERARAHLEA

SEQ ID NO: 119470 - protein, 20 aa, Mycobacterium avium
DGTRWVGLWVPPGGHDAEAR

SEQ ID NO: 119471 - protein, 21 aa, Mycobacterium avium
DGVEVHLLPFPDLGEHEAGTD

SEQ ID NO: 119472 - protein, 26 aa, Mycobacterium avium
DGVYEFQLVAPPLRFVGAVGSPVNPI

SEQ ID NO: 119473 - protein, 29 aa, Mycobacterium avium
DGVYVRRRFTFDPGLLREAGMSNAAIWLV

SEQ ID NO: 119474 - protein, 17 aa, Mycobacterium avium
DGWWKDRDGAMVALVQR

SEQ ID NO: 119475 - protein, 25 aa, Mycobacterium avium
DGYGWHPQAWRYAFAHNATGGGQFS

SEQ ID NO: 119476 - protein, 25 aa, Mycobacterium avium
DHDDQAHVDLLWALSRAPDPDAALL

SEQ ID NO: 119477 - protein, 18 aa, Mycobacterium avium
DHDHLYGLAWNPVTLIDV

SEQ ID NO: 119478 - protein, 25 aa, Mycobacterium avium
DHERIAPLIADWADDLGRPIDVALQ

SEQ ID NO: 119479 - protein, 29 aa, Mycobacterium avium
DHIALVAHPVLMPVFRVSGLTELTTVEAA

SEQ ID NO: 119480 - protein, 19 aa, Mycobacterium avium
DHLELGESLGLIDMARGAK

SEQ ID NO: 119481 - protein, 25 aa, Mycobacterium avium
DHNWGRFRWGDDFGWTWGTILPAGP

SEQ ID NO: 119482 - protein, 21 aa, Mycobacterium avium
DHPRLGWRQAPVGQVLADALG

SEQ ID NO: 119483 - protein, 21 aa, Mycobacterium avium
DHQLPFAEKLATAGLATVVRE

SEQ ID NO: 119484 - protein, 24 aa, Mycobacterium avium
DHYADDWTRLWWVRADGLATIHRD

SEQ ID NO: 119485 - protein, 29 aa, Mycobacterium avium
DHYHDWDMLRANLLQLLIDGTVRPHEPAY

SEQ ID NO: 119486 - protein, 20 aa, Mycobacterium avium
DIALLMADFNLYSIPVVDEQ

SEQ ID NO: 119487 - protein, 23 aa, Mycobacterium avium
DIDGRLIGMRYPYEVNLVADAKA

SEQ ID NO: 119488 - protein, 18 aa, Mycobacterium avium
DIEFSALVASPNGARRAV

SEQ ID NO: 119489 - protein, 23 aa, Mycobacterium avium
DIEPIMQLLVDAEMKMFAGLSTP

SEQ ID NO: 119490 - protein, 23 aa, Mycobacterium avium
DIHQAIPVIRAFSHFALLANVAE

SEQ ID NO: 119491 - protein, 26 aa, Mycobacterium avium
DIHRRLYALMVLMKTADDRLSRGIGT

SEQ ID NO: 119492 - protein, 20 aa, Mycobacterium avium
DILAFERQWWKFAGVKEDAI

SEQ ID NO: 119493 - protein, 20 aa, Mycobacterium avium
DILLIAFAMAWTQVVGAGTP

SEQ ID NO: 119494 - protein, 37 aa, Mycobacterium avium
DIMTELLTHLFKAGGKRFRPLFTVLSAQIGPDPDAAE

SEQ ID NO: 119495 - protein, 24 aa, Mycobacterium avium
DIPKTKMTPAPTKPIPILVGGHAD

SEQ ID NO: 119496 - protein, 18 aa, Mycobacterium avium
DIRFHRDLDIVFGTTVLR

SEQ ID NO: 119497 - protein, 17 aa, Mycobacterium avium
DIRVAAELALPHRRRRD

SEQ ID NO: 119498 - protein, 22 aa, Mycobacterium avium
DIRWALDLLRRRFAKVIWVPGN

SEQ ID NO: 119499 - protein, 28 aa, Mycobacterium avium
DISPLQARCGWAIGWKKEAFFGRDALLA

SEQ ID NO: 119500 - protein, 18 aa, Mycobacterium avium
DKDDCAAIGLVKFDLLGL

SEQ ID NO: 119501 - protein, 23 aa, Mycobacterium avium
DKGELVMFLTTRMPPGAPRTKPT

SEQ ID NO: 119502 - protein, 24 aa, Mycobacterium avium
DKKDNFTAYKLLIADVIGGELKAV

SEQ ID NO: 119503 - protein, 25 aa, Mycobacterium avium
DKRNRSVLVFVLDAGMPGLTQGKPF

SEQ ID NO: 119504 - protein, 31 aa, Mycobacterium avium
DKTLPGPNQLGAFLFWMVRKRPALQIHLLKS

SEQ ID NO: 119505 - protein, 34 aa, Mycobacterium avium
DKVDGPYYFFGVLAKLAVLPRFTPMLLPDTGRTN

SEQ ID NO: 119506 - protein, 25 aa, Mycobacterium avium
DLALSCALWVGMGRVLRTLDIGQAC

SEQ ID NO: 119507 - protein, 19 aa, Mycobacterium avium
DLAPDWPQPRIAIAPKDLG

SEQ ID NO: 119508 - protein, 34 aa, Mycobacterium avium
DLDALITKVWKTPSFFLTHPLGIAAFGREATYRG

SEQ ID NO: 119509 - protein, 19 aa, Mycobacterium avium
DLEAWKRRVRLDDILIAED

SEQ ID NO: 119510 - protein, 18 aa, Mycobacterium avium
DLEPYLEWDLATEPERYA

SEQ ID NO: 119511 - protein, 30 aa, Mycobacterium avium
DLERGPAIRFLLIELPDAHWRLVLTAHHIV

SEQ ID NO: 119512 - protein, 30 aa, Mycobacterium avium
DLFDEWDLPVPALFGQMRLPSAASTLLAQL

SEQ ID NO: 119513 - protein, 18 aa, Mycobacterium avium
DLFGHLIGHLLPSASAKP

SEQ ID NO: 119514 - protein, 33 aa, Mycobacterium avium
DLGAPYQPFAEALRMLVPCLGPDRLRGLRGVEA

SEQ ID NO: 119515 - protein, 23 aa, Mycobacterium avium
DLGCKVLLEIGPQPVLTAAALRA

SEQ ID NO: 119516 - protein, 24 aa, Mycobacterium avium
DLGPGDILTRLTAPVIRGLGVGIV

SEQ ID NO: 119517 - protein, 24 aa, Mycobacterium avium
DLGVRRTLTGEPLPPRYAATAAAQ

SEQ ID NO: 119518 - protein, 38 aa, Mycobacterium avium
DLHWDRILFCAKEATYKAWFPLTRRWLGFEDAHITFEA

SEQ ID NO: 119519 - protein, 20 aa, Mycobacterium avium
DLILSCGAALHHCVVGFAAV

SEQ ID NO: 119520 - protein, 23 aa, Mycobacterium avium
DLKDWFGFLAERGLDWRAVRLDD

SEQ ID NO: 119521 - protein, 20 aa, Mycobacterium avium
DLLPEAFAVAREAAWRVLDQ

SEQ ID NO: 119522 - protein, 17 aa, Mycobacterium avium
DLLRRNLTRYGSDELVP

SEQ ID NO: 119523 - protein, 21 aa, Mycobacterium avium
DLLRSRFGGRLDVRVSSIRTD

SEQ ID NO: 119524 - protein, 19 aa, Mycobacterium avium
DLLVLLRQLHRRDDVDRIV

SEQ ID NO: 119525 - protein, 18 aa, Mycobacterium avium
DLMMSIDFRMTSTTLVSD

SEQ ID NO: 119526 - protein, 21 aa, Mycobacterium avium
DLNIAWALHRAGQPVELAPAG

SEQ ID NO: 119527 - protein, 31 aa, Mycobacterium avium
DLPGPVDFVLLDGWKDLYLPVLELLEPRLSP

SEQ ID NO: 119528 - protein, 19 aa, Mycobacterium avium
DLPLITGAGLVRPVPGPPP

SEQ ID NO: 119529 - protein, 17 aa, Mycobacterium avium
DLQLYSGGRFRLGLGSQ

SEQ ID NO: 119530 - protein, 23 aa, Mycobacterium avium
DLRAWLTTVVSRLGLDRLRSATH

SEQ ID NO: 119531 - protein, 21 aa, Mycobacterium avium
DLRGRRIVIIDDVLATGGTLA

SEQ ID NO: 119532 - protein, 22 aa, Mycobacterium avium
DLRKILAPDYARRAREIAARMT

SEQ ID NO: 119533 - protein, 26 aa, Mycobacterium avium
DLSALIGVPIRPAIGLLAVAALDDLG

SEQ ID NO: 119534 - protein, 20 aa, Mycobacterium avium
DLSLMVKAGVQWGLFGGAVE

SEQ ID NO: 119535 - protein, 18 aa, Mycobacterium avium
DLTPADGIMLLAAHISRH

SEQ ID NO: 119536 - protein, 24 aa, Mycobacterium avium
DLTTPSLWPKLASVLVAETPVRGA

SEQ ID NO: 119537 - protein, 19 aa, Mycobacterium avium
DLVDLFPVGASPPGYLPVL

SEQ ID NO: 119538 - protein, 33 aa, Mycobacterium avium
DLVDRVQFWMLPLDDPLPWLLADRRAVRVTAVH

SEQ ID NO: 119539 - protein, 20 aa, Mycobacterium avium
DLVLAIYNPASKTRTWQVGA

SEQ ID NO: 119540 - protein, 22 aa, Mycobacterium avium
DLVTPWRTGLLLAVDEFETKLP

SEQ ID NO: 119541 - protein, 19 aa, Mycobacterium avium
DLVYGLGTLITGLPGVLSR

SEQ ID NO: 119542 - protein, 23 aa, Mycobacterium avium
DMPDRVVWLPLNSSGSAVHRQLG

SEQ ID NO: 119543 - protein, 20 aa, Mycobacterium avium
DMTEGMLELLLRELDVHPGD

SEQ ID NO: 119544 - protein, 32 aa, Mycobacterium avium
DMTRTFVLTKAADWQLEIYRLVADAQRAGREA

SEQ ID NO: 119545 - protein, 26 aa, Mycobacterium avium
DNESYCYIPLLEELDFMPSKKFADGA

SEQ ID NO: 119546 - protein, 17 aa, Mycobacterium avium
DNGLVEIVPLGISKATG

SEQ ID NO: 119547 - protein, 18 aa, Mycobacterium avium
DNPGTWVMHCHNTYHQVA

SEQ ID NO: 119548 - protein, 23 aa, Mycobacterium avium
DNQWGYHLNLRKGDDGRMVFLKR

SEQ ID NO: 119549 - protein, 27 aa, Mycobacterium avium
DNRGSQFYLALYWAQELAAQNDDDELR

SEQ ID NO: 119550 - protein, 28 aa, Mycobacterium avium
DNVNPPNNFLPLTSLPKPFEVTLAAAIA

SEQ ID NO: 119551 - protein, 18 aa, Mycobacterium avium
DNVPALLVGLEGPDHRFV

SEQ ID NO: 119552 - protein, 26 aa, Mycobacterium avium
DPAHRLITIILMRCGLRITDALRLRS

SEQ ID NO: 119553 - protein, 21 aa, Mycobacterium avium
DPALLRYFHELAADHLEVIAG

SEQ ID NO: 119554 - protein, 23 aa, Mycobacterium avium
DPAPWVIGGAQIYLLALPHATRC

SEQ ID NO: 119555 - protein, 22 aa, Mycobacterium avium
DPDGGLLPSWTPGAHIDVLLPS

SEQ ID NO: 119556 - protein, 17 aa, Mycobacterium avium
DPDGILNVALRDLAKDL

SEQ ID NO: 119557 - protein, 18 aa, Mycobacterium avium
DPDGRDLILSCGAALHHC

SEQ ID NO: 119558 - protein, 30 aa, Mycobacterium avium
DPDIIIGRYIPNLVPRPFTLDRDFIQEIRD

SEQ ID NO: 119559 - protein, 23 aa, Mycobacterium avium
DPDLPWPGRLPEPSPAVLLDDPV

SEQ ID NO: 119560 - protein, 28 aa, Mycobacterium avium
DPEHRIYRSLLNPYLSPAAVSRWQPFID

SEQ ID NO: 119561 - protein, 34 aa, Mycobacterium avium
DPELSLYALRDSVGTPFLLLAGLEPDLKWERFIT

SEQ ID NO: 119562 - protein, 23 aa, Mycobacterium avium
DPELWTWVAVSGLNLLYQAYLRV

SEQ ID NO: 119563 - protein, 19 aa, Mycobacterium avium
DPFVALGFAAATTSTLRLI

SEQ ID NO: 119564 - protein, 18 aa, Mycobacterium avium
DPGSVSYLFSRKGVVTCE

SEQ ID NO: 119565 - protein, 24 aa, Mycobacterium avium
DPHGPVAFWGYSQGGGATASAAEL

SEQ ID NO: 119566 - protein, 25 aa, Mycobacterium avium
DPHPELLRAWDLPTTADGLAAFCDI

SEQ ID NO: 119567 - protein, 21 aa, Mycobacterium avium
DPLEVEALTWQNPRTLAAMVG

SEQ ID NO: 119568 - protein, 20 aa, Mycobacterium avium
DPLVLRLRSNPAYSAPVVTP

SEQ ID NO: 119569 - protein, 17 aa, Mycobacterium avium
DPMLVKRLRRLRASRQK

SEQ ID NO: 119570 - protein, 17 aa, Mycobacterium avium
DPNAFDIRRPRQAHIAF

SEQ ID NO: 119571 - protein, 23 aa, Mycobacterium avium
DPNGLFDFYTEVLGFRSRGAFRV

SEQ ID NO: 119572 - protein, 23 aa, Mycobacterium avium
DPPGGWPEPLRTKALQGRGPAKP

SEQ ID NO: 119573 - protein, 20 aa, Mycobacterium avium
DPPLHPLPFHAMFDADLYGE

SEQ ID NO: 119574 - protein, 19 aa, Mycobacterium avium
DPQPELYLESARHAMTLLD

SEQ ID NO: 119575 - protein, 18 aa, Mycobacterium avium
DPQPLGRLARDLARKRGW

SEQ ID NO: 119576 - protein, 22 aa, Mycobacterium avium
DPQQRMALELTWEALEHARIPA

SEQ ID NO: 119577 - protein, 21 aa, Mycobacterium avium
DPRRAVLVRPPRGLAAAELAT

SEQ ID NO: 119578 - protein, 17 aa, Mycobacterium avium
DPRREPADYPPPAGYRG

SEQ ID NO: 119579 - protein, 19 aa, Mycobacterium avium
DPTDPGFWAVTRRADIVTV

SEQ ID NO: 119580 - protein, 25 aa, Mycobacterium avium
DQEEYLRWAVGAFRLATSGVADSTQ

SEQ ID NO: 119581 - protein, 28 aa, Mycobacterium avium
DQFSGKPLVLNIFPSIDTPVCATSVRTF

SEQ ID NO: 119582 - protein, 28 aa, Mycobacterium avium
DQFTAMAWSLMKLATLHRTIKPELLQSP

SEQ ID NO: 119583 - protein, 18 aa, Mycobacterium avium
DQGELRYTDLRKLRGVWL

SEQ ID NO: 119584 - protein, 30 aa, Mycobacterium avium
DQGRPQAYLIYALLVCPTKDGRWLQFAQVS

SEQ ID NO: 119585 - protein, 19 aa, Mycobacterium avium
DQLFRPLVAGQRWIAAGLF

SEQ ID NO: 119586 - protein, 17 aa, Mycobacterium avium
DQLGLVPERSGNRWDIS

SEQ ID NO: 119587 - protein, 19 aa, Mycobacterium avium
DQMYPLVDFLTRSADKIAA

SEQ ID NO: 119588 - protein, 20 aa, Mycobacterium avium
DQNWIENDFIPTVAKRGAAI

SEQ ID NO: 119589 - protein, 19 aa, Mycobacterium avium
DQPLLDRLDLTYNSASVLA

SEQ ID NO: 119590 - protein, 17 aa, Mycobacterium avium
DQPRWADGLPYFVRDGN

SEQ ID NO: 119591 - protein, 22 aa, Mycobacterium avium
DQRTFGGWMLADLLEVDGSVVP

SEQ ID NO: 119592 - protein, 24 aa, Mycobacterium avium
DQSARMDLVFSLAERWNPDGEFAG

SEQ ID NO: 119593 - protein, 22 aa, Mycobacterium avium
DQSDFIGYLVGLAGLADVVHTL

SEQ ID NO: 119594 - protein, 25 aa, Mycobacterium avium
DQTVAVVDYLIPGLAEAIRQSGLPK

SEQ ID NO: 119595 - protein, 23 aa, Mycobacterium avium
DQWHRLCRALGSPSWAMDPELST

SEQ ID NO: 119596 - protein, 31 aa, Mycobacterium avium
DQWNPFHNMVVIYALFPNIVLSVTIANGELF

SEQ ID NO: 119597 - protein, 27 aa, Mycobacterium avium
DRAFAAVPAALLRWGVDQFDADQRPDQ

SEQ ID NO: 119598 - protein, 17 aa, Mycobacterium avium
DRAGFKIIASGLRDCIT

SEQ ID NO: 119599 - protein, 23 aa, Mycobacterium avium
DREMKVILWNRGCEELWGLRADE

SEQ ID NO: 119600 - protein, 30 aa, Mycobacterium avium
DREPDWVNTIFLSTRFKAWRVGGYNEYLYT

SEQ ID NO: 119601 - protein, 19 aa, Mycobacterium avium
DREVLFCPDQFLGAHVRRM

SEQ ID NO: 119602 - protein, 19 aa, Mycobacterium avium
DREYQRMRDLGIAILREVG

SEQ ID NO: 119603 - protein, 33 aa, Mycobacterium avium
DRFQTLCGIQYYFDTEFQLLRGHLLYAGTEWAL

SEQ ID NO: 119604 - protein, 19 aa, Mycobacterium avium
DRGAGAGCLLLVYPNVIAV

SEQ ID NO: 119605 - protein, 29 aa, Mycobacterium avium
DRGGPPVRFQLLWYPSTMWDASLPSFAEN

SEQ ID NO: 119606 - protein, 17 aa, Mycobacterium avium
DRHGDYPLFMPQSTEQS

SEQ ID NO: 119607 - protein, 22 aa, Mycobacterium avium
DRIDPRFPVFSATALTDALPGP

SEQ ID NO: 119608 - protein, 31 aa, Mycobacterium avium
DRLGLDYLDLYLIHWPAPKLGKYVESFEGMI

SEQ ID NO: 119609 - protein, 18 aa, Mycobacterium avium
DRLRAHCPDVAFLHLSGS

SEQ ID NO: 119610 - protein, 22 aa, Mycobacterium avium
DRLRMADLRVTRPRVAVLEVVD

SEQ ID NO: 119611 - protein, 24 aa, Mycobacterium avium
DRLRTRFEWGLITDVQPPELETRI

SEQ ID NO: 119612 - protein, 23 aa, Mycobacterium avium
DRLTTPLLRVRGALRPCDWDTAM

SEQ ID NO: 119613 - protein, 27 aa, Mycobacterium avium
DRPVPMLSYIDIRKLPFGDYFDGLRAG

SEQ ID NO: 119614 - protein, 26 aa, Mycobacterium avium
DRPVPQLLAMGLLRRLDAETVILPRH

SEQ ID NO: 119615 - protein, 31 aa, Mycobacterium avium
DRPYTRWERWAFAHLPLAKKLYRTRLWLRSE

SEQ ID NO: 119616 - protein, 25 aa, Mycobacterium avium
DRRTYTAKHLILAAGTWGTQHLLFK

SEQ ID NO: 119617 - protein, 21 aa, Mycobacterium avium
DRRVHELIATDPQFAAAQPDP

SEQ ID NO: 119618 - protein, 24 aa, Mycobacterium avium
DRRYQYVPTYILRGLTELHLEFTL

SEQ ID NO: 119619 - protein, 26 aa, Mycobacterium avium
DRTKGMLMLVYGIDEDAAFNMLKSLS

SEQ ID NO: 119620 - protein, 39 aa, Mycobacterium avium
DRTLRFDGIPQPWLRDLAKRWVRWRLSTGLGLEAGGGRP

SEQ ID NO: 119621 - protein, 17 aa, Mycobacterium avium
DRVTSVFRHDSLASALA

SEQ ID NO: 119622 - protein, 27 aa, Mycobacterium avium
DRWFGTWHYWWQAHLLDCLVDAQQRDP

SEQ ID NO: 119623 - protein, 23 aa, Mycobacterium avium
DRWRVVPDVYLLGKALGGGVVPL

SEQ ID NO: 119624 - protein, 23 aa, Mycobacterium avium
DSALVHHYFGTKEKLFAAAVQIP

SEQ ID NO: 119625 - protein, 23 aa, Mycobacterium avium
DSARLWDVPDVPVGIGVAIGGTR

SEQ ID NO: 119626 - protein, 18 aa, Mycobacterium avium
DSAYAWAYNVDKGQKTRI

SEQ ID NO: 119627 - protein, 29 aa, Mycobacterium avium
DSHCAMASQFTLYALGAGGGGTSGPGAGG

SEQ ID NO: 119628 - protein, 20 aa, Mycobacterium avium
DSLCFLLDDAVLTADTVLGR

SEQ ID NO: 119629 - protein, 20 aa, Mycobacterium avium
DSLTTMRLITAINSALDTDL

SEQ ID NO: 119630 - protein, 19 aa, Mycobacterium avium
DSLVPLGPPVMDVALNITC

SEQ ID NO: 119631 - protein, 21 aa, Mycobacterium avium
DSPLQVTMWTKRLRAVDFTLG

SEQ ID NO: 119632 - protein, 17 aa, Mycobacterium avium
DSRGFFTSRVIGTFVNE

SEQ ID NO: 119633 - protein, 23 aa, Mycobacterium avium
DSRRAVVAPLLLASAYHARLDIP

SEQ ID NO: 119634 - protein, 26 aa, Mycobacterium avium
DSTTVGLFTYPVLQAADVLAYDTGLV

SEQ ID NO: 119635 - protein, 21 aa, Mycobacterium avium
DSVVFDRGGYTYGGRIAALAD

SEQ ID NO: 119636 - protein, 24 aa, Mycobacterium avium
DTALLDARLADFAPLPAPDDVLAA

SEQ ID NO: 119637 - protein, 30 aa, Mycobacterium avium
DTAQRLYDDLKPLLTFIVAGGLATTVKAGL

SEQ ID NO: 119638 - protein, 24 aa, Mycobacterium avium
DTDGDWPSFPLPLGDTWASSKGDL

SEQ ID NO: 119639 - protein, 27 aa, Mycobacterium avium
DTDRRTPALWKALSGAGVFGLAIAEEY

SEQ ID NO: 119640 - protein, 21 aa, Mycobacterium avium
DTFVVPEMLIPKVTAKIYDLA

SEQ ID NO: 119641 - protein, 25 aa, Mycobacterium avium
DTGATKMWMARLYPTYERNTCLISN

SEQ ID NO: 119642 - protein, 24 aa, Mycobacterium avium
DTKRRFREALDRKMAKSTGGSEHK

SEQ ID NO: 119643 - protein, 17 aa, Mycobacterium avium
DTLLVYENYPIDTAALS

SEQ ID NO: 119644 - protein, 29 aa, Mycobacterium avium
DTNLALLPVGYADGIFRSLGGRLQVSING

SEQ ID NO: 119645 - protein, 25 aa, Mycobacterium avium
DTPRFDRVRAALLAARRSRIQPGRD

SEQ ID NO: 119646 - protein, 24 aa, Mycobacterium avium
DTSKSALMAAWTSLYDAAKNDRPG

SEQ ID NO: 119647 - protein, 28 aa, Mycobacterium avium
DTTATFEWAFRWLAARRPRAAPAVLVHG

SEQ ID NO: 119648 - protein, 26 aa, Mycobacterium avium
DTTDPAALEQARPLFPHHLDTVVHVP

SEQ ID NO: 119649 - protein, 22 aa, Mycobacterium avium
DTTGARLVWVPRRAGDRGALEA

SEQ ID NO: 119650 - protein, 26 aa, Mycobacterium avium
DTTLLPGLMDMELNLLIGGPGGPEGL

SEQ ID NO: 119651 - protein, 25 aa, Mycobacterium avium
DTTPSMFAQLQAFGLLSEAPLTVLA

SEQ ID NO: 119652 - protein, 34 aa, Mycobacterium avium
DTVAPLLQPAGVAVGLKWPNDVLAGPAGSPGKLA

SEQ ID NO: 119653 - protein, 23 aa, Mycobacterium avium
DTVGARLTVLRRLAHPDDARLGP

SEQ ID NO: 119654 - protein, 20 aa, Mycobacterium avium
DTWMVLAGVERALALDSEPP

SEQ ID NO: 119655 - protein, 18 aa, Mycobacterium avium
DVAAFRQVIAGRLNKLDP

SEQ ID NO: 119656 - protein, 25 aa, Mycobacterium avium
DVADILPLTPLQQGLLFHATGSHAE

SEQ ID NO: 119657 - protein, 32 aa, Mycobacterium avium
DVDAAELATFFLTGLFALLATGAHDGALLSHY

SEQ ID NO: 119658 - protein, 18 aa, Mycobacterium avium
DVDAVLRVLPGAVERARR

SEQ ID NO: 119659 - protein, 23 aa, Mycobacterium avium
DVDKYLITPVVDVLASLAESNAP

SEQ ID NO: 119660 - protein, 33 aa, Mycobacterium avium
DVDLAVFDIMLLAHGWALKHWHFGPIYTLDEYI

SEQ ID NO: 119661 - protein, 27 aa, Mycobacterium avium
DVDRIVVHLAPWLEPEPICLAINHVRV

SEQ ID NO: 119662 - protein, 17 aa, Mycobacterium avium
DVEALMAMLAPDATWTA

SEQ ID NO: 119663 - protein, 22 aa, Mycobacterium avium
DVEPYLQRACDWAACGRAVFNA

SEQ ID NO: 119664 - protein, 17 aa, Mycobacterium avium
DVESLFYHAGLMKRLIG

SEQ ID NO: 119665 - protein, 20 aa, Mycobacterium avium
DVKKALYRVLRQRSMRERIR

SEQ ID NO: 119666 - protein, 24 aa, Mycobacterium avium
DVLDALSVWAPKQSVTAYDAVAAG

SEQ ID NO: 119667 - protein, 18 aa, Mycobacterium avium
DVLINNAFRVPSMKPLAG

SEQ ID NO: 119668 - protein, 18 aa, Mycobacterium avium
DVLITRWVSTFTPDPVPL

SEQ ID NO: 119669 - protein, 20 aa, Mycobacterium avium
DVLRAWGKLGYPRRAKRLHE

SEQ ID NO: 119670 - protein, 27 aa, Mycobacterium avium
DVLVHGPLQAALLARALGDWIGGRGRL

SEQ ID NO: 119671 - protein, 17 aa, Mycobacterium avium
DVLVHLAWNQPLATRTD

SEQ ID NO: 119672 - protein, 18 aa, Mycobacterium avium
DVLVLRSLTKTWALAGLR

SEQ ID NO: 119673 - protein, 17 aa, Mycobacterium avium
DVLYLPRGQVHSARTHS

SEQ ID NO: 119674 - protein, 22 aa, Mycobacterium avium
DVNLSGVWRTMKATVPHMISAG

SEQ ID NO: 119675 - protein, 18 aa, Mycobacterium avium
DVPPDDPLPLKLVDQRAA

SEQ ID NO: 119676 - protein, 18 aa, Mycobacterium avium
DVRRLGTVDYRAAWQQQR

SEQ ID NO: 119677 - protein, 19 aa, Mycobacterium avium
DVRTVLPPVLSIRNGRRSV

SEQ ID NO: 119678 - protein, 36 aa, Mycobacterium avium
DVTESFRLNPAPWLPVYWVFGGFLRKRRNIRDMTKT

SEQ ID NO: 119679 - protein, 25 aa, Mycobacterium avium
DVTKRVGVPGIWYAGSHGFELTAPD

SEQ ID NO: 119680 - protein, 31 aa, Mycobacterium avium
DVTLTSVFRATRAALRYFRDAPHGGVIVNNA

SEQ ID NO: 119681 - protein, 18 aa, Mycobacterium avium
DVTYDLISVQYHSLKAGH

SEQ ID NO: 119682 - protein, 20 aa, Mycobacterium avium
DVVAAAYRRGLLATPGAGTL

SEQ ID NO: 119683 - protein, 26 aa, Mycobacterium avium
DVVAHALWACLELRLLEALDMTGQRI

SEQ ID NO: 119684 - protein, 18 aa, Mycobacterium avium
DVVLHFEGDRNGSLRMVR

SEQ ID NO: 119685 - protein, 18 aa, Mycobacterium avium
DVYARRLAAAASATAAAG

SEQ ID NO: 119686 - protein, 18 aa, Mycobacterium avium
DVYRMLRVTNPSPYMYLL

SEQ ID NO: 119687 - protein, 28 aa, Mycobacterium avium
DWAARYTWPRFVCALPREFFAAVRAELA

SEQ ID NO: 119688 - protein, 34 aa, Mycobacterium avium
DWEHDLAVNLNGPFFLCRAALPQLLERGGNIVNV

SEQ ID NO: 119689 - protein, 19 aa, Mycobacterium avium
DWITGWHRDKNHPHPSGKP

SEQ ID NO: 119690 - protein, 17 aa, Mycobacterium avium
DWPRYGGYALAGVSSFG

SEQ ID NO: 119691 - protein, 17 aa, Mycobacterium avium
DWTATSAEFRKLLAEWK

SEQ ID NO: 119692 - protein, 18 aa, Mycobacterium avium
DWVVSWFEHLNLSDVTLF

SEQ ID NO: 119693 - protein, 17 aa, Mycobacterium avium
DYALMFPTLASLVEERM

SEQ ID NO: 119694 - protein, 35 aa, Mycobacterium avium
DYCAGSLAHFEWLVGCGVPFKAEFFGEPGWEPMGD

SEQ ID NO: 119695 - protein, 22 aa, Mycobacterium avium
DYDAEWIVVLDDWTDGVGKSPA

SEQ ID NO: 119696 - protein, 32 aa, Mycobacterium avium
DYELVLDPRFRTAATWLPTLRAWRRVRRFRPD

SEQ ID NO: 119697 - protein, 20 aa, Mycobacterium avium
DYLNWEARSWRLNETGDYQE

SEQ ID NO: 119698 - protein, 30 aa, Mycobacterium avium
DYPQFQRWSISLLSWILNPQRGLAASAALC

SEQ ID NO: 119699 - protein, 26 aa, Mycobacterium avium
DYRPLDGFVYAITPFNFTSIAGNLPT

SEQ ID NO: 119700 - protein, 23 aa, Mycobacterium avium
DYSLGAFAVWLRDFLDELGVSRA

SEQ ID NO: 119701 - protein, 23 aa, Mycobacterium avium
DYVINGRKWWTSGAADPRCKILI

SEQ ID NO: 119702 - protein, 18 aa, Mycobacterium avium
DYYALLRGTVHDPTARRM

SEQ ID NO: 119703 - protein, 27 aa, Mycobacterium avium
DYYENYRRYRWDLTLRRDYQRAAFEAG

SEQ ID NO: 119704 - protein, 33 aa, Mycobacterium avium
EAAALVGVARRLLLDPREIGPIRLLGVGFSGLS

SEQ ID NO: 119705 - protein, 23 aa, Mycobacterium avium
EAAFRERLRSWLSLHAKEFASSG

SEQ ID NO: 119706 - protein, 17 aa, Mycobacterium avium
EAAFVDIGRGRNGVLYA

SEQ ID NO: 119707 - protein, 25 aa, Mycobacterium avium
EAAKLIAAARKPVLYVGGGVIRGEA

SEQ ID NO: 119708 - protein, 29 aa, Mycobacterium avium
EAAKLLERFRAMEPWLQGGRVHAPFWEVH

SEQ ID NO: 119709 - protein, 26 aa, Mycobacterium avium
EAAVAGAIPVIRPLTQSLAGDTVLRV

SEQ ID NO: 119710 - protein, 24 aa, Mycobacterium avium
EAAVRELLFAIGENPDRHGLAETP

SEQ ID NO: 119711 - protein, 26 aa, Mycobacterium avium
EADHMADLGFLPGVTRILAATPNDGQ

SEQ ID NO: 119712 - protein, 23 aa, Mycobacterium avium
EAEIRGHRRTYVGALPGRIVRAI

SEQ ID NO: 119713 - protein, 18 aa, Mycobacterium avium
EAELLVRSAPGLRHRIYR

SEQ ID NO: 119714 - protein, 25 aa, Mycobacterium avium
EAGAFNYAWLNLRKDRQVDLLKVTQ

SEQ ID NO: 119715 - protein, 23 aa, Mycobacterium avium
EAGAPLGWIDAEGLRRHRDGLAL

SEQ ID NO: 119716 - protein, 26 aa, Mycobacterium avium
EAGRPLRIVLVAPPYFDVPPDGYGGV

SEQ ID NO: 119717 - protein, 26 aa, Mycobacterium avium
EAIGLLKMDFLGLRNLTIIGDALDNI

SEQ ID NO: 119718 - protein, 18 aa, Mycobacterium avium
EAILVRRVDWVQEITRVH

SEQ ID NO: 119719 - protein, 27 aa, Mycobacterium avium
EAITDRILLLDGLPNYQRLFSLRIGQT

SEQ ID NO: 119720 - protein, 40 aa, Mycobacterium avium
EALALRAAGISAPVLAWLHPPGIDFRPALLAGVQIGLSSQ

SEQ ID NO: 119721 - protein, 17 aa, Mycobacterium avium
EALGRPAALLYTSEDRA

SEQ ID NO: 119722 - protein, 23 aa, Mycobacterium avium
EALKLPYPGVLPEGPPPPKAFGS

SEQ ID NO: 119723 - protein, 24 aa, Mycobacterium avium
EALPSRPVQVIGFTSVPGAGDNLL

SEQ ID NO: 119724 - protein, 27 aa, Mycobacterium avium
EALTELLMIVATYYGLALVLNATDLDI

SEQ ID NO: 119725 - protein, 19 aa, Mycobacterium avium
EALYLAKRIDKVSGEGQTV

SEQ ID NO: 119726 - protein, 26 aa, Mycobacterium avium
EAPAEMHFYFPQFRALCMAENATHNL

SEQ ID NO: 119727 - protein, 24 aa, Mycobacterium avium
EAPARAYNPLFIWGESGLGKTHLL

SEQ ID NO: 119728 - protein, 23 aa, Mycobacterium avium
EAPQFLLSLIDSSAVRSASGAEV

SEQ ID NO: 119729 - protein, 17 aa, Mycobacterium avium
EAQAPRRSHPIPLVLGG

SEQ ID NO: 119730 - protein, 28 aa, Mycobacterium avium
EAQPHPHAALRRSTLPGGLRVVTEYLPA

SEQ ID NO: 119731 - protein, 24 aa, Mycobacterium avium
EAQVYPSPERIAAAALKTLGRTLT

SEQ ID NO: 119732 - protein, 17 aa, Mycobacterium avium
EAREEAVRIATAAKREY

SEQ ID NO: 119733 - protein, 21 aa, Mycobacterium avium
EARLGFGDPALFAEALLGDAR

SEQ ID NO: 119734 - protein, 26 aa, Mycobacterium avium
EARLLDPQHRLLLETAWRAVEHSGTA

SEQ ID NO: 119735 - protein, 34 aa, Mycobacterium avium
EARRGMALAAELRLPLVLVIDTAGPALSAEAEQG

SEQ ID NO: 119736 - protein, 17 aa, Mycobacterium avium
EATRRLDRHFTISVIDC

SEQ ID NO: 119737 - protein, 21 aa, Mycobacterium avium
EATVFFEELLRRYPRIELVGE

SEQ ID NO: 119738 - protein, 25 aa, Mycobacterium avium
EAYEDKATIVLPGTGGSVSGTAVNE

SEQ ID NO: 119739 - protein, 20 aa, Mycobacterium avium
EAYEQLILDVLLGEPSLFPV

SEQ ID NO: 119740 - protein, 22 aa, Mycobacterium avium
EAYGPHVAVFLPELELARAWER

SEQ ID NO: 119741 - protein, 19 aa, Mycobacterium avium
EAYLRAVIAWHFGADTGSP

SEQ ID NO: 119742 - protein, 34 aa, Mycobacterium avium
ECCRLRKVEPLRRALRGYAAWVSGLRRVEAPTRA

SEQ ID NO: 119743 - protein, 30 aa, Mycobacterium avium
ECSIEPWIFMNWRRAAYYLYLAEVIDARKA

SEQ ID NO: 119744 - protein, 19 aa, Mycobacterium avium
ECVSARTALTMFLGRADQP

SEQ ID NO: 119745 - protein, 27 aa, Mycobacterium avium
EDEEIYSFLRLLLPAGVETTYRALGSL

SEQ ID NO: 119746 - protein, 22 aa, Mycobacterium avium
EDELAFPRLYGVQTRFFDDFFD

SEQ ID NO: 119747 - protein, 29 aa, Mycobacterium avium
EDERAIQQAFLFGPPPLGPDAPPLDRLVA

SEQ ID NO: 119748 - protein, 27 aa, Mycobacterium avium
EDFSAGRTFLLPPTWTQLDSLAGRTVA

SEQ ID NO: 119749 - protein, 17 aa, Mycobacterium avium
EDGYLYIVDRRVDMIIS

SEQ ID NO: 119750 - protein, 24 aa, Mycobacterium avium
EDIADAVAWLASDQSRFVTASGIS

SEQ ID NO: 119751 - protein, 19 aa, Mycobacterium avium
EDIRFGLYGALAHPMEAAG

SEQ ID NO: 119752 - protein, 17 aa, Mycobacterium avium
EDLLPFSDETLCRAIAA

SEQ ID NO: 119753 - protein, 18 aa, Mycobacterium avium
EDLLRAERIFLNVGGRAV

SEQ ID NO: 119754 - protein, 24 aa, Mycobacterium avium
EDPGWANLLDLLAALGFSAEPVRV

SEQ ID NO: 119755 - protein, 24 aa, Mycobacterium avium
EDPHPMRFYNALGAIRAVLQDNRD

SEQ ID NO: 119756 - protein, 25 aa, Mycobacterium avium
EDVLLKIRLRQGLPVDLLNPAERER

SEQ ID NO: 119757 - protein, 24 aa, Mycobacterium avium
EDYTNRGRIITPLKDRFGAEIRTH

SEQ ID NO: 119758 - protein, 18 aa, Mycobacterium avium
EEALRVIRLLWDTDGPVD

SEQ ID NO: 119759 - protein, 18 aa, Mycobacterium avium
EEAVPFYGGLRRMINRND

SEQ ID NO: 119760 - protein, 18 aa, Mycobacterium avium
EEAYWFGEGVLPLLERMG

SEQ ID NO: 119761 - protein, 23 aa, Mycobacterium avium
EEERRLLYVGITRARTHLALSWA

SEQ ID NO: 119762 - protein, 28 aa, Mycobacterium avium
EEGKGFQYILDGLNPERMLIAAEALGIG

SEQ ID NO: 119763 - protein, 32 aa, Mycobacterium avium
EEGRTYQFNALFLDPYLWKLQVGGKRLVQKAR

SEQ ID NO: 119764 - protein, 22 aa, Mycobacterium avium
EEGTLRMLWVTATNPAVSLPEL

SEQ ID NO: 119765 - protein, 19 aa, Mycobacterium avium
EELILEVGSPRAITFGPQL

SEQ ID NO: 119766 - protein, 29 aa, Mycobacterium avium
EELLSYVRGVLYFRTGRWPDVLNQFPEGK

SEQ ID NO: 119767 - protein, 24 aa, Mycobacterium avium
EEQKKRWLPGIADGTLTMAFAITE

SEQ ID NO: 119768 - protein, 26 aa, Mycobacterium avium
EEQMAALLMAILLRGMDGGETAAWTS

SEQ ID NO: 119769 - protein, 17 aa, Mycobacterium avium
EEQSQWPRWVPVGRMGL

SEQ ID NO: 119770 - protein, 17 aa, Mycobacterium avium
EERVGIITLNRPKALNA

SEQ ID NO: 119771 - protein, 23 aa, Mycobacterium avium
EEVRASGLLPTWAETQAFIEGLP

SEQ ID NO: 119772 - protein, 21 aa, Mycobacterium avium
EFERPVLLFSGGKDSIVMLHL

SEQ ID NO: 119773 - protein, 17 aa, Mycobacterium avium
EFGDRLPVILLDGREHS

SEQ ID NO: 119774 - protein, 23 aa, Mycobacterium avium
EFHPELQFDRPYLLAMANAGPGT

SEQ ID NO: 119775 - protein, 42 aa, Mycobacterium avium
EFPRLMVYRGPRRKGVRYFGPYSHAWAIRETLDLLTRVFPAR

SEQ ID NO: 119776 - protein, 19 aa, Mycobacterium avium
EFRASRIMLERARANDKIT

SEQ ID NO: 119777 - protein, 21 aa, Mycobacterium avium
EFRKLLAEWKAAGRAAREVDD

SEQ ID NO: 119778 - protein, 26 aa, Mycobacterium avium
EFRYSDINYLLLGALLEKITGEDEDD

SEQ ID NO: 119779 - protein, 17 aa, Mycobacterium avium
EFSRQLKLLAKELEVPV

SEQ ID NO: 119780 - protein, 26 aa, Mycobacterium avium
EFTCSSCFLVQHRSRLRRSAAGLPVC

SEQ ID NO: 119781 - protein, 17 aa, Mycobacterium avium
EFTQRFGIARVCEFYAS

SEQ ID NO: 119782 - protein, 23 aa, Mycobacterium avium
EFVDVVLALWRDAATGGGVDHRG

SEQ ID NO: 119783 - protein, 24 aa, Mycobacterium avium
EGADALWLAQRGWTVLAVDISATA

SEQ ID NO: 119784 - protein, 28 aa, Mycobacterium avium
EGAHGLLVVTPYYSKPPQRGLIAHFTAV

SEQ ID NO: 119785 - protein, 20 aa, Mycobacterium avium
EGFFGWEAAGLRWLSSVDGG

SEQ ID NO: 119786 - protein, 21 aa, Mycobacterium avium
EGFLPTLLDWCRRNDVLFIAD

SEQ ID NO: 119787 - protein, 24 aa, Mycobacterium avium
EGGRLLEFDLAGGPPRVLLDNVPS

SEQ ID NO: 119788 - protein, 32 aa, Mycobacterium avium
EGLFDPRLKRPIPFLPNMIGLITGRASAAERD

SEQ ID NO: 119789 - protein, 25 aa, Mycobacterium avium
EGLIDAIVGLWRAPVHVAAAAGPTA

SEQ ID NO: 119790 - protein, 35 aa, Mycobacterium avium
EGLTTNLRRRGDRWYWHWDPQFISGTAAFPPFEVT

SEQ ID NO: 119791 - protein, 22 aa, Mycobacterium avium
EGRNRIVRRLLAAAGFPVESLV

SEQ ID NO: 119792 - protein, 22 aa, Mycobacterium avium
EGRPKHYWSIYQKMIVKGRDFD

SEQ ID NO: 119793 - protein, 19 aa, Mycobacterium avium
EGVTSCQSVLALAASYDVE

SEQ ID NO: 119794 - protein, 26 aa, Mycobacterium avium
EHAVKLWQHWDHCALHWFPGSHVLHI

SEQ ID NO: 119795 - protein, 29 aa, Mycobacterium avium
EHEPFQRFMDRLYRVLLSDAGLDGRIEAA

SEQ ID NO: 119796 - protein, 18 aa, Mycobacterium avium
EHHCDFAKLLPAVRAVRE

SEQ ID NO: 119797 - protein, 23 aa, Mycobacterium avium
EHKLLQPLALAPKGIWLGPKELR

SEQ ID NO: 119798 - protein, 18 aa, Mycobacterium avium
EHLGLRTRLFAAPGWVVS

SEQ ID NO: 119799 - protein, 26 aa, Mycobacterium avium
EHPAAMVLFSPLYDLTFELAKARERI

SEQ ID NO: 119800 - protein, 21 aa, Mycobacterium avium
EHQRVVAGLIRARPPVAVPLA

SEQ ID NO: 119801 - protein, 24 aa, Mycobacterium avium
EHSAHYYFRDFWGADSGMLAALYV

SEQ ID NO: 119802 - protein, 24 aa, Mycobacterium avium
EHSDLLLRWAGQLAPGSWIGVQMP

SEQ ID NO: 119803 - protein, 30 aa, Mycobacterium avium
EHTDYNLGFALPIALPQRTVASFTPADDDA

SEQ ID NO: 119804 - protein, 19 aa, Mycobacterium avium
EIAAQRIPVLTALLNAALP

SEQ ID NO: 119805 - protein, 25 aa, Mycobacterium avium
EIAERGWPVFLVSTVAREGLQPLIF

SEQ ID NO: 119806 - protein, 26 aa, Mycobacterium avium
EIAVRVIRTLHRLGIRSVAVYSDPDA

SEQ ID NO: 119807 - protein, 19 aa, Mycobacterium avium
EIDLDYHIRPWRVSPPGGR

SEQ ID NO: 119808 - protein, 22 aa, Mycobacterium avium
EIDPFRLRLLDGLATSIGERGY

SEQ ID NO: 119809 - protein, 24 aa, Mycobacterium avium
EIEEGQILRRVPLAIVPSAQLPNT

SEQ ID NO: 119810 - protein, 23 aa, Mycobacterium avium
EIERPPEDWLFKARTGDMRVDVL

SEQ ID NO: 119811 - protein, 40 aa, Mycobacterium avium
EIGAPISFARRAQVGLPAFMIRAFCDLAERHPWQETRPGF

SEQ ID NO: 119812 - protein, 19 aa, Mycobacterium avium
EIGGLLRAKFTHPLRFDVP

SEQ ID NO: 119813 - protein, 21 aa, Mycobacterium avium
EIHGYGRFTDPHTLAVELNDG

SEQ ID NO: 119814 - protein, 18 aa, Mycobacterium avium
EIKKQMIDWWGPIIDEYY

SEQ ID NO: 119815 - protein, 17 aa, Mycobacterium avium
EILILRVVVGLSAEETA

SEQ ID NO: 119816 - protein, 21 aa, Mycobacterium avium
EIPGTWLCRNGMEGTLIEGDL

SEQ ID NO: 119817 - protein, 20 aa, Mycobacterium avium
EIPLRARLFRIADDEHVLVA

SEQ ID NO: 119818 - protein, 17 aa, Mycobacterium avium
EIQRVVGSIPVKRLRQA

SEQ ID NO: 119819 - protein, 21 aa, Mycobacterium avium
EIQVPLFINTGDKLKVDTRDG

SEQ ID NO: 119820 - protein, 17 aa, Mycobacterium avium
EIVHGRVRRLGRGRYGP

SEQ ID NO: 119821 - protein, 38 aa, Mycobacterium avium
EIVRQLRLRDIGGIVVIDFIDMVLESNRDLVLRRLTEA

SEQ ID NO: 119822 - protein, 32 aa, Mycobacterium avium
EIYTPAAKRRYGYYVWPLLMDGRLAARVDLKA

SEQ ID NO: 119823 - protein, 26 aa, Mycobacterium avium
EKAVKALWDTILPFAGYAFNKSHAAG

SEQ ID NO: 119824 - protein, 30 aa, Mycobacterium avium
EKLTDEAIIAFLRLLLPAGLETTYRSSGNL

SEQ ID NO: 119825 - protein, 27 aa, Mycobacterium avium
EKRFQRFAALMRALNPLINRLPVRVLY

SEQ ID NO: 119826 - protein, 32 aa, Mycobacterium avium
EKVDDPLAMYLFDLCTLPLNLAGHCGMSVPSG

SEQ ID NO: 119827 - protein, 17 aa, Mycobacterium avium
ELAAMLAADPPLCALAA

SEQ ID NO: 119828 - protein, 24 aa, Mycobacterium avium
ELADLWNLEPLQIPHYGPPTHAMQ

SEQ ID NO: 119829 - protein, 18 aa, Mycobacterium avium
ELALEALYLAKRIDKVSG

SEQ ID NO: 119830 - protein, 20 aa, Mycobacterium avium
ELAPIYVLLASDEASYISGA

SEQ ID NO: 119831 - protein, 17 aa, Mycobacterium avium
ELAQRRAGYLRRLPEGT

SEQ ID NO: 119832 - protein, 20 aa, Mycobacterium avium
ELDLVLTPQGTLAEKLRAGG

SEQ ID NO: 119833 - protein, 28 aa, Mycobacterium avium
ELDRRNLLRRIGGAPYLHTLISTVPTAA

SEQ ID NO: 119834 - protein, 17 aa, Mycobacterium avium
ELEALLETVFHRGSKMH

SEQ ID NO: 119835 - protein, 25 aa, Mycobacterium avium
ELEKRRAHVPWVTWGTTAMVARSVA

SEQ ID NO: 119836 - protein, 26 aa, Mycobacterium avium
ELEQLPALGIMLTLFSAAGESTASLL

SEQ ID NO: 119837 - protein, 23 aa, Mycobacterium avium
ELERRVAEFLGFSTVLTSVGQVY

SEQ ID NO: 119838 - protein, 21 aa, Mycobacterium avium
ELEYVEMWLRDVAAMLGYHAG

SEQ ID NO: 119839 - protein, 21 aa, Mycobacterium avium
ELFAGILAQVPFVDPLTTILD

SEQ ID NO: 119840 - protein, 17 aa, Mycobacterium avium
ELFKPLATKATRPEVRG

SEQ ID NO: 119841 - protein, 24 aa, Mycobacterium avium
ELGDTGRILLRPSGTEPMIRVMVE

SEQ ID NO: 119842 - protein, 21 aa, Mycobacterium avium
ELGDWLVLHEAWRGELPDELG

SEQ ID NO: 119843 - protein, 31 aa, Mycobacterium avium
ELGEHLPVFRPPLDMARLFGQPRLGACEDGI

SEQ ID NO: 119844 - protein, 24 aa, Mycobacterium avium
ELGGDFGGVWYWNRYPGIQCDNES

SEQ ID NO: 119845 - protein, 19 aa, Mycobacterium avium
ELGNPTWYARFAAQAMTDP

SEQ ID NO: 119846 - protein, 25 aa, Mycobacterium avium
ELGQPLPLFIKWDDAEYGLRAGEHG

SEQ ID NO: 119847 - protein, 20 aa, Mycobacterium avium
ELGRADGEKWVWAGAAVIHP

SEQ ID NO: 119848 - protein, 18 aa, Mycobacterium avium
ELIGTGLGWRRLDVVEQT

SEQ ID NO: 119849 - protein, 18 aa, Mycobacterium avium
ELITMLVRFRTQAVATVT

SEQ ID NO: 119850 - protein, 27 aa, Mycobacterium avium
ELITVKRYWNEWKDPRLIIAVLHNNDL

SEQ ID NO: 119851 - protein, 24 aa, Mycobacterium avium
ELLADVVNRVWFLDAVRGEVDVYN

SEQ ID NO: 119852 - protein, 23 aa, Mycobacterium avium
ELLCRIILQGLASRPPSDAALDR

SEQ ID NO: 119853 - protein, 30 aa, Mycobacterium avium
ELNAAHGRTFFLATRLLAPDQRPPVHALYG

SEQ ID NO: 119854 - protein, 18 aa, Mycobacterium avium
ELPFALDGFQRRACAALE

SEQ ID NO: 119855 - protein, 20 aa, Mycobacterium avium
ELRKFIFTSTYATVGRRRGH

SEQ ID NO: 119856 - protein, 42 aa, Mycobacterium avium
ELRLLAAHAPPYNRRSRFPQRWWWVALTDEAFPRLAVVRAPR

SEQ ID NO: 119857 - protein, 20 aa, Mycobacterium avium
ELRMTLRALGSLRVEADLID

SEQ ID NO: 119858 - protein, 21 aa, Mycobacterium avium
ELRPQLLDRFGLTVDVHASRD

SEQ ID NO: 119859 - protein, 19 aa, Mycobacterium avium
ELRRRFALAARIRPRRSLT

SEQ ID NO: 119860 - protein, 17 aa, Mycobacterium avium
ELRTEVFALYDPPAPPG

SEQ ID NO: 119861 - protein, 22 aa, Mycobacterium avium
ELRTLWHGPSSTAMAAAAAPFI

SEQ ID NO: 119862 - protein, 19 aa, Mycobacterium avium
ELSRLREMLGQALVGKKLS

SEQ ID NO: 119863 - protein, 17 aa, Mycobacterium avium
ELSTELPAWRARIAEDL

SEQ ID NO: 119864 - protein, 20 aa, Mycobacterium avium
ELSTIRLLAKLPTIAAYAYK

SEQ ID NO: 119865 - protein, 17 aa, Mycobacterium avium
ELTDEVWYYLRGEEYSA

SEQ ID NO: 119866 - protein, 24 aa, Mycobacterium avium
ELTGLAVLDLYAGSGALGLEALSR

SEQ ID NO: 119867 - protein, 20 aa, Mycobacterium avium
ELTPEERLLRAIFGEKAREV

SEQ ID NO: 119868 - protein, 17 aa, Mycobacterium avium
ELVARWRSRRTHEHPLV

SEQ ID NO: 119869 - protein, 19 aa, Mycobacterium avium
ELVPGVPFSFDPTVLRAAR

SEQ ID NO: 119870 - protein, 20 aa, Mycobacterium avium
EMAQAWRLVKLDDAVHAVVL

SEQ ID NO: 119871 - protein, 20 aa, Mycobacterium avium
EMGRPRFGSWLRNSTRGALA

SEQ ID NO: 119872 - protein, 18 aa, Mycobacterium avium
EMSPVTCMLLGEDAIRKR

SEQ ID NO: 119873 - protein, 25 aa, Mycobacterium avium
ENHVSAELLGILRDDLNVDVSRVTP

SEQ ID NO: 119874 - protein, 21 aa, Mycobacterium avium
ENIKRQWWRSVVTGREDVVGL

SEQ ID NO: 119875 - protein, 29 aa, Mycobacterium avium
ENLAPGLDPVSFTLTLDGGSYQLYCPGAS

SEQ ID NO: 119876 - protein, 22 aa, Mycobacterium avium
ENLEAFLRVMVYDQKLITDELI

SEQ ID NO: 119877 - protein, 35 aa, Mycobacterium avium
ENNLTLPHPLAHLRAFVLIPWLAVDPDARLTVADG

SEQ ID NO: 119878 - protein, 17 aa, Mycobacterium avium
ENPTVVRVLGAIEIPVV

SEQ ID NO: 119879 - protein, 27 aa, Mycobacterium avium
EPALARTLRRTLPLMARLTLAKVPARV

SEQ ID NO: 119880 - protein, 20 aa, Mycobacterium avium
EPFLVAIPVLQEKDIKVLTV

SEQ ID NO: 119881 - protein, 18 aa, Mycobacterium avium
EPGDPYYLQYTHDPLHDP

SEQ ID NO: 119882 - protein, 21 aa, Mycobacterium avium
EPGFITMNLPRLLDALDGQGI

SEQ ID NO: 119883 - protein, 29 aa, Mycobacterium avium
EPGKQPPGHLWRWELSPVNAELTTVTHTY

SEQ ID NO: 119884 - protein, 18 aa, Mycobacterium avium
EPGLVLLADLRRIHRLAA

SEQ ID NO: 119885 - protein, 30 aa, Mycobacterium avium
EPLANMGVIYWVYPNLILANSPVGVEIIDM

SEQ ID NO: 119886 - protein, 20 aa, Mycobacterium avium
EPMLGTWQSIVLVDLNRDNP

SEQ ID NO: 119887 - protein, 24 aa, Mycobacterium avium
EPPNGPPPPARWSRRKPEAAARLE

SEQ ID NO: 119888 - protein, 27 aa, Mycobacterium avium
EPQRVGRFRFFLDGHRWEWSDAVARMH

SEQ ID NO: 119889 - protein, 22 aa, Mycobacterium avium
EPRPRIALAAPTGKAAARLAEA

SEQ ID NO: 119890 - protein, 21 aa, Mycobacterium avium
EPRVLALWRTADTESLAAVLR

SEQ ID NO: 119891 - protein, 18 aa, Mycobacterium avium
EPSAEVDVWFVGKKGGAG

SEQ ID NO: 119892 - protein, 29 aa, Mycobacterium avium
EPSMYRFHRRLAAFARVIRLDQRGIGLSS

SEQ ID NO: 119893 - protein, 31 aa, Mycobacterium avium
EQIAILVALGHQLAAVPYLESVVLGAGALAR

SEQ ID NO: 119894 - protein, 34 aa, Mycobacterium avium
EQKQRFLPPTLRGEMIWCQLFSEPGAGSDLAGLS

SEQ ID NO: 119895 - protein, 20 aa, Mycobacterium avium
EQLLGFIGELDRPGRLTLVE

SEQ ID NO: 119896 - protein, 25 aa, Mycobacterium avium
EQQHPLVMRLSVPGRHMALNALGAL

SEQ ID NO: 119897 - protein, 19 aa, Mycobacterium avium
EQTLASVSILLNGGGIGQL

SEQ ID NO: 119898 - protein, 23 aa, Mycobacterium avium
EQVLDLLRIDLMRSLGVGINDIQ

SEQ ID NO: 119899 - protein, 26 aa, Mycobacterium avium
ERAAVFLRAADLLAGPWREKIAAATM

SEQ ID NO: 119900 - protein, 27 aa, Mycobacterium avium
ERDFPATSVRFFASSRSQGRKLEFRGA

SEQ ID NO: 119901 - protein, 27 aa, Mycobacterium avium
EREARFLQSIPLHRVARPREIAHAICF

SEQ ID NO: 119902 - protein, 24 aa, Mycobacterium avium
EREFSDVFGVLFPGGEGRLRLTDP

SEQ ID NO: 119903 - protein, 23 aa, Mycobacterium avium
EREPAPPTAPRPGGMPPWDSTPV

SEQ ID NO: 119904 - protein, 23 aa, Mycobacterium avium
EREVRFYGDLAPRLGGPIAPCYH

SEQ ID NO: 119905 - protein, 19 aa, Mycobacterium avium
ERFDLVRYAVDTLTRDPNA

SEQ ID NO: 119906 - protein, 18 aa, Mycobacterium avium
ERFSPFSGFGYFAGGLSG

SEQ ID NO: 119907 - protein, 26 aa, Mycobacterium avium
ERGSNGLYQLILDYPLRGGKALRPAL

SEQ ID NO: 119908 - protein, 17 aa, Mycobacterium avium
ERHLAMLTTLRADNSPH

SEQ ID NO: 119909 - protein, 22 aa, Mycobacterium avium
ERIKPAFKHWAAVVIHAGEPGA

SEQ ID NO: 119910 - protein, 18 aa, Mycobacterium avium
ERILAELTEHARATFAEI

SEQ ID NO: 119911 - protein, 33 aa, Mycobacterium avium
ERISVPYFFNPRLDARIPVLSLPPELRARAVER

SEQ ID NO: 119912 - protein, 18 aa, Mycobacterium avium
ERKPPWIRVRARMGPEYT

SEQ ID NO: 119913 - protein, 27 aa, Mycobacterium avium
ERLSEILAAYALLRDPARRADYDREHR

SEQ ID NO: 119914 - protein, 21 aa, Mycobacterium avium
ERLWEALLRGDDFVTEIPPDR

SEQ ID NO: 119915 - protein, 22 aa, Mycobacterium avium
ERPDVVMYLGRALAEGGALGSV

SEQ ID NO: 119916 - protein, 22 aa, Mycobacterium avium
ERQCNVTALPPYLESAYQEFMA

SEQ ID NO: 119917 - protein, 21 aa, Mycobacterium avium
ERRAKRLIVFDVDSTLVQGEV

SEQ ID NO: 119918 - protein, 19 aa, Mycobacterium avium
ERRPGWVGLPLTGVQTRVV

SEQ ID NO: 119919 - protein, 32 aa, Mycobacterium avium
ERRVPPRWWPPVMKKFVWPWVAGRRQVVVNSF

SEQ ID NO: 119920 - protein, 25 aa, Mycobacterium avium
ERSRRFYESVFGWPVLLEVPDNADA

SEQ ID NO: 119921 - protein, 25 aa, Mycobacterium avium
ERTAQIVWGARALGGPVPIPEDVNR

SEQ ID NO: 119922 - protein, 28 aa, Mycobacterium avium
ERTGYSWGPLSLTLLATALAQLGDTAAT

SEQ ID NO: 119923 - protein, 26 aa, Mycobacterium avium
ERTMVLNYYAPLRLIRGIAPGMIERG

SEQ ID NO: 119924 - protein, 32 aa, Mycobacterium avium
ERVDILHDLYRRWPFFRSVLSNLAQVLAKSDL

SEQ ID NO: 119925 - protein, 24 aa, Mycobacterium avium
ERYGVPAHQLLHRAGQRKLIGGQE

SEQ ID NO: 119926 - protein, 21 aa, Mycobacterium avium
ESALWEASLFEEHGFSDIKIS

SEQ ID NO: 119927 - protein, 28 aa, Mycobacterium avium
ESAVAAWRGFSRWLMRAYDVLIDEDQIA

SEQ ID NO: 119928 - protein, 24 aa, Mycobacterium avium
ESDNLAVKGIYWARRDAEPRQRRI

SEQ ID NO: 119929 - protein, 19 aa, Mycobacterium avium
ESDRRAREEWLARAIQERY

SEQ ID NO: 119930 - protein, 21 aa, Mycobacterium avium
ESEARLLFIGSGLPMPELQYS

SEQ ID NO: 119931 - protein, 20 aa, Mycobacterium avium
ESGARWILDLGPGDILTRLT

SEQ ID NO: 119932 - protein, 17 aa, Mycobacterium avium
ESGLFAVALPFTNLIDY

SEQ ID NO: 119933 - protein, 26 aa, Mycobacterium avium
ESLADPLAFLLRKEGFEATVVTDGSA

SEQ ID NO: 119934 - protein, 29 aa, Mycobacterium avium
ESLRVEWWQSCRLPVNWKLATAAFMEGYH

SEQ ID NO: 119935 - protein, 24 aa, Mycobacterium avium
ESRAQMATLPRLKPRVFYDLVVEV

SEQ ID NO: 119936 - protein, 19 aa, Mycobacterium avium
ESTWDRRPGWFAKVAGRAT

SEQ ID NO: 119937 - protein, 19 aa, Mycobacterium avium
ESTWPEFFDAIRAAGYTRV

SEQ ID NO: 119938 - protein, 23 aa, Mycobacterium avium
ESVQWLEQHLAAYAGAVLAVTHD

SEQ ID NO: 119939 - protein, 18 aa, Mycobacterium avium
ESWSRIIDVNLTGTFHCC

SEQ ID NO: 119940 - protein, 26 aa, Mycobacterium avium
ETADTYAYFGGAPLFEYTLAQGIEDG

SEQ ID NO: 119941 - protein, 33 aa, Mycobacterium avium
ETAFANWKALGARFFALRPATQLHWTGHDDPDV

SEQ ID NO: 119942 - protein, 25 aa, Mycobacterium avium
ETALTGLLGVRKWVRIPDVHFAADA

SEQ ID NO: 119943 - protein, 28 aa, Mycobacterium avium
ETAWRDGQWYTARLRPGPLRPADRRTTV

SEQ ID NO: 119944 - protein, 27 aa, Mycobacterium avium
ETDAAARVLLLWGRRPADPSRIRSRVG

SEQ ID NO: 119945 - protein, 31 aa, Mycobacterium avium
ETFIALKVGIDNWRWAGVPVYLRTGKRMAEG

SEQ ID NO: 119946 - protein, 30 aa, Mycobacterium avium
ETFRFRGHYFGDRMPYIPADQLQAALAADP

SEQ ID NO: 119947 - protein, 33 aa, Mycobacterium avium
ETGQPAWSQWYAGRPLLVTANDYGLRLYNGDTG

SEQ ID NO: 119948 - protein, 23 aa, Mycobacterium avium
ETGYLRVPQPGRLELVLAHPSGI

SEQ ID NO: 119949 - protein, 18 aa, Mycobacterium avium
ETHLLFGIPYDRIEVVVH

SEQ ID NO: 119950 - protein, 25 aa, Mycobacterium avium
ETKPEWADRWPDLVAAFTAATRAEE

SEQ ID NO: 119951 - protein, 28 aa, Mycobacterium avium
ETLARVIDYTLAIKKYPIVVNDGRGFFT

SEQ ID NO: 119952 - protein, 17 aa, Mycobacterium avium
ETPIVHGMWLSAAAQHA

SEQ ID NO: 119953 - protein, 23 aa, Mycobacterium avium
ETPLENPPPYWQAAAEQGLHGVH

SEQ ID NO: 119954 - protein, 20 aa, Mycobacterium avium
ETRDWWGGMWADRILHSTVA

SEQ ID NO: 119955 - protein, 17 aa, Mycobacterium avium
ETSLIMVKSYAAMGGLH

SEQ ID NO: 119956 - protein, 25 aa, Mycobacterium avium
ETVPPPVVTANRTLLAQLVATNILG

SEQ ID NO: 119957 - protein, 17 aa, Mycobacterium avium
ETYWSRFAEQGWYFAGD

SEQ ID NO: 119958 - protein, 26 aa, Mycobacterium avium
EVAAKRIAWMKLLNAGQTCVAPDYVL

SEQ ID NO: 119959 - protein, 21 aa, Mycobacterium avium
EVARAWSSYAPTLVRLPDGRV

SEQ ID NO: 119960 - protein, 17 aa, Mycobacterium avium
EVARGFLTSQKARWAAR

SEQ ID NO: 119961 - protein, 24 aa, Mycobacterium avium
EVARRLWDSWEDDAVIRDVATGRY

SEQ ID NO: 119962 - protein, 19 aa, Mycobacterium avium
EVDILTIGLLIAEVKVTYK

SEQ ID NO: 119963 - protein, 18 aa, Mycobacterium avium
EVEAWLAAEPFRAPEADE

SEQ ID NO: 119964 - protein, 20 aa, Mycobacterium avium
EVELLSPDGLYRLRPRTGRT

SEQ ID NO: 119965 - protein, 20 aa, Mycobacterium avium
EVERFRTELRDWLSDNLTDE

SEQ ID NO: 119966 - protein, 29 aa, Mycobacterium avium
EVFGDEKAVWWQRAVEAWPDYAEYQTKTD

SEQ ID NO: 119967 - protein, 18 aa, Mycobacterium avium
EVFGFPVAAALLLQIMQH

SEQ ID NO: 119968 - protein, 28 aa, Mycobacterium avium
EVGAKLWVDMAHFAGLVAAGLHPSPVPH

SEQ ID NO: 119969 - protein, 39 aa, Mycobacterium avium
EVGDGVRWAMRHLPFYGRWYRFLVLWPGSDKGLDAAEAD

SEQ ID NO: 119970 - protein, 20 aa, Mycobacterium avium
EVHLGSWRPGLSYRQLAREL

SEQ ID NO: 119971 - protein, 24 aa, Mycobacterium avium
EVKVGIQILESLNLRPRSLEIVSC

SEQ ID NO: 119972 - protein, 25 aa, Mycobacterium avium
EVLGVYGPPLKFDVSLPLSSISEFE

SEQ ID NO: 119973 - protein, 17 aa, Mycobacterium avium
EVLTLDILSRRGKTIRP

SEQ ID NO: 119974 - protein, 22 aa, Mycobacterium avium
EVLWTAMPLFHLSAAPSVLAPM

SEQ ID NO: 119975 - protein, 17 aa, Mycobacterium avium
EVNSARMYAGPGSGPML

SEQ ID NO: 119976 - protein, 42 aa, Mycobacterium avium
EVPSHKLLIRAGYIRPVAPGLYSWLPLGLRVLRRIEHIVREE

SEQ ID NO: 119977 - protein, 28 aa, Mycobacterium avium
EVRALLTWGRPGVDAALIAALPNLEVIV

SEQ ID NO: 119978 - protein, 21 aa, Mycobacterium avium
EVRDKIERRYANAIGAAELAQ

SEQ ID NO: 119979 - protein, 24 aa, Mycobacterium avium
EVRVPWSLAPRQRGPRRRPSLLER

SEQ ID NO: 119980 - protein, 18 aa, Mycobacterium avium
EVSITRRMFRDGASEYEI

SEQ ID NO: 119981 - protein, 20 aa, Mycobacterium avium
EVTRERQGWGAWPVCSGRAG

SEQ ID NO: 119982 - protein, 18 aa, Mycobacterium avium
EVVAPLASYVPAVRTGNL

SEQ ID NO: 119983 - protein, 19 aa, Mycobacterium avium
EVVEFHYRPERYRFSVTLP

SEQ ID NO: 119984 - protein, 25 aa, Mycobacterium avium
EVVGQDHLLAPGSPLRRLVEGSGVA

SEQ ID NO: 119985 - protein, 18 aa, Mycobacterium avium
EVWTPRDRMPVFPVPEGH

SEQ ID NO: 119986 - protein, 17 aa, Mycobacterium avium
EVYARDLTLDKFLDATT

SEQ ID NO: 119987 - protein, 25 aa, Mycobacterium avium
EWAQRGWLAVRYNLPFRRRRPTGPP

SEQ ID NO: 119988 - protein, 22 aa, Mycobacterium avium
EWLAAHGWVVDPVRNTLDLQAG

SEQ ID NO: 119989 - protein, 26 aa, Mycobacterium avium
EWTVPTRLALVRRLGSVELDLTRARF

SEQ ID NO: 119990 - protein, 19 aa, Mycobacterium avium
EWVDWFPPTHPDRPDAPNM

SEQ ID NO: 119991 - protein, 17 aa, Mycobacterium avium
EYFQQFLRRRAALAINT

SEQ ID NO: 119992 - protein, 18 aa, Mycobacterium avium
EYGVWAGVKLPGGQYRKR

SEQ ID NO: 119993 - protein, 26 aa, Mycobacterium avium
EYIRSPAELVLLPGAARALAALNAAG

SEQ ID NO: 119994 - protein, 25 aa, Mycobacterium avium
EYVEGMWRMLQAPEPDDYVLATGRG

SEQ ID NO: 119995 - protein, 19 aa, Mycobacterium avium
EYVFLLTNTDPRRPKHKNL

SEQ ID NO: 119996 - protein, 20 aa, Mycobacterium avium
EYYDLPLATLHHVPMRPNGQ

SEQ ID NO: 119997 - protein, 32 aa, Mycobacterium avium
FAALSTAERWQLLAGSWLDLPGRPALIGGRGP

SEQ ID NO: 119998 - protein, 20 aa, Mycobacterium avium
FAARARAWLADNMPAIDRES

SEQ ID NO: 119999 - protein, 26 aa, Mycobacterium avium
FAATVPPPVIAANRALLASLIATNVL

SEQ ID NO: 120000 - protein, 20 aa, Mycobacterium avium
FAERTDVLALLLRSTYDDGA

SEQ ID NO: 120001 - protein, 20 aa, Mycobacterium avium
FAHGMAIMCGASLIFQYDVT

SEQ ID NO: 120002 - protein, 18 aa, Mycobacterium avium
FALPRPWAPDDEHVLLQE

SEQ ID NO: 120003 - protein, 21 aa, Mycobacterium avium
FAMTVPPAVVAANRAQLATLV

SEQ ID NO: 120004 - protein, 23 aa, Mycobacterium avium
FANIRLRNLLLDDVAGGYTRDFT

SEQ ID NO: 120005 - protein, 20 aa, Mycobacterium avium
FAPEIYRAPLSYPYRDGLLD

SEQ ID NO: 120006 - protein, 25 aa, Mycobacterium avium
FAPGLPVPSLFTSRPQVLKTYTFAE

SEQ ID NO: 120007 - protein, 21 aa, Mycobacterium avium
FAPGRPLIEVLRDLASRIFTD

SEQ ID NO: 120008 - protein, 34 aa, Mycobacterium avium
FAPTTLKPIPTLRIVRQMFAKRPAFDFKQLITED

SEQ ID NO: 120009 - protein, 35 aa, Mycobacterium avium
FAQPALFAVEVALFRLLESWGVRPDFVMGHSIGEL

SEQ ID NO: 120010 - protein, 18 aa, Mycobacterium avium
FATSGDFWHTDPALLQSQ

SEQ ID NO: 120011 - protein, 17 aa, Mycobacterium avium
FAVLGRQVAIGGQLLQL

SEQ ID NO: 120012 - protein, 32 aa, Mycobacterium avium
FAVNVFGPVELTLALLPALRRARGQVVFINSG

SEQ ID NO: 120013 - protein, 18 aa, Mycobacterium avium
FAWHIDLAKRCGKPLMIH

SEQ ID NO: 120014 - protein, 18 aa, Mycobacterium avium
FCATGVTNGDLLKGVQYY

SEQ ID NO: 120015 - protein, 17 aa, Mycobacterium avium
FDALHPVVRLRALERME

SEQ ID NO: 120016 - protein, 25 aa, Mycobacterium avium
FDDLQDRYLFIQAIETQKAYDDGVI

SEQ ID NO: 120017 - protein, 17 aa, Mycobacterium avium
FDELLLRCDDIEIGPAK

SEQ ID NO: 120018 - protein, 17 aa, Mycobacterium avium
FDHLNVIAGFDELPRKL

SEQ ID NO: 120019 - protein, 31 aa, Mycobacterium avium
FDPNAGWFNYFSTWGNQFISSGFPINLLGVW

SEQ ID NO: 120020 - protein, 31 aa, Mycobacterium avium
FDPTQRTAWLAEGLLMYLPAEAQDRLFTLIG

SEQ ID NO: 120021 - protein, 17 aa, Mycobacterium avium
FDRISYSWIPRERNSHA

SEQ ID NO: 120022 - protein, 20 aa, Mycobacterium avium
FDRMYDAPLPYISALHQYTG

SEQ ID NO: 120023 - protein, 26 aa, Mycobacterium avium
FDTIGRLWDRIGDKGIGFCLDTCHAW

SEQ ID NO: 120024 - protein, 19 aa, Mycobacterium avium
FDTIVRALPRIPDAELVIV

SEQ ID NO: 120025 - protein, 18 aa, Mycobacterium avium
FDTWRHAVATAPHLLRKS

SEQ ID NO: 120026 - protein, 22 aa, Mycobacterium avium
FDVMGFGKPLDDVPMLLQPGVL

SEQ ID NO: 120027 - protein, 17 aa, Mycobacterium avium
FEAAQVCRWLLTSRLEL

SEQ ID NO: 120028 - protein, 19 aa, Mycobacterium avium
FEFELDTTRPYAAWMKEVE

SEQ ID NO: 120029 - protein, 18 aa, Mycobacterium avium
FEGPPPWNIGEPQPELAA

SEQ ID NO: 120030 - protein, 20 aa, Mycobacterium avium
FELAQKAVMAGIPVLAAVSA

SEQ ID NO: 120031 - protein, 28 aa, Mycobacterium avium
FELRLSDAWVWDMYRPARFVKQVRVVTF

SEQ ID NO: 120032 - protein, 17 aa, Mycobacterium avium
FEPGGLIAYLRAGWDLA

SEQ ID NO: 120033 - protein, 28 aa, Mycobacterium avium
FEPWERHPLMLRSYFQARSGPGGKRLIQ

SEQ ID NO: 120034 - protein, 17 aa, Mycobacterium avium
FERKRLLVNQFKAYGVN

SEQ ID NO: 120035 - protein, 23 aa, Mycobacterium avium
FESPKLLMLSGIGPGRELAKHGI

SEQ ID NO: 120036 - protein, 29 aa, Mycobacterium avium
FEVNEAFAPVPLAWLAETGADAARTNPLG

SEQ ID NO: 120037 - protein, 18 aa, Mycobacterium avium
FFASVEQLTRPTLRGRPV

SEQ ID NO: 120038 - protein, 17 aa, Mycobacterium avium
FFDEAARRGLRVVAEAF

SEQ ID NO: 120039 - protein, 18 aa, Mycobacterium avium
FFESQGMPMPFSDTPTRD

SEQ ID NO: 120040 - protein, 18 aa, Mycobacterium avium
FFQRYRDAVLARARRVPL

SEQ ID NO: 120041 - protein, 18 aa, Mycobacterium avium
FGALICHGALSRNPDLRI

SEQ ID NO: 120042 - protein, 19 aa, Mycobacterium avium
FGAVGIQYGPAFSGLAAVS

SEQ ID NO: 120043 - protein, 25 aa, Mycobacterium avium
FGAVRMVLALLPHWRERRFGHVVNV

SEQ ID NO: 120044 - protein, 20 aa, Mycobacterium avium
FGDLVAMEAYRRSLLEQASG

SEQ ID NO: 120045 - protein, 25 aa, Mycobacterium avium
FGDPQGRAMFWLHGTPGARRQIPVE

SEQ ID NO: 120046 - protein, 19 aa, Mycobacterium avium
FGGTPPPYPGWPDTLGAQD

SEQ ID NO: 120047 - protein, 34 aa, Mycobacterium avium
FGNQILGRALGLSTYKMVFGHRGINIPVIDHATG

SEQ ID NO: 120048 - protein, 24 aa, Mycobacterium avium
FGPEVKRRIMIGTYALSAGYYDAY

SEQ ID NO: 120049 - protein, 17 aa, Mycobacterium avium
FGRTDVELPWEQLNKVD

SEQ ID NO: 120050 - protein, 17 aa, Mycobacterium avium
FGRYFRSMGVLPAAPDA

SEQ ID NO: 120051 - protein, 18 aa, Mycobacterium avium
FGSLRPLLEAAAAHDRGV

SEQ ID NO: 120052 - protein, 19 aa, Mycobacterium avium
FGTHWHGLLDNDDFRRAWL

SEQ ID NO: 120053 - protein, 26 aa, Mycobacterium avium
FGTNHLGHFALTGRLLALLRAADSAR

SEQ ID NO: 120054 - protein, 26 aa, Mycobacterium avium
FGTRIQYNIGLGLLFGRPKSNLTFAQ

SEQ ID NO: 120055 - protein, 18 aa, Mycobacterium avium
FHLRDLAVTFRFGEEVTA

SEQ ID NO: 120056 - protein, 17 aa, Mycobacterium avium
FHNGSPLYIELPVSVEM

SEQ ID NO: 120057 - protein, 17 aa, Mycobacterium avium
FIDYCTNMLYITAAPYV

SEQ ID NO: 120058 - protein, 21 aa, Mycobacterium avium
FIEHDSQGYRLIFENDYVTEP

SEQ ID NO: 120059 - protein, 17 aa, Mycobacterium avium
FIGAFWYHYDEAHYDEL

SEQ ID NO: 120060 - protein, 18 aa, Mycobacterium avium
FIQGFELDDFHPLAPLHS

SEQ ID NO: 120061 - protein, 25 aa, Mycobacterium avium
FISSGFPINLLGVWAQLATAQGVAS

SEQ ID NO: 120062 - protein, 17 aa, Mycobacterium avium
FISSPGYEHAWLNPDNT

SEQ ID NO: 120063 - protein, 18 aa, Mycobacterium avium
FIVLAKPEGAPDNSRGVA

SEQ ID NO: 120064 - protein, 20 aa, Mycobacterium avium
FKPRYNPWDQRMCLIPDADL

SEQ ID NO: 120065 - protein, 18 aa, Mycobacterium avium
FLAALSAQMRPGDSLLLG

SEQ ID NO: 120066 - protein, 18 aa, Mycobacterium avium
FLAENWRPYVAGDIVIHE

SEQ ID NO: 120067 - protein, 23 aa, Mycobacterium avium
FLAPYRVRRVVLSPDAHGWAPEQ

SEQ ID NO: 120068 - protein, 27 aa, Mycobacterium avium
FLELPGPPILRHSLTVALIAGLSRVRS

SEQ ID NO: 120069 - protein, 19 aa, Mycobacterium avium
FLEVSYLLIYGELPDKDQL

SEQ ID NO: 120070 - protein, 30 aa, Mycobacterium avium
FLPTAQRRTPPAFYAWRAFARYSPVLPAGR

SEQ ID NO: 120071 - protein, 38 aa, Mycobacterium avium
FLREYPYREAYLLRDAKLFRAELKMPLILLGGITNRET

SEQ ID NO: 120072 - protein, 26 aa, Mycobacterium avium
FLRMEADWESAYLLSLRAAWQADNKI

SEQ ID NO: 120073 - protein, 20 aa, Mycobacterium avium
FLRNWREALELPPARHLDTF

SEQ ID NO: 120074 - protein, 17 aa, Mycobacterium avium
FLSNWTPVAQPQTIMVP

SEQ ID NO: 120075 - protein, 17 aa, Mycobacterium avium
FLYGLFSDYVRDRRRQP

SEQ ID NO: 120076 - protein, 20 aa, Mycobacterium avium
FMEFHLRRRVKALPNVTFLD

SEQ ID NO: 120077 - protein, 23 aa, Mycobacterium avium
FNNITFEDWQRVIDVNLNGVFHT

SEQ ID NO: 120078 - protein, 28 aa, Mycobacterium avium
FNSRRPFHPGRLHACLDLLLDGVIRTRG

SEQ ID NO: 120079 - protein, 25 aa, Mycobacterium avium
FPASDRPWLTHFSDRWNRLGRRVTA

SEQ ID NO: 120080 - protein, 24 aa, Mycobacterium avium
FPTLPPMMRITLNAILRAVFGAEG

SEQ ID NO: 120081 - protein, 27 aa, Mycobacterium avium
FPTRHPYGLALWQNHIERILADWVGEL

SEQ ID NO: 120082 - protein, 20 aa, Mycobacterium avium
FPYAWPRKPVLADNVVCTSQ

SEQ ID NO: 120083 - protein, 18 aa, Mycobacterium avium
FQERMAALAEAVWALPQP

SEQ ID NO: 120084 - protein, 20 aa, Mycobacterium avium
FQEYAIIRDDLFSTPIPGED

SEQ ID NO: 120085 - protein, 19 aa, Mycobacterium avium
FQHLPVPFELYSDGIDLPV

SEQ ID NO: 120086 - protein, 18 aa, Mycobacterium avium
FREELIPLLRDAYPPRAD

SEQ ID NO: 120087 - protein, 21 aa, Mycobacterium avium
FRGRARAWLAANMPRLDPARA

SEQ ID NO: 120088 - protein, 30 aa, Mycobacterium avium
FRHRRVGFVFQFFNLLPTLSAWENVAIPRL

SEQ ID NO: 120089 - protein, 22 aa, Mycobacterium avium
FRHTFDWCVTSAFIMSQLVAAH

SEQ ID NO: 120090 - protein, 21 aa, Mycobacterium avium
FRIKNMWGLLTVRGRFTDFTG

SEQ ID NO: 120091 - protein, 27 aa, Mycobacterium avium
FRNARALREAVPLIPPGQLLVETDAPF

SEQ ID NO: 120092 - protein, 17 aa, Mycobacterium avium
FRNLAWAAIFEPSTLCK

SEQ ID NO: 120093 - protein, 17 aa, Mycobacterium avium
FRRAWLVRVADAAGRRF

SEQ ID NO: 120094 - protein, 18 aa, Mycobacterium avium
FRRHAGLDLLPQLVFRDG

SEQ ID NO: 120095 - protein, 24 aa, Mycobacterium avium
FRVRRLAGRVVWMQPPDTPPRAQT

SEQ ID NO: 120096 - protein, 19 aa, Mycobacterium avium
FSAVAVRPLLRGSVLGVTG

SEQ ID NO: 120097 - protein, 18 aa, Mycobacterium avium
FSDELLADLALSCALWVG

SEQ ID NO: 120098 - protein, 20 aa, Mycobacterium avium
FSGYYEVDPYTPVTPREPIR

SEQ ID NO: 120099 - protein, 19 aa, Mycobacterium avium
FSLGHFPQSFEYATIGGFA

SEQ ID NO: 120100 - protein, 18 aa, Mycobacterium avium
FSLHYPWSQQLPVHSLDG

SEQ ID NO: 120101 - protein, 35 aa, Mycobacterium avium
FSSAQPVDRPIPRPVPRPGAPRPGAPRPGASPGNM

SEQ ID NO: 120102 - protein, 17 aa, Mycobacterium avium
FTALDWVSDRLADRRYL

SEQ ID NO: 120103 - protein, 28 aa, Mycobacterium avium
FTCIATAKAAIWAGLASPVMIWSMAQAA

SEQ ID NO: 120104 - protein, 30 aa, Mycobacterium avium
FTEKDRYSMDWYYPILGSAVRGPAAAARIK

SEQ ID NO: 120105 - protein, 18 aa, Mycobacterium avium
FTHELRMTLRALGSLRVE

SEQ ID NO: 120106 - protein, 19 aa, Mycobacterium avium
FTHHMFLPMPPEDGGAPPP

SEQ ID NO: 120107 - protein, 19 aa, Mycobacterium avium
FTTLFMQQQWLRGGAEAGA

SEQ ID NO: 120108 - protein, 18 aa, Mycobacterium avium
FTTLVPNLGVVSAGEHTF

SEQ ID NO: 120109 - protein, 22 aa, Mycobacterium avium
FTVVALDRPGYGSSAPYPGAMT

SEQ ID NO: 120110 - protein, 26 aa, Mycobacterium avium
FTWEHDLHLYWRRAISLAASIGPANR

SEQ ID NO: 120111 - protein, 23 aa, Mycobacterium avium
FVAGLVAALREGAAPREAGRRAA

SEQ ID NO: 120112 - protein, 19 aa, Mycobacterium avium
FVCAPLRDRVLRELTDEAD

SEQ ID NO: 120113 - protein, 17 aa, Mycobacterium avium
FVDWSLIDALRGAPGAA

SEQ ID NO: 120114 - protein, 18 aa, Mycobacterium avium
FVEINASFYPKRPAGQKL

SEQ ID NO: 120115 - protein, 18 aa, Mycobacterium avium
FVGQLYDVFVEHQGLLLT

SEQ ID NO: 120116 - protein, 19 aa, Mycobacterium avium
FVHGLPLCAVSLALLHAGR

SEQ ID NO: 120117 - protein, 24 aa, Mycobacterium avium
FVHGYLMGGQLWRQVGDRLAGRGL

SEQ ID NO: 120118 - protein, 31 aa, Mycobacterium avium
FVIDVNLGRLAWLLRLFGFDVWWSNDADDQT

SEQ ID NO: 120119 - protein, 20 aa, Mycobacterium avium
FVMDHFYQLPMLGSPDQPML

SEQ ID NO: 120120 - protein, 19 aa, Mycobacterium avium
FVPELSADPLSWLAGQLAD

SEQ ID NO: 120121 - protein, 19 aa, Mycobacterium avium
FVTMHPGFGMRRLLDELCA

SEQ ID NO: 120122 - protein, 26 aa, Mycobacterium avium
FWDTEGYVLPVLTYTAPHTVADALRW

SEQ ID NO: 120123 - protein, 18 aa, Mycobacterium avium
FWFIVDRVKDMIVTGGFN

SEQ ID NO: 120124 - protein, 22 aa, Mycobacterium avium
FYALPQSPQLFKQLLMVAGMER

SEQ ID NO: 120125 - protein, 25 aa, Mycobacterium avium
FYDDPVMVWLFPDRRKRIARLSRVF

SEQ ID NO: 120126 - protein, 17 aa, Mycobacterium avium
FYRPAHQNVYDAILDLY

SEQ ID NO: 120127 - protein, 25 aa, Mycobacterium avium
FYTPRPIIRFIVQQVDPRLGEVILD

SEQ ID NO: 120128 - protein, 21 aa, Mycobacterium avium
GAAGLLLRAPQPDGTPAVLLQ

SEQ ID NO: 120129 - protein, 28 aa, Mycobacterium avium
GAAKATFLRWAWYAARREELHLDGADDD

SEQ ID NO: 120130 - protein, 29 aa, Mycobacterium avium
GAAMTAPRGLRPIARLMLSALIGRVAIPD

SEQ ID NO: 120131 - protein, 28 aa, Mycobacterium avium
GAARLSAFSVLLEMLGRPPLKSATREEQ

SEQ ID NO: 120132 - protein, 19 aa, Mycobacterium avium
GAAWWLREQGSPINTLAVP

SEQ ID NO: 120133 - protein, 29 aa, Mycobacterium avium
GAAYLFTNDYEWELLLSKTGWSEADVQQK

SEQ ID NO: 120134 - protein, 28 aa, Mycobacterium avium
GADLRRYLTRWIGPAIAYPQLLRAMDAL

SEQ ID NO: 120135 - protein, 24 aa, Mycobacterium avium
GADSGMLAALYVLAALGEQDRPLS

SEQ ID NO: 120136 - protein, 23 aa, Mycobacterium avium
GADWPRLVAPVFDPKKAVLFDDR

SEQ ID NO: 120137 - protein, 23 aa, Mycobacterium avium
GAEFLRPGPGWGGSCLPKDTAAL

SEQ ID NO: 120138 - protein, 22 aa, Mycobacterium avium
GAFEMAATVDYLFGYDATAGVM

SEQ ID NO: 120139 - protein, 19 aa, Mycobacterium avium
GAFGCFGMSRREALWAAGA

SEQ ID NO: 120140 - protein, 25 aa, Mycobacterium avium
GAFVNWEGRFRPFQAALRGSMTQAG

SEQ ID NO: 120141 - protein, 34 aa, Mycobacterium avium
GAGDFPGEPWAVPKFYWSVFATRPFEAAVQALTP

SEQ ID NO: 120142 - protein, 22 aa, Mycobacterium avium
GAGERALLPDALYTEAGADIGD

SEQ ID NO: 120143 - protein, 20 aa, Mycobacterium avium
GAGGWFHRADYPKMAMSDAA

SEQ ID NO: 120144 - protein, 24 aa, Mycobacterium avium
GAGLALALAGRRHRWLRRAGLLAA

SEQ ID NO: 120145 - protein, 17 aa, Mycobacterium avium
GAHLRNMAFYNFALRML

SEQ ID NO: 120146 - protein, 25 aa, Mycobacterium avium
GAIAVPLNFRLTAAEIAFLVQDCQA

SEQ ID NO: 120147 - protein, 23 aa, Mycobacterium avium
GAIRAQHRPPPPRRGRATGWQNT

SEQ ID NO: 120148 - protein, 22 aa, Mycobacterium avium
GAKRWHAIAEIIARGWDDVLGA

SEQ ID NO: 120149 - protein, 18 aa, Mycobacterium avium
GALALFGGWTGVDLAELD

SEQ ID NO: 120150 - protein, 18 aa, Mycobacterium avium
GALLLGGRLGPARTAAIC

SEQ ID NO: 120151 - protein, 25 aa, Mycobacterium avium
GAMVADAAVPRWGKPEEMAELLAFC

SEQ ID NO: 120152 - protein, 22 aa, Mycobacterium avium
GAPKQRAVLAMLLIHRNRPVSV

SEQ ID NO: 120153 - protein, 24 aa, Mycobacterium avium
GAPLAALHFFPADTLELGWIQSHV

SEQ ID NO: 120154 - protein, 17 aa, Mycobacterium avium
GAPLPTLADAVLPLGWT

SEQ ID NO: 120155 - protein, 20 aa, Mycobacterium avium
GAPSILARIIDRSGPLPASA

SEQ ID NO: 120156 - protein, 27 aa, Mycobacterium avium
GAPVRMVPRRVLLERLLDGFPTGRIHC

SEQ ID NO: 120157 - protein, 18 aa, Mycobacterium avium
GAPYLRYLNHKMKRDALV

SEQ ID NO: 120158 - protein, 17 aa, Mycobacterium avium
GAQGVRCNGVMPGLVMG

SEQ ID NO: 120159 - protein, 20 aa, Mycobacterium avium
GAQLLLWRTAFCEKLVGRGL

SEQ ID NO: 120160 - protein, 24 aa, Mycobacterium avium
GARIAFFFTRRKLAQMTGLETAGM

SEQ ID NO: 120161 - protein, 25 aa, Mycobacterium avium
GARKDTVMVLPKQKLAAVLSADNPG

SEQ ID NO: 120162 - protein, 24 aa, Mycobacterium avium
GARLPQRAWTSRAVLAVLGRAAGP

SEQ ID NO: 120163 - protein, 18 aa, Mycobacterium avium
GARLPRALAAAGVPVTAP

SEQ ID NO: 120164 - protein, 18 aa, Mycobacterium avium
GARLSAPLRAGPAPPPDQ

SEQ ID NO: 120165 - protein, 31 aa, Mycobacterium avium
GATPAQVALAWLLAKGPDIVPIPGTKRVARL

SEQ ID NO: 120166 - protein, 23 aa, Mycobacterium avium
GAVAATLLRLRRVRRHRALLRAA

SEQ ID NO: 120167 - protein, 17 aa, Mycobacterium avium
GAVALVGWSLGGAAAAG

SEQ ID NO: 120168 - protein, 20 aa, Mycobacterium avium
GAVFGKLPFTMEGIQLEVVG

SEQ ID NO: 120169 - protein, 18 aa, Mycobacterium avium
GAVPDWREPRVRGGGALW

SEQ ID NO: 120170 - protein, 18 aa, Mycobacterium avium
GAYRLIDFVLSNLVNARY

SEQ ID NO: 120171 - protein, 17 aa, Mycobacterium avium
GCALVGAQLPWSRIATD

SEQ ID NO: 120172 - protein, 31 aa, Mycobacterium avium
GCASSAWTLGFYALHNWMLSLFDPRAQREVF

SEQ ID NO: 120173 - protein, 26 aa, Mycobacterium avium
GCSTYKWETFLTSELPSYLASNKGVK

SEQ ID NO: 120174 - protein, 17 aa, Mycobacterium avium
GDARLPLRFISAAPIDA

SEQ ID NO: 120175 - protein, 27 aa, Mycobacterium avium
GDDTLFLERFVLRPRHIEVQILADTHG

SEQ ID NO: 120176 - protein, 18 aa, Mycobacterium avium
GDEWEAFLGKDEDLYVFS

SEQ ID NO: 120177 - protein, 44 aa, Mycobacterium avium
GDFLRTIHEMLLSDAFWDDIFRELSIPYLPIRWSTDNPDSIVDK

SEQ ID NO: 120178 - protein, 22 aa, Mycobacterium avium
GDIAALRRLPGQILGRVAFGVL

SEQ ID NO: 120179 - protein, 19 aa, Mycobacterium avium
GDIAYYLDKRQRGFDLCIY

SEQ ID NO: 120180 - protein, 19 aa, Mycobacterium avium
GDIQWNFEKFLISPDGEVV

SEQ ID NO: 120181 - protein, 21 aa, Mycobacterium avium
GDLANWMVPGKMVKGPGGAMD

SEQ ID NO: 120182 - protein, 27 aa, Mycobacterium avium
GDLLDAAAHRFADLGALAFAADAAAQA

SEQ ID NO: 120183 - protein, 36 aa, Mycobacterium avium
GDLPIRALISSPLLRCRRTLEPLADTLCLAPLVDDR

SEQ ID NO: 120184 - protein, 28 aa, Mycobacterium avium
GDNPHKIAMLGLTFDDVLLLPAASDVVP

SEQ ID NO: 120185 - protein, 20 aa, Mycobacterium avium
GDRFTPLSLKHRIFRKAVGS

SEQ ID NO: 120186 - protein, 19 aa, Mycobacterium avium
GDRGALEAGALPGLLPGGR

SEQ ID NO: 120187 - protein, 22 aa, Mycobacterium avium
GDSISAMRLIAAVNAALNADLP

SEQ ID NO: 120188 - protein, 29 aa, Mycobacterium avium
GDTAWLTRPLIDSYHTVWFELHEELIVAV

SEQ ID NO: 120189 - protein, 20 aa, Mycobacterium avium
GDTGMTYQVWQAQWNEAMES

SEQ ID NO: 120190 - protein, 24 aa, Mycobacterium avium
GDTQWSWAQYLRDAAARAAALLGA

SEQ ID NO: 120191 - protein, 26 aa, Mycobacterium avium
GDVFAGVLAANWPLEPGSPDQRRLAL

SEQ ID NO: 120192 - protein, 18 aa, Mycobacterium avium
GDYDIGIAIGLDKHPRGA

SEQ ID NO: 120193 - protein, 23 aa, Mycobacterium avium
GDYLEELLDLLDFDGDIDLDVEG

SEQ ID NO: 120194 - protein, 25 aa, Mycobacterium avium
GEAELDLVLAILRARQLFGGEQVLP

SEQ ID NO: 120195 - protein, 20 aa, Mycobacterium avium
GEAHRAILDVLAGGGGYFFR

SEQ ID NO: 120196 - protein, 26 aa, Mycobacterium avium
GEAVSVDLPLARLAYEGLAAGLGVPH

SEQ ID NO: 120197 - protein, 24 aa, Mycobacterium avium
GEDGVIAWLLSGPEHTYRVPLPEP

SEQ ID NO: 120198 - protein, 23 aa, Mycobacterium avium
GEELRLKYRYLDLRRDAPAAAIR

SEQ ID NO: 120199 - protein, 26 aa, Mycobacterium avium
GEENIRFVQALAASPIRYVLTRHEQA

SEQ ID NO: 120200 - protein, 18 aa, Mycobacterium avium
GEFRKLWISRINAAARAN

SEQ ID NO: 120201 - protein, 22 aa, Mycobacterium avium
GEGIAPPLAWSAPTGAALVVDD

SEQ ID NO: 120202 - protein, 26 aa, Mycobacterium avium
GEGTTVFFDYPPHPRTIAHTVRGFDE

SEQ ID NO: 120203 - protein, 20 aa, Mycobacterium avium
GEKTRLALAGLVASTANVLL

SEQ ID NO: 120204 - protein, 17 aa, Mycobacterium avium
GELLGCVSGALGLRKFF

SEQ ID NO: 120205 - protein, 23 aa, Mycobacterium avium
GELVLASAPLLDGKLPPDAAAWL

SEQ ID NO: 120206 - protein, 24 aa, Mycobacterium avium
GEPTWSYLYRTMITPLTDAGNRVL

SEQ ID NO: 120207 - protein, 19 aa, Mycobacterium avium
GEQAVFIERLRYLGELPLS

SEQ ID NO: 120208 - protein, 31 aa, Mycobacterium avium
GERILTWRQLYNLDALPDHLIVVGSGVTGAE

SEQ ID NO: 120209 - protein, 25 aa, Mycobacterium avium
GERKLYRARFLFFGSGYYNYDEGYT

SEQ ID NO: 120210 - protein, 29 aa, Mycobacterium avium
GERSSHTWFVLYELLGHRNVKNYDGSWTE

SEQ ID NO: 120211 - protein, 24 aa, Mycobacterium avium
GETASIFLPSVPNLLQLASELEAQ

SEQ ID NO: 120212 - protein, 20 aa, Mycobacterium avium
GETQWLPPPHLDRNQPRTNT

SEQ ID NO: 120213 - protein, 20 aa, Mycobacterium avium
GEVWLRNLYIPEYQHGSWTN

SEQ ID NO: 120214 - protein, 19 aa, Mycobacterium avium
GEVWPGKAYPLGASYDGAG

SEQ ID NO: 120215 - protein, 18 aa, Mycobacterium avium
GFELDDFHPLAPLHSCSL

SEQ ID NO: 120216 - protein, 25 aa, Mycobacterium avium
GFFDGEVPRRWRSPAPLWGDVSFES

SEQ ID NO: 120217 - protein, 25 aa, Mycobacterium avium
GFIGSPAMNLFTLPVVDSAVSLGDW

SEQ ID NO: 120218 - protein, 26 aa, Mycobacterium avium
GFKDLVISQYPWDMPLHSDELMRTSI

SEQ ID NO: 120219 - protein, 24 aa, Mycobacterium avium
GFLGRYLVLEWLEQLEQVDGKLIC

SEQ ID NO: 120220 - protein, 22 aa, Mycobacterium avium
GFRAFETLLRHDRPYAGYAPIM

SEQ ID NO: 120221 - protein, 26 aa, Mycobacterium avium
GFRLGITTDWKSRWYADKQYADYVKE

SEQ ID NO: 120222 - protein, 17 aa, Mycobacterium avium
GFRLVDLYSAPSMRELD

SEQ ID NO: 120223 - protein, 20 aa, Mycobacterium avium
GFSPILHFRGEETLLACDLA

SEQ ID NO: 120224 - protein, 17 aa, Mycobacterium avium
GFTLYHRHAGGTRQARV

SEQ ID NO: 120225 - protein, 24 aa, Mycobacterium avium
GFTQSYTYFTWRTAKWELTEFGND

SEQ ID NO: 120226 - protein, 17 aa, Mycobacterium avium
GFTVAPRVREAIERMAP

SEQ ID NO: 120227 - protein, 18 aa, Mycobacterium avium
GFVFPFTQNFVDRAVRGD

SEQ ID NO: 120228 - protein, 29 aa, Mycobacterium avium
GFVNDLELILTGVVFGFLTRFAQGEIEVT

SEQ ID NO: 120229 - protein, 17 aa, Mycobacterium avium
GFVWTELAGRRLAFVDV

SEQ ID NO: 120230 - protein, 17 aa, Mycobacterium avium
GFYSAYQLGLVNGELGI

SEQ ID NO: 120231 - protein, 18 aa, Mycobacterium avium
GGAAAMAGGFIYLGGGTP

SEQ ID NO: 120232 - protein, 24 aa, Mycobacterium avium
GGAAVELVWIIAQRAGLAVQPVSP

SEQ ID NO: 120233 - protein, 29 aa, Mycobacterium avium
GGAEVQWWFDLPWSTGFVRPQHPIETIRS

SEQ ID NO: 120234 - protein, 18 aa, Mycobacterium avium
GGAIALGHPLGASGAVLM

SEQ ID NO: 120235 - protein, 34 aa, Mycobacterium avium
GGARLTFRATVQVRVPIIGGKLENFIGARLAELI

SEQ ID NO: 120236 - protein, 21 aa, Mycobacterium avium
GGATLKAAWLAMIAVAATHLG

SEQ ID NO: 120237 - protein, 19 aa, Mycobacterium avium
GGCYLLPRRIGMQKAKEMA

SEQ ID NO: 120238 - protein, 28 aa, Mycobacterium avium
GGEPRDWFEVSLIPTTRELTTLGGAPVG

SEQ ID NO: 120239 - protein, 18 aa, Mycobacterium avium
GGFDALFLADVLGVYDIY

SEQ ID NO: 120240 - protein, 18 aa, Mycobacterium avium
GGGLGISYLAADDPPPMG

SEQ ID NO: 120241 - protein, 20 aa, Mycobacterium avium
GGGRLTYRQLWDRAARVAGG

SEQ ID NO: 120242 - protein, 23 aa, Mycobacterium avium
GGGSYFIHFAWDSSDPEQLSETE

SEQ ID NO: 120243 - protein, 18 aa, Mycobacterium avium
GGHGLHLFATLLSAAERA

SEQ ID NO: 120244 - protein, 17 aa, Mycobacterium avium
GGHLSVDLLLQPGVEHP

SEQ ID NO: 120245 - protein, 26 aa, Mycobacterium avium
GGKFPTARLVVFKLSGDFDPAQVIKH

SEQ ID NO: 120246 - protein, 24 aa, Mycobacterium avium
GGLLLATGKLPRVASAALALTVLP

SEQ ID NO: 120247 - protein, 28 aa, Mycobacterium avium
GGLPGDLKFTLVEPLRLLFKDEVRAVGR

SEQ ID NO: 120248 - protein, 24 aa, Mycobacterium avium
GGNHAFYLAIPPKSFPVVCEQLHK

SEQ ID NO: 120249 - protein, 19 aa, Mycobacterium avium
GGNLYGPGGVALPMRLALP

SEQ ID NO: 120250 - protein, 17 aa, Mycobacterium avium
GGNPFFLIQALHHVDES

SEQ ID NO: 120251 - protein, 27 aa, Mycobacterium avium
GGNPYQLSWWVNRFLEIFQTIGRDLEE

SEQ ID NO: 120252 - protein, 23 aa, Mycobacterium avium
GGPGNLLGGMPLAGAGAGGHGAA

SEQ ID NO: 120253 - protein, 32 aa, Mycobacterium avium
GGQLLVYGVDPLILRQAYPVPQAPYGLAGSRA

SEQ ID NO: 120254 - protein, 17 aa, Mycobacterium avium
GGRLSFALAERLHITRS

SEQ ID NO: 120255 - protein, 20 aa, Mycobacterium avium
GGRMMVTFGVGWLAREFELL

SEQ ID NO: 120256 - protein, 25 aa, Mycobacterium avium
GGRRPNGDHLIWHAMRCRRQYLILV

SEQ ID NO: 120257 - protein, 24 aa, Mycobacterium avium
GGRTEYLERFTVALDAAIGAGFIL

SEQ ID NO: 120258 - protein, 25 aa, Mycobacterium avium
GGRYGLAGILIQLARQRGVSSFAGD

SEQ ID NO: 120259 - protein, 25 aa, Mycobacterium avium
GGSPDTFPGLAGLGDLIVTCTSQRS

SEQ ID NO: 120260 - protein, 29 aa, Mycobacterium avium
GGSTVVYEPLLKRLPPDTPMYGFERVEGS

SEQ ID NO: 120261 - protein, 17 aa, Mycobacterium avium
GGSWDAGAAWPPILAAA

SEQ ID NO: 120262 - protein, 25 aa, Mycobacterium avium
GGTGLLDLLNRLGITPLPNTAGCRG

SEQ ID NO: 120263 - protein, 17 aa, Mycobacterium avium
GGTLPSFPLPLGDPSVP

SEQ ID NO: 120264 - protein, 20 aa, Mycobacterium avium
GGVPIHRAIVARLRQATAAD

SEQ ID NO: 120265 - protein, 27 aa, Mycobacterium avium
GGVRPDPLPWHPLGMAIDVMIPDPESA

SEQ ID NO: 120266 - protein, 26 aa, Mycobacterium avium
GGYFCRGLRRDFDRLGLPGWAWSDVL

SEQ ID NO: 120267 - protein, 19 aa, Mycobacterium avium
GGYGYMREYPVARAYLDAR

SEQ ID NO: 120268 - protein, 19 aa, Mycobacterium avium
GGYRKKYLRAMSRLLALTA

SEQ ID NO: 120269 - protein, 20 aa, Mycobacterium avium
GGYTYGGRIAALADAARENG

SEQ ID NO: 120270 - protein, 26 aa, Mycobacterium avium
GHAAPPRFDPAIWPVTAHPDEEGRLC

SEQ ID NO: 120271 - protein, 23 aa, Mycobacterium avium
GHDFTYRFSVPNPGTYWAHPHTG

SEQ ID NO: 120272 - protein, 26 aa, Mycobacterium avium
GHDQLFDTLFVYENYPIDSGMTLGAD

SEQ ID NO: 120273 - protein, 22 aa, Mycobacterium avium
GHERTMMWLGFADRLENMIADF

SEQ ID NO: 120274 - protein, 19 aa, Mycobacterium avium
GHFALTNLLLPKLTDRVVT

SEQ ID NO: 120275 - protein, 27 aa, Mycobacterium avium
GHHCAQPALRRLGLEATVRPSFAFYNT

SEQ ID NO: 120276 - protein, 19 aa, Mycobacterium avium
GHLDPTVFQRLAPGIMPLS

SEQ ID NO: 120277 - protein, 18 aa, Mycobacterium avium
GHPGAQFELVKLPALDAP

SEQ ID NO: 120278 - protein, 23 aa, Mycobacterium avium
GHPVLLESFLDGPEVSLFCIVDG

SEQ ID NO: 120279 - protein, 19 aa, Mycobacterium avium
GHRRPFVGSLTLGLPTGVD

SEQ ID NO: 120280 - protein, 26 aa, Mycobacterium avium
GHRYRELSYWTELARTLEAGGFDALF

SEQ ID NO: 120281 - protein, 21 aa, Mycobacterium avium
GIALLSRYPVASWQVLRLPRI

SEQ ID NO: 120282 - protein, 18 aa, Mycobacterium avium
GICFGNQILGRALGLSTY

SEQ ID NO: 120283 - protein, 19 aa, Mycobacterium avium
GICIDLFHCWAEGDFEAQL

SEQ ID NO: 120284 - protein, 27 aa, Mycobacterium avium
GIDAPRQNPWWWDVLRNGHSSPYATFF

SEQ ID NO: 120285 - protein, 25 aa, Mycobacterium avium
GIELADLVVLLDHFGIKSEMVSATE

SEQ ID NO: 120286 - protein, 23 aa, Mycobacterium avium
GIGREMHVIVGQGKLDEILQSRP

SEQ ID NO: 120287 - protein, 21 aa, Mycobacterium avium
GIKAFFTAFSSHRALARAATE

SEQ ID NO: 120288 - protein, 31 aa, Mycobacterium avium
GILSGVYLTLISPLGRFLLAAAIREAHTKTD

SEQ ID NO: 120289 - protein, 25 aa, Mycobacterium avium
GIPAVTFWAAVPHYVSQPPNPKATV

SEQ ID NO: 120290 - protein, 17 aa, Mycobacterium avium
GISAELIAAKWGFSRTQ

SEQ ID NO: 120291 - protein, 26 aa, Mycobacterium avium
GISISTYFRYAPTKEGLLVDPAREVA

SEQ ID NO: 120292 - protein, 17 aa, Mycobacterium avium
GIVLITARDGLPDRLRG

SEQ ID NO: 120293 - protein, 21 aa, Mycobacterium avium
GIWMRPEAVPGFRRLTDAIHA

SEQ ID NO: 120294 - protein, 22 aa, Mycobacterium avium
GKAALYRRWDTKCELVHAALVF

SEQ ID NO: 120295 - protein, 18 aa, Mycobacterium avium
GKELLRRLKGLPGFGEQK

SEQ ID NO: 120296 - protein, 20 aa, Mycobacterium avium
GKGWTMVPGSFRGAGDAPTQ

SEQ ID NO: 120297 - protein, 23 aa, Mycobacterium avium
GKLAPRPFVLVGQQYLADPSRSA

SEQ ID NO: 120298 - protein, 21 aa, Mycobacterium avium
GKLRPPVFGILRYLADAVDEI

SEQ ID NO: 120299 - protein, 27 aa, Mycobacterium avium
GKRIRQPVPLTLSVRPPVLTPAAPPAR

SEQ ID NO: 120300 - protein, 38 aa, Mycobacterium avium
GKSARVEFWAFDLLYLDGRSLLRARYRDRRKLLEMLAS

SEQ ID NO: 120301 - protein, 20 aa, Mycobacterium avium
GKSTLLHLLGALDSPDSGSI

SEQ ID NO: 120302 - protein, 19 aa, Mycobacterium avium
GKVSRVLLTSGKLYYELVA

SEQ ID NO: 120303 - protein, 34 aa, Mycobacterium avium
GLAAHRRAHGLPAISLGWGLWDQASAMTGGLGAA

SEQ ID NO: 120304 - protein, 18 aa, Mycobacterium avium
GLAAVQERIGYWGEHRYE

SEQ ID NO: 120305 - protein, 26 aa, Mycobacterium avium
GLALSPTLIFDYPNSAALAGYMYREL

SEQ ID NO: 120306 - protein, 23 aa, Mycobacterium avium
GLASTDQLYFASGLLDCPGAMFT

SEQ ID NO: 120307 - protein, 18 aa, Mycobacterium avium
GLATVRDLAFRASPVAQI

SEQ ID NO: 120308 - protein, 24 aa, Mycobacterium avium
GLAVQPVSPVFLYAHTRTEFEELS

SEQ ID NO: 120309 - protein, 24 aa, Mycobacterium avium
GLDAPYSYWGFGGADPGAYRRAEA

SEQ ID NO: 120310 - protein, 18 aa, Mycobacterium avium
GLDLLPQLVFRDGELDAG

SEQ ID NO: 120311 - protein, 17 aa, Mycobacterium avium
GLDPGCPFAPRCPLAID

SEQ ID NO: 120312 - protein, 24 aa, Mycobacterium avium
GLDRGWYVRPTLFAAAGNAMRIAR

SEQ ID NO: 120313 - protein, 22 aa, Mycobacterium avium
GLDSRAYRLDWPAATTIFELDQ

SEQ ID NO: 120314 - protein, 21 aa, Mycobacterium avium
GLDVLVHAAGLWQPGIPGCIG

SEQ ID NO: 120315 - protein, 21 aa, Mycobacterium avium
GLELVECSEFFKDTTFRVFQA

SEQ ID NO: 120316 - protein, 20 aa, Mycobacterium avium
GLESDLIAIFLDAPASVVGM

SEQ ID NO: 120317 - protein, 20 aa, Mycobacterium avium
GLEWDAVFLVGLADGTLPIS

SEQ ID NO: 120318 - protein, 17 aa, Mycobacterium avium
GLFAVNGILFNHESPRR

SEQ ID NO: 120319 - protein, 17 aa, Mycobacterium avium
GLFITLPGIRELPDRAT

SEQ ID NO: 120320 - protein, 19 aa, Mycobacterium avium
GLGILLDRGYPIVCGVPTQ

SEQ ID NO: 120321 - protein, 20 aa, Mycobacterium avium
GLHLFATLLSAAERAGAGPL

SEQ ID NO: 120322 - protein, 20 aa, Mycobacterium avium
GLHNDIVAPYLLALATEEQK

SEQ ID NO: 120323 - protein, 20 aa, Mycobacterium avium
GLIADRLLPGGVLHVATDHA

SEQ ID NO: 120324 - protein, 24 aa, Mycobacterium avium
GLIDDFMVMVRPLSGATALSEAMG

SEQ ID NO: 120325 - protein, 19 aa, Mycobacterium avium
GLITNMRGYWNLDMMQFGQ

SEQ ID NO: 120326 - protein, 17 aa, Mycobacterium avium
GLLLTRRSENATVTLCH

SEQ ID NO: 120327 - protein, 18 aa, Mycobacterium avium
GLLVADLSSMWAGPLCGQ

SEQ ID NO: 120328 - protein, 18 aa, Mycobacterium avium
GLMFSGMPNFAITFGYTN

SEQ ID NO: 120329 - protein, 23 aa, Mycobacterium avium
GLNLLYQAYLRVCGRRLSTDEKE

SEQ ID NO: 120330 - protein, 23 aa, Mycobacterium avium
GLNLSIRDGWWDEWYDGENGWEI

SEQ ID NO: 120331 - protein, 23 aa, Mycobacterium avium
GLPQWYGDQGMFLTTHYFGTKIM

SEQ ID NO: 120332 - protein, 28 aa, Mycobacterium avium
GLRKVARFLPRGYALHRGLKLQRAIMNL

SEQ ID NO: 120333 - protein, 26 aa, Mycobacterium avium
GLRSLLAYQWAHPGKQLLFMGQEFGQ

SEQ ID NO: 120334 - protein, 17 aa, Mycobacterium avium
GLSPDVPFAYLMVLHVP

SEQ ID NO: 120335 - protein, 27 aa, Mycobacterium avium
GLVDRALIAAYAGGLVPILCLTKTDLA

SEQ ID NO: 120336 - protein, 19 aa, Mycobacterium avium
GLWLSRQIVARIMGTFGPS

SEQ ID NO: 120337 - protein, 18 aa, Mycobacterium avium
GMIWRYPDYFVVGREQLR

SEQ ID NO: 120338 - protein, 18 aa, Mycobacterium avium
GMLHWPDSGNGPAQFHCE

SEQ ID NO: 120339 - protein, 25 aa, Mycobacterium avium
GMLNRIKWTVVRYKPPEGMTLNGDG

SEQ ID NO: 120340 - protein, 31 aa, Mycobacterium avium
GMRDIRKHIAWYLHGFPAGSELRRALAMVKT

SEQ ID NO: 120341 - protein, 28 aa, Mycobacterium avium
GMSPIGRRLMQLPLALTVQACEAAIADA

SEQ ID NO: 120342 - protein, 17 aa, Mycobacterium avium
GMSQLRGWLTPEARATI

SEQ ID NO: 120343 - protein, 17 aa, Mycobacterium avium
GMTAWDLYGGAGVFAAA

SEQ ID NO: 120344 - protein, 30 aa, Mycobacterium avium
GMVRCVRAALPLLRKAQWARIVNFSAHSTQ

SEQ ID NO: 120345 - protein, 26 aa, Mycobacterium avium
GNEVQLFEQAFARRLPVMLTGPTGCG

SEQ ID NO: 120346 - protein, 18 aa, Mycobacterium avium
GNGTCYWKRMGNPDGAVI

SEQ ID NO: 120347 - protein, 29 aa, Mycobacterium avium
GNLAAAMQGLVALPLLAGYDIDAPDPEGA

SEQ ID NO: 120348 - protein, 23 aa, Mycobacterium avium
GNLALMPLSLYFSEGKVKVELAL

SEQ ID NO: 120349 - protein, 17 aa, Mycobacterium avium
GNLDIADWWAYLDDVQS

SEQ ID NO: 120350 - protein, 25 aa, Mycobacterium avium
GNPHPALLPLAAAAPARPASGRAVL

SEQ ID NO: 120351 - protein, 29 aa, Mycobacterium avium
GNPLTWDDLPWLRSLTDLPLIIKGICHPD

SEQ ID NO: 120352 - protein, 35 aa, Mycobacterium avium
GNVSPIGMPLAHLGFFVLDGWLRPVPAGVTGELYI

SEQ ID NO: 120353 - protein, 21 aa, Mycobacterium avium
GNWTGIPVFKLTEAETTRLLR

SEQ ID NO: 120354 - protein, 23 aa, Mycobacterium avium
GPADIPLLVADLAYVRGMVHRQL

SEQ ID NO: 120355 - protein, 23 aa, Mycobacterium avium
GPAFQGTIKSAVAFGALLSRGIG

SEQ ID NO: 120356 - protein, 20 aa, Mycobacterium avium
GPALLLGARGRRLDVRQART

SEQ ID NO: 120357 - protein, 22 aa, Mycobacterium avium
GPAPWKPMVSLSGPTSLPIEFD

SEQ ID NO: 120358 - protein, 19 aa, Mycobacterium avium
GPARTWREHSMAAMKPRTG

SEQ ID NO: 120359 - protein, 17 aa, Mycobacterium avium
GPDAWIVIEKILAVDEA

SEQ ID NO: 120360 - protein, 26 aa, Mycobacterium avium
GPDRPIELRLLEIEPALKALEGVVME

SEQ ID NO: 120361 - protein, 20 aa, Mycobacterium avium
GPDYPFALITGRTIYHFHTR

SEQ ID NO: 120362 - protein, 25 aa, Mycobacterium avium
GPEHTYRVPLPEPGEPKRAILDSYT

SEQ ID NO: 120363 - protein, 19 aa, Mycobacterium avium
GPEMTVLVGGLRALGANHG

SEQ ID NO: 120364 - protein, 29 aa, Mycobacterium avium
GPFALGCFAGWLFTEFPPHVLTGHALSRV

SEQ ID NO: 120365 - protein, 18 aa, Mycobacterium avium
GPFGARPGFGFGFGPGRV

SEQ ID NO: 120366 - protein, 26 aa, Mycobacterium avium
GPGGVALPMRLALPGAVNRGNAAQAV

SEQ ID NO: 120367 - protein, 22 aa, Mycobacterium avium
GPIEALPIAAFSMMRAMSTRND

SEQ ID NO: 120368 - protein, 27 aa, Mycobacterium avium
GPLAEQPAVRALLTVLLATADGLDGQR

SEQ ID NO: 120369 - protein, 26 aa, Mycobacterium avium
GPMRWTCVEPLKKWRLDVGPNNSGIE

SEQ ID NO: 120370 - protein, 21 aa, Mycobacterium avium
GPNVDLPVPAGWQLNQNSGTS

SEQ ID NO: 120371 - protein, 20 aa, Mycobacterium avium
GPPICAQVLLYPGLDRDMSV

SEQ ID NO: 120372 - protein, 44 aa, Mycobacterium avium
GPSLTRGLDGLATYPWPASTVRNWFRGDYANLTLIVDLTLSRID

SEQ ID NO: 120373 - protein, 18 aa, Mycobacterium avium
GPSYQHPPAYDLAGRRGG

SEQ ID NO: 120374 - protein, 25 aa, Mycobacterium avium
GPTALLAPEWVPWEQRVRPGDLSPG

SEQ ID NO: 120375 - protein, 26 aa, Mycobacterium avium
GPVGHFGLFFLGFGDQQFLSTVGTGQ

SEQ ID NO: 120376 - protein, 18 aa, Mycobacterium avium
GPVMLSRAHWLEDVGLIP

SEQ ID NO: 120377 - protein, 26 aa, Mycobacterium avium
GPVNTPLLQELFAKDPQRAARRLVHV

SEQ ID NO: 120378 - protein, 23 aa, Mycobacterium avium
GPVPPTPIMRWLQAAERAGGATD

SEQ ID NO: 120379 - protein, 25 aa, Mycobacterium avium
GPVQATPIMRWLQTVQGPIDDFNQT

SEQ ID NO: 120380 - protein, 26 aa, Mycobacterium avium
GPVSRFLGPWVPEPQLWQDPVPPVDH

SEQ ID NO: 120381 - protein, 28 aa, Mycobacterium avium
GQAGIALSTYRFPTGWFIVAFGSDLAPG

SEQ ID NO: 120382 - protein, 29 aa, Mycobacterium avium
GQAYEDLAWFCIRAWRFGAPAGLGAGGLG

SEQ ID NO: 120383 - protein, 23 aa, Mycobacterium avium
GQDWGGLIGLRLAAEHPERFARM

SEQ ID NO: 120384 - protein, 24 aa, Mycobacterium avium
GQEIEFEHVIARLVELAYSRVDMV

SEQ ID NO: 120385 - protein, 25 aa, Mycobacterium avium
GQGKTRLLRALVGLLDEWTPVIAGA

SEQ ID NO: 120386 - protein, 18 aa, Mycobacterium avium
GQHWLDVCAMLGLPEFGE

SEQ ID NO: 120387 - protein, 20 aa, Mycobacterium avium
GQLSLLLRRTIDPDRPLSDY

SEQ ID NO: 120388 - protein, 25 aa, Mycobacterium avium
GQMFKFVLFQTGHDEFYLFGCCHHI

SEQ ID NO: 120389 - protein, 25 aa, Mycobacterium avium
GQNARLAARLTGWRIDIRGDSPGGA

SEQ ID NO: 120390 - protein, 23 aa, Mycobacterium avium
GQPAPDWFPLLGGHEGAGVVAEV

SEQ ID NO: 120391 - protein, 17 aa, Mycobacterium avium
GQRLGSLLVNPGGPGGS

SEQ ID NO: 120392 - protein, 24 aa, Mycobacterium avium
GQTLERLLPVPPTATQLHTGVAVL

SEQ ID NO: 120393 - protein, 23 aa, Mycobacterium avium
GQVRVALRAIATNFRDVMITLGM

SEQ ID NO: 120394 - protein, 20 aa, Mycobacterium avium
GQWWQQQVVLGLQRGGSPPQ

SEQ ID NO: 120395 - protein, 17 aa, Mycobacterium avium
GRADLLRSLDFTRGLAG

SEQ ID NO: 120396 - protein, 22 aa, Mycobacterium avium
GRAEIRAIFRSSKVGIIAGCMI

SEQ ID NO: 120397 - protein, 23 aa, Mycobacterium avium
GRALLEELLQRATVPERVYRHGW

SEQ ID NO: 120398 - protein, 19 aa, Mycobacterium avium
GRAVFTPSLAGLVLGEYRR

SEQ ID NO: 120399 - protein, 24 aa, Mycobacterium avium
GRDIPLRLVYVIDPHGAPGGHGPD

SEQ ID NO: 120400 - protein, 23 aa, Mycobacterium avium
GRDKCRVPMPWSGQAPPFGFSSR

SEQ ID NO: 120401 - protein, 20 aa, Mycobacterium avium
GRFQWVVFTSTNAVRAVWEK

SEQ ID NO: 120402 - protein, 20 aa, Mycobacterium avium
GRGLLVLLDALRTTITGQAP

SEQ ID NO: 120403 - protein, 23 aa, Mycobacterium avium
GRGPVATVLIQRGTLRVGDSIVA

SEQ ID NO: 120404 - protein, 27 aa, Mycobacterium avium
GRGSTWTRQLPWLTRLGTVYSYDAPWH

SEQ ID NO: 120405 - protein, 27 aa, Mycobacterium avium
GRKAIAASYVPLFRKLLRNTRLEVDVT

SEQ ID NO: 120406 - protein, 20 aa, Mycobacterium avium
GRLADKQGIQWMLVDSEVDL

SEQ ID NO: 120407 - protein, 25 aa, Mycobacterium avium
GRLTAHLPSARRLLLFKADGSVSVH

SEQ ID NO: 120408 - protein, 25 aa, Mycobacterium avium
GRNQSGLVVLLTFGTGIGSAVIHNG

SEQ ID NO: 120409 - protein, 22 aa, Mycobacterium avium
GRPSRVLLAGHLDTVPVAGNLP

SEQ ID NO: 120410 - protein, 19 aa, Mycobacterium avium
GRQLSLPVPGLVLADVLGG

SEQ ID NO: 120411 - protein, 24 aa, Mycobacterium avium
GRRGPGGGLPITYSRKVFIPVTHL

SEQ ID NO: 120412 - protein, 17 aa, Mycobacterium avium
GRRPGAMVTLRTTVPSP

SEQ ID NO: 120413 - protein, 23 aa, Mycobacterium avium
GRRRARGRRRASGHLTRLADVLI

SEQ ID NO: 120414 - protein, 25 aa, Mycobacterium avium
GRRWRVPVTAFWQAHRDAAATYRAL

SEQ ID NO: 120415 - protein, 24 aa, Mycobacterium avium
GRSGRLRWRWLAGCDARPVDSAGH

SEQ ID NO: 120416 - protein, 24 aa, Mycobacterium avium
GRSHAWIEAWTGAWWSYDPTNDAE

SEQ ID NO: 120417 - protein, 24 aa, Mycobacterium avium
GRSPLLERTFDWLEAHWPAAADAA

SEQ ID NO: 120418 - protein, 23 aa, Mycobacterium avium
GRVAGVHFLMKKNKITEIHGYGR

SEQ ID NO: 120419 - protein, 20 aa, Mycobacterium avium
GRYFSVPGPFLCEPSPQRTP

SEQ ID NO: 120420 - protein, 25 aa, Mycobacterium avium
GRYNHGELLGLIRRHATGGPPEIQI

SEQ ID NO: 120421 - protein, 20 aa, Mycobacterium avium
GRYRDLLVPDGGGWLIQHRA

SEQ ID NO: 120422 - protein, 25 aa, Mycobacterium avium
GRYRLVVARACPWANRAIIVRRLLG

SEQ ID NO: 120423 - protein, 25 aa, Mycobacterium avium
GRYSYQLTIYVFRYGEGTAMAMMYP

SEQ ID NO: 120424 - protein, 25 aa, Mycobacterium avium
GSAPDPTLPPLPLAGVRIVDLTAFW

SEQ ID NO: 120425 - protein, 20 aa, Mycobacterium avium
GSDHQLAFVNALCSSLLSTR

SEQ ID NO: 120426 - protein, 26 aa, Mycobacterium avium
GSDPLYMLTGVIPATEKVLSKAGLTL

SEQ ID NO: 120427 - protein, 21 aa, Mycobacterium avium
GSFRAPQFTVAWPTGEIGGMG

SEQ ID NO: 120428 - protein, 21 aa, Mycobacterium avium
GSGFDWDGWLQALGATPDAVA

SEQ ID NO: 120429 - protein, 23 aa, Mycobacterium avium
GSHRLGHACVLAFLDVDGLKQVN

SEQ ID NO: 120430 - protein, 26 aa, Mycobacterium avium
GSIGFAVAFCYARFVRRGRKAPGFFV

SEQ ID NO: 120431 - protein, 22 aa, Mycobacterium avium
GSIYAFECPLLLGTTAVLMDRW

SEQ ID NO: 120432 - protein, 24 aa, Mycobacterium avium
GSLDILLAAYSLAATLWQVANPPE

SEQ ID NO: 120433 - protein, 17 aa, Mycobacterium avium
GSLLVNPGGPGGSAVDM

SEQ ID NO: 120434 - protein, 23 aa, Mycobacterium avium
GSLRLSDYPLIPARVDTWAGLVF

SEQ ID NO: 120435 - protein, 23 aa, Mycobacterium avium
GSPPAELAWVEPLLEATTTLQVA

SEQ ID NO: 120436 - protein, 27 aa, Mycobacterium avium
GSPPRRVALLQAFLVRRMRRNAVWPPA

SEQ ID NO: 120437 - protein, 27 aa, Mycobacterium avium
GSPVPGAALFVLDKWLRPAPEGVVGEL

SEQ ID NO: 120438 - protein, 28 aa, Mycobacterium avium
GSPYQVFTPFLRRWRDTGWRPPAKTGAA

SEQ ID NO: 120439 - protein, 24 aa, Mycobacterium avium
GSRFLVFMQRYTPAALFISSPDQG

SEQ ID NO: 120440 - protein, 19 aa, Mycobacterium avium
GSRLLTFQLYDQQANVPLG

SEQ ID NO: 120441 - protein, 22 aa, Mycobacterium avium
GSRVPLAGMALPVVSAKTVRIN

SEQ ID NO: 120442 - protein, 25 aa, Mycobacterium avium
GSSSAPLQTVGWTAAAPQAGVGTVV

SEQ ID NO: 120443 - protein, 27 aa, Mycobacterium avium
GSTWLLARLVGLARARRMLLLGEKVGG

SEQ ID NO: 120444 - protein, 22 aa, Mycobacterium avium
GSVPQRLWAKPAITVIGIDATP

SEQ ID NO: 120445 - protein, 29 aa, Mycobacterium avium
GSWASIVPHTWLWASPLGPGIRAVELVDP

SEQ ID NO: 120446 - protein, 17 aa, Mycobacterium avium
GSYALWAYGAPEPSHDA

SEQ ID NO: 120447 - protein, 34 aa, Mycobacterium avium
GSYRGAELLGTRYLPPFPYFMDSPNAFRVLAGEF

SEQ ID NO: 120448 - protein, 27 aa, Mycobacterium avium
GTALLCPFDPLIFFRPRVERLFEFHYR

SEQ ID NO: 120449 - protein, 18 aa, Mycobacterium avium
GTAWAYQQFGVQPDVVAF

SEQ ID NO: 120450 - protein, 23 aa, Mycobacterium avium
GTDHCDWIILGAMLGDEQGVPLM

SEQ ID NO: 120451 - protein, 27 aa, Mycobacterium avium
GTDRRGKYLWLLLDGRDTALVVHLGMS

SEQ ID NO: 120452 - protein, 24 aa, Mycobacterium avium
GTEPRKIFDLLEQAPIGVAVVTNA

SEQ ID NO: 120453 - protein, 24 aa, Mycobacterium avium
GTERILFTHIAVPVMTRLKQPERQ

SEQ ID NO: 120454 - protein, 23 aa, Mycobacterium avium
GTGAPLFCIHPASGLSWPYHALG

SEQ ID NO: 120455 - protein, 25 aa, Mycobacterium avium
GTGPMPLLPNGRWLYEHGQPRRLAQ

SEQ ID NO: 120456 - protein, 27 aa, Mycobacterium avium
GTKDKNYNLIWFTEKCLDNALRLETYI

SEQ ID NO: 120457 - protein, 28 aa, Mycobacterium avium
GTKGLSLFYVPKYLFDPETFELGPRNGV

SEQ ID NO: 120458 - protein, 24 aa, Mycobacterium avium
GTPEPALPALRRLLDSPRHEVIAV

SEQ ID NO: 120459 - protein, 20 aa, Mycobacterium avium
GTPFFVMDYVDGLVPPDVMP

SEQ ID NO: 120460 - protein, 24 aa, Mycobacterium avium
GTPTYTYVGALLGLTPPTTVPMPS

SEQ ID NO: 120461 - protein, 37 aa, Mycobacterium avium
GTRRDWVRRTLLAAPPPWIDVFIARNFHYLTELHCPA

SEQ ID NO: 120462 - protein, 17 aa, Mycobacterium avium
GTTWQNTFGILADIGRF

SEQ ID NO: 120463 - protein, 18 aa, Mycobacterium avium
GTVGLIADRLLPGGVLHV

SEQ ID NO: 120464 - protein, 20 aa, Mycobacterium avium
GTYAINWYAFDPCCPFGGYK

SEQ ID NO: 120465 - protein, 33 aa, Mycobacterium avium
GVACGYWRRGGLTASWFVACPFGAPGARMYRTG

SEQ ID NO: 120466 - protein, 17 aa, Mycobacterium avium
GVAEFRRSLDRVMPRDK

SEQ ID NO: 120467 - protein, 41 aa, Mycobacterium avium
GVARNRYLIYTSPDIRALYAFKRLAWWPYSVAMRQVNVIFT

SEQ ID NO: 120468 - protein, 24 aa, Mycobacterium avium
GVDDFGMGLLLKGRQVKKVIASYV

SEQ ID NO: 120469 - protein, 26 aa, Mycobacterium avium
GVDLDLPRDALIVFTGLSGSGKSSLA

SEQ ID NO: 120470 - protein, 25 aa, Mycobacterium avium
GVDTRIRFLPPDSWGNHEWDTMTAM

SEQ ID NO: 120471 - protein, 23 aa, Mycobacterium avium
GVEHTWLGFVDSGLPKGDPPPPL

SEQ ID NO: 120472 - protein, 17 aa, Mycobacterium avium
GVFPILGMDWRDSEAKG

SEQ ID NO: 120473 - protein, 18 aa, Mycobacterium avium
GVIGFTRNLAHEVALRGV

SEQ ID NO: 120474 - protein, 22 aa, Mycobacterium avium
GVKAWKGIRYAAPPIGDLRFRA

SEQ ID NO: 120475 - protein, 27 aa, Mycobacterium avium
GVKYQWPQGTYLAWLDCRELGFAEDAA

SEQ ID NO: 120476 - protein, 25 aa, Mycobacterium avium
GVLPLLERMGLWRHPNRRSRPAATT

SEQ ID NO: 120477 - protein, 19 aa, Mycobacterium avium
GVPITFGRPVWRVDLFGST

SEQ ID NO: 120478 - protein, 19 aa, Mycobacterium avium
GVPLKDRRAERRALLVEAA

SEQ ID NO: 120479 - protein, 22 aa, Mycobacterium avium
GVPLVAVGLYYRSGYFRQSLTA

SEQ ID NO: 120480 - protein, 18 aa, Mycobacterium avium
GVPWSQMAVIVRSVPRAG

SEQ ID NO: 120481 - protein, 25 aa, Mycobacterium avium
GVQRVFYGWAQVWRTKSREAEAIRR

SEQ ID NO: 120482 - protein, 28 aa, Mycobacterium avium
GVRDWGRAFAWMGMPDEYFASSGNAPIA

SEQ ID NO: 120483 - protein, 17 aa, Mycobacterium avium
GVRHTIEWYSAAHGFAV

SEQ ID NO: 120484 - protein, 25 aa, Mycobacterium avium
GVRPARYRFLTRNRLVAAMAGATVV

SEQ ID NO: 120485 - protein, 27 aa, Mycobacterium avium
GVRSRLMLDIASWRRRRREELAALGDK

SEQ ID NO: 120486 - protein, 20 aa, Mycobacterium avium
GVRVGLSVCYDIRFPELYTE

SEQ ID NO: 120487 - protein, 18 aa, Mycobacterium avium
GVRYGLLSAWRGPNGQDL

SEQ ID NO: 120488 - protein, 24 aa, Mycobacterium avium
GVTWGVIQYHFGDRNGLLMAVVDD

SEQ ID NO: 120489 - protein, 33 aa, Mycobacterium avium
GVVGAITPWNSPLLLLTWKLAAGLAAGCTFVVK

SEQ ID NO: 120490 - protein, 32 aa, Mycobacterium avium
GWDKPSFAKELFLGRFPLELIHPFPQPSDADE

SEQ ID NO: 120491 - protein, 19 aa, Mycobacterium avium
GWELTRVRLYTDGSRRVLL

SEQ ID NO: 120492 - protein, 19 aa, Mycobacterium avium
GWLEGYLLTGRHGLFNCYE

SEQ ID NO: 120493 - protein, 25 aa, Mycobacterium avium
GWLKDRFGLSWQIVPDRLFELIGDP

SEQ ID NO: 120494 - protein, 33 aa, Mycobacterium avium
GWRDNPQRVWGWYLWRHYLVADVAPNAGHRAIA

SEQ ID NO: 120495 - protein, 24 aa, Mycobacterium avium
GWRNFRGILPAFAAHYRCLVLEFP

SEQ ID NO: 120496 - protein, 18 aa, Mycobacterium avium
GWSAGRIINLDIGGGSLE

SEQ ID NO: 120497 - protein, 27 aa, Mycobacterium avium
GYALPSMLLPLWDSEVGAAFIATLRSI

SEQ ID NO: 120498 - protein, 18 aa, Mycobacterium avium
GYETPLLLNVPSFAICCA

SEQ ID NO: 120499 - protein, 24 aa, Mycobacterium avium
GYFHVELMSIRRSATKLKFLAASE

SEQ ID NO: 120500 - protein, 26 aa, Mycobacterium avium
GYIDVKGLRLTLTQAAWRVSEDLPAE

SEQ ID NO: 120501 - protein, 18 aa, Mycobacterium avium
GYRDPGALGGYRTYTPAL

SEQ ID NO: 120502 - protein, 24 aa, Mycobacterium avium
GYRNPVDPDPFADPGWFLTDDLGA

SEQ ID NO: 120503 - protein, 25 aa, Mycobacterium avium
GYRRPAPHEFIPFSAGLHRCVGAAM

SEQ ID NO: 120504 - protein, 23 aa, Mycobacterium avium
GYRSLREVVLPLGRLSVITGANG

SEQ ID NO: 120505 - protein, 25 aa, Mycobacterium avium
GYVDATYWRDMGTPEDFVRGSADLV

SEQ ID NO: 120506 - protein, 27 aa, Mycobacterium avium
HAAFVHAHPRWIAQAFADALGAAAAEL

SEQ ID NO: 120507 - protein, 17 aa, Mycobacterium avium
HAAGLWQPGIPGCIGAD

SEQ ID NO: 120508 - protein, 24 aa, Mycobacterium avium
HAASAFALWFPIEGEVDYGQAKIE

SEQ ID NO: 120509 - protein, 23 aa, Mycobacterium avium
HADAASWLLIGTTATADVLASTL

SEQ ID NO: 120510 - protein, 26 aa, Mycobacterium avium
HADAPALPVLPWMVSAKSAAALRAQA

SEQ ID NO: 120511 - protein, 26 aa, Mycobacterium avium
HADAPALPVLPWVVSAKSAAALRAQA

SEQ ID NO: 120512 - protein, 17 aa, Mycobacterium avium
HADVAWLGQSKLTTTPG

SEQ ID NO: 120513 - protein, 19 aa, Mycobacterium avium
HAFYLQYKNVKADYVKAFW

SEQ ID NO: 120514 - protein, 26 aa, Mycobacterium avium
HAHVLMARHMFTLWAPERAGVTDAVA

SEQ ID NO: 120515 - protein, 33 aa, Mycobacterium avium
HAIWGHRVNHWLWRRGARLAARICAEITRILTG

SEQ ID NO: 120516 - protein, 17 aa, Mycobacterium avium
HAKALRMFAVLPTIVAA

SEQ ID NO: 120517 - protein, 22 aa, Mycobacterium avium
HALDLLLGSWPAERRTLACLPG

SEQ ID NO: 120518 - protein, 17 aa, Mycobacterium avium
HALRLLGSAALAAAARG

SEQ ID NO: 120519 - protein, 24 aa, Mycobacterium avium
HAMCELEAPDYFRVPKRGKVEIVD

SEQ ID NO: 120520 - protein, 22 aa, Mycobacterium avium
HAPFSLAWMTAVGERTTRITLG

SEQ ID NO: 120521 - protein, 23 aa, Mycobacterium avium
HAQFTVVLPRRDGVEYSVEHAVV

SEQ ID NO: 120522 - protein, 26 aa, Mycobacterium avium
HARGEFRPRPSFLSPGKKILHDDRLN

SEQ ID NO: 120523 - protein, 19 aa, Mycobacterium avium
HARLRKKIAGTPERPRLVV

SEQ ID NO: 120524 - protein, 23 aa, Mycobacterium avium
HARTKAMMLADPDSWHALMEKLT

SEQ ID NO: 120525 - protein, 27 aa, Mycobacterium avium
HASSLPGTTPAVWTGSPSPSGAGAAEA

SEQ ID NO: 120526 - protein, 20 aa, Mycobacterium avium
HAVVAVLRRVTAAPFGNVRV

SEQ ID NO: 120527 - protein, 23 aa, Mycobacterium avium
HAWSAAPNFAFDLAARKTTDGDL

SEQ ID NO: 120528 - protein, 42 aa, Mycobacterium avium
HAYAGELLFLYNGVRPRHVMPVHGTWRMLRANSKLAARTGVP

SEQ ID NO: 120529 - protein, 22 aa, Mycobacterium avium
HCGWPSFYDPANSDAVILLPDH

SEQ ID NO: 120530 - protein, 19 aa, Mycobacterium avium
HCPDVAFLHLSGSAALLGP

SEQ ID NO: 120531 - protein, 17 aa, Mycobacterium avium
HCRSRGLSRYKHPERLV

SEQ ID NO: 120532 - protein, 26 aa, Mycobacterium avium
HCSFEQVAYLLWYGELPDDQQLALFS

SEQ ID NO: 120533 - protein, 23 aa, Mycobacterium avium
HDEDPMMPYPQRAPVLVGIDGSP

SEQ ID NO: 120534 - protein, 19 aa, Mycobacterium avium
HDMNPFPLNALGCLIRSIT

SEQ ID NO: 120535 - protein, 18 aa, Mycobacterium avium
HDRAGWLALMSDDVVIED

SEQ ID NO: 120536 - protein, 37 aa, Mycobacterium avium
HDTLWDFVSLQPETLHAIMWLMSDRALPRSYRMMQGF

SEQ ID NO: 120537 - protein, 26 aa, Mycobacterium avium
HDVSELLPELTLAQKWDLTATELARN

SEQ ID NO: 120538 - protein, 25 aa, Mycobacterium avium
HEAALFRLMRSALMPITPHAITSMF

SEQ ID NO: 120539 - protein, 19 aa, Mycobacterium avium
HEALNFAAVFRTPCVFFVQ

SEQ ID NO: 120540 - protein, 17 aa, Mycobacterium avium
HERFVANMLAGVGPVPA

SEQ ID NO: 120541 - protein, 17 aa, Mycobacterium avium
HERLWEVLGAHPRSFTT

SEQ ID NO: 120542 - protein, 26 aa, Mycobacterium avium
HERPLSEFCWPSWPHLAWGQERQSAQ

SEQ ID NO: 120543 - protein, 19 aa, Mycobacterium avium
HEVVAPDQLMPAALRLARS

SEQ ID NO: 120544 - protein, 24 aa, Mycobacterium avium
HEYRPFRSLIRAVLRHAGGVRIDH

SEQ ID NO: 120545 - protein, 26 aa, Mycobacterium avium
HFVNGAFPGLSWPLTPGHEIAGRIAE

SEQ ID NO: 120546 - protein, 23 aa, Mycobacterium avium
HGADYLLVNPLHAAGFSGPANRM

SEQ ID NO: 120547 - protein, 17 aa, Mycobacterium avium
HGDYRLDNLLFDPDRTR

SEQ ID NO: 120548 - protein, 29 aa, Mycobacterium avium
HGEFIKGFAGPFTLLVIADLLGVPEEDRD

SEQ ID NO: 120549 - protein, 24 aa, Mycobacterium avium
HGEIPLGIYCRASLAQYMDAERLF

SEQ ID NO: 120550 - protein, 25 aa, Mycobacterium avium
HGESWSLALSLRLAAYELLRADESD

SEQ ID NO: 120551 - protein, 25 aa, Mycobacterium avium
HGEVKLGLLPLLDAVLDAVSVPVLA

SEQ ID NO: 120552 - protein, 22 aa, Mycobacterium avium
HGRARFARFHLGRNGAVHGGSL

SEQ ID NO: 120553 - protein, 17 aa, Mycobacterium avium
HGRHPRILYLADRNVLV

SEQ ID NO: 120554 - protein, 24 aa, Mycobacterium avium
HGVVGLMRVYANLLAGQMIRVNSI

SEQ ID NO: 120555 - protein, 24 aa, Mycobacterium avium
HHANIVPWQLISQKTGAILKVAPI

SEQ ID NO: 120556 - protein, 33 aa, Mycobacterium avium
HHDLPDERWALLPLVPLIPKRVFRRLLGVVTGG

SEQ ID NO: 120557 - protein, 17 aa, Mycobacterium avium
HHVKTTIKILGLVDKEI

SEQ ID NO: 120558 - protein, 26 aa, Mycobacterium avium
HIDTMVLYPSLGLCAPSLRDPEFAAG

SEQ ID NO: 120559 - protein, 36 aa, Mycobacterium avium
HIGGAAMLATALLTGMRLALFEAFDPAATPLAIAAH

SEQ ID NO: 120560 - protein, 28 aa, Mycobacterium avium
HIKDAQTPTLLFPFAAPRVAGDLSEAGS

SEQ ID NO: 120561 - protein, 22 aa, Mycobacterium avium
HILRDTIAKPPPAGSPALMLAV

SEQ ID NO: 120562 - protein, 23 aa, Mycobacterium avium
HKTVHHYLMRFSGGELSDEDLEV

SEQ ID NO: 120563 - protein, 22 aa, Mycobacterium avium
HLAYAAYDLQLYSGGRFRLGLG

SEQ ID NO: 120564 - protein, 20 aa, Mycobacterium avium
HLEALGPTMRRALSAAGVTK

SEQ ID NO: 120565 - protein, 17 aa, Mycobacterium avium
HLGYRVIAVDLVPERLG

SEQ ID NO: 120566 - protein, 17 aa, Mycobacterium avium
HLIAAVAAALAFPAYVR

SEQ ID NO: 120567 - protein, 19 aa, Mycobacterium avium
HLIRTTWPTMFNPMTYVGM

SEQ ID NO: 120568 - protein, 32 aa, Mycobacterium avium
HLKGHFATMRHAAAYWRGLSKAGKAVDGRIIN

SEQ ID NO: 120569 - protein, 31 aa, Mycobacterium avium
HLRASDLDWTILGPGRLTLDPPTGRIAVGRG

SEQ ID NO: 120570 - protein, 17 aa, Mycobacterium avium
HLRLLTIVGRQLPNLDM

SEQ ID NO: 120571 - protein, 28 aa, Mycobacterium avium
HLSVFQRSPAYTLPWRVHRFQPGELDEM

SEQ ID NO: 120572 - protein, 25 aa, Mycobacterium avium
HLVKTFWGWREQQLPDATLILTSPA

SEQ ID NO: 120573 - protein, 20 aa, Mycobacterium avium
HLYNFWRDADNPRGLWRRTT

SEQ ID NO: 120574 - protein, 19 aa, Mycobacterium avium
HNLLVVYPDGYEKSWADGR

SEQ ID NO: 120575 - protein, 26 aa, Mycobacterium avium
HNSTLGLDFLRSCSIKHRMASVIFSL

SEQ ID NO: 120576 - protein, 17 aa, Mycobacterium avium
HNVAFSKPPIGKRGYNE

SEQ ID NO: 120577 - protein, 23 aa, Mycobacterium avium
HNVVPVRFLQAVETLAQAIAPVI

SEQ ID NO: 120578 - protein, 23 aa, Mycobacterium avium
HPDAGHWRVPPSRRFLPEDQTVH

SEQ ID NO: 120579 - protein, 24 aa, Mycobacterium avium
HPDGRSAFALWFTGGIFVNQSGDR

SEQ ID NO: 120580 - protein, 17 aa, Mycobacterium avium
HPEWFRTGDLGRLDRDQ

SEQ ID NO: 120581 - protein, 26 aa, Mycobacterium avium
HPHALQLIMDSLRYWVTEMHVDGFRF

SEQ ID NO: 120582 - protein, 21 aa, Mycobacterium avium
HPHRDMEIVTWVLAGALAHQD

SEQ ID NO: 120583 - protein, 27 aa, Mycobacterium avium
HPIASPTYRMALLRWLSVCDIRDEHGQ

SEQ ID NO: 120584 - protein, 19 aa, Mycobacterium avium
HPIHWAVVDRWFDPECPDV

SEQ ID NO: 120585 - protein, 17 aa, Mycobacterium avium
HPKDEFWVPRRLGGGAP

SEQ ID NO: 120586 - protein, 18 aa, Mycobacterium avium
HPLATMEKMFIAPSQFHV

SEQ ID NO: 120587 - protein, 20 aa, Mycobacterium avium
HPLPESLVGDAARFLLEGMP

SEQ ID NO: 120588 - protein, 26 aa, Mycobacterium avium
HPVHRYFLAAKQAEFALGGATGQLRR

SEQ ID NO: 120589 - protein, 24 aa, Mycobacterium avium
HPVSVWWSEIARVLRPGGSYFAQH

SEQ ID NO: 120590 - protein, 20 aa, Mycobacterium avium
HPVVHYLHRPVPRNELIAFF

SEQ ID NO: 120591 - protein, 18 aa, Mycobacterium avium
HPVVVPPPPSDPHRFGRV

SEQ ID NO: 120592 - protein, 17 aa, Mycobacterium avium
HQFLVDEAYLLDAQHYQ

SEQ ID NO: 120593 - protein, 25 aa, Mycobacterium avium
HRAHQAMYLDRLLNDGLARDWGICG

SEQ ID NO: 120594 - protein, 18 aa, Mycobacterium avium
HRDDLELWLGEQVAKGFA

SEQ ID NO: 120595 - protein, 24 aa, Mycobacterium avium
HREVLAHWPEVIASPTPASAGRVQ

SEQ ID NO: 120596 - protein, 29 aa, Mycobacterium avium
HRKQPPLQRLLRALLGLDAKLSQYTRGKA

SEQ ID NO: 120597 - protein, 28 aa, Mycobacterium avium
HRPVPLWQHVLVGKRLFDLFDYRNSEAP

SEQ ID NO: 120598 - protein, 22 aa, Mycobacterium avium
HRRLTSWLSSLTGLPVFCVDYR

SEQ ID NO: 120599 - protein, 20 aa, Mycobacterium avium
HRRRPLWIGVAIGGTVDSAT

SEQ ID NO: 120600 - protein, 18 aa, Mycobacterium avium
HRSGSYVLPMPEGKDVKK

SEQ ID NO: 120601 - protein, 19 aa, Mycobacterium avium
HRVCRYLEDLAGDYHRFYD

SEQ ID NO: 120602 - protein, 24 aa, Mycobacterium avium
HSDKLGPFCAALAYLCDKDMVLPM

SEQ ID NO: 120603 - protein, 26 aa, Mycobacterium avium
HSEVDTLRRVELLRQLRLGEYDVLVG

SEQ ID NO: 120604 - protein, 25 aa, Mycobacterium avium
HSFANELPAQPLLRIAGFGYNEEAT

SEQ ID NO: 120605 - protein, 27 aa, Mycobacterium avium
HSGTPVPLWLAAFQEAPLPALNLAGCP

SEQ ID NO: 120606 - protein, 26 aa, Mycobacterium avium
HSHYWLSGQVGWLARDRWAVPLVHTA

SEQ ID NO: 120607 - protein, 24 aa, Mycobacterium avium
HSQLLRVPPIRRTTEVPSIEPAKD

SEQ ID NO: 120608 - protein, 28 aa, Mycobacterium avium
HSWGVRDWWSMDWIWSALHLDDGTHLHG

SEQ ID NO: 120609 - protein, 19 aa, Mycobacterium avium
HTAGIFRGRTCAVAGHRCL

SEQ ID NO: 120610 - protein, 28 aa, Mycobacterium avium
HTALLRSCTGWPSGIWIDDPRRSAPDGS

SEQ ID NO: 120611 - protein, 19 aa, Mycobacterium avium
HTDDPALWHKRIHASADPG

SEQ ID NO: 120612 - protein, 25 aa, Mycobacterium avium
HTFRDHYLDLDLDLSDVVFLATANV

SEQ ID NO: 120613 - protein, 21 aa, Mycobacterium avium
HTGWGIFELLLGGQGYRRYPN

SEQ ID NO: 120614 - protein, 28 aa, Mycobacterium avium
HTGWLIVRDALVMGPWHDLERRSRTHRR

SEQ ID NO: 120615 - protein, 19 aa, Mycobacterium avium
HTRLRRLVSKAFAPRVVAA

SEQ ID NO: 120616 - protein, 24 aa, Mycobacterium avium
HTRRGKPVIPAWEDVLLGVRSGGQ

SEQ ID NO: 120617 - protein, 18 aa, Mycobacterium avium
HTRTLRRAAWEAYMAEHD

SEQ ID NO: 120618 - protein, 27 aa, Mycobacterium avium
HTRVRGFNFRLLFRNPLWANTDRRRRR

SEQ ID NO: 120619 - protein, 17 aa, Mycobacterium avium
HTWKRSSFSGTEIFGKT

SEQ ID NO: 120620 - protein, 24 aa, Mycobacterium avium
HVDLSRTVGWFTTKYPVALAIDGL

SEQ ID NO: 120621 - protein, 25 aa, Mycobacterium avium
HVDSIPLALALLRKGGVCVLTGITP

SEQ ID NO: 120622 - protein, 19 aa, Mycobacterium avium
HVGRRRAARFLAEGPNLVE

SEQ ID NO: 120623 - protein, 18 aa, Mycobacterium avium
HVIHCEEQLRGSLAGLSA

SEQ ID NO: 120624 - protein, 19 aa, Mycobacterium avium
HVLQRFTISQLQQLPQVEV

SEQ ID NO: 120625 - protein, 36 aa, Mycobacterium avium
HVRGFPLGPGFLLEGRPVILTAPRRPAPAAAARTAS

SEQ ID NO: 120626 - protein, 23 aa, Mycobacterium avium
HVTPIKMLLREALDAGPGILYRL

SEQ ID NO: 120627 - protein, 18 aa, Mycobacterium avium
HYEPFGIVALEAAAAGTP

SEQ ID NO: 120628 - protein, 28 aa, Mycobacterium avium
HYVYVSYQPTILPSPHYPPPGYADAAID

SEQ ID NO: 120629 - protein, 32 aa, Mycobacterium avium
IAATERGLLLTTLWYIRVVDPTTLLVTGLTRD

SEQ ID NO: 120630 - protein, 20 aa, Mycobacterium avium
IADGPMAGLLARAIVVVGAD

SEQ ID NO: 120631 - protein, 30 aa, Mycobacterium avium
IAFAPGDLGPYLRATWDLITPNAYIETVHR

SEQ ID NO: 120632 - protein, 17 aa, Mycobacterium avium
IAGFDELAAQLPGCIPF

SEQ ID NO: 120633 - protein, 19 aa, Mycobacterium avium
IAGFQPVPYMAVYSATKAF

SEQ ID NO: 120634 - protein, 21 aa, Mycobacterium avium
IAHGGLGWVYLAVDHNVNDRP

SEQ ID NO: 120635 - protein, 27 aa, Mycobacterium avium
IAIELDGLRLITWRGAARAEQGLPFAR

SEQ ID NO: 120636 - protein, 23 aa, Mycobacterium avium
IAKAAAFHLRHGTTTTMASLVTG

SEQ ID NO: 120637 - protein, 23 aa, Mycobacterium avium
IAKVAMNVLLRRTFEATLQLTGR

SEQ ID NO: 120638 - protein, 17 aa, Mycobacterium avium
IALLHRDHPSRDGACVR

SEQ ID NO: 120639 - protein, 25 aa, Mycobacterium avium
IALRDRLIVEMLYATGIRVSELCGL

SEQ ID NO: 120640 - protein, 18 aa, Mycobacterium avium
IALREGIRLAYDILTKGD

SEQ ID NO: 120641 - protein, 17 aa, Mycobacterium avium
IALTAARLAAHAAVFWL

SEQ ID NO: 120642 - protein, 18 aa, Mycobacterium avium
IAMYLCRELTDLSLPKIG

SEQ ID NO: 120643 - protein, 26 aa, Mycobacterium avium
IASERAMFGVPLVGLGFHHGDGGISR

SEQ ID NO: 120644 - protein, 17 aa, Mycobacterium avium
IASRWPGLLPEVQRLLP

SEQ ID NO: 120645 - protein, 27 aa, Mycobacterium avium
IASVDCALGPLWNPVRLAEDIALVDNM

SEQ ID NO: 120646 - protein, 20 aa, Mycobacterium avium
IATDNLMRFPGRFSEHLLAE

SEQ ID NO: 120647 - protein, 22 aa, Mycobacterium avium
IAVKSNLPGLNAKGACIGPMGQ

SEQ ID NO: 120648 - protein, 20 aa, Mycobacterium avium
IAVQSLRLYERHGLVTPARS

SEQ ID NO: 120649 - protein, 20 aa, Mycobacterium avium
IAWSWLRHPVKSREFPAKHE

SEQ ID NO: 120650 - protein, 32 aa, Mycobacterium avium
IDAAEIYVPFSWFEPMWLENLGFAPEGEGWKL

SEQ ID NO: 120651 - protein, 24 aa, Mycobacterium avium
IDADPYPIYKMLRNEAPLYYNERH

SEQ ID NO: 120652 - protein, 24 aa, Mycobacterium avium
IDATLRTLGQRPFYPPSVGGWPSG

SEQ ID NO: 120653 - protein, 17 aa, Mycobacterium avium
IDAYARLVAMRLVATRA

SEQ ID NO: 120654 - protein, 24 aa, Mycobacterium avium
IDCPPSLGLLTINALVAAPEVMIP

SEQ ID NO: 120655 - protein, 23 aa, Mycobacterium avium
IDELNLAAPLVLPAGGSVAIQVV

SEQ ID NO: 120656 - protein, 17 aa, Mycobacterium avium
IDFVIDMQVGYGEIAWA

SEQ ID NO: 120657 - protein, 17 aa, Mycobacterium avium
IDLLVKRAEALGVQIRY

SEQ ID NO: 120658 - protein, 18 aa, Mycobacterium avium
IDMQRYNFQFTGQRFYRI

SEQ ID NO: 120659 - protein, 21 aa, Mycobacterium avium
IDPAALCGPPLTALSGRWSVA

SEQ ID NO: 120660 - protein, 24 aa, Mycobacterium avium
IDPDLLVTVVKAAAAPVICETADE

SEQ ID NO: 120661 - protein, 20 aa, Mycobacterium avium
IDPLARLLEQTLLGYDQLGL

SEQ ID NO: 120662 - protein, 17 aa, Mycobacterium avium
IDQHVHGCWLTTGGRRR

SEQ ID NO: 120663 - protein, 25 aa, Mycobacterium avium
IDVTRCGGITDWLRAAAVAAAHNVD

SEQ ID NO: 120664 - protein, 27 aa, Mycobacterium avium
IDWEHQGLRLAQTLTPWPAIDGQRTAA

SEQ ID NO: 120665 - protein, 27 aa, Mycobacterium avium
IEADYEQWVAVRPPPLFGTEPDARVLT

SEQ ID NO: 120666 - protein, 30 aa, Mycobacterium avium
IEAFQAFAPQIAAFSLALPAGAAAGLAGLS

SEQ ID NO: 120667 - protein, 17 aa, Mycobacterium avium
IEDPLLREGYRRCRELN

SEQ ID NO: 120668 - protein, 24 aa, Mycobacterium avium
IEEFAPLIAYVLRSMQTGGDLAKM

SEQ ID NO: 120669 - protein, 19 aa, Mycobacterium avium
IELPNGRYGWRVCLPAMMS

SEQ ID NO: 120670 - protein, 27 aa, Mycobacterium avium
IENPNRRFFTMLGTLVRGRITVGGSAG

SEQ ID NO: 120671 - protein, 21 aa, Mycobacterium avium
IEPGIYFPGRWGARIEDIVVV

SEQ ID NO: 120672 - protein, 24 aa, Mycobacterium avium
IERASRWLNALTANPLHTAAVTHP

SEQ ID NO: 120673 - protein, 18 aa, Mycobacterium avium
IERKLYPNVDFYTGLIYR

SEQ ID NO: 120674 - protein, 17 aa, Mycobacterium avium
IFALRRDSWSDTEARPP

SEQ ID NO: 120675 - protein, 18 aa, Mycobacterium avium
IFTEVIIAPAYQPAALDI

SEQ ID NO: 120676 - protein, 19 aa, Mycobacterium avium
IFYNFAPERVAKALPAAWE

SEQ ID NO: 120677 - protein, 20 aa, Mycobacterium avium
IGAPMTSFYDWYADLPVASP

SEQ ID NO: 120678 - protein, 24 aa, Mycobacterium avium
IGGKLAHLLADRLLITRAEAARRI

SEQ ID NO: 120679 - protein, 23 aa, Mycobacterium avium
IGGKLSVPVAWSGAPATPALGHA

SEQ ID NO: 120680 - protein, 22 aa, Mycobacterium avium
IGGKTFPLPNPFLVMATQNPIE

SEQ ID NO: 120681 - protein, 23 aa, Mycobacterium avium
IGHTDAVLWDLQRPNPALLTQGM

SEQ ID NO: 120682 - protein, 28 aa, Mycobacterium avium
IGKRIERGLWLTALLRATLTVVRGAAAE

SEQ ID NO: 120683 - protein, 17 aa, Mycobacterium avium
IGLLIAEVKVTYKGQLR

SEQ ID NO: 120684 - protein, 18 aa, Mycobacterium avium
IGNAPTALFRLLELVDDG

SEQ ID NO: 120685 - protein, 20 aa, Mycobacterium avium
IGQFELFLITAAVAEGWAVS

SEQ ID NO: 120686 - protein, 18 aa, Mycobacterium avium
IGQLLPCNVVVRSDPAEG

SEQ ID NO: 120687 - protein, 25 aa, Mycobacterium avium
IGRADAVLLVGARLNWLLGHGESPQ

SEQ ID NO: 120688 - protein, 23 aa, Mycobacterium avium
IGVCDLLHRRGLAGATVLLGVDG

SEQ ID NO: 120689 - protein, 19 aa, Mycobacterium avium
IGVNCLWPQTYIATAAVAN

SEQ ID NO: 120690 - protein, 26 aa, Mycobacterium avium
IGVNYIDTYFRSGQYPRELPFIIGQE

SEQ ID NO: 120691 - protein, 30 aa, Mycobacterium avium
IGVTPEPLPISPLQLITPGLSIVGHPSGTA

SEQ ID NO: 120692 - protein, 19 aa, Mycobacterium avium
IHRLITFLKPSARSEVFGF

SEQ ID NO: 120693 - protein, 19 aa, Mycobacterium avium
IHVGPGAVPLLAAAAAWDG

SEQ ID NO: 120694 - protein, 25 aa, Mycobacterium avium
IIAELASMMPMRVIGMLLGIPESEQ

SEQ ID NO: 120695 - protein, 25 aa, Mycobacterium avium
IIDDYLDHIDFAAPALAIAEGLLGK

SEQ ID NO: 120696 - protein, 19 aa, Mycobacterium avium
IINDPFAAPLVRAVGLDFF

SEQ ID NO: 120697 - protein, 26 aa, Mycobacterium avium
IINEPPVTIGPLYAAKTIELCVPGDP

SEQ ID NO: 120698 - protein, 17 aa, Mycobacterium avium
IIRDDLFSTPIPGEDDQ

SEQ ID NO: 120699 - protein, 27 aa, Mycobacterium avium
IIRGKAALRQYWTAALASIPDLRFSVE

SEQ ID NO: 120700 - protein, 18 aa, Mycobacterium avium
IIRVSPGCYFPASDRPWL

SEQ ID NO: 120701 - protein, 24 aa, Mycobacterium avium
IKPGNNLPLRNIPAGTVIHAVELR

SEQ ID NO: 120702 - protein, 25 aa, Mycobacterium avium
IKVEVKTRGWLSRDWRCYFGSQVSQ

SEQ ID NO: 120703 - protein, 22 aa, Mycobacterium avium
ILADYDTWLAERRIEMARTVLI

SEQ ID NO: 120704 - protein, 19 aa, Mycobacterium avium
ILDAVLGRLAPRARVVLCG

SEQ ID NO: 120705 - protein, 18 aa, Mycobacterium avium
ILDLVLPSAVGEASGDSE

SEQ ID NO: 120706 - protein, 17 aa, Mycobacterium avium
ILFLRMMDRVKAGAKLI

SEQ ID NO: 120707 - protein, 19 aa, Mycobacterium avium
ILGLDIKGHVVKKLLVSEA

SEQ ID NO: 120708 - protein, 22 aa, Mycobacterium avium
ILICGGPRMVAATKAALIAKGA

SEQ ID NO: 120709 - protein, 18 aa, Mycobacterium avium
ILINVTSFFRDPDAWEFV

SEQ ID NO: 120710 - protein, 19 aa, Mycobacterium avium
ILNVALRDLAKDLGDATVL

SEQ ID NO: 120711 - protein, 18 aa, Mycobacterium avium
ILPLQHPIVLAKALATAD

SEQ ID NO: 120712 - protein, 24 aa, Mycobacterium avium
IMAPQGLDYIVAFLGALHAGQVAV

SEQ ID NO: 120713 - protein, 18 aa, Mycobacterium avium
IMRRLYPLIGRLFARQTA

SEQ ID NO: 120714 - protein, 19 aa, Mycobacterium avium
INAPAWRRAMAARQRINNL

SEQ ID NO: 120715 - protein, 24 aa, Mycobacterium avium
INEAFASVVLSWARVHEPDMARVN

SEQ ID NO: 120716 - protein, 19 aa, Mycobacterium avium
INEALLGRRHRFGYTVGTD

SEQ ID NO: 120717 - protein, 21 aa, Mycobacterium avium
INNAFRVPSMKPLAGTSFQHI

SEQ ID NO: 120718 - protein, 19 aa, Mycobacterium avium
INPRHPLIVASLAQTAQAA

SEQ ID NO: 120719 - protein, 18 aa, Mycobacterium avium
IPEMVRKAFKLAESERPA

SEQ ID NO: 120720 - protein, 17 aa, Mycobacterium avium
IPGLPQAAAPSAPSTAT

SEQ ID NO: 120721 - protein, 19 aa, Mycobacterium avium
IPHGLLFERFLNPERPSAP

SEQ ID NO: 120722 - protein, 17 aa, Mycobacterium avium
IPHMGWNVVESGPGSVL

SEQ ID NO: 120723 - protein, 21 aa, Mycobacterium avium
IPIYDEDFVLALPPGHPLAGK

SEQ ID NO: 120724 - protein, 18 aa, Mycobacterium avium
IPLLRDAYPPRADGTTIF

SEQ ID NO: 120725 - protein, 17 aa, Mycobacterium avium
IPMAALAGMRRGQALPH

SEQ ID NO: 120726 - protein, 17 aa, Mycobacterium avium
IPPLQKIVKERGLWATH

SEQ ID NO: 120727 - protein, 18 aa, Mycobacterium avium
IPRAMLPEIGPSSSPRPF

SEQ ID NO: 120728 - protein, 27 aa, Mycobacterium avium
IPVIADIHFQPKYIFAAIDAGCAAVRV

SEQ ID NO: 120729 - protein, 21 aa, Mycobacterium avium
IQLARLIWRVQGLKITITGVE

SEQ ID NO: 120730 - protein, 17 aa, Mycobacterium avium
IQRLIIGSNLVKAAQRA

SEQ ID NO: 120731 - protein, 33 aa, Mycobacterium avium
IQTAVLYDHFTPFTLIQLEELGFCGKGEAKDFI

SEQ ID NO: 120732 - protein, 17 aa, Mycobacterium avium
IRAVWTGDDISFEGRHF

SEQ ID NO: 120733 - protein, 17 aa, Mycobacterium avium
IRDVGIPGYLRATTGLA

SEQ ID NO: 120734 - protein, 18 aa, Mycobacterium avium
IREQLRGAARRRAFRLWL

SEQ ID NO: 120735 - protein, 20 aa, Mycobacterium avium
IRGKRFFHPDGVLAGGVVER

SEQ ID NO: 120736 - protein, 19 aa, Mycobacterium avium
IRGYRIELGEIRSALAGLD

SEQ ID NO: 120737 - protein, 17 aa, Mycobacterium avium
IRLGLLAGHYRGDRYWS

SEQ ID NO: 120738 - protein, 18 aa, Mycobacterium avium
IRMVTLAPELPGADAAIR

SEQ ID NO: 120739 - protein, 19 aa, Mycobacterium avium
IRQAGLAGDWLRAGAPAID

SEQ ID NO: 120740 - protein, 19 aa, Mycobacterium avium
IRRALLTHKVIFFRHQHHL

SEQ ID NO: 120741 - protein, 28 aa, Mycobacterium avium
IRTSTTTYPCDVLIFATGFDALTGALTR

SEQ ID NO: 120742 - protein, 24 aa, Mycobacterium avium
IRTVNPKIVYARGSALGPRGAESE

SEQ ID NO: 120743 - protein, 25 aa, Mycobacterium avium
ISAAWREWAAAPDGWIAIPHGEIIC

SEQ ID NO: 120744 - protein, 28 aa, Mycobacterium avium
ISEEILAALWALIGYEIPRPIPRISYAD

SEQ ID NO: 120745 - protein, 25 aa, Mycobacterium avium
ISFTHLLGYALVQAIKKFPNMNRHY

SEQ ID NO: 120746 - protein, 24 aa, Mycobacterium avium
ISGQKRFITNAPVANLFVVFARTR

SEQ ID NO: 120747 - protein, 26 aa, Mycobacterium avium
ISLDRPAYVYPLFEQALRVATGESVE

SEQ ID NO: 120748 - protein, 23 aa, Mycobacterium avium
ISNAILFLVSDDARYITGVSLPV

SEQ ID NO: 120749 - protein, 24 aa, Mycobacterium avium
ISQQPRRGFVVLPVTRRDVTDVAN

SEQ ID NO: 120750 - protein, 26 aa, Mycobacterium avium
ISRKADKWLPLLENRTPVVAAALLNT

SEQ ID NO: 120751 - protein, 18 aa, Mycobacterium avium
ISSWKAYAPAWAGKVAIE

SEQ ID NO: 120752 - protein, 26 aa, Mycobacterium avium
ISTELPLERWFRDLRVKRLGEGATEV

SEQ ID NO: 120753 - protein, 19 aa, Mycobacterium avium
ISVRAAFAAATRGGWRAAG

SEQ ID NO: 120754 - protein, 25 aa, Mycobacterium avium
ITDDAIVFFFDQNALQPAMEATRVS

SEQ ID NO: 120755 - protein, 24 aa, Mycobacterium avium
ITELANIYADEIFAWMAHTPVDEI

SEQ ID NO: 120756 - protein, 18 aa, Mycobacterium avium
ITELGPVLALHVGAGAVA

SEQ ID NO: 120757 - protein, 25 aa, Mycobacterium avium
ITGGKRSFILVPGIDVPFHSRVLRV

SEQ ID NO: 120758 - protein, 17 aa, Mycobacterium avium
ITGIHRYLRTLVDVGLG

SEQ ID NO: 120759 - protein, 25 aa, Mycobacterium avium
ITGRAVLAALRRFGAAPTLCDDDPA

SEQ ID NO: 120760 - protein, 17 aa, Mycobacterium avium
ITISSAAKMFNCTGWKI

SEQ ID NO: 120761 - protein, 31 aa, Mycobacterium avium
ITLARMMTRRQFGRTLFEHQALRLRMADLQA

SEQ ID NO: 120762 - protein, 17 aa, Mycobacterium avium
ITLGMFTHDALLGGEGA

SEQ ID NO: 120763 - protein, 26 aa, Mycobacterium avium
ITPTWVRFYDFGAGRLPRFLADLTEG

SEQ ID NO: 120764 - protein, 25 aa, Mycobacterium avium
ITRARFYLFVNQIANFVPFAVSSAV

SEQ ID NO: 120765 - protein, 24 aa, Mycobacterium avium
ITRARTHLALSWALARSPGGRQSR

SEQ ID NO: 120766 - protein, 25 aa, Mycobacterium avium
ITRLHQYNVFPNMTFLTNADHLTVM

SEQ ID NO: 120767 - protein, 22 aa, Mycobacterium avium
ITRVRLRVHRIPQAVRYEAWSF

SEQ ID NO: 120768 - protein, 32 aa, Mycobacterium avium
ITSDDRYLCINPFFHNFGYKAGILACLQTGAT

SEQ ID NO: 120769 - protein, 20 aa, Mycobacterium avium
IVAELFKPLPSMVVAHYLGV

SEQ ID NO: 120770 - protein, 18 aa, Mycobacterium avium
IVAFLTRKWQRELDYSLR

SEQ ID NO: 120771 - protein, 17 aa, Mycobacterium avium
IVALKYPGGVVLAGDRR

SEQ ID NO: 120772 - protein, 17 aa, Mycobacterium avium
IVAPKPLQDNGIPLWIA

SEQ ID NO: 120773 - protein, 25 aa, Mycobacterium avium
IVAVMAPFPHMRFPSGWTAYDEDND

SEQ ID NO: 120774 - protein, 25 aa, Mycobacterium avium
IVDVALRIWRPRWAKWTAHVVRSGG

SEQ ID NO: 120775 - protein, 24 aa, Mycobacterium avium
IVIADGLFPFLNKEQIIAVMRAIT

SEQ ID NO: 120776 - protein, 22 aa, Mycobacterium avium
IVPALQAFSPELIIVSAGFDAH

SEQ ID NO: 120777 - protein, 25 aa, Mycobacterium avium
IVSGLFMLFEQPFRIDDWLDTGTTS

SEQ ID NO: 120778 - protein, 20 aa, Mycobacterium avium
IVSLWLDRLRRRNPVAHSAV

SEQ ID NO: 120779 - protein, 20 aa, Mycobacterium avium
IVTGGLGGLGLFLAEKMASP

SEQ ID NO: 120780 - protein, 18 aa, Mycobacterium avium
IVTGLRLMTRMAQTGSPL

SEQ ID NO: 120781 - protein, 18 aa, Mycobacterium avium
IWSIGDPRIDVGWFLINC

SEQ ID NO: 120782 - protein, 23 aa, Mycobacterium avium
IYPNTVPPFFPHASLAAPPPETA

SEQ ID NO: 120783 - protein, 33 aa, Mycobacterium avium
IYTLTDEAPLLATYAFLPIVRAFAEPAGIEIKT

SEQ ID NO: 120784 - protein, 17 aa, Mycobacterium avium
IYYGSFHAVAEVTLSVL

SEQ ID NO: 120785 - protein, 17 aa, Mycobacterium avium
KAALERLVEAWRAEHPD

SEQ ID NO: 120786 - protein, 26 aa, Mycobacterium avium
KAALWELVWAGWITGDTFAPVRALLG

SEQ ID NO: 120787 - protein, 17 aa, Mycobacterium avium
KAARVLSLAQDTADRLT

SEQ ID NO: 120788 - protein, 20 aa, Mycobacterium avium
KADFTRCFDLVFAEAAEQGV

SEQ ID NO: 120789 - protein, 17 aa, Mycobacterium avium
KAELLGVDPALIEAHGA

SEQ ID NO: 120790 - protein, 27 aa, Mycobacterium avium
KAFAAKPFDYWRQHLKTMKGQWAPFQS

SEQ ID NO: 120791 - protein, 19 aa, Mycobacterium avium
KAILDRTPWRAEEPVVIVA

SEQ ID NO: 120792 - protein, 17 aa, Mycobacterium avium
KALRMFAVLPTIVAADM

SEQ ID NO: 120793 - protein, 20 aa, Mycobacterium avium
KAMLPKAIEAGVRIACGTDA

SEQ ID NO: 120794 - protein, 19 aa, Mycobacterium avium
KANLTWTPQPAMPGQLRAV

SEQ ID NO: 120795 - protein, 18 aa, Mycobacterium avium
KAPEGFMLVCSYNPAYRS

SEQ ID NO: 120796 - protein, 26 aa, Mycobacterium avium
KAPLEQLLLERAYLLGVTGPEMTVLV

SEQ ID NO: 120797 - protein, 26 aa, Mycobacterium avium
KAWEALGRWEKPFLAIFGARDPILGH

SEQ ID NO: 120798 - protein, 18 aa, Mycobacterium avium
KCGPWHQGGWDPIPERPG

SEQ ID NO: 120799 - protein, 25 aa, Mycobacterium avium
KDAEVWDRLTGNFWLPEKVPVSNDL

SEQ ID NO: 120800 - protein, 18 aa, Mycobacterium avium
KDGRPFPPWTDPESAFEA

SEQ ID NO: 120801 - protein, 21 aa, Mycobacterium avium
KDHIEAIANWDPKAEPSIEIQ

SEQ ID NO: 120802 - protein, 17 aa, Mycobacterium avium
KDKQLYTLDLGSLVAGS

SEQ ID NO: 120803 - protein, 20 aa, Mycobacterium avium
KDQFVACVFDWVVAELAATT

SEQ ID NO: 120804 - protein, 24 aa, Mycobacterium avium
KDRDGAMVALVQRLDRWASGRDDD

SEQ ID NO: 120805 - protein, 25 aa, Mycobacterium avium
KDREAVLRRAPWVDVVFGTHNIGSL

SEQ ID NO: 120806 - protein, 34 aa, Mycobacterium avium
KDVLQGQCTFSWPPRIHLPGYKPTTKPHSRQIRE

SEQ ID NO: 120807 - protein, 24 aa, Mycobacterium avium
KDVPPVVWTVLMTSLSRFLVLEQA

SEQ ID NO: 120808 - protein, 20 aa, Mycobacterium avium
KEAKIAFLMLPGVGTKEDIK

SEQ ID NO: 120809 - protein, 25 aa, Mycobacterium avium
KEDWYQWPWRVHVGLWAAASASLLD

SEQ ID NO: 120810 - protein, 18 aa, Mycobacterium avium
KEEIVPIDTPHGLFSVDE

SEQ ID NO: 120811 - protein, 18 aa, Mycobacterium avium
KEGYAIDDYLRPGPKHDS

SEQ ID NO: 120812 - protein, 20 aa, Mycobacterium avium
KEIDLPSYGLVWKWPQIDCA

SEQ ID NO: 120813 - protein, 21 aa, Mycobacterium avium
KEINVQFVLAYTPEEFGDSLR

SEQ ID NO: 120814 - protein, 28 aa, Mycobacterium avium
KELVVVRPIGFEPLSWVRALAAEDPVPS

SEQ ID NO: 120815 - protein, 26 aa, Mycobacterium avium
KENYPAYLDWAVRLARPGAVIVADNV

SEQ ID NO: 120816 - protein, 26 aa, Mycobacterium avium
KEPRITALSDLWFEAARRVGFDVAAV

SEQ ID NO: 120817 - protein, 27 aa, Mycobacterium avium
KEPRITTLSDLWFQAARRAGFDVAAVI

SEQ ID NO: 120818 - protein, 26 aa, Mycobacterium avium
KFAAEHPWLLGAYLTHTFGVDEVQDA

SEQ ID NO: 120819 - protein, 24 aa, Mycobacterium avium
KFADMKLWLEACRATTWAAVAEVA

SEQ ID NO: 120820 - protein, 21 aa, Mycobacterium avium
KFATAFTRRGLIAEYGITWIL

SEQ ID NO: 120821 - protein, 18 aa, Mycobacterium avium
KFDYTKGFKFSTYATWWI

SEQ ID NO: 120822 - protein, 19 aa, Mycobacterium avium
KFLEDKDYWLAHRPGDGTA

SEQ ID NO: 120823 - protein, 23 aa, Mycobacterium avium
KFTTVHMALVRTPMISPTTLYDK

SEQ ID NO: 120824 - protein, 34 aa, Mycobacterium avium
KGDDGRMVFLKRPVAPYFVPVPELDGLPPVDQTV

SEQ ID NO: 120825 - protein, 20 aa, Mycobacterium avium
KGFHAIERDLWQAGAITPGT

SEQ ID NO: 120826 - protein, 17 aa, Mycobacterium avium
KGFKSFASPTTLRFEPG

SEQ ID NO: 120827 - protein, 26 aa, Mycobacterium avium
KGGNRRWFEQWLLTNLDDALSAWPPE

SEQ ID NO: 120828 - protein, 19 aa, Mycobacterium avium
KGILQLIADLGAEGMTMVV

SEQ ID NO: 120829 - protein, 25 aa, Mycobacterium avium
KGKRLELGALLLGYYQGDQLRYAGK

SEQ ID NO: 120830 - protein, 17 aa, Mycobacterium avium
KGLRRWRAVAKAAARQS

SEQ ID NO: 120831 - protein, 17 aa, Mycobacterium avium
KGNLLRRTMGIAALGGA

SEQ ID NO: 120832 - protein, 23 aa, Mycobacterium avium
KGSTLTWPPPLLGLEPSSYVGTQ

SEQ ID NO: 120833 - protein, 17 aa, Mycobacterium avium
KHFFVHYKDLEPGKFVK

SEQ ID NO: 120834 - protein, 28 aa, Mycobacterium avium
KHIAGVDTFFVATAPRYSFVSSSLAKEV

SEQ ID NO: 120835 - protein, 21 aa, Mycobacterium avium
KIADYPFTTLVPNLGVVSAGE

SEQ ID NO: 120836 - protein, 30 aa, Mycobacterium avium
KIEKGLPLSPILLVRGDFLAGVPLQIADGY

SEQ ID NO: 120837 - protein, 17 aa, Mycobacterium avium
KLDSLVPLGPPVMDVAL

SEQ ID NO: 120838 - protein, 19 aa, Mycobacterium avium
KLGAVLQRLAGYQARSVEI

SEQ ID NO: 120839 - protein, 21 aa, Mycobacterium avium
KLGVPPLTMKPDVCWQLPIRR

SEQ ID NO: 120840 - protein, 17 aa, Mycobacterium avium
KLIEIAPAQGLSEELRR

SEQ ID NO: 120841 - protein, 35 aa, Mycobacterium avium
KLKEALVKAIPLRRLARPEEVAAAVLFFASQAASF

SEQ ID NO: 120842 - protein, 30 aa, Mycobacterium avium
KLLELNGDNPFVLVGWSLGGALAYACAIGL

SEQ ID NO: 120843 - protein, 18 aa, Mycobacterium avium
KLMLVRKRPFNAHARDLG

SEQ ID NO: 120844 - protein, 24 aa, Mycobacterium avium
KLNRRPRQTLDWKTPAEALDELLC

SEQ ID NO: 120845 - protein, 25 aa, Mycobacterium avium
KLRELLKFEFLFSARAQFEKELADE

SEQ ID NO: 120846 - protein, 19 aa, Mycobacterium avium
KLRYAFADRLVLSKVRRRL

SEQ ID NO: 120847 - protein, 17 aa, Mycobacterium avium
KLSLAKVAFFEDHLYLT

SEQ ID NO: 120848 - protein, 17 aa, Mycobacterium avium
KLVLRNMTRRNTGKVLF

SEQ ID NO: 120849 - protein, 24 aa, Mycobacterium avium
KNLSIPVLLIRGKLSDVVSPEGVR

SEQ ID NO: 120850 - protein, 22 aa, Mycobacterium avium
KNYAQLLDVPFAYSTNGVSIVE

SEQ ID NO: 120851 - protein, 19 aa, Mycobacterium avium
KPEILASNRFRAGLAKIPG

SEQ ID NO: 120852 - protein, 26 aa, Mycobacterium avium
KPGEPSWPTPWGRGRPGWHTECVAMA

SEQ ID NO: 120853 - protein, 20 aa, Mycobacterium avium
KPGRLAGPDPSLLAAAYAAL

SEQ ID NO: 120854 - protein, 20 aa, Mycobacterium avium
KPGTYLFFYPAAEPHEYSAQ

SEQ ID NO: 120855 - protein, 28 aa, Mycobacterium avium
KPITHPLRADIPIFLGAEGPKNVALAAE

SEQ ID NO: 120856 - protein, 27 aa, Mycobacterium avium
KPLDDVPMLLQPGVLSLAWGSVVRQLA

SEQ ID NO: 120857 - protein, 29 aa, Mycobacterium avium
KPQTDLFVKPILNLWEFSKPTIAQVHGYC

SEQ ID NO: 120858 - protein, 29 aa, Mycobacterium avium
KPSAWIAEGLLIYLPASAQEQLFTGIDAL

SEQ ID NO: 120859 - protein, 26 aa, Mycobacterium avium
KPSTTYLWETKGVVPILKIDKGLAEA

SEQ ID NO: 120860 - protein, 21 aa, Mycobacterium avium
KPVEFLVQGTLYPDVVESGGG

SEQ ID NO: 120861 - protein, 26 aa, Mycobacterium avium
KPVKGMLTGPVTILAWSFVRDDQPLA

SEQ ID NO: 120862 - protein, 25 aa, Mycobacterium avium
KPVLYQHFTSKLELYLAVLARHVEN

SEQ ID NO: 120863 - protein, 24 aa, Mycobacterium avium
KPVPGAQAYLLDDGLRPVPVGVVG

SEQ ID NO: 120864 - protein, 17 aa, Mycobacterium avium
KPVRALISICAAGGQGV

SEQ ID NO: 120865 - protein, 18 aa, Mycobacterium avium
KQLYTLDLGSLVAGSRYR

SEQ ID NO: 120866 - protein, 22 aa, Mycobacterium avium
KQMIDWWGPIIDEYYASSEAIG

SEQ ID NO: 120867 - protein, 28 aa, Mycobacterium avium
KQTAETAWLFLQLVIRMLKDGGRCGIVV

SEQ ID NO: 120868 - protein, 17 aa, Mycobacterium avium
KRFAAMISGLDVRYDLG

SEQ ID NO: 120869 - protein, 17 aa, Mycobacterium avium
KRFPNIATLLDGVRPLH

SEQ ID NO: 120870 - protein, 18 aa, Mycobacterium avium
KRIMRSGNQLAYLDSGAT

SEQ ID NO: 120871 - protein, 25 aa, Mycobacterium avium
KRLAWTACRTFLAINAHWIEAPEDE

SEQ ID NO: 120872 - protein, 20 aa, Mycobacterium avium
KRQRRRDGRDAGRRRPPVLT

SEQ ID NO: 120873 - protein, 17 aa, Mycobacterium avium
KRRFLQPGTVGLIADRL

SEQ ID NO: 120874 - protein, 23 aa, Mycobacterium avium
KRSLNHWYRMMGPTFETSVGLEF

SEQ ID NO: 120875 - protein, 26 aa, Mycobacterium avium
KRVCRDCGFFLPLSGSLGRMFGVCGN

SEQ ID NO: 120876 - protein, 18 aa, Mycobacterium avium
KRWVDDIMPLLTDDDPLG

SEQ ID NO: 120877 - protein, 29 aa, Mycobacterium avium
KRYTGRGMAFLDLIQEGNLGLIRAVEKFD

SEQ ID NO: 120878 - protein, 18 aa, Mycobacterium avium
KSALLALIADCERGLGRP

SEQ ID NO: 120879 - protein, 22 aa, Mycobacterium avium
KSGAAYLPIDPALPGERIGFML

SEQ ID NO: 120880 - protein, 22 aa, Mycobacterium avium
KSGREIYFGLYQQLADGGDEPT

SEQ ID NO: 120881 - protein, 18 aa, Mycobacterium avium
KSIIFMDPPEHRHMRSLL

SEQ ID NO: 120882 - protein, 22 aa, Mycobacterium avium
KSVWFQRGPLDEAIRASIAIPG

SEQ ID NO: 120883 - protein, 24 aa, Mycobacterium avium
KTADEWVRLLQAAGLMACHAYTWK

SEQ ID NO: 120884 - protein, 27 aa, Mycobacterium avium
KTFVSMQIVWKLWNSQWVHGRHPRILY

SEQ ID NO: 120885 - protein, 34 aa, Mycobacterium avium
KTLDLPYMESVIWAFKQLWDKGLAYEGYRVLPYC

SEQ ID NO: 120886 - protein, 18 aa, Mycobacterium avium
KTLQLIAEQLSAAGVPVL

SEQ ID NO: 120887 - protein, 25 aa, Mycobacterium avium
KTLREAVLYLTGMSQRELYGASYRV

SEQ ID NO: 120888 - protein, 22 aa, Mycobacterium avium
KTQKEFLLRQQLAAIRKELGEG

SEQ ID NO: 120889 - protein, 22 aa, Mycobacterium avium
KTVCEKGFRNMTYVRDLAPMLV

SEQ ID NO: 120890 - protein, 25 aa, Mycobacterium avium
KTYDAEPFIYLMPEGQLPRTGAVIG

SEQ ID NO: 120891 - protein, 19 aa, Mycobacterium avium
KVAIARDYLLPRQRERAAL

SEQ ID NO: 120892 - protein, 21 aa, Mycobacterium avium
KVIDRAPLWCAVDLRDGNQAL

SEQ ID NO: 120893 - protein, 29 aa, Mycobacterium avium
KVILSRCLQVPFALDFPSTYRLARRHNTP

SEQ ID NO: 120894 - protein, 23 aa, Mycobacterium avium
KVPNASALPFRYTVNGYRGCSHA

SEQ ID NO: 120895 - protein, 20 aa, Mycobacterium avium
KVRPFRADGAYIITGGLGGL

SEQ ID NO: 120896 - protein, 19 aa, Mycobacterium avium
KVSALLEALPKVGKVKAQE

SEQ ID NO: 120897 - protein, 18 aa, Mycobacterium avium
KWELEDLSFAILHPKKYD

SEQ ID NO: 120898 - protein, 38 aa, Mycobacterium avium
KWHRQRVIEPLDIDAYRDFLIEIGYLLPEPEDFTITTS

SEQ ID NO: 120899 - protein, 18 aa, Mycobacterium avium
KWRAHPADVLPLWVAEMD

SEQ ID NO: 120900 - protein, 17 aa, Mycobacterium avium
KYMASALDGYAAAAAAV

SEQ ID NO: 120901 - protein, 25 aa, Mycobacterium avium
LAAAALLPDRWLIVGTGAADQELGD

SEQ ID NO: 120902 - protein, 17 aa, Mycobacterium avium
LAAEMIARVAPVERIRL

SEQ ID NO: 120903 - protein, 26 aa, Mycobacterium avium
LAAGACAGFFRHPPRVPPTRPGAIVA

SEQ ID NO: 120904 - protein, 17 aa, Mycobacterium avium
LAALAPLLGTWTGRGSG

SEQ ID NO: 120905 - protein, 32 aa, Mycobacterium avium
LAAPGARRQAALNRLLFPGPTKELEEHREQYG

SEQ ID NO: 120906 - protein, 18 aa, Mycobacterium avium
LAARLQLPIDVIATVPMA

SEQ ID NO: 120907 - protein, 28 aa, Mycobacterium avium
LAASPFPHFRHPIPPPGRGRVTLLGDAA

SEQ ID NO: 120908 - protein, 19 aa, Mycobacterium avium
LACMAAWANTDFRPDLTRV

SEQ ID NO: 120909 - protein, 23 aa, Mycobacterium avium
LADDPLFCDLLANLHLHLEHEVD

SEQ ID NO: 120910 - protein, 18 aa, Mycobacterium avium
LADHDWFREQFARLDYLQ

SEQ ID NO: 120911 - protein, 26 aa, Mycobacterium avium
LADLDRAALPALRHIVRIPIETDDPV

SEQ ID NO: 120912 - protein, 19 aa, Mycobacterium avium
LADLELGFAAAAKFGANAG

SEQ ID NO: 120913 - protein, 36 aa, Mycobacterium avium
LADPKWQGFPMLPTPELRTEWWDMMIERVGARTLAE

SEQ ID NO: 120914 - protein, 18 aa, Mycobacterium avium
LADPQVPVYALTTGPRWP

SEQ ID NO: 120915 - protein, 18 aa, Mycobacterium avium
LADVLDVGLRSSYVASWY

SEQ ID NO: 120916 - protein, 23 aa, Mycobacterium avium
LADVMLRYNFPGAGLTDDALRTL

SEQ ID NO: 120917 - protein, 18 aa, Mycobacterium avium
LADVVYQIGALQAIAHAA

SEQ ID NO: 120918 - protein, 30 aa, Mycobacterium avium
LAEGLHRALSKLFAMLRRGDPSGAAAGDLT

SEQ ID NO: 120919 - protein, 26 aa, Mycobacterium avium
LAEGRTDWRTVRLIITRTSLVTDAEL

SEQ ID NO: 120920 - protein, 27 aa, Mycobacterium avium
LAEILRAPLVKAFLLQVSAKTLGEFGF

SEQ ID NO: 120921 - protein, 19 aa, Mycobacterium avium
LAELILQSPMDISRPLWTA

SEQ ID NO: 120922 - protein, 26 aa, Mycobacterium avium
LAELRAARRMGSKSALLALIADCERG

SEQ ID NO: 120923 - protein, 25 aa, Mycobacterium avium
LAEQRRWLAPWYSSVPLQSGPAELT

SEQ ID NO: 120924 - protein, 19 aa, Mycobacterium avium
LAEYRRFVSPRGALALFGG

SEQ ID NO: 120925 - protein, 18 aa, Mycobacterium avium
LAGHPIGNLMLAGLSEVL

SEQ ID NO: 120926 - protein, 24 aa, Mycobacterium avium
LAGRHLRRHPNAQPVVLVVTDGEP

SEQ ID NO: 120927 - protein, 25 aa, Mycobacterium avium
LAHPDRAVAVLAALPAWAGAPEEAP

SEQ ID NO: 120928 - protein, 22 aa, Mycobacterium avium
LAITTELWHAPPAPTLAQLSEE

SEQ ID NO: 120929 - protein, 17 aa, Mycobacterium avium
LAKPGRLAGPDPSLLAA

SEQ ID NO: 120930 - protein, 25 aa, Mycobacterium avium
LAKRDSEWMGRVHRFLGLDVGVILA

SEQ ID NO: 120931 - protein, 42 aa, Mycobacterium avium
LAKVPYYRVLELAPWLKWPQPNFPVSNFFHAGAAPLNAVLAA

SEQ ID NO: 120932 - protein, 17 aa, Mycobacterium avium
LALAWPKEHGGGGGSVW

SEQ ID NO: 120933 - protein, 18 aa, Mycobacterium avium
LALCQATRQVIANGLAIL

SEQ ID NO: 120934 - protein, 20 aa, Mycobacterium avium
LALGGRFIELGKRDIYRDSR

SEQ ID NO: 120935 - protein, 17 aa, Mycobacterium avium
LALIALSAKMRIDQIEE

SEQ ID NO: 120936 - protein, 18 aa, Mycobacterium avium
LAMDLLPYERSSCFWQRI

SEQ ID NO: 120937 - protein, 26 aa, Mycobacterium avium
LAMHLAAVRPDRVAGLLLLDPAIGLD

SEQ ID NO: 120938 - protein, 34 aa, Mycobacterium avium
LANHPPAQAMRRWMDLFTDWLATKHGMLGTLRAM

SEQ ID NO: 120939 - protein, 17 aa, Mycobacterium avium
LANWDRFHTRRPIIEVC

SEQ ID NO: 120940 - protein, 36 aa, Mycobacterium avium
LAPDRVYICTSFHQSPLPLALLCRMAAVPWVGAVSV

SEQ ID NO: 120941 - protein, 27 aa, Mycobacterium avium
LAPQVVTIFARLYRLGFPIEKIRTVDH

SEQ ID NO: 120942 - protein, 17 aa, Mycobacterium avium
LAPVVFTSALGLGELFS

SEQ ID NO: 120943 - protein, 34 aa, Mycobacterium avium
LAQGIPARPVVIGPITFLLLSKGVDGAGAPIERL

SEQ ID NO: 120944 - protein, 19 aa, Mycobacterium avium
LAQKAFHRSADALAAMIAS

SEQ ID NO: 120945 - protein, 25 aa, Mycobacterium avium
LAQLSILVTLLDQGPIRMTDLAAHE

SEQ ID NO: 120946 - protein, 30 aa, Mycobacterium avium
LARAGWRVVILEAGPFWHPDEDWVSDEAGS

SEQ ID NO: 120947 - protein, 19 aa, Mycobacterium avium
LARILAGEQSLDVLAGAWS

SEQ ID NO: 120948 - protein, 22 aa, Mycobacterium avium
LARNPQLADLLLGKVVGGLPEL

SEQ ID NO: 120949 - protein, 26 aa, Mycobacterium avium
LARSVFNRFPYLEPLNHLQVELLRRY

SEQ ID NO: 120950 - protein, 24 aa, Mycobacterium avium
LARVSRSASYWHPSHPLQAHWMYD

SEQ ID NO: 120951 - protein, 17 aa, Mycobacterium avium
LARWEPTIVRPICNALI

SEQ ID NO: 120952 - protein, 26 aa, Mycobacterium avium
LASLPDGALMRRAAFGLATEIAAELT

SEQ ID NO: 120953 - protein, 19 aa, Mycobacterium avium
LASRARKAPGFALLGEPGE

SEQ ID NO: 120954 - protein, 20 aa, Mycobacterium avium
LASRCHPETLRQMRWANAML

SEQ ID NO: 120955 - protein, 19 aa, Mycobacterium avium
LATGACGRLGLPASGYLYG

SEQ ID NO: 120956 - protein, 26 aa, Mycobacterium avium
LATHHDLHLWLPHPSDRLWRALAGTN

SEQ ID NO: 120957 - protein, 25 aa, Mycobacterium avium
LATIRPYRPSLSHPVPPAALWGRPG

SEQ ID NO: 120958 - protein, 35 aa, Mycobacterium avium
LATITALPRYRDRGRPFLAFLYGIAAHKVADAHRA

SEQ ID NO: 120959 - protein, 17 aa, Mycobacterium avium
LAVGRRPNTDDLDLAVA

SEQ ID NO: 120960 - protein, 18 aa, Mycobacterium avium
LAVLVPELLLIGQMMDRS

SEQ ID NO: 120961 - protein, 19 aa, Mycobacterium avium
LCALPARYITPSSKKKPRP

SEQ ID NO: 120962 - protein, 19 aa, Mycobacterium avium
LCFCPELVAYHRPSQIRSA

SEQ ID NO: 120963 - protein, 26 aa, Mycobacterium avium
LCGTEPLLIERIDAEYARYFTPTGRP

SEQ ID NO: 120964 - protein, 23 aa, Mycobacterium avium
LDAADRLWIPVRRSWRLNERHYG

SEQ ID NO: 120965 - protein, 19 aa, Mycobacterium avium
LDAGVLIRDVGIPGYLRAT

SEQ ID NO: 120966 - protein, 17 aa, Mycobacterium avium
LDALLGLKETFKDLGEV

SEQ ID NO: 120967 - protein, 18 aa, Mycobacterium avium
LDALRRFLPDDGAVRSMF

SEQ ID NO: 120968 - protein, 17 aa, Mycobacterium avium
LDALTAHLQQHAPWGAQ

SEQ ID NO: 120969 - protein, 23 aa, Mycobacterium avium
LDCTAIRWGLWQDAGVVAGSEIA

SEQ ID NO: 120970 - protein, 31 aa, Mycobacterium avium
LDDLAERVGWQWRLVWYKAVAELLTGDYDSA

SEQ ID NO: 120971 - protein, 21 aa, Mycobacterium avium
LDDLRQRVLVWGDGALQVAAD

SEQ ID NO: 120972 - protein, 24 aa, Mycobacterium avium
LDDPVRQALIPPLQKIVKERGLWA

SEQ ID NO: 120973 - protein, 22 aa, Mycobacterium avium
LDDSLFAKFGLPAALGPRQEGV

SEQ ID NO: 120974 - protein, 25 aa, Mycobacterium avium
LDDVGEFVAWLRLPLRARHGQVAVL

SEQ ID NO: 120975 - protein, 34 aa, Mycobacterium avium
LDDVLRRAVRLLAQLTRQVAIVQYPTLSSSTVRH

SEQ ID NO: 120976 - protein, 21 aa, Mycobacterium avium
LDEALEIILPMIRGERATFEG

SEQ ID NO: 120977 - protein, 27 aa, Mycobacterium avium
LDELRRLIPPWVTLGSRLAALPKPQRY

SEQ ID NO: 120978 - protein, 24 aa, Mycobacterium avium
LDEWGNRAILTKPVKAPASIPGMF

SEQ ID NO: 120979 - protein, 22 aa, Mycobacterium avium
LDGYGLHIIERVPLPVRANAEN

SEQ ID NO: 120980 - protein, 22 aa, Mycobacterium avium
LDIADWWAYLDDVQSTYPLSYG

SEQ ID NO: 120981 - protein, 20 aa, Mycobacterium avium
LDIELLPSMTSREKVRHILG

SEQ ID NO: 120982 - protein, 24 aa, Mycobacterium avium
LDIENYWFRRHEVVYQRLARHCAG

SEQ ID NO: 120983 - protein, 18 aa, Mycobacterium avium
LDITLYRDDLMQKPPRPL

SEQ ID NO: 120984 - protein, 28 aa, Mycobacterium avium
LDLAKHRRILGDWLVTVPGLVAELARDE

SEQ ID NO: 120985 - protein, 19 aa, Mycobacterium avium
LDLKPGMTLLDIGCGWGTT

SEQ ID NO: 120986 - protein, 17 aa, Mycobacterium avium
LDLTVVNPLVDATWRFM

SEQ ID NO: 120987 - protein, 23 aa, Mycobacterium avium
LDLYARHRVECAVLLRGIGGFGT

SEQ ID NO: 120988 - protein, 24 aa, Mycobacterium avium
LDNWLSPPYARWSFQHVEDFVPTA

SEQ ID NO: 120989 - protein, 20 aa, Mycobacterium avium
LDPTLQLMLSGLRAVGIDGL

SEQ ID NO: 120990 - protein, 22 aa, Mycobacterium avium
LDPWHGAWFHPYSFTRLEVLAT

SEQ ID NO: 120991 - protein, 26 aa, Mycobacterium avium
LDRHTQPLIRLPLSTEELALRLIPSV

SEQ ID NO: 120992 - protein, 30 aa, Mycobacterium avium
LDRPLTASLGLLFLASGHRYGWPVAEGGSG

SEQ ID NO: 120993 - protein, 34 aa, Mycobacterium avium
LDSQAWLDVYRNFWTSFFRGFWKMGEMRGMWREM

SEQ ID NO: 120994 - protein, 37 aa, Mycobacterium avium
LDSWTNYQWHQLARTFLMYRTQRWPDVLLTAAEELPP

SEQ ID NO: 120995 - protein, 30 aa, Mycobacterium avium
LDVAQLYDGFTFLTLAWLEALGVCGDGEAG

SEQ ID NO: 120996 - protein, 17 aa, Mycobacterium avium
LDVARAVRPPTPGRRLP

SEQ ID NO: 120997 - protein, 26 aa, Mycobacterium avium
LDVRKAAVLALTRWAGEPAARDALGI

SEQ ID NO: 120998 - protein, 18 aa, Mycobacterium avium
LDVVGLREFAGHYPRQVS

SEQ ID NO: 120999 - protein, 17 aa, Mycobacterium avium
LDYASPVPAILTMKLMG

SEQ ID NO: 121000 - protein, 30 aa, Mycobacterium avium
LEAAYNLLHAWLQTPLTFAKWDAKPTGSLR

SEQ ID NO: 121001 - protein, 27 aa, Mycobacterium avium
LEAGLRNLYLLPSSPLQELRKLLPENT

SEQ ID NO: 121002 - protein, 17 aa, Mycobacterium avium
LEDGRHVWAIRGALQAP

SEQ ID NO: 121003 - protein, 22 aa, Mycobacterium avium
LEDLFVRPGFRRRGLARALLAA

SEQ ID NO: 121004 - protein, 20 aa, Mycobacterium avium
LEDLGWYVADNLPPQLITRM

SEQ ID NO: 121005 - protein, 18 aa, Mycobacterium avium
LEELKALWFAEAARYNGL

SEQ ID NO: 121006 - protein, 31 aa, Mycobacterium avium
LEFRPKVIIAGWSAYPRVLDFAAFASIADEV

SEQ ID NO: 121007 - protein, 23 aa, Mycobacterium avium
LEGQPEHLIDWKGNDWYAGKTDT

SEQ ID NO: 121008 - protein, 22 aa, Mycobacterium avium
LEKDWKSYGGTAYFGCPQRFSF

SEQ ID NO: 121009 - protein, 17 aa, Mycobacterium avium
LELLLRELDVHPGDVIE

SEQ ID NO: 121010 - protein, 31 aa, Mycobacterium avium
LELPDREFLVPPYTLGAWLGDGTSAAAQITA

SEQ ID NO: 121011 - protein, 17 aa, Mycobacterium avium
LEMLASGGDLTVPELLP

SEQ ID NO: 121012 - protein, 23 aa, Mycobacterium avium
LEPLLRRQRGAWVGWPGIVDEDV

SEQ ID NO: 121013 - protein, 25 aa, Mycobacterium avium
LEPSVRFNPILLKPGSDRTSQLVIK

SEQ ID NO: 121014 - protein, 26 aa, Mycobacterium avium
LEQTPIRSILSFELFVDRTSMAALNF

SEQ ID NO: 121015 - protein, 25 aa, Mycobacterium avium
LERAVARGSFFPVIPVCSSTGVGTC

SEQ ID NO: 121016 - protein, 17 aa, Mycobacterium avium
LERLQVAVQLLYEASRP

SEQ ID NO: 121017 - protein, 20 aa, Mycobacterium avium
LERMRSAPTVFIDAAHNPAG

SEQ ID NO: 121018 - protein, 23 aa, Mycobacterium avium
LERWAPLLRDGATLVSLAKGIEL

SEQ ID NO: 121019 - protein, 23 aa, Mycobacterium avium
LESALPAPWVACAADLVGVAGAA

SEQ ID NO: 121020 - protein, 19 aa, Mycobacterium avium
LFARAFPEITVEPDALFVC

SEQ ID NO: 121021 - protein, 18 aa, Mycobacterium avium
LFDAKLQLAPYSDGGIPL

SEQ ID NO: 121022 - protein, 22 aa, Mycobacterium avium
LFDNELIPIAGLATDEFIRPGT

SEQ ID NO: 121023 - protein, 17 aa, Mycobacterium avium
LFFDFEGDPLWTADGRE

SEQ ID NO: 121024 - protein, 24 aa, Mycobacterium avium
LFLGSSCIYPKYAPQPIHESALLT

SEQ ID NO: 121025 - protein, 18 aa, Mycobacterium avium
LFLRQLLSDQMAAGRMRR

SEQ ID NO: 121026 - protein, 19 aa, Mycobacterium avium
LFTGAEWLDTARGAGVDAV

SEQ ID NO: 121027 - protein, 17 aa, Mycobacterium avium
LFTVPLAELRQTSESVL

SEQ ID NO: 121028 - protein, 24 aa, Mycobacterium avium
LGAAHPMVWYKSFNYNLASQQPVT

SEQ ID NO: 121029 - protein, 19 aa, Mycobacterium avium
LGADNTSLFLHDESFRAAI

SEQ ID NO: 121030 - protein, 17 aa, Mycobacterium avium
LGAGLAGLLLIAAGDDV

SEQ ID NO: 121031 - protein, 27 aa, Mycobacterium avium
LGAQGCLQRLWWLHSGPGEPRVLALWR

SEQ ID NO: 121032 - protein, 27 aa, Mycobacterium avium
LGASRKRFLGTLLAGPDGAPRPPDGRE

SEQ ID NO: 121033 - protein, 19 aa, Mycobacterium avium
LGDGWLVAPAIAYGASGEH

SEQ ID NO: 121034 - protein, 24 aa, Mycobacterium avium
LGDNLRRTLLKLRRAKSNVQRLKL

SEQ ID NO: 121035 - protein, 36 aa, Mycobacterium avium
LGDTITFVIHIPLSIDLLVDLWLDKQRFVVSGDIAL

SEQ ID NO: 121036 - protein, 20 aa, Mycobacterium avium
LGEGFGVWRLGDDDAMLGIV

SEQ ID NO: 121037 - protein, 28 aa, Mycobacterium avium
LGEPARDLGPMLVFLAGSGSGFITGQLL

SEQ ID NO: 121038 - protein, 25 aa, Mycobacterium avium
LGERLPAYMVPAAVLGLDAIPLTPN

SEQ ID NO: 121039 - protein, 20 aa, Mycobacterium avium
LGETFFTTAYFDPNMAHMNE

SEQ ID NO: 121040 - protein, 29 aa, Mycobacterium avium
LGGATQLAELLWSFAPAPRSRPADASEIP

SEQ ID NO: 121041 - protein, 27 aa, Mycobacterium avium
LGGDKDFWLQVGIDPIRIITSSGTFYT

SEQ ID NO: 121042 - protein, 24 aa, Mycobacterium avium
LGGLSIALLAYQLSLNGQPAPVID

SEQ ID NO: 121043 - protein, 21 aa, Mycobacterium avium
LGGPFPPLPFTPEGDDISAQI

SEQ ID NO: 121044 - protein, 20 aa, Mycobacterium avium
LGHFALTNLLLPRLTDRVVT

SEQ ID NO: 121045 - protein, 19 aa, Mycobacterium avium
LGIIPLLQVDMWEHAFYLQ

SEQ ID NO: 121046 - protein, 17 aa, Mycobacterium avium
LGKPLHLINHPVRERIP

SEQ ID NO: 121047 - protein, 21 aa, Mycobacterium avium
LGLSYLLPRAIGSSRAFEIML

SEQ ID NO: 121048 - protein, 23 aa, Mycobacterium avium
LGPIRPPQRLAPHSYALGAEVKH

SEQ ID NO: 121049 - protein, 17 aa, Mycobacterium avium
LGPMAKLVKVRSGYEAA

SEQ ID NO: 121050 - protein, 25 aa, Mycobacterium avium
LGPNVRRLHYLSVPPKAARAVITML

SEQ ID NO: 121051 - protein, 18 aa, Mycobacterium avium
LGQLLGAQRRRELTPPQR

SEQ ID NO: 121052 - protein, 19 aa, Mycobacterium avium
LGQLPRIYRADGSPIRVLL

SEQ ID NO: 121053 - protein, 26 aa, Mycobacterium avium
LGREWDFVVIAGLQDGLWPNTVPRGG

SEQ ID NO: 121054 - protein, 21 aa, Mycobacterium avium
LGRTKVPWRDGFRRMIEARHP

SEQ ID NO: 121055 - protein, 18 aa, Mycobacterium avium
LGRYLAGRAAEAGARTLG

SEQ ID NO: 121056 - protein, 17 aa, Mycobacterium avium
LGSDPGLARFIDQVARR

SEQ ID NO: 121057 - protein, 24 aa, Mycobacterium avium
LGTYDSFRRLLRRATDPDPRRRFS

SEQ ID NO: 121058 - protein, 27 aa, Mycobacterium avium
LGYPRGNLAFRWFLADGVPARPEVELV

SEQ ID NO: 121059 - protein, 27 aa, Mycobacterium avium
LHAPSWCDPVWLDFPGIAFGRPDEAGA

SEQ ID NO: 121060 - protein, 31 aa, Mycobacterium avium
LHATIRASQNLIPRLFWTTYQGGRDDLLPFY

SEQ ID NO: 121061 - protein, 18 aa, Mycobacterium avium
LHDHLVDVLLDAAAMGRV

SEQ ID NO: 121062 - protein, 31 aa, Mycobacterium avium
LHEILGTARLLSFPVDYASVTRLLFSRSGQA

SEQ ID NO: 121063 - protein, 18 aa, Mycobacterium avium
LHHFGSREGLLLAIVEEV

SEQ ID NO: 121064 - protein, 28 aa, Mycobacterium avium
LHILEVQRLIRFMPKVVICLVNGWAAGG

SEQ ID NO: 121065 - protein, 18 aa, Mycobacterium avium
LHPRLAAPDWAPGSTVAQ

SEQ ID NO: 121066 - protein, 30 aa, Mycobacterium avium
LHQATAGQPLEWFCLFSSAAALVGSPGQGA

SEQ ID NO: 121067 - protein, 18 aa, Mycobacterium avium
LHRALLGVPAGRKLPWFG

SEQ ID NO: 121068 - protein, 39 aa, Mycobacterium avium
LHRAPGPLPFAGLRVLDLTTFWAGAYLTCYLGAFGADIV

SEQ ID NO: 121069 - protein, 25 aa, Mycobacterium avium
LHRLPLAIARLRRARRRTAPLFGIY

SEQ ID NO: 121070 - protein, 19 aa, Mycobacterium avium
LHRMPYRWNDAYPARLGVM

SEQ ID NO: 121071 - protein, 28 aa, Mycobacterium avium
LHRQIAYVPGDVTLWPSLTGGEIIDLLA

SEQ ID NO: 121072 - protein, 19 aa, Mycobacterium avium
LIAEGLSLPEAARAAIAGP

SEQ ID NO: 121073 - protein, 22 aa, Mycobacterium avium
LIAPHWPKPWGLDAGPLRQLII

SEQ ID NO: 121074 - protein, 17 aa, Mycobacterium avium
LIDRIRHAHDIPIIAAG

SEQ ID NO: 121075 - protein, 19 aa, Mycobacterium avium
LIDVNLIDPLARLLEQTLL

SEQ ID NO: 121076 - protein, 20 aa, Mycobacterium avium
LIEVDRTLSTWPQLASDVVL

SEQ ID NO: 121077 - protein, 18 aa, Mycobacterium avium
LIGRLMRELTSDWDYAVV

SEQ ID NO: 121078 - protein, 23 aa, Mycobacterium avium
LIGSMRGVDLAYLELYWGAKDLI

SEQ ID NO: 121079 - protein, 17 aa, Mycobacterium avium
LIGWTRGTGLMGHNDAI

SEQ ID NO: 121080 - protein, 24 aa, Mycobacterium avium
LINRPPDVLITTPESLFLMLTSAA

SEQ ID NO: 121081 - protein, 19 aa, Mycobacterium avium
LIPGLAYLDQSELAPDIQI

SEQ ID NO: 121082 - protein, 21 aa, Mycobacterium avium
LIPHGVWILGYRIYLWDMRSR

SEQ ID NO: 121083 - protein, 19 aa, Mycobacterium avium
LITAGRAWARFEHGQVVFK

SEQ ID NO: 121084 - protein, 24 aa, Mycobacterium avium
LKIWNMLQRLPFGNRIFSQAVCFK

SEQ ID NO: 121085 - protein, 20 aa, Mycobacterium avium
LKNVFAIAVGMGYSLGIGEN

SEQ ID NO: 121086 - protein, 27 aa, Mycobacterium avium
LKPQLVHYYFRTMEELFLEVFRRRAEE

SEQ ID NO: 121087 - protein, 17 aa, Mycobacterium avium
LKRLWPSLGTALTSLAD

SEQ ID NO: 121088 - protein, 18 aa, Mycobacterium avium
LKTLHPKLPSGPGQVWSQ

SEQ ID NO: 121089 - protein, 22 aa, Mycobacterium avium
LKTVFADFPGLEVCVYAAPSQT

SEQ ID NO: 121090 - protein, 18 aa, Mycobacterium avium
LKTYARLSGRWHTGLPVG

SEQ ID NO: 121091 - protein, 21 aa, Mycobacterium avium
LKVVDLLTPYVRGGKIALFGG

SEQ ID NO: 121092 - protein, 19 aa, Mycobacterium avium
LKWGVAVPPDDYDHWAPKP

SEQ ID NO: 121093 - protein, 18 aa, Mycobacterium avium
LLAGHYRGDRYWSDQVLD

SEQ ID NO: 121094 - protein, 22 aa, Mycobacterium avium
LLAHQELTRRGLLADADLVVAG

SEQ ID NO: 121095 - protein, 18 aa, Mycobacterium avium
LLARRLPGSIVSISSISG

SEQ ID NO: 121096 - protein, 23 aa, Mycobacterium avium
LLASIAASCTASYTVALVPGGPS

SEQ ID NO: 121097 - protein, 34 aa, Mycobacterium avium; identical to SEQ ID NO: 100120

SEQ ID NO: 121098 - protein, 17 aa, Mycobacterium avium
LLCGVVLTAPRAKDAEA

SEQ ID NO: 121099 - protein, 25 aa, Mycobacterium avium
LLDELCAAAQFRPRVALQAPNLTTA

SEQ ID NO: 121100 - protein, 25 aa, Mycobacterium avium
LLDGVIRTRGRLWLASRADRAMWLE

SEQ ID NO: 121101 - protein, 24 aa, Mycobacterium avium
LLDLSSLWQIYDLDRPALKDPAFV

SEQ ID NO: 121102 - protein, 21 aa, Mycobacterium avium
LLERQGWLVRRQGLGTFVANP

SEQ ID NO: 121103 - protein, 17 aa, Mycobacterium avium
LLGKTYHAIESKGAFVN

SEQ ID NO: 121104 - protein, 28 aa, Mycobacterium avium
LLGQEGMGFIYLMQNLPQERISIAVMAA

SEQ ID NO: 121105 - protein, 19 aa, Mycobacterium avium
LLGREMLDQRFAGMKQALQ

SEQ ID NO: 121106 - protein, 23 aa, Mycobacterium avium
LLGSSMYSAHLAAAKGLPYVFAH

SEQ ID NO: 121107 - protein, 21 aa, Mycobacterium avium
LLHVDDLASACLFLLEHFDGP

SEQ ID NO: 121108 - protein, 19 aa, Mycobacterium avium
LLIAPRLEDRYPSHGVIAK

SEQ ID NO: 121109 - protein, 17 aa, Mycobacterium avium
LLIELRDVSLRRGGNVL

SEQ ID NO: 121110 - protein, 18 aa, Mycobacterium avium
LLNFQTMVADLTGLEIAN

SEQ ID NO: 121111 - protein, 27 aa, Mycobacterium avium
LLNVVHTRGPWRLIIAQHFASADELMA

SEQ ID NO: 121112 - protein, 17 aa, Mycobacterium avium
LLPALLEALVRNVSRGL

SEQ ID NO: 121113 - protein, 29 aa, Mycobacterium avium
LLPVHVHFEGEGWRFLIYPALDCSSGDVG

SEQ ID NO: 121114 - protein, 26 aa, Mycobacterium avium
LLPYERSSCFWQRIAYLYSRFDDLIA

SEQ ID NO: 121115 - protein, 21 aa, Mycobacterium avium
LLRAGWLLRDPVRKTYHLGPA

SEQ ID NO: 121116 - protein, 18 aa, Mycobacterium avium
LLRSLDFTRGLAGDSGAV

SEQ ID NO: 121117 - protein, 30 aa, Mycobacterium avium
LLRSRQLMRAPIWIYRARGGAVFGSRILLL

SEQ ID NO: 121118 - protein, 25 aa, Mycobacterium avium
LLTFVNNELLPYLRGLSGTGSHDPR

SEQ ID NO: 121119 - protein, 20 aa, Mycobacterium avium
LLTKACLPHLRRAANPHVLT

SEQ ID NO: 121120 - protein, 20 aa, Mycobacterium avium
LLVDVIGLPWEEVHAEACRW

SEQ ID NO: 121121 - protein, 18 aa, Mycobacterium avium
LLVLQADVQPVPTAKLLA

SEQ ID NO: 121122 - protein, 19 aa, Mycobacterium avium
LLVSVFLDKDFTFVVSSEA

SEQ ID NO: 121123 - protein, 18 aa, Mycobacterium avium
LLYSSDYPHWTFDDPRWL

SEQ ID NO: 121124 - protein, 26 aa, Mycobacterium avium
LMAVEDWPLLRWRMRQYRHGRWGTHI

SEQ ID NO: 121125 - protein, 26 aa, Mycobacterium avium
LMDMTTRLLAIPLHQLYAVLWRVGII

SEQ ID NO: 121126 - protein, 32 aa, Mycobacterium avium
LMEDAWWGPTVPLVGAPWFALSERNSPGSIIV

SEQ ID NO: 121127 - protein, 21 aa, Mycobacterium avium
LMLSLGQRWITTLVAKLDQAA

SEQ ID NO: 121128 - protein, 17 aa, Mycobacterium avium
LMRAAMGGAVKFFAGRL

SEQ ID NO: 121129 - protein, 20 aa, Mycobacterium avium
LMRFPGRFSEHLLAEHLQKV

SEQ ID NO: 121130 - protein, 18 aa, Mycobacterium avium
LMTYKGLMFSGMPNFAIT

SEQ ID NO: 121131 - protein, 19 aa, Mycobacterium avium
LMYSGPGAGPLLAAAAAWN

SEQ ID NO: 121132 - protein, 18 aa, Mycobacterium avium
LNEEFPRLMVYRGPRRKG

SEQ ID NO: 121133 - protein, 20 aa, Mycobacterium avium
LNEHILGDPWPSAGVRLQML

SEQ ID NO: 121134 - protein, 26 aa, Mycobacterium avium
LNFRSRPYSAWLAYSQSKLANLLFTS

SEQ ID NO: 121135 - protein, 31 aa, Mycobacterium avium
LNGDLDRIPQLAWLLFLKAFDGLEENREITE

SEQ ID NO: 121136 - protein, 21 aa, Mycobacterium avium
LNLDSHYRSWFDRYARTFAAT

SEQ ID NO: 121137 - protein, 23 aa, Mycobacterium avium
LNPLPVTTFDIRRGRAALRYLSQ

SEQ ID NO: 121138 - protein, 18 aa, Mycobacterium avium
LNSPFLELPGPPILRHSL

SEQ ID NO: 121139 - protein, 18 aa, Mycobacterium avium
LNTGIWESWRHRPPRYAP

SEQ ID NO: 121140 - protein, 17 aa, Mycobacterium avium
LNTIRRLHPALQQLRTI

SEQ ID NO: 121141 - protein, 20 aa, Mycobacterium avium
LPAGLALAATFDPALARAAG

SEQ ID NO: 121142 - protein, 17 aa, Mycobacterium avium
LPALERLHRALLSGKPA

SEQ ID NO: 121143 - protein, 18 aa, Mycobacterium avium
LPAPIRLGGQRRYDEAVL

SEQ ID NO: 121144 - protein, 17 aa, Mycobacterium avium
LPATEFAGFLWVSLDPG

SEQ ID NO: 121145 - protein, 26 aa, Mycobacterium avium
LPAVRQRWPDVPPLRVRPRRAATAAH

SEQ ID NO: 121146 - protein, 20 aa, Mycobacterium avium
LPDALARFEELHRPAPRLHN

SEQ ID NO: 121147 - protein, 25 aa, Mycobacterium avium
LPDLDQPVEFWPTAAIRSALQSGDI

SEQ ID NO: 121148 - protein, 24 aa, Mycobacterium avium
LPDPDGIAYLIYTSGTTGAPKGVA

SEQ ID NO: 121149 - protein, 25 aa, Mycobacterium avium
LPDSRLWWLLNLVITRGTPPRLEGC

SEQ ID NO: 121150 - protein, 29 aa, Mycobacterium avium
LPDYRGLIGPRCRAVWLLTVRAEHVDGDD

SEQ ID NO: 121151 - protein, 25 aa, Mycobacterium avium
LPELDVYASYLTFDRARPLALDEIT

SEQ ID NO: 121152 - protein, 19 aa, Mycobacterium avium
LPELLGSMRRGGVAAVSPV

SEQ ID NO: 121153 - protein, 22 aa, Mycobacterium avium
LPERYAAALRAGRPPVVGRLEG

SEQ ID NO: 121154 - protein, 24 aa, Mycobacterium avium
LPEVPQLRWRVTGAPLGLDRPWFV

SEQ ID NO: 121155 - protein, 25 aa, Mycobacterium avium
LPFRAPKHWSALEPVLRDAGRDHSV

SEQ ID NO: 121156 - protein, 19 aa, Mycobacterium avium
LPGGTEVTLRFADGEVVTM

SEQ ID NO: 121157 - protein, 17 aa, Mycobacterium avium
LPGLRLAVPPEQLKFKD

SEQ ID NO: 121158 - protein, 20 aa, Mycobacterium avium
LPGNAHFTFRGCEGDALLML

SEQ ID NO: 121159 - protein, 20 aa, Mycobacterium avium
LPHPLDVGAPTSFIPPPAGG

SEQ ID NO: 121160 - protein, 21 aa, Mycobacterium avium
LPLLERAKFLAIFASNLDEFY

SEQ ID NO: 121161 - protein, 21 aa, Mycobacterium avium
LPLLVIHGGPGLPHDYLRSLR

SEQ ID NO: 121162 - protein, 18 aa, Mycobacterium avium
LPLRFISAAPIDARSYRD

SEQ ID NO: 121163 - protein, 17 aa, Mycobacterium avium
LPRRIGMQKAKEMAFFG

SEQ ID NO: 121164 - protein, 19 aa, Mycobacterium avium
LPRVASAALALTVLPANLG

SEQ ID NO: 121165 - protein, 22 aa, Mycobacterium avium
LPVAPMGFISTRYYVSMNVADK

SEQ ID NO: 121166 - protein, 18 aa, Mycobacterium avium
LPVLELLEPRLSPGVLVV

SEQ ID NO: 121167 - protein, 18 aa, Mycobacterium avium
LPYLVELTTPEQQRRWLP

SEQ ID NO: 121168 - protein, 17 aa, Mycobacterium avium
LQAVLDDPDFQAGRITT

SEQ ID NO: 121169 - protein, 18 aa, Mycobacterium avium
LQDIRPKVFDPKTGQYLA

SEQ ID NO: 121170 - protein, 23 aa, Mycobacterium avium
LQDRFFRELPELAVRWQAETFPE

SEQ ID NO: 121171 - protein, 27 aa, Mycobacterium avium
LQEIDHVPFVAPLARFAATAQSAADAG

SEQ ID NO: 121172 - protein, 18 aa, Mycobacterium avium
LQIAPGTDLALLNGLLHL

SEQ ID NO: 121173 - protein, 19 aa, Mycobacterium avium
LQKIVKERGLWATHLGPHL

SEQ ID NO: 121174 - protein, 18 aa, Mycobacterium avium
LQLGDIENFPFLDPPDRR

SEQ ID NO: 121175 - protein, 26 aa, Mycobacterium avium
LQLMSNPNLMFPQTPLSIGAKQGTDM

SEQ ID NO: 121176 - protein, 23 aa, Mycobacterium avium
LQNRLPCIYLVDSGGAFLPRQDE

SEQ ID NO: 121177 - protein, 26 aa, Mycobacterium avium
LQPGLRRLHDITGRPTYGVLPYADRL

SEQ ID NO: 121178 - protein, 21 aa, Mycobacterium avium
LQPLPAPRFSRTAPETPRPAA

SEQ ID NO: 121179 - protein, 27 aa, Mycobacterium avium
LQPWDRDQIHRLFDDLEFRVLRDRLFE

SEQ ID NO: 121180 - protein, 28 aa, Mycobacterium avium
LQQTPVSRVLPIWPDWVRRWPTPSATAA

SEQ ID NO: 121181 - protein, 26 aa, Mycobacterium avium
LQRPEVRWWMLDFAGPGLKKMMNKKM

SEQ ID NO: 121182 - protein, 30 aa, Mycobacterium avium
LQSRHRIADILPLTPLQQGLLFHSSTAQGN

SEQ ID NO: 121183 - protein, 17 aa, Mycobacterium avium
LQVATALCDARGGAVAP

SEQ ID NO: 121184 - protein, 20 aa, Mycobacterium avium
LRAATWAAFPGVHGKAYRAL

SEQ ID NO: 121185 - protein, 23 aa, Mycobacterium avium
LRAEAPGLRFAGLGGATETPVHN

SEQ ID NO: 121186 - protein, 18 aa, Mycobacterium avium
LRAGYWRQVRTQLVVTPA

SEQ ID NO: 121187 - protein, 29 aa, Mycobacterium avium
LRALAAPPQRRQWWIDRVTACHGLLVPSS

SEQ ID NO: 121188 - protein, 17 aa, Mycobacterium avium
LRAPMSAGYRYLGGAPP

SEQ ID NO: 121189 - protein, 18 aa, Mycobacterium avium
LRAPQPDGTPAVLLQHRA

SEQ ID NO: 121190 - protein, 26 aa, Mycobacterium avium
LRDAIADTMFPILLTAASEVTCDAGQ

SEQ ID NO: 121191 - protein, 20 aa, Mycobacterium avium
LRDGLGIAVPLGVPAAFTEE

SEQ ID NO: 121192 - protein, 26 aa, Mycobacterium avium
LRDLGCDYVICYFPEAAYDRSGIELF

SEQ ID NO: 121193 - protein, 18 aa, Mycobacterium avium
LRDRILTGALPAGSRIDL

SEQ ID NO: 121194 - protein, 27 aa, Mycobacterium avium
LREDIVTPLFSIYVSPRIRAAIGTFAG

SEQ ID NO: 121195 - protein, 24 aa, Mycobacterium avium
LREENPQLPVLLLTAKDAVEDRIA

SEQ ID NO: 121196 - protein, 20 aa, Mycobacterium avium
LREQFPLLDRGRDALRLLHE

SEQ ID NO: 121197 - protein, 24 aa, Mycobacterium avium
LREYVGYIVEKRFNLSWSIEGTRS

SEQ ID NO: 121198 - protein, 17 aa, Mycobacterium avium
LRFEQIFHHAPASESLL

SEQ ID NO: 121199 - protein, 33 aa, Mycobacterium avium
LRGDRMWEFLDRLTSIALPRIRDFRGLSPKQFD

SEQ ID NO: 121200 - protein, 19 aa, Mycobacterium avium
LRIELLDRPGSLGSLAVAL

SEQ ID NO: 121201 - protein, 18 aa, Mycobacterium avium
LRISDLAHLLRLPGPYEA

SEQ ID NO: 121202 - protein, 17 aa, Mycobacterium avium
LRLDFFVSTSSIASVWG

SEQ ID NO: 121203 - protein, 21 aa, Mycobacterium avium
LRLGHLLGQAILRSARRHEAA

SEQ ID NO: 121204 - protein, 17 aa, Mycobacterium avium
LRLLLGHPAYAQGRLTI

SEQ ID NO: 121205 - protein, 18 aa, Mycobacterium avium
LRLPMWGPVVMVSDPQLA

SEQ ID NO: 121206 - protein, 19 aa, Mycobacterium avium
LRLVHPLIVAVQTLFRGQT

SEQ ID NO: 121207 - protein, 17 aa, Mycobacterium avium
LRNLGHCARVVVVGTTP

SEQ ID NO: 121208 - protein, 17 aa, Mycobacterium avium
LRPHLMSVAYRLTGTVA

SEQ ID NO: 121209 - protein, 37 aa, Mycobacterium avium
LRPLTLSAPKPMLPTAGLPFLTHLLSRIAAAGIEHVI

SEQ ID NO: 121210 - protein, 23 aa, Mycobacterium avium
LRQKNPAVTARRKLRMICHGIGR

SEQ ID NO: 121211 - protein, 21 aa, Mycobacterium avium
LRRQPLQWPCPPQSTADRNPI

SEQ ID NO: 121212 - protein, 18 aa, Mycobacterium avium
LRRRVRLASVLRRCTVLD

SEQ ID NO: 121213 - protein, 20 aa, Mycobacterium avium
LRRWRAVAKAAARQSRRPHI

SEQ ID NO: 121214 - protein, 32 aa, Mycobacterium avium
LRSADVVACTPWYEPFGIVPLEAMACGVPVVA

SEQ ID NO: 121215 - protein, 17 aa, Mycobacterium avium
LRSLAGPGGMLSIACST

SEQ ID NO: 121216 - protein, 29 aa, Mycobacterium avium
LRTAPPFAVHRFWLDRPVSPRRPAFLGTA

SEQ ID NO: 121217 - protein, 35 aa, Mycobacterium avium
LRTILRLSPEAVFKPRWLWKFGKTLRPPELRVPNQ

SEQ ID NO: 121218 - protein, 19 aa, Mycobacterium avium
LRVLAPLGLVFDENSPWLS

SEQ ID NO: 121219 - protein, 26 aa, Mycobacterium avium
LRVSELPYLVPILEQSFDHPDYVLVV

SEQ ID NO: 121220 - protein, 29 aa, Mycobacterium avium
LRVVSPDAFFQFPTSKYGLALDNWSIRRL

SEQ ID NO: 121221 - protein, 17 aa, Mycobacterium avium
LSALDLPLITGAGLVRP

SEQ ID NO: 121222 - protein, 21 aa, Mycobacterium avium
LSALGTPSWYARFAAQAMADP

SEQ ID NO: 121223 - protein, 25 aa, Mycobacterium avium
LSDEYEWVPLRLPPEVTRVSASTRL

SEQ ID NO: 121224 - protein, 26 aa, Mycobacterium avium
LSDPRLQRIFTFQSLYAGVAPRDALA

SEQ ID NO: 121225 - protein, 18 aa, Mycobacterium avium
LSGTAVSLLVPLGSTEQH

SEQ ID NO: 121226 - protein, 26 aa, Mycobacterium avium
LSHIAWYTVLACFKLGIVIEGTLARA

SEQ ID NO: 121227 - protein, 17 aa, Mycobacterium avium
LSKIARLVDLYAKRPQV

SEQ ID NO: 121228 - protein, 17 aa, Mycobacterium avium
LSKKLAIRRFSVTTAAC

SEQ ID NO: 121229 - protein, 19 aa, Mycobacterium avium
LSLPQAFRRAYATVLSQLP

SEQ ID NO: 121230 - protein, 34 aa, Mycobacterium avium
LSMLETQILCLTYYPVTYFEVLGRPWRDTRRPTV

SEQ ID NO: 121231 - protein, 19 aa, Mycobacterium avium
LSRRRIYHSFNPQGVNIVA

SEQ ID NO: 121232 - protein, 22 aa, Mycobacterium avium
LSSALWLKYNLLAERHTRGVPR

SEQ ID NO: 121233 - protein, 21 aa, Mycobacterium avium
LSSMWAGPLCGQLLARAGATV

SEQ ID NO: 121234 - protein, 20 aa, Mycobacterium avium
LSTKFTRLTGRSPILLAGMT

SEQ ID NO: 121235 - protein, 20 aa, Mycobacterium avium
LSYSLDEACLLIFGRRDLSA

SEQ ID NO: 121236 - protein, 19 aa, Mycobacterium avium
LTAARALGRYGVCANAICP

SEQ ID NO: 121237 - protein, 29 aa, Mycobacterium avium
LTARFERDAIPLLDQLYGGALRMTRNPAD

SEQ ID NO: 121238 - protein, 24 aa, Mycobacterium avium
LTARQQPLVAILWGRDASTLKPIL

SEQ ID NO: 121239 - protein, 21 aa, Mycobacterium avium
LTASRFVACPFGAPGARMYRT

SEQ ID NO: 121240 - protein, 25 aa, Mycobacterium avium
LTDDEVLGFMFLMVIAGNETTTKLL

SEQ ID NO: 121241 - protein, 17 aa, Mycobacterium avium
LTDHLSALGTPSWYARF

SEQ ID NO: 121242 - protein, 26 aa, Mycobacterium avium
LTELARELRPWVPVVSLVKGLEQGTN

SEQ ID NO: 121243 - protein, 19 aa, Mycobacterium avium
LTGFDRLRLIQRIVDRLPE

SEQ ID NO: 121244 - protein, 24 aa, Mycobacterium avium
LTGLPVFCVDYRLAPRHRFPTAAD

SEQ ID NO: 121245 - protein, 28 aa, Mycobacterium avium
LTGPDGWYRFLTIKPGPYPWRNHHNAWR

SEQ ID NO: 121246 - protein, 18 aa, Mycobacterium avium
LTGPPPRFDSLPTLFAEQ

SEQ ID NO: 121247 - protein, 24 aa, Mycobacterium avium
LTGRPFAASAPRIGAPRWDTVIIG

SEQ ID NO: 121248 - protein, 17 aa, Mycobacterium avium
LTGRQNVAWFARLYGVP

SEQ ID NO: 121249 - protein, 28 aa, Mycobacterium avium
LTLAMLGVPLRKWTMYNEPVHAMVYTPP

SEQ ID NO: 121250 - protein, 26 aa, Mycobacterium avium
LTLRNRALLELLYSTGARISEAVGLD

SEQ ID NO: 121251 - protein, 25 aa, Mycobacterium avium
LTMDDYLAARWINEPFRVLDCTSEV

SEQ ID NO: 121252 - protein, 17 aa, Mycobacterium avium
LTMLSWNALKGIVEVGG

SEQ ID NO: 121253 - protein, 24 aa, Mycobacterium avium
LTNSYTGIVALFARLARQGQALEV

SEQ ID NO: 121254 - protein, 31 aa, Mycobacterium avium
LTNVSILELDRLPTHLVIVGGSYIALEFAQM

SEQ ID NO: 121255 - protein, 26 aa, Mycobacterium avium
LTPLPGTLPEPEIWARLVRALGVVTE

SEQ ID NO: 121256 - protein, 23 aa, Mycobacterium avium
LTQLGTMYPGNFGLGPVAVLGDN

SEQ ID NO: 121257 - protein, 27 aa, Mycobacterium avium
LTQVGSPYVWGGAAPGGFDCSGLVMWA

SEQ ID NO: 121258 - protein, 17 aa, Mycobacterium avium
LTRMLARLEQRLGVALF

SEQ ID NO: 121259 - protein, 20 aa, Mycobacterium avium
LTRPAINHYFSSKRALYQEV

SEQ ID NO: 121260 - protein, 27 aa, Mycobacterium avium
LTRPSLAHFIRTGQEFSWRAEELFAAI

SEQ ID NO: 121261 - protein, 21 aa, Mycobacterium avium
LTTPAAVMLRRCETCAADIDE

SEQ ID NO: 121262 - protein, 29 aa, Mycobacterium avium
LTTRVIDLIMPIGKGQRALIVSPPKAGKT

SEQ ID NO: 121263 - protein, 28 aa, Mycobacterium avium
LTYNGQFPGPLLRFMQGRRTWVDVYNDT

SEQ ID NO: 121264 - protein, 31 aa, Mycobacterium avium
LVALAVPDVGDLLTWRGGSELFEFADVEVVD

SEQ ID NO: 121265 - protein, 18 aa, Mycobacterium avium
LVARRRGISVLGDRPPMV

SEQ ID NO: 121266 - protein, 32 aa, Mycobacterium avium
LVATAAQWQALSSQFIGAPPSPGPSFEATTAA

SEQ ID NO: 121267 - protein, 25 aa, Mycobacterium avium
LVATEVGMLYQLRRAAPQVDFQAVN

SEQ ID NO: 121268 - protein, 23 aa, Mycobacterium avium
LVAWTTQGFPPGAPYAGPTGKDF

SEQ ID NO: 121269 - protein, 17 aa, Mycobacterium avium
LVAYHRPSQIRSASRAQ

SEQ ID NO: 121270 - protein, 31 aa, Mycobacterium avium
LVCSVPLLDMKRYHLLLAGASWVAEYGDPDN

SEQ ID NO: 121271 - protein, 18 aa, Mycobacterium avium
LVCTPRRPPRPTPVLQAM

SEQ ID NO: 121272 - protein, 23 aa, Mycobacterium avium
LVDVVLPLVDGLVPWLRRGADVA

SEQ ID NO: 121273 - protein, 25 aa, Mycobacterium avium
LVERTPGMRAKLFEAARLAAGAIGY

SEQ ID NO: 121274 - protein, 24 aa, Mycobacterium avium
LVGLDFPVFVIRDPIKFPQMVRSA

SEQ ID NO: 121275 - protein, 22 aa, Mycobacterium avium
LVGRLMSYKLDRSRPLWEMWVI

SEQ ID NO: 121276 - protein, 19 aa, Mycobacterium avium
LVIDGQLWQIVEFQHVKPG

SEQ ID NO: 121277 - protein, 19 aa, Mycobacterium avium
LVIPAPFDQTALMKSERIR

SEQ ID NO: 121278 - protein, 18 aa, Mycobacterium avium
LVLAADYPDRVSSLVIIN

SEQ ID NO: 121279 - protein, 17 aa, Mycobacterium avium
LVLLADLRRIHRLAAGV

SEQ ID NO: 121280 - protein, 33 aa, Mycobacterium avium
LVLSKLRERLGFGELRWAVSGAAPIPKETLAFF

SEQ ID NO: 121281 - protein, 25 aa, Mycobacterium avium
LVMAEPLTYFFSDPAARDFVTGVAQ

SEQ ID NO: 121282 - protein, 21 aa, Mycobacterium avium
LVMPMWERLEAAWGPARDVRD

SEQ ID NO: 121283 - protein, 18 aa, Mycobacterium avium
LVNCAGVLHRTPLPQETA

SEQ ID NO: 121284 - protein, 17 aa, Mycobacterium avium
LVPIDTPPYHAAAFGVS

SEQ ID NO: 121285 - protein, 17 aa, Mycobacterium avium
LVRAVGLDFFRRLVDGE

SEQ ID NO: 121286 - protein, 24 aa, Mycobacterium avium
LVRDPRWIALAGWAPRIQVVHDDR

SEQ ID NO: 121287 - protein, 19 aa, Mycobacterium avium
LVSAPLSFASQFFEGLSSL

SEQ ID NO: 121288 - protein, 33 aa, Mycobacterium avium
LVTPLTPQQRAWLNLVRPLTIVEGFALLSVPSS

SEQ ID NO: 121289 - protein, 29 aa, Mycobacterium avium
LVVDGIAADRFWMMGPPAPSDDVVRRKAA

SEQ ID NO: 121290 - protein, 32 aa, Mycobacterium avium
LVVGHPYVDIWQAVKPQRLGLAAWPEVPRHVE

SEQ ID NO: 121291 - protein, 23 aa, Mycobacterium avium
LVVRLRAPLRGVAPGQTLALYRR

SEQ ID NO: 121292 - protein, 18 aa, Mycobacterium avium
LWPAKPPRRPLYPVQVTE

SEQ ID NO: 121293 - protein, 19 aa, Mycobacterium avium
LWQIVEFQHVKPGKGPAFV

SEQ ID NO: 121294 - protein, 19 aa, Mycobacterium avium
LWTYGLIEEQSRLRGATPE

SEQ ID NO: 121295 - protein, 36 aa, Mycobacterium avium
LYAIPRGVNRWAVSLAYLTDALFARSVVSIGLSSED

SEQ ID NO: 121296 - protein, 20 aa, Mycobacterium avium
LYDADWMRYGWPAEVGGLGG

SEQ ID NO: 121297 - protein, 22 aa, Mycobacterium avium
LYDAPEVVIPMLVPDGAHSYPD

SEQ ID NO: 121298 - protein, 18 aa, Mycobacterium avium
LYDKFPALTPEQAAGVIA

SEQ ID NO: 121299 - protein, 28 aa, Mycobacterium avium
LYGRREVLSQLPPFLTGGSMIETVTMES

SEQ ID NO: 121300 - protein, 22 aa, Mycobacterium avium
LYPQIAARPFGMMIGFQGHHGF

SEQ ID NO: 121301 - protein, 17 aa, Mycobacterium avium
LYRVLRQRSMRERIRIE

SEQ ID NO: 121302 - protein, 27 aa, Mycobacterium avium
LYTYNDVPFYFHYLGPGAELGGPEIMT

SEQ ID NO: 121303 - protein, 17 aa, Mycobacterium avium
LYVTGRIADLVRIDGRN

SEQ ID NO: 121304 - protein, 25 aa, Mycobacterium avium
MAAAAAPFIAWLDGTAVQAEQTAAQ

SEQ ID NO: 121305 - protein, 17 aa, Mycobacterium avium
MAAARRLSALPVVAAVG

SEQ ID NO: 121306 - protein, 24 aa, Mycobacterium avium
MAAHGFDRWLLPTLADGRVALDDA

SEQ ID NO: 121307 - protein, 22 aa, Mycobacterium avium
MAAISAVLRALAPPGSTVVVPA

SEQ ID NO: 121308 - protein, 27 aa, Mycobacterium avium
MAARTAFFDNFFLAATRAGVRQVVILA

SEQ ID NO: 121309 - protein, 17 aa, Mycobacterium avium
MAGLLARAIVVVGADGN

SEQ ID NO: 121310 - protein, 25 aa, Mycobacterium avium
MANPANRFHSWIYRARPDVQCIVHT

SEQ ID NO: 121311 - protein, 21 aa, Mycobacterium avium
MASVIPKLHALPAGGAVHVGG

SEQ ID NO: 121312 - protein, 22 aa, Mycobacterium avium
MAVPGFPNFFMLYGPNTNVGSN

SEQ ID NO: 121313 - protein, 22 aa, Mycobacterium avium
MCKAVLVYRSLNGRSGYRFGHI

SEQ ID NO: 121314 - protein, 19 aa, Mycobacterium avium
MDKPLQRYWRDVHVGQMHA

SEQ ID NO: 121315 - protein, 24 aa, Mycobacterium avium
MDPQQRVALRVAWRALENSGINPD

SEQ ID NO: 121316 - protein, 24 aa, Mycobacterium avium
MEEATFLTRFARSVTLVHRREEFR

SEQ ID NO: 121317 - protein, 20 aa, Mycobacterium avium
MERLAPLGPVYQAGTLSGNP

SEQ ID NO: 121318 - protein, 20 aa, Mycobacterium avium
MFDTLLVYENFPMDGLTAGG

SEQ ID NO: 121319 - protein, 24 aa, Mycobacterium avium
MFMVSHFHYDPVWWNTQGAYTSEW

SEQ ID NO: 121320 - protein, 17 aa, Mycobacterium avium
MFPLESALLPDQDLPLR

SEQ ID NO: 121321 - protein, 21 aa, Mycobacterium avium
MFSLHVKATMMKVSHPIVFGH

SEQ ID NO: 121322 - protein, 17 aa, Mycobacterium avium
MFYLPRICEHCLNPSCV

SEQ ID NO: 121323 - protein, 25 aa, Mycobacterium avium
MGAVLHTLNIRLFPEQIAYVANEAE

SEQ ID NO: 121324 - protein, 30 aa, Mycobacterium avium; identical to SEQ ID NO: 24559

SEQ ID NO: 121325 - protein, 22 aa, Mycobacterium avium
MGEVRRYFRDYSWGMRVPRRLR

SEQ ID NO: 121326 - protein, 18 aa, Mycobacterium avium
MGINPFFDAPYEDVSKGI

SEQ ID NO: 121327 - protein, 21 aa, Mycobacterium avium
MGINWVGPALMRYGTEEQKAK

SEQ ID NO: 121328 - protein, 18 aa, Mycobacterium avium
MGLDIGPGSVKRFTALLS

SEQ ID NO: 121329 - protein, 27 aa, Mycobacterium avium
MGLFGYAIPQQWGGLGLNLMQDVELAM

SEQ ID NO: 121330 - protein, 19 aa, Mycobacterium avium
MGRLAGRGFAAYGTAKAAL

SEQ ID NO: 121331 - protein, 20 aa, Mycobacterium avium
MGRQLYERFVVFARALDEAV

SEQ ID NO: 121332 - protein, 17 aa, Mycobacterium avium
MIASTFLGLVPSPASPE

SEQ ID NO: 121333 - protein, 29 aa, Mycobacterium avium
MIREWLTVLLRRDLGLLVMIAVPGREPSR

SEQ ID NO: 121334 - protein, 25 aa, Mycobacterium avium
MISGLDVRYDLGPGHPLLGRRMPDL

SEQ ID NO: 121335 - protein, 19 aa, Mycobacterium avium
MISPTTLYDKFPALTPEQA

SEQ ID NO: 121336 - protein, 23 aa, Mycobacterium avium
MKGKPIIVLTTVGAKTGKLRRTP

SEQ ID NO: 121337 - protein, 17 aa, Mycobacterium avium
MKRVWAGEKLTESVLPV

SEQ ID NO: 121338 - protein, 25 aa, Mycobacterium avium
MKSVHRILRNFKMPGFTVPEFRRKA

SEQ ID NO: 121339 - protein, 24 aa, Mycobacterium avium
MLATTSFINLSRPPGPHKVAIDTT

SEQ ID NO: 121340 - protein, 17 aa, Mycobacterium avium
MLDILRRTDIMAHLAEW

SEQ ID NO: 121341 - protein, 18 aa, Mycobacterium avium
MLDLLGGDPAKLAELERR

SEQ ID NO: 121342 - protein, 34 aa, Mycobacterium avium
MLDTLIKEKWLTANAVIGFFPANAIGPGFEDIEL

SEQ ID NO: 121343 - protein, 27 aa, Mycobacterium avium
MLEADATNMLMLPLFNYADGNCDAIRE

SEQ ID NO: 121344 - protein, 30 aa, Mycobacterium avium
MLIHEALELVYSLGFRLTGLLPGFTDPRNG

SEQ ID NO: 121345 - protein, 17 aa, Mycobacterium avium
MLLDHLTHGRIIGGVGP

SEQ ID NO: 121346 - protein, 25 aa, Mycobacterium avium
MLQAFIGRMSGVPPAAWGGLAAARF

SEQ ID NO: 121347 - protein, 17 aa, Mycobacterium avium
MLRHLGVDEDRIRMLRS

SEQ ID NO: 121348 - protein, 19 aa, Mycobacterium avium
MLRPGRLFRSGELSGLDDE

SEQ ID NO: 121349 - protein, 54 aa, Mycobacterium avium
MLTDVKLLARLFGLPYFPVTPLFPLAGPMGLVPLPSKWHIAFGEPIYTGDYAAS

SEQ ID NO: 121350 - protein, 18 aa, Mycobacterium avium
MLVLGPLGESVGRVRDVV

SEQ ID NO: 121351 - protein, 17 aa, Mycobacterium avium
MMAKLRTGQPLGPVPLV

SEQ ID NO: 121352 - protein, 23 aa, Mycobacterium avium
MMFQQLPTAGLPFQFQTWAEFEG

SEQ ID NO: 121353 - protein, 19 aa, Mycobacterium avium
MMGTLVSPQYWMLERAMRE

SEQ ID NO: 121354 - protein, 30 aa, Mycobacterium avium
MNRGFHAFFRQYYNLRALLARLDPRLRMLV

SEQ ID NO: 121355 - protein, 20 aa, Mycobacterium avium
MNTEFYFKFLRAPDGSGITD

SEQ ID NO: 121356 - protein, 20 aa, Mycobacterium avium
MPAHYSAGWWMDSAASLAEA

SEQ ID NO: 121357 - protein, 38 aa, Mycobacterium avium
MPGGMYRNQMWLPYPGDNVLLCLGMCGQMIYVNRAAEM

SEQ ID NO: 121358 - protein, 28 aa, Mycobacterium avium
MPVPTCPDWTLRQLFRHVGRGDRWAAQI

SEQ ID NO: 121359 - protein, 21 aa, Mycobacterium avium
MPVVWAMFEWGRRHLPGRHRL

SEQ ID NO: 121360 - protein, 19 aa, Mycobacterium avium
MPYSWNPNYPARVGVMPRD

SEQ ID NO: 121361 - protein, 17 aa, Mycobacterium avium
MQWIAARFRGEPTAPNC

SEQ ID NO: 121362 - protein, 21 aa, Mycobacterium avium
MRAHQILLARVETALRPYDLS

SEQ ID NO: 121363 - protein, 19 aa, Mycobacterium avium
MRELTSDWDYAVVGGLTLG

SEQ ID NO: 121364 - protein, 18 aa, Mycobacterium avium
MRLDAFAERFTAAGYVCL

SEQ ID NO: 121365 - protein, 22 aa, Mycobacterium avium
MRNQVYVMGRFDLAPDEAFVVE

SEQ ID NO: 121366 - protein, 22 aa, Mycobacterium avium
MRRLRGRFYDGMRALHGAPDEV

SEQ ID NO: 121367 - protein, 28 aa, Mycobacterium avium
MRYVGDRFPLMPIPSWMDNPIDPISIRD

SEQ ID NO: 121368 - protein, 22 aa, Mycobacterium avium
MSEVLLPRRGTLVAWTTQGFPP

SEQ ID NO: 121369 - protein, 23 aa, Mycobacterium avium
MTAFDWFCWRLNKKVEDAQRREL

SEQ ID NO: 121370 - protein, 19 aa, Mycobacterium avium
MTAIVKGLRTGTDFEYELQ

SEQ ID NO: 121371 - protein, 21 aa, Mycobacterium avium
MTLHDVLVSPPIWFDASEGQV

SEQ ID NO: 121372 - protein, 19 aa, Mycobacterium avium
MTRAPGCPFAPPPKVLQLN

SEQ ID NO: 121373 - protein, 18 aa, Mycobacterium avium
MTVALLLAATRHLLPADA

SEQ ID NO: 121374 - protein, 17 aa, Mycobacterium avium
MVAFARHLEACGFESIV

SEQ ID NO: 121375 - protein, 18 aa, Mycobacterium avium
MVIQTALTVLLAKLGANP

SEQ ID NO: 121376 - protein, 27 aa, Mycobacterium avium
MVRDLEYIYCPWHQWGFELATGTTAVK

SEQ ID NO: 121377 - protein, 26 aa, Mycobacterium avium
MVRRHRLLETFLVNELGYAWDEVHDE

SEQ ID NO: 121378 - protein, 19 aa, Mycobacterium avium
MVSLAELWKSVGVSPDAVI

SEQ ID NO: 121379 - protein, 18 aa, Mycobacterium avium
MVVNPILPSLRDHDLRFV

SEQ ID NO: 121380 - protein, 19 aa, Mycobacterium avium
MWFNRDFFESPWPGWTVDV

SEQ ID NO: 121381 - protein, 30 aa, Mycobacterium avium
MWREVHRLRQPVLLIWGREDRVNPLDGALV

SEQ ID NO: 121382 - protein, 24 aa, Mycobacterium avium
MYKPRWGAFYGTKLEQHLRESGTD

SEQ ID NO: 121383 - protein, 23 aa, Mycobacterium avium
NAAALLLVALTLAPGREIVLSRG

SEQ ID NO: 121384 - protein, 26 aa, Mycobacterium avium
NAAAPGVIRLAPPLIVTEAQIDGFIA

SEQ ID NO: 121385 - protein, 22 aa, Mycobacterium avium
NAARARYGIPGPAAVFECVGAP

SEQ ID NO: 121386 - protein, 27 aa, Mycobacterium avium
NADQLLIVVALADPPPRTGLVDRALIA

SEQ ID NO: 121387 - protein, 25 aa, Mycobacterium avium
NADTWADPWPMYRALRDHDPVHHVV

SEQ ID NO: 121388 - protein, 18 aa, Mycobacterium avium
NAFDIRRPRQAHIAFAGG

SEQ ID NO: 121389 - protein, 21 aa, Mycobacterium avium
NAGGKVQWVLGNLGAIPTVKL

SEQ ID NO: 121390 - protein, 24 aa, Mycobacterium avium
NAGVYAFDTAALRSALNRLSADNA

SEQ ID NO: 121391 - protein, 23 aa, Mycobacterium avium
NANIYLPLANLTAFQSALLDPST

SEQ ID NO: 121392 - protein, 22 aa, Mycobacterium avium
NAPTWLCSVMGKSGLFSDYLIK

SEQ ID NO: 121393 - protein, 28 aa, Mycobacterium avium
NAQQELYLTDVIAILRGDGLPIRARHVD

SEQ ID NO: 121394 - protein, 25 aa, Mycobacterium avium
NDATAFIYIGEVCRYLLNQPAKPTD

SEQ ID NO: 121395 - protein, 25 aa, Mycobacterium avium
NDIQLQQMFLQAAKVTRLGEPRDIA

SEQ ID NO: 121396 - protein, 17 aa, Mycobacterium avium
NDMLRLRRWCSGTSNRW

SEQ ID NO: 121397 - protein, 38 aa, Mycobacterium avium
NDSMSPINLAMTEFKMFYKLPVEGLDIPKSALGAGLGL

SEQ ID NO: 121398 - protein, 17 aa, Mycobacterium avium
NDSMVARYAPRIAGRPA

SEQ ID NO: 121399 - protein, 37 aa, Mycobacterium avium
NDVVTRMWSFLAPAYDLPFLQQWVYRPPHNEVIAQLR

SEQ ID NO: 121400 - protein, 31 aa, Mycobacterium avium
NEEEASEWPWRPRHLVVTLGSHGARYVGADG

SEQ ID NO: 121401 - protein, 23 aa, Mycobacterium avium
NEELIGILGGETRQLAFAKTPPT

SEQ ID NO: 121402 - protein, 21 aa, Mycobacterium avium
NEHIHAVMWAARRSGLYYVPI

SEQ ID NO: 121403 - protein, 31 aa, Mycobacterium avium
NEPGWMLQTRLKALRIFERKPMPTWGSNLDG

SEQ ID NO: 121404 - protein, 26 aa, Mycobacterium avium
NETDDLRPLWLAAPVTEVLPRTTVAA

SEQ ID NO: 121405 - protein, 25 aa, Mycobacterium avium
NFAGYNGLLFISLDPAAPPLQDFLG

SEQ ID NO: 121406 - protein, 31 aa, Mycobacterium avium
NFDSPLSLLTPRLAQLIAIGGFRNWDRMVKR

SEQ ID NO: 121407 - protein, 20 aa, Mycobacterium avium
NFDVFDFDFGAETALTSSRD

SEQ ID NO: 121408 - protein, 26 aa, Mycobacterium avium
NFMTQGWFTGLVPITVPIAAASFADA

SEQ ID NO: 121409 - protein, 23 aa, Mycobacterium avium
NFPQAFTHLALINAVVHVIRAEE

SEQ ID NO: 121410 - protein, 20 aa, Mycobacterium avium
NFRDVMITLGMFTHDALLGG

SEQ ID NO: 121411 - protein, 18 aa, Mycobacterium avium
NGALLVFADDRPPVLATD

SEQ ID NO: 121412 - protein, 23 aa, Mycobacterium avium
NGARDPLRLPGNAHFTFRGCEGD

SEQ ID NO: 121413 - protein, 26 aa, Mycobacterium avium
NGDCVAFFWFADAPDRVPGISSPGAI

SEQ ID NO: 121414 - protein, 17 aa, Mycobacterium avium
NGFVFINFDPQPRQSLR

SEQ ID NO: 121415 - protein, 17 aa, Mycobacterium avium
NGGWTVMRFALDAEHGI

SEQ ID NO: 121416 - protein, 23 aa, Mycobacterium avium
NGIPLWAGAAFKHASAGPAADII

SEQ ID NO: 121417 - protein, 17 aa, Mycobacterium avium
NGLPLHGVLAGYPGWRV

SEQ ID NO: 121418 - protein, 17 aa, Mycobacterium avium
NGPVTTVIINRPAARNA

SEQ ID NO: 121419 - protein, 19 aa, Mycobacterium avium
NGSPAVYLLDGLRAQDDYN

SEQ ID NO: 121420 - protein, 24 aa, Mycobacterium avium
NGTAAILLAFYVAAAEKKGIPRAN

SEQ ID NO: 121421 - protein, 23 aa, Mycobacterium avium
NGTPLLEWLRRRGVDEVDVVGIA

SEQ ID NO: 121422 - protein, 25 aa, Mycobacterium avium
NGVCGYRRFFSITSLAGLRQEDPAV

SEQ ID NO: 121423 - protein, 26 aa, Mycobacterium avium
NGYSPFASLFYNTEGLPYFSTGMANT

SEQ ID NO: 121424 - protein, 28 aa, Mycobacterium avium
NHDVGFYGPTGIFIKVGYRGNLVVSGYT

SEQ ID NO: 121425 - protein, 17 aa, Mycobacterium avium
NHRGGTVLGPAAAPLGA

SEQ ID NO: 121426 - protein, 17 aa, Mycobacterium avium
NHTSQRWPAGTPVLFPR

SEQ ID NO: 121427 - protein, 26 aa, Mycobacterium avium
NIELQDFILMNKTLAGTIFGSCNPRA

SEQ ID NO: 121428 - protein, 18 aa, Mycobacterium avium
NIPPTRFKRKEHWLDVHF

SEQ ID NO: 121429 - protein, 25 aa, Mycobacterium avium
NKAAALQTLFPGPAAAPRVCAVVGR

SEQ ID NO: 121430 - protein, 17 aa, Mycobacterium avium
NKRAGAPSLLPGGRWAA

SEQ ID NO: 121431 - protein, 33 aa, Mycobacterium avium
NKVMPIMTSLLNYYPHLLALSASSPWWTGVDTG

SEQ ID NO: 121432 - protein, 18 aa, Mycobacterium avium
NLDKLDLKPGMTLLDIGC

SEQ ID NO: 121433 - protein, 23 aa, Mycobacterium avium
NLEHTVLGIFRDISRPTYDDAAR

SEQ ID NO: 121434 - protein, 22 aa, Mycobacterium avium
NLGLIRAMEKFDYTKGFKFSTY

SEQ ID NO: 121435 - protein, 26 aa, Mycobacterium avium
NLITSRSPKDLPAFCSTILAQFAGAT

SEQ ID NO: 121436 - protein, 20 aa, Mycobacterium avium
NLKGPFRLSALVGERMVAAG

SEQ ID NO: 121437 - protein, 19 aa, Mycobacterium avium
NLLFFTGDAMARPLLDALN

SEQ ID NO: 121438 - protein, 25 aa, Mycobacterium avium
NLNRRNRLFWPTTCTVVEIIPDRKL

SEQ ID NO: 121439 - protein, 28 aa, Mycobacterium avium
NLRLRDGRWYWHWDPAFMTKPGDDPELR

SEQ ID NO: 121440 - protein, 25 aa, Mycobacterium avium
NLTGRPAISVPLHWTDDGLPLGVQF

SEQ ID NO: 121441 - protein, 20 aa, Mycobacterium avium
NLVAQACAFINYAMGRYGVA

SEQ ID NO: 121442 - protein, 26 aa, Mycobacterium avium
NLVDGDHIMVVLALAMREAGELASDT

SEQ ID NO: 121443 - protein, 20 aa, Mycobacterium avium
NLYMMGTFRLDPGQALVLDI

SEQ ID NO: 121444 - protein, 23 aa, Mycobacterium avium
NMFGPMRLTMRCHDLLKSSRAAG

SEQ ID NO: 121445 - protein, 26 aa, Mycobacterium avium
NNAGIEQFGYLWDTPVVNWQRVMDVN

SEQ ID NO: 121446 - protein, 24 aa, Mycobacterium avium
NNDVGFIGVPFFHIAGIGNMLTGL

SEQ ID NO: 121447 - protein, 21 aa, Mycobacterium avium
NNGSFPEFPLPLGNPSEATAS

SEQ ID NO: 121448 - protein, 21 aa, Mycobacterium avium
NNIRTAIRQLSVRAQLARKEG

SEQ ID NO: 121449 - protein, 31 aa, Mycobacterium avium
NNSALLPPPAPRALLALLKGPPPDSPREVII

SEQ ID NO: 121450 - protein, 22 aa, Mycobacterium avium
NPDSLTLLGALAAWTERVRLLT

SEQ ID NO: 121451 - protein, 21 aa, Mycobacterium avium
NPEAVYYRRGPFTPADITASR

SEQ ID NO: 121452 - protein, 31 aa, Mycobacterium avium
NPEHLIAADLTWLLSRWTCVFGTPACQGTVA

SEQ ID NO: 121453 - protein, 18 aa, Mycobacterium avium
NPFFLIQALHHVDESGGR

SEQ ID NO: 121454 - protein, 24 aa, Mycobacterium avium
NPIMAAAMFLARTSTLIASVDCAL

SEQ ID NO: 121455 - protein, 31 aa, Mycobacterium avium
NPLAAQWLIRVFLALWGWPLKDPAAERALVH

SEQ ID NO: 121456 - protein, 22 aa, Mycobacterium avium
NPLQVRQLLYRAQREGALLPVG

SEQ ID NO: 121457 - protein, 25 aa, Mycobacterium avium
NPNLRPLVNGPFYAVRMVLSDLGTC

SEQ ID NO: 121458 - protein, 55 aa, Mycobacterium avium
NPSQFPALINYFIAWQTYRIINWTIRTLRFILQELPLLLQVGLSLSITSLGGLAG

SEQ ID NO: 121459 - protein, 19 aa, Mycobacterium avium
NPVVPMTRNFKLYSSGNTP

SEQ ID NO: 121460 - protein, 17 aa, Mycobacterium avium
NPYLDGFLAPVRAEVTA

SEQ ID NO: 121461 - protein, 20 aa, Mycobacterium avium
NQGYTMDPFAPFGGVKASGY

SEQ ID NO: 121462 - protein, 21 aa, Mycobacterium avium
NQQLLAYLQAWRELLERWTAM

SEQ ID NO: 121463 - protein, 24 aa, Mycobacterium avium
NRATMHRGRPWPAHQPRCMVRSTI

SEQ ID NO: 121464 - protein, 25 aa, Mycobacterium avium
NRELKRANEILKRAASFFGAELDRQ

SEQ ID NO: 121465 - protein, 24 aa, Mycobacterium avium
NRHSGWTLATFPPGYSGPTDVFKR

SEQ ID NO: 121466 - protein, 17 aa, Mycobacterium avium
NRLKYYERMGFAKANAS

SEQ ID NO: 121467 - protein, 22 aa, Mycobacterium avium
NRLPPVHVFAGINLSFGAMGPL

SEQ ID NO: 121468 - protein, 23 aa, Mycobacterium avium
NRLSWATPFTEVLDWSRAPFAEW

SEQ ID NO: 121469 - protein, 18 aa, Mycobacterium avium
NRMFLQRLKDKLGNHANA

SEQ ID NO: 121470 - protein, 25 aa, Mycobacterium avium
NRSKLSEMPVLWAYARDLFQTPGFG

SEQ ID NO: 121471 - protein, 18 aa, Mycobacterium avium
NRVYVRCGMVPAGVDVIW

SEQ ID NO: 121472 - protein, 27 aa, Mycobacterium avium
NSAIVRPLLRVFFRSWFRVEVSGIENL

SEQ ID NO: 121473 - protein, 19 aa, Mycobacterium avium
NSPFFFGHQLWAETRIELF

SEQ ID NO: 121474 - protein, 17 aa, Mycobacterium avium
NSPYYPHDALFGSAATQ

SEQ ID NO: 121475 - protein, 24 aa, Mycobacterium avium
NSVAPGPIWTPLIPSTMPPDSVES

SEQ ID NO: 121476 - protein, 17 aa, Mycobacterium avium
NTAFKLLEQSRSAVMLC

SEQ ID NO: 121477 - protein, 19 aa, Mycobacterium avium
NTALLLAQLRDVPDERRAA

SEQ ID NO: 121478 - protein, 24 aa, Mycobacterium avium
NTDNMFGFWDWVGGRYSVDSAIGL

SEQ ID NO: 121479 - protein, 22 aa, Mycobacterium avium
NTPGLRWPDLALQGGRLNWAAV

SEQ ID NO: 121480 - protein, 23 aa, Mycobacterium avium
NTPWRSEYLYSRAATIYGGTAEI

SEQ ID NO: 121481 - protein, 24 aa, Mycobacterium avium
NTVVIRLRPQSHQSFRELLAQTRD

SEQ ID NO: 121482 - protein, 17 aa, Mycobacterium avium
NVAGLLSAAGAPLAESD

SEQ ID NO: 121483 - protein, 18 aa, Mycobacterium avium
NVAILAGDYLFATASRLV

SEQ ID NO: 121484 - protein, 22 aa, Mycobacterium avium
NVDAVMRTLLARGLITEAGVDE

SEQ ID NO: 121485 - protein, 25 aa, Mycobacterium avium
NVDPKRKVRFLPYGIAVSVLDDDPE

SEQ ID NO: 121486 - protein, 26 aa, Mycobacterium avium
NVGRPLVTALLAAGAPVRAVTRRSGP

SEQ ID NO: 121487 - protein, 22 aa, Mycobacterium avium
NVIAIRGERLALRRLRFSEQDR

SEQ ID NO: 121488 - protein, 19 aa, Mycobacterium avium
NVLPSMEAAFVDIGRGRNG

SEQ ID NO: 121489 - protein, 25 aa, Mycobacterium avium
NVLRRLYSLLRPGGQLRYLEHIASA

SEQ ID NO: 121490 - protein, 17 aa, Mycobacterium avium
NVNGTFYAIANYCPHQG

SEQ ID NO: 121491 - protein, 20 aa, Mycobacterium avium
NVNIRLAIDWLDRWADDMPL

SEQ ID NO: 121492 - protein, 24 aa, Mycobacterium avium
NVPADLVEYVIMGQVLTAGAGQMP

SEQ ID NO: 121493 - protein, 18 aa, Mycobacterium avium
NVPNVVRTLAAPADPPGL

SEQ ID NO: 121494 - protein, 17 aa, Mycobacterium avium
NVPQSALYLADVITRGG

SEQ ID NO: 121495 - protein, 38 aa, Mycobacterium avium
NVSLDKARRLLWPVKKKYGNKISWADLIIFAGNCALES

SEQ ID NO: 121496 - protein, 26 aa, Mycobacterium avium
NVTSGLAFMPSALTPTYCASKAALHS

SEQ ID NO: 121497 - protein, 27 aa, Mycobacterium avium
NVVDVFIGYLRRKLEANGGPRLLHTVR

SEQ ID NO: 121498 - protein, 22 aa, Mycobacterium avium
NYARVPLIVLSANRPYELLGTG

SEQ ID NO: 121499 - protein, 25 aa, Mycobacterium avium
NYLGRPLFSTRKLMLVRKRPFNAHA

SEQ ID NO: 121500 - protein, 25 aa, Mycobacterium avium
PAAAKALPGLGGLGGMLGGGAAAAH

SEQ ID NO: 121501 - protein, 32 aa, Mycobacterium avium
PAAFHAGIHDILLIAFGLAWTEFLGEPGAPIG

SEQ ID NO: 121502 - protein, 20 aa, Mycobacterium avium
PAALVMISPLLQLAKEPKQA

SEQ ID NO: 121503 - protein, 23 aa, Mycobacterium avium
PAALWGRPGYVRALLGERIGEIT

SEQ ID NO: 121504 - protein, 18 aa, Mycobacterium avium
PAAQLADTMLIPAALDGG

SEQ ID NO: 121505 - protein, 20 aa, Mycobacterium avium
PAARYRRWLAALRGSARVVI

SEQ ID NO: 121506 - protein, 20 aa, Mycobacterium avium
PADDPWLRRRLAQAEADVAV

SEQ ID NO: 121507 - protein, 31 aa, Mycobacterium avium
PADIRARLGQRLPAYMVPAAVVVLDALPLTV

SEQ ID NO: 121508 - protein, 30 aa, Mycobacterium avium
PADLLGQWGIRVVPLHILLDGTDLRDGVDE

SEQ ID NO: 121509 - protein, 32 aa, Mycobacterium avium
PADLVREFALPVPSLVIALLLGVPPEDLELFQ

SEQ ID NO: 121510 - protein, 20 aa, Mycobacterium avium
PAEPLPPPPPREQPLTQKMV

SEQ ID NO: 121511 - protein, 34 aa, Mycobacterium avium
PAEQRITPFVLTLRLLVIALRRNEIMNSTWVDTP

SEQ ID NO: 121512 - protein, 21 aa, Mycobacterium avium
PAETLSWLYEMMVLTRELDGE

SEQ ID NO: 121513 - protein, 22 aa, Mycobacterium avium
PAGRKLPWFGPPMSAASMATAR

SEQ ID NO: 121514 - protein, 28 aa, Mycobacterium avium
PAGRLVDAPLPTWAHRRLMLRRESVQRA

SEQ ID NO: 121515 - protein, 20 aa, Mycobacterium avium
PAKLLAARIADRQVALAGDS

SEQ ID NO: 121516 - protein, 23 aa, Mycobacterium avium
PALDPQGLPLRLLTDATGDPALV

SEQ ID NO: 121517 - protein, 24 aa, Mycobacterium avium
PALEALAPVRAVLPAGAAALAAAE

SEQ ID NO: 121518 - protein, 19 aa, Mycobacterium avium
PALGHAIPVSSISAAPEAA

SEQ ID NO: 121519 - protein, 17 aa, Mycobacterium avium
PALTIMALASRLAERLA

SEQ ID NO: 121520 - protein, 19 aa, Mycobacterium avium
PALVYAHGGGFVFCDLDSH

SEQ ID NO: 121521 - protein, 17 aa, Mycobacterium avium
PAPAAPQPPPAPKPEPK

SEQ ID NO: 121522 - protein, 38 aa, Mycobacterium avium
PAPDNPLHPLALRLLRPKQVIMLGRPTLHRPVSALLAD

SEQ ID NO: 121523 - protein, 24 aa, Mycobacterium avium
PAPGQPPRPGATPGPRPGPAPKPA

SEQ ID NO: 121524 - protein, 23 aa, Mycobacterium avium
PARKLPSMRVAAALPPPIDYRDR

SEQ ID NO: 121525 - protein, 17 aa, Mycobacterium avium
PARLKVGIISAGRVGTA

SEQ ID NO: 121526 - protein, 18 aa, Mycobacterium avium
PARLPFWRGDGVGRPAEL

SEQ ID NO: 121527 - protein, 22 aa, Mycobacterium avium
PARPLVVFVGRITRQKGLAHLV

SEQ ID NO: 121528 - protein, 20 aa, Mycobacterium avium
PASELPLPILPIESDPPETQ

SEQ ID NO: 121529 - protein, 18 aa, Mycobacterium avium
PATGEPLLEPLRALFEPI

SEQ ID NO: 121530 - protein, 26 aa, Mycobacterium avium
PATGQFLWQNIFGVWPVTGEVTAALR

SEQ ID NO: 121531 - protein, 33 aa, Mycobacterium avium
PAVVPLSFAQQRLWFIDQLLGPSPIYNMAAALR

SEQ ID NO: 121532 - protein, 20 aa, Mycobacterium avium
PAYTLSKYGMTLLSLGWAAE

SEQ ID NO: 121533 - protein, 24 aa, Mycobacterium avium
PCIYNKHMIFPKPGVDLSNPDNFA

SEQ ID NO: 121534 - protein, 18 aa, Mycobacterium avium
PCLIGAPVLFGRGSVVFA

SEQ ID NO: 121535 - protein, 23 aa, Mycobacterium avium
PCRRARITLLQPTRNAKSNYEFY

SEQ ID NO: 121536 - protein, 28 aa, Mycobacterium avium
PDCEPLADYLFPAAKILEPFGLENMRYK

SEQ ID NO: 121537 - protein, 24 aa, Mycobacterium avium
PDDAQPWLTDADRLRMLLREVFTA

SEQ ID NO: 121538 - protein, 18 aa, Mycobacterium avium
PDEPWHCRGVAFTPKHGG

SEQ ID NO: 121539 - protein, 26 aa, Mycobacterium avium
PDFDAVLRLFRPTQIVHLAAETGTAQ

SEQ ID NO: 121540 - protein, 26 aa, Mycobacterium avium
PDGARDLIRAFWPGALSLVVTQAPSL

SEQ ID NO: 121541 - protein, 29 aa, Mycobacterium avium
PDGDDDWLIARWGCLRAANLFWGCGDVEA

SEQ ID NO: 121542 - protein, 25 aa, Mycobacterium avium
PDGLAAELLRRLPFELTAGQREVLD

SEQ ID NO: 121543 - protein, 30 aa, Mycobacterium avium
PDGLPHVPVRLHARSWHRYPEPSPDATAMI

SEQ ID NO: 121544 - protein, 18 aa, Mycobacterium avium
PDGTSVYLDYALDPNPVG

SEQ ID NO: 121545 - protein, 23 aa, Mycobacterium avium
PDIITAAWRKLLTNALAGFMALS

SEQ ID NO: 121546 - protein, 23 aa, Mycobacterium avium
PDLAAELIAYCRAHLAGYKCPRT

SEQ ID NO: 121547 - protein, 21 aa, Mycobacterium avium
PDLEILNHGLTLWDLDRVFKV

SEQ ID NO: 121548 - protein, 17 aa, Mycobacterium avium
PDNIAYLLYTSGTTGVP

SEQ ID NO: 121549 - protein, 23 aa, Mycobacterium avium
PDPDWPQTDGPKYTWIHETRPLI

SEQ ID NO: 121550 - protein, 17 aa, Mycobacterium avium
PDPGYPLQLVHHDDVAS

SEQ ID NO: 121551 - protein, 24 aa, Mycobacterium avium
PDPNFVHMFLEAESRGWSVVSPHH

SEQ ID NO: 121552 - protein, 34 aa, Mycobacterium avium
PDPSETISWSDALTLPMCLLNQGMRGRRLIDDAL

SEQ ID NO: 121553 - protein, 20 aa, Mycobacterium avium
PDSAQVRLKRMYPAASYRAT

SEQ ID NO: 121554 - protein, 33 aa, Mycobacterium avium
PDSHFGFGILTWHLPILFRTPPGYNLLVRGPAN

SEQ ID NO: 121555 - protein, 18 aa, Mycobacterium avium
PDSKTVFMVLRDPAADMS

SEQ ID NO: 121556 - protein, 18 aa, Mycobacterium avium
PDVFYWAHSTFFVGTIHV

SEQ ID NO: 121557 - protein, 24 aa, Mycobacterium avium
PDVPEPVLALIGKDLPPVSGPAPA

SEQ ID NO: 121558 - protein, 26 aa, Mycobacterium avium
PDVPFAYLMVLHVPAGAPSILARIID

SEQ ID NO: 121559 - protein, 29 aa, Mycobacterium avium
PEAIDPVLLDLLRLGTYQLLRTRVDAHAA

SEQ ID NO: 121560 - protein, 29 aa, Mycobacterium avium
PEAKVVAERRLWLAVLRAQQQLGVAVPAE

SEQ ID NO: 121561 - protein, 18 aa, Mycobacterium avium
PEAWIEQMKRIGIYGLAV

SEQ ID NO: 121562 - protein, 22 aa, Mycobacterium avium
PEDSRLLTRELFYTAVTRAKSR

SEQ ID NO: 121563 - protein, 24 aa, Mycobacterium avium
PEEDHQRVFHWTNVILGFGDPDLA

SEQ ID NO: 121564 - protein, 18 aa, Mycobacterium avium
PEFDPFWRDVEDAGLPIV

SEQ ID NO: 121565 - protein, 25 aa, Mycobacterium avium
PEGDWLGTPYLRFERYGPIALCTID

SEQ ID NO: 121566 - protein, 29 aa, Mycobacterium avium
PEGLKGLYEFFTPLLRNLGHCARVVVVGT

SEQ ID NO: 121567 - protein, 19 aa, Mycobacterium avium
PEHRLLDVFNLVPAVIDTH

SEQ ID NO: 121568 - protein, 21 aa, Mycobacterium avium
PEIPVIENISFLVGDGGHRAR

SEQ ID NO: 121569 - protein, 19 aa, Mycobacterium avium
PEKLAKFRDAEKLTFPLLS

SEQ ID NO: 121570 - protein, 21 aa, Mycobacterium avium
PELAWGLMIATVRHLADEHRQ

SEQ ID NO: 121571 - protein, 17 aa, Mycobacterium avium
PELLAALDDSSLVVAPP

SEQ ID NO: 121572 - protein, 23 aa, Mycobacterium avium
PEQVQQILRRWADNLWDTGIEFG

SEQ ID NO: 121573 - protein, 29 aa, Mycobacterium avium
PERDFPTLIELYLQGRLPLEKFVSERIGL

SEQ ID NO: 121574 - protein, 27 aa, Mycobacterium avium
PERGYDLELITPVPLPRKPTGDLARLP

SEQ ID NO: 121575 - protein, 23 aa, Mycobacterium avium
PERLRLLEIFDRETRRLRVPGHQ

SEQ ID NO: 121576 - protein, 24 aa, Mycobacterium avium
PERYRFSVTLPRTVPGPGAGIVER

SEQ ID NO: 121577 - protein, 34 aa, Mycobacterium avium
PETLQRIKDLVIPPAWKKVWISPHPNGHIQAVGV

SEQ ID NO: 121578 - protein, 19 aa, Mycobacterium avium
PEVAAGAELLLLAVPDSEL

SEQ ID NO: 121579 - protein, 28 aa, Mycobacterium avium
PEVACTVWSNLVLIAGLRNGQLLLVHGG

SEQ ID NO: 121580 - protein, 20 aa, Mycobacterium avium
PFAHWVATHRDLFDRRNERK

SEQ ID NO: 121581 - protein, 17 aa, Mycobacterium avium
PFARNVRFYPTAAAAQR

SEQ ID NO: 121582 - protein, 21 aa, Mycobacterium avium
PFAVYRWVFELDALDGPARTR

SEQ ID NO: 121583 - protein, 20 aa, Mycobacterium avium
PFFARIWPVVATHETAAVRA

SEQ ID NO: 121584 - protein, 18 aa, Mycobacterium avium
PFGFQGVFGHLAASVVPG

SEQ ID NO: 121585 - protein, 32 aa, Mycobacterium avium
PFGLENMRYKWRKWLYFDCNWKVALEAFNETY

SEQ ID NO: 121586 - protein, 19 aa, Mycobacterium avium
PFNATRLGRLIAEKTDIPA

SEQ ID NO: 121587 - protein, 23 aa, Mycobacterium avium
PGARLFLHYADLTDGTRLVTLLS

SEQ ID NO: 121588 - protein, 23 aa, Mycobacterium avium
PGASYFVLVFDRNAMPAEGPVNA

SEQ ID NO: 121589 - protein, 21 aa, Mycobacterium avium
PGAVPLLAAAAAWDGLAAELH

SEQ ID NO: 121590 - protein, 17 aa, Mycobacterium avium
PGDFLSAGGHFQAPGHT

SEQ ID NO: 121591 - protein, 28 aa, Mycobacterium avium
PGDLDEDLRWQPPLWRALVARVAADPPH

SEQ ID NO: 121592 - protein, 27 aa, Mycobacterium avium
PGDPPYVAVPYLDRMDLAYAAADLVIC

SEQ ID NO: 121593 - protein, 19 aa, Mycobacterium avium
PGGLGPRFTFVPADVTDES

SEQ ID NO: 121594 - protein, 33 aa, Mycobacterium avium
PGIDFTNDPLLQFRNFSYLDTQLIRLGGPNFAQ

SEQ ID NO: 121595 - protein, 22 aa, Mycobacterium avium
PGKKITRLSLLSGGEKALTAVA

SEQ ID NO: 121596 - protein, 24 aa, Mycobacterium avium
PGLARLYQPMLQRETNRHHGKPEA

SEQ ID NO: 121597 - protein, 32 aa, Mycobacterium avium
PGLLPRQLRPVLRLVWPVLTSLAARPVVVCSA

SEQ ID NO: 121598 - protein, 18 aa, Mycobacterium avium
PGLQLVAAPWRSKVPTTD

SEQ ID NO: 121599 - protein, 22 aa, Mycobacterium avium
PGLRQRFDEVIGRLAEGLATTV

SEQ ID NO: 121600 - protein, 25 aa, Mycobacterium avium
PGMNEIVFPAAILQPPFFDAEADDA

SEQ ID NO: 121601 - protein, 17 aa, Mycobacterium avium
PGPAGYGAVVWTPDRGT

SEQ ID NO: 121602 - protein, 19 aa, Mycobacterium avium
PGPHLLVLARGPEGYRRLS

SEQ ID NO: 121603 - protein, 24 aa, Mycobacterium avium
PGPTLVPAERYYSPAFAALEVERM

SEQ ID NO: 121604 - protein, 24 aa, Mycobacterium avium
PGQPVIHLSQLLRAPVLARSGETV

SEQ ID NO: 121605 - protein, 17 aa, Mycobacterium avium
PGRPIDAFVVRKSAKTH

SEQ ID NO: 121606 - protein, 21 aa, Mycobacterium avium
PGRQVLFDRLRRLAADVIALG

SEQ ID NO: 121607 - protein, 25 aa, Mycobacterium avium
PGRVSSLIAQLLPVIGDMPLGGHFH

SEQ ID NO: 121608 - protein, 18 aa, Mycobacterium avium
PGSPWLADTWRDRFEQML

SEQ ID NO: 121609 - protein, 27 aa, Mycobacterium avium
PGSRARFGDVLPFLVKVLAADEPLSLQ

SEQ ID NO: 121610 - protein, 26 aa, Mycobacterium avium
PGTFEGWLHRITTNLFLDMVRRRSRI

SEQ ID NO: 121611 - protein, 21 aa, Mycobacterium avium
PGTRMRVALSALTMAEWFRDE

SEQ ID NO: 121612 - protein, 18 aa, Mycobacterium avium
PGVLLTQIAAVRALARQG

SEQ ID NO: 121613 - protein, 18 aa, Mycobacterium avium
PGYWHPAHFASAAATLDR

SEQ ID NO: 121614 - protein, 24 aa, Mycobacterium avium
PHADVRLWVDRSFTVRGAGTVVTG

SEQ ID NO: 121615 - protein, 23 aa, Mycobacterium avium
PHGPVTMWMAAPAALEAARAARR

SEQ ID NO: 121616 - protein, 19 aa, Mycobacterium avium
PHGVRPLSLGRLDRGWVVA

SEQ ID NO: 121617 - protein, 17 aa, Mycobacterium avium
PHLVERLILVGAGGVTK

SEQ ID NO: 121618 - protein, 28 aa, Mycobacterium avium
PHLVHAMPQLVPLLPSMSRATRALVRGG

SEQ ID NO: 121619 - protein, 24 aa, Mycobacterium avium
PHTKPPDFWAWLIAAVKGIDPDVL

SEQ ID NO: 121620 - protein, 20 aa, Mycobacterium avium
PHVSPPVIVKYITDLQLLGL

SEQ ID NO: 121621 - protein, 25 aa, Mycobacterium avium
PHVVHLASPALLGYGGLRAARWLGV

SEQ ID NO: 121622 - protein, 24 aa, Mycobacterium avium
PIAKNMIQAFFFDLQAVQGGTSRP

SEQ ID NO: 121623 - protein, 18 aa, Mycobacterium avium
PIARVLPMLSVPHLDREF

SEQ ID NO: 121624 - protein, 30 aa, Mycobacterium avium
PIEGQPLDRPFAWALIKLDGADTPLLHAVD

SEQ ID NO: 121625 - protein, 24 aa, Mycobacterium avium
PIKVGYLMDFALPPGFPEEMKADF

SEQ ID NO: 121626 - protein, 19 aa, Mycobacterium avium
PILPYVDRVLYLVDGRFRI

SEQ ID NO: 121627 - protein, 19 aa, Mycobacterium avium
PITILAEHIADTFIAMGWE

SEQ ID NO: 121628 - protein, 24 aa, Mycobacterium avium
PIVPGAVIFDLPVGGWQCRPTAEF

SEQ ID NO: 121629 - protein, 20 aa, Mycobacterium avium
PIYHREWWDRYVAVNRRFAE

SEQ ID NO: 121630 - protein, 27 aa, Mycobacterium avium
PKDELLQYMYGFAQFLRQQWCSDGPDV

SEQ ID NO: 121631 - protein, 22 aa, Mycobacterium avium
PKGYFPVPALTHLEGPYLDMVR

SEQ ID NO: 121632 - protein, 26 aa, Mycobacterium avium
PKHKNLTMFLVPLDSPGIEIQGIRTV

SEQ ID NO: 121633 - protein, 25 aa, Mycobacterium avium
PKLLAGFPFPHLLQVAVRLAGRTLT

SEQ ID NO: 121634 - protein, 17 aa, Mycobacterium avium
PKLLSFGSGAHFCLGAH

SEQ ID NO: 121635 - protein, 30 aa, Mycobacterium avium
PKLPDGTPFPTLYYLTHPALTAAASRLETT

SEQ ID NO: 121636 - protein, 20 aa, Mycobacterium avium
PKMVPWTRHNIAASIRSIVA

SEQ ID NO: 121637 - protein, 17 aa, Mycobacterium avium
PKNPVWYHNIKKNPRVE

SEQ ID NO: 121638 - protein, 27 aa, Mycobacterium avium
PKPKFVLMPTPLWDQLFRPLVAGQRWI

SEQ ID NO: 121639 - protein, 32 aa, Mycobacterium avium
PKSGSRAPWRLKQNYFFDMRTIRRGRVDDEGL

SEQ ID NO: 121640 - protein, 19 aa, Mycobacterium avium
PKVESLALVVDGNALAVSN

SEQ ID NO: 121641 - protein, 25 aa, Mycobacterium avium
PLAGKFERLYRAAPLMRFGGGTNEV

SEQ ID NO: 121642 - protein, 33 aa, Mycobacterium avium
PLAPSLTTVPDALVGLCWPAVFAAIGAAATDTG

SEQ ID NO: 121643 - protein, 26 aa, Mycobacterium avium
PLAVDPAHPFPFVSGLSLNLAVMVRQ

SEQ ID NO: 121644 - protein, 25 aa, Mycobacterium avium
PLGAREFHKFLLAKQHEIASVVTEA

SEQ ID NO: 121645 - protein, 20 aa, Mycobacterium avium
PLGHRAGLPGPSILGFQACS

SEQ ID NO: 121646 - protein, 17 aa, Mycobacterium avium
PLGLLLTRRSENATVTL

SEQ ID NO: 121647 - protein, 18 aa, Mycobacterium avium
PLGPVYQAGTLSGNPVAV

SEQ ID NO: 121648 - protein, 35 aa, Mycobacterium avium
PLGVVGVITPWNFPMPIASWGIAPALAAGNAVLVK

SEQ ID NO: 121649 - protein, 33 aa, Mycobacterium avium
PLHATRGPWQLMPDTFAAFHQPGTSNSAWDPVA

SEQ ID NO: 121650 - protein, 26 aa, Mycobacterium avium
PLINRLPVRVLYTPWAAQAWSRAGVD

SEQ ID NO: 121651 - protein, 20 aa, Mycobacterium avium
PLLLNVPSFAICCATILDMG

SEQ ID NO: 121652 - protein, 21 aa, Mycobacterium avium
PLLQVDMWEHAFYLQYKNVKA

SEQ ID NO: 121653 - protein, 21 aa, Mycobacterium avium
PLLVACDLQRPAAVNQLQVVG

SEQ ID NO: 121654 - protein, 18 aa, Mycobacterium avium
PLPAAALHAGWRALGWWL

SEQ ID NO: 121655 - protein, 19 aa, Mycobacterium avium
PLPAAGTPAQLWLRAVAAG

SEQ ID NO: 121656 - protein, 18 aa, Mycobacterium avium
PLPEGCFALVPLEEAIEA

SEQ ID NO: 121657 - protein, 24 aa, Mycobacterium avium
PLPGYLPSLWEIMPDLSVYIEAVH

SEQ ID NO: 121658 - protein, 18 aa, Mycobacterium avium
PLQEILPIVQKTLADRYR

SEQ ID NO: 121659 - protein, 24 aa, Mycobacterium avium
PLRAGMRLGLIPTVAPYVLPTVLA

SEQ ID NO: 121660 - protein, 23 aa, Mycobacterium avium
PLRCDAWIDRREGVKVFARGIIS

SEQ ID NO: 121661 - protein, 23 aa, Mycobacterium avium
PLRGRAAIAAFLRGVTGGIAVDV

SEQ ID NO: 121662 - protein, 20 aa, Mycobacterium avium
PLRIAHAWSFAFDAAWQPLV

SEQ ID NO: 121663 - protein, 20 aa, Mycobacterium avium
PLRLDCDVLVIGGGTAGTMA

SEQ ID NO: 121664 - protein, 30 aa, Mycobacterium avium
PLSGIRVTDLTAFWAGPVATQLLGALGADV

SEQ ID NO: 121665 - protein, 25 aa, Mycobacterium avium
PLTANAYLGAWGIVDCLGDGANVVV

SEQ ID NO: 121666 - protein, 18 aa, Mycobacterium avium
PLTRGQLDIWLSQEAGFA

SEQ ID NO: 121667 - protein, 19 aa, Mycobacterium avium
PLVMPERDWDRWLDPDAPV

SEQ ID NO: 121668 - protein, 26 aa, Mycobacterium avium
PMERPGLPAVLLGPGPFVGRGRELDG

SEQ ID NO: 121669 - protein, 28 aa, Mycobacterium avium
PMFMNEGTMRLFRPDLKNPGPDDLKVAA

SEQ ID NO: 121670 - protein, 22 aa, Mycobacterium avium
PMHRYYSTIKDLTRLLGGPSHR

SEQ ID NO: 121671 - protein, 21 aa, Mycobacterium avium
PMIARRGLTLVGFAVSGIDRD

SEQ ID NO: 121672 - protein, 17 aa, Mycobacterium avium
PMLLGRNDYTVEAVYHL

SEQ ID NO: 121673 - protein, 17 aa, Mycobacterium avium
PMPLPDELKEDLKSTVA

SEQ ID NO: 121674 - protein, 24 aa, Mycobacterium avium
PMPRQAGCPFAPPPDVMALAHDKP

SEQ ID NO: 121675 - protein, 17 aa, Mycobacterium avium
PMRALCMPLVHVFEGIG

SEQ ID NO: 121676 - protein, 23 aa, Mycobacterium avium
PMTNTKVNFGFDPYVPRIDPGHA

SEQ ID NO: 121677 - protein, 20 aa, Mycobacterium avium
PMTPFERKIVHDAVAAVPGV

SEQ ID NO: 121678 - protein, 18 aa, Mycobacterium avium
PMWDVRLTDTSLRDGSHH

SEQ ID NO: 121679 - protein, 32 aa, Mycobacterium avium
PNRPEFLEITWGCQLSGLYYTPVNTHFTADEV

SEQ ID NO: 121680 - protein, 36 aa, Mycobacterium avium
PNRTANIALLHFLDGEKRYIIAPQGLSQGDVVESGP

SEQ ID NO: 121681 - protein, 22 aa, Mycobacterium avium
PNYFEVQRLGGPPATPARTLDE

SEQ ID NO: 121682 - protein, 17 aa, Mycobacterium avium
PPAIRKLTAKYLHDPLE

SEQ ID NO: 121683 - protein, 19 aa, Mycobacterium avium
PPALRRALDLLIDPPADPD

SEQ ID NO: 121684 - protein, 17 aa, Mycobacterium avium
PPAWPTLLQGEASWGDV

SEQ ID NO: 121685 - protein, 17 aa, Mycobacterium avium
PPDHTRLRRLVSKAFAP

SEQ ID NO: 121686 - protein, 17 aa, Mycobacterium avium
PPEDGPWRLGMSSYGTI

SEQ ID NO: 121687 - protein, 21 aa, Mycobacterium avium
PPEDRPWRLGISSAGTFENLQ

SEQ ID NO: 121688 - protein, 19 aa, Mycobacterium avium
PPELLAYQFDNADNHVVIC

SEQ ID NO: 121689 - protein, 28 aa, Mycobacterium avium
PPEVAALRFFWPRLTPGAFVLLDDYANR

SEQ ID NO: 121690 - protein, 17 aa, Mycobacterium avium
PPFRFSKTPVPQPRPAP

SEQ ID NO: 121691 - protein, 21 aa, Mycobacterium avium
PPGFIDTPMLRAAEKNGFLGD

SEQ ID NO: 121692 - protein, 19 aa, Mycobacterium avium
PPLGDDWLRVAAVRLPRIS

SEQ ID NO: 121693 - protein, 25 aa, Mycobacterium avium
PPTDTRAYFRGECLRRFGADIAAAS

SEQ ID NO: 121694 - protein, 17 aa, Mycobacterium avium
PPTMPPPTPPTAPPPSM

SEQ ID NO: 121695 - protein, 26 aa, Mycobacterium avium
PPVQPQPILAPLTPAAIFLVLTVDDG

SEQ ID NO: 121696 - protein, 20 aa, Mycobacterium avium
PPYPVIIGTGLLGELDELLG

SEQ ID NO: 121697 - protein, 18 aa, Mycobacterium avium
PQGILLHGGVLYVVDAGA

SEQ ID NO: 121698 - protein, 34 aa, Mycobacterium avium
PQLWDELYRINLHHVFLVTHAFLPTMIDRGAGAI

SEQ ID NO: 121699 - protein, 28 aa, Mycobacterium avium
PQNESTPFYPRSPYGAAKVFSYWTTRNY

SEQ ID NO: 121700 - protein, 32 aa, Mycobacterium avium
PQSLDYIAAFLGSMQAGLVAVPLPLPHRGSSH

SEQ ID NO: 121701 - protein, 23 aa, Mycobacterium avium
PQSRKWFQLYMWKDRERSMALVR

SEQ ID NO: 121702 - protein, 24 aa, Mycobacterium avium
PRAGELCAAVRFLVRRDSVVIELT

SEQ ID NO: 121703 - protein, 19 aa, Mycobacterium avium
PRALMARLAHPLFGELRRA

SEQ ID NO: 121704 - protein, 24 aa, Mycobacterium avium
PRAVMIRMPAFGLDGPWRDRVGFA

SEQ ID NO: 121705 - protein, 27 aa, Mycobacterium avium
PRAYRGGMVPGFPNMFISSAPNYSPGH

SEQ ID NO: 121706 - protein, 20 aa, Mycobacterium avium
PRDMSSLRRISYGSAPVPPG

SEQ ID NO: 121707 - protein, 25 aa, Mycobacterium avium
PREPAEGFAAMWADLRRPELREFER

SEQ ID NO: 121708 - protein, 17 aa, Mycobacterium avium
PRGLMSHMVYADQPANP

SEQ ID NO: 121709 - protein, 22 aa, Mycobacterium avium
PRHVTPLRRLAPLPPVEPPVTP

SEQ ID NO: 121710 - protein, 24 aa, Mycobacterium avium
PRIAAMGFDVVYLPPIHPIGKVHR

SEQ ID NO: 121711 - protein, 20 aa, Mycobacterium avium
PRIAGPCGMVIFGVTGDLAR

SEQ ID NO: 121712 - protein, 17 aa, Mycobacterium avium
PRILYLADRNVLVDQPI

SEQ ID NO: 121713 - protein, 35 aa, Mycobacterium avium
PRIPHNLYRPTFVKSLVMVPIRKLDPIGAIGNYWA

SEQ ID NO: 121714 - protein, 19 aa, Mycobacterium avium
PRLDALIFGVGDFSLSQGA

SEQ ID NO: 121715 - protein, 19 aa, Mycobacterium avium
PRPRRVLFVSGGSGITPVM

SEQ ID NO: 121716 - protein, 22 aa, Mycobacterium avium
PRQWHGLRRWLGEPEDFQDPKY

SEQ ID NO: 121717 - protein, 37 aa, Mycobacterium avium
PRQWLEIRYLDSVPDTLWPAVVFTLVALLDDPVAAGL

SEQ ID NO: 121718 - protein, 19 aa, Mycobacterium avium
PRWLADLRARAYRHSRDGR

SEQ ID NO: 121719 - protein, 27 aa, Mycobacterium avium
PSAAAMIAAITPYLTWMRTTGAQAEET

SEQ ID NO: 121720 - protein, 28 aa, Mycobacterium avium
PSAALTQLLRDIWLLIVDEIGHAIEAFQ

SEQ ID NO: 121721 - protein, 25 aa, Mycobacterium avium
PSANPYLASAAILGLALDGIKSQAA

SEQ ID NO: 121722 - protein, 21 aa, Mycobacterium avium
PSDFLHGKWLVLRRGKRTIAG

SEQ ID NO: 121723 - protein, 28 aa, Mycobacterium avium
PSDLVFNDFLIAVARMRALDPVTSELVR

SEQ ID NO: 121724 - protein, 29 aa, Mycobacterium avium
PSDYYLGGRALIARFLRAIGEFPTATLRR

SEQ ID NO: 121725 - protein, 24 aa, Mycobacterium avium
PSFAFYNTFEEIDVFLRAVRRIAE

SEQ ID NO: 121726 - protein, 21 aa, Mycobacterium avium
PSGGRVLLVWDAPNLDMGLGS

SEQ ID NO: 121727 - protein, 20 aa, Mycobacterium avium
PSLALAEELVALLGAGHEPA

SEQ ID NO: 121728 - protein, 19 aa, Mycobacterium avium
PSLPPAIVEGLRRAYPIGE

SEQ ID NO: 121729 - protein, 34 aa, Mycobacterium avium
PSNLKCLCRGHHLLKTFWGWRDRQLPDGTVIWTL

SEQ ID NO: 121730 - protein, 24 aa, Mycobacterium avium
PSQGEGPWHLLPKGPVVCSSATRA

SEQ ID NO: 121731 - protein, 32 aa, Mycobacterium avium
PSQIVESVPMYKLRRYFPPDSRPGQPPVGPPV

SEQ ID NO: 121732 - protein, 20 aa, Mycobacterium avium
PSQPVLPRTAKLPAGFRVVI

SEQ ID NO: 121733 - protein, 23 aa, Mycobacterium avium
PSRGRLPLDATLRRMPVGVVANG

SEQ ID NO: 121734 - protein, 17 aa, Mycobacterium avium
PSRVELPWRSVTASPAE

SEQ ID NO: 121735 - protein, 18 aa, Mycobacterium avium
PSVLLLDEPLAALDALTR

SEQ ID NO: 121736 - protein, 21 aa, Mycobacterium avium
PSYRTIFYEELPDCLNALTID

SEQ ID NO: 121737 - protein, 31 aa, Mycobacterium avium
PTDAPGFTVPYYWWTFNMPTDHGEVELTDVR

SEQ ID NO: 121738 - protein, 21 aa, Mycobacterium avium
PTFAELLAQVRRRSLAAFEHQ

SEQ ID NO: 121739 - protein, 25 aa, Mycobacterium avium
PTGDAELLLIGWGSSYGPIGEACRR

SEQ ID NO: 121740 - protein, 26 aa, Mycobacterium avium
PTGSGKTLAAFLWALDSLAGQAERAP

SEQ ID NO: 121741 - protein, 27 aa, Mycobacterium avium
PTIAKALRWQFDGVDRVGPDLLLSLVP

SEQ ID NO: 121742 - protein, 17 aa, Mycobacterium avium
PTIRALVQHRKPQRNTE

SEQ ID NO: 121743 - protein, 21 aa, Mycobacterium avium
PTKPLIPLAVSAFLTSRKKAA

SEQ ID NO: 121744 - protein, 21 aa, Mycobacterium avium
PTKTAMGWSLPAEKIGPALED

SEQ ID NO: 121745 - protein, 28 aa, Mycobacterium avium
PTKWDNTFLETLYGYEWELTKSPAGAWQ

SEQ ID NO: 121746 - protein, 19 aa, Mycobacterium avium
PTLHRPVSALLADPQVPVY

SEQ ID NO: 121747 - protein, 17 aa, Mycobacterium avium
PTMWFNRDFFESPWPGW

SEQ ID NO: 121748 - protein, 17 aa, Mycobacterium avium
PTPPQRVLDIAAAARDR

SEQ ID NO: 121749 - protein, 21 aa, Mycobacterium avium
PTVAELLARVRQRSLAAYEHQ

SEQ ID NO: 121750 - protein, 22 aa, Mycobacterium avium
PTVIDMLANSAFFYGMLRSLSE

SEQ ID NO: 121751 - protein, 32 aa, Mycobacterium avium
PTVRNIVLFRPVGSMALFKQMIGRGTRLFPDE

SEQ ID NO: 121752 - protein, 18 aa, Mycobacterium avium
PTWILPKPDRPYTRWERW

SEQ ID NO: 121753 - protein, 25 aa, Mycobacterium avium
PVAEAWLPFHVPMSYHGTFTTRVAQ

SEQ ID NO: 121754 - protein, 27 aa, Mycobacterium avium
PVAGATLFVLDGWLRPVPAGVTGELYI

SEQ ID NO: 121755 - protein, 19 aa, Mycobacterium avium
PVAHWKKIWSTNPLERLNK

SEQ ID NO: 121756 - protein, 21 aa, Mycobacterium avium
PVARSMLWARLRVSPGELRRR

SEQ ID NO: 121757 - protein, 17 aa, Mycobacterium avium
PVAWIHATALRTEPLAY

SEQ ID NO: 121758 - protein, 30 aa, Mycobacterium avium
PVDITMISPVDYMLYTPLLPDVAGGVVDAR

SEQ ID NO: 121759 - protein, 27 aa, Mycobacterium avium
PVFNEPFKSFWLTPRQHQDALAAKHWH

SEQ ID NO: 121760 - protein, 17 aa, Mycobacterium avium
PVFVFHPAGGSTVVYEP

SEQ ID NO: 121761 - protein, 18 aa, Mycobacterium avium
PVGACRPFDRDRTGFVFG

SEQ ID NO: 121762 - protein, 17 aa, Mycobacterium avium
PVGNGTCYWKRMGNPDG

SEQ ID NO: 121763 - protein, 20 aa, Mycobacterium avium
PVKLRLGIGYVIQHAGLMPH

SEQ ID NO: 121764 - protein, 17 aa, Mycobacterium avium
PVLFPRPTKNIDGTHPI

SEQ ID NO: 121765 - protein, 17 aa, Mycobacterium avium
PVLGAIPSGWRNLPSGF

SEQ ID NO: 121766 - protein, 29 aa, Mycobacterium avium
PVNFVPVIDKDVRRWWRSDSLWQAHDARY

SEQ ID NO: 121767 - protein, 17 aa, Mycobacterium avium
PVPDPLPEPLRAKFDLV

SEQ ID NO: 121768 - protein, 18 aa, Mycobacterium avium
PVPQAPYGLAGSRALAWV

SEQ ID NO: 121769 - protein, 19 aa, Mycobacterium avium
PVPVGVVGELYYAGDQLAR

SEQ ID NO: 121770 - protein, 23 aa, Mycobacterium avium
PVQPTPIMRWLQDIDGPIDEFNQ

SEQ ID NO: 121771 - protein, 25 aa, Mycobacterium avium
PVQRPHPPIWFGGLAPKALARAVRH

SEQ ID NO: 121772 - protein, 17 aa, Mycobacterium avium
PVRAACAAGVRAVVLTN

SEQ ID NO: 121773 - protein, 18 aa, Mycobacterium avium
PVRGAMGFRLLVDKRKGA

SEQ ID NO: 121774 - protein, 32 aa, Mycobacterium avium
PVRVRRLGPAAARLRLARPLPLRVADVGLLRD

SEQ ID NO: 121775 - protein, 35 aa, Mycobacterium avium
PVSALVVFEVMVRPLIRLSLGKRQPMRRIVQARTL

SEQ ID NO: 121776 - protein, 18 aa, Mycobacterium avium
PVTGLDPWTSVRAAAHHR

SEQ ID NO: 121777 - protein, 17 aa, Mycobacterium avium
PVTMPWLGAVNAVVQAW

SEQ ID NO: 121778 - protein, 27 aa, Mycobacterium avium
PVTRAAFFVLDDWLRPVPPGVVGELYL

SEQ ID NO: 121779 - protein, 18 aa, Mycobacterium avium
PVTRSSLPTAQRARKLVY

SEQ ID NO: 121780 - protein, 18 aa, Mycobacterium avium
PVVLRPKGSTWRGVKEEG

SEQ ID NO: 121781 - protein, 20 aa, Mycobacterium avium
PVWAMAGFGAQHRKMGKNLY

SEQ ID NO: 121782 - protein, 17 aa, Mycobacterium avium
PVWTERGGPATIVPMFL

SEQ ID NO: 121783 - protein, 17 aa, Mycobacterium avium
PVYRERYVLLAPADLLA

SEQ ID NO: 121784 - protein, 19 aa, Mycobacterium avium
PWGDPHRYSFAPHPISGAA

SEQ ID NO: 121785 - protein, 26 aa, Mycobacterium avium
PWRLKCPSHVLWLDRLAAVFPDAKFV

SEQ ID NO: 121786 - protein, 27 aa, Mycobacterium avium
PWYLVRYWRLLKFKLANPHIITRGMVF

SEQ ID NO: 121787 - protein, 25 aa, Mycobacterium avium
PYCYGAAFDAWTGRYLLVLEDLPAE

SEQ ID NO: 121788 - protein, 28 aa, Mycobacterium avium
PYEEPAFDIFALLPPPGDAGLGRIARLE

SEQ ID NO: 121789 - protein, 28 aa, Mycobacterium avium
PYHLLANSMVWLSDRYPRLLLPRVPSWV

SEQ ID NO: 121790 - protein, 20 aa, Mycobacterium avium
PYIRFGNWASPQRDPALALL

SEQ ID NO: 121791 - protein, 19 aa, Mycobacterium avium
PYRRQIFAGVRLAWDVPGA

SEQ ID NO: 121792 - protein, 40 aa, Mycobacterium avium
PYSRRTPRLARTRAWTTLQQDGMLFVWNDPEGNPPPPEVT

SEQ ID NO: 121793 - protein, 26 aa, Mycobacterium avium
PYTKLDLVRYYLSVADGALRGVAGRP

SEQ ID NO: 121794 - protein, 19 aa, Mycobacterium avium
QAARLVRVLAAGADLALIA

SEQ ID NO: 121795 - protein, 23 aa, Mycobacterium avium
QAATLPVLRPLLGFDKQEILAEA

SEQ ID NO: 121796 - protein, 25 aa, Mycobacterium avium
QADPLWEAWPNHMKIFWNNKGVVAK

SEQ ID NO: 121797 - protein, 35 aa, Mycobacterium avium
QAEFAVYVAALQLGWRWLPRRLTLEPLAYNRYQYE

SEQ ID NO: 121798 - protein, 24 aa, Mycobacterium avium
QAGLRTDYLFRLANQRGGIVLGTG

SEQ ID NO: 121799 - protein, 23 aa, Mycobacterium avium
QAGSPFQISQLAQAFHTAGRCTA

SEQ ID NO: 121800 - protein, 18 aa, Mycobacterium avium
QAILAAVRELLQEKPFAE

SEQ ID NO: 121801 - protein, 21 aa, Mycobacterium avium
QALPCHVGDPDLWFAEAPADL

SEQ ID NO: 121802 - protein, 29 aa, Mycobacterium avium
QALSRRWISAWQLPLEWLQIPRGGVALDV

SEQ ID NO: 121803 - protein, 25 aa, Mycobacterium avium
QAMVTDRRVLLTLPISHVYGMPPGM

SEQ ID NO: 121804 - protein, 23 aa, Mycobacterium avium
QANHLIAGLIATGAIDVGIACGI

SEQ ID NO: 121805 - protein, 32 aa, Mycobacterium avium
QAPNSTLCSYLNKLLWILTGNFAKRGGQHLHS

SEQ ID NO: 121806 - protein, 26 aa, Mycobacterium avium
QARPPARLIGWTARFLGMVRPGDEVA

SEQ ID NO: 121807 - protein, 24 aa, Mycobacterium avium
QATIPIVYAVSRVVEVPYAEIVAS

SEQ ID NO: 121808 - protein, 19 aa, Mycobacterium avium
QATRRYPGADRPALDNLNL

SEQ ID NO: 121809 - protein, 21 aa, Mycobacterium avium
QAVDVLRRLLDNASLASSLAG

SEQ ID NO: 121810 - protein, 25 aa, Mycobacterium avium
QCAQQAIRRRAFTKALRITGSPDTS

SEQ ID NO: 121811 - protein, 34 aa, Mycobacterium avium
QDAAAMYAYARASAGFWKLTPFDSPPPAADPAPA

SEQ ID NO: 121812 - protein, 30 aa, Mycobacterium avium
QDQIVGLLLRLQRQLGLTYLFVSHDLSVVR

SEQ ID NO: 121813 - protein, 19 aa, Mycobacterium avium
QDYALTELCALSWTVYSLP

SEQ ID NO: 121814 - protein, 17 aa, Mycobacterium avium
QDYANIPPTRFKRKEHW

SEQ ID NO: 121815 - protein, 24 aa, Mycobacterium avium
QEAGNLPPVKYLAKASPVGRLGTG

SEQ ID NO: 121816 - protein, 23 aa, Mycobacterium avium
QEAYTLAMLLAEALGFDAFRQRV

SEQ ID NO: 121817 - protein, 27 aa, Mycobacterium avium
QEHDLSLLLLRVQAVRSAWGPPQVHRR

SEQ ID NO: 121818 - protein, 37 aa, Mycobacterium avium
QEIFACYYGARLPAPAPYRGFVTWLAARDVPAARAAW

SEQ ID NO: 121819 - protein, 28 aa, Mycobacterium avium
QEIMTELEIAPTRRLRGLGDRQRKALLE

SEQ ID NO: 121820 - protein, 17 aa, Mycobacterium avium
QELHAIIKALRTAAVND

SEQ ID NO: 121821 - protein, 20 aa, Mycobacterium avium
QERYPLLEETLELDLSGLSD

SEQ ID NO: 121822 - protein, 34 aa, Mycobacterium avium
QETRRILDRLYGYEVSPVLWKKVAPKLSAGRVQS

SEQ ID NO: 121823 - protein, 19 aa, Mycobacterium avium
QEVIRILQRYKDLQDIIAI

SEQ ID NO: 121824 - protein, 18 aa, Mycobacterium avium
QEYNDLRGILAPIGDTER

SEQ ID NO: 121825 - protein, 19 aa, Mycobacterium avium
QFGKPIGAFQGVKHALADN

SEQ ID NO: 121826 - protein, 21 aa, Mycobacterium avium
QFGSCQAIWRMDTGYVAASDP

SEQ ID NO: 121827 - protein, 22 aa, Mycobacterium avium
QFLAGHPHLHRPRVIAIDEIPD

SEQ ID NO: 121828 - protein, 35 aa, Mycobacterium avium
QFNDVGLLVNFPLSQWLKFAPPIGYGALPKDALGA

SEQ ID NO: 121829 - protein, 18 aa, Mycobacterium avium
QFRYYIKDAPIISDAEFD

SEQ ID NO: 121830 - protein, 19 aa, Mycobacterium avium
QFYAAMLAGLGLDGADLPG

SEQ ID NO: 121831 - protein, 27 aa, Mycobacterium avium
QGFLFDGALFIVGRIKDLLIINGRNHY

SEQ ID NO: 121832 - protein, 20 aa, Mycobacterium avium
QGGEHFPAQLGLGGGDPAVD

SEQ ID NO: 121833 - protein, 34 aa, Mycobacterium avium
QGIGPLLHPKALTGVLAPLLRSDLLTGSTALSSA

SEQ ID NO: 121834 - protein, 23 aa, Mycobacterium avium
QGIPPQFLVDILTNLRTDRLVRS

SEQ ID NO: 121835 - protein, 17 aa, Mycobacterium avium
QGMFLTTHYFGTKIMRY

SEQ ID NO: 121836 - protein, 23 aa, Mycobacterium avium
QGTLGILNGLLGGAGQQAPSAPS

SEQ ID NO: 121837 - protein, 25 aa, Mycobacterium avium
QGTVLQWISTFGNPLTWDDLPWLRS

SEQ ID NO: 121838 - protein, 19 aa, Mycobacterium avium
QGTWERNGGLRFAPRADLA

SEQ ID NO: 121839 - protein, 31 aa, Mycobacterium avium
QGVEPDRLTWIMPRDSWLLDRATMQPGALFA

SEQ ID NO: 121840 - protein, 17 aa, Mycobacterium avium
QGVWVHPEWRGLGLGTA

SEQ ID NO: 121841 - protein, 17 aa, Mycobacterium avium
QGWLTDHAVSGTVVFPG

SEQ ID NO: 121842 - protein, 21 aa, Mycobacterium avium
QGWQLITTQLNFERAALGNLG

SEQ ID NO: 121843 - protein, 18 aa, Mycobacterium avium
QHCAYGSSKWALRGLTQT

SEQ ID NO: 121844 - protein, 29 aa, Mycobacterium avium
QHETGHLDGFLYLDRLIGRYARSAKRAVK

SEQ ID NO: 121845 - protein, 25 aa, Mycobacterium avium
QHRSRLYQLLRYADYNHFDSDIYNF

SEQ ID NO: 121846 - protein, 24 aa, Mycobacterium avium
QIDGPLPPRLRVLAVVLAAEQTVV

SEQ ID NO: 121847 - protein, 19 aa, Mycobacterium avium
QIDPDLTTPSLWPKLASVL

SEQ ID NO: 121848 - protein, 17 aa, Mycobacterium avium
QIEWLFGTLLGPRPNWS

SEQ ID NO: 121849 - protein, 20 aa, Mycobacterium avium
QIFANEPDFFWSPVNSLEDV

SEQ ID NO: 121850 - protein, 19 aa, Mycobacterium avium
QIIARIACEMGFSEAFSYS

SEQ ID NO: 121851 - protein, 20 aa, Mycobacterium avium
QILRALRINLSVRGYEVVTA

SEQ ID NO: 121852 - protein, 24 aa, Mycobacterium avium
QIRQSVPDWLVWTHGCPGGESVAQ

SEQ ID NO: 121853 - protein, 21 aa, Mycobacterium avium
QIWAKGVELYPGWRKYEVRAG

SEQ ID NO: 121854 - protein, 17 aa, Mycobacterium avium
QKLFGYSEPHATKLMLQ

SEQ ID NO: 121855 - protein, 17 aa, Mycobacterium avium
QKVWAQAGFRPVDPAVA

SEQ ID NO: 121856 - protein, 19 aa, Mycobacterium avium
QLADTMLIPAALDGGDVGL

SEQ ID NO: 121857 - protein, 26 aa, Mycobacterium avium
QLAERLPAYMVPAAVVVLDALPLTVN

SEQ ID NO: 121858 - protein, 22 aa, Mycobacterium avium
QLAEWMCFMLSDAADFLCGSVV

SEQ ID NO: 121859 - protein, 17 aa, Mycobacterium avium
QLAFDERRLRQALTASD

SEQ ID NO: 121860 - protein, 25 aa, Mycobacterium avium
QLAKAMDRKVWLPSGGTLVIDRTEA

SEQ ID NO: 121861 - protein, 21 aa, Mycobacterium avium
QLALLAVYPRNQECLLRLAAL

SEQ ID NO: 121862 - protein, 24 aa, Mycobacterium avium
QLAMTPTYLRVFGLRSMRGRAVQE

SEQ ID NO: 121863 - protein, 17 aa, Mycobacterium avium
QLANRLAILARDVTVPP

SEQ ID NO: 121864 - protein, 31 aa, Mycobacterium avium
QLARMELQIVLPTLLRRVPTLRLAAPLDELP

SEQ ID NO: 121865 - protein, 36 aa, Mycobacterium avium
QLAVIIHHLAVDAVSWWILLEDLNIAWALHRAGQPV

SEQ ID NO: 121866 - protein, 20 aa, Mycobacterium avium
QLDRWKTVTSTPAALPAPRP

SEQ ID NO: 121867 - protein, 21 aa, Mycobacterium avium
QLDWGTYVFDFGRREVRNFLV

SEQ ID NO: 121868 - protein, 18 aa, Mycobacterium avium
QLGVDFWVDGVNPPGYTG

SEQ ID NO: 121869 - protein, 21 aa, Mycobacterium avium
QLLRRSVRRFSAEPVPAELVR

SEQ ID NO: 121870 - protein, 17 aa, Mycobacterium avium
QLPDRGWRRALRLATFG

SEQ ID NO: 121871 - protein, 19 aa, Mycobacterium avium
QLRALPDGLTYGLLRYLNP

SEQ ID NO: 121872 - protein, 27 aa, Mycobacterium avium
QLREAHELIYRPLRHPDGPPQPQVEYK

SEQ ID NO: 121873 - protein, 28 aa, Mycobacterium avium
QLRTLPEPLTYGLLRYLNTDVDLAGADP

SEQ ID NO: 121874 - protein, 21 aa, Mycobacterium avium
QLSFLFGGVIYDLGGTLLGLR

SEQ ID NO: 121875 - protein, 18 aa, Mycobacterium avium
QLVATGIPVLLGASRKRF

SEQ ID NO: 121876 - protein, 20 aa, Mycobacterium avium
QLVDRFFEARKMMSSMLGGM

SEQ ID NO: 121877 - protein, 21 aa, Mycobacterium avium
QLWVAGTRPFGPTCVLVRETG

SEQ ID NO: 121878 - protein, 25 aa, Mycobacterium avium
QMEYMLPRLRGWGESMSRQAGGRAG

SEQ ID NO: 121879 - protein, 25 aa, Mycobacterium avium
QMFGYPREELIGREVEILIPPRHRG

SEQ ID NO: 121880 - protein, 21 aa, Mycobacterium avium
QNAMVLQQKIAERTKLLSQLE

SEQ ID NO: 121881 - protein, 17 aa, Mycobacterium avium
QNTFGILADIGRFSTVA

SEQ ID NO: 121882 - protein, 17 aa, Mycobacterium avium
QNVAWFARLYGVPRAER

SEQ ID NO: 121883 - protein, 19 aa, Mycobacterium avium
QNVWRTTALVAPPLDEVRP

SEQ ID NO: 121884 - protein, 30 aa, Mycobacterium avium
QPAVNMLRGGFELAYRLLSYPKPVVMACTG

SEQ ID NO: 121885 - protein, 24 aa, Mycobacterium avium
QPFHEKLTLLWHNHFATSAQKVRV

SEQ ID NO: 121886 - protein, 20 aa, Mycobacterium avium
QPLRQALLQTSRLSSALRAD

SEQ ID NO: 121887 - protein, 19 aa, Mycobacterium avium
QPMRRIVQARTLSPITSVA

SEQ ID NO: 121888 - protein, 18 aa, Mycobacterium avium
QPMTPQLGLVEPVTLSVG

SEQ ID NO: 121889 - protein, 20 aa, Mycobacterium avium
QPNRAFLRNWREALELPPAR

SEQ ID NO: 121890 - protein, 23 aa, Mycobacterium avium
QPQRPKVLILGSGPNRIGQGIEF

SEQ ID NO: 121891 - protein, 22 aa, Mycobacterium avium
QPVLEAVLGILRDLTSGPVNAV

SEQ ID NO: 121892 - protein, 25 aa, Mycobacterium avium
QQHAQLALYQLAVAHGLLGAAGGDA

SEQ ID NO: 121893 - protein, 25 aa, Mycobacterium avium
QQQADYFMRLLTGRRGLIDQRLDGY

SEQ ID NO: 121894 - protein, 20 aa, Mycobacterium avium
QQRFLSVAEGLPALPPGAAG

SEQ ID NO: 121895 - protein, 17 aa, Mycobacterium avium
QQRRYTLLGLSGLGGRY

SEQ ID NO: 121896 - protein, 18 aa, Mycobacterium avium
QQRYAPLLAALDCPVHLI

SEQ ID NO: 121897 - protein, 25 aa, Mycobacterium avium
QQVAELLFDVLGPTALDAGSGAPLH

SEQ ID NO: 121898 - protein, 24 aa, Mycobacterium avium
QQVLSRFLHDFAGLGADWTAANIA

SEQ ID NO: 121899 - protein, 25 aa, Mycobacterium avium
QQVRAGLKAIYLSGWQVAGDANLSG

SEQ ID NO: 121900 - protein, 29 aa, Mycobacterium avium
QRCAEARIFFVDYLTMLPPAGVPAAPLSA

SEQ ID NO: 121901 - protein, 21 aa, Mycobacterium avium
QRDFTLWKGAKPGEPSWPTPW

SEQ ID NO: 121902 - protein, 24 aa, Mycobacterium avium
QRDLAYTTIMTVLQRLAKKNLVSQ

SEQ ID NO: 121903 - protein, 21 aa, Mycobacterium avium
QRDRFLFKINVGYPSPEEERE

SEQ ID NO: 121904 - protein, 18 aa, Mycobacterium avium
QRFVDATLWPRLFGNCHT

SEQ ID NO: 121905 - protein, 22 aa, Mycobacterium avium
QRGNHLPALTALDLLSTGRLDG

SEQ ID NO: 121906 - protein, 23 aa, Mycobacterium avium
QRHLRRLWGLPATQLGVVAWPPT

SEQ ID NO: 121907 - protein, 24 aa, Mycobacterium avium
QRLAPGTALARVFWPNGRVVVTRE

SEQ ID NO: 121908 - protein, 26 aa, Mycobacterium avium
QRPSIRAGEFLIAGAGAGLARRVDDT

SEQ ID NO: 121909 - protein, 33 aa, Mycobacterium avium
QRTMQLNYLGAVQLILKFIPGMRERGFGQIINV

SEQ ID NO: 121910 - protein, 41 aa, Mycobacterium avium
QRTPMPLTGPMIKFALFRTGSAEYYWFTTCHHIAIDGMGIA

SEQ ID NO: 121911 - protein, 33 aa, Mycobacterium avium
QRTVMPLDGPLFKFALLQTRVDEFYLFVCCHHI

SEQ ID NO: 121912 - protein, 17 aa, Mycobacterium avium
QRVAVGWFGGCCYRCDP

SEQ ID NO: 121913 - protein, 17 aa, Mycobacterium avium
QRYAMFMSFSLASGAGR

SEQ ID NO: 121914 - protein, 21 aa, Mycobacterium avium
QRYNFQFTGQRFYRIRGGRLD

SEQ ID NO: 121915 - protein, 34 aa, Mycobacterium avium
QSESNAMWALSIPVPFIKPVGAGAGGYFAPHVRA

SEQ ID NO: 121916 - protein, 20 aa, Mycobacterium avium
QSEWGWAWPADRRVLYNRAS

SEQ ID NO: 121917 - protein, 23 aa, Mycobacterium avium
QSFSEFLVVPYRAESIQAAVEKG

SEQ ID NO: 121918 - protein, 21 aa, Mycobacterium avium
QSGILRDRLIPRVLAAAPDAL

SEQ ID NO: 121919 - protein, 18 aa, Mycobacterium avium
QSGLARTGYTFACDRWRV

SEQ ID NO: 121920 - protein, 30 aa, Mycobacterium avium
QSLEAMRAIGIPVYLLPGNHDPLDASSVYT

SEQ ID NO: 121921 - protein, 20 aa, Mycobacterium avium
QSQWPRWVPVGRMGLPEDQA

SEQ ID NO: 121922 - protein, 26 aa, Mycobacterium avium
QSVLRLHPYPVLRTYSIYAADPDRGA

SEQ ID NO: 121923 - protein, 20 aa, Mycobacterium avium
QTALTLLHLGTHPDLRQQLI

SEQ ID NO: 121924 - protein, 24 aa, Mycobacterium avium
QTEAQMVRLLVQYAAWHLDRDHHM

SEQ ID NO: 121925 - protein, 20 aa, Mycobacterium avium
QTFFTTPHFDGYPAVLVNLD

SEQ ID NO: 121926 - protein, 26 aa, Mycobacterium avium
QTKDLPVYRFVLRAYAAQLVQNHANL

SEQ ID NO: 121927 - protein, 28 aa, Mycobacterium avium
QTLTTLMPLRYQDANWWLRARTASDIGG

SEQ ID NO: 121928 - protein, 24 aa, Mycobacterium avium
QTPQGFATDLLLRAYAAGAGTAGF

SEQ ID NO: 121929 - protein, 22 aa, Mycobacterium avium
QTVPGMITGFVPLVLKASPGSS

SEQ ID NO: 121930 - protein, 23 aa, Mycobacterium avium
QTVRPKILSPQYSDYQVLQGGQG

SEQ ID NO: 121931 - protein, 20 aa, Mycobacterium avium
QVGDRVWAWTLPDGGYGWSN

SEQ ID NO: 121932 - protein, 19 aa, Mycobacterium avium
QVIELHDCFSANELLLYEA

SEQ ID NO: 121933 - protein, 26 aa, Mycobacterium avium
QVISRLIDWVSFTPLHNVTGEPAISL

SEQ ID NO: 121934 - protein, 19 aa, Mycobacterium avium
QVLMWVNRFDTETTLTVAF

SEQ ID NO: 121935 - protein, 22 aa, Mycobacterium avium
QVLRRQPLPLSLLATHPIDISR

SEQ ID NO: 121936 - protein, 19 aa, Mycobacterium avium
QVNNIHLVRGMLGRPGCGV

SEQ ID NO: 121937 - protein, 20 aa, Mycobacterium avium
QVPLWPERLLTRDGGAEIER

SEQ ID NO: 121938 - protein, 28 aa, Mycobacterium avium
QVRGLDAVLPALLARDLHPTAVAGFLMT

SEQ ID NO: 121939 - protein, 24 aa, Mycobacterium avium
QVSLAGRYLVYVPGASSTGISRKL

SEQ ID NO: 121940 - protein, 17 aa, Mycobacterium avium
QVSLPAGQSWSITAVGP

SEQ ID NO: 121941 - protein, 22 aa, Mycobacterium avium
QVTELLIARCEALLAAGDVGSA

SEQ ID NO: 121942 - protein, 18 aa, Mycobacterium avium
QVTPRRPGSDRWIAVVAE

SEQ ID NO: 121943 - protein, 17 aa, Mycobacterium avium
QWATAGHRRPFVGSLTL

SEQ ID NO: 121944 - protein, 41 aa, Mycobacterium avium
QWGISNFQIFPNLEILIYGGWYLLYRYWPTSHNTHRFEAYT

SEQ ID NO: 121945 - protein, 19 aa, Mycobacterium avium
QWLTMLDVNLSGVWRTMKA

SEQ ID NO: 121946 - protein, 19 aa, Mycobacterium avium
QWRDPYAGTPWHKHVPARI

SEQ ID NO: 121947 - protein, 19 aa, Mycobacterium avium
QWVLGNLGAIPTVKLDYRT

SEQ ID NO: 121948 - protein, 21 aa, Mycobacterium avium
QYADFYTPPDPLPPGRPGDLI

SEQ ID NO: 121949 - protein, 20 aa, Mycobacterium avium
QYATLHRLWTEEPVLPCLYL

SEQ ID NO: 121950 - protein, 18 aa, Mycobacterium avium
QYVPKLLELNGDNPFVLV

SEQ ID NO: 121951 - protein, 23 aa, Mycobacterium avium
RAAALESLTSIRRAGADIVLSYW

SEQ ID NO: 121952 - protein, 26 aa, Mycobacterium avium
RAAEIAGITGLPLLAAIKAQPQLGAQ

SEQ ID NO: 121953 - protein, 25 aa, Mycobacterium avium
RAAELMGIQIPRFCDHPLLEPVGAC

SEQ ID NO: 121954 - protein, 26 aa, Mycobacterium avium
RAAHRRPLWYLMPDGVVQYVSKRRLY

SEQ ID NO: 121955 - protein, 25 aa, Mycobacterium avium
RAALAERLPAYMVPAAVVVLDSLPM

SEQ ID NO: 121956 - protein, 17 aa, Mycobacterium avium
RAALRDLTLMLVYEASR

SEQ ID NO: 121957 - protein, 18 aa, Mycobacterium avium
RAAMSKRPLLVLAPGDRV

SEQ ID NO: 121958 - protein, 22 aa, Mycobacterium avium
RAAQALPVYFGNRNWEPYVEDT

SEQ ID NO: 121959 - protein, 18 aa, Mycobacterium avium
RAARFLAEGPNLVEAAAG

SEQ ID NO: 121960 - protein, 25 aa, Mycobacterium avium
RAARVVVPDFQLSLAIGKEGQNARL

SEQ ID NO: 121961 - protein, 24 aa, Mycobacterium avium
RAAVEPLVLMLAPLAPHMAEELWL

SEQ ID NO: 121962 - protein, 23 aa, Mycobacterium avium
RAAVGKYWVIDEIRPSFIVSNVP

SEQ ID NO: 121963 - protein, 29 aa, Mycobacterium avium
RADEAVAGHWLLARLGKRVLRPGGVELTR

SEQ ID NO: 121964 - protein, 25 aa, Mycobacterium avium
RADGDPPALIPFSGPARKVLELTVR

SEQ ID NO: 121965 - protein, 19 aa, Mycobacterium avium
RADLLRRAGRPAEALPWYR

SEQ ID NO: 121966 - protein, 25 aa, Mycobacterium avium
RADRAGWLRYGLPASLGGRDGSNVD

SEQ ID NO: 121967 - protein, 27 aa, Mycobacterium avium
RADVVFASHHWPTWGRDGIVEFLSLQR

SEQ ID NO: 121968 - protein, 27 aa, Mycobacterium avium
RADWLAREHPWLLRRDLRTGSAGIDPI

SEQ ID NO: 121969 - protein, 17 aa, Mycobacterium avium
RAEHLMLVDLGRNDLGR

SEQ ID NO: 121970 - protein, 22 aa, Mycobacterium avium
RAEIDALLARLPQPGDTEDPDK

SEQ ID NO: 121971 - protein, 26 aa, Mycobacterium avium
RAESVQQTWFALSALAERVAATVRIA

SEQ ID NO: 121972 - protein, 19 aa, Mycobacterium avium
RAFERLVALQVIRVDGSRA

SEQ ID NO: 121973 - protein, 50 aa, Mycobacterium avium
RAFFHTNSVPLYFISPTPFNLLGIDRWIRNFFYLTYFDSFEGIHSRVFVP

SEQ ID NO: 121974 - protein, 23 aa, Mycobacterium avium
RAGDVTLPLTYRFQPGAADDGVT

SEQ ID NO: 121975 - protein, 28 aa, Mycobacterium avium
RAGELLAKPTAWLFGPESHGLPSEVAAA

SEQ ID NO: 121976 - protein, 25 aa, Mycobacterium avium
RAGLTAARFVACPFGGAGARMYRTG

SEQ ID NO: 121977 - protein, 25 aa, Mycobacterium avium
RAGPHNRMISWPYTKLMNSNNMVDQ

SEQ ID NO: 121978 - protein, 29 aa, Mycobacterium avium
RAGRKRSHWMWFVFPQLRGLGGSAMADRY

SEQ ID NO: 121979 - protein, 26 aa, Mycobacterium avium
RAGVARSGFYFYFDSKYAVLAQLMAE

SEQ ID NO: 121980 - protein, 19 aa, Mycobacterium avium
RAHRRSFVADRLATGTAAL

SEQ ID NO: 121981 - protein, 21 aa, Mycobacterium avium
RALAADPPILLMDEPFSAVDP

SEQ ID NO: 121982 - protein, 17 aa, Mycobacterium avium
RALAGFGLTEPGAGSDA

SEQ ID NO: 121983 - protein, 25 aa, Mycobacterium avium
RALAPVATRRRCVVRPATALNRMTR

SEQ ID NO: 121984 - protein, 18 aa, Mycobacterium avium
RALGARYLDTGGMYRMVT

SEQ ID NO: 121985 - protein, 30 aa, Mycobacterium avium
RALGFPTRMFTVLFALGRLPGWIAHWREMH

SEQ ID NO: 121986 - protein, 20 aa, Mycobacterium avium
RALGRYGVCANAICPRARTA

SEQ ID NO: 121987 - protein, 21 aa, Mycobacterium avium
RALMMISSVHPSLGALLSAHQ

SEQ ID NO: 121988 - protein, 17 aa, Mycobacterium avium
RALPSTFATWRERRKLI

SEQ ID NO: 121989 - protein, 17 aa, Mycobacterium avium
RALRDQQAAADRAKAAV

SEQ ID NO: 121990 - protein, 17 aa, Mycobacterium avium
RALRMSTPLALTEEELV

SEQ ID NO: 121991 - protein, 21 aa, Mycobacterium avium
RALRPARLLVSGSAPLPVPVF

SEQ ID NO: 121992 - protein, 25 aa, Mycobacterium avium
RALSQEFPMLFIEDLLDGDDWAGFT

SEQ ID NO: 121993 - protein, 24 aa, Mycobacterium avium
RANASGLVRLQWVSARTLTIAPKD

SEQ ID NO: 121994 - protein, 45 aa, Mycobacterium avium
RANRMRWPHGRLRYYVAMLAELSQLRLLPFRLVLDGAREIDADIT

SEQ ID NO: 121995 - protein, 20 aa, Mycobacterium avium
RAQLADRLPPYMVPTAVMVL

SEQ ID NO: 121996 - protein, 21 aa, Mycobacterium avium
RAQLLPWTATLKPHYVRITPT

SEQ ID NO: 121997 - protein, 25 aa, Mycobacterium avium
RARAMAMVMLALPGAVFIYNGEELG

SEQ ID NO: 121998 - protein, 24 aa, Mycobacterium avium
RARAWRRLPDWPPATTERALYLRP

SEQ ID NO: 121999 - protein, 20 aa, Mycobacterium avium
RARHRPVWVKGFGEHVPFKT

SEQ ID NO: 122000 - protein, 21 aa, Mycobacterium avium
RARKSIAQFKLREGMPIGARV

SEQ ID NO: 122001 - protein, 18 aa, Mycobacterium avium
RARRRTAPLFGIYDAALT

SEQ ID NO: 122002 - protein, 22 aa, Mycobacterium avium
RASARRLGLDRIPLYQVHQPNP

SEQ ID NO: 122003 - protein, 27 aa, Mycobacterium avium
RASCRYMKMITPAALLRCLVEGADEVH

SEQ ID NO: 122004 - protein, 22 aa, Mycobacterium avium
RASGRYRFLTPDQLIAEVRDAP

SEQ ID NO: 122005 - protein, 39 aa, Mycobacterium avium
RASIAGLRYIVYGAAPMPLPLLHRALSTWPGTKFVQVYG

SEQ ID NO: 122006 - protein, 22 aa, Mycobacterium avium
RASKPLVRLRVPFTLSRYEIDN

SEQ ID NO: 122007 - protein, 26 aa, Mycobacterium avium
RATARRAAALWLLCTIEFAARRWLSG

SEQ ID NO: 122008 - protein, 18 aa, Mycobacterium avium
RATELRSRRVRELGAEVI

SEQ ID NO: 122009 - protein, 34 aa, Mycobacterium avium
RATGLPWMTDLVEQFGLRPPPVEQIEAFAALPSP

SEQ ID NO: 122010 - protein, 24 aa, Mycobacterium avium
RATLYRHFATKNDLVLAVLQRREE

SEQ ID NO: 122011 - protein, 23 aa, Mycobacterium avium
RATTHWHDVRLFARAFPEITVEP

SEQ ID NO: 122012 - protein, 24 aa, Mycobacterium avium
RAVDAVSFRLHRARTLAIAGESGS

SEQ ID NO: 122013 - protein, 18 aa, Mycobacterium avium
RAWELMGMRVHWQSSNDL

SEQ ID NO: 122014 - protein, 25 aa, Mycobacterium avium
RAYLDFGEPLPLRKRLEELRAEESG

SEQ ID NO: 122015 - protein, 17 aa, Mycobacterium avium
RAYLLDQNALPDAPLTA

SEQ ID NO: 122016 - protein, 17 aa, Mycobacterium avium
RAYLSVDEIVGTALACG

SEQ ID NO: 122017 - protein, 17 aa, Mycobacterium avium
RAYRLEWPPATTVFEVD

SEQ ID NO: 122018 - protein, 31 aa, Mycobacterium avium
RCAVVFQEPRLLPWRSLAANVAFGLPRGTER

SEQ ID NO: 122019 - protein, 30 aa, Mycobacterium avium
RDADRDWWARRLPELPDPPALPITAGRGAN

SEQ ID NO: 122020 - protein, 25 aa, Mycobacterium avium
RDEAVHGYYIGYKYQRGLALVDDAK

SEQ ID NO: 122021 - protein, 23 aa, Mycobacterium avium
RDEDKVVWLSQTTLSVDETMEIV

SEQ ID NO: 122022 - protein, 27 aa, Mycobacterium avium
RDELYRRWTGLLSYRYIGRKHSSMNLG

SEQ ID NO: 122023 - protein, 23 aa, Mycobacterium avium
RDERRHELFFSNLVAHCLEYTRD

SEQ ID NO: 122024 - protein, 25 aa, Mycobacterium avium
RDEWQPLYVFGTRTVPQIDLLVGSW

SEQ ID NO: 122025 - protein, 35 aa, Mycobacterium avium
RDFARASFKYGLNAKWPVYLSTKNTILKAYDGMFK

SEQ ID NO: 122026 - protein, 24 aa, Mycobacterium avium
RDFATARFGLKRFLADWDRVIGEL

SEQ ID NO: 122027 - protein, 27 aa, Mycobacterium avium
RDGEQPLALMIAYLPPGLGEAVEPLLK

SEQ ID NO: 122028 - protein, 28 aa, Mycobacterium avium
RDGGRFQKLLRIFANPKLPVIGDYYEPW

SEQ ID NO: 122029 - protein, 31 aa, Mycobacterium avium
RDGQDPRYILWAAWHRSGLQRRWLSVSERGG

SEQ ID NO: 122030 - protein, 32 aa, Mycobacterium avium
RDGVRQVLLPFWNAYSFLALYAPKVGTWRTDS

SEQ ID NO: 122031 - protein, 23 aa, Mycobacterium avium
RDHGWPQFADRLLELARAAETGS

SEQ ID NO: 122032 - protein, 28 aa, Mycobacterium avium
RDHSDYYVLLVEYWLRAQRDPQLRERLI

SEQ ID NO: 122033 - protein, 20 aa, Mycobacterium avium
RDIAMVFQSYALYPHMTVRQ

SEQ ID NO: 122034 - protein, 32 aa, Mycobacterium avium
RDKVAVITFRQQQARLLLPPTSSAHIAGRRLA

SEQ ID NO: 122035 - protein, 19 aa, Mycobacterium avium
RDLADIWPVIDRDPAVRAV

SEQ ID NO: 122036 - protein, 23 aa, Mycobacterium avium
RDLSSIVFILQGAAVMPPSLLHT

SEQ ID NO: 122037 - protein, 31 aa, Mycobacterium avium
RDPMECAELLDWPAKLRLLEGFRQRENLSWS

SEQ ID NO: 122038 - protein, 29 aa, Mycobacterium avium
RDQARALLPTLLQYQVPLWPERLLTRDGG

SEQ ID NO: 122039 - protein, 19 aa, Mycobacterium avium
RDRFGFTAHMDFYEPAELQ

SEQ ID NO: 122040 - protein, 25 aa, Mycobacterium avium
RDRPRIFDLFDRILKALAPDAHPRG

SEQ ID NO: 122041 - protein, 19 aa, Mycobacterium avium
RDRRKLLEMLASGGDLTVP

SEQ ID NO: 122042 - protein, 17 aa, Mycobacterium avium
RDTALVVHLGMSGQMLL

SEQ ID NO: 122043 - protein, 21 aa, Mycobacterium avium
RDTWRLVLRGLDETASRRYGA

SEQ ID NO: 122044 - protein, 26 aa, Mycobacterium avium
RDVELAFLGLIPQPIKAVQLLYRTMD

SEQ ID NO: 122045 - protein, 19 aa, Mycobacterium avium
RDVELLALAQLIGAAGTLV

SEQ ID NO: 122046 - protein, 18 aa, Mycobacterium avium
REAAFAHFGRRFDDLATE

SEQ ID NO: 122047 - protein, 18 aa, Mycobacterium avium
REAFAWHIDLAKRCGKPL

SEQ ID NO: 122048 - protein, 18 aa, Mycobacterium avium
REAFEVDILTIGLLIAEV

SEQ ID NO: 122049 - protein, 18 aa, Mycobacterium avium
REAKSYFLNIKGPELLNK

SEQ ID NO: 122050 - protein, 24 aa, Mycobacterium avium
REALGPITILVNNAAFTAPGRPPA

SEQ ID NO: 122051 - protein, 21 aa, Mycobacterium avium
RECIATWTGIPIGYVAVHVVS

SEQ ID NO: 122052 - protein, 21 aa, Mycobacterium avium
REDILRVYPALDPSAVHVIRN

SEQ ID NO: 122053 - protein, 22 aa, Mycobacterium avium
REEWPSAIRRLVSGQLSLLLRR

SEQ ID NO: 122054 - protein, 31 aa, Mycobacterium avium
REGDRYLQINPYFHTFGLKAGLITSFLRGAT

SEQ ID NO: 122055 - protein, 27 aa, Mycobacterium avium
REHAVWALMDYGFRVVISSRFGDIFRG

SEQ ID NO: 122056 - protein, 18 aa, Mycobacterium avium
REHLYEMDYLKEGIGLRA

SEQ ID NO: 122057 - protein, 25 aa, Mycobacterium avium
RELADRWQIRRYGFHGTSHRYVSEQ

SEQ ID NO: 122058 - protein, 19 aa, Mycobacterium avium
RELIARIRAVLRRGGDDDS

SEQ ID NO: 122059 - protein, 19 aa, Mycobacterium avium
RELLPLRRADQEEYLRWAV

SEQ ID NO: 122060 - protein, 26 aa, Mycobacterium avium
RELPALVVLERIPVPVLAIAGDGSIL

SEQ ID NO: 122061 - protein, 20 aa, Mycobacterium avium
RELRVPLHYYRDPKITEIEE

SEQ ID NO: 122062 - protein, 31 aa, Mycobacterium avium
REPVGVVGAIVPWNFPFEVTLNKLGQALGTG

SEQ ID NO: 122063 - protein, 29 aa, Mycobacterium avium
RERMAFPRSLIERLPHLRLLTIVGRQLPN

SEQ ID NO: 122064 - protein, 22 aa, Mycobacterium avium
RETCWRDYRLGVLQAPLISALG

SEQ ID NO: 122065 - protein, 17 aa, Mycobacterium avium
RETGFWRFVRDPDDPSE

SEQ ID NO: 122066 - protein, 26 aa, Mycobacterium avium
RETNGDRYLPIWIGQSEAAAIALEQQ

SEQ ID NO: 122067 - protein, 30 aa, Mycobacterium avium; identical to SEQ ID NO: 24951

SEQ ID NO: 122068 - protein, 19 aa, Mycobacterium avium
REVLRMRFFESMTQSQIAE

SEQ ID NO: 122069 - protein, 24 aa, Mycobacterium avium
REVQADIRRKIEIGCYQGLRHRRG

SEQ ID NO: 122070 - protein, 25 aa, Mycobacterium avium
REVQDVWTWVQPYFDDRATGAAKKL

SEQ ID NO: 122071 - protein, 30 aa, Mycobacterium avium
REVRNFLVANALYWLQEFHIDGLRVDAVAS

SEQ ID NO: 122072 - protein, 21 aa, Mycobacterium avium
RFARFAPRRLVGPRTLPLMRV

SEQ ID NO: 122073 - protein, 23 aa, Mycobacterium avium
RFDPQAKGLGEWLRGRYLDIPES

SEQ ID NO: 122074 - protein, 20 aa, Mycobacterium avium
RFEAYTYFHPARSVRERIEH

SEQ ID NO: 122075 - protein, 18 aa, Mycobacterium avium
RFEQAAGAVLHWGMQRGS

SEQ ID NO: 122076 - protein, 23 aa, Mycobacterium avium
RFGEWMTIFAGWRGPVPDTIGEG

SEQ ID NO: 122077 - protein, 17 aa, Mycobacterium avium
RFGTLTGVERPVAEGDF

SEQ ID NO: 122078 - protein, 18 aa, Mycobacterium avium
RFLDITDEDFRHTFDWCV

SEQ ID NO: 122079 - protein, 18 aa, Mycobacterium avium
RFNDDMIIMPLQAATQWD

SEQ ID NO: 122080 - protein, 20 aa, Mycobacterium avium
RFRRMLSKPFTFKRVEGLRP

SEQ ID NO: 122081 - protein, 21 aa, Mycobacterium avium
RFSEHLLAEHLQKVSLSFLVD

SEQ ID NO: 122082 - protein, 18 aa, Mycobacterium avium
RFVANALSPAKVVSVSII

SEQ ID NO: 122083 - protein, 36 aa, Mycobacterium avium
RFVLTSHHILLDGWSLPILLREIFAGYYGQRLPAAG

SEQ ID NO: 122084 - protein, 20 aa, Mycobacterium avium
RFVPHKTVLYGTGYLRKGIP

SEQ ID NO: 122085 - protein, 24 aa, Mycobacterium avium
RFYEGLLGFQFWWEIDPPDDRTAQ

SEQ ID NO: 122086 - protein, 20 aa, Mycobacterium avium
RGALAALARAVPAAGGVHVV

SEQ ID NO: 122087 - protein, 18 aa, Mycobacterium avium
RGARLAVDWPAELQQQLR

SEQ ID NO: 122088 - protein, 32 aa, Mycobacterium avium
RGDLGRRWAGPAFLLNEMLVWGFTGQVISALL

SEQ ID NO: 122089 - protein, 26 aa, Mycobacterium avium
RGDYGAALLLDTWALLGRQDLRAAED

SEQ ID NO: 122090 - protein, 24 aa, Mycobacterium avium
RGEHPSLCLFASWAAPDSPAGRRL

SEQ ID NO: 122091 - protein, 21 aa, Mycobacterium avium
RGEQVFAPAPIPFDRPTQERR

SEQ ID NO: 122092 - protein, 22 aa, Mycobacterium avium
RGERLVNSMFTLSTLVGLSVSQ

SEQ ID NO: 122093 - protein, 19 aa, Mycobacterium avium
RGFAFYALDLHKCGRSRRD

SEQ ID NO: 122094 - protein, 20 aa, Mycobacterium avium
RGGAADPALWTTASLAGARV

SEQ ID NO: 122095 - protein, 25 aa, Mycobacterium avium
RGGFTAFWMPQVPGYLDALTAVALI

SEQ ID NO: 122096 - protein, 25 aa, Mycobacterium avium
RGGKVWINVFPDRPLTKKPAETRMG

SEQ ID NO: 122097 - protein, 17 aa, Mycobacterium avium
RGHNWLPTTPESRKLFI

SEQ ID NO: 122098 - protein, 27 aa, Mycobacterium avium
RGIEKKPLPFLLGMMNLVLHGVGQPNI

SEQ ID NO: 122099 - protein, 29 aa, Mycobacterium avium
RGLGGDATRLLYTLGWHEVPPQPSNDGVA

SEQ ID NO: 122100 - protein, 23 aa, Mycobacterium avium
RGLHVFCEKPFVLDVRDGERLVT

SEQ ID NO: 122101 - protein, 30 aa, Mycobacterium avium
RGLTRERVLALGLRLLDRGYFRSGGEQYAE

SEQ ID NO: 122102 - protein, 17 aa, Mycobacterium avium
RGMWREMWDLSDQCWAQ

SEQ ID NO: 122103 - protein, 24 aa, Mycobacterium avium
RGNALDVLQRLIAPASLTGVRVFF

SEQ ID NO: 122104 - protein, 26 aa, Mycobacterium avium
RGPEMLSFVLKHTPLKMCWVPRYSDY

SEQ ID NO: 122105 - protein, 21 aa, Mycobacterium avium
RGPHRVLRGDLAFAGLPGVVY

SEQ ID NO: 122106 - protein, 20 aa, Mycobacterium avium
RGPVVPALGLALLGARAAGK

SEQ ID NO: 122107 - protein, 24 aa, Mycobacterium avium
RGSRDVLMVAWMDDAALARTLETR

SEQ ID NO: 122108 - protein, 27 aa, Mycobacterium avium
RGSVLAALGRIDYWFVTDGRRVHKTVH

SEQ ID NO: 122109 - protein, 29 aa, Mycobacterium avium
RGSYLQMHFALQEAPVFAAPYQVLNEPAM

SEQ ID NO: 122110 - protein, 28 aa, Mycobacterium avium
RGTAPTGPGFWFPPTVLTPSRTDRCVTE

SEQ ID NO: 122111 - protein, 29 aa, Mycobacterium avium
RGTGLDGLSLPLLRSWLSAAAAGGVARTT

SEQ ID NO: 122112 - protein, 21 aa, Mycobacterium avium
RGTHALRFIRSCSAPLTAETA

SEQ ID NO: 122113 - protein, 25 aa, Mycobacterium avium
RGVEPIIVADFRADRRRLAADSFGA

SEQ ID NO: 122114 - protein, 38 aa, Mycobacterium avium
RGVPVFAWKGETLEEYWWAAEQALTWPPLADGTEAPAN

SEQ ID NO: 122115 - protein, 26 aa, Mycobacterium avium
RGVSDYPVIGLELRVSVPPGADGALR

SEQ ID NO: 122116 - protein, 22 aa, Mycobacterium avium
RGYGYGPAFQGLTAAWVRGDEV

SEQ ID NO: 122117 - protein, 17 aa, Mycobacterium avium
RGYLPDVTPAQRRKRVL

SEQ ID NO: 122118 - protein, 23 aa, Mycobacterium avium
RHDTFRSWFHHSGDGEFVRHTVS

SEQ ID NO: 122119 - protein, 18 aa, Mycobacterium avium
RHHKRRFLQPGTVGLIAD

SEQ ID NO: 122120 - protein, 18 aa, Mycobacterium avium
RHLGVDEDRIRMLRSFDP

SEQ ID NO: 122121 - protein, 19 aa, Mycobacterium avium
RHLPGGIDEYLRLAAQRRD

SEQ ID NO: 122122 - protein, 19 aa, Mycobacterium avium
RHPGWPMSVGPLRVPAGVV

SEQ ID NO: 122123 - protein, 17 aa, Mycobacterium avium
RHPRILYLADRNVLVDQ

SEQ ID NO: 122124 - protein, 31 aa, Mycobacterium avium
RHYAYLKKVLQALTFLRGPRTWVLKSPQHCE

SEQ ID NO: 122125 - protein, 23 aa, Mycobacterium avium
RIAAALGPGWPRAVKSTLQMTFS

SEQ ID NO: 122126 - protein, 19 aa, Mycobacterium avium
RIAALRAQARARHGWIMDT

SEQ ID NO: 122127 - protein, 30 aa, Mycobacterium avium
RIAEDIGYPVLVRPSYVLGGRGMEIVYDEE

SEQ ID NO: 122128 - protein, 18 aa, Mycobacterium avium
RIAFVFPGQGNQWQAMGA

SEQ ID NO: 122129 - protein, 17 aa, Mycobacterium avium
RIEARLAKLNPAPTRDI

SEQ ID NO: 122130 - protein, 29 aa, Mycobacterium avium
RIGGPAAWLGTALALKPLLRIDDGKLVLA

SEQ ID NO: 122131 - protein, 29 aa, Mycobacterium avium
RIKLSDKPMPLFQLLVLCMLASKPIDAAI

SEQ ID NO: 122132 - protein, 17 aa, Mycobacterium avium
RILHTVRGIGYRLQPER

SEQ ID NO: 122133 - protein, 17 aa, Mycobacterium avium
RILRRRSLAALRAQVEP

SEQ ID NO: 122134 - protein, 18 aa, Mycobacterium avium
RIPMLAGRRSLNLSNAAA

SEQ ID NO: 122135 - protein, 19 aa, Mycobacterium avium
RIQLAQFIMRSDLEPDLDV

SEQ ID NO: 122136 - protein, 18 aa, Mycobacterium avium
RIRVYRPEAAAPLPALVY

SEQ ID NO: 122137 - protein, 20 aa, Mycobacterium avium
RISYSWIPRERNSHADRLAN

SEQ ID NO: 122138 - protein, 18 aa, Mycobacterium avium
RITFLAKSEYFTGTGLKG

SEQ ID NO: 122139 - protein, 19 aa, Mycobacterium avium
RITRRYNGFLMALDADLVV

SEQ ID NO: 122140 - protein, 18 aa, Mycobacterium avium
RIVGWIMRTDSSDLPWHR

SEQ ID NO: 122141 - protein, 17 aa, Mycobacterium avium
RIYNGKLCKGQQVAWMR

SEQ ID NO: 122142 - protein, 30 aa, Mycobacterium avium
RKAGRRFARLAPIVGTYRKLMAAREDLETA

SEQ ID NO: 122143 - protein, 21 aa, Mycobacterium avium
RKCSMFTCRAFSRFAEYLSNA

SEQ ID NO: 122144 - protein, 28 aa, Mycobacterium avium
RKFRNHMRDMLFLFKGAPSTSPFCAWVN

SEQ ID NO: 122145 - protein, 17 aa, Mycobacterium avium
RKGYLRRDPNRPRAVDV

SEQ ID NO: 122146 - protein, 24 aa, Mycobacterium avium
RKLDPIGAIGNYWAEPHQPSEHEV

SEQ ID NO: 122147 - protein, 33 aa, Mycobacterium avium
RKLIEVPVGFKWFVDGLIGGTLGFGGEESAGAS

SEQ ID NO: 122148 - protein, 20 aa, Mycobacterium avium
RKNVREHMAFARGVHSCPGG

SEQ ID NO: 122149 - protein, 26 aa, Mycobacterium avium
RKPHRVPVWFMRQAGRSLPEYRALRA

SEQ ID NO: 122150 - protein, 24 aa, Mycobacterium avium
RKRFAALFRCEVGLSPKAYLRVRR

SEQ ID NO: 122151 - protein, 30 aa, Mycobacterium avium
RKTVPATLGALLKSVSLLPDTPRFAVAHAV

SEQ ID NO: 122152 - protein, 36 aa, Mycobacterium avium; identical to SEQ ID NO: 17410

SEQ ID NO: 122153 - protein, 29 aa, Mycobacterium avium
RLAADELGLPTAPFWFAGSLGELEAVGAH

SEQ ID NO: 122154 - protein, 18 aa, Mycobacterium avium
RLAELLTGFLARLKTDLQ

SEQ ID NO: 122155 - protein, 17 aa, Mycobacterium avium
RLAPIKFLSALVSDGDL

SEQ ID NO: 122156 - protein, 17 aa, Mycobacterium avium
RLARLRDLGCDYVICYF

SEQ ID NO: 122157 - protein, 18 aa, Mycobacterium avium
RLATQLGYSETVFVDLPA

SEQ ID NO: 122158 - protein, 18 aa, Mycobacterium avium
RLDDDLAHLFIELAEKVW

SEQ ID NO: 122159 - protein, 28 aa, Mycobacterium avium
RLDGRHLLESWIPLLALAAHDRGRDWSA

SEQ ID NO: 122160 - protein, 22 aa, Mycobacterium avium
RLDLPAGWSYQPRVLTSELRVD

SEQ ID NO: 122161 - protein, 23 aa, Mycobacterium avium
RLDRLIGQLKLELQYVLQRRHDD

SEQ ID NO: 122162 - protein, 17 aa, Mycobacterium avium
RLDRRVHELIATDPQFA

SEQ ID NO: 122163 - protein, 23 aa, Mycobacterium avium
RLELRVLFEELLSRFGAVRVVRP

SEQ ID NO: 122164 - protein, 19 aa, Mycobacterium avium
RLENLAMLRTLVGAIGTFE

SEQ ID NO: 122165 - protein, 29 aa, Mycobacterium avium
RLESRGMRFGLFIPQGWRMDLVGIEPDEH

SEQ ID NO: 122166 - protein, 27 aa, Mycobacterium avium
RLGRNIVSPFWAVLGFGRASAGPGQHT

SEQ ID NO: 122167 - protein, 24 aa, Mycobacterium avium
RLGVQPPRGVLLYGPPGCGKTFVV

SEQ ID NO: 122168 - protein, 18 aa, Mycobacterium avium
RLHRVRSWSQLIPDLNVA

SEQ ID NO: 122169 - protein, 27 aa, Mycobacterium avium
RLIAEHVIDTVWFGAAAPLALLAQRAR

SEQ ID NO: 122170 - protein, 24 aa, Mycobacterium avium
RLKPRVFYDLVVEVALIRPGPIQG

SEQ ID NO: 122171 - protein, 18 aa, Mycobacterium avium
RLLAALPPRRQPPKTVPP

SEQ ID NO: 122172 - protein, 26 aa, Mycobacterium avium
RLLADLSFDAVVLLINGVPKLLGLEE

SEQ ID NO: 122173 - protein, 20 aa, Mycobacterium avium
RLLDTYVDVLRLPVDIVAAD

SEQ ID NO: 122174 - protein, 22 aa, Mycobacterium avium
RLLEHAGFFLEGRLARHAVYPT

SEQ ID NO: 122175 - protein, 18 aa, Mycobacterium avium
RLLEQTLLGYDQLGLVPE

SEQ ID NO: 122176 - protein, 28 aa, Mycobacterium avium
RLLHRRYGWQWNIVPLLKIPGVTNVHRD

SEQ ID NO: 122177 - protein, 23 aa, Mycobacterium avium
RLLLKGIELRYVLAMQLAVHGPA

SEQ ID NO: 122178 - protein, 19 aa, Mycobacterium avium
RLLRHRKLAQRYLTVEGHR

SEQ ID NO: 122179 - protein, 20 aa, Mycobacterium avium
RLQAELGLAYLFISHDLAVI

SEQ ID NO: 122180 - protein, 30 aa, Mycobacterium avium
RLRDRVLLRFGLHRALRLGKPLQLHVGFGD

SEQ ID NO: 122181 - protein, 17 aa, Mycobacterium avium
RLRRLPLVMRPLGWLPQ

SEQ ID NO: 122182 - protein, 19 aa, Mycobacterium avium
RLSVPPTWASATPAIRLAS

SEQ ID NO: 122183 - protein, 19 aa, Mycobacterium avium
RLTGRSPILLAGMTPTTVD

SEQ ID NO: 122184 - protein, 18 aa, Mycobacterium avium
RLTIPVAEKAKPRRIEIN

SEQ ID NO: 122185 - protein, 34 aa, Mycobacterium avium
RLTMHDYFWRWDTDWFWCSRAFGVQNPRVRRWWP

SEQ ID NO: 122186 - protein, 30 aa, Mycobacterium avium
RLTNFEGPFDLLLQLIFAHRLDVTEVALHQ

SEQ ID NO: 122187 - protein, 20 aa, Mycobacterium avium
RLTVPGGATLKAAWLAMIAV

SEQ ID NO: 122188 - protein, 29 aa, Mycobacterium avium
RLVGPRTLPLMRVALAWRGRLGKPVRDVE

SEQ ID NO: 122189 - protein, 18 aa, Mycobacterium avium
RLVVELTPDEAAALRDEL

SEQ ID NO: 122190 - protein, 17 aa, Mycobacterium avium
RMDVSPAAITYLVDRMI

SEQ ID NO: 122191 - protein, 17 aa, Mycobacterium avium
RMLLREVFTAAGGSHDD

SEQ ID NO: 122192 - protein, 20 aa, Mycobacterium avium
RMLMHSIFTYPQSQWKERGI

SEQ ID NO: 122193 - protein, 20 aa, Mycobacterium avium
RMNELMPLGLRLIEEGFALY

SEQ ID NO: 122194 - protein, 19 aa, Mycobacterium avium
RMRSNNVWTPVLMLTAKDG

SEQ ID NO: 122195 - protein, 21 aa, Mycobacterium avium
RMSARRFWVRYAAEAAGALTL

SEQ ID NO: 122196 - protein, 19 aa, Mycobacterium avium
RMYRTGDLVRWRADGQLDY

SEQ ID NO: 122197 - protein, 18 aa, Mycobacterium avium
RNAELAHIFTKEAKTFGI

SEQ ID NO: 122198 - protein, 26 aa, Mycobacterium avium
RNALSPAMYFGIRYAVGRLNEDPDLA

SEQ ID NO: 122199 - protein, 25 aa, Mycobacterium avium
RNDIGAMNECWVRHLSAHADADVLE

SEQ ID NO: 122200 - protein, 22 aa, Mycobacterium avium
RNFLDDIRRYGATYMNYVGKPL

SEQ ID NO: 122201 - protein, 40 aa, Mycobacterium avium
RNFVKALLDRAYAKKFRFPTFLGAFKYYTSYTLKTFDGKR

SEQ ID NO: 122202 - protein, 33 aa, Mycobacterium avium
RNHSPGAVALVRRARRLLPGDPDFGDPLSTAGD

SEQ ID NO: 122203 - protein, 22 aa, Mycobacterium avium
RNRALLLDAARRLVAERGADAV

SEQ ID NO: 122204 - protein, 18 aa, Mycobacterium avium
RNRYWVIPGADHYLQCDA

SEQ ID NO: 122205 - protein, 24 aa, Mycobacterium avium
RNTFYGMARWQAKLEQRQGFLGRV

SEQ ID NO: 122206 - protein, 18 aa, Mycobacterium avium
RNVIHWTVTRYDQPKSIE

SEQ ID NO: 122207 - protein, 22 aa, Mycobacterium avium
RNVRQLCLPTLRALADELGTTV

SEQ ID NO: 122208 - protein, 34 aa, Mycobacterium avium
RPAPRPENVTSRLIELFLAHFAIRDWDAMAELLA

SEQ ID NO: 122209 - protein, 24 aa, Mycobacterium avium
RPDPEVLAPLQDLASRYALAAVSS

SEQ ID NO: 122210 - protein, 24 aa, Mycobacterium avium
RPDQALLITIPVTDAPYLGFQLGS

SEQ ID NO: 122211 - protein, 29 aa, Mycobacterium avium
RPDRTFSLGSWWSGVAWSTIKVPLAIAAL

SEQ ID NO: 122212 - protein, 17 aa, Mycobacterium avium
RPDYSSSWPVHCLAGSA

SEQ ID NO: 122213 - protein, 23 aa, Mycobacterium avium
RPEFLNRIDDIIVFHQLTRDEII

SEQ ID NO: 122214 - protein, 23 aa, Mycobacterium avium
RPGGLAVLSYTVWLGPFGGHEMG

SEQ ID NO: 122215 - protein, 23 aa, Mycobacterium avium
RPITTPFGLYDCDVPCDGAIAVI

SEQ ID NO: 122216 - protein, 24 aa, Mycobacterium avium
RPLRGSYRVAFLSLKGGVGKTTIA

SEQ ID NO: 122217 - protein, 24 aa, Mycobacterium avium
RPLTDACEIMLLLKDNLAAHHREL

SEQ ID NO: 122218 - protein, 19 aa, Mycobacterium avium
RPLTVAVLLRITEVFGVDA

SEQ ID NO: 122219 - protein, 18 aa, Mycobacterium avium
RPMTRYFPELVAAVRAEL

SEQ ID NO: 122220 - protein, 22 aa, Mycobacterium avium
RPNGQLLPRVPGPLVRTGMAVY

SEQ ID NO: 122221 - protein, 21 aa, Mycobacterium avium
RPPAPPTFRPHPPAAAPAPAA

SEQ ID NO: 122222 - protein, 24 aa, Mycobacterium avium
RPPDWDQWWEWGPVFLCSNNNKRG

SEQ ID NO: 122223 - protein, 23 aa, Mycobacterium avium
RPPRASITPPAWPTLLQGEASWG

SEQ ID NO: 122224 - protein, 28 aa, Mycobacterium avium
RPQYRELLQDFLFGLDLDEETRRRARLN

SEQ ID NO: 122225 - protein, 17 aa, Mycobacterium avium
RPRAYHEFGALARHLRF

SEQ ID NO: 122226 - protein, 22 aa, Mycobacterium avium
RPRDLKLRVISWGAAPAPDALL

SEQ ID NO: 122227 - protein, 21 aa, Mycobacterium avium
RPSAVPGVRLPALADQVGAVM

SEQ ID NO: 122228 - protein, 32 aa, Mycobacterium avium
RPTGPRPFLRLEGSAVFRWAAFEMGKVGQQAM

SEQ ID NO: 122229 - protein, 17 aa, Mycobacterium avium
RPVLGICGGFQMLCRRI

SEQ ID NO: 122230 - protein, 17 aa, Mycobacterium avium
RPYKVVFKDATDGGYLV

SEQ ID NO: 122231 - protein, 26 aa, Mycobacterium avium
RQAVWPERMFSLLAGFVEAGESFEVC

SEQ ID NO: 122232 - protein, 22 aa, Mycobacterium avium
RQFQVFLDDVRLPSDALVGAED

SEQ ID NO: 122233 - protein, 17 aa, Mycobacterium avium
RQIDFLTRATAQRPDAV

SEQ ID NO: 122234 - protein, 19 aa, Mycobacterium avium
RQKFNPLVRLDSVNGGSVE

SEQ ID NO: 122235 - protein, 17 aa, Mycobacterium avium
RQPWDFVIVTDRTQLQE

SEQ ID NO: 122236 - protein, 18 aa, Mycobacterium avium
RQRRHAARYLVVTEGALA

SEQ ID NO: 122237 - protein, 25 aa, Mycobacterium avium
RQRYGRFFRMAYDVLPPGGIMLLHT

SEQ ID NO: 122238 - protein, 19 aa, Mycobacterium avium
RQVARAVEPPLLDAGGHIV

SEQ ID NO: 122239 - protein, 21 aa, Mycobacterium avium
RQVNVIFTRALRPAPATLVRH

SEQ ID NO: 122240 - protein, 23 aa, Mycobacterium avium
RRAADMLKPCTLELGGKSAAIVL

SEQ ID NO: 122241 - protein, 23 aa, Mycobacterium avium
RRADLLRLLSNLRAFPLLTHAEV

SEQ ID NO: 122242 - protein, 25 aa, Mycobacterium avium
RRAGRPAEALPWYRIALQSNGSEPG

SEQ ID NO: 122243 - protein, 20 aa, Mycobacterium avium
RRATYMYGTLLPRGPRDHVG

SEQ ID NO: 122244 - protein, 22 aa, Mycobacterium avium
RRDCWVFAFAFAGRPGVRLGWA

SEQ ID NO: 122245 - protein, 18 aa, Mycobacterium avium
RRFRDGEQPLALMIAYLP

SEQ ID NO: 122246 - protein, 20 aa, Mycobacterium avium
RRFVSPRGALALFGGWTGVD

SEQ ID NO: 122247 - protein, 21 aa, Mycobacterium avium
RRGGRYGLITLCVAGGMGVAT

SEQ ID NO: 122248 - protein, 17 aa, Mycobacterium avium
RRGLRVVAEAFADRAYR

SEQ ID NO: 122249 - protein, 20 aa, Mycobacterium avium
RRHFDIAVFAAYELMQRVCP

SEQ ID NO: 122250 - protein, 32 aa, Mycobacterium avium
RRIEMARTVLIELLAWQFASPVRWIETQDLLF

SEQ ID NO: 122251 - protein, 25 aa, Mycobacterium avium
RRIVTALRHTLGRPLSGCRITALGL

SEQ ID NO: 122252 - protein, 26 aa, Mycobacterium avium
RRLPLVMRPLGWLPQPDPRRPGRRAW

SEQ ID NO: 122253 - protein, 22 aa, Mycobacterium avium
RRLQRAFPRYDAMRVELAVGQF

SEQ ID NO: 122254 - protein, 22 aa, Mycobacterium avium
RRLVRTLQFDPVVVRLLAEHEP

SEQ ID NO: 122255 - protein, 18 aa, Mycobacterium avium
RRMPYTVGLLGSVPRLDA

SEQ ID NO: 122256 - protein, 40 aa, Mycobacterium avium
RRQLAATGRARLWVPARAPLAAVWLPDADLRDARALPVLV

SEQ ID NO: 122257 - protein, 24 aa, Mycobacterium avium
RRRDVTLLWPPTEPGGYSLIVDGT

SEQ ID NO: 122258 - protein, 20 aa, Mycobacterium avium
RRRREELAALGDKVARRVLE

SEQ ID NO: 122259 - protein, 25 aa, Mycobacterium avium
RRSLRDYLNGLQLYRQNMPAPMLAP

SEQ ID NO: 122260 - protein, 27 aa, Mycobacterium avium
RRVGLLLQDALLFPHMSVAANVAFGPH

SEQ ID NO: 122261 - protein, 25 aa, Mycobacterium avium
RRVRRGRIQFVRQEPLFAPSVKYSA

SEQ ID NO: 122262 - protein, 19 aa, Mycobacterium avium
RRWHWLDPQTRDALFARAQ

SEQ ID NO: 122263 - protein, 20 aa, Mycobacterium avium
RRYLRRWHRRRPLWIGVAIG

SEQ ID NO: 122264 - protein, 17 aa, Mycobacterium avium
RSAAIRIAGARALQLAG

SEQ ID NO: 122265 - protein, 23 aa, Mycobacterium avium
RSACRALLLENPSPAAALAGLDR

SEQ ID NO: 122266 - protein, 20 aa, Mycobacterium avium
RSALYLPGNKPRALEKGKSL

SEQ ID NO: 122267 - protein, 17 aa, Mycobacterium avium
RSAPGLRHRIYRPAVVV

SEQ ID NO: 122268 - protein, 26 aa, Mycobacterium avium
RSDSDMFTLGFRFKPWRSAKSIADGA

SEQ ID NO: 122269 - protein, 27 aa, Mycobacterium avium
RSEMEMKVLLWAVQRLIGGLSKIGAER

SEQ ID NO: 122270 - protein, 23 aa, Mycobacterium avium
RSFARTWLNELKDRRIRVNVLSP

SEQ ID NO: 122271 - protein, 24 aa, Mycobacterium avium
RSGAAHLVVWPVEPTLGGAEDRRH

SEQ ID NO: 122272 - protein, 17 aa, Mycobacterium avium
RSHLHIEIVPGLAPTNA

SEQ ID NO: 122273 - protein, 19 aa, Mycobacterium avium
RSIVPIETELQFDAGVDRV

SEQ ID NO: 122274 - protein, 17 aa, Mycobacterium avium
RSLAISQRLLGTREIIL

SEQ ID NO: 122275 - protein, 22 aa, Mycobacterium avium
RSLLELANVDAELSRLAHRAEH

SEQ ID NO: 122276 - protein, 24 aa, Mycobacterium avium
RSLRYREIPAAAVRRRFVGLGLGA

SEQ ID NO: 122277 - protein, 25 aa, Mycobacterium avium
RSPEQLAQTWLGLGPAVVAVTMADR

SEQ ID NO: 122278 - protein, 22 aa, Mycobacterium avium
RSPRLPGVDASLLLPPVRGAVP

SEQ ID NO: 122279 - protein, 18 aa, Mycobacterium avium
RSPWAPIVFGTQAPDTGN

SEQ ID NO: 122280 - protein, 27 aa, Mycobacterium avium
RSRAQSRFAWQRIALDALNIYQSLGVH

SEQ ID NO: 122281 - protein, 23 aa, Mycobacterium avium
RSRGVPPTRLRLIYLADGQVLDY

SEQ ID NO: 122282 - protein, 21 aa, Mycobacterium avium
RSRLGLAQFAAPRPGRRIGLV

SEQ ID NO: 122283 - protein, 21 aa, Mycobacterium avium
RSSLPTAQRARKLVYAPKLDG

SEQ ID NO: 122284 - protein, 25 aa, Mycobacterium avium
RSVRLLGIQNALMQVLLTGNRFKPA

SEQ ID NO: 122285 - protein, 24 aa, Mycobacterium avium
RSVSWLARDVPSLGWRAYRLVAGE

SEQ ID NO: 122286 - protein, 23 aa, Mycobacterium avium
RTAGYLAIGLAIAAGAPVCVAMT

SEQ ID NO: 122287 - protein, 19 aa, Mycobacterium avium
RTALLTAGWPETVPGVTVD

SEQ ID NO: 122288 - protein, 22 aa, Mycobacterium avium
RTALRNWLRRVRLDPEQTLNVL

SEQ ID NO: 122289 - protein, 17 aa, Mycobacterium avium
RTAVFDPVLHVADLSFA

SEQ ID NO: 122290 - protein, 19 aa, Mycobacterium avium
RTDTWLPMPKEWAALTVQK

SEQ ID NO: 122291 - protein, 18 aa, Mycobacterium avium
RTELRDWLSDNLTDELVK

SEQ ID NO: 122292 - protein, 25 aa, Mycobacterium avium
RTGLPALEQYLAKNRKIIAFVNSSV

SEQ ID NO: 122293 - protein, 25 aa, Mycobacterium avium
RTHGRTWDLLRLTRMPTVQVDVGYV

SEQ ID NO: 122294 - protein, 18 aa, Mycobacterium avium
RTLGQLQDWLSGTGALDG

SEQ ID NO: 122295 - protein, 25 aa, Mycobacterium avium
RTLTPAIVDAMWASGLMSAFNTIEA

SEQ ID NO: 122296 - protein, 23 aa, Mycobacterium avium
RTPDQGMPLLRRAIRDGTGQDPD

SEQ ID NO: 122297 - protein, 24 aa, Mycobacterium avium
RTPGRGWQHRWALSVLHTALGGGL

SEQ ID NO: 122298 - protein, 26 aa, Mycobacterium avium
RTQRSVRALLTGYLLYTLGGDKRYRD

SEQ ID NO: 122299 - protein, 25 aa, Mycobacterium avium
RTREFIRLLRRLWTQDDVTFHGEFF

SEQ ID NO: 122300 - protein, 19 aa, Mycobacterium avium
RTRELLRRPGVAAVSPMAP

SEQ ID NO: 122301 - protein, 18 aa, Mycobacterium avium
RTREPLMVTDAWLPPELA

SEQ ID NO: 122302 - protein, 28 aa, Mycobacterium avium
RTRIYCPRWVALFRWAKPVLSSRLGEMP

SEQ ID NO: 122303 - protein, 26 aa, Mycobacterium avium
RTTIPAGRRVLLLYGSANRDERQYGP

SEQ ID NO: 122304 - protein, 37 aa, Mycobacterium avium
RTVAGWRVVALQPYGGAWLNSWLDRDLGISGRLSVRD

SEQ ID NO: 122305 - protein, 26 aa, Mycobacterium avium
RTVARGLIFLIQLYRHMVSPLRPATC

SEQ ID NO: 122306 - protein, 26 aa, Mycobacterium avium
RTVEGHLYRLFTKLGINNRDQLIQLI

SEQ ID NO: 122307 - protein, 19 aa, Mycobacterium avium
RTVHGYAYAVLRRAAERAG

SEQ ID NO: 122308 - protein, 22 aa, Mycobacterium avium
RTVHLAAPNVAGLLSAAGAPLA

SEQ ID NO: 122309 - protein, 17 aa, Mycobacterium avium
RTVIWLDSPADAGAAKA

SEQ ID NO: 122310 - protein, 20 aa, Mycobacterium avium
RVAFLGWSMGGYGALLLGGR

SEQ ID NO: 122311 - protein, 17 aa, Mycobacterium avium
RVAGHDRFRFYLNVEVG

SEQ ID NO: 122312 - protein, 19 aa, Mycobacterium avium
RVAPIWWNEQPIGAGGFDD

SEQ ID NO: 122313 - protein, 18 aa, Mycobacterium avium
RVCLPAMMSYWSELARDP

SEQ ID NO: 122314 - protein, 23 aa, Mycobacterium avium
RVDGIEATRRLGGRPPVLALTTF

SEQ ID NO: 122315 - protein, 30 aa, Mycobacterium avium
RVDGWPGQQFALLFVDWLTADPDARADYLA

SEQ ID NO: 122316 - protein, 20 aa, Mycobacterium avium
RVDMLPAVGAIPWNDGSEAG

SEQ ID NO: 122317 - protein, 21 aa, Mycobacterium avium
RVDQLPAIWKRLVDGGMESGH

SEQ ID NO: 122318 - protein, 17 aa, Mycobacterium avium
RVDSWSALPHLRTSGHE

SEQ ID NO: 122319 - protein, 24 aa, Mycobacterium avium
RVEIRMPVVVDPEWERPARSVTNE

SEQ ID NO: 122320 - protein, 20 aa, Mycobacterium avium
RVEVAGWPAPAYLRAGRAVP

SEQ ID NO: 122321 - protein, 20 aa, Mycobacterium avium
RVFKLPDNVSFEAGAGLLFN

SEQ ID NO: 122322 - protein, 26 aa, Mycobacterium avium
RVGAIILHPYIELHLGKPFFTEQQLR

SEQ ID NO: 122323 - protein, 18 aa, Mycobacterium avium
RVGLTGEPLPPLLAATAA

SEQ ID NO: 122324 - protein, 17 aa, Mycobacterium avium
RVGSANTLVRTATGWRA

SEQ ID NO: 122325 - protein, 17 aa, Mycobacterium avium
RVHAVSTGGFRAERVDD

SEQ ID NO: 122326 - protein, 20 aa, Mycobacterium avium
RVHLLAHDWGSIQAWAAVTD

SEQ ID NO: 122327 - protein, 26 aa, Mycobacterium avium
RVHNLGRPPRMLVLLHLDGSVDRPAT

SEQ ID NO: 122328 - protein, 19 aa, Mycobacterium avium
RVHTPLGTLSLPRVEIRMP

SEQ ID NO: 122329 - protein, 18 aa, Mycobacterium avium
RVIAQKTVVIPSQGAVYV

SEQ ID NO: 122330 - protein, 28 aa, Mycobacterium avium
RVIGQALRRPLDPGRPPWECWVIEGLRG

SEQ ID NO: 122331 - protein, 20 aa, Mycobacterium avium
RVLDAIGRPVTIIGASMGGL

SEQ ID NO: 122332 - protein, 20 aa, Mycobacterium avium
RVLDPAIYREATRRLDRHFT

SEQ ID NO: 122333 - protein, 24 aa, Mycobacterium avium
RVLRGWSSLPVRLGPARSLAAAEA

SEQ ID NO: 122334 - protein, 24 aa, Mycobacterium avium
RVLRPSGLLLMSTPNRITFSPGRD

SEQ ID NO: 122335 - protein, 18 aa, Mycobacterium avium
RVLRVGVAEFRRSLDRVM

SEQ ID NO: 122336 - protein, 17 aa, Mycobacterium avium
RVNPPLREAADAAALRR

SEQ ID NO: 122337 - protein, 17 aa, Mycobacterium avium
RVPATVFDLGLNKARVA

SEQ ID NO: 122338 - protein, 20 aa, Mycobacterium avium
RVPDPTRVWPLLERNKAALA

SEQ ID NO: 122339 - protein, 17 aa, Mycobacterium avium
RVPTLIACGDHDLLTPD

SEQ ID NO: 122340 - protein, 21 aa, Mycobacterium avium
RVPVVWDPHPRGAPPVPGCAL

SEQ ID NO: 122341 - protein, 21 aa, Mycobacterium avium
RVQSLQLHYARTLDLWAQALE

SEQ ID NO: 122342 - protein, 25 aa, Mycobacterium avium
RVRAHVLFPGGFLNTGIWESWRHRP

SEQ ID NO: 122343 - protein, 18 aa, Mycobacterium avium
RVRALLRSVRVVALPSFA

SEQ ID NO: 122344 - protein, 18 aa, Mycobacterium avium
RVRLIAGNGLRPEIWDEF

SEQ ID NO: 122345 - protein, 17 aa, Mycobacterium avium
RVRLLERLGQVGGAAVS

SEQ ID NO: 122346 - protein, 18 aa, Mycobacterium avium
RVRLYTDGSRRVLLRRKK

SEQ ID NO: 122347 - protein, 31 aa, Mycobacterium avium
RVRRCGMVSPTVFWPIPRVYSGLVRIDRYPT

SEQ ID NO: 122348 - protein, 20 aa, Mycobacterium avium
RVRRVPPGQPGLLLSPVNRL

SEQ ID NO: 122349 - protein, 17 aa, Mycobacterium avium
RVRTGQLVLLHVLNASA

SEQ ID NO: 122350 - protein, 17 aa, Mycobacterium avium
RVSTVIKADWRAGVSDA

SEQ ID NO: 122351 - protein, 17 aa, Mycobacterium avium
RVWLLVVTGTGRAFCSG

SEQ ID NO: 122352 - protein, 32 aa, Mycobacterium avium
RWHAESSWAARVSLAHALIGWTRGTGLMGHND

SEQ ID NO: 122353 - protein, 17 aa, Mycobacterium avium
RWIAVVAEGGLIGGANA

SEQ ID NO: 122354 - protein, 20 aa, Mycobacterium avium
RWKAIAFSTFQYQLSRKAPA

SEQ ID NO: 122355 - protein, 22 aa, Mycobacterium avium
RWLAPAAKRLAPRRFWRRKFRI

SEQ ID NO: 122356 - protein, 26 aa, Mycobacterium avium
RWPESMRPLVRPLAPARYLPDRHRIT

SEQ ID NO: 122357 - protein, 19 aa, Mycobacterium avium
RWPGFGEVSARELVLDTLL

SEQ ID NO: 122358 - protein, 18 aa, Mycobacterium avium
RWVPDFLSLPIAVENSLK

SEQ ID NO: 122359 - protein, 22 aa, Mycobacterium avium
RYEAWSFPDFETGAAALRAVTQ

SEQ ID NO: 122360 - protein, 22 aa, Mycobacterium avium
RYEGCSFINVLLELGPEHPAGK

SEQ ID NO: 122361 - protein, 21 aa, Mycobacterium avium
RYGYYLHNIHFVIAAAALSGD

SEQ ID NO: 122362 - protein, 25 aa, Mycobacterium avium
RYPDYVFYPCMPYAHKYANAVTEFG

SEQ ID NO: 122363 - protein, 36 aa, Mycobacterium avium
RYPVASWQVLRLPRIPMRFPMYLPGPNRVMIVDEEP

SEQ ID NO: 122364 - protein, 22 aa, Mycobacterium avium
RYRSASDVVRSALRLLEDRETQ

SEQ ID NO: 122365 - protein, 20 aa, Mycobacterium avium
RYTDIDPARPTILAIHGFPD

SEQ ID NO: 122366 - protein, 21 aa, Mycobacterium avium
RYTQTLTLWRGVARVDCRTTI

SEQ ID NO: 122367 - protein, 20 aa, Mycobacterium avium
RYYSVIYQAIDEIEKALRGM

SEQ ID NO: 122368 - protein, 21 aa, Mycobacterium avium
SAAFFDRFIERVGPFARRVGG

SEQ ID NO: 122369 - protein, 24 aa, Mycobacterium avium
SAALCDYFAPILAARRAEPKDDLI

SEQ ID NO: 122370 - protein, 48 aa, Mycobacterium avium
SAANYFSWIPGCKPTYDRWAEYGGPEWTWQPLLPYLRKSATYHDDHGT

SEQ ID NO: 122371 - protein, 26 aa, Mycobacterium avium
SAAVEGLILGSYRFTEFRSAKTAPKD

SEQ ID NO: 122372 - protein, 31 aa, Mycobacterium avium
SADYEFDLDWRLSGIPPVAPPLFVHTGSIAA

SEQ ID NO: 122373 - protein, 19 aa, Mycobacterium avium
SAEHRVFLNLLRERFETDK

SEQ ID NO: 122374 - protein, 30 aa, Mycobacterium avium
SAERYVAAHAPYLAWLERASANSAAVAAQQ

SEQ ID NO: 122375 - protein, 22 aa, Mycobacterium avium
SAESPLLFPLSSTSADELRRTA

SEQ ID NO: 122376 - protein, 27 aa, Mycobacterium avium
SAFDFSVWEIFGALLRGRRLLVVPESV

SEQ ID NO: 122377 - protein, 19 aa, Mycobacterium avium
SAFFDRAYDILPDDGRMLL

SEQ ID NO: 122378 - protein, 17 aa, Mycobacterium avium
SAFGLAGVKPVYLGASW

SEQ ID NO: 122379 - protein, 23 aa, Mycobacterium avium
SAGGIFNPLPKLDADTAAKMAQR

SEQ ID NO: 122380 - protein, 23 aa, Mycobacterium avium
SAGHNFPLACPGLLGAMTVGATT

SEQ ID NO: 122381 - protein, 17 aa, Mycobacterium avium
SAGWWMDSAASLAEAQD

SEQ ID NO: 122382 - protein, 21 aa, Mycobacterium avium
SAGYLRDILGKYTGLDCYDDL

SEQ ID NO: 122383 - protein, 20 aa, Mycobacterium avium
SAHVDLYFEAAVAGAIPVIR

SEQ ID NO: 122384 - protein, 23 aa, Mycobacterium avium
SAIATYLVTLYTSLAVLTDDALA

SEQ ID NO: 122385 - protein, 17 aa, Mycobacterium avium
SAKPVEYPTFSDRPDAG

SEQ ID NO: 122386 - protein, 21 aa, Mycobacterium avium
SAKWNLLAPYAVKSEGGAHGD

SEQ ID NO: 122387 - protein, 21 aa, Mycobacterium avium
SALALPVPSLVISQLLGVPYE

SEQ ID NO: 122388 - protein, 25 aa, Mycobacterium avium
SALARLGPLLVVTATGREADDLTAE

SEQ ID NO: 122389 - protein, 18 aa, Mycobacterium avium
SALFLRRGPQPDGRVWSP

SEQ ID NO: 122390 - protein, 25 aa, Mycobacterium avium
SAPMCDIFLVLAQAPGGLSCFLLPR

SEQ ID NO: 122391 - protein, 20 aa, Mycobacterium avium
SARDAALVSPVLRADRAGAP

SEQ ID NO: 122392 - protein, 18 aa, Mycobacterium avium
SARFGIRALTAYCVAKGG

SEQ ID NO: 122393 - protein, 24 aa, Mycobacterium avium
SARGPVHLTVLPRFPEPGSTVEKG

SEQ ID NO: 122394 - protein, 29 aa, Mycobacterium avium
SASAALIWRRPRWAKRLQPEPVADLLREA

SEQ ID NO: 122395 - protein, 25 aa, Mycobacterium avium
SASGRTITFPGFLKAYVETVDELAG

SEQ ID NO: 122396 - protein, 27 aa, Mycobacterium avium
SATMAALANFFRIKPAYFTDDEYYEKL

SEQ ID NO: 122397 - protein, 23 aa, Mycobacterium avium
SAVKAFTAWAVRRGLLTADPAAR

SEQ ID NO: 122398 - protein, 17 aa, Mycobacterium avium
SAVLNYPLTQYMFCAPD

SEQ ID NO: 122399 - protein, 21 aa, Mycobacterium avium
SCATCDGFFFKDQDIAVIGGG

SEQ ID NO: 122400 - protein, 19 aa, Mycobacterium avium
SCELSFDNFRAPATAVLGG

SEQ ID NO: 122401 - protein, 19 aa, Mycobacterium avium
SCVPLLKQLLEAEGVEQSK

SEQ ID NO: 122402 - protein, 25 aa, Mycobacterium avium
SDDERIWSALRRIPLRELRRTGLLD

SEQ ID NO: 122403 - protein, 26 aa, Mycobacterium avium
SDEALARVFDYTLAIGKTPIVVNDSR

SEQ ID NO: 122404 - protein, 33 aa, Mycobacterium avium
SDEVRRYIIGCALRWMRDFHADGLRLDAVHALV

SEQ ID NO: 122405 - protein, 20 aa, Mycobacterium avium
SDFPILKETVNGKPLIWFDN

SEQ ID NO: 122406 - protein, 24 aa, Mycobacterium avium
SDGVPSWVFRLLHVADTYNPIAPK

SEQ ID NO: 122407 - protein, 25 aa, Mycobacterium avium
SDHAEWVLPTDWPVAPGRPVLEVVL

SEQ ID NO: 122408 - protein, 19 aa, Mycobacterium avium
SDLSELGDWLVLHEAWRGE

SEQ ID NO: 122409 - protein, 22 aa, Mycobacterium avium
SDNLVSSKPFWEKPLDLADVLD

SEQ ID NO: 122410 - protein, 23 aa, Mycobacterium avium
SDRLKPWEVIAARLEAAAAADLV

SEQ ID NO: 122411 - protein, 25 aa, Mycobacterium avium
SDRLRRTSIDPQWLLDYWSDRVHRL

SEQ ID NO: 122412 - protein, 19 aa, Mycobacterium avium
SEDRWWEKSPIFEALNTNK

SEQ ID NO: 122413 - protein, 28 aa, Mycobacterium avium
SEDSTFYGDLFPHAVRWKGITYLEDGLH

SEQ ID NO: 122414 - protein, 18 aa, Mycobacterium avium
SEEQWLTMLDVNLSGVWR

SEQ ID NO: 122415 - protein, 25 aa, Mycobacterium avium
SEGGIGWIPFYLDRSDRHYSNQKWL

SEQ ID NO: 122416 - protein, 29 aa, Mycobacterium avium
SEHADRFTLLRPLLFTIAYEMLGSATEAD

SEQ ID NO: 122417 - protein, 19 aa, Mycobacterium avium
SELIENPYPYYEALRQRCP

SEQ ID NO: 122418 - protein, 26 aa, Mycobacterium avium
SELPGESPRLFVLTRNAAVVVAGDAP

SEQ ID NO: 122419 - protein, 24 aa, Mycobacterium avium
SEPLTEAIPLWKRPQDGAIITGWD

SEQ ID NO: 122420 - protein, 19 aa, Mycobacterium avium
SEQLVMWWNFVGRSHEDIV

SEQ ID NO: 122421 - protein, 22 aa, Mycobacterium avium
SERDFRIVLVTDAISGLYDRGA

SEQ ID NO: 122422 - protein, 17 aa, Mycobacterium avium
SERPAIHRFPGSMAKRI

SEQ ID NO: 122423 - protein, 24 aa, Mycobacterium avium
SESLHPHGYWQRSPRLPGVDASLL

SEQ ID NO: 122424 - protein, 24 aa, Mycobacterium avium
SETWRSVIPPLAKKFRVIAPDLLG

SEQ ID NO: 122425 - protein, 18 aa, Mycobacterium avium
SEVSFPKPVFHGDTLYAE

SEQ ID NO: 122426 - protein, 22 aa, Mycobacterium avium
SFENWDAVLKVHLYGGYNVIRA

SEQ ID NO: 122427 - protein, 18 aa, Mycobacterium avium
SFLDALAAHRRAHGLPAI

SEQ ID NO: 122428 - protein, 18 aa, Mycobacterium avium
SFLQSRGIHLPDGSPDDA

SEQ ID NO: 122429 - protein, 22 aa, Mycobacterium avium
SFMALNYLYHLMNMIAEGVFER

SEQ ID NO: 122430 - protein, 24 aa, Mycobacterium avium
SFNYKDRIFATPVITLPIVDRALE

SEQ ID NO: 122431 - protein, 28 aa, Mycobacterium avium
SFRGSKNVLLVFFPLAFTGICQGELDQL

SEQ ID NO: 122432 - protein, 26 aa, Mycobacterium avium
SFVDDFVLYWGFLALAQVRSGRHLFG

SEQ ID NO: 122433 - protein, 27 aa, Mycobacterium avium
SGAAGAPWFAVSPLMHAAGMWTAFAAI

SEQ ID NO: 122434 - protein, 29 aa, Mycobacterium avium
SGAGILNFVFGEMWLRPGLGMKERRLITV

SEQ ID NO: 122435 - protein, 28 aa, Mycobacterium avium
SGCQPWQLTPDAVPPPSAPPAGVQGTLG

SEQ ID NO: 122436 - protein, 28 aa, Mycobacterium avium
SGDWWDAAYLMMWGSNVPITRTPDAHWM

SEQ ID NO: 122437 - protein, 19 aa, Mycobacterium avium
SGEEMARLFAWCPEAVTAA

SEQ ID NO: 122438 - protein, 25 aa, Mycobacterium avium
SGFNLARVVAVELGFDFLPGTTVNR

SEQ ID NO: 122439 - protein, 29 aa, Mycobacterium avium
SGGAKPGWPGFVSTPLHAYRRHFDIAVFA

SEQ ID NO: 122440 - protein, 19 aa, Mycobacterium avium
SGGHLFSIYDGCRDEGIRL

SEQ ID NO: 122441 - protein, 31 aa, Mycobacterium avium
SGGSFIYVPPGVHVDIPLQAYFRINTENMGQ

SEQ ID NO: 122442 - protein, 31 aa, Mycobacterium avium; identical to SEQ ID NO: 25151

SEQ ID NO: 122443 - protein, 35 aa, Mycobacterium avium
SGIEWELYYEPTAPMWELLPMKVSGPDGRLLADMY

SEQ ID NO: 122444 - protein, 25 aa, Mycobacterium avium
SGKGSPEWWVVNVKPGRVLFELSYP

SEQ ID NO: 122445 - protein, 23 aa, Mycobacterium avium
SGLSHRLVRIDEPILRVPQLAIH

SEQ ID NO: 122446 - protein, 23 aa, Mycobacterium avium
SGNGCWGSFVLADARHAVTLPPE

SEQ ID NO: 122447 - protein, 23 aa, Mycobacterium avium
SGPDRLFELIWSAQPSTAVQPVS

SEQ ID NO: 122448 - protein, 24 aa, Mycobacterium avium
SGPHLNYAGAFLRSARTPRAVARV

SEQ ID NO: 122449 - protein, 19 aa, Mycobacterium avium
SGPTAALTDVWRALRASMR

SEQ ID NO: 122450 - protein, 19 aa, Mycobacterium avium
SGPTDVFKRHFYTCFISDK

SEQ ID NO: 122451 - protein, 29 aa, Mycobacterium avium
SGQTTKLLNNLLFTANLATAATALSLAEQ

SEQ ID NO: 122452 - protein, 27 aa, Mycobacterium avium
SGRLQRFPGAFSPLVAKLVAELGFDGV

SEQ ID NO: 122453 - protein, 17 aa, Mycobacterium avium
SGRVAFALGLEGPAVAV

SEQ ID NO: 122454 - protein, 28 aa, Mycobacterium avium
SGRWAEKYGFPLMPIDGILVGTAAMATL

SEQ ID NO: 122455 - protein, 24 aa, Mycobacterium avium
SGSEAAFLWHLTLDAGDTRTRISP

SEQ ID NO: 122456 - protein, 18 aa, Mycobacterium avium
SGYPHLEEAYWFGEGVLP

SEQ ID NO: 122457 - protein, 24 aa, Mycobacterium avium
SGYRGKLWTFRQYSGFGTAEESNR

SEQ ID NO: 122458 - protein, 24 aa, Mycobacterium avium
SHDENLHMIFYRDVSAAGLDIAPN

SEQ ID NO: 122459 - protein, 38 aa, Mycobacterium avium
SHEVGLAILGPLRDLDEVAYLRFASVYRSFESADDFER

SEQ ID NO: 122460 - protein, 18 aa, Mycobacterium avium
SHLPALIFGLQCAAFMET

SEQ ID NO: 122461 - protein, 24 aa, Mycobacterium avium
SHTLRALTVFPDEKSWLLEDFDHR

SEQ ID NO: 122462 - protein, 18 aa, Mycobacterium avium
SIAVFQPHLYSRTKAFAE

SEQ ID NO: 122463 - protein, 18 aa, Mycobacterium avium
SIDHLLAWEPRSVISHCH

SEQ ID NO: 122464 - protein, 22 aa, Mycobacterium avium
SIFGIGYPPWTGGVRQFATGYP

SEQ ID NO: 122465 - protein, 17 aa, Mycobacterium avium
SIISLLTTEQWTGGGSA

SEQ ID NO: 122466 - protein, 22 aa, Mycobacterium avium
SIPGLPAIPGLSAPAAPATPPA

SEQ ID NO: 122467 - protein, 26 aa, Mycobacterium avium
SIPVKRLRQAGVLELLLALANESTGT

SEQ ID NO: 122468 - protein, 18 aa, Mycobacterium avium
SISVIRYTELRPFVLHVN

SEQ ID NO: 122469 - protein, 26 aa, Mycobacterium avium
SIVLGALPFDVRRPAALLTPDTVSVS

SEQ ID NO: 122470 - protein, 18 aa, Mycobacterium avium
SKEELFNLRFQMATGQLT

SEQ ID NO: 122471 - protein, 27 aa, Mycobacterium avium
SKELIAWLPTLLGLGPADLIVVPELAY

SEQ ID NO: 122472 - protein, 30 aa, Mycobacterium avium
SKLDITKWTFLNTDLAVHVFRVPDGDWIGI

SEQ ID NO: 122473 - protein, 23 aa, Mycobacterium avium
SKPAIYRRWPSKAHLVHEAVFPV

SEQ ID NO: 122474 - protein, 18 aa, Mycobacterium avium
SKPFTFKRVEGLRPTIQQ

SEQ ID NO: 122475 - protein, 25 aa, Mycobacterium avium
SKPTAWIAEGLFGYLAPEAQDGLLD

SEQ ID NO: 122476 - protein, 22 aa, Mycobacterium avium
SKQAPFAPLPGDVTHVPYGDAE

SEQ ID NO: 122477 - protein, 32 aa, Mycobacterium avium
SKQHQIADILPLTPLQQGLLFHASFAQDPGDD

SEQ ID NO: 122478 - protein, 26 aa, Mycobacterium avium
SKSALVAAVYLRFLRDLPVHTDVNET

SEQ ID NO: 122479 - protein, 20 aa, Mycobacterium avium
SLDELARPGFTLYHRHAGGT

SEQ ID NO: 122480 - protein, 24 aa, Mycobacterium avium
SLGDELMRRFNGAALEAMLNRLNL

SEQ ID NO: 122481 - protein, 18 aa, Mycobacterium avium
SLGLSLIEAMLLGMPVVA

SEQ ID NO: 122482 - protein, 24 aa, Mycobacterium avium
SLGMLFDTVLGLTASVLTGSRRQR

SEQ ID NO: 122483 - protein, 22 aa, Mycobacterium avium
SLHNSQPWRWVAGSTGVDLFVD

SEQ ID NO: 122484 - protein, 18 aa, Mycobacterium avium
SLHSALLERFAGAIGGGL

SEQ ID NO: 122485 - protein, 17 aa, Mycobacterium avium
SLIGEFNGWTGTEAPMR

SEQ ID NO: 122486 - protein, 27 aa, Mycobacterium avium
SLLERQLLDELCLTIAPYLVGGHARRI

SEQ ID NO: 122487 - protein, 27 aa, Mycobacterium avium
SLLSRPSVNNVLRVAPRQFKMPRPSAG

SEQ ID NO: 122488 - protein, 35 aa, Mycobacterium avium
SLLVDTLFDLALTREMLTAMRPITASAPITDAVIT

SEQ ID NO: 122489 - protein, 17 aa, Mycobacterium avium
SLLVLPVAIDSGEAWVM

SEQ ID NO: 122490 - protein, 22 aa, Mycobacterium avium
SLNDIRWLYELMHRVGSLNHAR

SEQ ID NO: 122491 - protein, 33 aa, Mycobacterium avium
SLPTLLDQGQRLLIFLPLAHVLARSLTLSAFAN

SEQ ID NO: 122492 - protein, 19 aa, Mycobacterium avium
SLPTMPPWHHQENKWRAAR

SEQ ID NO: 122493 - protein, 22 aa, Mycobacterium avium
SLPYFEQFLRREGMRHATANPG

SEQ ID NO: 122494 - protein, 33 aa, Mycobacterium avium
SLRAFYQHFSSKDELLLALFDRTIAQSAQTWRA

SEQ ID NO: 122495 - protein, 17 aa, Mycobacterium avium
SLRYPDDTLPTKPYAVP

SEQ ID NO: 122496 - protein, 19 aa, Mycobacterium avium
SLSPFVTWGTNPGQGVPLA

SEQ ID NO: 122497 - protein, 20 aa, Mycobacterium avium
SLSYGFFTPLTGFMGRREVD

SEQ ID NO: 122498 - protein, 19 aa, Mycobacterium avium
SLTKTWALAGLRVGYALGA

SEQ ID NO: 122499 - protein, 18 aa, Mycobacterium avium
SLTVKYAAQSGDWGVALE

SEQ ID NO: 122500 - protein, 30 aa, Mycobacterium avium
SLVKIEQQLPLAPSALLSCAIPTGYGSAAN

SEQ ID NO: 122501 - protein, 19 aa, Mycobacterium avium
SLWANAWLAGKAAPDDVLD

SEQ ID NO: 122502 - protein, 20 aa, Mycobacterium avium
SMEPRWFAWVDDMHDWCISR

SEQ ID NO: 122503 - protein, 19 aa, Mycobacterium avium
SMEWYGFVLAWHERHGRAP

SEQ ID NO: 122504 - protein, 19 aa, Mycobacterium avium
SMLSELLRAGWLLRDPVRK

SEQ ID NO: 122505 - protein, 28 aa, Mycobacterium avium
SMQKKRFGRIIYIGSVSGMWGIGNQSNY

SEQ ID NO: 122506 - protein, 23 aa, Mycobacterium avium
SNAAIWLVNPPISDPSHGSGILS

SEQ ID NO: 122507 - protein, 24 aa, Mycobacterium avium
SNDELRAPMEKATPLRRLGDPVDI

SEQ ID NO: 122508 - protein, 29 aa, Mycobacterium avium
SNISGQRFAGMLVAGVFLREFVADGVGWA

SEQ ID NO: 122509 - protein, 21 aa, Mycobacterium avium
SNRVILNFIPTTNLANIAGAR

SEQ ID NO: 122510 - protein, 26 aa, Mycobacterium avium
SPAAPFTPPFMPPAAAPAPMPPAPAD

SEQ ID NO: 122511 - protein, 25 aa, Mycobacterium avium
SPAELRGMLSARLPRYMVPQRIIMV

SEQ ID NO: 122512 - protein, 19 aa, Mycobacterium avium
SPALWLSSGAAAPGAFDGP

SEQ ID NO: 122513 - protein, 25 aa, Mycobacterium avium
SPANWDAIMGVNVRGVIWGSRAFGA

SEQ ID NO: 122514 - protein, 23 aa, Mycobacterium avium
SPAQPAGPPPPPPPVSDVINALR

SEQ ID NO: 122515 - protein, 21 aa, Mycobacterium avium
SPATALYPSMPIAAAQAGADL

SEQ ID NO: 122516 - protein, 18 aa, Mycobacterium avium
SPEHVVNLVTFLSSPAAA

SEQ ID NO: 122517 - protein, 28 aa, Mycobacterium avium
SPESGWIRTWLDTVLELPWNVRTDDSTD

SEQ ID NO: 122518 - protein, 22 aa, Mycobacterium avium
SPFGELVFPLPATELPYLHPVT

SEQ ID NO: 122519 - protein, 17 aa, Mycobacterium avium
SPFVTAAVAWELQEATK

SEQ ID NO: 122520 - protein, 21 aa, Mycobacterium avium
SPGCDPPWPGPPAGGAPCPPG

SEQ ID NO: 122521 - protein, 19 aa, Mycobacterium avium
SPKLMLRPATWVADTVADL

SEQ ID NO: 122522 - protein, 27 aa, Mycobacterium avium
SPQAQRMLKFAFNLLDDGLVGQQLFAG

SEQ ID NO: 122523 - protein, 21 aa, Mycobacterium avium
SPQLAAAIKAAVAGTPIAEAF

SEQ ID NO: 122524 - protein, 21 aa, Mycobacterium avium
SPRRALSELLRRGTKNMPGAD

SEQ ID NO: 122525 - protein, 24 aa, Mycobacterium avium
SPTAALMIRIRRLSDRFVKVKSAR

SEQ ID NO: 122526 - protein, 24 aa, Mycobacterium avium
SPVLLFETGLPTRYYIDPTDVDFA

SEQ ID NO: 122527 - protein, 28 aa, Mycobacterium avium
SPVPRAALFVLDRWLRPAPPGVVGELYI

SEQ ID NO: 122528 - protein, 18 aa, Mycobacterium avium
SPWHERAKKLAPKGTGAV

SEQ ID NO: 122529 - protein, 29 aa, Mycobacterium avium
SQGALFDTPILVPPQAAMLGTGAIVKRPR

SEQ ID NO: 122530 - protein, 38 aa, Mycobacterium avium
SQGRSRLALRLLGPLLRPLLRTILIVQRRLEGRGPYAD

SEQ ID NO: 122531 - protein, 23 aa, Mycobacterium avium
SQKFAWARLFRPMVHGHPLTPFT

SEQ ID NO: 122532 - protein, 24 aa, Mycobacterium avium
SQLGWHPKWTLEDGLRALLEWIGN

SEQ ID NO: 122533 - protein, 20 aa, Mycobacterium avium
SQSFLAMDPPRHTKLRKLAH

SEQ ID NO: 122534 - protein, 25 aa, Mycobacterium avium
SRACESLYHFAWDEFCDWYVELAKT

SEQ ID NO: 122535 - protein, 21 aa, Mycobacterium avium
SRAKLVRLFPTVMKGTHVELE

SEQ ID NO: 122536 - protein, 33 aa, Mycobacterium avium
SRALMDTHPFGWLPLLSRVLASAQLLPDAVGGR

SEQ ID NO: 122537 - protein, 23 aa, Mycobacterium avium
SRARLLLLDEPSSGLDPLMENVF

SEQ ID NO: 122538 - protein, 24 aa, Mycobacterium avium
SRARYLMLRLLERAGEQRVAIPSL

SEQ ID NO: 122539 - protein, 26 aa, Mycobacterium avium
SRDAKARWLPPLVSGSMRATTALWSA

SEQ ID NO: 122540 - protein, 17 aa, Mycobacterium avium
SRFYANLVLETAQEARR

SEQ ID NO: 122541 - protein, 28 aa, Mycobacterium avium
SRGGLLGHVWLRAGKRYLSFQRAAVAKA

SEQ ID NO: 122542 - protein, 24 aa, Mycobacterium avium
SRGHGFIVVHRLDNLRRSGRIGGP

SEQ ID NO: 122543 - protein, 19 aa, Mycobacterium avium
SRGITMYRADPANVFERDK

SEQ ID NO: 122544 - protein, 26 aa, Mycobacterium avium
SRIALERLLDFMPRYEVDWAGCRRVT

SEQ ID NO: 122545 - protein, 18 aa, Mycobacterium avium
SRILLLEHVGRKSGAPRY

SEQ ID NO: 122546 - protein, 17 aa, Mycobacterium avium
SRILLQVHDELLFEVAA

SEQ ID NO: 122547 - protein, 22 aa, Mycobacterium avium
SRIPGFERTLIGRALDFWNEEV

SEQ ID NO: 122548 - protein, 18 aa, Mycobacterium avium
SRIWVTEDGLVVMASEAG

SEQ ID NO: 122549 - protein, 19 aa, Mycobacterium avium
SRKGLISSWKAYAPAWAGK

SEQ ID NO: 122550 - protein, 22 aa, Mycobacterium avium
SRLPMPDLIRMATKAIHYLAVF

SEQ ID NO: 122551 - protein, 23 aa, Mycobacterium avium
SRLSQLWFEALAGICAHVRAGGG

SEQ ID NO: 122552 - protein, 17 aa, Mycobacterium avium
SRMLGRPGDGWRLAMDL

SEQ ID NO: 122553 - protein, 21 aa, Mycobacterium avium
SRPTVYRRWPDTRSIVAALLT

SEQ ID NO: 122554 - protein, 18 aa, Mycobacterium avium
SRREALSAELDPELFALY

SEQ ID NO: 122555 - protein, 17 aa, Mycobacterium avium
SRRHFVPELSADPLSWL

SEQ ID NO: 122556 - protein, 24 aa, Mycobacterium avium
SRRIGTIICALALPAGAVGCGGHG

SEQ ID NO: 122557 - protein, 22 aa, Mycobacterium avium
SRTYIASWLRRWQERGELADDL

SEQ ID NO: 122558 - protein, 18 aa, Mycobacterium avium
SRVGHSYIKALMADTGAI

SEQ ID NO: 122559 - protein, 20 aa, Mycobacterium avium
SRWPGLLPEVQRLLPDVHPQ

SEQ ID NO: 122560 - protein, 23 aa, Mycobacterium avium
SSAAVELALASYPGFHVTAPPGD

SEQ ID NO: 122561 - protein, 26 aa, Mycobacterium avium
SSAIFDPDPCLFIETIRLQGKKGLVP

SEQ ID NO: 122562 - protein, 17 aa, Mycobacterium avium
SSCISVTGPFPGFPVPL

SEQ ID NO: 122563 - protein, 21 aa, Mycobacterium avium
SSEIASFFILLVVAGNETTRN

SEQ ID NO: 122564 - protein, 17 aa, Mycobacterium avium
SSFAIVGYAARFPGAAD

SEQ ID NO: 122565 - protein, 30 aa, Mycobacterium avium
SSGTFYTLRCYLDDQPIFLGRNGRISVFTS

SEQ ID NO: 122566 - protein, 17 aa, Mycobacterium avium
SSIIGVHNWHLALFDQQ

SEQ ID NO: 122567 - protein, 21 aa, Mycobacterium avium
SSLMHHFGYISLKDLNFRSRP

SEQ ID NO: 122568 - protein, 20 aa, Mycobacterium avium
SSRLLVEYWAHEAALMAVED

SEQ ID NO: 122569 - protein, 29 aa, Mycobacterium avium
SSSKQRSRLALWARRLLGEAITQAQYLLA

SEQ ID NO: 122570 - protein, 25 aa, Mycobacterium avium
SSTTRSIELLPKQAKDRLLELSIAM

SEQ ID NO: 122571 - protein, 22 aa, Mycobacterium avium
SSVPLYVHAPYLINVASANNRV

SEQ ID NO: 122572 - protein, 19 aa, Mycobacterium avium
STALFLAAQAIRGGLVDCA

SEQ ID NO: 122573 - protein, 27 aa, Mycobacterium avium
STDPRSRVPALPRLGPTDALPRCRRTV

SEQ ID NO: 122574 - protein, 27 aa, Mycobacterium avium
STETLKFLVAFRPGLLSPTLAAQMAGT

SEQ ID NO: 122575 - protein, 25 aa, Mycobacterium avium
STFDNPWLFDVARTPNPHLGFGGGG

SEQ ID NO: 122576 - protein, 23 aa, Mycobacterium avium
STGKVVVLLFIDQTVTNTAAPDP

SEQ ID NO: 122577 - protein, 18 aa, Mycobacterium avium
STHMRMFGLPYRITSTIT

SEQ ID NO: 122578 - protein, 27 aa, Mycobacterium avium
STLGLRLELGGRALFGPVGSAAARAVK

SEQ ID NO: 122579 - protein, 18 aa, Mycobacterium avium
STLGYKGYPKSCCTSLNE

SEQ ID NO: 122580 - protein, 22 aa, Mycobacterium avium
STLLLEVAHRWAQSGRRALYIS

SEQ ID NO: 122581 - protein, 19 aa, Mycobacterium avium
STNIPFLQAVLDDPDFQAG

SEQ ID NO: 122582 - protein, 26 aa, Mycobacterium avium
STPMDPALYLLWAQANVVAGYRYSAE

SEQ ID NO: 122583 - protein, 24 aa, Mycobacterium avium
STPSNYFHLLRRHALDGIKRPLIV

SEQ ID NO: 122584 - protein, 34 aa, Mycobacterium avium
STQILGVLIRQMGELLLQPMVDAVWDRVAKPTDA

SEQ ID NO: 122585 - protein, 24 aa, Mycobacterium avium
STTWPKLKDRPMLGISVLGEEHDE

SEQ ID NO: 122586 - protein, 24 aa, Mycobacterium avium
SVALGFGFRCGFLGLLHMEITRER

SEQ ID NO: 122587 - protein, 35 aa, Mycobacterium avium
SVCMRMTLSGFYSHPWAWNEIGFGGPAYPRGFMRL

SEQ ID NO: 122588 - protein, 26 aa, Mycobacterium avium
SVFTHRLRKYIGAYLAVLGHTDVISF

SEQ ID NO: 122589 - protein, 20 aa, Mycobacterium avium
SVKKLRLAPIKFLSALVSDG

SEQ ID NO: 122590 - protein, 19 aa, Mycobacterium avium
SVKPISLVVGLIDELRRRF

SEQ ID NO: 122591 - protein, 23 aa, Mycobacterium avium
SVLDLFAENIRYFGSLLPEVSDE

SEQ ID NO: 122592 - protein, 23 aa, Mycobacterium avium
SVLDRELSWEALVDGGVTALPVP

SEQ ID NO: 122593 - protein, 19 aa, Mycobacterium avium
SVPALMRGYLRLGAQVCGE

SEQ ID NO: 122594 - protein, 26 aa, Mycobacterium avium
SVPPEDWWLEDLWRRNVWQARHGGYQ

SEQ ID NO: 122595 - protein, 18 aa, Mycobacterium avium
SVPVRYLPDFSAAAEQVA

SEQ ID NO: 122596 - protein, 26 aa, Mycobacterium avium
SVSPINIAGWHRFPLRDKVAAAVPAT

SEQ ID NO: 122597 - protein, 28 aa, Mycobacterium avium
SVTFMREHALLKKLLRTEPETILPSLTV

SEQ ID NO: 122598 - protein, 26 aa, Mycobacterium avium
SVVQWLHTATLFLLAPSWRYRPHADK

SEQ ID NO: 122599 - protein, 17 aa, Mycobacterium avium
SVVQYFPNAGYLADVID

SEQ ID NO: 122600 - protein, 28 aa, Mycobacterium avium
SVVRRVFRPFLVKWILEVAAVLHRRRGA

SEQ ID NO: 122601 - protein, 19 aa, Mycobacterium avium
SWQLEKALPVPVFVQSMAQ

SEQ ID NO: 122602 - protein, 17 aa, Mycobacterium avium
SWRAGDVTLPLTYRFQP

SEQ ID NO: 122603 - protein, 18 aa, Mycobacterium avium
SYALYPHMTVRQNIAFPL

SEQ ID NO: 122604 - protein, 23 aa, Mycobacterium avium
SYGPHHRLVFPLNTILELDDIPE

SEQ ID NO: 122605 - protein, 19 aa, Mycobacterium avium
SYIPGTMTRGPWGAAMGGQ

SEQ ID NO: 122606 - protein, 18 aa, Mycobacterium avium
SYLAGMLTGLRSDVGRRA

SEQ ID NO: 122607 - protein, 22 aa, Mycobacterium avium
SYVSTLRRLLRSALPNPNGLLA

SEQ ID NO: 122608 - protein, 24 aa, Mycobacterium avium
TAAILRGVMRIFEDFRYLREIGDP

SEQ ID NO: 122609 - protein, 17 aa, Mycobacterium avium
TAAQFWASIHGFVMLEL

SEQ ID NO: 122610 - protein, 22 aa, Mycobacterium avium
TAARRYGRIDIAFNNAGISPPD

SEQ ID NO: 122611 - protein, 23 aa, Mycobacterium avium
TAARVIVRLVAEHRWRVGVVAQS

SEQ ID NO: 122612 - protein, 28 aa, Mycobacterium avium
TAASARWRPWRSYATQYLWTTLEHPVNH

SEQ ID NO: 122613 - protein, 29 aa, Mycobacterium avium
TADATPLFVMLLAESWRWGADEAVIRSLL

SEQ ID NO: 122614 - protein, 18 aa, Mycobacterium avium
TAELIRLALTTRKKPFAY

SEQ ID NO: 122615 - protein, 26 aa, Mycobacterium avium
TAGAHADAYLWIKRPGESDGSCGKGD

SEQ ID NO: 122616 - protein, 17 aa, Mycobacterium avium
TAGKPPELLTRFPKELA

SEQ ID NO: 122617 - protein, 26 aa, Mycobacterium avium
TAGRLARYWRLLPNVGAHAFDDDEIG

SEQ ID NO: 122618 - protein, 28 aa, Mycobacterium avium
TALAERLPGYMVPAAVLMLDALPLTPSG

SEQ ID NO: 122619 - protein, 33 aa, Mycobacterium avium
TALHTTARLRLVPLRWALACLLIDIGSVEFSSR

SEQ ID NO: 122620 - protein, 22 aa, Mycobacterium avium
TALIARWLEAPGVRIVRVEGTQ

SEQ ID NO: 122621 - protein, 26 aa, Mycobacterium avium
TALIDPNFELPLRPLARVAHVDFDEP

SEQ ID NO: 122622 - protein, 27 aa, Mycobacterium avium
TALPFNGLRVLDLTTFWAGPCCTHFMA

SEQ ID NO: 122623 - protein, 23 aa, Mycobacterium avium
TALRRHFNWVRSWYDFAVPDIGR

SEQ ID NO: 122624 - protein, 27 aa, Mycobacterium avium
TALSVISGRIAYTLGLTGPALTVDSSC

SEQ ID NO: 122625 - protein, 25 aa, Mycobacterium avium
TAMSLAPLAYTLFQRVMRHDPSDTH

SEQ ID NO: 122626 - protein, 20 aa, Mycobacterium avium
TAPIYAILRDAKERAHQAGA

SEQ ID NO: 122627 - protein, 28 aa, Mycobacterium avium
TAPNPMFLAWVISEDLKRLWPSLGTALT

SEQ ID NO: 122628 - protein, 26 aa, Mycobacterium avium
TAQTSLAYRRGWWVRSTLADAARAAA

SEQ ID NO: 122629 - protein, 22 aa, Mycobacterium avium
TARKQLINRCLSGSGLLRGEPV

SEQ ID NO: 122630 - protein, 23 aa, Mycobacterium avium
TARPLAAPPVRKLAKELMVDLGS

SEQ ID NO: 122631 - protein, 22 aa, Mycobacterium avium
TARQPLIAAGMAGLLAGALLEC

SEQ ID NO: 122632 - protein, 20 aa, Mycobacterium avium
TARVRGLAAVQERIGYWGEH

SEQ ID NO: 122633 - protein, 21 aa, Mycobacterium avium
TASNPDLFWALRGGGGGNFGV

SEQ ID NO: 122634 - protein, 18 aa, Mycobacterium avium
TASPYLGFGSLRPLLEAA

SEQ ID NO: 122635 - protein, 21 aa, Mycobacterium avium
TASRFVACPFGGPGARMYRTG

SEQ ID NO: 122636 - protein, 19 aa, Mycobacterium avium
TASRFVACPFGGTGTRMYR

SEQ ID NO: 122637 - protein, 20 aa, Mycobacterium avium
TATFFNANYLKKGLTEGTKV

SEQ ID NO: 122638 - protein, 22 aa, Mycobacterium avium
TAVEVLWRGQRLRVLASLPELV

SEQ ID NO: 122639 - protein, 21 aa, Mycobacterium avium
TAVGGTPPFITAARGCRLTDA

SEQ ID NO: 122640 - protein, 20 aa, Mycobacterium avium
TAVLIETLVALGAEVRWASC

SEQ ID NO: 122641 - protein, 20 aa, Mycobacterium avium
TAVLTRLWKEGPSSASALAA

SEQ ID NO: 122642 - protein, 17 aa, Mycobacterium avium
TAVRVPIGTPIRIGKTA

SEQ ID NO: 122643 - protein, 17 aa, Mycobacterium avium
TAYLEKFSNHVRAMVLD

SEQ ID NO: 122644 - protein, 17 aa, Mycobacterium avium
TCMLLGEDAIRKRGSVG

SEQ ID NO: 122645 - protein, 21 aa, Mycobacterium avium
TCRIPHCELWPQGTSAFCQTH

SEQ ID NO: 122646 - protein, 20 aa, Mycobacterium avium
TDAFAVGEFYVRSARLQPGE

SEQ ID NO: 122647 - protein, 24 aa, Mycobacterium avium
TDDLIDRCWAPKVYGAWNLHQATA

SEQ ID NO: 122648 - protein, 20 aa, Mycobacterium avium
TDDWLGEWTFSFPQGSMTDE

SEQ ID NO: 122649 - protein, 20 aa, Mycobacterium avium
TDPLCYVDPYLPIESFKRRD

SEQ ID NO: 122650 - protein, 23 aa, Mycobacterium avium
TDQVLFCGLWYDDEFVRTPGGWR

SEQ ID NO: 122651 - protein, 20 aa, Mycobacterium avium
TDRRGLFTALATQGFELLTQ

SEQ ID NO: 122652 - protein, 23 aa, Mycobacterium avium
TDSLDCFFVYLARHPQHRRQLVE

SEQ ID NO: 122653 - protein, 23 aa, Mycobacterium avium
TDTRTYCPFKGEASYYSVTTSAG

SEQ ID NO: 122654 - protein, 24 aa, Mycobacterium avium
TEANVVNFRRQLGRLGLGHDSRRS

SEQ ID NO: 122655 - protein, 24 aa, Mycobacterium avium
TEAVSVMQDRLPFFADLEASQRAS

SEQ ID NO: 122656 - protein, 18 aa, Mycobacterium avium
TEDARVGRLLFSTQLADP

SEQ ID NO: 122657 - protein, 24 aa, Mycobacterium avium
TEELWFAHDYVPYDRGENFAFLGG

SEQ ID NO: 122658 - protein, 23 aa, Mycobacterium avium
TEEMPIAVPWSLPAARPVHSGDP

SEQ ID NO: 122659 - protein, 24 aa, Mycobacterium avium
TEEQKQRWLPKFCTGELITAIAMT

SEQ ID NO: 122660 - protein, 17 aa, Mycobacterium avium
TEFGMLDALRRFLPDDG

SEQ ID NO: 122661 - protein, 24 aa, Mycobacterium avium
TEHLLFRHFGSKAALFREALVLPF

SEQ ID NO: 122662 - protein, 25 aa, Mycobacterium avium
TELAGLARYPRPLAPVAAAAAAGMA

SEQ ID NO: 122663 - protein, 18 aa, Mycobacterium avium
TELAGRRLAFVDVPGHER

SEQ ID NO: 122664 - protein, 22 aa, Mycobacterium avium
TELEALLRGYGYRPITVAGDDP

SEQ ID NO: 122665 - protein, 23 aa, Mycobacterium avium
TELLLAPEFFTNWADSRPAAAGL

SEQ ID NO: 122666 - protein, 18 aa, Mycobacterium avium
TELPLLVVDVQRGGPSTG

SEQ ID NO: 122667 - protein, 26 aa, Mycobacterium avium
TELTLAYILGVLLIGSAGWQLLTECV

SEQ ID NO: 122668 - protein, 29 aa, Mycobacterium avium
TELVRAVARWLVVYLKRAGGQSQFSALVE

SEQ ID NO: 122669 - protein, 25 aa, Mycobacterium avium
TEPEILRTNLAAVLLQMAALQLGDI

SEQ ID NO: 122670 - protein, 24 aa, Mycobacterium avium
TERSARAWLFTVARNMIIDDRRSA

SEQ ID NO: 122671 - protein, 17 aa, Mycobacterium avium
TESWDRALLALPGNDYQ

SEQ ID NO: 122672 - protein, 18 aa, Mycobacterium avium
TFAETPPGWRVVFGAAGR

SEQ ID NO: 122673 - protein, 33 aa, Mycobacterium avium
TFFNLEFPRNTFQLRRPLLTPLPGTLPEPEIWA

SEQ ID NO: 122674 - protein, 24 aa, Mycobacterium avium
TFGNFKVLKRLGFNQPYIAMMPQW

SEQ ID NO: 122675 - protein, 22 aa, Mycobacterium avium
TFGPLFGHIPNLVTMRGDRYRD

SEQ ID NO: 122676 - protein, 27 aa, Mycobacterium avium
TFPELRLLVLNEPLATQLGLDTGWLRG

SEQ ID NO: 122677 - protein, 19 aa, Mycobacterium avium
TFPQWRTQVRLQHALVLLA

SEQ ID NO: 122678 - protein, 17 aa, Mycobacterium avium
TFVAYFTEGLKLMKAAW

SEQ ID NO: 122679 - protein, 20 aa, Mycobacterium avium
TFVYKGMLTTPQLKAFYLDL

SEQ ID NO: 122680 - protein, 27 aa, Mycobacterium avium
TFYFGHVTFFYHLLLKVVEQLYFDGAM

SEQ ID NO: 122681 - protein, 21 aa, Mycobacterium avium
TGAAYLPIDPALPAARMEFML

SEQ ID NO: 122682 - protein, 25 aa, Mycobacterium avium
TGADRLVRLRWPCPVPGAMPVSEVG

SEQ ID NO: 122683 - protein, 17 aa, Mycobacterium avium
TGATGFLGRYLVLEWLE

SEQ ID NO: 122684 - protein, 24 aa, Mycobacterium avium
TGAYGALPYLKKSAGSLMFSTSSS

SEQ ID NO: 122685 - protein, 23 aa, Mycobacterium avium
TGDPARMFGRMLGCDLGLNPPFE

SEQ ID NO: 122686 - protein, 21 aa, Mycobacterium avium
TGDSFFHLAPLGQSGALAGLN

SEQ ID NO: 122687 - protein, 20 aa, Mycobacterium avium
TGDYLAELTMLILGRDRMKH

SEQ ID NO: 122688 - protein, 28 aa, Mycobacterium avium
TGFLGRYLVLQWLERLELADGKLICLVR

SEQ ID NO: 122689 - protein, 17 aa, Mycobacterium avium
TGFVRPQHPIETIRSHF

SEQ ID NO: 122690 - protein, 22 aa, Mycobacterium avium
TGGPLLMFANPDCRISLSRRSE

SEQ ID NO: 122691 - protein, 29 aa, Mycobacterium avium
TGIDRRDWPLFRTVFTDDCVLDYGEIGHW

SEQ ID NO: 122692 - protein, 20 aa, Mycobacterium avium
TGITPFTEPPVPLVLQEMTL

SEQ ID NO: 122693 - protein, 26 aa, Mycobacterium avium
TGKLRPALFVVPTDAPGFSATPIEME

SEQ ID NO: 122694 - protein, 27 aa, Mycobacterium avium
TGLALSPTLIFDYPTPNALAGYIRTEL

SEQ ID NO: 122695 - protein, 22 aa, Mycobacterium avium
TGLESTMRFILSAKSAYVDGQV

SEQ ID NO: 122696 - protein, 17 aa, Mycobacterium avium
TGLGTVAGLPPGVGTVA

SEQ ID NO: 122697 - protein, 24 aa, Mycobacterium avium
TGLKGWFQRWFFTAVGQVPIDRTD

SEQ ID NO: 122698 - protein, 27 aa, Mycobacterium avium
TGMGKTFAFGVPLLQRITAGTAPRALN

SEQ ID NO: 122699 - protein, 24 aa, Mycobacterium avium
TGNGYAGGLQFTSSTWHANGGSGS

SEQ ID NO: 122700 - protein, 27 aa, Mycobacterium avium
TGPDSYGRFMRIRVFDCWMHEQDIRVA

SEQ ID NO: 122701 - protein, 17 aa, Mycobacterium avium
TGPSGEPWPLQDTVRPW

SEQ ID NO: 122702 - protein, 24 aa, Mycobacterium avium
TGQDLLLITVLKGAVIFVTDLARA

SEQ ID NO: 122703 - protein, 28 aa, Mycobacterium avium
TGQLNTEYFVAPGLWRGFDHGGLARALS

SEQ ID NO: 122704 - protein, 23 aa, Mycobacterium avium
TGRLTRVATLPRPLRPLRNAGMC

SEQ ID NO: 122705 - protein, 29 aa, Mycobacterium avium
TGSGKTLAFSIPLVGRLSTGNRRPARPTG

SEQ ID NO: 122706 - protein, 27 aa, Mycobacterium avium
TGSRPQALLLPLGPLAENNIRATFASN

SEQ ID NO: 122707 - protein, 25 aa, Mycobacterium avium
TGSTAARLFYAYADTLLALGRNDEA

SEQ ID NO: 122708 - protein, 22 aa, Mycobacterium avium
TGTFLCLQAALPDMVEAGWGRV

SEQ ID NO: 122709 - protein, 21 aa, Mycobacterium avium
TGTFTFAELLAHELSVERTSQ

SEQ ID NO: 122710 - protein, 30 aa, Mycobacterium avium
TGVPKVILNLAPSLWIPQHGEPFLSNWTPV

SEQ ID NO: 122711 - protein, 19 aa, Mycobacterium avium
TGVRVFFPDPWPKARHHKR

SEQ ID NO: 122712 - protein, 21 aa, Mycobacterium avium
TGWDYPSCEAIGLLKMDFLGL

SEQ ID NO: 122713 - protein, 19 aa, Mycobacterium avium
THASINGDYLLLMRSMPSD

SEQ ID NO: 122714 - protein, 18 aa, Mycobacterium avium
THCLPTGLVLTSIGYRGK

SEQ ID NO: 122715 - protein, 32 aa, Mycobacterium avium
THDELRPLKVLASRMPCPYLNPGPYVGGRPLV

SEQ ID NO: 122716 - protein, 25 aa, Mycobacterium avium
THGALRSAWIGYWVPRSATGGGVAT

SEQ ID NO: 122717 - protein, 27 aa, Mycobacterium avium
THLSFVPGWNRRQLRRLIRDLRGLPGP

SEQ ID NO: 122718 - protein, 24 aa, Mycobacterium avium
THQPIEHLAALRAIPKLSVVRPAD

SEQ ID NO: 122719 - protein, 25 aa, Mycobacterium avium
THRPVPYLAALPDKLAGRSVMVLDP

SEQ ID NO: 122720 - protein, 18 aa, Mycobacterium avium
THRVQFTANPWLPGYMSQ

SEQ ID NO: 122721 - protein, 28 aa, Mycobacterium avium
THRVTVLHFMPGWLEMLVEVGRGRLSSV

SEQ ID NO: 122722 - protein, 21 aa, Mycobacterium avium
THWGGAFKYAASLLGLPTGAY

SEQ ID NO: 122723 - protein, 17 aa, Mycobacterium avium
TIASDRLGLRPLATIRS

SEQ ID NO: 122724 - protein, 20 aa, Mycobacterium avium
TIHEHKVNLLFFTGDAMARP

SEQ ID NO: 122725 - protein, 17 aa, Mycobacterium avium
TILAWSFVRDDQPLADT

SEQ ID NO: 122726 - protein, 17 aa, Mycobacterium avium
TINLGAALAEYGRRVLL

SEQ ID NO: 122727 - protein, 17 aa, Mycobacterium avium
TIPDLDGIRVLRTFDES

SEQ ID NO: 122728 - protein, 17 aa, Mycobacterium avium
TIRLPVHLVEQVNKLAR

SEQ ID NO: 122729 - protein, 27 aa, Mycobacterium avium
TISGAGRPPVLYELAHGTPFTELLALH

SEQ ID NO: 122730 - protein, 19 aa, Mycobacterium avium
TIYSFTGASPRFLLDFSRR

SEQ ID NO: 122731 - protein, 22 aa, Mycobacterium avium
TKAKELGLTPLARIVSTGVSGL

SEQ ID NO: 122732 - protein, 24 aa, Mycobacterium avium
TKTDGPPRILAHLRNIAADLPGSI

SEQ ID NO: 122733 - protein, 17 aa, Mycobacterium avium
TLAFAFSHRSYLDGMLL

SEQ ID NO: 122734 - protein, 17 aa, Mycobacterium avium
TLALYRRDPDGDEVLGS

SEQ ID NO: 122735 - protein, 23 aa, Mycobacterium avium
TLAPREVIALLETPRGAVFATEI

SEQ ID NO: 122736 - protein, 18 aa, Mycobacterium avium
TLARRLPGLRLAVPPEQL

SEQ ID NO: 122737 - protein, 20 aa, Mycobacterium avium
TLASRWRHIHGGPGELLDLS

SEQ ID NO: 122738 - protein, 23 aa, Mycobacterium avium
TLAWQRLVPWPDVLPGLTRLKKK

SEQ ID NO: 122739 - protein, 27 aa, Mycobacterium avium
TLDEFALPDSTLWSIPIVFDMSADDIA

SEQ ID NO: 122740 - protein, 17 aa, Mycobacterium avium
TLDLRGGTLTRSAYWRS

SEQ ID NO: 122741 - protein, 28 aa, Mycobacterium avium
TLDWDDELLSFFTIPRAMLPEIGPSSSP

SEQ ID NO: 122742 - protein, 17 aa, Mycobacterium avium
TLHAALELSRRGSGYAV

SEQ ID NO: 122743 - protein, 27 aa, Mycobacterium avium
TLHADLLGPVDLPPGARRPAGTPPGAP

SEQ ID NO: 122744 - protein, 33 aa, Mycobacterium avium
TLKEPYSVVGLIFPWNGPIFNASAKLAPALAAG

SEQ ID NO: 122745 - protein, 17 aa, Mycobacterium avium
TLKHIHWNVVGPNFIGV

SEQ ID NO: 122746 - protein, 25 aa, Mycobacterium avium
TLKKNGVIVILTIAPQAGPSTVYHR

SEQ ID NO: 122747 - protein, 17 aa, Mycobacterium avium
TLLHPRPRSVLGELAAA

SEQ ID NO: 122748 - protein, 27 aa, Mycobacterium avium
TLPASVRELAVYWTARQIGCSWCVDFG

SEQ ID NO: 122749 - protein, 19 aa, Mycobacterium avium
TLPRDPNGKLYKRRIRERY

SEQ ID NO: 122750 - protein, 35 aa, Mycobacterium avium
TLRDAGFELPPSQANFLWLPLGSRTEDFVQEAANA

SEQ ID NO: 122751 - protein, 35 aa, Mycobacterium avium
TLREHMLRSAYQRWLNLGFAVRADWLAREHPWLLR

SEQ ID NO: 122752 - protein, 19 aa, Mycobacterium avium
TLRERLGAAGPLLGDDHPG

SEQ ID NO: 122753 - protein, 28 aa, Mycobacterium avium
TLRLSMYVLNSAFYKPALLSRDMQALDL

SEQ ID NO: 122754 - protein, 23 aa, Mycobacterium avium
TLSRTHPNLVRKLFSLEVPEIAD

SEQ ID NO: 122755 - protein, 17 aa, Mycobacterium avium
TLVAFLREDSMNIYTRA

SEQ ID NO: 122756 - protein, 33 aa, Mycobacterium avium
TLVKFELVADPNVPLPGFVLKRAVKGTIDSATK

SEQ ID NO: 122757 - protein, 17 aa, Mycobacterium avium
TLWARRPATLEVFADTD

SEQ ID NO: 122758 - protein, 26 aa, Mycobacterium avium
TMEETALWLDLTYDGPAPVVLTGAMR

SEQ ID NO: 122759 - protein, 21 aa, Mycobacterium avium
TMNHLAFHVPAEKFDAYRQRL

SEQ ID NO: 122760 - protein, 24 aa, Mycobacterium avium
TMVLMAALARLGAVQNPIIPVLRE

SEQ ID NO: 122761 - protein, 26 aa, Mycobacterium avium
TNATMPYVLALADRGWRAACRSDHAL

SEQ ID NO: 122762 - protein, 19 aa, Mycobacterium avium
TNAVKHFKFTRKDGKRRIH

SEQ ID NO: 122763 - protein, 17 aa, Mycobacterium avium
TNAWVPFVVAGTVLVRD

SEQ ID NO: 122764 - protein, 19 aa, Mycobacterium avium
TNEEPPFLNKLVINHALPM

SEQ ID NO: 122765 - protein, 32 aa, Mycobacterium avium
TNHHIVMDGWSLPILLREILAIYYGDQLPAPA

SEQ ID NO: 122766 - protein, 23 aa, Mycobacterium avium
TNIDQLLEAVLLTADAALDLRAN

SEQ ID NO: 122767 - protein, 21 aa, Mycobacterium avium
TNLHHALALAGRHLRRHPNAQ

SEQ ID NO: 122768 - protein, 19 aa, Mycobacterium avium
TNLIDYRLQITYPDSEPYV

SEQ ID NO: 122769 - protein, 19 aa, Mycobacterium avium
TNYGVTFPLLAKTDVNGDD

SEQ ID NO: 122770 - protein, 26 aa, Mycobacterium avium
TPAVIEAMLLVRLPYHLSSVTQAAAR

SEQ ID NO: 122771 - protein, 24 aa, Mycobacterium avium
TPDHLLIGVLSDPAALATVLLRLQ

SEQ ID NO: 122772 - protein, 19 aa, Mycobacterium avium
TPDLLTFTRADLLRTEETG

SEQ ID NO: 122773 - protein, 29 aa, Mycobacterium avium
TPEYKQVALFSATMPPAIRKLTAKYLHDP

SEQ ID NO: 122774 - protein, 17 aa, Mycobacterium avium
TPFTPPRPDTTANGIAA

SEQ ID NO: 122775 - protein, 28 aa, Mycobacterium avium
TPNSAGRYRPFYLRNLLDAVQGRTLEEA

SEQ ID NO: 122776 - protein, 21 aa, Mycobacterium avium
TPPAFDRYDPLGLDALLSDDE

SEQ ID NO: 122777 - protein, 17 aa, Mycobacterium avium
TPPGLLHLAARAYTASG

SEQ ID NO: 122778 - protein, 23 aa, Mycobacterium avium
TPTGLWCEDAWLTTAMLVESTET

SEQ ID NO: 122779 - protein, 25 aa, Mycobacterium avium
TPTGSLWCYATPETRDWWGGMWADR

SEQ ID NO: 122780 - protein, 19 aa, Mycobacterium avium
TPVISRFWDDPESWTLQTY

SEQ ID NO: 122781 - protein, 17 aa, Mycobacterium avium
TPVTPREPIREDIDVAV

SEQ ID NO: 122782 - protein, 19 aa, Mycobacterium avium
TQAVLPDMIEAGWGRIVNI

SEQ ID NO: 122783 - protein, 19 aa, Mycobacterium avium
TQCAVPCSRPLPWPARPVS

SEQ ID NO: 122784 - protein, 18 aa, Mycobacterium avium
TQFLNWRPRSRAAVRAWH

SEQ ID NO: 122785 - protein, 27 aa, Mycobacterium avium
TQLGKRLPAYMVPAAVVVLESLPLTVN

SEQ ID NO: 122786 - protein, 18 aa, Mycobacterium avium
TQRPSWPGGIAVGKTAVS

SEQ ID NO: 122787 - protein, 34 aa, Mycobacterium avium
TQRVKANLFYRGLVFHRFPVIGDSLYTRTEVVGL

SEQ ID NO: 122788 - protein, 23 aa, Mycobacterium avium
TQVARMDLTFTLGERWTSAGEPA

SEQ ID NO: 122789 - protein, 18 aa, Mycobacterium avium
TQVRLQHALVLLAERRDV

SEQ ID NO: 122790 - protein, 21 aa, Mycobacterium avium
TRAQHLLSGAARRFKGYALAA

SEQ ID NO: 122791 - protein, 20 aa, Mycobacterium avium
TRCGRIYWPGSHHAKLLALV

SEQ ID NO: 122792 - protein, 24 aa, Mycobacterium avium
TRDDLAKALLAYFTGHLGISTTMR

SEQ ID NO: 122793 - protein, 22 aa, Mycobacterium avium
TRDDLLHPLRAPSLLAVEPPEH

SEQ ID NO: 122794 - protein, 23 aa, Mycobacterium avium
TRDRWYEAFTETWKDSLSIGWQG

SEQ ID NO: 122795 - protein, 18 aa, Mycobacterium avium
TREIILIHHTDCGMLTFT

SEQ ID NO: 122796 - protein, 21 aa, Mycobacterium avium
TRFVEHMGSLLQRPVVTISCH

SEQ ID NO: 122797 - protein, 21 aa, Mycobacterium avium
TRGGYLKDIKGFDSEFFAVAK

SEQ ID NO: 122798 - protein, 18 aa, Mycobacterium avium
TRGWGYDGVLWYSVHEPY

SEQ ID NO: 122799 - protein, 26 aa, Mycobacterium avium
TRHGDSWLLNGFKWFASNCAGEAFIV

SEQ ID NO: 122800 - protein, 18 aa, Mycobacterium avium
TRLLPTGRVRYFPDSEYR

SEQ ID NO: 122801 - protein, 19 aa, Mycobacterium avium
TRNLPLIGAPANPGITGAP

SEQ ID NO: 122802 - protein, 23 aa, Mycobacterium avium
TRQTIYRYFPTHEALLGATALSA

SEQ ID NO: 122803 - protein, 31 aa, Mycobacterium avium
TRRGLIAEYGITWILPRLAGWGAAMDLLLSG

SEQ ID NO: 122804 - protein, 25 aa, Mycobacterium avium
TRRIGRWRTAYLVLSGRTVGAATAL

SEQ ID NO: 122805 - protein, 25 aa, Mycobacterium avium
TRSVLPGGLNWPLDLAVGHDGRLYV

SEQ ID NO: 122806 - protein, 26 aa, Mycobacterium avium
TRTARMDLAWSLAERWTPDGSPAGIG

SEQ ID NO: 122807 - protein, 21 aa, Mycobacterium avium
TRVDAVFRKGAYAAGYSGFEG

SEQ ID NO: 122808 - protein, 18 aa, Mycobacterium avium
TRYPGMYHGFLMRSDATA

SEQ ID NO: 122809 - protein, 27 aa, Mycobacterium avium
TSAAAHEFYIRDVLLDWDRDDPNYFEV

SEQ ID NO: 122810 - protein, 21 aa, Mycobacterium avium
TSAIAVLAVPCRWTELELGAA

SEQ ID NO: 122811 - protein, 18 aa, Mycobacterium avium
TSAWTLIELIRHPDVYAE

SEQ ID NO: 122812 - protein, 27 aa, Mycobacterium avium
TSDTIMRIPALPEHLVIVGSGFVAAEF

SEQ ID NO: 122813 - protein, 20 aa, Mycobacterium avium
TSELQRRLTAAGSPLRALAA

SEQ ID NO: 122814 - protein, 24 aa, Mycobacterium avium
TSHDRPLDAAALRDWAHTAVSDLI

SEQ ID NO: 122815 - protein, 23 aa, Mycobacterium avium
TSNVVIFAIQIALGELLRHHGAK

SEQ ID NO: 122816 - protein, 24 aa, Mycobacterium avium
TSPPVLLAYLAPQTTRLRLGSGGV

SEQ ID NO: 122817 - protein, 17 aa, Mycobacterium avium
TSPRERFTALKQRLGDA

SEQ ID NO: 122818 - protein, 23 aa, Mycobacterium avium
TSQRWPAGTPVLFPRPTKNIDGT

SEQ ID NO: 122819 - protein, 21 aa, Mycobacterium avium
TSRAILTEALSRMGRALAARS

SEQ ID NO: 122820 - protein, 17 aa, Mycobacterium avium
TSRRVLAALGPRMLRLA

SEQ ID NO: 122821 - protein, 20 aa, Mycobacterium avium
TSRVLTTYRKAAPGPRGAAI

SEQ ID NO: 122822 - protein, 26 aa, Mycobacterium avium
TSSYGRGFLTPRDSLRQRCVAHRLTI

SEQ ID NO: 122823 - protein, 24 aa, Mycobacterium avium
TSVSELIRHAALLYLATEAAQPPD

SEQ ID NO: 122824 - protein, 20 aa, Mycobacterium avium
TTAAGGWFRSSRRPGREWTN

SEQ ID NO: 122825 - protein, 21 aa, Mycobacterium avium
TTAGVALLRPTAHHLDRLVAK

SEQ ID NO: 122826 - protein, 25 aa, Mycobacterium avium
TTAKPYSVVILKRGPGFGDESAAGV

SEQ ID NO: 122827 - protein, 23 aa, Mycobacterium avium
TTAVLMDRWDPARAVALMTAHRC

SEQ ID NO: 122828 - protein, 29 aa, Mycobacterium avium
TTEQLREIVGAYFPLGWQLACHVQGDAGV

SEQ ID NO: 122829 - protein, 28 aa, Mycobacterium avium
TTGRRRRCGWFDAVIARYATRVNGITDF

SEQ ID NO: 122830 - protein, 19 aa, Mycobacterium avium
TTHGDLALPLLSTARELDE

SEQ ID NO: 122831 - protein, 23 aa, Mycobacterium avium
TTIGPQEWLAHPGSVGIPLAPVH

SEQ ID NO: 122832 - protein, 19 aa, Mycobacterium avium
TTINILSTLIRPTSGRASV

SEQ ID NO: 122833 - protein, 27 aa, Mycobacterium avium
TTKNMGQWLAALGFQPGIGGPGSISVG

SEQ ID NO: 122834 - protein, 26 aa, Mycobacterium avium
TTLRYYEQIGLLPAPIRLGGQRRYDE

SEQ ID NO: 122835 - protein, 20 aa, Mycobacterium avium
TTNPPLLLATRHLIGDDGTY

SEQ ID NO: 122836 - protein, 20 aa, Mycobacterium avium
TTQWALDRHTFGRPLASYQA

SEQ ID NO: 122837 - protein, 18 aa, Mycobacterium avium
TTRHIPAFKLTRSSAAYW

SEQ ID NO: 122838 - protein, 25 aa, Mycobacterium avium
TTRVRYRRPIAARAVWALVGPLHRR

SEQ ID NO: 122839 - protein, 25 aa, Mycobacterium avium
TTSGELIRQVQLLSVPPGLSPARVL

SEQ ID NO: 122840 - protein, 29 aa, Mycobacterium avium
TTSTDPLSEIWFLLTGQTTLPTSLGSAVN

SEQ ID NO: 122841 - protein, 28 aa, Mycobacterium avium
TTTAEQWRLVLDVNLIGAWNTCAAALPH

SEQ ID NO: 122842 - protein, 17 aa, Mycobacterium avium
TTYGGVDLLFNVGADMS

SEQ ID NO: 122843 - protein, 19 aa, Mycobacterium avium
TVDANLKLGLPADARDYGI

SEQ ID NO: 122844 - protein, 22 aa, Mycobacterium avium
TVDDLLDHLLPPDWRVDMQELD

SEQ ID NO: 122845 - protein, 17 aa, Mycobacterium avium
TVDLGGGLGISYLAADD

SEQ ID NO: 122846 - protein, 22 aa, Mycobacterium avium
TVEHYLRVPFVLTKCAVPHMRK

SEQ ID NO: 122847 - protein, 23 aa, Mycobacterium avium
TVELNASFYRWPKDSTFAGWREQ

SEQ ID NO: 122848 - protein, 27 aa, Mycobacterium avium
TVEYLVDAVFNYPTFSEAYKVAALDVM

SEQ ID NO: 122849 - protein, 17 aa, Mycobacterium avium
TVFQRLAPGIMPLSVAE

SEQ ID NO: 122850 - protein, 33 aa, Mycobacterium avium
TVGTLSVPPTWTAAAPAIRPAALALPATTVTAA

SEQ ID NO: 122851 - protein, 23 aa, Mycobacterium avium
TVKNYVSRLLAKLGMERRTQAAV

SEQ ID NO: 122852 - protein, 18 aa, Mycobacterium avium
TVLLRTLPLVVNGASAGA

SEQ ID NO: 122853 - protein, 18 aa, Mycobacterium avium
TVLPANLGAHSFWNESDP

SEQ ID NO: 122854 - protein, 21 aa, Mycobacterium avium
TVLSRFGFPGGGYLAPEGTPF

SEQ ID NO: 122855 - protein, 19 aa, Mycobacterium avium
TVMSNLGLHLAMRSAGITV

SEQ ID NO: 122856 - protein, 24 aa, Mycobacterium avium
TVNTLMQMAWALVLSRLTDTRDVV

SEQ ID NO: 122857 - protein, 29 aa, Mycobacterium avium
TVNTVLQAGWAQLLMRLTGQHDVAFGTAV

SEQ ID NO: 122858 - protein, 18 aa, Mycobacterium avium
TVPGWRSRAERFDMAVLE

SEQ ID NO: 122859 - protein, 17 aa, Mycobacterium avium
TVPIVGAPMAGGPGTPA

SEQ ID NO: 122860 - protein, 20 aa, Mycobacterium avium
TVPQIDLLVGSWYVSTHPSS

SEQ ID NO: 122861 - protein, 27 aa, Mycobacterium avium
TVRLANKIRLLALAAGDFASPGLELTG

SEQ ID NO: 122862 - protein, 28 aa, Mycobacterium avium
TVRRLTTPELLIFLAVIAGAGVETTGRL

SEQ ID NO: 122863 - protein, 29 aa, Mycobacterium avium
TVSLRGYVAAMKYAIPRMLDRGGGAIVNM

SEQ ID NO: 122864 - protein, 23 aa, Mycobacterium avium
TVSLYFVLYRPDQRVGDAAAHRA

SEQ ID NO: 122865 - protein, 17 aa, Mycobacterium avium
TVSSLMHHFGYISLKDL

SEQ ID NO: 122866 - protein, 28 aa, Mycobacterium avium
TVSTADIERWRHFAFGVLGFAEGKGPDE

SEQ ID NO: 122867 - protein, 27 aa, Mycobacterium avium
TVTAGQSLIWLEAMKMEHTIAAPVDGV

SEQ ID NO: 122868 - protein, 17 aa, Mycobacterium avium
TVTAIETHPARRLLPHD

SEQ ID NO: 122869 - protein, 21 aa, Mycobacterium avium
TVVLPDAPVKIFLTASAETRA

SEQ ID NO: 122870 - protein, 25 aa, Mycobacterium avium
TVYRQEMLRMFGLPESGLAETLREA

SEQ ID NO: 122871 - protein, 18 aa, Mycobacterium avium
TWLIAGFDELAAQLPGCI

SEQ ID NO: 122872 - protein, 17 aa, Mycobacterium avium
TWQNTFGILADIGRFST

SEQ ID NO: 122873 - protein, 24 aa, Mycobacterium avium
TWTLPNVRAWWEMTWQGRPDPAVG

SEQ ID NO: 122874 - protein, 24 aa, Mycobacterium avium
TYDKMSLFIVPAETPGIEIVRNVG

SEQ ID NO: 122875 - protein, 18 aa, Mycobacterium avium
TYGRIFYEHARRAQLELD

SEQ ID NO: 122876 - protein, 17 aa, Mycobacterium avium
TYRALVLDWAQPGAGMT

SEQ ID NO: 122877 - protein, 34 aa, Mycobacterium avium
TYVALRTEIDNWRWAGVPIFLRAGKALPHKVTEV

SEQ ID NO: 122878 - protein, 28 aa, Mycobacterium avium
VAADGRPLVAPIWFVVDDGELAFNTGRG

SEQ ID NO: 122879 - protein, 19 aa, Mycobacterium avium
VAAELLLTGRMFGGAEAAA

SEQ ID NO: 122880 - protein, 38 aa, Mycobacterium avium
VAAGAPWFMTLFGRDSLLTAWMTLPLDVGLSIGTLQRL

SEQ ID NO: 122881 - protein, 25 aa, Mycobacterium avium
VAAGEPLFTLYTDTPERFGAALAEL

SEQ ID NO: 122882 - protein, 19 aa, Mycobacterium avium
VAARHRTVWALGDYALMAE

SEQ ID NO: 122883 - protein, 20 aa, Mycobacterium avium
VAARQVLGVLPPAGARRKGK

SEQ ID NO: 122884 - protein, 22 aa, Mycobacterium avium
VAARRFRWQALVDGEPVITAAV

SEQ ID NO: 122885 - protein, 18 aa, Mycobacterium avium
VAATHRYPMVLDAIQNKY

SEQ ID NO: 122886 - protein, 30 aa, Mycobacterium avium
VADSYTELIPFRLTVLHAAWLIDNGDERAA

SEQ ID NO: 122887 - protein, 22 aa, Mycobacterium avium
VADYLTGKGWRVTPHPARQLYA

SEQ ID NO: 122888 - protein, 23 aa, Mycobacterium avium
VAEKALLRRLVEAGTRVVQYGYA

SEQ ID NO: 122889 - protein, 18 aa, Mycobacterium avium
VAELAELRKSAPIYWMDV

SEQ ID NO: 122890 - protein, 25 aa, Mycobacterium avium
VAELGRLDIIVANAGICCPAPWDQI

SEQ ID NO: 122891 - protein, 21 aa, Mycobacterium avium
VAELLPQVFAWARSVDPCQPL

SEQ ID NO: 122892 - protein, 22 aa, Mycobacterium avium
VAEVAWVPMRELPSRLAYADER

SEQ ID NO: 122893 - protein, 17 aa, Mycobacterium avium
VAEVTRERQGWGAWPVC

SEQ ID NO: 122894 - protein, 26 aa, Mycobacterium avium
VAGGLARHVLCFRTLWEATHTELMKQ

SEQ ID NO: 122895 - protein, 18 aa, Mycobacterium avium
VAGPGFINLRLEASAQAV

SEQ ID NO: 122896 - protein, 17 aa, Mycobacterium avium
VAGQNWPWGDPHRYSFA

SEQ ID NO: 122897 - protein, 25 aa, Mycobacterium avium
VAGTALIAGLLKGLLDLGVTPRVNA

SEQ ID NO: 122898 - protein, 24 aa, Mycobacterium avium
VAIARAFVNRPLVLLADEPTGNLD

SEQ ID NO: 122899 - protein, 17 aa, Mycobacterium avium
VAIPHLNVTWLIESLDA

SEQ ID NO: 122900 - protein, 25 aa, Mycobacterium avium
VALIDVAHWASEFPWCAQAADLLRS

SEQ ID NO: 122901 - protein, 17 aa, Mycobacterium avium
VALPFTNLIDYRLQITY

SEQ ID NO: 122902 - protein, 18 aa, Mycobacterium avium
VAMFNQFCYIQLGSARSG

SEQ ID NO: 122903 - protein, 21 aa, Mycobacterium avium
VAPGPLYPVSIVLSALAECSG

SEQ ID NO: 122904 - protein, 19 aa, Mycobacterium avium
VAPYLAWLDATAARARQTA

SEQ ID NO: 122905 - protein, 19 aa, Mycobacterium avium
VARAVRPPTPGRRLPKSLT

SEQ ID NO: 122906 - protein, 27 aa, Mycobacterium avium
VAREGLQPLIFGLWQMISEYQSAQPEI

SEQ ID NO: 122907 - protein, 24 aa, Mycobacterium avium
VARGTFYFHFPTKEHVLVEVERAE

SEQ ID NO: 122908 - protein, 17 aa, Mycobacterium avium
VARTLLRHWAAALGSPA

SEQ ID NO: 122909 - protein, 22 aa, Mycobacterium avium
VASFYTMYRRGPTGDYLVGVCT

SEQ ID NO: 122910 - protein, 18 aa, Mycobacterium avium
VASLYRDRRMPYTVGLLG

SEQ ID NO: 122911 - protein, 23 aa, Mycobacterium avium
VATTWHYLFSVAATVAAAWEFRQ

SEQ ID NO: 122912 - protein, 35 aa, Mycobacterium avium
VATVPLPAVLANRARLLVLIATNFFGQNTAAIAQT

SEQ ID NO: 122913 - protein, 20 aa, Mycobacterium avium
VAVARLVLGPGMRIQAPPNL

SEQ ID NO: 122914 - protein, 24 aa, Mycobacterium avium
VAVLLRITEVFGVDATFFSSQDDT

SEQ ID NO: 122915 - protein, 20 aa, Mycobacterium avium
VAVSASFLWAPDPGPMRLVT

SEQ ID NO: 122916 - protein, 23 aa, Mycobacterium avium
VAVVLQALLDRHPMLRLRVEDDG

SEQ ID NO: 122917 - protein, 26 aa, Mycobacterium avium
VAYGASKAFDMVFAEALWAELHDKGV

SEQ ID NO: 122918 - protein, 20 aa, Mycobacterium avium
VAYQLSFHEGSRYPLDRGAA

SEQ ID NO: 122919 - protein, 28 aa, Mycobacterium avium
VCAVLPAGWAIAWLTAAAWSDSPSGAVV

SEQ ID NO: 122920 - protein, 20 aa, Mycobacterium avium
VCGSVVIRGPRRSLLRRRLS

SEQ ID NO: 122921 - protein, 24 aa, Mycobacterium avium
VCRRAGLAARYFYESFTDKDQFVA

SEQ ID NO: 122922 - protein, 17 aa, Mycobacterium avium
VCVSDRGRWQSPSCRLS

SEQ ID NO: 122923 - protein, 17 aa, Mycobacterium avium
VDAARYKVAARRGRDAA

SEQ ID NO: 122924 - protein, 31 aa, Mycobacterium avium
VDALRVGVLPTPAVAYLTGAYDADFGVMISA

SEQ ID NO: 122925 - protein, 23 aa, Mycobacterium avium
VDAMLGLVRLARGEFPAACAAFT

SEQ ID NO: 122926 - protein, 24 aa, Mycobacterium avium
VDDALYEMELVGHDFFLFQDKQTE

SEQ ID NO: 122927 - protein, 24 aa, Mycobacterium avium
VDDDGTVWLISAAGERVVGSWQAG

SEQ ID NO: 122928 - protein, 28 aa, Mycobacterium avium
VDDPALPEPLPDGPVRRAPLGTIAGARS

SEQ ID NO: 122929 - protein, 17 aa, Mycobacterium avium
VDDPPLHPLPFHAMFDA

SEQ ID NO: 122930 - protein, 18 aa, Mycobacterium avium
VDDVGLDSVAFAVGMVAI

SEQ ID NO: 122931 - protein, 25 aa, Mycobacterium avium
VDEERIEMWLRATGRQRVRVGALGL

SEQ ID NO: 122932 - protein, 19 aa, Mycobacterium avium
VDEILPLKITQADGSVTEF

SEQ ID NO: 122933 - protein, 24 aa, Mycobacterium avium
VDFYSNVLGMPLVKSLDLPGGAGQ

SEQ ID NO: 122934 - protein, 22 aa, Mycobacterium avium
VDGETVVPLLPAQDFKRVGDAD

SEQ ID NO: 122935 - protein, 18 aa, Mycobacterium avium
VDGEWVDWFPPTHPDRPD

SEQ ID NO: 122936 - protein, 24 aa, Mycobacterium avium
VDGRPFGLYVHVPFCVTRCGYCDF

SEQ ID NO: 122937 - protein, 36 aa, Mycobacterium avium
VDGVFLPFHLLTLRDMGLMLGEYWDLSALAADCAAD

SEQ ID NO: 122938 - protein, 24 aa, Mycobacterium avium
VDHGKSTLLHRLTGMWPDRLAEEQ

SEQ ID NO: 122939 - protein, 25 aa, Mycobacterium avium
VDIAFNWDHFFPLYGDPDGAHFECW

SEQ ID NO: 122940 - protein, 20 aa, Mycobacterium avium
VDKFDRCSWHPGPHRLPILD

SEQ ID NO: 122941 - protein, 29 aa, Mycobacterium avium
VDLAPGALGFRYDTGLYLQFRATTTDDFQ

SEQ ID NO: 122942 - protein, 28 aa, Mycobacterium avium
VDLRDWRQWWHWVPGASWRHPFGPDSDV

SEQ ID NO: 122943 - protein, 18 aa, Mycobacterium avium
VDMEPFFDAYRAVKPYLI

SEQ ID NO: 122944 - protein, 17 aa, Mycobacterium avium
VDPHQPGARLFLHYADL

SEQ ID NO: 122945 - protein, 19 aa, Mycobacterium avium
VDQLLWLPVAEAMQRLNYT

SEQ ID NO: 122946 - protein, 24 aa, Mycobacterium avium
VDRSAAYAMRWVAKNIVAAGLAER

SEQ ID NO: 122947 - protein, 29 aa, Mycobacterium avium
VDTEAFHVDLLWLLEIGSNQKIAGWATFD

SEQ ID NO: 122948 - protein, 22 aa, Mycobacterium avium
VDTMTLGWFASLIPVTVPTAGE

SEQ ID NO: 122949 - protein, 33 aa, Mycobacterium avium
VDTNFVPLGEYPGDFWQYARNKVIVAARIAGID

SEQ ID NO: 122950 - protein, 24 aa, Mycobacterium avium
VDTPFLGPVLADDLLRHVGADAAA

SEQ ID NO: 122951 - protein, 29 aa, Mycobacterium avium
VDTPHGPVRFPGVPTWFSQTPGRVAGPAP

SEQ ID NO: 122952 - protein, 25 aa, Mycobacterium avium
VDTVKARLPVWKHQFFADGTDEWVG

SEQ ID NO: 122953 - protein, 18 aa, Mycobacterium avium
VDTVVILGALLADTPHTR

SEQ ID NO: 122954 - protein, 27 aa, Mycobacterium avium
VDVALAQHVLPFPAGQIVTRSGPFMAT

SEQ ID NO: 122955 - protein, 25 aa, Mycobacterium avium
VDVIPDVLRHRLVLTYDALADEISP

SEQ ID NO: 122956 - protein, 17 aa, Mycobacterium avium
VDVRCRATVGEVGNAEQ

SEQ ID NO: 122957 - protein, 24 aa, Mycobacterium avium
VDVSNAVVFLASDQARYITGTQIV

SEQ ID NO: 122958 - protein, 25 aa, Mycobacterium avium
VDWDELARWALIDKALGLDVPEPAE

SEQ ID NO: 122959 - protein, 18 aa, Mycobacterium avium
VEAFWGADWSREISVVAA

SEQ ID NO: 122960 - protein, 20 aa, Mycobacterium avium
VEAITLCRGLADGPLIAGGH

SEQ ID NO: 122961 - protein, 18 aa, Mycobacterium avium
VEALSALTYANLTRWLRG

SEQ ID NO: 122962 - protein, 24 aa, Mycobacterium avium
VEAQLYGDLMTILAALATAGGGDH

SEQ ID NO: 122963 - protein, 28 aa, Mycobacterium avium
VEEFRAGRIATIPLGRFADPVEIAHAAV

SEQ ID NO: 122964 - protein, 24 aa, Mycobacterium avium
VEELTLQAPLMLPAKDSGIGSVAV

SEQ ID NO: 122965 - protein, 20 aa, Mycobacterium avium
VEFIGRHFEIGPADRCLALS

SEQ ID NO: 122966 - protein, 24 aa, Mycobacterium avium
VEIGDLHWFYVYSGVMWACVFMRT

SEQ ID NO: 122967 - protein, 17 aa, Mycobacterium avium
VEIRYYSVIYQAIDEIE

SEQ ID NO: 122968 - protein, 26 aa, Mycobacterium avium
VELCSLTYPGYKPSLAGLVGSALFAD

SEQ ID NO: 122969 - protein, 19 aa, Mycobacterium avium
VELGLLKRRPYREPGQRSR

SEQ ID NO: 122970 - protein, 38 aa, Mycobacterium avium
VELPFLHKELYREYALRPPKGVLLYGPPGCGKTLIAKA

SEQ ID NO: 122971 - protein, 24 aa, Mycobacterium avium
VELPTYAFDRRRFWLSGEGAAADA

SEQ ID NO: 122972 - protein, 31 aa, Mycobacterium avium
VELSDLELFLLRITLALLSNRPILVVGDLEQ

SEQ ID NO: 122973 - protein, 21 aa, Mycobacterium avium
VENLLVMHPKLLDAAVFGVPN

SEQ ID NO: 122974 - protein, 19 aa, Mycobacterium avium
VEPDGFYRRLWQADDEDRD

SEQ ID NO: 122975 - protein, 17 aa, Mycobacterium avium
VEQIRRALLTHKVIFFR

SEQ ID NO: 122976 - protein, 24 aa, Mycobacterium avium
VERATKILGLLTAAAKSYSATIRL

SEQ ID NO: 122977 - protein, 20 aa, Mycobacterium avium
VESMISAMAQLYVYGHDLDI

SEQ ID NO: 122978 - protein, 29 aa, Mycobacterium avium
VESRDVTEAVLWLAGPRSRYVTGVAIPVD

SEQ ID NO: 122979 - protein, 20 aa, Mycobacterium avium
VESVRTWVRQADIDEGLAPG

SEQ ID NO: 122980 - protein, 21 aa, Mycobacterium avium
VEVAIIHRPRYDDWSLPKGKV

SEQ ID NO: 122981 - protein, 18 aa, Mycobacterium avium
VEVEPIARVLPMLSVPHL

SEQ ID NO: 122982 - protein, 17 aa, Mycobacterium avium
VFAAPYQVLNEPAMQAS

SEQ ID NO: 122983 - protein, 21 aa, Mycobacterium avium
VFAARPVRMSARRFWVRYAAE

SEQ ID NO: 122984 - protein, 22 aa, Mycobacterium avium
VFDLLLGARRAVLGNPAAARRV

SEQ ID NO: 122985 - protein, 18 aa, Mycobacterium avium
VFGGRLADKQGIQWMLVD

SEQ ID NO: 122986 - protein, 20 aa, Mycobacterium avium
VFHIHLHVLPRRNGDKLSVA

SEQ ID NO: 122987 - protein, 33 aa, Mycobacterium avium
VFIERLRYLGELPLSLDLTYLAPAIGRQVLEHS

SEQ ID NO: 122988 - protein, 18 aa, Mycobacterium avium
VFKRHFYTCFISDKVGVR

SEQ ID NO: 122989 - protein, 17 aa, Mycobacterium avium
VFLQLLGLPLEDLDRFL

SEQ ID NO: 122990 - protein, 17 aa, Mycobacterium avium
VFVLAATSNPEGATVQR

SEQ ID NO: 122991 - protein, 17 aa, Mycobacterium avium
VFVPPKFAKDAIIEAID

SEQ ID NO: 122992 - protein, 19 aa, Mycobacterium avium
VFWALDNYEADEEATLAAV

SEQ ID NO: 122993 - protein, 31 aa, Mycobacterium avium
VGAIRLPRRVGWANAMELLLTGKPMSAERAK

SEQ ID NO: 122994 - protein, 24 aa, Mycobacterium avium
VGATWYTAVPTIHQILLERARTEA

SEQ ID NO: 122995 - protein, 25 aa, Mycobacterium avium
VGDALYLGFLFLNEEADAYLVALTC

SEQ ID NO: 122996 - protein, 18 aa, Mycobacterium avium
VGDLFVVAVRTAPDRHKG

SEQ ID NO: 122997 - protein, 24 aa, Mycobacterium avium
VGEMTYLQWLQRYVELAIGDGDST

SEQ ID NO: 122998 - protein, 18 aa, Mycobacterium avium
VGFFKDPVQGFFRALQFT

SEQ ID NO: 122999 - protein, 29 aa, Mycobacterium avium
VGFFKNVMQLTHPAFLILDSPDGRNKGTR

SEQ ID NO: 123000 - protein, 20 aa, Mycobacterium avium
VGGFLAWGDPSLYDSTLRIL

SEQ ID NO: 123001 - protein, 19 aa, Mycobacterium avium
VGGRDVYLPPPASPAPEAP

SEQ ID NO: 123002 - protein, 26 aa, Mycobacterium avium
VGKGTLFRRFGSRAGLMMVLLDEDER

SEQ ID NO: 123003 - protein, 17 aa, Mycobacterium avium
VGLERKDGTAWLTENHS

SEQ ID NO: 123004 - protein, 20 aa, Mycobacterium avium
VGLHPFGRFEGKSAMEMAVD

SEQ ID NO: 123005 - protein, 31 aa, Mycobacterium avium
VGPSHHWIIRDMLGLPYQKPAAYTRDYLQVL

SEQ ID NO: 123006 - protein, 22 aa, Mycobacterium avium
VGQKFAREIFFLGREYTAEQMH

SEQ ID NO: 123007 - protein, 17 aa, Mycobacterium avium
VGQPPRLVAAAVNTPEY

SEQ ID NO: 123008 - protein, 19 aa, Mycobacterium avium
VGRLLFSTQLADPVVVRKR

SEQ ID NO: 123009 - protein, 27 aa, Mycobacterium avium
VGSGPVFLQYPWQVIPDELIKPLEEAA

SEQ ID NO: 123010 - protein, 26 aa, Mycobacterium avium
VGSLVTQLLVLRKARVLGIAGPGNAD

SEQ ID NO: 123011 - protein, 18 aa, Mycobacterium avium
VGSSFPYTQFLPEFGQCR

SEQ ID NO: 123012 - protein, 20 aa, Mycobacterium avium
VGTSMVWLVAPRHAEEWLRE

SEQ ID NO: 123013 - protein, 19 aa, Mycobacterium avium
VGTSPVGVFAPNAFGLLDM

SEQ ID NO: 123014 - protein, 18 aa, Mycobacterium avium
VGVDYYRPTGRGAEREMA

SEQ ID NO: 123015 - protein, 30 aa, Mycobacterium avium
VGVGYWRRPGLTAARFLACPFGEPGTRMYR

SEQ ID NO: 123016 - protein, 19 aa, Mycobacterium avium
VGWDSLWVYDHFHTVPVPT

SEQ ID NO: 123017 - protein, 33 aa, Mycobacterium avium
VGYIPLLTVAALPRPLRRLPLLGDRIAELLDAE

SEQ ID NO: 123018 - protein, 22 aa, Mycobacterium avium
VGYPREWRRRKPYGWLRQVLPD

SEQ ID NO: 123019 - protein, 19 aa, Mycobacterium avium
VHCVYKPVAGEAPLWDFPD

SEQ ID NO: 123020 - protein, 20 aa, Mycobacterium avium
VHEWRTWPGYSEQERLAAEF

SEQ ID NO: 123021 - protein, 25 aa, Mycobacterium avium
VHGGMIPLYYDWLFGMVVSGANCPP

SEQ ID NO: 123022 - protein, 19 aa, Mycobacterium avium
VHGRGVRLLINFSFNNEAF

SEQ ID NO: 123023 - protein, 26 aa, Mycobacterium avium
VHREDFQIILVDTPGLHRPRTLLGKR

SEQ ID NO: 123024 - protein, 27 aa, Mycobacterium avium
VHSLDGANLLPPLRPPANANPNILPAG

SEQ ID NO: 123025 - protein, 25 aa, Mycobacterium avium
VHSTTLYYPLVATPMIAPTKAYQGV

SEQ ID NO: 123026 - protein, 18 aa, Mycobacterium avium
VIACVRYQIRHGAKLIKV

SEQ ID NO: 123027 - protein, 24 aa, Mycobacterium avium
VIDLGEAILLPGLMDMEVNLLMGG

SEQ ID NO: 123028 - protein, 23 aa, Mycobacterium avium
VIDNALELLAPGGSLFIGDVRNH

SEQ ID NO: 123029 - protein, 24 aa, Mycobacterium avium
VIDSYRPGCWLDSGPFGCLGSGPG

SEQ ID NO: 123030 - protein, 30 aa, Mycobacterium avium
VIELGDWVRPVLLDGLAVLLLEPPRQQDNG

SEQ ID NO: 123031 - protein, 25 aa, Mycobacterium avium
VIETRYFVHLVTGPIAKNMIQAFFF

SEQ ID NO: 123032 - protein, 24 aa, Mycobacterium avium
VIFDRDAIFKVFRRVSSGINPDIE

SEQ ID NO: 123033 - protein, 25 aa, Mycobacterium avium
VIGFGGYVALPAYLAARGVSPRKPR

SEQ ID NO: 123034 - protein, 18 aa, Mycobacterium avium
VIGFNYLGRLGAAADLPG

SEQ ID NO: 123035 - protein, 24 aa, Mycobacterium avium
VIGTHRLLQTGVRWKDLGLVVVDE

SEQ ID NO: 123036 - protein, 38 aa, Mycobacterium avium
VINRRLQRPLIKLRPKLTSRQRWILSAATLSVIGSITD

SEQ ID NO: 123037 - protein, 17 aa, Mycobacterium avium
VIPDELVPGVPFSFDPT

SEQ ID NO: 123038 - protein, 31 aa, Mycobacterium avium
VIPLSFAQTRLWFIDQFQGPSPMYNITVALR

SEQ ID NO: 123039 - protein, 23 aa, Mycobacterium avium
VIRPVVAELQRKFSVSAAETGSH

SEQ ID NO: 123040 - protein, 18 aa, Mycobacterium avium
VIRQVTSITWCRRRTVQV

SEQ ID NO: 123041 - protein, 42 aa, Mycobacterium avium
VIVREQGHWYSTGADFKRPSPHWWFDPQDGGNLYGPGGVALP

SEQ ID NO: 123042 - protein, 22 aa, Mycobacterium avium
VKDPLYVLAGRDEGYVPFYDEY

SEQ ID NO: 123043 - protein, 25 aa, Mycobacterium avium
VKEVQSYVPGYRLLNEPQFDDPSLN

SEQ ID NO: 123044 - protein, 18 aa, Mycobacterium avium
VKHDVTIAAPLNLPATMP

SEQ ID NO: 123045 - protein, 24 aa, Mycobacterium avium
VKHRMMRWFGPIIHEYYGGTEGFA

SEQ ID NO: 123046 - protein, 28 aa, Mycobacterium avium
VKQALVYYYFPTMDDLFVEVLRAGAESA

SEQ ID NO: 123047 - protein, 25 aa, Mycobacterium avium
VKVAHAPLLALLTELMEAAGEAGKL

SEQ ID NO: 123048 - protein, 18 aa, Mycobacterium avium
VLAARGPLLCGELTLRRH

SEQ ID NO: 123049 - protein, 24 aa, Mycobacterium avium
VLAIKDMAGLLRAPAAATLVSALK

SEQ ID NO: 123050 - protein, 17 aa, Mycobacterium avium
VLAPRVPYRSDAITTRP

SEQ ID NO: 123051 - protein, 26 aa, Mycobacterium avium
VLAVLRKHFRLRPDPAPRGSAPAQLW

SEQ ID NO: 123052 - protein, 18 aa, Mycobacterium avium
VLAWHDALNASDLDTLIA

SEQ ID NO: 123053 - protein, 18 aa, Mycobacterium avium
VLCETFPTRLERGAGIPA

SEQ ID NO: 123054 - protein, 20 aa, Mycobacterium avium
VLDCAINWKLAIDTFAENYH

SEQ ID NO: 123055 - protein, 23 aa, Mycobacterium avium
VLDESQVYLALNKPRGVHSTMSD

SEQ ID NO: 123056 - protein, 25 aa, Mycobacterium avium
VLDRYDYVLIDCQPSLGLLTVNGLA

SEQ ID NO: 123057 - protein, 23 aa, Mycobacterium avium
VLEETGLLPHLNPGVMSWSEMAR

SEQ ID NO: 123058 - protein, 17 aa, Mycobacterium avium
VLEGRLEQLRTFEREYR

SEQ ID NO: 123059 - protein, 20 aa, Mycobacterium avium
VLGADFIMFASDYPHWDGEW

SEQ ID NO: 123060 - protein, 31 aa, Mycobacterium avium
VLGFRSRGAFRVPLPAEFGPIRVRFLGINAR

SEQ ID NO: 123061 - protein, 17 aa, Mycobacterium avium
VLGTPFFVMDYVDGLVP

SEQ ID NO: 123062 - protein, 18 aa, Mycobacterium avium
VLHSAALRRLADKTQVVG

SEQ ID NO: 123063 - protein, 20 aa, Mycobacterium avium
VLIPSPDYPLWTASTSLAGG

SEQ ID NO: 123064 - protein, 19 aa, Mycobacterium avium
VLLIGVGAFAPMALAVARR

SEQ ID NO: 123065 - protein, 26 aa, Mycobacterium avium
VLLLTAHVIALDPASWRVVLGELGAA

SEQ ID NO: 123066 - protein, 24 aa, Mycobacterium avium
VLLQDFYLIEQLAAFNRERVPERQ

SEQ ID NO: 123067 - protein, 23 aa, Mycobacterium avium
VLMAAYGISAERAFDILVWRSQE

SEQ ID NO: 123068 - protein, 45 aa, Mycobacterium avium
VLPARGAVDLGFRLAPPAWLDPGQWWALVRIGCAGELLYSPAVRV

SEQ ID NO: 123069 - protein, 20 aa, Mycobacterium avium
VLQAAWAVVLTSLTGRHDVV

SEQ ID NO: 123070 - protein, 17 aa, Mycobacterium avium
VLQIEGCKTWRVSDEPP

SEQ ID NO: 123071 - protein, 17 aa, Mycobacterium avium
VLRAFPQIAQHYRRRFR

SEQ ID NO: 123072 - protein, 19 aa, Mycobacterium avium
VLRVSWCTVLRSAGGELHR

SEQ ID NO: 123073 - protein, 20 aa, Mycobacterium avium
VLSRYVEAIVWRTFEQQRLE

SEQ ID NO: 123074 - protein, 20 aa, Mycobacterium avium
VLSWGRVWELTDEQWDTVIG

SEQ ID NO: 123075 - protein, 17 aa, Mycobacterium avium
VLTGWRMLLDNGRMQDG

SEQ ID NO: 123076 - protein, 17 aa, Mycobacterium avium
VLVNNVGHWLRHPGGFA

SEQ ID NO: 123077 - protein, 18 aa, Mycobacterium avium
VLWEAQFGDFVNGAQSII

SEQ ID NO: 123078 - protein, 19 aa, Mycobacterium avium
VMARVRIPHELRIPAPDRL

SEQ ID NO: 123079 - protein, 27 aa, Mycobacterium avium
VMPHEPKFPFFEYPYIVVLVELEEGVR

SEQ ID NO: 123080 - protein, 19 aa, Mycobacterium avium
VMRPEIELGPIRPPQRLAP

SEQ ID NO: 123081 - protein, 21 aa, Mycobacterium avium
VMRSLGLPTMFPTIGGHEGSG

SEQ ID NO: 123082 - protein, 26 aa, Mycobacterium avium
VNALSPSKPILTPGLSYYARDFDDTA

SEQ ID NO: 123083 - protein, 17 aa, Mycobacterium avium
VNCVGVFDFYRGVADID

SEQ ID NO: 123084 - protein, 18 aa, Mycobacterium avium
VNEELLARALRGRRDRVV

SEQ ID NO: 123085 - protein, 19 aa, Mycobacterium avium
VNGTLKQGISSENAKKITK

SEQ ID NO: 123086 - protein, 31 aa, Mycobacterium avium
VNRYLPRFIRQFPFNVLLYDLDRRIRKGRPL

SEQ ID NO: 123087 - protein, 17 aa, Mycobacterium avium
VNTLVLRVDLAGDPSFT

SEQ ID NO: 123088 - protein, 29 aa, Mycobacterium avium
VPADRVLAALHGWLAPLPPEGASAIVFRD

SEQ ID NO: 123089 - protein, 19 aa, Mycobacterium avium
VPAMFTRMLKLPEAVRHSY

SEQ ID NO: 123090 - protein, 23 aa, Mycobacterium avium
VPDAIEPVDDLPRRAHRGQVDGT

SEQ ID NO: 123091 - protein, 26 aa, Mycobacterium avium
VPDGEDLSWLWDVRFEHFNDAFQTTP

SEQ ID NO: 123092 - protein, 36 aa, Mycobacterium avium
VPEVFDLRPGAIIRDLDLLRPIYAQTAAYGHFGRTD

SEQ ID NO: 123093 - protein, 28 aa, Mycobacterium avium
VPFFTDYARRYTDLPFLIKLEERGDMLV

SEQ ID NO: 123094 - protein, 18 aa, Mycobacterium avium
VPGAYVAGWIKRGPSGFI

SEQ ID NO: 123095 - protein, 25 aa, Mycobacterium avium
VPGFPNLFTVFGPYGYVGSSYFALI

SEQ ID NO: 123096 - protein, 19 aa, Mycobacterium avium
VPGPFLCEPSPQRTPVLFQ

SEQ ID NO: 123097 - protein, 20 aa, Mycobacterium avium
VPGPPFPLYMAGAKLDSLVP

SEQ ID NO: 123098 - protein, 17 aa, Mycobacterium avium
VPLPALGRLVTGIAAIA

SEQ ID NO: 123099 - protein, 23 aa, Mycobacterium avium
VPMATTWAAVPTCAALAAAGRYS

SEQ ID NO: 123100 - protein, 46 aa, Mycobacterium avium
VPPGRLGWGWAKFAFNGWKTLSWVDANIWRRVVPKGWFYNVMVTGV

SEQ ID NO: 123101 - protein, 18 aa, Mycobacterium avium
VPPPLIAANRMQVSQLQA

SEQ ID NO: 123102 - protein, 31 aa, Mycobacterium avium
VPQLSTITPRWLLHLLNWVPVEAGIYRVNRV

SEQ ID NO: 123103 - protein, 25 aa, Mycobacterium avium
VPQVMPNWHYLHIHNDVIPALKQRG

SEQ ID NO: 123104 - protein, 17 aa, Mycobacterium avium
VPRGISFLLNRNRLNVA

SEQ ID NO: 123105 - protein, 19 aa, Mycobacterium avium
VPRLAFPTPSGRAVFFARP

SEQ ID NO: 123106 - protein, 17 aa, Mycobacterium avium
VPRRGYVPSLACARCRT

SEQ ID NO: 123107 - protein, 27 aa, Mycobacterium avium
VPSKTFIASTWLRTELRRAPRLGFEID

SEQ ID NO: 123108 - protein, 26 aa, Mycobacterium avium
VPTELVDVVLAIVRNRPLRPVARITT

SEQ ID NO: 123109 - protein, 29 aa, Mycobacterium avium
VPVFAIRDPMKFPNLIRAGGRRADNDLHD

SEQ ID NO: 123110 - protein, 28 aa, Mycobacterium avium
VPVPHAPIAEYFVWFGDEYRIDETDRLL

SEQ ID NO: 123111 - protein, 26 aa, Mycobacterium avium
VPVSGTWVEIPFTLPPNTIDGGTPVV

SEQ ID NO: 123112 - protein, 21 aa, Mycobacterium avium
VPWQELARRTGASLRWYGVTD

SEQ ID NO: 123113 - protein, 20 aa, Mycobacterium avium
VQAALPGMLDAEWGRIVNVT

SEQ ID NO: 123114 - protein, 23 aa, Mycobacterium avium
VQDAWLRWHGQDGAITDLRAWLT

SEQ ID NO: 123115 - protein, 17 aa, Mycobacterium avium
VQEDVAVVGLSILSGAH

SEQ ID NO: 123116 - protein, 19 aa, Mycobacterium avium
VQENQHVLQRFTISQLQQL

SEQ ID NO: 123117 - protein, 28 aa, Mycobacterium avium
VQGGLNWDSLPLKLFAGGNAKFWNPADI

SEQ ID NO: 123118 - protein, 18 aa, Mycobacterium avium
VQIGGGLLLATGKLPRVA

SEQ ID NO: 123119 - protein, 18 aa, Mycobacterium avium
VQIGRRLARLARTHQVIV

SEQ ID NO: 123120 - protein, 27 aa, Mycobacterium avium
VRAGATHAFFVPPVIARFLDAGEAARA

SEQ ID NO: 123121 - protein, 23 aa, Mycobacterium avium
VRAIWEMYTGWFRHRSTTELYGV

SEQ ID NO: 123122 - protein, 23 aa, Mycobacterium avium
VRAWAFRRVGGFSPILHFRGEET

SEQ ID NO: 123123 - protein, 18 aa, Mycobacterium avium
VRCRATVGEVGNAEQANI

SEQ ID NO: 123124 - protein, 25 aa, Mycobacterium avium
VRDEVEPLEVLFPGCEFLPLNDERR

SEQ ID NO: 123125 - protein, 17 aa, Mycobacterium avium
VRDFVYIDDVVDALFAA

SEQ ID NO: 123126 - protein, 25 aa, Mycobacterium avium
VRDRGRLRYPHWVPAAVAPEQVVRH

SEQ ID NO: 123127 - protein, 23 aa, Mycobacterium avium
VRDRLRGWRFYDGFRVDAGAPAR

SEQ ID NO: 123128 - protein, 17 aa, Mycobacterium avium
VREQLDRLGATRTRIVV

SEQ ID NO: 123129 - protein, 25 aa, Mycobacterium avium
VRGGKQPRILFATQAAARPPTFVLF

SEQ ID NO: 123130 - protein, 25 aa, Mycobacterium avium
VRKLAGFWGHAWQSAVFPSGKAFGY

SEQ ID NO: 123131 - protein, 23 aa, Mycobacterium avium
VRKSGVLPYLRPDGKTQVTIEYE

SEQ ID NO: 123132 - protein, 18 aa, Mycobacterium avium
VRLELRLVDRDEPQGSIY

SEQ ID NO: 123133 - protein, 17 aa, Mycobacterium avium
VRLIYDAPRRGTANSRI

SEQ ID NO: 123134 - protein, 18 aa, Mycobacterium avium
VRPPRGLAAAELATLLRS

SEQ ID NO: 123135 - protein, 17 aa, Mycobacterium avium
VRPYWEAGFTDIALVQI

SEQ ID NO: 123136 - protein, 17 aa, Mycobacterium avium
VRQYGLAKLGFTQSYTY

SEQ ID NO: 123137 - protein, 25 aa, Mycobacterium avium
VRRARFAAAFTFQYSKRPGTPAAEL

SEQ ID NO: 123138 - protein, 18 aa, Mycobacterium avium
VRRRGGVLVLFTSPELQD

SEQ ID NO: 123139 - protein, 17 aa, Mycobacterium avium
VRTAVDPALSPLAVEWT

SEQ ID NO: 123140 - protein, 17 aa, Mycobacterium avium
VRTPMISPTTLYDKFPA

SEQ ID NO: 123141 - protein, 23 aa, Mycobacterium avium
VRTRLVGLQREMASGPGSIVVEG

SEQ ID NO: 123142 - protein, 18 aa, Mycobacterium avium
VRVEGVPYGLIANSTHHL

SEQ ID NO: 123143 - protein, 19 aa, Mycobacterium avium
VRVEVKIPLVGRKLEKTIG

SEQ ID NO: 123144 - protein, 28 aa, Mycobacterium avium
VRVSDRIDFWLWLDAGFGDHAIEAWVIE

SEQ ID NO: 123145 - protein, 27 aa, Mycobacterium avium
VRVSRYSYLVSLLPPRIIDDLGARVRL

SEQ ID NO: 123146 - protein, 23 aa, Mycobacterium avium
VRWFDIEPCYVYHPLNAYSEIRD

SEQ ID NO: 123147 - protein, 26 aa, Mycobacterium avium
VRWPDIVSRVFGRIDPIALSGEEYRR

SEQ ID NO: 123148 - protein, 33 aa, Mycobacterium avium
VSARTLTIAPKDPLPLVIFSEPCTLREPAFAIL

SEQ ID NO: 123149 - protein, 24 aa, Mycobacterium avium
VSEAYFAALLGLPFVAVMPESTSA

SEQ ID NO: 123150 - protein, 26 aa, Mycobacterium avium
VSEFAARRWQWHDLDVSRTALVPDVM

SEQ ID NO: 123151 - protein, 19 aa, Mycobacterium avium
VSEFVCRLLNYMDAKGFDF

SEQ ID NO: 123152 - protein, 24 aa, Mycobacterium avium
VSGPSFLGWEHPPAAAASVTAPAK

SEQ ID NO: 123153 - protein, 17 aa, Mycobacterium avium
VSGRDLLAVCERLIGMT

SEQ ID NO: 123154 - protein, 18 aa, Mycobacterium avium
VSGTAPIYAILRDAKERA

SEQ ID NO: 123155 - protein, 29 aa, Mycobacterium avium
VSIFSATRYEWAILDLAILAVGAVTVPIY

SEQ ID NO: 123156 - protein, 27 aa, Mycobacterium avium
VSIGTEALTLLLIEYGRSAAGWAQRVV

SEQ ID NO: 123157 - protein, 24 aa, Mycobacterium avium
VSISVGCNNSCTFCIVPSLRGKEV

SEQ ID NO: 123158 - protein, 28 aa, Mycobacterium avium
VSLCILDERWPFSYLQVYADAALDEDRE

SEQ ID NO: 123159 - protein, 20 aa, Mycobacterium avium
VSLFGAQFITWRGIPLIPSD

SEQ ID NO: 123160 - protein, 26 aa, Mycobacterium avium
VSLHRQWLLVELRSDWTLGTRTYAAG

SEQ ID NO: 123161 - protein, 26 aa, Mycobacterium avium
VSLSEGNYRCRVGHAWTAEALLSARD

SEQ ID NO: 123162 - protein, 29 aa, Mycobacterium avium
VSLSPTEFTLLRYFVINAGTVLSKPKILD

SEQ ID NO: 123163 - protein, 26 aa, Mycobacterium avium
VSQRHRGEIAFIHYAPTPAEACYRDE

SEQ ID NO: 123164 - protein, 31 aa, Mycobacterium avium
VSRFIGLGRGYRWLQLIDAAGLPVHDVRRLF

SEQ ID NO: 123165 - protein, 23 aa, Mycobacterium avium
VSRPTGAVFIKGTALWLESAVEQ

SEQ ID NO: 123166 - protein, 17 aa, Mycobacterium avium
VSSTPEGFIDLLKAMRP

SEQ ID NO: 123167 - protein, 23 aa, Mycobacterium avium
VSTDLTPELLQRSRDRAAGMGLT

SEQ ID NO: 123168 - protein, 25 aa, Mycobacterium avium
VSTFTPDPVPLPIIGPPGTAELVAA

SEQ ID NO: 123169 - protein, 27 aa, Mycobacterium avium
VSTIMQPGMTFTIEPMINLGGLDYEIW

SEQ ID NO: 123170 - protein, 24 aa, Mycobacterium avium
VSTPLGLLDCDVPIDGSIAVVVSH

SEQ ID NO: 123171 - protein, 24 aa, Mycobacterium avium
VSVGDYHIPKMVGWTLLGRPVDDA

SEQ ID NO: 123172 - protein, 23 aa, Mycobacterium avium
VTANGRFTIAAYAAPKTGGLWRE

SEQ ID NO: 123173 - protein, 17 aa, Mycobacterium avium
VTAPLRGPGLDKLRALA

SEQ ID NO: 123174 - protein, 18 aa, Mycobacterium avium
VTATLFEVLSRHGVELLN

SEQ ID NO: 123175 - protein, 23 aa, Mycobacterium avium
VTAVQPYVQWMHTTAGQLQQAAA

SEQ ID NO: 123176 - protein, 19 aa, Mycobacterium avium
VTCLLGAASLLAGAREHWR

SEQ ID NO: 123177 - protein, 28 aa, Mycobacterium avium
VTDSIPALHLLPMAGVLGVLPVLATDVL

SEQ ID NO: 123178 - protein, 27 aa, Mycobacterium avium
VTDYRQILEFFFQIHDPTTKDRQGNDR

SEQ ID NO: 123179 - protein, 23 aa, Mycobacterium avium
VTEPLLFEWTDRDTLLYALGVGA

SEQ ID NO: 123180 - protein, 17 aa, Mycobacterium avium
VTFRLDDIVPGLGASRA

SEQ ID NO: 123181 - protein, 31 aa, Mycobacterium avium
VTGHDALFDTLFLYENYPIDTSVPLGFHELA

SEQ ID NO: 123182 - protein, 17 aa, Mycobacterium avium
VTLDTWIPGWRPRDLST

SEQ ID NO: 123183 - protein, 25 aa, Mycobacterium avium
VTLRAQDVLPGDLFAALPGATTHGA

SEQ ID NO: 123184 - protein, 23 aa, Mycobacterium avium
VTRMLVRVPRRDGLALAAALRRG

SEQ ID NO: 123185 - protein, 23 aa, Mycobacterium avium
VTRPNAREHLAFASGIHACLGAA

SEQ ID NO: 123186 - protein, 17 aa, Mycobacterium avium
VTSLGLVQLTRKRLGTG

SEQ ID NO: 123187 - protein, 23 aa, Mycobacterium avium
VTTPGSALLFPSLCVPTGEPARP

SEQ ID NO: 123188 - protein, 33 aa, Mycobacterium avium
VVAAIVPWNMPQFLIVTKLIPALLAGCTVVLKP

SEQ ID NO: 123189 - protein, 18 aa, Mycobacterium avium
VVALISTGGLPKGDALAT

SEQ ID NO: 123190 - protein, 18 aa, Mycobacterium avium
VVALTRFAGYLADIGVES

SEQ ID NO: 123191 - protein, 26 aa, Mycobacterium avium
VVARIDWTRFLPLYQQAGQRSLLAEL

SEQ ID NO: 123192 - protein, 27 aa, Mycobacterium avium
VVATGRPPRWIRPVVDALGFAPIAVCA

SEQ ID NO: 123193 - protein, 18 aa, Mycobacterium avium
VVAVRTAPDRHKGLSLLV

SEQ ID NO: 123194 - protein, 27 aa, Mycobacterium avium
VVDICADLPAIPYALGTDAELAETVRL

SEQ ID NO: 123195 - protein, 18 aa, Mycobacterium avium
VVDKALTSVPKALAVLAQ

SEQ ID NO: 123196 - protein, 18 aa, Mycobacterium avium
VVEALKFHLRDLAVTFRF

SEQ ID NO: 123197 - protein, 22 aa, Mycobacterium avium
VVERYLQCLAAHDWDGLAGTIA

SEQ ID NO: 123198 - protein, 26 aa, Mycobacterium avium
VVGGVRLPHGNGETIRLARGASLSDF

SEQ ID NO: 123199 - protein, 18 aa, Mycobacterium avium
VVLALQHDKLPPSINFAG

SEQ ID NO: 123200 - protein, 17 aa, Mycobacterium avium
VVLHYFLHAEPTGVAAW

SEQ ID NO: 123201 - protein, 18 aa, Mycobacterium avium
VVLNWRAVCGQCRACKRG

SEQ ID NO: 123202 - protein, 19 aa, Mycobacterium avium
VVLVDGELAWFLERGGRSL

SEQ ID NO: 123203 - protein, 22 aa, Mycobacterium avium
VVMPVLKKWRIFEREDFTGEAA

SEQ ID NO: 123204 - protein, 26 aa, Mycobacterium avium
VVPAAADPVSLLAAARFAQHGQAFQA

SEQ ID NO: 123205 - protein, 23 aa, Mycobacterium avium
VVPADPVMAWRYIQLGPEDVDPE

SEQ ID NO: 123206 - protein, 17 aa, Mycobacterium avium
VVPAGQWRPYGRRVRVL

SEQ ID NO: 123207 - protein, 33 aa, Mycobacterium avium
VVPHFEKMLYDNALLLRVYAHWARRTGDPLAAR

SEQ ID NO: 123208 - protein, 17 aa, Mycobacterium avium
VVPPSWRPDLLQPADLV

SEQ ID NO: 123209 - protein, 18 aa, Mycobacterium avium
VVQAAFAALLAKVSASSD

SEQ ID NO: 123210 - protein, 17 aa, Mycobacterium avium
VVQAALAVLLSKIGASS

SEQ ID NO: 123211 - protein, 21 aa, Mycobacterium avium
VVRAAALYVLAARRAGDAARY

SEQ ID NO: 123212 - protein, 33 aa, Mycobacterium avium
VVRRGDTPLPVRTPLPVQLPEPMAQQLREAAAA

SEQ ID NO: 123213 - protein, 26 aa, Mycobacterium avium
VVTSPGFAPTAPLPLAAAAAGVPVWG

SEQ ID NO: 123214 - protein, 19 aa, Mycobacterium avium
VVVGLPRTLADRTGTSALD

SEQ ID NO: 123215 - protein, 28 aa, Mycobacterium avium
VVVLDHPNPFLAAVLRRLAPRARVRVGA

SEQ ID NO: 123216 - protein, 23 aa, Mycobacterium avium
VVVVSIFVNPLQFGAGEDLDAYP

SEQ ID NO: 123217 - protein, 18 aa, Mycobacterium avium
VWFEIHVNPLVDAENGLL

SEQ ID NO: 123218 - protein, 29 aa, Mycobacterium avium
VWGEVIFPSLGMWASTFRTPELLKACMRA

SEQ ID NO: 123219 - protein, 18 aa, Mycobacterium avium
VWVPRRAGDRGALEAGAL

SEQ ID NO: 123220 - protein, 22 aa, Mycobacterium avium
VYACPFAIHDRFLAGNVLSDGG

SEQ ID NO: 123221 - protein, 17 aa, Mycobacterium avium
VYDAAAAWARRFLDGPR

SEQ ID NO: 123222 - protein, 18 aa, Mycobacterium avium
VYRDATWVSSYRIDPFDV

SEQ ID NO: 123223 - protein, 17 aa, Mycobacterium avium
VYTYWDYTALRFPKRQG

SEQ ID NO: 123224 - protein, 20 aa, Mycobacterium avium
VYVRSFYFQDPDGITLEFAC

SEQ ID NO: 123225 - protein, 17 aa, Mycobacterium avium
WAALRTLAADPAACLDG

SEQ ID NO: 123226 - protein, 19 aa, Mycobacterium avium
WADRGLRVIGLDAGGDTTL

SEQ ID NO: 123227 - protein, 26 aa, Mycobacterium avium
WAEGRRYLGLDILTRCRLTTITDDNP

SEQ ID NO: 123228 - protein, 17 aa, Mycobacterium avium
WAQMLAVWQAADDIDVY

SEQ ID NO: 123229 - protein, 35 aa, Mycobacterium avium
WARQAEWHQALYREGFFGLSWPREYGGQELAPVYD

SEQ ID NO: 123230 - protein, 26 aa, Mycobacterium avium
WAVSSPRVLSELFWIGRYGERAESMA

SEQ ID NO: 123231 - protein, 26 aa, Mycobacterium avium
WCGYCHRLMTVLKSNGIPYEAVDIEH

SEQ ID NO: 123232 - protein, 18 aa, Mycobacterium avium
WDIFSCVRLVLDVLDPVP

SEQ ID NO: 123233 - protein, 25 aa, Mycobacterium avium
WDINTPAFEWYYQSGLSVIMPVGGQ

SEQ ID NO: 123234 - protein, 17 aa, Mycobacterium avium
WDMPLHSDELMRTSIQD

SEQ ID NO: 123235 - protein, 41 aa, Mycobacterium avium
WDSAFAQRHWGGLLAPPALLMGWLIAPPWQPDGRPSASLIA

SEQ ID NO: 123236 - protein, 19 aa, Mycobacterium avium
WDYFPGHFDPDYARAQGNP

SEQ ID NO: 123237 - protein, 27 aa, Mycobacterium avium
WEHDLHLYLRRVTLYRGMFGTPEEHNL

SEQ ID NO: 123238 - protein, 19 aa, Mycobacterium avium
WEIIDRCLQLHGGYGYINE

SEQ ID NO: 123239 - protein, 31 aa, Mycobacterium avium
WFGPSSMSMLAAVTPYLTWLTDTATRAEEAA

SEQ ID NO: 123240 - protein, 17 aa, Mycobacterium avium
WFREQFARLDYLQAQAA

SEQ ID NO: 123241 - protein, 29 aa, Mycobacterium avium
WGPNAIHQLIAPNAWRLPFEREWRDPRPY

SEQ ID NO: 123242 - protein, 17 aa, Mycobacterium avium
WGQVLRRQPLPLSLLAT

SEQ ID NO: 123243 - protein, 18 aa, Mycobacterium avium
WGRRHLPGRHRLQLTHVG

SEQ ID NO: 123244 - protein, 18 aa, Mycobacterium avium
WHCRGVAFTPKHGGRIVV

SEQ ID NO: 123245 - protein, 17 aa, Mycobacterium avium
WHGLLDNDDFRRAWLVR

SEQ ID NO: 123246 - protein, 20 aa, Mycobacterium avium
WHNFVAFRGRELAPEGRLVA

SEQ ID NO: 123247 - protein, 19 aa, Mycobacterium avium
WHTDVTFAANYPAASILRA

SEQ ID NO: 123248 - protein, 17 aa, Mycobacterium avium
WIPTAVDGRLRAACALI

SEQ ID NO: 123249 - protein, 19 aa, Mycobacterium avium
WIRRRLHETAVHRADAAIA

SEQ ID NO: 123250 - protein, 20 aa, Mycobacterium avium
WKYLMAKFNATIDERADPKV

SEQ ID NO: 123251 - protein, 21 aa, Mycobacterium avium
WLADHAVGGVVLFPGAGFVEL

SEQ ID NO: 123252 - protein, 17 aa, Mycobacterium avium
WLRDVAAMLGYHAGAQS

SEQ ID NO: 123253 - protein, 24 aa, Mycobacterium avium
WLREGPLIRLASAKGFRVIVTLHG

SEQ ID NO: 123254 - protein, 18 aa, Mycobacterium avium
WLRGATVVRGYLGDPAIT

SEQ ID NO: 123255 - protein, 18 aa, Mycobacterium avium
WNRHLAVNLTGTFLCLQA

SEQ ID NO: 123256 - protein, 17 aa, Mycobacterium avium
WPDDHIVWGVLSEQVRE

SEQ ID NO: 123257 - protein, 20 aa, Mycobacterium avium
WPHPPEALGPRYVAAMGGID

SEQ ID NO: 123258 - protein, 20 aa, Mycobacterium avium
WPKVLPARRLPGYLRRFTRF

SEQ ID NO: 123259 - protein, 27 aa, Mycobacterium avium
WQAVGNGVLFPFAATYMKLYACASPAD

SEQ ID NO: 123260 - protein, 18 aa, Mycobacterium avium
WRAGRLPVESLVSSTIRL

SEQ ID NO: 123261 - protein, 19 aa, Mycobacterium avium
WRGEAIRIGFVARTILEPG

SEQ ID NO: 123262 - protein, 27 aa, Mycobacterium avium
WRHPLGHRWRWEFESLSPTRTRVTETF

SEQ ID NO: 123263 - protein, 17 aa, Mycobacterium avium
WRSARLIVTIRSGEPVL

SEQ ID NO: 123264 - protein, 24 aa, Mycobacterium avium
WSDFGFHEYLEVKSILGYAPAQGD

SEQ ID NO: 123265 - protein, 23 aa, Mycobacterium avium
WSPKRLPESLLHYMRTRGQDKVI

SEQ ID NO: 123266 - protein, 23 aa, Mycobacterium avium
WSQLPGRERAKILWRIGDLIDEH

SEQ ID NO: 123267 - protein, 20 aa, Mycobacterium avium
WSQMAVIVRSVPRAGARLPR

SEQ ID NO: 123268 - protein, 23 aa, Mycobacterium avium
WSQWHSLVFDVSVWETWGALLHG

SEQ ID NO: 123269 - protein, 18 aa, Mycobacterium avium
WSRWPLQRMALSRYADRQ

SEQ ID NO: 123270 - protein, 27 aa, Mycobacterium avium
WSSNSRFLLNVPLFGRQPLHPDVDALV

SEQ ID NO: 123271 - protein, 33 aa, Mycobacterium avium
WSYIGAENIALPSIYYAHRRKVFRRDGMLLAVD

SEQ ID NO: 123272 - protein, 18 aa, Mycobacterium avium
WTAQRDTNLALLPVGYAD

SEQ ID NO: 123273 - protein, 17 aa, Mycobacterium avium
WTATLKPHYVRITPTEV

SEQ ID NO: 123274 - protein, 17 aa, Mycobacterium avium
WTDGPLTRAVKAGAICY

SEQ ID NO: 123275 - protein, 22 aa, Mycobacterium avium
WTGRKIGELVSEPLWKVVQAHP

SEQ ID NO: 123276 - protein, 30 aa, Mycobacterium avium
WTKDHPKKLWRPKVPIIVLVGEPIQPTLGV

SEQ ID NO: 123277 - protein, 26 aa, Mycobacterium avium
WTQFHSYAFDFSVWEIWGALLHGGRL

SEQ ID NO: 123278 - protein, 19 aa, Mycobacterium avium
WTVGLQWWRRFGPDRPLHG

SEQ ID NO: 123279 - protein, 26 aa, Mycobacterium avium
WVAHTLHALAWMVPGELAVFGLGELE

SEQ ID NO: 123280 - protein, 37 aa, Mycobacterium avium
WVDDMHDWCISRQLWWGHRIPIWYGPNGEQRCVGPDE

SEQ ID NO: 123281 - protein, 27 aa, Mycobacterium avium
WVHAHGDLALPDLAYTLARRRVHRPVR

SEQ ID NO: 123282 - protein, 17 aa, Mycobacterium avium
WVIPGADHYLQCDAPAQ

SEQ ID NO: 123283 - protein, 17 aa, Mycobacterium avium
WVTLLRSAGAHDTYLRT

SEQ ID NO: 123284 - protein, 18 aa, Mycobacterium avium
WVTPWSLLVEIPGLLAWR

SEQ ID NO: 123285 - protein, 17 aa, Mycobacterium avium
WWAQRFGIEPDLAEALV

SEQ ID NO: 123286 - protein, 24 aa, Mycobacterium avium
WYGTLDAIVAGRLDPLPSVGKIIG

SEQ ID NO: 123287 - protein, 17 aa, Mycobacterium avium
YACHAIDLMNFIAGVPH

SEQ ID NO: 123288 - protein, 25 aa, Mycobacterium avium
YADEDAIAPLWKGSRFPMTSCISGW

SEQ ID NO: 123289 - protein, 21 aa, Mycobacterium avium
YADRRRRLCGALAERGVDAHG

SEQ ID NO: 123290 - protein, 17 aa, Mycobacterium avium
YAERRRISWRSGGGSPH

SEQ ID NO: 123291 - protein, 17 aa, Mycobacterium avium
YALVVTSPGFAPTAPLP

SEQ ID NO: 123292 - protein, 22 aa, Mycobacterium avium
YANFLSILDEGRIAIAALATGA

SEQ ID NO: 123293 - protein, 25 aa, Mycobacterium avium
YAVSKSFVKWYSQSQAERFNARGLR

SEQ ID NO: 123294 - protein, 18 aa, Mycobacterium avium
YCAGGWYTGDTLDITTAT

SEQ ID NO: 123295 - protein, 20 aa, Mycobacterium avium
YCRTHHLVKTFWGWREQQLP

SEQ ID NO: 123296 - protein, 26 aa, Mycobacterium avium
YDADDPEWLRWNYATVVWGIATAHEL

SEQ ID NO: 123297 - protein, 22 aa, Mycobacterium avium
YDALMRMLKTCQVRLEDDVREL

SEQ ID NO: 123298 - protein, 20 aa, Mycobacterium avium
YDALWTGRRFVVQDTGGWEP

SEQ ID NO: 123299 - protein, 25 aa, Mycobacterium avium
YDDPEKWMYAAWMQLTDKGEQLARS

SEQ ID NO: 123300 - protein, 24 aa, Mycobacterium avium
YDEDQRWIVLARGRLRIVCNLGAE

SEQ ID NO: 123301 - protein, 23 aa, Mycobacterium avium
YDELLRFEKTLMAIWRAIQSAGR

SEQ ID NO: 123302 - protein, 20 aa, Mycobacterium avium
YDFFGIIFDGHPSLTRIEMP

SEQ ID NO: 123303 - protein, 29 aa, Mycobacterium avium
YDLKKWIDWSVDLYYWSPSYSQIYTELKK

SEQ ID NO: 123304 - protein, 19 aa, Mycobacterium avium
YDRAWWFARFVADSYGPPK

SEQ ID NO: 123305 - protein, 30 aa, Mycobacterium avium
YDRGFFDDLVTPFLGLYRDDNLRPDSSPEK

SEQ ID NO: 123306 - protein, 17 aa, Mycobacterium avium
YDVLVGINLLREGLDLP

SEQ ID NO: 123307 - protein, 26 aa, Mycobacterium avium
YDVSDEFFALFLDPTMAYTCAFFERD

SEQ ID NO: 123308 - protein, 23 aa, Mycobacterium avium
YEARHRPGWLPIPLRSIARLTAA

SEQ ID NO: 123309 - protein, 27 aa, Mycobacterium avium
YERTYQVNYLAPFLLTTQLLDVLLESR

SEQ ID NO: 123310 - protein, 20 aa, Mycobacterium avium
YFGEELVLFRTASGRVHVMD

SEQ ID NO: 123311 - protein, 17 aa, Mycobacterium avium
YFNDHGAQIDRFASSLI

SEQ ID NO: 123312 - protein, 21 aa, Mycobacterium avium
YFTEGLKLMKAAWSDDPRVTF

SEQ ID NO: 123313 - protein, 25 aa, Mycobacterium avium
YGAAKLGLVGLINSLALEGAKYNIH

SEQ ID NO: 123314 - protein, 19 aa, Mycobacterium avium
YGAWNLHQATAGQPLEWFC

SEQ ID NO: 123315 - protein, 29 aa, Mycobacterium avium
YGDQLPAPATYRSYLTWLAGQDRSAAQAA

SEQ ID NO: 123316 - protein, 17 aa, Mycobacterium avium
YGLAGHRVLRMSPESAE

SEQ ID NO: 123317 - protein, 31 aa, Mycobacterium avium
YGQGGGIAHRLGMRPSWVLDLNNGGCAAFVL

SEQ ID NO: 123318 - protein, 19 aa, Mycobacterium avium
YGQLAWSLRSDARVVVVER

SEQ ID NO: 123319 - protein, 23 aa, Mycobacterium avium
YHDRLPPIWIGASGPRMLDIAGR

SEQ ID NO: 123320 - protein, 18 aa, Mycobacterium avium
YHIRPWRVSPPGGRRELD

SEQ ID NO: 123321 - protein, 18 aa, Mycobacterium avium
YHLRRSALPEPGRVRDLL

SEQ ID NO: 123322 - protein, 17 aa, Mycobacterium avium
YHRQWQPKIPLGRMGRP

SEQ ID NO: 123323 - protein, 28 aa, Mycobacterium avium
YHSVWLPDHMVSFWPDSIWAPEFTDLAT

SEQ ID NO: 123324 - protein, 24 aa, Mycobacterium avium
YHTAWAAIPHLLAGNRGGVIIFTS

SEQ ID NO: 123325 - protein, 19 aa, Mycobacterium avium
YHTFGGWKRSGFGDLNQHG

SEQ ID NO: 123326 - protein, 20 aa, Mycobacterium avium
YHTFGGWKRSGFGDLNQHGP

SEQ ID NO: 123327 - protein, 17 aa, Mycobacterium avium
YIATDVYARYFRMTGRN

SEQ ID NO: 123328 - protein, 18 aa, Mycobacterium avium
YIPMRPNGQLLPRVPGPL

SEQ ID NO: 123329 - protein, 17 aa, Mycobacterium avium
YIVDRRVDMIISGGANV

SEQ ID NO: 123330 - protein, 22 aa, Mycobacterium avium
YKAYALVRQLTRFQPRSRLYVA

SEQ ID NO: 123331 - protein, 26 aa, Mycobacterium avium
YKLDRSRPLWEMWVIEGLDGNAGGRF

SEQ ID NO: 123332 - protein, 17 aa, Mycobacterium avium
YKLYKRYASHEGGIADT

SEQ ID NO: 123333 - protein, 19 aa, Mycobacterium avium
YLAIFDQGKALALYHTKRL

SEQ ID NO: 123334 - protein, 29 aa, Mycobacterium avium
YLDGMLLPEVILANRLFPALTFGGSNLNF

SEQ ID NO: 123335 - protein, 19 aa, Mycobacterium avium
YLHAKSREQVPETLWPVLK

SEQ ID NO: 123336 - protein, 19 aa, Mycobacterium avium
YLHTARWTSLGLSLIEAML

SEQ ID NO: 123337 - protein, 18 aa, Mycobacterium avium
YLLDVALQRAVDAGWHAG

SEQ ID NO: 123338 - protein, 24 aa, Mycobacterium avium
YLNRELSWLDFNARVLALADDNSL

SEQ ID NO: 123339 - protein, 19 aa, Mycobacterium avium
YLRELAFRDFYADVLHHRP

SEQ ID NO: 123340 - protein, 17 aa, Mycobacterium avium
YLTGDFLAYYTKFTEQI

SEQ ID NO: 123341 - protein, 18 aa, Mycobacterium avium
YLYTTSLMHCMTVSLAAD

SEQ ID NO: 123342 - protein, 23 aa, Mycobacterium avium
YMPPAPTRAFFQWASARDGHNKI

SEQ ID NO: 123343 - protein, 20 aa, Mycobacterium avium
YNDLHLTLKHIHWNVVGPNF

SEQ ID NO: 123344 - protein, 20 aa, Mycobacterium avium
YPETRWRFEYSPESYTGTEL

SEQ ID NO: 123345 - protein, 17 aa, Mycobacterium avium
YPSMPIAAAQAGADLVL

SEQ ID NO: 123346 - protein, 17 aa, Mycobacterium avium
YQRLFSLRIGQTLREQF

SEQ ID NO: 123347 - protein, 20 aa, Mycobacterium avium
YRAERFLGIIDRVRAAMPHA

SEQ ID NO: 123348 - protein, 27 aa, Mycobacterium avium
YRGCMRGRTMWVVPFCMGPLGAEDPKL

SEQ ID NO: 123349 - protein, 18 aa, Mycobacterium avium
YRLGEWVIPRGYSIIVGI

SEQ ID NO: 123350 - protein, 24 aa, Mycobacterium avium
YRRLRAWLTRLYRTEFDGFIAANF

SEQ ID NO: 123351 - protein, 25 aa, Mycobacterium avium
YRVARRDLPWRAPGVSAWQILVSEF

SEQ ID NO: 123352 - protein, 17 aa, Mycobacterium avium
YRYFRAPYPEPIEQLKQ

SEQ ID NO: 123353 - protein, 25 aa, Mycobacterium avium
YSANNLMFQLLDRVVYVDPKTDAVR

SEQ ID NO: 123354 - protein, 18 aa, Mycobacterium avium
YSGPGSAPLLAAAAAWHG

SEQ ID NO: 123355 - protein, 25 aa, Mycobacterium avium
YSGVMWACVFMRTGARRVHFGETEK

SEQ ID NO: 123356 - protein, 25 aa, Mycobacterium avium
YSKNITALLDLLIKDGKLAPDFDDE

SEQ ID NO: 123357 - protein, 32 aa, Mycobacterium avium
YSMCGRAYSPRFLWMWPNARISVMGGEQAASV

SEQ ID NO: 123358 - protein, 23 aa, Mycobacterium avium
YSNRAYLIQIRRAGAGTVLIDPV

SEQ ID NO: 123359 - protein, 30 aa, Mycobacterium avium
YSPAFAALEVERMWPRVWQLACMVDHVAAP

SEQ ID NO: 123360 - protein, 29 aa, Mycobacterium avium
YSPQSWTTIPGGPFLSFGQAYAWGQNGQG

SEQ ID NO: 123361 - protein, 23 aa, Mycobacterium avium
YSQQLFGYLQAWRQYLEQMAGAS

SEQ ID NO: 123362 - protein, 27 aa, Mycobacterium avium
YTKGFKFSTYATWWIRQAITRGMADQS

SEQ ID NO: 123363 - protein, 24 aa, Mycobacterium avium
YTVQKALPLLNDGASIILTGSTTA

SEQ ID NO: 123364 - protein, 23 aa, Mycobacterium avium
YVATQGYPLLKKGIRINAICPGP

SEQ ID NO: 123365 - protein, 25 aa, Mycobacterium avium
YVAVFDAFVERLAPGGALVVCVDDP

SEQ ID NO: 123366 - protein, 26 aa, Mycobacterium avium
YVDDLIALVGQRLLPGLPGSATVLDV

SEQ ID NO: 123367 - protein, 18 aa, Mycobacterium avium
YVDVLRLPVDIVAADRFA

SEQ ID NO: 123368 - protein, 22 aa, Mycobacterium avium
YVELFYGRPRTQSSWELVTDAL

SEQ ID NO: 123369 - protein, 31 aa, Mycobacterium avium
YVEVTFPISAHYFTVLPLAKRMATLGKSYLR

SEQ ID NO: 123370 - protein, 25 aa, Mycobacterium avium
YVHADAPPFFVLHGQKDELVPSGQA

SEQ ID NO: 123371 - protein, 25 aa, Mycobacterium avium
YVHNLIHGFILAAQHLTPGGTAPGQ

SEQ ID NO: 123372 - protein, 17 aa, Mycobacterium avium
YVLGGRGMEIVYDEETL

SEQ ID NO: 123373 - protein, 23 aa, Mycobacterium avium
YWMSAKIPNDEFLLYAFDGEPAD

SEQ ID NO: 123374 - protein, 20 aa, Mycobacterium avium
YYDIVHSHYWLSGQVGWLAR

SEQ ID NO: 123375 - protein, 25 aa, Mycobacterium avium
YYDPYDIGIITDPYPTYARLREEAP

SEQ ID NO: 123376 - protein, 23 aa, Mycobacterium avium
YYGIPMATLHYIPMRPNGQLLPR

SEQ ID NO: 123377 - protein, 34 aa, Mycobacterium avium
YYGQRLPAAGSYRAFLTWLAERDLDAARRAWGEV

SEQ ID NO: 123378 - protein, 19 aa, Mycobacterium avium
YYVQYAHARLSALARNAAE

SEQ ID NO: 123379 - protein, 37 aa, Mycobacterium avium
AAAAAPPGRPGPFGEMPLFGGAPLMGLPGRGAADSRD

SEQ ID NO: 123380 - protein, 19 aa, Mycobacterium avium
AAAAPYVAWLQATGAQAEQ

SEQ ID NO: 123381 - protein, 19 aa, Mycobacterium avium
AAAAPYVAWLSATSAQART

SEQ ID NO: 123382 - protein, 25 aa, Mycobacterium avium
AAACDDVLGFSLWIAATPAVTRRLT

SEQ ID NO: 123383 - protein, 17 aa, Mycobacterium avium
AAAFIHHLPVDQSFTLE

SEQ ID NO: 123384 - protein, 24 aa, Mycobacterium avium
AAAGQWQGLSAQLAEVAPPSPGQP

SEQ ID NO: 123385 - protein, 22 aa, Mycobacterium avium
AAAHPHLAIEALRAVLTKELAA

SEQ ID NO: 123386 - protein, 17 aa, Mycobacterium avium
AAAHWHTYRNRLAEVIS

SEQ ID NO: 123387 - protein, 19 aa, Mycobacterium avium
AAAIPVLAQAAGRLSDELG

SEQ ID NO: 123388 - protein, 21 aa, Mycobacterium avium
AAALCPVSRLFAGATISVDAE

SEQ ID NO: 123389 - protein, 17 aa, Mycobacterium avium
AAALHELGLRRGDGVAL

SEQ ID NO: 123390 - protein, 18 aa, Mycobacterium avium
AAALRVVNVMPATVVLRP

SEQ ID NO: 123391 - protein, 29 aa, Mycobacterium avium
AAALTEWFTVDWHRAIVDKWRGAGVRMAD

SEQ ID NO: 123392 - protein, 17 aa, Mycobacterium avium
AAALWKAAGIKSPIDEI

SEQ ID NO: 123393 - protein, 17 aa, Mycobacterium avium
AAALYRKATTGQGSVVD

SEQ ID NO: 123394 - protein, 24 aa, Mycobacterium avium
AAAPIERILLRHSAINRVAVYAVP

SEQ ID NO: 123395 - protein, 35 aa, Mycobacterium avium
AAAPPPVPPPPVPPPPPPVPPPAPPAPAPEPPKGP

SEQ ID NO: 123396 - protein, 24 aa, Mycobacterium avium
AAAPSRVFVLMRSILADEAEQPAD

SEQ ID NO: 123397 - protein, 18 aa, Mycobacterium avium
AAAPYVAWLSATSAQART

SEQ ID NO: 123398 - protein, 18 aa, Mycobacterium avium
AAARAYLRELAFRDFYAD

SEQ ID NO: 123399 - protein, 21 aa, Mycobacterium avium
AAATALLTRALQIGFEKDDVD

SEQ ID NO: 123400 - protein, 17 aa, Mycobacterium avium
AAAVPLPDPYLGEKICA

SEQ ID NO: 123401 - protein, 23 aa, Mycobacterium avium
AAAYLPGYLSGVEWWGQSFSEPE

SEQ ID NO: 123402 - protein, 23 aa, Mycobacterium avium
AADAAAGAVLRRVRERAGLTLDQ

SEQ ID NO: 123403 - protein, 23 aa, Mycobacterium avium
AADAVLDYTFDFTNWLAGTGDSV

SEQ ID NO: 123404 - protein, 25 aa, Mycobacterium avium
AADDARFWEPFMARGFTPDSGAAWL

SEQ ID NO: 123405 - protein, 26 aa, Mycobacterium avium
AADDHRTLFLPPYVAHGFQTLVDDTE

SEQ ID NO: 123406 - protein, 25 aa, Mycobacterium avium
AADEIPPFAPFLTTSAVKDAAVKQN

SEQ ID NO: 123407 - protein, 33 aa, Mycobacterium avium
AADEQFFGMNALYRMYRAADGYVFLAAPLPREW

SEQ ID NO: 123408 - protein, 17 aa, Mycobacterium avium
AADFSVGMLAAGAARRV

SEQ ID NO: 123409 - protein, 19 aa, Mycobacterium avium
AADGFIISAAYLPGIYEEF

SEQ ID NO: 123410 - protein, 27 aa, Mycobacterium avium
AADGRPLVAPIWFVVDDGELAFNTGRG

SEQ ID NO: 123411 - protein, 23 aa, Mycobacterium avium
AADLAFAVLRRPHAALSTALRAD

SEQ ID NO: 123412 - protein, 26 aa, Mycobacterium avium
AADLLWSRVIKQFPDVRFALSEGGTG

SEQ ID NO: 123413 - protein, 20 aa, Mycobacterium avium
AADLPWPAAGDWLAAVRASP

SEQ ID NO: 123414 - protein, 19 aa, Mycobacterium avium
AADLVRAELGLPADWEPLG

SEQ ID NO: 123415 - protein, 18 aa, Mycobacterium avium
AADLVRTELGLPADWEPL

SEQ ID NO: 123416 - protein, 27 aa, Mycobacterium avium
AADPNLSGPFAGVPFLLKDLGQEYRGF

SEQ ID NO: 123417 - protein, 25 aa, Mycobacterium avium
AAEAEGFTSLWYASTVAGDPLVAMA

SEQ ID NO: 123418 - protein, 19 aa, Mycobacterium avium
AAEDALWRWMTAAALVRPR

SEQ ID NO: 123419 - protein, 20 aa, Mycobacterium avium
AAEDALWRWMTAAALVRPRG

SEQ ID NO: 123420 - protein, 23 aa, Mycobacterium avium
AAEDWLCLLEAFDQPHRPGVVRA

SEQ ID NO: 123421 - protein, 21 aa, Mycobacterium avium
AAEHGLWYPPDPSSFEICSIG

SEQ ID NO: 123422 - protein, 28 aa, Mycobacterium avium
AAEIFSRGPLPSPYMLFVHDVAEHWRSR

SEQ ID NO: 123423 - protein, 31 aa, Mycobacterium avium
AAEIFSRGPLPSPYMLFVHDVAEHWRSRIPA

SEQ ID NO: 123424 - protein, 26 aa, Mycobacterium avium
AAEIFSRGPLPSPYMLFVHDVGEHWR

SEQ ID NO: 123425 - protein, 32 aa, Mycobacterium avium
AAELADGWLPPAFTPGMLPAVAPLLQRGFERR

SEQ ID NO: 123426 - protein, 26 aa, Mycobacterium avium
AAELATFFLTGLFALLATGAHDGALL

SEQ ID NO: 123427 - protein, 23 aa, Mycobacterium avium
AAELGALAFKTAYARWAEPDESG

SEQ ID NO: 123428 - protein, 24 aa, Mycobacterium avium
AAELMGIQIPRFCDHPLLEPVGAC

SEQ ID NO: 123429 - protein, 26 aa, Mycobacterium avium
AAELTARFARPLRFGTAGLRGPVRAG

SEQ ID NO: 123430 - protein, 22 aa, Mycobacterium avium
AAENFEAACLLMLNGDWTAPQY

SEQ ID NO: 123431 - protein, 25 aa, Mycobacterium avium
AAEQGFKAVFLPTTPHPSAPDWHRK

SEQ ID NO: 123432 - protein, 26 aa, Mycobacterium avium
AAEQTWLHGWLLRAGPPPGRPAGPST

SEQ ID NO: 123433 - protein, 26 aa, Mycobacterium avium
AAERAMRILHTTYPPLRRPKHRRVFT

SEQ ID NO: 123434 - protein, 27 aa, Mycobacterium avium
AAERAMRILHTTYPPLRRPKHRRVFTV

SEQ ID NO: 123435 - protein, 23 aa, Mycobacterium avium
AAETLAHVLSWTQVGLDPTRTGS

SEQ ID NO: 123436 - protein, 26 aa, Mycobacterium avium
AAFAQPYLSRLWARLHGRDVWQEPCD

SEQ ID NO: 123437 - protein, 21 aa, Mycobacterium avium
AAFINVFNVPRSTGIFPLPLA

SEQ ID NO: 123438 - protein, 22 aa, Mycobacterium avium
AAFINVFNVPRSTGIFPLPLAY

SEQ ID NO: 123439 - protein, 22 aa, Mycobacterium avium
AAFPNVFTWQPVGNYPASIFNP

SEQ ID NO: 123440 - protein, 18 aa, Mycobacterium avium
AAFYLERLDETLGLLPTG

SEQ ID NO: 123441 - protein, 18 aa, Mycobacterium avium
AAGALTPLPVKAFDARCA

SEQ ID NO: 123442 - protein, 24 aa, Mycobacterium avium
AAGFKQLRTWARSFYPESAEPVAT

SEQ ID NO: 123443 - protein, 28 aa, Mycobacterium avium
AAGFTDVVILAYAAKFASAFYGPFREAV

SEQ ID NO: 123444 - protein, 26 aa, Mycobacterium avium
AAGGDWFDAIPLGDRLVLIVGDIVGH

SEQ ID NO: 123445 - protein, 25 aa, Mycobacterium avium
AAGGDWFDAIPLGDRLVLIVGDVVG

SEQ ID NO: 123446 - protein, 26 aa, Mycobacterium avium
AAGGDWFDAIPLGDRLVLIVGDVVGH

SEQ ID NO: 123447 - protein, 24 aa, Mycobacterium avium
AAGKPDILSLWWPTDDGSGLAEAE

SEQ ID NO: 123448 - protein, 18 aa, Mycobacterium avium
AAGLAELALSRGAAVVEV

SEQ ID NO: 123449 - protein, 25 aa, Mycobacterium avium
AAGLDARAYRLTWPAGTVVFEVDQP

SEQ ID NO: 123450 - protein, 34 aa, Mycobacterium avium
AAGLIDWIGDLPIRALISSPLLRCRRTLEPLADT

SEQ ID NO: 123451 - protein, 18 aa, Mycobacterium avium
AAGLMRKVAGDTVDVFSA

SEQ ID NO: 123452 - protein, 17 aa, Mycobacterium avium
AAGLRRTRWWTDGADDF

SEQ ID NO: 123453 - protein, 23 aa, Mycobacterium avium
AAGQLDNLPYRVAFSTFTSGPPQ

SEQ ID NO: 123454 - protein, 18 aa, Mycobacterium avium
AAGTTLLRYEPLGVVAAM

SEQ ID NO: 123455 - protein, 24 aa, Mycobacterium avium
AAGWSFDELLPYFKRSESMCGKDP

SEQ ID NO: 123456 - protein, 24 aa, Mycobacterium avium
AAGWSFDELLPYFKRSESTCGKDP

SEQ ID NO: 123457 - protein, 21 aa, Mycobacterium avium
AAHEFYIRDVLLDRDRDDPNY

SEQ ID NO: 123458 - protein, 20 aa, Mycobacterium avium
AAHIFGLLPVQTPAKLGAMS

SEQ ID NO: 123459 - protein, 25 aa, Mycobacterium avium
AAHLEDWHMMQPQWLADLPDSTRAR

SEQ ID NO: 123460 - protein, 19 aa, Mycobacterium avium
AAIGGPFLPTVVASAVIAE

SEQ ID NO: 123461 - protein, 33 aa, Mycobacterium avium; identical to SEQ ID NO: 21762

SEQ ID NO: 123462 - protein, 24 aa, Mycobacterium avium
AAILNASRRLFLERGYAGTPINAI

SEQ ID NO: 123463 - protein, 18 aa, Mycobacterium avium
AAINRHELPWLTPDWVNI

SEQ ID NO: 123464 - protein, 21 aa, Mycobacterium avium
AAIVDRLTVLTPSPPVPTMST

SEQ ID NO: 123465 - protein, 17 aa, Mycobacterium avium
AAKAGVIGLTIAAARDL

SEQ ID NO: 123466 - protein, 20 aa, Mycobacterium avium
AAKLLDLQPYLDRKPKDLSG

SEQ ID NO: 123467 - protein, 26 aa, Mycobacterium avium
AAKMSAAVTPYLEWLHTTATQAEQAG

SEQ ID NO: 123468 - protein, 25 aa, Mycobacterium avium
AAKPQLLRRYLDRWYWQVKDYVAGL

SEQ ID NO: 123469 - protein, 26 aa, Mycobacterium avium
AAKPQLLRRYLDRWYWQVKDYVAGLT

SEQ ID NO: 123470 - protein, 23 aa, Mycobacterium avium
AALAAHAPPERLLRCIEAVLECR

SEQ ID NO: 123471 - protein, 20 aa, Mycobacterium avium
AALALLARYADPHSLIRLGH

SEQ ID NO: 123472 - protein, 20 aa, Mycobacterium avium
AALALLRQVARAVEPPLLDA

SEQ ID NO: 123473 - protein, 19 aa, Mycobacterium avium
AALARFDQLTRPAPRLQNA

SEQ ID NO: 123474 - protein, 22 aa, Mycobacterium avium
AALDEILRSWRAEHPEIAVIRV

SEQ ID NO: 123475 - protein, 20 aa, Mycobacterium avium
AALDFLPHALAAAGGRPVFL

SEQ ID NO: 123476 - protein, 25 aa, Mycobacterium avium
AALDPILAALVLGGVRRMSLAEGLG

SEQ ID NO: 123477 - protein, 18 aa, Mycobacterium avium
AALDVAAPVSFDAAQFPD

SEQ ID NO: 123478 - protein, 20 aa, Mycobacterium avium
AALESLTSIRRAGADIVLSY

SEQ ID NO: 123479 - protein, 22 aa, Mycobacterium avium
AALFREALVLPFTDFVAEFGRT

SEQ ID NO: 123480 - protein, 18 aa, Mycobacterium avium
AALGHHLPQRLGAVHAAR

SEQ ID NO: 123481 - protein, 20 aa, Mycobacterium avium
AALGPLAVPASWTSVIPAAH

SEQ ID NO: 123482 - protein, 21 aa, Mycobacterium avium
AALHRRWDALWDKLIAACHPG

SEQ ID NO: 123483 - protein, 19 aa, Mycobacterium avium
AALIMFAGGDPWKINATLQ

SEQ ID NO: 123484 - protein, 17 aa, Mycobacterium avium
AALIRQTIDIPSVIARF

SEQ ID NO: 123485 - protein, 25 aa, Mycobacterium avium
AALKTALIDGLGLKPRKAFGPIRVG

SEQ ID NO: 123486 - protein, 25 aa, Mycobacterium avium
AALLEYPVWMWHWAVPGDPAVPWER

SEQ ID NO: 123487 - protein, 17 aa, Mycobacterium avium
AALLTLDRQARISTRVV

SEQ ID NO: 123488 - protein, 26 aa, Mycobacterium avium
AALPEKVGVAAIPLSPFCDPAGAHGP

SEQ ID NO: 123489 - protein, 27 aa, Mycobacterium avium
AALPFNGLRVLDLTTFWAGPCCTHFMA

SEQ ID NO: 123490 - protein, 17 aa, Mycobacterium avium
AALRRIDRRRTAREALL

SEQ ID NO: 123491 - protein, 17 aa, Mycobacterium avium
AALRRRAAGLRRLRVTR

SEQ ID NO: 123492 - protein, 29 aa, Mycobacterium avium
AALSAAGTRWLWDAGIRPGMTIAWQLPSH

SEQ ID NO: 123493 - protein, 30 aa, Mycobacterium avium
AALSTAERWQLLAGSWLDLPGRPALIGGRG

SEQ ID NO: 123494 - protein, 34 aa, Mycobacterium avium
AALWESLDLDEWKWWARWRVIRARAGWLTDELVA

SEQ ID NO: 123495 - protein, 22 aa, Mycobacterium avium
AALWGRPGYVRALLGERIGEIT

SEQ ID NO: 123496 - protein, 25 aa, Mycobacterium avium
AAMGVIAPWLLSEYDRFALLHGNYR

SEQ ID NO: 123497 - protein, 19 aa, Mycobacterium avium
AAMLPLLIGLMKAKEYVLL

SEQ ID NO: 123498 - protein, 29 aa, Mycobacterium avium
AAMTAPRGLRPIARLMLSALIGRVAIPDP

SEQ ID NO: 123499 - protein, 20 aa, Mycobacterium avium
AAMWSDDIAVWRVGSRRDDD

SEQ ID NO: 123500 - protein, 20 aa, Mycobacterium avium
AAMYGYAASSATAGKLSPLT

SEQ ID NO: 123501 - protein, 31 aa, Mycobacterium avium
AANRWITHYQNLLYGLQITTVGDFKAVLPAL

SEQ ID NO: 123502 - protein, 24 aa, Mycobacterium avium
AANSWLDAFARWRHARGAPATAIA

SEQ ID NO: 123503 - protein, 26 aa, Mycobacterium avium
AANSWLDAFTHWRRAQGLPATAIAWG

SEQ ID NO: 123504 - protein, 24 aa, Mycobacterium avium
AAPALRLSGMTVTRPAAAMRLAAA

SEQ ID NO: 123505 - protein, 26 aa, Mycobacterium avium
AAPDARLFIVAFPPGGRFGVPGIDRA

SEQ ID NO: 123506 - protein, 25 aa, Mycobacterium avium
AAPEAFFIAKLEPLGLPVGPERDQE

SEQ ID NO: 123507 - protein, 25 aa, Mycobacterium avium
AAPEAVGPLLFPLSSTSAEQLRVTA

SEQ ID NO: 123508 - protein, 18 aa, Mycobacterium avium
AAPFTPPAAPFTPPFMPP

SEQ ID NO: 123509 - protein, 23 aa, Mycobacterium avium
AAPLDRRLLLGMLSELPPGAGVD

SEQ ID NO: 123510 - protein, 25 aa, Mycobacterium avium
AAPLDRRLLLGMLSELPPGAGVDAT

SEQ ID NO: 123511 - protein, 31 aa, Mycobacterium avium
AAPLLCAGITLFSPLRHWNAGPGTRLAIVGL

SEQ ID NO: 123512 - protein, 21 aa, Mycobacterium avium
AAPMLGIVRASDGWIGINCLT

SEQ ID NO: 123513 - protein, 32 aa, Mycobacterium avium
AAPRPPGTAPMLAPLVLWAQGPARLDEVAHRA

SEQ ID NO: 123514 - protein, 20 aa, Mycobacterium avium
AAPVVLRWHIQRGDIVFPKT

SEQ ID NO: 123515 - protein, 21 aa, Mycobacterium avium
AAQFAAYAQMYQAVSAQAAAI

SEQ ID NO: 123516 - protein, 25 aa, Mycobacterium avium
AAQGFSVLLLPGPAPTPVVAFAVRH

SEQ ID NO: 123517 - protein, 24 aa, Mycobacterium avium
AAQLAYWQQALAGMPERLALPTDR

SEQ ID NO: 123518 - protein, 33 aa, Mycobacterium avium
AAQNILAFRFANGLFEPIWNRNFIDHIQIDIPE

SEQ ID NO: 123519 - protein, 30 aa, Mycobacterium avium
AAQPWLADHAVAGTVLFPGAGFVELALRAG

SEQ ID NO: 123520 - protein, 17 aa, Mycobacterium avium
AAQRPRNPCPQKRIAGQ

SEQ ID NO: 123521 - protein, 25 aa, Mycobacterium avium
AAQRRPLWYLMPDGVVQYVSKRRLY

SEQ ID NO: 123522 - protein, 20 aa, Mycobacterium avium
AAQVVLRWHIQRGDVVFPKT

SEQ ID NO: 123523 - protein, 21 aa, Mycobacterium avium
AARAAFDAGPWSRGAPSHRIA

SEQ ID NO: 123524 - protein, 24 aa, Mycobacterium avium
AARALLLPRRHPGRRSPLWQQRQR

SEQ ID NO: 123525 - protein, 20 aa, Mycobacterium avium
AARALTPPALIARVVQALRD

SEQ ID NO: 123526 - protein, 28 aa, Mycobacterium avium
AAREVDDALWRRFKQAQDVFFTARNAAT

SEQ ID NO: 123527 - protein, 33 aa, Mycobacterium avium
AARFALDIIRHFPGRQARKVSCPILFAICANDT

SEQ ID NO: 123528 - protein, 33 aa, Mycobacterium avium
AARFALDIIRHFPGRQARKVSCPILFAICENDT

SEQ ID NO: 123529 - protein, 23 aa, Mycobacterium avium
AARHGLALDPRFSNSNPRIAPEY

SEQ ID NO: 123530 - protein, 18 aa, Mycobacterium avium
AARHRTVWALGDYALMAE

SEQ ID NO: 123531 - protein, 17 aa, Mycobacterium avium
AARLAFLVSGGTGAGKT

SEQ ID NO: 123532 - protein, 21 aa, Mycobacterium avium
AARLALAHALGWQGRGREADA

SEQ ID NO: 123533 - protein, 25 aa, Mycobacterium avium
AARLGRPLRIAHAWSFAFDAAWQPL

SEQ ID NO: 123534 - protein, 19 aa, Mycobacterium avium
AARRGQLGQQLLLGGRDPL

SEQ ID NO: 123535 - protein, 25 aa, Mycobacterium avium
AARRQAEKLTLRTYAKTWLDNKTKL

SEQ ID NO: 123536 - protein, 22 aa, Mycobacterium avium
AARSLLDRRTARAVLSRLGGPS

SEQ ID NO: 123537 - protein, 26 aa, Mycobacterium avium
AARTAGFALVIGLAPVGRDGDGLRGA

SEQ ID NO: 123538 - protein, 22 aa, Mycobacterium avium
AARTGIIELAGRFLERVCPPDA

SEQ ID NO: 123539 - protein, 17 aa, Mycobacterium avium
AARTRFFDSFFQAATQA

SEQ ID NO: 123540 - protein, 17 aa, Mycobacterium avium
AARTRFFDSFFQGATQA

SEQ ID NO: 123541 - protein, 18 aa, Mycobacterium avium
AARTRFFDSFFQGATQAG

SEQ ID NO: 123542 - protein, 22 aa, Mycobacterium avium
AARVVPTNFLTLFPEHEKHSLD

SEQ ID NO: 123543 - protein, 26 aa, Mycobacterium avium
AASALLKGLTAHYLLTSVYPVQAGDT

SEQ ID NO: 123544 - protein, 20 aa, Mycobacterium avium
AASARFGLLLARTGPDKHRD

SEQ ID NO: 123545 - protein, 20 aa, Mycobacterium avium
AASFTRSFARYEPMPESAAA

SEQ ID NO: 123546 - protein, 20 aa, Mycobacterium avium
AASNPDLFWALRGGGGGNFG

SEQ ID NO: 123547 - protein, 28 aa, Mycobacterium avium
AASRDYWRARLPSLPPAPKLADMSLLFE

SEQ ID NO: 123548 - protein, 20 aa, Mycobacterium avium
AASRWHGFAAAMNGVQGTLN

SEQ ID NO: 123549 - protein, 22 aa, Mycobacterium avium
AASSLYRHFRSKSHLLVTVLAR

SEQ ID NO: 123550 - protein, 19 aa, Mycobacterium avium
AATAGKIDFAITGNTPPIF

SEQ ID NO: 123551 - protein, 30 aa, Mycobacterium avium
AATALARRHPMLRVRFLPDGTQCITPAVEC

SEQ ID NO: 123552 - protein, 31 aa, Mycobacterium avium
AATALARRHPMLRVRFLPDGTQRITPAVECG

SEQ ID NO: 123553 - protein, 24 aa, Mycobacterium avium
AATLPGYMMPSSLTVLDALPKTES

SEQ ID NO: 123554 - protein, 19 aa, Mycobacterium avium
AATLPYGLSPLVVPQLKTI

SEQ ID NO: 123555 - protein, 24 aa, Mycobacterium avium
AATPFSAVAVRPLLRGSALGVTGM

SEQ ID NO: 123556 - protein, 23 aa, Mycobacterium avium
AATQAAIWFFTNGLALDTRPLNV

SEQ ID NO: 123557 - protein, 23 aa, Mycobacterium avium
AATRAVTTTPWLTSRHSFSFGDH

SEQ ID NO: 123558 - protein, 25 aa, Mycobacterium avium
AATRLGHSVAFFIGTAYGSPETAER

SEQ ID NO: 123559 - protein, 25 aa, Mycobacterium avium
AATSAYLFSHPDVNAYFTSLKGQPR

SEQ ID NO: 123560 - protein, 19 aa, Mycobacterium avium
AATVIRIAISHYIVRSDDA

SEQ ID NO: 123561 - protein, 27 aa, Mycobacterium avium
AATVPPPVIAANRALLATLVATNMLGQ

SEQ ID NO: 123562 - protein, 26 aa, Mycobacterium avium
AAVAGAIPVIRPLTQSLAGDTVLRVA

SEQ ID NO: 123563 - protein, 41 aa, Mycobacterium avium
AAVDFSMLYPDGRLLDVPLPAWTHRHLLLGLDSRDTQPQAG

SEQ ID NO: 123564 - protein, 25 aa, Mycobacterium avium
AAVEGLILGSYRFTEFRSAKTAPKD

SEQ ID NO: 123565 - protein, 25 aa, Mycobacterium avium
AAVGAPYRYGNALMSFYNQPDEDFA

SEQ ID NO: 123566 - protein, 21 aa, Mycobacterium avium
AAVLAALAKLARAVAAELVAG

SEQ ID NO: 123567 - protein, 21 aa, Mycobacterium avium
AAVLQALLDRHAMLRLRVEDD

SEQ ID NO: 123568 - protein, 22 aa, Mycobacterium avium
AAVLQALLDRHAMLRLRVEDDG

SEQ ID NO: 123569 - protein, 17 aa, Mycobacterium avium
AAVMLRRCETCAADIDE

SEQ ID NO: 123570 - protein, 27 aa, Mycobacterium avium
AAVRKLPIFGGPFRWEDLEWLRSTTSL

SEQ ID NO: 123571 - protein, 20 aa, Mycobacterium avium
AAVVALLHRELGGTGQFVDV

SEQ ID NO: 123572 - protein, 19 aa, Mycobacterium avium
AAVVLIHPTYGATADAIDA

SEQ ID NO: 123573 - protein, 25 aa, Mycobacterium avium
AAVWELVWAGWITGDTFAPVRALLG

SEQ ID NO: 123574 - protein, 19 aa, Mycobacterium avium
AAWGMQRMTDMLTARTRYI

SEQ ID NO: 123575 - protein, 17 aa, Mycobacterium avium
AAYADYIWLAVRTDPDA

SEQ ID NO: 123576 - protein, 20 aa, Mycobacterium avium
AAYDRLFTALDWVSDRLADR

SEQ ID NO: 123577 - protein, 27 aa, Mycobacterium avium
AAYETAFAMTVPPALVAANRAQLAALI

SEQ ID NO: 123578 - protein, 28 aa, Mycobacterium avium
AAYETAFAMTVPPALVAANRAQLAALIA

SEQ ID NO: 123579 - protein, 24 aa, Mycobacterium avium
AAYGRFLPAWHRVGAAESSRAPGH

SEQ ID NO: 123580 - protein, 24 aa, Mycobacterium avium
AAYGSSVLILPDASLDAVHVNASL

SEQ ID NO: 123581 - protein, 26 aa, Mycobacterium avium
ACAILALELLVHAWDYARAVGRDVRA

SEQ ID NO: 123582 - protein, 18 aa, Mycobacterium avium
ACAPVVQFLSVGPLTFGA

SEQ ID NO: 123583 - protein, 20 aa, Mycobacterium avium
ACERLDYVSWQKNFPRSVRD

SEQ ID NO: 123584 - protein, 23 aa, Mycobacterium avium
ACFPFSAWTGATARRRARNCWPS

SEQ ID NO: 123585 - protein, 18 aa, Mycobacterium avium
ACHPGQRGLFLLVEAARQ

SEQ ID NO: 123586 - protein, 21 aa, Mycobacterium avium
ACLDAGVRVGCFRPPTVPAGT

SEQ ID NO: 123587 - protein, 21 aa, Mycobacterium avium
ACLDGGVRVGCFRPPTVPAGT

SEQ ID NO: 123588 - protein, 25 aa, Mycobacterium avium
ACMDARLDVYRILGLREGEAHVIRN

SEQ ID NO: 123589 - protein, 19 aa, Mycobacterium avium
ACMDFATTAELLAKLYAAM

SEQ ID NO: 123590 - protein, 17 aa, Mycobacterium avium
ACPGRLEDLMRQRLITL

SEQ ID NO: 123591 - protein, 18 aa, Mycobacterium avium
ACPGRLEDLMRQRLITLE

SEQ ID NO: 123592 - protein, 36 aa, Mycobacterium avium
ACPQRRPILHLPTHWPWADHWITLWCNTIGHSPPTT

SEQ ID NO: 123593 - protein, 19 aa, Mycobacterium avium
ACPRQAISVLTEQPPYAPD

SEQ ID NO: 123594 - protein, 19 aa, Mycobacterium avium
ACRTKFFDDYFLAAAGEGI

SEQ ID NO: 123595 - protein, 23 aa, Mycobacterium avium
ACSALKRAYRDRLRAHCPDVAFL

SEQ ID NO: 123596 - protein, 25 aa, Mycobacterium avium
ACTLRNWLGMWSLRVAQTRAEPHLA

SEQ ID NO: 123597 - protein, 25 aa, Mycobacterium avium
ACTLRNWLSMWSLRVAQTRAEPHLA

SEQ ID NO: 123598 - protein, 19 aa, Mycobacterium avium
ACVQLLDTLSGLAAQDNGK

SEQ ID NO: 123599 - protein, 22 aa, Mycobacterium avium
ADAAGLKWWTSEIQWEIIDRCL

SEQ ID NO: 123600 - protein, 29 aa, Mycobacterium avium
ADAAIDNRLLWQLDGRYMQALFGETLNAR

SEQ ID NO: 123601 - protein, 17 aa, Mycobacterium avium
ADAALLRVDSRNQVLVA

SEQ ID NO: 123602 - protein, 21 aa, Mycobacterium avium
ADAFSWRATFENLALVDGPTA

SEQ ID NO: 123603 - protein, 21 aa, Mycobacterium avium
ADAGLAPRLRLVPIRRDCGTG

SEQ ID NO: 123604 - protein, 25 aa, Mycobacterium avium
ADAGQRLRPQPAQPGDLLIVERRRR

SEQ ID NO: 123605 - protein, 22 aa, Mycobacterium avium
ADAGSWLLIGTTATADVLASTL

SEQ ID NO: 123606 - protein, 25 aa, Mycobacterium avium
ADAGVEPLFAAPFFAVVPYEWDRYV

SEQ ID NO: 123607 - protein, 18 aa, Mycobacterium avium
ADAGVEPLFAASFFAVVP

SEQ ID NO: 123608 - protein, 26 aa, Mycobacterium avium
ADAKTYRFNPFDVTKVWPHADYPPIE

SEQ ID NO: 123609 - protein, 18 aa, Mycobacterium avium
ADAQGALALLLRLADRGA

SEQ ID NO: 123610 - protein, 29 aa, Mycobacterium avium
ADARARWATTIAAPILAGAFAVAWEWENT

SEQ ID NO: 123611 - protein, 28 aa, Mycobacterium avium
ADAVLYEGYLLYPYRATSSKNESRWQFG

SEQ ID NO: 123612 - protein, 25 aa, Mycobacterium avium
ADAVMILPVSYWKLTEREIFRHYRS

SEQ ID NO: 123613 - protein, 19 aa, Mycobacterium avium
ADAVQFFLSNPQSWKKPKP

SEQ ID NO: 123614 - protein, 18 aa, Mycobacterium avium
ADAWDFLTRTPLANTPTN

SEQ ID NO: 123615 - protein, 28 aa, Mycobacterium avium
ADAYGADFFAPWGKLAALRTPTIAAVAG

SEQ ID NO: 123616 - protein, 28 aa, Mycobacterium avium
ADAYGADFFAPWGKLAAVRTPTIAAVAG

SEQ ID NO: 123617 - protein, 26 aa, Mycobacterium avium
ADDAPLGYLLYRVGAALRPEVSGALG

SEQ ID NO: 123618 - protein, 30 aa, Mycobacterium avium
ADDDGYLAQLKKIGVAWQPGGDTTLIQLGH

SEQ ID NO: 123619 - protein, 20 aa, Mycobacterium avium
ADDPWLCRRLAQAEADVAVA

SEQ ID NO: 123620 - protein, 24 aa, Mycobacterium avium
ADDQPALFLIDPMAEGVAVEAERV

SEQ ID NO: 123621 - protein, 29 aa, Mycobacterium avium
ADDVYLSPAPIYHTAPLKWCAGVQALGGT

SEQ ID NO: 123622 - protein, 27 aa, Mycobacterium avium
ADDWPRHQLRLPAGHGLLLLTDGLYEG

SEQ ID NO: 123623 - protein, 25 aa, Mycobacterium avium
ADEARFPDIWAATVARRGLVHAAEN

SEQ ID NO: 123624 - protein, 22 aa, Mycobacterium avium
ADEERIVWLAEPLVADNLPDGH

SEQ ID NO: 123625 - protein, 23 aa, Mycobacterium avium
ADEQLAVLWALWAHRPDGASFHG

SEQ ID NO: 123626 - protein, 27 aa, Mycobacterium avium
ADERITVLHLAPVMLRALLDEVSDRLA

SEQ ID NO: 123627 - protein, 24 aa, Mycobacterium avium
ADERRTCVFFESPRRLPACLQDAV

SEQ ID NO: 123628 - protein, 27 aa, Mycobacterium avium
ADEVCLQMHLLYLSFSIAVRKRAADDA

SEQ ID NO: 123629 - protein, 23 aa, Mycobacterium avium
ADFAQHLIPTLDDSALAVVDQTQ

SEQ ID NO: 123630 - protein, 18 aa, Mycobacterium avium
ADFIGFSQPIDDLPTAEG

SEQ ID NO: 123631 - protein, 26 aa, Mycobacterium avium
ADFLTPFIWRMDTFGRPHLEQTPWAP

SEQ ID NO: 123632 - protein, 21 aa, Mycobacterium avium
ADFSALFPNEVITTMLGVPKQ

SEQ ID NO: 123633 - protein, 24 aa, Mycobacterium avium
ADFTDWLLFDQFSPSIVGRRGLAT

SEQ ID NO: 123634 - protein, 19 aa, Mycobacterium avium
ADFTRCFDLVFAEAAEQGV

SEQ ID NO: 123635 - protein, 18 aa, Mycobacterium avium
ADFTTRVVVLTPADPARF

SEQ ID NO: 123636 - protein, 24 aa, Mycobacterium avium
ADGDPPALIPFSGPARKVLELTVR

SEQ ID NO: 123637 - protein, 26 aa, Mycobacterium avium
ADGKEIAGRLAAWIGSGLLVDVVEVK

SEQ ID NO: 123638 - protein, 24 aa, Mycobacterium avium
ADGMSRLSGWLTPEARASWEAVLA

SEQ ID NO: 123639 - protein, 18 aa, Mycobacterium avium
ADGNLALGGPLPVNTHGG

SEQ ID NO: 123640 - protein, 25 aa, Mycobacterium avium
ADGQNVLFPPPPQAAGKDTLPAGSI

SEQ ID NO: 123641 - protein, 23 aa, Mycobacterium avium
ADHVHLLVAYPPTLAISALAQRL

SEQ ID NO: 123642 - protein, 24 aa, Mycobacterium avium
ADIEFPAPALIYGYGAYEICIDPS

SEQ ID NO: 123643 - protein, 25 aa, Mycobacterium avium
ADIEFPAPALIYGYGAYEICIDPSF

SEQ ID NO: 123644 - protein, 19 aa, Mycobacterium avium
ADIGLLGDQRRARRGRAVG

SEQ ID NO: 123645 - protein, 23 aa, Mycobacterium avium
ADIGLLGDQRRARRGRAVGHLYP

SEQ ID NO: 123646 - protein, 18 aa, Mycobacterium avium
ADKPPLTDPILTSKHHRL

SEQ ID NO: 123647 - protein, 17 aa, Mycobacterium avium
ADLFAAAGQLQSAPRFA

SEQ ID NO: 123648 - protein, 24 aa, Mycobacterium avium
ADLFVIGAAYRRYAIKHRHMYRLM

SEQ ID NO: 123649 - protein, 24 aa, Mycobacterium avium
ADLFVIGAAYRRYAIRHRHMYRLM

SEQ ID NO: 123650 - protein, 17 aa, Mycobacterium avium
ADLGYFDQAHFLREFRA

SEQ ID NO: 123651 - protein, 21 aa, Mycobacterium avium
ADLLLAHLVLRPFLDAYHIVA

SEQ ID NO: 123652 - protein, 38 aa, Mycobacterium avium
ADLPGPVDFVLLDGWKDLYLPVLELLEPRLSPGVLVVA

SEQ ID NO: 123653 - protein, 27 aa, Mycobacterium avium
ADLRRYLTRWIGPAIAYPQLLRAMDAL

SEQ ID NO: 123654 - protein, 18 aa, Mycobacterium avium
ADLSAWPPAGATKVDIAD

SEQ ID NO: 123655 - protein, 25 aa, Mycobacterium avium
ADLSDALLALLPLVGVWRGEGEGRG

SEQ ID NO: 123656 - protein, 23 aa, Mycobacterium avium
ADNGRVHWPPRPEPARGEDAGTL

SEQ ID NO: 123657 - protein, 23 aa, Mycobacterium avium
ADNGRVHWPPRPGPARGEDAGTL

SEQ ID NO: 123658 - protein, 22 aa, Mycobacterium avium
ADNPLINDLFAEPLVKAVGVDL

SEQ ID NO: 123659 - protein, 28 aa, Mycobacterium avium
ADPATLADLVFAWRVCRAVKSNAIVIAA

SEQ ID NO: 123660 - protein, 17 aa, Mycobacterium avium
ADPGPLTVTLPHRPMRY

SEQ ID NO: 123661 - protein, 20 aa, Mycobacterium avium
ADPLTPLAAAALPDDVPASS

SEQ ID NO: 123662 - protein, 26 aa, Mycobacterium avium
ADPNTWKQNWPQHLAGAYIDAGMADQ

SEQ ID NO: 123663 - protein, 18 aa, Mycobacterium avium
ADPRWRAHHDRMSELGFE

SEQ ID NO: 123664 - protein, 23 aa, Mycobacterium avium
ADPTVKVVLLSGAGRNFCAGGDV

SEQ ID NO: 123665 - protein, 25 aa, Mycobacterium avium
ADPVDFFRRTYLTEGLTDLVGRAVR

SEQ ID NO: 123666 - protein, 23 aa, Mycobacterium avium
ADQLAAWAGLAPVPSDSGKRTGR

SEQ ID NO: 123667 - protein, 24 aa, Mycobacterium avium
ADRAGWLRYGLPASLGGRDGSNVD

SEQ ID NO: 123668 - protein, 27 aa, Mycobacterium avium
ADRDTLLLLAELLTVSLRDLLVVGAHR

SEQ ID NO: 123669 - protein, 28 aa, Mycobacterium avium
ADREFVALVRRPKLVAMTTLDLTRSWAR

SEQ ID NO: 123670 - protein, 26 aa, Mycobacterium avium
ADRGLINMPMFHFGALGIIGGLHARG

SEQ ID NO: 123671 - protein, 29 aa, Mycobacterium avium
ADRLPGYMLPSAVLALDALPLTVNGKLDT

SEQ ID NO: 123672 - protein, 19 aa, Mycobacterium avium
ADRLRARLVERINNLRVGH

SEQ ID NO: 123673 - protein, 26 aa, Mycobacterium avium
ADRRTPALWKALSGAGVFGLAIAEEY

SEQ ID NO: 123674 - protein, 25 aa, Mycobacterium avium
ADRVATVLRRMFIRGEIPEGTMLPP

SEQ ID NO: 123675 - protein, 24 aa, Mycobacterium avium
ADRVATVLRRMFIRGEITEGTMLP

SEQ ID NO: 123676 - protein, 23 aa, Mycobacterium avium
ADRWGLDSWRISPAVGPDVVVST

SEQ ID NO: 123677 - protein, 19 aa, Mycobacterium avium
ADSPFRRGPLNRLADVEML

SEQ ID NO: 123678 - protein, 24 aa, Mycobacterium avium
ADTDLLDQAWWSPGLTHPDGRSAF

SEQ ID NO: 123679 - protein, 17 aa, Mycobacterium avium
ADTTFYGLNAFLFTNSA

SEQ ID NO: 123680 - protein, 17 aa, Mycobacterium avium
ADTTLFFAALDPQGRVV

SEQ ID NO: 123681 - protein, 22 aa, Mycobacterium avium
ADVATLVAFLLSAEGDWINGQV

SEQ ID NO: 123682 - protein, 31 aa, Mycobacterium avium
ADVDALLAPLRARLPLPCLIGAPVLFGRGSV

SEQ ID NO: 123683 - protein, 21 aa, Mycobacterium avium
ADVIGELLHRLPVPRTGAGPG

SEQ ID NO: 123684 - protein, 17 aa, Mycobacterium avium
ADVLDVGLRSSYVASWY

SEQ ID NO: 123685 - protein, 18 aa, Mycobacterium avium
ADVLRVLDAIGRPVTIIG

SEQ ID NO: 123686 - protein, 28 aa, Mycobacterium avium
ADVLVLNRADPFTAAALRRLAPRARIQV

SEQ ID NO: 123687 - protein, 20 aa, Mycobacterium avium
ADVLVSYLPVGSEEADKFYA

SEQ ID NO: 123688 - protein, 26 aa, Mycobacterium avium
ADVNLHLVLGAWRILGAVQQSLRIVT

SEQ ID NO: 123689 - protein, 37 aa, Mycobacterium avium; identical to SEQ ID NO: 21788

SEQ ID NO: 123690 - protein, 25 aa, Mycobacterium avium
ADVVRNRIYVTDISRWREVGAVHAE

SEQ ID NO: 123691 - protein, 26 aa, Mycobacterium avium
ADVVRTRIYVTDISRWREVGAVHAEV

SEQ ID NO: 123692 - protein, 20 aa, Mycobacterium avium
ADVWPLRPDCRILACSSVFG

SEQ ID NO: 123693 - protein, 20 aa, Mycobacterium avium
ADWITGWRRDKNHPHPSGKP

SEQ ID NO: 123694 - protein, 35 aa, Mycobacterium avium
ADYMATRGIGFLGWNTRFRGFESSFLLDHALVDIG

SEQ ID NO: 123695 - protein, 36 aa, Mycobacterium avium
ADYMATRGIGFLGWNTRFRGFESSFLLDHALVDIGV

SEQ ID NO: 123696 - protein, 18 aa, Mycobacterium avium
ADYPYAYLITVDDDYRAH

SEQ ID NO: 123697 - protein, 27 aa, Mycobacterium avium
AEAADLGPRRALTGEPLPALLPATAAA

SEQ ID NO: 123698 - protein, 20 aa, Mycobacterium avium
AEAARRFGCGFAPSGWDTLT

SEQ ID NO: 123699 - protein, 19 aa, Mycobacterium avium
AEADLARFPADVARVVVRL

SEQ ID NO: 123700 - protein, 20 aa, Mycobacterium avium
AEADLARFPADVARVVVRLI

SEQ ID NO: 123701 - protein, 27 aa, Mycobacterium avium
AEAFGVIKALLAIAPTLHPLDALEEEA

SEQ ID NO: 123702 - protein, 17 aa, Mycobacterium avium
AEAIRWAGALAGYGLRW

SEQ ID NO: 123703 - protein, 18 aa, Mycobacterium avium
AEANRWAELSKSVDYPPV

SEQ ID NO: 123704 - protein, 26 aa, Mycobacterium avium
AEAPARAYNPLFIWGESGLGKTHLLH

SEQ ID NO: 123705 - protein, 31 aa, Mycobacterium avium
AEDALLAFPAMQPMPIPFIEPQDVSNAVCFL

SEQ ID NO: 123706 - protein, 18 aa, Mycobacterium avium
AEDARVLYHAALAHASNH

SEQ ID NO: 123707 - protein, 19 aa, Mycobacterium avium
AEDRLREVLARYGPQDPVH

SEQ ID NO: 123708 - protein, 33 aa, Mycobacterium avium
AEDWDLDALWTALKTLYPVGIDYATLTRRDADG

SEQ ID NO: 123709 - protein, 26 aa, Mycobacterium avium
AEEARARFLHRALPDAWNHVVVVHSD

SEQ ID NO: 123710 - protein, 18 aa, Mycobacterium avium
AEEIGYPVLIKPSAGGGG

SEQ ID NO: 123711 - protein, 25 aa, Mycobacterium avium
AEENRKLLADWWTETWNAGGGDFVR

SEQ ID NO: 123712 - protein, 34 aa, Mycobacterium avium
AEFAVYVAALQLGWRWLPRRLTLEPLAYNRYQYE

SEQ ID NO: 123713 - protein, 25 aa, Mycobacterium avium
AEFDSRRTAFTPPPPRYKTGVLAKY

SEQ ID NO: 123714 - protein, 22 aa, Mycobacterium avium
AEFRKLLAEWKAAGRAAREVDD

SEQ ID NO: 123715 - protein, 31 aa, Mycobacterium avium
AEFVTPGWFASFIPVTFPVAGASFGDAVIAA

SEQ ID NO: 123716 - protein, 23 aa, Mycobacterium avium
AEGAAMFVLQRKSVALRAGRRVV

SEQ ID NO: 123717 - protein, 19 aa, Mycobacterium avium
AEGFEFVAMARALLAEPDL

SEQ ID NO: 123718 - protein, 20 aa, Mycobacterium avium
AEGFEFVAMARALLAEPDLI

SEQ ID NO: 123719 - protein, 24 aa, Mycobacterium avium
AEGHAAKVLNLRSTLLTLAGGDAM

SEQ ID NO: 123720 - protein, 23 aa, Mycobacterium avium
AEGHPHFGAPLTGPEGSGHELFP

SEQ ID NO: 123721 - protein, 33 aa, Mycobacterium avium
AEGLFDPRLKRPIPFLPNMIGLITGRASAAERD

SEQ ID NO: 123722 - protein, 17 aa, Mycobacterium avium
AEGLISQQPRRGFVVLP

SEQ ID NO: 123723 - protein, 17 aa, Mycobacterium avium
AEGRRYANTPRGARLRD

SEQ ID NO: 123724 - protein, 30 aa, Mycobacterium avium
AEHEPFQRFMDRLYRVLLSDAGLDGRIEAA

SEQ ID NO: 123725 - protein, 18 aa, Mycobacterium avium
AEHFELGIKDLVPMAYAE

SEQ ID NO: 123726 - protein, 25 aa, Mycobacterium avium
AEHGPGWHLAVLPLTDGGAVVSLVT

SEQ ID NO: 123727 - protein, 18 aa, Mycobacterium avium
AEHVVNYPPMRLARDGRD

SEQ ID NO: 123728 - protein, 23 aa, Mycobacterium avium
AEHVVNYPPMRLARDGRDGNGCY

SEQ ID NO: 123729 - protein, 21 aa, Mycobacterium avium
AEIGGLLRAKFSHPLRFDVPI

SEQ ID NO: 123730 - protein, 22 aa, Mycobacterium avium
AEIQVPLFINTGDKLKVDTRDG

SEQ ID NO: 123731 - protein, 25 aa, Mycobacterium avium
AELAARFARPLRFGTAGLRGPVRGG

SEQ ID NO: 123732 - protein, 18 aa, Mycobacterium avium
AELAQRRAGYLRRLPEGT

SEQ ID NO: 123733 - protein, 33 aa, Mycobacterium avium
AELDAVAEALRGFPQRCYVLPDEPLLSAPTVTE

SEQ ID NO: 123734 - protein, 25 aa, Mycobacterium avium
AELDPYLPVEVFAAGLTFDTVDAFL

SEQ ID NO: 123735 - protein, 23 aa, Mycobacterium avium
AELDQLIGFFVNILVLRNDLDGN

SEQ ID NO: 123736 - protein, 22 aa, Mycobacterium avium
AELGADFFVFSGHKIYGPTGIG

SEQ ID NO: 123737 - protein, 22 aa, Mycobacterium avium
AELGALAFKTAYARWAEPDESG

SEQ ID NO: 123738 - protein, 28 aa, Mycobacterium avium
AELITVKRYWNEWKDPRLIIAVLHNNDL

SEQ ID NO: 123739 - protein, 29 aa, Mycobacterium avium
AELLTATFGPRTGLWLLLLAKGGGDDHVS

SEQ ID NO: 123740 - protein, 21 aa, Mycobacterium avium
AELMLRKATWLYDNGKPCGRE

SEQ ID NO: 123741 - protein, 25 aa, Mycobacterium avium
AELRAARRMGSKSALLALIADCERG

SEQ ID NO: 123742 - protein, 26 aa, Mycobacterium avium
AELRKSAPIYWVDVPGGTGGFGDKGY

SEQ ID NO: 123743 - protein, 28 aa, Mycobacterium avium
AELSDGTLRFLLWSAALLSPQPPSLMVL

SEQ ID NO: 123744 - protein, 17 aa, Mycobacterium avium
AELWNLEPLQIPHYGPP

SEQ ID NO: 123745 - protein, 21 aa, Mycobacterium avium
AEMAQAWRLVKLDDAVHAVVL

SEQ ID NO: 123746 - protein, 27 aa, Mycobacterium avium
AENPDRFRGFATLPLYDPAAAAEELRR

SEQ ID NO: 123747 - protein, 24 aa, Mycobacterium avium
AEPTLRSWQRLFDAAPPVQTGTSS

SEQ ID NO: 123748 - protein, 22 aa, Mycobacterium avium
AEPVFPLVQAMPVPYVEPEDIS

SEQ ID NO: 123749 - protein, 17 aa, Mycobacterium avium
AEPVGLFQMRIPRQDEV

SEQ ID NO: 123750 - protein, 27 aa, Mycobacterium avium
AEQLGYSMVFLPEHFLTPTAHLELSGD

SEQ ID NO: 123751 - protein, 22 aa, Mycobacterium avium
AEQMKMFLTRLGFGSKIVVTGD

SEQ ID NO: 123752 - protein, 38 aa, Mycobacterium avium
AEQTLAVNLLGPIRLIATLLPALLRRPHAAILNVTSGL

SEQ ID NO: 123753 - protein, 24 aa, Mycobacterium avium
AERAPGTRVLYVSPLKALAVDVER

SEQ ID NO: 123754 - protein, 26 aa, Mycobacterium avium
AEREQWWRRAVQAYPPYAEYPTKTAR

SEQ ID NO: 123755 - protein, 19 aa, Mycobacterium avium
AERFAVFAGLLAGAEYPEA

SEQ ID NO: 123756 - protein, 18 aa, Mycobacterium avium
AERFAVFAGLLAGAEYPQ

SEQ ID NO: 123757 - protein, 25 aa, Mycobacterium avium
AERGPGWHLAMLPLTDGGAVVSLVT

SEQ ID NO: 123758 - protein, 28 aa, Mycobacterium avium
AERHRMGYLQMMSTVLGRRVWENAGSPE

SEQ ID NO: 123759 - protein, 40 aa, Mycobacterium avium
AERHWRELGNPLHLHRILLQRSWIAIFWSRFADAVELIAQ

SEQ ID NO: 123760 - protein, 25 aa, Mycobacterium avium
AERMRHGMYWSGDLAYRDADGWIYL

SEQ ID NO: 123761 - protein, 26 aa, Mycobacterium avium
AERMRHGMYWSGDLAYRDADGWIYLA

SEQ ID NO: 123762 - protein, 18 aa, Mycobacterium avium
AERRILACLPGEYGPNLA

SEQ ID NO: 123763 - protein, 20 aa, Mycobacterium avium
AESHPAFVNALVALAGGDLV

SEQ ID NO: 123764 - protein, 26 aa, Mycobacterium avium
AESLLAMPRWLAESVWVPRGSVAVLS

SEQ ID NO: 123765 - protein, 20 aa, Mycobacterium avium
AESWSRIIDVNLTGTFHCCQ

SEQ ID NO: 123766 - protein, 25 aa, Mycobacterium avium
AETGYLRVPQPGRLELVLAHPSGIT

SEQ ID NO: 123767 - protein, 26 aa, Mycobacterium avium
AETHGAAVRKLWVSAGPPPCVVADMP

SEQ ID NO: 123768 - protein, 25 aa, Mycobacterium avium
AETLRRVFVEHLGLSPKAYRDRFRT

SEQ ID NO: 123769 - protein, 19 aa, Mycobacterium avium
AETLSWLYEMMVLTRELDG

SEQ ID NO: 123770 - protein, 25 aa, Mycobacterium avium
AETMPRHGWWFPANSRRPGQHVLSR

SEQ ID NO: 123771 - protein, 25 aa, Mycobacterium avium
AETTWKLLLDSQSGIRKLEDSFVEE

SEQ ID NO: 123772 - protein, 21 aa, Mycobacterium avium
AEVAAFFVLLSVAGNDTTRQT

SEQ ID NO: 123773 - protein, 30 aa, Mycobacterium avium
AEVAALMRVSKMTVYRLVHNGELPAVRVGR

SEQ ID NO: 123774 - protein, 24 aa, Mycobacterium avium
AEVAATWRRLELSVPLVVDPVCAS

SEQ ID NO: 123775 - protein, 28 aa, Mycobacterium avium
AEVERIVVHLAPWLEPEPICVAISHVRV

SEQ ID NO: 123776 - protein, 27 aa, Mycobacterium avium
AEVLEAMSIWDAEALIRLVDSAHTRAG

SEQ ID NO: 123777 - protein, 23 aa, Mycobacterium avium
AEVLGRPVALLYTSEDRAAGLAE

SEQ ID NO: 123778 - protein, 26 aa, Mycobacterium avium
AEVLRPGLLVLPVRGAARYFGSEEAA

SEQ ID NO: 123779 - protein, 27 aa, Mycobacterium avium
AEVNGQVFIVYGPQVTLVAAPTAEHKF

SEQ ID NO: 123780 - protein, 30 aa, Mycobacterium avium
AEVRALLTWGRPGVDAALIAALPNLEVIVN

SEQ ID NO: 123781 - protein, 23 aa, Mycobacterium avium
AEWAHWDGQRPFVGALTLGLPTD

SEQ ID NO: 123782 - protein, 17 aa, Mycobacterium avium
AFAAKRLAPHALEWDAA

SEQ ID NO: 123783 - protein, 18 aa, Mycobacterium avium
AFAAKRLAPHALEWDAAE

SEQ ID NO: 123784 - protein, 31 aa, Mycobacterium avium
AFAEREGVNLTFLPFIARAVIDALKIHPNIN

SEQ ID NO: 123785 - protein, 24 aa, Mycobacterium avium
AFAQPYLSRLWARLHGRDVWQEPC

SEQ ID NO: 123786 - protein, 21 aa, Mycobacterium avium
AFASVVLSWARVHEPDMARVN

SEQ ID NO: 123787 - protein, 18 aa, Mycobacterium avium
AFAVLAPSLKRIRKRIAQ

SEQ ID NO: 123788 - protein, 26 aa, Mycobacterium avium
AFAYTGIARWRALGDYWFEGVSRAAR

SEQ ID NO: 123789 - protein, 21 aa, Mycobacterium avium
AFDFSVWEIFGALLHGGRLVI

SEQ ID NO: 123790 - protein, 20 aa, Mycobacterium avium
AFDHGPWPRMSHAERMAKIE

SEQ ID NO: 123791 - protein, 25 aa, Mycobacterium avium
AFDLFEPGRPRMHQWMVELAGLFDA

SEQ ID NO: 123792 - protein, 18 aa, Mycobacterium avium
AFDLLRRLSQESQVKLVE

SEQ ID NO: 123793 - protein, 19 aa, Mycobacterium avium
AFDVLASPVPLVPIAFDPP

SEQ ID NO: 123794 - protein, 19 aa, Mycobacterium avium
AFEAGWIQPTWPREHGGRS

SEQ ID NO: 123795 - protein, 21 aa, Mycobacterium avium
AFEMAATVDYLFGYDATAGVM

SEQ ID NO: 123796 - protein, 20 aa, Mycobacterium avium
AFEMLRAWNQTMADAGWAAV

SEQ ID NO: 123797 - protein, 32 aa, Mycobacterium avium
AFENAWRVNCFGAFLGIRAALERLRGTPGASI

SEQ ID NO: 123798 - protein, 26 aa, Mycobacterium avium
AFENAWRVNCFGAFLGMRAALERLRG

SEQ ID NO: 123799 - protein, 27 aa, Mycobacterium avium
AFENAWRVNCFGAFLGMRAALERLRGT

SEQ ID NO: 123800 - protein, 17 aa, Mycobacterium avium
AFESQDLSHWEKAFAGF

SEQ ID NO: 123801 - protein, 28 aa, Mycobacterium avium
AFFACADGYVYLYMTSRAHWHGMKTLMG

SEQ ID NO: 123802 - protein, 23 aa, Mycobacterium avium
AFFAKNMLPRLSGLRGIIEAIDD

SEQ ID NO: 123803 - protein, 18 aa, Mycobacterium avium
AFFDRAYDILPDDGRMLL

SEQ ID NO: 123804 - protein, 19 aa, Mycobacterium avium
AFFDRFIERVGPFARRVGG

SEQ ID NO: 123805 - protein, 22 aa, Mycobacterium avium
AFGITPALARLYRASGQDIPVG

SEQ ID NO: 123806 - protein, 17 aa, Mycobacterium avium
AFGKRWVTECLRASYPL

SEQ ID NO: 123807 - protein, 23 aa, Mycobacterium avium
AFGLLSEAPLTVLALGGEALGNA

SEQ ID NO: 123808 - protein, 27 aa, Mycobacterium avium
AFGLLSEAPLTVLALGGEALGSAAWAR

SEQ ID NO: 123809 - protein, 25 aa, Mycobacterium avium
AFGPHSRRPMWRRGRRAEKATALCW

SEQ ID NO: 123810 - protein, 24 aa, Mycobacterium avium
AFGPKPIRKPHPVIWMGGDADAVL

SEQ ID NO: 123811 - protein, 24 aa, Mycobacterium avium
AFGREDYWLARIAPAATTTLDSLV

SEQ ID NO: 123812 - protein, 33 aa, Mycobacterium avium
AFHAGLQDILLIAFGLAWTQFIGTGAPIGIDVE

SEQ ID NO: 123813 - protein, 18 aa, Mycobacterium avium
AFHNGSPLYIELPVSVEM

SEQ ID NO: 123814 - protein, 18 aa, Mycobacterium avium
AFIRLIETGWDAEAHRRP

SEQ ID NO: 123815 - protein, 17 aa, Mycobacterium avium
AFLGKDEDLYVFSSVAD

SEQ ID NO: 123816 - protein, 17 aa, Mycobacterium avium
AFLLADMAAAVDSARAT

SEQ ID NO: 123817 - protein, 17 aa, Mycobacterium avium
AFLTPRVKPLIITNQPD

SEQ ID NO: 123818 - protein, 27 aa, Mycobacterium avium
AFMDENLKLAIPLRGALGDPATDLAPL

SEQ ID NO: 123819 - protein, 33 aa, Mycobacterium avium
AFNGWKTLSWVDANIWRRVVPKGWFYNVMVTGV

SEQ ID NO: 123820 - protein, 18 aa, Mycobacterium avium
AFPAPLAELRGGAVWDAA

SEQ ID NO: 123821 - protein, 19 aa, Mycobacterium avium
AFQGWLRNSPYYPHDALFG

SEQ ID NO: 123822 - protein, 17 aa, Mycobacterium avium
AFRAIDRLGPELSVREI

SEQ ID NO: 123823 - protein, 22 aa, Mycobacterium avium
AFRVSVPPSLSWFDVDQPSVIG

SEQ ID NO: 123824 - protein, 22 aa, Mycobacterium avium
AFSEPLARRYMAAGASFVLVGA

SEQ ID NO: 123825 - protein, 25 aa, Mycobacterium avium
AFTGQQTFYFYPVNEYGGYQLGSST

SEQ ID NO: 123826 - protein, 21 aa, Mycobacterium avium
AFTTVVPTFGVALSASIIAEG

SEQ ID NO: 123827 - protein, 25 aa, Mycobacterium avium
AFVGRIQPLKAPDIVLRAAAKLPGV

SEQ ID NO: 123828 - protein, 28 aa, Mycobacterium avium
AFVHIRYDLFPPDGPLQGAPPPVDQLRL

SEQ ID NO: 123829 - protein, 18 aa, Mycobacterium avium
AFVSERIGLAAQAYSSAQ

SEQ ID NO: 123830 - protein, 17 aa, Mycobacterium avium
AFYRGKIATAAFFAKNM

SEQ ID NO: 123831 - protein, 27 aa, Mycobacterium avium
AGACQLAQRPGGLLRDTRLFEAAAALP

SEQ ID NO: 123832 - protein, 24 aa, Mycobacterium avium
AGAGKWVCTTLQGGKQMSDVVSTL

SEQ ID NO: 123833 - protein, 19 aa, Mycobacterium avium
AGAGWAGVRWRNLTGGIVA

SEQ ID NO: 123834 - protein, 26 aa, Mycobacterium avium
AGALDLRPTAQLPPKSLRRLLEVNVE

SEQ ID NO: 123835 - protein, 19 aa, Mycobacterium avium
AGAPFVGPAGRLLARALHD

SEQ ID NO: 123836 - protein, 27 aa, Mycobacterium avium
AGAPPHPCPLSFIVAPTLIQHGTDQQK

SEQ ID NO: 123837 - protein, 32 aa, Mycobacterium avium
AGAPVGMTYIAQLDWPLADAVRWPAQYISEFA

SEQ ID NO: 123838 - protein, 25 aa, Mycobacterium avium
AGASEIPLDFRILDTILGAQTTFRS

SEQ ID NO: 123839 - protein, 29 aa, Mycobacterium avium
AGASPRFYASWCRLLPAGVDLYGVTYPGR

SEQ ID NO: 123840 - protein, 41 aa, Mycobacterium avium
AGCARRLLDAPAVLGLARDGGWWVFGVAAPALADCLRAVPM

SEQ ID NO: 123841 - protein, 18 aa, Mycobacterium avium
AGCATRDPVLCHSGFQIF

SEQ ID NO: 123842 - protein, 28 aa, Mycobacterium avium
AGCDRIRFTPYQKLVLLDIPDDKLDEVV

SEQ ID NO: 123843 - protein, 25 aa, Mycobacterium avium
AGDGWSIIMAGLDFERFGIGGNVVL

SEQ ID NO: 123844 - protein, 28 aa, Mycobacterium avium
AGDIGYNCHLIFRTDLYRRTTIERLAGW

SEQ ID NO: 123845 - protein, 25 aa, Mycobacterium avium
AGDQAGFPLGWVHDVVWAPRPVSGP

SEQ ID NO: 123846 - protein, 17 aa, Mycobacterium avium
AGDQLFLSTAGPGQPFA

SEQ ID NO: 123847 - protein, 18 aa, Mycobacterium avium
AGDQLFLSTAGPGQPFAS

SEQ ID NO: 123848 - protein, 17 aa, Mycobacterium avium
AGDVHLPFQLHVLDVRG

SEQ ID NO: 123849 - protein, 30 aa, Mycobacterium avium
AGDVWFPQPPPPDHPWRTMPNHAMTPHISG

SEQ ID NO: 123850 - protein, 27 aa, Mycobacterium avium
AGEAYFDEYKARLQPHLEAMAALKEQV

SEQ ID NO: 123851 - protein, 25 aa, Mycobacterium avium
AGEGKLTQLPPLLAAPPVKTRYVTS

SEQ ID NO: 123852 - protein, 28 aa, Mycobacterium avium
AGEGRVSWLFVPRLRADGWLRIGGADYR

SEQ ID NO: 123853 - protein, 25 aa, Mycobacterium avium
AGEIDFRLFATIVYRTDLITDRGVL

SEQ ID NO: 123854 - protein, 33 aa, Mycobacterium avium
AGEPQWVPPPPFTWDYRLFAGPHPAPVAPHDHT

SEQ ID NO: 123855 - protein, 27 aa, Mycobacterium avium
AGEPWTVSKLYYNHGFLRARMQLLHDE

SEQ ID NO: 123856 - protein, 17 aa, Mycobacterium avium
AGFAALLTLLAEAGDSA

SEQ ID NO: 123857 - protein, 18 aa, Mycobacterium avium
AGFDKGQPTAWIAEGLFG

SEQ ID NO: 123858 - protein, 23 aa, Mycobacterium avium
AGFDPEFFGINERPRWTRNTACC

SEQ ID NO: 123859 - protein, 22 aa, Mycobacterium avium
AGFGRPAFVSRSVLVTGGNRGI

SEQ ID NO: 123860 - protein, 37 aa, Mycobacterium avium
AGFIGSPAMNFFPATLTPIGLKLPFGEVMLTPEVQQV

SEQ ID NO: 123861 - protein, 32 aa, Mycobacterium avium
AGFIGSPAMNFFPATLTPIGLKVPFGEVMLTP

SEQ ID NO: 123862 - protein, 25 aa, Mycobacterium avium
AGFPNSPFFLGEWLCAPAVLDPLLG

SEQ ID NO: 123863 - protein, 20 aa, Mycobacterium avium
AGFPRVRIYCPHGAPACDGW

SEQ ID NO: 123864 - protein, 28 aa, Mycobacterium avium
AGFSHFTLLLVHALRQQFSRVRVFAFID

SEQ ID NO: 123865 - protein, 29 aa, Mycobacterium avium
AGGAEVQWWFDLPWSAGFVRPQHPIETIR

SEQ ID NO: 123866 - protein, 24 aa, Mycobacterium avium
AGGAHIVMIGILPTLMPEHLDHDW

SEQ ID NO: 123867 - protein, 25 aa, Mycobacterium avium
AGGAHIVMIGILPTLMPEHLDHDWM

SEQ ID NO: 123868 - protein, 32 aa, Mycobacterium avium
AGGGENPFLPVPLADQFGLSKGLPGLAEWTVG

SEQ ID NO: 123869 - protein, 26 aa, Mycobacterium avium
AGGIDYRAFQTLVFRTDLITDAQALA

SEQ ID NO: 123870 - protein, 26 aa, Mycobacterium avium
AGGIDYRAFQTLVFRTDLITDAQVLA

SEQ ID NO: 123871 - protein, 29 aa, Mycobacterium avium
AGGLIGAALRPWRLARVLPTTALTLAETV

SEQ ID NO: 123872 - protein, 24 aa, Mycobacterium avium
AGGLPRPLMVVTMGLPASGKTTLA

SEQ ID NO: 123873 - protein, 19 aa, Mycobacterium avium
AGGLTLRRIGLSDRLCELD

SEQ ID NO: 123874 - protein, 25 aa, Mycobacterium avium
AGGMVRTVSWLYLGQTMVIHQRFDP

SEQ ID NO: 123875 - protein, 20 aa, Mycobacterium avium
AGGRCLDVVRLLRITTDSPA

SEQ ID NO: 123876 - protein, 17 aa, Mycobacterium avium
AGGRRLAVPPRGTRPTT

SEQ ID NO: 123877 - protein, 27 aa, Mycobacterium avium
AGGRYGLVGILIQLARQRGVSSFAGDG

SEQ ID NO: 123878 - protein, 25 aa, Mycobacterium avium
AGGSEIPLDFRILDTILGAQTTFRS

SEQ ID NO: 123879 - protein, 19 aa, Mycobacterium avium
AGGWLRPDSPLTPPRFADR

SEQ ID NO: 123880 - protein, 29 aa, Mycobacterium avium
AGHALKASIAWRTLRALLLSRRGDYDEAR

SEQ ID NO: 123881 - protein, 30 aa, Mycobacterium avium
AGHALKASIAWRTLRALLLSRRGDYDEARR

SEQ ID NO: 123882 - protein, 24 aa, Mycobacterium avium
AGHHRGPFLGCTALRESIQAAVTR

SEQ ID NO: 123883 - protein, 18 aa, Mycobacterium avium
AGHIQDVRRLVDGGDLPG

SEQ ID NO: 123884 - protein, 21 aa, Mycobacterium avium
AGHNFPLACPGLLGAMTVGAT

SEQ ID NO: 123885 - protein, 20 aa, Mycobacterium avium
AGIALLACMPPRPGERELVS

SEQ ID NO: 123886 - protein, 25 aa, Mycobacterium avium
AGIDRPLRLTSPEATGLLVALRALA

SEQ ID NO: 123887 - protein, 18 aa, Mycobacterium avium
AGIPAVERLAISPKPPPP

SEQ ID NO: 123888 - protein, 18 aa, Mycobacterium avium
AGIRPGDTLVFAIKILGA

SEQ ID NO: 123889 - protein, 19 aa, Mycobacterium avium
AGIRPGDTLVFAIKILGAT

SEQ ID NO: 123890 - protein, 23 aa, Mycobacterium avium
AGKLGFLGVNLPEQYGGGGAGMY

SEQ ID NO: 123891 - protein, 26 aa, Mycobacterium avium
AGKTDRPIIFPLSNPTSRAEAHPAEL

SEQ ID NO: 123892 - protein, 25 aa, Mycobacterium avium
AGKTTLLRCLLGLLTPQSGTVRVAG

SEQ ID NO: 123893 - protein, 28 aa, Mycobacterium avium
AGLCGALRRYHEVFGVPISTLPMAVPVN

SEQ ID NO: 123894 - protein, 18 aa, Mycobacterium avium
AGLCLPVVRAAGLLHRET

SEQ ID NO: 123895 - protein, 24 aa, Mycobacterium avium
AGLDARAYRLDWPAGAVVYEVDQP

SEQ ID NO: 123896 - protein, 26 aa, Mycobacterium avium
AGLDNVRILDGGLAAWRAAGGRLVSG

SEQ ID NO: 123897 - protein, 25 aa, Mycobacterium avium
AGLDNVRILDGGLAAWRATGGRLES

SEQ ID NO: 123898 - protein, 26 aa, Mycobacterium avium
AGLDNVRILDGGLAAWRATGGRLVSG

SEQ ID NO: 123899 - protein, 17 aa, Mycobacterium avium
AGLINRIRLAGAIPRHI

SEQ ID NO: 123900 - protein, 19 aa, Mycobacterium avium
AGLKLLAPGGRFIEIGKRD

SEQ ID NO: 123901 - protein, 17 aa, Mycobacterium avium
AGLKPDLIVAINAGLDA

SEQ ID NO: 123902 - protein, 23 aa, Mycobacterium avium
AGLLFNDLTVYFALTVRGRLQRG

SEQ ID NO: 123903 - protein, 30 aa, Mycobacterium avium; identical to SEQ ID NO: 93653

SEQ ID NO: 123904 - protein, 23 aa, Mycobacterium avium
AGLPGSPWHERAKKLAPKGTGAV

SEQ ID NO: 123905 - protein, 26 aa, Mycobacterium avium
AGLRAGIPSLILWTAGDQPLWGSHIK

SEQ ID NO: 123906 - protein, 26 aa, Mycobacterium avium
AGLRAGIPSLILWTAGDQPLWGSRIK

SEQ ID NO: 123907 - protein, 29 aa, Mycobacterium avium
AGLRDAIADTMFPILLTAASEVTCDAGQT

SEQ ID NO: 123908 - protein, 27 aa, Mycobacterium avium
AGLRSLLAYQWAHPGKQLLFMGQEFGQ

SEQ ID NO: 123909 - protein, 21 aa, Mycobacterium avium
AGLVGLIKTLAIEGAKYGITA

SEQ ID NO: 123910 - protein, 20 aa, Mycobacterium avium
AGMAPYMVRVLGTTAPTQQV

SEQ ID NO: 123911 - protein, 24 aa, Mycobacterium avium
AGMDARAYRLAWPDGTVVYELDQP

SEQ ID NO: 123912 - protein, 28 aa, Mycobacterium avium
AGMRAGVPTLVLWMRNEQPLWGAAVKQM

SEQ ID NO: 123913 - protein, 19 aa, Mycobacterium avium
AGNADFAIAIRTALMRGGT

SEQ ID NO: 123914 - protein, 19 aa, Mycobacterium avium
AGNGMLLPKSMTATPEAFN

SEQ ID NO: 123915 - protein, 23 aa, Mycobacterium avium
AGNRAFFDWMNHGKLCYGIDFDR

SEQ ID NO: 123916 - protein, 23 aa, Mycobacterium avium
AGPAPWKPMVSLSGPTSLPIEFD

SEQ ID NO: 123917 - protein, 29 aa, Mycobacterium avium
AGPDQPALRALLDLLPIAAGSGTLGDRFT

SEQ ID NO: 123918 - protein, 24 aa, Mycobacterium avium
AGPHNRMISWPYTKLMNSNNMVDQ

SEQ ID NO: 123919 - protein, 19 aa, Mycobacterium avium
AGPKIWEKTGLTPADMDVA

SEQ ID NO: 123920 - protein, 18 aa, Mycobacterium avium
AGPLRRPGTAWPPNYVPP

SEQ ID NO: 123921 - protein, 20 aa, Mycobacterium avium
AGPQRLSGPEALSFVRQRHE

SEQ ID NO: 123922 - protein, 17 aa, Mycobacterium avium
AGPRRRPRLGRRTRHLQ

SEQ ID NO: 123923 - protein, 18 aa, Mycobacterium avium
AGPTPRVNPWSTPIPKVY

SEQ ID NO: 123924 - protein, 31 aa, Mycobacterium avium
AGPVDLRAWRQWWTWMPGACWRQPFGPGSSI

SEQ ID NO: 123925 - protein, 25 aa, Mycobacterium avium
AGQDKLFDTLFGYENYPLDTSALAV

SEQ ID NO: 123926 - protein, 21 aa, Mycobacterium avium
AGQDLLGGRFGGAVFTGAVFG

SEQ ID NO: 123927 - protein, 17 aa, Mycobacterium avium
AGQRWNWSGGRDGEVLV

SEQ ID NO: 123928 - protein, 20 aa, Mycobacterium avium
AGQWRALALVTTTADLVGVA

SEQ ID NO: 123929 - protein, 21 aa, Mycobacterium avium
AGRDHLARYYAFAPGYAQVNV

SEQ ID NO: 123930 - protein, 27 aa, Mycobacterium avium
AGRGPRTWPRRWPPPTPEVPAPRCWPG

SEQ ID NO: 123931 - protein, 23 aa, Mycobacterium avium
AGRGPVVPALGLALLGARAAGKV

SEQ ID NO: 123932 - protein, 20 aa, Mycobacterium avium
AGRHAQWPMVLAASPHVADP

SEQ ID NO: 123933 - protein, 19 aa, Mycobacterium avium
AGRHPAVFFDFDGTLSDIV

SEQ ID NO: 123934 - protein, 19 aa, Mycobacterium avium
AGRLVAAERPAVLPLSFAQ

SEQ ID NO: 123935 - protein, 22 aa, Mycobacterium avium
AGRNLAPRKVLRARTRTPARHR

SEQ ID NO: 123936 - protein, 25 aa, Mycobacterium avium
AGRPLRIVLVAPPYFDVPPDGYGGV

SEQ ID NO: 123937 - protein, 22 aa, Mycobacterium avium
AGRPMILKRFVKGITQEAVFQK

SEQ ID NO: 123938 - protein, 28 aa, Mycobacterium avium
AGRPPVLYELVHGTPFTELLALHGVSAD

SEQ ID NO: 123939 - protein, 25 aa, Mycobacterium avium
AGRRGRKWFQIKASQQVVLPQRRHG

SEQ ID NO: 123940 - protein, 24 aa, Mycobacterium avium
AGRSGTALLFVSPRERHLLKAIEK

SEQ ID NO: 123941 - protein, 25 aa, Mycobacterium avium
AGRSGTALLFVSPRERHLLKAIEKA

SEQ ID NO: 123942 - protein, 24 aa, Mycobacterium avium
AGRTMYVIAFCMGPLDAAEPKFGV

SEQ ID NO: 123943 - protein, 32 aa, Mycobacterium avium
AGRVVEFMLLDRLFPRSVFYSLRLAEHNLDEL

SEQ ID NO: 123944 - protein, 17 aa, Mycobacterium avium
AGRYRTVRVGGHDVRML

SEQ ID NO: 123945 - protein, 26 aa, Mycobacterium avium
AGSAPLSWPPGWSGWPHRVYGDTRLE

SEQ ID NO: 123946 - protein, 28 aa, Mycobacterium avium
AGTAAALMRLALDTAGRWGATRVWLGVN

SEQ ID NO: 123947 - protein, 26 aa, Mycobacterium avium
AGTAAALMRLALDTAGRWGVSRVWLG

SEQ ID NO: 123948 - protein, 18 aa, Mycobacterium avium
AGTLARVGVLLDAVYDPW

SEQ ID NO: 123949 - protein, 25 aa, Mycobacterium avium
AGTRRARLFYANRSRDAVIFDEDLA

SEQ ID NO: 123950 - protein, 25 aa, Mycobacterium avium
AGTTVFFDYPPHPRTIAHTVRGFDE

SEQ ID NO: 123951 - protein, 20 aa, Mycobacterium avium
AGTVDPLALLFPEGTLDTAT

SEQ ID NO: 123952 - protein, 23 aa, Mycobacterium avium
AGTVLSRFGFPGGGYLAPEGTPF

SEQ ID NO: 123953 - protein, 37 aa, Mycobacterium avium
AGTVNFYGQLLQILKNRLLLTDLLKRHPEIHDIELHS

SEQ ID NO: 123954 - protein, 37 aa, Mycobacterium avium
AGTVNFYGQLLQILKNRLLLTDLLKRHPEIHDIELRS

SEQ ID NO: 123955 - protein, 29 aa, Mycobacterium avium
AGTVRPYIGARFPLARTAAALRHVADRKV

SEQ ID NO: 123956 - protein, 25 aa, Mycobacterium avium
AGVARSGFYFYFDSKYAVLAQLMAE

SEQ ID NO: 123957 - protein, 25 aa, Mycobacterium avium
AGVAVRILRLLAAAEAVGGLGACTE

SEQ ID NO: 123958 - protein, 19 aa, Mycobacterium avium
AGVDAPPTVILSISTQGQA

SEQ ID NO: 123959 - protein, 22 aa, Mycobacterium avium
AGVDYPLPPSDALRVLEHPGAE

SEQ ID NO: 123960 - protein, 28 aa, Mycobacterium avium
AGVPPHPCPLSFILAPTLIAHGTQQQKD

SEQ ID NO: 123961 - protein, 31 aa, Mycobacterium avium
AGVQDILLIAFGLAWTQFIGTGAPIGIDVEG

SEQ ID NO: 123962 - protein, 24 aa, Mycobacterium avium
AGVQLAVHPLASRALFGLPSAEIP

SEQ ID NO: 123963 - protein, 19 aa, Mycobacterium avium
AGVSGLWLLSGMSDDGVLT

SEQ ID NO: 123964 - protein, 17 aa, Mycobacterium avium
AGVTALAKGRFVTAPQL

SEQ ID NO: 123965 - protein, 17 aa, Mycobacterium avium
AGVTYHLADGRAALCDH

SEQ ID NO: 123966 - protein, 23 aa, Mycobacterium avium
AGVYYRRALMLAASFGRSSDYPQ

SEQ ID NO: 123967 - protein, 17 aa, Mycobacterium avium
AGWIKRGPSGFIGTNKS

SEQ ID NO: 123968 - protein, 24 aa, Mycobacterium avium
AGWMTTYAYPPQAITSRNLSQAWT

SEQ ID NO: 123969 - protein, 25 aa, Mycobacterium avium
AGYGLVSYWTAYLKANYPAEYMAGL

SEQ ID NO: 123970 - protein, 24 aa, Mycobacterium avium
AHDDLALPDLAYTLARRRVHRPVR

SEQ ID NO: 123971 - protein, 25 aa, Mycobacterium avium
AHDEGWLAEHMLILKLISPENKAYY

SEQ ID NO: 123972 - protein, 19 aa, Mycobacterium avium
AHDLNPLLPILDSVIYMLD

SEQ ID NO: 123973 - protein, 34 aa, Mycobacterium avium
AHERSLNIDFLLGYLRELLPRRPDLKLIITSATI

SEQ ID NO: 123974 - protein, 35 aa, Mycobacterium avium
AHERSLNIDFLLGYLRELLPRRPDLKLIITSATIE

SEQ ID NO: 123975 - protein, 18 aa, Mycobacterium avium
AHGMAIMCGASLIFQYDV

SEQ ID NO: 123976 - protein, 21 aa, Mycobacterium avium
AHGPRILHTVRGIGYRLQPER

SEQ ID NO: 123977 - protein, 20 aa, Mycobacterium avium
AHGQLPNMRAIVGFAAETGD

SEQ ID NO: 123978 - protein, 18 aa, Mycobacterium avium
AHGTPFTELLALHGVSAD

SEQ ID NO: 123979 - protein, 18 aa, Mycobacterium avium
AHGTPFTELLALHGVSAN

SEQ ID NO: 123980 - protein, 24 aa, Mycobacterium avium
AHHEGRVVFVRYALPGERVRVRVT

SEQ ID NO: 123981 - protein, 19 aa, Mycobacterium avium
AHHRPVWVKGFGEHVPFKT

SEQ ID NO: 123982 - protein, 24 aa, Mycobacterium avium
AHIETLLMPSLQPETRLAAPLLAK

SEQ ID NO: 123983 - protein, 21 aa, Mycobacterium avium
AHIYTRLDRPLTASLGLLFLA

SEQ ID NO: 123984 - protein, 36 aa, Mycobacterium avium
AHIYTRLDRPLTASLGLLFLASGHRYGWPVAEGGSG

SEQ ID NO: 123985 - protein, 26 aa, Mycobacterium avium
AHLVERGHRRIAFAYTGIARWRALGD

SEQ ID NO: 123986 - protein, 19 aa, Mycobacterium avium
AHLVVWPVEPTLGGAEDRR

SEQ ID NO: 123987 - protein, 26 aa, Mycobacterium avium
AHQLQQHGVLLGFGQPVEAMRQRGFR

SEQ ID NO: 123988 - protein, 25 aa, Mycobacterium avium
AHREVLAHWPEVIASPTPASAGRVQ

SEQ ID NO: 123989 - protein, 17 aa, Mycobacterium avium
AHRGAFGGAQLLDRVVG

SEQ ID NO: 123990 - protein, 24 aa, Mycobacterium avium
AHSQKFAWTRLFRPMVHGHPLTPF

SEQ ID NO: 123991 - protein, 18 aa, Mycobacterium avium
AHVLADRLLITRAEAARR

SEQ ID NO: 123992 - protein, 41 aa, Mycobacterium avium
AIAAAHPDLILGSQGLTPALYPQLAAIAPTVFTAAPGAAWR

SEQ ID NO: 123993 - protein, 28 aa, Mycobacterium avium
AIAEGGWVLPYLPKPWGRAAGPVEQIII

SEQ ID NO: 123994 - protein, 22 aa, Mycobacterium avium
AIAELIRVLKVGGTLAVSVPRW

SEQ ID NO: 123995 - protein, 25 aa, Mycobacterium avium
AIAGGILAAVKRLYLLGKNDRPTGT

SEQ ID NO: 123996 - protein, 18 aa, Mycobacterium avium
AIAPLWKGSRFPMTSCIS

SEQ ID NO: 123997 - protein, 22 aa, Mycobacterium avium
AIARRFAHLTYRGEVELDTRFG

SEQ ID NO: 123998 - protein, 23 aa, Mycobacterium avium
AIASHWPFEQWGRFLPEHTTAAS

SEQ ID NO: 123999 - protein, 20 aa, Mycobacterium avium
AICHIATTLLTRIATCWRTG

SEQ ID NO: 124000 - protein, 25 aa, Mycobacterium avium
AIDKGRWTFGYLMSRATTIGAGTAE

SEQ ID NO: 124001 - protein, 20 aa, Mycobacterium avium
AIDKPVIPIISYLTGQPAAD

SEQ ID NO: 124002 - protein, 19 aa, Mycobacterium avium
AIEEAWPLHKELFDKAWGS

SEQ ID NO: 124003 - protein, 17 aa, Mycobacterium avium
AIELTGAWPGLRCDVDT

SEQ ID NO: 124004 - protein, 30 aa, Mycobacterium avium
AIFTVPNFLGLDYWQMWHYGDSTMAGVYSA

SEQ ID NO: 124005 - protein, 18 aa, Mycobacterium avium
AIFVARPLCRRRSLRWRD

SEQ ID NO: 124006 - protein, 20 aa, Mycobacterium avium
AIFYNFAPERVAKALPAAWE

SEQ ID NO: 124007 - protein, 24 aa, Mycobacterium avium
AIGLFSQMVGAQLIARAVAHADPG

SEQ ID NO: 124008 - protein, 18 aa, Mycobacterium avium
AIGLQYARYCLERGARTV

SEQ ID NO: 124009 - protein, 19 aa, Mycobacterium avium
AIGNAPTALFRLLELVDDG

SEQ ID NO: 124010 - protein, 17 aa, Mycobacterium avium
AIGVAVMGLLDRAWHTV

SEQ ID NO: 124011 - protein, 33 aa, Mycobacterium avium
AIHEEWVLTRDLPQWGMAPLAPGEKAPLIRAVI

SEQ ID NO: 124012 - protein, 17 aa, Mycobacterium avium
AIHRFPGSMAKRIQALA

SEQ ID NO: 124013 - protein, 25 aa, Mycobacterium avium
AIHYLAVFDEHTGRPLYLGRQKRVA

SEQ ID NO: 124014 - protein, 17 aa, Mycobacterium avium
AIIACYAAMERELAHVP

SEQ ID NO: 124015 - protein, 24 aa, Mycobacterium avium
AIITELGPVLALHVGAGAVAVVVQ

SEQ ID NO: 124016 - protein, 31 aa, Mycobacterium avium
AIITRGLAEIMRLGIALGAKGATLAGLAGVG

SEQ ID NO: 124017 - protein, 28 aa, Mycobacterium avium
AILCGSAPAPVWLWQRIAKDFGVSEIVT

SEQ ID NO: 124018 - protein, 23 aa, Mycobacterium avium
AILRDGVPILLIRGQMSDLVSQE

SEQ ID NO: 124019 - protein, 18 aa, Mycobacterium avium
AILRRHDIIPQTSRPEFR

SEQ ID NO: 124020 - protein, 26 aa, Mycobacterium avium
AILTGRPAISVPLHWTDDGLPLGVQF

SEQ ID NO: 124021 - protein, 28 aa, Mycobacterium avium
AIPDDWLIATLLTVGWPKGGHHAVRRKP

SEQ ID NO: 124022 - protein, 17 aa, Mycobacterium avium
AIPGGFVRDVVERVAPS

SEQ ID NO: 124023 - protein, 24 aa, Mycobacterium avium
AIQHRLVELLVFEVKARAVIMKAA

SEQ ID NO: 124024 - protein, 22 aa, Mycobacterium avium
AIQMPADLPDRLAGVIYPPGTA

SEQ ID NO: 124025 - protein, 19 aa, Mycobacterium avium
AIQMPADLPDRLAGVTYPP

SEQ ID NO: 124026 - protein, 18 aa, Mycobacterium avium
AIRAGMSLGIMHDLAVGV

SEQ ID NO: 124027 - protein, 20 aa, Mycobacterium avium
AIRDARLQIAFYLTVKTYDS

SEQ ID NO: 124028 - protein, 26 aa, Mycobacterium avium
AIRREDLDYWRPLMADLPEPLELPGP

SEQ ID NO: 124029 - protein, 27 aa, Mycobacterium avium
AIRREDLDYWRPLMADLPEPLELPGPN

SEQ ID NO: 124030 - protein, 17 aa, Mycobacterium avium
AIRTTKKALWHSLEVGM

SEQ ID NO: 124031 - protein, 30 aa, Mycobacterium avium
AISDELWDLLPGYLIFRSIVPTRPPSRRTV

SEQ ID NO: 124032 - protein, 24 aa, Mycobacterium avium
AISKAPLVPSMLEWLHTARTSMVM

SEQ ID NO: 124033 - protein, 25 aa, Mycobacterium avium
AITDDQLIFYFAPGEMLPAFGGPVQ

SEQ ID NO: 124034 - protein, 21 aa, Mycobacterium avium
AITTELWHAPPAPTLAQLSEE

SEQ ID NO: 124035 - protein, 19 aa, Mycobacterium avium
AIVAPKPLQDNGIPLWIAG

SEQ ID NO: 124036 - protein, 20 aa, Mycobacterium avium
AIVQAALPYLRRSGNAHVVN

SEQ ID NO: 124037 - protein, 24 aa, Mycobacterium avium
AIYVYAPDLIPKIKAQAGQPAPPA

SEQ ID NO: 124038 - protein, 22 aa, Mycobacterium avium
AKAAAFHLRHGTTTTMASLVTG

SEQ ID NO: 124039 - protein, 17 aa, Mycobacterium avium
AKADVLVSYLPVGSEEA

SEQ ID NO: 124040 - protein, 18 aa, Mycobacterium avium
AKEPLPVFADRWFQRYSQ

SEQ ID NO: 124041 - protein, 19 aa, Mycobacterium avium
AKFTHPLRFDVPITGQHST

SEQ ID NO: 124042 - protein, 17 aa, Mycobacterium avium
AKIAELKPPAPAAEPEP

SEQ ID NO: 124043 - protein, 18 aa, Mycobacterium avium
AKKITKLIRDEGPKGVKT

SEQ ID NO: 124044 - protein, 25 aa, Mycobacterium avium
AKKLGLQRQWLHARSLSFAHPADGR

SEQ ID NO: 124045 - protein, 28 aa, Mycobacterium avium
AKKLNPRLLTMIIPARWFAGGKGLDEFR

SEQ ID NO: 124046 - protein, 38 aa, Mycobacterium avium
AKLEKTKRFLLGELLGSITRHLLLMTATPHSGKEEDFQ

SEQ ID NO: 124047 - protein, 21 aa, Mycobacterium avium
AKLRIHLEEIRRINPSIIYVT

SEQ ID NO: 124048 - protein, 17 aa, Mycobacterium avium
AKMPKWLHSHPYNDMLG

SEQ ID NO: 124049 - protein, 26 aa, Mycobacterium avium
AKMVRKRLRALKYSKQMIDDVSQLVY

SEQ ID NO: 124050 - protein, 22 aa, Mycobacterium avium
AKMVRKRLRALKYSKQMVDDVS

SEQ ID NO: 124051 - protein, 23 aa, Mycobacterium avium
AKMVRKRLRALRYSKQMVDDVSQ

SEQ ID NO: 124052 - protein, 25 aa, Mycobacterium avium
AKNLSIPVLLIRGKLSDVVSPEGVR

SEQ ID NO: 124053 - protein, 24 aa, Mycobacterium avium
AKPDDLLRLAEALVRRADVTHANV

SEQ ID NO: 124054 - protein, 17 aa, Mycobacterium avium
AKPGYIGYAWTAMEPVN

SEQ ID NO: 124055 - protein, 24 aa, Mycobacterium avium
AKPRAVLTMLGLHGGALVSADALM

SEQ ID NO: 124056 - protein, 22 aa, Mycobacterium avium
AKRLVDFAAGLAFALRGSFDKV

SEQ ID NO: 124057 - protein, 21 aa, Mycobacterium avium
AKRWHAIAEIIARGWDDVLGA

SEQ ID NO: 124058 - protein, 30 aa, Mycobacterium avium
AKRYTGRGMAFLDLIQEGNLGLIRAVEKFD

SEQ ID NO: 124059 - protein, 24 aa, Mycobacterium avium
AKSPIKGIPAIVKAEYKAGTALGE

SEQ ID NO: 124060 - protein, 17 aa, Mycobacterium avium
AKVDVLVSYLPVGSEEA

SEQ ID NO: 124061 - protein, 24 aa, Mycobacterium avium
AKVRRIRLHDARHSCASLMHAQGV

SEQ ID NO: 124062 - protein, 22 aa, Mycobacterium avium
AKVSTLRLLRSILDVAHQDGRI

SEQ ID NO: 124063 - protein, 28 aa, Mycobacterium avium
AKVWRMLTEPELMKLWWAEGQVAAVVGH

SEQ ID NO: 124064 - protein, 21 aa, Mycobacterium avium
AKYPVALRLGGLSWGQVVGGD

SEQ ID NO: 124065 - protein, 17 aa, Mycobacterium avium
ALAADPPILLMDEPFSA

SEQ ID NO: 124066 - protein, 18 aa, Mycobacterium avium
ALAALWESLGVTPDVVMG

SEQ ID NO: 124067 - protein, 18 aa, Mycobacterium avium
ALAAPVRIAIVLQLRQSH

SEQ ID NO: 124068 - protein, 24 aa, Mycobacterium avium
ALAERRLVRLLHLGGTAALPSYFE

SEQ ID NO: 124069 - protein, 20 aa, Mycobacterium avium
ALAGLERWVRGEKARRRRVG

SEQ ID NO: 124070 - protein, 25 aa, Mycobacterium avium
ALAGLRGWGLRDLGYTLTRRRAHRP

SEQ ID NO: 124071 - protein, 28 aa, Mycobacterium avium
ALAGPTGWGLRDLGYTLTRRRAHRPVRT

SEQ ID NO: 124072 - protein, 38 aa, Mycobacterium avium
ALAIQRTPMPLSGPLFRFALFATRRDQFYLFACCHHIV

SEQ ID NO: 124073 - protein, 25 aa, Mycobacterium avium
ALALKLINNLLFAANAQLLASAAQL

SEQ ID NO: 124074 - protein, 21 aa, Mycobacterium avium
ALALYHTKRLASPAQRIVLYA

SEQ ID NO: 124075 - protein, 17 aa, Mycobacterium avium
ALAPHAWRRKPMSVDAI

SEQ ID NO: 124076 - protein, 25 aa, Mycobacterium avium
ALAPKRVLPVFGLRSAIPAEREVFV

SEQ ID NO: 124077 - protein, 26 aa, Mycobacterium avium
ALAPKRVLPVFGLRSAIPAEREVFVV

SEQ ID NO: 124078 - protein, 24 aa, Mycobacterium avium
ALAPTHTLLLAGRPSDRLDAVARR

SEQ ID NO: 124079 - protein, 24 aa, Mycobacterium avium
ALAPVATRRRCVVRPATALNRMTR

SEQ ID NO: 124080 - protein, 18 aa, Mycobacterium avium
ALARFDQLTRPAPRLQNA

SEQ ID NO: 124081 - protein, 24 aa, Mycobacterium avium
ALARLGPLLVVTATGREADDLTAE

SEQ ID NO: 124082 - protein, 20 aa, Mycobacterium avium
ALASDFLVHGRIVYAAGPIG

SEQ ID NO: 124083 - protein, 22 aa, Mycobacterium avium
ALAVHRAFDALGGTARLLEMTV

SEQ ID NO: 124084 - protein, 17 aa, Mycobacterium avium
ALCAAFDVDGMRADLVV

SEQ ID NO: 124085 - protein, 25 aa, Mycobacterium avium
ALCGAPVRIPLLFGGRSAATVRRVV

SEQ ID NO: 124086 - protein, 24 aa, Mycobacterium avium
ALCSSTLWAADVLATAPALGEGND

SEQ ID NO: 124087 - protein, 24 aa, Mycobacterium avium
ALDIYFNLANYRNNWKRLGFTDDE

SEQ ID NO: 124088 - protein, 18 aa, Mycobacterium avium
ALDLLDDALLGEQPLVVG

SEQ ID NO: 124089 - protein, 19 aa, Mycobacterium avium
ALDLLPQVGFVNAYGLTET

SEQ ID NO: 124090 - protein, 18 aa, Mycobacterium avium
ALDLRKRLRRTVGNSVPV

SEQ ID NO: 124091 - protein, 20 aa, Mycobacterium avium
ALDPLSALMGLSQRVWWVCG

SEQ ID NO: 124092 - protein, 21 aa, Mycobacterium avium
ALDPLYLCGTGRDLQTAADGA

SEQ ID NO: 124093 - protein, 19 aa, Mycobacterium avium
ALDPQRVVLLPDGTEDYWS

SEQ ID NO: 124094 - protein, 24 aa, Mycobacterium avium
ALDPRWTVRQILDGPLRSYRVHDR

SEQ ID NO: 124095 - protein, 17 aa, Mycobacterium avium
ALDRAGFKIIASGLRDC

SEQ ID NO: 124096 - protein, 24 aa, Mycobacterium avium
ALDTLRGQLFPLATLVTPNLDEVR

SEQ ID NO: 124097 - protein, 25 aa, Mycobacterium avium
ALDTLRGQLFPLATLVTPNLDEVRL

SEQ ID NO: 124098 - protein, 17 aa, Mycobacterium avium
ALDVLIRERPRITAALD

SEQ ID NO: 124099 - protein, 17 aa, Mycobacterium avium
ALDVLTNARRPLIVLGK

SEQ ID NO: 124100 - protein, 18 aa, Mycobacterium avium
ALECGALSEWRATLIVRE

SEQ ID NO: 124101 - protein, 19 aa, Mycobacterium avium
ALECGALSEWRATLIVRES

SEQ ID NO: 124102 - protein, 19 aa, Mycobacterium avium
ALEDVSIPTLLLSLVHITG

SEQ ID NO: 124103 - protein, 21 aa, Mycobacterium avium
ALEIDVPSRHEHHVRAGLGDS

SEQ ID NO: 124104 - protein, 22 aa, Mycobacterium avium
ALELDLDAIPLVATLPAPRISP

SEQ ID NO: 124105 - protein, 23 aa, Mycobacterium avium
ALELDLDAIPLVATLPAPRVSPF

SEQ ID NO: 124106 - protein, 17 aa, Mycobacterium avium
ALEMLTYTHRHAIDAIY

SEQ ID NO: 124107 - protein, 17 aa, Mycobacterium avium
ALERMEASRRRQIAVSH

SEQ ID NO: 124108 - protein, 24 aa, Mycobacterium avium
ALETIALMRKMPAEAVLRMALVGS

SEQ ID NO: 124109 - protein, 22 aa, Mycobacterium avium
ALEVFPRAKAMLPKAIEAGVRI

SEQ ID NO: 124110 - protein, 23 aa, Mycobacterium avium
ALEVFPRAKAMLPKAIEAGVRIA

SEQ ID NO: 124111 - protein, 39 aa, Mycobacterium avium
ALEVRLRLLRDRIHQGWILNALWLLDTGITAAALVRSQA

SEQ ID NO: 124112 - protein, 38 aa, Mycobacterium avium
ALEVRLRLLRDRIHQGWILNALWLLDTGITAATLVRSQ

SEQ ID NO: 124113 - protein, 17 aa, Mycobacterium avium
ALFDAVVALLAAVSAGA

SEQ ID NO: 124114 - protein, 23 aa, Mycobacterium avium
ALFDTPILVPPQAAMLGTGAIVK

SEQ ID NO: 124115 - protein, 22 aa, Mycobacterium avium
ALFEYRLRQRFWAGRVIHTIRL

SEQ ID NO: 124116 - protein, 19 aa, Mycobacterium avium
ALFGGFPVVLIPKVSAADL

SEQ ID NO: 124117 - protein, 35 aa, Mycobacterium avium
ALFGHPAFRYVGWGPRLWWWAETMGLRKFSEMLFT

SEQ ID NO: 124118 - protein, 17 aa, Mycobacterium avium
ALFGTWHAGGVYTPLNP

SEQ ID NO: 124119 - protein, 35 aa, Mycobacterium avium
ALFHAFAVQMNLIGPLWFAIRTYRQMQTQDRMGCI

SEQ ID NO: 124120 - protein, 22 aa, Mycobacterium avium
ALFRLLELVDDGVGPPAGVLGG

SEQ ID NO: 124121 - protein, 17 aa, Mycobacterium avium
ALGFLDLSALNSAGRSF

SEQ ID NO: 124122 - protein, 19 aa, Mycobacterium avium
ALGGRFIELGKRDIYRDSQ

SEQ ID NO: 124123 - protein, 19 aa, Mycobacterium avium
ALGRLLLGSVTAALLAHAH

SEQ ID NO: 124124 - protein, 26 aa, Mycobacterium avium
ALGTALARLGMFAPALSYLEEPEGPV

SEQ ID NO: 124125 - protein, 17 aa, Mycobacterium avium
ALGYFNHLAGDQGVAWS

SEQ ID NO: 124126 - protein, 26 aa, Mycobacterium avium
ALHAGWRALGWWLVGTSRAMLTLARR

SEQ ID NO: 124127 - protein, 18 aa, Mycobacterium avium
ALHAIHLAQLLPAEHTGA

SEQ ID NO: 124128 - protein, 24 aa, Mycobacterium avium
ALHALGPQWVLVKGGHLRSSQRSC

SEQ ID NO: 124129 - protein, 25 aa, Mycobacterium avium
ALHGFELRLGLLRAGGGRLDALGQP

SEQ ID NO: 124130 - protein, 17 aa, Mycobacterium avium
ALHGYTYTIRGRAEGFD

SEQ ID NO: 124131 - protein, 19 aa, Mycobacterium avium
ALHHCVVGFAAVGWQARVT

SEQ ID NO: 124132 - protein, 18 aa, Mycobacterium avium
ALHRGLLQGLAGPAKPVG

SEQ ID NO: 124133 - protein, 19 aa, Mycobacterium avium
ALHSSAMPGGWAAAPSPGP

SEQ ID NO: 124134 - protein, 17 aa, Mycobacterium avium
ALIARWLEAPGVRIVRV

SEQ ID NO: 124135 - protein, 20 aa, Mycobacterium avium
ALIAVRGLHRFLAAEGLAEL

SEQ ID NO: 124136 - protein, 18 aa, Mycobacterium avium
ALIDAELTAFIGASPHER

SEQ ID NO: 124137 - protein, 24 aa, Mycobacterium avium
ALIDVAHWASEFPWCAQAADLLRS

SEQ ID NO: 124138 - protein, 19 aa, Mycobacterium avium
ALKPRQWYDDNDITLRLGS

SEQ ID NO: 124139 - protein, 18 aa, Mycobacterium avium
ALLAGLAARRDAEMERGM

SEQ ID NO: 124140 - protein, 20 aa, Mycobacterium avium
ALLAQLVATNIFGQNTAAIA

SEQ ID NO: 124141 - protein, 20 aa, Mycobacterium avium
ALLEELLQRATVPERVYSHG

SEQ ID NO: 124142 - protein, 29 aa, Mycobacterium avium
ALLELRRSRPYWGPRRLVFELAKRRVGPV

SEQ ID NO: 124143 - protein, 18 aa, Mycobacterium avium
ALLFGNVLARLTTADWDR

SEQ ID NO: 124144 - protein, 24 aa, Mycobacterium avium
ALLFTKRPLMAEAMLRVFFEAYEI

SEQ ID NO: 124145 - protein, 19 aa, Mycobacterium avium
ALLIVLNIGDEPLRVSLRE

SEQ ID NO: 124146 - protein, 26 aa, Mycobacterium avium
ALLNGPRYWLMNGIEKQPQGPRITKT

SEQ ID NO: 124147 - protein, 30 aa, Mycobacterium avium
ALLPVHVHFEGEGWRFLIYPALDCSSGDVG

SEQ ID NO: 124148 - protein, 25 aa, Mycobacterium avium
ALLQCDAMPVLRWVRRMRSNSELPA

SEQ ID NO: 124149 - protein, 18 aa, Mycobacterium avium
ALLRRLVEAGTRVVQYGY

SEQ ID NO: 124150 - protein, 25 aa, Mycobacterium avium
ALLSGLLEALPPNAALLVTADHGGL

SEQ ID NO: 124151 - protein, 31 aa, Mycobacterium avium
ALMSTKPPRILTAALVLPIGMLEADLPSTAP

SEQ ID NO: 124152 - protein, 20 aa, Mycobacterium avium
ALMTNPLLRRFNDLQATTLM

SEQ ID NO: 124153 - protein, 22 aa, Mycobacterium avium
ALNAISGRVAFALGLEGPAVAV

SEQ ID NO: 124154 - protein, 20 aa, Mycobacterium avium
ALNLFSFRPNVWDTEAETIG

SEQ ID NO: 124155 - protein, 18 aa, Mycobacterium avium
ALNVFELQKAMIAAGVAG

SEQ ID NO: 124156 - protein, 17 aa, Mycobacterium avium
ALPARYITPSSKKKPRP

SEQ ID NO: 124157 - protein, 19 aa, Mycobacterium avium
ALPEMRLLTYQMPDELLAV

SEQ ID NO: 124158 - protein, 24 aa, Mycobacterium avium
ALPLPLIAGYLDRYGIRADKVRIT

SEQ ID NO: 124159 - protein, 20 aa, Mycobacterium avium
ALPPRYAKALRRYTFGPGVA

SEQ ID NO: 124160 - protein, 18 aa, Mycobacterium avium
ALPRWAFANAATGEMSGD

SEQ ID NO: 124161 - protein, 19 aa, Mycobacterium avium
ALPSREQLLRFIGELDRPG

SEQ ID NO: 124162 - protein, 36 aa, Mycobacterium avium
ALPYAFTYRTGCTWLRTWDAKLWSLHSGGGVLARGV

SEQ ID NO: 124163 - protein, 25 aa, Mycobacterium avium
ALQDRFFRELPELAVRWQAETFPEL

SEQ ID NO: 124164 - protein, 19 aa, Mycobacterium avium
ALQLWVGACLYKGGLDIYR

SEQ ID NO: 124165 - protein, 17 aa, Mycobacterium avium
ALQPPALRAICPWEGFT

SEQ ID NO: 124166 - protein, 27 aa, Mycobacterium avium
ALQRPEVRWWMLDFAGPGLKKMMNKKM

SEQ ID NO: 124167 - protein, 23 aa, Mycobacterium avium
ALQTFYRYFATKDELLLAVIADA

SEQ ID NO: 124168 - protein, 17 aa, Mycobacterium avium
ALQYEAPYGATLIAKYA

SEQ ID NO: 124169 - protein, 17 aa, Mycobacterium avium
ALRARLRELLGVEVAVL

SEQ ID NO: 124170 - protein, 17 aa, Mycobacterium avium
ALRAYWEMDRAAANTKK

SEQ ID NO: 124171 - protein, 24 aa, Mycobacterium avium
ALRCPACAYVRWAAVVSAHEDGGN

SEQ ID NO: 124172 - protein, 35 aa, Mycobacterium avium
ALRDAGFELPPSQANFLWLPLGSRTEDFVQEAANA

SEQ ID NO: 124173 - protein, 19 aa, Mycobacterium avium
ALRDRVRWHGWAAGPGPAL

SEQ ID NO: 124174 - protein, 17 aa, Mycobacterium avium
ALRDRVRWHGWSAGPGP

SEQ ID NO: 124175 - protein, 21 aa, Mycobacterium avium
ALRELLPLRRADQDEYLRWAV

SEQ ID NO: 124176 - protein, 24 aa, Mycobacterium avium
ALREWRGPVLDDLHNFAFVDAFAN

SEQ ID NO: 124177 - protein, 25 aa, Mycobacterium avium
ALREWRGPVLDDLHNFAFVDAFANL

SEQ ID NO: 124178 - protein, 20 aa, Mycobacterium avium
ALRIAFRALTLAGVHGVELM

SEQ ID NO: 124179 - protein, 17 aa, Mycobacterium avium
ALRKTLGVPLFQEQLMQ

SEQ ID NO: 124180 - protein, 33 aa, Mycobacterium avium
ALRPYDMSFSRYELLRLLAFSRTGALPITKASD

SEQ ID NO: 124181 - protein, 31 aa, Mycobacterium avium
ALRRHIYLEETFLFPPIRKAGIMMPVFVMMR

SEQ ID NO: 124182 - protein, 19 aa, Mycobacterium avium
ALRVKFDGGTLPPMFVDLI

SEQ ID NO: 124183 - protein, 19 aa, Mycobacterium avium
ALRWRTTVGAAAISVAQRI

SEQ ID NO: 124184 - protein, 19 aa, Mycobacterium avium
ALSERAYTLLKRAFKQRTV

SEQ ID NO: 124185 - protein, 17 aa, Mycobacterium avium
ALSQTLLPEVPLVESRD

SEQ ID NO: 124186 - protein, 19 aa, Mycobacterium avium
ALSQTLLPEVPLVESRDVT

SEQ ID NO: 124187 - protein, 20 aa, Mycobacterium avium
ALSRLPAPPLPTARLRPRPI

SEQ ID NO: 124188 - protein, 20 aa, Mycobacterium avium
ALSRTLIFDYPTPAALADHL

SEQ ID NO: 124189 - protein, 22 aa, Mycobacterium avium
ALSRTLIFDYPTPTALADHLRR

SEQ ID NO: 124190 - protein, 27 aa, Mycobacterium avium
ALSVISGRIAYTLGLAGPALTLDSSCA

SEQ ID NO: 124191 - protein, 20 aa, Mycobacterium avium
ALTEIDGCVGLSLLVDRQSG

SEQ ID NO: 124192 - protein, 27 aa, Mycobacterium avium
ALTGRQNVAWFARLYGVPGAERAQRVD

SEQ ID NO: 124193 - protein, 25 aa, Mycobacterium avium
ALTPNLHWPLEYVDSFAGLVPRLGS

SEQ ID NO: 124194 - protein, 26 aa, Mycobacterium avium
ALTPRMRRIRFSGPRLQGLGWTPGQH

SEQ ID NO: 124195 - protein, 21 aa, Mycobacterium avium
ALTQLMIATLVDALTAAASDD

SEQ ID NO: 124196 - protein, 22 aa, Mycobacterium avium
ALTQRRFGWQPVGPGLLDDLET

SEQ ID NO: 124197 - protein, 26 aa, Mycobacterium avium
ALTSDRGWVMLLSRYQRPKAIRNSGV

SEQ ID NO: 124198 - protein, 26 aa, Mycobacterium avium
ALVAGLRLRLPIVATALGTYDTASAA

SEQ ID NO: 124199 - protein, 29 aa, Mycobacterium avium
ALVDAFFERYGIPILVVYGATEFSGAVAG

SEQ ID NO: 124200 - protein, 25 aa, Mycobacterium avium
ALVDHTIWFHRAADFTDWLLFDQFS

SEQ ID NO: 124201 - protein, 26 aa, Mycobacterium avium
ALVETLLVVMCGVGLYAGYVETYQEM

SEQ ID NO: 124202 - protein, 18 aa, Mycobacterium avium
ALVFEAFAHALASIGAGQ

SEQ ID NO: 124203 - protein, 20 aa, Mycobacterium avium
ALVLHYLPEFDMRTGAVLGT

SEQ ID NO: 124204 - protein, 17 aa, Mycobacterium avium
ALVLWEAQFGDFVNGAQ

SEQ ID NO: 124205 - protein, 20 aa, Mycobacterium avium
ALVLWEAQFGDFVNGAQSII

SEQ ID NO: 124206 - protein, 27 aa, Mycobacterium avium
ALVVGPPHTLIWPNLFLAEMNVMFVEP

SEQ ID NO: 124207 - protein, 28 aa, Mycobacterium avium
ALVVGPPHTLIWPNLFLAEMNVMFVEPQ

SEQ ID NO: 124208 - protein, 22 aa, Mycobacterium avium
ALVVLERIPVPVLAIAGDGSIL

SEQ ID NO: 124209 - protein, 33 aa, Mycobacterium avium
ALWESLDLDEWKWWARWRVIRARAGWLTDELVA

SEQ ID NO: 124210 - protein, 17 aa, Mycobacterium avium
AMAYKLIDAAQARWRAV

SEQ ID NO: 124211 - protein, 18 aa, Mycobacterium avium
AMDILGPASIRHSSRWDA

SEQ ID NO: 124212 - protein, 18 aa, Mycobacterium avium
AMHLAAVRPDRVAGLLLL

SEQ ID NO: 124213 - protein, 17 aa, Mycobacterium avium
AMLLIHRNRPVSVDALI

SEQ ID NO: 124214 - protein, 37 aa, Mycobacterium avium
AMLPIPAQAWTLEVMGPAVLKFAPKLAAQYLPGYLDG

SEQ ID NO: 124215 - protein, 22 aa, Mycobacterium avium
AMLTTAWLHKPMFTLRGGTNEV

SEQ ID NO: 124216 - protein, 20 aa, Mycobacterium avium
AMMGTLVSPQYWMLERAMRE

SEQ ID NO: 124217 - protein, 17 aa, Mycobacterium avium
AMMIMALEDFGFCKKGE

SEQ ID NO: 124218 - protein, 17 aa, Mycobacterium avium
AMMSYWSELARDPVLPP

SEQ ID NO: 124219 - protein, 25 aa, Mycobacterium avium
AMPHTYRLIMAMGSQLATAGAALDP

SEQ ID NO: 124220 - protein, 17 aa, Mycobacterium avium
AMPLFHLSAAPSVLAPM

SEQ ID NO: 124221 - protein, 22 aa, Mycobacterium avium
AMPREWFHDLLDPDGRPFRDSE

SEQ ID NO: 124222 - protein, 18 aa, Mycobacterium avium
AMRDLLVTRDWSAITLSD

SEQ ID NO: 124223 - protein, 18 aa, Mycobacterium avium
AMRRIVIDADRILSDVDL

SEQ ID NO: 124224 - protein, 25 aa, Mycobacterium avium
AMSYRTLMADLAALYLGRDLPELHY

SEQ ID NO: 124225 - protein, 17 aa, Mycobacterium avium
AMTDPFLGSEALAARLL

SEQ ID NO: 124226 - protein, 18 aa, Mycobacterium avium
AMTLARIDFAANTLTWTG

SEQ ID NO: 124227 - protein, 17 aa, Mycobacterium avium
AMVLVARVLPQPVLQRL

SEQ ID NO: 124228 - protein, 18 aa, Mycobacterium avium
AMVLVARVLPQPVLQRLA

SEQ ID NO: 124229 - protein, 24 aa, Mycobacterium avium
AMVTDRRVLLTLPISHVYGMPPGM

SEQ ID NO: 124230 - protein, 18 aa, Mycobacterium avium
AMYGYAASSATAGKLSPL

SEQ ID NO: 124231 - protein, 24 aa, Mycobacterium avium
ANDGFAAELLEWLRNRLAHYKCPR

SEQ ID NO: 124232 - protein, 25 aa, Mycobacterium avium
ANDLDKLIWAEGFSLPLTQSPGDVA

SEQ ID NO: 124233 - protein, 27 aa, Mycobacterium avium
ANESRFRISFRLAGFHLAISPPAAPGG

SEQ ID NO: 124234 - protein, 28 aa, Mycobacterium avium
ANGGRKPWLPHFYLGHGIGPYPADAPMI

SEQ ID NO: 124235 - protein, 24 aa, Mycobacterium avium
ANGKWWIDNWISETVDLLIDGLVH

SEQ ID NO: 124236 - protein, 18 aa, Mycobacterium avium
ANGPAGIFLARYGDHLKR

SEQ ID NO: 124237 - protein, 25 aa, Mycobacterium avium
ANGTDYVLTLRAWLQAQGDPTEAGE

SEQ ID NO: 124238 - protein, 23 aa, Mycobacterium avium
ANGTPVRKLWVSAGPPPCVVGDM

SEQ ID NO: 124239 - protein, 19 aa, Mycobacterium avium
ANHRATLLQGPRFVGTGPQ

SEQ ID NO: 124240 - protein, 22 aa, Mycobacterium avium
ANIRLRNLLLDDVAGGYTRDFT

SEQ ID NO: 124241 - protein, 20 aa, Mycobacterium avium
ANKEALFLAVFLAVQEQVDS

SEQ ID NO: 124242 - protein, 24 aa, Mycobacterium avium
ANLERWMHGWADIYDAHAAVFAEY

SEQ ID NO: 124243 - protein, 23 aa, Mycobacterium avium
ANLKRAWELMGMRVHWQSSNDLV

SEQ ID NO: 124244 - protein, 23 aa, Mycobacterium avium
ANLMVVVICRDPEHFYRYLAERL

SEQ ID NO: 124245 - protein, 20 aa, Mycobacterium avium
ANLRSFNRWFDEEWGFNYED

SEQ ID NO: 124246 - protein, 24 aa, Mycobacterium avium
ANPANRFHSWIYRARPDVQCIVHT

SEQ ID NO: 124247 - protein, 22 aa, Mycobacterium avium
ANQLGRLRYAVVAHGGFGVAQR

SEQ ID NO: 124248 - protein, 23 aa, Mycobacterium avium
ANQLGRLRYAVVAHGGFGVAQRI

SEQ ID NO: 124249 - protein, 18 aa, Mycobacterium avium
ANRAIIVRRLLGLESVLS

SEQ ID NO: 124250 - protein, 19 aa, Mycobacterium avium
ANRAIIVRRLLGLESVLSI

SEQ ID NO: 124251 - protein, 24 aa, Mycobacterium avium
ANRARLAAALGLKPDRVVWMNQVH

SEQ ID NO: 124252 - protein, 18 aa, Mycobacterium avium
ANRELTAELALALGAAAA

SEQ ID NO: 124253 - protein, 19 aa, Mycobacterium avium
ANRELTAELALALGAAAAR

SEQ ID NO: 124254 - protein, 17 aa, Mycobacterium avium
ANRLAHLLSGQGAGPGQ

SEQ ID NO: 124255 - protein, 21 aa, Mycobacterium avium
ANRLAPHGVWLERGEVILSGS

SEQ ID NO: 124256 - protein, 17 aa, Mycobacterium avium
ANRLPDLIGLRQAVYRR

SEQ ID NO: 124257 - protein, 24 aa, Mycobacterium avium
ANRVQLATLIATNFFGQNAAAIAA

SEQ ID NO: 124258 - protein, 20 aa, Mycobacterium avium
ANTALLLAQLRDVPDERRAA

SEQ ID NO: 124259 - protein, 27 aa, Mycobacterium avium
ANVAKWLKRKPLKGRLFPLHGRPQLVV

SEQ ID NO: 124260 - protein, 25 aa, Mycobacterium avium
ANVAKWLKRKPLRGRLFALHGRPQL

SEQ ID NO: 124261 - protein, 29 aa, Mycobacterium avium
ANVAKWLKRKPLRGRLFPLHGRPQLVVTA

SEQ ID NO: 124262 - protein, 25 aa, Mycobacterium avium
ANVLGYVHASPAWLPVFVAAQLITR

SEQ ID NO: 124263 - protein, 17 aa, Mycobacterium avium
ANWQKYAVIISHTIPFD

SEQ ID NO: 124264 - protein, 18 aa, Mycobacterium avium
ANYHPYPPTPWNANPRDV

SEQ ID NO: 124265 - protein, 29 aa, Mycobacterium avium
APAALPLCALLGGWLRGQVQPQAAARARI

SEQ ID NO: 124266 - protein, 30 aa, Mycobacterium avium
APAALPLCVLLGGWLRGQVQPRAAARARIY

SEQ ID NO: 124267 - protein, 28 aa, Mycobacterium avium
APAALPLCVLLGGWLRRQVQPRAAARAR

SEQ ID NO: 124268 - protein, 18 aa, Mycobacterium avium
APADLIAEYGPHIALPPS

SEQ ID NO: 124269 - protein, 21 aa, Mycobacterium avium
APAHDWLTLTGGAIGYGIPAA

SEQ ID NO: 124270 - protein, 21 aa, Mycobacterium avium
APARALLKKAPTLRRIVKRQQ

SEQ ID NO: 124271 - protein, 18 aa, Mycobacterium avium
APARWAMRIPGGKSVQRL

SEQ ID NO: 124272 - protein, 25 aa, Mycobacterium avium
APCFAALAGLASLVGYPGGPPLGTS

SEQ ID NO: 124273 - protein, 23 aa, Mycobacterium avium
APDDFVHLLLGVASVGAGIARLA

SEQ ID NO: 124274 - protein, 22 aa, Mycobacterium avium
APDGGLLPSWTPGAHIDVLLPS

SEQ ID NO: 124275 - protein, 25 aa, Mycobacterium avium
APDLVLDALTMFGAIGFTWEHDLHL

SEQ ID NO: 124276 - protein, 26 aa, Mycobacterium avium
APDLVRRLCWDWEPTPDPFAAVEAFL

SEQ ID NO: 124277 - protein, 18 aa, Mycobacterium avium
APDNIAYLLYTSGTTGVP

SEQ ID NO: 124278 - protein, 26 aa, Mycobacterium avium
APDRTALVSGLLRELGRRIVSWQAAR

SEQ ID NO: 124279 - protein, 28 aa, Mycobacterium avium
APDVKDAMIDWWGPILVEYYGATEQHGT

SEQ ID NO: 124280 - protein, 19 aa, Mycobacterium avium
APELLQARDLRYTLLDDVP

SEQ ID NO: 124281 - protein, 20 aa, Mycobacterium avium
APELYGLRRVAGDAYSRIAP

SEQ ID NO: 124282 - protein, 23 aa, Mycobacterium avium
APETVGPLLFPLSSTSAEQLRVT

SEQ ID NO: 124283 - protein, 23 aa, Mycobacterium avium
APEVVGPLLFPLSSTSAEQLRVT

SEQ ID NO: 124284 - protein, 20 aa, Mycobacterium avium
APFSLAWMTAVGERTTRITL

SEQ ID NO: 124285 - protein, 36 aa, Mycobacterium avium
APGALAPLRRLATGHWLRRWWPASRQDGIAGLDRAL

SEQ ID NO: 124286 - protein, 17 aa, Mycobacterium avium
APGDHVVFSFIPSCGRC

SEQ ID NO: 124287 - protein, 31 aa, Mycobacterium avium
APGGGPCLLTPPPWYPILRGTTQQTLFEVAR

SEQ ID NO: 124288 - protein, 23 aa, Mycobacterium avium
APGHGAGLVPQAPRQRDRRKPVR

SEQ ID NO: 124289 - protein, 24 aa, Mycobacterium avium
APGLPVPSLFTSRPQVLKTYTFAE

SEQ ID NO: 124290 - protein, 26 aa, Mycobacterium avium
APGPGTLRQAVPRLPHRAADRGDPER

SEQ ID NO: 124291 - protein, 20 aa, Mycobacterium avium
APGPLYPVSIVLSALAECSG

SEQ ID NO: 124292 - protein, 19 aa, Mycobacterium avium
APGPMPYPGAPPYGAPQYA

SEQ ID NO: 124293 - protein, 17 aa, Mycobacterium avium
APGYFSLDDWGYASLIG

SEQ ID NO: 124294 - protein, 29 aa, Mycobacterium avium
APHLVHAMPQLVPLLPSMSRATRALVRGG

SEQ ID NO: 124295 - protein, 19 aa, Mycobacterium avium
APKNPVWYHNIKKNPRVEL

SEQ ID NO: 124296 - protein, 17 aa, Mycobacterium avium
APLAFRQLSIEEELAQW

SEQ ID NO: 124297 - protein, 21 aa, Mycobacterium avium
APLFHTHYEPLWALCAELDLT

SEQ ID NO: 124298 - protein, 18 aa, Mycobacterium avium
APLTSDRLGALLLSASEV

SEQ ID NO: 124299 - protein, 22 aa, Mycobacterium avium
APMIARRGLTLVGFAVSGIDRD

SEQ ID NO: 124300 - protein, 23 aa, Mycobacterium avium
APNPAVIAAVEWVGTVDASGATF

SEQ ID NO: 124301 - protein, 27 aa, Mycobacterium avium
APNQLWVTDLTFVPTWAGVAYVCFIID

SEQ ID NO: 124302 - protein, 35 aa, Mycobacterium avium
APNSLGFRYDTGLYLQFRATTPDDFHLAYAAALAT

SEQ ID NO: 124303 - protein, 24 aa, Mycobacterium avium
APPASRKVLWERIARWRPGWIGSC

SEQ ID NO: 124304 - protein, 40 aa, Mycobacterium avium
APPPEFVDWRQRPGLRRALFQGNPVWVVSRYRDIRAALVD

SEQ ID NO: 124305 - protein, 23 aa, Mycobacterium avium
APPTLPPFMLADGVASLNAAYAV

SEQ ID NO: 124306 - protein, 24 aa, Mycobacterium avium
APRGEIKLYDAGHFDIYVGADFER

SEQ ID NO: 124307 - protein, 24 aa, Mycobacterium avium
APRPGHRRIVLRFGARPVEVVGAD

SEQ ID NO: 124308 - protein, 27 aa, Mycobacterium avium
APRRFWRRKFRILDRLGRSRPDVQLVA

SEQ ID NO: 124309 - protein, 17 aa, Mycobacterium avium
APRWDTVIIGLDCDTTL

SEQ ID NO: 124310 - protein, 33 aa, Mycobacterium avium
APRYAELIKRTQWWGRQMLIWGVHVHVGISSPN

SEQ ID NO: 124311 - protein, 23 aa, Mycobacterium avium
APSLHNSKPWRWVAGSTGVDLFV

SEQ ID NO: 124312 - protein, 26 aa, Mycobacterium avium
APTALLRIYGDALPPRYAKALRRYTF

SEQ ID NO: 124313 - protein, 24 aa, Mycobacterium avium
APTHVRSWPLRPLPTQCREIGIRF

SEQ ID NO: 124314 - protein, 24 aa, Mycobacterium avium
APVALAVVPPPPTSPRQADGYDPL

SEQ ID NO: 124315 - protein, 23 aa, Mycobacterium avium
APVARFLAHWVRRAGPRIVEPSC

SEQ ID NO: 124316 - protein, 29 aa, Mycobacterium avium
APVIATLYPVRRMVFVGGLLPVPGHSFVE

SEQ ID NO: 124317 - protein, 21 aa, Mycobacterium avium
APVYGYKGWRSPALPEFDPFW

SEQ ID NO: 124318 - protein, 33 aa, Mycobacterium avium
AQAFWHSNTGMVQLFYLLNPPTGAQTVTASVTG

SEQ ID NO: 124319 - protein, 29 aa, Mycobacterium avium
AQASPPDMRLPISLALGWPHRVPGAAACC

SEQ ID NO: 124320 - protein, 20 aa, Mycobacterium avium
AQAWRSIVFGEADVAICGGV

SEQ ID NO: 124321 - protein, 19 aa, Mycobacterium avium
AQDAAAMYGYALASAAAST

SEQ ID NO: 124322 - protein, 17 aa, Mycobacterium avium
AQDWRWLVVTDADKRAA

SEQ ID NO: 124323 - protein, 25 aa, Mycobacterium avium
AQEEIFGPIIGVLGYRDIDDAVAIA

SEQ ID NO: 124324 - protein, 22 aa, Mycobacterium avium
AQEFYFPVCFELAVTKGAPAPH

SEQ ID NO: 124325 - protein, 23 aa, Mycobacterium avium
AQELYFPVCFELAVTKGAPAPHD

SEQ ID NO: 124326 - protein, 23 aa, Mycobacterium avium
AQELYFPVCFELAVTKGAPPPHD

SEQ ID NO: 124327 - protein, 17 aa, Mycobacterium avium
AQFELVKLPALDAPPAE

SEQ ID NO: 124328 - protein, 22 aa, Mycobacterium avium
AQFTVVLPRREGVEYSVEHAVV

SEQ ID NO: 124329 - protein, 24 aa, Mycobacterium avium
AQGIPPQFLVDILTNLRTDRLVRS

SEQ ID NO: 124330 - protein, 24 aa, Mycobacterium avium
AQGLCEFIDASPSPFHVCATVAAR

SEQ ID NO: 124331 - protein, 18 aa, Mycobacterium avium
AQGRPFIYAIPDGTNPTC

SEQ ID NO: 124332 - protein, 23 aa, Mycobacterium avium
AQIAQAFVSERIGLATQAYSSAQ

SEQ ID NO: 124333 - protein, 21 aa, Mycobacterium avium
AQIFAGEPDFFWSPVNSLEDV

SEQ ID NO: 124334 - protein, 20 aa, Mycobacterium avium
AQLAFSRRFGPLGVTKVGAV

SEQ ID NO: 124335 - protein, 18 aa, Mycobacterium avium
AQLLLWRTAFCEKLVGRG

SEQ ID NO: 124336 - protein, 20 aa, Mycobacterium avium
AQLPESLDILLNGQRVVLCN

SEQ ID NO: 124337 - protein, 26 aa, Mycobacterium avium
AQMGWPLADAIRWPAQLISTFQWERM

SEQ ID NO: 124338 - protein, 39 aa, Mycobacterium avium
AQNAFGDKVLPLYLPTGLPACTGLIGLLSQRRYAYADGK

SEQ ID NO: 124339 - protein, 32 aa, Mycobacterium avium
AQNILAFRFANGLFEPIWNRNFIDHIQIDIPE

SEQ ID NO: 124340 - protein, 23 aa, Mycobacterium avium
AQNQKLRTLSLGDFRTLAYAMLT

SEQ ID NO: 124341 - protein, 34 aa, Mycobacterium avium
AQPALFAVEVALFRLLESWGVRPDFVMGHSIGEL

SEQ ID NO: 124342 - protein, 22 aa, Mycobacterium avium
AQPGTALPWPAPEDTAYIIYTS

SEQ ID NO: 124343 - protein, 21 aa, Mycobacterium avium
AQQFAWGPPIGLVARALDVEL

SEQ ID NO: 124344 - protein, 25 aa, Mycobacterium avium
AQQRRFGWLLFSLRLADRLIPHWVW

SEQ ID NO: 124345 - protein, 24 aa, Mycobacterium avium
AQRALHRVISLLGAGRAVLTHCFA

SEQ ID NO: 124346 - protein, 22 aa, Mycobacterium avium
AQRLLTLDAYVAAGFHVVALLN

SEQ ID NO: 124347 - protein, 24 aa, Mycobacterium avium
AQRRDMMWICRDGDRAKNHLLEAN

SEQ ID NO: 124348 - protein, 18 aa, Mycobacterium avium
AQRRYPAWPASQDASLRV

SEQ ID NO: 124349 - protein, 29 aa, Mycobacterium avium
AQRVAGELVGLVPHLARGLGPGPHVHAHA

SEQ ID NO: 124350 - protein, 30 aa, Mycobacterium avium
AQRYRVADVLPLTPLQQGLLFHAGTAQGSQ

SEQ ID NO: 124351 - protein, 32 aa, Mycobacterium avium
AQRYRVADVLPLTPLQQGLLFHAGTAQGSQEP

SEQ ID NO: 124352 - protein, 23 aa, Mycobacterium avium
AQSFDLITFVASLHHVPLRDALG

SEQ ID NO: 124353 - protein, 25 aa, Mycobacterium avium
AQSGPLLFDPLRERLAHYAGLDFLS

SEQ ID NO: 124354 - protein, 28 aa, Mycobacterium avium
AQSPKESWLRVLLIDAGFPRPQTQIAVR

SEQ ID NO: 124355 - protein, 27 aa, Mycobacterium avium
AQSPKESWLRVLLIDAGFPRPQTQIPV

SEQ ID NO: 124356 - protein, 28 aa, Mycobacterium avium
AQSPKETWLRLLLIRAGLPRPQTQIPVS

SEQ ID NO: 124357 - protein, 19 aa, Mycobacterium avium
AQSRLRTVFGQLGNDHGAQ

SEQ ID NO: 124358 - protein, 19 aa, Mycobacterium avium
AQVAVYRKALQAADIDATT

SEQ ID NO: 124359 - protein, 32 aa, Mycobacterium avium
AQVEPTLPLRIRAAWLWSGRTAVIAGAAAAAV

SEQ ID NO: 124360 - protein, 17 aa, Mycobacterium avium
AQVVAWWSPAYHEPNGG

SEQ ID NO: 124361 - protein, 24 aa, Mycobacterium avium
AQVYPSPERIAVAALKTLGRTLTG

SEQ ID NO: 124362 - protein, 19 aa, Mycobacterium avium
AQWLAGEALIARCPCLLAV

SEQ ID NO: 124363 - protein, 20 aa, Mycobacterium avium
AQYPSMLTALRRAVAEQAIV

SEQ ID NO: 124364 - protein, 25 aa, Mycobacterium avium
ARAAGFALVIGLAPDGRDGDGLRAA

SEQ ID NO: 124365 - protein, 20 aa, Mycobacterium avium
ARAEFLVAAVALHVDADRSA

SEQ ID NO: 124366 - protein, 18 aa, Mycobacterium avium
ARAGWRVVVLEAGPFWHP

SEQ ID NO: 124367 - protein, 30 aa, Mycobacterium avium
ARAIDEVLRPLRLTRLNPLGLNNAAAALFS

SEQ ID NO: 124368 - protein, 21 aa, Mycobacterium avium
ARAIPHIHALIRLDPYEDPDQ

SEQ ID NO: 124369 - protein, 27 aa, Mycobacterium avium
ARAIVEVRRLLPGIPLVASGGIRTGMD

SEQ ID NO: 124370 - protein, 29 aa, Mycobacterium avium
ARAKLNWWESRALYGWTVLVPRTKDQAGE

SEQ ID NO: 124371 - protein, 34 aa, Mycobacterium avium
ARALAKGRRTVWIPWALGPAAAVLRMLPQPIWRR

SEQ ID NO: 124372 - protein, 22 aa, Mycobacterium avium
ARALRPARLLVSGSAPLPVPVF

SEQ ID NO: 124373 - protein, 28 aa, Mycobacterium avium
ARARHHHARLLALRYRLRHGVGLAGLRG

SEQ ID NO: 124374 - protein, 33 aa, Mycobacterium avium
ARARHHHARLLALRYRLRHGVGLAGLRGPGSDR

SEQ ID NO: 124375 - protein, 24 aa, Mycobacterium avium
ARARLVYAGDLLHPVHPAHQDGLG

SEQ ID NO: 124376 - protein, 20 aa, Mycobacterium avium
ARAVPLPMPKRLPPWILAKM

SEQ ID NO: 124377 - protein, 18 aa, Mycobacterium avium
ARAVRRGRPGLRPAQLHD

SEQ ID NO: 124378 - protein, 22 aa, Mycobacterium avium
ARCYLRRWHRRRPLWIGVAIGG

SEQ ID NO: 124379 - protein, 25 aa, Mycobacterium avium
ARDFATARFGLKRFLADWDQVIGEL

SEQ ID NO: 124380 - protein, 19 aa, Mycobacterium avium
ARDHFIGNHPGMPFPDRDH

SEQ ID NO: 124381 - protein, 19 aa, Mycobacterium avium
ARDMGIYLGHGYTVEKIRV

SEQ ID NO: 124382 - protein, 24 aa, Mycobacterium avium
ARDMGIYLGHGYTVEKIRVFDAFP

SEQ ID NO: 124383 - protein, 25 aa, Mycobacterium avium
ARDSVLRYIATLIRVFIRVARPAAD

SEQ ID NO: 124384 - protein, 18 aa, Mycobacterium avium
ARDYLLPRQRERAALTED

SEQ ID NO: 124385 - protein, 25 aa, Mycobacterium avium
ARERDIWLPVHPVTRRRWPNGRVTH

SEQ ID NO: 124386 - protein, 24 aa, Mycobacterium avium
ARFDPQAKGLGEWLRGRYLDIPES

SEQ ID NO: 124387 - protein, 24 aa, Mycobacterium avium
ARFDRISYTWIPRERNSHADRLAN

SEQ ID NO: 124388 - protein, 25 aa, Mycobacterium avium
ARFGPRALLPATVLARWFHTEQARA

SEQ ID NO: 124389 - protein, 26 aa, Mycobacterium avium
ARFGPRALLPATVLARWFRTEQARAL

SEQ ID NO: 124390 - protein, 25 aa, Mycobacterium avium
ARGDDRGWWVRRAAPGLRRPALPGP

SEQ ID NO: 124391 - protein, 18 aa, Mycobacterium avium
ARGRLLISAMAAGATAAA

SEQ ID NO: 124392 - protein, 18 aa, Mycobacterium avium
ARHAGVSRSWIYTQIDLK

SEQ ID NO: 124393 - protein, 19 aa, Mycobacterium avium
ARHAGVSRSWIYTQIDLKD

SEQ ID NO: 124394 - protein, 32 aa, Mycobacterium avium
ARHITAVLPGRPPLATLFLPHNRGKKSVLADL

SEQ ID NO: 124395 - protein, 18 aa, Mycobacterium avium
ARHVVVYRTIQMLGGTVP

SEQ ID NO: 124396 - protein, 25 aa, Mycobacterium avium
ARIADLLRRAAPDAALVAIVVSWLS

SEQ ID NO: 124397 - protein, 18 aa, Mycobacterium avium
ARIADRPAAVLLHLGPGL

SEQ ID NO: 124398 - protein, 30 aa, Mycobacterium avium
ARIKYRLAQLKPPPLHPIPILIGSSGEKKT

SEQ ID NO: 124399 - protein, 18 aa, Mycobacterium avium
ARILAGEQSLDVLAGAWS

SEQ ID NO: 124400 - protein, 18 aa, Mycobacterium avium
ARILEIIPIERSSLRRLP

SEQ ID NO: 124401 - protein, 17 aa, Mycobacterium avium
ARIWPVVATHETAAVRA

SEQ ID NO: 124402 - protein, 31 aa, Mycobacterium avium
ARKAGRRFARLAPIVGTYRKLMAAREDLETA

SEQ ID NO: 124403 - protein, 23 aa, Mycobacterium avium
ARKDTVMVLPKQKLAAVLSADNP

SEQ ID NO: 124404 - protein, 30 aa, Mycobacterium avium
ARLAAFKVPARWFVADAFPVTPTGKVRRFA

SEQ ID NO: 124405 - protein, 24 aa, Mycobacterium avium
ARLELRVLFEELLSRFGAVRVVRP

SEQ ID NO: 124406 - protein, 25 aa, Mycobacterium avium
ARLGESLALLGWNMSVSNLRWDGDY

SEQ ID NO: 124407 - protein, 21 aa, Mycobacterium avium
ARLIGTARRLLSTVLQGFYQS

SEQ ID NO: 124408 - protein, 18 aa, Mycobacterium avium
ARLIWRVQGLKITITGVE

SEQ ID NO: 124409 - protein, 23 aa, Mycobacterium avium
ARLNALFEIVVPAVVDGGGHVNK

SEQ ID NO: 124410 - protein, 19 aa, Mycobacterium avium
ARLRTLQELGWIVVRVIAE

SEQ ID NO: 124411 - protein, 18 aa, Mycobacterium avium
ARLSRAIQSLERAALGVG

SEQ ID NO: 124412 - protein, 22 aa, Mycobacterium avium
ARMADVLLLLLSGTTNGRLAVE

SEQ ID NO: 124413 - protein, 25 aa, Mycobacterium avium
ARMESRIALGALLDLLPEYEVDRSG

SEQ ID NO: 124414 - protein, 26 aa, Mycobacterium avium
ARMGHRLTIAMTRWRAGVSWAGSRPV

SEQ ID NO: 124415 - protein, 26 aa, Mycobacterium avium
ARMGHRLTIAMTRWRGGVGWAGSRPV

SEQ ID NO: 124416 - protein, 26 aa, Mycobacterium avium
ARMGHRLTIAMTRWRGGVSWAGSRPV

SEQ ID NO: 124417 - protein, 19 aa, Mycobacterium avium
ARNPQLANIDLFAEVAGSA

SEQ ID NO: 124418 - protein, 23 aa, Mycobacterium avium
ARNSGMPVVFWLDQERPHENELR

SEQ ID NO: 124419 - protein, 25 aa, Mycobacterium avium
ARNTFYGMARWQAKLEQRQGFLGRV

SEQ ID NO: 124420 - protein, 18 aa, Mycobacterium avium
ARPAPAPPPPPVASRPAP

SEQ ID NO: 124421 - protein, 24 aa, Mycobacterium avium
ARPDTVTAWRRALHRWLQHEVRAP

SEQ ID NO: 124422 - protein, 25 aa, Mycobacterium avium
ARPDTVTAWRRALHRWLQHEVRAPD

SEQ ID NO: 124423 - protein, 22 aa, Mycobacterium avium
ARPIVMLERFSLDGWHNAIKDH

SEQ ID NO: 124424 - protein, 18 aa, Mycobacterium avium
ARPLTDWLTAVADGIALL

SEQ ID NO: 124425 - protein, 19 aa, Mycobacterium avium
ARPPRPWPPCCSRRARWPD

SEQ ID NO: 124426 - protein, 18 aa, Mycobacterium avium
ARPRAGLIGCAFAELAEV

SEQ ID NO: 124427 - protein, 20 aa, Mycobacterium avium
ARPSRFLRSTATVTWMAEEV

SEQ ID NO: 124428 - protein, 18 aa, Mycobacterium avium
ARQRRRAGGGLSAQDLLR

SEQ ID NO: 124429 - protein, 43 aa, Mycobacterium avium
ARQVFRSWYILYFQLPWLPERSASWVLPLLWRRWSPGYRAEED

SEQ ID NO: 124430 - protein, 44 aa, Mycobacterium avium
ARQVFRSWYIMYFQLPWLPERSASWVLPLLWRRWSPGYRAEEDL

SEQ ID NO: 124431 - protein, 17 aa, Mycobacterium avium
ARQVLGVLPPAGARRKG

SEQ ID NO: 124432 - protein, 31 aa, Mycobacterium avium
ARRDPFPNGMLVRALEIWPDKDAGELRKEFA

SEQ ID NO: 124433 - protein, 19 aa, Mycobacterium avium
ARREIADALLKALERRHEI

SEQ ID NO: 124434 - protein, 17 aa, Mycobacterium avium
ARRIECSPLPFGRHRWV

SEQ ID NO: 124435 - protein, 22 aa, Mycobacterium avium
ARRLRVGAVGLIRSWRARNSGR

SEQ ID NO: 124436 - protein, 25 aa, Mycobacterium avium
ARRPPAGARAGRPLRRTWRNRRCGS

SEQ ID NO: 124437 - protein, 23 aa, Mycobacterium avium
ARRRSQLVDWTWQMVRDTVLDRL

SEQ ID NO: 124438 - protein, 20 aa, Mycobacterium avium
ARRRTNVLYALIRDNRTWQP

SEQ ID NO: 124439 - protein, 44 aa, Mycobacterium avium
ARRRYQVGLRRSLIAMRSQRYFRLLDSLDAIAARRPGFPGAEEQ

SEQ ID NO: 124440 - protein, 43 aa, Mycobacterium avium
ARRRYQVGLRRSLIAMRSQRYFRLLDSLDAIAARRPGLPGAEE

SEQ ID NO: 124441 - protein, 17 aa, Mycobacterium avium
ARRTGHVAAYLTGAGVA

SEQ ID NO: 124442 - protein, 29 aa, Mycobacterium avium
ARRVADVLGIPFYVWDFAEKFQADVIDAF

SEQ ID NO: 124443 - protein, 29 aa, Mycobacterium avium
ARSCVPPDFLFMHTGLALATGWALAAGGQ

SEQ ID NO: 124444 - protein, 23 aa, Mycobacterium avium
ARSDTRTLRLPGNRLDIRERSTT

SEQ ID NO: 124445 - protein, 19 aa, Mycobacterium avium
ARSMLLLHGDHHDHDERPA

SEQ ID NO: 124446 - protein, 25 aa, Mycobacterium avium
ARSVFNRFPYLEPLNHLQVELLRRY

SEQ ID NO: 124447 - protein, 20 aa, Mycobacterium avium
ARTILGLPVDTMMVSPAAAR

SEQ ID NO: 124448 - protein, 19 aa, Mycobacterium avium
ARTLANLHQIPPAAVGLLP

SEQ ID NO: 124449 - protein, 20 aa, Mycobacterium avium
ARTLATRLAARRRRSRAGTI

SEQ ID NO: 124450 - protein, 17 aa, Mycobacterium avium
ARTTLYRHFNSSSQLLA

SEQ ID NO: 124451 - protein, 18 aa, Mycobacterium avium
ARVALVDFSLVAVARDVD

SEQ ID NO: 124452 - protein, 30 aa, Mycobacterium avium
ARVEFKLRDWLFARQRYWGEPFPIVYDSDG

SEQ ID NO: 124453 - protein, 19 aa, Mycobacterium avium
ARVWPDVLAFTRSGDPAQT

SEQ ID NO: 124454 - protein, 19 aa, Mycobacterium avium
ARWCCWPRRAAGWWTGRRC

SEQ ID NO: 124455 - protein, 23 aa, Mycobacterium avium
ARWGYKFRFGVFKIDDHDLEVIR

SEQ ID NO: 124456 - protein, 33 aa, Mycobacterium avium
ARYQLLVQYPNVNPALLLKCLLMATTEGIASGD

SEQ ID NO: 124457 - protein, 22 aa, Mycobacterium avium
ARYWREAFRLPSMDLTELGRRL

SEQ ID NO: 124458 - protein, 41 aa, Mycobacterium avium
ASAFEAAYAMTVPPPLIAANRARLLALVQSNIFGQNTPAIM

SEQ ID NO: 124459 - protein, 21 aa, Mycobacterium avium
ASAGVWKLTPFDSPPPAADPA

SEQ ID NO: 124460 - protein, 24 aa, Mycobacterium avium
ASAGYMLMKPLVETATAAGARALY

SEQ ID NO: 124461 - protein, 17 aa, Mycobacterium avium
ASALRMYREGWRVVAAM

SEQ ID NO: 124462 - protein, 18 aa, Mycobacterium avium
ASAWHRPLLPAQPPETTP

SEQ ID NO: 124463 - protein, 26 aa, Mycobacterium avium
ASDAAEWFAGRLPEQWFDGDPTVIVD

SEQ ID NO: 124464 - protein, 18 aa, Mycobacterium avium
ASDKPVIPIISNLTGQPA

SEQ ID NO: 124465 - protein, 24 aa, Mycobacterium avium
ASDLSLAVMRLARQLRFRNPSSPV

SEQ ID NO: 124466 - protein, 30 aa, Mycobacterium avium
ASDRPLPWAVMHKLTAPTLLTWGRDDRVSP

SEQ ID NO: 124467 - protein, 31 aa, Mycobacterium avium
ASDVIAIRGQRLFLGRTRFFGREQGPGAFHS

SEQ ID NO: 124468 - protein, 19 aa, Mycobacterium avium
ASEAAIALAFDEASRRGVG

SEQ ID NO: 124469 - protein, 30 aa, Mycobacterium avium
ASEALRLGLDIMLIGVWNTFQVAIPHMKER

SEQ ID NO: 124470 - protein, 22 aa, Mycobacterium avium
ASELATAIAFDEALRRGVDLNA

SEQ ID NO: 124471 - protein, 17 aa, Mycobacterium avium
ASELATAIAFDEASRRG

SEQ ID NO: 124472 - protein, 24 aa, Mycobacterium avium
ASERAMFGAPLVGLGFHHGDGGIS

SEQ ID NO: 124473 - protein, 19 aa, Mycobacterium avium
ASFQAPDGKPLFCIWENAR

SEQ ID NO: 124474 - protein, 18 aa, Mycobacterium avium
ASFQPLLARMVDAAPRLA

SEQ ID NO: 124475 - protein, 17 aa, Mycobacterium avium
ASFRRLLGPLVARSDDV

SEQ ID NO: 124476 - protein, 17 aa, Mycobacterium avium
ASGKPIPPAFFGSLQDL

SEQ ID NO: 124477 - protein, 26 aa, Mycobacterium avium
ASGLDARAYRLPWPAGTTVFEIDQPR

SEQ ID NO: 124478 - protein, 26 aa, Mycobacterium avium
ASGLDARAYRLPWPAGTVVYEVDMPD

SEQ ID NO: 124479 - protein, 18 aa, Mycobacterium avium
ASGLLGSVPTYALLAQRW

SEQ ID NO: 124480 - protein, 28 aa, Mycobacterium avium
ASGLRMLYEAWLQFGGRAGARQLSDPHT

SEQ ID NO: 124481 - protein, 24 aa, Mycobacterium avium
ASGLSWPYHALGNYLGCPIIGIQQ

SEQ ID NO: 124482 - protein, 18 aa, Mycobacterium avium
ASGPLGLELLARGDADVA

SEQ ID NO: 124483 - protein, 25 aa, Mycobacterium avium
ASGPLGMMKAILALQHGVVPRNLHF

SEQ ID NO: 124484 - protein, 23 aa, Mycobacterium avium
ASGRTITFAGFLKAYVETVDELA

SEQ ID NO: 124485 - protein, 19 aa, Mycobacterium avium
ASGRVAYTLGLHGPAVTVD

SEQ ID NO: 124486 - protein, 19 aa, Mycobacterium avium
ASIHRAIAYAYDELGRRKK

SEQ ID NO: 124487 - protein, 17 aa, Mycobacterium avium
ASILIRRAIAAGNPMER

SEQ ID NO: 124488 - protein, 23 aa, Mycobacterium avium
ASKARTWQVGAMRDILLARREPG

SEQ ID NO: 124489 - protein, 25 aa, Mycobacterium avium
ASKHGIVGLMRTLADALAPLNIRVN

SEQ ID NO: 124490 - protein, 21 aa, Mycobacterium avium
ASKPLVRLRVPFTLSRYEIDN

SEQ ID NO: 124491 - protein, 22 aa, Mycobacterium avium
ASLIADVWLANLIAVIGGRIDA

SEQ ID NO: 124492 - protein, 17 aa, Mycobacterium avium
ASLYRDRRMPYTVGLLG

SEQ ID NO: 124493 - protein, 22 aa, Mycobacterium avium
ASMLEPIWQVMPPSKAEGVWTT

SEQ ID NO: 124494 - protein, 25 aa, Mycobacterium avium
ASNKPVLVDFWATWCGPCKMVAPVL

SEQ ID NO: 124495 - protein, 19 aa, Mycobacterium avium
ASNTLWPRTLVATAAVQNL

SEQ ID NO: 124496 - protein, 21 aa, Mycobacterium avium
ASPFPHFRHPIPRPGQGRVTL

SEQ ID NO: 124497 - protein, 33 aa, Mycobacterium avium
ASPFRLDYGPRRLLWQLMIGGIFDRYPQLRFVL

SEQ ID NO: 124498 - protein, 26 aa, Mycobacterium avium
ASPKETWLRLLLIDAGIPVPATQIPV

SEQ ID NO: 124499 - protein, 37 aa, Mycobacterium avium
ASPVPAILTMKLMGLPYDNWHLYANLFHAVMAVCQDS

SEQ ID NO: 124500 - protein, 37 aa, Mycobacterium avium
ASPVPAILTMKLMGLPYDNWHLYANLFHSVMAVSQDS

SEQ ID NO: 124501 - protein, 23 aa, Mycobacterium avium
ASRADRERYLNSGLLPVDCRFCH

SEQ ID NO: 124502 - protein, 19 aa, Mycobacterium avium
ASRALAMAVQWARERHQFG

SEQ ID NO: 124503 - protein, 26 aa, Mycobacterium avium
ASRAMALMLQDWLPAFDGAPSNVATF

SEQ ID NO: 124504 - protein, 18 aa, Mycobacterium avium
ASRARKAPGFALLGEPGE

SEQ ID NO: 124505 - protein, 18 aa, Mycobacterium avium
ASRFYANLVLETAQEARR

SEQ ID NO: 124506 - protein, 18 aa, Mycobacterium avium
ASRRLGLGRAVRQRTVGR

SEQ ID NO: 124507 - protein, 19 aa, Mycobacterium avium
ASRVDLPLLSPEQARAYCR

SEQ ID NO: 124508 - protein, 17 aa, Mycobacterium avium
ASRVTPFTPPQRTTNEA

SEQ ID NO: 124509 - protein, 21 aa, Mycobacterium avium
ASRYHTRSRFLPAGVAPERGL

SEQ ID NO: 124510 - protein, 17 aa, Mycobacterium avium
ASSGDFWHTDPALLQSQ

SEQ ID NO: 124511 - protein, 18 aa, Mycobacterium avium
ASSIYWHFKNKDDLIAAV

SEQ ID NO: 124512 - protein, 26 aa, Mycobacterium avium
ASSQFDHHMFLPTLYGEGAATGMPGF

SEQ ID NO: 124513 - protein, 25 aa, Mycobacterium avium
ASSQFDQHMFLPTLYGEGAATGMPG

SEQ ID NO: 124514 - protein, 23 aa, Mycobacterium avium
ASSVPLYVHAPYLINVASANNRV

SEQ ID NO: 124515 - protein, 26 aa, Mycobacterium avium
ASSVRIYYYVFDLLHLDGKSTVAVPL

SEQ ID NO: 124516 - protein, 17 aa, Mycobacterium avium
ASTAWEAFDLGGNKIGQ

SEQ ID NO: 124517 - protein, 33 aa, Mycobacterium avium
ASTGAALAAFPRYHPRWAWSLTSVPVLREFLVS

SEQ ID NO: 124518 - protein, 27 aa, Mycobacterium avium
ASTPMDPALYLLWAQANVVAGYRYSAE

SEQ ID NO: 124519 - protein, 22 aa, Mycobacterium avium
ASVHMMFSGPAFGWHAEAGIHI

SEQ ID NO: 124520 - protein, 19 aa, Mycobacterium avium
ASVIRYHFGSRDGLIRALV

SEQ ID NO: 124521 - protein, 26 aa, Mycobacterium avium
ASVLAYPRVVWIAGGLLKGASVDAEV

SEQ ID NO: 124522 - protein, 25 aa, Mycobacterium avium
ASVQVLCEHPHQWELLRQRPELAMR

SEQ ID NO: 124523 - protein, 24 aa, Mycobacterium avium
ASVRELAVYWTARQIGCSWCVDFG

SEQ ID NO: 124524 - protein, 23 aa, Mycobacterium avium
ASVSYPGCTARQRLCIDQSGAID

SEQ ID NO: 124525 - protein, 21 aa, Mycobacterium avium
ASVTGGNPFFLIQALHHVDES

SEQ ID NO: 124526 - protein, 24 aa, Mycobacterium avium
ASVVAMAGVFWPKTLVATNIASCA

SEQ ID NO: 124527 - protein, 17 aa, Mycobacterium avium
ASWQQGRSSLRRPLDRP

SEQ ID NO: 124528 - protein, 20 aa, Mycobacterium avium
ATAARLAVAMLSNDTSHGPA

SEQ ID NO: 124529 - protein, 21 aa, Mycobacterium avium
ATAARLAVAMLSNDTSRGPAA

SEQ ID NO: 124530 - protein, 20 aa, Mycobacterium avium
ATAFEPGGLIAYLRAGWDLA

SEQ ID NO: 124531 - protein, 19 aa, Mycobacterium avium
ATAFRIPYAPVANGANVTS

SEQ ID NO: 124532 - protein, 27 aa, Mycobacterium avium
ATAGQPLEWFCLFSSAAALVGSPGQGA

SEQ ID NO: 124533 - protein, 30 aa, Mycobacterium avium
ATALARRHPMLRVRFLPDGTQRIAPADEFG

SEQ ID NO: 124534 - protein, 24 aa, Mycobacterium avium
ATAQTLLDLAFSRWTDRGGRGSLA

SEQ ID NO: 124535 - protein, 30 aa, Mycobacterium avium
ATATHARLGGPGSWLLALPAHHIAGVQVLV

SEQ ID NO: 124536 - protein, 30 aa, Mycobacterium avium
ATATHVRLGGPGSWLLALPAHHIAGVQVLV

SEQ ID NO: 124537 - protein, 25 aa, Mycobacterium avium
ATAVDPQHRLLLETSWDAIEHAGLD

SEQ ID NO: 124538 - protein, 19 aa, Mycobacterium avium
ATCDVFLTSYLPTRRKKMG

SEQ ID NO: 124539 - protein, 30 aa, Mycobacterium avium
ATDFVVGDVLYLGFLFLNEEADAYLVALTC

SEQ ID NO: 124540 - protein, 24 aa, Mycobacterium avium
ATDLCEFVEFPTELLQVCGDSFAG

SEQ ID NO: 124541 - protein, 26 aa, Mycobacterium avium
ATDPQVRGWLLGRRQRIAPGAAAEAS

SEQ ID NO: 124542 - protein, 25 aa, Mycobacterium avium
ATDPQVRGWLLGRRQRIAPGGAAEA

SEQ ID NO: 124543 - protein, 24 aa, Mycobacterium avium
ATDYGINPLVLGALTPRIASLELE

SEQ ID NO: 124544 - protein, 24 aa, Mycobacterium avium
ATEEFLRYFTPAPGDARTISADME

SEQ ID NO: 124545 - protein, 25 aa, Mycobacterium avium
ATEIPLRAWLFRRNHDEHVLVAVVH

SEQ ID NO: 124546 - protein, 24 aa, Mycobacterium avium
ATELRAMLGTRLPRYMVPQRIVLV

SEQ ID NO: 124547 - protein, 26 aa, Mycobacterium avium
ATETEQTFLLRLLGGELRQGALAGIM

SEQ ID NO: 124548 - protein, 28 aa, Mycobacterium avium
ATEVDAPLLINLVLGGLTPLQSAARLHE

SEQ ID NO: 124549 - protein, 23 aa, Mycobacterium avium
ATEVGMLYQLRRAAPQVDFQAVN

SEQ ID NO: 124550 - protein, 24 aa, Mycobacterium avium
ATFERLLPQVIPPAPTSGTLRERL

SEQ ID NO: 124551 - protein, 21 aa, Mycobacterium avium
ATGDRLSRLAGRWLRVPVQAQ

SEQ ID NO: 124552 - protein, 17 aa, Mycobacterium avium
ATGEPLLEPLRALFEPV

SEQ ID NO: 124553 - protein, 17 aa, Mycobacterium avium
ATGLVIMAMLERSWLMV

SEQ ID NO: 124554 - protein, 20 aa, Mycobacterium avium
ATGLVVVPVMFDRIMDLPAE

SEQ ID NO: 124555 - protein, 22 aa, Mycobacterium avium
ATGLVVVPVMFDRIMDLPAGVR

SEQ ID NO: 124556 - protein, 27 aa, Mycobacterium avium
ATGLYTYNDVPFCFHYLGPGAELGGPE

SEQ ID NO: 124557 - protein, 20 aa, Mycobacterium avium
ATGMPYGPKVLARYDDFSFN

SEQ ID NO: 124558 - protein, 32 aa, Mycobacterium avium
ATGNILRDYLTDLFPILELGTSAKMLSIVPLM

SEQ ID NO: 124559 - protein, 28 aa, Mycobacterium avium
ATHERLGGPGSWLLALPAHHIAGVQVLV

SEQ ID NO: 124560 - protein, 24 aa, Mycobacterium avium
ATHPARLALRWRPDDYRGERHGDV

SEQ ID NO: 124561 - protein, 17 aa, Mycobacterium avium
ATILAALGQRRLIERRP

SEQ ID NO: 124562 - protein, 20 aa, Mycobacterium avium
ATIRNPLADAWDFLTRTPLA

SEQ ID NO: 124563 - protein, 24 aa, Mycobacterium avium
ATIRPYRPSLSHPVPPAALWGRPG

SEQ ID NO: 124564 - protein, 21 aa, Mycobacterium avium
ATLASRWRRIHGGPGELLDLS

SEQ ID NO: 124565 - protein, 17 aa, Mycobacterium avium
ATLLWSQSARSRGPWPW

SEQ ID NO: 124566 - protein, 18 aa, Mycobacterium avium
ATLPYGLSPLVVPQLKTI

SEQ ID NO: 124567 - protein, 23 aa, Mycobacterium avium
ATLVPIIHIYGPSEVAFILVESG

SEQ ID NO: 124568 - protein, 23 aa, Mycobacterium avium
ATMAGWRTDFLNQMGLVIADSIK

SEQ ID NO: 124569 - protein, 22 aa, Mycobacterium avium
ATMLALLGERGMRRILTEGGPT

SEQ ID NO: 124570 - protein, 23 aa, Mycobacterium avium
ATMLALLGERGMRRILTEGGPTL

SEQ ID NO: 124571 - protein, 23 aa, Mycobacterium avium
ATMPSVHRDLLAAAATLERHGRD

SEQ ID NO: 124572 - protein, 20 aa, Mycobacterium avium
ATMRFEFNSLPFTLGMKEPA

SEQ ID NO: 124573 - protein, 25 aa, Mycobacterium avium
ATNKQRPVALFLRALARDLNASTPG

SEQ ID NO: 124574 - protein, 22 aa, Mycobacterium avium
ATNPDAWFYQRPITLEDHQNSR

SEQ ID NO: 124575 - protein, 23 aa, Mycobacterium avium
ATNRARLAMLLASNVFGQNSAAI

SEQ ID NO: 124576 - protein, 17 aa, Mycobacterium avium
ATPAIRLASGLAPATAA

SEQ ID NO: 124577 - protein, 27 aa, Mycobacterium avium
ATPAVIEAMLLVRLPYHLSSVTQAAAR

SEQ ID NO: 124578 - protein, 18 aa, Mycobacterium avium
ATPIIRWLQDVESAGGQV

SEQ ID NO: 124579 - protein, 23 aa, Mycobacterium avium
ATPKATASALRRVLRRARDGVAL

SEQ ID NO: 124580 - protein, 21 aa, Mycobacterium avium
ATPRHKGISILLVEHRPGLTV

SEQ ID NO: 124581 - protein, 32 aa, Mycobacterium avium
ATPRPPGTAPMLAPLVLWAQGPARLDEVAHRA

SEQ ID NO: 124582 - protein, 31 aa, Mycobacterium avium
ATPTWKKTFGLHPLLAFLDRPEISGGEALAG

SEQ ID NO: 124583 - protein, 27 aa, Mycobacterium avium
ATQESTLGLIFHWAKERNWPLVTTDNL

SEQ ID NO: 124584 - protein, 28 aa, Mycobacterium avium
ATQESTLGLIFHWAKERNWPLVTTDNLR

SEQ ID NO: 124585 - protein, 22 aa, Mycobacterium avium
ATRAAAWSASARRRAAAATGPP

SEQ ID NO: 124586 - protein, 17 aa, Mycobacterium avium
ATRAVLPVLQSWLARDG

SEQ ID NO: 124587 - protein, 19 aa, Mycobacterium avium
ATRFVACPFGGPGARMYRT

SEQ ID NO: 124588 - protein, 25 aa, Mycobacterium avium
ATRGAHLALFRFAFVSQEHEPEAFQ

SEQ ID NO: 124589 - protein, 26 aa, Mycobacterium avium
ATRNPLRLKRFGWFDEITPVPLDAAD

SEQ ID NO: 124590 - protein, 23 aa, Mycobacterium avium
ATRVRSEALRQLSLTPGHEHDTA

SEQ ID NO: 124591 - protein, 24 aa, Mycobacterium avium
ATSAYLFSHPDVNAYFTSLKGQPR

SEQ ID NO: 124592 - protein, 23 aa, Mycobacterium avium
ATTLPGYMMPSSLTVLDVLPKTE

SEQ ID NO: 124593 - protein, 21 aa, Mycobacterium avium
ATTMGCWPACAPCWPQETSAN

SEQ ID NO: 124594 - protein, 21 aa, Mycobacterium avium
ATTRLLAALPPRRQPPKTVPP

SEQ ID NO: 124595 - protein, 17 aa, Mycobacterium avium
ATTTFGLADLFAAAGLP

SEQ ID NO: 124596 - protein, 22 aa, Mycobacterium avium
ATTWHYLFSVAATVAAAWEFRQ

SEQ ID NO: 124597 - protein, 24 aa, Mycobacterium avium
ATVGPFAYLRPGTVLGDDGKLGAF

SEQ ID NO: 124598 - protein, 24 aa, Mycobacterium avium
ATVLRINVFRKPDAGPRPVILSIH

SEQ ID NO: 124599 - protein, 25 aa, Mycobacterium avium
ATVQVRVPIIGGKLENFIGARLAEL

SEQ ID NO: 124600 - protein, 27 aa, Mycobacterium avium
ATVRPEVLHAWHLLQRSRGLIPVTALA

SEQ ID NO: 124601 - protein, 26 aa, Mycobacterium avium
ATVRPEVLHAWHLLQRSRGLMPVTAL

SEQ ID NO: 124602 - protein, 30 aa, Mycobacterium avium
ATVTVRLANKIRLLALAAGDFASPGLELTG

SEQ ID NO: 124603 - protein, 26 aa, Mycobacterium avium
ATYLLGSAELYRWADRRPILRGVGYT

SEQ ID NO: 124604 - protein, 19 aa, Mycobacterium avium
ATYRALVLDWAQPGAGMTA

SEQ ID NO: 124605 - protein, 17 aa, Mycobacterium avium
AVAAHIFGLLPVQTPAK

SEQ ID NO: 124606 - protein, 23 aa, Mycobacterium avium
AVAEHALGFMLDLAKKITVSDRA

SEQ ID NO: 124607 - protein, 20 aa, Mycobacterium avium
AVAGITRLLTGLGYSGYFEL

SEQ ID NO: 124608 - protein, 20 aa, Mycobacterium avium
AVAGLPPDIPDRIHVVCIEH

SEQ ID NO: 124609 - protein, 19 aa, Mycobacterium avium
AVAGVTYHLADGRAALCDH

SEQ ID NO: 124610 - protein, 19 aa, Mycobacterium avium
AVALGALGVLTPRWDHPPS

SEQ ID NO: 124611 - protein, 21 aa, Mycobacterium avium
AVALGWIASRWPGLLPEVQRL

SEQ ID NO: 124612 - protein, 17 aa, Mycobacterium avium
AVALQIAALKARYLSRD

SEQ ID NO: 124613 - protein, 18 aa, Mycobacterium avium
AVANVRWLATGSDPAASG

SEQ ID NO: 124614 - protein, 20 aa, Mycobacterium avium
AVAPYLAWLDATAARARQTA

SEQ ID NO: 124615 - protein, 23 aa, Mycobacterium avium
AVASFYTMYRRGPTGDYLVGVCT

SEQ ID NO: 124616 - protein, 20 aa, Mycobacterium avium
AVATFRLEFRNQCTFGEVRT

SEQ ID NO: 124617 - protein, 19 aa, Mycobacterium avium
AVATFRLEFRNQRTFGEVR

SEQ ID NO: 124618 - protein, 26 aa, Mycobacterium avium
AVAVHRLLCWGIVATPLIVVPAPTRR

SEQ ID NO: 124619 - protein, 27 aa, Mycobacterium avium
AVAVHRLLGWGIVATPLIVVPAPTRLS

SEQ ID NO: 124620 - protein, 24 aa, Mycobacterium avium
AVAYEAITLLRKSPMEAVLRMTLS

SEQ ID NO: 124621 - protein, 18 aa, Mycobacterium avium
AVCMFTLAANPPVTVADG

SEQ ID NO: 124622 - protein, 18 aa, Mycobacterium avium
AVDAYVEALLAKQKLLID

SEQ ID NO: 124623 - protein, 26 aa, Mycobacterium avium
AVDDLGLPDMLLLLATDLVAVDHHEG

SEQ ID NO: 124624 - protein, 24 aa, Mycobacterium avium
AVDDRTRAQRPEWLAAAAAVTAGQ

SEQ ID NO: 124625 - protein, 25 aa, Mycobacterium avium
AVDDRTRAQRPEWLAAAAAVTAGQP

SEQ ID NO: 124626 - protein, 23 aa, Mycobacterium avium
AVDGSLRRLATDRIDLYYQHRLD

SEQ ID NO: 124627 - protein, 17 aa, Mycobacterium avium
AVDLDKSYPIWDVLHES

SEQ ID NO: 124628 - protein, 32 aa, Mycobacterium avium
AVDQSMRVPGWWVLDPMRALPVAVGGHPVVLV

SEQ ID NO: 124629 - protein, 23 aa, Mycobacterium avium
AVDRLSLTVPTGKLTVFVGSSGS

SEQ ID NO: 124630 - protein, 18 aa, Mycobacterium avium
AVDWLYSGLPSRFPNLKI

SEQ ID NO: 124631 - protein, 36 aa, Mycobacterium avium
AVERLAVVPLSFAQQRLWFIDQLQGPSPIYNMAAAL

SEQ ID NO: 124632 - protein, 25 aa, Mycobacterium avium
AVESILTVLALRDQVVPPTLNLENL

SEQ ID NO: 124633 - protein, 26 aa, Mycobacterium avium
AVESILTVLALRDQVVPPTLNLENLD

SEQ ID NO: 124634 - protein, 20 aa, Mycobacterium avium
AVFAQLVATNFFGVNTIPIA

SEQ ID NO: 124635 - protein, 17 aa, Mycobacterium avium
AVFARRAARIGRPMKIP

SEQ ID NO: 124636 - protein, 19 aa, Mycobacterium avium
AVFELAVTLLPAERSRLHV

SEQ ID NO: 124637 - protein, 23 aa, Mycobacterium avium
AVFGLLLGARRAVLGNPAAARRV

SEQ ID NO: 124638 - protein, 19 aa, Mycobacterium avium
AVFKAAYRQGLALVLKGPT

SEQ ID NO: 124639 - protein, 24 aa, Mycobacterium avium
AVGAAFPIAVLNLKGGVGKTAVVE

SEQ ID NO: 124640 - protein, 23 aa, Mycobacterium avium
AVGALLSLLTKLSGGKAIAEVGT

SEQ ID NO: 124641 - protein, 25 aa, Mycobacterium avium
AVGATWYTAVPTIHQILLERARTEA

SEQ ID NO: 124642 - protein, 27 aa, Mycobacterium avium
AVGDPHYAYKLDWLAALRDSAAGWLRE

SEQ ID NO: 124643 - protein, 17 aa, Mycobacterium avium
AVGFARALPDDARLLLT

SEQ ID NO: 124644 - protein, 21 aa, Mycobacterium avium
AVGHRAVTLVFTLAGGAEPCT

SEQ ID NO: 124645 - protein, 23 aa, Mycobacterium avium
AVGLPKPFVPPCMPLGSGPAMAE

SEQ ID NO: 124646 - protein, 20 aa, Mycobacterium avium
AVGQDYLKAIWNAQEWSPEG

SEQ ID NO: 124647 - protein, 29 aa, Mycobacterium avium
AVGTRLVNPPLLVPVLRAGLGMVDPAQAA

SEQ ID NO: 124648 - protein, 22 aa, Mycobacterium avium
AVGWLASFVPLAIPTAGASFDE

SEQ ID NO: 124649 - protein, 22 aa, Mycobacterium avium
AVGWLASFVPLAIPTAGASFNE

SEQ ID NO: 124650 - protein, 25 aa, Mycobacterium avium
AVIAGLTNESWLGPASLSMAGAVMP

SEQ ID NO: 124651 - protein, 23 aa, Mycobacterium avium
AVIKARFRFVAPSRPVREEWLNA

SEQ ID NO: 124652 - protein, 17 aa, Mycobacterium avium
AVILASGLDARAYRLAW

SEQ ID NO: 124653 - protein, 26 aa, Mycobacterium avium
AVKAQVLAEALPWLKQLHGKIVVVKY

SEQ ID NO: 124654 - protein, 17 aa, Mycobacterium avium
AVLALGDSSYELFCNAG

SEQ ID NO: 124655 - protein, 19 aa, Mycobacterium avium
AVLGLLDGPPPRLRLATRL

SEQ ID NO: 124656 - protein, 26 aa, Mycobacterium avium
AVLIGAAWQRCRVHFLRNVLAQVPKG

SEQ ID NO: 124657 - protein, 27 aa, Mycobacterium avium
AVLIGAAWQRCRVHFLRNVLAQVPKGS

SEQ ID NO: 124658 - protein, 27 aa, Mycobacterium avium
AVLIGAAWQRCRVHFLRNVRACQDNCV

SEQ ID NO: 124659 - protein, 26 aa, Mycobacterium avium
AVLINKALIEIPPKFSGQPPVSPDVA

SEQ ID NO: 124660 - protein, 26 aa, Mycobacterium avium
AVLLQMAALRLGDIENFPFLDPPDRR

SEQ ID NO: 124661 - protein, 19 aa, Mycobacterium avium
AVLPSHYEPFGIVALEAAA

SEQ ID NO: 124662 - protein, 17 aa, Mycobacterium avium
AVLRPAFAEAGLGLVFL

SEQ ID NO: 124663 - protein, 19 aa, Mycobacterium avium
AVLRSLPLHAWLQVDTTTP

SEQ ID NO: 124664 - protein, 19 aa, Mycobacterium avium
AVLTRLWKEGPSSASALAA

SEQ ID NO: 124665 - protein, 19 aa, Mycobacterium avium
AVLVCDLVAALIARGGSVS

SEQ ID NO: 124666 - protein, 17 aa, Mycobacterium avium
AVLVDRGHRELPLRADY

SEQ ID NO: 124667 - protein, 18 aa, Mycobacterium avium
AVMAAPVGLLSTLDLPLV

SEQ ID NO: 124668 - protein, 20 aa, Mycobacterium avium
AVMAQFLERVMSGKLSLGET

SEQ ID NO: 124669 - protein, 18 aa, Mycobacterium avium
AVMGLLDRAWHTVHRQTV

SEQ ID NO: 124670 - protein, 19 aa, Mycobacterium avium
AVMRKHRLAERLLVDVIRL

SEQ ID NO: 124671 - protein, 18 aa, Mycobacterium avium
AVMRPVITQLWEDNYRVY

SEQ ID NO: 124672 - protein, 24 aa, Mycobacterium avium
AVNRAARLRALAAGGQILCSGATA

SEQ ID NO: 124673 - protein, 22 aa, Mycobacterium avium
AVNRAARLRSLAAGGQILCSGA

SEQ ID NO: 124674 - protein, 31 aa, Mycobacterium avium
AVNVFGPVELTLALLPALRRARGQVVFINSG

SEQ ID NO: 124675 - protein, 18 aa, Mycobacterium avium
AVPCRWTELELGAATLTD

SEQ ID NO: 124676 - protein, 33 aa, Mycobacterium avium
AVPELWRQPGRGPGRFWGVYGLKKAIAVAEVAQ

SEQ ID NO: 124677 - protein, 17 aa, Mycobacterium avium
AVPERRQIFARRLDLPG

SEQ ID NO: 124678 - protein, 24 aa, Mycobacterium avium
AVPGIIELAPFYADPPDGVRANMI

SEQ ID NO: 124679 - protein, 17 aa, Mycobacterium avium
AVPPWVQGALHTDAGQQ

SEQ ID NO: 124680 - protein, 21 aa, Mycobacterium avium
AVPVNNIHLVRGMLGRPGCGV

SEQ ID NO: 124681 - protein, 24 aa, Mycobacterium avium
AVQRAWQLRIHRIHDLLVNAVVGD

SEQ ID NO: 124682 - protein, 22 aa, Mycobacterium avium
AVQRMAEFQRYAEDMIAEIDSR

SEQ ID NO: 124683 - protein, 19 aa, Mycobacterium avium
AVQSLRLYERHGLVTPARS

SEQ ID NO: 124684 - protein, 23 aa, Mycobacterium avium
AVRDPFLRKRARSLYRETLRHIT

SEQ ID NO: 124685 - protein, 18 aa, Mycobacterium avium
AVRERLDYRILAEILALE

SEQ ID NO: 124686 - protein, 17 aa, Mycobacterium avium
AVRMILYTSGTTSSPKG

SEQ ID NO: 124687 - protein, 17 aa, Mycobacterium avium
AVRTLFHAPSVRGLCRQ

SEQ ID NO: 124688 - protein, 23 aa, Mycobacterium avium
AVRTRFFDDFFTGAARDGIRQSV

SEQ ID NO: 124689 - protein, 24 aa, Mycobacterium avium
AVSAALLIHRLVAKRFGGVLRIGI

SEQ ID NO: 124690 - protein, 24 aa, Mycobacterium avium
AVTALLKERLLLTVHLDPFTREQT

SEQ ID NO: 124691 - protein, 25 aa, Mycobacterium avium
AVTALWKDDLLTRLDLEPLSAAATR

SEQ ID NO: 124692 - protein, 26 aa, Mycobacterium avium
AVTALWKDDLLTRLDLEPLSAAATRE

SEQ ID NO: 124693 - protein, 18 aa, Mycobacterium avium
AVTIPVMAKARIGHFVEA

SEQ ID NO: 124694 - protein, 17 aa, Mycobacterium avium
AVTLAALAPRPGERLWD

SEQ ID NO: 124695 - protein, 34 aa, Mycobacterium avium
AVVARDGLVLGELPPGSLVGTSSPRRAAQLRALG

SEQ ID NO: 124696 - protein, 31 aa, Mycobacterium avium
AVVPLSFAQNRLWFLDQLQGPSPVYNMAAAL

SEQ ID NO: 124697 - protein, 30 aa, Mycobacterium avium
AVVPLSFAQSRLWFLDQLHGPSPVHNMAIA

SEQ ID NO: 124698 - protein, 19 aa, Mycobacterium avium
AVWLALRGLRVLGLDVSPV

SEQ ID NO: 124699 - protein, 21 aa, Mycobacterium avium
AVWPPARLAPVLRGADLDPSM

SEQ ID NO: 124700 - protein, 23 aa, Mycobacterium avium
AVYDKWRTLGPLVDKFGLTTKGV

SEQ ID NO: 124701 - protein, 18 aa, Mycobacterium avium
AVYVLQLNADGLESDQGP

SEQ ID NO: 124702 - protein, 27 aa, Mycobacterium avium
AWALTPNLHWPLEYVDSFAGLVPRLGS

SEQ ID NO: 124703 - protein, 25 aa, Mycobacterium avium
AWELPNELVLLRDTVRRFMDAHVHP

SEQ ID NO: 124704 - protein, 17 aa, Mycobacterium avium
AWFAERAGRTGESTQQL

SEQ ID NO: 124705 - protein, 18 aa, Mycobacterium avium
AWFDLDKLPPMTADMRRR

SEQ ID NO: 124706 - protein, 25 aa, Mycobacterium avium
AWIAEGLFGYLPPEAQDRLLDNITA

SEQ ID NO: 124707 - protein, 19 aa, Mycobacterium avium
AWLGRAWRRIGEEVAAGRQ

SEQ ID NO: 124708 - protein, 18 aa, Mycobacterium avium
AWLTLIRDGAEVRALDAM

SEQ ID NO: 124709 - protein, 25 aa, Mycobacterium avium
AWRNDEWLTARLRLSPLRPDERRTA

SEQ ID NO: 124710 - protein, 18 aa, Mycobacterium avium
AWRSARLIVTIRSGEPVL

SEQ ID NO: 124711 - protein, 24 aa, Mycobacterium avium
AWSDANVLVVPLIETLDALDNIEE

SEQ ID NO: 124712 - protein, 33 aa, Mycobacterium avium
AWTELHARFGKLPFERLFAPAIAYGRNGFPVSP

SEQ ID NO: 124713 - protein, 32 aa, Mycobacterium avium
AWTELHARFGKLPFERLFAPAISYGRNGFPVS

SEQ ID NO: 124714 - protein, 18 aa, Mycobacterium avium
AWVSRVLDRCTGGLRGAV

SEQ ID NO: 124715 - protein, 17 aa, Mycobacterium avium
AWVTIARHAGRQPAPAV

SEQ ID NO: 124716 - protein, 20 aa, Mycobacterium avium
AWVTVRSQRLSAFELQARTI

SEQ ID NO: 124717 - protein, 18 aa, Mycobacterium avium
AYADLVRLVDDLAARLRA

SEQ ID NO: 124718 - protein, 24 aa, Mycobacterium avium
AYAEWMRSLGYRPLLTRHVNEGQG

SEQ ID NO: 124719 - protein, 18 aa, Mycobacterium avium
AYANLALPALLRERGITG

SEQ ID NO: 124720 - protein, 17 aa, Mycobacterium avium
AYDLGRRPGSVAAVIAI

SEQ ID NO: 124721 - protein, 19 aa, Mycobacterium avium
AYEQLILDVLLGEPSLFPV

SEQ ID NO: 124722 - protein, 19 aa, Mycobacterium avium
AYERVADGLLPMPASTHYP

SEQ ID NO: 124723 - protein, 20 aa, Mycobacterium avium
AYFENLGWRTVQVEALYSAA

SEQ ID NO: 124724 - protein, 21 aa, Mycobacterium avium
AYGPHVAVFLPELELARAWER

SEQ ID NO: 124725 - protein, 17 aa, Mycobacterium avium
AYGYYRMARYPTMNSAG

SEQ ID NO: 124726 - protein, 28 aa, Mycobacterium avium
AYHHPRRLHWYVPRSIRLIDVFKGLSPE

SEQ ID NO: 124727 - protein, 29 aa, Mycobacterium avium
AYHHPRRLHWYVPRSIRLIDVFKGLSPEF

SEQ ID NO: 124728 - protein, 27 aa, Mycobacterium avium
AYLKKVLQALTFLRGPRTWVLKSPQHC

SEQ ID NO: 124729 - protein, 19 aa, Mycobacterium avium
AYLRVLRLQAALRALDTPA

SEQ ID NO: 124730 - protein, 17 aa, Mycobacterium avium
AYLVSDEARYVTGVTFP

SEQ ID NO: 124731 - protein, 29 aa, Mycobacterium avium
AYRDELYRRWTGLLSYRYIGRKHSSMNLG

SEQ ID NO: 124732 - protein, 18 aa, Mycobacterium avium
AYRQGLALVLKGPTGCGK

SEQ ID NO: 124733 - protein, 28 aa, Mycobacterium avium
AYRSATRCLYFATYAKSAKVRHLRSAPE

SEQ ID NO: 124734 - protein, 24 aa, Mycobacterium avium
AYVATQGYPLLKKGIRINAICPGP

SEQ ID NO: 124735 - protein, 31 aa, Mycobacterium avium
AYVELTFPISAHYFTVIPLAKRMAALGRAYL

SEQ ID NO: 124736 - protein, 24 aa, Mycobacterium avium
AYYEHGLKVWDRAAGALIAAEAGA

SEQ ID NO: 124737 - protein, 22 aa, Mycobacterium avium
CAIRAWAYQIDDLAGDYRVIAY

SEQ ID NO: 124738 - protein, 24 aa, Mycobacterium avium
CALVENSPVIFLGGQRARVTERRV

SEQ ID NO: 124739 - protein, 17 aa, Mycobacterium avium
CAQAAAPLWSFQLEARL

SEQ ID NO: 124740 - protein, 17 aa, Mycobacterium avium
CARIMLGATISQLRAEE

SEQ ID NO: 124741 - protein, 29 aa, Mycobacterium avium
CAWDQGDHLWMIYLMRVVDAQTVLDKPRS

SEQ ID NO: 124742 - protein, 32 aa, Mycobacterium avium
CCRLRKVEPLRRALRGYAAWVSGLRRVEAPTR

SEQ ID NO: 124743 - protein, 25 aa, Mycobacterium avium
CDLHKANPLLLLDFLHHSGDVPIVL

SEQ ID NO: 124744 - protein, 26 aa, Mycobacterium avium
CDLHKANPLLLLDFLHHSGDVPIVLL

SEQ ID NO: 124745 - protein, 20 aa, Mycobacterium avium
CDLVPVYRSARARLQRLLDE

SEQ ID NO: 124746 - protein, 25 aa, Mycobacterium avium
CDVRPGVPVLFLDTGYHFPETIGTR

SEQ ID NO: 124747 - protein, 19 aa, Mycobacterium avium
CDYFAPILAARRTEPKDDL

SEQ ID NO: 124748 - protein, 17 aa, Mycobacterium avium
CEDVLAAVCALLPAGSA

SEQ ID NO: 124749 - protein, 23 aa, Mycobacterium avium
CFTPTEIVLMEDLGFSVAGNAWK

SEQ ID NO: 124750 - protein, 31 aa, Mycobacterium avium
CGAAPGRYIPLMLIPMWDPKLAAKEMERMAA

SEQ ID NO: 124751 - protein, 17 aa, Mycobacterium avium
CGFAELSLALAARGYTV

SEQ ID NO: 124752 - protein, 18 aa, Mycobacterium avium
CGGAADPALWTTASLAGA

SEQ ID NO: 124753 - protein, 24 aa, Mycobacterium avium
CGGTPFGHLLQRDRLAGVAAVPAA

SEQ ID NO: 124754 - protein, 26 aa, Mycobacterium avium
CGLRWGELAALRWADVDLANKTLRVA

SEQ ID NO: 124755 - protein, 17 aa, Mycobacterium avium
CGRPTLFARTALLDADG

SEQ ID NO: 124756 - protein, 19 aa, Mycobacterium avium
CGSVVIRGPRRSLLRRRLS

SEQ ID NO: 124757 - protein, 26 aa, Mycobacterium avium
CGVAVRGFPNYFFATGPDPGPQARYI

SEQ ID NO: 124758 - protein, 24 aa, Mycobacterium avium
CHRAQGFLLSRPLDSAAMESLLAQ

SEQ ID NO: 124759 - protein, 22 aa, Mycobacterium avium
CHSLAFDFSVWEIWAALLHGGR

SEQ ID NO: 124760 - protein, 26 aa, Mycobacterium avium
CHWILEIHLVDPRRGFGGFYEQLLDL

SEQ ID NO: 124761 - protein, 23 aa, Mycobacterium avium
CIEWPEISFGLAKAGLIAVPVNI

SEQ ID NO: 124762 - protein, 20 aa, Mycobacterium avium
CIEWPEISFGLAKAGLITVP

SEQ ID NO: 124763 - protein, 18 aa, Mycobacterium avium
CIRTLSALALLDTEVLLP

SEQ ID NO: 124764 - protein, 21 aa, Mycobacterium avium
CKLLAAEGLLALAWPKEHGGG

SEQ ID NO: 124765 - protein, 26 aa, Mycobacterium avium
CLDRYARLFAHLRTWDSHTELAVIPA

SEQ ID NO: 124766 - protein, 17 aa, Mycobacterium avium
CLIGAPVLFGRGSVVFA

SEQ ID NO: 124767 - protein, 17 aa, Mycobacterium avium
CLPGFFPRRRSRVPGNH

SEQ ID NO: 124768 - protein, 21 aa, Mycobacterium avium
CLRCPYHGWLWDADGRNAEIP

SEQ ID NO: 124769 - protein, 24 aa, Mycobacterium avium
CLVSLTHPAPPPATAYGQWQGGWV

SEQ ID NO: 124770 - protein, 18 aa, Mycobacterium avium
CMDFATTARLLAGLYAAM

SEQ ID NO: 124771 - protein, 27 aa, Mycobacterium avium
CMDNGMPILVFNLLTNGNIARAVGGEK

SEQ ID NO: 124772 - protein, 20 aa, Mycobacterium avium
CMVGLVEPRLRVAITSGQCD

SEQ ID NO: 124773 - protein, 23 aa, Mycobacterium avium
CNLRCSYCMPAEGLDWLPGEQLL

SEQ ID NO: 124774 - protein, 23 aa, Mycobacterium avium
CNNWADIGLPEVFNDPDLASFNG

SEQ ID NO: 124775 - protein, 24 aa, Mycobacterium avium
CPAAFPRLLTLLAAAGHADAVSLL

SEQ ID NO: 124776 - protein, 25 aa, Mycobacterium avium
CPDEFRRPDLRLALMDRQGVYGAVM

SEQ ID NO: 124777 - protein, 17 aa, Mycobacterium avium
CPDQFLGAHVRRMTGRE

SEQ ID NO: 124778 - protein, 25 aa, Mycobacterium avium
CPDSPVIPGIVWYSATTQPQGWVRL

SEQ ID NO: 124779 - protein, 23 aa, Mycobacterium avium
CPLWNVYETFANPGKILVQIAQM

SEQ ID NO: 124780 - protein, 19 aa, Mycobacterium avium
CPRTKMVLGGYSQGAAVMG

SEQ ID NO: 124781 - protein, 29 aa, Mycobacterium avium
CPVAWNENYGGFWFLSSYDAVSQTARDGD

SEQ ID NO: 124782 - protein, 29 aa, Mycobacterium avium
CPVAWNENYGGFWFLSSYDAVSQTARNGD

SEQ ID NO: 124783 - protein, 25 aa, Mycobacterium avium
CPVSPVIPGIVWYSATTQPQGWVRL

SEQ ID NO: 124784 - protein, 19 aa, Mycobacterium avium
CQFAVGLSRQLYGRTIASE

SEQ ID NO: 124785 - protein, 26 aa, Mycobacterium avium
CQPWQLTPDAVPPPSAPPAGVQGTLG

SEQ ID NO: 124786 - protein, 17 aa, Mycobacterium avium
CQQVWCPVCALAALATG

SEQ ID NO: 124787 - protein, 18 aa, Mycobacterium avium
CRALLIENPSPAAALAGL

SEQ ID NO: 124788 - protein, 24 aa, Mycobacterium avium
CRDHNMQWDFWTLSPESAHQVAMI

SEQ ID NO: 124789 - protein, 21 aa, Mycobacterium avium
CRDLTCRFPGCSRPAVICDLD

SEQ ID NO: 124790 - protein, 21 aa, Mycobacterium avium
CRGTVRVRVLLAPAAEFGKHG

SEQ ID NO: 124791 - protein, 17 aa, Mycobacterium avium
CRKLGLPFAADPSQQLP

SEQ ID NO: 124792 - protein, 17 aa, Mycobacterium avium
CRPWLIAEIEAVHPRVI

SEQ ID NO: 124793 - protein, 21 aa, Mycobacterium avium
CRPWLIAEIEAVHPRVIVCLG

SEQ ID NO: 124794 - protein, 19 aa, Mycobacterium avium
CRRARITLLQPTRNAKSNY

SEQ ID NO: 124795 - protein, 25 aa, Mycobacterium avium
CRTDQRLLRILRGLADVVLVGAGTA

SEQ ID NO: 124796 - protein, 26 aa, Mycobacterium avium
CRTDQRLLRILRGLADVVLVGAGTAR

SEQ ID NO: 124797 - protein, 19 aa, Mycobacterium avium
CSDAPFMANLTWGASRTSG

SEQ ID NO: 124798 - protein, 18 aa, Mycobacterium avium
CSERPAIHRFPGSMAKRI

SEQ ID NO: 124799 - protein, 28 aa, Mycobacterium avium
CSIEPWIFMNWRRAAYYLYLAEVIDARK

SEQ ID NO: 124800 - protein, 18 aa, Mycobacterium avium
CSLALACDLVVAAPASYF

SEQ ID NO: 124801 - protein, 26 aa, Mycobacterium avium
CTALPRPPLFLMASSAAVYGSRNPYR

SEQ ID NO: 124802 - protein, 26 aa, Mycobacterium avium
CTALSRPPLFLMASSAAVYGSRNPYR

SEQ ID NO: 124803 - protein, 25 aa, Mycobacterium avium
CTARGIAFVAYFPLGSGFSTDNPVL

SEQ ID NO: 124804 - protein, 23 aa, Mycobacterium avium
CTGHGRCYTLAPDVFDADEFGHC

SEQ ID NO: 124805 - protein, 17 aa, Mycobacterium avium
CTGSFILGQAGLLDGRR

SEQ ID NO: 124806 - protein, 17 aa, Mycobacterium avium
CTHPVAPATWRSSVRAQ

SEQ ID NO: 124807 - protein, 22 aa, Mycobacterium avium
CTLGYVDPGLKIAFTAGHCRGG

SEQ ID NO: 124808 - protein, 18 aa, Mycobacterium avium
CTLLVTGGDWQGAPTRLA

SEQ ID NO: 124809 - protein, 27 aa, Mycobacterium avium
CTPQEYVLFLRQTPIFEQMLIDDGILL

SEQ ID NO: 124810 - protein, 19 aa, Mycobacterium avium
CTVERLMRANGWRGVTRRK

SEQ ID NO: 124811 - protein, 18 aa, Mycobacterium avium
CVASSLFGRLHTGTGECI

SEQ ID NO: 124812 - protein, 24 aa, Mycobacterium avium
CVCRRLSLRTVSRRFRRATVCARG

SEQ ID NO: 124813 - protein, 17 aa, Mycobacterium avium
CVDNAVVRYFVAGTPPP

SEQ ID NO: 124814 - protein, 17 aa, Mycobacterium avium
CVLAFLDVDGLKQVNDE

SEQ ID NO: 124815 - protein, 18 aa, Mycobacterium avium
CVPLLKQLLEAEGVEQSK

SEQ ID NO: 124816 - protein, 26 aa, Mycobacterium avium
CVQGKDRLSLWMLGNRHALAIAQKYW

SEQ ID NO: 124817 - protein, 19 aa, Mycobacterium avium
CVSVEALFDPYANSLRACH

SEQ ID NO: 124818 - protein, 27 aa, Mycobacterium avium
CVTQVRRYCHLRGIRRDLDSWMQLRRP

SEQ ID NO: 124819 - protein, 18 aa, Mycobacterium avium
CVVDTRAWLRDTSPLFRT

SEQ ID NO: 124820 - protein, 20 aa, Mycobacterium avium
CVVELPTALLIDAHALHDAA

SEQ ID NO: 124821 - protein, 17 aa, Mycobacterium avium
CVYKPVAGEAPLWDFPD

SEQ ID NO: 124822 - protein, 29 aa, Mycobacterium avium
CVYRDRGLLPPPLRVGRIALFNDTHLTRL

SEQ ID NO: 124823 - protein, 18 aa, Mycobacterium avium
CWDLLRGLTLGRLVTHAD

SEQ ID NO: 124824 - protein, 31 aa, Mycobacterium avium
CWHVGMGMGMYGVRPLRLAWRNRQRIPRFYT

SEQ ID NO: 124825 - protein, 31 aa, Mycobacterium avium
CYCRTHHLVKTFWGWREQQLPDATLILTSPA

SEQ ID NO: 124826 - protein, 25 aa, Mycobacterium avium
CYRRGGRVYLLTLTMRHSRRDGLAD

SEQ ID NO: 124827 - protein, 21 aa, Mycobacterium avium
DAAAFLLTNGYINGEVMRLDG

SEQ ID NO: 124828 - protein, 25 aa, Mycobacterium avium
DAAAGLRHLLVLLAAGIDEALRFDP

SEQ ID NO: 124829 - protein, 17 aa, Mycobacterium avium
DAAAPYPRRLAQLRRQR

SEQ ID NO: 124830 - protein, 18 aa, Mycobacterium avium
DAAAWLARHGWRVHSVDN

SEQ ID NO: 124831 - protein, 22 aa, Mycobacterium avium
DAAGFFRIGDLGRWALADSADR

SEQ ID NO: 124832 - protein, 18 aa, Mycobacterium avium
DAAIDWVIDAYTGGLVAE

SEQ ID NO: 124833 - protein, 17 aa, Mycobacterium avium
DAAIDWVIDAYTRGLVA

SEQ ID NO: 124834 - protein, 19 aa, Mycobacterium avium
DAALQRTITELGTPAILVN

SEQ ID NO: 124835 - protein, 23 aa, Mycobacterium avium
DAALTFVHVPYPAPSDWTRRTLT

SEQ ID NO: 124836 - protein, 23 aa, Mycobacterium avium
DAALVCVPPYHIAGVGAALSNLY

SEQ ID NO: 124837 - protein, 32 aa, Mycobacterium avium
DAAPITRAFRRIVLYEPPIPSLGLDVGSPGGW

SEQ ID NO: 124838 - protein, 30 aa, Mycobacterium avium
DAAQRLYDDLKPLLTFIVAGGLATTVKAGL

SEQ ID NO: 124839 - protein, 28 aa, Mycobacterium avium
DAAVPVPHDIPWFPKDQQAWSVRWVILH

SEQ ID NO: 124840 - protein, 19 aa, Mycobacterium avium
DADGWAGYYYYGFSQAIGG

SEQ ID NO: 124841 - protein, 22 aa, Mycobacterium avium
DADLFTFGKVMSGGLPAAAFGG

SEQ ID NO: 124842 - protein, 26 aa, Mycobacterium avium
DADLHDWYGRYLYFAPDEVEPLEAHP

SEQ ID NO: 124843 - protein, 27 aa, Mycobacterium avium
DADLSGWSLIYLGVLSRYGVAMFHGGT

SEQ ID NO: 124844 - protein, 22 aa, Mycobacterium avium
DADPASFWRVDVAPAAYVVMHH

SEQ ID NO: 124845 - protein, 25 aa, Mycobacterium avium
DADRAWWAQRLPELPDPPALPTTAG

SEQ ID NO: 124846 - protein, 25 aa, Mycobacterium avium
DADRYRRLHVIIGDANLAETSTYLK

SEQ ID NO: 124847 - protein, 28 aa, Mycobacterium avium
DADTEIARLVPFIEWLRGAYPDQLISAD

SEQ ID NO: 124848 - protein, 17 aa, Mycobacterium avium
DADYLEMVELKTSWYSF

SEQ ID NO: 124849 - protein, 32 aa, Mycobacterium avium
DADYLEMVELKTSWYSFITPLQAGAVAAGATP

SEQ ID NO: 124850 - protein, 21 aa, Mycobacterium avium
DAEAARRFGCGFAPSGWDTLT

SEQ ID NO: 124851 - protein, 17 aa, Mycobacterium avium
DAEGWFRTGDLGRIDDD

SEQ ID NO: 124852 - protein, 23 aa, Mycobacterium avium
DAENARMICRYSRRARFLQTGLA

SEQ ID NO: 124853 - protein, 27 aa, Mycobacterium avium
DAEPANLDLLVGPAHVVQLPVGTPARQ

SEQ ID NO: 124854 - protein, 23 aa, Mycobacterium avium
DAEPPSAIFIGGGLTRPGLLDAC

SEQ ID NO: 124855 - protein, 17 aa, Mycobacterium avium
DAFDRIAAALPAAARAA

SEQ ID NO: 124856 - protein, 20 aa, Mycobacterium avium
DAFSWRATFENLALVDGPTA

SEQ ID NO: 124857 - protein, 21 aa, Mycobacterium avium
DAFTFNVATAHALTVAAVPLM

SEQ ID NO: 124858 - protein, 24 aa, Mycobacterium avium
DAFTKLHREILVQLMPHGAQLDPA

SEQ ID NO: 124859 - protein, 18 aa, Mycobacterium avium
DAGFVVVAPHTYFPRLRL

SEQ ID NO: 124860 - protein, 27 aa, Mycobacterium avium
DAGGPAPVLQWLIYPRTDFTARTRSLS

SEQ ID NO: 124861 - protein, 25 aa, Mycobacterium avium
DAGLIGPFRVRIPLLLSADDGHQLV

SEQ ID NO: 124862 - protein, 28 aa, Mycobacterium avium
DAGPHELAIVLYGLARHAGAVPLAETDA

SEQ ID NO: 124863 - protein, 24 aa, Mycobacterium avium
DAGPQLHANWRWARSVLTDEQLNR

SEQ ID NO: 124864 - protein, 23 aa, Mycobacterium avium
DAGRAFPASSFLEKARKTNEVQS

SEQ ID NO: 124865 - protein, 23 aa, Mycobacterium avium
DAGVEPLIAAPFFAVVPYEWDRY

SEQ ID NO: 124866 - protein, 20 aa, Mycobacterium avium
DAHAFDAEGWFRTGDLGRID

SEQ ID NO: 124867 - protein, 29 aa, Mycobacterium avium
DAHQVTVLHFMPGWLEMLVEVGRGRLSSV

SEQ ID NO: 124868 - protein, 20 aa, Mycobacterium avium
DAIPGLRRVSLSETARWRST

SEQ ID NO: 124869 - protein, 18 aa, Mycobacterium avium
DAKFLWSHRDPAKVMASV

SEQ ID NO: 124870 - protein, 19 aa, Mycobacterium avium
DAKIAFLMLPGVGTKEDIK

SEQ ID NO: 124871 - protein, 23 aa, Mycobacterium avium
DAKRLVDFAAGLAFALRGSFDKV

SEQ ID NO: 124872 - protein, 22 aa, Mycobacterium avium
DAKTYRFNPFDVTKVWPHADYP

SEQ ID NO: 124873 - protein, 25 aa, Mycobacterium avium
DAKTYRFNPFDVTKVWPHADYPPIE

SEQ ID NO: 124874 - protein, 24 aa, Mycobacterium avium
DALALDTLALLEARWRDVVATLDR

SEQ ID NO: 124875 - protein, 26 aa, Mycobacterium avium
DALDTLRGQLFPLATLVTPNLDEVRL

SEQ ID NO: 124876 - protein, 23 aa, Mycobacterium avium
DALGDMFLGALFGDHPVGRPVIG

SEQ ID NO: 124877 - protein, 21 aa, Mycobacterium avium
DALGIGYEIVPGVPAFAAAAA

SEQ ID NO: 124878 - protein, 26 aa, Mycobacterium avium
DALGPRSPTPANRWCWPAGPRPGPAR

SEQ ID NO: 124879 - protein, 22 aa, Mycobacterium avium
DALLNLLENPPPQVFRMKGVVA

SEQ ID NO: 124880 - protein, 20 aa, Mycobacterium avium
DALQRVWRPLADKLDVHAYI

SEQ ID NO: 124881 - protein, 25 aa, Mycobacterium avium
DALQTFPTMQALPIAYTEPIDVANA

SEQ ID NO: 124882 - protein, 23 aa, Mycobacterium avium
DALRRIEIALHQAGAALADVVRN

SEQ ID NO: 124883 - protein, 20 aa, Mycobacterium avium
DALRRIEIALRQAGAELADV

SEQ ID NO: 124884 - protein, 22 aa, Mycobacterium avium
DALRSVGFPFPGVRVRIVGDDG

SEQ ID NO: 124885 - protein, 17 aa, Mycobacterium avium
DAMLGVVRLARGEFPAA

SEQ ID NO: 124886 - protein, 18 aa, Mycobacterium avium
DAMVGFGLPVRRSRRATA

SEQ ID NO: 124887 - protein, 19 aa, Mycobacterium avium
DANLKLGFPADARDYGIGA

SEQ ID NO: 124888 - protein, 35 aa, Mycobacterium avium
DANPKSWWRAALRFGYHMQFAWYVSLARALRLDDS

SEQ ID NO: 124889 - protein, 17 aa, Mycobacterium avium
DANVVPIVFHRSGFRRL

SEQ ID NO: 124890 - protein, 19 aa, Mycobacterium avium
DANWMALMADRPVDALWGV

SEQ ID NO: 124891 - protein, 17 aa, Mycobacterium avium
DAPAHFGSAALSSVFAA

SEQ ID NO: 124892 - protein, 17 aa, Mycobacterium avium
DAPGFAAFYRRCRLVTE

SEQ ID NO: 124893 - protein, 25 aa, Mycobacterium avium
DAPGLGLIPFAEPGSCRLFLPDPVV

SEQ ID NO: 124894 - protein, 19 aa, Mycobacterium avium
DARDTELLREFKARRGREV

SEQ ID NO: 124895 - protein, 23 aa, Mycobacterium avium
DARPPILDLVLPSAVGEASGDSE

SEQ ID NO: 124896 - protein, 27 aa, Mycobacterium avium
DASDAAEWFAGRLPEQWFDGDPTVIVD

SEQ ID NO: 124897 - protein, 30 aa, Mycobacterium avium
DASEALRLGLDIMLIGVWNAFQVAIPHMKE

SEQ ID NO: 124898 - protein, 28 aa, Mycobacterium avium
DASRREWTLPAWSPMPVSELLLGRAHRP

SEQ ID NO: 124899 - protein, 27 aa, Mycobacterium avium
DASTFLGRLALIRIYNGKLRKGQQVAW

SEQ ID NO: 124900 - protein, 23 aa, Mycobacterium avium
DATAFIYIGEVCRYLLNQPAKPT

SEQ ID NO: 124901 - protein, 22 aa, Mycobacterium avium
DATLRTLGQRPFYPPSVGGWPS

SEQ ID NO: 124902 - protein, 17 aa, Mycobacterium avium
DATPGIMIPFLASHTAK

SEQ ID NO: 124903 - protein, 21 aa, Mycobacterium avium
DATRLPALLEGNPDAPLYADP

SEQ ID NO: 124904 - protein, 23 aa, Mycobacterium avium
DAVAEMTVALLLAATRHLLPADA

SEQ ID NO: 124905 - protein, 23 aa, Mycobacterium avium
DAVARQRLWRVREALAEVLGVYG

SEQ ID NO: 124906 - protein, 27 aa, Mycobacterium avium
DAVDGRPRGHLRKFGLSRVRVRELAHA

SEQ ID NO: 124907 - protein, 19 aa, Mycobacterium avium
DAVIAVHLSGAFNVTRAVW

SEQ ID NO: 124908 - protein, 18 aa, Mycobacterium avium
DAVLARAARIGPMSVPAG

SEQ ID NO: 124909 - protein, 33 aa, Mycobacterium avium
DAVRQQASIRLGFSWLLPDPWAQDTVARFERTT

SEQ ID NO: 124910 - protein, 26 aa, Mycobacterium avium
DAVVNLNLKGPFRLSALVGERMVAAG

SEQ ID NO: 124911 - protein, 20 aa, Mycobacterium avium
DAVWATGMRAKLGLPAQVDA

SEQ ID NO: 124912 - protein, 18 aa, Mycobacterium avium
DAVYADHAFFAKKKLSAP

SEQ ID NO: 124913 - protein, 21 aa, Mycobacterium avium
DAWQPLPTWFERLAAAGVRAR

SEQ ID NO: 124914 - protein, 19 aa, Mycobacterium avium
DAYFRADDWPKVLPARRLP

SEQ ID NO: 124915 - protein, 26 aa, Mycobacterium avium
DAYGADFFATWGKLAAVRTPTIAAVA

SEQ ID NO: 124916 - protein, 27 aa, Mycobacterium avium
DAYIAVFDAFVERLAPGGALVVCVDDP

SEQ ID NO: 124917 - protein, 30 aa, Mycobacterium avium
DCEGFQRFAMAMAPFGFRASAATPAYGMAE

SEQ ID NO: 124918 - protein, 21 aa, Mycobacterium avium
DCGEPLFDGWPAVPGLADRYR

SEQ ID NO: 124919 - protein, 29 aa, Mycobacterium avium
DCGGPPVRFQLLWYPSTMWDASLPSFAEN

SEQ ID NO: 124920 - protein, 28 aa, Mycobacterium avium
DCPIPDPLDLLAFLAGHTTRLGLATGVL

SEQ ID NO: 124921 - protein, 20 aa, Mycobacterium avium
DCPRAEVLVSFRPAVDPTHI

SEQ ID NO: 124922 - protein, 19 aa, Mycobacterium avium
DCRILACSSVFGTWGGYGH

SEQ ID NO: 124923 - protein, 23 aa, Mycobacterium avium
DDAARMWARLRIHLAEAGRRMRA

SEQ ID NO: 124924 - protein, 18 aa, Mycobacterium avium
DDALLGEQPLVVGTRLDR

SEQ ID NO: 124925 - protein, 20 aa, Mycobacterium avium
DDAPAHFGSAALSSVFAADV

SEQ ID NO: 124926 - protein, 23 aa, Mycobacterium avium
DDAQPWLTDADRLRLLLREVFTA

SEQ ID NO: 124927 - protein, 23 aa, Mycobacterium avium
DDARVGRLLFSTQLADPVVVRKR

SEQ ID NO: 124928 - protein, 24 aa, Mycobacterium avium
DDAVREYLYPIAANRIRGVKLPGP

SEQ ID NO: 124929 - protein, 23 aa, Mycobacterium avium
DDAVRMWARLRIHLAEAGRRMRA

SEQ ID NO: 124930 - protein, 19 aa, Mycobacterium avium
DDAWVLDELRELAGILGVA

SEQ ID NO: 124931 - protein, 20 aa, Mycobacterium avium
DDDASWYDYLHTVTGARVTA

SEQ ID NO: 124932 - protein, 25 aa, Mycobacterium avium
DDDFYAPYPWATHREPMRMHPQFAA

SEQ ID NO: 124933 - protein, 28 aa, Mycobacterium avium
DDEALLFVELGKRLAPGPFLACTLGARV

SEQ ID NO: 124934 - protein, 31 aa, Mycobacterium avium
DDEFFGMSALYRMYRAADGYVFLAAPLPREW

SEQ ID NO: 124935 - protein, 23 aa, Mycobacterium avium
DDEHLPLLDRLDLNGIQVLEVGS

SEQ ID NO: 124936 - protein, 24 aa, Mycobacterium avium
DDEKFRAFLAEQPDLGPKQWPSYV

SEQ ID NO: 124937 - protein, 19 aa, Mycobacterium avium
DDELPSLLDFYMCYRAYVR

SEQ ID NO: 124938 - protein, 24 aa, Mycobacterium avium
DDEQLVLDLLLQEKILVTHGTGFN

SEQ ID NO: 124939 - protein, 17 aa, Mycobacterium avium
DDERIWSALRRIPLREL

SEQ ID NO: 124940 - protein, 23 aa, Mycobacterium avium
DDERPQVHLAARPGALTAAELAD

SEQ ID NO: 124941 - protein, 23 aa, Mycobacterium avium
DDERPQVHLAARPGVLTAAELAD

SEQ ID NO: 124942 - protein, 28 aa, Mycobacterium avium
DDFPTTLFGQYLQFLRTGDLPGSARIGP

SEQ ID NO: 124943 - protein, 24 aa, Mycobacterium avium
DDGKPPHPSWLPRQRRGTTPQMIG

SEQ ID NO: 124944 - protein, 25 aa, Mycobacterium avium
DDGNRALLASWWTETWNAGGGDFVK

SEQ ID NO: 124945 - protein, 18 aa, Mycobacterium avium
DDIAVWRVGSRRDDDKAR

SEQ ID NO: 124946 - protein, 22 aa, Mycobacterium avium
DDIRWALDLLRQRFAKVIWVPG

SEQ ID NO: 124947 - protein, 30 aa, Mycobacterium avium
DDLAERVGWQWRLVWYKAVAELLTGDYDSA

SEQ ID NO: 124948 - protein, 24 aa, Mycobacterium avium
DDLARLYHDLMFGKGLACVRGFPV

SEQ ID NO: 124949 - protein, 17 aa, Mycobacterium avium
DDLAVQIVRAALDKVPA

SEQ ID NO: 124950 - protein, 36 aa, Mycobacterium avium
DDLDALITKVWKTPSFFLTHPLGIAAFGREATYRGV

SEQ ID NO: 124951 - protein, 31 aa, Mycobacterium avium
DDLGALAGWYVWAALGLYPATPGTPILTVAA

SEQ ID NO: 124952 - protein, 23 aa, Mycobacterium avium
DDLHRFVVLVAEQGRQVGMAVDD

SEQ ID NO: 124953 - protein, 22 aa, Mycobacterium avium
DDLIDRCWAPKVYGAWNLHQAT

SEQ ID NO: 124954 - protein, 26 aa, Mycobacterium avium
DDLIRESLGWVPYTQLAILTGRPAIS

SEQ ID NO: 124955 - protein, 29 aa, Mycobacterium avium
DDLLTATLLTARCPVLFAPAMHTEMWLHP

SEQ ID NO: 124956 - protein, 21 aa, Mycobacterium avium
DDLMPRERLLAVFATPPAFTD

SEQ ID NO: 124957 - protein, 33 aa, Mycobacterium avium
DDLPIAPKPLQRPHPPIWFGGLAPKALARAVRH

SEQ ID NO: 124958 - protein, 24 aa, Mycobacterium avium
DDLQDRYLFIQAIETQKAYDDGVI

SEQ ID NO: 124959 - protein, 26 aa, Mycobacterium avium
DDLRREPRWPRYAPAAVQLGVLSSLS

SEQ ID NO: 124960 - protein, 17 aa, Mycobacterium avium
DDLWAALRTLAADPAAC

SEQ ID NO: 124961 - protein, 35 aa, Mycobacterium avium
DDMHDWCVSRQLWWGHRIPIWYGPNGEQRCVGPDE

SEQ ID NO: 124962 - protein, 26 aa, Mycobacterium avium
DDPAKLALPQWYANNGQFVTTKFFGM

SEQ ID NO: 124963 - protein, 25 aa, Mycobacterium avium
DDPAQLRLIFTAFTEYLRSPAAAAT

SEQ ID NO: 124964 - protein, 25 aa, Mycobacterium avium
DDPEFHPPRLGDLKRSCLDIGLAAR

SEQ ID NO: 124965 - protein, 22 aa, Mycobacterium avium
DDPEKWMYAAWMQLTDKGEQLA

SEQ ID NO: 124966 - protein, 23 aa, Mycobacterium avium
DDPVRQALIPPLQKIVKERGLWA

SEQ ID NO: 124967 - protein, 24 aa, Mycobacterium avium
DDPYLQAVLQRRLPVVVVDQPKGL

SEQ ID NO: 124968 - protein, 25 aa, Mycobacterium avium
DDSDPKLTYLDRDEPRRPRLFLVSA

SEQ ID NO: 124969 - protein, 17 aa, Mycobacterium avium
DDSPIELRWIVFAKTRA

SEQ ID NO: 124970 - protein, 18 aa, Mycobacterium avium
DDTAERLAALPSPQLLLN

SEQ ID NO: 124971 - protein, 17 aa, Mycobacterium avium
DDTLLTRLYGTPIHVHR

SEQ ID NO: 124972 - protein, 25 aa, Mycobacterium avium
DDTVPAPRRHWPSPMLPALQSLLDD

SEQ ID NO: 124973 - protein, 24 aa, Mycobacterium avium
DDVEPYLQRACDWAACGRAVFNAR

SEQ ID NO: 124974 - protein, 28 aa, Mycobacterium avium
DDVSTFDLYSCFPVPVFNFCDGTSLATD

SEQ ID NO: 124975 - protein, 35 aa, Mycobacterium avium
DDVSTYQRWLGTRLPYYANWIRIKSYWGTADNNYP

SEQ ID NO: 124976 - protein, 24 aa, Mycobacterium avium
DDVYLFRACVDLAKLSWGKNHDAH

SEQ ID NO: 124977 - protein, 26 aa, Mycobacterium avium
DDWPRHQLRLPAGHGLLLLTDGLYEG

SEQ ID NO: 124978 - protein, 26 aa, Mycobacterium avium
DDYLVKPFVLAELVARVKALLRRRGA

SEQ ID NO: 124979 - protein, 28 aa, Mycobacterium avium
DDYNELVIATPIRLTLPPIGSSYPEEQV

SEQ ID NO: 124980 - protein, 17 aa, Mycobacterium avium
DEAALLDALVSGGIAGA

SEQ ID NO: 124981 - protein, 26 aa, Mycobacterium avium
DEAAVLLLRFTAAPPASVPSRRSVER

SEQ ID NO: 124982 - protein, 24 aa, Mycobacterium avium
DEAGALVGLQWGAGLVVPIAPAAV

SEQ ID NO: 124983 - protein, 33 aa, Mycobacterium avium
DEAIKEFHWGLERGMKTFLVRPAPVPSRFGGSR

SEQ ID NO: 124984 - protein, 20 aa, Mycobacterium avium
DEALARVFDYTLASGKTPIV

SEQ ID NO: 124985 - protein, 28 aa, Mycobacterium avium
DEALTELLMIVATYYGLALVLNATDLDI

SEQ ID NO: 124986 - protein, 25 aa, Mycobacterium avium
DECMQLLKLLHGQWAPVQDAWEVAN

SEQ ID NO: 124987 - protein, 26 aa, Mycobacterium avium
DECSDLFYSIWWPRLPGDTADVPEGK

SEQ ID NO: 124988 - protein, 24 aa, Mycobacterium avium
DEDGYLYIVDRRVDMIISGGANVF

SEQ ID NO: 124989 - protein, 25 aa, Mycobacterium avium
DEDRRLDGVVWVITLLQVDPSETLE

SEQ ID NO: 124990 - protein, 17 aa, Mycobacterium avium
DEELDVWLISWVPGHPT

SEQ ID NO: 124991 - protein, 21 aa, Mycobacterium avium
DEELVICDLFEAVLDHTHGSP

SEQ ID NO: 124992 - protein, 17 aa, Mycobacterium avium
DEFKYRRTADKVIDLVV

SEQ ID NO: 124993 - protein, 24 aa, Mycobacterium avium
DEGALLTHLGDLRRRHRGHRDLGE

SEQ ID NO: 124994 - protein, 21 aa, Mycobacterium avium
DEGWLAEHMLILKLTSPEQQV

SEQ ID NO: 124995 - protein, 24 aa, Mycobacterium avium
DEIEVGLRYYAAAFFKVIPRVNAE

SEQ ID NO: 124996 - protein, 22 aa, Mycobacterium avium
DEIGYGVLFFASDASSYCSGQT

SEQ ID NO: 124997 - protein, 23 aa, Mycobacterium avium
DEIGYGVLFFASDASSYCSGQTL

SEQ ID NO: 124998 - protein, 18 aa, Mycobacterium avium
DEIIPLQVPQADGSVITF

SEQ ID NO: 124999 - protein, 17 aa, Mycobacterium avium
DEKGVIGNSLQLMSNPN

SEQ ID NO: 125000 - protein, 20 aa, Mycobacterium avium
DELAFPRLYGAQTRFFDDFF

SEQ ID NO: 125001 - protein, 20 aa, Mycobacterium avium
DELGPYFVLLSVAGNDTTRT

SEQ ID NO: 125002 - protein, 30 aa, Mycobacterium avium
DELLQRSSGNPLLLRGFLTAARDTGALFRT

SEQ ID NO: 125003 - protein, 18 aa, Mycobacterium avium
DELNLAAPLVLPAGGSVA

SEQ ID NO: 125004 - protein, 18 aa, Mycobacterium avium
DELRRRGENIGLTTVYRT

SEQ ID NO: 125005 - protein, 29 aa, Mycobacterium avium
DELRRRGENIGLTTVYRTLQSMAAAGLID

SEQ ID NO: 125006 - protein, 20 aa, Mycobacterium avium
DELVDRYGPRIRACELDVTD

SEQ ID NO: 125007 - protein, 25 aa, Mycobacterium avium
DELVIVVPPTHKWARRSRVVTAREL

SEQ ID NO: 125008 - protein, 25 aa, Mycobacterium avium
DENLQRIWTPDPNAPRVPPGDPFGV

SEQ ID NO: 125009 - protein, 30 aa, Mycobacterium avium
DENLRSLDWNAPLTRIYTCAATPSPSPVSP

SEQ ID NO: 125010 - protein, 22 aa, Mycobacterium avium
DEQIYGFMRNLLPAGAETTSRS

SEQ ID NO: 125011 - protein, 22 aa, Mycobacterium avium
DEQRARWLPRLVSGDMVVGIGA

SEQ ID NO: 125012 - protein, 27 aa, Mycobacterium avium
DERAIQQAFLFGPPPLGPDAPPLDRLV

SEQ ID NO: 125013 - protein, 23 aa, Mycobacterium avium
DERWRLIQYLIEHPDLETRDRVA

SEQ ID NO: 125014 - protein, 25 aa, Mycobacterium avium
DESFTLVYDALVSRAGQNVAALPTA

SEQ ID NO: 125015 - protein, 17 aa, Mycobacterium avium
DESSLFTIAGAALLRGA

SEQ ID NO: 125016 - protein, 17 aa, Mycobacterium avium
DESWWRRGKPTLHIDHG

SEQ ID NO: 125017 - protein, 18 aa, Mycobacterium avium
DESWWRRGKPTLHIDHGV

SEQ ID NO: 125018 - protein, 28 aa, Mycobacterium avium
DEVESLWAVLARTLPEPWRVEALVLVAF

SEQ ID NO: 125019 - protein, 22 aa, Mycobacterium avium
DEVFAGYHWYPPMGEPAAATLD

SEQ ID NO: 125020 - protein, 31 aa, Mycobacterium avium
DEVNTRLLQRLTVAEFFSLIRQFSEGSGQPL

SEQ ID NO: 125021 - protein, 32 aa, Mycobacterium avium
DEVRRYIIGCALRWMRDFHADGLRLDAVHALV

SEQ ID NO: 125022 - protein, 17 aa, Mycobacterium avium
DEVWRTIHEHKVNLLFF

SEQ ID NO: 125023 - protein, 18 aa, Mycobacterium avium
DEVWRTIHEHKVNLLFFT

SEQ ID NO: 125024 - protein, 17 aa, Mycobacterium avium
DEVWRTIHEHKVNLVFF

SEQ ID NO: 125025 - protein, 24 aa, Mycobacterium avium
DEWRRLTTLLVDKGTFVALTKKPN

SEQ ID NO: 125026 - protein, 38 aa, Mycobacterium avium
DFAELLVEALTGTAPPPGALFRALRRVRAVLDAAGRCH

SEQ ID NO: 125027 - protein, 33 aa, Mycobacterium avium
DFAELLVEALTGTAPPPGAPFRALRRVRAVLDA

SEQ ID NO: 125028 - protein, 18 aa, Mycobacterium avium
DFCAAIPVLTITGSFGVP

SEQ ID NO: 125029 - protein, 18 aa, Mycobacterium avium
DFDALHPVVRLRALERME

SEQ ID NO: 125030 - protein, 19 aa, Mycobacterium avium
DFDVWRRTLDVNLLGYVRT

SEQ ID NO: 125031 - protein, 23 aa, Mycobacterium avium
DFEKTLRFWLERGVDGFRIDVAH

SEQ ID NO: 125032 - protein, 26 aa, Mycobacterium avium
DFENMHPLMVPFLEQFVLKARYADAP

SEQ ID NO: 125033 - protein, 20 aa, Mycobacterium avium
DFFEGVMMPELFMADAVGAT

SEQ ID NO: 125034 - protein, 26 aa, Mycobacterium avium
DFGTGYSVLTYLKSLPVDSLKIDKGF

SEQ ID NO: 125035 - protein, 18 aa, Mycobacterium avium
DFHLAYAAALATAGRFAD

SEQ ID NO: 125036 - protein, 25 aa, Mycobacterium avium
DFKGRKVIVYFYPAASTPGCTKQAC

SEQ ID NO: 125037 - protein, 17 aa, Mycobacterium avium
DFLFFPGQRDRGPTMSF

SEQ ID NO: 125038 - protein, 18 aa, Mycobacterium avium
DFLPGDPARLGPTLSEAA

SEQ ID NO: 125039 - protein, 18 aa, Mycobacterium avium
DFLPGDPARLGPTLTEAA

SEQ ID NO: 125040 - protein, 24 aa, Mycobacterium avium
DFPATSVRFFASSRSQGRKLEFRG

SEQ ID NO: 125041 - protein, 20 aa, Mycobacterium avium
DFPMDHVFSMAADDGRPGAL

SEQ ID NO: 125042 - protein, 25 aa, Mycobacterium avium
DFSLTERYVVFYDLPVTFDEAVGAA

SEQ ID NO: 125043 - protein, 20 aa, Mycobacterium avium
DFVLPDPRPRRVLFVSGGSG

SEQ ID NO: 125044 - protein, 21 aa, Mycobacterium avium
DFVLPDPRPRRVLFVSGGSGI

SEQ ID NO: 125045 - protein, 24 aa, Mycobacterium avium
DFVLPTPRPRRVLFVSGGSGITPV

SEQ ID NO: 125046 - protein, 20 aa, Mycobacterium avium
DFVPAFGSAFQWQYPTPPEG

SEQ ID NO: 125047 - protein, 27 aa, Mycobacterium avium
DFVSSFATLLPLRIIDDMLGVPREHEQ

SEQ ID NO: 125048 - protein, 24 aa, Mycobacterium avium
DGAGVKRVPLARARRAAQRHDYLG

SEQ ID NO: 125049 - protein, 32 aa, Mycobacterium avium
DGALHTVGMLFSPGYPGFLRGVAASGPDEFVV

SEQ ID NO: 125050 - protein, 48 aa, Mycobacterium avium
DGASDRACSWLPLYHDMGLAFLLTSALSGMPLWQAPTGAFSAAPLRWA

SEQ ID NO: 125051 - protein, 27 aa, Mycobacterium avium
DGATRRWPECILFERGGDGLISHISVF

SEQ ID NO: 125052 - protein, 21 aa, Mycobacterium avium
DGDPWFVLADLCRVLDIRNAR

SEQ ID NO: 125053 - protein, 43 aa, Mycobacterium avium
DGDVAWLTRPIIDSYHTVWFELHEELILATGLTRDAEAQAGHA

SEQ ID NO: 125054 - protein, 22 aa, Mycobacterium avium
DGEPAVFLLDPTIDSVVAEAER

SEQ ID NO: 125055 - protein, 17 aa, Mycobacterium avium
DGETVVPLLPAQDFKRV

SEQ ID NO: 125056 - protein, 25 aa, Mycobacterium avium
DGEVKLGLLPLLDAALDAVSVPVLA

SEQ ID NO: 125057 - protein, 28 aa, Mycobacterium avium
DGEVRQQFSLLFTTRVLGGELAIDHEST

SEQ ID NO: 125058 - protein, 17 aa, Mycobacterium avium
DGEWVDWFPPTHPDRPD

SEQ ID NO: 125059 - protein, 23 aa, Mycobacterium avium
DGGASALLPLLIGRARTSRMAMT

SEQ ID NO: 125060 - protein, 23 aa, Mycobacterium avium
DGGNLRLALTDFPPNFNILHIDG

SEQ ID NO: 125061 - protein, 24 aa, Mycobacterium avium
DGGRWQDEWLYARAYTIAGGSSEI

SEQ ID NO: 125062 - protein, 25 aa, Mycobacterium avium
DGHPSGVFDWRPPSSLIAALSDLLD

SEQ ID NO: 125063 - protein, 18 aa, Mycobacterium avium
DGHRAVVPALPLHDTVKA

SEQ ID NO: 125064 - protein, 22 aa, Mycobacterium avium
DGHSLSRPTWSLDDVVWVVVDG

SEQ ID NO: 125065 - protein, 20 aa, Mycobacterium avium
DGIKRPLIVFTPKSMLRNKA

SEQ ID NO: 125066 - protein, 24 aa, Mycobacterium avium
DGITVFCLGIDVMAFRRVCEDTIA

SEQ ID NO: 125067 - protein, 25 aa, Mycobacterium avium
DGKEIAGRLAARIGSGLLVDVVEVK

SEQ ID NO: 125068 - protein, 19 aa, Mycobacterium avium
DGKELLRRLKGLPGFGEQK

SEQ ID NO: 125069 - protein, 23 aa, Mycobacterium avium
DGKPPHPSWLPRQRRGTTPQMIG

SEQ ID NO: 125070 - protein, 17 aa, Mycobacterium avium
DGKWNVRLTDTDGDGLA

SEQ ID NO: 125071 - protein, 26 aa, Mycobacterium avium
DGLDRGWYVRPTLFAAAGNAMRIARE

SEQ ID NO: 125072 - protein, 20 aa, Mycobacterium avium
DGLGRVFQQPRAVLGRAVEQ

SEQ ID NO: 125073 - protein, 17 aa, Mycobacterium avium
DGLPRIAQAVAAPAVRK

SEQ ID NO: 125074 - protein, 23 aa, Mycobacterium avium
DGMEALLPVLRPGKQVLLTDQLA

SEQ ID NO: 125075 - protein, 17 aa, Mycobacterium avium
DGPADHVLLPDLSTGCV

SEQ ID NO: 125076 - protein, 24 aa, Mycobacterium avium
DGPDGAFQWFTQVLKMAFPDLTVT

SEQ ID NO: 125077 - protein, 26 aa, Mycobacterium avium
DGPDLTKLDLIPADGIMLLAAHISRH

SEQ ID NO: 125078 - protein, 17 aa, Mycobacterium avium
DGPIDLVLLPGPSIPID

SEQ ID NO: 125079 - protein, 18 aa, Mycobacterium avium
DGPRMPLLPGSWSAETED

SEQ ID NO: 125080 - protein, 20 aa, Mycobacterium avium
DGPRPQEWLLFLGADDALDQ

SEQ ID NO: 125081 - protein, 24 aa, Mycobacterium avium
DGQNYLPFGTAAGAGRYLAAHPGG

SEQ ID NO: 125082 - protein, 23 aa, Mycobacterium avium
DGRARWYRNRWVRTAHVCAALGE

SEQ ID NO: 125083 - protein, 23 aa, Mycobacterium avium
DGRIPVLLSSHDPELIRRDAAAI

SEQ ID NO: 125084 - protein, 18 aa, Mycobacterium avium
DGRIVITGRTKDLIIRKG

SEQ ID NO: 125085 - protein, 17 aa, Mycobacterium avium
DGRMLLHTILTYTQKQQ

SEQ ID NO: 125086 - protein, 38 aa, Mycobacterium avium
DGRPLFAANLALPWPEDPLAALWHATTLLREQRGDAHV

SEQ ID NO: 125087 - protein, 23 aa, Mycobacterium avium
DGRPTEHTWLPESIIRTGGTLAF

SEQ ID NO: 125088 - protein, 29 aa, Mycobacterium avium
DGRRIVYALPCYHMFGYIEGLLSAMFVGG

SEQ ID NO: 125089 - protein, 23 aa, Mycobacterium avium
DGRRRLAARRPATTRPLIERCDW

SEQ ID NO: 125090 - protein, 25 aa, Mycobacterium avium
DGRSHAWIEAWTGAWWSYDPTNDAE

SEQ ID NO: 125091 - protein, 23 aa, Mycobacterium avium
DGRTAWIPPPQWDRGARINDFHH

SEQ ID NO: 125092 - protein, 21 aa, Mycobacterium avium
DGRTAWIPPPQWDRGARTNDF

SEQ ID NO: 125093 - protein, 23 aa, Mycobacterium avium
DGRTAWIPPPQWDRGARTNEFHH

SEQ ID NO: 125094 - protein, 21 aa, Mycobacterium avium
DGRVLVVAQGPRPAGEKLLEL

SEQ ID NO: 125095 - protein, 23 aa, Mycobacterium avium
DGSGLLQWAGRALSPRIAQSPAD

SEQ ID NO: 125096 - protein, 19 aa, Mycobacterium avium
DGSLRLPYWMIYDDKEGAV

SEQ ID NO: 125097 - protein, 23 aa, Mycobacterium avium
DGSPLRELASWPALLRGKRSVTL

SEQ ID NO: 125098 - protein, 29 aa, Mycobacterium avium
DGSPYQVFTPFLRRWRDTGWRPPVKTGAA

SEQ ID NO: 125099 - protein, 21 aa, Mycobacterium avium
DGSYHFTFYERGQLGFDRVGN

SEQ ID NO: 125100 - protein, 21 aa, Mycobacterium avium
DGSYLAELLLSKGYEVHGLVR

SEQ ID NO: 125101 - protein, 24 aa, Mycobacterium avium
DGTCPVRLFLPDGSGPWPGVVMYP

SEQ ID NO: 125102 - protein, 25 aa, Mycobacterium avium
DGTHTWVRCGWRRSAAAMRTTRQVA

SEQ ID NO: 125103 - protein, 24 aa, Mycobacterium avium
DGTIKIEMNFLPDVYVPCEVCHGA

SEQ ID NO: 125104 - protein, 24 aa, Mycobacterium avium
DGTNALLLPGGFPEQFTAELSANE

SEQ ID NO: 125105 - protein, 24 aa, Mycobacterium avium
DGTPLYPGLPPAPPPGRPRDAGPP

SEQ ID NO: 125106 - protein, 25 aa, Mycobacterium avium
DGTTSFYFRTRSALLRAAAERLAEL

SEQ ID NO: 125107 - protein, 19 aa, Mycobacterium avium
DGVEVHLLPFPDLGEHEAG

SEQ ID NO: 125108 - protein, 27 aa, Mycobacterium avium
DGVIRTRGRLWLASRPSHAMWLESAGA

SEQ ID NO: 125109 - protein, 23 aa, Mycobacterium avium
DGVPSWAFRLLHVADTYNPIAPK

SEQ ID NO: 125110 - protein, 25 aa, Mycobacterium avium
DGVYEFQLVAPPLRFVGAVGSPVNP

SEQ ID NO: 125111 - protein, 27 aa, Mycobacterium avium
DGWSMPVFINEMMILYQAGGDLSALPV

SEQ ID NO: 125112 - protein, 19 aa, Mycobacterium avium
DGWVLDELRELAGILGVAR

SEQ ID NO: 125113 - protein, 22 aa, Mycobacterium avium
DGYVFLAAPLPREWPALAKAMS

SEQ ID NO: 125114 - protein, 17 aa, Mycobacterium avium
DGYWRKLPHEQSCFGAT

SEQ ID NO: 125115 - protein, 20 aa, Mycobacterium avium
DHAEAITLVVRFLHLQHRGA

SEQ ID NO: 125116 - protein, 27 aa, Mycobacterium avium
DHAMLATGLLALYQLSAEDSWLTAATD

SEQ ID NO: 125117 - protein, 35 aa, Mycobacterium avium
DHAWFIAETIGAGSFPWVLAITCPYRDAAERNAFL

SEQ ID NO: 125118 - protein, 17 aa, Mycobacterium avium
DHDLDVWSLTDLVAYST

SEQ ID NO: 125119 - protein, 20 aa, Mycobacterium avium
DHEIVVVPYAMSSAERRQEL

SEQ ID NO: 125120 - protein, 21 aa, Mycobacterium avium
DHESLRYARSAVVLGSAAAGL

SEQ ID NO: 125121 - protein, 20 aa, Mycobacterium avium
DHFAARGFAFYALDLHKCGR

SEQ ID NO: 125122 - protein, 24 aa, Mycobacterium avium
DHFAARGFAFYALDLHKCGRSRRD

SEQ ID NO: 125123 - protein, 17 aa, Mycobacterium avium
DHFTAMMIMALEDFGFC

SEQ ID NO: 125124 - protein, 31 aa, Mycobacterium avium
DHIALVAHPVLMPVFRLSGLTELTTVEAAPS

SEQ ID NO: 125125 - protein, 27 aa, Mycobacterium avium
DHIDTMVLYPSLGLCAPSLRDPEFAAG

SEQ ID NO: 125126 - protein, 21 aa, Mycobacterium avium
DHLYVVQLDLTLTGPLDRDRL

SEQ ID NO: 125127 - protein, 17 aa, Mycobacterium avium
DHMNQLRDRLLIVVAGY

SEQ ID NO: 125128 - protein, 23 aa, Mycobacterium avium
DHNWGRFRWGDDFGWTWGTILPA

SEQ ID NO: 125129 - protein, 18 aa, Mycobacterium avium
DHPDGGALLLGVLGASHV

SEQ ID NO: 125130 - protein, 28 aa, Mycobacterium avium
DHRETYDAMFDLWFPAALGARAVVTDED

SEQ ID NO: 125131 - protein, 28 aa, Mycobacterium avium
DHSTFFRERWPRLLRSLYPIGGVVFDGD

SEQ ID NO: 125132 - protein, 29 aa, Mycobacterium avium
DHSTFFRERWPRLLRSLYPIGGVVFDGDR

SEQ ID NO: 125133 - protein, 29 aa, Mycobacterium avium
DHSWGVRDWWSMDWIWSALHLDDGTHLHG

SEQ ID NO: 125134 - protein, 20 aa, Mycobacterium avium
DHTRLRRLVSKAFAPRVVAA

SEQ ID NO: 125135 - protein, 17 aa, Mycobacterium avium
DHVGGLCPNGCWGTFVT

SEQ ID NO: 125136 - protein, 17 aa, Mycobacterium avium
DHVMTYFFTDASGLRGF

SEQ ID NO: 125137 - protein, 22 aa, Mycobacterium avium
DIAAFLVAQLDDETFIRAAPAI

SEQ ID NO: 125138 - protein, 17 aa, Mycobacterium avium
DIAAVRDAVGGAVLKVI

SEQ ID NO: 125139 - protein, 24 aa, Mycobacterium avium
DIAFNWDHFFPLYGDPDGAHFECW

SEQ ID NO: 125140 - protein, 20 aa, Mycobacterium avium
DIAYLLFTSGTTGASKCCIL

SEQ ID NO: 125141 - protein, 18 aa, Mycobacterium avium
DIAYYLDKRQRGFDLCIY

SEQ ID NO: 125142 - protein, 17 aa, Mycobacterium avium
DICFIPSGNTRAFLGER

SEQ ID NO: 125143 - protein, 18 aa, Mycobacterium avium
DICFIPSGNTRAFLGERI

SEQ ID NO: 125144 - protein, 19 aa, Mycobacterium avium
DIDFFGLHIPKGSTMMVNL

SEQ ID NO: 125145 - protein, 19 aa, Mycobacterium avium
DIDIHWRTVTFALVTHSEG

SEQ ID NO: 125146 - protein, 24 aa, Mycobacterium avium
DIDLSHTVGWFTTKYPVALTVGAL

SEQ ID NO: 125147 - protein, 21 aa, Mycobacterium avium
DIDMTPHRGFYRVAAITPGHA

SEQ ID NO: 125148 - protein, 24 aa, Mycobacterium avium
DIDVAWVTPWSLLVEIPGLLAWRI

SEQ ID NO: 125149 - protein, 17 aa, Mycobacterium avium
DIEAALAGLPSWDGRTL

SEQ ID NO: 125150 - protein, 17 aa, Mycobacterium avium
DIEFSALVASPNGARRA

SEQ ID NO: 125151 - protein, 18 aa, Mycobacterium avium
DIEHMPLRPERLLDTEYL

SEQ ID NO: 125152 - protein, 18 aa, Mycobacterium avium
DIHFLPTLKEDMTEFWRG

SEQ ID NO: 125153 - protein, 19 aa, Mycobacterium avium
DILAFERQWWKFAGVKEDA

SEQ ID NO: 125154 - protein, 26 aa, Mycobacterium avium
DIPDRIHVVCIEHARGMPWEFECLVA

SEQ ID NO: 125155 - protein, 24 aa, Mycobacterium avium
DIRAWVGHYFDYMDHHGAFVLASA

SEQ ID NO: 125156 - protein, 18 aa, Mycobacterium avium
DIRFGLYGALAHPMEATG

SEQ ID NO: 125157 - protein, 18 aa, Mycobacterium avium
DIRVAAELALPHRRRRDP

SEQ ID NO: 125158 - protein, 24 aa, Mycobacterium avium
DISNAILFLVSDDARYITGVALPV

SEQ ID NO: 125159 - protein, 28 aa, Mycobacterium avium
DITAFADFPVLHWKKIWSTNPLERLNKE

SEQ ID NO: 125160 - protein, 23 aa, Mycobacterium avium
DITDVHIFPIEKWDALGDGSPDL

SEQ ID NO: 125161 - protein, 28 aa, Mycobacterium avium
DITMISPVDYMLYTPLLPDVAGGVVDAR

SEQ ID NO: 125162 - protein, 22 aa, Mycobacterium avium
DIVRRALALGVTLFDTAEIYGF

SEQ ID NO: 125163 - protein, 17 aa, Mycobacterium avium
DIVVDPPEDWSEANRFG

SEQ ID NO: 125164 - protein, 18 aa, Mycobacterium avium
DIWFFDSEYMRSSADATR

SEQ ID NO: 125165 - protein, 17 aa, Mycobacterium avium
DKAIWNMTADDFDLVMR

SEQ ID NO: 125166 - protein, 17 aa, Mycobacterium avium
DKAIWNMTVDDFDLVMR

SEQ ID NO: 125167 - protein, 19 aa, Mycobacterium avium
DKAPAPSPILTAGSDKPEC

SEQ ID NO: 125168 - protein, 19 aa, Mycobacterium avium
DKDDCAAIGLVKFDLLGLG

SEQ ID NO: 125169 - protein, 22 aa, Mycobacterium avium
DKEALQWIVGQLLDALDAGRFA

SEQ ID NO: 125170 - protein, 19 aa, Mycobacterium avium
DKGLWAPHLGPELGGQGFG

SEQ ID NO: 125171 - protein, 23 aa, Mycobacterium avium
DKHWNAFMNAVRPPWASELYATL

SEQ ID NO: 125172 - protein, 24 aa, Mycobacterium avium
DKHWNAFMNAVRPPWASELYATLE

SEQ ID NO: 125173 - protein, 25 aa, Mycobacterium avium
DKKENFTAYKLLIADVIGGELKAVP

SEQ ID NO: 125174 - protein, 26 aa, Mycobacterium avium
DKRLETVLPFSWQGVSLHAAGASRVR

SEQ ID NO: 125175 - protein, 25 aa, Mycobacterium avium
DKRNRPVLVFVLDAGMPGLTQGKPF

SEQ ID NO: 125176 - protein, 17 aa, Mycobacterium avium
DKSYPIWDVLHESMGFG

SEQ ID NO: 125177 - protein, 17 aa, Mycobacterium avium
DKTLPGPNQLGAFLFWM

SEQ ID NO: 125178 - protein, 21 aa, Mycobacterium avium
DKVLAGLRPFPVAVTTIDDGF

SEQ ID NO: 125179 - protein, 24 aa, Mycobacterium avium
DKVLAGLRPFPVAVTTIDGGFANG

SEQ ID NO: 125180 - protein, 29 aa, Mycobacterium avium
DKVVRFMLGLARRYGPGFYSAYQLGLVNG

SEQ ID NO: 125181 - protein, 30 aa, Mycobacterium avium
DKVVRFMLGLARRYGPGFYSAYQLGLVNGE

SEQ ID NO: 125182 - protein, 34 aa, Mycobacterium avium
DKVVRFMLGLARRYGPGFYSAYQLGLVNGELGIY

SEQ ID NO: 125183 - protein, 17 aa, Mycobacterium avium
DKVVVWYPAANRDPAVF

SEQ ID NO: 125184 - protein, 21 aa, Mycobacterium avium
DKWVHRPYLDGPRGDVKLYYA

SEQ ID NO: 125185 - protein, 31 aa, Mycobacterium avium
DLAAGLFQAAPWPSVAPLTLFGHSMGAVVAF

SEQ ID NO: 125186 - protein, 26 aa, Mycobacterium avium
DLAGLRRFHRHLGAGRLARRIECSPL

SEQ ID NO: 125187 - protein, 21 aa, Mycobacterium avium
DLAKALLAYFTGHLGISTTMR

SEQ ID NO: 125188 - protein, 26 aa, Mycobacterium avium
DLALSCALWVGMGRVLRTLDIGQACK

SEQ ID NO: 125189 - protein, 18 aa, Mycobacterium avium
DLAPLLRAHLPADDVLAC

SEQ ID NO: 125190 - protein, 21 aa, Mycobacterium avium
DLARRFFRAAAAPIRQAWQLS

SEQ ID NO: 125191 - protein, 18 aa, Mycobacterium avium
DLAVLWSRGSAGDYVVFV

SEQ ID NO: 125192 - protein, 20 aa, Mycobacterium avium
DLCCKVLLEIGPQPVLTAAA

SEQ ID NO: 125193 - protein, 18 aa, Mycobacterium avium
DLDAAIEKLLAHKLRRRT

SEQ ID NO: 125194 - protein, 36 aa, Mycobacterium avium
DLDAWTTNHWDWFDPFWAHRLLWPDRDYRPGLDILI

SEQ ID NO: 125195 - protein, 37 aa, Mycobacterium avium
DLDAWTTNHWDWFDPFWAHRLLWPDRDYRPGLDILIA

SEQ ID NO: 125196 - protein, 36 aa, Mycobacterium avium
DLDAWTTNHWDWFDPFWAHRLLWPDREYRPDLDILI

SEQ ID NO: 125197 - protein, 17 aa, Mycobacterium avium
DLDKSYPIWDVLHESMG

SEQ ID NO: 125198 - protein, 23 aa, Mycobacterium avium
DLDLLVGPAQIVQLPVRAPAHQV

SEQ ID NO: 125199 - protein, 17 aa, Mycobacterium avium
DLDPLILDALKAQPREL

SEQ ID NO: 125200 - protein, 18 aa, Mycobacterium avium
DLDRLYCEVAAAGAGLDI

SEQ ID NO: 125201 - protein, 31 aa, Mycobacterium avium
DLEHGPAIRFLLIELPGAQWRLVLTAHHIVI

SEQ ID NO: 125202 - protein, 19 aa, Mycobacterium avium
DLEILNHGLTLWDLDRVFK

SEQ ID NO: 125203 - protein, 24 aa, Mycobacterium avium
DLELILTGVVFGFLTRFAQGEIEV

SEQ ID NO: 125204 - protein, 24 aa, Mycobacterium avium
DLELRIPKLRSGSFFPALLERRRR

SEQ ID NO: 125205 - protein, 25 aa, Mycobacterium avium
DLELRIPKLRTGSCFPALLERRRRV

SEQ ID NO: 125206 - protein, 25 aa, Mycobacterium avium
DLEYHLTTLFPPVRPRQWLEIRYLD

SEQ ID NO: 125207 - protein, 30 aa, Mycobacterium avium
DLFDEWDLPVPALFGQMRLPSAASTLLARL

SEQ ID NO: 125208 - protein, 19 aa, Mycobacterium avium
DLFVPLEQPIQQGATQILR

SEQ ID NO: 125209 - protein, 21 aa, Mycobacterium avium
DLGEGFGVWRLGDDDAMLGIV

SEQ ID NO: 125210 - protein, 36 aa, Mycobacterium avium
DLGFRLAPPAWLDPGQWWALVRIGCAGELLYSPAVR

SEQ ID NO: 125211 - protein, 18 aa, Mycobacterium avium
DLGLHLLERCYGPRIAHA

SEQ ID NO: 125212 - protein, 24 aa, Mycobacterium avium
DLGLLRGRPPRRVRRCPVRRARRP

SEQ ID NO: 125213 - protein, 20 aa, Mycobacterium avium
DLGVLLAEVGWSVAPVPVYA

SEQ ID NO: 125214 - protein, 23 aa, Mycobacterium avium
DLGVRRTLTGEPLPPRYAATAAA

SEQ ID NO: 125215 - protein, 27 aa, Mycobacterium avium
DLHKANPLLLLDFLRHSGDAPIVLLHC

SEQ ID NO: 125216 - protein, 19 aa, Mycobacterium avium
DLINVRYLSGFTGSNGALL

SEQ ID NO: 125217 - protein, 17 aa, Mycobacterium avium
DLKKAGLPIPPPSKKEQ

SEQ ID NO: 125218 - protein, 18 aa, Mycobacterium avium
DLKPGMTLLDIGCGWGTT

SEQ ID NO: 125219 - protein, 17 aa, Mycobacterium avium
DLLALTLITPPGEIGAD

SEQ ID NO: 125220 - protein, 19 aa, Mycobacterium avium
DLLARMRGGIDKKRRAELI

SEQ ID NO: 125221 - protein, 26 aa, Mycobacterium avium
DLLDAAAHRFADLGALAFAADAAAQA

SEQ ID NO: 125222 - protein, 20 aa, Mycobacterium avium
DLLGDLAVKPVIPLPVNCAT

SEQ ID NO: 125223 - protein, 17 aa, Mycobacterium avium
DLLHGRHTAAEAVPGGT

SEQ ID NO: 125224 - protein, 20 aa, Mycobacterium avium
DLLKVMLREPDELGDLDEKT

SEQ ID NO: 125225 - protein, 25 aa, Mycobacterium avium
DLLLVPAVLDLPDAPGARLVSNIVD

SEQ ID NO: 125226 - protein, 25 aa, Mycobacterium avium
DLLSAPAIKLLIRRAGARSSDIAAE

SEQ ID NO: 125227 - protein, 25 aa, Mycobacterium avium
DLLSAPAIKLLIRRAGARSSDMAAE

SEQ ID NO: 125228 - protein, 19 aa, Mycobacterium avium
DLLVHLRFASKRQWDCTAA

SEQ ID NO: 125229 - protein, 20 aa, Mycobacterium avium
DLLVRFETAVRWARAHPQQW

SEQ ID NO: 125230 - protein, 17 aa, Mycobacterium avium
DLMMSIDFRMTSTTLVS

SEQ ID NO: 125231 - protein, 22 aa, Mycobacterium avium
DLNMNPYPVFARIREEAPLYYN

SEQ ID NO: 125232 - protein, 20 aa, Mycobacterium avium
DLNWHRRRYNPWSAYGESKL

SEQ ID NO: 125233 - protein, 22 aa, Mycobacterium avium
DLPDALARFEELHRPAPRLHNT

SEQ ID NO: 125234 - protein, 32 aa, Mycobacterium avium
DLPDYLREATAWLQLATAALIQLRAPVVTAVQ

SEQ ID NO: 125235 - protein, 30 aa, Mycobacterium avium
DLPTYAFARERFWLGGASLAGAPAGAAPVG

SEQ ID NO: 125236 - protein, 18 aa, Mycobacterium avium
DLQLYSGGRFRLGLGSQI

SEQ ID NO: 125237 - protein, 17 aa, Mycobacterium avium
DLQWADRDTLLLLAELL

SEQ ID NO: 125238 - protein, 18 aa, Mycobacterium avium
DLRLDFFVSTSSIASVWG

SEQ ID NO: 125239 - protein, 17 aa, Mycobacterium avium
DLRLLCHRSLPARRPSM

SEQ ID NO: 125240 - protein, 20 aa, Mycobacterium avium
DLRPGWSMPSAEQFTFGYAD

SEQ ID NO: 125241 - protein, 25 aa, Mycobacterium avium
DLRRMAWRLHVFGPVHGIPGVRGPG

SEQ ID NO: 125242 - protein, 21 aa, Mycobacterium avium
DLRTGRVRFLDALELEAIVWL

SEQ ID NO: 125243 - protein, 17 aa, Mycobacterium avium
DLRWHDLRHSGAVLAAA

SEQ ID NO: 125244 - protein, 25 aa, Mycobacterium avium
DLSALIGVPIRPAIGLLAVAALDDL

SEQ ID NO: 125245 - protein, 27 aa, Mycobacterium avium
DLSHIAWYTVLACFKLGIVIEGTLARA

SEQ ID NO: 125246 - protein, 17 aa, Mycobacterium avium
DLSHWEKAFAGFDGVWD

SEQ ID NO: 125247 - protein, 24 aa, Mycobacterium avium
DLSRTVGWFTAKYPVALRLGGLSW

SEQ ID NO: 125248 - protein, 17 aa, Mycobacterium avium
DLTLLPIGAYNTAWPDV

SEQ ID NO: 125249 - protein, 25 aa, Mycobacterium avium
DLTRRLLNSGLALPTLLVAATVATV

SEQ ID NO: 125250 - protein, 26 aa, Mycobacterium avium
DLTVAIIHALNQWMLEHWGFSHANRV

SEQ ID NO: 125251 - protein, 42 aa, Mycobacterium avium
DLTVAIIHALNQWMLEHWGFTYANRIYSTPVLNLGLVDEARR

SEQ ID NO: 125252 - protein, 21 aa, Mycobacterium avium
DLVASLLLVHGLHPHDVGRRV

SEQ ID NO: 125253 - protein, 33 aa, Mycobacterium avium
DLVDRVQFWMLPLDDPLPWLLADRRSVRVTAVH

SEQ ID NO: 125254 - protein, 19 aa, Mycobacterium avium
DLVLSLQPDRLITGHFDPI

SEQ ID NO: 125255 - protein, 22 aa, Mycobacterium avium
DLVLVPAVLDLADAPGARLVSN

SEQ ID NO: 125256 - protein, 25 aa, Mycobacterium avium
DLVSLTQILAWDLPLTKKVSDHVAR

SEQ ID NO: 125257 - protein, 26 aa, Mycobacterium avium
DLVSLTQILAWDLPLTKKVSDHVARH

SEQ ID NO: 125258 - protein, 21 aa, Mycobacterium avium
DLVTPWRTGLLLAVDEFETKL

SEQ ID NO: 125259 - protein, 18 aa, Mycobacterium avium
DLVYGLGTLITGLPGVLS

SEQ ID NO: 125260 - protein, 20 aa, Mycobacterium avium
DLWAKLIDAGILSSASATSL

SEQ ID NO: 125261 - protein, 18 aa, Mycobacterium avium
DLWQSRLPKRLADLTPRA

SEQ ID NO: 125262 - protein, 20 aa, Mycobacterium avium
DLWTKLIDAGILSSASATSL

SEQ ID NO: 125263 - protein, 20 aa, Mycobacterium avium
DMALIPMRTIPNAELHIFPN

SEQ ID NO: 125264 - protein, 22 aa, Mycobacterium avium
DMALIPMRTIPNAELHIFPNSG

SEQ ID NO: 125265 - protein, 29 aa, Mycobacterium avium
DMAQLYDGFSFLTVMWLEAMGFCEHGKVG

SEQ ID NO: 125266 - protein, 18 aa, Mycobacterium avium
DMDAAESIARFQQAALAM

SEQ ID NO: 125267 - protein, 17 aa, Mycobacterium avium
DMFVVRTAGQAIDTAVL

SEQ ID NO: 125268 - protein, 17 aa, Mycobacterium avium
DMHMAIASALNMYDNVL

SEQ ID NO: 125269 - protein, 17 aa, Mycobacterium avium
DMIAIEAGAPLDLDLQV

SEQ ID NO: 125270 - protein, 20 aa, Mycobacterium avium
DMIMTAMMLLRKGGTCVLTG

SEQ ID NO: 125271 - protein, 25 aa, Mycobacterium avium
DMITSLICHGTLTRFPKLRIASVEN

SEQ ID NO: 125272 - protein, 25 aa, Mycobacterium avium
DMLTSLICHGTLTRFPKLRIASVEN

SEQ ID NO: 125273 - protein, 20 aa, Mycobacterium avium
DMRVQRWLDAMPQYGPGHAE

SEQ ID NO: 125274 - protein, 19 aa, Mycobacterium avium
DMTEGMLELLLRELDVHPG

SEQ ID NO: 125275 - protein, 22 aa, Mycobacterium avium
DMVSIYDCYTITVLLSLEDAGF

SEQ ID NO: 125276 - protein, 21 aa, Mycobacterium avium
DNACRFLLQRGAGEDVTALGW

SEQ ID NO: 125277 - protein, 23 aa, Mycobacterium avium
DNAFARVFGGPIVPQEVEALLCR

SEQ ID NO: 125278 - protein, 25 aa, Mycobacterium avium
DNALLYGLGPRFAAAAAARGIPRPP

SEQ ID NO: 125279 - protein, 21 aa, Mycobacterium avium
DNARRFMGLPIANPDPDAVKP

SEQ ID NO: 125280 - protein, 31 aa, Mycobacterium avium
DNDHTPISVLQPYGGYILPNSTINDLNIFIS

SEQ ID NO: 125281 - protein, 19 aa, Mycobacterium avium
DNEVIVEDWLIQPIAADTV

SEQ ID NO: 125282 - protein, 17 aa, Mycobacterium avium
DNGFDKWFGTVAATGFD

SEQ ID NO: 125283 - protein, 23 aa, Mycobacterium avium
DNGGGIFELLEQGDPRFSDVSSR

SEQ ID NO: 125284 - protein, 17 aa, Mycobacterium avium
DNHVVICEGTFMPQVLA

SEQ ID NO: 125285 - protein, 20 aa, Mycobacterium avium
DNLAALLVDRGVGPGTLVGL

SEQ ID NO: 125286 - protein, 27 aa, Mycobacterium avium
DNLGRPTSFIWYGPRWAQAATAPSRLH

SEQ ID NO: 125287 - protein, 25 aa, Mycobacterium avium
DNLNWWLGEWSWVFDKYSTMFVQWT

SEQ ID NO: 125288 - protein, 23 aa, Mycobacterium avium
DNLNWWLGEWSWVFEKYSTMFVQ

SEQ ID NO: 125289 - protein, 26 aa, Mycobacterium avium
DNNGTLPAFPLPLGDGPVPCDMLSVQ

SEQ ID NO: 125290 - protein, 17 aa, Mycobacterium avium
DNPTVVRVLGAIEIPVV

SEQ ID NO: 125291 - protein, 19 aa, Mycobacterium avium
DNPVLGNPALRRAAVRLDA

SEQ ID NO: 125292 - protein, 26 aa, Mycobacterium avium
DNQLLDPQFPMLLRRNDYTVEAVYHL

SEQ ID NO: 125293 - protein, 27 aa, Mycobacterium avium
DNRGSQFYLALYWAQELAAQHDDEELR

SEQ ID NO: 125294 - protein, 26 aa, Mycobacterium avium
DNRGSQFYLALYWAQELAAQNDDDEL

SEQ ID NO: 125295 - protein, 18 aa, Mycobacterium avium
DNTPWPRKLQQPRRAAVS

SEQ ID NO: 125296 - protein, 17 aa, Mycobacterium avium
DNVPALLVGLEGPDHRF

SEQ ID NO: 125297 - protein, 17 aa, Mycobacterium avium
DNWSVDTPALTVSLRGL

SEQ ID NO: 125298 - protein, 23 aa, Mycobacterium avium
DNWSVDTPALTVSLRGLVDCVVE

SEQ ID NO: 125299 - protein, 21 aa, Mycobacterium avium
DPAATCDLLVSAGATWYGGPD

SEQ ID NO: 125300 - protein, 19 aa, Mycobacterium avium
DPAAWSALVEFGLPGLAVD

SEQ ID NO: 125301 - protein, 24 aa, Mycobacterium avium
DPADVAALVAFLLSAEGDWINGQV

SEQ ID NO: 125302 - protein, 20 aa, Mycobacterium avium
DPAHPLSLAEAAKMAGLTPP

SEQ ID NO: 125303 - protein, 22 aa, Mycobacterium avium
DPALLRYFHELAADHLEVIAGD

SEQ ID NO: 125304 - protein, 28 aa, Mycobacterium avium
DPATLADLAFAWRVCRAVKSNAIVIAAG

SEQ ID NO: 125305 - protein, 27 aa, Mycobacterium avium
DPATLADLVFAWRVCRAVKSNAIVIAA

SEQ ID NO: 125306 - protein, 21 aa, Mycobacterium avium
DPDAFAAYRIPGERACLGYAE

SEQ ID NO: 125307 - protein, 25 aa, Mycobacterium avium
DPDGRDLILSCGAALHHCVVGFAAV

SEQ ID NO: 125308 - protein, 20 aa, Mycobacterium avium
DPDLFPIDDSGYSILEAHEV

SEQ ID NO: 125309 - protein, 21 aa, Mycobacterium avium
DPDLLLRRMAAAPFDPHSVPV

SEQ ID NO: 125310 - protein, 23 aa, Mycobacterium avium
DPDLPWPGRLPEPSPSVLLDDPV

SEQ ID NO: 125311 - protein, 26 aa, Mycobacterium avium
DPDRKKLFRGLFRGTGKYYAGVKWAW

SEQ ID NO: 125312 - protein, 18 aa, Mycobacterium avium
DPDRLVLRKYDPVIRRHV

SEQ ID NO: 125313 - protein, 23 aa, Mycobacterium avium
DPDSTLSFFRRALELRRRRVEFD

SEQ ID NO: 125314 - protein, 24 aa, Mycobacterium avium
DPDYNDRFFRKFMGRVGAGAAIGG

SEQ ID NO: 125315 - protein, 17 aa, Mycobacterium avium
DPEHRIYRSLLNPYLSP

SEQ ID NO: 125316 - protein, 35 aa, Mycobacterium avium
DPELSLYALRDSVGTPFLLLAGLEPDLKWERFITA

SEQ ID NO: 125317 - protein, 27 aa, Mycobacterium avium
DPERKKLFRGLFRGTGKYYSGVKWTWY

SEQ ID NO: 125318 - protein, 22 aa, Mycobacterium avium
DPERVVLLRRLVACRGTVRVRV

SEQ ID NO: 125319 - protein, 32 aa, Mycobacterium avium
DPGAPKFMPQPYGGYILPGSTLDDLKLLGSQW

SEQ ID NO: 125320 - protein, 25 aa, Mycobacterium avium
DPGAPKFMPQPYGGYIMPGSTLDDM

SEQ ID NO: 125321 - protein, 18 aa, Mycobacterium avium
DPGFRLVTACVQAGLPVG

SEQ ID NO: 125322 - protein, 17 aa, Mycobacterium avium
DPGQALVLDIAPPDTRY

SEQ ID NO: 125323 - protein, 29 aa, Mycobacterium avium
DPGSAVQAPWPLLRTFAAGPALSREAALL

SEQ ID NO: 125324 - protein, 19 aa, Mycobacterium avium
DPHIKRYVARYDALLRFTP

SEQ ID NO: 125325 - protein, 22 aa, Mycobacterium avium
DPHPMRFYNALGAIRAVLQDNR

SEQ ID NO: 125326 - protein, 23 aa, Mycobacterium avium
DPIGGAPEPAANGLLCDTHMVVS

SEQ ID NO: 125327 - protein, 17 aa, Mycobacterium avium
DPISVMRSLYDWAGDEL

SEQ ID NO: 125328 - protein, 23 aa, Mycobacterium avium
DPKDPSLGSPVVAWLASPEAGHV

SEQ ID NO: 125329 - protein, 25 aa, Mycobacterium avium
DPKWREAGIFPILSEGALRATLGIL

SEQ ID NO: 125330 - protein, 31 aa, Mycobacterium avium
DPLAAQWLIRVFLALWGWPLKDPAAERALVH

SEQ ID NO: 125331 - protein, 19 aa, Mycobacterium avium
DPLCYVDPYLPIESFKRRD

SEQ ID NO: 125332 - protein, 17 aa, Mycobacterium avium
DPLIPASVRFSAEDSLP

SEQ ID NO: 125333 - protein, 22 aa, Mycobacterium avium
DPLQALWLMNSDTALTALNAEF

SEQ ID NO: 125334 - protein, 25 aa, Mycobacterium avium
DPLRAGMRLGLIPTVVPYVLPTVLA

SEQ ID NO: 125335 - protein, 20 aa, Mycobacterium avium
DPMMPYPQRAPVLVGIDGSP

SEQ ID NO: 125336 - protein, 20 aa, Mycobacterium avium
DPNAFDIRRPRQAHIAFAGG

SEQ ID NO: 125337 - protein, 23 aa, Mycobacterium avium
DPNFVRMFLEAESRGWSVVSPHH

SEQ ID NO: 125338 - protein, 23 aa, Mycobacterium avium
DPPGGWPEPLRTKALQGRGPGQA

SEQ ID NO: 125339 - protein, 22 aa, Mycobacterium avium
DPQAARIWLLQALTGRRASEIL

SEQ ID NO: 125340 - protein, 26 aa, Mycobacterium avium
DPQDLLLPHWAGVVPLQLSAGPPVPA

SEQ ID NO: 125341 - protein, 19 aa, Mycobacterium avium
DPQQRIMLEICWEALERAG

SEQ ID NO: 125342 - protein, 22 aa, Mycobacterium avium
DPQQRVSLRVAWRALENSGINP

SEQ ID NO: 125343 - protein, 17 aa, Mycobacterium avium
DPRGLTLTGGLPYFGGP

SEQ ID NO: 125344 - protein, 24 aa, Mycobacterium avium
DPRRAVLVRPPRGLAAAELARLLR

SEQ ID NO: 125345 - protein, 22 aa, Mycobacterium avium
DPRVRARWERRLAEVGVGELHA

SEQ ID NO: 125346 - protein, 17 aa, Mycobacterium avium
DPRWRAHHDRMSELGFE

SEQ ID NO: 125347 - protein, 33 aa, Mycobacterium avium
DPSETISWSDALTLPMCLLNQGMRGRRLIDDAL

SEQ ID NO: 125348 - protein, 23 aa, Mycobacterium avium
DPSLLRDAVIRRIYRRTSAEGTI

SEQ ID NO: 125349 - protein, 17 aa, Mycobacterium avium
DPSMRAHFFALASFTRA

SEQ ID NO: 125350 - protein, 25 aa, Mycobacterium avium
DPTEVRWWEVWLLNRDRREQARFSD

SEQ ID NO: 125351 - protein, 24 aa, Mycobacterium avium
DPVIRNKVMRLWAQERVRGWTNER

SEQ ID NO: 125352 - protein, 19 aa, Mycobacterium avium
DPVSFTLTVDGGSYQLYCP

SEQ ID NO: 125353 - protein, 33 aa, Mycobacterium avium
DPVWCPLPGTKIDGLYIAFLRSPDGVVFEFVER

SEQ ID NO: 125354 - protein, 17 aa, Mycobacterium avium
DPWAARIAATGKPTFSK

SEQ ID NO: 125355 - protein, 19 aa, Mycobacterium avium
DPWHGAWFHPYSFTRLEVL

SEQ ID NO: 125356 - protein, 22 aa, Mycobacterium avium
DPWKINATLQSGRPAQISNLAK

SEQ ID NO: 125357 - protein, 20 aa, Mycobacterium avium
DPYHRVYGYPTLYVVDGAAI

SEQ ID NO: 125358 - protein, 17 aa, Mycobacterium avium
DPYLWLEDITGEQALDW

SEQ ID NO: 125359 - protein, 17 aa, Mycobacterium avium
DPYLWLEDMTGEQALDW

SEQ ID NO: 125360 - protein, 33 aa, Mycobacterium avium
DQAGALLPTLLRYQVPLWPERLLTRDGGAEIER

SEQ ID NO: 125361 - protein, 25 aa, Mycobacterium avium
DQDEYLRWAVGAFRLATSGVADSTQ

SEQ ID NO: 125362 - protein, 23 aa, Mycobacterium avium
DQFEQVPELLWPNSVRTYTRMWR

SEQ ID NO: 125363 - protein, 27 aa, Mycobacterium avium
DQFSGKPLVLNIIPSIDTPVCATSVRT

SEQ ID NO: 125364 - protein, 24 aa, Mycobacterium avium
DQGDVVTILAYTGLRWSELVGLRV

SEQ ID NO: 125365 - protein, 17 aa, Mycobacterium avium
DQGLGDMFVVRTAGQAI

SEQ ID NO: 125366 - protein, 36 aa, Mycobacterium avium
DQIAKLPPDQQLRLLRNAFAHPAPPAPAPAPAAPRP

SEQ ID NO: 125367 - protein, 18 aa, Mycobacterium avium
DQIARSEFWLDAATFTLT

SEQ ID NO: 125368 - protein, 25 aa, Mycobacterium avium
DQIDGPLPPRLRVLAVVLAAEQTVV

SEQ ID NO: 125369 - protein, 24 aa, Mycobacterium avium
DQIKDLLGREILDQRFAGMKQALQ

SEQ ID NO: 125370 - protein, 18 aa, Mycobacterium avium
DQLDLRRMAWRLHVFGPV

SEQ ID NO: 125371 - protein, 28 aa, Mycobacterium avium
DQLDLRRMAWRLHVFGPVDGIPGVRGPG

SEQ ID NO: 125372 - protein, 26 aa, Mycobacterium avium
DQLEASPAAGFDFERSWRAVGPDDVL

SEQ ID NO: 125373 - protein, 17 aa, Mycobacterium avium
DQLFRPLVAGQRWIAAG

SEQ ID NO: 125374 - protein, 33 aa, Mycobacterium avium
DQLRRRGARRLVIAPWFLAPGFITDGVSTFARD

SEQ ID NO: 125375 - protein, 34 aa, Mycobacterium avium
DQLRRRGARRLVIAPWFLAPGFITDGVSTFARDN

SEQ ID NO: 125376 - protein, 26 aa, Mycobacterium avium
DQMFGYPREELIGREVEILIPPRHRG

SEQ ID NO: 125377 - protein, 19 aa, Mycobacterium avium
DQNWIENDFIPTVAKRGAA

SEQ ID NO: 125378 - protein, 27 aa, Mycobacterium avium
DQTVAVVDYLIPGLAEAIRRSGLPKVP

SEQ ID NO: 125379 - protein, 20 aa, Mycobacterium avium
DQTYSTLFMRTYGWGSQVQN

SEQ ID NO: 125380 - protein, 30 aa, Mycobacterium avium
DQWNPFHNMVVIYALFPNIVLSVTIANGEL

SEQ ID NO: 125381 - protein, 23 aa, Mycobacterium avium
DQWQRLCRALGSPSWAMDPELSA

SEQ ID NO: 125382 - protein, 18 aa, Mycobacterium avium
DRACAPWGLLAEDKQAAL

SEQ ID NO: 125383 - protein, 18 aa, Mycobacterium avium
DRACAPWGLLAEDKQATL

SEQ ID NO: 125384 - protein, 23 aa, Mycobacterium avium
DRADWMFALVRTGSGGKPSDGIT

SEQ ID NO: 125385 - protein, 18 aa, Mycobacterium avium
DRAGFKIIASGLRDCITR

SEQ ID NO: 125386 - protein, 20 aa, Mycobacterium avium
DRALFPDFPAFLQATAAPEA

SEQ ID NO: 125387 - protein, 25 aa, Mycobacterium avium
DRATGLPWMTDLVEQFGLRPPPAEQ

SEQ ID NO: 125388 - protein, 24 aa, Mycobacterium avium
DRDEVVLPFAWQGVSLHAAGASAV

SEQ ID NO: 125389 - protein, 21 aa, Mycobacterium avium
DRDIAMVFQSYALYPHMTVRQ

SEQ ID NO: 125390 - protein, 20 aa, Mycobacterium avium
DREAAFAHFGRRFDDLATEV

SEQ ID NO: 125391 - protein, 29 aa, Mycobacterium avium
DREPDWVNTIFLSTRFKAWRVGGYNEYLY

SEQ ID NO: 125392 - protein, 24 aa, Mycobacterium avium
DRERKMGFNLAFGYGIHSCLGAAL

SEQ ID NO: 125393 - protein, 18 aa, Mycobacterium avium
DREYQRMRDLGIAILREV

SEQ ID NO: 125394 - protein, 17 aa, Mycobacterium avium
DRFDLRALAACFCDEGV

SEQ ID NO: 125395 - protein, 18 aa, Mycobacterium avium
DRFGFTAHMDFYEPAELQ

SEQ ID NO: 125396 - protein, 21 aa, Mycobacterium avium
DRFIEAFAALIRQTIDIPSVI

SEQ ID NO: 125397 - protein, 19 aa, Mycobacterium avium
DRFLQNLTHHSWQDHGQAV

SEQ ID NO: 125398 - protein, 21 aa, Mycobacterium avium
DRFLVAVTFRIGRLGVPVVAE

SEQ ID NO: 125399 - protein, 20 aa, Mycobacterium avium
DRFLVAVTFRMGRLGVPVVA

SEQ ID NO: 125400 - protein, 30 aa, Mycobacterium avium
DRFQTASLRVNFLRPFFAGGTSSYVATPVR

SEQ ID NO: 125401 - protein, 21 aa, Mycobacterium avium
DRGAWWPCKWCGGRADCYRVS

SEQ ID NO: 125402 - protein, 29 aa, Mycobacterium avium
DRGFFDDLVTPFLGLYRDDNLRPDSSPEK

SEQ ID NO: 125403 - protein, 18 aa, Mycobacterium avium
DRGYYFEPTVLDLPSNAN

SEQ ID NO: 125404 - protein, 24 aa, Mycobacterium avium
DRHEHLWLHFARHGPDITPPIITR

SEQ ID NO: 125405 - protein, 20 aa, Mycobacterium avium
DRHLGVLAYSRLAQADPALV

SEQ ID NO: 125406 - protein, 17 aa, Mycobacterium avium
DRHRDFEVLAYPSVLRT

SEQ ID NO: 125407 - protein, 25 aa, Mycobacterium avium
DRHTQPLIRLPLSTEELALRLIPSV

SEQ ID NO: 125408 - protein, 22 aa, Mycobacterium avium
DRIDPRFPVFSATALTEALPGP

SEQ ID NO: 125409 - protein, 18 aa, Mycobacterium avium
DRLALLREGVRVFGFHLC

SEQ ID NO: 125410 - protein, 30 aa, Mycobacterium avium
DRLDPERGVLLGAVWLRPADGDGVLLLTAH

SEQ ID NO: 125411 - protein, 31 aa, Mycobacterium avium
DRLGLDYLDLYLIHWPAPTLGKYVESFEGMI

SEQ ID NO: 125412 - protein, 22 aa, Mycobacterium avium
DRLKIVMRVYFEKPRTTIGWKG

SEQ ID NO: 125413 - protein, 22 aa, Mycobacterium avium
DRLLKIATDRGLTPQPAALGAF

SEQ ID NO: 125414 - protein, 20 aa, Mycobacterium avium
DRLMRPVVVVKLDSAKVADV

SEQ ID NO: 125415 - protein, 21 aa, Mycobacterium avium
DRLRRTSIDPQWLLDYWSDRV

SEQ ID NO: 125416 - protein, 21 aa, Mycobacterium avium
DRPHLDGLTPGGAFVAAERGA

SEQ ID NO: 125417 - protein, 22 aa, Mycobacterium avium
DRPLRTPKHFRRARGRKVDVVL

SEQ ID NO: 125418 - protein, 18 aa, Mycobacterium avium
DRRAARAALGLPLDKDIV

SEQ ID NO: 125419 - protein, 28 aa, Mycobacterium avium
DRRAGLARLLHQPLAADLQLPQVRVQEQ

SEQ ID NO: 125420 - protein, 17 aa, Mycobacterium avium
DRRHGELLAQRKYTYKQ

SEQ ID NO: 125421 - protein, 23 aa, Mycobacterium avium
DRRLVRTLQFDPVVVRLLAEHEP

SEQ ID NO: 125422 - protein, 21 aa, Mycobacterium avium
DRRRRGALQPDPLLGGHPDRH

SEQ ID NO: 125423 - protein, 21 aa, Mycobacterium avium
DRRYQYVPTYILRGLTELHLE

SEQ ID NO: 125424 - protein, 24 aa, Mycobacterium avium
DRTKWQRIIEINLFSALAATQAAI

SEQ ID NO: 125425 - protein, 20 aa, Mycobacterium avium
DRTQAFWDQAMRLRDLLKFD

SEQ ID NO: 125426 - protein, 17 aa, Mycobacterium avium
DRVALYAYYSQGRRAVS

SEQ ID NO: 125427 - protein, 24 aa, Mycobacterium avium
DRVRFLERVLTVDRQLVTVAGQAP

SEQ ID NO: 125428 - protein, 24 aa, Mycobacterium avium
DRVVALPELLRDAGYLTLMSGKWH

SEQ ID NO: 125429 - protein, 17 aa, Mycobacterium avium
DRVWAWTLPDGGYGWSN

SEQ ID NO: 125430 - protein, 18 aa, Mycobacterium avium
DRWHRELDPPTGVRRRVR

SEQ ID NO: 125431 - protein, 19 aa, Mycobacterium avium
DRWIAVVAEGGLIGGANAE

SEQ ID NO: 125432 - protein, 17 aa, Mycobacterium avium
DRYGDYPLFMPQSTEQS

SEQ ID NO: 125433 - protein, 40 aa, Mycobacterium avium
DSAFAQHHWGGLLAPPALLMGWLIAPPWQPDGRPSASLIA

SEQ ID NO: 125434 - protein, 27 aa, Mycobacterium avium
DSAICHIATILLTRIATCWRAGAHYVL

SEQ ID NO: 125435 - protein, 25 aa, Mycobacterium avium
DSARYIAVALGMLDIPGLAVNRQCA

SEQ ID NO: 125436 - protein, 19 aa, Mycobacterium avium
DSAYAWAYNVDKGQKARII

SEQ ID NO: 125437 - protein, 28 aa, Mycobacterium avium
DSDVTAWPATLDRLLALGGPGARYVPGH

SEQ ID NO: 125438 - protein, 25 aa, Mycobacterium avium
DSEQPIFVGWALGIDELAWANAMYG

SEQ ID NO: 125439 - protein, 25 aa, Mycobacterium avium
DSEQPIFVGWALGIDELSWANAMYG

SEQ ID NO: 125440 - protein, 20 aa, Mycobacterium avium
DSFRRLLRRATDPDPRRRFS

SEQ ID NO: 125441 - protein, 31 aa, Mycobacterium avium
DSGDRHKLWARSGYLHPHWPKPYGRGADSVE

SEQ ID NO: 125442 - protein, 30 aa, Mycobacterium avium
DSGSTWLLARLVGLARARRMLLLGEKVGGR

SEQ ID NO: 125443 - protein, 24 aa, Mycobacterium avium
DSHGRFMRIRVFDCWMHEQDIRVA

SEQ ID NO: 125444 - protein, 29 aa, Mycobacterium avium
DSKTLRPADRWWRLIADHGWRPTHMIQDG

SEQ ID NO: 125445 - protein, 17 aa, Mycobacterium avium
DSKTVFMVLRDPAADMS

SEQ ID NO: 125446 - protein, 17 aa, Mycobacterium avium
DSLFNEVFLDNVFVPDE

SEQ ID NO: 125447 - protein, 37 aa, Mycobacterium avium
DSMSPINLAMTEFKMFYKLPVEGLDIPKSALGAGLGL

SEQ ID NO: 125448 - protein, 18 aa, Mycobacterium avium
DSPVRVLLKVTGVPAGEA

SEQ ID NO: 125449 - protein, 20 aa, Mycobacterium avium
DSRAWRLPFEDGTTVYELDQ

SEQ ID NO: 125450 - protein, 23 aa, Mycobacterium avium
DSRESLFWVSDYGVRFGIANDES

SEQ ID NO: 125451 - protein, 28 aa, Mycobacterium avium
DSSLSRRGFLWWAVVEGLVNAGAPVLEV

SEQ ID NO: 125452 - protein, 17 aa, Mycobacterium avium
DSSPPIRTTPVVPVAVI

SEQ ID NO: 125453 - protein, 23 aa, Mycobacterium avium
DSSPVRYIIFTQGHVDHVGGLDS

SEQ ID NO: 125454 - protein, 28 aa, Mycobacterium avium
DSSYQRGAPVDFPLGGVVPGFQKAIAGQ

SEQ ID NO: 125455 - protein, 25 aa, Mycobacterium avium
DSTTVGLFTYPVLQAADVLAYDTGL

SEQ ID NO: 125456 - protein, 25 aa, Mycobacterium avium
DSVAVATRFPGPITDLQLSRDSTRA

SEQ ID NO: 125457 - protein, 20 aa, Mycobacterium avium
DSVVFDRGGYTYGGRIAALA

SEQ ID NO: 125458 - protein, 26 aa, Mycobacterium avium
DSYGPHHRLIFPLNTILELDDIPEDQ

SEQ ID NO: 125459 - protein, 24 aa, Mycobacterium avium
DTAVPVCFGFHPYLQLPAVPRAEW

SEQ ID NO: 125460 - protein, 24 aa, Mycobacterium avium
DTAVPVCFGFHPYLQLPGVPRAEW

SEQ ID NO: 125461 - protein, 18 aa, Mycobacterium avium
DTCLWLLGRGVEPDRLTW

SEQ ID NO: 125462 - protein, 25 aa, Mycobacterium avium
DTDEVALPFAWQGVSLHAAGASAVR

SEQ ID NO: 125463 - protein, 27 aa, Mycobacterium avium
DTENYRSIWMYLKELEFRQGFIDIPVN

SEQ ID NO: 125464 - protein, 20 aa, Mycobacterium avium
DTEYLERRAALIDPARAKPV

SEQ ID NO: 125465 - protein, 21 aa, Mycobacterium avium
DTFIAPRDIRFHRDLDIVFGT

SEQ ID NO: 125466 - protein, 26 aa, Mycobacterium avium
DTGATKMWMARLYPTYERNTCLISNG

SEQ ID NO: 125467 - protein, 22 aa, Mycobacterium avium
DTHGATLRFAPPLVVTAQEIDW

SEQ ID NO: 125468 - protein, 25 aa, Mycobacterium avium
DTHGATLRFAPPLVVTAQEIDWAVG

SEQ ID NO: 125469 - protein, 22 aa, Mycobacterium avium
DTHLTRLRLITSMLDRGYTIAH

SEQ ID NO: 125470 - protein, 18 aa, Mycobacterium avium
DTIGRCNLRGALRGPVRA

SEQ ID NO: 125471 - protein, 26 aa, Mycobacterium avium
DTITGAGGLPLRRAWPDGTEPFCGVA

SEQ ID NO: 125472 - protein, 22 aa, Mycobacterium avium
DTIVIARHQVLGPRAVRKPCER

SEQ ID NO: 125473 - protein, 25 aa, Mycobacterium avium
DTKRRFREALDRKMAKSTGGSEHKD

SEQ ID NO: 125474 - protein, 20 aa, Mycobacterium avium
DTLPRDPNGKLYKRRIRERY

SEQ ID NO: 125475 - protein, 35 aa, Mycobacterium avium
DTLVALRRHIYLEEIFLFPPLREAGIVMPIFVMMR

SEQ ID NO: 125476 - protein, 31 aa, Mycobacterium avium
DTNFVPLGEYPGDFWQYARNKVIVAARIAGI

SEQ ID NO: 125477 - protein, 24 aa, Mycobacterium avium
DTNVYYRRALMLAASFGRSSDYPQ

SEQ ID NO: 125478 - protein, 25 aa, Mycobacterium avium
DTNVYYRRALMLAASFGRSSDYPQK

SEQ ID NO: 125479 - protein, 17 aa, Mycobacterium avium
DTPMIMIGPGTGIAPFR

SEQ ID NO: 125480 - protein, 25 aa, Mycobacterium avium
DTPRFDRVRAALLAARRGRIQPGRD

SEQ ID NO: 125481 - protein, 23 aa, Mycobacterium avium
DTPYSGVAAIFRSALEKGEPPRV

SEQ ID NO: 125482 - protein, 23 aa, Mycobacterium avium
DTQDILLRVEFARRPRIRSSRGL

SEQ ID NO: 125483 - protein, 17 aa, Mycobacterium avium
DTREQLRRHLEACPGCF

SEQ ID NO: 125484 - protein, 23 aa, Mycobacterium avium
DTREQLRRHLEACPGCFKHYGLE

SEQ ID NO: 125485 - protein, 20 aa, Mycobacterium avium
DTRIRFLPPESWGNHEWDTM

SEQ ID NO: 125486 - protein, 18 aa, Mycobacterium avium
DTRKRRLGVLGYDDLLTR

SEQ ID NO: 125487 - protein, 24 aa, Mycobacterium avium
DTRLARLLWQHRESWRYSTKAYGG

SEQ ID NO: 125488 - protein, 18 aa, Mycobacterium avium
DTSHAFHSALRDPILDEF

SEQ ID NO: 125489 - protein, 24 aa, Mycobacterium avium
DTSKSALMAAWTSLYDAAKSDRPG

SEQ ID NO: 125490 - protein, 21 aa, Mycobacterium avium
DTSTYCPFKGEASYYSVTTSA

SEQ ID NO: 125491 - protein, 28 aa, Mycobacterium avium
DTTATFEWAFRWLAARRPRAAPAVLAHG

SEQ ID NO: 125492 - protein, 32 aa, Mycobacterium avium
DTTDPAALEQARPLFPHHLDTIVHVPAPSWEA

SEQ ID NO: 125493 - protein, 21 aa, Mycobacterium avium
DTTGARLVWVPRRAGDRGALE

SEQ ID NO: 125494 - protein, 25 aa, Mycobacterium avium
DTTLLPGLMDMELNLLIGGPGGPEG

SEQ ID NO: 125495 - protein, 23 aa, Mycobacterium avium
DTTPSMFAQLQAFGLLTDVPLTV

SEQ ID NO: 125496 - protein, 29 aa, Mycobacterium avium
DTTTAEQWRLVLDVNLIGAWNTCAAALPH

SEQ ID NO: 125497 - protein, 34 aa, Mycobacterium avium
DTVAPLLQPAGVAVGLKWPNDVLAGPAGTPGKLA

SEQ ID NO: 125498 - protein, 19 aa, Mycobacterium avium
DTVELRLPLRETFAGKAKG

SEQ ID NO: 125499 - protein, 17 aa, Mycobacterium avium
DTVLWDVLCNQVGVAGI

SEQ ID NO: 125500 - protein, 25 aa, Mycobacterium avium
DTVRRAAPFATLPRSIYEATLDLLS

SEQ ID NO: 125501 - protein, 17 aa, Mycobacterium avium
DTVVILGALLADTPHTR

SEQ ID NO: 125502 - protein, 31 aa, Mycobacterium avium
DVAELYDAFTYMLLLTLEDLGFCPKGEGGPF

SEQ ID NO: 125503 - protein, 24 aa, Mycobacterium avium
DVALLYDHFSPMVLMQLEDYGFCG

SEQ ID NO: 125504 - protein, 25 aa, Mycobacterium avium
DVAPRRGWLEALLGHFCDPTVGAGR

SEQ ID NO: 125505 - protein, 18 aa, Mycobacterium avium
DVAQAFGLEFRSALAQAA

SEQ ID NO: 125506 - protein, 20 aa, Mycobacterium avium
DVDAFLTALAGRHIDLLIYN

SEQ ID NO: 125507 - protein, 17 aa, Mycobacterium avium
DVDAVLRVLPGAVERAR

SEQ ID NO: 125508 - protein, 22 aa, Mycobacterium avium
DVDKYLITPVVDVLASLAESNA

SEQ ID NO: 125509 - protein, 18 aa, Mycobacterium avium
DVDLAVFDIMLLAHGWAL

SEQ ID NO: 125510 - protein, 18 aa, Mycobacterium avium
DVDPLAYPGYAGSLDHIW

SEQ ID NO: 125511 - protein, 18 aa, Mycobacterium avium
DVDQPSVIGLRRRLYDDT

SEQ ID NO: 125512 - protein, 18 aa, Mycobacterium avium
DVDRLARSMLLLHGDHHD

SEQ ID NO: 125513 - protein, 18 aa, Mycobacterium avium
DVEALMAMLAPDATWTAD

SEQ ID NO: 125514 - protein, 22 aa, Mycobacterium avium
DVEAWVAGYFDYLDRNGAFVIR

SEQ ID NO: 125515 - protein, 24 aa, Mycobacterium avium
DVELAFLGLISQPIKAVQLLYRTM

SEQ ID NO: 125516 - protein, 22 aa, Mycobacterium avium
DVEVAIIHRPRYDDWSLPKGKV

SEQ ID NO: 125517 - protein, 20 aa, Mycobacterium avium
DVFLTNWLPGALERARLTVA

SEQ ID NO: 125518 - protein, 24 aa, Mycobacterium avium
DVGEYLGLRPRWIDSTAVGGASWE

SEQ ID NO: 125519 - protein, 17 aa, Mycobacterium avium
DVGLFLLVADAAGVEIR

SEQ ID NO: 125520 - protein, 19 aa, Mycobacterium avium
DVGPWWTCYPGRADYFTHW

SEQ ID NO: 125521 - protein, 19 aa, Mycobacterium avium
DVGSWWTCHPGRADYFTHW

SEQ ID NO: 125522 - protein, 18 aa, Mycobacterium avium
DVGSWWTCYPGRADYFTH

SEQ ID NO: 125523 - protein, 17 aa, Mycobacterium avium
DVHLGVRALFEAPTIRR

SEQ ID NO: 125524 - protein, 23 aa, Mycobacterium avium
DVIAGELLAWLYARLARYKCLGR

SEQ ID NO: 125525 - protein, 24 aa, Mycobacterium avium
DVIDGGVAALRLWGAGATGSRLVT

SEQ ID NO: 125526 - protein, 17 aa, Mycobacterium avium
DVLDSFTILGVLTGQAA

SEQ ID NO: 125527 - protein, 18 aa, Mycobacterium avium
DVLDSFTILGVLTGQAAA

SEQ ID NO: 125528 - protein, 29 aa, Mycobacterium avium
DVLDYLVSRIPKWIDHEIVVVPYAMSSAE

SEQ ID NO: 125529 - protein, 17 aa, Mycobacterium avium
DVLLLPAASDVVPATAD

SEQ ID NO: 125530 - protein, 17 aa, Mycobacterium avium
DVLLPSGRRRQYSLCGP

SEQ ID NO: 125531 - protein, 18 aa, Mycobacterium avium
DVLPAVGAIPWNDGSEAG

SEQ ID NO: 125532 - protein, 17 aa, Mycobacterium avium
DVLVLRSLTKTWALAGL

SEQ ID NO: 125533 - protein, 18 aa, Mycobacterium avium
DVMGFGKPLDDTPMLLQP

SEQ ID NO: 125534 - protein, 26 aa, Mycobacterium avium
DVNLVPLYRERYVLLAPADLLASGAA

SEQ ID NO: 125535 - protein, 24 aa, Mycobacterium avium
DVPADLVEYVIMGQVLTAGAGQMP

SEQ ID NO: 125536 - protein, 17 aa, Mycobacterium avium
DVPILIGAFNKIMLRTV

SEQ ID NO: 125537 - protein, 17 aa, Mycobacterium avium
DVPPDDPLPLKLVDQRA

SEQ ID NO: 125538 - protein, 25 aa, Mycobacterium avium
DVQGVLFFAYAISAAVDWLYSGLPS

SEQ ID NO: 125539 - protein, 17 aa, Mycobacterium avium
DVREQLLPGLLAGTTVA

SEQ ID NO: 125540 - protein, 24 aa, Mycobacterium avium
DVRLRAAMPQRMPTWRAFWADGDP

SEQ ID NO: 125541 - protein, 25 aa, Mycobacterium avium
DVRLRAAQQLPWHPGRCAEVLVGDT

SEQ ID NO: 125542 - protein, 29 aa, Mycobacterium avium
DVRRYLSYFPPSAWSYPPSLPPGDAAMPR

SEQ ID NO: 125543 - protein, 21 aa, Mycobacterium avium
DVRVQRWLDAMPQYGPGHAEL

SEQ ID NO: 125544 - protein, 18 aa, Mycobacterium avium
DVRVVGPAGALRGDGRRP

SEQ ID NO: 125545 - protein, 24 aa, Mycobacterium avium
DVRWSAAFTGLHARRVDLPTYAFA

SEQ ID NO: 125546 - protein, 25 aa, Mycobacterium avium
DVSETVLFLVSDSGRYYTGTTLMLD

SEQ ID NO: 125547 - protein, 25 aa, Mycobacterium avium
DVSIGFFRGDIARTIEFGPRLCEPD

SEQ ID NO: 125548 - protein, 24 aa, Mycobacterium avium
DVSIGFFRGDIARTIELGPRLCEP

SEQ ID NO: 125549 - protein, 21 aa, Mycobacterium avium
DVTAFTARLADRVQAHSRRVA

SEQ ID NO: 125550 - protein, 36 aa, Mycobacterium avium
DVTESFRLNPAPWVPVYWVFGGFLRKRRNIRDMTKT

SEQ ID NO: 125551 - protein, 25 aa, Mycobacterium avium
DVTKRVGVLGIWYAGSHGFELTAPD

SEQ ID NO: 125552 - protein, 25 aa, Mycobacterium avium
DVTNFWALLKYEDVRYVSGHPLTFS

SEQ ID NO: 125553 - protein, 25 aa, Mycobacterium avium
DVVAHALWACLELRLLEALDMTGQR

SEQ ID NO: 125554 - protein, 23 aa, Mycobacterium avium
DVVGRLLRHRKLAQRYLTVEGHR

SEQ ID NO: 125555 - protein, 31 aa, Mycobacterium avium
DVVKQVLASSYIWFFLAPGAPEWAIRSGATV

SEQ ID NO: 125556 - protein, 18 aa, Mycobacterium avium
DVVLSWDYRAGCFPPGVV

SEQ ID NO: 125557 - protein, 24 aa, Mycobacterium avium
DVVRTRIYVTDISRWREVGAVHAE

SEQ ID NO: 125558 - protein, 21 aa, Mycobacterium avium
DVVVLISTGGLPKGDALATAR

SEQ ID NO: 125559 - protein, 17 aa, Mycobacterium avium
DVWLISWVPGHPTELHD

SEQ ID NO: 125560 - protein, 19 aa, Mycobacterium avium
DVWPLRPDCRILACSSVFG

SEQ ID NO: 125561 - protein, 19 aa, Mycobacterium avium
DVYRMLRVTNPSPYMYLLH

SEQ ID NO: 125562 - protein, 20 aa, Mycobacterium avium
DWADEVYVFGYPRVPMTAEM

SEQ ID NO: 125563 - protein, 18 aa, Mycobacterium avium
DWAGLPVNLDFAFSRDQR

SEQ ID NO: 125564 - protein, 19 aa, Mycobacterium avium
DWAGLPVNLDFAFSRDQRD

SEQ ID NO: 125565 - protein, 18 aa, Mycobacterium avium
DWALKFLFEKIDREFHGK

SEQ ID NO: 125566 - protein, 27 aa, Mycobacterium avium
DWDKQGLRLAQTLTPWPATDGQRIAAA

SEQ ID NO: 125567 - protein, 23 aa, Mycobacterium avium
DWDMLRANLLQLLIDGTVRPHEP

SEQ ID NO: 125568 - protein, 32 aa, Mycobacterium avium
DWEHDLAVNLNGPFFLCRAALPELLERGGNIV

SEQ ID NO: 125569 - protein, 17 aa, Mycobacterium avium
DWGTYVFDFGRREVRNF

SEQ ID NO: 125570 - protein, 17 aa, Mycobacterium avium
DWLTAVADGIALLTRVR

SEQ ID NO: 125571 - protein, 21 aa, Mycobacterium avium
DWRSRLGGWGLMSNAAHPGLA

SEQ ID NO: 125572 - protein, 18 aa, Mycobacterium avium
DWTRLWWVRADGLATIHR

SEQ ID NO: 125573 - protein, 20 aa, Mycobacterium avium
DWTWQMVRDTVLDRLLSNPA

SEQ ID NO: 125574 - protein, 21 aa, Mycobacterium avium
DYAHRLAPLATRYAERLKIVM

SEQ ID NO: 125575 - protein, 18 aa, Mycobacterium avium
DYALTELCALSWTVYSLP

SEQ ID NO: 125576 - protein, 21 aa, Mycobacterium avium
DYGLTPWPKTSGSRGFPIYAR

SEQ ID NO: 125577 - protein, 19 aa, Mycobacterium avium
DYHLRRSALPEPGRVRDLL

SEQ ID NO: 125578 - protein, 20 aa, Mycobacterium avium
DYLEELLDLLDFDGDIDLDV

SEQ ID NO: 125579 - protein, 17 aa, Mycobacterium avium
DYLKRLTADLRRTRRRV

SEQ ID NO: 125580 - protein, 20 aa, Mycobacterium avium
DYLNWEARSWRLNDTGDYQE

SEQ ID NO: 125581 - protein, 18 aa, Mycobacterium avium
DYPLFMPQSTEQSVTGGR

SEQ ID NO: 125582 - protein, 30 aa, Mycobacterium avium
DYPQFQRWSISLLSWILNPERGLAASAALC

SEQ ID NO: 125583 - protein, 24 aa, Mycobacterium avium
DYPRPRLFSLLHEFVHLVLHTEGL

SEQ ID NO: 125584 - protein, 22 aa, Mycobacterium avium
DYRHRDLPPAPAPLSDAQVAAR

SEQ ID NO: 125585 - protein, 24 aa, Mycobacterium avium
DYRHSKWLAMMERRLLIARELLNP

SEQ ID NO: 125586 - protein, 24 aa, Mycobacterium avium
DYRRRMGELFAPFTKVAAKNPFAS

SEQ ID NO: 125587 - protein, 25 aa, Mycobacterium avium
DYRRRMGELFAPFTKVAAKNPFASA

SEQ ID NO: 125588 - protein, 24 aa, Mycobacterium avium
DYRRRMGELFAPFTKVAAKNPSAS

SEQ ID NO: 125589 - protein, 24 aa, Mycobacterium avium
DYSLGAFAVWLRDFLDELGVSRAT

SEQ ID NO: 125590 - protein, 27 aa, Mycobacterium avium
DYTFRLNVGAYFYLTKAALPHLRAGSS

SEQ ID NO: 125591 - protein, 22 aa, Mycobacterium avium
DYTNRGRIITPLKDRFGAEIRT

SEQ ID NO: 125592 - protein, 18 aa, Mycobacterium avium
DYVGAASGLLFSSGYAAN

SEQ ID NO: 125593 - protein, 32 aa, Mycobacterium avium
EAAALVGVARRLLLDPREIGSIRLLGVGFSGL

SEQ ID NO: 125594 - protein, 19 aa, Mycobacterium avium
EAAFAMTVPPPAVAANRVQ

SEQ ID NO: 125595 - protein, 18 aa, Mycobacterium avium
EAAKGTPGILLVISIPAS

SEQ ID NO: 125596 - protein, 29 aa, Mycobacterium avium
EAAKLLERFRAMEPWLQAGRVHAPFWEVH

SEQ ID NO: 125597 - protein, 17 aa, Mycobacterium avium
EAALLELRRSRPYWGPR

SEQ ID NO: 125598 - protein, 25 aa, Mycobacterium avium
EAALPKLRALLRCDLNLVPREEGLV

SEQ ID NO: 125599 - protein, 23 aa, Mycobacterium avium
EAASRYIGLWTPDDSSAAPAATD

SEQ ID NO: 125600 - protein, 24 aa, Mycobacterium avium
EAAVRELLFAIGEDPDRHGLAETP

SEQ ID NO: 125601 - protein, 18 aa, Mycobacterium avium
EACPGCFKHYGLEERIKA

SEQ ID NO: 125602 - protein, 27 aa, Mycobacterium avium
EADEMLDLGFLPDIERILRQIPDDRQS

SEQ ID NO: 125603 - protein, 28 aa, Mycobacterium avium
EADEMLDLGFLPDIERILRQIPDDRQSM

SEQ ID NO: 125604 - protein, 30 aa, Mycobacterium avium
EADEMLDLGFLPDIERILRQIPDDRQSMLF

SEQ ID NO: 125605 - protein, 25 aa, Mycobacterium avium
EADVRRREWLAGRRGRVADQREQIA

SEQ ID NO: 125606 - protein, 25 aa, Mycobacterium avium
EAELDQLIGFFVNILVLRNDLDGNP

SEQ ID NO: 125607 - protein, 25 aa, Mycobacterium avium
EAELDQLIGFFVNILVLRNDMDGNP

SEQ ID NO: 125608 - protein, 34 aa, Mycobacterium avium
EAELLATLSLPRRLMLRKLLSFTGAHVRAVELGK

SEQ ID NO: 125609 - protein, 21 aa, Mycobacterium avium
EAFGPILIFRSVVPADPQHPG

SEQ ID NO: 125610 - protein, 19 aa, Mycobacterium avium
EAFIRLIETGWDAEAHRRP

SEQ ID NO: 125611 - protein, 24 aa, Mycobacterium avium
EAFSRYGAHLPKINVLPIYGGSSY

SEQ ID NO: 125612 - protein, 24 aa, Mycobacterium avium
EAGAFNYAWLNLRKDRQVDLLKAT

SEQ ID NO: 125613 - protein, 21 aa, Mycobacterium avium
EAGAPLGWIDAEGLRRHRDGL

SEQ ID NO: 125614 - protein, 23 aa, Mycobacterium avium
EAGNLPPVKYLAKASPVGRLGTG

SEQ ID NO: 125615 - protein, 24 aa, Mycobacterium avium
EAGVYPLRASWLHGYSLTVLSPNE

SEQ ID NO: 125616 - protein, 36 aa, Mycobacterium avium
EAHERSLNIDFLLGYLRALLPRRPDLKLIITSATIE

SEQ ID NO: 125617 - protein, 24 aa, Mycobacterium avium
EAIAKFAANIPFPKRLGTPAEYAD

SEQ ID NO: 125618 - protein, 17 aa, Mycobacterium avium
EAIANWDPKAEPSIEIQ

SEQ ID NO: 125619 - protein, 38 aa, Mycobacterium avium
EAIDRLLLETDQLFGWIAFEFGVYRYGLQQRLAPGTAL

SEQ ID NO: 125620 - protein, 24 aa, Mycobacterium avium
EAILIGASWQRCRVHFLRNVLAQV

SEQ ID NO: 125621 - protein, 28 aa, Mycobacterium avium
EAITDRILLLDGLPNYQRLFSLRIGQTL

SEQ ID NO: 125622 - protein, 17 aa, Mycobacterium avium
EALAEQLSFFRGVLDGA

SEQ ID NO: 125623 - protein, 25 aa, Mycobacterium avium
EALAKFAANIPFPKRLGTPDEFADA

SEQ ID NO: 125624 - protein, 32 aa, Mycobacterium avium
EALDMWMQSPPHRAIILNCGFTAGGFATARDG

SEQ ID NO: 125625 - protein, 17 aa, Mycobacterium avium
EALFFGSDEFDFAADPG

SEQ ID NO: 125626 - protein, 23 aa, Mycobacterium avium
EALKLPYPGVLPEGPPPPKVFGS

SEQ ID NO: 125627 - protein, 17 aa, Mycobacterium avium
EALLCREARDGVQKLHG

SEQ ID NO: 125628 - protein, 17 aa, Mycobacterium avium
EALLLRDDRMRMALDDL

SEQ ID NO: 125629 - protein, 28 aa, Mycobacterium avium
EALPLASIFKLYVLHALAGAVTAGRVSW

SEQ ID NO: 125630 - protein, 24 aa, Mycobacterium avium
EALPSRPVQAIGFTSVPGAGDNLL

SEQ ID NO: 125631 - protein, 18 aa, Mycobacterium avium
EALTFAYHRLGRADVGAA

SEQ ID NO: 125632 - protein, 17 aa, Mycobacterium avium
EALVAQHPYREPLWAQL

SEQ ID NO: 125633 - protein, 33 aa, Mycobacterium avium
EALVAQHPYREPLWAQLITAYYVTERQSDALGA

SEQ ID NO: 125634 - protein, 17 aa, Mycobacterium avium
EALWRSLAASRGDIVVF

SEQ ID NO: 125635 - protein, 23 aa, Mycobacterium avium
EAMEAFRVLCRTEGIIPAIESAH

SEQ ID NO: 125636 - protein, 24 aa, Mycobacterium avium
EAMLNTAWLHKPMFTLRGGTNEVL

SEQ ID NO: 125637 - protein, 23 aa, Mycobacterium avium
EANVVNFRRQLGRLGLGHDSRRS

SEQ ID NO: 125638 - protein, 24 aa, Mycobacterium avium
EAPEDIIVFCGVHFMAETAKILSP

SEQ ID NO: 125639 - protein, 18 aa, Mycobacterium avium
EAPNILMPLMNAVGITSE

SEQ ID NO: 125640 - protein, 19 aa, Mycobacterium avium
EAPVARRLRESFGGGKAAE

SEQ ID NO: 125641 - protein, 19 aa, Mycobacterium avium
EAPVRYSERLYASTPGIVI

SEQ ID NO: 125642 - protein, 18 aa, Mycobacterium avium
EAQAPRRSHPIPLVLGGS

SEQ ID NO: 125643 - protein, 28 aa, Mycobacterium avium
EAQEKFGFLLEAFTFGAPPHGGIAFGWD

SEQ ID NO: 125644 - protein, 25 aa, Mycobacterium avium
EARFLQSIPLHRVARPREIAHAICF

SEQ ID NO: 125645 - protein, 20 aa, Mycobacterium avium
EARLGFGDPALFAEALLGDA

SEQ ID NO: 125646 - protein, 26 aa, Mycobacterium avium
EARLLDPQHRLLLETAWRAVEHCGTA

SEQ ID NO: 125647 - protein, 26 aa, Mycobacterium avium
EARRLQRAWPRYDAMRVELAVGQFAD

SEQ ID NO: 125648 - protein, 27 aa, Mycobacterium avium
EARRVALPNIVRLLPPARAAGVRIVHC

SEQ ID NO: 125649 - protein, 23 aa, Mycobacterium avium
EARTVFLEVINFPKPLVSAVNGP

SEQ ID NO: 125650 - protein, 18 aa, Mycobacterium avium
EARWRRQPGDVPALTKLQ

SEQ ID NO: 125651 - protein, 26 aa, Mycobacterium avium
EASGWRTTYPADHSWMVATLSGARSS

SEQ ID NO: 125652 - protein, 17 aa, Mycobacterium avium
EASLACMAAWANTDFRP

SEQ ID NO: 125653 - protein, 18 aa, Mycobacterium avium
EASLACMAAWANTDFRPD

SEQ ID NO: 125654 - protein, 22 aa, Mycobacterium avium
EASLACMAAWANTDFRPDLTRV

SEQ ID NO: 125655 - protein, 24 aa, Mycobacterium avium
EASRSRLGLAQFAAPRPGRRIGLV

SEQ ID NO: 125656 - protein, 26 aa, Mycobacterium avium
EATGPMPLLPNGRWLYEHGNPRRLAQ

SEQ ID NO: 125657 - protein, 17 aa, Mycobacterium avium
EATRRLGGTPPVLALTT

SEQ ID NO: 125658 - protein, 20 aa, Mycobacterium avium
EATVFFEELLRRYPRIELVG

SEQ ID NO: 125659 - protein, 17 aa, Mycobacterium avium
EAVPFYGGLRRMVNRND

SEQ ID NO: 125660 - protein, 17 aa, Mycobacterium avium
EAWIEQMKRIGIYGLAV

SEQ ID NO: 125661 - protein, 19 aa, Mycobacterium avium
EAWLDSLPLVVDTGAEAEA

SEQ ID NO: 125662 - protein, 20 aa, Mycobacterium avium
EAWVNQTVSVLAQYTNRRKP

SEQ ID NO: 125663 - protein, 22 aa, Mycobacterium avium
EAYTLAMLLAEALGFDAFRQRV

SEQ ID NO: 125664 - protein, 18 aa, Mycobacterium avium
EAYTYFHPARSVRERIEH

SEQ ID NO: 125665 - protein, 17 aa, Mycobacterium avium
ECAARALLLPRRHPGRR

SEQ ID NO: 125666 - protein, 26 aa, Mycobacterium avium
ECAARALLLPRRHPGRRSPLWQQRQR

SEQ ID NO: 125667 - protein, 27 aa, Mycobacterium avium
ECAARALLLPRRHPGRRSPLWQQRQRA

SEQ ID NO: 125668 - protein, 18 aa, Mycobacterium avium
ECDKILLYSSDYPHWTFD

SEQ ID NO: 125669 - protein, 30 aa, Mycobacterium avium
ECGAAIAPIPLLCSVGLAAGLLRGSGLDAV

SEQ ID NO: 125670 - protein, 30 aa, Mycobacterium avium
ECGAAIAPIPLLCSVGLAAGLLRGSGLDGV

SEQ ID NO: 125671 - protein, 30 aa, Mycobacterium avium
ECGAAIAPIPLLCSVGLAAGLLRGSGLDLV

SEQ ID NO: 125672 - protein, 18 aa, Mycobacterium avium
ECLAAMFELWHSDSPSFD

SEQ ID NO: 125673 - protein, 18 aa, Mycobacterium avium
ECLLPFFDRKTATAVAEE

SEQ ID NO: 125674 - protein, 40 aa, Mycobacterium avium
ECYDYFGHVLFTWHLPELWRRFTITLRRALRRHLKAAGAD

SEQ ID NO: 125675 - protein, 31 aa, Mycobacterium avium
EDAEVTFPFMQAMPIPYIDPCDVSHAVVYLA

SEQ ID NO: 125676 - protein, 21 aa, Mycobacterium avium
EDCYTALTWLAGLPSVDRYGI

SEQ ID NO: 125677 - protein, 26 aa, Mycobacterium avium
EDEEIYSFLRLLLPAGVETTYRALGS

SEQ ID NO: 125678 - protein, 24 aa, Mycobacterium avium
EDESWWRRGKPTLHIDYGVPVAVN

SEQ ID NO: 125679 - protein, 25 aa, Mycobacterium avium
EDFDRLVEVLRFPAKFFTTAPTSRV

SEQ ID NO: 125680 - protein, 25 aa, Mycobacterium avium
EDGAFWTAFLRSLKTRGLSGVQLVI

SEQ ID NO: 125681 - protein, 23 aa, Mycobacterium avium
EDGVIAWLLSGPEHTYRVPLPEP

SEQ ID NO: 125682 - protein, 18 aa, Mycobacterium avium
EDGYLFIGGRSDDTIIRG

SEQ ID NO: 125683 - protein, 28 aa, Mycobacterium avium
EDHAMLATGLLALYQLSAEDSWLTAATD

SEQ ID NO: 125684 - protein, 25 aa, Mycobacterium avium
EDIANAVAFLVSDEARFITGTAWPL

SEQ ID NO: 125685 - protein, 28 aa, Mycobacterium avium
EDIAWLREVWGGPFMLKGVMRVDDAKRA

SEQ ID NO: 125686 - protein, 29 aa, Mycobacterium avium
EDIAWLREVWGGPFMLKGVMRVDDAKRAV

SEQ ID NO: 125687 - protein, 19 aa, Mycobacterium avium
EDLGWYVADNLPPQLITRM

SEQ ID NO: 125688 - protein, 18 aa, Mycobacterium avium
EDLLPFSDETLCRAIAAC

SEQ ID NO: 125689 - protein, 17 aa, Mycobacterium avium
EDLLRAERIFLNVGGRA

SEQ ID NO: 125690 - protein, 25 aa, Mycobacterium avium
EDPGWANLLDLLAALGFSAEPVRVD

SEQ ID NO: 125691 - protein, 25 aa, Mycobacterium avium
EDRLRTRFEWGLITDVQPPELETRI

SEQ ID NO: 125692 - protein, 24 aa, Mycobacterium avium
EDRSAFLAENWRPYVAGDIVIHEI

SEQ ID NO: 125693 - protein, 21 aa, Mycobacterium avium
EDRWKLARRSIFVDESVLRMQ

SEQ ID NO: 125694 - protein, 25 aa, Mycobacterium avium
EDSHALKEWKGNPGLPLLRYMIANR

SEQ ID NO: 125695 - protein, 20 aa, Mycobacterium avium
EDSRLLTRELFYTAVTRAKS

SEQ ID NO: 125696 - protein, 17 aa, Mycobacterium avium
EDTGLRPDFPRQPVPSG

SEQ ID NO: 125697 - protein, 35 aa, Mycobacterium avium
EDVAAAQLVLALGLFLLRDLPAVQLEARQLFRGAG

SEQ ID NO: 125698 - protein, 19 aa, Mycobacterium avium
EDVARAVLWFSSPSAARQV

SEQ ID NO: 125699 - protein, 25 aa, Mycobacterium avium
EDVLLKIRLRQGFPVDLLNSAERER

SEQ ID NO: 125700 - protein, 19 aa, Mycobacterium avium
EDVLRWSEDRWKLARRSIF

SEQ ID NO: 125701 - protein, 20 aa, Mycobacterium avium
EDVLRWSEDRWKLARRSIFV

SEQ ID NO: 125702 - protein, 17 aa, Mycobacterium avium
EEALRVIRLLWDTDGPV

SEQ ID NO: 125703 - protein, 19 aa, Mycobacterium avium
EEDVWIPAEMKQFAKRYAT

SEQ ID NO: 125704 - protein, 35 aa, Mycobacterium avium
EEERRLLYVGITRARTYLALSWALARSPGGRQSRK

SEQ ID NO: 125705 - protein, 25 aa, Mycobacterium avium
EEESLPGVLATIPPGYRALVVDNNS

SEQ ID NO: 125706 - protein, 18 aa, Mycobacterium avium
EEEWHDVVDLNLGSVWFL

SEQ ID NO: 125707 - protein, 27 aa, Mycobacterium avium
EEFRAGRIATIPLGRFADPVEIAHAAV

SEQ ID NO: 125708 - protein, 24 aa, Mycobacterium avium
EEILKRFPAWEVDWANAVPSETAA

SEQ ID NO: 125709 - protein, 32 aa, Mycobacterium avium
EELADAFAKAWYKLLHRDMGLVSRFLGPWVPE

SEQ ID NO: 125710 - protein, 27 aa, Mycobacterium avium
EELADAFAKAWYKLLHRDMGPVSRFLG

SEQ ID NO: 125711 - protein, 21 aa, Mycobacterium avium
EELGNPTWYARFAAQAMTDPA

SEQ ID NO: 125712 - protein, 22 aa, Mycobacterium avium
EELIGILGGETRQLAFAKTPPT

SEQ ID NO: 125713 - protein, 17 aa, Mycobacterium avium
EELKALWFAEAARYNGL

SEQ ID NO: 125714 - protein, 18 aa, Mycobacterium avium
EELMRYLSIIQTGQRRIA

SEQ ID NO: 125715 - protein, 19 aa, Mycobacterium avium
EELMRYLSIIQTGQRRIAI

SEQ ID NO: 125716 - protein, 20 aa, Mycobacterium avium
EELMRYLSIIQTGQRRIAIE

SEQ ID NO: 125717 - protein, 17 aa, Mycobacterium avium
EELPPDWAPDEPAYQPL

SEQ ID NO: 125718 - protein, 23 aa, Mycobacterium avium
EELTLQAPLMLPAKDSGIGSVAV

SEQ ID NO: 125719 - protein, 28 aa, Mycobacterium avium
EEMGRALVCSPFFATVALATQAILASED

SEQ ID NO: 125720 - protein, 24 aa, Mycobacterium avium
EEPPPSTVFLLCAPSVDPEDVAIT

SEQ ID NO: 125721 - protein, 21 aa, Mycobacterium avium
EEPRWIYYSSGTTAAPKGARH

SEQ ID NO: 125722 - protein, 25 aa, Mycobacterium avium
EEQKKRWLPGIADGTLTMAFAITEP

SEQ ID NO: 125723 - protein, 23 aa, Mycobacterium avium
EEQKQRWLPKFCTGELITAIAMT

SEQ ID NO: 125724 - protein, 22 aa, Mycobacterium avium
EEQSQWPRWVPVGRMGLPEDQA

SEQ ID NO: 125725 - protein, 30 aa, Mycobacterium avium
EERDTGGFSLLHRLPDRPVQRVALDAAVDA

SEQ ID NO: 125726 - protein, 23 aa, Mycobacterium avium
EEREGPLRVLNDADLWGALADRM

SEQ ID NO: 125727 - protein, 25 aa, Mycobacterium avium
EERILFTGNLFGPLFGHVPNLMTIR

SEQ ID NO: 125728 - protein, 23 aa, Mycobacterium avium
EERMMLAANAYARFARERPHEFR

SEQ ID NO: 125729 - protein, 25 aa, Mycobacterium avium
EESYLALLDALRWLGLDWDEGPEVG

SEQ ID NO: 125730 - protein, 24 aa, Mycobacterium avium
EETDVILQFRRAVAGNAALQGRFL

SEQ ID NO: 125731 - protein, 29 aa, Mycobacterium avium
EETSEWPWRPRHLVVTLGSHGARYVGADG

SEQ ID NO: 125732 - protein, 22 aa, Mycobacterium avium
EEVADVVAFLLSDAASFITATT

SEQ ID NO: 125733 - protein, 22 aa, Mycobacterium avium
EEVRASGLLPTWAETQAFIEGL

SEQ ID NO: 125734 - protein, 21 aa, Mycobacterium avium
EEVRRYFGSKVLRTVIPRSVK

SEQ ID NO: 125735 - protein, 17 aa, Mycobacterium avium
EEWHDVVDLNLGSVWFL

SEQ ID NO: 125736 - protein, 21 aa, Mycobacterium avium
EEWPSAIRRLVSGQLSLLLRR

SEQ ID NO: 125737 - protein, 25 aa, Mycobacterium avium
EFAQPALFVFEVALAALWESLGVTP

SEQ ID NO: 125738 - protein, 21 aa, Mycobacterium avium
EFDYNLQWKPVGGFPITFGWL

SEQ ID NO: 125739 - protein, 20 aa, Mycobacterium avium
EFERPVLLFSGGKDSIVMLH

SEQ ID NO: 125740 - protein, 27 aa, Mycobacterium avium
EFGPVTRAPSIPLLPSGVEVRPDRLLT

SEQ ID NO: 125741 - protein, 24 aa, Mycobacterium avium
EFHPELQFDRPYLLAMANAGPGTN

SEQ ID NO: 125742 - protein, 18 aa, Mycobacterium avium
EFIGRHFDIGPADRCLAL

SEQ ID NO: 125743 - protein, 18 aa, Mycobacterium avium
EFPRGSVPGLFNALHAEI

SEQ ID NO: 125744 - protein, 22 aa, Mycobacterium avium
EFQLINVSRWDSMAAHEAATAR

SEQ ID NO: 125745 - protein, 19 aa, Mycobacterium avium
EFRGGLYVVAGYPGADWAA

SEQ ID NO: 125746 - protein, 21 aa, Mycobacterium avium
EFRKRLPMYFWVAAWETGRRM

SEQ ID NO: 125747 - protein, 17 aa, Mycobacterium avium
EFVKPHLALYIGGMGAK

SEQ ID NO: 125748 - protein, 32 aa, Mycobacterium avium
EFVKSPSKPGLPLGPLARPPAPDSAPPPADYK

SEQ ID NO: 125749 - protein, 29 aa, Mycobacterium avium
EGAAAFRRRLILPCLRVGAATLACDHLPM

SEQ ID NO: 125750 - protein, 17 aa, Mycobacterium avium
EGAAMFVLQRKSAALQA

SEQ ID NO: 125751 - protein, 17 aa, Mycobacterium avium
EGAAMFVLQRKSTAVRA

SEQ ID NO: 125752 - protein, 25 aa, Mycobacterium avium
EGADALWLAQRGWTVLAVDISATAL

SEQ ID NO: 125753 - protein, 32 aa, Mycobacterium avium
EGAHGLLVVTPYYSKPPQRGLIAHFTAVADAT

SEQ ID NO: 125754 - protein, 26 aa, Mycobacterium avium
EGAPHVMIFPNLFIAEIQVFNIQPVA

SEQ ID NO: 125755 - protein, 18 aa, Mycobacterium avium
EGCSFINVLLELGPEHPA

SEQ ID NO: 125756 - protein, 18 aa, Mycobacterium avium
EGDDYWVDPLKLTKQVAL

SEQ ID NO: 125757 - protein, 22 aa, Mycobacterium avium
EGDIRWCQLFSEPGAGSDAAAV

SEQ ID NO: 125758 - protein, 23 aa, Mycobacterium avium
EGDPHAWAIPRLTGTAKAAFVAV

SEQ ID NO: 125759 - protein, 23 aa, Mycobacterium avium
EGEWRWPYRLPGCAGSVCTGKPR

SEQ ID NO: 125760 - protein, 23 aa, Mycobacterium avium
EGGEQVFLCPLELASFTMATAED

SEQ ID NO: 125761 - protein, 17 aa, Mycobacterium avium
EGGGRLVVELTPDEAAA

SEQ ID NO: 125762 - protein, 26 aa, Mycobacterium avium
EGGTGLLDLLNRLGITPLPNTAGCRG

SEQ ID NO: 125763 - protein, 24 aa, Mycobacterium avium
EGGWAGIAWPKEYGGQGLTLMQQL

SEQ ID NO: 125764 - protein, 20 aa, Mycobacterium avium
EGGYPTTLWARRPATLEVFA

SEQ ID NO: 125765 - protein, 22 aa, Mycobacterium avium
EGHPHFGAPLTGPEGSGHELFP

SEQ ID NO: 125766 - protein, 24 aa, Mycobacterium avium
EGIVVLRKIAIRAGIPDYGYAFWP

SEQ ID NO: 125767 - protein, 26 aa, Mycobacterium avium
EGKGFQYILDGLNPERMLIAAEALGI

SEQ ID NO: 125768 - protein, 25 aa, Mycobacterium avium
EGLIDAIVGLWRAPVHVAAAAGPTG

SEQ ID NO: 125769 - protein, 23 aa, Mycobacterium avium
EGLQPLTFGLWQMISEYQSAQPE

SEQ ID NO: 125770 - protein, 34 aa, Mycobacterium avium
EGLTTNLRRRGDRWYWHWDPQFTSGTAAFPPFEV

SEQ ID NO: 125771 - protein, 19 aa, Mycobacterium avium
EGNLHLNVLRCAADREHAL

SEQ ID NO: 125772 - protein, 20 aa, Mycobacterium avium
EGNLHLNVLRCAADREHALY

SEQ ID NO: 125773 - protein, 26 aa, Mycobacterium avium
EGQRPIVGPSWRMTRRPARITRGAPN

SEQ ID NO: 125774 - protein, 18 aa, Mycobacterium avium
EGRATLRRLGITDVADLR

SEQ ID NO: 125775 - protein, 41 aa, Mycobacterium avium
EGRENPHILTLSPPVLLGKEWLKPTAYMMAKFGMTLCALGI

SEQ ID NO: 125776 - protein, 19 aa, Mycobacterium avium
EGRFFVQPTMLYAHPELDP

SEQ ID NO: 125777 - protein, 29 aa, Mycobacterium avium
EGRGFYHLMHNLPSERLSIAISAIAGARE

SEQ ID NO: 125778 - protein, 23 aa, Mycobacterium avium
EGRNRIVRRLLAAAGFPVESLVR

SEQ ID NO: 125779 - protein, 39 aa, Mycobacterium avium
EGRRIRSGRLLIFSPYVTHRLPEIWPEPMRFAPERWNPD

SEQ ID NO: 125780 - protein, 29 aa, Mycobacterium avium
EGRRIRSGRLLIFSPYVTHRLPEIWPEPR

SEQ ID NO: 125781 - protein, 29 aa, Mycobacterium avium
EGTDLDSVLKRFGPLPPPRAVAIITQIAS

SEQ ID NO: 125782 - protein, 22 aa, Mycobacterium avium
EGTPYVTPLVRKLAAENNIDLS

SEQ ID NO: 125783 - protein, 17 aa, Mycobacterium avium
EGTTSYYYRTRAALLQG

SEQ ID NO: 125784 - protein, 19 aa, Mycobacterium avium
EGVNTLFGIPDPNFVRMFL

SEQ ID NO: 125785 - protein, 36 aa, Mycobacterium avium
EGVRWAMRHLPFYGRWYRFLVLWPGSDKGLDAAEAD

SEQ ID NO: 125786 - protein, 17 aa, Mycobacterium avium
EGWAHGPQIDKGARWDP

SEQ ID NO: 125787 - protein, 21 aa, Mycobacterium avium
EGWVRPQLLEYMRTAPDFYFD

SEQ ID NO: 125788 - protein, 19 aa, Mycobacterium avium
EGYRQHHMAVRPKLSRSPK

SEQ ID NO: 125789 - protein, 28 aa, Mycobacterium avium
EHADRFTLLRPLLFTIAYEMLGSATEAD

SEQ ID NO: 125790 - protein, 25 aa, Mycobacterium avium
EHAPPDADLLLLPADTRLLGPLTRT

SEQ ID NO: 125791 - protein, 25 aa, Mycobacterium avium
EHAPPDADLLLLPAGTRLLGPLTRT

SEQ ID NO: 125792 - protein, 20 aa, Mycobacterium avium
EHAQRLLDERLLTIEWEARE

SEQ ID NO: 125793 - protein, 24 aa, Mycobacterium avium
EHARRDAFHWLSLTTEFGITVWNS

SEQ ID NO: 125794 - protein, 26 aa, Mycobacterium avium
EHAVWALMDYGFRVVISSRFGDIFRG

SEQ ID NO: 125795 - protein, 21 aa, Mycobacterium avium
EHDLLDPVLARSMTKLWARMW

SEQ ID NO: 125796 - protein, 33 aa, Mycobacterium avium
EHDMIRAPLLTSLPFMPFDADLSGWSLIYLGVL

SEQ ID NO: 125797 - protein, 17 aa, Mycobacterium avium
EHEGAEVTWLPTAADGS

SEQ ID NO: 125798 - protein, 25 aa, Mycobacterium avium
EHEYRPFRALIRAVLRHAGGVRIDH

SEQ ID NO: 125799 - protein, 24 aa, Mycobacterium avium
EHGAQALVPGYHVAQRRAQRPGVE

SEQ ID NO: 125800 - protein, 18 aa, Mycobacterium avium
EHGPFDLTLLPIGAYNTA

SEQ ID NO: 125801 - protein, 19 aa, Mycobacterium avium
EHGYQPMYSYGVAKLAQLM

SEQ ID NO: 125802 - protein, 20 aa, Mycobacterium avium
EHGYQPMYSYGVAKLAQLMF

SEQ ID NO: 125803 - protein, 21 aa, Mycobacterium avium
EHGYQPMYSYGVAKLAQLMFA

SEQ ID NO: 125804 - protein, 22 aa, Mycobacterium avium
EHGYVCLHWPVEYGGADASVAF

SEQ ID NO: 125805 - protein, 24 aa, Mycobacterium avium
EHHNLPALRDWLRRQRDERSGAPE

SEQ ID NO: 125806 - protein, 25 aa, Mycobacterium avium
EHISAESPLLFPLSSTSADELRRTA

SEQ ID NO: 125807 - protein, 21 aa, Mycobacterium avium
EHLAFPLNRPGFDGGSCYWIS

SEQ ID NO: 125808 - protein, 19 aa, Mycobacterium avium
EHLGLQIRLDWDRGFELIA

SEQ ID NO: 125809 - protein, 23 aa, Mycobacterium avium
EHLGLRTRLFAAPGWVVSPGVVK

SEQ ID NO: 125810 - protein, 18 aa, Mycobacterium avium
EHLLAEHLQKVSLSFLVD

SEQ ID NO: 125811 - protein, 17 aa, Mycobacterium avium
EHLYEMDYLKEGIGLRA

SEQ ID NO: 125812 - protein, 26 aa, Mycobacterium avium
EHPGLLRFTIGLAQTTTLLLAGRLEQ

SEQ ID NO: 125813 - protein, 19 aa, Mycobacterium avium
EHPVPAMVWPFVQECLREH

SEQ ID NO: 125814 - protein, 20 aa, Mycobacterium avium
EHQRVVAGLIRARPPVAVPL

SEQ ID NO: 125815 - protein, 25 aa, Mycobacterium avium
EHRIYRSLLNPYLSPAAVSRWQPFI

SEQ ID NO: 125816 - protein, 17 aa, Mycobacterium avium
EHRKSLTFALRFRAPDR

SEQ ID NO: 125817 - protein, 18 aa, Mycobacterium avium
EHRKSLTFALRFRAPDRT

SEQ ID NO: 125818 - protein, 22 aa, Mycobacterium avium
EHSRLPVREVMWGADPELLQST

SEQ ID NO: 125819 - protein, 27 aa, Mycobacterium avium
EHTDYNLGFALPIALPQRTVASFTRAD

SEQ ID NO: 125820 - protein, 23 aa, Mycobacterium avium
EHTLLQPLALAPKGIWLGPKELR

SEQ ID NO: 125821 - protein, 20 aa, Mycobacterium avium
EHTSYRRWAHALTARAHRLD

SEQ ID NO: 125822 - protein, 17 aa, Mycobacterium avium
EHVVNYPPMRLARDGRD

SEQ ID NO: 125823 - protein, 17 aa, Mycobacterium avium
EHYLKVVYEKTACLIAA

SEQ ID NO: 125824 - protein, 20 aa, Mycobacterium avium
EIACLVLYGIHRAGLRCPGD

SEQ ID NO: 125825 - protein, 25 aa, Mycobacterium avium
EIAERGWPVFLVSTVAREGLQPLTF

SEQ ID NO: 125826 - protein, 33 aa, Mycobacterium avium
EIAIELQRRGCPVRHLILLDALLVIPSSDALNS

SEQ ID NO: 125827 - protein, 21 aa, Mycobacterium avium
EIAVAQRRPAQIQLAHHADRD

SEQ ID NO: 125828 - protein, 25 aa, Mycobacterium avium
EIEEFAPLIAYVLRSMQTGGDLAKM

SEQ ID NO: 125829 - protein, 22 aa, Mycobacterium avium
EIEYLQMWLQAATTMAIYEAVS

SEQ ID NO: 125830 - protein, 25 aa, Mycobacterium avium
EIGALIAFLLSDICAFVTGQTIYAD

SEQ ID NO: 125831 - protein, 23 aa, Mycobacterium avium
EIGIRFFTGVRVYNAVLGEFIAR

SEQ ID NO: 125832 - protein, 21 aa, Mycobacterium avium
EIGYGVLFFASDASSYCSGQT

SEQ ID NO: 125833 - protein, 25 aa, Mycobacterium avium
EIKKQMIDWWGPIIDEYYASSEAIG

SEQ ID NO: 125834 - protein, 26 aa, Mycobacterium avium
EILKPVCFVFDFAPTRALRQLAEYGI

SEQ ID NO: 125835 - protein, 23 aa, Mycobacterium avium
EILKRFPEWEVDLSRATLSPTST

SEQ ID NO: 125836 - protein, 25 aa, Mycobacterium avium
EILRAPLVKAFLLQVSAKTLGEFGF

SEQ ID NO: 125837 - protein, 26 aa, Mycobacterium avium
EIMTELEIAPTRRLRGLGDRQRKALL

SEQ ID NO: 125838 - protein, 20 aa, Mycobacterium avium
EINEAFAVQVLAVLSGWGIK

SEQ ID NO: 125839 - protein, 25 aa, Mycobacterium avium
EINGYPRLLCMTRMSTFAEDEVVTV

SEQ ID NO: 125840 - protein, 22 aa, Mycobacterium avium
EIPGTIVSVLRAAATAVAQCAR

SEQ ID NO: 125841 - protein, 23 aa, Mycobacterium avium
EIPGTIVSVLRAAATAVAQCARA

SEQ ID NO: 125842 - protein, 23 aa, Mycobacterium avium
EIPGTWLCRNGMEGTLIEGDLPE

SEQ ID NO: 125843 - protein, 18 aa, Mycobacterium avium
EIPLRAVLLRCGAEEHLL

SEQ ID NO: 125844 - protein, 30 aa, Mycobacterium avium
EIRRFVECTGIPFLPMSMAKGLIPDAHPQS

SEQ ID NO: 125845 - protein, 30 aa, Mycobacterium avium
EIRRFVECTGIPFLPMSMAKGLLPDAHPQS

SEQ ID NO: 125846 - protein, 17 aa, Mycobacterium avium
EITPVPLDAADPASLRS

SEQ ID NO: 125847 - protein, 27 aa, Mycobacterium avium
EIVDLAVAFRIPVAPIATPEILPKLDH

SEQ ID NO: 125848 - protein, 17 aa, Mycobacterium avium
EIVGMRLGHRILIPARE

SEQ ID NO: 125849 - protein, 18 aa, Mycobacterium avium
EIVPRRPVIRPVPVDDSG

SEQ ID NO: 125850 - protein, 37 aa, Mycobacterium avium
EIVRQLRLRDIGGIVVIDFIDMVLESNRDLVLRRLTE

SEQ ID NO: 125851 - protein, 19 aa, Mycobacterium avium
EIWSIGDPRIDVGWFLINC

SEQ ID NO: 125852 - protein, 20 aa, Mycobacterium avium
EIYLNTFRHLYGLDCSHIAP

SEQ ID NO: 125853 - protein, 26 aa, Mycobacterium avium
EKAYDAEPFIYLMPEGQLPRTGAVIG

SEQ ID NO: 125854 - protein, 26 aa, Mycobacterium avium
EKDARGWLSLRQAEIIRKAWVPPEAD

SEQ ID NO: 125855 - protein, 28 aa, Mycobacterium avium
EKGLRRWRAVARSAARQSRRAHIPLVDG

SEQ ID NO: 125856 - protein, 30 aa, Mycobacterium avium
EKLTDEAIIAFLRLLLPGGLETTYRSSGNL

SEQ ID NO: 125857 - protein, 25 aa, Mycobacterium avium
EKQVDPEGKLPPALRAKMAENARAA

SEQ ID NO: 125858 - protein, 27 aa, Mycobacterium avium
EKRFELAAGEFLLFPTVAHSHAQRVRP

SEQ ID NO: 125859 - protein, 19 aa, Mycobacterium avium
EKTRLALAGLVASTANVLL

SEQ ID NO: 125860 - protein, 25 aa, Mycobacterium avium
EKTTLSWEFPFGFLDQGLSSPIRMP

SEQ ID NO: 125861 - protein, 32 aa, Mycobacterium avium
EKVDDPLAMYLFDLCTLPLNLAGNCGMSVPSG

SEQ ID NO: 125862 - protein, 20 aa, Mycobacterium avium
ELAAGRLPRWWDGLVANGFH

SEQ ID NO: 125863 - protein, 24 aa, Mycobacterium avium
ELAARFARPLRFGTAGLRGPVRAG

SEQ ID NO: 125864 - protein, 25 aa, Mycobacterium avium
ELAGFGYAVLLPDVYYRSGEWAPFD

SEQ ID NO: 125865 - protein, 27 aa, Mycobacterium avium
ELAGRWRRALQLDPLAPGVLARLILAA

SEQ ID NO: 125866 - protein, 31 aa, Mycobacterium avium
ELAGYKQPRRFVFWREFPLGPAGKILKREIA

SEQ ID NO: 125867 - protein, 23 aa, Mycobacterium avium
ELAIELQRRGCAIARVVLLDAQP

SEQ ID NO: 125868 - protein, 18 aa, Mycobacterium avium
ELALCQLVGPLVFARMTG

SEQ ID NO: 125869 - protein, 19 aa, Mycobacterium avium
ELAQKTVMAGIPVLAAVSA

SEQ ID NO: 125870 - protein, 30 aa, Mycobacterium avium
ELATRCAALGRFAFLLSAAPPRIGSLTGVP

SEQ ID NO: 125871 - protein, 19 aa, Mycobacterium avium
ELAVLVPELLLIGQMMDRS

SEQ ID NO: 125872 - protein, 17 aa, Mycobacterium avium
ELCAAAQFRPRVAPASA

SEQ ID NO: 125873 - protein, 31 aa, Mycobacterium avium
ELDDRTILGFTKRDTLKLTGAKLGRDQWVRD

SEQ ID NO: 125874 - protein, 19 aa, Mycobacterium avium
ELDLVLTPQGTLAEKLRAG

SEQ ID NO: 125875 - protein, 27 aa, Mycobacterium avium
ELDRRNLLRRIGGAPYLHTLISTVPTA

SEQ ID NO: 125876 - protein, 19 aa, Mycobacterium avium
ELEAPDYFRVPKRGKVEIV

SEQ ID NO: 125877 - protein, 21 aa, Mycobacterium avium
ELEGRMYACFAAGAMAAGCEY

SEQ ID NO: 125878 - protein, 25 aa, Mycobacterium avium
ELEKRRAHVPWVTWGTTAMVARSVT

SEQ ID NO: 125879 - protein, 24 aa, Mycobacterium avium
ELERRGWRIIRVSADLLRNRPDVL

SEQ ID NO: 125880 - protein, 25 aa, Mycobacterium avium
ELESTRPDCVLLDLHLPDASGIDAL

SEQ ID NO: 125881 - protein, 20 aa, Mycobacterium avium
ELFAGILAQVPFVDPLTTIL

SEQ ID NO: 125882 - protein, 23 aa, Mycobacterium avium
ELFDRLYEEWSSLERFQRTRGVL

SEQ ID NO: 125883 - protein, 29 aa, Mycobacterium avium
ELFERSAGNLLLLRGFLTAGVESGALVHT

SEQ ID NO: 125884 - protein, 27 aa, Mycobacterium avium
ELGDYRQLDPWRQTLIALGTWEARGLL

SEQ ID NO: 125885 - protein, 31 aa, Mycobacterium avium
ELGEHLPVFRPPLDMARLFGQPRLGACEDGV

SEQ ID NO: 125886 - protein, 20 aa, Mycobacterium avium
ELGLLIGIVPGRPRGCGLLH

SEQ ID NO: 125887 - protein, 18 aa, Mycobacterium avium
ELGLLKRRPYREPGQRSR

SEQ ID NO: 125888 - protein, 22 aa, Mycobacterium avium
ELGLSYLLPRAIGSSRAFEIML

SEQ ID NO: 125889 - protein, 24 aa, Mycobacterium avium
ELGQPLPLLIKWDDAEYGLRAGEH

SEQ ID NO: 125890 - protein, 31 aa, Mycobacterium avium
ELGRALAPVPFVASAVLATGLLLATRESDPD

SEQ ID NO: 125891 - protein, 18 aa, Mycobacterium avium
ELGWRPRIALKDGIDATV

SEQ ID NO: 125892 - protein, 19 aa, Mycobacterium avium
ELGWRPRIALKEGIDATVS

SEQ ID NO: 125893 - protein, 25 aa, Mycobacterium avium
ELHRRLLSVLMDPAWTPGVAAAVDA

SEQ ID NO: 125894 - protein, 18 aa, Mycobacterium avium
ELIARIRAVLRRGGDDDS

SEQ ID NO: 125895 - protein, 21 aa, Mycobacterium avium
ELICYAINHTPVCVGPGYADG

SEQ ID NO: 125896 - protein, 20 aa, Mycobacterium avium
ELIEQYAVALWELTHRKEAE

SEQ ID NO: 125897 - protein, 19 aa, Mycobacterium avium
ELIGTGLGWRRLDVVEQTG

SEQ ID NO: 125898 - protein, 20 aa, Mycobacterium avium
ELLADVVNRVWFLDAVRGEV

SEQ ID NO: 125899 - protein, 19 aa, Mycobacterium avium
ELLAEQLALLLDGASVRTR

SEQ ID NO: 125900 - protein, 19 aa, Mycobacterium avium
ELLARRLPGSIVSISSISG

SEQ ID NO: 125901 - protein, 35 aa, Mycobacterium avium
ELLAVPPHGWINLHFSLLPAWRGAAPVQAAIAAGD

SEQ ID NO: 125902 - protein, 22 aa, Mycobacterium avium
ELLCRIILQGLASRPPSDTALD

SEQ ID NO: 125903 - protein, 21 aa, Mycobacterium avium
ELLEDFQQFGYYLVHNPALAF

SEQ ID NO: 125904 - protein, 27 aa, Mycobacterium avium
ELLGPKAHKVWKPVIAALHGIVAGGAM

SEQ ID NO: 125905 - protein, 17 aa, Mycobacterium avium
ELLQPIRRMAHGCASSA

SEQ ID NO: 125906 - protein, 18 aa, Mycobacterium avium
ELLQPIRRMAHGCASSAW

SEQ ID NO: 125907 - protein, 17 aa, Mycobacterium avium
ELLQPIRRMAQGCASSA

SEQ ID NO: 125908 - protein, 17 aa, Mycobacterium avium
ELLVGGGFRDVSISGLF

SEQ ID NO: 125909 - protein, 18 aa, Mycobacterium avium
ELLVGGGFRDVSISGLFH

SEQ ID NO: 125910 - protein, 33 aa, Mycobacterium avium
ELMDTALIVDEPFLLPAHIDLAALRVKFDGGTL

SEQ ID NO: 125911 - protein, 18 aa, Mycobacterium avium
ELMLARKANRHFSFGIGV

SEQ ID NO: 125912 - protein, 20 aa, Mycobacterium avium
ELMRRFNGAALEVMLNRLNL

SEQ ID NO: 125913 - protein, 18 aa, Mycobacterium avium
ELMTLYRAGGDRSALPAA

SEQ ID NO: 125914 - protein, 21 aa, Mycobacterium avium
ELNAIPAVMAAPVGLLSTLDL

SEQ ID NO: 125915 - protein, 26 aa, Mycobacterium avium
ELNVPRRDLRMLAARLGSDVPFALHG

SEQ ID NO: 125916 - protein, 30 aa, Mycobacterium avium
ELPDREFLVPPYTLGAWLGDGTSAAAQITA

SEQ ID NO: 125917 - protein, 37 aa, Mycobacterium avium
ELPFLHKELYREYALRPPKGVLLYGPPGCGKTLIAKA

SEQ ID NO: 125918 - protein, 24 aa, Mycobacterium avium
ELPGESPRLFVLTRNAAVVVAGDA

SEQ ID NO: 125919 - protein, 25 aa, Mycobacterium avium
ELPGLGHPLLPPWTVVDSGAHGVTM

SEQ ID NO: 125920 - protein, 20 aa, Mycobacterium avium
ELPGLYDYPDRHAGTWVRAN

SEQ ID NO: 125921 - protein, 17 aa, Mycobacterium avium
ELPNGRYGWRVCLPAMM

SEQ ID NO: 125922 - protein, 30 aa, Mycobacterium avium
ELPTYAFARERFWLGGASLAGAPAGAAPVG

SEQ ID NO: 125923 - protein, 22 aa, Mycobacterium avium
ELPTYAFDRRRFWLSGEGAAAD

SEQ ID NO: 125924 - protein, 18 aa, Mycobacterium avium
ELPVGRGAALEGHRRRLR

SEQ ID NO: 125925 - protein, 25 aa, Mycobacterium avium
ELQAYDEFFFPGLAAEWAHCEVRRP

SEQ ID NO: 125926 - protein, 25 aa, Mycobacterium avium
ELQAYDEFFFPGLAAEWAQCEVRRP

SEQ ID NO: 125927 - protein, 25 aa, Mycobacterium avium
ELQAYDEFFFPGLAAEWAQCGVRRP

SEQ ID NO: 125928 - protein, 26 aa, Mycobacterium avium
ELQRAAAGGLLLPVGVRRLRNYHSTR

SEQ ID NO: 125929 - protein, 26 aa, Mycobacterium avium
ELQRRGCAIARLVLLDAQPGLDGSVT

SEQ ID NO: 125930 - protein, 20 aa, Mycobacterium avium
ELQVTPRRPGSDRWIAVVAE

SEQ ID NO: 125931 - protein, 20 aa, Mycobacterium avium
ELRAAWVDIPEVFSAATVTG

SEQ ID NO: 125932 - protein, 17 aa, Mycobacterium avium
ELRAIFVHSLRSVVQGA

SEQ ID NO: 125933 - protein, 22 aa, Mycobacterium avium
ELRDRAFYAPAQSRYRVFIVDE

SEQ ID NO: 125934 - protein, 18 aa, Mycobacterium avium
ELRDWVGALVRPLTDHLS

SEQ ID NO: 125935 - protein, 19 aa, Mycobacterium avium
ELRDWVGALVRPLTDHLSA

SEQ ID NO: 125936 - protein, 17 aa, Mycobacterium avium
ELRIKPRFGHVPVDEIS

SEQ ID NO: 125937 - protein, 25 aa, Mycobacterium avium
ELRKAFGAIGIQYGPAFSGLAAVLV

SEQ ID NO: 125938 - protein, 19 aa, Mycobacterium avium
ELRKFIFTSTYATVGRRRG

SEQ ID NO: 125939 - protein, 41 aa, Mycobacterium avium
ELRLLAAHAPPYNRRSRFPQRWWWVALTDEAYPRLAVVRAP

SEQ ID NO: 125940 - protein, 26 aa, Mycobacterium avium
ELRLSDAWVWDMYRPARFVKQVRVVT

SEQ ID NO: 125941 - protein, 17 aa, Mycobacterium avium
ELRLTGAGVAALCDRRR

SEQ ID NO: 125942 - protein, 21 aa, Mycobacterium avium
ELRRHFAALAASLGENEQRIV

SEQ ID NO: 125943 - protein, 19 aa, Mycobacterium avium
ELRRIAALCAAFDVDGMRA

SEQ ID NO: 125944 - protein, 19 aa, Mycobacterium avium
ELRVPLHYYRDPKITEIEE

SEQ ID NO: 125945 - protein, 21 aa, Mycobacterium avium
ELSLPQAFRRAYATVLSQLPD

SEQ ID NO: 125946 - protein, 21 aa, Mycobacterium avium
ELSPELWRLSPDSFALAGAAG

SEQ ID NO: 125947 - protein, 22 aa, Mycobacterium avium
ELSPELWRLSPDSFALAGAAGA

SEQ ID NO: 125948 - protein, 20 aa, Mycobacterium avium
ELSRRRIYHSFNPQGVNIVA

SEQ ID NO: 125949 - protein, 23 aa, Mycobacterium avium
ELSSALWLKYNLLAERHTRGVQR

SEQ ID NO: 125950 - protein, 18 aa, Mycobacterium avium
ELTAGWLQHLTRANWKLL

SEQ ID NO: 125951 - protein, 25 aa, Mycobacterium avium
ELTLAYILGVLLIGSAGWQLLTECV

SEQ ID NO: 125952 - protein, 29 aa, Mycobacterium avium
ELTTPLPARLILRLLKFDESRHMDWVHWV

SEQ ID NO: 125953 - protein, 17 aa, Mycobacterium avium
ELVDRYGALPEPALRLV

SEQ ID NO: 125954 - protein, 17 aa, Mycobacterium avium
ELVDRYGPRIRACELDV

SEQ ID NO: 125955 - protein, 18 aa, Mycobacterium avium
ELVPVYPTCHYVMGGIPT

SEQ ID NO: 125956 - protein, 19 aa, Mycobacterium avium
ELVPVYPTCHYVMGGIPTT

SEQ ID NO: 125957 - protein, 23 aa, Mycobacterium avium
ELVRVCRPGGRIGLISWTPEGFF

SEQ ID NO: 125958 - protein, 22 aa, Mycobacterium avium
ELWFAHDYVPYDRGENFAFLGG

SEQ ID NO: 125959 - protein, 31 aa, Mycobacterium avium
ELYDPFSIVTLVLLDEYRLTGDIPAGAFVRD

SEQ ID NO: 125960 - protein, 27 aa, Mycobacterium avium
ELYDPFSIVTLVLLEEYRLTGDVPAGA

SEQ ID NO: 125961 - protein, 19 aa, Mycobacterium avium
EMCPRIMAMTVREGKVCAL

SEQ ID NO: 125962 - protein, 36 aa, Mycobacterium avium
EMDKVDRPYYFFGVLAKLAVLPRFTPMLLPDTGRTN

SEQ ID NO: 125963 - protein, 24 aa, Mycobacterium avium
EMIAEKWGFDRAALDEFSLASHEK

SEQ ID NO: 125964 - protein, 19 aa, Mycobacterium avium
EMLPVDDDAVRMWARLRIH

SEQ ID NO: 125965 - protein, 23 aa, Mycobacterium avium
EMPNPVASIYKTRDGRFIAFVLL

SEQ ID NO: 125966 - protein, 23 aa, Mycobacterium avium
EMPNPVASIYKTRDNRFIAFVLL

SEQ ID NO: 125967 - protein, 19 aa, Mycobacterium avium
EMQVAFATLARRLPGLRLA

SEQ ID NO: 125968 - protein, 23 aa, Mycobacterium avium
EMSEVLLPRRGTLVAWTTQGFPP

SEQ ID NO: 125969 - protein, 25 aa, Mycobacterium avium
EMVRRTMVFLTTPAAKAALPGLIGE

SEQ ID NO: 125970 - protein, 24 aa, Mycobacterium avium
EMVRRTMVFLTTPAARAALPGLIG

SEQ ID NO: 125971 - protein, 28 aa, Mycobacterium avium
EMWFTEAHWPAFRRVDFLRALRDYSQRH

SEQ ID NO: 125972 - protein, 29 aa, Mycobacterium avium
EMWFTEAHWPAFRRVDFLRALRDYSQRHR

SEQ ID NO: 125973 - protein, 30 aa, Mycobacterium avium
EMWFTEAHWPAFRRVDFLRALRDYSQRHRR

SEQ ID NO: 125974 - protein, 25 aa, Mycobacterium avium
ENDMHLYLKRAHVFRHLFGEPTDVL

SEQ ID NO: 125975 - protein, 31 aa, Mycobacterium avium
ENEQWWDDVPYLFDAPWYVQVLDGGAEVARV

SEQ ID NO: 125976 - protein, 24 aa, Mycobacterium avium
ENHWTLYERALKAILNQMEIFTLL

SEQ ID NO: 125977 - protein, 20 aa, Mycobacterium avium
ENHWTLYERALKAILSQMEI

SEQ ID NO: 125978 - protein, 24 aa, Mycobacterium avium
ENHWTLYERALKAILSQMEIFTLL

SEQ ID NO: 125979 - protein, 21 aa, Mycobacterium avium
ENIKRQWWRSVVTAREDVVGL

SEQ ID NO: 125980 - protein, 21 aa, Mycobacterium avium
ENLEAFLRVMVYDQKLITDEL

SEQ ID NO: 125981 - protein, 20 aa, Mycobacterium avium
ENLHMIFYRDVSAAGLDIAP

SEQ ID NO: 125982 - protein, 21 aa, Mycobacterium avium
ENLIRPTGFFRNKASALIRLG

SEQ ID NO: 125983 - protein, 34 aa, Mycobacterium avium
ENNLTLPHPLAHLRAFVLIPWLAVDPDAQLTVAD

SEQ ID NO: 125984 - protein, 17 aa, Mycobacterium avium
ENPLISDPFARVFLDAA

SEQ ID NO: 125985 - protein, 21 aa, Mycobacterium avium
ENQVARMDLVWSLAERWTADG

SEQ ID NO: 125986 - protein, 18 aa, Mycobacterium avium
ENRALLAQLVATNIFGQN

SEQ ID NO: 125987 - protein, 19 aa, Mycobacterium avium
ENRSPIWRGMLRGGSGPLR

SEQ ID NO: 125988 - protein, 25 aa, Mycobacterium avium
EPAALVMISPLLQLAKKPKQAHPNI

SEQ ID NO: 125989 - protein, 21 aa, Mycobacterium avium
EPAESLPPPYDNRLAQPYGGY

SEQ ID NO: 125990 - protein, 21 aa, Mycobacterium avium
EPARVWPDVLAFTRSSDPAQT

SEQ ID NO: 125991 - protein, 25 aa, Mycobacterium avium
EPATSGRPVGLRPAGALGAEALRPQ

SEQ ID NO: 125992 - protein, 21 aa, Mycobacterium avium
EPAVWMRRLPEDGMLPAKLAG

SEQ ID NO: 125993 - protein, 27 aa, Mycobacterium avium
EPDDGFVTVIYRWARTADLAAALAAAD

SEQ ID NO: 125994 - protein, 18 aa, Mycobacterium avium
EPDGYYRRLWQADDEDRD

SEQ ID NO: 125995 - protein, 25 aa, Mycobacterium avium
EPDTQLPRHLFLKSQLSTVHDLPEA

SEQ ID NO: 125996 - protein, 21 aa, Mycobacterium avium
EPEMLRRALLYAIERKRAELI

SEQ ID NO: 125997 - protein, 28 aa, Mycobacterium avium
EPETPVAIKLFRGPRYVVAMLAVLKAGG

SEQ ID NO: 125998 - protein, 20 aa, Mycobacterium avium
EPGLVLLADLRRIHRLAAGV

SEQ ID NO: 125999 - protein, 25 aa, Mycobacterium avium
EPGVRQFERLLARALRKVTTKLAEQ

SEQ ID NO: 126000 - protein, 26 aa, Mycobacterium avium
EPGVRQFERLLARALRKVTTKLAEQP

SEQ ID NO: 126001 - protein, 20 aa, Mycobacterium avium
EPGWAPFTASGLAQWGPPAS

SEQ ID NO: 126002 - protein, 17 aa, Mycobacterium avium
EPIVPAHVLHRPKLGFP

SEQ ID NO: 126003 - protein, 30 aa, Mycobacterium avium
EPLANMGVIYWVYPNLILANSPVGLEIIDM

SEQ ID NO: 126004 - protein, 17 aa, Mycobacterium avium
EPLFGIPLTLMTTNMAD

SEQ ID NO: 126005 - protein, 36 aa, Mycobacterium avium
EPLGVVGVITPWNFPMPIASWGIAPALAAGNAVLVK

SEQ ID NO: 126006 - protein, 18 aa, Mycobacterium avium
EPMGVVGAITPWNFPFEI

SEQ ID NO: 126007 - protein, 17 aa, Mycobacterium avium
EPMGVVGAITPWNFPVE

SEQ ID NO: 126008 - protein, 21 aa, Mycobacterium avium
EPMLGTWQSIVLVDLNRDNPQ

SEQ ID NO: 126009 - protein, 25 aa, Mycobacterium avium
EPPNGPPPPARWSRRKPEAAARLEA

SEQ ID NO: 126010 - protein, 30 aa, Mycobacterium avium
EPPQGIYWSFSIGNPWWETIHYGRHQSSLN

SEQ ID NO: 126011 - protein, 24 aa, Mycobacterium avium
EPQRPILHGLLGDLDIGLLPGMSS

SEQ ID NO: 126012 - protein, 17 aa, Mycobacterium avium
EPRGVLAIAYRCPNGEP

SEQ ID NO: 126013 - protein, 23 aa, Mycobacterium avium
EPRHARFERFLSFGDVCEQIRRA

SEQ ID NO: 126014 - protein, 24 aa, Mycobacterium avium
EPRHARFERFLSFGDVCEQIRRAS

SEQ ID NO: 126015 - protein, 19 aa, Mycobacterium avium
EPRLPYASLKAAVATFTRG

SEQ ID NO: 126016 - protein, 17 aa, Mycobacterium avium
EPSAEVDVWFVGKKGGA

SEQ ID NO: 126017 - protein, 24 aa, Mycobacterium avium
EPSVRFNPVLLKPGSDRTSQLVIK

SEQ ID NO: 126018 - protein, 29 aa, Mycobacterium avium
EPTRRVRLMRWGLVPPWAKAGPDGAPETK

SEQ ID NO: 126019 - protein, 29 aa, Mycobacterium avium
EPTRRVRLMRWGLVPPWAKAGPGGAPETK

SEQ ID NO: 126020 - protein, 29 aa, Mycobacterium avium
EPTRRVRLMRWGLVPPWAKAGRDGAPETK

SEQ ID NO: 126021 - protein, 28 aa, Mycobacterium avium
EPTTEYHEWTWRTTLLPRIAPTARDEES

SEQ ID NO: 126022 - protein, 24 aa, Mycobacterium avium
EPVDTALPALPYKGAANASAGRRG

SEQ ID NO: 126023 - protein, 18 aa, Mycobacterium avium
EPVGVVGAIVPWNFPFEV

SEQ ID NO: 126024 - protein, 25 aa, Mycobacterium avium
EPVVLLHGFLMSQTVWDPVAPRLAD

SEQ ID NO: 126025 - protein, 27 aa, Mycobacterium avium
EPWERHPLMLRSYFQARSGPGGKRLIR

SEQ ID NO: 126026 - protein, 23 aa, Mycobacterium avium
EPWRVEALVLVAFSAYARGDGPL

SEQ ID NO: 126027 - protein, 17 aa, Mycobacterium avium
EQCRLRPVTFDEVDFTL

SEQ ID NO: 126028 - protein, 18 aa, Mycobacterium avium
EQCRLRPVTFDEVDFTLA

SEQ ID NO: 126029 - protein, 24 aa, Mycobacterium avium
EQHGPELAVLLDDSLRRLEASHSA

SEQ ID NO: 126030 - protein, 23 aa, Mycobacterium avium
EQHSLWPAFADIPAGWQMVYGEA

SEQ ID NO: 126031 - protein, 25 aa, Mycobacterium avium
EQIERLMWPSLEGDIRWCQLFSEPG

SEQ ID NO: 126032 - protein, 23 aa, Mycobacterium avium
EQIPALLGILSVGAVYLPIGVDQ

SEQ ID NO: 126033 - protein, 22 aa, Mycobacterium avium
EQKNIVLQRFPGAKYDSPTTRS

SEQ ID NO: 126034 - protein, 34 aa, Mycobacterium avium
EQKQRFLPPTFRGEMIWCQLFSEPGAGSDLAGLS

SEQ ID NO: 126035 - protein, 23 aa, Mycobacterium avium
EQLSFLFGGVIYDLGGTLLGLRP

SEQ ID NO: 126036 - protein, 18 aa, Mycobacterium avium
EQLWQFCLTALGGTARKS

SEQ ID NO: 126037 - protein, 19 aa, Mycobacterium avium
EQMAALLMAILVRGMDGGE

SEQ ID NO: 126038 - protein, 21 aa, Mycobacterium avium
EQPKHKGITYFLLDMHQPGVE

SEQ ID NO: 126039 - protein, 25 aa, Mycobacterium avium
EQQHPLVMRLSVPGRHMALNAMGAL

SEQ ID NO: 126040 - protein, 24 aa, Mycobacterium avium
EQQIYSQTLRTQWTLFAAHNQGHT

SEQ ID NO: 126041 - protein, 22 aa, Mycobacterium avium
EQRERWLPRLVSGDVVAGIGTN

SEQ ID NO: 126042 - protein, 17 aa, Mycobacterium avium
EQRLGDEKGVIGNSLQL

SEQ ID NO: 126043 - protein, 24 aa, Mycobacterium avium
EQRRIIDDQLALVLWDEVQVHAAA

SEQ ID NO: 126044 - protein, 37 aa, Mycobacterium avium
EQTVAVNLLGPIRLIATLLPALLRRPHAAILNVTSGL

SEQ ID NO: 126045 - protein, 34 aa, Mycobacterium avium
EQVDRLIWPSLEGELRWCQLFSEPGAGSDAAAVA

SEQ ID NO: 126046 - protein, 24 aa, Mycobacterium avium
ERAAQIAQAVFDKGAPASGFMTDG

SEQ ID NO: 126047 - protein, 17 aa, Mycobacterium avium
ERAPGTRVLYVSPLKAL

SEQ ID NO: 126048 - protein, 23 aa, Mycobacterium avium
ERATKILGLLTAAAKSYSATIRL

SEQ ID NO: 126049 - protein, 26 aa, Mycobacterium avium
ERAVKLWQHWDRCALHWFPGSHVLHI

SEQ ID NO: 126050 - protein, 25 aa, Mycobacterium avium
ERDVGQIPLLGFGAGHIQDVRRLVD

SEQ ID NO: 126051 - protein, 24 aa, Mycobacterium avium
ERELSALRRSPVADFPRLGGPAGG

SEQ ID NO: 126052 - protein, 27 aa, Mycobacterium avium
EREPLPGFLPSLWEIMPDLSVYIEAVH

SEQ ID NO: 126053 - protein, 24 aa, Mycobacterium avium
ERERLHKLIERLVVWENIQDGKLL

SEQ ID NO: 126054 - protein, 24 aa, Mycobacterium avium
ERFEQAAGAVLRWGMQRGSGLRVQ

SEQ ID NO: 126055 - protein, 17 aa, Mycobacterium avium
ERFGVSRPTLREAFRVL

SEQ ID NO: 126056 - protein, 19 aa, Mycobacterium avium
ERFSPFSGFGYFAGGLSGF

SEQ ID NO: 126057 - protein, 17 aa, Mycobacterium avium
ERFVVFARALDEAVAVV

SEQ ID NO: 126058 - protein, 21 aa, Mycobacterium avium
ERGIAGLMLESFLVAGAQSLS

SEQ ID NO: 126059 - protein, 24 aa, Mycobacterium avium
ERGMRTVMCILNGQLRPVVVRDRS

SEQ ID NO: 126060 - protein, 27 aa, Mycobacterium avium
ERGPEMLSFVLKHTPLKMCWVPRYSDY

SEQ ID NO: 126061 - protein, 27 aa, Mycobacterium avium
ERGSNGLYQLILDYPLRGGKALRPALS

SEQ ID NO: 126062 - protein, 20 aa, Mycobacterium avium
ERGTLNLSHVDYLVLDEADE

SEQ ID NO: 126063 - protein, 24 aa, Mycobacterium avium
ERHAIIARLAAAGVTWLTIAPSGS

SEQ ID NO: 126064 - protein, 26 aa, Mycobacterium avium
ERHERLAEAIALIRQLWSGSRISFSG

SEQ ID NO: 126065 - protein, 27 aa, Mycobacterium avium
ERHRMGYLQMMSTVLGRRVWENAGSPE

SEQ ID NO: 126066 - protein, 34 aa, Mycobacterium avium
ERISVPYFFNPRLDARIPVLSLPPELRARAGERW

SEQ ID NO: 126067 - protein, 18 aa, Mycobacterium avium
ERIVAAPVTFVDIAGLVK

SEQ ID NO: 126068 - protein, 19 aa, Mycobacterium avium
ERIVAAPVTFVDIAGLVKG

SEQ ID NO: 126069 - protein, 18 aa, Mycobacterium avium
ERKGYLRRDPNRPRAVDV

SEQ ID NO: 126070 - protein, 24 aa, Mycobacterium avium
ERLAGETVPLGAPLPASVVAAAIR

SEQ ID NO: 126071 - protein, 31 aa, Mycobacterium avium
ERLARLRDLGCDYVICYFPEAAYDRSGIELF

SEQ ID NO: 126072 - protein, 17 aa, Mycobacterium avium
ERLKIVMRVYFEKPRTT

SEQ ID NO: 126073 - protein, 21 aa, Mycobacterium avium
ERNESIYIWHDVARRAPMWEV

SEQ ID NO: 126074 - protein, 22 aa, Mycobacterium avium
ERPGTFWTATAPTRACCTTATR

SEQ ID NO: 126075 - protein, 24 aa, Mycobacterium avium
ERPLSEFCWPSWPHLAWGQERQSA

SEQ ID NO: 126076 - protein, 25 aa, Mycobacterium avium
ERPVREWCEMWLSAQPVRAPATERK

SEQ ID NO: 126077 - protein, 31 aa, Mycobacterium avium
ERQHRIADVLPLTPLQQGLLFHANTTRGGDD

SEQ ID NO: 126078 - protein, 21 aa, Mycobacterium avium
ERQRMALAPYPAEAQSVVQRA

SEQ ID NO: 126079 - protein, 24 aa, Mycobacterium avium
ERQYRDMRILGIGGGTTEILTALS

SEQ ID NO: 126080 - protein, 24 aa, Mycobacterium avium
ERQYRGMRILGIGGGTTEILTALS

SEQ ID NO: 126081 - protein, 26 aa, Mycobacterium avium
ERRDSALLLMGFAGAFRRSELSGLTG

SEQ ID NO: 126082 - protein, 33 aa, Mycobacterium avium
ERRVPPRWWPPVMKKFVWPWVAGRRQVVVNSFP

SEQ ID NO: 126083 - protein, 18 aa, Mycobacterium avium
ERSAIVIPLIADGAVLGV

SEQ ID NO: 126084 - protein, 19 aa, Mycobacterium avium
ERSALTTALLRSAGAGPAV

SEQ ID NO: 126085 - protein, 21 aa, Mycobacterium avium
ERSDGSWSGWVEPLADAIRLD

SEQ ID NO: 126086 - protein, 32 aa, Mycobacterium avium
ERSPFGEVWSFPPPEHPLSKLGQHVFWCDSAS

SEQ ID NO: 126087 - protein, 24 aa, Mycobacterium avium
ERSQDIWTVIITGAGRALCVGADV

SEQ ID NO: 126088 - protein, 24 aa, Mycobacterium avium
ERTAQIVWGARALGGPVPIPADVN

SEQ ID NO: 126089 - protein, 30 aa, Mycobacterium avium
ERTMLQEWHYFFQNNLRWRNLRKITIAQVH

SEQ ID NO: 126090 - protein, 33 aa, Mycobacterium avium
ERVDILHDLYRRWPFFRSVLSNLAQVLAKSDLG

SEQ ID NO: 126091 - protein, 17 aa, Mycobacterium avium
ERVQTGIWDIPAGYLPA

SEQ ID NO: 126092 - protein, 29 aa, Mycobacterium avium
ERVRAAEPLGFDLKLWKALLETGAVEMAV

SEQ ID NO: 126093 - protein, 20 aa, Mycobacterium avium
ERVWLSWAMANRDPSLFDNP

SEQ ID NO: 126094 - protein, 19 aa, Mycobacterium avium
ERYERDLGALPPELVRGPV

SEQ ID NO: 126095 - protein, 23 aa, Mycobacterium avium
ERYGVPAHQLLHRAGQRKLIGGQ

SEQ ID NO: 126096 - protein, 23 aa, Mycobacterium avium
ERYRFSVTLPRTVPGRGAGIVER

SEQ ID NO: 126097 - protein, 24 aa, Mycobacterium avium
ESAAVRLPTPRLVVEPGRAIAGPG

SEQ ID NO: 126098 - protein, 24 aa, Mycobacterium avium
ESAHWLTEHKPLLDAVTVGVGAMG

SEQ ID NO: 126099 - protein, 23 aa, Mycobacterium avium
ESAQNLTYYCRWHHRGPGGVHCA

SEQ ID NO: 126100 - protein, 20 aa, Mycobacterium avium
ESAWLAALTGAGLAPADCAA

SEQ ID NO: 126101 - protein, 22 aa, Mycobacterium avium
ESDLRVCGRGFRALATAPEVAA

SEQ ID NO: 126102 - protein, 24 aa, Mycobacterium avium
ESDNLAVKGIYWARRDAEPRHRRI

SEQ ID NO: 126103 - protein, 17 aa, Mycobacterium avium
ESELLALVATRQPQNAI

SEQ ID NO: 126104 - protein, 18 aa, Mycobacterium avium
ESELMERFGVSRPTLREA

SEQ ID NO: 126105 - protein, 23 aa, Mycobacterium avium
ESFTLVYDVLVSRAGQNVAALPT

SEQ ID NO: 126106 - protein, 27 aa, Mycobacterium avium
ESIGVRSICYLPLTYDHRLIDGADAGR

SEQ ID NO: 126107 - protein, 27 aa, Mycobacterium avium
ESIGVRSVCYLPLTYDHRLIDGADAGR

SEQ ID NO: 126108 - protein, 29 aa, Mycobacterium avium
ESLDDLLPEALRWPGRRPGGCSTSARSTC

SEQ ID NO: 126109 - protein, 26 aa, Mycobacterium avium
ESLFDSVMYVLTFLEGCSGPSALGFE

SEQ ID NO: 126110 - protein, 23 aa, Mycobacterium avium
ESLHPHGYWQRSPRLPGVDASLL

SEQ ID NO: 126111 - protein, 18 aa, Mycobacterium avium
ESLKFPLGHSDLIQPHMF

SEQ ID NO: 126112 - protein, 25 aa, Mycobacterium avium
ESLLAMPRWLAESVRVPRGSVAVLS

SEQ ID NO: 126113 - protein, 26 aa, Mycobacterium avium
ESPEVYQFVVLFPSPEQASAFLSASS

SEQ ID NO: 126114 - protein, 19 aa, Mycobacterium avium
ESPSPRRLAAGAVVRSRNV

SEQ ID NO: 126115 - protein, 19 aa, Mycobacterium avium
ESPWARRAFDLRCGPLRDQ

SEQ ID NO: 126116 - protein, 27 aa, Mycobacterium avium
ESQLQIHLVGAFRLASAVLPGMLERQR

SEQ ID NO: 126117 - protein, 23 aa, Mycobacterium avium
ESRAQMATLPRLKPRVFYDLVVE

SEQ ID NO: 126118 - protein, 28 aa, Mycobacterium avium
ESRDVTGAVLWLAGPRSRYVTGVAIPVD

SEQ ID NO: 126119 - protein, 26 aa, Mycobacterium avium
ESRIALERLLDFMPRYDVDWAGCRRV

SEQ ID NO: 126120 - protein, 26 aa, Mycobacterium avium
ESSAAVVDWLRPFIDELRVCLHGCGV

SEQ ID NO: 126121 - protein, 20 aa, Mycobacterium avium
ESTWDRRPGWFAKVAGRATG

SEQ ID NO: 126122 - protein, 29 aa, Mycobacterium avium
ESVQTTLEALWWDRPFTLNGVDIGASVAT

SEQ ID NO: 126123 - protein, 22 aa, Mycobacterium avium
ESVQWLEQHLAAYAGAVLAVTH

SEQ ID NO: 126124 - protein, 33 aa, Mycobacterium avium
ETAFANWKALGARFFALRPATQLRWTGHDDPDV

SEQ ID NO: 126125 - protein, 25 aa, Mycobacterium avium
ETAGMLEPLRMYAHIPRLLNAYGKL

SEQ ID NO: 126126 - protein, 31 aa, Mycobacterium avium
ETALETHTALIRLRWAFAAAVYHGEAPAITK

SEQ ID NO: 126127 - protein, 25 aa, Mycobacterium avium
ETALTGLLGVRKWVRIPDVHFAANA

SEQ ID NO: 126128 - protein, 39 aa, Mycobacterium avium
ETAYAMTVPPPLVAANRIRLLALIQTNIFGQNTPAIMAT

SEQ ID NO: 126129 - protein, 18 aa, Mycobacterium avium
ETESLQNSLCGLQGKHHA

SEQ ID NO: 126130 - protein, 26 aa, Mycobacterium avium
ETFDLATQIPLRATLFRIGEDEHVLV

SEQ ID NO: 126131 - protein, 18 aa, Mycobacterium avium
ETFLVNELGYAWDEVHDE

SEQ ID NO: 126132 - protein, 30 aa, Mycobacterium avium
ETFRFRGHYFADRMPYIPADQLQAALAADP

SEQ ID NO: 126133 - protein, 25 aa, Mycobacterium avium
ETGQDLLLITVLKGAVIFVTDLARA

SEQ ID NO: 126134 - protein, 19 aa, Mycobacterium avium
ETHSSWVILAGPYAYKLKK

SEQ ID NO: 126135 - protein, 17 aa, Mycobacterium avium
ETLARQFAVPGTPGLEH

SEQ ID NO: 126136 - protein, 27 aa, Mycobacterium avium
ETLARVIDYTLAINKYPIVVNDGRGFF

SEQ ID NO: 126137 - protein, 22 aa, Mycobacterium avium
ETLDYVKQWHAFGAPIAAFQNS

SEQ ID NO: 126138 - protein, 18 aa, Mycobacterium avium
ETQWIPPPHLDRNQPRTN

SEQ ID NO: 126139 - protein, 19 aa, Mycobacterium avium
ETQWLPPPHLDRNQPRTNT

SEQ ID NO: 126140 - protein, 23 aa, Mycobacterium avium
ETRMNELMPLGLRLIEEGFALYD

SEQ ID NO: 126141 - protein, 18 aa, Mycobacterium avium
ETSLIMVKSYAAMGGLHG

SEQ ID NO: 126142 - protein, 28 aa, Mycobacterium avium
ETVLRLKARLWFVHRGLEQLFHGRIASG

SEQ ID NO: 126143 - protein, 25 aa, Mycobacterium avium
ETVRRAAPFATLPRSIYEATLDLLS

SEQ ID NO: 126144 - protein, 19 aa, Mycobacterium avium
ETVVPLLPAQDFKRVGDAD

SEQ ID NO: 126145 - protein, 18 aa, Mycobacterium avium
ETWKRLCDPMAQQISTVW

SEQ ID NO: 126146 - protein, 26 aa, Mycobacterium avium
EVAAKRIAWMKLLNAGQTCVVPDYVL

SEQ ID NO: 126147 - protein, 19 aa, Mycobacterium avium
EVAALLGCAVLTGGGAVLN

SEQ ID NO: 126148 - protein, 30 aa, Mycobacterium avium
EVAAVFPIQVFLTLFGLPLDMRDQFIEWKD

SEQ ID NO: 126149 - protein, 17 aa, Mycobacterium avium
EVAPWFHQPGGGQQYRI

SEQ ID NO: 126150 - protein, 18 aa, Mycobacterium avium
EVARLLAGIAPRSAAAAG

SEQ ID NO: 126151 - protein, 23 aa, Mycobacterium avium
EVARRLWDSWEDDAVIRDVVTGR

SEQ ID NO: 126152 - protein, 34 aa, Mycobacterium avium
EVAWRAYNHPRRLHWYVPRSIRLIDVFKGLSPEF

SEQ ID NO: 126153 - protein, 17 aa, Mycobacterium avium
EVAWVPMRELPSRLAYA

SEQ ID NO: 126154 - protein, 17 aa, Mycobacterium avium
EVDGHHVFWTVHARNKR

SEQ ID NO: 126155 - protein, 19 aa, Mycobacterium avium
EVEAAMAVPPWVQGALHTD

SEQ ID NO: 126156 - protein, 18 aa, Mycobacterium avium
EVEAAMAVPPWVQGALRN

SEQ ID NO: 126157 - protein, 17 aa, Mycobacterium avium
EVEALLCREARDGVQKL

SEQ ID NO: 126158 - protein, 23 aa, Mycobacterium avium
EVEREFRRYFMTGPVLEDWHAWA

SEQ ID NO: 126159 - protein, 18 aa, Mycobacterium avium
EVESFLDAVEKLPRWRLD

SEQ ID NO: 126160 - protein, 26 aa, Mycobacterium avium
EVESLWAVLARTLPEPWRVEALVLVA

SEQ ID NO: 126161 - protein, 17 aa, Mycobacterium avium
EVFGPVLSITPYDGGDD

SEQ ID NO: 126162 - protein, 26 aa, Mycobacterium avium
EVGIGFCFAPLFHPSYRHTSAVRREI

SEQ ID NO: 126163 - protein, 19 aa, Mycobacterium avium
EVHLGSWRPGLSYRQLARE

SEQ ID NO: 126164 - protein, 20 aa, Mycobacterium avium
EVIPMHYFGRDLVAFRQLDG

SEQ ID NO: 126165 - protein, 18 aa, Mycobacterium avium
EVIRILQRYKDLQDIIAI

SEQ ID NO: 126166 - protein, 18 aa, Mycobacterium avium
EVIVFPLTPPQPTPIPRT

SEQ ID NO: 126167 - protein, 25 aa, Mycobacterium avium
EVKAMYPLGPIFHGSGLNITAMSLR

SEQ ID NO: 126168 - protein, 23 aa, Mycobacterium avium
EVKVGIQILESLNLRPRSLEIVS

SEQ ID NO: 126169 - protein, 20 aa, Mycobacterium avium
EVLDGLEKPSLGLGNWVVPT

SEQ ID NO: 126170 - protein, 17 aa, Mycobacterium avium
EVLLTGIIVNKEGKRFV

SEQ ID NO: 126171 - protein, 18 aa, Mycobacterium avium
EVLRMRFFESMTQSQIAE

SEQ ID NO: 126172 - protein, 19 aa, Mycobacterium avium
EVLVCKMVDPGWTALVSLA

SEQ ID NO: 126173 - protein, 19 aa, Mycobacterium avium
EVLVPFVSAIVTAVSLDDG

SEQ ID NO: 126174 - protein, 19 aa, Mycobacterium avium
EVLVPFVSAIVTAVSLEDG

SEQ ID NO: 126175 - protein, 20 aa, Mycobacterium avium
EVLWTAMPLFHLSAAPSVLA

SEQ ID NO: 126176 - protein, 23 aa, Mycobacterium avium
EVNLLHDHLVDVLLDAAAMGRVH

SEQ ID NO: 126177 - protein, 18 aa, Mycobacterium avium
EVNSTRMYTGAGAAPMMA

SEQ ID NO: 126178 - protein, 23 aa, Mycobacterium avium
EVNVFERLPTPFGLVRFGVAPDH

SEQ ID NO: 126179 - protein, 22 aa, Mycobacterium avium
EVPARIFVVDELPRGAALKVDR

SEQ ID NO: 126180 - protein, 20 aa, Mycobacterium avium
EVPASYRLLAAELGEMVVGL

SEQ ID NO: 126181 - protein, 23 aa, Mycobacterium avium
EVPLIGFAGAPFTLASYLIEGGP

SEQ ID NO: 126182 - protein, 25 aa, Mycobacterium avium
EVPLRRALIFPVCDLALHSWDIHRC

SEQ ID NO: 126183 - protein, 41 aa, Mycobacterium avium
EVPSHKLLIRAGYIRPVAPGLYSWLPLGLRVLRRIEHIVRE

SEQ ID NO: 126184 - protein, 17 aa, Mycobacterium avium
EVPYYSATLWNPRERPS

SEQ ID NO: 126185 - protein, 23 aa, Mycobacterium avium
EVQADIRRKIEIGCYQGLRHRRG

SEQ ID NO: 126186 - protein, 17 aa, Mycobacterium avium
EVRGPWIAGSYYLGRDD

SEQ ID NO: 126187 - protein, 18 aa, Mycobacterium avium
EVRRLGTVDYRAAWQQQR

SEQ ID NO: 126188 - protein, 17 aa, Mycobacterium avium
EVRRLLPDIPLVASGGI

SEQ ID NO: 126189 - protein, 18 aa, Mycobacterium avium
EVRRPFVGALTLALPTEA

SEQ ID NO: 126190 - protein, 23 aa, Mycobacterium avium
EVSLRTLFRYFSGKDEILFARDY

SEQ ID NO: 126191 - protein, 17 aa, Mycobacterium avium
EVTLRFADGEVVTMHVI

SEQ ID NO: 126192 - protein, 18 aa, Mycobacterium avium
EVVEFHYRPERYRFSVTL

SEQ ID NO: 126193 - protein, 28 aa, Mycobacterium avium
EVVNEQTVMLGLGPGWRATADEPNWRVE

SEQ ID NO: 126194 - protein, 18 aa, Mycobacterium avium
EVWTFNGAIIPNIGLNAV

SEQ ID NO: 126195 - protein, 17 aa, Mycobacterium avium
EVWTPRDRMPVFPVPEG

SEQ ID NO: 126196 - protein, 17 aa, Mycobacterium avium
EVWVSVLGLPSTEALSP

SEQ ID NO: 126197 - protein, 17 aa, Mycobacterium avium
EWAGLGVGLLGNAISFD

SEQ ID NO: 126198 - protein, 17 aa, Mycobacterium avium
EWDVARGSYRPAWCTVR

SEQ ID NO: 126199 - protein, 19 aa, Mycobacterium avium
EWGCFTYGIIQHAEYFTFY

SEQ ID NO: 126200 - protein, 19 aa, Mycobacterium avium
EWGRPPPRIVAGLPVAVHD

SEQ ID NO: 126201 - protein, 21 aa, Mycobacterium avium
EWLAAHGWVVDAVRNTLDLQA

SEQ ID NO: 126202 - protein, 18 aa, Mycobacterium avium
EWLKLFGELEIPAAPLNS

SEQ ID NO: 126203 - protein, 25 aa, Mycobacterium avium
EWLRDDPVRYLRELADRLRAALPAA

SEQ ID NO: 126204 - protein, 22 aa, Mycobacterium avium
EWNPALLALRAELERVFLAGVR

SEQ ID NO: 126205 - protein, 23 aa, Mycobacterium avium
EWNPALLALRAELERVFLAGVRR

SEQ ID NO: 126206 - protein, 19 aa, Mycobacterium avium
EWPVLAFAAFGAAAPRPPG

SEQ ID NO: 126207 - protein, 18 aa, Mycobacterium avium
EWVAALAPGARVIKAFNT

SEQ ID NO: 126208 - protein, 17 aa, Mycobacterium avium
EWVDCPDFDLAWHLRRV

SEQ ID NO: 126209 - protein, 17 aa, Mycobacterium avium
EWVDWFPPTHPDRPDAP

SEQ ID NO: 126210 - protein, 17 aa, Mycobacterium avium
EYARDHFIGNHPGMPFP

SEQ ID NO: 126211 - protein, 18 aa, Mycobacterium avium
EYDVLVGINLLREGLDLP

SEQ ID NO: 126212 - protein, 17 aa, Mycobacterium avium
EYERRGTVWRPVGREPA

SEQ ID NO: 126213 - protein, 24 aa, Mycobacterium avium
EYEVARLWRDSRVQRLYAGTTEIM

SEQ ID NO: 126214 - protein, 18 aa, Mycobacterium avium
EYFQQFLRRRAALAINTS

SEQ ID NO: 126215 - protein, 26 aa, Mycobacterium avium
EYIKSPAELVLLPGAARALAALNAAG

SEQ ID NO: 126216 - protein, 28 aa, Mycobacterium avium
EYLAALQAPLVITPWRSVLVGDLREEVA

SEQ ID NO: 126217 - protein, 18 aa, Mycobacterium avium
EYLAHYHLAWFQAINHRA

SEQ ID NO: 126218 - protein, 18 aa, Mycobacterium avium
EYLEAMFELWHSDSPSYD

SEQ ID NO: 126219 - protein, 22 aa, Mycobacterium avium
EYPDHSALYRKGYVWVAVFART

SEQ ID NO: 126220 - protein, 27 aa, Mycobacterium avium
EYPVEACALLFRAQGRSLALTDALDRI

SEQ ID NO: 126221 - protein, 26 aa, Mycobacterium avium
EYRGITLREHLGLAPAPGSAPGADLE

SEQ ID NO: 126222 - protein, 29 aa, Mycobacterium avium
EYRKLDEEFVWYGRIPRAKLADYVGALEG

SEQ ID NO: 126223 - protein, 29 aa, Mycobacterium avium
EYRKLDEEFVWYGRIPRAKLAKYVDALEK

SEQ ID NO: 126224 - protein, 21 aa, Mycobacterium avium
EYVVTWSAMLRPFMEARGYSD

SEQ ID NO: 126225 - protein, 21 aa, Mycobacterium avium
EYWNHNSAYHPWLVGIAARHR

SEQ ID NO: 126226 - protein, 27 aa, Mycobacterium avium
FAARGVRLRPLPTTPPPVWVGGNSKPA

SEQ ID NO: 126227 - protein, 26 aa, Mycobacterium avium
FAARVRPFTIPKEPVYWAVVLDALEE

SEQ ID NO: 126228 - protein, 31 aa, Mycobacterium avium
FAAYYGQRLPAPAPYRGFVDWLAERDLDAAR

SEQ ID NO: 126229 - protein, 27 aa, Mycobacterium avium
FAAYYRWDVYCFTTAGDVLLPIGYDAS

SEQ ID NO: 126230 - protein, 18 aa, Mycobacterium avium
FADLDAVVAAGRTFRDVD

SEQ ID NO: 126231 - protein, 26 aa, Mycobacterium avium
FADLFLATLNNVPLTVPIVCAQLHNG

SEQ ID NO: 126232 - protein, 17 aa, Mycobacterium avium
FAEALTFAYHRLGRADV

SEQ ID NO: 126233 - protein, 25 aa, Mycobacterium avium
FAEGERLWLSWAMANRDPNLFDNPD

SEQ ID NO: 126234 - protein, 25 aa, Mycobacterium avium
FAEGERLWLSWAMANRDPSLFDNPN

SEQ ID NO: 126235 - protein, 20 aa, Mycobacterium avium
FAEHFELGIKDLVPMAYAEA

SEQ ID NO: 126236 - protein, 31 aa, Mycobacterium avium
FAELAGRLALPQRLERLLRRWLDALEEAGMV

SEQ ID NO: 126237 - protein, 30 aa, Mycobacterium avium
FAEREGVNLTFLPFIARAVIDALKIHPNIN

SEQ ID NO: 126238 - protein, 27 aa, Mycobacterium avium
FAETSLRDLLLHAIRYGDQPEVKAKMH

SEQ ID NO: 126239 - protein, 36 aa, Mycobacterium avium
FAGFYQRCRLVTERLWPTLLEPLRSRRHARRHVVDG

SEQ ID NO: 126240 - protein, 18 aa, Mycobacterium avium
FAGGWKVNADLPTPAGFA

SEQ ID NO: 126241 - protein, 31 aa, Mycobacterium avium
FAGRATVPNFLPLLAERWARQRLTALARVEG

SEQ ID NO: 126242 - protein, 27 aa, Mycobacterium avium
FAGYTPRLWRYWAEHLDPDRARRDDPR

SEQ ID NO: 126243 - protein, 19 aa, Mycobacterium avium
FAHWVATHRDLFDRRNERK

SEQ ID NO: 126244 - protein, 17 aa, Mycobacterium avium
FAIAIRTALMRGGTAYV

SEQ ID NO: 126245 - protein, 21 aa, Mycobacterium avium
FAIGAVLSMHFAKQAARFFDS

SEQ ID NO: 126246 - protein, 17 aa, Mycobacterium avium
FAIHDRFLAGNVLSDGG

SEQ ID NO: 126247 - protein, 23 aa, Mycobacterium avium
FAKGNLFQDAWSLFAQSLTMVVE

SEQ ID NO: 126248 - protein, 25 aa, Mycobacterium avium
FAKPDGVFVLTDANWMALMADRPVD

SEQ ID NO: 126249 - protein, 18 aa, Mycobacterium avium
FALAPREFALSTLRDIYG

SEQ ID NO: 126250 - protein, 21 aa, Mycobacterium avium
FALFEYRIRQRFWAGRVIHTI

SEQ ID NO: 126251 - protein, 17 aa, Mycobacterium avium
FALPRPWAPDDEHVLLQ

SEQ ID NO: 126252 - protein, 19 aa, Mycobacterium avium
FAPAMHTEMWLHPATVDNV

SEQ ID NO: 126253 - protein, 20 aa, Mycobacterium avium
FAPAMHTEMWLHPATVDNVA

SEQ ID NO: 126254 - protein, 21 aa, Mycobacterium avium
FAPAMHTEMWLHPATVDNVAT

SEQ ID NO: 126255 - protein, 17 aa, Mycobacterium avium
FAPDLLLSSWDLRPFTE

SEQ ID NO: 126256 - protein, 19 aa, Mycobacterium avium
FAPEIYRAPLSYPYRDGLL

SEQ ID NO: 126257 - protein, 23 aa, Mycobacterium avium
FAPGELFSYMRAAWDDTPDLTSY

SEQ ID NO: 126258 - protein, 18 aa, Mycobacterium avium
FAPPPSGPPPFGPPPPDA

SEQ ID NO: 126259 - protein, 28 aa, Mycobacterium avium
FAPSRSPRHVGLLISYLGLDARSLSTVV

SEQ ID NO: 126260 - protein, 34 aa, Mycobacterium avium
FAPTTLKPIPTLRIVRQMFAKRPAFNFKQLITED

SEQ ID NO: 126261 - protein, 17 aa, Mycobacterium avium
FAQMRGLITDELVARIG

SEQ ID NO: 126262 - protein, 18 aa, Mycobacterium avium
FAQWLSETWAQVVDHPDA

SEQ ID NO: 126263 - protein, 27 aa, Mycobacterium avium
FARLGVRPPRGVLLYGPPGCGKTFVVR

SEQ ID NO: 126264 - protein, 21 aa, Mycobacterium avium
FASGRVAYTLGLHGPAVTVDT

SEQ ID NO: 126265 - protein, 17 aa, Mycobacterium avium
FATFGDPIGRHAFGQSF

SEQ ID NO: 126266 - protein, 17 aa, Mycobacterium avium
FAVGQRVAVGWFGGCCY

SEQ ID NO: 126267 - protein, 27 aa, Mycobacterium avium
FAVIDMTIPRLKRTLLAGTRWGDPDAP

SEQ ID NO: 126268 - protein, 17 aa, Mycobacterium avium
FAYEWAAQRGLPGGGED

SEQ ID NO: 126269 - protein, 25 aa, Mycobacterium avium
FCARDPFGIKPLFVATGTGGTAVAS

SEQ ID NO: 126270 - protein, 17 aa, Mycobacterium avium
FCATGVTNGDLLKGVQY

SEQ ID NO: 126271 - protein, 18 aa, Mycobacterium avium
FCEWSLPHPLDVGAPTSF

SEQ ID NO: 126272 - protein, 17 aa, Mycobacterium avium
FCHARVAVRRLGPGHTA

SEQ ID NO: 126273 - protein, 23 aa, Mycobacterium avium
FCHARVAVRRLGPGHTAVQWNTE

SEQ ID NO: 126274 - protein, 23 aa, Mycobacterium avium
FCHARVAVRRLGPGHTAVQWSTE

SEQ ID NO: 126275 - protein, 22 aa, Mycobacterium avium
FCKLLAAEGLLALAWPKEHGGG

SEQ ID NO: 126276 - protein, 18 aa, Mycobacterium avium
FCPSPCRPGGAGVASPHT

SEQ ID NO: 126277 - protein, 17 aa, Mycobacterium avium
FDAATLIAPGLGEAGAA

SEQ ID NO: 126278 - protein, 21 aa, Mycobacterium avium
FDAVIAVHLRGTWLGVREAAA

SEQ ID NO: 126279 - protein, 19 aa, Mycobacterium avium
FDDGVWADMPPVERAQILH

SEQ ID NO: 126280 - protein, 19 aa, Mycobacterium avium
FDDVILHTYFTPETLQRSV

SEQ ID NO: 126281 - protein, 19 aa, Mycobacterium avium
FDFFYEALPGYEKSGLRRT

SEQ ID NO: 126282 - protein, 17 aa, Mycobacterium avium
FDFMGFGHTPDHPAPLF

SEQ ID NO: 126283 - protein, 20 aa, Mycobacterium avium
FDGLTPERMLEDLRPDIWVK

SEQ ID NO: 126284 - protein, 27 aa, Mycobacterium avium
FDGSDTVTLVWLGQRRIPGIDSGRTLR

SEQ ID NO: 126285 - protein, 28 aa, Mycobacterium avium
FDHSDLRDRWYREGWYSRRTLVDALEQG

SEQ ID NO: 126286 - protein, 19 aa, Mycobacterium avium
FDHSLRFSLGTTIYAGTSE

SEQ ID NO: 126287 - protein, 27 aa, Mycobacterium avium
FDKRLAGASAWWRYTPGATSACFPFSA

SEQ ID NO: 126288 - protein, 18 aa, Mycobacterium avium
FDLAAEIPLRAVLLRCGA

SEQ ID NO: 126289 - protein, 21 aa, Mycobacterium avium
FDNELIPIAGLATDEFIRPGT

SEQ ID NO: 126290 - protein, 31 aa, Mycobacterium avium
FDPNAGWFNYFSTWGNQFISSGFPINLLDVW

SEQ ID NO: 126291 - protein, 26 aa, Mycobacterium avium
FDPYDVGLIADPYPMFARLREEAPLY

SEQ ID NO: 126292 - protein, 19 aa, Mycobacterium avium
FDRMYDAPLPYISALHQYT

SEQ ID NO: 126293 - protein, 24 aa, Mycobacterium avium
FDRPAPPDAPAPDAPPPAPADLPP

SEQ ID NO: 126294 - protein, 27 aa, Mycobacterium avium
FDSGGWNLKYDVPAPLPATEFGPVTRA

SEQ ID NO: 126295 - protein, 27 aa, Mycobacterium avium
FDTIGRLWDRIGDKGIGFCLDTCHAWA

SEQ ID NO: 126296 - protein, 18 aa, Mycobacterium avium
FDTLLVYENYPIDTAALS

SEQ ID NO: 126297 - protein, 24 aa, Mycobacterium avium
FDVATLALPGGPLSKLGKFGHTAA

SEQ ID NO: 126298 - protein, 19 aa, Mycobacterium avium
FDVMVPLKEALQKVTYDNA

SEQ ID NO: 126299 - protein, 18 aa, Mycobacterium avium
FDVWRRTLDVNLLGYVRT

SEQ ID NO: 126300 - protein, 20 aa, Mycobacterium avium
FDWRGLVHRLTGIDLGPGKE

SEQ ID NO: 126301 - protein, 20 aa, Mycobacterium avium
FDYNLQWKPVGGFPITFGWL

SEQ ID NO: 126302 - protein, 18 aa, Mycobacterium avium
FEAAQVCRWLLTSRLELI

SEQ ID NO: 126303 - protein, 46 aa, Mycobacterium avium
FEDDLRAIMRRIPPNWGRWVGCSRGWYPIIIALDQALAAIDPAYEL

SEQ ID NO: 126304 - protein, 28 aa, Mycobacterium avium
FEGGWALEQIIGPAPLLAPLELLAYCAA

SEQ ID NO: 126305 - protein, 29 aa, Mycobacterium avium
FEGGWALEQIIGPAPLLAPLELLAYCAAC

SEQ ID NO: 126306 - protein, 28 aa, Mycobacterium avium
FEGGWALEQIIGPAPPLAPLELLAYCAA

SEQ ID NO: 126307 - protein, 19 aa, Mycobacterium avium
FEGKKLFPERIAETVPYEL

SEQ ID NO: 126308 - protein, 30 aa, Mycobacterium avium
FEGLPRRLQQQAVLRIYRGCLALADAEKVG

SEQ ID NO: 126309 - protein, 21 aa, Mycobacterium avium
FEKTLRFWLERGVDGFRIDVA

SEQ ID NO: 126310 - protein, 17 aa, Mycobacterium avium
FENGFREVFRRARKSAL

SEQ ID NO: 126311 - protein, 18 aa, Mycobacterium avium
FEPKIRWEAAVFDQSPGI

SEQ ID NO: 126312 - protein, 24 aa, Mycobacterium avium
FEQDRLISWTVLGQIQPPIGHVYG

SEQ ID NO: 126313 - protein, 25 aa, Mycobacterium avium
FERDAIPLLDQLYGGALRMTRNPAD

SEQ ID NO: 126314 - protein, 18 aa, Mycobacterium avium
FERDKWQPWTGKDWGNPR

SEQ ID NO: 126315 - protein, 29 aa, Mycobacterium avium
FEREAPAWRKLFYEDFLPVDKNPAINITS

SEQ ID NO: 126316 - protein, 17 aa, Mycobacterium avium
FERSGPERILSTGPLLF

SEQ ID NO: 126317 - protein, 32 aa, Mycobacterium avium
FERSGPERILSTGPLLLAAIRALSNGPAPDER

SEQ ID NO: 126318 - protein, 22 aa, Mycobacterium avium
FESPKLLMLSGIGPGRELAKHG

SEQ ID NO: 126319 - protein, 28 aa, Mycobacterium avium
FETTLAEGLLYERRLFHSTFATADQSEG

SEQ ID NO: 126320 - protein, 29 aa, Mycobacterium avium
FETTLAEGLLYERRLFHSTFATADQSEGM

SEQ ID NO: 126321 - protein, 28 aa, Mycobacterium avium
FETTLAEGLLYERRLFHSTFATADQTEG

SEQ ID NO: 126322 - protein, 17 aa, Mycobacterium avium
FEVAKLLAAEGARVAIL

SEQ ID NO: 126323 - protein, 28 aa, Mycobacterium avium
FEVNEAFAPVPLAWLAETGADAARTNPL

SEQ ID NO: 126324 - protein, 25 aa, Mycobacterium avium
FFFDGELFIIGRMKDLLIVYGRNHS

SEQ ID NO: 126325 - protein, 21 aa, Mycobacterium avium
FFKVIPRVNAEVRNALRARWP

SEQ ID NO: 126326 - protein, 17 aa, Mycobacterium avium
FFVLHGQKDELVPSGQA

SEQ ID NO: 126327 - protein, 18 aa, Mycobacterium avium
FGANNFPASVLGAVGVDR

SEQ ID NO: 126328 - protein, 19 aa, Mycobacterium avium
FGAPPPFAPPPSGPPPFAP

SEQ ID NO: 126329 - protein, 17 aa, Mycobacterium avium
FGASTMVLLPLVAAHVD

SEQ ID NO: 126330 - protein, 22 aa, Mycobacterium avium
FGDGWAPWLTKPDELPAKLDYL

SEQ ID NO: 126331 - protein, 19 aa, Mycobacterium avium
FGDLVAMEAYRRSLLEQAS

SEQ ID NO: 126332 - protein, 27 aa, Mycobacterium avium
FGEGPRWFEGLLWFSDMLGEAVHTTTM

SEQ ID NO: 126333 - protein, 32 aa, Mycobacterium avium
FGGTPFEAAPGKAWPFGLPSIGAHGSYWDNMS

SEQ ID NO: 126334 - protein, 17 aa, Mycobacterium avium
FGHIPNLVTMRGDRYRD

SEQ ID NO: 126335 - protein, 19 aa, Mycobacterium avium
FGHPVGASGLRMLYEAWLQ

SEQ ID NO: 126336 - protein, 23 aa, Mycobacterium avium
FGHRHPAPRRPGQNRRVANLFQV

SEQ ID NO: 126337 - protein, 17 aa, Mycobacterium avium
FGHRPYGRGVGQHGRRH

SEQ ID NO: 126338 - protein, 38 aa, Mycobacterium avium
FGICFGNQILGRALGLSTYKMVFGHRGINIPVIDHATG

SEQ ID NO: 126339 - protein, 19 aa, Mycobacterium avium
FGKTNLLEALWYSSTLGSH

SEQ ID NO: 126340 - protein, 20 aa, Mycobacterium avium
FGKTNLLEALWYSSTLGSHR

SEQ ID NO: 126341 - protein, 19 aa, Mycobacterium avium
FGLRPPPAEQIEAFAALPS

SEQ ID NO: 126342 - protein, 24 aa, Mycobacterium avium
FGLSTRGYTRLGAPLRHLTSRLLA

SEQ ID NO: 126343 - protein, 24 aa, Mycobacterium avium
FGMLTGYGRELFRELVFRVVNRFE

SEQ ID NO: 126344 - protein, 24 aa, Mycobacterium avium
FGMSMRFYKSREALLDKAKRAEDA

SEQ ID NO: 126345 - protein, 17 aa, Mycobacterium avium
FGNFGQANYGAAKMGLV

SEQ ID NO: 126346 - protein, 27 aa, Mycobacterium avium
FGPTSPRRWGPRGPAPHAALWAGRSGD

SEQ ID NO: 126347 - protein, 28 aa, Mycobacterium avium
FGPTSPRRWGPRGPAPHAALWAGRSGDP

SEQ ID NO: 126348 - protein, 17 aa, Mycobacterium avium
FGRIGVKVWIYKGDVVG

SEQ ID NO: 126349 - protein, 17 aa, Mycobacterium avium
FGRLLRWRAGGVLSVAD

SEQ ID NO: 126350 - protein, 20 aa, Mycobacterium avium
FGRPAFVSRSVLVTGGNRGI

SEQ ID NO: 126351 - protein, 24 aa, Mycobacterium avium
FGRREVRNFWWPTRCTGCRSSTST

SEQ ID NO: 126352 - protein, 19 aa, Mycobacterium avium
FGSAFQWQYPTPPEGDHIT

SEQ ID NO: 126353 - protein, 17 aa, Mycobacterium avium
FGSWLRNSTRGALAMDP

SEQ ID NO: 126354 - protein, 21 aa, Mycobacterium avium
FGTHWHGLLDNDDFRRAWLVR

SEQ ID NO: 126355 - protein, 37 aa, Mycobacterium avium
FGTKVWRLHQYLIGLRRRHPWLHAATTTALLLQNRHY

SEQ ID NO: 126356 - protein, 24 aa, Mycobacterium avium
FGTLRLSDYPLIPARVDTWAGLVF

SEQ ID NO: 126357 - protein, 17 aa, Mycobacterium avium
FGTNHLGHFALTGLLLD

SEQ ID NO: 126358 - protein, 27 aa, Mycobacterium avium
FHAGVQDILLIAFALACAEFCGTRGTP

SEQ ID NO: 126359 - protein, 17 aa, Mycobacterium avium
FHDDQIDGPLPPRLRVL

SEQ ID NO: 126360 - protein, 22 aa, Mycobacterium avium
FHDVLLATVRSVQAALPHLAVN

SEQ ID NO: 126361 - protein, 25 aa, Mycobacterium avium
FHKMLFENWDAVLKVHLYGGYNVIR

SEQ ID NO: 126362 - protein, 17 aa, Mycobacterium avium
FHLRDLAVTFRFGEEVT

SEQ ID NO: 126363 - protein, 26 aa, Mycobacterium avium
FHRAHQAMYLDRLLNDGLARDWGICG

SEQ ID NO: 126364 - protein, 22 aa, Mycobacterium avium
FHSQFVQLMNGGALQYAVTEAA

SEQ ID NO: 126365 - protein, 31 aa, Mycobacterium avium
FIAETTGAGSFPWVLAITCPYRDAAERNAFL

SEQ ID NO: 126366 - protein, 26 aa, Mycobacterium avium
FIDCPPSLGLLTINALVAAPEVMIPI

SEQ ID NO: 126367 - protein, 20 aa, Mycobacterium avium
FIEHDSQGYRLIFENDYVTE

SEQ ID NO: 126368 - protein, 17 aa, Mycobacterium avium
FIEPTFAAYHQRGTSRD

SEQ ID NO: 126369 - protein, 18 aa, Mycobacterium avium
FIEPTFAAYHQRGTSRDI

SEQ ID NO: 126370 - protein, 19 aa, Mycobacterium avium
FIERKLYPNVDFYTGLIYR

SEQ ID NO: 126371 - protein, 18 aa, Mycobacterium avium
FIGELDRPGRLTLVEGAG

SEQ ID NO: 126372 - protein, 21 aa, Mycobacterium avium
FIHSMRAKAIARLGFGYDDVA

SEQ ID NO: 126373 - protein, 17 aa, Mycobacterium avium
FILGQAGLLDGRRATTH

SEQ ID NO: 126374 - protein, 18 aa, Mycobacterium avium
FINVFNVPRSTGIFPLPL

SEQ ID NO: 126375 - protein, 21 aa, Mycobacterium avium
FIQGFELDDFHPLAPLHSCSL

SEQ ID NO: 126376 - protein, 20 aa, Mycobacterium avium
FIRQPGYRFVELRDPKRSDR

SEQ ID NO: 126377 - protein, 20 aa, Mycobacterium avium
FIVEYIGQTRGWFYTLHVLA

SEQ ID NO: 126378 - protein, 21 aa, Mycobacterium avium
FIVEYIGQTRGWFYTLHVLAT

SEQ ID NO: 126379 - protein, 23 aa, Mycobacterium avium
FIVLAQRHWDMLLDQHRLCGRHF

SEQ ID NO: 126380 - protein, 25 aa, Mycobacterium avium
FIVLAQRHWDMLLDQHRLRGRHFIA

SEQ ID NO: 126381 - protein, 23 aa, Mycobacterium avium
FKALRPDFLFFSRRADGTIAANI

SEQ ID NO: 126382 - protein, 17 aa, Mycobacterium avium
FKDLVISQYPWDMPLHS

SEQ ID NO: 126383 - protein, 21 aa, Mycobacterium avium
FKEPQYGAPPLLLRMVEAGRI

SEQ ID NO: 126384 - protein, 23 aa, Mycobacterium avium
FKEPQYGAPPLLLRMVEAGRLGK

SEQ ID NO: 126385 - protein, 28 aa, Mycobacterium avium
FKGVGEEGWGFLKGLYEVSPNRMLLDPV

SEQ ID NO: 126386 - protein, 33 aa, Mycobacterium avium
FKLDLNDPPPCAVGFLPPPLMRTPADETVRELP

SEQ ID NO: 126387 - protein, 19 aa, Mycobacterium avium
FKPRYNPWDQRMCLIPDAD

SEQ ID NO: 126388 - protein, 17 aa, Mycobacterium avium
FKRHFYTCFISDKVGVR

SEQ ID NO: 126389 - protein, 19 aa, Mycobacterium avium
FLATLAQFVEFVRDGQFDQ

SEQ ID NO: 126390 - protein, 27 aa, Mycobacterium avium
FLDAVEKLPRWRLDLDDGSITFDNTEL

SEQ ID NO: 126391 - protein, 20 aa, Mycobacterium avium
FLDDIRRYGATYMNYVGKPL

SEQ ID NO: 126392 - protein, 19 aa, Mycobacterium avium
FLDLAGFTALWDGPPLTVQ

SEQ ID NO: 126393 - protein, 18 aa, Mycobacterium avium
FLDRLRARHGWLDHLIRA

SEQ ID NO: 126394 - protein, 28 aa, Mycobacterium avium
FLELPGPPILWHSLTVALIAGLSRVRSK

SEQ ID NO: 126395 - protein, 18 aa, Mycobacterium avium
FLGALEAGLIAVPLAPPA

SEQ ID NO: 126396 - protein, 18 aa, Mycobacterium avium
FLGIRAVVKPMKKAGRGS

SEQ ID NO: 126397 - protein, 18 aa, Mycobacterium avium
FLGMRAALERLRGTPGAS

SEQ ID NO: 126398 - protein, 20 aa, Mycobacterium avium
FLGPGLRVLNFNNLPIPINI

SEQ ID NO: 126399 - protein, 18 aa, Mycobacterium avium
FLPLNRDPRLAGSINDVG

SEQ ID NO: 126400 - protein, 29 aa, Mycobacterium avium
FLPTAQRRTPPAFYAWRAFARYSPVLPAG

SEQ ID NO: 126401 - protein, 38 aa, Mycobacterium avium
FLREYPYRDAYLLRDAKLFRAELKMPLILLGGITNRET

SEQ ID NO: 126402 - protein, 26 aa, Mycobacterium avium
FLRMEADWESAYLLSLRAAWQADNEI

SEQ ID NO: 126403 - protein, 17 aa, Mycobacterium avium
FLRSTATVTWMAEEVHE

SEQ ID NO: 126404 - protein, 17 aa, Mycobacterium avium
FLTIFNKNRPGGTVVAD

SEQ ID NO: 126405 - protein, 17 aa, Mycobacterium avium
FLVHGRIVYAAGPIGIA

SEQ ID NO: 126406 - protein, 18 aa, Mycobacterium avium
FLVHGRIVYAAGPIGIAQ

SEQ ID NO: 126407 - protein, 18 aa, Mycobacterium avium
FMAAARRLSALPVVAAVG

SEQ ID NO: 126408 - protein, 33 aa, Mycobacterium avium
FMAKMQLESIFRELIFRAPSLRLGEPEYLTGNF

SEQ ID NO: 126409 - protein, 21 aa, Mycobacterium avium
FMALNYIYHLMNMIAEGVFER

SEQ ID NO: 126410 - protein, 25 aa, Mycobacterium avium
FMETLDPSIYWMGMHHSRLIKRDSN

SEQ ID NO: 126411 - protein, 24 aa, Mycobacterium avium
FMTQGWFTGLVPITVPIAAASFAD

SEQ ID NO: 126412 - protein, 17 aa, Mycobacterium avium
FNDDMIIMPLQAATQWD

SEQ ID NO: 126413 - protein, 25 aa, Mycobacterium avium
FNDTHLTRLRLITSMLDRGYTIAHV

SEQ ID NO: 126414 - protein, 24 aa, Mycobacterium avium
FNEGDKVVMWYPAANRDPAVFDDP

SEQ ID NO: 126415 - protein, 19 aa, Mycobacterium avium
FNEPKLRPGNVYFLNAQKL

SEQ ID NO: 126416 - protein, 19 aa, Mycobacterium avium
FNGQAYAHAVAHEAAFGNE

SEQ ID NO: 126417 - protein, 20 aa, Mycobacterium avium
FNGSVWFPAAFNNASGAGIV

SEQ ID NO: 126418 - protein, 34 aa, Mycobacterium avium
FNGVGLLVNFPLSQWLKFAPPIGYGALPKDALGA

SEQ ID NO: 126419 - protein, 21 aa, Mycobacterium avium
FNKAIAQRYLAAGASFVLVGA

SEQ ID NO: 126420 - protein, 18 aa, Mycobacterium avium
FNSLFILCEPLSATLRIT

SEQ ID NO: 126421 - protein, 17 aa, Mycobacterium avium
FNVATAHALTVAAVPLM

SEQ ID NO: 126422 - protein, 23 aa, Mycobacterium avium
FNYKDRIFATPVITLPIVDRALE

SEQ ID NO: 126423 - protein, 21 aa, Mycobacterium avium
FPAPQTYVAPIAFNVVPLAGS

SEQ ID NO: 126424 - protein, 22 aa, Mycobacterium avium
FPAPQTYVAPIAFNVVPLAGSL

SEQ ID NO: 126425 - protein, 17 aa, Mycobacterium avium
FPASRWRRYDKLDRVPA

SEQ ID NO: 126426 - protein, 18 aa, Mycobacterium avium
FPERIAETVPYELTALEY

SEQ ID NO: 126427 - protein, 19 aa, Mycobacterium avium
FPHLVERLILVGAGGVTKD

SEQ ID NO: 126428 - protein, 17 aa, Mycobacterium avium
FPILKRIVRSGNQLAYL

SEQ ID NO: 126429 - protein, 22 aa, Mycobacterium avium
FPQAFTHLALINAVVHVIRAEE

SEQ ID NO: 126430 - protein, 25 aa, Mycobacterium avium
FPQPSPPHHPWRTMPNHAMTPHISG

SEQ ID NO: 126431 - protein, 18 aa, Mycobacterium avium
FPRWLHTYNHHRGHTALG

SEQ ID NO: 126432 - protein, 26 aa, Mycobacterium avium
FPSFHDDYWDPMWRALSDTNTVLSVH

SEQ ID NO: 126433 - protein, 18 aa, Mycobacterium avium
FPVWTERGGPATIVPMFL

SEQ ID NO: 126434 - protein, 19 aa, Mycobacterium avium
FPYAWPRKPVLADNVVCTS

SEQ ID NO: 126435 - protein, 32 aa, Mycobacterium avium
FPYSDVRLLPYLNHSLWFLPSVASCHAMANLL

SEQ ID NO: 126436 - protein, 20 aa, Mycobacterium avium
FPYTQFLPEFGQCRAVQIDI

SEQ ID NO: 126437 - protein, 22 aa, Mycobacterium avium
FQEYAIIRDDLFSTPIPGEHDQ

SEQ ID NO: 126438 - protein, 18 aa, Mycobacterium avium
FQHLPVPFELYSDGIDLP

SEQ ID NO: 126439 - protein, 23 aa, Mycobacterium avium
FQHQPPLAVCLGGVGLHGAGAPR

SEQ ID NO: 126440 - protein, 18 aa, Mycobacterium avium
FQHWLDIGANTNPDLLPK

SEQ ID NO: 126441 - protein, 17 aa, Mycobacterium avium
FQQYRGTARQREVAFTV

SEQ ID NO: 126442 - protein, 19 aa, Mycobacterium avium
FQRFVDATLWPRLFGNCHT

SEQ ID NO: 126443 - protein, 18 aa, Mycobacterium avium
FQRGPLDEAIRASIAIPG

SEQ ID NO: 126444 - protein, 18 aa, Mycobacterium avium
FRAAGWWCDSTLSDAVRR

SEQ ID NO: 126445 - protein, 18 aa, Mycobacterium avium
FRAALRDLTLMLVYEASR

SEQ ID NO: 126446 - protein, 21 aa, Mycobacterium avium
FRAFETLLRHDRPYAGYAPIM

SEQ ID NO: 126447 - protein, 18 aa, Mycobacterium avium
FRALRRWASGFYPEPEAA

SEQ ID NO: 126448 - protein, 18 aa, Mycobacterium avium
FRASRIMLERARANDKIT

SEQ ID NO: 126449 - protein, 26 aa, Mycobacterium avium
FRDAEKLTFPLLSDPDRKVLTAYGAY

SEQ ID NO: 126450 - protein, 26 aa, Mycobacterium avium
FRDELGDWRVILHSPYGLGVNGPLAL

SEQ ID NO: 126451 - protein, 27 aa, Mycobacterium avium
FRDELGDWRVILHSPYGLGVNGPLALA

SEQ ID NO: 126452 - protein, 17 aa, Mycobacterium avium
FRDIVDVNLVGVWNTVE

SEQ ID NO: 126453 - protein, 17 aa, Mycobacterium avium
FRGGLYVVAGYPGADWA

SEQ ID NO: 126454 - protein, 18 aa, Mycobacterium avium
FRIVEQLPRKVAMRLLLT

SEQ ID NO: 126455 - protein, 18 aa, Mycobacterium avium
FRLFRPDLENPGPDDFAP

SEQ ID NO: 126456 - protein, 25 aa, Mycobacterium avium
FRLSKTPVPPPLPAPALRTNGAQAK

SEQ ID NO: 126457 - protein, 21 aa, Mycobacterium avium
FRLVADGANWSRWAKPIVLHS

SEQ ID NO: 126458 - protein, 17 aa, Mycobacterium avium
FRNPYTGAPTVGPLAIL

SEQ ID NO: 126459 - protein, 20 aa, Mycobacterium avium
FRPGVTERLGLGPEVCCAAN

SEQ ID NO: 126460 - protein, 27 aa, Mycobacterium avium
FRQGAQLLLGPFEDGAQRRVAGGHLRP

SEQ ID NO: 126461 - protein, 34 aa, Mycobacterium avium
FRRAQPPRALPSNCRYLLPSLIRSSARAGTAGKK

SEQ ID NO: 126462 - protein, 19 aa, Mycobacterium avium
FRVPELFRGYADTYYSQML

SEQ ID NO: 126463 - protein, 17 aa, Mycobacterium avium
FRWFAQCLEIRSAAAGE

SEQ ID NO: 126464 - protein, 18 aa, Mycobacterium avium
FSAAPLRWAEWLSDSQAT

SEQ ID NO: 126465 - protein, 25 aa, Mycobacterium avium
FSAGRSFLLPPTWTQLDSLAGRTVA

SEQ ID NO: 126466 - protein, 19 aa, Mycobacterium avium
FSDELLADLALSCALWVGM

SEQ ID NO: 126467 - protein, 26 aa, Mycobacterium avium
FSDHAEWVLPTDWPVAPGRPVLEVVL

SEQ ID NO: 126468 - protein, 25 aa, Mycobacterium avium
FSEIGQAVSWLYATSPRGLAGPLPT

SEQ ID NO: 126469 - protein, 26 aa, Mycobacterium avium
FSGIVGHRFIYTYANGWQYEMYVKNA

SEQ ID NO: 126470 - protein, 27 aa, Mycobacterium avium
FSGIVGHRFIYTYANGWQYEMYVKNAT

SEQ ID NO: 126471 - protein, 21 aa, Mycobacterium avium
FSGYYEVDPYTPVTPREPIRE

SEQ ID NO: 126472 - protein, 17 aa, Mycobacterium avium
FSKYLHTLGLPAAGEAV

SEQ ID NO: 126473 - protein, 21 aa, Mycobacterium avium
FSPSVYLLRLSGPIFALSARS

SEQ ID NO: 126474 - protein, 17 aa, Mycobacterium avium
FSSFYFDTALSSSAAAL

SEQ ID NO: 126475 - protein, 17 aa, Mycobacterium avium
FSSLPLFSVVNKPFEAN

SEQ ID NO: 126476 - protein, 17 aa, Mycobacterium avium
FSVRVPWQWRATGSAAE

SEQ ID NO: 126477 - protein, 18 aa, Mycobacterium avium
FTAGLFADLAAEAGIPDG

SEQ ID NO: 126478 - protein, 17 aa, Mycobacterium avium
FTALFNTILINVTSFFR

SEQ ID NO: 126479 - protein, 18 aa, Mycobacterium avium
FTALFNTILINVTSFFRD

SEQ ID NO: 126480 - protein, 19 aa, Mycobacterium avium
FTALFNTILINVTSFFRDP

SEQ ID NO: 126481 - protein, 20 aa, Mycobacterium avium
FTEGLKLMKAAWSDDPRVTF

SEQ ID NO: 126482 - protein, 30 aa, Mycobacterium avium
FTEKDRYSMDWYYPILGSAVRGPAAVARIK

SEQ ID NO: 126483 - protein, 17 aa, Mycobacterium avium
FTETGRLRIVGRKKDMF

SEQ ID NO: 126484 - protein, 17 aa, Mycobacterium avium
FTFNVATAHALTVAAVP

SEQ ID NO: 126485 - protein, 19 aa, Mycobacterium avium
FTFNVATAHALTVAAVPLM

SEQ ID NO: 126486 - protein, 17 aa, Mycobacterium avium
FTGGLNWYRNFDRNWET

SEQ ID NO: 126487 - protein, 35 aa, Mycobacterium avium
FTGMDPMLTGRENLVLFGRLRGLNRRRAKARADEL

SEQ ID NO: 126488 - protein, 18 aa, Mycobacterium avium
FTGRVLTAVEALDWGLVT

SEQ ID NO: 126489 - protein, 22 aa, Mycobacterium avium
FTHWGGAFKYAASLLGLPIGAY

SEQ ID NO: 126490 - protein, 17 aa, Mycobacterium avium
FTLLVIADLLGVPEEDR

SEQ ID NO: 126491 - protein, 29 aa, Mycobacterium avium
FTLSRPGALIAALPAVLGFVPESSLVLVS

SEQ ID NO: 126492 - protein, 18 aa, Mycobacterium avium
FTMRYLDAPPRVALDLSD

SEQ ID NO: 126493 - protein, 17 aa, Mycobacterium avium
FTQAFVLRQKNPKMYDL

SEQ ID NO: 126494 - protein, 20 aa, Mycobacterium avium
FTRDTLGFSVLRVVRDNPTS

SEQ ID NO: 126495 - protein, 23 aa, Mycobacterium avium
FTTQEFAPPLPYKGSRDPKIFRP

SEQ ID NO: 126496 - protein, 21 aa, Mycobacterium avium
FTTQWALDRHTFGRPLASYQA

SEQ ID NO: 126497 - protein, 21 aa, Mycobacterium avium
FTVDAELVVPAPPAELRPVHT

SEQ ID NO: 126498 - protein, 19 aa, Mycobacterium avium
FTVDLLRPALLAPVQIRTS

SEQ ID NO: 126499 - protein, 21 aa, Mycobacterium avium
FTVDLLRPALLAPVQIRTSVQ

SEQ ID NO: 126500 - protein, 21 aa, Mycobacterium avium
FTVVALDRPGYGSSAPYPEAM

SEQ ID NO: 126501 - protein, 27 aa, Mycobacterium avium
FTWEHDLHLYWRRAISLAASIGPANRW

SEQ ID NO: 126502 - protein, 18 aa, Mycobacterium avium
FTYGLLYQREADLAQRCR

SEQ ID NO: 126503 - protein, 17 aa, Mycobacterium avium
FTYKVDEAGLITNMRGY

SEQ ID NO: 126504 - protein, 23 aa, Mycobacterium avium
FVAGLVAALRDGAAPREAGRRAA

SEQ ID NO: 126505 - protein, 17 aa, Mycobacterium avium
FVALGFAAATTSTLRLI

SEQ ID NO: 126506 - protein, 20 aa, Mycobacterium avium
FVDGQIFRRKLPSSAMEAFF

SEQ ID NO: 126507 - protein, 19 aa, Mycobacterium avium
FVEINASFYPKRPAGQKLP

SEQ ID NO: 126508 - protein, 21 aa, Mycobacterium avium
FVHGAYVTGLLWQDVVDRLSD

SEQ ID NO: 126509 - protein, 18 aa, Mycobacterium avium
FVHGLPLCAVSLALLHAG

SEQ ID NO: 126510 - protein, 26 aa, Mycobacterium avium
FVKNNLTFFLQFGAAAPKNGFLPAID

SEQ ID NO: 126511 - protein, 17 aa, Mycobacterium avium
FVLHDVFAMPFETIAEL

SEQ ID NO: 126512 - protein, 26 aa, Mycobacterium avium
FVLVHDAARALTPPALIARVVQALHD

SEQ ID NO: 126513 - protein, 25 aa, Mycobacterium avium
FVNGAFPGLSWPLTPGHEIAGRIAE

SEQ ID NO: 126514 - protein, 24 aa, Mycobacterium avium
FVNPITMVIAMAEAIWNGLQFVAA

SEQ ID NO: 126515 - protein, 21 aa, Mycobacterium avium
FVNTDLAVHVFRVPDGDWIGI

SEQ ID NO: 126516 - protein, 18 aa, Mycobacterium avium
FVPAMFVRMLRLPEAVRM

SEQ ID NO: 126517 - protein, 18 aa, Mycobacterium avium
FVQILDWLNRPVDAALKV

SEQ ID NO: 126518 - protein, 17 aa, Mycobacterium avium
FVRAVANYYRPGFHPSQ

SEQ ID NO: 126519 - protein, 26 aa, Mycobacterium avium
FVSSFATLLPLRIIDTMLGVPREHEQ

SEQ ID NO: 126520 - protein, 19 aa, Mycobacterium avium
FVVAVRTAPDRHKGLSLLV

SEQ ID NO: 126521 - protein, 31 aa, Mycobacterium avium
FVVDVNLGRLAWLLRLFGFDVWWSNDADDQT

SEQ ID NO: 126522 - protein, 27 aa, Mycobacterium avium
FVVVAPHTYFPRLRLELDKGLGWKAEV

SEQ ID NO: 126523 - protein, 19 aa, Mycobacterium avium
FVYKGMLTTPQLKAFYLDL

SEQ ID NO: 126524 - protein, 19 aa, Mycobacterium avium
FWDDIAAVGATWYTAVPTI

SEQ ID NO: 126525 - protein, 18 aa, Mycobacterium avium
FYAAMLAGLGLDGADLPG

SEQ ID NO: 126526 - protein, 20 aa, Mycobacterium avium
FYGDRYSYNRFRPSRLGAGL

SEQ ID NO: 126527 - protein, 18 aa, Mycobacterium avium
FYNHFPSKEDLALEVLHQ

SEQ ID NO: 126528 - protein, 18 aa, Mycobacterium avium
FYQKPITLEQHQQSRWII

SEQ ID NO: 126529 - protein, 24 aa, Mycobacterium avium
GAAGLLLRAPQPDGTPAVLLQHRA

SEQ ID NO: 126530 - protein, 17 aa, Mycobacterium avium
GAALRIAFRALTLAGVH

SEQ ID NO: 126531 - protein, 31 aa, Mycobacterium avium
GAAMLATALLTGMWLVLFEAFDPAATPLAIA

SEQ ID NO: 126532 - protein, 24 aa, Mycobacterium avium
GAAPAMRPPPLPVAWVPISTAVAA

SEQ ID NO: 126533 - protein, 17 aa, Mycobacterium avium
GAAPLPGPPPGAASLPD

SEQ ID NO: 126534 - protein, 22 aa, Mycobacterium avium
GAAPYVGWLHTTAERAQQTATQ

SEQ ID NO: 126535 - protein, 25 aa, Mycobacterium avium
GAARLSAFSVLLEMLGRPPLKSATP

SEQ ID NO: 126536 - protein, 20 aa, Mycobacterium avium
GAAVGRFLDSVDQRVLLIGT

SEQ ID NO: 126537 - protein, 19 aa, Mycobacterium avium
GAAVWGLVRSAQAEHPGRV

SEQ ID NO: 126538 - protein, 25 aa, Mycobacterium avium
GADDPFDLLARRPGAPQRRTGQPGL

SEQ ID NO: 126539 - protein, 24 aa, Mycobacterium avium
GADRNTWFHQWLDADAAAVRRNAK

SEQ ID NO: 126540 - protein, 23 aa, Mycobacterium avium
GADSGMLAALYVLAALGEQDRPL

SEQ ID NO: 126541 - protein, 17 aa, Mycobacterium avium
GADWPVEYGGRDDYHPL

SEQ ID NO: 126542 - protein, 18 aa, Mycobacterium avium
GADWSKTIPGRLLMGVTG

SEQ ID NO: 126543 - protein, 24 aa, Mycobacterium avium
GAELRAAFTDRIVPALQAFSPELI

SEQ ID NO: 126544 - protein, 24 aa, Mycobacterium avium
GAEMARLFAWRPQAVTAAAELGEQ

SEQ ID NO: 126545 - protein, 19 aa, Mycobacterium avium
GAEPLFLQDYIAVGRTVPE

SEQ ID NO: 126546 - protein, 28 aa, Mycobacterium avium
GAFDMAQFGWLGDAFPLSALTQIYKSDG

SEQ ID NO: 126547 - protein, 20 aa, Mycobacterium avium
GAFGCFGMSRREALWAAGAA

SEQ ID NO: 126548 - protein, 24 aa, Mycobacterium avium
GAFVNWEGRFRPFQAALRGSMTQA

SEQ ID NO: 126549 - protein, 33 aa, Mycobacterium avium
GAGGGENPFLPVPLADRFGLSKGLPGLAEWTVG

SEQ ID NO: 126550 - protein, 28 aa, Mycobacterium avium
GAGILNFVFGEMWLRPGLGMKERRLITV

SEQ ID NO: 126551 - protein, 22 aa, Mycobacterium avium
GAGMTAWDLYGGAGVFAAALGE

SEQ ID NO: 126552 - protein, 34 aa, Mycobacterium avium
GAGNFPGEPWAVPKFYWSVFATRPFEAAVQALTP

SEQ ID NO: 126553 - protein, 37 aa, Mycobacterium avium
GAGRQPGVTPLWMAPYAPFGFMTPAAWVALHAQRYMT

SEQ ID NO: 126554 - protein, 22 aa, Mycobacterium avium
GAGTFRRLPLHVIATRGAHDSA

SEQ ID NO: 126555 - protein, 26 aa, Mycobacterium avium
GAGTMTHAWLITGPPGSGRSVAALCF

SEQ ID NO: 126556 - protein, 18 aa, Mycobacterium avium
GAGVTALAKGRFVTAPQL

SEQ ID NO: 126557 - protein, 18 aa, Mycobacterium avium
GAGWLKVKPVHTLDLVVL

SEQ ID NO: 126558 - protein, 24 aa, Mycobacterium avium
GAGWRWRTWHLYPDLPAGRGGTVV

SEQ ID NO: 126559 - protein, 25 aa, Mycobacterium avium
GAGWRWRTWHLYPDRPAGRGGTVVR

SEQ ID NO: 126560 - protein, 23 aa, Mycobacterium avium
GAGYFPIDPGYPLARKQFMLDDV

SEQ ID NO: 126561 - protein, 17 aa, Mycobacterium avium
GAHEFFENGFREVFRRA

SEQ ID NO: 126562 - protein, 17 aa, Mycobacterium avium
GAHPVRRLVTGGGQHHQ

SEQ ID NO: 126563 - protein, 19 aa, Mycobacterium avium
GAHVGHTVGKYAESLLTLG

SEQ ID NO: 126564 - protein, 31 aa, Mycobacterium avium
GAHVGHTVGKYAESLLTLGWAAEFASIPVAV

SEQ ID NO: 126565 - protein, 17 aa, Mycobacterium avium
GAIALGHPLGASGAVLM

SEQ ID NO: 126566 - protein, 27 aa, Mycobacterium avium
GAIEIGIKWLSLYAFSTENWKRSPEEV

SEQ ID NO: 126567 - protein, 29 aa, Mycobacterium avium
GAIGVTSEHPLWLFTLRAQSWADDYGTTA

SEQ ID NO: 126568 - protein, 30 aa, Mycobacterium avium
GAIGVTSEHPLWLFTLRAQSWTADYGTTAN

SEQ ID NO: 126569 - protein, 25 aa, Mycobacterium avium
GAKAWITHGGIADFYSLFARTGEGG

SEQ ID NO: 126570 - protein, 22 aa, Mycobacterium avium
GAKHPAWYFNLKGHPEATVTVG

SEQ ID NO: 126571 - protein, 24 aa, Mycobacterium avium
GAKIAFFFTRRKLAQMTGLETAGM

SEQ ID NO: 126572 - protein, 41 aa, Mycobacterium avium
GAKVSGSRFYFLTGKGALLQLGLLQLALRLAVENGFVPMIP

SEQ ID NO: 126573 - protein, 25 aa, Mycobacterium avium
GALDLRPTPKLPPKNFHRLLGVNVE

SEQ ID NO: 126574 - protein, 27 aa, Mycobacterium avium
GALGEHDLLLVSPIILYDHPEVAEQSE

SEQ ID NO: 126575 - protein, 17 aa, Mycobacterium avium
GALGKLLSSHPADLLPA

SEQ ID NO: 126576 - protein, 17 aa, Mycobacterium avium
GALICHGALSRNPDLRI

SEQ ID NO: 126577 - protein, 20 aa, Mycobacterium avium
GALLIESYTLATLNLRQAAR

SEQ ID NO: 126578 - protein, 19 aa, Mycobacterium avium
GALRAALPERLTMIAGISG

SEQ ID NO: 126579 - protein, 21 aa, Mycobacterium avium
GALSRLPAPPLPTARLRPRPI

SEQ ID NO: 126580 - protein, 22 aa, Mycobacterium avium
GALSRLPAPPLPTARLRPRPMP

SEQ ID NO: 126581 - protein, 20 aa, Mycobacterium avium
GALTVAMKHIKEPPPPLPAE

SEQ ID NO: 126582 - protein, 20 aa, Mycobacterium avium
GANLRAAWLTMIAVASTHQG

SEQ ID NO: 126583 - protein, 24 aa, Mycobacterium avium
GAPLAALHFFPADTLELGWMQSHV

SEQ ID NO: 126584 - protein, 18 aa, Mycobacterium avium
GAPMTSFYDWYADLPVAS

SEQ ID NO: 126585 - protein, 24 aa, Mycobacterium avium
GAPRHPSWYLNLQANPAAGIQVQA

SEQ ID NO: 126586 - protein, 19 aa, Mycobacterium avium
GAPRPRGGAHRRPGHRRPG

SEQ ID NO: 126587 - protein, 24 aa, Mycobacterium avium
GAPSLLPGGRWAAVLAGAVMLAQC

SEQ ID NO: 126588 - protein, 25 aa, Mycobacterium avium
GAPSLLPGGRWAAVLAGAVMLAQCT

SEQ ID NO: 126589 - protein, 24 aa, Mycobacterium avium
GAPTSAIAFTKRLLNDSPDTDRSG

SEQ ID NO: 126590 - protein, 18 aa, Mycobacterium avium
GAPVLVQVPRRGYVPSLA

SEQ ID NO: 126591 - protein, 19 aa, Mycobacterium avium
GAPVLVQVPRRGYVPSLAC

SEQ ID NO: 126592 - protein, 28 aa, Mycobacterium avium
GAPVRMVPRRVLLERLLDGFPPGRIHCD

SEQ ID NO: 126593 - protein, 20 aa, Mycobacterium avium
GARALLGESWRDGGELLALA

SEQ ID NO: 126594 - protein, 17 aa, Mycobacterium avium
GARLTFRATVQVRVPII

SEQ ID NO: 126595 - protein, 18 aa, Mycobacterium avium
GARLTVLRRLAHPDDARL

SEQ ID NO: 126596 - protein, 32 aa, Mycobacterium avium
GARRVILIHWDDFFRPLSKPLRALPYAGDDLD

SEQ ID NO: 126597 - protein, 17 aa, Mycobacterium avium
GARTVALHLLRSRASAD

SEQ ID NO: 126598 - protein, 25 aa, Mycobacterium avium
GARVGYGFITWSLARNPGVLDLALD

SEQ ID NO: 126599 - protein, 19 aa, Mycobacterium avium
GARVRRANYVYGSAKAGLD

SEQ ID NO: 126600 - protein, 47 aa, Mycobacterium avium
GASDRACSWLPLYHDMGLAFLLTSVLSGMPLWQAPTGAFSAAPLRWA

SEQ ID NO: 126601 - protein, 23 aa, Mycobacterium avium
GASIRSLTIWLSDTGVAPPASKS

SEQ ID NO: 126602 - protein, 26 aa, Mycobacterium avium
GASYAYFGVGIFKNGLLYDTDVICLT

SEQ ID NO: 126603 - protein, 17 aa, Mycobacterium avium
GATLLPELGPEPSDLVL

SEQ ID NO: 126604 - protein, 34 aa, Mycobacterium avium
GATLLWSQSARKRGPWPWLQPNRNDAPPVAGLHL

SEQ ID NO: 126605 - protein, 30 aa, Mycobacterium avium
GATPAQVALAWLLAKGPDVVPIPGTKRVAR

SEQ ID NO: 126606 - protein, 33 aa, Mycobacterium avium
GATPAQVGLAWILARAPHTLLIPGTRSITHLEE

SEQ ID NO: 126607 - protein, 20 aa, Mycobacterium avium
GATPYMVLMAAFAALVHRYT

SEQ ID NO: 126608 - protein, 23 aa, Mycobacterium avium
GATRILRLLATAEAIGGLGACTE

SEQ ID NO: 126609 - protein, 25 aa, Mycobacterium avium
GATVGPFAYLRPGTVLGDDGKLGAF

SEQ ID NO: 126610 - protein, 20 aa, Mycobacterium avium
GAVALLAGLLGRRATARRAA

SEQ ID NO: 126611 - protein, 19 aa, Mycobacterium avium
GAVFGKLPFTMEGIQLEVV

SEQ ID NO: 126612 - protein, 23 aa, Mycobacterium avium
GAVLVPIVHIYGMAEVAFVLDQS

SEQ ID NO: 126613 - protein, 19 aa, Mycobacterium avium
GAVPTIWNAVLHHLEDEPD

SEQ ID NO: 126614 - protein, 33 aa, Mycobacterium avium
GAVPVSTLRPPQARVLLIAALAAGLPAADVLGR

SEQ ID NO: 126615 - protein, 22 aa, Mycobacterium avium
GAYIITGGLGGLGLFLAGEMAC

SEQ ID NO: 126616 - protein, 30 aa, Mycobacterium avium
GCASSAWTLGFYALHNWMLSLFDPQAQREV

SEQ ID NO: 126617 - protein, 18 aa, Mycobacterium avium
GCGFAELSLALAARGYTV

SEQ ID NO: 126618 - protein, 17 aa, Mycobacterium avium
GCLLLVYPNVIAVERQL

SEQ ID NO: 126619 - protein, 18 aa, Mycobacterium avium
GCSDLVPVLLAGYGGVIE

SEQ ID NO: 126620 - protein, 31 aa, Mycobacterium avium
GCWQKITRDLWPAPYLVMDTGASLAPYNHLE

SEQ ID NO: 126621 - protein, 24 aa, Mycobacterium avium
GDAGRAFPASSFLEKARKTIEVQS

SEQ ID NO: 126622 - protein, 24 aa, Mycobacterium avium
GDAGRAFPASSFLEKARKTNEVQS

SEQ ID NO: 126623 - protein, 23 aa, Mycobacterium avium
GDAKVSALRWGSTDPRIVFVHGG

SEQ ID NO: 126624 - protein, 26 aa, Mycobacterium avium
GDALDDGPRMPLLPGSWSAETEDPEN

SEQ ID NO: 126625 - protein, 21 aa, Mycobacterium avium
GDATTITWRQYRDRVRAIAAG

SEQ ID NO: 126626 - protein, 22 aa, Mycobacterium avium
GDCALNRGVFTDAYGVVGAVGE

SEQ ID NO: 126627 - protein, 22 aa, Mycobacterium avium
GDCGEPLFDGWPAVPGLADRYR

SEQ ID NO: 126628 - protein, 20 aa, Mycobacterium avium
GDDELPSLLDFYMCYRAYVR

SEQ ID NO: 126629 - protein, 18 aa, Mycobacterium avium
GDDGRVRRVPPGQPGLLL

SEQ ID NO: 126630 - protein, 24 aa, Mycobacterium avium
GDDGTFLWPGFGDNSRVLKWALQR

SEQ ID NO: 126631 - protein, 27 aa, Mycobacterium avium
GDDTLFLERFMLRPRHIEVQILADAHG

SEQ ID NO: 126632 - protein, 25 aa, Mycobacterium avium
GDEFGGGAGMPLLPGSWAPPDPRDS

SEQ ID NO: 126633 - protein, 18 aa, Mycobacterium avium
GDEKGVIGNSLQLMSNPN

SEQ ID NO: 126634 - protein, 19 aa, Mycobacterium avium
GDEKGVIGNSLQLMSNPNL

SEQ ID NO: 126635 - protein, 26 aa, Mycobacterium avium
GDETLLGSIRRLLTVRRTLARVQVES

SEQ ID NO: 126636 - protein, 17 aa, Mycobacterium avium
GDEWEAFLGKDEDLYVF

SEQ ID NO: 126637 - protein, 25 aa, Mycobacterium avium
GDFFDLVGMAHWRALDEKYAHTGGR

SEQ ID NO: 126638 - protein, 44 aa, Mycobacterium avium
GDFLRTIHEMLLSDGFWDDIFRELSIPYLPIRWSTDNPDSIVDK

SEQ ID NO: 126639 - protein, 25 aa, Mycobacterium avium
GDGALGLVLGIRRLRAYSAARNAHY

SEQ ID NO: 126640 - protein, 23 aa, Mycobacterium avium
GDGALTVAMKHIKEPPPPLPAEL

SEQ ID NO: 126641 - protein, 25 aa, Mycobacterium avium
GDGPHVQLWPHRHGTDAMFAAALRR

SEQ ID NO: 126642 - protein, 24 aa, Mycobacterium avium
GDGPHVQLWPHRHGTDAMFASALR

SEQ ID NO: 126643 - protein, 18 aa, Mycobacterium avium
GDGPIDLVLLPGPSIPID

SEQ ID NO: 126644 - protein, 25 aa, Mycobacterium avium
GDGPQRLLGLLAPAQQHQVHRPHPG

SEQ ID NO: 126645 - protein, 24 aa, Mycobacterium avium
GDGRVRARREISVKIPAGVGDGMR

SEQ ID NO: 126646 - protein, 21 aa, Mycobacterium avium
GDHQLAIMLGGPERDEFFAKA

SEQ ID NO: 126647 - protein, 21 aa, Mycobacterium avium
GDIAALRRLPGQILGRVAFGV

SEQ ID NO: 126648 - protein, 23 aa, Mycobacterium avium
GDIADVVLFLASDDARWVNGQAL

SEQ ID NO: 126649 - protein, 25 aa, Mycobacterium avium
GDIQLYYRRVRGWAMVFGEPAVALD

SEQ ID NO: 126650 - protein, 19 aa, Mycobacterium avium
GDKPFLIADGQELTYIDLD

SEQ ID NO: 126651 - protein, 20 aa, Mycobacterium avium
GDLANWMVPGKMVKGPGGAM

SEQ ID NO: 126652 - protein, 36 aa, Mycobacterium avium
GDLGDVLITRWISTFTPDPVPLPIIGPPGTAELVAA

SEQ ID NO: 126653 - protein, 22 aa, Mycobacterium avium
GDLGGVQRGLPVRLPAGDQVVG

SEQ ID NO: 126654 - protein, 30 aa, Mycobacterium avium
GDLGRRWAGPAFLLNEMLVWGFTGQVISAL

SEQ ID NO: 126655 - protein, 23 aa, Mycobacterium avium
GDLMARLISLRQLSLSVARTLTH

SEQ ID NO: 126656 - protein, 26 aa, Mycobacterium avium
GDLRGSLRLLIRALRGHRRPVAPAGQ

SEQ ID NO: 126657 - protein, 19 aa, Mycobacterium avium
GDLVFQWHRRDVHVAQAHI

SEQ ID NO: 126658 - protein, 17 aa, Mycobacterium avium
GDLVVLASSLIPGNEEA

SEQ ID NO: 126659 - protein, 29 aa, Mycobacterium avium
GDMGAMLGGIIIGDLLSSGMRGGFGGWGP

SEQ ID NO: 126660 - protein, 23 aa, Mycobacterium avium
GDMGLMLGEYWDLSALAADCAAD

SEQ ID NO: 126661 - protein, 27 aa, Mycobacterium avium
GDMVGVPEWLAEILPSAYPSRSIEGLY

SEQ ID NO: 126662 - protein, 21 aa, Mycobacterium avium
GDNARRFMGLPIANPDPEAVK

SEQ ID NO: 126663 - protein, 22 aa, Mycobacterium avium
GDPARMFGRMLGCDLGLNPPFE

SEQ ID NO: 126664 - protein, 22 aa, Mycobacterium avium
GDPHAWAIPRLTGTAKAAFVAV

SEQ ID NO: 126665 - protein, 24 aa, Mycobacterium avium
GDPQGRAMFWLHGTPGARRQIPVE

SEQ ID NO: 126666 - protein, 18 aa, Mycobacterium avium
GDPWAINRSLQAGSPLQI

SEQ ID NO: 126667 - protein, 19 aa, Mycobacterium avium
GDRFTPLSLKHRIFRKAVG

SEQ ID NO: 126668 - protein, 19 aa, Mycobacterium avium
GDRWIINGAKTWSTSAFAA

SEQ ID NO: 126669 - protein, 29 aa, Mycobacterium avium
GDRWIINGAKTWSTWAFAADYGLCLARTD

SEQ ID NO: 126670 - protein, 28 aa, Mycobacterium avium
GDSIGWTWMHYLPPTPGFAFLDHTVIGC

SEQ ID NO: 126671 - protein, 23 aa, Mycobacterium avium
GDSPWQLTVLRPSRSAGSPRTSV

SEQ ID NO: 126672 - protein, 30 aa, Mycobacterium avium
GDTAWLTRPLIDSYHTVWFELHEELIVAVG

SEQ ID NO: 126673 - protein, 24 aa, Mycobacterium avium
GDTGMTYQVWQAQWNEAMESLVRA

SEQ ID NO: 126674 - protein, 22 aa, Mycobacterium avium
GDTLRVLDLTKESVRKAVRDGA

SEQ ID NO: 126675 - protein, 22 aa, Mycobacterium avium
GDTSRLLARFPALGGTDTSGRS

SEQ ID NO: 126676 - protein, 23 aa, Mycobacterium avium
GDTSRLLARFPALGGTDTSGRSM

SEQ ID NO: 126677 - protein, 25 aa, Mycobacterium avium
GDTYGLIRFGSRLDTYLPAGAQPLV

SEQ ID NO: 126678 - protein, 27 aa, Mycobacterium avium
GDVFAGVLAANWPLEPGSPDQRRLALR

SEQ ID NO: 126679 - protein, 22 aa, Mycobacterium avium
GDVFSAGLMLIWACDLIVGSEE

SEQ ID NO: 126680 - protein, 18 aa, Mycobacterium avium
GDWTAPQYALLRAAYESA

SEQ ID NO: 126681 - protein, 27 aa, Mycobacterium avium
GDWWDAAYLMMWGSNVPITRTPDAHWM

SEQ ID NO: 126682 - protein, 19 aa, Mycobacterium avium
GDYDIGIAIGLDKHPRGAF

SEQ ID NO: 126683 - protein, 25 aa, Mycobacterium avium
GEAAYPTVPYLFSASPARISTAAPS

SEQ ID NO: 126684 - protein, 19 aa, Mycobacterium avium
GEAHRAILDVLAGGGGYFF

SEQ ID NO: 126685 - protein, 18 aa, Mycobacterium avium
GEAKPTVVTNRPNRRIVI

SEQ ID NO: 126686 - protein, 23 aa, Mycobacterium avium
GEAKPTVVTNRPNRRIVIMPSDD

SEQ ID NO: 126687 - protein, 33 aa, Mycobacterium avium
GEALDMWMQSPPHRAIILNCGFTAGGFATARDG

SEQ ID NO: 126688 - protein, 25 aa, Mycobacterium avium
GEAVSVDLPLARLAYEGLAAGLGVP

SEQ ID NO: 126689 - protein, 23 aa, Mycobacterium avium
GEELRLKYRYLDLRRDAPASAIR

SEQ ID NO: 126690 - protein, 23 aa, Mycobacterium avium
GEEPMIFYRDLVRLMTHLSDKHG

SEQ ID NO: 126691 - protein, 22 aa, Mycobacterium avium
GEFDYNLQWKPVGGFPITFGWL

SEQ ID NO: 126692 - protein, 21 aa, Mycobacterium avium
GEFHHPLAHPGTARLEQVEGA

SEQ ID NO: 126693 - protein, 19 aa, Mycobacterium avium
GEFRKLWISRINAAARAND

SEQ ID NO: 126694 - protein, 23 aa, Mycobacterium avium
GEGFHCIAPTWPLGAHSTPTGGA

SEQ ID NO: 126695 - protein, 21 aa, Mycobacterium avium
GEGLRYLMSHLPRERLGVTAK

SEQ ID NO: 126696 - protein, 22 aa, Mycobacterium avium
GEGLVVWFNTLLASGGGRVLSE

SEQ ID NO: 126697 - protein, 26 aa, Mycobacterium avium
GEIAVRVIRTLRRLGIRSVAVYSDPD

SEQ ID NO: 126698 - protein, 17 aa, Mycobacterium avium
GEILARVRQRSLAAYEH

SEQ ID NO: 126699 - protein, 17 aa, Mycobacterium avium
GEIPCITGRQWRAERRG

SEQ ID NO: 126700 - protein, 22 aa, Mycobacterium avium
GEIVDRFITRPPTNPRAPGVVV

SEQ ID NO: 126701 - protein, 28 aa, Mycobacterium avium
GEKAPLEQLLLERAYLLGVTGPEMTVLV

SEQ ID NO: 126702 - protein, 18 aa, Mycobacterium avium
GEKTPEGVGWLYNFIRAQ

SEQ ID NO: 126703 - protein, 23 aa, Mycobacterium avium
GEKTPEGVGWLYNFIRAQGERNY

SEQ ID NO: 126704 - protein, 19 aa, Mycobacterium avium
GELFNIPLTAHFLGGAVIG

SEQ ID NO: 126705 - protein, 29 aa, Mycobacterium avium
GELLSYVRGVLYFRTGRWPDVLNQFPEGK

SEQ ID NO: 126706 - protein, 23 aa, Mycobacterium avium
GELRPQLLDRFGLTVDVHASRDV

SEQ ID NO: 126707 - protein, 20 aa, Mycobacterium avium
GELRRRFALAARIRPRRSLT

SEQ ID NO: 126708 - protein, 17 aa, Mycobacterium avium
GENFRRGGFLAHADRYR

SEQ ID NO: 126709 - protein, 26 aa, Mycobacterium avium
GENVLLIALHYRVGGSVWGVGDTIIN

SEQ ID NO: 126710 - protein, 18 aa, Mycobacterium avium
GEPLPPLLAATAAAQRAG

SEQ ID NO: 126711 - protein, 22 aa, Mycobacterium avium
GEPPVVIGPLFQDKTLKVCATE

SEQ ID NO: 126712 - protein, 23 aa, Mycobacterium avium
GEPRPRIALAAPTGKAAARLAEA

SEQ ID NO: 126713 - protein, 23 aa, Mycobacterium avium
GEPTWSYLYRTMITPLTDAGNRV

SEQ ID NO: 126714 - protein, 19 aa, Mycobacterium avium
GEPVVPSLRMLIGGGAACP

SEQ ID NO: 126715 - protein, 23 aa, Mycobacterium avium
GEPYRRMDPIAPKAPVVPAEAPG

SEQ ID NO: 126716 - protein, 19 aa, Mycobacterium avium
GEQALIDALRRAVAFRRFR

SEQ ID NO: 126717 - protein, 37 aa, Mycobacterium avium
GEQAVFIERLRYLGELPLSLDLTYLAPPIGRQVLEHS

SEQ ID NO: 126718 - protein, 17 aa, Mycobacterium avium
GEQFFVEVFKQALPLIR

SEQ ID NO: 126719 - protein, 21 aa, Mycobacterium avium
GEQFFVEVFKQALPLIRDDQL

SEQ ID NO: 126720 - protein, 26 aa, Mycobacterium avium
GEQLTQAAWVFLPERPSDASAVLLCL

SEQ ID NO: 126721 - protein, 21 aa, Mycobacterium avium
GEQVFLCPLELASFTLATPED

SEQ ID NO: 126722 - protein, 32 aa, Mycobacterium avium
GERILTWRQLYNLDALPDHLIVVGSGVTGAEF

SEQ ID NO: 126723 - protein, 26 aa, Mycobacterium avium
GERKLYRARFLFFGSGYYNYDEGYTP

SEQ ID NO: 126724 - protein, 17 aa, Mycobacterium avium
GERLAMAVVLEPGVEIS

SEQ ID NO: 126725 - protein, 24 aa, Mycobacterium avium
GERLPAYMVPAAIVALDAIPLTPN

SEQ ID NO: 126726 - protein, 25 aa, Mycobacterium avium
GERLRDMLWTAIFPSIDLKTDSARE

SEQ ID NO: 126727 - protein, 26 aa, Mycobacterium avium
GERPARVTELLPLAAAYDMTAAELAA

SEQ ID NO: 126728 - protein, 20 aa, Mycobacterium avium
GERPPAYDVPALLAARSSSV

SEQ ID NO: 126729 - protein, 20 aa, Mycobacterium avium
GERRPGWVGLPLTGVQTRVV

SEQ ID NO: 126730 - protein, 17 aa, Mycobacterium avium
GERSGREVLYRLADHHL

SEQ ID NO: 126731 - protein, 18 aa, Mycobacterium avium
GERSGREVLYRLADHHLA

SEQ ID NO: 126732 - protein, 19 aa, Mycobacterium avium
GERSGREVLYRLADHHLAH

SEQ ID NO: 126733 - protein, 29 aa, Mycobacterium avium
GERSSHTWFVLYELLGHRNVKNYNGSWTE

SEQ ID NO: 126734 - protein, 24 aa, Mycobacterium avium
GERVLAAQWRALPDILTDADVTAL

SEQ ID NO: 126735 - protein, 26 aa, Mycobacterium avium
GESTAAFWSAIFNVPAEHLGADRWGL

SEQ ID NO: 126736 - protein, 32 aa, Mycobacterium avium
GESWSTLVRHRPTGRRLLICGSAGFVAGALAG

SEQ ID NO: 126737 - protein, 17 aa, Mycobacterium avium
GETASIFLPSVPNLLQL

SEQ ID NO: 126738 - protein, 31 aa, Mycobacterium avium
GETKGRWWTDDGLWKEIVSTGWLGLHVDEAF

SEQ ID NO: 126739 - protein, 24 aa, Mycobacterium avium
GEVPLIGFAGAPFTLASYLIEGGP

SEQ ID NO: 126740 - protein, 26 aa, Mycobacterium avium
GEVPLRRALIFPVCDLALHSWDIHRC

SEQ ID NO: 126741 - protein, 22 aa, Mycobacterium avium
GFAVRLHAVLPPVAAAGTCLSL

SEQ ID NO: 126742 - protein, 17 aa, Mycobacterium avium
GFDKGQPTAWIAEGLFG

SEQ ID NO: 126743 - protein, 24 aa, Mycobacterium avium
GFDPLDVIAPFEVLAAGAAMVAGE

SEQ ID NO: 126744 - protein, 17 aa, Mycobacterium avium
GFDVVYVPPIHPIGKVH

SEQ ID NO: 126745 - protein, 25 aa, Mycobacterium avium
GFFDAEVPRRWRSPAPLWGDVSFES

SEQ ID NO: 126746 - protein, 19 aa, Mycobacterium avium
GFFGWEAAGLRWLSSVDGG

SEQ ID NO: 126747 - protein, 40 aa, Mycobacterium avium
GFGFDLFRQTLARRLHLLEPLRYQLTEIRGRIHRAMWLEN

SEQ ID NO: 126748 - protein, 31 aa, Mycobacterium avium
GFGHTPDHPAPLFDPNRLAALWGPTVHLVAD

SEQ ID NO: 126749 - protein, 25 aa, Mycobacterium avium
GFGPEVKRRIMIGTYALSAGYYDAY

SEQ ID NO: 126750 - protein, 25 aa, Mycobacterium avium
GFGPFTPGFRSVPFGDAGALAQAID

SEQ ID NO: 126751 - protein, 26 aa, Mycobacterium avium
GFGPFTPGFRSVPFGDAGTLAQAIDD

SEQ ID NO: 126752 - protein, 20 aa, Mycobacterium avium
GFHIDMLIIVETSADKRILA

SEQ ID NO: 126753 - protein, 22 aa, Mycobacterium avium
GFHVVAVLDGRRRLAARRPATT

SEQ ID NO: 126754 - protein, 35 aa, Mycobacterium avium
GFIGSPAMNFFPATLTPIGLKLPFGEVMLTPEIQQ

SEQ ID NO: 126755 - protein, 21 aa, Mycobacterium avium
GFKAVFLPTTPHPSAPDWHRK

SEQ ID NO: 126756 - protein, 19 aa, Mycobacterium avium
GFLAGLRYDALLPAIHKTN

SEQ ID NO: 126757 - protein, 17 aa, Mycobacterium avium
GFLDGLLDVVRKVVTPA

SEQ ID NO: 126758 - protein, 18 aa, Mycobacterium avium
GFPVVLIPKVSAADLPRV

SEQ ID NO: 126759 - protein, 23 aa, Mycobacterium avium
GFRLGITTDWKSRWYADKQYADY

SEQ ID NO: 126760 - protein, 18 aa, Mycobacterium avium
GFRLVDLYSAPSMRELNT

SEQ ID NO: 126761 - protein, 25 aa, Mycobacterium avium
GFRVRRLAGRVVWMQPPDTPPRAQT

SEQ ID NO: 126762 - protein, 27 aa, Mycobacterium avium
GFSFHDLRHYLASLLIARGCDVKTVQA

SEQ ID NO: 126763 - protein, 23 aa, Mycobacterium avium
GFTANVLLRLCKDAELRAKFTAD

SEQ ID NO: 126764 - protein, 23 aa, Mycobacterium avium
GFTGTTLWMDPGSDTYVILLSNS

SEQ ID NO: 126765 - protein, 25 aa, Mycobacterium avium
GFTGTTLWMDPGSDTYVILLSNSIH

SEQ ID NO: 126766 - protein, 35 aa, Mycobacterium avium
GFTGTTLWMDPGSDTYVILLSNSIHLRGSPPISNL

SEQ ID NO: 126767 - protein, 17 aa, Mycobacterium avium
GFTLGLGPSHEPLVSGV

SEQ ID NO: 126768 - protein, 25 aa, Mycobacterium avium
GFTWEHPAHLLLRRAKANAVLVGRP

SEQ ID NO: 126769 - protein, 27 aa, Mycobacterium avium
GFVGRYLVLQWLERLELADGKLICLVR

SEQ ID NO: 126770 - protein, 19 aa, Mycobacterium avium
GFVNDLELILTGVVFGFLT

SEQ ID NO: 126771 - protein, 25 aa, Mycobacterium avium
GGAAVELVWIIAQRLGLAVQPVSPV

SEQ ID NO: 126772 - protein, 33 aa, Mycobacterium avium
GGAELRAAFTDRFVPALQAFSPELIIVSAGFNA

SEQ ID NO: 126773 - protein, 23 aa, Mycobacterium avium
GGAHIVMIGILPTLMPEHLDHDW

SEQ ID NO: 126774 - protein, 30 aa, Mycobacterium avium
GGAIIRQPIPPFKWWRGLRARQLLEDYFSE

SEQ ID NO: 126775 - protein, 24 aa, Mycobacterium avium
GGAKHPAWYFNLKAHPEATVTVGR

SEQ ID NO: 126776 - protein, 28 aa, Mycobacterium avium
GGAKPGWPGFVSTPLHAYRRHFDIAVFA

SEQ ID NO: 126777 - protein, 24 aa, Mycobacterium avium
GGALGKWLKKLLSSARKTGSGGGP

SEQ ID NO: 126778 - protein, 20 aa, Mycobacterium avium
GGALGKWLKKLLSSARKTGT

SEQ ID NO: 126779 - protein, 23 aa, Mycobacterium avium
GGALGKWLKKLLSSARKTGTGGG

SEQ ID NO: 126780 - protein, 20 aa, Mycobacterium avium
GGALNVFELQKAMIAAGVAG

SEQ ID NO: 126781 - protein, 30 aa, Mycobacterium avium
GGALVLVAPHDPIPLLRQLDHRTSGRLEIR

SEQ ID NO: 126782 - protein, 21 aa, Mycobacterium avium
GGANLRAAWLTMIAVASTHQG

SEQ ID NO: 126783 - protein, 34 aa, Mycobacterium avium
GGAPDDFRWPFNNPGYWMTPMFTLAVGGVGAGDP

SEQ ID NO: 126784 - protein, 29 aa, Mycobacterium avium
GGARPPRIGIPLKVMYALGLCGDVAAKVL

SEQ ID NO: 126785 - protein, 24 aa, Mycobacterium avium
GGAVFVLDEWLRPVPPGVVGELYV

SEQ ID NO: 126786 - protein, 22 aa, Mycobacterium avium
GGAWLHVRLPEAPAPPQNTPVD

SEQ ID NO: 126787 - protein, 19 aa, Mycobacterium avium
GGAYRLIDFVLSNLVNARY

SEQ ID NO: 126788 - protein, 36 aa, Mycobacterium avium
GGDAGAIAYPYYLVNGRIAAFPKTFNAKPGQRIRIR

SEQ ID NO: 126789 - protein, 28 aa, Mycobacterium avium
GGDAGDIAYPYYLVNGRIAASPKIFNAK

SEQ ID NO: 126790 - protein, 20 aa, Mycobacterium avium
GGDFVSTWRVLEEFARDGRA

SEQ ID NO: 126791 - protein, 18 aa, Mycobacterium avium
GGDIRLSRAGRPVYHHLG

SEQ ID NO: 126792 - protein, 26 aa, Mycobacterium avium
GGEGTPYVTPLVRRLAAENDIDLSSI

SEQ ID NO: 126793 - protein, 27 aa, Mycobacterium avium
GGEPRDWFEVSLIPTTRELTTLGGAPV

SEQ ID NO: 126794 - protein, 23 aa, Mycobacterium avium
GGESRYFIDFADNWYIVNSSDRR

SEQ ID NO: 126795 - protein, 26 aa, Mycobacterium avium
GGETGYLWNGVPILLLTVTGRRTGRA

SEQ ID NO: 126796 - protein, 17 aa, Mycobacterium avium
GGEWRRPPVRDGGCTRR

SEQ ID NO: 126797 - protein, 24 aa, Mycobacterium avium
GGFAVRLHAVLPPVAAAGTCLSLR

SEQ ID NO: 126798 - protein, 19 aa, Mycobacterium avium
GGFLAWGDPSLYDSTLRIL

SEQ ID NO: 126799 - protein, 22 aa, Mycobacterium avium
GGFPPMRSWQEPTVRSPGGGAE

SEQ ID NO: 126800 - protein, 17 aa, Mycobacterium avium
GGGALRALGAAPPRSRH

SEQ ID NO: 126801 - protein, 17 aa, Mycobacterium avium
GGGAVPGVRRRGRRRPT

SEQ ID NO: 126802 - protein, 24 aa, Mycobacterium avium
GGGLASCHPGMRGMFLMVEAVRQL

SEQ ID NO: 126803 - protein, 17 aa, Mycobacterium avium
GGGLGISYLAADEPPPM

SEQ ID NO: 126804 - protein, 25 aa, Mycobacterium avium
GGGPGRRVLFDPVTLLPNPEVPEEV

SEQ ID NO: 126805 - protein, 28 aa, Mycobacterium avium
GGGTQLAELLWSFAPAPRSRPADASEIP

SEQ ID NO: 126806 - protein, 23 aa, Mycobacterium avium
GGHGLHLFATLLSAAERAGAGPL

SEQ ID NO: 126807 - protein, 17 aa, Mycobacterium avium
GGHLFSIYDGCRDEGIR

SEQ ID NO: 126808 - protein, 25 aa, Mycobacterium avium
GGIGFTWEYPLHYELRRVFTNSHLI

SEQ ID NO: 126809 - protein, 28 aa, Mycobacterium avium
GGIYGDFYNFYLCDISIKVNGLQPGGPV

SEQ ID NO: 126810 - protein, 21 aa, Mycobacterium avium
GGKTFPLPNPFLVMATQNPIE

SEQ ID NO: 126811 - protein, 18 aa, Mycobacterium avium
GGLGGMFGLSSNGANIGN

SEQ ID NO: 126812 - protein, 22 aa, Mycobacterium avium
GGLGGMFGLSSNGANIGNIGIG

SEQ ID NO: 126813 - protein, 24 aa, Mycobacterium avium
GGLNLSIRDGWWDEWYDGENGWEI

SEQ ID NO: 126814 - protein, 19 aa, Mycobacterium avium
GGLPELRRCREVTSLLGLF

SEQ ID NO: 126815 - protein, 24 aa, Mycobacterium avium
GGMVRTVSWLYLGQTMVIHQRFDP

SEQ ID NO: 126816 - protein, 17 aa, Mycobacterium avium
GGPLMHVIAAKAVALKI

SEQ ID NO: 126817 - protein, 21 aa, Mycobacterium avium
GGPLRIRVYRPEAAAPLPVVV

SEQ ID NO: 126818 - protein, 26 aa, Mycobacterium avium
GGPSGTDTIPAWLSPHEYVEPSEAVD

SEQ ID NO: 126819 - protein, 22 aa, Mycobacterium avium
GGPVHKVIADRLRISCAEACRR

SEQ ID NO: 126820 - protein, 18 aa, Mycobacterium avium
GGPYAGTWLLSSSVLADH

SEQ ID NO: 126821 - protein, 26 aa, Mycobacterium avium
GGQGLTLMQQLIWYEEYAARGFPGID

SEQ ID NO: 126822 - protein, 26 aa, Mycobacterium avium
GGRDGLIHSVAVNPLFLVLSGGGPDV

SEQ ID NO: 126823 - protein, 17 aa, Mycobacterium avium
GGRFGLIWTSRDRDVDW

SEQ ID NO: 126824 - protein, 22 aa, Mycobacterium avium
GGRLFDIDGIPGAPPGLAINPL

SEQ ID NO: 126825 - protein, 17 aa, Mycobacterium avium
GGRLVVELTPDEAAALG

SEQ ID NO: 126826 - protein, 21 aa, Mycobacterium avium
GGRMMVTFGVGWLAREFELLG

SEQ ID NO: 126827 - protein, 19 aa, Mycobacterium avium
GGRSFDVYPVNYPATDQWD

SEQ ID NO: 126828 - protein, 17 aa, Mycobacterium avium
GGRVKVYSMASPLGRSV

SEQ ID NO: 126829 - protein, 28 aa, Mycobacterium avium
GGSSFLGLGLYPGFVGESLAPILSRLTE

SEQ ID NO: 126830 - protein, 18 aa, Mycobacterium avium
GGTPPFITAARGCRLTDA

SEQ ID NO: 126831 - protein, 23 aa, Mycobacterium avium
GGTRQDYLSRLPASLLASADMAH

SEQ ID NO: 126832 - protein, 23 aa, Mycobacterium avium
GGVFRIVEQLPRKVALELVLTGE

SEQ ID NO: 126833 - protein, 29 aa, Mycobacterium avium
GGVQVRIPGLPPVTIGPRPTARPAGKGRR

SEQ ID NO: 126834 - protein, 22 aa, Mycobacterium avium
GGVVFLLHPLAGLLLGQMLGPV

SEQ ID NO: 126835 - protein, 22 aa, Mycobacterium avium
GGWAGIAWPTEYGGKGLTLLQQ

SEQ ID NO: 126836 - protein, 18 aa, Mycobacterium avium
GGWDLHVPPPGSVDARPI

SEQ ID NO: 126837 - protein, 28 aa, Mycobacterium avium
GGYFCRGLPRDFDRLGLPGWAWSDVLDS

SEQ ID NO: 126838 - protein, 24 aa, Mycobacterium avium
GHALGGGCELAMMCDVLIAADTAK

SEQ ID NO: 126839 - protein, 23 aa, Mycobacterium avium
GHARACGWAIRDGVVGPSSTPGH

SEQ ID NO: 126840 - protein, 25 aa, Mycobacterium avium
GHDLSDPLWSARLLADAPQEIVAVH

SEQ ID NO: 126841 - protein, 22 aa, Mycobacterium avium
GHDVRMLLAKNPAGWQEALSMV

SEQ ID NO: 126842 - protein, 25 aa, Mycobacterium avium
GHEAKVDWILRNSLPLRSTAELSRQ

SEQ ID NO: 126843 - protein, 25 aa, Mycobacterium avium
GHEPKVDWILRNSFPLRSTAELSRQ

SEQ ID NO: 126844 - protein, 27 aa, Mycobacterium avium
GHGDPVEIMRLCAALWLDACADPEIQR

SEQ ID NO: 126845 - protein, 31 aa, Mycobacterium avium
GHGQRWQHLAGLLPEFAWAAPDLVGHGRSSW

SEQ ID NO: 126846 - protein, 31 aa, Mycobacterium avium
GHLAAELMGRFAFDRPGLAAMSLPDATAAIT

SEQ ID NO: 126847 - protein, 18 aa, Mycobacterium avium
GHLDPTVFQRLAPGIMPL

SEQ ID NO: 126848 - protein, 17 aa, Mycobacterium avium
GHLFTRGHRLDWAGVFA

SEQ ID NO: 126849 - protein, 27 aa, Mycobacterium avium
GHPHALQLIMDSLRYWVTEMHVDGFRF

SEQ ID NO: 126850 - protein, 23 aa, Mycobacterium avium
GHPVLLESFLDGPEVSLFCVVDG

SEQ ID NO: 126851 - protein, 20 aa, Mycobacterium avium
GHRRPFVGSLTLGLASGVDD

SEQ ID NO: 126852 - protein, 18 aa, Mycobacterium avium
GHTDAVLWDLQRPNPALL

SEQ ID NO: 126853 - protein, 28 aa, Mycobacterium avium
GHTGPVATTLLLLSVLDAVRGTGIPVIA

SEQ ID NO: 126854 - protein, 18 aa, Mycobacterium avium
GHTITVNGDLAFTPGPEG

SEQ ID NO: 126855 - protein, 19 aa, Mycobacterium avium
GHTLVRKHQPLYARVTRAG

SEQ ID NO: 126856 - protein, 25 aa, Mycobacterium avium
GHTRRAIVRLLLESGSITAGEIGDR

SEQ ID NO: 126857 - protein, 25 aa, Mycobacterium avium
GHTVGKYAESLLTLGWAEEFASVPI

SEQ ID NO: 126858 - protein, 17 aa, Mycobacterium avium
GHTVRVYVPFGTQWYGY

SEQ ID NO: 126859 - protein, 22 aa, Mycobacterium avium
GHVALPPPLTTGGPPIWIGGNG

SEQ ID NO: 126860 - protein, 23 aa, Mycobacterium avium
GHVPVLLERCVELLTPALTRRHP

SEQ ID NO: 126861 - protein, 43 aa, Mycobacterium avium
GHVYAGELLFLYNGVRPRHVMPVHGTWRMLRANSKLAARTGVP

SEQ ID NO: 126862 - protein, 24 aa, Mycobacterium avium
GIAAFIICASLIRQFEFAQNVWIN

SEQ ID NO: 126863 - protein, 42 aa, Mycobacterium avium
GIALLSRYPVASWQVLRLPRIPMRFPMYLPGPNRVMIVDEEP

SEQ ID NO: 126864 - protein, 22 aa, Mycobacterium avium
GIAQAWRNIVFGEADIAICGGV

SEQ ID NO: 126865 - protein, 27 aa, Mycobacterium avium
GIDAPRQNPWWWDVLRNGRSSPYATFF

SEQ ID NO: 126866 - protein, 25 aa, Mycobacterium avium
GIDLSRTVGWFTTKYPVSLDVAGLR

SEQ ID NO: 126867 - protein, 23 aa, Mycobacterium avium
GIDQCVMYPTLASLIEERTTDDV

SEQ ID NO: 126868 - protein, 24 aa, Mycobacterium avium
GIELADLVVLLDHFGIKSEMVSAT

SEQ ID NO: 126869 - protein, 18 aa, Mycobacterium avium
GIFLVPAQWQAVCAEQRA

SEQ ID NO: 126870 - protein, 21 aa, Mycobacterium avium
GIGNVYCNELCFVSGHLPTAP

SEQ ID NO: 126871 - protein, 21 aa, Mycobacterium avium
GIGNVYCNELCFVSGHLPTTP

SEQ ID NO: 126872 - protein, 20 aa, Mycobacterium avium
GIGNVYCNELCFVSGQLPTA

SEQ ID NO: 126873 - protein, 18 aa, Mycobacterium avium
GIGVTPILPMIRVAAGRG

SEQ ID NO: 126874 - protein, 19 aa, Mycobacterium avium
GIIARFNGRTGYHLGLRAG

SEQ ID NO: 126875 - protein, 18 aa, Mycobacterium avium
GIITDPYPTYARLREEAP

SEQ ID NO: 126876 - protein, 18 aa, Mycobacterium avium
GIKPIIGVEAYIAPGSRF

SEQ ID NO: 126877 - protein, 18 aa, Mycobacterium avium
GILRKPVIRLGHNDPRFS

SEQ ID NO: 126878 - protein, 17 aa, Mycobacterium avium
GINCLTGQHWLDVCAMV

SEQ ID NO: 126879 - protein, 25 aa, Mycobacterium avium
GINHLGHFALTCLLGDRIRDRVVLV

SEQ ID NO: 126880 - protein, 26 aa, Mycobacterium avium
GIPAVTFWAAVPHYVSQPPNPKATVA

SEQ ID NO: 126881 - protein, 21 aa, Mycobacterium avium
GIQIVPFLARYAQHLYVFQRT

SEQ ID NO: 126882 - protein, 24 aa, Mycobacterium avium
GIREEWLPLFDQYQVDLVLCGHEH

SEQ ID NO: 126883 - protein, 19 aa, Mycobacterium avium
GIRLRLFHGRGGTVGRGGG

SEQ ID NO: 126884 - protein, 19 aa, Mycobacterium avium
GIRPSFPALAASLANLGRV

SEQ ID NO: 126885 - protein, 18 aa, Mycobacterium avium
GIRVLRYGSGPHGQAPSG

SEQ ID NO: 126886 - protein, 27 aa, Mycobacterium avium
GIRVNAICPAAMPLTGFMAAGGLEVDA

SEQ ID NO: 126887 - protein, 25 aa, Mycobacterium avium
GISISTYFRYAPTKEGLLVDPAREV

SEQ ID NO: 126888 - protein, 32 aa, Mycobacterium avium
GITLARMMTRRQFGRTLFEHQALRLRMADLQA

SEQ ID NO: 126889 - protein, 30 aa, Mycobacterium avium
GITLFIVPTDSPGFSWKPLHTMPGVSTYYT

SEQ ID NO: 126890 - protein, 19 aa, Mycobacterium avium
GITPFTEPPVPLVLQEMTL

SEQ ID NO: 126891 - protein, 20 aa, Mycobacterium avium
GITPFYVMDVWLAAAERQRS

SEQ ID NO: 126892 - protein, 25 aa, Mycobacterium avium
GITRGALYFYFGSKQEVITALFART

SEQ ID NO: 126893 - protein, 20 aa, Mycobacterium avium
GIVPVVFTYAADSPLLSAED

SEQ ID NO: 126894 - protein, 21 aa, Mycobacterium avium
GIVRPLNVLHRSRPSLGVCGG

SEQ ID NO: 126895 - protein, 22 aa, Mycobacterium avium
GIWMRPEAVPGFRRLTDAIHAE

SEQ ID NO: 126896 - protein, 20 aa, Mycobacterium avium
GIYLGHGYTVEKIRVFDAFP

SEQ ID NO: 126897 - protein, 22 aa, Mycobacterium avium
GKAALALLARYADPHSLIRLGH

SEQ ID NO: 126898 - protein, 23 aa, Mycobacterium avium
GKAALYRRWDTKCELVHAALVFA

SEQ ID NO: 126899 - protein, 20 aa, Mycobacterium avium
GKCFPSGNYAKYCRPHRFSC

SEQ ID NO: 126900 - protein, 23 aa, Mycobacterium avium
GKCPPPAGFFGTVASVDGNTIAV

SEQ ID NO: 126901 - protein, 27 aa, Mycobacterium avium
GKEADPRAVVWLLARPLANSIAAGEMF

SEQ ID NO: 126902 - protein, 27 aa, Mycobacterium avium
GKFAAEHPWLLGAYLTHTFGVDEVQDA

SEQ ID NO: 126903 - protein, 26 aa, Mycobacterium avium
GKGLTLLQQLIWYEEYAARGFPGIDA

SEQ ID NO: 126904 - protein, 23 aa, Mycobacterium avium
GKGSPEWWVVNVKPGRVLFELSY

SEQ ID NO: 126905 - protein, 25 aa, Mycobacterium avium
GKGTLFRRFGSRAGLMMVLLDEDER

SEQ ID NO: 126906 - protein, 22 aa, Mycobacterium avium
GKLAPRPFVLVGQQYLADPSRS

SEQ ID NO: 126907 - protein, 26 aa, Mycobacterium avium
GKLPSHLEWVAPFGALSAANWLAMPA

SEQ ID NO: 126908 - protein, 23 aa, Mycobacterium avium
GKLRPPVFGILRYLADAVDEIDG

SEQ ID NO: 126909 - protein, 18 aa, Mycobacterium avium
GKPTFWISDALAGPNREV

SEQ ID NO: 126910 - protein, 17 aa, Mycobacterium avium
GKRIRQPVPLTLSVRPP

SEQ ID NO: 126911 - protein, 29 aa, Mycobacterium avium
GKRRYAVTTLVDLAPRPALPHITEEDLAT

SEQ ID NO: 126912 - protein, 24 aa, Mycobacterium avium
GKSAAATGWLHRPSGRDGKRSQTH

SEQ ID NO: 126913 - protein, 24 aa, Mycobacterium avium
GKSAIPAYSLRFVLRCEPVGVNRF

SEQ ID NO: 126914 - protein, 39 aa, Mycobacterium avium
GKSARVEFWAFDLLYLDGRSLLRARYRDRRKLLEMLASG

SEQ ID NO: 126915 - protein, 28 aa, Mycobacterium avium
GKSTALRLILRALQMQLGRGGTIVLGDG

SEQ ID NO: 126916 - protein, 21 aa, Mycobacterium avium
GKSTLLHLLGALDSPDSGSIR

SEQ ID NO: 126917 - protein, 27 aa, Mycobacterium avium
GKTHSMLALWHVAAGLPVGEFPQDTQE

SEQ ID NO: 126918 - protein, 18 aa, Mycobacterium avium
GKVSRVLLTSGKLYYELV

SEQ ID NO: 126919 - protein, 25 aa, Mycobacterium avium
GKVTVWKDYWDMQSLVAFAPPNHFD

SEQ ID NO: 126920 - protein, 25 aa, Mycobacterium avium
GKVTVWKDYWDMQSLVAFAPPNHFE

SEQ ID NO: 126921 - protein, 20 aa, Mycobacterium avium
GKWIHPPLERSRYTGGPVHF

SEQ ID NO: 126922 - protein, 24 aa, Mycobacterium avium
GLAAELPEWLMLARGIESDVDDMT

SEQ ID NO: 126923 - protein, 18 aa, Mycobacterium avium
GLAAVQERIGYWGEHRYD

SEQ ID NO: 126924 - protein, 27 aa, Mycobacterium avium
GLAKVRGIFLALLDRDPCPTPAETLSL

SEQ ID NO: 126925 - protein, 25 aa, Mycobacterium avium
GLALSPTLIFDYPNSAALAGYMYRE

SEQ ID NO: 126926 - protein, 18 aa, Mycobacterium avium
GLANIALLRGPAGMDQET

SEQ ID NO: 126927 - protein, 17 aa, Mycobacterium avium
GLAPQPRPAYITFSYAA

SEQ ID NO: 126928 - protein, 19 aa, Mycobacterium avium
GLAVLTIDRPHPRNAIALD

SEQ ID NO: 126929 - protein, 24 aa, Mycobacterium avium
GLAVQPVSPVFLYAHNRAEFDQLS

SEQ ID NO: 126930 - protein, 30 aa, Mycobacterium avium
GLAVRMLGKTWLSTPNLPGGPFEPFAAVLD

SEQ ID NO: 126931 - protein, 19 aa, Mycobacterium avium
GLAVRTLFHAPSVRGLCRQ

SEQ ID NO: 126932 - protein, 20 aa, Mycobacterium avium
GLAVRTLFHAPSVRGLCRQL

SEQ ID NO: 126933 - protein, 20 aa, Mycobacterium avium
GLAYANLALLLGNAELARGA

SEQ ID NO: 126934 - protein, 24 aa, Mycobacterium avium
GLDADYWYRNIRQTVQFDQAVRSA

SEQ ID NO: 126935 - protein, 25 aa, Mycobacterium avium
GLDADYWYRNIRQTVQFDQAVRSAA

SEQ ID NO: 126936 - protein, 21 aa, Mycobacterium avium
GLDADYWYRNIRQTVQFDQTV

SEQ ID NO: 126937 - protein, 24 aa, Mycobacterium avium
GLDAVIHAAGLWLPGIAGTITDAD

SEQ ID NO: 126938 - protein, 17 aa, Mycobacterium avium
GLDDVIFHLAITPDRGY

SEQ ID NO: 126939 - protein, 18 aa, Mycobacterium avium
GLDDVIFHLAITPDRGYC

SEQ ID NO: 126940 - protein, 19 aa, Mycobacterium avium
GLDEYVDWLIEAGYLIERV

SEQ ID NO: 126941 - protein, 26 aa, Mycobacterium avium
GLDIENYWFRRHEVVYQRLARHCAGR

SEQ ID NO: 126942 - protein, 17 aa, Mycobacterium avium
GLDQRFDRDLWAKLIDA

SEQ ID NO: 126943 - protein, 22 aa, Mycobacterium avium
GLDSRAWRLPFEDGTTVYELDQ

SEQ ID NO: 126944 - protein, 23 aa, Mycobacterium avium
GLDVLVHAAGLWQPGIPGCIGAD

SEQ ID NO: 126945 - protein, 18 aa, Mycobacterium avium
GLEQRFDRDLWAKLIDAG

SEQ ID NO: 126946 - protein, 21 aa, Mycobacterium avium
GLESDLIAIFLDAPASVVGMG

SEQ ID NO: 126947 - protein, 19 aa, Mycobacterium avium
GLEWDAVFLVGLADGTLPI

SEQ ID NO: 126948 - protein, 18 aa, Mycobacterium avium
GLGEWVVPTLLQHGSKEQ

SEQ ID NO: 126949 - protein, 24 aa, Mycobacterium avium
GLGRKAPIYVIEDAPWSAFRDRDN

SEQ ID NO: 126950 - protein, 27 aa, Mycobacterium avium
GLGSDDRIFLISPLASVTGVLQALFIG

SEQ ID NO: 126951 - protein, 17 aa, Mycobacterium avium
GLGVQRVGIQRALRGHR

SEQ ID NO: 126952 - protein, 28 aa, Mycobacterium avium
GLHAPSWCDPVWLDFPGIAFGRPDEAGA

SEQ ID NO: 126953 - protein, 17 aa, Mycobacterium avium
GLHPGGQRLVDGGLLEA

SEQ ID NO: 126954 - protein, 23 aa, Mycobacterium avium
GLHRPDPLVGRAQLAVGGGHGDD

SEQ ID NO: 126955 - protein, 24 aa, Mycobacterium avium
GLIDDFMVMVRPLSGATPLSEAMG

SEQ ID NO: 126956 - protein, 23 aa, Mycobacterium avium
GLKGGVCYFLWDRDNPGSCRVTT

SEQ ID NO: 126957 - protein, 27 aa, Mycobacterium avium
GLKHTEVLPLYARLPTAEQQKVFAPHT

SEQ ID NO: 126958 - protein, 25 aa, Mycobacterium avium
GLKMLDEMFPLMKTLYNSEPTAPTE

SEQ ID NO: 126959 - protein, 17 aa, Mycobacterium avium
GLLALAWPKEHGGGGGS

SEQ ID NO: 126960 - protein, 23 aa, Mycobacterium avium
GLLDAVPLKTLIYGASPITVDTL

SEQ ID NO: 126961 - protein, 17 aa, Mycobacterium avium
GLLEPPGQEFFQRYRDA

SEQ ID NO: 126962 - protein, 21 aa, Mycobacterium avium
GLLGVAWPVEYGGGGLTALEQ

SEQ ID NO: 126963 - protein, 22 aa, Mycobacterium avium
GLMLSLGQRWITTLVAKLDQAA

SEQ ID NO: 126964 - protein, 17 aa, Mycobacterium avium
GLMRTFAVELGQHFIRV

SEQ ID NO: 126965 - protein, 17 aa, Mycobacterium avium
GLMYRFFGEIADPPDEA

SEQ ID NO: 126966 - protein, 17 aa, Mycobacterium avium
GLPFAADPSQQLPRLSG

SEQ ID NO: 126967 - protein, 21 aa, Mycobacterium avium
GLPGDLTFSWYAVDKTHQPWV

SEQ ID NO: 126968 - protein, 39 aa, Mycobacterium avium
GLPGLAEWTVGFLEDLVLGPLETAAWAAIGQAPPGAGGT

SEQ ID NO: 126969 - protein, 36 aa, Mycobacterium avium
GLPPGWNIEFSIAAPWFGHPGGEPQLLLLAPEGEEA

SEQ ID NO: 126970 - protein, 23 aa, Mycobacterium avium
GLQGIVVPERWGGAGAGVVELAV

SEQ ID NO: 126971 - protein, 20 aa, Mycobacterium avium
GLQPLPAPRFSRTAPQTPRP

SEQ ID NO: 126972 - protein, 31 aa, Mycobacterium avium
GLQYKAIVAAERLIPRTLMRAITKRVGGGRG

SEQ ID NO: 126973 - protein, 31 aa, Mycobacterium avium
GLQYKAIVAVERLIPRTLMRAITKRVGGGRG

SEQ ID NO: 126974 - protein, 19 aa, Mycobacterium avium
GLRAKLLGALDYIEAAGPV

SEQ ID NO: 126975 - protein, 17 aa, Mycobacterium avium
GLRLRGRKFYSTGAQFS

SEQ ID NO: 126976 - protein, 19 aa, Mycobacterium avium
GLRNPFTGAPAVGPLAILV

SEQ ID NO: 126977 - protein, 19 aa, Mycobacterium avium
GLRRRVRLASVLRRCTVLD

SEQ ID NO: 126978 - protein, 21 aa, Mycobacterium avium
GLRSRILLQVHDELLFEVAAG

SEQ ID NO: 126979 - protein, 19 aa, Mycobacterium avium
GLRTKLLGALDYIEAAGAV

SEQ ID NO: 126980 - protein, 20 aa, Mycobacterium avium
GLRTRLFAAPGWVVSPGVVK

SEQ ID NO: 126981 - protein, 24 aa, Mycobacterium avium
GLRVTRRLVLPDPPRRLLRRDELS

SEQ ID NO: 126982 - protein, 31 aa, Mycobacterium avium
GLSDFSSFLNPYNLVSLGSAFFGNGTGLIGV

SEQ ID NO: 126983 - protein, 21 aa, Mycobacterium avium
GLSDILPIYPTVDSALSGADR

SEQ ID NO: 126984 - protein, 19 aa, Mycobacterium avium
GLSHLAILRTHPDLDVVGV

SEQ ID NO: 126985 - protein, 17 aa, Mycobacterium avium
GLSPLVVPQLKTITLGG

SEQ ID NO: 126986 - protein, 18 aa, Mycobacterium avium
GLSRPTVVRLIENGELRA

SEQ ID NO: 126987 - protein, 24 aa, Mycobacterium avium
GLTAARFVANPFGAEPGSRLYRSG

SEQ ID NO: 126988 - protein, 20 aa, Mycobacterium avium
GLTASRFVACPFGGVGVRMY

SEQ ID NO: 126989 - protein, 28 aa, Mycobacterium avium
GLTEAALMDWALLRAANQFWMLSEPERA

SEQ ID NO: 126990 - protein, 26 aa, Mycobacterium avium
GLTGLYWHGPASRAMAAGAAPYVGWL

SEQ ID NO: 126991 - protein, 24 aa, Mycobacterium avium
GLTPEGETLWAYCKGLIGPRIELV

SEQ ID NO: 126992 - protein, 27 aa, Mycobacterium avium
GLTRERVLALGLRLLDRGYFRSGGEQY

SEQ ID NO: 126993 - protein, 18 aa, Mycobacterium avium
GLTVSRDLPKLGYKGVES

SEQ ID NO: 126994 - protein, 18 aa, Mycobacterium avium
GLVAAAYLARAGLRVRLL

SEQ ID NO: 126995 - protein, 19 aa, Mycobacterium avium
GLVDLSPHWIALDPEGAGA

SEQ ID NO: 126996 - protein, 17 aa, Mycobacterium avium
GLVGTLYRNGSGRWTVG

SEQ ID NO: 126997 - protein, 37 aa, Mycobacterium avium
GLVLGGRVFRPLDVDLRWVAALLLRNGTIEESGVAAA

SEQ ID NO: 126998 - protein, 18 aa, Mycobacterium avium
GLVPILCLTKTDLAPPEP

SEQ ID NO: 126999 - protein, 25 aa, Mycobacterium avium
GLVPVPATRPLVAAPMPPLDAAPTL

SEQ ID NO: 127000 - protein, 26 aa, Mycobacterium avium
GLVPVPATRPLVAAPMPPLDAAPTLP

SEQ ID NO: 127001 - protein, 25 aa, Mycobacterium avium
GLVSRFLGPWVPEPQLWQDPVPPVD

SEQ ID NO: 127002 - protein, 26 aa, Mycobacterium avium
GLVTLPIVHIGGLWSLLQSLVAARPI

SEQ ID NO: 127003 - protein, 17 aa, Mycobacterium avium
GLVVHRHRRHVEVTQCQ

SEQ ID NO: 127004 - protein, 23 aa, Mycobacterium avium
GLYGSFIRPLRRITGRTLNKEPR

SEQ ID NO: 127005 - protein, 19 aa, Mycobacterium avium
GLYVVAGYPGADWAANARA

SEQ ID NO: 127006 - protein, 23 aa, Mycobacterium avium
GMAVPGFPNFFMLYGPNTNVGSN

SEQ ID NO: 127007 - protein, 22 aa, Mycobacterium avium
GMDDMYAVQLDFTLTGPLDADR

SEQ ID NO: 127008 - protein, 18 aa, Mycobacterium avium
GMFGLSSNGANIGNIGIG

SEQ ID NO: 127009 - protein, 18 aa, Mycobacterium avium
GMLALGVPYGEVMRWALL

SEQ ID NO: 127010 - protein, 23 aa, Mycobacterium avium
GMLTGYGRELFRELVFRVVNRFE

SEQ ID NO: 127011 - protein, 34 aa, Mycobacterium avium
GMLTPDDVFLPVIPTPFGFGIWTSHTTPIHLGAT

SEQ ID NO: 127012 - protein, 31 aa, Mycobacterium avium
GMMKQKWPERLFFVDEFPLTGLGKVAKAELV

SEQ ID NO: 127013 - protein, 24 aa, Mycobacterium avium
GMPNVRAMNFLGEPPVVIGPLFQD

SEQ ID NO: 127014 - protein, 25 aa, Mycobacterium avium
GMPNVRAMNFLGEPPVVIGPLFQDK

SEQ ID NO: 127015 - protein, 31 aa, Mycobacterium avium
GMRDIRKHIAWYLHGFPAGSELRRALAIVKT

SEQ ID NO: 127016 - protein, 24 aa, Mycobacterium avium
GMSLYFDVLPVIVLNGGDYPRPRL

SEQ ID NO: 127017 - protein, 18 aa, Mycobacterium avium
GMTAVFWLDTERPHEVEL

SEQ ID NO: 127018 - protein, 30 aa, Mycobacterium avium
GMVRCVRAALPLLRKAQWARIVTFSAHSTQ

SEQ ID NO: 127019 - protein, 25 aa, Mycobacterium avium
GMVRTALFNWAYARHTGGTFVFRIE

SEQ ID NO: 127020 - protein, 18 aa, Mycobacterium avium
GMWVSWLHEFDDGQLGGG

SEQ ID NO: 127021 - protein, 22 aa, Mycobacterium avium
GNALDVLQRLIAPASLTGVRVF

SEQ ID NO: 127022 - protein, 27 aa, Mycobacterium avium
GNEVQLFEPAFARRLPVMLTGPTGCGK

SEQ ID NO: 127023 - protein, 23 aa, Mycobacterium avium
GNGIVLLLRHPEQLALLHDNPDL

SEQ ID NO: 127024 - protein, 19 aa, Mycobacterium avium
GNGVRVFAHYLRASGLETR

SEQ ID NO: 127025 - protein, 18 aa, Mycobacterium avium
GNKTVPTVKFADGSTLTN

SEQ ID NO: 127026 - protein, 28 aa, Mycobacterium avium
GNLAAAMQGLVALPLLAGYDIDARDPEG

SEQ ID NO: 127027 - protein, 21 aa, Mycobacterium avium
GNLIQLLSRLPQRGGAQLRRR

SEQ ID NO: 127028 - protein, 24 aa, Mycobacterium avium
GNNHPLLQIIVNGVAILEYLDTSG

SEQ ID NO: 127029 - protein, 26 aa, Mycobacterium avium
GNPGLPLLRYMIANRIPFGVVEVKSA

SEQ ID NO: 127030 - protein, 24 aa, Mycobacterium avium
GNPGQWYLHLFDTEQPDLNWEHPD

SEQ ID NO: 127031 - protein, 32 aa, Mycobacterium avium
GNPTTFDYGRMRETWLIHLCTDWMGDDAWLWK

SEQ ID NO: 127032 - protein, 19 aa, Mycobacterium avium
GNSLFVAFAARLAHRMGRV

SEQ ID NO: 127033 - protein, 17 aa, Mycobacterium avium
GNTLVLKPSPLTPLAGL

SEQ ID NO: 127034 - protein, 18 aa, Mycobacterium avium
GNVAFATIPVLDGAGWSD

SEQ ID NO: 127035 - protein, 25 aa, Mycobacterium avium
GNVDALFTWLPWAAELEDLSGARVL

SEQ ID NO: 127036 - protein, 19 aa, Mycobacterium avium
GNVFTLRLPMWGPVVMVSD

SEQ ID NO: 127037 - protein, 22 aa, Mycobacterium avium
GNVSGHITAILPGAQSAKGEPS

SEQ ID NO: 127038 - protein, 17 aa, Mycobacterium avium
GNVTHGALRSAWIGYWV

SEQ ID NO: 127039 - protein, 24 aa, Mycobacterium avium
GNVWAYPAAPWWDKLRQRITDFFH

SEQ ID NO: 127040 - protein, 25 aa, Mycobacterium avium
GNWKALHLPAPYGPGSWQLYDLASD

SEQ ID NO: 127041 - protein, 34 aa, Mycobacterium avium
GNYSMCGRAYSPRFLWLWPNARISVMGGEQAASV

SEQ ID NO: 127042 - protein, 18 aa, Mycobacterium avium
GPADVFKRHFYTCFISDK

SEQ ID NO: 127043 - protein, 35 aa, Mycobacterium avium
GPAEQRITPFVLTLRLLVIALRRNEIMNSTWVDTP

SEQ ID NO: 127044 - protein, 24 aa, Mycobacterium avium
GPASARLFVASALARLGPLLVVTA

SEQ ID NO: 127045 - protein, 28 aa, Mycobacterium avium
GPASMSMVAAVMPYIAWMTATAEQCQQA

SEQ ID NO: 127046 - protein, 25 aa, Mycobacterium avium
GPASTRLFVASALARLGPLLVVTAT

SEQ ID NO: 127047 - protein, 26 aa, Mycobacterium avium
GPAVKFTFQMIPVAYGTPLPSPNPEV

SEQ ID NO: 127048 - protein, 20 aa, Mycobacterium avium
GPAVLLLPKDIQQARVGVGE

SEQ ID NO: 127049 - protein, 18 aa, Mycobacterium avium
GPAYTTFAYASWGAAHAA

SEQ ID NO: 127050 - protein, 25 aa, Mycobacterium avium
GPDLAAELIAYCRAHLAGYKCPRTV

SEQ ID NO: 127051 - protein, 18 aa, Mycobacterium avium
GPDSAFEMLHRTGREWRG

SEQ ID NO: 127052 - protein, 17 aa, Mycobacterium avium
GPEFMRWPTDVRLRAAM

SEQ ID NO: 127053 - protein, 24 aa, Mycobacterium avium
GPEHTYRVPLPEPGEPKRAILDSY

SEQ ID NO: 127054 - protein, 24 aa, Mycobacterium avium
GPELRAAFTDRIVPALQAFSPELI

SEQ ID NO: 127055 - protein, 25 aa, Mycobacterium avium
GPEQVKWWWDSLSDAQQRLLIDQHP

SEQ ID NO: 127056 - protein, 18 aa, Mycobacterium avium
GPFAFSVPYGLQSPGQMF

SEQ ID NO: 127057 - protein, 18 aa, Mycobacterium avium
GPFAIVQAALPYLRRSGN

SEQ ID NO: 127058 - protein, 30 aa, Mycobacterium avium
GPFALGCFAGWLFTEFPPHVLTGHALSRVS

SEQ ID NO: 127059 - protein, 24 aa, Mycobacterium avium
GPGAPRIPIWWAGTSPRARPTSCG

SEQ ID NO: 127060 - protein, 17 aa, Mycobacterium avium
GPGELLLRTLSTAICAS

SEQ ID NO: 127061 - protein, 26 aa, Mycobacterium avium
GPGKADPGLLKWLEDPKVGGVELRGF

SEQ ID NO: 127062 - protein, 32 aa, Mycobacterium avium
GPGPAARPGRWWCWWTASWPGSWSGAAGRCSP

SEQ ID NO: 127063 - protein, 24 aa, Mycobacterium avium
GPGQLGTALLRRTKIPLSIDTGLL

SEQ ID NO: 127064 - protein, 17 aa, Mycobacterium avium
GPGVHGLWPQALALGYR

SEQ ID NO: 127065 - protein, 17 aa, Mycobacterium avium
GPGVHGLWPQVLALGYR

SEQ ID NO: 127066 - protein, 21 aa, Mycobacterium avium
GPHLQANWTWARSALDDKQIG

SEQ ID NO: 127067 - protein, 21 aa, Mycobacterium avium
GPHRDDLELWLGERVPKGFAS

SEQ ID NO: 127068 - protein, 21 aa, Mycobacterium avium
GPIDALPIAAFSMMRAMSTRN

SEQ ID NO: 127069 - protein, 24 aa, Mycobacterium avium
GPIKAIPKALELAGRKLEDVALFE

SEQ ID NO: 127070 - protein, 23 aa, Mycobacterium avium
GPLIPARVVRAPWLTRLQALGED

SEQ ID NO: 127071 - protein, 17 aa, Mycobacterium avium
GPLLSDAERRYLTCDAT

SEQ ID NO: 127072 - protein, 26 aa, Mycobacterium avium
GPLPVQYIDYALWQRAQFGDLEDPDS

SEQ ID NO: 127073 - protein, 18 aa, Mycobacterium avium
GPLSPLPDLPDNPKQFTQ

SEQ ID NO: 127074 - protein, 20 aa, Mycobacterium avium
GPNAAPFYRGIPSSEVIHAV

SEQ ID NO: 127075 - protein, 24 aa, Mycobacterium avium
GPNVDLPVPAGWQLNQISGTSYGG

SEQ ID NO: 127076 - protein, 17 aa, Mycobacterium avium
GPPAWTCGCAPRSSCRG

SEQ ID NO: 127077 - protein, 23 aa, Mycobacterium avium
GPPICAQVLLYPGLDRDMSVASI

SEQ ID NO: 127078 - protein, 25 aa, Mycobacterium avium
GPPMPPTPSLPEPASLPSGPSGDLP

SEQ ID NO: 127079 - protein, 17 aa, Mycobacterium avium
GPPPFGAPPPFAPPPSG

SEQ ID NO: 127080 - protein, 23 aa, Mycobacterium avium
GPPYAPEFLARYRAAQTARNHAI

SEQ ID NO: 127081 - protein, 23 aa, Mycobacterium avium
GPPYTPEFLARYRSAQVARNHAI

SEQ ID NO: 127082 - protein, 31 aa, Mycobacterium avium
GPQARGLFDGALDLWLALTAAALAGAAKRAV

SEQ ID NO: 127083 - protein, 19 aa, Mycobacterium avium
GPQGDVAWMCAPRWESDAL

SEQ ID NO: 127084 - protein, 19 aa, Mycobacterium avium
GPQKALGEFVFHPSSPAAA

SEQ ID NO: 127085 - protein, 23 aa, Mycobacterium avium
GPQLHANWTWAPSALNRDQVTRL

SEQ ID NO: 127086 - protein, 19 aa, Mycobacterium avium
GPQQWSLPFGAASAANWIG

SEQ ID NO: 127087 - protein, 20 aa, Mycobacterium avium
GPQYVVAILAVLKAGGMCVP

SEQ ID NO: 127088 - protein, 17 aa, Mycobacterium avium
GPRPTPVLVAPVALSGQ

SEQ ID NO: 127089 - protein, 22 aa, Mycobacterium avium
GPRVVLLGIPTRGVTLADRLAR

SEQ ID NO: 127090 - protein, 22 aa, Mycobacterium avium
GPRWRADMHEVQRWCALLEWAG

SEQ ID NO: 127091 - protein, 24 aa, Mycobacterium avium
GPSGTDTIPAWLSPHEYVEPSEAV

SEQ ID NO: 127092 - protein, 19 aa, Mycobacterium avium
GPSHRLDLVAIASAAQPGA

SEQ ID NO: 127093 - protein, 26 aa, Mycobacterium avium
GPTALLAPEWVPWEQRVRPGDLSPGD

SEQ ID NO: 127094 - protein, 23 aa, Mycobacterium avium
GPTKTAMGWSLPAEKIGPALEDW

SEQ ID NO: 127095 - protein, 17 aa, Mycobacterium avium
GPTLMVGDTMRAAAQLL

SEQ ID NO: 127096 - protein, 23 aa, Mycobacterium avium
GPTLVPAERYYSPAFAALEVERM

SEQ ID NO: 127097 - protein, 21 aa, Mycobacterium avium
GPVATTLLLPSVLDAVRGTGI

SEQ ID NO: 127098 - protein, 22 aa, Mycobacterium avium
GPVATTLLLPSVLDAVRGTGIP

SEQ ID NO: 127099 - protein, 17 aa, Mycobacterium avium
GPVGLAADAQRQLCGGG

SEQ ID NO: 127100 - protein, 20 aa, Mycobacterium avium
GPVHPLPRRRADLDAGVFEH

SEQ ID NO: 127101 - protein, 22 aa, Mycobacterium avium
GPVRAVEKLFYKTGVGFDDLAL

SEQ ID NO: 127102 - protein, 17 aa, Mycobacterium avium
GPVWEEVILHLPDEVRV

SEQ ID NO: 127103 - protein, 23 aa, Mycobacterium avium
GPYETTMRYYKPAPELIAGFAIR

SEQ ID NO: 127104 - protein, 24 aa, Mycobacterium avium
GPYETTMRYYKPAPELIAGFAIRT

SEQ ID NO: 127105 - protein, 24 aa, Mycobacterium avium
GPYETTMRYYTPAPELIAGFAIRT

SEQ ID NO: 127106 - protein, 19 aa, Mycobacterium avium
GQARFARFHLGRNGAVHGG

SEQ ID NO: 127107 - protein, 29 aa, Mycobacterium avium
GQAYEDLAWFCIRAWRFGAPAGFGAGGLG

SEQ ID NO: 127108 - protein, 25 aa, Mycobacterium avium
GQDKLFDTLFAYENYPIDAGALSGD

SEQ ID NO: 127109 - protein, 24 aa, Mycobacterium avium
GQDWGGLIGLRLAAEHPERFARLV

SEQ ID NO: 127110 - protein, 22 aa, Mycobacterium avium
GQERPFPLDLVPRVISAAEWAR

SEQ ID NO: 127111 - protein, 23 aa, Mycobacterium avium
GQFPGPLLRFMQGRRTWVDVYND

SEQ ID NO: 127112 - protein, 21 aa, Mycobacterium avium
GQGVGFGGWYAPVALRVDTAS

SEQ ID NO: 127113 - protein, 19 aa, Mycobacterium avium
GQHWLDVCAMLGLPEFGEH

SEQ ID NO: 127114 - protein, 23 aa, Mycobacterium avium
GQKTFISNGLLSKLVLTAVKTDP

SEQ ID NO: 127115 - protein, 17 aa, Mycobacterium avium
GQKVWTTDGHWARYGYL

SEQ ID NO: 127116 - protein, 21 aa, Mycobacterium avium
GQLLALPARVVDFDSATIAVV

SEQ ID NO: 127117 - protein, 17 aa, Mycobacterium avium
GQLLGRRCGACRLEIDR

SEQ ID NO: 127118 - protein, 17 aa, Mycobacterium avium
GQLLPCNVVVRSDPAEG

SEQ ID NO: 127119 - protein, 17 aa, Mycobacterium avium
GQLVIIGMQGGVKAELN

SEQ ID NO: 127120 - protein, 18 aa, Mycobacterium avium
GQPAPKWWFTVGGEVQPG

SEQ ID NO: 127121 - protein, 23 aa, Mycobacterium avium
GQPGKYLAIFGDSFSGNKMGEGE

SEQ ID NO: 127122 - protein, 20 aa, Mycobacterium avium
GQPTAWIAEGLFGYLPPEAQ

SEQ ID NO: 127123 - protein, 29 aa, Mycobacterium avium
GQPTAWIAEGLFGYLPPEAQDRLLDNITA

SEQ ID NO: 127124 - protein, 23 aa, Mycobacterium avium
GQPVIHLSQLLRAPVLARSGETV

SEQ ID NO: 127125 - protein, 26 aa, Mycobacterium avium
GQQKSPLRCGWLANSWRLPSCGRRGA

SEQ ID NO: 127126 - protein, 25 aa, Mycobacterium avium
GQQRRFGWLLFSLRLADRLIPHGVW

SEQ ID NO: 127127 - protein, 21 aa, Mycobacterium avium
GQRGWLLNAPRKPADPALTAH

SEQ ID NO: 127128 - protein, 22 aa, Mycobacterium avium
GQRLGQLLGAQRRRELTPPQRF

SEQ ID NO: 127129 - protein, 27 aa, Mycobacterium avium
GQRRYNPGWNLAIDLRNMLLVSECVAK

SEQ ID NO: 127130 - protein, 22 aa, Mycobacterium avium
GQRVLAAQWRTLPDILTDTDIT

SEQ ID NO: 127131 - protein, 31 aa, Mycobacterium avium
GQSLEAMRAIGIPVYLLPGNHDPLDASSVYT

SEQ ID NO: 127132 - protein, 23 aa, Mycobacterium avium
GQTGYIHRIPFLRGVTRGVVTVT

SEQ ID NO: 127133 - protein, 23 aa, Mycobacterium avium
GQTGYVHRIPFLRGVTRGVVTVT

SEQ ID NO: 127134 - protein, 29 aa, Mycobacterium avium
GQTTKLVNNLLFTANLATAATALSLAEQL

SEQ ID NO: 127135 - protein, 32 aa, Mycobacterium avium
GQVGRHRVEFAQRLFLALAVLEHPRGFLDERA

SEQ ID NO: 127136 - protein, 31 aa, Mycobacterium avium; identical to SEQ ID NO: 97770

SEQ ID NO: 127137 - protein, 20 aa, Mycobacterium avium
GQWRLSPKAMRRLGETALRD

SEQ ID NO: 127138 - protein, 18 aa, Mycobacterium avium
GQYFLEAFDRTETGWRLH

SEQ ID NO: 127139 - protein, 28 aa, Mycobacterium avium
GRAAAKGRKLFRRLVHRGELRVEVRGNV

SEQ ID NO: 127140 - protein, 18 aa, Mycobacterium avium
GRADGEKWVWAGAAVIHP

SEQ ID NO: 127141 - protein, 22 aa, Mycobacterium avium
GRADLLRSLDFTRGLAGDSGAV

SEQ ID NO: 127142 - protein, 26 aa, Mycobacterium avium
GRAHPGRWFGGLDGFGWAACHSGAPV

SEQ ID NO: 127143 - protein, 17 aa, Mycobacterium avium
GRALLEELLQRATVPER

SEQ ID NO: 127144 - protein, 18 aa, Mycobacterium avium
GRALPLTCDVRDAAAVAA

SEQ ID NO: 127145 - protein, 25 aa, Mycobacterium avium
GRANDVSFIWAKMNRVIANKRASDS

SEQ ID NO: 127146 - protein, 23 aa, Mycobacterium avium
GRAPFVLFRMPDAVRVRKLLHDK

SEQ ID NO: 127147 - protein, 22 aa, Mycobacterium avium
GRATELMAVARLLVSADSLGAA

SEQ ID NO: 127148 - protein, 29 aa, Mycobacterium avium
GRATLALPGGLRWVAVHRPDGYDPPRRFV

SEQ ID NO: 127149 - protein, 26 aa, Mycobacterium avium
GRAYLDFGEPLPLRKRLEELRAEESG

SEQ ID NO: 127150 - protein, 25 aa, Mycobacterium avium
GRDCTAIRWGLWQGAGVVVGNEITR

SEQ ID NO: 127151 - protein, 24 aa, Mycobacterium avium
GRDIPLRLVYVIDPHGAPGGHEPD

SEQ ID NO: 127152 - protein, 27 aa, Mycobacterium avium
GREGVRLARVLPLPVAMRLILMGKHEK

SEQ ID NO: 127153 - protein, 20 aa, Mycobacterium avium
GRELLLAAIAGFEVGPRVGH

SEQ ID NO: 127154 - protein, 25 aa, Mycobacterium avium
GRENLVLFSRLRGLNRRRAKARADE

SEQ ID NO: 127155 - protein, 18 aa, Mycobacterium avium
GRERLPILCGLDLTRKVA

SEQ ID NO: 127156 - protein, 23 aa, Mycobacterium avium
GREYLISNFARVLASRLEVHDYA

SEQ ID NO: 127157 - protein, 19 aa, Mycobacterium avium
GREYVVQLLISGAGALHIP

SEQ ID NO: 127158 - protein, 23 aa, Mycobacterium avium
GRFDHRGLLYLVDRKKDVIITGG

SEQ ID NO: 127159 - protein, 23 aa, Mycobacterium avium
GRFLDGIAERVLVIGTGGLSHSP

SEQ ID NO: 127160 - protein, 18 aa, Mycobacterium avium
GRFLQPFQRIGGAVPEFA

SEQ ID NO: 127161 - protein, 26 aa, Mycobacterium avium
GRGYGYGPAFRGLRAVWRRGAETFAE

SEQ ID NO: 127162 - protein, 17 aa, Mycobacterium avium
GRHPAVFFDFDGTLSDI

SEQ ID NO: 127163 - protein, 18 aa, Mycobacterium avium
GRHPAVFFDFDGTLSDIV

SEQ ID NO: 127164 - protein, 25 aa, Mycobacterium avium
GRHYRKALRRTAGLTLWTGLTCTEI

SEQ ID NO: 127165 - protein, 19 aa, Mycobacterium avium
GRIVGADLLEPLSAYAQID

SEQ ID NO: 127166 - protein, 18 aa, Mycobacterium avium
GRKFLRRRIAECTSAAES

SEQ ID NO: 127167 - protein, 28 aa, Mycobacterium avium
GRKPHRVPVWFMRQAGRSLPEYRALRAQ

SEQ ID NO: 127168 - protein, 23 aa, Mycobacterium avium
GRLDLPAGWSYQPRVLTSELRVD

SEQ ID NO: 127169 - protein, 20 aa, Mycobacterium avium
GRLHGFGFLYEAVLQLRHQA

SEQ ID NO: 127170 - protein, 18 aa, Mycobacterium avium
GRLPITFPVGLHQTPRPQ

SEQ ID NO: 127171 - protein, 19 aa, Mycobacterium avium
GRLQLLADIDTRAAAVTQT

SEQ ID NO: 127172 - protein, 19 aa, Mycobacterium avium
GRLQLLADIDTRAAVVTQT

SEQ ID NO: 127173 - protein, 22 aa, Mycobacterium avium
GRLRLCVGVGWLQEELRACGAD

SEQ ID NO: 127174 - protein, 23 aa, Mycobacterium avium
GRLRLCVGVGWLQEELRACGADF

SEQ ID NO: 127175 - protein, 19 aa, Mycobacterium avium
GRLVARRLRAGGVDTVFTL

SEQ ID NO: 127176 - protein, 23 aa, Mycobacterium avium
GRNDEALQWFLHSAAADLDGVTD

SEQ ID NO: 127177 - protein, 34 aa, Mycobacterium avium
GRNLDTVIIPKARRARDVWWVDVLLSQLEGKLNL

SEQ ID NO: 127178 - protein, 24 aa, Mycobacterium avium
GRPDAGLDLPIVLGGNMIQYNWTI

SEQ ID NO: 127179 - protein, 23 aa, Mycobacterium avium
GRPDLGWFPGLAARLRAAERGRP

SEQ ID NO: 127180 - protein, 21 aa, Mycobacterium avium
GRPDPGLDLPIVLGGNMIQYN

SEQ ID NO: 127181 - protein, 21 aa, Mycobacterium avium
GRPKHYWSIYQKMIVKGRDFD

SEQ ID NO: 127182 - protein, 18 aa, Mycobacterium avium
GRPMLPLDAERRADATLD

SEQ ID NO: 127183 - protein, 19 aa, Mycobacterium avium
GRPPPRRRGPRGSRCSRAG

SEQ ID NO: 127184 - protein, 18 aa, Mycobacterium avium
GRPVLGICGGFQMLCRRI

SEQ ID NO: 127185 - protein, 28 aa, Mycobacterium avium
GRRCAAWWRARAWHRPSCTGRRAAARPR

SEQ ID NO: 127186 - protein, 20 aa, Mycobacterium avium
GRRCPASRRLGLGRAVRQRT

SEQ ID NO: 127187 - protein, 23 aa, Mycobacterium avium
GRREARHLPRPGQRQRHARLRRA

SEQ ID NO: 127188 - protein, 27 aa, Mycobacterium avium
GRREPIPLPLKTSYAWAAARYGGDDPV

SEQ ID NO: 127189 - protein, 17 aa, Mycobacterium avium
GRRLDWARVVAGEAALG

SEQ ID NO: 127190 - protein, 21 aa, Mycobacterium avium
GRRWRADFAWPAHDPVGLIAR

SEQ ID NO: 127191 - protein, 20 aa, Mycobacterium avium
GRSQWRLLVNRGLALTKDNG

SEQ ID NO: 127192 - protein, 18 aa, Mycobacterium avium
GRTCHWILEIHLVDPRRG

SEQ ID NO: 127193 - protein, 25 aa, Mycobacterium avium
GRTCHWILEIHLVDRRRGFGGFYEQ

SEQ ID NO: 127194 - protein, 19 aa, Mycobacterium avium
GRTEIVACRPWLIAEIEAV

SEQ ID NO: 127195 - protein, 23 aa, Mycobacterium avium
GRTEYLERFTVALDAAIGAGFIL

SEQ ID NO: 127196 - protein, 22 aa, Mycobacterium avium
GRTFQLYVSLINTLAAAARSGH

SEQ ID NO: 127197 - protein, 22 aa, Mycobacterium avium
GRTGVFWIREMLPIGELREILS

SEQ ID NO: 127198 - protein, 20 aa, Mycobacterium avium
GRTKVPWREGFRRMIEARHP

SEQ ID NO: 127199 - protein, 33 aa, Mycobacterium avium
GRTPFFALTVFARGLLNRLFTRAYLPGAGPDTD

SEQ ID NO: 127200 - protein, 19 aa, Mycobacterium avium
GRTTWNSRAIWELYGGWFH

SEQ ID NO: 127201 - protein, 19 aa, Mycobacterium avium
GRTVALIGDLTFVHDSSGL

SEQ ID NO: 127202 - protein, 24 aa, Mycobacterium avium
GRVAGVHFLMKKNKITEIHGYGRF

SEQ ID NO: 127203 - protein, 26 aa, Mycobacterium avium
GRVGMARFNAIWTGPETLPLPVEIEE

SEQ ID NO: 127204 - protein, 20 aa, Mycobacterium avium
GRVIALLRDEGARTKSVVVL

SEQ ID NO: 127205 - protein, 18 aa, Mycobacterium avium
GRVRLLLIADTHIPGRAR

SEQ ID NO: 127206 - protein, 32 aa, Mycobacterium avium
GRVRRCGMVSPTVFWPIPRVYSGLVRIDRYPT

SEQ ID NO: 127207 - protein, 23 aa, Mycobacterium avium
GRVVATPIMRWLQNMDGPVEQFN

SEQ ID NO: 127208 - protein, 32 aa, Mycobacterium avium
GRVVRPLDVDLRWVAALLLRNGVIEESGVAAA

SEQ ID NO: 127209 - protein, 20 aa, Mycobacterium avium
GRVVTLLKVVPYAGGDSKPR

SEQ ID NO: 127210 - protein, 19 aa, Mycobacterium avium
GRWEKPFLAIFGARDPILG

SEQ ID NO: 127211 - protein, 18 aa, Mycobacterium avium
GRWLAFEVGVLVARQNGK

SEQ ID NO: 127212 - protein, 21 aa, Mycobacterium avium
GRYRLVVARACPWANRAIIVR

SEQ ID NO: 127213 - protein, 17 aa, Mycobacterium avium
GSAFQWQYPTPPEGDHI

SEQ ID NO: 127214 - protein, 23 aa, Mycobacterium avium
GSAPLSWPAGWSGWPHRVYGDTR

SEQ ID NO: 127215 - protein, 22 aa, Mycobacterium avium
GSAWIKPLFDDLQSTYGKMPQN

SEQ ID NO: 127216 - protein, 25 aa, Mycobacterium avium
GSDAEHWTMRYVVSEGDKVTREFTA

SEQ ID NO: 127217 - protein, 22 aa, Mycobacterium avium
GSDLLLVFGVIPEGFPQQGAIV

SEQ ID NO: 127218 - protein, 23 aa, Mycobacterium avium
GSDPVMMLTAPIPATQHALKRTG

SEQ ID NO: 127219 - protein, 20 aa, Mycobacterium avium
GSDYLVARRVLPDGSAHVFH

SEQ ID NO: 127220 - protein, 27 aa, Mycobacterium avium
GSEHEFVLTGLALLGATRPGVESLQSL

SEQ ID NO: 127221 - protein, 17 aa, Mycobacterium avium
GSEILVDAMFRDSYMRA

SEQ ID NO: 127222 - protein, 24 aa, Mycobacterium avium
GSEPGFISLNLPTALLAGAGTVDS

SEQ ID NO: 127223 - protein, 26 aa, Mycobacterium avium
GSEPLYMLTGVIPATEKVLSKAGLTL

SEQ ID NO: 127224 - protein, 17 aa, Mycobacterium avium
GSEVWTFNGAIIPNIGL

SEQ ID NO: 127225 - protein, 36 aa, Mycobacterium avium
GSFLCTGMPFAFLGKPRRWLRRVPPRYGEHTAEVLT

SEQ ID NO: 127226 - protein, 21 aa, Mycobacterium avium
GSFRAPQFTVAWPTGEIDGMG

SEQ ID NO: 127227 - protein, 21 aa, Mycobacterium avium
GSGCRALRIWSRSAASIDGRS

SEQ ID NO: 127228 - protein, 22 aa, Mycobacterium avium
GSGHYRDLLGRAARLNDGFAHG

SEQ ID NO: 127229 - protein, 17 aa, Mycobacterium avium
GSGLAYLTGLPNGPADF

SEQ ID NO: 127230 - protein, 17 aa, Mycobacterium avium
GSGTWAVAVDRTGQLRW

SEQ ID NO: 127231 - protein, 21 aa, Mycobacterium avium
GSILPRPVAHLARDPLDPRFD

SEQ ID NO: 127232 - protein, 26 aa, Mycobacterium avium
GSIYSGGFWLVPTLESLANATGAVQH

SEQ ID NO: 127233 - protein, 17 aa, Mycobacterium avium
GSKLHLVGQRPPGPVPT

SEQ ID NO: 127234 - protein, 18 aa, Mycobacterium avium
GSLDPVYLSGRARDLWTA

SEQ ID NO: 127235 - protein, 26 aa, Mycobacterium avium
GSLDRRFHTNLFTKLGEIPGSGAWVA

SEQ ID NO: 127236 - protein, 24 aa, Mycobacterium avium
GSLGMLFDTVLGLTASVLTGSRRQ

SEQ ID NO: 127237 - protein, 26 aa, Mycobacterium avium
GSMDPYNWFYEMVLERYPGAFEPMDA

SEQ ID NO: 127238 - protein, 21 aa, Mycobacterium avium
GSMFGPYHLKRLLGRGGMGEV

SEQ ID NO: 127239 - protein, 17 aa, Mycobacterium avium
GSNSPIALWQEVGTRHF

SEQ ID NO: 127240 - protein, 21 aa, Mycobacterium avium
GSPLQISNLANAFHAAGRSTA

SEQ ID NO: 127241 - protein, 26 aa, Mycobacterium avium
GSPLRELAGWPALLRGKLSVTLDLHD

SEQ ID NO: 127242 - protein, 17 aa, Mycobacterium avium
GSPPLAMAELLVVTTHH

SEQ ID NO: 127243 - protein, 27 aa, Mycobacterium avium
GSRATVIAWIWARTVTCPNPACGIAMP

SEQ ID NO: 127244 - protein, 18 aa, Mycobacterium avium
GSRFVACPFGAPATRMYR

SEQ ID NO: 127245 - protein, 19 aa, Mycobacterium avium
GSRQRFCVTIPVLRQAPGC

SEQ ID NO: 127246 - protein, 19 aa, Mycobacterium avium
GSRYLGWLSGPISWDYGSD

SEQ ID NO: 127247 - protein, 24 aa, Mycobacterium avium
GSTAARLFYAYADTLLALGRNDEA

SEQ ID NO: 127248 - protein, 22 aa, Mycobacterium avium
GSTLTWPPPLLGLEPSSYVGTQ

SEQ ID NO: 127249 - protein, 23 aa, Mycobacterium avium
GSTLVVPPTPWSAQGMFDILRAE

SEQ ID NO: 127250 - protein, 25 aa, Mycobacterium avium
GSVLAALGRIDYWFVTDGRRVHKTV

SEQ ID NO: 127251 - protein, 18 aa, Mycobacterium avium
GSVWVACEAPLQPAALRA

SEQ ID NO: 127252 - protein, 19 aa, Mycobacterium avium
GSVYPTLQLLADEGLITAT

SEQ ID NO: 127253 - protein, 20 aa, Mycobacterium avium
GSVYPTLQLLADEGLITATE

SEQ ID NO: 127254 - protein, 27 aa, Mycobacterium avium
GSWASIVPHTWLWASPLGAGIRAVELV

SEQ ID NO: 127255 - protein, 28 aa, Mycobacterium avium
GSWFTSVIPHVMVPGLAAALRATTARRA

SEQ ID NO: 127256 - protein, 20 aa, Mycobacterium avium
GSYAFVPPVPGHELPTCHVY

SEQ ID NO: 127257 - protein, 34 aa, Mycobacterium avium
GSYRGAELLGTRYLPPFPYFMDNPNAFRVLAGEF

SEQ ID NO: 127258 - protein, 23 aa, Mycobacterium avium
GTAAALGLAPRPPWHTARAPITA

SEQ ID NO: 127259 - protein, 24 aa, Mycobacterium avium
GTAAALMRLAVDTAGRWGVSRVWL

SEQ ID NO: 127260 - protein, 24 aa, Mycobacterium avium
GTAALLAGLLGRRATARRAAALWL

SEQ ID NO: 127261 - protein, 19 aa, Mycobacterium avium
GTAISRPVIPFFVNAIGVP

SEQ ID NO: 127262 - protein, 18 aa, Mycobacterium avium
GTALLRRTAMPLRVDTGL

SEQ ID NO: 127263 - protein, 19 aa, Mycobacterium avium
GTAWAYHQFGVQPDVVAFG

SEQ ID NO: 127264 - protein, 22 aa, Mycobacterium avium
GTDAYFRADDWPKVLPARRLPG

SEQ ID NO: 127265 - protein, 17 aa, Mycobacterium avium
GTDPWLADLYQSMIRRE

SEQ ID NO: 127266 - protein, 24 aa, Mycobacterium avium
GTELRDGWHLRIARSRLDRTDMFH

SEQ ID NO: 127267 - protein, 24 aa, Mycobacterium avium
GTEPRKIFDLLEQAPIGVAVVTNT

SEQ ID NO: 127268 - protein, 36 aa, Mycobacterium avium
GTEVWRLHQYLIGLRRRHPWLHAATTTALLLQNRHY

SEQ ID NO: 127269 - protein, 35 aa, Mycobacterium avium
GTEVWRLHQYLIGLRRRHPWLHGATTTALLLQNRH

SEQ ID NO: 127270 - protein, 36 aa, Mycobacterium avium
GTFLCTGMPFAFLGKPRRWLRRVPPRYGEHTAEVLT

SEQ ID NO: 127271 - protein, 24 aa, Mycobacterium avium
GTGAPLFCIHAAGGLSWSYQVLGN

SEQ ID NO: 127272 - protein, 30 aa, Mycobacterium avium
GTGPPDIDLGWWLMFERFLCEALGFTRLPG

SEQ ID NO: 127273 - protein, 25 aa, Mycobacterium avium
GTGQGALPGIGFSGGIIGGLEGAAT

SEQ ID NO: 127274 - protein, 26 aa, Mycobacterium avium
GTGQGALPGIGFSGGIIGGLEGAATQ

SEQ ID NO: 127275 - protein, 21 aa, Mycobacterium avium
GTHGWGYDGVLWYSVHEPYGG

SEQ ID NO: 127276 - protein, 25 aa, Mycobacterium avium
GTHHYRFTLYQLPNDYQLPAGLAGV

SEQ ID NO: 127277 - protein, 25 aa, Mycobacterium avium
GTHHYRFTLYQLPNDYQLPGGLAGA

SEQ ID NO: 127278 - protein, 21 aa, Mycobacterium avium
GTHLIDKWKIYTGRAAPGTGN

SEQ ID NO: 127279 - protein, 25 aa, Mycobacterium avium
GTHPKYGFDRFWRNIRTHTLHDPVS

SEQ ID NO: 127280 - protein, 18 aa, Mycobacterium avium
GTLPLLAPMSEVAGRLSA

SEQ ID NO: 127281 - protein, 24 aa, Mycobacterium avium
GTLRERLIELLSRQADLFAEAPVQ

SEQ ID NO: 127282 - protein, 20 aa, Mycobacterium avium
GTLVFYIRRGTLYIDYVELL

SEQ ID NO: 127283 - protein, 17 aa, Mycobacterium avium
GTLVRPLTDHLSALGTP

SEQ ID NO: 127284 - protein, 23 aa, Mycobacterium avium
GTMQYLFDTVQSKLLPGMKLNQG

SEQ ID NO: 127285 - protein, 25 aa, Mycobacterium avium
GTNHLGHFALTCLLGDRIRNRVVVV

SEQ ID NO: 127286 - protein, 24 aa, Mycobacterium avium
GTNIDQLLEAVLLTADAALDLRAN

SEQ ID NO: 127287 - protein, 33 aa, Mycobacterium avium
GTNRWPAVHRLDAATLFRLALEKAPAGTALHGT

SEQ ID NO: 127288 - protein, 17 aa, Mycobacterium avium
GTPAWIISQGPQVLLDA

SEQ ID NO: 127289 - protein, 24 aa, Mycobacterium avium
GTPEPALPALRRLLDSPRHEMIAV

SEQ ID NO: 127290 - protein, 22 aa, Mycobacterium avium
GTPLLEWLRRRGVDEVDVVGIA

SEQ ID NO: 127291 - protein, 20 aa, Mycobacterium avium
GTPLSPGTFLATISGAGRPP

SEQ ID NO: 127292 - protein, 23 aa, Mycobacterium avium
GTPPTLPPFMLADGVTSLNAAYA

SEQ ID NO: 127293 - protein, 26 aa, Mycobacterium avium
GTPVEYVTYLAWRGLVTMEPPRRPEP

SEQ ID NO: 127294 - protein, 19 aa, Mycobacterium avium
GTQHQWTLPVAAPAATDIE

SEQ ID NO: 127295 - protein, 24 aa, Mycobacterium avium
GTQLAYWEDALAGMPERLALPTDR

SEQ ID NO: 127296 - protein, 24 aa, Mycobacterium avium
GTRGALYHHFANKEALFLAVFLAV

SEQ ID NO: 127297 - protein, 18 aa, Mycobacterium avium
GTRHFPEDAIFAKTAKYF

SEQ ID NO: 127298 - protein, 17 aa, Mycobacterium avium
GTRPMATITFTGATALK

SEQ ID NO: 127299 - protein, 32 aa, Mycobacterium avium
GTRRYVRRQRSWFRRDHRVRWLDAGACSPPRL

SEQ ID NO: 127300 - protein, 19 aa, Mycobacterium avium
GTRVLYVSPLKALAVDVER

SEQ ID NO: 127301 - protein, 18 aa, Mycobacterium avium
GTSPVGVFAPNAFGLLDM

SEQ ID NO: 127302 - protein, 22 aa, Mycobacterium avium
GTTPPMPIVWGISATTQNFEDA

SEQ ID NO: 127303 - protein, 24 aa, Mycobacterium avium
GTTVCKIRIRARGQSVLRLDRGDA

SEQ ID NO: 127304 - protein, 21 aa, Mycobacterium avium
GTTWQNTFGILADIGRFSTVA

SEQ ID NO: 127305 - protein, 23 aa, Mycobacterium avium
GTVDRLTFDPAGFGFPRAELDDL

SEQ ID NO: 127306 - protein, 39 aa, Mycobacterium avium
GTVLQWISTFGHPLTWDDLPWLRSLTDLPLIIKGICHPD

SEQ ID NO: 127307 - protein, 31 aa, Mycobacterium avium
GTWAVAVDRTGQLRWFGLDGVEHTGGPMVDF

SEQ ID NO: 127308 - protein, 28 aa, Mycobacterium avium
GTWAVSFPRVLSELFWIGRYGERAESMA

SEQ ID NO: 127309 - protein, 19 aa, Mycobacterium avium
GTWLIAGFDELGAQLPGCI

SEQ ID NO: 127310 - protein, 17 aa, Mycobacterium avium
GTYVFDFGRREVRNFWW

SEQ ID NO: 127311 - protein, 17 aa, Mycobacterium avium
GVAAAPRQRQRGGGQQA

SEQ ID NO: 127312 - protein, 18 aa, Mycobacterium avium
GVAALRMWGAGATGSRLV

SEQ ID NO: 127313 - protein, 19 aa, Mycobacterium avium
GVAALRMWGAGATGSRLVT

SEQ ID NO: 127314 - protein, 21 aa, Mycobacterium avium
GVACYALPAARRALELTKAYA

SEQ ID NO: 127315 - protein, 22 aa, Mycobacterium avium
GVCDLLHRRGLAGATVLLGVDG

SEQ ID NO: 127316 - protein, 18 aa, Mycobacterium avium
GVDAIWLNPVTVSPMADH

SEQ ID NO: 127317 - protein, 22 aa, Mycobacterium avium
GVDCRQLLLAPEPDSHARGGLA

SEQ ID NO: 127318 - protein, 24 aa, Mycobacterium avium
GVDELRAFDLLRRLSQESQTKLID

SEQ ID NO: 127319 - protein, 23 aa, Mycobacterium avium
GVDRLGYRLIRLSGQVSGRAELP

SEQ ID NO: 127320 - protein, 18 aa, Mycobacterium avium
GVDSWLAGWDEEFSGRLG

SEQ ID NO: 127321 - protein, 18 aa, Mycobacterium avium
GVDYFLLAGYKEGSTRPT

SEQ ID NO: 127322 - protein, 24 aa, Mycobacterium avium
GVEIRYYSVIYQAIDEIEKALRGM

SEQ ID NO: 127323 - protein, 35 aa, Mycobacterium avium
GVEQFGRLDIVLANAGIAPLAFRQVEHRGGTGPVA

SEQ ID NO: 127324 - protein, 25 aa, Mycobacterium avium
GVFLGCKYAVLRFKEQGAGGVILNT

SEQ ID NO: 127325 - protein, 43 aa, Mycobacterium avium
GVFNDVDLRWVILAARIGILRQPLNIKLFFSDRWVSYNDPDPD

SEQ ID NO: 127326 - protein, 30 aa, Mycobacterium avium
GVGAMGTAWLAIKGYNIASTILSPIGTGLG

SEQ ID NO: 127327 - protein, 20 aa, Mycobacterium avium
GVGFVDFPMDHVFSMAADDG

SEQ ID NO: 127328 - protein, 17 aa, Mycobacterium avium
GVGMHRCLGSHYAKLMF

SEQ ID NO: 127329 - protein, 17 aa, Mycobacterium avium
GVGNYTFGLAEQSVFHE

SEQ ID NO: 127330 - protein, 23 aa, Mycobacterium avium
GVGPVGEKLRRQKQFGFAEHGVA

SEQ ID NO: 127331 - protein, 27 aa, Mycobacterium avium
GVGSLVTQLLVLRRARVLGIAGPGNAD

SEQ ID NO: 127332 - protein, 18 aa, Mycobacterium avium
GVGYGLLSAWRGPNGQDL

SEQ ID NO: 127333 - protein, 20 aa, Mycobacterium avium
GVGYGYLRRAGLTASRFVAC

SEQ ID NO: 127334 - protein, 21 aa, Mycobacterium avium
GVHGLWPQALALGYRVAVRPS

SEQ ID NO: 127335 - protein, 18 aa, Mycobacterium avium
GVHRYRRDFDIAEGQPRG

SEQ ID NO: 127336 - protein, 18 aa, Mycobacterium avium
GVISQGTVIWPPATNHVT

SEQ ID NO: 127337 - protein, 27 aa, Mycobacterium avium
GVKAQEAYRRGLQGYIGAFADLLRVSA

SEQ ID NO: 127338 - protein, 20 aa, Mycobacterium avium
GVKVIPWIPTAVRRGLVRGR

SEQ ID NO: 127339 - protein, 21 aa, Mycobacterium avium
GVKVIPWIPTAVRRGLVRGRS

SEQ ID NO: 127340 - protein, 22 aa, Mycobacterium avium
GVKVIPWIPTAVRRGLVRGRSV

SEQ ID NO: 127341 - protein, 28 aa, Mycobacterium avium
GVKYQWPQGTYLAWLDCRELGFAEDAAQ

SEQ ID NO: 127342 - protein, 21 aa, Mycobacterium avium
GVLDAVTYPPAGKRGICPAYR

SEQ ID NO: 127343 - protein, 21 aa, Mycobacterium avium
GVLERAAISEALLLTNLANLA

SEQ ID NO: 127344 - protein, 24 aa, Mycobacterium avium
GVLGGLSVPLKWGVAVPPDDYDHW

SEQ ID NO: 127345 - protein, 20 aa, Mycobacterium avium
GVLLAGWCGLRKGEVFALRR

SEQ ID NO: 127346 - protein, 28 aa, Mycobacterium avium
GVLPEIAALLRRPLFTLERVRVCKRDGR

SEQ ID NO: 127347 - protein, 25 aa, Mycobacterium avium
GVLRRLYSLLRPGGQLRYLEHIASA

SEQ ID NO: 127348 - protein, 23 aa, Mycobacterium avium
GVMFSLHVKATMMKVSHPIVFGH

SEQ ID NO: 127349 - protein, 24 aa, Mycobacterium avium
GVMHTHRALLYQAADTNLVTEANR

SEQ ID NO: 127350 - protein, 21 aa, Mycobacterium avium
GVNLTGTFLVAKAALARMIDQ

SEQ ID NO: 127351 - protein, 25 aa, Mycobacterium avium
GVNYIDTYFRSGQYPRELPFIIGQE

SEQ ID NO: 127352 - protein, 27 aa, Mycobacterium avium
GVPAPVDADWLLLVELAADHDQTERLA

SEQ ID NO: 127353 - protein, 20 aa, Mycobacterium avium
GVPDYLGWDWKSKAGIPIVC

SEQ ID NO: 127354 - protein, 19 aa, Mycobacterium avium
GVPIHRAIVARLRQATAAD

SEQ ID NO: 127355 - protein, 22 aa, Mycobacterium avium
GVPIPTLRYWRHIDAGPASFKL

SEQ ID NO: 127356 - protein, 22 aa, Mycobacterium avium
GVPISAIFFGGRRAGAIPLVSQ

SEQ ID NO: 127357 - protein, 18 aa, Mycobacterium avium
GVPLKDRRAERRALLVEA

SEQ ID NO: 127358 - protein, 23 aa, Mycobacterium avium
GVPLVAVGLYYRSGYFRQSLAAD

SEQ ID NO: 127359 - protein, 19 aa, Mycobacterium avium
GVPPLTMKPDVCWQLPIRR

SEQ ID NO: 127360 - protein, 26 aa, Mycobacterium avium
GVPQRYALLGRPIAGMQLRIAATDEP

SEQ ID NO: 127361 - protein, 23 aa, Mycobacterium avium
GVPVYERAVLIRDSRLARDMVAA

SEQ ID NO: 127362 - protein, 24 aa, Mycobacterium avium
GVPWARACAAALLAVTTPAGLRVG

SEQ ID NO: 127363 - protein, 21 aa, Mycobacterium avium
GVQLLFDRAARIWYFERPATD

SEQ ID NO: 127364 - protein, 23 aa, Mycobacterium avium
GVRAAPAWPARAPAALGGPRDAA

SEQ ID NO: 127365 - protein, 20 aa, Mycobacterium avium
GVRAAPAWPARAPAALGGSG

SEQ ID NO: 127366 - protein, 22 aa, Mycobacterium avium
GVRPIQLYESYLRNFEINSGRF

SEQ ID NO: 127367 - protein, 18 aa, Mycobacterium avium
GVRPYWEAGFTDIALVQI

SEQ ID NO: 127368 - protein, 18 aa, Mycobacterium avium
GVRRPFVGALTLELPTEA

SEQ ID NO: 127369 - protein, 17 aa, Mycobacterium avium
GVRVFFPDPWPKARHHK

SEQ ID NO: 127370 - protein, 19 aa, Mycobacterium avium
GVRVGLSVCYDIRFPELYT

SEQ ID NO: 127371 - protein, 20 aa, Mycobacterium avium
GVRVRRPGRHPCRLDPGRCG

SEQ ID NO: 127372 - protein, 17 aa, Mycobacterium avium
GVSLTRLGPLPPLRMHP

SEQ ID NO: 127373 - protein, 26 aa, Mycobacterium avium
GVSPRTFFRYFPTKESVLFFGEYDFI

SEQ ID NO: 127374 - protein, 26 aa, Mycobacterium avium
GVSRRHLEIRWDGQVALLSDLNSTNG

SEQ ID NO: 127375 - protein, 26 aa, Mycobacterium avium
GVSTGSFYHFFDNWPKYTRELIEHWQ

SEQ ID NO: 127376 - protein, 33 aa, Mycobacterium avium
GVTHDDVMFTAMPFFWVGGLITGLHAVIHHGAT

SEQ ID NO: 127377 - protein, 26 aa, Mycobacterium avium
GVTLRAQDVLPGDLFAALPGATTHGA

SEQ ID NO: 127378 - protein, 64 aa, Mycobacterium avium
GVTPADVGCSWLPLYHDMGLSFLLASALGGMSLWLAPTSAFTASPFRWLAWLSESRATITAAPN

SEQ ID NO: 127379 - protein, 33 aa, Mycobacterium avium
GVTPAQVGLAWILARAPHTLLIPGTRSITHLEE

SEQ ID NO: 127380 - protein, 25 aa, Mycobacterium avium
GVTPSLVQYYFPSLDDIFVAAIRRY

SEQ ID NO: 127381 - protein, 28 aa, Mycobacterium avium
GVTQPVSVTSLVAIPWAQGDRSGVAFRA

SEQ ID NO: 127382 - protein, 25 aa, Mycobacterium avium
GVTWGVIQYHFGDRNGLLMAAVDDG

SEQ ID NO: 127383 - protein, 20 aa, Mycobacterium avium
GVVFEFVERPLKYFSPAVAR

SEQ ID NO: 127384 - protein, 26 aa, Mycobacterium avium
GVVGAIVPWNFPFEVTLNKLGQALGT

SEQ ID NO: 127385 - protein, 32 aa, Mycobacterium avium
GVVRLDYEVPLLLSALSPRMLRIAGHFADGVV

SEQ ID NO: 127386 - protein, 25 aa, Mycobacterium avium
GVVRRDPMAMLPFIGYHVGDYFQHW

SEQ ID NO: 127387 - protein, 18 aa, Mycobacterium avium
GWAPWLTRPEELPAKMDY

SEQ ID NO: 127388 - protein, 23 aa, Mycobacterium avium
GWAVTMFLMQYERGMYGYAVLNK

SEQ ID NO: 127389 - protein, 18 aa, Mycobacterium avium
GWDSLWVYDHFHTVPVPT

SEQ ID NO: 127390 - protein, 18 aa, Mycobacterium avium
GWELTRVRLYTDGSRRVL

SEQ ID NO: 127391 - protein, 18 aa, Mycobacterium avium
GWFALDADRRIALGAGAD

SEQ ID NO: 127392 - protein, 19 aa, Mycobacterium avium
GWFATRDVAMLDEDGYLFI

SEQ ID NO: 127393 - protein, 17 aa, Mycobacterium avium
GWIPATLASLDVAAARY

SEQ ID NO: 127394 - protein, 20 aa, Mycobacterium avium
GWLASTVIDGDRRLSRPGRA

SEQ ID NO: 127395 - protein, 20 aa, Mycobacterium avium
GWLEGYLLTGRHGLFNCYEA

SEQ ID NO: 127396 - protein, 26 aa, Mycobacterium avium
GWLKDRFGLSWQIVPDRLFELIGDPD

SEQ ID NO: 127397 - protein, 19 aa, Mycobacterium avium
GWNHGAVVHPRRGDPLTAD

SEQ ID NO: 127398 - protein, 18 aa, Mycobacterium avium
GWPNYFTERPHAIDPAVA

SEQ ID NO: 127399 - protein, 19 aa, Mycobacterium avium
GWRAYRLVAGEAASGWAPL

SEQ ID NO: 127400 - protein, 19 aa, Mycobacterium avium
GWRTVQVEALYSAARRLRR

SEQ ID NO: 127401 - protein, 26 aa, Mycobacterium avium
GWRVVVLEAGPFWHPDEDWVSDEAGS

SEQ ID NO: 127402 - protein, 19 aa, Mycobacterium avium
GWSAGRIINLDIGGGSLEM

SEQ ID NO: 127403 - protein, 17 aa, Mycobacterium avium
GWTATFSDALIGYARKR

SEQ ID NO: 127404 - protein, 17 aa, Mycobacterium avium
GWTVMRFALDAEHGITD

SEQ ID NO: 127405 - protein, 18 aa, Mycobacterium avium
GWTVMRFALDAEHGITDP

SEQ ID NO: 127406 - protein, 23 aa, Mycobacterium avium
GYANFLSILDEGRIAIAALATGA

SEQ ID NO: 127407 - protein, 28 aa, Mycobacterium avium
GYDFSQLIKLLTWPRQAVLRTKLTQPIS

SEQ ID NO: 127408 - protein, 23 aa, Mycobacterium avium
GYFHVELMSIRRSATKLKFLAAS

SEQ ID NO: 127409 - protein, 18 aa, Mycobacterium avium
GYFRRSMHLLPKSGSRAP

SEQ ID NO: 127410 - protein, 19 aa, Mycobacterium avium
GYFRRSMHLLPKSGSRAPW

SEQ ID NO: 127411 - protein, 29 aa, Mycobacterium avium
GYGLNIMRRNGLPVPPAFCITTEICAQWL

SEQ ID NO: 127412 - protein, 21 aa, Mycobacterium avium
GYIAALIYNDKHWNAFMNAVR

SEQ ID NO: 127413 - protein, 17 aa, Mycobacterium avium
GYIAYPPRPDGQPTFNE

SEQ ID NO: 127414 - protein, 32 aa, Mycobacterium avium
GYIPLLTVAALPRPLRRLPLLGDRIAELLDAE

SEQ ID NO: 127415 - protein, 26 aa, Mycobacterium avium
GYLAGMLVHDLDFLTSLLGRPVSVCA

SEQ ID NO: 127416 - protein, 23 aa, Mycobacterium avium
GYLDADGYLHITGRRTDLIISGG

SEQ ID NO: 127417 - protein, 30 aa, Mycobacterium avium
GYLRKGIPGPRWMPRPVWKIVSAPLNAYAR

SEQ ID NO: 127418 - protein, 21 aa, Mycobacterium avium
GYPEAVLARELEICYAAIALV

SEQ ID NO: 127419 - protein, 23 aa, Mycobacterium avium
GYPPEQAGYPPQQGYPPPRHPEQ

SEQ ID NO: 127420 - protein, 21 aa, Mycobacterium avium
GYPREWRRRKPYGWLRQVLPD

SEQ ID NO: 127421 - protein, 17 aa, Mycobacterium avium
GYRDPGALGGYRTYTPA

SEQ ID NO: 127422 - protein, 18 aa, Mycobacterium avium
GYRKKYLRAMSRLLALTA

SEQ ID NO: 127423 - protein, 24 aa, Mycobacterium avium
GYRNPVDPDPFAEPGWFLTDDLGA

SEQ ID NO: 127424 - protein, 17 aa, Mycobacterium avium
GYRPGRVGFPPYFRCVT

SEQ ID NO: 127425 - protein, 19 aa, Mycobacterium avium
GYRVAVTWGAQPGILSAVF

SEQ ID NO: 127426 - protein, 32 aa, Mycobacterium avium
GYSDLSDYFYVWLRRSLRSVHPRLLSTMLVPK

SEQ ID NO: 127427 - protein, 31 aa, Mycobacterium avium
GYSQGAICGSWWWRDFILANGLQARVPAALM

SEQ ID NO: 127428 - protein, 18 aa, Mycobacterium avium
GYTYGGRIAALADAAREN

SEQ ID NO: 127429 - protein, 26 aa, Mycobacterium avium
GYVELPPERLSKASPAPFVLEQWAEL

SEQ ID NO: 127430 - protein, 35 aa, Mycobacterium avium
GYVELPPERLSKASPAPFVLEQWAELGAAALQDAG

SEQ ID NO: 127431 - protein, 20 aa, Mycobacterium avium
GYVFLAAPLPREWPALTKAM

SEQ ID NO: 127432 - protein, 20 aa, Mycobacterium avium
GYYHCFQEIEQLVRGRLADG

SEQ ID NO: 127433 - protein, 20 aa, Mycobacterium avium
GYYKAELIYGPARPGPWKTV

SEQ ID NO: 127434 - protein, 23 aa, Mycobacterium avium
HAARVVPTNFLTLFPEHEKHSLD

SEQ ID NO: 127435 - protein, 24 aa, Mycobacterium avium
HAASAFALWFPIEGEVDYGRAKIE

SEQ ID NO: 127436 - protein, 25 aa, Mycobacterium avium
HADHLDKFLGELTELALILGVGAHS

SEQ ID NO: 127437 - protein, 27 aa, Mycobacterium avium
HAERFLADLPGLRLIALDRDPSALEIA

SEQ ID NO: 127438 - protein, 27 aa, Mycobacterium avium
HAERFLTDLPGLRLIALDRDPSALEIA

SEQ ID NO: 127439 - protein, 21 aa, Mycobacterium avium
HAEWDTLRILGRRTAVAASQC

SEQ ID NO: 127440 - protein, 24 aa, Mycobacterium avium
HAGGLPRPLMVVTMGLPASGKTTL

SEQ ID NO: 127441 - protein, 25 aa, Mycobacterium avium
HAGGLPRPLMVVTMGLPASGKTTLA

SEQ ID NO: 127442 - protein, 25 aa, Mycobacterium avium
HAGQHRGQRFGLRTHPPADREVQRH

SEQ ID NO: 127443 - protein, 27 aa, Mycobacterium avium
HAGVNDILLIAFALAWAEFLDSADAPI

SEQ ID NO: 127444 - protein, 27 aa, Mycobacterium avium
HAHVLMARHMFTLWAPERAGVTDAVAA

SEQ ID NO: 127445 - protein, 31 aa, Mycobacterium avium
HAIWGHRVNHWLWRRGARLAARISAEITRIL

SEQ ID NO: 127446 - protein, 19 aa, Mycobacterium avium
HAKALRMFAVLPTIVAADM

SEQ ID NO: 127447 - protein, 25 aa, Mycobacterium avium
HALAPVRFFNPIGMRFAKKATREDI

SEQ ID NO: 127448 - protein, 23 aa, Mycobacterium avium
HALDLLLGSWPAERRILACLPGE

SEQ ID NO: 127449 - protein, 22 aa, Mycobacterium avium
HALDPFVALAFAAAATTDVKLL

SEQ ID NO: 127450 - protein, 17 aa, Mycobacterium avium
HALTRLRDSAIDEVIVL

SEQ ID NO: 127451 - protein, 41 aa, Mycobacterium avium
HAMLPIPAQHWTLETLGPALLKFAPGLAAAYLPGYLSGVEW

SEQ ID NO: 127452 - protein, 23 aa, Mycobacterium avium
HANIVPWQLISQKTGAILKVAPI

SEQ ID NO: 127453 - protein, 17 aa, Mycobacterium avium
HAPRRVVPEIPRWPTRA

SEQ ID NO: 127454 - protein, 17 aa, Mycobacterium avium
HARAKLQRKGCDLLVVN

SEQ ID NO: 127455 - protein, 26 aa, Mycobacterium avium
HARGEFRPRPSFLSPGKKILHDDRLD

SEQ ID NO: 127456 - protein, 29 aa, Mycobacterium avium
HARMNGVDHLWLHPVLVGRDRWHEIQTPG

SEQ ID NO: 127457 - protein, 22 aa, Mycobacterium avium
HARTKAMMLADPESWHTLMEKL

SEQ ID NO: 127458 - protein, 20 aa, Mycobacterium avium
HARTWSVIAEGYAAFNRHEP

SEQ ID NO: 127459 - protein, 20 aa, Mycobacterium avium
HARVAVRRLGPGHTAVQWNT

SEQ ID NO: 127460 - protein, 24 aa, Mycobacterium avium
HATGRLLMVGLGPGTDLMFLPAAV

SEQ ID NO: 127461 - protein, 28 aa, Mycobacterium avium
HAVHPIALYLNDLVRFGMRLPTDLGPFP

SEQ ID NO: 127462 - protein, 19 aa, Mycobacterium avium
HAVKIFYKDAFAKHQELFD

SEQ ID NO: 127463 - protein, 25 aa, Mycobacterium avium
HAVMRGMLAFLAVNSTYRGPYTPGS

SEQ ID NO: 127464 - protein, 17 aa, Mycobacterium avium
HAWFIAETTGAGSFPWV

SEQ ID NO: 127465 - protein, 26 aa, Mycobacterium avium
HCPPDRFPGVIAEPLIPPARASAYRC

SEQ ID NO: 127466 - protein, 26 aa, Mycobacterium avium
HCSLEQVAYLLWYGELPDDQQLALFS

SEQ ID NO: 127467 - protein, 17 aa, Mycobacterium avium
HCWRNQFGGLKAEDAKR

SEQ ID NO: 127468 - protein, 24 aa, Mycobacterium avium
HDAGKIVLRRSRPLQISLDGHDSK

SEQ ID NO: 127469 - protein, 24 aa, Mycobacterium avium
HDAGKIVLRRSRPLQISLDGHDTK

SEQ ID NO: 127470 - protein, 24 aa, Mycobacterium avium
HDDQAHVDLLWALSRAPDPDAALL

SEQ ID NO: 127471 - protein, 17 aa, Mycobacterium avium
HDDVLIIRVSPGCYFPA

SEQ ID NO: 127472 - protein, 17 aa, Mycobacterium avium
HDEDPMMPYPQRAPVLV

SEQ ID NO: 127473 - protein, 30 aa, Mycobacterium avium
HDELRPLKVLASRMPCPYLNPGPYVGGRPL

SEQ ID NO: 127474 - protein, 34 aa, Mycobacterium avium
HDEPDERWALLPLVPLIPKPVFRRLLSVVTGGAA

SEQ ID NO: 127475 - protein, 23 aa, Mycobacterium avium
HDEVPASYRLLAAELGAMVVGLD

SEQ ID NO: 127476 - protein, 26 aa, Mycobacterium avium
HDGAGDVALIIAVKRLAAAKTRLAPV

SEQ ID NO: 127477 - protein, 27 aa, Mycobacterium avium
HDGAGDVALIIAVKRLAAAKTRLAPVF

SEQ ID NO: 127478 - protein, 25 aa, Mycobacterium avium
HDGALRLLQRQNFTRYAHAIEGGDD

SEQ ID NO: 127479 - protein, 27 aa, Mycobacterium avium
HDGDPWAWHAMSPLPIHGMRRRRRIDV

SEQ ID NO: 127480 - protein, 23 aa, Mycobacterium avium
HDGRTWYRTGDLVRYRPDGTLEF

SEQ ID NO: 127481 - protein, 19 aa, Mycobacterium avium
HDICFIPSGNTRAFLGERI

SEQ ID NO: 127482 - protein, 21 aa, Mycobacterium avium
HDLHTLIESLDLRDLTLVGSS

SEQ ID NO: 127483 - protein, 20 aa, Mycobacterium avium
HDLPPIPTLFVVADEFTLML

SEQ ID NO: 127484 - protein, 20 aa, Mycobacterium avium
HDMNPFPLNALGCLIRSITL

SEQ ID NO: 127485 - protein, 24 aa, Mycobacterium avium
HDPYLWLEDITGEQALDWVRARNE

SEQ ID NO: 127486 - protein, 22 aa, Mycobacterium avium
HDQWPTRLRRLVSEQVSLILRR

SEQ ID NO: 127487 - protein, 21 aa, Mycobacterium avium
HDRFLQNLTHHSWQDHGQAVS

SEQ ID NO: 127488 - protein, 27 aa, Mycobacterium avium
HDRGLRRLRLPRRAGPTARHPHPPGHR

SEQ ID NO: 127489 - protein, 17 aa, Mycobacterium avium
HDRYLSLVFQPGKASAF

SEQ ID NO: 127490 - protein, 24 aa, Mycobacterium avium
HDSSGLLIGPTEPTPRRLTIVVSN

SEQ ID NO: 127491 - protein, 26 aa, Mycobacterium avium
HDTASAIAWIGYDPPQVPGFDDIGKS

SEQ ID NO: 127492 - protein, 21 aa, Mycobacterium avium
HDTFRSWFHHSGDGEFVRHTV

SEQ ID NO: 127493 - protein, 18 aa, Mycobacterium avium
HDTLKLTGAKLGRDQWVR

SEQ ID NO: 127494 - protein, 36 aa, Mycobacterium avium
HDTLWDFVSLQPETLHAIMWLMSDRALPRSYRMMQG

SEQ ID NO: 127495 - protein, 17 aa, Mycobacterium avium
HDTVFYCVANMPSAVPK

SEQ ID NO: 127496 - protein, 18 aa, Mycobacterium avium
HDVLLATTRSVQAALPHL

SEQ ID NO: 127497 - protein, 25 aa, Mycobacterium avium
HEAALFRLMRSALMPITPHAIASMF

SEQ ID NO: 127498 - protein, 17 aa, Mycobacterium avium
HEAAMLFLAGRAEPFRV

SEQ ID NO: 127499 - protein, 25 aa, Mycobacterium avium
HEAKVDWILRNSFPLRSTAELSRQV

SEQ ID NO: 127500 - protein, 20 aa, Mycobacterium avium
HECWDLLRGLTLGRLVTHAD

SEQ ID NO: 127501 - protein, 21 aa, Mycobacterium avium
HECWDLLRGLTLGRLVTHADG

SEQ ID NO: 127502 - protein, 19 aa, Mycobacterium avium
HEFDVLARWLQGVQQRQAA

SEQ ID NO: 127503 - protein, 22 aa, Mycobacterium avium
HEHAQRLLDDRLLTIEWEAREL

SEQ ID NO: 127504 - protein, 23 aa, Mycobacterium avium
HEHAQRLLDDRLLTIEWEARELP

SEQ ID NO: 127505 - protein, 34 aa, Mycobacterium avium
HEIAIELQRRGCPVRHLILLDALLVIPSSDALNS

SEQ ID NO: 127506 - protein, 17 aa, Mycobacterium avium
HEMTFSMLYAFSENYVL

SEQ ID NO: 127507 - protein, 18 aa, Mycobacterium avium
HEMTFSMLYVFSENYVLP

SEQ ID NO: 127508 - protein, 20 aa, Mycobacterium avium
HEPVRLIQRAGIGCPQCVVV

SEQ ID NO: 127509 - protein, 24 aa, Mycobacterium avium
HERIAPLIADWADDLGRPIDVALQ

SEQ ID NO: 127510 - protein, 17 aa, Mycobacterium avium
HERQMIWIMNWVEINRG

SEQ ID NO: 127511 - protein, 18 aa, Mycobacterium avium
HERQMIWIMNWVEINRGL

SEQ ID NO: 127512 - protein, 19 aa, Mycobacterium avium
HERQMIWIMNWVEINRGLD

SEQ ID NO: 127513 - protein, 20 aa, Mycobacterium avium
HERTMMWLGFADRLENMIAD

SEQ ID NO: 127514 - protein, 28 aa, Mycobacterium avium
HETGHLDGFLYLDRLIGRYARSAKRAVK

SEQ ID NO: 127515 - protein, 34 aa, Mycobacterium avium
HEVGLAILGPLRDLDEVAYLRFASVYRSFESADD

SEQ ID NO: 127516 - protein, 19 aa, Mycobacterium avium
HFAARGFAFYALDLHKCGR

SEQ ID NO: 127517 - protein, 19 aa, Mycobacterium avium
HFDHLNVIAGFDELPRKLD

SEQ ID NO: 127518 - protein, 19 aa, Mycobacterium avium
HFGRTDVELPWEQLNKVDD

SEQ ID NO: 127519 - protein, 23 aa, Mycobacterium avium
HGADYLLVNPLQAAGFSGPANRM

SEQ ID NO: 127520 - protein, 17 aa, Mycobacterium avium
HGAIFVARPLCRRRSLR

SEQ ID NO: 127521 - protein, 18 aa, Mycobacterium avium
HGAYPSTLGYKGYPKSCC

SEQ ID NO: 127522 - protein, 23 aa, Mycobacterium avium
HGEAGVVAIFAQALQSGKPTKVF

SEQ ID NO: 127523 - protein, 26 aa, Mycobacterium avium
HGEFIKGFAGPFTLLVIADLLGVPEE

SEQ ID NO: 127524 - protein, 24 aa, Mycobacterium avium
HGEIPLGIYCRASLARYMDAERLF

SEQ ID NO: 127525 - protein, 26 aa, Mycobacterium avium
HGESWSLALSLRLAAFELLRADESDP

SEQ ID NO: 127526 - protein, 17 aa, Mycobacterium avium
HGFPEAMWVAIAHVGAH

SEQ ID NO: 127527 - protein, 21 aa, Mycobacterium avium
HGGYGYMREYPVARAYLDARV

SEQ ID NO: 127528 - protein, 24 aa, Mycobacterium avium
HGHDACYFRARPVRRLTNSRRAIR

SEQ ID NO: 127529 - protein, 29 aa, Mycobacterium avium
HGHPSTLHLWWARRPLAAARAVLFAQLVD

SEQ ID NO: 127530 - protein, 17 aa, Mycobacterium avium
HGLLFTEYAPGVRPARY

SEQ ID NO: 127531 - protein, 21 aa, Mycobacterium avium
HGLRLVVIEKSVFTLKSRRID

SEQ ID NO: 127532 - protein, 19 aa, Mycobacterium avium
HGLWPQVLALGYRVAVRPS

SEQ ID NO: 127533 - protein, 17 aa, Mycobacterium avium
HGNYRLDNLLFDPDRTR

SEQ ID NO: 127534 - protein, 17 aa, Mycobacterium avium
HGPSSIGFYTSGQLFAE

SEQ ID NO: 127535 - protein, 26 aa, Mycobacterium avium
HGPVGHFGLFFLGAGDQLFLSTAGPG

SEQ ID NO: 127536 - protein, 27 aa, Mycobacterium avium
HGPVGHFGLFFLGAGDQLFLSTAGPGQ

SEQ ID NO: 127537 - protein, 26 aa, Mycobacterium avium
HGQRWQHLAGLLPEFALAAPDLVGHG

SEQ ID NO: 127538 - protein, 24 aa, Mycobacterium avium
HGQRWQHLAGMLPEFALAAPDLVG

SEQ ID NO: 127539 - protein, 21 aa, Mycobacterium avium
HGRSLPRRRRRAVHGGRQHLG

SEQ ID NO: 127540 - protein, 23 aa, Mycobacterium avium
HGTAIVVLAALMGAGKLLGRDMS

SEQ ID NO: 127541 - protein, 25 aa, Mycobacterium avium
HGVGGTLIRLYGAGRVRVLPHVSSV

SEQ ID NO: 127542 - protein, 23 aa, Mycobacterium avium
HGVSRALFYGSPGIEASTPQQLH

SEQ ID NO: 127543 - protein, 24 aa, Mycobacterium avium
HGVTVTALVPALAKLWAHACEWED

SEQ ID NO: 127544 - protein, 25 aa, Mycobacterium avium
HGVVGLMRVYANLLAGQMIRVNSIH

SEQ ID NO: 127545 - protein, 24 aa, Mycobacterium avium
HGVVTFGRYFLGGGGAVHGGAIPL

SEQ ID NO: 127546 - protein, 17 aa, Mycobacterium avium
HGVWLERGEVILSGSFT

SEQ ID NO: 127547 - protein, 19 aa, Mycobacterium avium
HGWHLHIHALVFSVTSLSS

SEQ ID NO: 127548 - protein, 18 aa, Mycobacterium avium
HGWLWDADGRNAEIPYGE

SEQ ID NO: 127549 - protein, 18 aa, Mycobacterium avium
HGWQWSAEGRNVCIPYQD

SEQ ID NO: 127550 - protein, 26 aa, Mycobacterium avium
HHCAQPALRRLGLEATVRPSFAFYNT

SEQ ID NO: 127551 - protein, 17 aa, Mycobacterium avium
HHCDFAKLLPAVRAVRE

SEQ ID NO: 127552 - protein, 36 aa, Mycobacterium avium
HHEAGRVVLAGHPAKLLLQFGRPVHRQPRAAVVGHR

SEQ ID NO: 127553 - protein, 19 aa, Mycobacterium avium
HHEMTFSMLYAFSENYVLP

SEQ ID NO: 127554 - protein, 26 aa, Mycobacterium avium
HHEPALIHTGFLRNVLVTPDAVAIRH

SEQ ID NO: 127555 - protein, 17 aa, Mycobacterium avium
HHFGSREGLLLAIVEEV

SEQ ID NO: 127556 - protein, 24 aa, Mycobacterium avium
HHIAADGWSLRPLVRDLGVAYASR

SEQ ID NO: 127557 - protein, 18 aa, Mycobacterium avium
HHLDPIPLLVRDGVLSIA

SEQ ID NO: 127558 - protein, 24 aa, Mycobacterium avium
HHPDIDIRWRTVTFALVTHSEGGI

SEQ ID NO: 127559 - protein, 18 aa, Mycobacterium avium
HHPVRRRRAGAESWFGGG

SEQ ID NO: 127560 - protein, 18 aa, Mycobacterium avium
HHVFGPLGMHDTRYLPPA

SEQ ID NO: 127561 - protein, 18 aa, Mycobacterium avium
HHVKTTIKILGLVDKEIL

SEQ ID NO: 127562 - protein, 33 aa, Mycobacterium avium
HHYNVNLLVGTLKYTLWRLQERVVGRGPNAPQV

SEQ ID NO: 127563 - protein, 33 aa, Mycobacterium avium
HHYNVNLLVGTLKYTLWRLQERVVGRGPNSPQV

SEQ ID NO: 127564 - protein, 21 aa, Mycobacterium avium
HIAMDWLRKRFATVVYEPMDD

SEQ ID NO: 127565 - protein, 23 aa, Mycobacterium avium
HICPSCSDLYARDTWQLVHAGAA

SEQ ID NO: 127566 - protein, 21 aa, Mycobacterium avium
HIDCALLPWSIVEVGLSSVEP

SEQ ID NO: 127567 - protein, 20 aa, Mycobacterium avium
HIGGMVYLATALFGGFPVVL

SEQ ID NO: 127568 - protein, 22 aa, Mycobacterium avium
HIGKLPELPLRVGDTWEEAGPD

SEQ ID NO: 127569 - protein, 21 aa, Mycobacterium avium
HIGKLPELPLRVGDTWEETGP

SEQ ID NO: 127570 - protein, 18 aa, Mycobacterium avium
HILLTRTPALTGRYEFLS

SEQ ID NO: 127571 - protein, 22 aa, Mycobacterium avium
HILRDTIAKPPPAGTPALMLAV

SEQ ID NO: 127572 - protein, 19 aa, Mycobacterium avium
HILTSAWTCFSRGGFHATS

SEQ ID NO: 127573 - protein, 17 aa, Mycobacterium avium
HIRPWRVSPPGGRRELD

SEQ ID NO: 127574 - protein, 32 aa, Mycobacterium avium
HIWALAEHPPAGTGLLLAPFDPAQHVKRVLWQ

SEQ ID NO: 127575 - protein, 20 aa, Mycobacterium avium
HIYTRLDRPLTASLGLLFLA

SEQ ID NO: 127576 - protein, 19 aa, Mycobacterium avium
HKFDRCSWHPGPHRLPILD

SEQ ID NO: 127577 - protein, 24 aa, Mycobacterium avium
HKIAMLGLTFDDVLLLPAASDVVP

SEQ ID NO: 127578 - protein, 28 aa, Mycobacterium avium
HKRNPVLSVLIRRAAIAGPPLAATLHTA

SEQ ID NO: 127579 - protein, 30 aa, Mycobacterium avium
HLAAELMGRFAFDRPGLAAISLPDATAAIT

SEQ ID NO: 127580 - protein, 31 aa, Mycobacterium avium
HLAAELMGRFAFDRPGLAAISLPDATAAITA

SEQ ID NO: 127581 - protein, 18 aa, Mycobacterium avium
HLAHALVLLLTVGGAPSV

SEQ ID NO: 127582 - protein, 18 aa, Mycobacterium avium
HLATRLSGLFRTRRFRVY

SEQ ID NO: 127583 - protein, 25 aa, Mycobacterium avium
HLATRLSGLFRTRRFRVYTTDDVVG

SEQ ID NO: 127584 - protein, 19 aa, Mycobacterium avium
HLEALGPTMRRALSAAGVT

SEQ ID NO: 127585 - protein, 18 aa, Mycobacterium avium
HLELGETLGLIDMARGAK

SEQ ID NO: 127586 - protein, 21 aa, Mycobacterium avium
HLGHFALTNLLLPRLTDRVVT

SEQ ID NO: 127587 - protein, 20 aa, Mycobacterium avium
HLGLIVSDFLFFPGQRDRGP

SEQ ID NO: 127588 - protein, 17 aa, Mycobacterium avium
HLGVDEDRIRMLRSFDP

SEQ ID NO: 127589 - protein, 17 aa, Mycobacterium avium
HLHAVNPELLYVSAPGY

SEQ ID NO: 127590 - protein, 17 aa, Mycobacterium avium
HLHNLLAAPPTFRTMPY

SEQ ID NO: 127591 - protein, 18 aa, Mycobacterium avium
HLHTRLTQRFDAVIVPGV

SEQ ID NO: 127592 - protein, 17 aa, Mycobacterium avium
HLLAWEPRSVISHCHDC

SEQ ID NO: 127593 - protein, 20 aa, Mycobacterium avium
HLLIGVLSDPAALATVLLRL

SEQ ID NO: 127594 - protein, 32 aa, Mycobacterium avium
HLMIAMSAVRAIPYVLARPPGVVTAPVFGAIQ

SEQ ID NO: 127595 - protein, 18 aa, Mycobacterium avium
HLNVTWLIESLDAGLPPG

SEQ ID NO: 127596 - protein, 19 aa, Mycobacterium avium
HLNVTWLIESLDAGLPPGN

SEQ ID NO: 127597 - protein, 17 aa, Mycobacterium avium
HLPGVKYQWPQGTYLAW

SEQ ID NO: 127598 - protein, 31 aa, Mycobacterium avium
HLRVSDLDWTILGPGRLTLDPPTGRIAVGRG

SEQ ID NO: 127599 - protein, 22 aa, Mycobacterium avium
HLSRLVLGIPRQGSMRDGAWPL

SEQ ID NO: 127600 - protein, 24 aa, Mycobacterium avium
HLTQLGTMYPGNFGLGPVAVLGDN

SEQ ID NO: 127601 - protein, 23 aa, Mycobacterium avium
HLTRRDLILSLHLRISSLPWPGV

SEQ ID NO: 127602 - protein, 18 aa, Mycobacterium avium
HLVDRRRGFGGFYEQLLD

SEQ ID NO: 127603 - protein, 17 aa, Mycobacterium avium
HLVRRLTAPAPAAAPAG

SEQ ID NO: 127604 - protein, 17 aa, Mycobacterium avium
HMPLRPERLLDTEYLEQ

SEQ ID NO: 127605 - protein, 19 aa, Mycobacterium avium
HMPLRPERLLDTEYLERRA

SEQ ID NO: 127606 - protein, 22 aa, Mycobacterium avium
HMQLYGTRKEQLGWVPSTAGAT

SEQ ID NO: 127607 - protein, 19 aa, Mycobacterium avium
HMVGYFREHVPNVPIMIAG

SEQ ID NO: 127608 - protein, 19 aa, Mycobacterium avium
HNFVAFRGRELAPEGRLVA

SEQ ID NO: 127609 - protein, 21 aa, Mycobacterium avium
HNIHRNLLSRVFTPRKVLALE

SEQ ID NO: 127610 - protein, 28 aa, Mycobacterium avium
HNLLAAPPTFRTMPYWESVEPFPMPNEV

SEQ ID NO: 127611 - protein, 29 aa, Mycobacterium avium
HNLLAAPPTFRTMPYWESVEPFPMPNEVG

SEQ ID NO: 127612 - protein, 39 aa, Mycobacterium avium
HNPALAFQYLVQLALFDWPTHILEILTTAPQLLAPALLL

SEQ ID NO: 127613 - protein, 17 aa, Mycobacterium avium
HNVAFDYAFLAAEAELA

SEQ ID NO: 127614 - protein, 24 aa, Mycobacterium avium
HNVVPVRFLQAVETLAQAIAPVIG

SEQ ID NO: 127615 - protein, 24 aa, Mycobacterium avium
HPAAMVLFSPLYDLTFELAKARER

SEQ ID NO: 127616 - protein, 23 aa, Mycobacterium avium
HPCQGLYHRGVGRKPKVAMIATH

SEQ ID NO: 127617 - protein, 24 aa, Mycobacterium avium
HPDGRSAFALWFTGGIFVNQSADR

SEQ ID NO: 127618 - protein, 22 aa, Mycobacterium avium
HPDIDIRWRTVTFALVTHSEGG

SEQ ID NO: 127619 - protein, 22 aa, Mycobacterium avium
HPEIPVIENISFLVGDGGHRAR

SEQ ID NO: 127620 - protein, 24 aa, Mycobacterium avium
HPGLLRFTIGLAQTTTLLLAGRLE

SEQ ID NO: 127621 - protein, 23 aa, Mycobacterium avium
HPGQADVPWPCDHTKYISHFPEE

SEQ ID NO: 127622 - protein, 22 aa, Mycobacterium avium
HPHRDMEIVTWVLAGALAHQDS

SEQ ID NO: 127623 - protein, 23 aa, Mycobacterium avium
HPNLRASFFSRGIPRPVQIVPSR

SEQ ID NO: 127624 - protein, 19 aa, Mycobacterium avium
HPQAWRYAFAHNTTGGGQF

SEQ ID NO: 127625 - protein, 21 aa, Mycobacterium avium
HPQHLLTYWAKSAFPEGQPSQ

SEQ ID NO: 127626 - protein, 25 aa, Mycobacterium avium
HPRETHAVIIPVGRPRRGQPPGVVA

SEQ ID NO: 127627 - protein, 18 aa, Mycobacterium avium
HPRGMWYKSITDPATFWR

SEQ ID NO: 127628 - protein, 17 aa, Mycobacterium avium
HPRLAAPDWAPGSTVAQ

SEQ ID NO: 127629 - protein, 20 aa, Mycobacterium avium
HPRLLPGRMPAPVRRRHRRG

SEQ ID NO: 127630 - protein, 32 aa, Mycobacterium avium
HPRPRRLVRHAHWPEAWYPMRADAGPAPEFTA

SEQ ID NO: 127631 - protein, 19 aa, Mycobacterium avium
HPRRSVIEAAWRAIGPGVE

SEQ ID NO: 127632 - protein, 19 aa, Mycobacterium avium
HPVRLARFGPRALLPATVL

SEQ ID NO: 127633 - protein, 21 aa, Mycobacterium avium
HPVVHYLHRPVPRNELIAFFV

SEQ ID NO: 127634 - protein, 24 aa, Mycobacterium avium
HQAQRHLFNKFLGQLHHCLQTGRL

SEQ ID NO: 127635 - protein, 17 aa, Mycobacterium avium
HQEIAAVLLSPELADGL

SEQ ID NO: 127636 - protein, 19 aa, Mycobacterium avium
HQFRYYIKDAPIISDAEFD

SEQ ID NO: 127637 - protein, 24 aa, Mycobacterium avium
HQPRRRPRRRRRPRAVPGGRPGSA

SEQ ID NO: 127638 - protein, 19 aa, Mycobacterium avium
HQQLERHVLVLERGQAAPA

SEQ ID NO: 127639 - protein, 19 aa, Mycobacterium avium
HQRLRKIVSRGFSPRMVSE

SEQ ID NO: 127640 - protein, 25 aa, Mycobacterium avium
HQRRRADAILQRRTDRLPFLAPLDW

SEQ ID NO: 127641 - protein, 20 aa, Mycobacterium avium
HRADALVGHLGRPVAGADHP

SEQ ID NO: 127642 - protein, 28 aa, Mycobacterium avium
HRAFARIAPMLWLRAGARGPIITEIGDK

SEQ ID NO: 127643 - protein, 25 aa, Mycobacterium avium
HRAKPQLNVLLWQRAKEPQRGAWSL

SEQ ID NO: 127644 - protein, 26 aa, Mycobacterium avium
HRASFVQIHFALDGLPEFAPPHEFLN

SEQ ID NO: 127645 - protein, 19 aa, Mycobacterium avium
HRCFPVLAGALGEHDLLLV

SEQ ID NO: 127646 - protein, 25 aa, Mycobacterium avium
HRDDFQIILVDTPGLHRPRTLLGKR

SEQ ID NO: 127647 - protein, 26 aa, Mycobacterium avium
HRDFEVLAYPSVLRTWRIRLADGTEV

SEQ ID NO: 127648 - protein, 20 aa, Mycobacterium avium
HRDLADIWPVIDRDPAVRAV

SEQ ID NO: 127649 - protein, 27 aa, Mycobacterium avium
HREESMLVARRFAAVAALLRHRVATAD

SEQ ID NO: 127650 - protein, 17 aa, Mycobacterium avium
HRGRRQLRGLLADVAKE

SEQ ID NO: 127651 - protein, 21 aa, Mycobacterium avium
HRHLRRYMNWIPADYGDAMAP

SEQ ID NO: 127652 - protein, 23 aa, Mycobacterium avium
HRHLRRYMNWIPADYVDAMAPMT

SEQ ID NO: 127653 - protein, 24 aa, Mycobacterium avium
HRHWSLPVFVEWASGALIPCSCVG

SEQ ID NO: 127654 - protein, 20 aa, Mycobacterium avium
HRLAERLLVDVIGLPWEEVH

SEQ ID NO: 127655 - protein, 25 aa, Mycobacterium avium
HRLAERLLVDVIRLPWEEVHAEACR

SEQ ID NO: 127656 - protein, 25 aa, Mycobacterium avium
HRLDWAGVFAGLPARRVDLPTYAFA

SEQ ID NO: 127657 - protein, 24 aa, Mycobacterium avium
HRLDWAGVFAGLPARRVELPTYAF

SEQ ID NO: 127658 - protein, 17 aa, Mycobacterium avium
HRLLSLDQLSGGRLAWN

SEQ ID NO: 127659 - protein, 18 aa, Mycobacterium avium
HRLWTEEPVLPCLYLHGR

SEQ ID NO: 127660 - protein, 18 aa, Mycobacterium avium
HRMPYRWNDAYPARLGVM

SEQ ID NO: 127661 - protein, 29 aa, Mycobacterium avium
HRPVPLWQHVLVGKRLFDLFDYRNAEAPG

SEQ ID NO: 127662 - protein, 19 aa, Mycobacterium avium
HRRAFRHVVPAFGVALSAS

SEQ ID NO: 127663 - protein, 19 aa, Mycobacterium avium
HRRGQLGFGDFRPGRRFAG

SEQ ID NO: 127664 - protein, 23 aa, Mycobacterium avium
HRSSGAIELTGAWPGLRCDVDTP

SEQ ID NO: 127665 - protein, 27 aa, Mycobacterium avium
HRSTTELFPIPPWSVAPDVVAAAGAER

SEQ ID NO: 127666 - protein, 17 aa, Mycobacterium avium
HRTALKNPLFATARGLE

SEQ ID NO: 127667 - protein, 18 aa, Mycobacterium avium
HRVCRYLEDLAGDYHRFY

SEQ ID NO: 127668 - protein, 18 aa, Mycobacterium avium
HRYGEERFARRIAAQIVR

SEQ ID NO: 127669 - protein, 19 aa, Mycobacterium avium
HRYSFAPHPISGAAAKLWE

SEQ ID NO: 127670 - protein, 20 aa, Mycobacterium avium
HRYYSTIKDLTRLLGGPSHR

SEQ ID NO: 127671 - protein, 23 aa, Mycobacterium avium
HSAHYYFRDFWGADSGMLAALYV

SEQ ID NO: 127672 - protein, 24 aa, Mycobacterium avium
HSAPPVARLGCRIAPQAAGGRDVV

SEQ ID NO: 127673 - protein, 23 aa, Mycobacterium avium
HSDKLGPFCAALAYLCDKDMVLP

SEQ ID NO: 127674 - protein, 31 aa, Mycobacterium avium
HSDRPGFARALWAAPLLTPVMRYAAGRLWRD

SEQ ID NO: 127675 - protein, 32 aa, Mycobacterium avium
HSDRPGFARALWAAPLLTPVMRYAAGRLWRDD

SEQ ID NO: 127676 - protein, 25 aa, Mycobacterium avium
HSEVDTLRRVELLRQLRLGEYDVLV

SEQ ID NO: 127677 - protein, 26 aa, Mycobacterium avium
HSGTPVPLWLAAFQEAPLPALDLAGC

SEQ ID NO: 127678 - protein, 19 aa, Mycobacterium avium
HSGYWDPFFAACERNQVGI

SEQ ID NO: 127679 - protein, 26 aa, Mycobacterium avium
HSKGRYGGRHFLWSVPAEWAVPGMEL

SEQ ID NO: 127680 - protein, 24 aa, Mycobacterium avium
HSLAFDFSVWEIFGALLRGGRLVI

SEQ ID NO: 127681 - protein, 24 aa, Mycobacterium avium
HSQLLRVPPILRTTEVPSIEPAKD

SEQ ID NO: 127682 - protein, 18 aa, Mycobacterium avium
HSSRRDALSAELDPELFA

SEQ ID NO: 127683 - protein, 24 aa, Mycobacterium avium
HSSTLYYPLVATPMIAPTKAYQGV

SEQ ID NO: 127684 - protein, 27 aa, Mycobacterium avium
HSTFFRERWPRLLRSLYPIGGVVFDGD

SEQ ID NO: 127685 - protein, 28 aa, Mycobacterium avium
HSVWLPDHMVSFWPDSIWAPEFTDLATA

SEQ ID NO: 127686 - protein, 17 aa, Mycobacterium avium
HTAATWLSALTGSRVTL

SEQ ID NO: 127687 - protein, 32 aa, Mycobacterium avium
HTAGISIRRAPAPAWSHFTFNGAPGSILADRA

SEQ ID NO: 127688 - protein, 28 aa, Mycobacterium avium
HTAVQYRLPMTFVLFNNNAHAMCVTREQ

SEQ ID NO: 127689 - protein, 23 aa, Mycobacterium avium
HTELEALLRGYGYRPITVAGDDP

SEQ ID NO: 127690 - protein, 17 aa, Mycobacterium avium
HTFAPRAYLADLFYAGE

SEQ ID NO: 127691 - protein, 19 aa, Mycobacterium avium
HTFLWQHCAAMVPGFTGST

SEQ ID NO: 127692 - protein, 26 aa, Mycobacterium avium
HTFRDHYLDLDLDLSDVVFLATANVV

SEQ ID NO: 127693 - protein, 29 aa, Mycobacterium avium
HTGGRRISIYWTWSYPWESQRDIQTLDNR

SEQ ID NO: 127694 - protein, 20 aa, Mycobacterium avium
HTGWGIFELLLGGQGYRRYP

SEQ ID NO: 127695 - protein, 27 aa, Mycobacterium avium
HTGWLIVRDALVMGPWHDLERRSRTHR

SEQ ID NO: 127696 - protein, 24 aa, Mycobacterium avium
HTHPAFTAWRYNSAAYRELSETPG

SEQ ID NO: 127697 - protein, 23 aa, Mycobacterium avium
HTKPPDFWAWLIAAVKGIDPDVL

SEQ ID NO: 127698 - protein, 22 aa, Mycobacterium avium
HTLHALAWMVPGELAVFGLGEL

SEQ ID NO: 127699 - protein, 17 aa, Mycobacterium avium
HTLVESLDLRDLTLVGS

SEQ ID NO: 127700 - protein, 18 aa, Mycobacterium avium
HTLVRKHQPLYARVTRAG

SEQ ID NO: 127701 - protein, 17 aa, Mycobacterium avium
HTPFGGFKQSGLGRELG

SEQ ID NO: 127702 - protein, 18 aa, Mycobacterium avium
HTPFGGFKQSGLGRELGP

SEQ ID NO: 127703 - protein, 21 aa, Mycobacterium avium
HTRLTLSFIVTPHTSINLATV

SEQ ID NO: 127704 - protein, 18 aa, Mycobacterium avium
HTSALRPLRAALAELTPQ

SEQ ID NO: 127705 - protein, 18 aa, Mycobacterium avium
HTSRWIEIAAEWGRRDYW

SEQ ID NO: 127706 - protein, 18 aa, Mycobacterium avium
HTSYRRWAHALTARAPAG

SEQ ID NO: 127707 - protein, 24 aa, Mycobacterium avium
HTVMTIHFRPAGALAFLGCPLSDL

SEQ ID NO: 127708 - protein, 22 aa, Mycobacterium avium
HTVMTIHFRPAGALAFLGSPLS

SEQ ID NO: 127709 - protein, 23 aa, Mycobacterium avium
HTVMTIHFRPAGALAFLGSPLSD

SEQ ID NO: 127710 - protein, 27 aa, Mycobacterium avium
HTVPYRANLWALRKLGVRRVLAPCAVG

SEQ ID NO: 127711 - protein, 21 aa, Mycobacterium avium
HVAISFLPACGNCRWCASGYT

SEQ ID NO: 127712 - protein, 23 aa, Mycobacterium avium
HVARARFVLAGVTPTVLAGLLGQ

SEQ ID NO: 127713 - protein, 19 aa, Mycobacterium avium
HVDIPLQAYFRINTENMGQ

SEQ ID NO: 127714 - protein, 23 aa, Mycobacterium avium
HVDTPYRRLFTSRGSWRRYRRYV

SEQ ID NO: 127715 - protein, 24 aa, Mycobacterium avium
HVEGRYDFHTWLWAITACPGGGCV

SEQ ID NO: 127716 - protein, 20 aa, Mycobacterium avium
HVFEGTLYFPAPRTPRERVA

SEQ ID NO: 127717 - protein, 21 aa, Mycobacterium avium
HVFEGTLYFPAPRTPRERVAQ

SEQ ID NO: 127718 - protein, 17 aa, Mycobacterium avium
HVFGPLGMHDTRYLPPA

SEQ ID NO: 127719 - protein, 29 aa, Mycobacterium avium
HVGELVRRSHFLLLRFHEGRLPQRPVDPA

SEQ ID NO: 127720 - protein, 23 aa, Mycobacterium avium
HVGISFLRRFRPQVLRPAGRAVG

SEQ ID NO: 127721 - protein, 17 aa, Mycobacterium avium
HVGPGAVPLLAAAAAWD

SEQ ID NO: 127722 - protein, 20 aa, Mycobacterium avium
HVGRRRAARFLAEGSNLVEA

SEQ ID NO: 127723 - protein, 17 aa, Mycobacterium avium
HVHAVMWAARRSGLYYT

SEQ ID NO: 127724 - protein, 17 aa, Mycobacterium avium
HVLDLPAFRIGTIPVTN

SEQ ID NO: 127725 - protein, 25 aa, Mycobacterium avium
HVLERLFPGIGKLDESFPGLGMNGP

SEQ ID NO: 127726 - protein, 17 aa, Mycobacterium avium
HVLNVLHLLLPAGEQFF

SEQ ID NO: 127727 - protein, 22 aa, Mycobacterium avium
HVLRLGLHRLPIDQFGHLRELA

SEQ ID NO: 127728 - protein, 17 aa, Mycobacterium avium
HVPPPGSVDARPILRTV

SEQ ID NO: 127729 - protein, 23 aa, Mycobacterium avium
HVSAELLGILRDDLNVDVSRVTP

SEQ ID NO: 127730 - protein, 19 aa, Mycobacterium avium
HVSPPVIVKYITDLQLLGL

SEQ ID NO: 127731 - protein, 22 aa, Mycobacterium avium
HVTPIKMLLREALDAGPGILYR

SEQ ID NO: 127732 - protein, 18 aa, Mycobacterium avium
HVVAVLDGRRRLAARRPA

SEQ ID NO: 127733 - protein, 24 aa, Mycobacterium avium
HVVHLASPALLGYGGLRAARWLGV

SEQ ID NO: 127734 - protein, 17 aa, Mycobacterium avium
HVVHPVRAACAAGVRAV

SEQ ID NO: 127735 - protein, 19 aa, Mycobacterium avium
HVVHPVRAACAAGVRAVVL

SEQ ID NO: 127736 - protein, 18 aa, Mycobacterium avium
HVVICEGTFLPQVLAAAQ

SEQ ID NO: 127737 - protein, 18 aa, Mycobacterium avium
HVVICEGTFMPQVLAAAQ

SEQ ID NO: 127738 - protein, 23 aa, Mycobacterium avium
HVVRARFVLAGVTPTVLAGLLGQ

SEQ ID NO: 127739 - protein, 17 aa, Mycobacterium avium
HWGELAAFYLERLDETL

SEQ ID NO: 127740 - protein, 33 aa, Mycobacterium avium
HWGRYRDVLVPLNGRWLFAHRRISVDAFAADSL

SEQ ID NO: 127741 - protein, 22 aa, Mycobacterium avium
HWRGSLVAVFQPAEELGDGARR

SEQ ID NO: 127742 - protein, 23 aa, Mycobacterium avium
HWRGSLVAVFQPAEELGDGARRM

SEQ ID NO: 127743 - protein, 34 aa, Mycobacterium avium
HWRTFARWVREHQLKPAIWVRPNGRRVFTRHSSE

SEQ ID NO: 127744 - protein, 17 aa, Mycobacterium avium
HWRVPPSRRFLPEDRTV

SEQ ID NO: 127745 - protein, 18 aa, Mycobacterium avium
HYAERRRMSWRSGGGSPH

SEQ ID NO: 127746 - protein, 24 aa, Mycobacterium avium
HYAKLMFDVMITQVLKRLPDFELA

SEQ ID NO: 127747 - protein, 24 aa, Mycobacterium avium
HYAKMMFDVMLTQVLKRLPDFELA

SEQ ID NO: 127748 - protein, 22 aa, Mycobacterium avium
HYEDAVIPIPLISAAAGYEIDE

SEQ ID NO: 127749 - protein, 21 aa, Mycobacterium avium
HYFGEELVLFRTASGRVHVMD

SEQ ID NO: 127750 - protein, 18 aa, Mycobacterium avium
HYPVTAERSLRWVAVHTA

SEQ ID NO: 127751 - protein, 19 aa, Mycobacterium avium
HYQFHRLRSPFRPKRPLAD

SEQ ID NO: 127752 - protein, 24 aa, Mycobacterium avium
HYRLDLACLLGCGFITGWGSAVYA

SEQ ID NO: 127753 - protein, 24 aa, Mycobacterium avium
HYRLDLACLLGCGFITGWGSSVYA

SEQ ID NO: 127754 - protein, 28 aa, Mycobacterium avium
HYVYVSYQPTILPSPHYPPPGYADAPSA

SEQ ID NO: 127755 - protein, 18 aa, Mycobacterium avium
HYYATFWYDPFGIKLEAV

SEQ ID NO: 127756 - protein, 25 aa, Mycobacterium avium
IAAGSPPVYFGFGSLPVKSPADTVA

SEQ ID NO: 127757 - protein, 22 aa, Mycobacterium avium
IAAIVDRLTVLTPSPPVPTMST

SEQ ID NO: 127758 - protein, 17 aa, Mycobacterium avium
IAAIWSQAGPNLVIEPA

SEQ ID NO: 127759 - protein, 20 aa, Mycobacterium avium
IAARTRYFDEFYADAAAAGI

SEQ ID NO: 127760 - protein, 32 aa, Mycobacterium avium
IAATERGLLLTTLWYIRVVEPTTLLVTGLTRD

SEQ ID NO: 127761 - protein, 21 aa, Mycobacterium avium
IAAVIERSFADWRKAWQVPDE

SEQ ID NO: 127762 - protein, 28 aa, Mycobacterium avium
IAAVRTLWRTWPFASVLGDRPTGVFADT

SEQ ID NO: 127763 - protein, 25 aa, Mycobacterium avium
IADACGFAVPYYELVDERPVLNAYH

SEQ ID NO: 127764 - protein, 27 aa, Mycobacterium avium
IADEIRTRWPPWPAAAPACSGSGKCFP

SEQ ID NO: 127765 - protein, 23 aa, Mycobacterium avium
IADGPMAGLLARAIVVVGADGNV

SEQ ID NO: 127766 - protein, 29 aa, Mycobacterium avium
IAEQRPDLVPIFLNALPAPLIEASDVSNA

SEQ ID NO: 127767 - protein, 27 aa, Mycobacterium avium
IAESRGYFDLAWAHAGGLPRPLMVVTM

SEQ ID NO: 127768 - protein, 26 aa, Mycobacterium avium
IAEVAATWRRLGLSVPLVVDPVCASM

SEQ ID NO: 127769 - protein, 26 aa, Mycobacterium avium
IAFDLAIAIEVFGRVWLDGGAPGYRV

SEQ ID NO: 127770 - protein, 19 aa, Mycobacterium avium
IAFPIAHIGGMVYLASALI

SEQ ID NO: 127771 - protein, 26 aa, Mycobacterium avium
IAGAAMFVLDKWLQPVPAGVVGELYL

SEQ ID NO: 127772 - protein, 17 aa, Mycobacterium avium
IAGFDELGAQLPGCIPF

SEQ ID NO: 127773 - protein, 17 aa, Mycobacterium avium
IAGLLRCQGLRAKVANA

SEQ ID NO: 127774 - protein, 22 aa, Mycobacterium avium
IAHGGLGWVYLAVDHNVNDRPV

SEQ ID NO: 127775 - protein, 17 aa, Mycobacterium avium
IAHVAVFDTGFFHDLPP

SEQ ID NO: 127776 - protein, 18 aa, Mycobacterium avium
IALLMADFNLYSIPVVDE

SEQ ID NO: 127777 - protein, 19 aa, Mycobacterium avium
IAMEKRWRKVLGERRLTEL

SEQ ID NO: 127778 - protein, 20 aa, Mycobacterium avium
IAMYLCRELTDLSLPKIGQA

SEQ ID NO: 127779 - protein, 19 aa, Mycobacterium avium
IAPLAFRQLSIEEELAQWR

SEQ ID NO: 127780 - protein, 24 aa, Mycobacterium avium
IAPRTFYAWLARAPSARALWDTVI

SEQ ID NO: 127781 - protein, 21 aa, Mycobacterium avium
IAQEEVFGPVLTVLRYRDDDD

SEQ ID NO: 127782 - protein, 17 aa, Mycobacterium avium
IARHLQGMWVSWLHEFD

SEQ ID NO: 127783 - protein, 19 aa, Mycobacterium avium
IARLVDLYAKRPQVQERLT

SEQ ID NO: 127784 - protein, 17 aa, Mycobacterium avium
IARRWEFRQVRLAAQTV

SEQ ID NO: 127785 - protein, 18 aa, Mycobacterium avium
IARSFAAALGLQFTRVQF

SEQ ID NO: 127786 - protein, 20 aa, Mycobacterium avium
IARWLEAPGVRIVRVKGTPD

SEQ ID NO: 127787 - protein, 19 aa, Mycobacterium avium
IASDRLRLEAYRRLAAAGS

SEQ ID NO: 127788 - protein, 20 aa, Mycobacterium avium
IASNTLWPRTLVATAAVQNL

SEQ ID NO: 127789 - protein, 21 aa, Mycobacterium avium
IASNTLWPRTLVATAAVQNLL

SEQ ID NO: 127790 - protein, 22 aa, Mycobacterium avium
IASRWPGLLPEVQRLLPDVHPQ

SEQ ID NO: 127791 - protein, 17 aa, Mycobacterium avium
IAVLLPPQPMDTGIVGS

SEQ ID NO: 127792 - protein, 21 aa, Mycobacterium avium
IAWSWLRHPVKSREFPAKHER

SEQ ID NO: 127793 - protein, 20 aa, Mycobacterium avium
IAYRDMSSGAFKALRPDFLF

SEQ ID NO: 127794 - protein, 31 aa, Mycobacterium avium
IDAAEIYVPFSWFEPMWLENLGFAPEGEGWK

SEQ ID NO: 127795 - protein, 24 aa, Mycobacterium avium
IDAEPRRPLHWRPGSDPAVADLVG

SEQ ID NO: 127796 - protein, 27 aa, Mycobacterium avium
IDAGVPIIPLIVWGAHRIWTKDHPRTL

SEQ ID NO: 127797 - protein, 19 aa, Mycobacterium avium
IDAIYIDPPYNSGAKDWKY

SEQ ID NO: 127798 - protein, 21 aa, Mycobacterium avium
IDAMFAHHIDELLRLASADEA

SEQ ID NO: 127799 - protein, 19 aa, Mycobacterium avium
IDAMFAYHIDELLRLASAD

SEQ ID NO: 127800 - protein, 20 aa, Mycobacterium avium
IDAMFAYHIDELLRLASADD

SEQ ID NO: 127801 - protein, 17 aa, Mycobacterium avium
IDCAAARIALAHARALA

SEQ ID NO: 127802 - protein, 26 aa, Mycobacterium avium
IDDVSQLVYLHLRFHGYGDGKWTDSA

SEQ ID NO: 127803 - protein, 21 aa, Mycobacterium avium
IDDVWIPLFEPTGGTDERDLL

SEQ ID NO: 127804 - protein, 25 aa, Mycobacterium avium
IDDYQPGLSPLLDSYRGRDFVVKCA

SEQ ID NO: 127805 - protein, 18 aa, Mycobacterium avium
IDEYLQLCGNVCATLGVW

SEQ ID NO: 127806 - protein, 19 aa, Mycobacterium avium
IDEYLQLCGNVCATLSVWY

SEQ ID NO: 127807 - protein, 19 aa, Mycobacterium avium
IDGQLYVDMRLIDGKDLAG

SEQ ID NO: 127808 - protein, 21 aa, Mycobacterium avium
IDGQMFLEMRLVEGTDLDSVL

SEQ ID NO: 127809 - protein, 35 aa, Mycobacterium avium
IDGRAPFFALTVFARGLLNRLFTRAYLPGAGPDTD

SEQ ID NO: 127810 - protein, 18 aa, Mycobacterium avium
IDGWSLPVLLQEVFAGYY

SEQ ID NO: 127811 - protein, 20 aa, Mycobacterium avium
IDHNLLDRPVDLTQWAAPQF

SEQ ID NO: 127812 - protein, 18 aa, Mycobacterium avium
IDILRWTDEHFGPVDGPR

SEQ ID NO: 127813 - protein, 17 aa, Mycobacterium avium
IDKPVIPIISNLTGQPA

SEQ ID NO: 127814 - protein, 19 aa, Mycobacterium avium
IDLALALHPTPAVGGVPTD

SEQ ID NO: 127815 - protein, 18 aa, Mycobacterium avium
IDLDYHIRPWRVSPPGGR

SEQ ID NO: 127816 - protein, 20 aa, Mycobacterium avium
IDLLARMRGGIDKKRRAELI

SEQ ID NO: 127817 - protein, 20 aa, Mycobacterium avium
IDLLARMRGGIDKRRRAELI

SEQ ID NO: 127818 - protein, 20 aa, Mycobacterium avium
IDLLTDHRFELGLGAGYVKE

SEQ ID NO: 127819 - protein, 21 aa, Mycobacterium avium
IDLSRTVGWFTAKYPVSLDVA

SEQ ID NO: 127820 - protein, 17 aa, Mycobacterium avium
IDPHRAFADLGFDSLIG

SEQ ID NO: 127821 - protein, 21 aa, Mycobacterium avium
IDPLVLRLRSNPAYSAPVVTP

SEQ ID NO: 127822 - protein, 17 aa, Mycobacterium avium
IDPRWAKLAGMFASDEA

SEQ ID NO: 127823 - protein, 32 aa, Mycobacterium avium
IDRLDPERGVLLRAVWLRPAGGDGVLLLTAHV

SEQ ID NO: 127824 - protein, 20 aa, Mycobacterium avium
IDRLLILQDEKVRHRNLIPD

SEQ ID NO: 127825 - protein, 24 aa, Mycobacterium avium
IDRRAPLFRSCRNGVLSEGPLSGA

SEQ ID NO: 127826 - protein, 18 aa, Mycobacterium avium
IDRSTAFLTPRVKPLIIT

SEQ ID NO: 127827 - protein, 17 aa, Mycobacterium avium
IDSPQRLWEALLRGDDL

SEQ ID NO: 127828 - protein, 22 aa, Mycobacterium avium
IDSYRPGCWLDSGPFGCLGSGP

SEQ ID NO: 127829 - protein, 23 aa, Mycobacterium avium
IDVALLYDHFSPMVLMQLEDYGF

SEQ ID NO: 127830 - protein, 28 aa, Mycobacterium avium
IDVEAIRWTTWHAAWLIAEGRPAAREAA

SEQ ID NO: 127831 - protein, 18 aa, Mycobacterium avium
IDVLADPARIAKLGLRAP

SEQ ID NO: 127832 - protein, 19 aa, Mycobacterium avium
IDVTRCGGITDWLRAAAVA

SEQ ID NO: 127833 - protein, 17 aa, Mycobacterium avium
IDVYHRALWDSRLNGPV

SEQ ID NO: 127834 - protein, 30 aa, Mycobacterium avium
IEADYEQWVAVRPPPLFGTEPDARVLTLAA

SEQ ID NO: 127835 - protein, 17 aa, Mycobacterium avium
IEALDLLLEAKDRSTKK

SEQ ID NO: 127836 - protein, 25 aa, Mycobacterium avium
IEALHGLAEMPWRLSIFGDGPDRQR

SEQ ID NO: 127837 - protein, 26 aa, Mycobacterium avium
IEALRGLAEIPWRLSIFGDGPDRQRL

SEQ ID NO: 127838 - protein, 20 aa, Mycobacterium avium
IEAPVRYSERLYASTPGIVI

SEQ ID NO: 127839 - protein, 21 aa, Mycobacterium avium
IEAPVRYSERLYASTPGIVID

SEQ ID NO: 127840 - protein, 18 aa, Mycobacterium avium
IEDPVFDEFPYYQAKREA

SEQ ID NO: 127841 - protein, 26 aa, Mycobacterium avium
IEDSDELPPLWRAFGASRRADGHWTL

SEQ ID NO: 127842 - protein, 24 aa, Mycobacterium avium
IEDSDELPPLWRAFGASRRGDGHW

SEQ ID NO: 127843 - protein, 25 aa, Mycobacterium avium
IEDSDELPPLWRAFGASRRGDGHWT

SEQ ID NO: 127844 - protein, 17 aa, Mycobacterium avium
IEEKRMFGGLAFLLNGN

SEQ ID NO: 127845 - protein, 24 aa, Mycobacterium avium
IEETLSALIFDNLFGRFPGLNVLV

SEQ ID NO: 127846 - protein, 29 aa, Mycobacterium avium
IEFTVQSGKLWLLQSRAAKRSPQAALRCA

SEQ ID NO: 127847 - protein, 24 aa, Mycobacterium avium
IEHGDAFFLGELLPDVIAAEVWHG

SEQ ID NO: 127848 - protein, 17 aa, Mycobacterium avium
IEHLTALLPDDGWFAGH

SEQ ID NO: 127849 - protein, 19 aa, Mycobacterium avium
IEHLTALLPDDGWFAGHRL

SEQ ID NO: 127850 - protein, 28 aa, Mycobacterium avium
IEKGLPLSPILLVRGDFLAGVPLQIADG

SEQ ID NO: 127851 - protein, 29 aa, Mycobacterium avium
IELGDWVRPVLLDGLAVLLLEPPRQQNNG

SEQ ID NO: 127852 - protein, 25 aa, Mycobacterium avium
IELGGDFGGVWYWNRYPGIQCDNES

SEQ ID NO: 127853 - protein, 26 aa, Mycobacterium avium
IELPGLGHPLLPPWTVADSGAHGVTM

SEQ ID NO: 127854 - protein, 27 aa, Mycobacterium avium
IELQRRGCAIARLVLLDAQPGLDGSVT

SEQ ID NO: 127855 - protein, 30 aa, Mycobacterium avium
IELQRRGCPVRHLILLDALLVIPSSDVLNS

SEQ ID NO: 127856 - protein, 17 aa, Mycobacterium avium
IEPLGLSRRPRDLATKQ

SEQ ID NO: 127857 - protein, 18 aa, Mycobacterium avium
IEPLGLSRRPRDLATKQA

SEQ ID NO: 127858 - protein, 17 aa, Mycobacterium avium
IEPVDDGPRRAHRGQID

SEQ ID NO: 127859 - protein, 25 aa, Mycobacterium avium
IERASRWLNALTANPLRTVAVTHPA

SEQ ID NO: 127860 - protein, 27 aa, Mycobacterium avium
IERCAELVVAWWAVTKAGGVYAPVNLD

SEQ ID NO: 127861 - protein, 26 aa, Mycobacterium avium
IERCAELVVAWWAVTKVGGVYAPVNL

SEQ ID NO: 127862 - protein, 17 aa, Mycobacterium avium
IERIDAEYGRYFTPTGR

SEQ ID NO: 127863 - protein, 17 aa, Mycobacterium avium
IERLIAAAHRRGIKITM

SEQ ID NO: 127864 - protein, 18 aa, Mycobacterium avium
IERMRLVRDDIARRVETL

SEQ ID NO: 127865 - protein, 26 aa, Mycobacterium avium
IERPGLGHPLLPPWTVVDSGAHGVTM

SEQ ID NO: 127866 - protein, 22 aa, Mycobacterium avium
IETFHLHMLRHTAATRWLRAGG

SEQ ID NO: 127867 - protein, 25 aa, Mycobacterium avium
IETMLRRHAYPTLGDRQLTSILPSD

SEQ ID NO: 127868 - protein, 17 aa, Mycobacterium avium
IEVARRLLPGIAHVAVF

SEQ ID NO: 127869 - protein, 18 aa, Mycobacterium avium
IEVLRDLASRIFTDFTYR

SEQ ID NO: 127870 - protein, 18 aa, Mycobacterium avium
IFLGGQRARVTERRVRRG

SEQ ID NO: 127871 - protein, 17 aa, Mycobacterium avium
IFLVPAQWQAVCAEQRA

SEQ ID NO: 127872 - protein, 26 aa, Mycobacterium avium
IFNEKQIEFMLKDTPLRRLTTAEDVA

SEQ ID NO: 127873 - protein, 19 aa, Mycobacterium avium
IFNTYGPGMRADDGRMVPT

SEQ ID NO: 127874 - protein, 19 aa, Mycobacterium avium
IFTEVIIAPAYQPAALEIL

SEQ ID NO: 127875 - protein, 18 aa, Mycobacterium avium
IFVKDKPAWLGRAWRRIG

SEQ ID NO: 127876 - protein, 20 aa, Mycobacterium avium
IFYLMGGLAPFPGVTDGILC

SEQ ID NO: 127877 - protein, 37 aa, Mycobacterium avium
IFYRRKLFEGIGPYNLRYPIWADWDFNIRCFSNPALV

SEQ ID NO: 127878 - protein, 30 aa, Mycobacterium avium
IGADKRIGYDFLFPGIGYGASCLPKDVRAL

SEQ ID NO: 127879 - protein, 24 aa, Mycobacterium avium
IGAEFLRPGPGWGGSCLPKDTAAL

SEQ ID NO: 127880 - protein, 30 aa, Mycobacterium avium
IGAIQVPAQPLAWWPEVKAQANVVGAVDTM

SEQ ID NO: 127881 - protein, 18 aa, Mycobacterium avium
IGAITPDWLREGVRFWLR

SEQ ID NO: 127882 - protein, 19 aa, Mycobacterium avium
IGALIAFLLSDVCGFVTGQ

SEQ ID NO: 127883 - protein, 19 aa, Mycobacterium avium
IGALSFAYTGPGPLTERVN

SEQ ID NO: 127884 - protein, 25 aa, Mycobacterium avium
IGASLLQDWTQFAAPAVFGIAMRLY

SEQ ID NO: 127885 - protein, 18 aa, Mycobacterium avium
IGCALVGAQLPWSRIATD

SEQ ID NO: 127886 - protein, 23 aa, Mycobacterium avium
IGEIFGTLIMGARLVIPRPDGLR

SEQ ID NO: 127887 - protein, 17 aa, Mycobacterium avium
IGELDRPGRLTLVEGAG

SEQ ID NO: 127888 - protein, 19 aa, Mycobacterium avium
IGFPAALRTLETVDLVVHA

SEQ ID NO: 127889 - protein, 19 aa, Mycobacterium avium
IGGGIWHRSRLVAGGDAAG

SEQ ID NO: 127890 - protein, 23 aa, Mycobacterium avium
IGGRIAPELLFDASARPEQIGQL

SEQ ID NO: 127891 - protein, 17 aa, Mycobacterium avium
IGHPRPRRLVRHAHWPE

SEQ ID NO: 127892 - protein, 18 aa, Mycobacterium avium
IGIVLITARDGLPDRLRG

SEQ ID NO: 127893 - protein, 24 aa, Mycobacterium avium
IGKPAALLRAARASLGDAGLLLVV

SEQ ID NO: 127894 - protein, 28 aa, Mycobacterium avium
IGKRIERGLWLTALLRATLAVVRGAAAE

SEQ ID NO: 127895 - protein, 24 aa, Mycobacterium avium
IGLASTDQLYFASGLLDCPGAMFT

SEQ ID NO: 127896 - protein, 19 aa, Mycobacterium avium
IGLTGLLHPIGPASQPPVP

SEQ ID NO: 127897 - protein, 21 aa, Mycobacterium avium
IGLVRLLRERADPAVAPWIHR

SEQ ID NO: 127898 - protein, 25 aa, Mycobacterium avium
IGRRYLNINLAPWVDTRILGMSTSH

SEQ ID NO: 127899 - protein, 30 aa, Mycobacterium avium
IGRVLPEIAALLRRPLFTLERVRVCKRDGQ

SEQ ID NO: 127900 - protein, 30 aa, Mycobacterium avium
IGRVLPEIAALLRRPLFTLERVRVCKRDGR

SEQ ID NO: 127901 - protein, 22 aa, Mycobacterium avium
IGSAVAYLIGPAARYVTGQTLG

SEQ ID NO: 127902 - protein, 31 aa, Mycobacterium avium
IGSTIFAADLVRAVLGLPADWEPLGAIAIGY

SEQ ID NO: 127903 - protein, 23 aa, Mycobacterium avium
IGTHRLLQTGVRWKDLGLVVVDE

SEQ ID NO: 127904 - protein, 18 aa, Mycobacterium avium
IGVGTLDLFYPECLEYAR

SEQ ID NO: 127905 - protein, 23 aa, Mycobacterium avium
IGVRSVCYLPLTYDHRLIDGADA

SEQ ID NO: 127906 - protein, 30 aa, Mycobacterium avium
IGVTPEPLPISPLQLITPGLSIVGYPSGTA

SEQ ID NO: 127907 - protein, 24 aa, Mycobacterium avium
IGVTPILPMIRVAARRGIDWRAIY

SEQ ID NO: 127908 - protein, 25 aa, Mycobacterium avium
IHEARTVFLEVINFPKPLVSAVNGP

SEQ ID NO: 127909 - protein, 19 aa, Mycobacterium avium
IHGFILADQHLTPGGTAPG

SEQ ID NO: 127910 - protein, 25 aa, Mycobacterium avium
IHNHPYYVCVLAALGTLPELVHQTG

SEQ ID NO: 127911 - protein, 19 aa, Mycobacterium avium
IHPFPQHCAYGSSKWALRG

SEQ ID NO: 127912 - protein, 31 aa, Mycobacterium avium
IHPLKNVLILAFMWLLCWMAEGDWPPGVPRR

SEQ ID NO: 127913 - protein, 24 aa, Mycobacterium avium
IHPPDAASRLLALIVGTGGDATRI

SEQ ID NO: 127914 - protein, 22 aa, Mycobacterium avium
IHQAIPVIRAFSHFALLANVAE

SEQ ID NO: 127915 - protein, 29 aa, Mycobacterium avium
IHRAAAPGASLFILVFAKGAFPAEMQPKP

SEQ ID NO: 127916 - protein, 19 aa, Mycobacterium avium
IHYLPVRRDGRFVVALGMG

SEQ ID NO: 127917 - protein, 26 aa, Mycobacterium avium
IIAELASMMPMRVIGMLLGIPESEPV

SEQ ID NO: 127918 - protein, 27 aa, Mycobacterium avium
IIAEVAATWRRLGLSVPLVVDPVCASM

SEQ ID NO: 127919 - protein, 20 aa, Mycobacterium avium
IIANRVSYFYDFRGPSVAVD

SEQ ID NO: 127920 - protein, 17 aa, Mycobacterium avium
IIGAIIQGLGGILGGTG

SEQ ID NO: 127921 - protein, 17 aa, Mycobacterium avium
IIKALRTAAVNDTKDAL

SEQ ID NO: 127922 - protein, 18 aa, Mycobacterium avium
IINDPFAAPLVRAVGLDF

SEQ ID NO: 127923 - protein, 17 aa, Mycobacterium avium
IITGSGTFYTLRCYLDD

SEQ ID NO: 127924 - protein, 19 aa, Mycobacterium avium
IKAARVLSLAQDTADRLTS

SEQ ID NO: 127925 - protein, 18 aa, Mycobacterium avium
IKAFFTAFSSHRALARAA

SEQ ID NO: 127926 - protein, 25 aa, Mycobacterium avium
IKDHKPILIGLPPPAIREVLNSDIP

SEQ ID NO: 127927 - protein, 17 aa, Mycobacterium avium
IKDPFAQVFLDAAGDGV

SEQ ID NO: 127928 - protein, 17 aa, Mycobacterium avium
IKERLLELLPNRVITDS

SEQ ID NO: 127929 - protein, 17 aa, Mycobacterium avium
IKGQNLFGFGWDIDTGY

SEQ ID NO: 127930 - protein, 18 aa, Mycobacterium avium
IKGQNLFGFGWDIDTGYS

SEQ ID NO: 127931 - protein, 27 aa, Mycobacterium avium
IKSVDLLNRFVGLGLRFISAGTDVGMM

SEQ ID NO: 127932 - protein, 17 aa, Mycobacterium avium
IKVAIDEFVRWTTPVMT

SEQ ID NO: 127933 - protein, 26 aa, Mycobacterium avium
IKVRVLRRWGPARIAYLLGLNVSTVH

SEQ ID NO: 127934 - protein, 20 aa, Mycobacterium avium
ILAAVKRLYLLGKNDRPTGT

SEQ ID NO: 127935 - protein, 17 aa, Mycobacterium avium
ILALLDAEVGLGEAVQA

SEQ ID NO: 127936 - protein, 24 aa, Mycobacterium avium
ILAMERVEYRILGPQYKSPRLVKP

SEQ ID NO: 127937 - protein, 19 aa, Mycobacterium avium
ILAPLTPAAIFLVLTVDDG

SEQ ID NO: 127938 - protein, 27 aa, Mycobacterium avium
ILASGLDARAYRLAWPAGTTVFEIDQP

SEQ ID NO: 127939 - protein, 28 aa, Mycobacterium avium
ILASGLDARAYRLAWPAGTTVFEIDQPQ

SEQ ID NO: 127940 - protein, 24 aa, Mycobacterium avium
ILDEALICHLGYLSGGRPVVLPTT

SEQ ID NO: 127941 - protein, 30 aa, Mycobacterium avium
ILEDYAMLATGLLALYQLSAEDSWLTAATD

SEQ ID NO: 127942 - protein, 26 aa, Mycobacterium avium
ILELDTLPTHLVIVGGSYIALEFAQM

SEQ ID NO: 127943 - protein, 35 aa, Mycobacterium avium
ILEPFGLEKMRYKWRKWLYFDCNWKVALEAFNETY

SEQ ID NO: 127944 - protein, 18 aa, Mycobacterium avium
ILFTQDWGFRLDQVKVPV

SEQ ID NO: 127945 - protein, 20 aa, Mycobacterium avium
ILGLDIKGHVVKKLLVSEAS

SEQ ID NO: 127946 - protein, 17 aa, Mycobacterium avium
ILGLSWDSVDLDAGLLT

SEQ ID NO: 127947 - protein, 23 aa, Mycobacterium avium
ILKKLMARNPAFQSALDPGTFES

SEQ ID NO: 127948 - protein, 20 aa, Mycobacterium avium
ILLSGLAVRLTIPGAAPADT

SEQ ID NO: 127949 - protein, 19 aa, Mycobacterium avium
ILLYSSDYPHWTFDDPRWL

SEQ ID NO: 127950 - protein, 31 aa, Mycobacterium avium
ILMPNSVDWALAWFATTRIGAVAVPLNTFYQ

SEQ ID NO: 127951 - protein, 25 aa, Mycobacterium avium
ILNQMEIFTLLGYWNMPRAQISLVA

SEQ ID NO: 127952 - protein, 22 aa, Mycobacterium avium
ILRDGVPILLIRGQMSDLVSQE

SEQ ID NO: 127953 - protein, 18 aa, Mycobacterium avium
ILRNFKMPGFTVPEFRRK

SEQ ID NO: 127954 - protein, 26 aa, Mycobacterium avium
ILSQMEIFTLLGYWNTPRAQISLVAT

SEQ ID NO: 127955 - protein, 34 aa, Mycobacterium avium
ILSSMERAGLLLPLGWNPRLPIMGQQYISQGAIS

SEQ ID NO: 127956 - protein, 25 aa, Mycobacterium avium
ILTESNITSGFRKGWYPFNKTLGKA

SEQ ID NO: 127957 - protein, 17 aa, Mycobacterium avium
ILTNNHVVAAAAGPPKG

SEQ ID NO: 127958 - protein, 18 aa, Mycobacterium avium
ILVLGPLGESVGRVRDVV

SEQ ID NO: 127959 - protein, 18 aa, Mycobacterium avium
IMGLGPIEATKKALARAK

SEQ ID NO: 127960 - protein, 25 aa, Mycobacterium avium
INDANFEKFFGYPGKAKRNLPGAPS

SEQ ID NO: 127961 - protein, 25 aa, Mycobacterium avium
INDANFEKFFGYPGKAKRNLPTSPT

SEQ ID NO: 127962 - protein, 18 aa, Mycobacterium avium
INEAFASVVLSWARVHEP

SEQ ID NO: 127963 - protein, 18 aa, Mycobacterium avium
INEELLARALRGRRDRVV

SEQ ID NO: 127964 - protein, 24 aa, Mycobacterium avium
INEPPVTIGPLYAAKTIELCVPGD

SEQ ID NO: 127965 - protein, 19 aa, Mycobacterium avium
INFLTRRGVALIRCAGWSD

SEQ ID NO: 127966 - protein, 27 aa, Mycobacterium avium
INGAKTWISNARRSGLIALLCKTDPQA

SEQ ID NO: 127967 - protein, 27 aa, Mycobacterium avium
INGFAIIRAFLEIPYKQALLDSAGADA

SEQ ID NO: 127968 - protein, 22 aa, Mycobacterium avium
INGRICINFTYSSILPAMKTLG

SEQ ID NO: 127969 - protein, 23 aa, Mycobacterium avium
INKMFEIIAPPLDDFISLVIGQG

SEQ ID NO: 127970 - protein, 29 aa, Mycobacterium avium
INMVSAIPGPIGWVGIAASTAWEAFDLGG

SEQ ID NO: 127971 - protein, 22 aa, Mycobacterium avium
INNIRTAIRQLSVRAQLARKEG

SEQ ID NO: 127972 - protein, 18 aa, Mycobacterium avium
INPRHPLIVASLAQTAQA

SEQ ID NO: 127973 - protein, 21 aa, Mycobacterium avium
INRPPDVLITTPESLFLMLTS

SEQ ID NO: 127974 - protein, 18 aa, Mycobacterium avium
INTIWGELAWQLGGAEAF

SEQ ID NO: 127975 - protein, 19 aa, Mycobacterium avium
INTLAVPAGIVQVGYDGPC

SEQ ID NO: 127976 - protein, 22 aa, Mycobacterium avium
IPANLDLLVGPAHVVQLPVGTP

SEQ ID NO: 127977 - protein, 17 aa, Mycobacterium avium
IPAPGLGALGAGRGGKE

SEQ ID NO: 127978 - protein, 33 aa, Mycobacterium avium
IPDQQVVLTRRPDYAWPPSSWPNQGPAYVDKVV

SEQ ID NO: 127979 - protein, 34 aa, Mycobacterium avium
IPDQQVVLTRRPDYAWPPSSWPNQGPAYVDKVVF

SEQ ID NO: 127980 - protein, 19 aa, Mycobacterium avium
IPEMVRKAFKLAESERPAA

SEQ ID NO: 127981 - protein, 25 aa, Mycobacterium avium
IPGDGLDFGLLRYLRDDTAARLAGF

SEQ ID NO: 127982 - protein, 24 aa, Mycobacterium avium
IPGDGLDYGLLRYLRDDTAERLAA

SEQ ID NO: 127983 - protein, 22 aa, Mycobacterium avium
IPGDRIPYAPPFGVAMAAWDTE

SEQ ID NO: 127984 - protein, 19 aa, Mycobacterium avium
IPIPQDLALLLSASVQKYP

SEQ ID NO: 127985 - protein, 19 aa, Mycobacterium avium
IPLDDFGTKVWRLHQYLIG

SEQ ID NO: 127986 - protein, 18 aa, Mycobacterium avium
IPLLVRDGVLSIAVPAEP

SEQ ID NO: 127987 - protein, 17 aa, Mycobacterium avium
IPLNLVLLKDICVRGME

SEQ ID NO: 127988 - protein, 30 aa, Mycobacterium avium
IPLRELRRTGLLDKLLLLAGIPETATTDPK

SEQ ID NO: 127989 - protein, 33 aa, Mycobacterium avium
IPNRLWAAQRKLLAPFFVWVTVGLYDPPVRELM

SEQ ID NO: 127990 - protein, 34 aa, Mycobacterium avium
IPNRLWAAQRKLLAPFFVWVTVGLYDPPVRELMG

SEQ ID NO: 127991 - protein, 19 aa, Mycobacterium avium
IPPHLLPAIRDHLDRFVEP

SEQ ID NO: 127992 - protein, 19 aa, Mycobacterium avium
IPRHITVVERIGFTDAGKL

SEQ ID NO: 127993 - protein, 17 aa, Mycobacterium avium
IPRWPTRARRRLLRTPR

SEQ ID NO: 127994 - protein, 26 aa, Mycobacterium avium
IPSGNTRAFLGERIGVRRGAVVNADG

SEQ ID NO: 127995 - protein, 18 aa, Mycobacterium avium
IPSQGAVYVLQLNADGLE

SEQ ID NO: 127996 - protein, 23 aa, Mycobacterium avium
IPSQGAVYVLQLNADGLESDQGP

SEQ ID NO: 127997 - protein, 24 aa, Mycobacterium avium
IPSQGAVYVLQLNADGLESDQGPL

SEQ ID NO: 127998 - protein, 18 aa, Mycobacterium avium
IPVMASFAPYELHFDNVR

SEQ ID NO: 127999 - protein, 24 aa, Mycobacterium avium
IPYPSQVFLTLFGLPLEDRDKLVA

SEQ ID NO: 128000 - protein, 21 aa, Mycobacterium avium
IQALDALYPRLSPGGFCIVDD

SEQ ID NO: 128001 - protein, 22 aa, Mycobacterium avium
IQALDALYPRLSPGGFCIVDDY

SEQ ID NO: 128002 - protein, 22 aa, Mycobacterium avium
IQALDFFFRKIVRDRGQALQFV

SEQ ID NO: 128003 - protein, 25 aa, Mycobacterium avium
IQAYEDFLFPGLAAEWAHWDGQRPF

SEQ ID NO: 128004 - protein, 18 aa, Mycobacterium avium
IQDVRRLVDGGDLPGRDP

SEQ ID NO: 128005 - protein, 17 aa, Mycobacterium avium
IQELTLPLALAGDDLIG

SEQ ID NO: 128006 - protein, 24 aa, Mycobacterium avium
IQITDAPLIRWLGHKKAAAVVLRP

SEQ ID NO: 128007 - protein, 20 aa, Mycobacterium avium
IQLAGLFDPMLAVATSDVRP

SEQ ID NO: 128008 - protein, 23 aa, Mycobacterium avium
IQLAKAIFGDRYEAFKAAGGRAN

SEQ ID NO: 128009 - protein, 21 aa, Mycobacterium avium
IQLKTYYLPSEGRRIRLRVSA

SEQ ID NO: 128010 - protein, 28 aa, Mycobacterium avium
IQNGTAFRLLGLPVIITDNIPAVSTKAR

SEQ ID NO: 128011 - protein, 25 aa, Mycobacterium avium
IQNSGGGSLLLPLGVRRIRAYASAR

SEQ ID NO: 128012 - protein, 18 aa, Mycobacterium avium
IQRIVLLEALAVLGWERW

SEQ ID NO: 128013 - protein, 32 aa, Mycobacterium avium
IQTAVLYDHFTPFTLIQLEELGFCGKGEAKEF

SEQ ID NO: 128014 - protein, 24 aa, Mycobacterium avium
IQTWQDDVFPPVAGIYRDDRRNVF

SEQ ID NO: 128015 - protein, 24 aa, Mycobacterium avium
IRAGRQLWCQLFSEPGAGSDLASL

SEQ ID NO: 128016 - protein, 21 aa, Mycobacterium avium
IRAQEGPLSPAPPLPDDPTQF

SEQ ID NO: 128017 - protein, 19 aa, Mycobacterium avium
IRARGPLMRAPFVWASVDH

SEQ ID NO: 128018 - protein, 25 aa, Mycobacterium avium
IRASGLPYALFRLGGIISPDTHASI

SEQ ID NO: 128019 - protein, 20 aa, Mycobacterium avium
IRDFLRADRAEFGWMPAVDA

SEQ ID NO: 128020 - protein, 23 aa, Mycobacterium avium
IREEWLPLFDQYQVDLVVCGHEH

SEQ ID NO: 128021 - protein, 27 aa, Mycobacterium avium
IREISLVDFFWRGSLVDRLNYVHVDGA

SEQ ID NO: 128022 - protein, 17 aa, Mycobacterium avium
IREMLPIGELREILSAA

SEQ ID NO: 128023 - protein, 18 aa, Mycobacterium avium
IRGRPIGGRIVREGIANT

SEQ ID NO: 128024 - protein, 19 aa, Mycobacterium avium
IRGYRIEVGEIRSALAALD

SEQ ID NO: 128025 - protein, 17 aa, Mycobacterium avium
IRIAISHYIVRSDDADQ

SEQ ID NO: 128026 - protein, 18 aa, Mycobacterium avium
IRLRLFHGRGGTVGRGGG

SEQ ID NO: 128027 - protein, 19 aa, Mycobacterium avium
IRMVTLAPELPGADAAIRR

SEQ ID NO: 128028 - protein, 27 aa, Mycobacterium avium
IRNRLARFQIGNLSWPRVVAAARGLSH

SEQ ID NO: 128029 - protein, 20 aa, Mycobacterium avium
IRPFPQHCAYGSSKWALRGL

SEQ ID NO: 128030 - protein, 23 aa, Mycobacterium avium
IRPFPQHCAYGSSKWALRGLTQT

SEQ ID NO: 128031 - protein, 30 aa, Mycobacterium avium
IRPGMTIAWQLPSHVSAALLMLALARCSVT

SEQ ID NO: 128032 - protein, 26 aa, Mycobacterium avium
IRQADLDYWRPLMADLPEPLELPGPN

SEQ ID NO: 128033 - protein, 20 aa, Mycobacterium avium
IRQAGLAGDWLRAGAPAIDG

SEQ ID NO: 128034 - protein, 18 aa, Mycobacterium avium
IRQIDFLTRATAQRPDAV

SEQ ID NO: 128035 - protein, 17 aa, Mycobacterium avium
IRRRLHETAVHLADAAI

SEQ ID NO: 128036 - protein, 18 aa, Mycobacterium avium
IRRSMLVVHCGPSARACP

SEQ ID NO: 128037 - protein, 25 aa, Mycobacterium avium
IRTARALLLDIIDVGLPVGCEFLEP

SEQ ID NO: 128038 - protein, 25 aa, Mycobacterium avium
IRTARGLLLDIIDVGLPVGCEFLEP

SEQ ID NO: 128039 - protein, 18 aa, Mycobacterium avium
IRVGAVARVALNLRGVDR

SEQ ID NO: 128040 - protein, 30 aa, Mycobacterium avium
IRVYRDRGLLPPPLRVGRIALFNDTHLTRL

SEQ ID NO: 128041 - protein, 17 aa, Mycobacterium avium
ISAMRVITAINASLGVE

SEQ ID NO: 128042 - protein, 17 aa, Mycobacterium avium
ISAPLRPGALGGVPIGS

SEQ ID NO: 128043 - protein, 17 aa, Mycobacterium avium
ISDFLWVRINDIPEVLG

SEQ ID NO: 128044 - protein, 23 aa, Mycobacterium avium
ISDNLVRPKPFWEKPLDLADVLD

SEQ ID NO: 128045 - protein, 18 aa, Mycobacterium avium
ISDVLPLFVSGYSGKVRR

SEQ ID NO: 128046 - protein, 28 aa, Mycobacterium avium
ISGNDLINRWYYNPDYFKIMSSCANSQM

SEQ ID NO: 128047 - protein, 24 aa, Mycobacterium avium
ISGQKRFITNAPVADLFVVFARTR

SEQ ID NO: 128048 - protein, 26 aa, Mycobacterium avium
ISLDRPAYVYPLFEQALRVSTGESVE

SEQ ID NO: 128049 - protein, 21 aa, Mycobacterium avium
ISLGWGLWDQASAMTGGLGAA

SEQ ID NO: 128050 - protein, 18 aa, Mycobacterium avium
ISPDLMDILGTASALPVG

SEQ ID NO: 128051 - protein, 20 aa, Mycobacterium avium
ISPKPPPPSWTAPSIWCWPA

SEQ ID NO: 128052 - protein, 26 aa, Mycobacterium avium
ISPSTRAVLFHLGQFIPQGVPDTYGF

SEQ ID NO: 128053 - protein, 19 aa, Mycobacterium avium
ISPTPWRAFPVRPCPTWIR

SEQ ID NO: 128054 - protein, 17 aa, Mycobacterium avium
ISPWGTWDWMGPAAVGA

SEQ ID NO: 128055 - protein, 25 aa, Mycobacterium avium
ISRAIRGRAGLPKIVPRLADAAAAG

SEQ ID NO: 128056 - protein, 33 aa, Mycobacterium avium
ISRASFYIYFEDKGHLLRRLASRVFGELTDGAR

SEQ ID NO: 128057 - protein, 26 aa, Mycobacterium avium
ISRKADKWLPLLENRIPVVAAALLNT

SEQ ID NO: 128058 - protein, 17 aa, Mycobacterium avium
ISRPLWTATLVDGLADG

SEQ ID NO: 128059 - protein, 24 aa, Mycobacterium avium
ISSGFPINLLDVWAQLATAQGVAS

SEQ ID NO: 128060 - protein, 28 aa, Mycobacterium avium
ISTAFLYDHFTPFVFTQLEELGFCGRGE

SEQ ID NO: 128061 - protein, 23 aa, Mycobacterium avium
ISTIPMVYPPAAPKHWRTALDSA

SEQ ID NO: 128062 - protein, 19 aa, Mycobacterium avium
ISVESFRALLLLNDELRKS

SEQ ID NO: 128063 - protein, 21 aa, Mycobacterium avium
ITAASTPWRQDPYRDTQGGSS

SEQ ID NO: 128064 - protein, 19 aa, Mycobacterium avium
ITAAWHKLLTNALAGFMAL

SEQ ID NO: 128065 - protein, 25 aa, Mycobacterium avium
ITAFADFPVLHWKKIWSTNPLERLN

SEQ ID NO: 128066 - protein, 19 aa, Mycobacterium avium
ITAIDLVGPVLIKFGTDEQ

SEQ ID NO: 128067 - protein, 17 aa, Mycobacterium avium
ITASTFLVDGGISAAYV

SEQ ID NO: 128068 - protein, 23 aa, Mycobacterium avium
ITAVPYVTYLRRSCLPDWYVPDE

SEQ ID NO: 128069 - protein, 19 aa, Mycobacterium avium
ITDIFIRDYFNADGSVFNL

SEQ ID NO: 128070 - protein, 21 aa, Mycobacterium avium
ITFTTFIPTMLHRTLAILEDG

SEQ ID NO: 128071 - protein, 23 aa, Mycobacterium avium
ITGDSLFNEVFLDNVFIPDEMVV

SEQ ID NO: 128072 - protein, 25 aa, Mycobacterium avium
ITGELLERCWAPKVVGAWNLHRVTA

SEQ ID NO: 128073 - protein, 22 aa, Mycobacterium avium
ITGETLFNEVFFDDVFVPDRDV

SEQ ID NO: 128074 - protein, 18 aa, Mycobacterium avium
ITGIHRYLRTLVDVGLGY

SEQ ID NO: 128075 - protein, 25 aa, Mycobacterium avium
ITGLVRSYALMLAADRIRVNGVAPT

SEQ ID NO: 128076 - protein, 24 aa, Mycobacterium avium
ITGRQRFPGWPFRISPGPIHQHRA

SEQ ID NO: 128077 - protein, 17 aa, Mycobacterium avium
ITKKWWDWTAIFEEHHR

SEQ ID NO: 128078 - protein, 17 aa, Mycobacterium avium
ITLLDPAPQLGGILRTE

SEQ ID NO: 128079 - protein, 20 aa, Mycobacterium avium
ITLVVRFLHLQHRGAERDTG

SEQ ID NO: 128080 - protein, 31 aa, Mycobacterium avium
ITPYNAALIMGFQKLIPALMAGNSVILRPSP

SEQ ID NO: 128081 - protein, 26 aa, Mycobacterium avium
ITRARFYLFVNHIANFVPFAVSSAVV

SEQ ID NO: 128082 - protein, 22 aa, Mycobacterium avium
ITRDYRLLTRALVLASTPRAVR

SEQ ID NO: 128083 - protein, 24 aa, Mycobacterium avium
ITRLHQYNAFPNMTFLTNADHLTV

SEQ ID NO: 128084 - protein, 26 aa, Mycobacterium avium
ITRRIGRWRTAYLVLSGRTVGAATAL

SEQ ID NO: 128085 - protein, 26 aa, Mycobacterium avium
ITSHERAWAFLPYVAGFGIPTFDQSG

SEQ ID NO: 128086 - protein, 23 aa, Mycobacterium avium
ITSLPGIGFRLGAEFLAAVGDPA

SEQ ID NO: 128087 - protein, 30 aa, Mycobacterium avium
ITSMHFVPSLLGLFLSLPGASQWRTLRRVP

SEQ ID NO: 128088 - protein, 30 aa, Mycobacterium avium
ITSMHFVPSLLGLFLSLPGVSQWRTLRRVP

SEQ ID NO: 128089 - protein, 35 aa, Mycobacterium avium
ITTLLVTDLASGWIPPHVRLPAHVTLLEPAARRHD

SEQ ID NO: 128090 - protein, 19 aa, Mycobacterium avium
ITTPVRMLLGTESPAYLRA

SEQ ID NO: 128091 - protein, 26 aa, Mycobacterium avium
ITVAQMLERIVALMPLGAAVVDAHRD

SEQ ID NO: 128092 - protein, 17 aa, Mycobacterium avium
ITVCYRFTRPGHDITLF

SEQ ID NO: 128093 - protein, 20 aa, Mycobacterium avium
ITVIHAVAPVVVGWPVGQLY

SEQ ID NO: 128094 - protein, 19 aa, Mycobacterium avium
IVALGELYEYFTKLIAARR

SEQ ID NO: 128095 - protein, 20 aa, Mycobacterium avium
IVALKLMSPALSNDPVFRSR

SEQ ID NO: 128096 - protein, 23 aa, Mycobacterium avium
IVDASMPAMIRLGGKMYGADGRT

SEQ ID NO: 128097 - protein, 23 aa, Mycobacterium avium
IVDLAVAFRIPVAPIANPETLAK

SEQ ID NO: 128098 - protein, 21 aa, Mycobacterium avium
IVEAITLCRGLADGPLIAGGH

SEQ ID NO: 128099 - protein, 18 aa, Mycobacterium avium
IVEGVEALLRFATKGRLG

SEQ ID NO: 128100 - protein, 25 aa, Mycobacterium avium
IVELLRSRVFFDWFGEAGVDDIPAV

SEQ ID NO: 128101 - protein, 19 aa, Mycobacterium avium
IVEYIGQTRGWFYTLHVLA

SEQ ID NO: 128102 - protein, 18 aa, Mycobacterium avium
IVGAPVDALVHLAEEEQA

SEQ ID NO: 128103 - protein, 18 aa, Mycobacterium avium
IVGDPLPGPPPGAAPLPG

SEQ ID NO: 128104 - protein, 23 aa, Mycobacterium avium
IVGIFNSVWGEYPAAVSWQATSE

SEQ ID NO: 128105 - protein, 19 aa, Mycobacterium avium
IVGPLARAALENTLQRGQA

SEQ ID NO: 128106 - protein, 28 aa, Mycobacterium avium
IVGSGPVFLQYPWQVIPDELIKPLEEAA

SEQ ID NO: 128107 - protein, 17 aa, Mycobacterium avium
IVGVPVDALVHLAEEEQ

SEQ ID NO: 128108 - protein, 17 aa, Mycobacterium avium
IVGWIMRTDSSDLPWHR

SEQ ID NO: 128109 - protein, 17 aa, Mycobacterium avium
IVHRVDIEFPSPALIYG

SEQ ID NO: 128110 - protein, 22 aa, Mycobacterium avium
IVIADGLFPFLNKEQIIAVMRA

SEQ ID NO: 128111 - protein, 17 aa, Mycobacterium avium
IVIGYDLSTGIPVEKVR

SEQ ID NO: 128112 - protein, 18 aa, Mycobacterium avium
IVIGYDLSTGIPVEKVRY

SEQ ID NO: 128113 - protein, 18 aa, Mycobacterium avium
IVINSVVQYFPNAGYLAD

SEQ ID NO: 128114 - protein, 18 aa, Mycobacterium avium
IVLAGRRPDPLQATAKEV

SEQ ID NO: 128115 - protein, 26 aa, Mycobacterium avium
IVLDGWSMPILLGEIFAAYYGQRLPA

SEQ ID NO: 128116 - protein, 37 aa, Mycobacterium avium
IVPEVFDLRPGAIIRDLDLLRPIYAQTAAYGHFGRTD

SEQ ID NO: 128117 - protein, 20 aa, Mycobacterium avium
IVPSRVELPWRSVSAAREDV

SEQ ID NO: 128118 - protein, 17 aa, Mycobacterium avium
IVRLMAETGLRANETLS

SEQ ID NO: 128119 - protein, 19 aa, Mycobacterium avium
IVRRALALGVTLFDTAEIY

SEQ ID NO: 128120 - protein, 26 aa, Mycobacterium avium
IVSPIQMQSLPWWRRSRGMDQYVICG

SEQ ID NO: 128121 - protein, 20 aa, Mycobacterium avium
IVTALRHTLGRPLSGRRITA

SEQ ID NO: 128122 - protein, 18 aa, Mycobacterium avium
IVTLMLTGLSAPAVYRTA

SEQ ID NO: 128123 - protein, 17 aa, Mycobacterium avium
IVTSRNTILALLDAEVG

SEQ ID NO: 128124 - protein, 17 aa, Mycobacterium avium
IVVIDLIPGRLDKAVRI

SEQ ID NO: 128125 - protein, 21 aa, Mycobacterium avium
IVWHETGLGPSFWVGDELAGD

SEQ ID NO: 128126 - protein, 27 aa, Mycobacterium avium
IWADKSLTFFDPFTKSGVFLREITSRL

SEQ ID NO: 128127 - protein, 33 aa, Mycobacterium avium
IWKDGHVSLGALWRLYSQYPYMPRLRDRRVLDE

SEQ ID NO: 128128 - protein, 18 aa, Mycobacterium avium
IWSALRRIPLRELRRTGL

SEQ ID NO: 128129 - protein, 30 aa, Mycobacterium avium
IYHKSIEQLLVVLPALFAAITTAAGGGPQD

SEQ ID NO: 128130 - protein, 25 aa, Mycobacterium avium
IYRRIDDAFLDPLQFRADSVLGVAG

SEQ ID NO: 128131 - protein, 34 aa, Mycobacterium avium
IYTLTDEAPLLATYAFLPIVRAFAEPAGIEIKTS

SEQ ID NO: 128132 - protein, 32 aa, Mycobacterium avium
IYTLTDEAPLLATYALLPVVQTFAAAAGINVK

SEQ ID NO: 128133 - protein, 17 aa, Mycobacterium avium
KAAGLRSLLAYQWAHPG

SEQ ID NO: 128134 - protein, 18 aa, Mycobacterium avium
KAALERLVEAWRAEHPDI

SEQ ID NO: 128135 - protein, 24 aa, Mycobacterium avium
KAAPVLWSQQVLTTGALRAVILNS

SEQ ID NO: 128136 - protein, 23 aa, Mycobacterium avium
KAAQLIMTFAAWFDLDVPVQALW

SEQ ID NO: 128137 - protein, 21 aa, Mycobacterium avium
KAAYAKARLYWERSESTVEGF

SEQ ID NO: 128138 - protein, 35 aa, Mycobacterium avium
KADPHVLAALRLHYLRWLLFDVGSGLHFQYQGIFD

SEQ ID NO: 128139 - protein, 26 aa, Mycobacterium avium
KAFAAKPFDYWRQHLKTMKGQWAPFQ

SEQ ID NO: 128140 - protein, 20 aa, Mycobacterium avium
KAFDVLGSPLPLVPISFDPP

SEQ ID NO: 128141 - protein, 21 aa, Mycobacterium avium
KAGDLALLIGYGAGLSYAAQV

SEQ ID NO: 128142 - protein, 20 aa, Mycobacterium avium
KAGDLALLIGYGAGLSYTAQ

SEQ ID NO: 128143 - protein, 26 aa, Mycobacterium avium
KAKEMAFFGERLSAAEALALGLVNRV

SEQ ID NO: 128144 - protein, 25 aa, Mycobacterium avium
KALAESIQAWTPPAAPPAAPGGPGA

SEQ ID NO: 128145 - protein, 22 aa, Mycobacterium avium
KALALYHTKRLASPAQRIVLYA

SEQ ID NO: 128146 - protein, 23 aa, Mycobacterium avium
KALALYHTKRLASPGQRIVLYAK

SEQ ID NO: 128147 - protein, 21 aa, Mycobacterium avium
KALRGMLKPIYEENQLGRAEI

SEQ ID NO: 128148 - protein, 20 aa, Mycobacterium avium
KALRHPRILPDEHRDLGVLE

SEQ ID NO: 128149 - protein, 27 aa, Mycobacterium avium
KALYDEHAAVLWRYALRLTGDASQSED

SEQ ID NO: 128150 - protein, 24 aa, Mycobacterium avium
KANRHLCWTLFSNDDPAFRQKTIQ

SEQ ID NO: 128151 - protein, 24 aa, Mycobacterium avium
KANRLIPLMLQTQVPIVAVVRGWA

SEQ ID NO: 128152 - protein, 17 aa, Mycobacterium avium
KAPEGFMLVCSYNPAYR

SEQ ID NO: 128153 - protein, 21 aa, Mycobacterium avium
KAPVTLMRLPRRVRTMTREVA

SEQ ID NO: 128154 - protein, 25 aa, Mycobacterium avium
KAQYNKLMRSYTRLADLVAARDGAE

SEQ ID NO: 128155 - protein, 22 aa, Mycobacterium avium
KARAVRVIDWFIGATARRRYQI

SEQ ID NO: 128156 - protein, 24 aa, Mycobacterium avium
KARRARDVWWVDVLLSQLEAKLNL

SEQ ID NO: 128157 - protein, 24 aa, Mycobacterium avium
KASPAPFVLEQWAELGAAALQDAG

SEQ ID NO: 128158 - protein, 18 aa, Mycobacterium avium
KASPAPFVLEQWAEPGAA

SEQ ID NO: 128159 - protein, 17 aa, Mycobacterium avium
KATALLAWDQALDRVRS

SEQ ID NO: 128160 - protein, 24 aa, Mycobacterium avium
KATAVLSMPMHRFRNPYTGAPTVG

SEQ ID NO: 128161 - protein, 21 aa, Mycobacterium avium
KAWEALGRWEKPFLAIFGARD

SEQ ID NO: 128162 - protein, 29 aa, Mycobacterium avium
KAWSIQHMLSLNIPVPPGFVLTTDVCREY

SEQ ID NO: 128163 - protein, 29 aa, Mycobacterium avium
KCLCRGHHLLKTFWGWRDRQLPDGTVIWT

SEQ ID NO: 128164 - protein, 21 aa, Mycobacterium avium
KCRMGAFFPALGAFGGNPPNI

SEQ ID NO: 128165 - protein, 22 aa, Mycobacterium avium
KCRMGAFFPALGAFGGNPPNIM

SEQ ID NO: 128166 - protein, 20 aa, Mycobacterium avium
KCSMFTCRAFSRFAEYLSNA

SEQ ID NO: 128167 - protein, 32 aa, Mycobacterium avium
KDARFRDALFPVWRYHPFFTNTDLPTAEADIT

SEQ ID NO: 128168 - protein, 23 aa, Mycobacterium avium
KDDLIIAMQEWAGDLILADLQKA

SEQ ID NO: 128169 - protein, 17 aa, Mycobacterium avium
KDGRPFPPWTDPESAFE

SEQ ID NO: 128170 - protein, 22 aa, Mycobacterium avium
KDGTWLQFSQTTERLWAAFLRA

SEQ ID NO: 128171 - protein, 19 aa, Mycobacterium avium
KDHIEAIANWDPKAEPSIE

SEQ ID NO: 128172 - protein, 30 aa, Mycobacterium avium
KDQIVGLLLRLQRQLGLTYLFVSHDLSVVR

SEQ ID NO: 128173 - protein, 25 aa, Mycobacterium avium
KDRDGAMVALVQRLDRWASGRDDDV

SEQ ID NO: 128174 - protein, 27 aa, Mycobacterium avium
KEADPRAVVWLLVRPLANSIAAGEMFV

SEQ ID NO: 128175 - protein, 24 aa, Mycobacterium avium
KEEDFQLFLTLLDRDRFEGKQKKA

SEQ ID NO: 128176 - protein, 18 aa, Mycobacterium avium
KEEIVPIDTPHGLFSIDE

SEQ ID NO: 128177 - protein, 29 aa, Mycobacterium avium
KEFRKRLPMYFWVAGWETCRRMLAFLKDK

SEQ ID NO: 128178 - protein, 30 aa, Mycobacterium avium
KEGRGFYHLMHNLPSERLSIAISAIAGARE

SEQ ID NO: 128179 - protein, 19 aa, Mycobacterium avium
KEIDLPSYGLVWKWPQIDC

SEQ ID NO: 128180 - protein, 25 aa, Mycobacterium avium
KEINVQFVLAYTPRGVRRFAARARR

SEQ ID NO: 128181 - protein, 22 aa, Mycobacterium avium
KEKFGGLRFYFHASESITEADR

SEQ ID NO: 128182 - protein, 26 aa, Mycobacterium avium
KELIAWLPTLLGLGPADLIVVPELAY

SEQ ID NO: 128183 - protein, 26 aa, Mycobacterium avium
KENDRLLASLMPEPVARRYREGEQTI

SEQ ID NO: 128184 - protein, 25 aa, Mycobacterium avium
KENYPAYLDWAVRLARPGAVIVADN

SEQ ID NO: 128185 - protein, 21 aa, Mycobacterium avium
KEPQYGAPPLLLRMVEAGRLG

SEQ ID NO: 128186 - protein, 27 aa, Mycobacterium avium
KEPRITALPGLWFEAARRVGFDVAAVI

SEQ ID NO: 128187 - protein, 17 aa, Mycobacterium avium
KESLDRLGLDYLDLYLI

SEQ ID NO: 128188 - protein, 25 aa, Mycobacterium avium
KFADMKLWLEACRATTWAAVAEVAA

SEQ ID NO: 128189 - protein, 20 aa, Mycobacterium avium
KFATAFTRRGLVAEYGITWI

SEQ ID NO: 128190 - protein, 20 aa, Mycobacterium avium
KFLRWVWRYPIDSRPLLDAA

SEQ ID NO: 128191 - protein, 27 aa, Mycobacterium avium
KFRDAEKLTFPLLSDPDRKVLTAYGAY

SEQ ID NO: 128192 - protein, 26 aa, Mycobacterium avium
KFRDAEKLTFPLLSDPDRTVLTAYGA

SEQ ID NO: 128193 - protein, 21 aa, Mycobacterium avium
KFSAHTFWDDIAAVGATWYTA

SEQ ID NO: 128194 - protein, 26 aa, Mycobacterium avium
KFSAHTFWDDIAAVGATWYTAVPTIH

SEQ ID NO: 128195 - protein, 19 aa, Mycobacterium avium
KFSAHTFWDDISAVGATWY

SEQ ID NO: 128196 - protein, 26 aa, Mycobacterium avium
KGAIAVYPVAGWWKNQRKYDQSNHGV

SEQ ID NO: 128197 - protein, 17 aa, Mycobacterium avium
KGFFVTWVTTYRDQNGE

SEQ ID NO: 128198 - protein, 21 aa, Mycobacterium avium
KGFHAIERDLWQAGAITPGTK

SEQ ID NO: 128199 - protein, 26 aa, Mycobacterium avium
KGGNRRWFEQWLLTNLDDALSAWPPG

SEQ ID NO: 128200 - protein, 19 aa, Mycobacterium avium
KGIDIMRTVRSFDPCLPCG

SEQ ID NO: 128201 - protein, 24 aa, Mycobacterium avium
KGKRLELGALLLGYYQGDQLHYAG

SEQ ID NO: 128202 - protein, 21 aa, Mycobacterium avium
KGLELIETHLLFGIPYDRIEV

SEQ ID NO: 128203 - protein, 21 aa, Mycobacterium avium
KGLGILLDRGYPLVCGVPTQT

SEQ ID NO: 128204 - protein, 41 aa, Mycobacterium avium
KGLPGLAEWTVGFLEDLVLGPLETAAWAAIGQAPPGAGGAG

SEQ ID NO: 128205 - protein, 21 aa, Mycobacterium avium
KGLRAKLLGALDYIEAAGAVV

SEQ ID NO: 128206 - protein, 22 aa, Mycobacterium avium
KGNFTLQALLSRLGEITGGVVT

SEQ ID NO: 128207 - protein, 18 aa, Mycobacterium avium
KGNLLRRTMGIAALGGAT

SEQ ID NO: 128208 - protein, 18 aa, Mycobacterium avium
KGQQVAWMREVDGLPVIT

SEQ ID NO: 128209 - protein, 25 aa, Mycobacterium avium
KGRENPHILTLSPPVLLGKEWLEPT

SEQ ID NO: 128210 - protein, 41 aa, Mycobacterium avium
KGRENPHILTLSPPVLLGKEWLKPTAYMMAKFGMTLCALGI

SEQ ID NO: 128211 - protein, 23 aa, Mycobacterium avium
KGRSFRIHILFASQTLDVGKIKD

SEQ ID NO: 128212 - protein, 25 aa, Mycobacterium avium
KGVDRLVAAWKLLLAEGIEGRCRII

SEQ ID NO: 128213 - protein, 26 aa, Mycobacterium avium
KGVDRLVAAWKLLLAEGIEGRCRIIG

SEQ ID NO: 128214 - protein, 26 aa, Mycobacterium avium
KGVDRLVAAWRLLLAEGIEGRCRIIG

SEQ ID NO: 128215 - protein, 17 aa, Mycobacterium avium
KHDVTIAAPLNLPATMP

SEQ ID NO: 128216 - protein, 20 aa, Mycobacterium avium
KHKGITWVICDMSTPGIDVR

SEQ ID NO: 128217 - protein, 25 aa, Mycobacterium avium
KHKNLTMFLVPLDSAGIEIQGIRTV

SEQ ID NO: 128218 - protein, 17 aa, Mycobacterium avium
KHLWSYDGQVFPTIGLN

SEQ ID NO: 128219 - protein, 36 aa, Mycobacterium avium
KHSRYYRELTPMLKPLPGARALLRRVADLGLQVVLA

SEQ ID NO: 128220 - protein, 24 aa, Mycobacterium avium
KIADYPFTTLVPNLGVVSAGEHTF

SEQ ID NO: 128221 - protein, 22 aa, Mycobacterium avium
KIAPARKDHWLAALKADRDGTK

SEQ ID NO: 128222 - protein, 23 aa, Mycobacterium avium
KIDFTPGELLGCASGALGLRKFF

SEQ ID NO: 128223 - protein, 21 aa, Mycobacterium avium
KIFRPYIVGFIELAEGVLVES

SEQ ID NO: 128224 - protein, 19 aa, Mycobacterium avium
KIIAFVNSSVILNADDQRT

SEQ ID NO: 128225 - protein, 24 aa, Mycobacterium avium
KILRCPLRFPHDLPRPEGHAGQLA

SEQ ID NO: 128226 - protein, 22 aa, Mycobacterium avium
KILTFRGYLTTHINRQSPVALK

SEQ ID NO: 128227 - protein, 17 aa, Mycobacterium avium
KINTRVYLLDNALQPVP

SEQ ID NO: 128228 - protein, 21 aa, Mycobacterium avium
KIRGQRFGRLPAGRAILLGDS

SEQ ID NO: 128229 - protein, 20 aa, Mycobacterium avium
KIRGYRIELGEIRSALVGLD

SEQ ID NO: 128230 - protein, 18 aa, Mycobacterium avium
KISLGEGLLILPERDSAS

SEQ ID NO: 128231 - protein, 23 aa, Mycobacterium avium
KISTTIAFLTWLDDQEIPLDSVT

SEQ ID NO: 128232 - protein, 21 aa, Mycobacterium avium
KITLRRRTGGSDAGWHLKLPA

SEQ ID NO: 128233 - protein, 35 aa, Mycobacterium avium
KIVFEPLEETPLTRYLKYELPLVNGVPALGTPGLI

SEQ ID NO: 128234 - protein, 18 aa, Mycobacterium avium
KIVRSITAPLSPVQARRF

SEQ ID NO: 128235 - protein, 18 aa, Mycobacterium avium
KIWNMLQRLPFGNRIFSQ

SEQ ID NO: 128236 - protein, 23 aa, Mycobacterium avium
KKNGVNVILTIAPQAGPSTVYHR

SEQ ID NO: 128237 - protein, 18 aa, Mycobacterium avium
KKTNLAPLTIHDLRHTYA

SEQ ID NO: 128238 - protein, 24 aa, Mycobacterium avium
KKTVVLHRHIKNRRLAAVGPIWAL

SEQ ID NO: 128239 - protein, 24 aa, Mycobacterium avium
KLADVMLRYNFPGAGLTDDALRTL

SEQ ID NO: 128240 - protein, 23 aa, Mycobacterium avium
KLAGRPVMVLDPMLATGGSMAHT

SEQ ID NO: 128241 - protein, 22 aa, Mycobacterium avium
KLAGRSVMVLDPMLATGGSMAH

SEQ ID NO: 128242 - protein, 22 aa, Mycobacterium avium
KLAGRSVMVLDPMLATGGSMVH

SEQ ID NO: 128243 - protein, 21 aa, Mycobacterium avium
KLALLTRCERLRRRLPAVEHP

SEQ ID NO: 128244 - protein, 18 aa, Mycobacterium avium
KLCSLFLGPGLRVLNFNN

SEQ ID NO: 128245 - protein, 18 aa, Mycobacterium avium
KLDPIGAIGNYWAEPHQP

SEQ ID NO: 128246 - protein, 29 aa, Mycobacterium avium
KLDWAEVPRWPLVINTASGTTGPWSWPAG

SEQ ID NO: 128247 - protein, 17 aa, Mycobacterium avium
KLGVPPLTMKPDVCWQL

SEQ ID NO: 128248 - protein, 22 aa, Mycobacterium avium
KLHHFKVVTYLKMGCPLSTEQV

SEQ ID NO: 128249 - protein, 24 aa, Mycobacterium avium
KLIDYYVETFGFVLAARYGDGETV

SEQ ID NO: 128250 - protein, 24 aa, Mycobacterium avium
KLIDYYVETFGFVLTARYGDGETV

SEQ ID NO: 128251 - protein, 25 aa, Mycobacterium avium
KLIDYYVETFGFVLTARYGDGETVD

SEQ ID NO: 128252 - protein, 31 aa, Mycobacterium avium
KLIEVPVGFKWFVDGLIGGTLGFGGEESAGA

SEQ ID NO: 128253 - protein, 36 aa, Mycobacterium avium
KLKEALVKAIPLRRLARPEEVAAAVLFFASQAASFV

SEQ ID NO: 128254 - protein, 20 aa, Mycobacterium avium
KLLAAEGLLALAWPKEHGGG

SEQ ID NO: 128255 - protein, 18 aa, Mycobacterium avium
KLLAARIADRQVALAGDS

SEQ ID NO: 128256 - protein, 18 aa, Mycobacterium avium
KLLGADCTSIRWSSRADP

SEQ ID NO: 128257 - protein, 17 aa, Mycobacterium avium
KLLGDHIVPTFGGLPIA

SEQ ID NO: 128258 - protein, 17 aa, Mycobacterium avium
KLLLDPYSKAVDGTFEW

SEQ ID NO: 128259 - protein, 19 aa, Mycobacterium avium
KLLSRMFTPRRIAALEPMI

SEQ ID NO: 128260 - protein, 18 aa, Mycobacterium avium
KLMGAWLTELDLLGELAD

SEQ ID NO: 128261 - protein, 21 aa, Mycobacterium avium
KLQAVALLHYDGKEGAAMDAL

SEQ ID NO: 128262 - protein, 28 aa, Mycobacterium avium
KLQLPENAPILFIERLRSVGGLPLSLDT

SEQ ID NO: 128263 - protein, 17 aa, Mycobacterium avium
KLRTGSFFPALLERRRR

SEQ ID NO: 128264 - protein, 20 aa, Mycobacterium avium
KLWVDMAHFAGPVAAGLHPS

SEQ ID NO: 128265 - protein, 25 aa, Mycobacterium avium
KMGINYGLNKVRFLAPVTAGSRVRV

SEQ ID NO: 128266 - protein, 17 aa, Mycobacterium avium
KMGLSHLAILRTHPDLD

SEQ ID NO: 128267 - protein, 18 aa, Mycobacterium avium
KMGPPQIRKLLLDTPDPL

SEQ ID NO: 128268 - protein, 20 aa, Mycobacterium avium
KMSQFPILCAFEAGEPFGSS

SEQ ID NO: 128269 - protein, 18 aa, Mycobacterium avium
KMTPAPTKPIPVLVGGHA

SEQ ID NO: 128270 - protein, 17 aa, Mycobacterium avium
KMVLGGYSQGAAVMGFV

SEQ ID NO: 128271 - protein, 18 aa, Mycobacterium avium
KMVPWTRHNIAASIRSIV

SEQ ID NO: 128272 - protein, 36 aa, Mycobacterium avium
KMYKRLIARELPEIFPLLILCIDELGAWAGQGLAKG

SEQ ID NO: 128273 - protein, 28 aa, Mycobacterium avium
KNDHLDSKLLARLPLLHPEGLRDHSGDG

SEQ ID NO: 128274 - protein, 32 aa, Mycobacterium avium
KNEPEWMLQTRLKALRIFERKPMPTWGSNLDG

SEQ ID NO: 128275 - protein, 17 aa, Mycobacterium avium
KNHFHALKNPKAQLRYE

SEQ ID NO: 128276 - protein, 23 aa, Mycobacterium avium
KNLDGLRIGLWGLSFKPQTDDVR

SEQ ID NO: 128277 - protein, 26 aa, Mycobacterium avium
KNLRLRDGRWCWHWDPAFMTKPGDDP

SEQ ID NO: 128278 - protein, 24 aa, Mycobacterium avium
KNLTRGIVALVYRCRPAGGKPHST

SEQ ID NO: 128279 - protein, 17 aa, Mycobacterium avium
KNRKIIAFVNSSVILNA

SEQ ID NO: 128280 - protein, 24 aa, Mycobacterium avium
KNTVLWGGYTWEYWRATRAVKPEE

SEQ ID NO: 128281 - protein, 23 aa, Mycobacterium avium
KPADVKFVYLQPADALSAFSQHQ

SEQ ID NO: 128282 - protein, 26 aa, Mycobacterium avium
KPAPHLITSFWFAFGSARGAREQIHR

SEQ ID NO: 128283 - protein, 26 aa, Mycobacterium avium
KPAPHLITSFWFAFGSPRTAREQIHR

SEQ ID NO: 128284 - protein, 26 aa, Mycobacterium avium
KPAPHLITSFWFAFGSPRTAREQVHR

SEQ ID NO: 128285 - protein, 25 aa, Mycobacterium avium
KPGEPSWPTPWGRGRPGWHTECVAM

SEQ ID NO: 128286 - protein, 20 aa, Mycobacterium avium
KPGNNLPLRNIPAGTVIHAV

SEQ ID NO: 128287 - protein, 26 aa, Mycobacterium avium
KPGQRQILGIPLLTSPYVTTTNNVVW

SEQ ID NO: 128288 - protein, 21 aa, Mycobacterium avium
KPGTYLFFYPAAEPHEYSAQR

SEQ ID NO: 128289 - protein, 30 aa, Mycobacterium avium
KPGYANFAIVEPPLKLVLLENPGKGGTINH

SEQ ID NO: 128290 - protein, 28 aa, Mycobacterium avium
KPITHPLRADIPIFLGAEGPRNVALAAE

SEQ ID NO: 128291 - protein, 22 aa, Mycobacterium avium
KPIYHREWWDRYVAVNRRFAEA

SEQ ID NO: 128292 - protein, 25 aa, Mycobacterium avium
KPNAYTVYFAMKFSRPFISYGSWDG

SEQ ID NO: 128293 - protein, 17 aa, Mycobacterium avium
KPPLTGAVGLVTLPIVH

SEQ ID NO: 128294 - protein, 18 aa, Mycobacterium avium
KPPQRGLIAHFTAVANAT

SEQ ID NO: 128295 - protein, 28 aa, Mycobacterium avium
KPQTDLFVKPILNLWEFSKPTIAQVHGY

SEQ ID NO: 128296 - protein, 25 aa, Mycobacterium avium
KPSTTYLWETKGVVPILKIDKGLAE

SEQ ID NO: 128297 - protein, 20 aa, Mycobacterium avium
KPTVVTNRPNRRIVIMPSDD

SEQ ID NO: 128298 - protein, 21 aa, Mycobacterium avium
KPVEFLVQGTLYPDVVESGRG

SEQ ID NO: 128299 - protein, 28 aa, Mycobacterium avium
KPVKGMLTGPVTILAWSFVRDDQPLADT

SEQ ID NO: 128300 - protein, 17 aa, Mycobacterium avium
KQALWLTERRSQVKVRT

SEQ ID NO: 128301 - protein, 28 aa, Mycobacterium avium
KQDRDQIRLWLDLLLERRPGEIATTAEG

SEQ ID NO: 128302 - protein, 27 aa, Mycobacterium avium
KQEMNAAGFVAWWRNPSRTAKDSLSIA

SEQ ID NO: 128303 - protein, 17 aa, Mycobacterium avium
KQLYTLDLGSLVAGSRY

SEQ ID NO: 128304 - protein, 17 aa, Mycobacterium avium
KQYRPAVAGLPPAAMRS

SEQ ID NO: 128305 - protein, 17 aa, Mycobacterium avium
KRAHDQFRWFAGGWKVN

SEQ ID NO: 128306 - protein, 24 aa, Mycobacterium avium
KRANRLAHFWYAAGLREGDTVAAL

SEQ ID NO: 128307 - protein, 36 aa, Mycobacterium avium
KRDIYRDSRLGLFPFRRNLSLFAVDLALLTHSHPHT

SEQ ID NO: 128308 - protein, 21 aa, Mycobacterium avium
KRLVDFAAGLAFALRGSFDKV

SEQ ID NO: 128309 - protein, 23 aa, Mycobacterium avium
KRSLNHWYRTMGPTFETSVGLEF

SEQ ID NO: 128310 - protein, 25 aa, Mycobacterium avium
KRWYDRVLRRFYRSIHLICGHQFDF

SEQ ID NO: 128311 - protein, 22 aa, Mycobacterium avium
KSEAVSFRRWVTGEVLPAIRKT

SEQ ID NO: 128312 - protein, 19 aa, Mycobacterium avium
KSIIFMDPPEHRHMRSLLN

SEQ ID NO: 128313 - protein, 24 aa, Mycobacterium avium
KSLNDIRWLYELMHRVGSLNHARD

SEQ ID NO: 128314 - protein, 27 aa, Mycobacterium avium
KSLVDKGYFAPAWPVEFGGQSRNAWDD

SEQ ID NO: 128315 - protein, 24 aa, Mycobacterium avium
KSSRYPGGLALRFARVLRYRDDKG

SEQ ID NO: 128316 - protein, 25 aa, Mycobacterium avium
KSSRYPGGLALRFARVLRYRDDKGP

SEQ ID NO: 128317 - protein, 17 aa, Mycobacterium avium
KSTFFRHFPDKRDVLAA

SEQ ID NO: 128318 - protein, 21 aa, Mycobacterium avium
KSVGVYPVNYPATTDFPTAAD

SEQ ID NO: 128319 - protein, 18 aa, Mycobacterium avium
KSVHRILRNFKMPGFTVP

SEQ ID NO: 128320 - protein, 19 aa, Mycobacterium avium
KSVWFQRGPLDEAIRASIA

SEQ ID NO: 128321 - protein, 20 aa, Mycobacterium avium
KSVYLLLDDADLATTVPGCI

SEQ ID NO: 128322 - protein, 20 aa, Mycobacterium avium
KTAAFAIPILSNIDVASTAT

SEQ ID NO: 128323 - protein, 23 aa, Mycobacterium avium
KTADEWVRLLQDAGLMACHAYTW

SEQ ID NO: 128324 - protein, 26 aa, Mycobacterium avium
KTASQVLLRWNLQLGNAVIFRSANAE

SEQ ID NO: 128325 - protein, 27 aa, Mycobacterium avium
KTASQVLLRWNLQLGNAVIFRSANAEH

SEQ ID NO: 128326 - protein, 26 aa, Mycobacterium avium
KTASQVLLRWNLQLSNAVIFRSANAE

SEQ ID NO: 128327 - protein, 27 aa, Mycobacterium avium
KTGKLRPALFVLPTDAPGFSATPIEME

SEQ ID NO: 128328 - protein, 26 aa, Mycobacterium avium
KTHQPWVVSFQLNWPRDHGPTATGWM

SEQ ID NO: 128329 - protein, 17 aa, Mycobacterium avium
KTIPGRLLMGVTGVRPA

SEQ ID NO: 128330 - protein, 24 aa, Mycobacterium avium
KTLDLPYMESVIWAFKQLWDKGLA

SEQ ID NO: 128331 - protein, 19 aa, Mycobacterium avium
KTMSFLAMDDPAHLRLRTL

SEQ ID NO: 128332 - protein, 27 aa, Mycobacterium avium
KTRDGRFIAFVLLQADRFWADFCTRLG

SEQ ID NO: 128333 - protein, 27 aa, Mycobacterium avium
KTRDNRFIAFVLLQADRFWADFCTRLG

SEQ ID NO: 128334 - protein, 20 aa, Mycobacterium avium
KTRHAVLAVAQWLRDESAPE

SEQ ID NO: 128335 - protein, 22 aa, Mycobacterium avium
KTRHAVLAVAQWLRDESAPEPA

SEQ ID NO: 128336 - protein, 23 aa, Mycobacterium avium
KTRHAVLAVARWLRDESAPEPAR

SEQ ID NO: 128337 - protein, 21 aa, Mycobacterium avium
KTTLLNHLLRHPGTRIGVIVN

SEQ ID NO: 128338 - protein, 23 aa, Mycobacterium avium
KTTPPRIAFVFPGQGNQWQAMGA

SEQ ID NO: 128339 - protein, 32 aa, Mycobacterium avium
KTVCEKGFRNMTYVRGLAPMLVGEPPALLGDD

SEQ ID NO: 128340 - protein, 21 aa, Mycobacterium avium
KTVHHYLMRFSGGELSDEDLE

SEQ ID NO: 128341 - protein, 29 aa, Mycobacterium avium
KTVPATLGALLKSVSLLPDTPRFAVAHAV

SEQ ID NO: 128342 - protein, 17 aa, Mycobacterium avium
KTWRDMIDVNLNGAWIT

SEQ ID NO: 128343 - protein, 18 aa, Mycobacterium avium
KVAELHAQGVRRGHSVDL

SEQ ID NO: 128344 - protein, 23 aa, Mycobacterium avium
KVAIARDYLLPRQRERAALTEDE

SEQ ID NO: 128345 - protein, 17 aa, Mycobacterium avium
KVALTRNVLLPVGTDYT

SEQ ID NO: 128346 - protein, 20 aa, Mycobacterium avium
KVIDRAPLWCAVDLRDGNQA

SEQ ID NO: 128347 - protein, 25 aa, Mycobacterium avium
KVILNLAPSLWIPQHGEPFLSNWTP

SEQ ID NO: 128348 - protein, 28 aa, Mycobacterium avium
KVILSRCLQVPFAVDFPSTYRLARRHNT

SEQ ID NO: 128349 - protein, 20 aa, Mycobacterium avium
KVLRVSWCTVLRSAGGELHR

SEQ ID NO: 128350 - protein, 23 aa, Mycobacterium avium
KVMASVCSLIQYVRSWSSDRNDP

SEQ ID NO: 128351 - protein, 32 aa, Mycobacterium avium
KVMPIMTSLLNYYPHLLALSASSPWWTGVDTG

SEQ ID NO: 128352 - protein, 17 aa, Mycobacterium avium
KVNADLPTPAGFAGATQ

SEQ ID NO: 128353 - protein, 26 aa, Mycobacterium avium
KVNPTHWVMTSASFSALRKLKVGTDD

SEQ ID NO: 128354 - protein, 26 aa, Mycobacterium avium
KVPLEPRALKFPNYDKTAKAWRADPG

SEQ ID NO: 128355 - protein, 20 aa, Mycobacterium avium
KVPLVELYALLWRVGVVEIR

SEQ ID NO: 128356 - protein, 20 aa, Mycobacterium avium
KVPRRLVVVSDLPVLASGKV

SEQ ID NO: 128357 - protein, 26 aa, Mycobacterium avium
KVRRLRRLAGLWLAGQDRGWAAIRID

SEQ ID NO: 128358 - protein, 18 aa, Mycobacterium avium
KVSALLEALPKVGKVKAQ

SEQ ID NO: 128359 - protein, 25 aa, Mycobacterium avium
KVSGTAPIYAILRDAKERAHQAGAK

SEQ ID NO: 128360 - protein, 19 aa, Mycobacterium avium
KVTIRMLLTNTSGEGIDVS

SEQ ID NO: 128361 - protein, 24 aa, Mycobacterium avium
KVTVWKDYWDFNSLVAFAPPNHFE

SEQ ID NO: 128362 - protein, 20 aa, Mycobacterium avium
KVVDLLTPYVRGGKIALFGG

SEQ ID NO: 128363 - protein, 25 aa, Mycobacterium avium
KVVGAWNLHRVTAGEPLDWFCLFSS

SEQ ID NO: 128364 - protein, 17 aa, Mycobacterium avium
KVVYEKTACLIAAAGRF

SEQ ID NO: 128365 - protein, 22 aa, Mycobacterium avium
KVWEPHLKLLTKILTSCARAGL

SEQ ID NO: 128366 - protein, 27 aa, Mycobacterium avium
KVWTTDGHWARYGYLLARTDPDAPKHK

SEQ ID NO: 128367 - protein, 17 aa, Mycobacterium avium
KWAAWFIAELVRSVYHY

SEQ ID NO: 128368 - protein, 19 aa, Mycobacterium avium
KWELEDLSFAILHPKKYDE

SEQ ID NO: 128369 - protein, 37 aa, Mycobacterium avium
KWHRQRVIEPLDIDAYRDFLIEIGYLLPEPEDFTITT

SEQ ID NO: 128370 - protein, 18 aa, Mycobacterium avium
KWLKKLLSSARKTGTGGG

SEQ ID NO: 128371 - protein, 26 aa, Mycobacterium avium
KWLTPNAVIGFFPANAIGPGFEDIEL

SEQ ID NO: 128372 - protein, 25 aa, Mycobacterium avium
KWREIFGADNFFLELMDHGLSIEQR

SEQ ID NO: 128373 - protein, 24 aa, Mycobacterium avium
KYKLPEELVFWDEPLPVNANGKVD

SEQ ID NO: 128374 - protein, 18 aa, Mycobacterium avium
KYMASALDGYAAAAAAVQ

SEQ ID NO: 128375 - protein, 20 aa, Mycobacterium avium
KYQALTGLRYVDVSNAAQSG

SEQ ID NO: 128376 - protein, 22 aa, Mycobacterium avium
KYSWVMSPRWFDGKDHLALDTG

SEQ ID NO: 128377 - protein, 25 aa, Mycobacterium avium
LAAAALLPDRWLIIGTGAADQELGD

SEQ ID NO: 128378 - protein, 29 aa, Mycobacterium avium
LAAGDLATPLHLFLERLQPAHRAGDRVLR

SEQ ID NO: 128379 - protein, 28 aa, Mycobacterium avium
LAAGLDARSWRLPWPAGTTVYELDQPRV

SEQ ID NO: 128380 - protein, 27 aa, Mycobacterium avium
LAAGRLPRWWDRLVTNGFHAVHLPEEL

SEQ ID NO: 128381 - protein, 23 aa, Mycobacterium avium
LAAGWLVERAGFGKGYPVPDPGG

SEQ ID NO: 128382 - protein, 19 aa, Mycobacterium avium
LAAHRRAHGLPAISLGWGL

SEQ ID NO: 128383 - protein, 18 aa, Mycobacterium avium
LAALLNRERHGVADVVRV

SEQ ID NO: 128384 - protein, 17 aa, Mycobacterium avium
LAALRVKFDGGTLPPMF

SEQ ID NO: 128385 - protein, 17 aa, Mycobacterium avium
LAALSAQMRPGDSLLLG

SEQ ID NO: 128386 - protein, 19 aa, Mycobacterium avium
LAALVSAATVSVLDCAGRL

SEQ ID NO: 128387 - protein, 18 aa, Mycobacterium avium
LAANADGKEIAGRLAARI

SEQ ID NO: 128388 - protein, 26 aa, Mycobacterium avium
LAAQGFSVLLLPGPAPTPVVAFAVRH

SEQ ID NO: 128389 - protein, 27 aa, Mycobacterium avium
LAAQGFSVLLLPGPVPTPVVAFAVRHT

SEQ ID NO: 128390 - protein, 30 aa, Mycobacterium avium
LAATRNDVFAAAWRLALMGLRRGEILGLSW

SEQ ID NO: 128391 - protein, 17 aa, Mycobacterium avium
LAAVRALAGLPTDHVGL

SEQ ID NO: 128392 - protein, 21 aa, Mycobacterium avium
LAAVRPDRVAGLLLLDPAIGL

SEQ ID NO: 128393 - protein, 17 aa, Mycobacterium avium
LACLPGEYGPNLAVMAA

SEQ ID NO: 128394 - protein, 19 aa, Mycobacterium avium
LACSSVFGTWGGYGHAAYA

SEQ ID NO: 128395 - protein, 24 aa, Mycobacterium avium
LADARRPLIVLGKGAAYAQADNEI

SEQ ID NO: 128396 - protein, 24 aa, Mycobacterium avium
LADDPLFCDLLANLHLHLEHEVDA

SEQ ID NO: 128397 - protein, 19 aa, Mycobacterium avium
LADHDWFREQFARLDYLQA

SEQ ID NO: 128398 - protein, 20 aa, Mycobacterium avium
LADILLRKPSLDEAFLHLTE

SEQ ID NO: 128399 - protein, 25 aa, Mycobacterium avium
LADLDRAALPALRHIVRIPIEADDP

SEQ ID NO: 128400 - protein, 18 aa, Mycobacterium avium
LADLQPLAGGGLGALGVA

SEQ ID NO: 128401 - protein, 17 aa, Mycobacterium avium
LADRLPGYMVPSAVVVL

SEQ ID NO: 128402 - protein, 18 aa, Mycobacterium avium
LADVLRPDVLLTRLVRRD

SEQ ID NO: 128403 - protein, 17 aa, Mycobacterium avium
LADVVYQIGALQAIAHA

SEQ ID NO: 128404 - protein, 17 aa, Mycobacterium avium
LADWDRMRGAVTAALDG

SEQ ID NO: 128405 - protein, 17 aa, Mycobacterium avium
LADWDRMRGAVTGALDG

SEQ ID NO: 128406 - protein, 24 aa, Mycobacterium avium
LAEAAADLFLLPSGDDLVLVQAGD

SEQ ID NO: 128407 - protein, 22 aa, Mycobacterium avium
LAEARLFALAQFMGDVYGGALL

SEQ ID NO: 128408 - protein, 21 aa, Mycobacterium avium
LAECPRLSYGLDEACLLIFGR

SEQ ID NO: 128409 - protein, 21 aa, Mycobacterium avium
LAEDFVWFRGPPDMVNIMAVR

SEQ ID NO: 128410 - protein, 26 aa, Mycobacterium avium
LAEGRTDWRTVRLIITRTSLVTDTEL

SEQ ID NO: 128411 - protein, 24 aa, Mycobacterium avium
LAELGEWLHPFEKFWRTRLRRLAE

SEQ ID NO: 128412 - protein, 19 aa, Mycobacterium avium
LAELTRIALAVSPLRAHTT

SEQ ID NO: 128413 - protein, 26 aa, Mycobacterium avium
LAEQGLLPDALYTSLLRRAITTAHLA

SEQ ID NO: 128414 - protein, 24 aa, Mycobacterium avium
LAEQRRWLAPWYSSVPLQSRPAEL

SEQ ID NO: 128415 - protein, 18 aa, Mycobacterium avium
LAERLPAYMVPAAVVTLD

SEQ ID NO: 128416 - protein, 25 aa, Mycobacterium avium
LAEVMLNHALPFPAGAIRDDTVDIV

SEQ ID NO: 128417 - protein, 18 aa, Mycobacterium avium
LAFAKLFAEAGFPPGVIN

SEQ ID NO: 128418 - protein, 19 aa, Mycobacterium avium
LAFAKLFAEAGFPPGVINV

SEQ ID NO: 128419 - protein, 30 aa, Mycobacterium avium
LAFARPGHITFGSDWPFAPVAVGKLFAAGL

SEQ ID NO: 128420 - protein, 20 aa, Mycobacterium avium
LAFQGWLRNSPYYPHDALFG

SEQ ID NO: 128421 - protein, 21 aa, Mycobacterium avium
LAFQGWLRNSPYYPHDALFGS

SEQ ID NO: 128422 - protein, 18 aa, Mycobacterium avium
LAFRRVGVFPRVGFKQQR

SEQ ID NO: 128423 - protein, 42 aa, Mycobacterium avium
LAGCARRLLDAPAVLGLARDGGWWVFGVAAPALADCLRAVPM

SEQ ID NO: 128424 - protein, 42 aa, Mycobacterium avium
LAGCARRLLDAPAVLGLARDGGWWVLGVAAPVLADCLRAVPM

SEQ ID NO: 128425 - protein, 18 aa, Mycobacterium avium
LAGDWLRAGAPAIDGVLC

SEQ ID NO: 128426 - protein, 19 aa, Mycobacterium avium
LAGDYLFATASRLVSRLGP

SEQ ID NO: 128427 - protein, 29 aa, Mycobacterium avium
LAGEISQLLYWTQVLMTARGLSLDDVYRK

SEQ ID NO: 128428 - protein, 22 aa, Mycobacterium avium
LAGETVPLGAPLPASVVAAAIR

SEQ ID NO: 128429 - protein, 32 aa, Mycobacterium avium
LAGHALKASIAWRALRALLLSRRGDYDEARRM

SEQ ID NO: 128430 - protein, 24 aa, Mycobacterium avium
LAGHHRGPFLGCTALRESIQAAVA

SEQ ID NO: 128431 - protein, 25 aa, Mycobacterium avium
LAGHHRGPFLGCTALRESIQAAVAR

SEQ ID NO: 128432 - protein, 17 aa, Mycobacterium avium
LAGIGNVYCNELCFVSG

SEQ ID NO: 128433 - protein, 28 aa, Mycobacterium avium
LAGLCGALRRYHEAFGVPISTLPMAVPV

SEQ ID NO: 128434 - protein, 29 aa, Mycobacterium avium
LAGLCGALRRYHEAFGVPISTLPMAVPVN

SEQ ID NO: 128435 - protein, 18 aa, Mycobacterium avium
LAGLGRIYGRMPGVADVP

SEQ ID NO: 128436 - protein, 24 aa, Mycobacterium avium
LAGPTGWGLRDLGYTLTRRRAHRP

SEQ ID NO: 128437 - protein, 20 aa, Mycobacterium avium
LAGQKLSGSHRLGHACVLAF

SEQ ID NO: 128438 - protein, 24 aa, Mycobacterium avium
LAGRAGIRVLGPRPRRARPGRRPY

SEQ ID NO: 128439 - protein, 25 aa, Mycobacterium avium
LAGRHLRRHPNALPVVLVVTDGEPT

SEQ ID NO: 128440 - protein, 17 aa, Mycobacterium avium
LAGYDPDRHLGGILYLF

SEQ ID NO: 128441 - protein, 24 aa, Mycobacterium avium
LAHHPLIQVMLTWRGDDPTRLRLG

SEQ ID NO: 128442 - protein, 24 aa, Mycobacterium avium
LAHPCPMCLGALYYCSPREVVFLT

SEQ ID NO: 128443 - protein, 18 aa, Mycobacterium avium
LAHRFRKAGLREGDTVAI

SEQ ID NO: 128444 - protein, 18 aa, Mycobacterium avium
LAHSAGYVELFYGRPRTQ

SEQ ID NO: 128445 - protein, 26 aa, Mycobacterium avium
LAHSPLEFLYGLFFDYVRDRRRQPRE

SEQ ID NO: 128446 - protein, 18 aa, Mycobacterium avium
LAHVDRVVVLGREAQVEP

SEQ ID NO: 128447 - protein, 20 aa, Mycobacterium avium
LAIAQKYWHRGQACPIAVVV

SEQ ID NO: 128448 - protein, 17 aa, Mycobacterium avium
LAIDTPLGAREFHKFLL

SEQ ID NO: 128449 - protein, 17 aa, Mycobacterium avium
LAIELQRRGCAIARLVL

SEQ ID NO: 128450 - protein, 18 aa, Mycobacterium avium
LAILTARHLDCWVLGTVG

SEQ ID NO: 128451 - protein, 22 aa, Mycobacterium avium
LAKPGRLAGPDPSLLAAAYAAL

SEQ ID NO: 128452 - protein, 24 aa, Mycobacterium avium
LAKRDSEWMGRVHRFLGLDVGVIL

SEQ ID NO: 128453 - protein, 41 aa, Mycobacterium avium
LAKVPYYRVLELAPWLKWPQPNFPVSNFFHAGAAPLNAVLA

SEQ ID NO: 128454 - protein, 17 aa, Mycobacterium avium
LAKYAPAVILIDEWVAY

SEQ ID NO: 128455 - protein, 18 aa, Mycobacterium avium
LALAAVPGNPAFVLVHDA

SEQ ID NO: 128456 - protein, 23 aa, Mycobacterium avium
LALELPTAPPDGWISRHAAAKVL

SEQ ID NO: 128457 - protein, 17 aa, Mycobacterium avium
LALIKPSAENPDVVVAA

SEQ ID NO: 128458 - protein, 20 aa, Mycobacterium avium
LALLAVYPRNQECLLRLAAL

SEQ ID NO: 128459 - protein, 18 aa, Mycobacterium avium
LALLPEIMGDAERFDIAG

SEQ ID NO: 128460 - protein, 20 aa, Mycobacterium avium
LALPALLRERGIIGRDAAFA

SEQ ID NO: 128461 - protein, 19 aa, Mycobacterium avium
LALQYFHVTPWVAWSDASQ

SEQ ID NO: 128462 - protein, 17 aa, Mycobacterium avium
LALRFHSHLFGLGGAIS

SEQ ID NO: 128463 - protein, 19 aa, Mycobacterium avium
LAMAVQWARERHQFGRPIG

SEQ ID NO: 128464 - protein, 25 aa, Mycobacterium avium
LAMDPQHRMLLELSWEALERAGIDP

SEQ ID NO: 128465 - protein, 23 aa, Mycobacterium avium
LANFRQIMSDYFLDYGKVAPPDT

SEQ ID NO: 128466 - protein, 25 aa, Mycobacterium avium
LANSFALLAPGLKRIRKRIAQYHDA

SEQ ID NO: 128467 - protein, 17 aa, Mycobacterium avium
LANWDRFHTRRPMIEVC

SEQ ID NO: 128468 - protein, 37 aa, Mycobacterium avium
LAPGALAPLRRLATGHWLRRWWPASRQDGIAGLDRAL

SEQ ID NO: 128469 - protein, 18 aa, Mycobacterium avium
LAPLREKRFDVGQRGRVV

SEQ ID NO: 128470 - protein, 25 aa, Mycobacterium avium
LAPTVHGPGDYGFVAMLVATARKTG

SEQ ID NO: 128471 - protein, 34 aa, Mycobacterium avium
LAQGIPARPVVIGPITFLLLSKGVDGAGGPIERL

SEQ ID NO: 128472 - protein, 31 aa, Mycobacterium avium
LAQHRAALPPLLSELAGRPARRMLEHTDMVS

SEQ ID NO: 128473 - protein, 18 aa, Mycobacterium avium
LAQKAFHRSADALAAMIA

SEQ ID NO: 128474 - protein, 19 aa, Mycobacterium avium
LAQLGAELNRRIVAAHQLA

SEQ ID NO: 128475 - protein, 22 aa, Mycobacterium avium
LAQLMSQITRYAPESVFPAIEG

SEQ ID NO: 128476 - protein, 22 aa, Mycobacterium avium
LAQLMSQITRYAPESVFPAIPG

SEQ ID NO: 128477 - protein, 22 aa, Mycobacterium avium
LAQLMSQITRYAPESVFPAIQG

SEQ ID NO: 128478 - protein, 28 aa, Mycobacterium avium
LAQWTPSEPTFYAGAAYSLSCGFDGNNH

SEQ ID NO: 128479 - protein, 17 aa, Mycobacterium avium
LARAALRRSGGLAARLA

SEQ ID NO: 128480 - protein, 29 aa, Mycobacterium avium
LARAARWGAAPLKAPALEAILAATGGRGA

SEQ ID NO: 128481 - protein, 30 aa, Mycobacterium avium
LARAFYDDPVMIWLLPDQDTRIAHLSRLFA

SEQ ID NO: 128482 - protein, 21 aa, Mycobacterium avium
LARDALIVFTGLSGSGKSSLA

SEQ ID NO: 128483 - protein, 26 aa, Mycobacterium avium
LARELVGVFVLQAWHTSGSATYLSVH

SEQ ID NO: 128484 - protein, 17 aa, Mycobacterium avium
LARGGLPVAWEIAAALH

SEQ ID NO: 128485 - protein, 20 aa, Mycobacterium avium
LARLRGLSASVRRPVDGLQR

SEQ ID NO: 128486 - protein, 17 aa, Mycobacterium avium
LARNPGVLDLALDRGPA

SEQ ID NO: 128487 - protein, 23 aa, Mycobacterium avium
LARNPQLADLLLRKVVGGLPELP

SEQ ID NO: 128488 - protein, 17 aa, Mycobacterium avium
LARNVFAARIHQRWSQG

SEQ ID NO: 128489 - protein, 21 aa, Mycobacterium avium
LARRDLILSLHLRISSLPWPG

SEQ ID NO: 128490 - protein, 20 aa, Mycobacterium avium
LARSMLLLHGDHHDHDERPA

SEQ ID NO: 128491 - protein, 21 aa, Mycobacterium avium
LARTALPTMTLLGAQFVMATA

SEQ ID NO: 128492 - protein, 29 aa, Mycobacterium avium
LARYGPRAPQLWLPPLDEPIPLSAMLARA

SEQ ID NO: 128493 - protein, 25 aa, Mycobacterium avium
LARYKVPRRLVLVADLPVLASGKVD

SEQ ID NO: 128494 - protein, 19 aa, Mycobacterium avium
LASADVFLTNWLPGALERA

SEQ ID NO: 128495 - protein, 24 aa, Mycobacterium avium
LASADVFLTNWLPGALERARLTVA

SEQ ID NO: 128496 - protein, 22 aa, Mycobacterium avium
LASAKPIPPAFFGSLQDLVGGE

SEQ ID NO: 128497 - protein, 28 aa, Mycobacterium avium
LASDLMRPVLRVPHHPVRLARFGPRALL

SEQ ID NO: 128498 - protein, 27 aa, Mycobacterium avium
LASENAFFMLAFTKIGLMPDGGASALV

SEQ ID NO: 128499 - protein, 26 aa, Mycobacterium avium
LASGLDARAYRLAWPAGTTVFEIDQP

SEQ ID NO: 128500 - protein, 22 aa, Mycobacterium avium
LASIAASCTASYTVALVPGGPS

SEQ ID NO: 128501 - protein, 18 aa, Mycobacterium avium
LASILSWQGWETLFELAH

SEQ ID NO: 128502 - protein, 27 aa, Mycobacterium avium
LASLPDGALMRRAAFGLATEIAAELTA

SEQ ID NO: 128503 - protein, 21 aa, Mycobacterium avium
LASRCHPETLRQMRWANAMLK

SEQ ID NO: 128504 - protein, 18 aa, Mycobacterium avium
LASVELRRRPELAGLPVI

SEQ ID NO: 128505 - protein, 18 aa, Mycobacterium avium
LASVERFAALGRRAYHYR

SEQ ID NO: 128506 - protein, 25 aa, Mycobacterium avium
LATDVWPNNLIIPIGYSQGAICGSW

SEQ ID NO: 128507 - protein, 26 aa, Mycobacterium avium
LATGTAALFAFGTRLDPRFGSDSSAR

SEQ ID NO: 128508 - protein, 26 aa, Mycobacterium avium
LATHHDLHLWLPHPSDRLWRALAGTH

SEQ ID NO: 128509 - protein, 24 aa, Mycobacterium avium
LATLSQLHAPFWGSRRLANGGDLS

SEQ ID NO: 128510 - protein, 18 aa, Mycobacterium avium
LATLSWVYWHNTSRLHSY

SEQ ID NO: 128511 - protein, 19 aa, Mycobacterium avium
LATLSWVYWHNTSRLHSYL

SEQ ID NO: 128512 - protein, 23 aa, Mycobacterium avium
LATMHPSRYLTLIEGVSAVFLTG

SEQ ID NO: 128513 - protein, 23 aa, Mycobacterium avium
LATMHPSRYLTLIEGVTAVFLTG

SEQ ID NO: 128514 - protein, 24 aa, Mycobacterium avium
LATSQWLRNAFSNLSFEHQETLAE

SEQ ID NO: 128515 - protein, 23 aa, Mycobacterium avium
LATTGWFVGFVPLTVSVAGSFSD

SEQ ID NO: 128516 - protein, 19 aa, Mycobacterium avium
LATVPSIVRKGRGGPVVLV

SEQ ID NO: 128517 - protein, 17 aa, Mycobacterium avium
LATVRDLAFRASPVAQI

SEQ ID NO: 128518 - protein, 26 aa, Mycobacterium avium
LAVDGVSWRILLQDLNIAWAQHHGGQ

SEQ ID NO: 128519 - protein, 26 aa, Mycobacterium avium
LAVDGVSWRVLLEDLNIAWGQHHNGQ

SEQ ID NO: 128520 - protein, 24 aa, Mycobacterium avium
LAVDPAHPFPFVSGLSLNLAVMVR

SEQ ID NO: 128521 - protein, 29 aa, Mycobacterium avium
LAVDPGLPGFLLRQRIRPVARAQRLQEGA

SEQ ID NO: 128522 - protein, 30 aa, Mycobacterium avium
LAVFDIMLLAHGWALKHWHFGPIYTLDEYF

SEQ ID NO: 128523 - protein, 33 aa, Mycobacterium avium
LAVGSHAPNLPWPWGLIDLTARVLLPVSATVRE

SEQ ID NO: 128524 - protein, 34 aa, Mycobacterium avium
LAVGSHAPNLPWPWGLIDLTARVLLPVSATVRET

SEQ ID NO: 128525 - protein, 36 aa, Mycobacterium avium
LAVGSHAPNLPWPWGLIDLTARVLLPVSATVRETVA

SEQ ID NO: 128526 - protein, 17 aa, Mycobacterium avium
LAVLRAQQQLGVAVPAE

SEQ ID NO: 128527 - protein, 21 aa, Mycobacterium avium
LAYAAYDLQLYSGGRFRLGLG

SEQ ID NO: 128528 - protein, 19 aa, Mycobacterium avium
LAYAGALATAGRFADADRI

SEQ ID NO: 128529 - protein, 26 aa, Mycobacterium avium
LAYFENLGWRTVQVEALYSAARRLRR

SEQ ID NO: 128530 - protein, 21 aa, Mycobacterium avium
LAYHCPLTYRPLLAKDRRMII

SEQ ID NO: 128531 - protein, 18 aa, Mycobacterium avium
LAYTLFQRVMRHDPSDTH

SEQ ID NO: 128532 - protein, 18 aa, Mycobacterium avium
LCEHLLSAGFDVAACRDI

SEQ ID NO: 128533 - protein, 17 aa, Mycobacterium avium
LCEVQGYVYAALLARAE

SEQ ID NO: 128534 - protein, 18 aa, Mycobacterium avium
LCFLLDDAVLTADTVLGR

SEQ ID NO: 128535 - protein, 18 aa, Mycobacterium avium
LCFPTITRFCGQLFMEAS

SEQ ID NO: 128536 - protein, 17 aa, Mycobacterium avium
LCGATTFDPEFFGISPR

SEQ ID NO: 128537 - protein, 18 aa, Mycobacterium avium
LCGNVCATLGVWYAPEQF

SEQ ID NO: 128538 - protein, 22 aa, Mycobacterium avium
LCGTEPLLIERIDAEYGRYFTP

SEQ ID NO: 128539 - protein, 20 aa, Mycobacterium avium
LCHRSCDRTAHIYSVGAGKV

SEQ ID NO: 128540 - protein, 18 aa, Mycobacterium avium
LCLESDGSAMYTISGLWT

SEQ ID NO: 128541 - protein, 17 aa, Mycobacterium avium
LCPNGCWGTFVTCDANV

SEQ ID NO: 128542 - protein, 17 aa, Mycobacterium avium
LCSVMGKSGLFSDYLIK

SEQ ID NO: 128543 - protein, 28 aa, Mycobacterium avium
LCTDWMGDDAWLWKLDCEFRLFNYVGDV

SEQ ID NO: 128544 - protein, 17 aa, Mycobacterium avium
LCVPGYRHPITVLIRAG

SEQ ID NO: 128545 - protein, 18 aa, Mycobacterium avium
LCVPSYRHPITVLIRAGR

SEQ ID NO: 128546 - protein, 17 aa, Mycobacterium avium
LCWGIVATPLTVVPAPT

SEQ ID NO: 128547 - protein, 24 aa, Mycobacterium avium
LDAADRLWIPVRRSWRLNERHYGA

SEQ ID NO: 128548 - protein, 17 aa, Mycobacterium avium
LDAAIEKLLAHKLRRRT

SEQ ID NO: 128549 - protein, 34 aa, Mycobacterium avium
LDAAPITRAFRRIVLYEPPIPSLGLDVGSPGGWA

SEQ ID NO: 128550 - protein, 26 aa, Mycobacterium avium
LDADATNMLMLPLFNYADGNCDAIRE

SEQ ID NO: 128551 - protein, 20 aa, Mycobacterium avium
LDADPASFWRVDVAPAACVV

SEQ ID NO: 128552 - protein, 21 aa, Mycobacterium avium
LDADPASFWRVDVAPAACVVM

SEQ ID NO: 128553 - protein, 19 aa, Mycobacterium avium
LDAGVLIRDVGIPGFLRAT

SEQ ID NO: 128554 - protein, 26 aa, Mycobacterium avium
LDALGYRGFWMGYFAARSAPLGAVPR

SEQ ID NO: 128555 - protein, 18 aa, Mycobacterium avium
LDALTAHLQQHAPWGAQV

SEQ ID NO: 128556 - protein, 23 aa, Mycobacterium avium
LDAQLELLGPAWYDALGSNYGKA

SEQ ID NO: 128557 - protein, 23 aa, Mycobacterium avium
LDAQLELLGPAWYDALGSSYGKA

SEQ ID NO: 128558 - protein, 21 aa, Mycobacterium avium
LDARDTELLRELKARRSRDVP

SEQ ID NO: 128559 - protein, 20 aa, Mycobacterium avium
LDARLADFTPLPAPDDVLAA

SEQ ID NO: 128560 - protein, 23 aa, Mycobacterium avium
LDASTWVVFFTDHGPAFPRAKST

SEQ ID NO: 128561 - protein, 30 aa, Mycobacterium avium
LDATPAQIALAWTLSVAPSIALIPGTSSVG

SEQ ID NO: 128562 - protein, 18 aa, Mycobacterium avium
LDAVWPLKRGGVEGRWEL

SEQ ID NO: 128563 - protein, 18 aa, Mycobacterium avium
LDCFFVYLARHPEHRRQL

SEQ ID NO: 128564 - protein, 21 aa, Mycobacterium avium
LDDPPPLPAPAMPAAPPARNG

SEQ ID NO: 128565 - protein, 18 aa, Mycobacterium avium
LDDQQIARLSRLWSQALT

SEQ ID NO: 128566 - protein, 25 aa, Mycobacterium avium
LDDRTILGFTKHDTLKLTGAKLGRD

SEQ ID NO: 128567 - protein, 23 aa, Mycobacterium avium
LDDSLFAKFGLPAALGPRQEGVR

SEQ ID NO: 128568 - protein, 31 aa, Mycobacterium avium
LDDTNLRRLISLFELLRARSQLIIITHQKPT

SEQ ID NO: 128569 - protein, 28 aa, Mycobacterium avium
LDDTVRAPRRQWPSPMLPALQSLLDDHT

SEQ ID NO: 128570 - protein, 28 aa, Mycobacterium avium
LDDVLRRAVRLLAQLTRQVAVVQYPTLS

SEQ ID NO: 128571 - protein, 26 aa, Mycobacterium avium
LDEAKHWPSQPGRYFTVRAGSLVAWD

SEQ ID NO: 128572 - protein, 27 aa, Mycobacterium avium
LDEAKHWPSQPGRYFTVRAGSLVAWNS

SEQ ID NO: 128573 - protein, 23 aa, Mycobacterium avium
LDEALEIILPMIRGERATFEGKW

SEQ ID NO: 128574 - protein, 17 aa, Mycobacterium avium
LDEEHYVLVAGAAGARD

SEQ ID NO: 128575 - protein, 26 aa, Mycobacterium avium
LDELEEIARRLSEAHDVLLAALESAE

SEQ ID NO: 128576 - protein, 23 aa, Mycobacterium avium
LDERGLLYLMDRKKDVIISGGEN

SEQ ID NO: 128577 - protein, 18 aa, Mycobacterium avium
LDEWAQIFAGEPDFFWSP

SEQ ID NO: 128578 - protein, 25 aa, Mycobacterium avium
LDFVPAFGSAFQWQYPAPPEGDHIT

SEQ ID NO: 128579 - protein, 18 aa, Mycobacterium avium
LDGFGWAACHSGAPVRPG

SEQ ID NO: 128580 - protein, 24 aa, Mycobacterium avium
LDGGPMRDLLRRMQPTEFNDIVAV

SEQ ID NO: 128581 - protein, 25 aa, Mycobacterium avium
LDGGPMRDLLRRMQPTEFNDIVAVL

SEQ ID NO: 128582 - protein, 25 aa, Mycobacterium avium
LDGGRWQDEWLYARAYTIAGGSSEI

SEQ ID NO: 128583 - protein, 26 aa, Mycobacterium avium
LDGMLLPEVILANRLFPALTFGGSNL

SEQ ID NO: 128584 - protein, 20 aa, Mycobacterium avium
LDGQKTWITDGHWADMGLAL

SEQ ID NO: 128585 - protein, 28 aa, Mycobacterium avium
LDGRDNRLLWQLDGRYMQALFGETLNAR

SEQ ID NO: 128586 - protein, 27 aa, Mycobacterium avium
LDGRHLLESWIPLLALAAHDRGRDWSA

SEQ ID NO: 128587 - protein, 18 aa, Mycobacterium avium
LDGRLRHLPGGVGEYLRL

SEQ ID NO: 128588 - protein, 47 aa, Mycobacterium avium
LDGWSKPLLLQEIFAAYFGVRLPAPVPYRNFITWLSAQDRAAAQAAW

SEQ ID NO: 128589 - protein, 48 aa, Mycobacterium avium
LDGWSKPLLLQEIFAAYFGVRLPAPVPYRNFITWLSAQDRAAAQAAWR

SEQ ID NO: 128590 - protein, 22 aa, Mycobacterium avium
LDGYGLHIIERVPLPVRTNAEN

SEQ ID NO: 128591 - protein, 20 aa, Mycobacterium avium
LDHIAAFLGALEAGLIAVPL

SEQ ID NO: 128592 - protein, 21 aa, Mycobacterium avium
LDHLKFAVLALGDSSYELFCN

SEQ ID NO: 128593 - protein, 25 aa, Mycobacterium avium
LDIGLAARVLGWQPKVGLQQGVART

SEQ ID NO: 128594 - protein, 19 aa, Mycobacterium avium
LDLGIDWKTYRDAIAGLRG

SEQ ID NO: 128595 - protein, 19 aa, Mycobacterium avium
LDLGIDWKTYRDAIDGLRG

SEQ ID NO: 128596 - protein, 17 aa, Mycobacterium avium
LDLSGHLIGHLLPSASA

SEQ ID NO: 128597 - protein, 21 aa, Mycobacterium avium
LDLSRLRFISVESFRALLLLN

SEQ ID NO: 128598 - protein, 23 aa, Mycobacterium avium
LDLTTYWAGAYLTCYLGAFGADI

SEQ ID NO: 128599 - protein, 26 aa, Mycobacterium avium
LDLVSLTQILAWDLPLTKKVSDHVAR

SEQ ID NO: 128600 - protein, 23 aa, Mycobacterium avium
LDLYARHRVECAVLLRGIGGFGS

SEQ ID NO: 128601 - protein, 24 aa, Mycobacterium avium
LDMDAFFASVEQLTRPTLRGRPVL

SEQ ID NO: 128602 - protein, 19 aa, Mycobacterium avium
LDPDAVRMILYTSGTTSSP

SEQ ID NO: 128603 - protein, 18 aa, Mycobacterium avium
LDPGQALVLDIAPPDTRY

SEQ ID NO: 128604 - protein, 22 aa, Mycobacterium avium
LDPLEVEALTWQNPRTLAAMVG

SEQ ID NO: 128605 - protein, 21 aa, Mycobacterium avium
LDPTLQLMLSGLRAVGIDGLV

SEQ ID NO: 128606 - protein, 20 aa, Mycobacterium avium
LDQAYPPWLAEPWDSVGLVC

SEQ ID NO: 128607 - protein, 21 aa, Mycobacterium avium
LDRFPTLRIVAVETGASWLGW

SEQ ID NO: 128608 - protein, 20 aa, Mycobacterium avium
LDRLTAGVLLFTARREVRGA

SEQ ID NO: 128609 - protein, 34 aa, Mycobacterium avium
LDRPTGPRPFLRLEGSAVFRWAAFEMGKVGQQAM

SEQ ID NO: 128610 - protein, 19 aa, Mycobacterium avium
LDRPVDLTQWAAPQFLTQS

SEQ ID NO: 128611 - protein, 21 aa, Mycobacterium avium
LDRPWRRPGALRYALNRIRGV

SEQ ID NO: 128612 - protein, 20 aa, Mycobacterium avium
LDRRSAALAIALLAEGISKG

SEQ ID NO: 128613 - protein, 17 aa, Mycobacterium avium
LDRVWSYDFGGRSNIVE

SEQ ID NO: 128614 - protein, 19 aa, Mycobacterium avium
LDRYFDYAEGRLGWRTLDF

SEQ ID NO: 128615 - protein, 21 aa, Mycobacterium avium
LDSRAWRLPFEDGTTVYELDQ

SEQ ID NO: 128616 - protein, 36 aa, Mycobacterium avium
LDSWTNYQWHQLARTFLMYRTQRWPDVLLTAAEELP

SEQ ID NO: 128617 - protein, 24 aa, Mycobacterium avium
LDTARAEWWYSRAATIMGGTAEVQ

SEQ ID NO: 128618 - protein, 27 aa, Mycobacterium avium
LDTDNYRSLWMYLKELEFRQGFVDIAV

SEQ ID NO: 128619 - protein, 25 aa, Mycobacterium avium
LDTEYLERRAALIDPARAKPVSAGA

SEQ ID NO: 128620 - protein, 32 aa, Mycobacterium avium
LDTLGAAASLQLWVMMETPRAFLRAEEVASAS

SEQ ID NO: 128621 - protein, 17 aa, Mycobacterium avium
LDTLTDWLLSRLPSLAR

SEQ ID NO: 128622 - protein, 25 aa, Mycobacterium avium
LDTRALPAPDYWHTGGYRAPESPTE

SEQ ID NO: 128623 - protein, 23 aa, Mycobacterium avium
LDTTRSAYLLVRNGIRNRYPNIR

SEQ ID NO: 128624 - protein, 29 aa, Mycobacterium avium
LDVAQLYDGFTFLTLAWLEALGVCGDGEA

SEQ ID NO: 128625 - protein, 21 aa, Mycobacterium avium
LDVLAELPILVAAAGPQMVSL

SEQ ID NO: 128626 - protein, 25 aa, Mycobacterium avium
LDVLIGFFRGDIARTIEFGPRLCEP

SEQ ID NO: 128627 - protein, 24 aa, Mycobacterium avium
LDVNLLGYVRTSRAVLAHLLQQGS

SEQ ID NO: 128628 - protein, 23 aa, Mycobacterium avium
LDVRKAAVLALTRWAGEPDARDA

SEQ ID NO: 128629 - protein, 17 aa, Mycobacterium avium
LDVVGLHRLAIVCHGRG

SEQ ID NO: 128630 - protein, 22 aa, Mycobacterium avium
LDWRSRLGGWGLMSNAAHPGLA

SEQ ID NO: 128631 - protein, 19 aa, Mycobacterium avium
LDYLAVRIRSLLGKPDAVQ

SEQ ID NO: 128632 - protein, 27 aa, Mycobacterium avium
LDYPRGNLAFRWFLADGVPARPEVELV

SEQ ID NO: 128633 - protein, 17 aa, Mycobacterium avium
LDYRILAEILALELGDT

SEQ ID NO: 128634 - protein, 19 aa, Mycobacterium avium
LDYYRMTTAAGAPPHPCPL

SEQ ID NO: 128635 - protein, 20 aa, Mycobacterium avium
LEAALCVASSLFGRLHTGTG

SEQ ID NO: 128636 - protein, 28 aa, Mycobacterium avium
LEAGLRNLYLLPSSPLQELRRLLPENTI

SEQ ID NO: 128637 - protein, 20 aa, Mycobacterium avium
LEARVMFEVLLGAFPTIELT

SEQ ID NO: 128638 - protein, 22 aa, Mycobacterium avium
LEATFTPFFKMLLDNEATLFRP

SEQ ID NO: 128639 - protein, 17 aa, Mycobacterium avium
LEAWKRRVRLDDILIAE

SEQ ID NO: 128640 - protein, 20 aa, Mycobacterium avium
LECDGTPWIDTPMLPGWGRV

SEQ ID NO: 128641 - protein, 23 aa, Mycobacterium avium
LEDLFVRPGFRRRGLARALLAAL

SEQ ID NO: 128642 - protein, 20 aa, Mycobacterium avium
LEDLMRQRLITLEAVRVTVI

SEQ ID NO: 128643 - protein, 23 aa, Mycobacterium avium
LEDLMRQRLITLEAVRVTVIDEA

SEQ ID NO: 128644 - protein, 23 aa, Mycobacterium avium
LEDYGLTPWPKTSGSRGFHIYAR

SEQ ID NO: 128645 - protein, 22 aa, Mycobacterium avium
LEETGLLPHLNPGVMSWSEMAR

SEQ ID NO: 128646 - protein, 22 aa, Mycobacterium avium
LEFARLLGTPIGHPAASALAAK

SEQ ID NO: 128647 - protein, 23 aa, Mycobacterium avium
LEFARLLGTPIGHPAASALAAKH

SEQ ID NO: 128648 - protein, 17 aa, Mycobacterium avium
LEFGSMFAGPYGATLLA

SEQ ID NO: 128649 - protein, 32 aa, Mycobacterium avium
LEFRPKVIIAGWSAYPRVLDFAAFASIADEVG

SEQ ID NO: 128650 - protein, 20 aa, Mycobacterium avium
LEFVAAIVGAWLAGAGVSIL

SEQ ID NO: 128651 - protein, 25 aa, Mycobacterium avium
LEFVVRQEPRLNWAIGDRADGTTIL

SEQ ID NO: 128652 - protein, 23 aa, Mycobacterium avium
LEGQPEHLIDWKGNDWYAGKTET

SEQ ID NO: 128653 - protein, 20 aa, Mycobacterium avium
LEGRMYACFAAGAMAAGCEY

SEQ ID NO: 128654 - protein, 17 aa, Mycobacterium avium
LELAIVLAEFGYGAVPG

SEQ ID NO: 128655 - protein, 18 aa, Mycobacterium avium
LELAIVLAEFGYGAVPGP

SEQ ID NO: 128656 - protein, 24 aa, Mycobacterium avium
LELALEALYLAKRIDKVSGEGQTV

SEQ ID NO: 128657 - protein, 22 aa, Mycobacterium avium
LELGGRALFGPVGSAAARAVKG

SEQ ID NO: 128658 - protein, 35 aa, Mycobacterium avium
LELMDTALIVDEPFLLPAHIDLAALRAKFDGGTLP

SEQ ID NO: 128659 - protein, 35 aa, Mycobacterium avium
LELMDTALIVDEPFLLPAHIDLAALRVKFDGGTLP

SEQ ID NO: 128660 - protein, 20 aa, Mycobacterium avium
LELVECSEFFKDTTFRVFQA

SEQ ID NO: 128661 - protein, 17 aa, Mycobacterium avium
LEMSARHPGNIAALAEI

SEQ ID NO: 128662 - protein, 17 aa, Mycobacterium avium
LENTRFWAPLSLTAEQK

SEQ ID NO: 128663 - protein, 27 aa, Mycobacterium avium
LENYHRLTMPSTWLEALVKTYVGDALA

SEQ ID NO: 128664 - protein, 24 aa, Mycobacterium avium
LEPLLRRQRGAWVGWPGIVDEDVD

SEQ ID NO: 128665 - protein, 19 aa, Mycobacterium avium
LEPLRPWKAEQLGGGYRIS

SEQ ID NO: 128666 - protein, 20 aa, Mycobacterium avium
LEPLRPWKAEQLGGGYRIST

SEQ ID NO: 128667 - protein, 18 aa, Mycobacterium avium
LEQFVLKARYADAPQRFA

SEQ ID NO: 128668 - protein, 32 aa, Mycobacterium avium
LEQIAILVALGHQLAAVPYLESVVLGAGALAR

SEQ ID NO: 128669 - protein, 22 aa, Mycobacterium avium
LEQIRESYSRLLHSALARLQAD

SEQ ID NO: 128670 - protein, 24 aa, Mycobacterium avium
LEQLPALGIMLTPFSAAGESTASL

SEQ ID NO: 128671 - protein, 17 aa, Mycobacterium avium
LEQQRLPLRATVLLVSG

SEQ ID NO: 128672 - protein, 25 aa, Mycobacterium avium
LEQQRLPLRATVLLVSGRASFELAQ

SEQ ID NO: 128673 - protein, 26 aa, Mycobacterium avium
LEQQRLPLRATVLLVSGRASFELAQK

SEQ ID NO: 128674 - protein, 20 aa, Mycobacterium avium
LERALVEDFGFDAALGRPGQ

SEQ ID NO: 128675 - protein, 25 aa, Mycobacterium avium
LERAVARGSFFPVIPVCSSTGVGTL

SEQ ID NO: 128676 - protein, 24 aa, Mycobacterium avium
LERPRFDALGRWLLARTAEVSAER

SEQ ID NO: 128677 - protein, 20 aa, Mycobacterium avium
LERQGWLVRRQGLGTFVANP

SEQ ID NO: 128678 - protein, 22 aa, Mycobacterium avium
LERRAKRLIVFDVDSTLVQGEV

SEQ ID NO: 128679 - protein, 22 aa, Mycobacterium avium
LERRGWRIIRVSADLLRNRPDV

SEQ ID NO: 128680 - protein, 26 aa, Mycobacterium avium
LERVVDRFDWILRRKRIGGRRGRGWP

SEQ ID NO: 128681 - protein, 24 aa, Mycobacterium avium
LESALPAPWVACAADLVGVAGAAL

SEQ ID NO: 128682 - protein, 17 aa, Mycobacterium avium
LESLLRNVPTDGLDLDE

SEQ ID NO: 128683 - protein, 24 aa, Mycobacterium avium
LESRSGRRFGHVDHPLLVSVRSGA

SEQ ID NO: 128684 - protein, 17 aa, Mycobacterium avium
LESVVLGAGALARFGTE

SEQ ID NO: 128685 - protein, 22 aa, Mycobacterium avium
LETCWRDYRLGVLQAPLISALG

SEQ ID NO: 128686 - protein, 31 aa, Mycobacterium avium
LEVAAQFMHVLPVGWVEPVDISNAVLFLASD

SEQ ID NO: 128687 - protein, 21 aa, Mycobacterium avium
LEVFPRAKAMLPKAIEAGVRI

SEQ ID NO: 128688 - protein, 20 aa, Mycobacterium avium
LEWGCFTYGIIQHAEYFTFY

SEQ ID NO: 128689 - protein, 20 aa, Mycobacterium avium
LEWRRMIDIGADFSGAKVAV

SEQ ID NO: 128690 - protein, 20 aa, Mycobacterium avium
LEYLSSIAAYREDFRRYLRD

SEQ ID NO: 128691 - protein, 19 aa, Mycobacterium avium
LFAQLPFYDVVDTDDSVVV

SEQ ID NO: 128692 - protein, 17 aa, Mycobacterium avium
LFDLFDYRNAEAPGQPG

SEQ ID NO: 128693 - protein, 18 aa, Mycobacterium avium
LFDSLQFAPRYRCADLAS

SEQ ID NO: 128694 - protein, 17 aa, Mycobacterium avium
LFEAAAALPQPALRRDQ

SEQ ID NO: 128695 - protein, 32 aa, Mycobacterium avium
LFGGGELPPHLEWTAPFGALSAANWLAMPAQR

SEQ ID NO: 128696 - protein, 20 aa, Mycobacterium avium
LFGQLLDPVGDGRVQLYRRG

SEQ ID NO: 128697 - protein, 22 aa, Mycobacterium avium
LFHAKGWWVGAVDRNDDGLATL

SEQ ID NO: 128698 - protein, 17 aa, Mycobacterium avium
LFHARAKLQRKGCDLLV

SEQ ID NO: 128699 - protein, 17 aa, Mycobacterium avium
LFLAGRAEPFRVAELPG

SEQ ID NO: 128700 - protein, 17 aa, Mycobacterium avium
LFLSRRLIGANTSRGAV

SEQ ID NO: 128701 - protein, 23 aa, Mycobacterium avium
LFRLVADGANWSRWAKPIVLHSS

SEQ ID NO: 128702 - protein, 18 aa, Mycobacterium avium
LFTALDWVSDRLADRRYL

SEQ ID NO: 128703 - protein, 17 aa, Mycobacterium avium
LFTTWITAPQPDIDVVV

SEQ ID NO: 128704 - protein, 17 aa, Mycobacterium avium
LFVGKKPDGWLVITDSD

SEQ ID NO: 128705 - protein, 19 aa, Mycobacterium avium
LGADNTSLFLHDESFRATI

SEQ ID NO: 128706 - protein, 19 aa, Mycobacterium avium
LGAELRLGQVFEANGHADL

SEQ ID NO: 128707 - protein, 27 aa, Mycobacterium avium
LGAESLLALPRWLAESVRVPRGSVAVL

SEQ ID NO: 128708 - protein, 18 aa, Mycobacterium avium
LGALMTCAQLGLRPGVSV

SEQ ID NO: 128709 - protein, 32 aa, Mycobacterium avium
LGAPYQPFAEALRMLVPCLGPDRLRGLRGVEA

SEQ ID NO: 128710 - protein, 28 aa, Mycobacterium avium
LGAQGCLQRLWWLHSGPGDPRVLALWRT

SEQ ID NO: 128711 - protein, 18 aa, Mycobacterium avium
LGAQRETTFTLGGRRRAR

SEQ ID NO: 128712 - protein, 25 aa, Mycobacterium avium
LGAREFHKFLLAKQHEIASVITEAQ

SEQ ID NO: 128713 - protein, 25 aa, Mycobacterium avium
LGARLPQRAWTSRAVLAVLGRAAGP

SEQ ID NO: 128714 - protein, 25 aa, Mycobacterium avium
LGASRKRFLGTLLAGPDGTPRPPDG

SEQ ID NO: 128715 - protein, 22 aa, Mycobacterium avium
LGAVERWCVALSGGPDSLALTA

SEQ ID NO: 128716 - protein, 17 aa, Mycobacterium avium
LGAWPQLAGKPDALAVL

SEQ ID NO: 128717 - protein, 20 aa, Mycobacterium avium
LGDDLVISIPYGAAGSGTFF

SEQ ID NO: 128718 - protein, 18 aa, Mycobacterium avium
LGDGLLERVAMDLAVDLD

SEQ ID NO: 128719 - protein, 25 aa, Mycobacterium avium
LGDGPHVQLWPHRHGTDAMFAAALR

SEQ ID NO: 128720 - protein, 25 aa, Mycobacterium avium
LGDNLRRTLLKLRRAKSNVQRLKLV

SEQ ID NO: 128721 - protein, 21 aa, Mycobacterium avium
LGDWRVILHSPYGLGVNGPLA

SEQ ID NO: 128722 - protein, 18 aa, Mycobacterium avium
LGEEQLAGFLASPGALSV

SEQ ID NO: 128723 - protein, 24 aa, Mycobacterium avium
LGEPPVVIGPLFQDKTLKVCATED

SEQ ID NO: 128724 - protein, 29 aa, Mycobacterium avium
LGEPVRDLGPMLVFLAGPGSGFITGQLLA

SEQ ID NO: 128725 - protein, 26 aa, Mycobacterium avium
LGETEVRMRVTLSYFVEPNPSSRGWT

SEQ ID NO: 128726 - protein, 21 aa, Mycobacterium avium
LGETFFTTAYFDPNMAHMNEI

SEQ ID NO: 128727 - protein, 23 aa, Mycobacterium avium
LGETGLLTLPHPEQWGGGGQPYE

SEQ ID NO: 128728 - protein, 18 aa, Mycobacterium avium
LGFASALRMYREGWRVVA

SEQ ID NO: 128729 - protein, 20 aa, Mycobacterium avium
LGFASALRMYREGWRVVAAM

SEQ ID NO: 128730 - protein, 19 aa, Mycobacterium avium
LGFGRPRLKTSLLSAADIK

SEQ ID NO: 128731 - protein, 25 aa, Mycobacterium avium
LGFTQSYTYFTWRTAKWELTEFGND

SEQ ID NO: 128732 - protein, 32 aa, Mycobacterium avium
LGGAWLTFKAIDIVGTILRPIASGLGTIIAQE

SEQ ID NO: 128733 - protein, 21 aa, Mycobacterium avium
LGGDIRLSRAGRPVYHHLGVS

SEQ ID NO: 128734 - protein, 26 aa, Mycobacterium avium
LGGDKDFWLQVGIDPIRIITGSGTFY

SEQ ID NO: 128735 - protein, 24 aa, Mycobacterium avium
LGGGAYFIHFAWDSSDPEQLSETE

SEQ ID NO: 128736 - protein, 17 aa, Mycobacterium avium
LGGPRLKDVAGLSLTKL

SEQ ID NO: 128737 - protein, 18 aa, Mycobacterium avium
LGGQHHLLGSPLGGGEQG

SEQ ID NO: 128738 - protein, 18 aa, Mycobacterium avium
LGGRLSFALAERLHITRS

SEQ ID NO: 128739 - protein, 22 aa, Mycobacterium avium
LGGTDHDKLFTRDGWMRMGDIC

SEQ ID NO: 128740 - protein, 25 aa, Mycobacterium avium
LGGTPFPEQLVMWWNFVGRSHEDIV

SEQ ID NO: 128741 - protein, 25 aa, Mycobacterium avium
LGGVQVRIPGLPPVTIGHGPLRGPR

SEQ ID NO: 128742 - protein, 20 aa, Mycobacterium avium
LGHLFGYHLSTPAVIDLWGS

SEQ ID NO: 128743 - protein, 17 aa, Mycobacterium avium
LGHPFGMTGARITTTLL

SEQ ID NO: 128744 - protein, 19 aa, Mycobacterium avium
LGHPIGCTGARLMTSMLHE

SEQ ID NO: 128745 - protein, 24 aa, Mycobacterium avium
LGHRLSAMLWLTVAPRDVHTVGER

SEQ ID NO: 128746 - protein, 24 aa, Mycobacterium avium
LGHSDLIQPHMFMNDQLGDCAIAG

SEQ ID NO: 128747 - protein, 20 aa, Mycobacterium avium
LGICIDLFHCWAEGDFEAQL

SEQ ID NO: 128748 - protein, 17 aa, Mycobacterium avium
LGKRDIYRDSRLGLFPF

SEQ ID NO: 128749 - protein, 38 aa, Mycobacterium avium
LGKRDIYRDSRLGLFPFRRNLSLFAVDLALLTHSHPHT

SEQ ID NO: 128750 - protein, 18 aa, Mycobacterium avium
LGLAPRPPWHTARAPITA

SEQ ID NO: 128751 - protein, 22 aa, Mycobacterium avium
LGLDYQGLALDYAGAGSILGAE

SEQ ID NO: 128752 - protein, 24 aa, Mycobacterium avium
LGLGNWVVPTLLQHGSAEQIERLM

SEQ ID NO: 128753 - protein, 17 aa, Mycobacterium avium
LGLLMPDSFIQVVESIN

SEQ ID NO: 128754 - protein, 24 aa, Mycobacterium avium
LGLSTRGYTRLGAPLRHLTSRLLA

SEQ ID NO: 128755 - protein, 25 aa, Mycobacterium avium
LGLSTRGYTRLGAPLRHLTSRLLAE

SEQ ID NO: 128756 - protein, 20 aa, Mycobacterium avium
LGLTKWLLHSANGLDLDRHL

SEQ ID NO: 128757 - protein, 17 aa, Mycobacterium avium
LGMRAALERLRGTPGAS

SEQ ID NO: 128758 - protein, 26 aa, Mycobacterium avium
LGNQARQFFDLRQPGYFATGGPSGTD

SEQ ID NO: 128759 - protein, 23 aa, Mycobacterium avium
LGNVRPLIPLQIDPPDHAKYRRI

SEQ ID NO: 128760 - protein, 17 aa, Mycobacterium avium
LGNVRPLIPLQIDPPEH

SEQ ID NO: 128761 - protein, 21 aa, Mycobacterium avium
LGNVRPLIPLQIDPPEHAKYR

SEQ ID NO: 128762 - protein, 21 aa, Mycobacterium avium
LGPDGHRYAFFSHPDGTEVPG

SEQ ID NO: 128763 - protein, 27 aa, Mycobacterium avium
LGPDRPIELRLLEIEPALKALEGVVME

SEQ ID NO: 128764 - protein, 17 aa, Mycobacterium avium
LGPFLVPATVSAPEGTV

SEQ ID NO: 128765 - protein, 21 aa, Mycobacterium avium
LGPIRPPQRLAPHSYALGAEV

SEQ ID NO: 128766 - protein, 18 aa, Mycobacterium avium
LGPLLSDAERRYLTCDAT

SEQ ID NO: 128767 - protein, 17 aa, Mycobacterium avium
LGPTLPDGLRGAAALWG

SEQ ID NO: 128768 - protein, 23 aa, Mycobacterium avium
LGRAEIRAIFRSSKVGIIAGCMI

SEQ ID NO: 128769 - protein, 19 aa, Mycobacterium avium
LGRALAPVPFVGSTVLATG

SEQ ID NO: 128770 - protein, 17 aa, Mycobacterium avium
LGRAYARFVAANGGLVV

SEQ ID NO: 128771 - protein, 19 aa, Mycobacterium avium
LGRIIFMEEFYSLIERHQD

SEQ ID NO: 128772 - protein, 18 aa, Mycobacterium avium
LGRLLLGSVTAALLAHAH

SEQ ID NO: 128773 - protein, 17 aa, Mycobacterium avium
LGRRALIVPTDVTETQQ

SEQ ID NO: 128774 - protein, 25 aa, Mycobacterium avium
LGSDMGEFFMPYPGTRINQDSTPLN

SEQ ID NO: 128775 - protein, 27 aa, Mycobacterium avium
LGSLSMMMYGAHAALQFLLPQGSGKII

SEQ ID NO: 128776 - protein, 27 aa, Mycobacterium avium
LGSLTMMMYGAHAALQFLLPQGSGKII

SEQ ID NO: 128777 - protein, 25 aa, Mycobacterium avium
LGSPQPMFPWMTPTPQQAPTQVPGC

SEQ ID NO: 128778 - protein, 23 aa, Mycobacterium avium
LGTAVDWRFAATVGRRLARPGPP

SEQ ID NO: 128779 - protein, 18 aa, Mycobacterium avium
LGTDLRGLASLRLQGTRL

SEQ ID NO: 128780 - protein, 19 aa, Mycobacterium avium
LGVAAAPRQRQRGGGQQAQ

SEQ ID NO: 128781 - protein, 24 aa, Mycobacterium avium
LGVEHIWLGFVDSGLPKGDPPPPL

SEQ ID NO: 128782 - protein, 19 aa, Mycobacterium avium
LGVLGPLQVRRHGTPVAIP

SEQ ID NO: 128783 - protein, 23 aa, Mycobacterium avium
LGVLLTHHLDIRAPSRALRALVA

SEQ ID NO: 128784 - protein, 20 aa, Mycobacterium avium
LGVPYGEVMRWALLGSEERM

SEQ ID NO: 128785 - protein, 33 aa, Mycobacterium avium
LGVTPAQVGLAWILARTPHTLLIPGTRSITHLE

SEQ ID NO: 128786 - protein, 31 aa, Mycobacterium avium
LGVVAAMTPWNFPHTLNVMKLGAALAAGNTL

SEQ ID NO: 128787 - protein, 22 aa, Mycobacterium avium
LGWKLHGRFREKDGRQLVIRDL

SEQ ID NO: 128788 - protein, 33 aa, Mycobacterium avium
LGYFDAGAMLRLQSPRRPLFTPLAPVAGVPDSL

SEQ ID NO: 128789 - protein, 18 aa, Mycobacterium avium
LHAAASRWHGFAAAMNGV

SEQ ID NO: 128790 - protein, 24 aa, Mycobacterium avium
LHADLLGPVDLPPGARRPAGTPPG

SEQ ID NO: 128791 - protein, 23 aa, Mycobacterium avium
LHALGPQWVLVKGGHLRSSQRSC

SEQ ID NO: 128792 - protein, 30 aa, Mycobacterium avium
LHALRDGVVPLQFLFSGTVFRAGARGFSVQ

SEQ ID NO: 128793 - protein, 17 aa, Mycobacterium avium
LHAPTVLTLVTSALHAL

SEQ ID NO: 128794 - protein, 29 aa, Mycobacterium avium
LHARRVDLPTYAFARRRFWLSGDAVGSAN

SEQ ID NO: 128795 - protein, 21 aa, Mycobacterium avium
LHEVQRWCALLEWAGIPCDST

SEQ ID NO: 128796 - protein, 17 aa, Mycobacterium avium
LHGSKWIDAARPAEIID

SEQ ID NO: 128797 - protein, 17 aa, Mycobacterium avium
LHHPCCGDLVYGADPKL

SEQ ID NO: 128798 - protein, 27 aa, Mycobacterium avium
LHLGVLERAAISEALLLANLADLADLP

SEQ ID NO: 128799 - protein, 27 aa, Mycobacterium avium
LHLGVLERAAISEALLLANLANLADLP

SEQ ID NO: 128800 - protein, 29 aa, Mycobacterium avium
LHLSVFQRSPAYTLPWRVHRFQPGELDEM

SEQ ID NO: 128801 - protein, 18 aa, Mycobacterium avium
LHNDIVAPYLLALATEEQ

SEQ ID NO: 128802 - protein, 20 aa, Mycobacterium avium
LHNPAMYQTFRPDLTNPSRE

SEQ ID NO: 128803 - protein, 24 aa, Mycobacterium avium
LHQDGLVELVSGPAGPFGGLQPPH

SEQ ID NO: 128804 - protein, 26 aa, Mycobacterium avium
LHQHLERHILVFEGLQAAGADPGQQL

SEQ ID NO: 128805 - protein, 22 aa, Mycobacterium avium
LHQYCESLLRNVLKSGRVARVD

SEQ ID NO: 128806 - protein, 27 aa, Mycobacterium avium
LHRAPGPLPFAGLRVLDLTTYWAGAYL

SEQ ID NO: 128807 - protein, 25 aa, Mycobacterium avium
LHRLPLAIARLRRARRRTAPLFGVY

SEQ ID NO: 128808 - protein, 29 aa, Mycobacterium avium
LHRQIAYVPGDVTLWPSLTGGEIIDLLAR

SEQ ID NO: 128809 - protein, 19 aa, Mycobacterium avium
LHRQPLPLSLLATHPIDIS

SEQ ID NO: 128810 - protein, 18 aa, Mycobacterium avium
LHRRGLLDDMTRQASLDS

SEQ ID NO: 128811 - protein, 17 aa, Mycobacterium avium
LHRRWDALWDKLIAACH

SEQ ID NO: 128812 - protein, 18 aa, Mycobacterium avium
LHRRWDALWDKLIAACHP

SEQ ID NO: 128813 - protein, 18 aa, Mycobacterium avium
LHTEDVLLKIRLRQGFPV

SEQ ID NO: 128814 - protein, 17 aa, Mycobacterium avium
LHTLGLPAAGEAVTLHR

SEQ ID NO: 128815 - protein, 18 aa, Mycobacterium avium
LHTLVESLDLRDLTLVGS

SEQ ID NO: 128816 - protein, 18 aa, Mycobacterium avium
LHVLARAAPRRYPPHPAP

SEQ ID NO: 128817 - protein, 17 aa, Mycobacterium avium
LHVTGTRTDALRSVATT

SEQ ID NO: 128818 - protein, 17 aa, Mycobacterium avium
LIADRLLPGGVLHVATD

SEQ ID NO: 128819 - protein, 18 aa, Mycobacterium avium
LIAGQLRYWEHTLAGMPE

SEQ ID NO: 128820 - protein, 23 aa, Mycobacterium avium
LIAPHWPKPWGLDAGPLRQLIID

SEQ ID NO: 128821 - protein, 21 aa, Mycobacterium avium
LICGGPRMVAATKAALIAKGA

SEQ ID NO: 128822 - protein, 17 aa, Mycobacterium avium
LIDRIRHTHDIPIIAAG

SEQ ID NO: 128823 - protein, 18 aa, Mycobacterium avium
LIEEKWLTPNAVIGFFPA

SEQ ID NO: 128824 - protein, 17 aa, Mycobacterium avium
LIETLTRLRDLGNTLIV

SEQ ID NO: 128825 - protein, 18 aa, Mycobacterium avium
LIGAWCFIDHYGPAHTRM

SEQ ID NO: 128826 - protein, 17 aa, Mycobacterium avium
LIGAWLTELDLLGELAD

SEQ ID NO: 128827 - protein, 19 aa, Mycobacterium avium
LIGLMKAKEYVLLGDRITP

SEQ ID NO: 128828 - protein, 27 aa, Mycobacterium avium
LIGRTQFAAMKPTAFFITTARGPVHDE

SEQ ID NO: 128829 - protein, 21 aa, Mycobacterium avium
LIGSVWVACPAPLDDAARGAL

SEQ ID NO: 128830 - protein, 19 aa, Mycobacterium avium
LIGVWNTVEAAIPALIDGG

SEQ ID NO: 128831 - protein, 19 aa, Mycobacterium avium
LIGVWNTVEAATPALIDGG

SEQ ID NO: 128832 - protein, 17 aa, Mycobacterium avium
LIIQPLIQQSIAGQVLT

SEQ ID NO: 128833 - protein, 18 aa, Mycobacterium avium
LIIRVSPGYYFPASDRPW

SEQ ID NO: 128834 - protein, 18 aa, Mycobacterium avium
LIRAMEKFDYTKGFKFST

SEQ ID NO: 128835 - protein, 19 aa, Mycobacterium avium
LIREQAFRLQFRLWELVNN

SEQ ID NO: 128836 - protein, 19 aa, Mycobacterium avium
LIRGLMNYTFWVPNGSPEY

SEQ ID NO: 128837 - protein, 17 aa, Mycobacterium avium
LISAAGERVVGSWQAGD

SEQ ID NO: 128838 - protein, 25 aa, Mycobacterium avium
LISQQPRRGFVVLPVTRRDVTDVAN

SEQ ID NO: 128839 - protein, 19 aa, Mycobacterium avium
LISSWKAYAPAWAGKVAIE

SEQ ID NO: 128840 - protein, 20 aa, Mycobacterium avium
LITAGRAWARFEHGQVVFKA

SEQ ID NO: 128841 - protein, 19 aa, Mycobacterium avium
LITIGVWHEPALASVERFA

SEQ ID NO: 128842 - protein, 19 aa, Mycobacterium avium
LITSRSPKDLPAFCSTILA

SEQ ID NO: 128843 - protein, 20 aa, Mycobacterium avium
LKAILDRTPWRAEEPVVIVA

SEQ ID NO: 128844 - protein, 17 aa, Mycobacterium avium
LKAIWNAQEWSPEGAPQ

SEQ ID NO: 128845 - protein, 18 aa, Mycobacterium avium
LKFKIRFLRVNQRHHSVA

SEQ ID NO: 128846 - protein, 20 aa, Mycobacterium avium
LKGAHFIELCDKRKVPLLFL

SEQ ID NO: 128847 - protein, 29 aa, Mycobacterium avium
LKGRFATMRHAASYWRGLSKAGEAVDGRI

SEQ ID NO: 128848 - protein, 25 aa, Mycobacterium avium
LKHTEVLPLYARLPTAEQQKVFAPH

SEQ ID NO: 128849 - protein, 26 aa, Mycobacterium avium
LKHTEVLPLYARLPTAEQQKVFAPHT

SEQ ID NO: 128850 - protein, 21 aa, Mycobacterium avium
LKIVMRVYFEKPRTTVGWKGL

SEQ ID NO: 128851 - protein, 22 aa, Mycobacterium avium
LKKLMARNPAFQSALDPGTFES

SEQ ID NO: 128852 - protein, 21 aa, Mycobacterium avium
LKKVALTRNVLLPAGTDYTPP

SEQ ID NO: 128853 - protein, 26 aa, Mycobacterium avium
LKLRELLKFEFLFSARAQFEKELADE

SEQ ID NO: 128854 - protein, 24 aa, Mycobacterium avium
LKPQLVHYYFRTMEELFLEVFRRR

SEQ ID NO: 128855 - protein, 19 aa, Mycobacterium avium
LKRLWPSLGTALMSLADGA

SEQ ID NO: 128856 - protein, 25 aa, Mycobacterium avium
LKTPVGAMALLAEALLASADDSETV

SEQ ID NO: 128857 - protein, 19 aa, Mycobacterium avium
LKTYARLSGRWHTGLPVGR

SEQ ID NO: 128858 - protein, 30 aa, Mycobacterium avium
LKVAAQFMHVLPVGWVEPVDISNAVLFLAS

SEQ ID NO: 128859 - protein, 31 aa, Mycobacterium avium
LKVAAQFMHVLPVGWVEPVDISNAVLFLASD

SEQ ID NO: 128860 - protein, 22 aa, Mycobacterium avium
LKVPLVELYALLWRVGVVEIRD

SEQ ID NO: 128861 - protein, 24 aa, Mycobacterium avium
LLADLSFDAVVLLINGVPKLLGLE

SEQ ID NO: 128862 - protein, 23 aa, Mycobacterium avium
LLAHQELTRRGLLADADLVVAGH

SEQ ID NO: 128863 - protein, 19 aa, Mycobacterium avium
LLAHSAGYVELFYGRPRTQ

SEQ ID NO: 128864 - protein, 20 aa, Mycobacterium avium
LLAHSAGYVELFYGRPRTQS

SEQ ID NO: 128865 - protein, 18 aa, Mycobacterium avium
LLALLKGPPPDSPREVII

SEQ ID NO: 128866 - protein, 17 aa, Mycobacterium avium
LLARLQADLGLAYLFIS

SEQ ID NO: 128867 - protein, 17 aa, Mycobacterium avium
LLAYLQAWRELLERWTA

SEQ ID NO: 128868 - protein, 28 aa, Mycobacterium avium
LLDATVPAPRRQWPSPMLPALQSLLDDH

SEQ ID NO: 128869 - protein, 17 aa, Mycobacterium avium
LLDDALLGEQPLVVGTR

SEQ ID NO: 128870 - protein, 18 aa, Mycobacterium avium
LLDEIDDVLEENAEDFVR

SEQ ID NO: 128871 - protein, 18 aa, Mycobacterium avium
LLDELCAAAQFRPRVAPA

SEQ ID NO: 128872 - protein, 29 aa, Mycobacterium avium
LLDHALWILVMFAWKRWPIKGARTRTGHA

SEQ ID NO: 128873 - protein, 24 aa, Mycobacterium avium
LLDPLSVTLVNQLAAWRSARLIVT

SEQ ID NO: 128874 - protein, 17 aa, Mycobacterium avium
LLEALWYSSTLGSHRVG

SEQ ID NO: 128875 - protein, 18 aa, Mycobacterium avium
LLEALWYSSTLGSHRVGT

SEQ ID NO: 128876 - protein, 17 aa, Mycobacterium avium
LLEIGRKLNIPPLATND

SEQ ID NO: 128877 - protein, 20 aa, Mycobacterium avium
LLFETGLPTRYYIDATDVDF

SEQ ID NO: 128878 - protein, 26 aa, Mycobacterium avium
LLGALDAGLPAPGVWALCHSLAFDVS

SEQ ID NO: 128879 - protein, 27 aa, Mycobacterium avium
LLGALDAGLPAPGVWALCHSLAFDVSV

SEQ ID NO: 128880 - protein, 19 aa, Mycobacterium avium
LLGDQRRARRGRAVGHLYP

SEQ ID NO: 128881 - protein, 17 aa, Mycobacterium avium
LLGIEVARRLLPGIAHV

SEQ ID NO: 128882 - protein, 29 aa, Mycobacterium avium
LLGQEGMGFIYLMQNLPQERISIAVMAAA

SEQ ID NO: 128883 - protein, 28 aa, Mycobacterium avium
LLGSVPTYALLAQRWLHVTGAGTDALRH

SEQ ID NO: 128884 - protein, 28 aa, Mycobacterium avium
LLGSVPTYALLTQRWLHVTGTRTDALRS

SEQ ID NO: 128885 - protein, 28 aa, Mycobacterium avium
LLGVPAGRKLPWFGPPMSAASMATARLM

SEQ ID NO: 128886 - protein, 32 aa, Mycobacterium avium
LLHEVLGTARLLSFPVDYASVTRLLFSRSGQA

SEQ ID NO: 128887 - protein, 18 aa, Mycobacterium avium
LLHFGSDEQKRMLLPSIR

SEQ ID NO: 128888 - protein, 20 aa, Mycobacterium avium
LLHWECIHPVPPATTATLKS

SEQ ID NO: 128889 - protein, 18 aa, Mycobacterium avium
LLIELRDVSLRRGGNVLV

SEQ ID NO: 128890 - protein, 18 aa, Mycobacterium avium
LLIGVGAFAPMALAVARR

SEQ ID NO: 128891 - protein, 18 aa, Mycobacterium avium
LLLDRFNLRRSDLIAALK

SEQ ID NO: 128892 - protein, 18 aa, Mycobacterium avium
LLLGIVMAVRLEPVWGRR

SEQ ID NO: 128893 - protein, 18 aa, Mycobacterium avium
LLLNVPSFAICCATILDM

SEQ ID NO: 128894 - protein, 18 aa, Mycobacterium avium
LLLTLAGRFKPSHGTLTV

SEQ ID NO: 128895 - protein, 24 aa, Mycobacterium avium
LLNGPRYWLMNGIEKQPQGPRITK

SEQ ID NO: 128896 - protein, 25 aa, Mycobacterium avium
LLNGPRYWLMNGIEKQPQGPRITKT

SEQ ID NO: 128897 - protein, 18 aa, Mycobacterium avium
LLNMVLGLIPSATGRLEI

SEQ ID NO: 128898 - protein, 18 aa, Mycobacterium avium
LLNRCERLRRRLPAIEHP

SEQ ID NO: 128899 - protein, 18 aa, Mycobacterium avium
LLPDDGWFAGHRLARDFS

SEQ ID NO: 128900 - protein, 25 aa, Mycobacterium avium
LLPPVEVSEYLGLRPTWVDATNVGG

SEQ ID NO: 128901 - protein, 20 aa, Mycobacterium avium
LLPRERLKRITAHSLGSRAA

SEQ ID NO: 128902 - protein, 22 aa, Mycobacterium avium
LLPYERSSCFWQRIAYLYSRFD

SEQ ID NO: 128903 - protein, 19 aa, Mycobacterium avium
LLQAWRPALAAAGNAKVVV

SEQ ID NO: 128904 - protein, 17 aa, Mycobacterium avium
LLQFVPDIPADGYQPVL

SEQ ID NO: 128905 - protein, 18 aa, Mycobacterium avium
LLQLAYELEEARPWARIQ

SEQ ID NO: 128906 - protein, 31 aa, Mycobacterium avium
LLQLPNGCQFAVALFALLRAGAIPVMCLPGH

SEQ ID NO: 128907 - protein, 29 aa, Mycobacterium avium
LLQTGSLRVNFLRPFFAGTESRYEGTTMR

SEQ ID NO: 128908 - protein, 20 aa, Mycobacterium avium
LLRDGFRWFAQCLEIRSAAA

SEQ ID NO: 128909 - protein, 18 aa, Mycobacterium avium
LLRDTRLFEAAAALPQPA

SEQ ID NO: 128910 - protein, 19 aa, Mycobacterium avium
LLRISDLAHLLRLPGPYEA

SEQ ID NO: 128911 - protein, 20 aa, Mycobacterium avium
LLRRSVRRFSAEPVPAELVR

SEQ ID NO: 128912 - protein, 29 aa, Mycobacterium avium
LLRSRRLMRAPIWIYRARGGAVFGSRILL

SEQ ID NO: 128913 - protein, 21 aa, Mycobacterium avium
LLRYEPLGVVAAMTPWNFPHT

SEQ ID NO: 128914 - protein, 25 aa, Mycobacterium avium
LLSALDLPLITGAGLVRPVLGPPPD

SEQ ID NO: 128915 - protein, 25 aa, Mycobacterium avium
LLSAPAIKLLIHRAGARSSDIAAEL

SEQ ID NO: 128916 - protein, 20 aa, Mycobacterium avium
LLSGRAALLGLRRAGQVSPG

SEQ ID NO: 128917 - protein, 17 aa, Mycobacterium avium
LLSHAGGFVPYASHRMA

SEQ ID NO: 128918 - protein, 18 aa, Mycobacterium avium
LLSKVFTRGIITWGIRDA

SEQ ID NO: 128919 - protein, 19 aa, Mycobacterium avium
LLTFLACFDVGDRVALASP

SEQ ID NO: 128920 - protein, 18 aa, Mycobacterium avium
LLTHYMPAHYSAGWWMDS

SEQ ID NO: 128921 - protein, 18 aa, Mycobacterium avium
LLTNVYIAAYRNPFLGAK

SEQ ID NO: 128922 - protein, 22 aa, Mycobacterium avium
LLTQHYGAAVLGPYGTKRSLPQ

SEQ ID NO: 128923 - protein, 19 aa, Mycobacterium avium
LLTQLLPRTAAVTDISIDL

SEQ ID NO: 128924 - protein, 20 aa, Mycobacterium avium
LLTQRYGAAVLGPYGTKRSL

SEQ ID NO: 128925 - protein, 17 aa, Mycobacterium avium
LLTRYDSVYPYDSSGRV

SEQ ID NO: 128926 - protein, 18 aa, Mycobacterium avium
LMAILVRGMDGGETAAWT

SEQ ID NO: 128927 - protein, 17 aa, Mycobacterium avium
LMAKFNATIDERADPKV

SEQ ID NO: 128928 - protein, 31 aa, Mycobacterium avium
LMAVNCTIAMVDWLFSGKLMQFPGLKLAFAE

SEQ ID NO: 128929 - protein, 31 aa, Mycobacterium avium
LMEDAWWGPTVPLVGAPWFALSERNSPGSII

SEQ ID NO: 128930 - protein, 19 aa, Mycobacterium avium
LMERFGVSRPTLREAFRVL

SEQ ID NO: 128931 - protein, 20 aa, Mycobacterium avium
LMHMLYSMIMVSFPVECWKQ

SEQ ID NO: 128932 - protein, 17 aa, Mycobacterium avium
LMHTTFAMLHSLCGLNG

SEQ ID NO: 128933 - protein, 17 aa, Mycobacterium avium
LMLARKANRHFSFGIGV

SEQ ID NO: 128934 - protein, 19 aa, Mycobacterium avium
LMMANRIEFYPLAIGAQHL

SEQ ID NO: 128935 - protein, 17 aa, Mycobacterium avium
LMMANRIEFYPLEIGAQ

SEQ ID NO: 128936 - protein, 18 aa, Mycobacterium avium
LMMANRIEFYPLEIGAQH

SEQ ID NO: 128937 - protein, 27 aa, Mycobacterium avium
LMQPNATALRFLGKGLTWGELHGRVRA

SEQ ID NO: 128938 - protein, 28 aa, Mycobacterium avium
LMQPNATALRFLGKGLTWGELHGRVRAL

SEQ ID NO: 128939 - protein, 19 aa, Mycobacterium avium
LMQVLLTGNRFKPAKAQQV

SEQ ID NO: 128940 - protein, 28 aa, Mycobacterium avium
LMRIPHMVNLYRYRGMYGLPSRATVSTS

SEQ ID NO: 128941 - protein, 18 aa, Mycobacterium avium
LMTDTKTILLCRPGANSP

SEQ ID NO: 128942 - protein, 18 aa, Mycobacterium avium
LMTTMHEHGLWATADIYP

SEQ ID NO: 128943 - protein, 17 aa, Mycobacterium avium
LNALLDPSPTLVIHDGV

SEQ ID NO: 128944 - protein, 17 aa, Mycobacterium avium
LNAVFSNALNLPMNAKV

SEQ ID NO: 128945 - protein, 27 aa, Mycobacterium avium
LNELGWTLRRPPLPPTGQHWRLLSTVK

SEQ ID NO: 128946 - protein, 17 aa, Mycobacterium avium
LNFQTMVADLTGLEIAN

SEQ ID NO: 128947 - protein, 17 aa, Mycobacterium avium
LNGLERYLRTVASLSHA

SEQ ID NO: 128948 - protein, 20 aa, Mycobacterium avium
LNIFPTPRWHDGDGGRYIGT

SEQ ID NO: 128949 - protein, 19 aa, Mycobacterium avium
LNNRRGFYLLAGQKLSGSH

SEQ ID NO: 128950 - protein, 21 aa, Mycobacterium avium
LNNRRGFYLLAGQKLSGSHRL

SEQ ID NO: 128951 - protein, 20 aa, Mycobacterium avium
LNPFALLASQGVPLALGSDA

SEQ ID NO: 128952 - protein, 23 aa, Mycobacterium avium
LNPSFYTVMLKQNTGLAYFSNGI

SEQ ID NO: 128953 - protein, 17 aa, Mycobacterium avium
LNRCERLRRRLPAIEHP

SEQ ID NO: 128954 - protein, 23 aa, Mycobacterium avium
LNRRNRLFWPTTCTVVEIIPDRK

SEQ ID NO: 128955 - protein, 24 aa, Mycobacterium avium
LNRRSPIFGGWVTGPTLLGPEEFA

SEQ ID NO: 128956 - protein, 18 aa, Mycobacterium avium
LNRRYTFDTFVIGASNRF

SEQ ID NO: 128957 - protein, 19 aa, Mycobacterium avium
LNSAPMYRQFRPDLEAPSR

SEQ ID NO: 128958 - protein, 29 aa, Mycobacterium avium
LNSLLERQLLDELCLTIAPYLVGGHARRI

SEQ ID NO: 128959 - protein, 18 aa, Mycobacterium avium
LNTIRRLHPALQQLRTIH

SEQ ID NO: 128960 - protein, 18 aa, Mycobacterium avium
LNVGPNQPYLWAGNEPSF

SEQ ID NO: 128961 - protein, 32 aa, Mycobacterium avium
LPAAAAVDLPAAPYLHVFLARGRADIEDVGEL

SEQ ID NO: 128962 - protein, 30 aa, Mycobacterium avium
LPAAAAVDLPAAPYLHVFLARGRADVEGVG

SEQ ID NO: 128963 - protein, 25 aa, Mycobacterium avium
LPADVPRTWILTTRDRALSVASQHA

SEQ ID NO: 128964 - protein, 24 aa, Mycobacterium avium
LPAFMIRAFCDLAERHPWQETRPG

SEQ ID NO: 128965 - protein, 19 aa, Mycobacterium avium
LPAFRGPRRLSRSKPMKTA

SEQ ID NO: 128966 - protein, 17 aa, Mycobacterium avium
LPAIYVPLPIGNGEQRL

SEQ ID NO: 128967 - protein, 18 aa, Mycobacterium avium
LPAIYVPLPIGNGEQRLN

SEQ ID NO: 128968 - protein, 18 aa, Mycobacterium avium
LPALERLHRALLAGKPAP

SEQ ID NO: 128969 - protein, 18 aa, Mycobacterium avium
LPAPGPVTRYDIPTGPGV

SEQ ID NO: 128970 - protein, 17 aa, Mycobacterium avium
LPAPSAPADLAAPGPPG

SEQ ID NO: 128971 - protein, 19 aa, Mycobacterium avium
LPAQLPPPTHRYMVIYELD

SEQ ID NO: 128972 - protein, 25 aa, Mycobacterium avium
LPAVRQRWPDVPPLRVRPRRAATAA

SEQ ID NO: 128973 - protein, 37 aa, Mycobacterium avium
LPDRESMWTAYRQSPAWGFCMWAIAPDQMYSVEVVGA

SEQ ID NO: 128974 - protein, 34 aa, Mycobacterium avium
LPDSHFGFGILTWHLPILFRTPPGYNLLVRGPAN

SEQ ID NO: 128975 - protein, 26 aa, Mycobacterium avium
LPELDVYASYLTFDRARPLPLDEIIG

SEQ ID NO: 128976 - protein, 21 aa, Mycobacterium avium
LPERYAAALRAGRPPVVGRLE

SEQ ID NO: 128977 - protein, 24 aa, Mycobacterium avium
LPFRAPKHWSALEPVLRDVGRDHS

SEQ ID NO: 128978 - protein, 25 aa, Mycobacterium avium
LPGAVIRRGVYYRYRLLWRNSCGGV

SEQ ID NO: 128979 - protein, 20 aa, Mycobacterium avium
LPGGLRWVAVHQPDGYHPPR

SEQ ID NO: 128980 - protein, 22 aa, Mycobacterium avium
LPGGTEVTLRFADGEVVTMQVI

SEQ ID NO: 128981 - protein, 17 aa, Mycobacterium avium
LPGIDWPAVRSEAERSL

SEQ ID NO: 128982 - protein, 17 aa, Mycobacterium avium
LPGLATVRDLAFRASPV

SEQ ID NO: 128983 - protein, 17 aa, Mycobacterium avium
LPGMDWPAVRSEAERSL

SEQ ID NO: 128984 - protein, 27 aa, Mycobacterium avium
LPGPPPGAAPLPGPPPGAAPLPDAGLG

SEQ ID NO: 128985 - protein, 29 aa, Mycobacterium avium
LPGPPPGAAPLPGPPPGAAPLPGPPPGAA

SEQ ID NO: 128986 - protein, 17 aa, Mycobacterium avium
LPGVPMTLRQGRLRGRA

SEQ ID NO: 128987 - protein, 20 aa, Mycobacterium avium
LPHGCIVHFAVDLIIADVTS

SEQ ID NO: 128988 - protein, 18 aa, Mycobacterium avium
LPHRLTTADATAFNISEF

SEQ ID NO: 128989 - protein, 22 aa, Mycobacterium avium
LPIPINIFLQKSVDPSKILYSE

SEQ ID NO: 128990 - protein, 19 aa, Mycobacterium avium
LPLFSVVNKPFEANLRDAG

SEQ ID NO: 128991 - protein, 20 aa, Mycobacterium avium
LPLLVIHGGPGLPHDYLRSL

SEQ ID NO: 128992 - protein, 17 aa, Mycobacterium avium
LPLQHPIVLAKALATAD

SEQ ID NO: 128993 - protein, 28 aa, Mycobacterium avium
LPLSASQLRSWFAYRMDGPSPVNNIPFA

SEQ ID NO: 128994 - protein, 19 aa, Mycobacterium avium
LPMLKAPFERHELRGGYSI

SEQ ID NO: 128995 - protein, 18 aa, Mycobacterium avium
LPNDYQLPAGLAGVQAAQ

SEQ ID NO: 128996 - protein, 28 aa, Mycobacterium avium
LPNLATVPAALPRTPALSASPTGLGRID

SEQ ID NO: 128997 - protein, 18 aa, Mycobacterium avium
LPNVPSPLSRLAVSAFWC

SEQ ID NO: 128998 - protein, 21 aa, Mycobacterium avium
LPPTVPGWRSRAERFDMAVLE

SEQ ID NO: 128999 - protein, 19 aa, Mycobacterium avium
LPQRLGAVHAAREAARHPD

SEQ ID NO: 129000 - protein, 27 aa, Mycobacterium avium
LPRDKRMEIALTYIYGVGRTRSNEILA

SEQ ID NO: 129001 - protein, 18 aa, Mycobacterium avium
LPRGFLLHRCRQTQHCDV

SEQ ID NO: 129002 - protein, 20 aa, Mycobacterium avium
LPRTVTFKVLKRQLAAQGVD

SEQ ID NO: 129003 - protein, 25 aa, Mycobacterium avium
LPTAFARFAAFRRRRVRRIVGESAL

SEQ ID NO: 129004 - protein, 18 aa, Mycobacterium avium
LPTAGLPFQFQTWAEFEG

SEQ ID NO: 129005 - protein, 18 aa, Mycobacterium avium
LPTMPPWHHQENKWRAAR

SEQ ID NO: 129006 - protein, 17 aa, Mycobacterium avium
LPVAAAPEFRTLIRGPL

SEQ ID NO: 129007 - protein, 25 aa, Mycobacterium avium
LPVAAAPEFRTLIRGPLDTDRLGAE

SEQ ID NO: 129008 - protein, 20 aa, Mycobacterium avium
LPVFCIDYRLAPKHRFPTAA

SEQ ID NO: 129009 - protein, 19 aa, Mycobacterium avium
LPVFGPFWDRDAQLPTAGG

SEQ ID NO: 129010 - protein, 35 aa, Mycobacterium avium
LPVGVVGAIVPWNTPLFIAALKLGPALAAGCTVVL

SEQ ID NO: 129011 - protein, 18 aa, Mycobacterium avium
LPVHECWDLLRGLTLGRL

SEQ ID NO: 129012 - protein, 24 aa, Mycobacterium avium
LPVHFVQMWVIPDEAGIDPSYQQH

SEQ ID NO: 129013 - protein, 18 aa, Mycobacterium avium
LPVLADPGAVPPPSLDVG

SEQ ID NO: 129014 - protein, 23 aa, Mycobacterium avium
LPVQYVDYTLWQRAQFGDLDDPG

SEQ ID NO: 129015 - protein, 24 aa, Mycobacterium avium
LPVQYVDYTLWQRAQFGELADSGS

SEQ ID NO: 129016 - protein, 26 aa, Mycobacterium avium
LQAFGLLTDVPLTVLALGGEALGSAA

SEQ ID NO: 129017 - protein, 23 aa, Mycobacterium avium
LQAFIGRMSGVPPAAWGGLAAAR

SEQ ID NO: 129018 - protein, 24 aa, Mycobacterium avium
LQAGSPFQISQLAEAFHAAGRCTA

SEQ ID NO: 129019 - protein, 24 aa, Mycobacterium avium
LQAGSPFRISQLAEAFHAAGRCTA

SEQ ID NO: 129020 - protein, 18 aa, Mycobacterium avium
LQAILAKIRRQHAELFGA

SEQ ID NO: 129021 - protein, 17 aa, Mycobacterium avium
LQCLAAHDWDGLADTIA

SEQ ID NO: 129022 - protein, 23 aa, Mycobacterium avium
LQDDLVLHYLLDLTNDEQKQRWL

SEQ ID NO: 129023 - protein, 27 aa, Mycobacterium avium
LQDRNETLFYRVLLDHIPEALPIVYTP

SEQ ID NO: 129024 - protein, 26 aa, Mycobacterium avium
LQEIDHVPFVAPLARFAATAQSADDA

SEQ ID NO: 129025 - protein, 25 aa, Mycobacterium avium
LQGAWAQLLTWLTGQHDVAFGTAVS

SEQ ID NO: 129026 - protein, 19 aa, Mycobacterium avium
LQGPWRDYVGWALNIEQVS

SEQ ID NO: 129027 - protein, 17 aa, Mycobacterium avium
LQIAPGTDLALLNGLLH

SEQ ID NO: 129028 - protein, 18 aa, Mycobacterium avium
LQIRLDWDRGFELIAPTA

SEQ ID NO: 129029 - protein, 27 aa, Mycobacterium avium
LQIRTGAPLLLLHRLTHLRDGTPFDLE

SEQ ID NO: 129030 - protein, 19 aa, Mycobacterium avium
LQKLTWIPGARYRDGFFAA

SEQ ID NO: 129031 - protein, 27 aa, Mycobacterium avium
LQLMSNPNLMFPQTPLSIGAKQGTDMV

SEQ ID NO: 129032 - protein, 24 aa, Mycobacterium avium
LQNRLPCIYLVDSGGAFLPRQDEV

SEQ ID NO: 129033 - protein, 35 aa, Mycobacterium avium
LQPGLRRLHDITGRPTYGVLPYADGLWLDAEDSLS

SEQ ID NO: 129034 - protein, 27 aa, Mycobacterium avium
LQPWDRDQIHRLFDDLEFRMLRDRLFE

SEQ ID NO: 129035 - protein, 17 aa, Mycobacterium avium
LQRIAALCAAFDVDGMR

SEQ ID NO: 129036 - protein, 25 aa, Mycobacterium avium
LQRLLQRYRVLFFRGQQLSTAHQIE

SEQ ID NO: 129037 - protein, 23 aa, Mycobacterium avium
LQRPARWMQLLAKESHTFSAAPN

SEQ ID NO: 129038 - protein, 18 aa, Mycobacterium avium
LQSEPMYRVFRPDLENPT

SEQ ID NO: 129039 - protein, 21 aa, Mycobacterium avium
LQSPMDISRPLWTATLVDGLA

SEQ ID NO: 129040 - protein, 23 aa, Mycobacterium avium
LQSPMDISRPLWTATLVDGLADG

SEQ ID NO: 129041 - protein, 17 aa, Mycobacterium avium
LQTARMAGLRAPSSCEI

SEQ ID NO: 129042 - protein, 32 aa, Mycobacterium avium
LQVLDGSFRPSGWTRLWRLGLGSSGPHHRGGG

SEQ ID NO: 129043 - protein, 20 aa, Mycobacterium avium
LQVLEELAARWAAVAVAVSV

SEQ ID NO: 129044 - protein, 30 aa, Mycobacterium avium
LQYKAIVAAERLIPRTLMRAITKRVGGGRG

SEQ ID NO: 129045 - protein, 23 aa, Mycobacterium avium
LRAARLLMYQAAWNADLGRNVRV

SEQ ID NO: 129046 - protein, 26 aa, Mycobacterium avium
LRALPAPEILSFLYLEARLADEGRYS

SEQ ID NO: 129047 - protein, 30 aa, Mycobacterium avium
LRALPDGLTYGLLRYLNPQAGLDVSDPAIA

SEQ ID NO: 129048 - protein, 18 aa, Mycobacterium avium
LRALRINLSVRGYEVVTA

SEQ ID NO: 129049 - protein, 19 aa, Mycobacterium avium
LRARRAHRLSNTGALWLGG

SEQ ID NO: 129050 - protein, 22 aa, Mycobacterium avium
LRARVLKRWSVAPGTPPVTVVQ

SEQ ID NO: 129051 - protein, 17 aa, Mycobacterium avium
LRAVLLRCGAEEHLLVA

SEQ ID NO: 129052 - protein, 17 aa, Mycobacterium avium
LRAWAYLSRVAEPPCPG

SEQ ID NO: 129053 - protein, 18 aa, Mycobacterium avium
LRDALAVHRAFDALGAAA

SEQ ID NO: 129054 - protein, 20 aa, Mycobacterium avium
LRDELGDVLLQVLFHARIAE

SEQ ID NO: 129055 - protein, 19 aa, Mycobacterium avium
LRDEPAWVTIARHAGRQPA

SEQ ID NO: 129056 - protein, 21 aa, Mycobacterium avium
LRDEPRWPRYAPAAVEHGVLS

SEQ ID NO: 129057 - protein, 24 aa, Mycobacterium avium
LRDNGYLPMTFTANDIAWSDQNPS

SEQ ID NO: 129058 - protein, 21 aa, Mycobacterium avium
LRDRAFYAPAQSRYRVFIVDE

SEQ ID NO: 129059 - protein, 25 aa, Mycobacterium avium
LREAQQCVFSFQDGPRGKVWDSNPP

SEQ ID NO: 129060 - protein, 27 aa, Mycobacterium avium
LREDIVTPLFSIYVSPRIRAAIGTIAG

SEQ ID NO: 129061 - protein, 25 aa, Mycobacterium avium
LREENPQLPVLLLTAKDAVEDRIAG

SEQ ID NO: 129062 - protein, 32 aa, Mycobacterium avium
LREGDRYLQINPYFHTFGLKAGLITSFLRGAT

SEQ ID NO: 129063 - protein, 18 aa, Mycobacterium avium
LREGPLIRLAGAKGFRVI

SEQ ID NO: 129064 - protein, 34 aa, Mycobacterium avium
LREHMLRSAYQRWLNLGFAVRADWLAREHPWLLR

SEQ ID NO: 129065 - protein, 20 aa, Mycobacterium avium
LREQFPLLDRGRDALRLLRE

SEQ ID NO: 129066 - protein, 28 aa, Mycobacterium avium
LREQHAAVLFYVPAVLRALVEYQRESTE

SEQ ID NO: 129067 - protein, 18 aa, Mycobacterium avium
LREVLARYGPQDPVHRAV

SEQ ID NO: 129068 - protein, 17 aa, Mycobacterium avium
LRGATVVRGYLGDPAIT

SEQ ID NO: 129069 - protein, 32 aa, Mycobacterium avium
LRGDRMWEFLDRLTSIALPRIRDFRGLSSKQF

SEQ ID NO: 129070 - protein, 18 aa, Mycobacterium avium
LRGGWLLRDPVRKTYHLG

SEQ ID NO: 129071 - protein, 20 aa, Mycobacterium avium
LRGRRIVIIDDVLATGGTLA

SEQ ID NO: 129072 - protein, 20 aa, Mycobacterium avium
LRGTWLGVREAAAVMRERKT

SEQ ID NO: 129073 - protein, 19 aa, Mycobacterium avium
LRGVLVVSPHTSWLDVFAI

SEQ ID NO: 129074 - protein, 20 aa, Mycobacterium avium
LRGYLPDVTPTQRRKRVLAE

SEQ ID NO: 129075 - protein, 24 aa, Mycobacterium avium
LRHSTVLDLIDRLLAKLRGTKPGL

SEQ ID NO: 129076 - protein, 19 aa, Mycobacterium avium
LRHWLRTYVEFYDRYSGCI

SEQ ID NO: 129077 - protein, 19 aa, Mycobacterium avium
LRKIDYSHIPPLRISARYA

SEQ ID NO: 129078 - protein, 27 aa, Mycobacterium avium
LRKVARFLPRGYALHRGLKLQRAIMNL

SEQ ID NO: 129079 - protein, 33 aa, Mycobacterium avium
LRLDRLLRLKVFPLAISLPWGIAPAALPQLPLP

SEQ ID NO: 129080 - protein, 19 aa, Mycobacterium avium
LRLELYPEQLQYIPANVTA

SEQ ID NO: 129081 - protein, 22 aa, Mycobacterium avium
LRLGHLLGQAILRSARRHEAAD

SEQ ID NO: 129082 - protein, 17 aa, Mycobacterium avium
LRLLLGHPAYAQGRLAI

SEQ ID NO: 129083 - protein, 18 aa, Mycobacterium avium
LRLLLREVFTAAGGSHDD

SEQ ID NO: 129084 - protein, 28 aa, Mycobacterium avium
LRLRDGRWYWHWDPAFMASPTDLPVQRD

SEQ ID NO: 129085 - protein, 20 aa, Mycobacterium avium
LRLRTLVSKGFTPRRIRELE

SEQ ID NO: 129086 - protein, 27 aa, Mycobacterium avium
LRLSMYVLNSAFYKPALLSRDMQALDL

SEQ ID NO: 129087 - protein, 20 aa, Mycobacterium avium
LRLTIPVAEKAKPRRIEINH

SEQ ID NO: 129088 - protein, 17 aa, Mycobacterium avium
LRMINRMIEPRPAPSAS

SEQ ID NO: 129089 - protein, 17 aa, Mycobacterium avium
LRMLAAQLGSDVPFALH

SEQ ID NO: 129090 - protein, 19 aa, Mycobacterium avium
LRNAELAHIFTKEAKTFGI

SEQ ID NO: 129091 - protein, 19 aa, Mycobacterium avium
LRNPRPAGPAPWKPMVSLS

SEQ ID NO: 129092 - protein, 40 aa, Mycobacterium avium
LRPAPPPELLAEPGRWAYYPWRRAVVAVLGPRGYRAVRLD

SEQ ID NO: 129093 - protein, 23 aa, Mycobacterium avium
LRPDVLLTRLVRRDGLLHFSTEV

SEQ ID NO: 129094 - protein, 21 aa, Mycobacterium avium
LRPEFRKFAQPMRWFGTTESR

SEQ ID NO: 129095 - protein, 17 aa, Mycobacterium avium
LRPGDVLYLPRGQVHSA

SEQ ID NO: 129096 - protein, 22 aa, Mycobacterium avium
LRPNHTFRLPGADVPIIMVGPG

SEQ ID NO: 129097 - protein, 20 aa, Mycobacterium avium
LRQAIRDAAQLRSNEGNPLL

SEQ ID NO: 129098 - protein, 17 aa, Mycobacterium avium
LRQLLDNGELIVAPGVF

SEQ ID NO: 129099 - protein, 19 aa, Mycobacterium avium
LRQVARAVEPPLLDAGGHI

SEQ ID NO: 129100 - protein, 19 aa, Mycobacterium avium
LRQYLAERNALPDSSLVAS

SEQ ID NO: 129101 - protein, 18 aa, Mycobacterium avium
LRRAAPGVRLVAMGGATE

SEQ ID NO: 129102 - protein, 20 aa, Mycobacterium avium
LRRDMLLSTLSVRLMHIMSP

SEQ ID NO: 129103 - protein, 23 aa, Mycobacterium avium
LRRLGELAVRIKYLEVLCQRSIS

SEQ ID NO: 129104 - protein, 24 aa, Mycobacterium avium
LRRNSRRCALSYVARLTSSPTPQM

SEQ ID NO: 129105 - protein, 17 aa, Mycobacterium avium
LRRQLACALGQLRDDTG

SEQ ID NO: 129106 - protein, 17 aa, Mycobacterium avium
LRRRGLLLAVVTNQSGV

SEQ ID NO: 129107 - protein, 17 aa, Mycobacterium avium
LRRRPELAGLPVIVGGN

SEQ ID NO: 129108 - protein, 18 aa, Mycobacterium avium
LRSIHRAAAPGASLFILV

SEQ ID NO: 129109 - protein, 26 aa, Mycobacterium avium
LRSLPDPLSYGLLRYLNPGVDLDGDD

SEQ ID NO: 129110 - protein, 31 aa, Mycobacterium avium
LRSPKARFLPTRLAAIPALLADVLRPDVLLT

SEQ ID NO: 129111 - protein, 24 aa, Mycobacterium avium
LRSRGVPPTRLRLIYLADGQVLDY

SEQ ID NO: 129112 - protein, 17 aa, Mycobacterium avium
LRSWRPYVTGEISSYPV

SEQ ID NO: 129113 - protein, 37 aa, Mycobacterium avium
LRTILRLSPEAVFKPRWLWKFGKTLWPPELRVPNQGR

SEQ ID NO: 129114 - protein, 20 aa, Mycobacterium avium
LRTLWRMDLARDRRLKRLRT

SEQ ID NO: 129115 - protein, 19 aa, Mycobacterium avium
LRTRLFAAPGWVVSPGVVK

SEQ ID NO: 129116 - protein, 20 aa, Mycobacterium avium
LRVIRAVWTGDDISFEGRHF

SEQ ID NO: 129117 - protein, 22 aa, Mycobacterium avium
LRVLDAIGRPVTIIGASMGGLT

SEQ ID NO: 129118 - protein, 20 aa, Mycobacterium avium
LRVPRHPVRLAQFGPRALLP

SEQ ID NO: 129119 - protein, 28 aa, Mycobacterium avium
LRVVSPDAFFQFPTSKYGLALDNWSIRR

SEQ ID NO: 129120 - protein, 18 aa, Mycobacterium avium
LRYAYPYSGRLGALCPTP

SEQ ID NO: 129121 - protein, 29 aa, Mycobacterium avium
LSAAALHRTAWIDDWLPAELNRAGRDKAR

SEQ ID NO: 129122 - protein, 25 aa, Mycobacterium avium
LSAAPPGQPTWYRGAARISDLVEQI

SEQ ID NO: 129123 - protein, 18 aa, Mycobacterium avium
LSALDFDLSVYDTFGALG

SEQ ID NO: 129124 - protein, 25 aa, Mycobacterium avium
LSALTYANLTRWLRGRERMHDAAMG

SEQ ID NO: 129125 - protein, 39 aa, Mycobacterium avium
LSAPPKPVQIIASLLPPAVKWKAFFNAQAKNPKYLRDGD

SEQ ID NO: 129126 - protein, 26 aa, Mycobacterium avium
LSDEEAVGLCFLFVLAGLDTVMDALG

SEQ ID NO: 129127 - protein, 20 aa, Mycobacterium avium
LSDILPIYPTVDSALSGADR

SEQ ID NO: 129128 - protein, 54 aa, Mycobacterium avium
LSDIRAFFHTNSVPLYFISPTPFNLLGIDRWIRNFFYLTYFDSFEGIHSRVFVP

SEQ ID NO: 129129 - protein, 24 aa, Mycobacterium avium
LSEARYGIIWGARGAARSAWQAAL

SEQ ID NO: 129130 - protein, 18 aa, Mycobacterium avium
LSEFEELLGPRTKLVAAS

SEQ ID NO: 129131 - protein, 25 aa, Mycobacterium avium
LSELAPLHNPPALLGIEVARRLLPG

SEQ ID NO: 129132 - protein, 18 aa, Mycobacterium avium
LSELWFDALAGICTHVRA

SEQ ID NO: 129133 - protein, 24 aa, Mycobacterium avium
LSETQWRAPSPLPGWDVKAVVSHM

SEQ ID NO: 129134 - protein, 30 aa, Mycobacterium avium
LSGAFNVTRAVWPIMRAQNYGRIVQTTSGT

SEQ ID NO: 129135 - protein, 25 aa, Mycobacterium avium
LSGELRQRQIGVGWAALRSRPPAAA

SEQ ID NO: 129136 - protein, 25 aa, Mycobacterium avium
LSGQERPFPLDLVPRVISAAEWARL

SEQ ID NO: 129137 - protein, 29 aa, Mycobacterium avium
LSGSHRLGHACVLAFLDVDGLKQVNDEQG

SEQ ID NO: 129138 - protein, 17 aa, Mycobacterium avium
LSGVRRLVSSLRGLRVV

SEQ ID NO: 129139 - protein, 28 aa, Mycobacterium avium
LSGVRVLEVAAWTFVPSAGAVLAEWGAE

SEQ ID NO: 129140 - protein, 18 aa, Mycobacterium avium
LSHLAILRTHPDLDVVGV

SEQ ID NO: 129141 - protein, 21 aa, Mycobacterium avium
LSIFGMPPLEFISLTAELGCH

SEQ ID NO: 129142 - protein, 18 aa, Mycobacterium avium
LSKIARLVDLYAKRPQVQ

SEQ ID NO: 129143 - protein, 18 aa, Mycobacterium avium
LSLLLRRTIDPDRPLSDY

SEQ ID NO: 129144 - protein, 25 aa, Mycobacterium avium
LSNVTLTFINGLLQRLVHGDRIVDS

SEQ ID NO: 129145 - protein, 18 aa, Mycobacterium avium
LSPFVTWGTNPGQGVPLA

SEQ ID NO: 129146 - protein, 19 aa, Mycobacterium avium
LSPHWIALDPEGAGATWGG

SEQ ID NO: 129147 - protein, 25 aa, Mycobacterium avium
LSQMEIFTLLGYWNTPRAQISLVAT

SEQ ID NO: 129148 - protein, 17 aa, Mycobacterium avium
LSQQTQFLNWRPRSRAA

SEQ ID NO: 129149 - protein, 32 aa, Mycobacterium avium
LSQVIGQALRRPLHPGRPPWECWVIEGLRGNR

SEQ ID NO: 129150 - protein, 24 aa, Mycobacterium avium
LSRDFDIHLIDFPGYGLSDKPPEP

SEQ ID NO: 129151 - protein, 23 aa, Mycobacterium avium
LSRDFDIHLIDFPGYGLSDKPSE

SEQ ID NO: 129152 - protein, 24 aa, Mycobacterium avium
LSRDFDIHLLDFPGYGLSDKPPEP

SEQ ID NO: 129153 - protein, 22 aa, Mycobacterium avium
LSRTVGWFTAKYPVALRLGGLS

SEQ ID NO: 129154 - protein, 25 aa, Mycobacterium avium
LSSGPGPGPLLASAGAWSSLCTEYA

SEQ ID NO: 129155 - protein, 20 aa, Mycobacterium avium
LSSMWAGPLCGQLLARAGAT

SEQ ID NO: 129156 - protein, 18 aa, Mycobacterium avium
LSVFFFDILHCDGVDLLD

SEQ ID NO: 129157 - protein, 27 aa, Mycobacterium avium
LSVQMFGLTLPSPVFMAPIGVIGICAQ

SEQ ID NO: 129158 - protein, 22 aa, Mycobacterium avium
LSVRLLPSATTATSWWPPSAGP

SEQ ID NO: 129159 - protein, 20 aa, Mycobacterium avium
LSYGLDEACLLIFGRRDLSA

SEQ ID NO: 129160 - protein, 24 aa, Mycobacterium avium
LTAARALGRYGVCANAICPRARTA

SEQ ID NO: 129161 - protein, 22 aa, Mycobacterium avium
LTAHLPSARRLLLFKVDGSVSV

SEQ ID NO: 129162 - protein, 21 aa, Mycobacterium avium
LTAMLKPDRLALRELITQRDR

SEQ ID NO: 129163 - protein, 23 aa, Mycobacterium avium
LTARQQPLVAILWGRDASTLKPI

SEQ ID NO: 129164 - protein, 18 aa, Mycobacterium avium
LTARWADAGVEPLFAASF

SEQ ID NO: 129165 - protein, 19 aa, Mycobacterium avium
LTASRFVACPFGRPGARMY

SEQ ID NO: 129166 - protein, 17 aa, Mycobacterium avium
LTATRFVANPYGGDPGS

SEQ ID NO: 129167 - protein, 27 aa, Mycobacterium avium
LTAVAMLVAIFRARPSPFYIMDEVEAA

SEQ ID NO: 129168 - protein, 22 aa, Mycobacterium avium
LTDAFSRMIIGWRVASHMRTTV

SEQ ID NO: 129169 - protein, 24 aa, Mycobacterium avium
LTDALDRIMLAELASLFDEPVDAI

SEQ ID NO: 129170 - protein, 18 aa, Mycobacterium avium
LTDHRIALCGNLSGGQRT

SEQ ID NO: 129171 - protein, 19 aa, Mycobacterium avium
LTDHRIALCGNLSGGQRTR

SEQ ID NO: 129172 - protein, 19 aa, Mycobacterium avium
LTDPILTSKHHRLLHTLNP

SEQ ID NO: 129173 - protein, 37 aa, Mycobacterium avium
LTDVKLLARLFGLPYFPVTPLFPLAGPIGLVPLPSKW

SEQ ID NO: 129174 - protein, 17 aa, Mycobacterium avium
LTDWLTAVADGIALLTR

SEQ ID NO: 129175 - protein, 17 aa, Mycobacterium avium
LTEDDLLRTELFRTKAG

SEQ ID NO: 129176 - protein, 23 aa, Mycobacterium avium
LTEDQLWAWCKQAVTPPASDVKA

SEQ ID NO: 129177 - protein, 19 aa, Mycobacterium avium
LTEVKLEPLFGIPLTLMTT

SEQ ID NO: 129178 - protein, 24 aa, Mycobacterium avium
LTGDPSFAELLALVQARSLAAFEH

SEQ ID NO: 129179 - protein, 21 aa, Mycobacterium avium
LTGDYLAELTMLILGRDRMKH

SEQ ID NO: 129180 - protein, 18 aa, Mycobacterium avium
LTGKGWRVTPHPARQLYA

SEQ ID NO: 129181 - protein, 23 aa, Mycobacterium avium
LTGLAVLDLYAGSGALGLEALSR

SEQ ID NO: 129182 - protein, 23 aa, Mycobacterium avium
LTGLYWHGPASRAMAAGAAPTWA

SEQ ID NO: 129183 - protein, 27 aa, Mycobacterium avium
LTGPDGWYRFLTIKPGPYPWRNHHNAW

SEQ ID NO: 129184 - protein, 32 aa, Mycobacterium avium
LTGRPFAASAPRIGAPRWDTVIIGLDCDTTVL

SEQ ID NO: 129185 - protein, 21 aa, Mycobacterium avium
LTGVGTFDPGLGRKAPIYVIE

SEQ ID NO: 129186 - protein, 17 aa, Mycobacterium avium
LTHDLHTLIESLDLRDL

SEQ ID NO: 129187 - protein, 25 aa, Mycobacterium avium
LTITGLTPEFRCKLVAGLNGVLTIE

SEQ ID NO: 129188 - protein, 27 aa, Mycobacterium avium
LTKRQRFWVSLYYPLTMRLLCNAITVP

SEQ ID NO: 129189 - protein, 29 aa, Mycobacterium avium
LTLAMLGVPLRKWTMYNEPVHAMVYTPPD

SEQ ID NO: 129190 - protein, 43 aa, Mycobacterium avium
LTLASLKWVLRNRAYTPWYLVRYWRLLKFKLANPHIITRGMVF

SEQ ID NO: 129191 - protein, 17 aa, Mycobacterium avium
LTLCGLDLRPARSRAHC

SEQ ID NO: 129192 - protein, 18 aa, Mycobacterium avium
LTLCGLDLRPARSRAHCL

SEQ ID NO: 129193 - protein, 25 aa, Mycobacterium avium
LTLRNRALLELLYSTGARISEAVGL

SEQ ID NO: 129194 - protein, 24 aa, Mycobacterium avium
LTNARRPLIVLGKGAAYAQADNEI

SEQ ID NO: 129195 - protein, 21 aa, Mycobacterium avium
LTPARLRRLLTKAGRRRHLDR

SEQ ID NO: 129196 - protein, 19 aa, Mycobacterium avium
LTPEERLLRAIFGEKAREV

SEQ ID NO: 129197 - protein, 19 aa, Mycobacterium avium
LTPPAEPFLVELRGPRGDT

SEQ ID NO: 129198 - protein, 26 aa, Mycobacterium avium
LTPQELAKFFILLIGAGNETTRNALT

SEQ ID NO: 129199 - protein, 20 aa, Mycobacterium avium
LTPRERLLAVFATPPAFTDE

SEQ ID NO: 129200 - protein, 28 aa, Mycobacterium avium
LTPVTRAVAAWLWSGRTATLAGLSAAAL

SEQ ID NO: 129201 - protein, 23 aa, Mycobacterium avium
LTQQLWGAVPWGTAAQPALVPMD

SEQ ID NO: 129202 - protein, 24 aa, Mycobacterium avium
LTQQLWGAVPWGTAAQPALVPMDA

SEQ ID NO: 129203 - protein, 18 aa, Mycobacterium avium
LTQRYGAAVLGPYSTKRS

SEQ ID NO: 129204 - protein, 19 aa, Mycobacterium avium
LTRCDIRVPRFATVDLTGQ

SEQ ID NO: 129205 - protein, 17 aa, Mycobacterium avium
LTRLPARRCGWSSPTIT

SEQ ID NO: 129206 - protein, 26 aa, Mycobacterium avium
LTRLRGMFAFALWDTVTRELFCARDP

SEQ ID NO: 129207 - protein, 17 aa, Mycobacterium avium
LTRMGLRVLHRNWRCRY

SEQ ID NO: 129208 - protein, 22 aa, Mycobacterium avium
LTRMGLRVLHRNWRCRYGELDI

SEQ ID NO: 129209 - protein, 18 aa, Mycobacterium avium
LTRMLIGIPVVYTSDYLV

SEQ ID NO: 129210 - protein, 28 aa, Mycobacterium avium
LTRPSLAHFIRTGQEFSWRAEELFVAIA

SEQ ID NO: 129211 - protein, 24 aa, Mycobacterium avium
LTRRLLESGLPLPTLLVAATAATV

SEQ ID NO: 129212 - protein, 30 aa, Mycobacterium avium
LTRSLDFYATFPFPKPTLSKWLRGDYANLT

SEQ ID NO: 129213 - protein, 17 aa, Mycobacterium avium
LTRVRVLDRGSGQVRWV

SEQ ID NO: 129214 - protein, 20 aa, Mycobacterium avium
LTSGQRAPAAPTDPPRRSAV

SEQ ID NO: 129215 - protein, 19 aa, Mycobacterium avium
LTTPAAVMLRRCETCAADI

SEQ ID NO: 129216 - protein, 24 aa, Mycobacterium avium
LTVFPDVRMIWAHRDPFKATGSLC

SEQ ID NO: 129217 - protein, 31 aa, Mycobacterium avium
LTVFQRTPIWCFPKLDVPLPAPARWAMRIPG

SEQ ID NO: 129218 - protein, 31 aa, Mycobacterium avium
LTVFQRTPIWRFPKLDVPLPAPARWAMRIPG

SEQ ID NO: 129219 - protein, 19 aa, Mycobacterium avium
LTVLPANLGAHSFWNESDP

SEQ ID NO: 129220 - protein, 27 aa, Mycobacterium avium
LTVVNPLVDATWRFMTLDHDGKIRMDC

SEQ ID NO: 129221 - protein, 28 aa, Mycobacterium avium
LTVVNPLVDATWRFMTLDHDGKIRMDCS

SEQ ID NO: 129222 - protein, 20 aa, Mycobacterium avium
LTWSQLYRRTVNAARALQHC

SEQ ID NO: 129223 - protein, 17 aa, Mycobacterium avium
LTWSRFRNHDFLARLRE

SEQ ID NO: 129224 - protein, 26 aa, Mycobacterium avium
LVAAAWLHDIGYAPSVRRTGFHPLDG

SEQ ID NO: 129225 - protein, 17 aa, Mycobacterium avium
LVAAAYLAKAGLDVLVV

SEQ ID NO: 129226 - protein, 19 aa, Mycobacterium avium
LVADDLVASLLLVHGLHPH

SEQ ID NO: 129227 - protein, 27 aa, Mycobacterium avium
LVAELDRVWRHLPFAAQWHSDNELARH

SEQ ID NO: 129228 - protein, 27 aa, Mycobacterium avium
LVAEYGITWILPRLAGWGAAMDLLLSG

SEQ ID NO: 129229 - protein, 22 aa, Mycobacterium avium
LVAFSLHYPWSQQLPVHSLDGA

SEQ ID NO: 129230 - protein, 19 aa, Mycobacterium avium
LVAQACAFINYAMGRYGVA

SEQ ID NO: 129231 - protein, 31 aa, Mycobacterium avium
LVAQHPYREPLWAQLITAYYVTERQSDALGA

SEQ ID NO: 129232 - protein, 27 aa, Mycobacterium avium
LVAQTSLEPRHLVLPMFVADGIDEPRP

SEQ ID NO: 129233 - protein, 32 aa, Mycobacterium avium
LVATAAQWQALSSQFIGAPPSPGLSFEATTAA

SEQ ID NO: 129234 - protein, 17 aa, Mycobacterium avium
LVATGIPVLLGASRKRF

SEQ ID NO: 129235 - protein, 22 aa, Mycobacterium avium
LVAWTTQGFPPGAPYAGPTGKD

SEQ ID NO: 129236 - protein, 29 aa, Mycobacterium avium
LVCSVPLLDMKRYHLLLAGASWVAEHGDP

SEQ ID NO: 129237 - protein, 21 aa, Mycobacterium avium
LVDAVRRRDGLPRIAQAVAAP

SEQ ID NO: 129238 - protein, 18 aa, Mycobacterium avium
LVDGPVVLGWQTLREIQE

SEQ ID NO: 129239 - protein, 18 aa, Mycobacterium avium
LVDLFPVGASPPGYLPVL

SEQ ID NO: 129240 - protein, 24 aa, Mycobacterium avium
LVDLRADCALWHGLSWEPAVVARL

SEQ ID NO: 129241 - protein, 19 aa, Mycobacterium avium
LVDRFFEARKMMSSMLGGM

SEQ ID NO: 129242 - protein, 24 aa, Mycobacterium avium
LVDSPLQVTMWTKRLRAVDFTLGY

SEQ ID NO: 129243 - protein, 22 aa, Mycobacterium avium
LVEKLRYALADRLVLSKVRRRL

SEQ ID NO: 129244 - protein, 31 aa, Mycobacterium avium
LVEQWQDELFFKFGLRFDLLTNQLIDANVNL

SEQ ID NO: 129245 - protein, 26 aa, Mycobacterium avium
LVERTPGMRAKLFEAARLAAGVIGYT

SEQ ID NO: 129246 - protein, 28 aa, Mycobacterium avium
LVGAQLADLLLAVQLDDLPGRCRVGRDD

SEQ ID NO: 129247 - protein, 18 aa, Mycobacterium avium
LVGENLIGPLYAHGAAGA

SEQ ID NO: 129248 - protein, 25 aa, Mycobacterium avium
LVGLDFPVFVIRDPIKFPQMVRSAK

SEQ ID NO: 129249 - protein, 33 aa, Mycobacterium avium
LVGRLMSYKLDRSRPLWEMWVIEGLDGNAGGRF

SEQ ID NO: 129250 - protein, 18 aa, Mycobacterium avium
LVGRSSLVYDMWGAAVNL

SEQ ID NO: 129251 - protein, 18 aa, Mycobacterium avium
LVGTYRTKDDRYVQLMML

SEQ ID NO: 129252 - protein, 19 aa, Mycobacterium avium
LVGVWNTVEAALPALIDGG

SEQ ID NO: 129253 - protein, 19 aa, Mycobacterium avium
LVHDAARALTPPALIARVV

SEQ ID NO: 129254 - protein, 24 aa, Mycobacterium avium
LVHDLDFLCSLLGRPVSVCAEVRT

SEQ ID NO: 129255 - protein, 25 aa, Mycobacterium avium
LVHGALQAALLARALGDWIGGRGRL

SEQ ID NO: 129256 - protein, 26 aa, Mycobacterium avium
LVHRDGGHFYFAVPDGVELPPGPPGA

SEQ ID NO: 129257 - protein, 33 aa, Mycobacterium avium
LVHTLYRKFEEIFLPKFPPPFRAGDLSFETLIS

SEQ ID NO: 129258 - protein, 25 aa, Mycobacterium avium
LVHVGFGHGLWGFTDALRAAGWDPP

SEQ ID NO: 129259 - protein, 18 aa, Mycobacterium avium
LVLAVNSLAVRHLTELFF

SEQ ID NO: 129260 - protein, 22 aa, Mycobacterium avium
LVLERLADARRLGHPVWAVLRG

SEQ ID NO: 129261 - protein, 29 aa, Mycobacterium avium
LVLLVDGLGWQLLAQLAGDAPLLAAVRAG

SEQ ID NO: 129262 - protein, 19 aa, Mycobacterium avium
LVLNGLERYLRTVASLSHA

SEQ ID NO: 129263 - protein, 17 aa, Mycobacterium avium
LVLQADVQPVPTAKLLA

SEQ ID NO: 129264 - protein, 17 aa, Mycobacterium avium
LVLQILQSKAPGTWNLK

SEQ ID NO: 129265 - protein, 17 aa, Mycobacterium avium
LVLSKLRERLGFGELRW

SEQ ID NO: 129266 - protein, 18 aa, Mycobacterium avium
LVMPERDWDRWLDPDAPV

SEQ ID NO: 129267 - protein, 18 aa, Mycobacterium avium
LVMTATPIPRTVALTVYG

SEQ ID NO: 129268 - protein, 25 aa, Mycobacterium avium
LVNLVRSLGVPAWLSYTIDGAHTRA

SEQ ID NO: 129269 - protein, 21 aa, Mycobacterium avium
LVPADFIGFSQPIDDLPTAEG

SEQ ID NO: 129270 - protein, 22 aa, Mycobacterium avium
LVPADFIGFSQPIDDLPTAEGS

SEQ ID NO: 129271 - protein, 27 aa, Mycobacterium avium
LVPQVMPNWHYLHIHNDVIPALKQRGV

SEQ ID NO: 129272 - protein, 24 aa, Mycobacterium avium
LVPVPATRPLVAAPMPPLDAAPTL

SEQ ID NO: 129273 - protein, 18 aa, Mycobacterium avium
LVQGMAHGLGPYVDNIAG

SEQ ID NO: 129274 - protein, 21 aa, Mycobacterium avium
LVQLQRVHWRLSAHALICESS

SEQ ID NO: 129275 - protein, 28 aa, Mycobacterium avium
LVQYPNVNPALLLKCLLMAATEGIASGD

SEQ ID NO: 129276 - protein, 21 aa, Mycobacterium avium
LVRGRWELARRGRGTPAIFLN

SEQ ID NO: 129277 - protein, 25 aa, Mycobacterium avium
LVRHRPTGRRLLICGSAGFVAGALA

SEQ ID NO: 129278 - protein, 26 aa, Mycobacterium avium
LVRHRPTGRRLLICGSAGFVPGALAG

SEQ ID NO: 129279 - protein, 23 aa, Mycobacterium avium
LVSQFFGKYFSPEEARKLIAEQA

SEQ ID NO: 129280 - protein, 17 aa, Mycobacterium avium
LVTANDYGLRLYNGDTG

SEQ ID NO: 129281 - protein, 27 aa, Mycobacterium avium
LVTAVGGWFFGWLTDRCGSLAAPMLAH

SEQ ID NO: 129282 - protein, 35 aa, Mycobacterium avium
LVTDLAHGWIPSGIALPAGVRLLEPERRSGDVVAL

SEQ ID NO: 129283 - protein, 18 aa, Mycobacterium avium
LVTFPPGHIAGVGSLLRP

SEQ ID NO: 129284 - protein, 18 aa, Mycobacterium avium
LVTHGTGFNWPAPDHLRI

SEQ ID NO: 129285 - protein, 28 aa, Mycobacterium avium
LVVDGIAADRFWMMGPPAPSDDVVRRKA

SEQ ID NO: 129286 - protein, 33 aa, Mycobacterium avium
LVVGHPYVDIWQAVKPQRLGLAAWPEVPRHVEW

SEQ ID NO: 129287 - protein, 18 aa, Mycobacterium avium
LVVLGPPGDRESATLRAG

SEQ ID NO: 129288 - protein, 18 aa, Mycobacterium avium
LVVPAPPAELRPVHTHRG

SEQ ID NO: 129289 - protein, 24 aa, Mycobacterium avium
LVVRLRAPLRGVAPGQTLALYRHD

SEQ ID NO: 129290 - protein, 18 aa, Mycobacterium avium
LVVRRRITFLAKSEYFTG

SEQ ID NO: 129291 - protein, 31 aa, Mycobacterium avium
LVVWLPEERILFTGNLFGPLFGHVPNLMTIR

SEQ ID NO: 129292 - protein, 32 aa, Mycobacterium avium
LVVWLPEERILFTGNLFGPLFGHVPNLMTIRG

SEQ ID NO: 129293 - protein, 17 aa, Mycobacterium avium
LVYDMWGAAVNLAHQTR

SEQ ID NO: 129294 - protein, 19 aa, Mycobacterium avium
LVYLGAGQGFRSGTEIAVC

SEQ ID NO: 129295 - protein, 20 aa, Mycobacterium avium
LWAGQTWPRPEGLQLCYVCS

SEQ ID NO: 129296 - protein, 17 aa, Mycobacterium avium
LWELHTAIQLAGAGRHQ

SEQ ID NO: 129297 - protein, 17 aa, Mycobacterium avium
LWPANPPRRPLYPVQVT

SEQ ID NO: 129298 - protein, 17 aa, Mycobacterium avium
LWPDYDRRDLWAACQEY

SEQ ID NO: 129299 - protein, 17 aa, Mycobacterium avium
LWTQKRSIFARGEGGFG

SEQ ID NO: 129300 - protein, 19 aa, Mycobacterium avium
LWVAALRETGRVIYPINPL

SEQ ID NO: 129301 - protein, 21 aa, Mycobacterium avium
LWVTDLTFVPTWAGVAYVCFI

SEQ ID NO: 129302 - protein, 21 aa, Mycobacterium avium
LWVTDLTFVPTWAGVAYVCFL

SEQ ID NO: 129303 - protein, 25 aa, Mycobacterium avium
LYAGRAIVYLRRFDPHEWVRLVRDE

SEQ ID NO: 129304 - protein, 35 aa, Mycobacterium avium
LYAIPRGVNRWAVSLAYLTDALFARSVVSIGLSSE

SEQ ID NO: 129305 - protein, 21 aa, Mycobacterium avium
LYDAPEVVIPMLVPDGAHSYP

SEQ ID NO: 129306 - protein, 33 aa, Mycobacterium avium
LYDTDVICLTSPGALPYYIQKGASFIGVQLDAG

SEQ ID NO: 129307 - protein, 19 aa, Mycobacterium avium
LYELPFKHDALAYGLYELP

SEQ ID NO: 129308 - protein, 21 aa, Mycobacterium avium
LYGLDLDYQGLALDEAGAGSI

SEQ ID NO: 129309 - protein, 21 aa, Mycobacterium avium
LYPQIAARPFGMMIGFQGHHG

SEQ ID NO: 129310 - protein, 17 aa, Mycobacterium avium
LYPVGIDHATLTRRDAD

SEQ ID NO: 129311 - protein, 19 aa, Mycobacterium avium
LYPVGIDHATLTRRDADGG

SEQ ID NO: 129312 - protein, 17 aa, Mycobacterium avium
LYVEFDAGLLDPGRLRA

SEQ ID NO: 129313 - protein, 17 aa, Mycobacterium avium
LYVLAGRDEGYVPFYDE

SEQ ID NO: 129314 - protein, 20 aa, Mycobacterium avium
LYWAPPQQFTAERARLAAAA

SEQ ID NO: 129315 - protein, 21 aa, Mycobacterium avium
LYWVPPQQFTAERARLAAAAS

SEQ ID NO: 129316 - protein, 22 aa, Mycobacterium avium
LYWVPPQQFTAERARLAAAASA

SEQ ID NO: 129317 - protein, 20 aa, Mycobacterium avium
MAALDFLPHALAAAAGRPVF

SEQ ID NO: 129318 - protein, 19 aa, Mycobacterium avium
MAARLDWQLRHYPPRTDDV

SEQ ID NO: 129319 - protein, 23 aa, Mycobacterium avium
MAARLDWQLRHYPPRTEDVRLAQ

SEQ ID NO: 129320 - protein, 25 aa, Mycobacterium avium
MAARTAFFDNFFLAATHAGVRQVVI

SEQ ID NO: 129321 - protein, 25 aa, Mycobacterium avium
MADKTMIRTLMKLLPKSTEQQQAIA

SEQ ID NO: 129322 - protein, 31 aa, Mycobacterium avium
MADPRLPDSRLWWLLNLVITRGTPPRLEGCR

SEQ ID NO: 129323 - protein, 17 aa, Mycobacterium avium
MAELSIFQVLLNHPPLA

SEQ ID NO: 129324 - protein, 17 aa, Mycobacterium avium
MAGVWNLVPDRSAITFS

SEQ ID NO: 129325 - protein, 18 aa, Mycobacterium avium
MAGWEVTVLLPHGCNTRS

SEQ ID NO: 129326 - protein, 19 aa, Mycobacterium avium
MALALKLGENHTPPQRLEV

SEQ ID NO: 129327 - protein, 29 aa, Mycobacterium avium
MALRRKFSASGFLPDVRRYGATYANYVGK

SEQ ID NO: 129328 - protein, 34 aa, Mycobacterium avium
MALTTRYAVFVLSPLRINPWALTGRQSYWESICF

SEQ ID NO: 129329 - protein, 34 aa, Mycobacterium avium
MALTTRYAVFVLSPLRINPWALTGRQSYWESIRF

SEQ ID NO: 129330 - protein, 35 aa, Mycobacterium avium
MALTTRYAVFVLSPLRINPWALTGRQSYWESIRFK

SEQ ID NO: 129331 - protein, 21 aa, Mycobacterium avium
MAPLTCFRDLDAPGLLDDVTT

SEQ ID NO: 129332 - protein, 22 aa, Mycobacterium avium
MAPREVIALLETPRGAVFATEI

SEQ ID NO: 129333 - protein, 30 aa, Mycobacterium avium
MAQLYDGFSFLTVMWLEALGFCEHGKVGDF

SEQ ID NO: 129334 - protein, 25 aa, Mycobacterium avium
MARHLLSETLLLPSAPVYWGGIDTE

SEQ ID NO: 129335 - protein, 26 aa, Mycobacterium avium
MARHLLSETLLLPSAPVYWGGIDTER

SEQ ID NO: 129336 - protein, 31 aa, Mycobacterium avium
MARHLLSETLLLPSAPVYWRGIDTERSHLLA

SEQ ID NO: 129337 - protein, 18 aa, Mycobacterium avium
MARVRIPHELRIPAPDRL

SEQ ID NO: 129338 - protein, 20 aa, Mycobacterium avium
MASRTAFFDSFFLEATGAGI

SEQ ID NO: 129339 - protein, 24 aa, Mycobacterium avium
MATALAPLTVVIASVVHSPLRRVE

SEQ ID NO: 129340 - protein, 24 aa, Mycobacterium avium
MAYEGKIDWAFAELLALGSLVAEG

SEQ ID NO: 129341 - protein, 25 aa, Mycobacterium avium
MAYEGKIDWAFAELLALGSLVAEGK

SEQ ID NO: 129342 - protein, 29 aa, Mycobacterium avium
MAYEGKIDWAFAELLALGSLVAGGKLVRL

SEQ ID NO: 129343 - protein, 17 aa, Mycobacterium avium
MAYPFVRLHQPSAFYGV

SEQ ID NO: 129344 - protein, 18 aa, Mycobacterium avium
MCPRIMAMTVREGKVCAL

SEQ ID NO: 129345 - protein, 21 aa, Mycobacterium avium
MDDMYAVQLDFTLTGPLDADR

SEQ ID NO: 129346 - protein, 17 aa, Mycobacterium avium
MDDPAHLRLRTLVSKGF

SEQ ID NO: 129347 - protein, 23 aa, Mycobacterium avium
MDGKVHRHWGFGGGPHRCLGSHL

SEQ ID NO: 129348 - protein, 17 aa, Mycobacterium avium
MDLARDRRLKRLRTPTL

SEQ ID NO: 129349 - protein, 25 aa, Mycobacterium avium
MDMTTRLLAIPLHQLYALLWRVGII

SEQ ID NO: 129350 - protein, 23 aa, Mycobacterium avium
MDMVSIYDCYTITVLLSLEDAGF

SEQ ID NO: 129351 - protein, 24 aa, Mycobacterium avium
MDPNTIPLTFFRKASGSITGPFDD

SEQ ID NO: 129352 - protein, 20 aa, Mycobacterium avium
MDPVLPQTVSMLKTSRVVLT

SEQ ID NO: 129353 - protein, 22 aa, Mycobacterium avium
MDRTYMLHVPAGDPVGLVLSLH

SEQ ID NO: 129354 - protein, 25 aa, Mycobacterium avium
MDSPDFIRLGLMLALERRPVEPRAR

SEQ ID NO: 129355 - protein, 18 aa, Mycobacterium avium
MEAAFWRLQDRVAREPVT

SEQ ID NO: 129356 - protein, 22 aa, Mycobacterium avium
MEAFHYRYHPLTLRAEEIIASG

SEQ ID NO: 129357 - protein, 23 aa, Mycobacterium avium
MEAWNDPTLLKFLATPALAREYL

SEQ ID NO: 129358 - protein, 26 aa, Mycobacterium avium
MEAYEDKATIVLPGTGGSVSGTAVNE

SEQ ID NO: 129359 - protein, 18 aa, Mycobacterium avium
MEPFASTYDAWWVESLRV

SEQ ID NO: 129360 - protein, 17 aa, Mycobacterium avium
MEQIRARGPLMRAPFVW

SEQ ID NO: 129361 - protein, 22 aa, Mycobacterium avium
MEQIRARGPLMRAPFVWASVDH

SEQ ID NO: 129362 - protein, 23 aa, Mycobacterium avium
MEQIRARGPLMRAPFVWASVDHA

SEQ ID NO: 129363 - protein, 18 aa, Mycobacterium avium
MERLAPLGPVYQAGTLSG

SEQ ID NO: 129364 - protein, 27 aa, Mycobacterium avium
MESRARLFPQGLARFIGLRDQRCRTPY

SEQ ID NO: 129365 - protein, 24 aa, Mycobacterium avium
MFAFSGILTALYTRATTGAVRPVS

SEQ ID NO: 129366 - protein, 17 aa, Mycobacterium avium
MFEVLLGAFPTIELTGD

SEQ ID NO: 129367 - protein, 17 aa, Mycobacterium avium
MFHALLESAPDAMVIVG

SEQ ID NO: 129368 - protein, 17 aa, Mycobacterium avium
MFQQLPTAGLPFQFQTW

SEQ ID NO: 129369 - protein, 25 aa, Mycobacterium avium
MFRAVDVVLLNKIDLVPYLDVDVDS

SEQ ID NO: 129370 - protein, 20 aa, Mycobacterium avium
MFSLHVKATMMKVSHPIVFG

SEQ ID NO: 129371 - protein, 22 aa, Mycobacterium avium
MGADLCQQLSWGASPQQLEGLA

SEQ ID NO: 129372 - protein, 17 aa, Mycobacterium avium
MGAQRLHWLGAELNGTS

SEQ ID NO: 129373 - protein, 25 aa, Mycobacterium avium
MGAVLHTLNIRLFPEQIAYVANEAG

SEQ ID NO: 129374 - protein, 19 aa, Mycobacterium avium
MGEVRRYFRDYSWGMRVPR

SEQ ID NO: 129375 - protein, 23 aa, Mycobacterium avium
MGFRINAVLPGPVQTPILPDFEE

SEQ ID NO: 129376 - protein, 20 aa, Mycobacterium avium
MGGWYVPGSPEHELLAAACE

SEQ ID NO: 129377 - protein, 20 aa, Mycobacterium avium
MGHSYLRYAMAMRERLPQVG

SEQ ID NO: 129378 - protein, 21 aa, Mycobacterium avium
MGIALVGRRIAAVYTALASAK

SEQ ID NO: 129379 - protein, 21 aa, Mycobacterium avium
MGIALVGRRIAAVYTALASGK

SEQ ID NO: 129380 - protein, 29 aa, Mycobacterium avium
MGIDVTYPLHRYFLWAKQIELSLGSAPQQ

SEQ ID NO: 129381 - protein, 17 aa, Mycobacterium avium
MGINPFFDAPYEDVSKG

SEQ ID NO: 129382 - protein, 21 aa, Mycobacterium avium
MGINWVGPALMRYGTEEQKTK

SEQ ID NO: 129383 - protein, 23 aa, Mycobacterium avium
MGINYGLNKVRFLSAVTAGSRIR

SEQ ID NO: 129384 - protein, 18 aa, Mycobacterium avium
MGLAFAEMGFRINAVLPG

SEQ ID NO: 129385 - protein, 26 aa, Mycobacterium avium
MGLFGYAIPQQWGGLGLNLMQDVELA

SEQ ID NO: 129386 - protein, 18 aa, Mycobacterium avium
MGLRVLHRNWRCRYGELD

SEQ ID NO: 129387 - protein, 25 aa, Mycobacterium avium
MGMLALGVPYGEVMRWALLGSEERM

SEQ ID NO: 129388 - protein, 26 aa, Mycobacterium avium
MGPAVTMYIPAFLRYDLRETNGEWLI

SEQ ID NO: 129389 - protein, 27 aa, Mycobacterium avium
MGPAVTMYIPAFLRYDLRETNGEWLIG

SEQ ID NO: 129390 - protein, 17 aa, Mycobacterium avium
MGPELVSRWAAYMPPAP

SEQ ID NO: 129391 - protein, 18 aa, Mycobacterium avium
MGPELVSRWAAYMPPAPT

SEQ ID NO: 129392 - protein, 27 aa, Mycobacterium avium
MGPTVTMYIPAFLRYDLRETNGEWLIG

SEQ ID NO: 129393 - protein, 18 aa, Mycobacterium avium
MGRLAGRGFAAYGTAKAA

SEQ ID NO: 129394 - protein, 20 aa, Mycobacterium avium
MHEVQRWCALLEWAGIPCDS

SEQ ID NO: 129395 - protein, 19 aa, Mycobacterium avium
MHLHTRLTQRFDAVIVPGV

SEQ ID NO: 129396 - protein, 20 aa, Mycobacterium avium
MHLHTRLTQRFDAVIVPGVT

SEQ ID NO: 129397 - protein, 19 aa, Mycobacterium avium
MHLLYSMIMVSFPVECWKQ

SEQ ID NO: 129398 - protein, 20 aa, Mycobacterium avium
MHLLYSMIMVSFPVECWKQP

SEQ ID NO: 129399 - protein, 19 aa, Mycobacterium avium
MHSAVSPRALYFATSSPAY

SEQ ID NO: 129400 - protein, 18 aa, Mycobacterium avium
MIADPLRRLDFCMESDYG

SEQ ID NO: 129401 - protein, 18 aa, Mycobacterium avium
MIASTFLGLVPSPASPEL

SEQ ID NO: 129402 - protein, 17 aa, Mycobacterium avium
MIEFYIPVTPEAGRLLY

SEQ ID NO: 129403 - protein, 25 aa, Mycobacterium avium
MIEHPILIERPFVVTPKGTRLARPI

SEQ ID NO: 129404 - protein, 23 aa, Mycobacterium avium
MIEPWVFMNYKRAAEYLYTAQTL

SEQ ID NO: 129405 - protein, 27 aa, Mycobacterium avium
MIGQMKALPDYYIYYAGLADKLQGEVV

SEQ ID NO: 129406 - protein, 17 aa, Mycobacterium avium
MILSIRHADVRDRLARI

SEQ ID NO: 129407 - protein, 25 aa, Mycobacterium avium
MIPRHVAVVERIGFTAAGKLDRRAV

SEQ ID NO: 129408 - protein, 18 aa, Mycobacterium avium
MIQAFFFDLQHINGGGSR

SEQ ID NO: 129409 - protein, 20 aa, Mycobacterium avium
MISPTTLYDKFPALTPEQAA

SEQ ID NO: 129410 - protein, 18 aa, Mycobacterium avium
MITTVFARMGFAPELVPA

SEQ ID NO: 129411 - protein, 18 aa, Mycobacterium avium
MKASYIYALHSRLSQIMA

SEQ ID NO: 129412 - protein, 41 aa, Mycobacterium avium
MLADAVGLALFVVLDTLPPAERLAFVLHDVFSVPFDQIATI

SEQ ID NO: 129413 - protein, 27 aa, Mycobacterium avium
MLAHDTWNWLIHVLAQRYGSAFTMSPP

SEQ ID NO: 129414 - protein, 17 aa, Mycobacterium avium
MLELAGKFAAEHPWLLG

SEQ ID NO: 129415 - protein, 24 aa, Mycobacterium avium
MLNRIKWTVVRYKPPEGMTLNGDG

SEQ ID NO: 129416 - protein, 18 aa, Mycobacterium avium
MLPVDDDAARMWARLRIH

SEQ ID NO: 129417 - protein, 19 aa, Mycobacterium avium
MLQRLPFGNRIFSQAVCFK

SEQ ID NO: 129418 - protein, 18 aa, Mycobacterium avium
MLQSWTMPPPKLAGIHER

SEQ ID NO: 129419 - protein, 19 aa, Mycobacterium avium
MLRHYRTLLDSLLSDPDAT

SEQ ID NO: 129420 - protein, 28 aa, Mycobacterium avium
MLRRATYMYGTLLPRGLFDHVGCGLGQA

SEQ ID NO: 129421 - protein, 25 aa, Mycobacterium avium
MLSGDWIPVSQPPEIAALAPNASML

SEQ ID NO: 129422 - protein, 17 aa, Mycobacterium avium
MMKRNLLELGGKSVYLL

SEQ ID NO: 129423 - protein, 17 aa, Mycobacterium avium
MMKVSHPIVFGHAVKIF

SEQ ID NO: 129424 - protein, 17 aa, Mycobacterium avium
MMRHVLSPVLRIYRLDV

SEQ ID NO: 129425 - protein, 24 aa, Mycobacterium avium
MNAHRPALVARCAALLVILCDPGR

SEQ ID NO: 129426 - protein, 19 aa, Mycobacterium avium
MNDQTFRLFRPDLENPGPD

SEQ ID NO: 129427 - protein, 20 aa, Mycobacterium avium
MNHLAFHVPAEKFDAYRQRL

SEQ ID NO: 129428 - protein, 29 aa, Mycobacterium avium
MNRGFHAFFRQYYNLRALLVRLDPRLRML

SEQ ID NO: 129429 - protein, 19 aa, Mycobacterium avium
MNRVYVRCGMVPAGVDVIW

SEQ ID NO: 129430 - protein, 17 aa, Mycobacterium avium
MPAAIAARTRYFDEFYA

SEQ ID NO: 129431 - protein, 29 aa, Mycobacterium avium
MPDRGHVFRRAFSWLPAQFASQSDAPVGA

SEQ ID NO: 129432 - protein, 25 aa, Mycobacterium avium
MPEGKYIPRLGGLAFRDPDWADEVY

SEQ ID NO: 129433 - protein, 37 aa, Mycobacterium avium
MPGGMYRNQMWLPYPGDNVLLCLGMCGQMIYVNRAAE

SEQ ID NO: 129434 - protein, 28 aa, Mycobacterium avium
MPLSASQLRSWFAYRLDGPSPVNNIPFA

SEQ ID NO: 129435 - protein, 19 aa, Mycobacterium avium
MPMIWQTDAFALATGFDEA

SEQ ID NO: 129436 - protein, 18 aa, Mycobacterium avium
MPMWERLEAAWGPARDVR

SEQ ID NO: 129437 - protein, 22 aa, Mycobacterium avium
MPPAPTRAFFQWASARDGHNKI

SEQ ID NO: 129438 - protein, 19 aa, Mycobacterium avium
MPRTSLYFKRDITTPFVEK

SEQ ID NO: 129439 - protein, 27 aa, Mycobacterium avium
MPSTPSNYFHLLRRHALDGIKRPLIVF

SEQ ID NO: 129440 - protein, 17 aa, Mycobacterium avium
MPVISDPGFRLVTACVQ

SEQ ID NO: 129441 - protein, 18 aa, Mycobacterium avium
MQELPQALKSTPKIISQT

SEQ ID NO: 129442 - protein, 26 aa, Mycobacterium avium
MQHRSRLYQLLRYADYNHFDSDIYNF

SEQ ID NO: 129443 - protein, 17 aa, Mycobacterium avium
MQIFEDFRYLREIGDPG

SEQ ID NO: 129444 - protein, 27 aa, Mycobacterium avium
MQKKRFGRIIYIGSVSGMWGIGNQSNY

SEQ ID NO: 129445 - protein, 32 aa, Mycobacterium avium
MQMMQAPMQMMQPLQSMMGMFANPGAMGMGGA

SEQ ID NO: 129446 - protein, 25 aa, Mycobacterium avium
MQNALPIQILMPEDIAGAVAWLTSD

SEQ ID NO: 129447 - protein, 25 aa, Mycobacterium avium
MQNALPIQILMPEDIAGAVAWLVSD

SEQ ID NO: 129448 - protein, 17 aa, Mycobacterium avium
MQVAFATLARRLPGLRL

SEQ ID NO: 129449 - protein, 18 aa, Mycobacterium avium
MQVAFATLARRLPGLRLA

SEQ ID NO: 129450 - protein, 23 aa, Mycobacterium avium
MRAGWYWRPDIAGVMRVFEDTGE

SEQ ID NO: 129451 - protein, 22 aa, Mycobacterium avium
MRAHQILLARVETALRPYDMSF

SEQ ID NO: 129452 - protein, 18 aa, Mycobacterium avium
MRALRAPTIGAALKHMVD

SEQ ID NO: 129453 - protein, 18 aa, Mycobacterium avium
MREVIILRVAHLQDSPYE

SEQ ID NO: 129454 - protein, 19 aa, Mycobacterium avium
MREVIILRVAHLQDSPYEL

SEQ ID NO: 129455 - protein, 19 aa, Mycobacterium avium
MRGLPITVIHAVAPVVVGW

SEQ ID NO: 129456 - protein, 21 aa, Mycobacterium avium
MRLRKIVSRGFTPRILSELRG

SEQ ID NO: 129457 - protein, 17 aa, Mycobacterium avium
MRMLKTCQVHLEDDVRE

SEQ ID NO: 129458 - protein, 18 aa, Mycobacterium avium
MRRDQAVLRPAFAGAGLG

SEQ ID NO: 129459 - protein, 17 aa, Mycobacterium avium
MRRLYPLIGRLFARQTA

SEQ ID NO: 129460 - protein, 18 aa, Mycobacterium avium
MRRRHRGDRLLVCRTASG

SEQ ID NO: 129461 - protein, 18 aa, Mycobacterium avium
MRSNNVWTPVLMLTAKDG

SEQ ID NO: 129462 - protein, 20 aa, Mycobacterium avium
MRTLAPPMGRGWEALAGDEV

SEQ ID NO: 129463 - protein, 28 aa, Mycobacterium avium
MRTSTTTYPCDVLIFATGFDALTGALTR

SEQ ID NO: 129464 - protein, 27 aa, Mycobacterium avium
MRYVGDRFPLMPIPSWMDNPIDPISIR

SEQ ID NO: 129465 - protein, 18 aa, Mycobacterium avium
MSARHPGNIAALAEIAPP

SEQ ID NO: 129466 - protein, 19 aa, Mycobacterium avium
MSARHPGNIAALAEIAPPA

SEQ ID NO: 129467 - protein, 18 aa, Mycobacterium avium
MSASWKASVPISVRPTWP

SEQ ID NO: 129468 - protein, 17 aa, Mycobacterium avium
MSEPVCCAPVAAGPADD

SEQ ID NO: 129469 - protein, 25 aa, Mycobacterium avium
MSGLDVRYDLGPGHPLLGRRMPDLD

SEQ ID NO: 129470 - protein, 17 aa, Mycobacterium avium
MSGLGICIDLFHCWAEG

SEQ ID NO: 129471 - protein, 21 aa, Mycobacterium avium
MSMRFYKSREALLDKAKRAED

SEQ ID NO: 129472 - protein, 22 aa, Mycobacterium avium
MSMRFYKSREALLDKAKRAEDA

SEQ ID NO: 129473 - protein, 23 aa, Mycobacterium avium
MSNGYLLLMQVGDGSHLAALAAA

SEQ ID NO: 129474 - protein, 24 aa, Mycobacterium avium
MSPDRKLMLLDTKTGKQARAAIAV

SEQ ID NO: 129475 - protein, 27 aa, Mycobacterium avium
MSPIGRRLMQLPLALTVQACEAAIADA

SEQ ID NO: 129476 - protein, 26 aa, Mycobacterium avium
MSSEPLTEAIPLWKRPRTAPSSPAGT

SEQ ID NO: 129477 - protein, 20 aa, Mycobacterium avium
MSSVPQTLQGLSTPGSTPGN

SEQ ID NO: 129478 - protein, 25 aa, Mycobacterium avium
MTARAAWAWFRHLHTLAGRTLAPST

SEQ ID NO: 129479 - protein, 17 aa, Mycobacterium avium
MTAVFWLDTERPHEVEL

SEQ ID NO: 129480 - protein, 21 aa, Mycobacterium avium
MTDFRYYIPLAKAAEAAGYHA

SEQ ID NO: 129481 - protein, 24 aa, Mycobacterium avium
MTDYMSRLMRYVEFMKKVVPMHDD

SEQ ID NO: 129482 - protein, 26 aa, Mycobacterium avium
MTECPEWTWRTTLLPRIAPTARDEES

SEQ ID NO: 129483 - protein, 35 aa, Mycobacterium avium
MTESLTHLFKAGGKRFRPLFTVLSAQIGPDPDAAE

SEQ ID NO: 129484 - protein, 17 aa, Mycobacterium avium
MTGMPMMPPGAMGAGGE

SEQ ID NO: 129485 - protein, 27 aa, Mycobacterium avium
MTIDQFAPQISFFFYTHGDFFEEIAKY

SEQ ID NO: 129486 - protein, 17 aa, Mycobacterium avium
MTILAALATAGGGDHPD

SEQ ID NO: 129487 - protein, 19 aa, Mycobacterium avium
MTLAGRWRRQGIAVDFATL

SEQ ID NO: 129488 - protein, 25 aa, Mycobacterium avium
MTPDTPAHLIDWKRRDWTPDCDAPA

SEQ ID NO: 129489 - protein, 18 aa, Mycobacterium avium
MTPFERKIVHDAVAAVPG

SEQ ID NO: 129490 - protein, 20 aa, Mycobacterium avium
MTRAPGCPFAPPPKVLQLNA

SEQ ID NO: 129491 - protein, 23 aa, Mycobacterium avium
MTTQPQPILLTRPRTGQADTKVR

SEQ ID NO: 129492 - protein, 20 aa, Mycobacterium avium
MTVAWQLPSHVNAAVAMLAL

SEQ ID NO: 129493 - protein, 28 aa, Mycobacterium avium
MTVHTLRRALSVLPRTGFLNLYGQTEAI

SEQ ID NO: 129494 - protein, 24 aa, Mycobacterium avium
MVAFADFPDQWQKLQKDRSKIPAA

SEQ ID NO: 129495 - protein, 18 aa, Mycobacterium avium
MVDPGWTALVSLAGALVT

SEQ ID NO: 129496 - protein, 42 aa, Mycobacterium avium
MVEAMLHSDYPLQALLYSAVLHRFLRWRLAGYDPDRHLGGIL

SEQ ID NO: 129497 - protein, 18 aa, Mycobacterium avium
MVGLFINTVPLRVRLDPA

SEQ ID NO: 129498 - protein, 20 aa, Mycobacterium avium
MVGLFINTVPLRVRLDSAAS

SEQ ID NO: 129499 - protein, 18 aa, Mycobacterium avium
MVIQAALAVLLAKLSAGN

SEQ ID NO: 129500 - protein, 18 aa, Mycobacterium avium
MVLLAAWCALRFGELTEL

SEQ ID NO: 129501 - protein, 18 aa, Mycobacterium avium
MVLTIRYDATGETETFLL

SEQ ID NO: 129502 - protein, 30 aa, Mycobacterium avium
MVPADRVLAALHGWLAPLPPEGASAIVFRD

SEQ ID NO: 129503 - protein, 17 aa, Mycobacterium avium
MVPTFCLQALRGDPLTV

SEQ ID NO: 129504 - protein, 19 aa, Mycobacterium avium
MVPVKRFHDQLNAQVIRRL

SEQ ID NO: 129505 - protein, 17 aa, Mycobacterium avium
MVRGNLIQLLSRLPQRG

SEQ ID NO: 129506 - protein, 35 aa, Mycobacterium avium
MVTDAWLPPELAPVLTERALRRAPLYELLSANGVA

SEQ ID NO: 129507 - protein, 19 aa, Mycobacterium avium
MVTILPLHNPIIAAKQIAT

SEQ ID NO: 129508 - protein, 27 aa, Mycobacterium avium
MVTLPIVHIGGLWALLQALVAARPIVM

SEQ ID NO: 129509 - protein, 35 aa, Mycobacterium avium
MVTNAWLPPELAPVLTERALRRAPLYELLSANGVA

SEQ ID NO: 129510 - protein, 18 aa, Mycobacterium avium
MVVQAALAVLLAKLSAST

SEQ ID NO: 129511 - protein, 17 aa, Mycobacterium avium
MWAYHRTVPDRQPAGSN

SEQ ID NO: 129512 - protein, 21 aa, Mycobacterium avium
MYKPRWGAFYGTKLVQHLRES

SEQ ID NO: 129513 - protein, 17 aa, Mycobacterium avium
MYQTFRPDLTNPSREDA

SEQ ID NO: 129514 - protein, 18 aa, Mycobacterium avium
MYRTGDLVRWRGDGQLDY

SEQ ID NO: 129515 - protein, 23 aa, Mycobacterium avium
NAALTFVHVPYPAPSDWTRRTLT

SEQ ID NO: 129516 - protein, 23 aa, Mycobacterium avium
NADAFSWRATFENLALVDGPTAL

SEQ ID NO: 129517 - protein, 23 aa, Mycobacterium avium
NADNHVVICEGTFLPQVLAAAQQ

SEQ ID NO: 129518 - protein, 17 aa, Mycobacterium avium
NADPAHPLSLAEAAKMA

SEQ ID NO: 129519 - protein, 30 aa, Mycobacterium avium
NADQLLIVVALADPPPRTGLVDRALIAAYA

SEQ ID NO: 129520 - protein, 26 aa, Mycobacterium avium
NAERMRHDMYWSGDLAYRDADGWIYL

SEQ ID NO: 129521 - protein, 22 aa, Mycobacterium avium
NAFARVFGGPIVPQEVEALLCR

SEQ ID NO: 129522 - protein, 18 aa, Mycobacterium avium
NAGFYRPALLARDVAAID

SEQ ID NO: 129523 - protein, 20 aa, Mycobacterium avium
NAGLLFVSYQKDPQDFIRLQ

SEQ ID NO: 129524 - protein, 21 aa, Mycobacterium avium
NAGVYAFDTAALRSALNRLSA

SEQ ID NO: 129525 - protein, 24 aa, Mycobacterium avium
NAHANFVYLPPDPQGRAWQRVFAR

SEQ ID NO: 129526 - protein, 25 aa, Mycobacterium avium
NAHIVNISPPLNLDPRWVGAHVGHT

SEQ ID NO: 129527 - protein, 22 aa, Mycobacterium avium
NAIQPGLIRTPMTAAMPPDVFA

SEQ ID NO: 129528 - protein, 24 aa, Mycobacterium avium
NAKGEAFIYPRITAYLAQRLQVED

SEQ ID NO: 129529 - protein, 18 aa, Mycobacterium avium
NAKMPKWLHSHPYNDMLG

SEQ ID NO: 129530 - protein, 24 aa, Mycobacterium avium
NALSPSKPILTPGLSYYARDFDDT

SEQ ID NO: 129531 - protein, 22 aa, Mycobacterium avium
NALTQLMIATLVDALTAAASDD

SEQ ID NO: 129532 - protein, 20 aa, Mycobacterium avium
NAMGRPGFTLGLGPSHEPLV

SEQ ID NO: 129533 - protein, 21 aa, Mycobacterium avium
NAMGRPGFTLGLGPSHEPLVS

SEQ ID NO: 129534 - protein, 25 aa, Mycobacterium avium
NANIYLPLANLTAFQSALLDPATAR

SEQ ID NO: 129535 - protein, 20 aa, Mycobacterium avium
NAPTWLCSVMGKSGLFSDYL

SEQ ID NO: 129536 - protein, 29 aa, Mycobacterium avium
NAQQELYLTDVIAILRGDGLPIRARHVDD

SEQ ID NO: 129537 - protein, 27 aa, Mycobacterium avium
NASQPIFWVVRALELLEDFQQFGYYLV

SEQ ID NO: 129538 - protein, 21 aa, Mycobacterium avium
NATLTVIVGMLHEIFERHMTA

SEQ ID NO: 129539 - protein, 31 aa, Mycobacterium avium
NAVRAWALTPNLHWPLEYVDSFAGLVPRLGS

SEQ ID NO: 129540 - protein, 26 aa, Mycobacterium avium
NCARTFPRWWQLKTNTTAIYLHDSRS

SEQ ID NO: 129541 - protein, 26 aa, Mycobacterium avium
NCDSFEHFPPKSFAPIVRLCALSQSL

SEQ ID NO: 129542 - protein, 21 aa, Mycobacterium avium
NDELDTLRRALPAALDALAVD

SEQ ID NO: 129543 - protein, 27 aa, Mycobacterium avium
NDHLDSKLLARLPLLHPEGLRDHSGDG

SEQ ID NO: 129544 - protein, 24 aa, Mycobacterium avium
NDIGAMNECWVRHLSAHADADVLE

SEQ ID NO: 129545 - protein, 18 aa, Mycobacterium avium
NDIRNEWLPAMRSATDGV

SEQ ID NO: 129546 - protein, 24 aa, Mycobacterium avium
NDMHLYLKRAHVFRHLFGEPTDVL

SEQ ID NO: 129547 - protein, 25 aa, Mycobacterium avium
NDNGPPPPFTSWQPPGGAAGAATAA

SEQ ID NO: 129548 - protein, 17 aa, Mycobacterium avium
NDPLAVTAALDDALRRA

SEQ ID NO: 129549 - protein, 23 aa, Mycobacterium avium
NDSILIWHDSAGREPLWDAPDAF

SEQ ID NO: 129550 - protein, 18 aa, Mycobacterium avium
NDSMVARYAPRIAGRPAA

SEQ ID NO: 129551 - protein, 18 aa, Mycobacterium avium
NDSRGFFTSRVIGTFVNE

SEQ ID NO: 129552 - protein, 24 aa, Mycobacterium avium
NDTHLTRLRLITSMLDRGYTIAHV

SEQ ID NO: 129553 - protein, 18 aa, Mycobacterium avium
NEALLGRRHRFGYTVGTD

SEQ ID NO: 129554 - protein, 30 aa, Mycobacterium avium
NEELCDLLPGYLIFRCIFSNRPPTHLTIET

SEQ ID NO: 129555 - protein, 21 aa, Mycobacterium avium
NEHIHVVMWAARRSGLYYVPI

SEQ ID NO: 129556 - protein, 18 aa, Mycobacterium avium
NEHILGDPWPSAGVRLQM

SEQ ID NO: 129557 - protein, 19 aa, Mycobacterium avium
NEILARFTAVPSQELILPY

SEQ ID NO: 129558 - protein, 18 aa, Mycobacterium avium
NELDRRLRAGPPDSDASA

SEQ ID NO: 129559 - protein, 25 aa, Mycobacterium avium
NESYCYIPLLEELDFMPSKKFADGA

SEQ ID NO: 129560 - protein, 26 aa, Mycobacterium avium
NETDDLRPLWLAAPVTEVLPRTTVAT

SEQ ID NO: 129561 - protein, 26 aa, Mycobacterium avium
NEYEVARLWRDARVQRLYAGTTEIMK

SEQ ID NO: 129562 - protein, 18 aa, Mycobacterium avium
NEYIITLGMHDFEKVSAD

SEQ ID NO: 129563 - protein, 25 aa, Mycobacterium avium
NFAGYDGLLFISLDPAAPPLQDFLG

SEQ ID NO: 129564 - protein, 19 aa, Mycobacterium avium
NFASRRTQLWDRIARWVPT

SEQ ID NO: 129565 - protein, 28 aa, Mycobacterium avium
NFEGPFDLLLQLIFVHRLDVTEVALHQV

SEQ ID NO: 129566 - protein, 18 aa, Mycobacterium avium
NFGAVRALDGLDLTVREG

SEQ ID NO: 129567 - protein, 25 aa, Mycobacterium avium
NFGLLDWVAALSWVAENIATFGGDP

SEQ ID NO: 129568 - protein, 23 aa, Mycobacterium avium
NFHIVTCRQLEWRRMIDIGADFS

SEQ ID NO: 129569 - protein, 17 aa, Mycobacterium avium
NFLFLSRRLIGANTSRG

SEQ ID NO: 129570 - protein, 17 aa, Mycobacterium avium
NFLTRRGVALIRCAGWS

SEQ ID NO: 129571 - protein, 26 aa, Mycobacterium avium
NFRDVLVALGMYPGAAQLGAEGAGVV

SEQ ID NO: 129572 - protein, 39 aa, Mycobacterium avium
NFVKSLLDRAYAKKFRFPTFLGAFKYYTSYTLKTFDGKR

SEQ ID NO: 129573 - protein, 34 aa, Mycobacterium avium
NGAKTWISNARRSGLIALLCKTDPKARPQHSGIS

SEQ ID NO: 129574 - protein, 18 aa, Mycobacterium avium
NGALNPNAFRRKEIPVDE

SEQ ID NO: 129575 - protein, 17 aa, Mycobacterium avium
NGALNPNAFRRKEIPVE

SEQ ID NO: 129576 - protein, 22 aa, Mycobacterium avium
NGAMMALRLGCQSDTLAAIAPV

SEQ ID NO: 129577 - protein, 28 aa, Mycobacterium avium
NGARDPLRLPGNAHFTFRGCEGDALLML

SEQ ID NO: 129578 - protein, 25 aa, Mycobacterium avium
NGDCVAFFWFADAPDRLPGISSPGA

SEQ ID NO: 129579 - protein, 19 aa, Mycobacterium avium
NGFGLHAFSWVNSAGEIHW

SEQ ID NO: 129580 - protein, 26 aa, Mycobacterium avium
NGGNAQRWFVVWLGTSNDPVDKVAAK

SEQ ID NO: 129581 - protein, 22 aa, Mycobacterium avium
NGGPLLMFANPDCRISLSRRSE

SEQ ID NO: 129582 - protein, 20 aa, Mycobacterium avium
NGGWTVMRFALDAEHGLTDP

SEQ ID NO: 129583 - protein, 27 aa, Mycobacterium avium
NGHRPAINALFRSVALTFGPRAIGVLL

SEQ ID NO: 129584 - protein, 28 aa, Mycobacterium avium
NGHRPAINALFRSVALTFGPRAIGVLLS

SEQ ID NO: 129585 - protein, 23 aa, Mycobacterium avium
NGIPLWAGAAFKHASAGPAADIV

SEQ ID NO: 129586 - protein, 21 aa, Mycobacterium avium
NGISVTVRYFAAARAAAGAES

SEQ ID NO: 129587 - protein, 22 aa, Mycobacterium avium
NGISVTVRYFAAARAAAGAESE

SEQ ID NO: 129588 - protein, 22 aa, Mycobacterium avium
NGIVLLLRHPEQLALLHDNPDL

SEQ ID NO: 129589 - protein, 28 aa, Mycobacterium avium
NGLAYFERLGWRTVQVEALYSAARRLRR

SEQ ID NO: 129590 - protein, 25 aa, Mycobacterium avium
NGLDALYSYWGFGGADPGAYRRAEA

SEQ ID NO: 129591 - protein, 23 aa, Mycobacterium avium
NGLTAAAILQRAGLRTVCLEANT

SEQ ID NO: 129592 - protein, 18 aa, Mycobacterium avium
NGLWAPHLGPELGGQGFG

SEQ ID NO: 129593 - protein, 18 aa, Mycobacterium avium
NGPFAGHTITVNGDLAFT

SEQ ID NO: 129594 - protein, 18 aa, Mycobacterium avium
NGPWIADRLLELGVELAH

SEQ ID NO: 129595 - protein, 19 aa, Mycobacterium avium
NGPWIADRLLELGVELAHI

SEQ ID NO: 129596 - protein, 17 aa, Mycobacterium avium
NGQAYAHAVAHEAAFGN

SEQ ID NO: 129597 - protein, 25 aa, Mycobacterium avium
NGQAYQFPMGLGLVSQFFGKYFSPE

SEQ ID NO: 129598 - protein, 17 aa, Mycobacterium avium
NGQFVTTKFFGMKVNKY

SEQ ID NO: 129599 - protein, 17 aa, Mycobacterium avium
NGQLNAGLLFISYQKDP

SEQ ID NO: 129600 - protein, 25 aa, Mycobacterium avium
NGQLNAGLLFISYQKDPQDFIRLQN

SEQ ID NO: 129601 - protein, 20 aa, Mycobacterium avium
NGRAVAMLTPLRPQRRRWLS

SEQ ID NO: 129602 - protein, 18 aa, Mycobacterium avium
NGRRDLFRPTVFHTLWAR

SEQ ID NO: 129603 - protein, 17 aa, Mycobacterium avium
NGSFPEFPLPLGNPSEA

SEQ ID NO: 129604 - protein, 24 aa, Mycobacterium avium
NGTAAILLAFYVAAAEKKGIPRAK

SEQ ID NO: 129605 - protein, 17 aa, Mycobacterium avium
NGTLKQGISSESAKKIT

SEQ ID NO: 129606 - protein, 18 aa, Mycobacterium avium
NGTYNLTRLVAAAVAAAE

SEQ ID NO: 129607 - protein, 26 aa, Mycobacterium avium
NGVCGYRRFFSITSLAGLRQEDPAVF

SEQ ID NO: 129608 - protein, 17 aa, Mycobacterium avium
NGVPPAQYPSMLTALRR

SEQ ID NO: 129609 - protein, 18 aa, Mycobacterium avium
NGVPPAQYPSMLTALRRA

SEQ ID NO: 129610 - protein, 23 aa, Mycobacterium avium
NGVWSPLEYGCHLRDVLLVQRER

SEQ ID NO: 129611 - protein, 22 aa, Mycobacterium avium
NGWDPEPLARLRSHPLLAGIRG

SEQ ID NO: 129612 - protein, 19 aa, Mycobacterium avium
NGWHQVTSELSFERSGPER

SEQ ID NO: 129613 - protein, 18 aa, Mycobacterium avium
NHGVHCLLVPIRDADGND

SEQ ID NO: 129614 - protein, 39 aa, Mycobacterium avium
NHHCYAGAIIHWLGPEQRDRWLRLGLVEEIDDTPPAAAA

SEQ ID NO: 129615 - protein, 18 aa, Mycobacterium avium
NHHIVLDGWSKPLLLQEI

SEQ ID NO: 129616 - protein, 19 aa, Mycobacterium avium
NHLVTVLSDALEALRAALR

SEQ ID NO: 129617 - protein, 19 aa, Mycobacterium avium
NHNYIGTEHILLGLIHEGE

SEQ ID NO: 129618 - protein, 19 aa, Mycobacterium avium
NHVAMHCLVPALPFGGVGA

SEQ ID NO: 129619 - protein, 19 aa, Mycobacterium avium
NHVIHCEEQLRGSLAGLSA

SEQ ID NO: 129620 - protein, 28 aa, Mycobacterium avium
NIAIELDGLRLITWRGAARAEQGLPFAR

SEQ ID NO: 129621 - protein, 31 aa, Mycobacterium avium
NIALLFNRDPAMLDLLVANDIRFVTTSAGDP

SEQ ID NO: 129622 - protein, 18 aa, Mycobacterium avium
NIARLLGAARAAGVAVVH

SEQ ID NO: 129623 - protein, 17 aa, Mycobacterium avium
NIDPLAEKFRVIVPDMP

SEQ ID NO: 129624 - protein, 25 aa, Mycobacterium avium
NIDRSTAFLTPRVKPLIITNQPDNF

SEQ ID NO: 129625 - protein, 19 aa, Mycobacterium avium
NIFPDQMVFLEQLRAHGQG

SEQ ID NO: 129626 - protein, 18 aa, Mycobacterium avium
NIHPMLEREIRANLMDLT

SEQ ID NO: 129627 - protein, 26 aa, Mycobacterium avium
NIQSKEGFFWRATLWATQETPVDNSI

SEQ ID NO: 129628 - protein, 17 aa, Mycobacterium avium
NITRLPVRYTFDNRYFS

SEQ ID NO: 129629 - protein, 22 aa, Mycobacterium avium
NITTPVRMLLGTESPAYLRAAT

SEQ ID NO: 129630 - protein, 24 aa, Mycobacterium avium
NKDTEPFWIAAKERRLVAPQCGDC

SEQ ID NO: 129631 - protein, 22 aa, Mycobacterium avium
NKGLELIETHLLFGIPYDRIEV

SEQ ID NO: 129632 - protein, 22 aa, Mycobacterium avium
NKITLRRRTGGSDAGWHLKLPA

SEQ ID NO: 129633 - protein, 26 aa, Mycobacterium avium
NKRLAWTACRTFLAINAHWIEAPEDE

SEQ ID NO: 129634 - protein, 23 aa, Mycobacterium avium
NKRPYHTIIPGFVTKGGAPVMSF

SEQ ID NO: 129635 - protein, 21 aa, Mycobacterium avium
NKSKTYRWTFAQVQGAPPKIT

SEQ ID NO: 129636 - protein, 25 aa, Mycobacterium avium
NKVPNASALLFRYTVNGYRGCSHAC

SEQ ID NO: 129637 - protein, 21 aa, Mycobacterium avium
NLAAHVLLHFGSDEQKRMLLP

SEQ ID NO: 129638 - protein, 20 aa, Mycobacterium avium
NLAALLARSGAGPGALVGLS

SEQ ID NO: 129639 - protein, 24 aa, Mycobacterium avium
NLAERQVLVLERVVVAVLQLRQQL

SEQ ID NO: 129640 - protein, 17 aa, Mycobacterium avium
NLAKARDFARRYLVPLV

SEQ ID NO: 129641 - protein, 20 aa, Mycobacterium avium
NLALPALLRERGITGRDAAF

SEQ ID NO: 129642 - protein, 20 aa, Mycobacterium avium
NLDDLLYWYTQSVVTGQAAK

SEQ ID NO: 129643 - protein, 17 aa, Mycobacterium avium
NLDKLDLKPGMTLLDIG

SEQ ID NO: 129644 - protein, 31 aa, Mycobacterium avium
NLDLTVVNPLVDATWRFMTLDHDGKIRMDCS

SEQ ID NO: 129645 - protein, 17 aa, Mycobacterium avium
NLDRLAYAGIRLTDFHS

SEQ ID NO: 129646 - protein, 19 aa, Mycobacterium avium
NLDRLHRRPVELEDFVTLC

SEQ ID NO: 129647 - protein, 21 aa, Mycobacterium avium
NLDSDYRSWFDRYARTFAATI

SEQ ID NO: 129648 - protein, 18 aa, Mycobacterium avium
NLDTLLEQLAKKPGIHAV

SEQ ID NO: 129649 - protein, 17 aa, Mycobacterium avium
NLDWLISVDDHILEPPN

SEQ ID NO: 129650 - protein, 22 aa, Mycobacterium avium
NLEHTVLGIFRDISRPTYDDAA

SEQ ID NO: 129651 - protein, 18 aa, Mycobacterium avium
NLEPLQIPHYGPPTHAMQ

SEQ ID NO: 129652 - protein, 21 aa, Mycobacterium avium
NLFVPQDNTPWPRKLQQPRRA

SEQ ID NO: 129653 - protein, 26 aa, Mycobacterium avium
NLGALEPLFAKTLKWASTTPLDDGMV

SEQ ID NO: 129654 - protein, 22 aa, Mycobacterium avium
NLGPELVPPSRYLAAPQATTAA

SEQ ID NO: 129655 - protein, 23 aa, Mycobacterium avium
NLGWTSWATRWLSRTPGAVPDHV

SEQ ID NO: 129656 - protein, 17 aa, Mycobacterium avium
NLIDYRLQITYPDSEPY

SEQ ID NO: 129657 - protein, 17 aa, Mycobacterium avium
NLIPDEKWRGITAPVMI

SEQ ID NO: 129658 - protein, 18 aa, Mycobacterium avium
NLKMPSHAVHIETLLTVF

SEQ ID NO: 129659 - protein, 23 aa, Mycobacterium avium
NLLDIWRRDDLAPGCRAPVLIQV

SEQ ID NO: 129660 - protein, 25 aa, Mycobacterium avium
NLQDHPIVPLVYRAARPVPAGRYNH

SEQ ID NO: 129661 - protein, 26 aa, Mycobacterium avium
NLQDHPIVPLVYRAARPVPAGRYNHG

SEQ ID NO: 129662 - protein, 17 aa, Mycobacterium avium
NLRAAWLTMIAVASTHQ

SEQ ID NO: 129663 - protein, 20 aa, Mycobacterium avium
NLTGVWHTVKAGVPHVLSGG

SEQ ID NO: 129664 - protein, 27 aa, Mycobacterium avium
NLTPQELAKFFILLIGAGNETTRNALT

SEQ ID NO: 129665 - protein, 20 aa, Mycobacterium avium
NLVQGMAHGLGPYVDNIAGT

SEQ ID NO: 129666 - protein, 17 aa, Mycobacterium avium
NLWLSDVFGAELIIPSY

SEQ ID NO: 129667 - protein, 18 aa, Mycobacterium avium
NLYMVGSFRLDPGQALVL

SEQ ID NO: 129668 - protein, 26 aa, Mycobacterium avium
NLYSDTFHVMLLGSGYTPDDTHRYQS

SEQ ID NO: 129669 - protein, 25 aa, Mycobacterium avium
NMCGPRPHLGGLRRSRLPAELITEI

SEQ ID NO: 129670 - protein, 24 aa, Mycobacterium avium
NMFGPMRLTMRCHDLLKSSRAAGG

SEQ ID NO: 129671 - protein, 18 aa, Mycobacterium avium
NMTGYPEAVLARELEICY

SEQ ID NO: 129672 - protein, 32 aa, Mycobacterium avium
NMWRDFFRNPIRLVLKVWDPIIKYWADASATL

SEQ ID NO: 129673 - protein, 31 aa, Mycobacterium avium
NMWRDFFRNPIRLVLKVWDPIIKYWAEASAT

SEQ ID NO: 129674 - protein, 26 aa, Mycobacterium avium
NNAGIEQFGYLWDTPVVNWQHVMDVN

SEQ ID NO: 129675 - protein, 22 aa, Mycobacterium avium
NNITFEDWQRVIDVNLNGVFHT

SEQ ID NO: 129676 - protein, 28 aa, Mycobacterium avium
NNSALLPPPAPRALLALLKGPPPDSPRE

SEQ ID NO: 129677 - protein, 20 aa, Mycobacterium avium
NPDAWFYQKPITLEQHQQSR

SEQ ID NO: 129678 - protein, 18 aa, Mycobacterium avium
NPDSLTLLGALAAWTERV

SEQ ID NO: 129679 - protein, 22 aa, Mycobacterium avium
NPEARLFIDGRLRDSSTGKTVD

SEQ ID NO: 129680 - protein, 20 aa, Mycobacterium avium
NPEAVYYRRGPFTPDDITAS

SEQ ID NO: 129681 - protein, 32 aa, Mycobacterium avium
NPEHLIAADLTWLLSRWTCVFGTPACRGTVAG

SEQ ID NO: 129682 - protein, 19 aa, Mycobacterium avium
NPELFYWAHASFVDQVIYN

SEQ ID NO: 129683 - protein, 23 aa, Mycobacterium avium
NPERIRLLEVLEHQTRRLQVPGH

SEQ ID NO: 129684 - protein, 24 aa, Mycobacterium avium
NPERIRLLEVLEYQTRRLQVPGHQ

SEQ ID NO: 129685 - protein, 23 aa, Mycobacterium avium
NPGQWYLHLFDTEQPDLNWEHPD

SEQ ID NO: 129686 - protein, 20 aa, Mycobacterium avium
NPLLPILDSVIYMLDGRPRY

SEQ ID NO: 129687 - protein, 23 aa, Mycobacterium avium
NPNDRAVYPLGFHSTPEILERVM

SEQ ID NO: 129688 - protein, 21 aa, Mycobacterium avium
NPPELLAYQFDNADNHVVICE

SEQ ID NO: 129689 - protein, 17 aa, Mycobacterium avium
NPRHRAVADAALESGVT

SEQ ID NO: 129690 - protein, 55 aa, Mycobacterium avium
NPSQFPALINYFIAWQTYRIINWTIRTLRFILQELPLLLQVGLSLSITSLGGMAG

SEQ ID NO: 129691 - protein, 24 aa, Mycobacterium avium
NPTRRQIHQFLAWAVHRGYAHDVA

SEQ ID NO: 129692 - protein, 20 aa, Mycobacterium avium
NPVRLAEAIRRFGPIFAQYY

SEQ ID NO: 129693 - protein, 20 aa, Mycobacterium avium
NPYGPPPVLLGALGPMMTRT

SEQ ID NO: 129694 - protein, 23 aa, Mycobacterium avium
NQFGSCQAIWRMDTGYVAASDPR

SEQ ID NO: 129695 - protein, 24 aa, Mycobacterium avium
NQGPAGWLRAKTGSLTAINALAGV

SEQ ID NO: 129696 - protein, 17 aa, Mycobacterium avium
NQKWLRRDFGSQLPSEV

SEQ ID NO: 129697 - protein, 25 aa, Mycobacterium avium
NQLRHDTRYLSLDGSRPRVTSRPHS

SEQ ID NO: 129698 - protein, 26 aa, Mycobacterium avium
NQPNRAFLRNWRDALELPPARHLDTF

SEQ ID NO: 129699 - protein, 23 aa, Mycobacterium avium
NQQLRIGLTSVYRILRALAADRI

SEQ ID NO: 129700 - protein, 23 aa, Mycobacterium avium
NQQPWKFVVLRSSALRDVVTAAA

SEQ ID NO: 129701 - protein, 23 aa, Mycobacterium avium
NQQRTVLEGRLEQLRTFEREYRT

SEQ ID NO: 129702 - protein, 21 aa, Mycobacterium avium
NQRQKFNPLVRLDSVNGGSVE

SEQ ID NO: 129703 - protein, 30 aa, Mycobacterium avium
NQTDGLPEGPLPLGTPVTGRLYFDVRNGTN

SEQ ID NO: 129704 - protein, 23 aa, Mycobacterium avium
NQTHSLGFITVWVAKRDRESSEP

SEQ ID NO: 129705 - protein, 17 aa, Mycobacterium avium
NRAIIVRRLLGLESVLS

SEQ ID NO: 129706 - protein, 19 aa, Mycobacterium avium
NRARTYFQAYSAAAALHFA

SEQ ID NO: 129707 - protein, 19 aa, Mycobacterium avium
NRAVLTRRPAAQASIPALF

SEQ ID NO: 129708 - protein, 19 aa, Mycobacterium avium
NRCLPGFFPRRRSRVPGND

SEQ ID NO: 129709 - protein, 17 aa, Mycobacterium avium
NRGLGPMLLPRIVASVF

SEQ ID NO: 129710 - protein, 24 aa, Mycobacterium avium
NRHSGWTLATFPPGYSGPADVFKR

SEQ ID NO: 129711 - protein, 32 aa, Mycobacterium avium
NRLNRLLEFVVRQEPRLNWAIGDRADGTTILV

SEQ ID NO: 129712 - protein, 23 aa, Mycobacterium avium
NRLPPVHVFAGINLSFGAMGPLL

SEQ ID NO: 129713 - protein, 25 aa, Mycobacterium avium
NRMESVATLIAIFRTERTLVTISPL

SEQ ID NO: 129714 - protein, 19 aa, Mycobacterium avium
NRMFLQRLKDKLGNHANAS

SEQ ID NO: 129715 - protein, 18 aa, Mycobacterium avium
NRQPWDFVIVTDRTQLQE

SEQ ID NO: 129716 - protein, 24 aa, Mycobacterium avium
NRRRARVHGFRLRMRTRAGRAIVS

SEQ ID NO: 129717 - protein, 26 aa, Mycobacterium avium
NRSKLSEMPVLWAYARDLFQTPGFGD

SEQ ID NO: 129718 - protein, 27 aa, Mycobacterium avium
NRSPRARLLALFDTPAPGDALMRGCPF

SEQ ID NO: 129719 - protein, 19 aa, Mycobacterium avium
NRSTIRWTLHQLVASGVVS

SEQ ID NO: 129720 - protein, 28 aa, Mycobacterium avium
NRVCRLAHIDIPILGAPMTYIAGAQLAA

SEQ ID NO: 129721 - protein, 19 aa, Mycobacterium avium
NRVYSTPVLTLGLVDEARR

SEQ ID NO: 129722 - protein, 17 aa, Mycobacterium avium
NRWYYFHQKAVANGMLT

SEQ ID NO: 129723 - protein, 23 aa, Mycobacterium avium
NSERIRLLEVLEHQTRRLQVPGH

SEQ ID NO: 129724 - protein, 25 aa, Mycobacterium avium
NSFLDALAIHRHAHGLPALSVAWGM

SEQ ID NO: 129725 - protein, 30 aa, Mycobacterium avium
NSLWELNVPRRDLRMLAARLGSDVPFALHG

SEQ ID NO: 129726 - protein, 24 aa, Mycobacterium avium
NSRAIWELYGGWFHHRSTTELFPI

SEQ ID NO: 129727 - protein, 24 aa, Mycobacterium avium
NSTLGLDFLRSCSIKHRMASVIFS

SEQ ID NO: 129728 - protein, 30 aa, Mycobacterium avium
NSVILRPSPLTPISSLIFGAAADAAGLPPG

SEQ ID NO: 129729 - protein, 17 aa, Mycobacterium avium
NTAFQLLEQSRSAVMLC

SEQ ID NO: 129730 - protein, 23 aa, Mycobacterium avium
NTDNMFGFWDWVGGRYSVDSAIG

SEQ ID NO: 129731 - protein, 20 aa, Mycobacterium avium
NTEAWQRCAYFTEVRQAGGD

SEQ ID NO: 129732 - protein, 18 aa, Mycobacterium avium
NTKQPPMWLVGSSNSQGG

SEQ ID NO: 129733 - protein, 31 aa, Mycobacterium avium
NTMVLKPAIETPWSALRWGRIIAEKTDIPAG

SEQ ID NO: 129734 - protein, 30 aa, Mycobacterium avium
NTNPDLLPKIFYVNWFRRGDDGTFLWPGFG

SEQ ID NO: 129735 - protein, 20 aa, Mycobacterium avium
NTPWRSEYLYSRAATIYGGT

SEQ ID NO: 129736 - protein, 21 aa, Mycobacterium avium
NTQLWACVDFDYLKKSDRQGA

SEQ ID NO: 129737 - protein, 18 aa, Mycobacterium avium
NTRVYLLDNALQPVPPGV

SEQ ID NO: 129738 - protein, 17 aa, Mycobacterium avium
NTSSVAFLGDYGGTGYP

SEQ ID NO: 129739 - protein, 23 aa, Mycobacterium avium
NTTLWASWALAGPTHRAYFGGDT

SEQ ID NO: 129740 - protein, 23 aa, Mycobacterium avium
NTVLWGGYTWEYWRATRAVKPEE

SEQ ID NO: 129741 - protein, 24 aa, Mycobacterium avium
NTVLWGGYTWEYWRATRAVKPQEY

SEQ ID NO: 129742 - protein, 20 aa, Mycobacterium avium
NTVPPFFPHASLAAPPPETA

SEQ ID NO: 129743 - protein, 22 aa, Mycobacterium avium
NTVRYRLRKMAEITNLSLDDSK

SEQ ID NO: 129744 - protein, 24 aa, Mycobacterium avium
NTVVVRLRPRPHQTFRELLAQTRD

SEQ ID NO: 129745 - protein, 18 aa, Mycobacterium avium
NVAGIIHRFARLNDLEFG

SEQ ID NO: 129746 - protein, 19 aa, Mycobacterium avium
NVAILAGDYLFATASRLVS

SEQ ID NO: 129747 - protein, 18 aa, Mycobacterium avium
NVAPPLNMDPRWVGAHVG

SEQ ID NO: 129748 - protein, 24 aa, Mycobacterium avium
NVASLLKLAPLGKKLYPGYIERLK

SEQ ID NO: 129749 - protein, 23 aa, Mycobacterium avium
NVDAVMRTLLARGLITEAGVDED

SEQ ID NO: 129750 - protein, 19 aa, Mycobacterium avium
NVDLWAPIRGFSPGKSTFG

SEQ ID NO: 129751 - protein, 17 aa, Mycobacterium avium
NVELLRPAGAISPHKST

SEQ ID NO: 129752 - protein, 25 aa, Mycobacterium avium
NVFNTIVSNILYNHTLDTAAAAGVA

SEQ ID NO: 129753 - protein, 24 aa, Mycobacterium avium
NVGLRDVLAALKWVRDNITAFGGD

SEQ ID NO: 129754 - protein, 18 aa, Mycobacterium avium
NVIAVRYLPDERVWPLPD

SEQ ID NO: 129755 - protein, 20 aa, Mycobacterium avium
NVIAVRYLPDERVWPLPDHA

SEQ ID NO: 129756 - protein, 21 aa, Mycobacterium avium
NVIFVKDKPAWLGRAWRRIGE

SEQ ID NO: 129757 - protein, 21 aa, Mycobacterium avium
NVKTSDISLAARILAEFPDHL

SEQ ID NO: 129758 - protein, 17 aa, Mycobacterium avium
NVLPQWTTLAAKPKTMF

SEQ ID NO: 129759 - protein, 19 aa, Mycobacterium avium
NVNIRLAIDWLDRWADDMP

SEQ ID NO: 129760 - protein, 22 aa, Mycobacterium avium
NVNPALLLKCLLMAATEGIASG

SEQ ID NO: 129761 - protein, 20 aa, Mycobacterium avium
NVPRRDLRMLAAQLGSDVPF

SEQ ID NO: 129762 - protein, 22 aa, Mycobacterium avium
NVRELIEITLVKNPAMRYRSGG

SEQ ID NO: 129763 - protein, 19 aa, Mycobacterium avium
NVRPLIPLQIDPPEHAKYR

SEQ ID NO: 129764 - protein, 37 aa, Mycobacterium avium
NVSLDKARRLLWPVKKKYGNKISWADLIIFAGNCALE

SEQ ID NO: 129765 - protein, 30 aa, Mycobacterium avium
NVSTDLLFNDAMYRTFRPDIDVPTKEDALQ

SEQ ID NO: 129766 - protein, 18 aa, Mycobacterium avium
NVTHLIEHLHLYLSVRTT

SEQ ID NO: 129767 - protein, 26 aa, Mycobacterium avium
NVTSRLIERFLAHFAIRDWDAMAELL

SEQ ID NO: 129768 - protein, 20 aa, Mycobacterium avium
NWHEAAVIYLAATLAGMVVN

SEQ ID NO: 129769 - protein, 23 aa, Mycobacterium avium
NWSADTPALTVSLRGLVDCVVEV

SEQ ID NO: 129770 - protein, 20 aa, Mycobacterium avium
NWTGIPVFKLTEAETTRLLR

SEQ ID NO: 129771 - protein, 27 aa, Mycobacterium avium
NWTGPSRFSAPLAARWISAGARIVGGC

SEQ ID NO: 129772 - protein, 17 aa, Mycobacterium avium
NYFGVTALNLVPGDGGR

SEQ ID NO: 129773 - protein, 17 aa, Mycobacterium avium
NYPPMRLARDGRDGNGC

SEQ ID NO: 129774 - protein, 34 aa, Mycobacterium avium
NYQGSKELFLWPTLRYWEFPKPMIAQVHGYAIGG

SEQ ID NO: 129775 - protein, 18 aa, Mycobacterium avium
NYQRLFSLRIGQTLREQF

SEQ ID NO: 129776 - protein, 23 aa, Mycobacterium avium
PAAADPVSLLAAARFAQHGQAFQ

SEQ ID NO: 129777 - protein, 28 aa, Mycobacterium avium
PAAEQTWLHGWLLRAGPPPGRPAGPAAD

SEQ ID NO: 129778 - protein, 27 aa, Mycobacterium avium
PAAEQTWLHGWLLRAGPPSGRPAGPAA

SEQ ID NO: 129779 - protein, 19 aa, Mycobacterium avium
PAAEYLRFLRDGGASPHTV

SEQ ID NO: 129780 - protein, 19 aa, Mycobacterium avium
PAAGLAELALSRGAAVVEV

SEQ ID NO: 129781 - protein, 37 aa, Mycobacterium avium
PAAGVMLSALWVGSTGRLVLIIHHLAVDGVSWRVLLE

SEQ ID NO: 129782 - protein, 25 aa, Mycobacterium avium
PAAICVNPLPLFHTAGCVIATLGPL

SEQ ID NO: 129783 - protein, 18 aa, Mycobacterium avium
PAAPAQRDPWPSAPVPLD

SEQ ID NO: 129784 - protein, 28 aa, Mycobacterium avium
PAARRRIVRPLPRRPPPPGSPRESRCRA

SEQ ID NO: 129785 - protein, 20 aa, Mycobacterium avium
PAAVDGWMESPLRGVVRNLG

SEQ ID NO: 129786 - protein, 21 aa, Mycobacterium avium
PAAVLKPYLIEAGIEPVMTNT

SEQ ID NO: 129787 - protein, 27 aa, Mycobacterium avium
PADDERAMLPTLPLPRARTLANYLAAK

SEQ ID NO: 129788 - protein, 32 aa, Mycobacterium avium
PADIRARLGQRLPAYMVPAAVVVLDALPLTVN

SEQ ID NO: 129789 - protein, 19 aa, Mycobacterium avium
PADLLDRLHWPTQGAPAGD

SEQ ID NO: 129790 - protein, 18 aa, Mycobacterium avium
PADLLPAVGLIKTITDTV

SEQ ID NO: 129791 - protein, 32 aa, Mycobacterium avium
PADLVREFALPVPSLVIALLLGVLPEDLELFQ

SEQ ID NO: 129792 - protein, 18 aa, Mycobacterium avium
PADPPGLTALDNLLGNPV

SEQ ID NO: 129793 - protein, 22 aa, Mycobacterium avium
PADRWDADLYYDPEPGVPGRSV

SEQ ID NO: 129794 - protein, 17 aa, Mycobacterium avium
PADVALPWVLSARSERA

SEQ ID NO: 129795 - protein, 27 aa, Mycobacterium avium
PADYQQWYPTFAESGLVVPTWAREHGG

SEQ ID NO: 129796 - protein, 25 aa, Mycobacterium avium
PAEDEWIWGRATVLAAGYLTGLAAA

SEQ ID NO: 129797 - protein, 20 aa, Mycobacterium avium
PAELRLTAAGVAALCDRRRG

SEQ ID NO: 129798 - protein, 21 aa, Mycobacterium avium
PAEPPSFRRGITGRRHRHWSL

SEQ ID NO: 129799 - protein, 22 aa, Mycobacterium avium
PAFQGTIKSAVAFGALLSRGIG

SEQ ID NO: 129800 - protein, 24 aa, Mycobacterium avium
PAFTDEPMPLCPFIAAAVEISDPQ

SEQ ID NO: 129801 - protein, 18 aa, Mycobacterium avium
PAGLLYDAFRENAATHPA

SEQ ID NO: 129802 - protein, 24 aa, Mycobacterium avium
PAGRLVDAPLPTWSHRRLMLRRES

SEQ ID NO: 129803 - protein, 20 aa, Mycobacterium avium
PAGRPVRYLAPGPPGAHDAA

SEQ ID NO: 129804 - protein, 26 aa, Mycobacterium avium
PAGTYVTFVSFPDLELALQSLDPQRS

SEQ ID NO: 129805 - protein, 25 aa, Mycobacterium avium
PAGVPIGFPVPGAGLFVLDESLRPV

SEQ ID NO: 129806 - protein, 24 aa, Mycobacterium avium
PAGVPIGFPVPGTGLFVLDESLRP

SEQ ID NO: 129807 - protein, 17 aa, Mycobacterium avium
PAHFGSAALSSVFAADV

SEQ ID NO: 129808 - protein, 27 aa, Mycobacterium avium
PAHRGLHVGVLVLRQPGRQPAPDRRQV

SEQ ID NO: 129809 - protein, 17 aa, Mycobacterium avium
PAHRRRAIDRLATDGET

SEQ ID NO: 129810 - protein, 32 aa, Mycobacterium avium
PAHVRSLLMPALQPEIRLAAPLLAKGLPACPG

SEQ ID NO: 129811 - protein, 32 aa, Mycobacterium avium
PAHVRSLLMPALQPEIRLTAPLLAKGLPACPG

SEQ ID NO: 129812 - protein, 27 aa, Mycobacterium avium
PAIAKALRWQFDGVDRVGPDLLLSLVP

SEQ ID NO: 129813 - protein, 21 aa, Mycobacterium avium
PAIQMPADLPDRLAGVTYPPG

SEQ ID NO: 129814 - protein, 17 aa, Mycobacterium avium
PAIRLASGLAPATAAAA

SEQ ID NO: 129815 - protein, 20 aa, Mycobacterium avium
PAKEPLPVFADRWFQRYSQG

SEQ ID NO: 129816 - protein, 17 aa, Mycobacterium avium
PAKLLAARIADRQVALA

SEQ ID NO: 129817 - protein, 26 aa, Mycobacterium avium
PALARTLRRALPLMARLTLAKVPARV

SEQ ID NO: 129818 - protein, 17 aa, Mycobacterium avium
PALDVVGLHRLAIVCHG

SEQ ID NO: 129819 - protein, 23 aa, Mycobacterium avium
PALEALAPVRAVLPAGAAALAAA

SEQ ID NO: 129820 - protein, 21 aa, Mycobacterium avium
PALIAFAGGDPWAINRSLQAG

SEQ ID NO: 129821 - protein, 22 aa, Mycobacterium avium
PALREELVTALIRSLPKDLRRN

SEQ ID NO: 129822 - protein, 18 aa, Mycobacterium avium
PALTIMALASRLAERLAA

SEQ ID NO: 129823 - protein, 33 aa, Mycobacterium avium
PALTRGLDGLATYPWPASTVRNWFRGDYANLTL

SEQ ID NO: 129824 - protein, 18 aa, Mycobacterium avium
PAMNLFTLQVVDSAVSLG

SEQ ID NO: 129825 - protein, 25 aa, Mycobacterium avium
PAMPAECLLDRNALIMGYSGVYSSF

SEQ ID NO: 129826 - protein, 25 aa, Mycobacterium avium
PANAKWFFDNFGPGDPIIVKNSSGG

SEQ ID NO: 129827 - protein, 26 aa, Mycobacterium avium
PAPARWAMRFPGGKALQRLLSQAYVE

SEQ ID NO: 129828 - protein, 26 aa, Mycobacterium avium
PAPDLVLDALTMFGAIGFTWEHDLHL

SEQ ID NO: 129829 - protein, 27 aa, Mycobacterium avium
PAPDLVLDALTMFGAIGFTWEHDLHLY

SEQ ID NO: 129830 - protein, 26 aa, Mycobacterium avium
PAPDTMTYLTALLPVAQGVSVYAALR

SEQ ID NO: 129831 - protein, 27 aa, Mycobacterium avium
PAPEAPPAAPPPPPPPAPEAPPGGPPP

SEQ ID NO: 129832 - protein, 20 aa, Mycobacterium avium
PAPEHDDPLGEIIFISATRT

SEQ ID NO: 129833 - protein, 28 aa, Mycobacterium avium
PAPHHTRPVRFVWLQTPAVRTQLLDAMK

SEQ ID NO: 129834 - protein, 28 aa, Mycobacterium avium
PAPHHTRPVRFVWLQTPAVRTRLLDAMK

SEQ ID NO: 129835 - protein, 29 aa, Mycobacterium avium
PAPHHTRPVRFVWLQTPAVRTRLLDAMKD

SEQ ID NO: 129836 - protein, 25 aa, Mycobacterium avium
PAPPSYRSYLMWLSAQDRAAAQDAW

SEQ ID NO: 129837 - protein, 23 aa, Mycobacterium avium
PAPVARFLARWVRRAGPRIVEPS

SEQ ID NO: 129838 - protein, 22 aa, Mycobacterium avium
PAPVARFLSRWVRRAGPRIVEP

SEQ ID NO: 129839 - protein, 17 aa, Mycobacterium avium
PAQGGVPGVPQIGSADA

SEQ ID NO: 129840 - protein, 17 aa, Mycobacterium avium
PAQHPHQVGRAHRRPIV

SEQ ID NO: 129841 - protein, 26 aa, Mycobacterium avium
PAQIERLLMPLLRGDEWWALGMSEPE

SEQ ID NO: 129842 - protein, 22 aa, Mycobacterium avium
PAQLRTLLRRISGVDAVLAEIG

SEQ ID NO: 129843 - protein, 32 aa, Mycobacterium avium
PAQPTAWLAEGVLIGFLPPEAEVRLLDSITPL

SEQ ID NO: 129844 - protein, 26 aa, Mycobacterium avium
PAQQRRFGWLLFSLRLADRLIPHGVW

SEQ ID NO: 129845 - protein, 20 aa, Mycobacterium avium
PARALLKKAPTLRRIVKRQQ

SEQ ID NO: 129846 - protein, 18 aa, Mycobacterium avium
PARHFSGRFLDRNTTLWA

SEQ ID NO: 129847 - protein, 20 aa, Mycobacterium avium
PARPALGVAPTPHAVPGQRN

SEQ ID NO: 129848 - protein, 18 aa, Mycobacterium avium
PARRPAVDQLGQAGLPDG

SEQ ID NO: 129849 - protein, 17 aa, Mycobacterium avium
PARTWREHSMAAMKPRT

SEQ ID NO: 129850 - protein, 18 aa, Mycobacterium avium
PARVLLLGGTPFPEQLVM

SEQ ID NO: 129851 - protein, 17 aa, Mycobacterium avium
PARWAMRIPGGKSVQRL

SEQ ID NO: 129852 - protein, 17 aa, Mycobacterium avium
PASARFLLRVRRDELLG

SEQ ID NO: 129853 - protein, 18 aa, Mycobacterium avium
PASARFLLRVRRDELLGA

SEQ ID NO: 129854 - protein, 24 aa, Mycobacterium avium
PASDRPWLTHFSDRWNRLGRRVTA

SEQ ID NO: 129855 - protein, 20 aa, Mycobacterium avium
PASEAAIALAFDEASRRGVG

SEQ ID NO: 129856 - protein, 17 aa, Mycobacterium avium
PASRRSRRCFRTSAWWW

SEQ ID NO: 129857 - protein, 17 aa, Mycobacterium avium
PASWRVILGELGAALTA

SEQ ID NO: 129858 - protein, 24 aa, Mycobacterium avium
PATALADLPLLLDEGHCLRDQALD

SEQ ID NO: 129859 - protein, 27 aa, Mycobacterium avium
PATDLAPLLVFLVGEGSGFITGQLLAV

SEQ ID NO: 129860 - protein, 25 aa, Mycobacterium avium
PATGQFLWQNIFGVWPVTGEVTAAL

SEQ ID NO: 129861 - protein, 24 aa, Mycobacterium avium
PATRLLRPSIMWRAARARGADHPG

SEQ ID NO: 129862 - protein, 24 aa, Mycobacterium avium
PATVPAAAPVPPPPAPAAAAPATP

SEQ ID NO: 129863 - protein, 19 aa, Mycobacterium avium
PAVDAWLGQWDEGFSARLG

SEQ ID NO: 129864 - protein, 17 aa, Mycobacterium avium
PAVERLAISPKPPPPSW

SEQ ID NO: 129865 - protein, 17 aa, Mycobacterium avium
PAVERLAYFAEAAAAQL

SEQ ID NO: 129866 - protein, 18 aa, Mycobacterium avium
PAVFRACSPPLTCSYSQP

SEQ ID NO: 129867 - protein, 24 aa, Mycobacterium avium
PAVGALLSLLTKLSGGKAIAEVGT

SEQ ID NO: 129868 - protein, 28 aa, Mycobacterium avium
PAVIKNAIDWLSRPFGDGALKGKPLAVI

SEQ ID NO: 129869 - protein, 20 aa, Mycobacterium avium
PAVILIDEWVAYARSLLGRD

SEQ ID NO: 129870 - protein, 28 aa, Mycobacterium avium
PAVNTPQFSWVLSRLPRHPQPVPPIYQP

SEQ ID NO: 129871 - protein, 20 aa, Mycobacterium avium
PAVQLEARQLFRGAGDDDRT

SEQ ID NO: 129872 - protein, 32 aa, Mycobacterium avium
PAVVPLSFAQSRLWFLDQLQGPSPVYNMAAAL

SEQ ID NO: 129873 - protein, 19 aa, Mycobacterium avium
PAVWMRRLPEDGMLPAKLA

SEQ ID NO: 129874 - protein, 20 aa, Mycobacterium avium
PAWVTLLRSAGAHDTYLRTY

SEQ ID NO: 129875 - protein, 28 aa, Mycobacterium avium
PAYDELKPDAWLANIFREEMCRLGRQPV

SEQ ID NO: 129876 - protein, 19 aa, Mycobacterium avium
PAYTLSKYGMTLLSLGWAA

SEQ ID NO: 129877 - protein, 24 aa, Mycobacterium avium
PCVYNKHMIFPKPGVDLSNPDNFA

SEQ ID NO: 129878 - protein, 30 aa, Mycobacterium avium
PDADIVISQPFWPAYITKERFAKARNLKLA

SEQ ID NO: 129879 - protein, 25 aa, Mycobacterium avium
PDAEAMLWHVIGCCLENLMAGKPHE

SEQ ID NO: 129880 - protein, 19 aa, Mycobacterium avium
PDAIAIRYGERQWSWAEWS

SEQ ID NO: 129881 - protein, 18 aa, Mycobacterium avium
PDATPGIMIPFLASHTAK

SEQ ID NO: 129882 - protein, 29 aa, Mycobacterium avium
PDCEPLADYLFPAAKILEPFGLEKMRYKW

SEQ ID NO: 129883 - protein, 21 aa, Mycobacterium avium
PDCHLDPRSLVRMIEDLRPTV

SEQ ID NO: 129884 - protein, 30 aa, Mycobacterium avium
PDDDRPFFAYLPFQAPHWPLQAPDESIAKY

SEQ ID NO: 129885 - protein, 17 aa, Mycobacterium avium
PDDFVHLLLGVASVGAG

SEQ ID NO: 129886 - protein, 25 aa, Mycobacterium avium
PDDLEIRAPWTLPKRSRKAGPSSRL

SEQ ID NO: 129887 - protein, 26 aa, Mycobacterium avium
PDDRQSMLFSATMPDPIITLARTFMN

SEQ ID NO: 129888 - protein, 25 aa, Mycobacterium avium
PDEDPHIPSLYRIYPTTDWHERETY

SEQ ID NO: 129889 - protein, 17 aa, Mycobacterium avium
PDELVGVDYYRPTGRGA

SEQ ID NO: 129890 - protein, 19 aa, Mycobacterium avium
PDEWMAIRYDNVVGVPHAD

SEQ ID NO: 129891 - protein, 19 aa, Mycobacterium avium
PDFDLAWHLRRVAIAGTGD

SEQ ID NO: 129892 - protein, 26 aa, Mycobacterium avium
PDGARDLIRAFWPGALSLVVPQAPSL

SEQ ID NO: 129893 - protein, 29 aa, Mycobacterium avium
PDGDDDWLIARWGCLRAANLFWGCGDAEA

SEQ ID NO: 129894 - protein, 25 aa, Mycobacterium avium
PDGDPHIPSLYRIYPTTDWHERETY

SEQ ID NO: 129895 - protein, 31 aa, Mycobacterium avium
PDGLPHVPVRLHARSWHRYPEPSPDATAMII

SEQ ID NO: 129896 - protein, 28 aa, Mycobacterium avium
PDGPVLLQDFYLIEQLAAFNRERVPERQ

SEQ ID NO: 129897 - protein, 19 aa, Mycobacterium avium
PDGPYHLVGWSFGGVVAHE

SEQ ID NO: 129898 - protein, 22 aa, Mycobacterium avium
PDHAVGSMRLLFAELRNVDIQF

SEQ ID NO: 129899 - protein, 29 aa, Mycobacterium avium
PDISPLQARCGWAIGWKKEAFFGRDALLA

SEQ ID NO: 129900 - protein, 24 aa, Mycobacterium avium
PDKGELVMFLTTRMPPGAPRTKPT

SEQ ID NO: 129901 - protein, 21 aa, Mycobacterium avium
PDLIGLRQAIYRREDTRRTID

SEQ ID NO: 129902 - protein, 19 aa, Mycobacterium avium
PDLIGLRQAVYRREDTRNT

SEQ ID NO: 129903 - protein, 25 aa, Mycobacterium avium
PDLVRRLCWDWEPTPDPFAAVDAFL

SEQ ID NO: 129904 - protein, 25 aa, Mycobacterium avium
PDLVRRLCWDWEPTPDPFAAVEAFL

SEQ ID NO: 129905 - protein, 24 aa, Mycobacterium avium
PDMALIPMRTIPNAELHIFPNSGH

SEQ ID NO: 129906 - protein, 29 aa, Mycobacterium avium
PDNPLHPLALRLLRPKQVIMLGRPTLHRP

SEQ ID NO: 129907 - protein, 23 aa, Mycobacterium avium
PDPEVLAPLQDLASRYALAAVSS

SEQ ID NO: 129908 - protein, 35 aa, Mycobacterium avium
PDPGQWIGNSLFRPAYKHWLLKDELIRIEATAARR

SEQ ID NO: 129909 - protein, 22 aa, Mycobacterium avium
PDPHWPQTDGPKYTWIHETRPL

SEQ ID NO: 129910 - protein, 18 aa, Mycobacterium avium
PDPLPPHRYRLVNQTAGE

SEQ ID NO: 129911 - protein, 28 aa, Mycobacterium avium
PDPQLFGLSPTHRLYPTADGWVMLAVSD

SEQ ID NO: 129912 - protein, 22 aa, Mycobacterium avium
PDPSPELMARWRSRRTHEHPLV

SEQ ID NO: 129913 - protein, 22 aa, Mycobacterium avium
PDPTLPPLPLAGVRIVDLTAFW

SEQ ID NO: 129914 - protein, 17 aa, Mycobacterium avium
PDQRLDAVRVEHVGAEF

SEQ ID NO: 129915 - protein, 23 aa, Mycobacterium avium
PDQVQQILRRWADNLWDTGIEFG

SEQ ID NO: 129916 - protein, 32 aa, Mycobacterium avium
PDRDARGQRLLDDPFLLCFNAHHESIEFTLPP

SEQ ID NO: 129917 - protein, 27 aa, Mycobacterium avium
PDRDARGQRLLDDSFLLCFNAHHESIE

SEQ ID NO: 129918 - protein, 28 aa, Mycobacterium avium
PDRDARGQRLLDDSFLLCFNAHHESIEF

SEQ ID NO: 129919 - protein, 28 aa, Mycobacterium avium
PDRGHVFRRAFSWLPAQFASQSDAPVGA

SEQ ID NO: 129920 - protein, 22 aa, Mycobacterium avium
PDRHLGGILYLFVRGMCGPDTP

SEQ ID NO: 129921 - protein, 17 aa, Mycobacterium avium
PDRLLLGRSFAYPDAHR

SEQ ID NO: 129922 - protein, 20 aa, Mycobacterium avium
PDRLRVHSLARTLGTTSKRV

SEQ ID NO: 129923 - protein, 22 aa, Mycobacterium avium
PDRPDNMFALANTLMGLATGHT

SEQ ID NO: 129924 - protein, 32 aa, Mycobacterium avium
PDRPYTQWERWAFAHLPLAKKLYRTRLWLRSE

SEQ ID NO: 129925 - protein, 23 aa, Mycobacterium avium
PDRVFKLPDKVSFEAGAGLLFND

SEQ ID NO: 129926 - protein, 20 aa, Mycobacterium avium
PDRYLALPDFALDRLQWEAL

SEQ ID NO: 129927 - protein, 21 aa, Mycobacterium avium
PDSAQVRLKRMYPAASYRATT

SEQ ID NO: 129928 - protein, 22 aa, Mycobacterium avium
PDSTLSFFRRALELRRRRVEFD

SEQ ID NO: 129929 - protein, 28 aa, Mycobacterium avium
PDSWRAGDLTLPLTYRFQPGAADDGVTV

SEQ ID NO: 129930 - protein, 33 aa, Mycobacterium avium
PDTTTVSWLPFYHDLGLILGICAPILAGVRSVF

SEQ ID NO: 129931 - protein, 29 aa, Mycobacterium avium
PDTVRVIRQPWWAPIIDLADGPAVLISGD

SEQ ID NO: 129932 - protein, 25 aa, Mycobacterium avium
PDTVRVIRQPWWAPIIDVADGPAVL

SEQ ID NO: 129933 - protein, 23 aa, Mycobacterium avium
PDTVTAWRRALHRWLQHEVRAPD

SEQ ID NO: 129934 - protein, 25 aa, Mycobacterium avium
PDVVGVAVMGLLDRAWHTVHRQTVA

SEQ ID NO: 129935 - protein, 24 aa, Mycobacterium avium
PDWASIPYGYPLANQMFRVVDDNG

SEQ ID NO: 129936 - protein, 23 aa, Mycobacterium avium
PEADHIASFALPIDDLDLTVRSY

SEQ ID NO: 129937 - protein, 23 aa, Mycobacterium avium
PEAMRAIGLPKLVEDERFASPAA

SEQ ID NO: 129938 - protein, 20 aa, Mycobacterium avium
PEAYLRAVIAWHFGADTGSP

SEQ ID NO: 129939 - protein, 17 aa, Mycobacterium avium
PEDHESLRYARSAVVLG

SEQ ID NO: 129940 - protein, 17 aa, Mycobacterium avium
PEDIAGAVAWLVSDEAK

SEQ ID NO: 129941 - protein, 23 aa, Mycobacterium avium
PEEDGLVHHMLIGRAQTILGGTS

SEQ ID NO: 129942 - protein, 24 aa, Mycobacterium avium
PEEDHQRVFHWTNVILGFGDSDLA

SEQ ID NO: 129943 - protein, 28 aa, Mycobacterium avium
PEELADAFAKAWYKLLHRDMGPVSRFLG

SEQ ID NO: 129944 - protein, 19 aa, Mycobacterium avium
PEFFAEMLAILDLDPEAVG

SEQ ID NO: 129945 - protein, 31 aa, Mycobacterium avium
PEGLKGLYEFFTPLLRNLGHCARVVVVGTTP

SEQ ID NO: 129946 - protein, 18 aa, Mycobacterium avium
PEHRLLDVFNLVPAVIDT

SEQ ID NO: 129947 - protein, 25 aa, Mycobacterium avium
PEHSDLLLRWAGQLAPGSWIGVQMP

SEQ ID NO: 129948 - protein, 19 aa, Mycobacterium avium
PEIVPRRPVIRPVPVDDSG

SEQ ID NO: 129949 - protein, 20 aa, Mycobacterium avium
PEIVWYLDEPVADPALVPLF

SEQ ID NO: 129950 - protein, 20 aa, Mycobacterium avium
PEKLAKFRDAEKLTFPLLSD

SEQ ID NO: 129951 - protein, 30 aa, Mycobacterium avium
PELAGRWRRALQLDPLAPGALARLILAASA

SEQ ID NO: 129952 - protein, 30 aa, Mycobacterium avium
PELAGRWRRALQLDPLAPGVLARLILAASA

SEQ ID NO: 129953 - protein, 20 aa, Mycobacterium avium
PELAWGLMIATVRHLADEHR

SEQ ID NO: 129954 - protein, 18 aa, Mycobacterium avium
PELHHTVVVAAFEGWNDA

SEQ ID NO: 129955 - protein, 19 aa, Mycobacterium avium
PELHYTYRQYRQAIEAEDA

SEQ ID NO: 129956 - protein, 17 aa, Mycobacterium avium
PELLGSMRRGGVAAVSP

SEQ ID NO: 129957 - protein, 18 aa, Mycobacterium avium
PELWTWVAVSGLNLLYQA

SEQ ID NO: 129958 - protein, 25 aa, Mycobacterium avium
PEMGRPRFGSWLRNSTRGALAMDPR

SEQ ID NO: 129959 - protein, 19 aa, Mycobacterium avium
PEMMRHVLSPVLRIYRLDV

SEQ ID NO: 129960 - protein, 18 aa, Mycobacterium avium
PEMTVLVGGLRALGANHG

SEQ ID NO: 129961 - protein, 22 aa, Mycobacterium avium
PEPARVWPDVLAFTRSSDPAQT

SEQ ID NO: 129962 - protein, 17 aa, Mycobacterium avium
PEPFLYTYCRDDDPQVL

SEQ ID NO: 129963 - protein, 19 aa, Mycobacterium avium
PEPGHRASPSWLGKDGFKP

SEQ ID NO: 129964 - protein, 24 aa, Mycobacterium avium
PEPGRPQRAAAHRGWLAPARRLGH

SEQ ID NO: 129965 - protein, 25 aa, Mycobacterium avium
PEPWRVEALVLVAFSAYARGDGPLA

SEQ ID NO: 129966 - protein, 19 aa, Mycobacterium avium
PEQGGYPPQQGYPPPRHPE

SEQ ID NO: 129967 - protein, 25 aa, Mycobacterium avium
PEQKERLLRQLAENNWWTGNASSEN

SEQ ID NO: 129968 - protein, 24 aa, Mycobacterium avium
PEQRALQVHIVLDSLPGVEAPVNA

SEQ ID NO: 129969 - protein, 18 aa, Mycobacterium avium
PEQVADLIIQPLIQQSIA

SEQ ID NO: 129970 - protein, 22 aa, Mycobacterium avium
PEQVNELLPCTASVLVNILEEQ

SEQ ID NO: 129971 - protein, 28 aa, Mycobacterium avium
PERDFPTLIELYLQGRLPLEKFVSERIG

SEQ ID NO: 129972 - protein, 30 aa, Mycobacterium avium
PERGTLLAAVWLRPPAGESVLLLAAHVVAL

SEQ ID NO: 129973 - protein, 24 aa, Mycobacterium avium
PERLRLLEIFERETRRLRAPGHQL

SEQ ID NO: 129974 - protein, 20 aa, Mycobacterium avium
PERRQIFARRLDLPGRGQTM

SEQ ID NO: 129975 - protein, 21 aa, Mycobacterium avium
PERVVLLRRLVACRGTVRVRV

SEQ ID NO: 129976 - protein, 24 aa, Mycobacterium avium
PESVSFLRQFLASPPGQRQQMAQM

SEQ ID NO: 129977 - protein, 32 aa, Mycobacterium avium
PETLQRIKDLVIPPAWKKVWISPHPNGHIQAV

SEQ ID NO: 129978 - protein, 17 aa, Mycobacterium avium
PETLRSLYFLSSRVTGG

SEQ ID NO: 129979 - protein, 21 aa, Mycobacterium avium
PETLRSLYFLSSRVTGGSPHA

SEQ ID NO: 129980 - protein, 29 aa, Mycobacterium avium
PETVQEETWIRVLFAKTAISTGWDCPRAE

SEQ ID NO: 129981 - protein, 30 aa, Mycobacterium avium
PEVACTVWSNLVLIAGLRNGQRLLVHGGAS

SEQ ID NO: 129982 - protein, 19 aa, Mycobacterium avium
PEVWRPIHKDIDLLASSEH

SEQ ID NO: 129983 - protein, 17 aa, Mycobacterium avium
PEVYWRSRRFSLDDYRF

SEQ ID NO: 129984 - protein, 17 aa, Mycobacterium avium
PEYMVPAAVVVLDALPL

SEQ ID NO: 129985 - protein, 18 aa, Mycobacterium avium
PEYMVPAAVVVLETLPLT

SEQ ID NO: 129986 - protein, 19 aa, Mycobacterium avium
PEYSTLDWFEPLQYVDDGK

SEQ ID NO: 129987 - protein, 20 aa, Mycobacterium avium
PFACGPHHRLLQPGAWTTHR

SEQ ID NO: 129988 - protein, 31 aa, Mycobacterium avium
PFAGLKVFDLSTFWAGAYLTCYLGAFGADVI

SEQ ID NO: 129989 - protein, 17 aa, Mycobacterium avium
PFEVPAEFRRAAELPHT

SEQ ID NO: 129990 - protein, 30 aa, Mycobacterium avium
PFFALTVFARGLLNRLFTRAYLPGAGPDTD

SEQ ID NO: 129991 - protein, 19 aa, Mycobacterium avium
PFFRDIDRLTQQLWGAVPW

SEQ ID NO: 129992 - protein, 21 aa, Mycobacterium avium
PFGELVFPLPATELPYLHPVT

SEQ ID NO: 129993 - protein, 20 aa, Mycobacterium avium
PFGSGHYLALRQFPATSFSP

SEQ ID NO: 129994 - protein, 25 aa, Mycobacterium avium
PFLKTNEYLDWRRQWDAANRARDGY

SEQ ID NO: 129995 - protein, 20 aa, Mycobacterium avium
PFNDIILFTQDWGFRLDQVK

SEQ ID NO: 129996 - protein, 19 aa, Mycobacterium avium
PFRALRRVRAVLDAAGRCH

SEQ ID NO: 129997 - protein, 19 aa, Mycobacterium avium
PFTASGLAQWGPPASKNFL

SEQ ID NO: 129998 - protein, 18 aa, Mycobacterium avium
PFVLEQWAEPGAAALQDA

SEQ ID NO: 129999 - protein, 19 aa, Mycobacterium avium
PFWACASELGLPLTFHSGT

SEQ ID NO: 130000 - protein, 27 aa, Mycobacterium avium
PGAECCRRLFRLPPVPVRQTRTSDPYF

SEQ ID NO: 130001 - protein, 35 aa, Mycobacterium avium
PGALAPLRRLATGHWLRRWWPASRQDGIAGLDRAL

SEQ ID NO: 130002 - protein, 35 aa, Mycobacterium avium
PGALRAHLAVRLPQYMIPKVFVSCPELPLTANGKV

SEQ ID NO: 130003 - protein, 24 aa, Mycobacterium avium
PGASYFVLVFDRNAMPAEGPVNAV

SEQ ID NO: 130004 - protein, 20 aa, Mycobacterium avium
PGAVPLLAAAAAWDGLAAEL

SEQ ID NO: 130005 - protein, 17 aa, Mycobacterium avium
PGDARLRIKRRRTERER

SEQ ID NO: 130006 - protein, 25 aa, Mycobacterium avium
PGDFDELLIALSLFDMVGIGIQVPD

SEQ ID NO: 130007 - protein, 24 aa, Mycobacterium avium
PGDGYLSWPDLTAGRYRRTSPSAD

SEQ ID NO: 130008 - protein, 29 aa, Mycobacterium avium
PGDLDEDLRWQPPLWRALLARVAADPPHV

SEQ ID NO: 130009 - protein, 17 aa, Mycobacterium avium
PGDPERVVLLRRLVACR

SEQ ID NO: 130010 - protein, 23 aa, Mycobacterium avium
PGDPRVLALWRTADTESLAAVLR

SEQ ID NO: 130011 - protein, 17 aa, Mycobacterium avium
PGDPYYLQYTHDPLHDP

SEQ ID NO: 130012 - protein, 21 aa, Mycobacterium avium
PGDRIPYAPPFGVAMAAWDTE

SEQ ID NO: 130013 - protein, 17 aa, Mycobacterium avium
PGDVLYLPRGQVHSART

SEQ ID NO: 130014 - protein, 19 aa, Mycobacterium avium
PGDVRLLQHKPTHWSYPEA

SEQ ID NO: 130015 - protein, 18 aa, Mycobacterium avium
PGEQRIYAIPNDTGRVVT

SEQ ID NO: 130016 - protein, 29 aa, Mycobacterium avium
PGERRRIRWGARAMLWQASSLKAVRCCGR

SEQ ID NO: 130017 - protein, 38 aa, Mycobacterium avium
PGFAAFYRRCRLVTERLWPTLLEPLRSRRHARRHVVDG

SEQ ID NO: 130018 - protein, 25 aa, Mycobacterium avium
PGFDDRPFSVFYSLAVLSVGQEHAI

SEQ ID NO: 130019 - protein, 23 aa, Mycobacterium avium
PGFGDRRKAMLQDMAILTGGQVI

SEQ ID NO: 130020 - protein, 24 aa, Mycobacterium avium
PGGCGRDYRILSVAMLEVTFCGFA

SEQ ID NO: 130021 - protein, 17 aa, Mycobacterium avium
PGGFVRDVVERVAPSIL

SEQ ID NO: 130022 - protein, 29 aa, Mycobacterium avium
PGGLGAARFGFPNPAPLAAPPGAAGADDA

SEQ ID NO: 130023 - protein, 29 aa, Mycobacterium avium
PGGLGAARFGFPNPAPLAAPPGAPGADDA

SEQ ID NO: 130024 - protein, 24 aa, Mycobacterium avium
PGGRLVFNTFLAHDGYVPDAAAVQ

SEQ ID NO: 130025 - protein, 17 aa, Mycobacterium avium
PGGRPLVSDPGLALTPG

SEQ ID NO: 130026 - protein, 19 aa, Mycobacterium avium
PGGVKLAAGWLVERAGFGK

SEQ ID NO: 130027 - protein, 17 aa, Mycobacterium avium
PGHPLLGRRMPDLDLVT

SEQ ID NO: 130028 - protein, 32 aa, Mycobacterium avium
PGIDFTNDPLLQFRNFSYLDTQLIRLGGPNFA

SEQ ID NO: 130029 - protein, 25 aa, Mycobacterium avium
PGLGRKAPIYVIEDAPWSAFRDRDN

SEQ ID NO: 130030 - protein, 25 aa, Mycobacterium avium
PGLLELRRLVLGRPPPGRSRARFGR

SEQ ID NO: 130031 - protein, 31 aa, Mycobacterium avium
PGLLPRQLRPVLRLVWPVLTSLAARPVVVCS

SEQ ID NO: 130032 - protein, 25 aa, Mycobacterium avium
PGLRQRFDEVIGRLAEGLAATVQYK

SEQ ID NO: 130033 - protein, 21 aa, Mycobacterium avium
PGLTAARFVACPFGDAGARMY

SEQ ID NO: 130034 - protein, 25 aa, Mycobacterium avium
PGMAAPPVRLLPTNLAPHAVGALYR

SEQ ID NO: 130035 - protein, 17 aa, Mycobacterium avium
PGNFLSAGGHYQAPGHT

SEQ ID NO: 130036 - protein, 25 aa, Mycobacterium avium
PGNLDIADWWAYLDDVQSTYPLSYG

SEQ ID NO: 130037 - protein, 17 aa, Mycobacterium avium
PGNPRHRAVADAALESG

SEQ ID NO: 130038 - protein, 29 aa, Mycobacterium avium
PGPARSRPPARWWPAPPARRRGAVVCRRR

SEQ ID NO: 130039 - protein, 24 aa, Mycobacterium avium
PGPEWASAVIAAALRHCRPEQVLP

SEQ ID NO: 130040 - protein, 35 aa, Mycobacterium avium
PGPPGTWGKGEPPPLLWAVIQALVSEVWPDGDEAG

SEQ ID NO: 130041 - protein, 28 aa, Mycobacterium avium
PGPPPGAAPLPGPPPGAAPLPGPPPGAA

SEQ ID NO: 130042 - protein, 18 aa, Mycobacterium avium
PGPQGPIAVRIYWPPSHS

SEQ ID NO: 130043 - protein, 17 aa, Mycobacterium avium
PGPVQPATVPAAAPVPP

SEQ ID NO: 130044 - protein, 26 aa, Mycobacterium avium
PGQHRGVAPLFEPGVLVGVEQVDRRQ

SEQ ID NO: 130045 - protein, 24 aa, Mycobacterium avium
PGQPGKYLAIFGDSFSGNKMGDGE

SEQ ID NO: 130046 - protein, 26 aa, Mycobacterium avium
PGQPPPPLPVFTPSPSDWSPNFDIWP

SEQ ID NO: 130047 - protein, 20 aa, Mycobacterium avium
PGRQVLFDRLRRLAADVIAL

SEQ ID NO: 130048 - protein, 25 aa, Mycobacterium avium
PGRVSSLIAQLLPVVGDMPLGGHFH

SEQ ID NO: 130049 - protein, 20 aa, Mycobacterium avium
PGRVWFSTFGDPVAFRILDL

SEQ ID NO: 130050 - protein, 21 aa, Mycobacterium avium
PGSALLFPTLCTPTGAVSPAK

SEQ ID NO: 130051 - protein, 25 aa, Mycobacterium avium
PGSDTYVILLSNSIHLRGSPPISNL

SEQ ID NO: 130052 - protein, 25 aa, Mycobacterium avium
PGSPERVVLLRRLVACRGTVRVRVL

SEQ ID NO: 130053 - protein, 28 aa, Mycobacterium avium
PGSRARFGDVLPFLVKVLAADEPLSLQA

SEQ ID NO: 130054 - protein, 17 aa, Mycobacterium avium
PGSRLAFDFVPDTAVFA

SEQ ID NO: 130055 - protein, 20 aa, Mycobacterium avium
PGSVVLRRIATRTGIPDYGY

SEQ ID NO: 130056 - protein, 25 aa, Mycobacterium avium
PGTFEGWLHRITTNLFLDMVRRRSR

SEQ ID NO: 130057 - protein, 30 aa, Mycobacterium avium
PGTKGLSLFYVPKYLFDPKTFELGPRNGVF

SEQ ID NO: 130058 - protein, 20 aa, Mycobacterium avium
PGTRVLYVSPLKALAVDVER

SEQ ID NO: 130059 - protein, 19 aa, Mycobacterium avium
PGVAPLTLFGYSMGGVVAF

SEQ ID NO: 130060 - protein, 18 aa, Mycobacterium avium
PGVLARLILAASATATGC

SEQ ID NO: 130061 - protein, 20 aa, Mycobacterium avium
PGVQPLPHLRDLGVGARVVG

SEQ ID NO: 130062 - protein, 24 aa, Mycobacterium avium
PGVRQFERLLAKALRKVTTKLAEQ

SEQ ID NO: 130063 - protein, 29 aa, Mycobacterium avium
PGVSVLGQAYLLPFWDKNLERPNGGKGGF

SEQ ID NO: 130064 - protein, 23 aa, Mycobacterium avium
PGYAADLLVLTLARIVGKTDHIH

SEQ ID NO: 130065 - protein, 19 aa, Mycobacterium avium
PGYIGYAWTAMEPVNAIPA

SEQ ID NO: 130066 - protein, 19 aa, Mycobacterium avium
PGYQELNFALREGALDVSQ

SEQ ID NO: 130067 - protein, 17 aa, Mycobacterium avium
PGYWHPAHFASAAATLD

SEQ ID NO: 130068 - protein, 25 aa, Mycobacterium avium
PHAVLSPIPISFSPLGFAPRGAPSR

SEQ ID NO: 130069 - protein, 25 aa, Mycobacterium avium
PHAWSAAPNFAFDLAARKTTDGDLA

SEQ ID NO: 130070 - protein, 24 aa, Mycobacterium avium
PHDVFRRNIWVSPFWEGSVADVVQ

SEQ ID NO: 130071 - protein, 17 aa, Mycobacterium avium
PHDVLVLQIEGCKTWRV

SEQ ID NO: 130072 - protein, 21 aa, Mycobacterium avium
PHELAIALYGVSRHAGAVPLA

SEQ ID NO: 130073 - protein, 17 aa, Mycobacterium avium
PHFELDFVPAFGSAFQW

SEQ ID NO: 130074 - protein, 18 aa, Mycobacterium avium
PHFELDFVPAFGSAFQWQ

SEQ ID NO: 130075 - protein, 19 aa, Mycobacterium avium
PHFELDFVPAFGSAFQWQY

SEQ ID NO: 130076 - protein, 17 aa, Mycobacterium avium
PHGLLFERFLNPERPSA

SEQ ID NO: 130077 - protein, 26 aa, Mycobacterium avium
PHGTGFHALRHYYASLLIRHGESVKT

SEQ ID NO: 130078 - protein, 18 aa, Mycobacterium avium
PHGVRPLSLGRLDRGWVV

SEQ ID NO: 130079 - protein, 28 aa, Mycobacterium avium
PHHDPAAVGDWMLLAAIQALIDGHEYLA

SEQ ID NO: 130080 - protein, 18 aa, Mycobacterium avium
PHHFQFVHRTPISPVVLR

SEQ ID NO: 130081 - protein, 29 aa, Mycobacterium avium
PHKRNPVLSILIRRAAIAGPPLAATLHTA

SEQ ID NO: 130082 - protein, 21 aa, Mycobacterium avium
PHLATTLLPALLEALVRNVSR

SEQ ID NO: 130083 - protein, 19 aa, Mycobacterium avium
PHLQANWTWARSALDDKQI

SEQ ID NO: 130084 - protein, 47 aa, Mycobacterium avium
PHMVHLYRYRDMLPLPARATVTWSLTGALQLMLFPETPADVLQVVAP

SEQ ID NO: 130085 - protein, 24 aa, Mycobacterium avium
PHPEGMWPDTWNWIKVAFAGVPEN

SEQ ID NO: 130086 - protein, 18 aa, Mycobacterium avium
PHPKDEFWVPRRLGGGAP

SEQ ID NO: 130087 - protein, 19 aa, Mycobacterium avium
PHPPEALGPRYVAAMGGID

SEQ ID NO: 130088 - protein, 23 aa, Mycobacterium avium
PHRLATWLHRHPGLPRMINMYGI

SEQ ID NO: 130089 - protein, 23 aa, Mycobacterium avium
PHVAALVLRVPLDATLRRRDGEL

SEQ ID NO: 130090 - protein, 22 aa, Mycobacterium avium
PHVHAHALVLNALAGERIDGAR

SEQ ID NO: 130091 - protein, 27 aa, Mycobacterium avium
PIAGAAMFVLDKWLQPVPAGVVGELYL

SEQ ID NO: 130092 - protein, 24 aa, Mycobacterium avium
PIAKNMIQAFFFDLQAVQSGTSRP

SEQ ID NO: 130093 - protein, 19 aa, Mycobacterium avium
PIALWQEVGTRHFPEDAIF

SEQ ID NO: 130094 - protein, 25 aa, Mycobacterium avium
PIATQLQYWQRALAGMPERVALPTD

SEQ ID NO: 130095 - protein, 29 aa, Mycobacterium avium
PIEGQPLDRPFAWALIKLDGADTPLLHAV

SEQ ID NO: 130096 - protein, 28 aa, Mycobacterium avium
PIENPNRRFFTMLGTLVRGRITVGGSAG

SEQ ID NO: 130097 - protein, 20 aa, Mycobacterium avium
PIERKPPWIRVRARMGPEYT

SEQ ID NO: 130098 - protein, 22 aa, Mycobacterium avium
PIFWSGLGESRLFVGKKPDGWL

SEQ ID NO: 130099 - protein, 20 aa, Mycobacterium avium
PIGAFGFDSPLPPGVDQHIA

SEQ ID NO: 130100 - protein, 27 aa, Mycobacterium avium
PIGGQRDAFRHPGQGSLPVLQLGGDRA

SEQ ID NO: 130101 - protein, 25 aa, Mycobacterium avium
PIKVGYLMDFALPPGFPEEMKADFT

SEQ ID NO: 130102 - protein, 18 aa, Mycobacterium avium
PILFLRMMDRVKAGAKLI

SEQ ID NO: 130103 - protein, 18 aa, Mycobacterium avium
PILKRIMRSGNQLAYLDS

SEQ ID NO: 130104 - protein, 20 aa, Mycobacterium avium
PILPYVDRVLYLVDGRFRIG

SEQ ID NO: 130105 - protein, 26 aa, Mycobacterium avium
PILTVAAPLFDRIEIALPAGKSIRIA

SEQ ID NO: 130106 - protein, 28 aa, Mycobacterium avium
PINDLELLNCLLLLFMAGLDTVSNQLSY

SEQ ID NO: 130107 - protein, 19 aa, Mycobacterium avium
PIRTTPVVPVAVIGMACRL

SEQ ID NO: 130108 - protein, 19 aa, Mycobacterium avium
PISFARRAQVGLPAFMIRA

SEQ ID NO: 130109 - protein, 17 aa, Mycobacterium avium
PISMPAYARAFEPKIRW

SEQ ID NO: 130110 - protein, 19 aa, Mycobacterium avium
PITDGWMLPVFRAAASPNA

SEQ ID NO: 130111 - protein, 19 aa, Mycobacterium avium
PITSPFGLYDCDVPCDGSI

SEQ ID NO: 130112 - protein, 18 aa, Mycobacterium avium
PIWDVRLTDTSLRDGSHH

SEQ ID NO: 130113 - protein, 19 aa, Mycobacterium avium
PIYDEDFVLALPPGHPLAG

SEQ ID NO: 130114 - protein, 22 aa, Mycobacterium avium
PKDPSLGSPVVAWLASPEAGHI

SEQ ID NO: 130115 - protein, 24 aa, Mycobacterium avium
PKETPLSPTQLWRPRNRAESLVAA

SEQ ID NO: 130116 - protein, 26 aa, Mycobacterium avium
PKGPAAPPVVPLPPGGPGGGPGAGTP

SEQ ID NO: 130117 - protein, 21 aa, Mycobacterium avium
PKGYFPVPALTHLEGPYLDMD

SEQ ID NO: 130118 - protein, 25 aa, Mycobacterium avium
PKIDNWLDELIARFLKQLGINWDPA

SEQ ID NO: 130119 - protein, 17 aa, Mycobacterium avium
PKLMLRPATWVADTVAD

SEQ ID NO: 130120 - protein, 24 aa, Mycobacterium avium
PKPAPPLDIWLGGSAPAAFRRILA

SEQ ID NO: 130121 - protein, 17 aa, Mycobacterium avium
PKPPPVEQLLGPLDQAR

SEQ ID NO: 130122 - protein, 18 aa, Mycobacterium avium
PKPPPVEQLLGPLNQARH

SEQ ID NO: 130123 - protein, 17 aa, Mycobacterium avium
PKQLHETSIRRWPSTTQ

SEQ ID NO: 130124 - protein, 19 aa, Mycobacterium avium
PKSLALYIFATGKVGRDLV

SEQ ID NO: 130125 - protein, 18 aa, Mycobacterium avium
PKTWRDMIDVNLNGAWIT

SEQ ID NO: 130126 - protein, 19 aa, Mycobacterium avium
PKTWRDMIDVNLNGAWITA

SEQ ID NO: 130127 - protein, 20 aa, Mycobacterium avium
PKVCWARTPRRPTTPWCWPP

SEQ ID NO: 130128 - protein, 18 aa, Mycobacterium avium
PKVLHPLGGRSMLSHLLH

SEQ ID NO: 130129 - protein, 17 aa, Mycobacterium avium
PKYLFIGVKQNLAGRRP

SEQ ID NO: 130130 - protein, 29 aa, Mycobacterium avium
PLAARLKAASLLAPVLRTGLASSSRPDPV

SEQ ID NO: 130131 - protein, 19 aa, Mycobacterium avium
PLAELRGGAVWDAAAVRKF

SEQ ID NO: 130132 - protein, 22 aa, Mycobacterium avium
PLAFVRFRLDGHDWPASVLPSL

SEQ ID NO: 130133 - protein, 20 aa, Mycobacterium avium
PLAGAPFYVNPNSAAMRAAQ

SEQ ID NO: 130134 - protein, 26 aa, Mycobacterium avium
PLAGKFERLYRAAPLMRFGGGANEVL

SEQ ID NO: 130135 - protein, 18 aa, Mycobacterium avium
PLASVTGVLQALFIGPML

SEQ ID NO: 130136 - protein, 22 aa, Mycobacterium avium
PLCWDSFRFIVIQRADHFTICL

SEQ ID NO: 130137 - protein, 25 aa, Mycobacterium avium
PLDDTPMLLQPGVLSPAWGSVVRQL

SEQ ID NO: 130138 - protein, 18 aa, Mycobacterium avium
PLDFFVDGVARTGPARAA

SEQ ID NO: 130139 - protein, 24 aa, Mycobacterium avium
PLDGIRVLELGTLIAGPFAGRLLG

SEQ ID NO: 130140 - protein, 25 aa, Mycobacterium avium
PLDGIRVLELGTLIAGPFAGRLLGD

SEQ ID NO: 130141 - protein, 24 aa, Mycobacterium avium
PLDGIRVLELGTLIAGPFASRLLG

SEQ ID NO: 130142 - protein, 19 aa, Mycobacterium avium
PLEVLFPGCEFLPLNDERR

SEQ ID NO: 130143 - protein, 21 aa, Mycobacterium avium
PLFDGTPPPYPGWPDTLGTQD

SEQ ID NO: 130144 - protein, 19 aa, Mycobacterium avium
PLFSTRNLMLVRKRPFNKQ

SEQ ID NO: 130145 - protein, 19 aa, Mycobacterium avium
PLFSTRNLMLVRKRPFNKR

SEQ ID NO: 130146 - protein, 18 aa, Mycobacterium avium
PLFTLHTDTPERFGAALA

SEQ ID NO: 130147 - protein, 22 aa, Mycobacterium avium
PLGDVFVALKPPPGDHDAPLLK

SEQ ID NO: 130148 - protein, 26 aa, Mycobacterium avium
PLGGRSMLSHLLHAIAKVAPQHLAVV

SEQ ID NO: 130149 - protein, 26 aa, Mycobacterium avium
PLGIIPLLQVDMWEHAFYLQYKNVKA

SEQ ID NO: 130150 - protein, 19 aa, Mycobacterium avium
PLGLLLTRRSENATVTLCH

SEQ ID NO: 130151 - protein, 17 aa, Mycobacterium avium
PLGPVYQAGTLSGNPVA

SEQ ID NO: 130152 - protein, 32 aa, Mycobacterium avium
PLHATRGPWQLMPDTFAAFHQPGTSNSAWDPV

SEQ ID NO: 130153 - protein, 17 aa, Mycobacterium avium
PLHPLPFHAMFDADLYG

SEQ ID NO: 130154 - protein, 18 aa, Mycobacterium avium
PLIGLGLPRTGSTALSML

SEQ ID NO: 130155 - protein, 17 aa, Mycobacterium avium
PLIKDPFAQVFLDAAGD

SEQ ID NO: 130156 - protein, 23 aa, Mycobacterium avium
PLIPARVVQAPWLTRLQALGEDV

SEQ ID NO: 130157 - protein, 27 aa, Mycobacterium avium
PLLAGDFVRWCRQVLDLLDQVRNAAPD

SEQ ID NO: 130158 - protein, 22 aa, Mycobacterium avium
PLLDLGIDWRTYRDAIDGLRGV

SEQ ID NO: 130159 - protein, 20 aa, Mycobacterium avium
PLLERAKFLAIFASNLDEFY

SEQ ID NO: 130160 - protein, 18 aa, Mycobacterium avium
PLLGKTYHAIESKGAFVN

SEQ ID NO: 130161 - protein, 17 aa, Mycobacterium avium
PLLPSDDPFYQPPLGFQ

SEQ ID NO: 130162 - protein, 18 aa, Mycobacterium avium
PLLPVPIPVPVPQKQAPA

SEQ ID NO: 130163 - protein, 24 aa, Mycobacterium avium
PLLRCRRTLEPLADTLCLAPLVDD

SEQ ID NO: 130164 - protein, 20 aa, Mycobacterium avium
PLLVSVFLDKDFTFVVSSEA

SEQ ID NO: 130165 - protein, 18 aa, Mycobacterium avium
PLPEGCFALVPLEESIEA

SEQ ID NO: 130166 - protein, 25 aa, Mycobacterium avium
PLPPQRAGLLTRAMYRIAKRRYGQV

SEQ ID NO: 130167 - protein, 25 aa, Mycobacterium avium
PLPVQYVDYTLWQRAQFGDLDDPHS

SEQ ID NO: 130168 - protein, 17 aa, Mycobacterium avium
PLQFLRQARRRHSPAAG

SEQ ID NO: 130169 - protein, 20 aa, Mycobacterium avium
PLQGPGRFLADYEAGLEAAL

SEQ ID NO: 130170 - protein, 21 aa, Mycobacterium avium
PLQVRQLLYRAQREGALLPVG

SEQ ID NO: 130171 - protein, 17 aa, Mycobacterium avium
PLRALFEARGVLAHLAV

SEQ ID NO: 130172 - protein, 24 aa, Mycobacterium avium
PLRCDAWIDRREGVKVFARGTISD

SEQ ID NO: 130173 - protein, 19 aa, Mycobacterium avium
PLREPVRSLVWVRGRLREV

SEQ ID NO: 130174 - protein, 23 aa, Mycobacterium avium
PLRGSYRVTFLSLKGGVGKTTIA

SEQ ID NO: 130175 - protein, 18 aa, Mycobacterium avium
PLRLAFSLTEPRLELVQA

SEQ ID NO: 130176 - protein, 18 aa, Mycobacterium avium
PLRPEHLLDTEYLERRAA

SEQ ID NO: 130177 - protein, 17 aa, Mycobacterium avium
PLRVQYADYAAWQRTFL

SEQ ID NO: 130178 - protein, 26 aa, Mycobacterium avium
PLSASQLRSWFAYRMDGPSPVNNIPF

SEQ ID NO: 130179 - protein, 17 aa, Mycobacterium avium
PLSELLVESLRCSGARI

SEQ ID NO: 130180 - protein, 20 aa, Mycobacterium avium
PLSVFFFDILHCDGVDLLDA

SEQ ID NO: 130181 - protein, 25 aa, Mycobacterium avium
PLTANAYLGAWGIVDCLGDGADVVV

SEQ ID NO: 130182 - protein, 17 aa, Mycobacterium avium
PLTTGGPPIWIGGNGAA

SEQ ID NO: 130183 - protein, 18 aa, Mycobacterium avium
PLTTLRVGPTARRLITCA

SEQ ID NO: 130184 - protein, 25 aa, Mycobacterium avium
PLVNSCVVAYLSALTLLECVMTTMR

SEQ ID NO: 130185 - protein, 19 aa, Mycobacterium avium
PLVPIDTPPYHAAAFGVSD

SEQ ID NO: 130186 - protein, 17 aa, Mycobacterium avium
PMATGVLVLGVERATKI

SEQ ID NO: 130187 - protein, 19 aa, Mycobacterium avium
PMATITFTGATALKLTGRE

SEQ ID NO: 130188 - protein, 18 aa, Mycobacterium avium
PMATITLSSAPALRLSGD

SEQ ID NO: 130189 - protein, 20 aa, Mycobacterium avium
PMATTWAAVPTCAALAATGR

SEQ ID NO: 130190 - protein, 17 aa, Mycobacterium avium
PMDIPGVTVRPLTQMDG

SEQ ID NO: 130191 - protein, 27 aa, Mycobacterium avium
PMERPGLPAVLLGPGPFVGRGRELDGL

SEQ ID NO: 130192 - protein, 28 aa, Mycobacterium avium
PMFMNEGTMRLFRPDLKNPGPDDLEVAA

SEQ ID NO: 130193 - protein, 25 aa, Mycobacterium avium
PMFNLPFHHDVGPLGGRAFAPFDSG

SEQ ID NO: 130194 - protein, 23 aa, Mycobacterium avium
PMGKYPILLLDPDFNEDIRLALV

SEQ ID NO: 130195 - protein, 17 aa, Mycobacterium avium
PMHRYYSTIKDLTRLLG

SEQ ID NO: 130196 - protein, 21 aa, Mycobacterium avium
PMIAEPLRLLDCARPVNGAVA

SEQ ID NO: 130197 - protein, 24 aa, Mycobacterium avium
PMIEEAVFRLFDELAAKGEHTVIG

SEQ ID NO: 130198 - protein, 30 aa, Mycobacterium avium
PMIREWLTVLLRRDLGLLVMIAVPGREPSR

SEQ ID NO: 130199 - protein, 22 aa, Mycobacterium avium
PMPKRLPPWILAKMGGAFTSSV

SEQ ID NO: 130200 - protein, 22 aa, Mycobacterium avium
PMRSLTRVLITGGAGFLGAHLC

SEQ ID NO: 130201 - protein, 19 aa, Mycobacterium avium
PMRVIGMLLGLPEDRQRQI

SEQ ID NO: 130202 - protein, 25 aa, Mycobacterium avium
PMRWTCVEPLKKWRLDVGPNNSGIE

SEQ ID NO: 130203 - protein, 24 aa, Mycobacterium avium
PMTNTKVNFGFDPYVPRIDPGHAL

SEQ ID NO: 130204 - protein, 20 aa, Mycobacterium avium
PMVAEPLRLLDCARPVNGAV

SEQ ID NO: 130205 - protein, 30 aa, Mycobacterium avium
PNADQPPLRGFPNAPMRAVHLWAAPERVTE

SEQ ID NO: 130206 - protein, 17 aa, Mycobacterium avium
PNAWRRKPMSEEAILAS

SEQ ID NO: 130207 - protein, 31 aa, Mycobacterium avium
PNEYLMFDAMGFGRPLDFKPMLELEGAQQFA

SEQ ID NO: 130208 - protein, 17 aa, Mycobacterium avium
PNFAYEWAAQRGLPGGG

SEQ ID NO: 130209 - protein, 19 aa, Mycobacterium avium
PNFAYEWAAQRGLPGGGED

SEQ ID NO: 130210 - protein, 19 aa, Mycobacterium avium
PNFFVYTRHEPVGVVGAIT

SEQ ID NO: 130211 - protein, 26 aa, Mycobacterium avium
PNLATVPAALPRTPALSASPSGLGRI

SEQ ID NO: 130212 - protein, 24 aa, Mycobacterium avium
PNLKDQLLLIPGYGKLPKDVAVVG

SEQ ID NO: 130213 - protein, 28 aa, Mycobacterium avium
PNNANFTFPMEFTPFQGGWQLSRHTAET

SEQ ID NO: 130214 - protein, 24 aa, Mycobacterium avium
PNPGIGFPGYVDYLPVTRGTPQPP

SEQ ID NO: 130215 - protein, 27 aa, Mycobacterium avium
PNPNLRPLFDGPFYAVRMVLSDLGTCG

SEQ ID NO: 130216 - protein, 17 aa, Mycobacterium avium
PNRGTLRSVISLAVRDS

SEQ ID NO: 130217 - protein, 31 aa, Mycobacterium avium
PNRPEFLEITWGCQLSGLYYTPVNTHFTADE

SEQ ID NO: 130218 - protein, 35 aa, Mycobacterium avium
PNRTANIALLHFLDGEKRYIIAPQGLSQGDVVESG

SEQ ID NO: 130219 - protein, 18 aa, Mycobacterium avium
PNTLAGHNLVFIYDDDDD

SEQ ID NO: 130220 - protein, 24 aa, Mycobacterium avium
PPAAPPPGAPPPGAPPPAEPPADP

SEQ ID NO: 130221 - protein, 21 aa, Mycobacterium avium
PPAEPLPPPPPREQPLTQKMV

SEQ ID NO: 130222 - protein, 26 aa, Mycobacterium avium
PPAFTDEPMPLCPFIAAAVEISDPQH

SEQ ID NO: 130223 - protein, 18 aa, Mycobacterium avium
PPAWIGVGTLDLFYPECL

SEQ ID NO: 130224 - protein, 22 aa, Mycobacterium avium
PPAWIGVGTLDLFYPECLEYAR

SEQ ID NO: 130225 - protein, 25 aa, Mycobacterium avium
PPDGDWLGTPYLKFTREGAFAVCTL

SEQ ID NO: 130226 - protein, 17 aa, Mycobacterium avium
PPDRFAAVAAALRDDGH

SEQ ID NO: 130227 - protein, 26 aa, Mycobacterium avium
PPEEKCLRMSGWPPATTMSSASRTRN

SEQ ID NO: 130228 - protein, 26 aa, Mycobacterium avium
PPEIPTPSDLPPWHQAQLALAESPEK

SEQ ID NO: 130229 - protein, 20 aa, Mycobacterium avium
PPEQGGYPPQQGYPPPRHPE

SEQ ID NO: 130230 - protein, 26 aa, Mycobacterium avium
PPERAWGLWLSRQIIARIMGTFGPSL

SEQ ID NO: 130231 - protein, 18 aa, Mycobacterium avium
PPEVRLADLAPLLRAHLP

SEQ ID NO: 130232 - protein, 18 aa, Mycobacterium avium
PPFARNVRFYPTAAAAQR

SEQ ID NO: 130233 - protein, 18 aa, Mycobacterium avium
PPFRFSKTPVPQPRPAPL

SEQ ID NO: 130234 - protein, 20 aa, Mycobacterium avium
PPGFIDTPMLRAAEKNGFLG

SEQ ID NO: 130235 - protein, 21 aa, Mycobacterium avium
PPGGRVLLVWDAPNLDMGLGS

SEQ ID NO: 130236 - protein, 25 aa, Mycobacterium avium
PPGHIAGVGSLLRPLISGARSVFVD

SEQ ID NO: 130237 - protein, 17 aa, Mycobacterium avium
PPHPDDPMYLVFTSGST

SEQ ID NO: 130238 - protein, 17 aa, Mycobacterium avium
PPHPHLVKLVARCANVE

SEQ ID NO: 130239 - protein, 18 aa, Mycobacterium avium
PPHVGVLLENTPLFSAVL

SEQ ID NO: 130240 - protein, 34 aa, Mycobacterium avium
PPIGSPLRGAAFFVLDGWLCPVPVGVVGELYVAG

SEQ ID NO: 130241 - protein, 42 aa, Mycobacterium avium
PPKRPPMPNLVPLSLSLWAGIYQVLFAFRAGSGVVLMDRFSP

SEQ ID NO: 130242 - protein, 20 aa, Mycobacterium avium
PPLGDDWLRVAAVRLPRISN

SEQ ID NO: 130243 - protein, 25 aa, Mycobacterium avium
PPLRRPSGPMALRTLWRMDLARDRR

SEQ ID NO: 130244 - protein, 20 aa, Mycobacterium avium
PPPSWTAPSIWCWPAPSRRC

SEQ ID NO: 130245 - protein, 24 aa, Mycobacterium avium
PPQTPEQILRLLTTRYNMTEVAEI

SEQ ID NO: 130246 - protein, 18 aa, Mycobacterium avium
PPRIPLVSNLTGQLAGPG

SEQ ID NO: 130247 - protein, 22 aa, Mycobacterium avium
PPRRRWIRRDELLSRLEGAQAD

SEQ ID NO: 130248 - protein, 21 aa, Mycobacterium avium
PPSGPPPFGPPPPDAGPVPAP

SEQ ID NO: 130249 - protein, 28 aa, Mycobacterium avium
PPSHGSDWRWGPVHVAPPAPPGPMKSPL

SEQ ID NO: 130250 - protein, 25 aa, Mycobacterium avium
PPSSSPPPWPTSKPPPAKASPAGAP

SEQ ID NO: 130251 - protein, 22 aa, Mycobacterium avium
PPVFVAPVYGYLVSDLARDVTG

SEQ ID NO: 130252 - protein, 34 aa, Mycobacterium avium
PPYDLQTLVPNTPFFFRLLVGLTKDGTWLQFSQT

SEQ ID NO: 130253 - protein, 21 aa, Mycobacterium avium
PQAARLVRVLAAGADLALIAG

SEQ ID NO: 130254 - protein, 24 aa, Mycobacterium avium
PQAQRPKVLILGSGPNRIGQGIEF

SEQ ID NO: 130255 - protein, 22 aa, Mycobacterium avium
PQDPIAWHQLDDLPLHGMRRRR

SEQ ID NO: 130256 - protein, 25 aa, Mycobacterium avium
PQDRALPHWAGVVPLQLSAGPPVPA

SEQ ID NO: 130257 - protein, 26 aa, Mycobacterium avium
PQFQTKYPMYTIIRRQLTDAAVRPAT

SEQ ID NO: 130258 - protein, 20 aa, Mycobacterium avium
PQFRSLRMWESQSPTPPPEA

SEQ ID NO: 130259 - protein, 19 aa, Mycobacterium avium
PQIKKRILNPNPPHPQHLT

SEQ ID NO: 130260 - protein, 20 aa, Mycobacterium avium
PQLAAAIKAAVGGTPIAEAF

SEQ ID NO: 130261 - protein, 33 aa, Mycobacterium avium
PQLWDELYRINLHHVFLVTHAFLPTMIDRNAGA

SEQ ID NO: 130262 - protein, 26 aa, Mycobacterium avium
PQPQHGVPIYQRLQHDCDLGLGHTRG

SEQ ID NO: 130263 - protein, 17 aa, Mycobacterium avium
PQQRIMLEICWEALERA

SEQ ID NO: 130264 - protein, 20 aa, Mycobacterium avium
PQQRPFTMRYLDAPPRVALD

SEQ ID NO: 130265 - protein, 18 aa, Mycobacterium avium
PQRGFYSHWASVVGGRSG

SEQ ID NO: 130266 - protein, 23 aa, Mycobacterium avium
PQSRKWFQLYMWKNRERSMALVR

SEQ ID NO: 130267 - protein, 18 aa, Mycobacterium avium
PQTGIATWIIPSIVAYGT

SEQ ID NO: 130268 - protein, 19 aa, Mycobacterium avium
PQVRAWIRFAQDNGGTLPS

SEQ ID NO: 130269 - protein, 23 aa, Mycobacterium avium
PQYWVEHVRAPVQFLAGVRAAEQ

SEQ ID NO: 130270 - protein, 17 aa, Mycobacterium avium
PRAMPMAVPLEPGQQTV

SEQ ID NO: 130271 - protein, 25 aa, Mycobacterium avium
PRAPAEGFAAMWADLRRPELREFER

SEQ ID NO: 130272 - protein, 19 aa, Mycobacterium avium
PRARGLRKLRAALPLVTSR

SEQ ID NO: 130273 - protein, 28 aa, Mycobacterium avium
PRAYRGGMVPGFPNMFISSAPNYSPGHG

SEQ ID NO: 130274 - protein, 20 aa, Mycobacterium avium
PRDQRRLRTAGLREGIAGGA

SEQ ID NO: 130275 - protein, 19 aa, Mycobacterium avium
PRDSILAAGRYLAANGFAA

SEQ ID NO: 130276 - protein, 30 aa, Mycobacterium avium
PREIGVWDMTHICRIDDSFWTTIPVVDSWR

SEQ ID NO: 130277 - protein, 26 aa, Mycobacterium avium
PRERPVQAWVLRRGAALIAAVRPDTG

SEQ ID NO: 130278 - protein, 19 aa, Mycobacterium avium
PRFASLLMDQFGGANGALT

SEQ ID NO: 130279 - protein, 17 aa, Mycobacterium avium
PRFDAAAVVKVLRRKHS

SEQ ID NO: 130280 - protein, 23 aa, Mycobacterium avium
PRGRRFAGRWAEAVFSVSPNLDI

SEQ ID NO: 130281 - protein, 17 aa, Mycobacterium avium
PRHRRCGGRGTCWGRRT

SEQ ID NO: 130282 - protein, 23 aa, Mycobacterium avium
PRISPFPAVFQDVSLVVAADVPA

SEQ ID NO: 130283 - protein, 21 aa, Mycobacterium avium
PRLAVPDRMLTPPPGLACERT

SEQ ID NO: 130284 - protein, 19 aa, Mycobacterium avium
PRLAVPDRMLTPPPGLTCE

SEQ ID NO: 130285 - protein, 20 aa, Mycobacterium avium
PRLHQQLFADLLAAAGLDTT

SEQ ID NO: 130286 - protein, 24 aa, Mycobacterium avium
PRLMIASVLWWRHVDEVYAAIRAT

SEQ ID NO: 130287 - protein, 20 aa, Mycobacterium avium
PRLTHPPGDQLRVLGTEVDH

SEQ ID NO: 130288 - protein, 18 aa, Mycobacterium avium
PRMRGVLALFEGVATGAA

SEQ ID NO: 130289 - protein, 19 aa, Mycobacterium avium
PRMRGVLALFEGVATGAAD

SEQ ID NO: 130290 - protein, 17 aa, Mycobacterium avium
PRPAGDALVLDLPTVET

SEQ ID NO: 130291 - protein, 27 aa, Mycobacterium avium
PRPLPDPEILAFLYLEARLADEGRYSE

SEQ ID NO: 130292 - protein, 22 aa, Mycobacterium avium
PRPPRIPLVSNLTGQLAGPGYG

SEQ ID NO: 130293 - protein, 23 aa, Mycobacterium avium
PRQPRTPLLTDDVMLLVSTAREQ

SEQ ID NO: 130294 - protein, 22 aa, Mycobacterium avium
PRQRLALELAWELLEDAFIVAE

SEQ ID NO: 130295 - protein, 23 aa, Mycobacterium avium
PRQWHGLRRWLGEPEDFQDPKYD

SEQ ID NO: 130296 - protein, 23 aa, Mycobacterium avium
PRRFEYRDEFPLGPAGKILKREI

SEQ ID NO: 130297 - protein, 26 aa, Mycobacterium avium
PRRFWRRKFRILDRLGRSRPDVQLVA

SEQ ID NO: 130298 - protein, 23 aa, Mycobacterium avium
PRRPVVGVPHRIRMVGGARRRPQ

SEQ ID NO: 130299 - protein, 18 aa, Mycobacterium avium
PRRSVIEAAWRAIGPGVE

SEQ ID NO: 130300 - protein, 26 aa, Mycobacterium avium
PRRVDDLPIDLGAFGLEHHLSGCPVG

SEQ ID NO: 130301 - protein, 24 aa, Mycobacterium avium
PRRVLDPAIYREATRRLDRHFTIS

SEQ ID NO: 130302 - protein, 17 aa, Mycobacterium avium
PRRYRRSSVYSKLVSLD

SEQ ID NO: 130303 - protein, 17 aa, Mycobacterium avium
PRTGLVDRALIAAYAGG

SEQ ID NO: 130304 - protein, 20 aa, Mycobacterium avium
PRTLEAFLDALHFVPSHHSR

SEQ ID NO: 130305 - protein, 20 aa, Mycobacterium avium
PRTTIGWKGLINDPAMDSSF

SEQ ID NO: 130306 - protein, 20 aa, Mycobacterium avium
PRTTVGWKGLINDPAMDGSF

SEQ ID NO: 130307 - protein, 20 aa, Mycobacterium avium
PRVAALPGPATALTGDGRGT

SEQ ID NO: 130308 - protein, 20 aa, Mycobacterium avium
PRVLPWQECPGAVASAARIT

SEQ ID NO: 130309 - protein, 18 aa, Mycobacterium avium
PRVLREYALLADGERGAL

SEQ ID NO: 130310 - protein, 19 aa, Mycobacterium avium
PRVNPWSTPIPKVYLCSAA

SEQ ID NO: 130311 - protein, 23 aa, Mycobacterium avium
PRVSPFPAVFQDVSLVVAADVPA

SEQ ID NO: 130312 - protein, 17 aa, Mycobacterium avium
PRVWWQGVRLRTESAPG

SEQ ID NO: 130313 - protein, 19 aa, Mycobacterium avium
PRWRDYFRAAWRGLVPGPL

SEQ ID NO: 130314 - protein, 24 aa, Mycobacterium avium
PSADPVFIKQLLDIGAQNIIVPMI

SEQ ID NO: 130315 - protein, 18 aa, Mycobacterium avium
PSAIFIGGGLTRPGLLDA

SEQ ID NO: 130316 - protein, 23 aa, Mycobacterium avium
PSANPYLASAAILGLSLDGIKSQ

SEQ ID NO: 130317 - protein, 21 aa, Mycobacterium avium
PSARAPLRRGGGHASPRACGG

SEQ ID NO: 130318 - protein, 21 aa, Mycobacterium avium
PSARAPLRRGSGHASPRACGG

SEQ ID NO: 130319 - protein, 26 aa, Mycobacterium avium
PSARLAVSVRRWTACGAVCGGPCQGI

SEQ ID NO: 130320 - protein, 29 aa, Mycobacterium avium
PSATRALIATLLLLLRVSPDRRVQPRAQR

SEQ ID NO: 130321 - protein, 25 aa, Mycobacterium avium
PSDGITYLLIPMKSPGITVRPLRDI

SEQ ID NO: 130322 - protein, 21 aa, Mycobacterium avium
PSDILVPPGFTRALGVPPAAE

SEQ ID NO: 130323 - protein, 28 aa, Mycobacterium avium
PSDLVFNDFLIVVARMRALDPVTSELVR

SEQ ID NO: 130324 - protein, 28 aa, Mycobacterium avium
PSDYYLGGRALIARFLRAIGEFPTATLR

SEQ ID NO: 130325 - protein, 19 aa, Mycobacterium avium
PSERVGVACYALPAARRAL

SEQ ID NO: 130326 - protein, 20 aa, Mycobacterium avium
PSERVGVACYALPAARRALE

SEQ ID NO: 130327 - protein, 23 aa, Mycobacterium avium
PSETAQVAVYRKALQAADIDATT

SEQ ID NO: 130328 - protein, 23 aa, Mycobacterium avium
PSFAFYNTFEEIDVFLRAVRRIA

SEQ ID NO: 130329 - protein, 20 aa, Mycobacterium avium
PSFDITTLFNGLQPVLATLS

SEQ ID NO: 130330 - protein, 19 aa, Mycobacterium avium
PSFMVPSAVVVLDVLPLTV

SEQ ID NO: 130331 - protein, 21 aa, Mycobacterium avium
PSGEPWPLQDTVRPWDSLNDE

SEQ ID NO: 130332 - protein, 24 aa, Mycobacterium avium
PSGFMLIGLIDHGAWITKAGIERR

SEQ ID NO: 130333 - protein, 24 aa, Mycobacterium avium
PSGFMLIVLIDHGAWITKAGIERR

SEQ ID NO: 130334 - protein, 19 aa, Mycobacterium avium
PSGIALPAGVRLLEPERRS

SEQ ID NO: 130335 - protein, 25 aa, Mycobacterium avium
PSGNTRAFLGERIGVRRGAVVDADG

SEQ ID NO: 130336 - protein, 25 aa, Mycobacterium avium
PSGNTRAFLGERIGVRRGAVVNADG

SEQ ID NO: 130337 - protein, 24 aa, Mycobacterium avium
PSGSAPYRYQLRLPPGAEQAPRRC

SEQ ID NO: 130338 - protein, 30 aa, Mycobacterium avium
PSGTPVVGYLPHPPTLTPAGYHARMARRVQ

SEQ ID NO: 130339 - protein, 17 aa, Mycobacterium avium
PSHRLDLVAIASTAQPG

SEQ ID NO: 130340 - protein, 19 aa, Mycobacterium avium
PSLIFRCIVGAGDLGCLAA

SEQ ID NO: 130341 - protein, 24 aa, Mycobacterium avium
PSLTAARFVACPFGAPGARMYRTG

SEQ ID NO: 130342 - protein, 24 aa, Mycobacterium avium
PSLTAARFVACPFGAPSARMYRTG

SEQ ID NO: 130343 - protein, 28 aa, Mycobacterium avium
PSMKVCKLISVVTIPIAPPTITYSTTRI

SEQ ID NO: 130344 - protein, 30 aa, Mycobacterium avium
PSMSPPGKDLWWFWTGLTPSYPEEGWDVAR

SEQ ID NO: 130345 - protein, 28 aa, Mycobacterium avium
PSNARWAAIWPAAPPRRAHAPWASRATW

SEQ ID NO: 130346 - protein, 21 aa, Mycobacterium avium
PSQPVLPRTAKLPAGFRVVII

SEQ ID NO: 130347 - protein, 24 aa, Mycobacterium avium
PSRADALLAFPAMQAMPTPYVEAS

SEQ ID NO: 130348 - protein, 30 aa, Mycobacterium avium
PSRLVVCLDLDWRPQFRVDLVPSYKAHRVA

SEQ ID NO: 130349 - protein, 25 aa, Mycobacterium avium
PSSMTPFPTMYELFSVGWGRPDLRS

SEQ ID NO: 130350 - protein, 21 aa, Mycobacterium avium
PSSTIAYWDVALDGGLVGITQ

SEQ ID NO: 130351 - protein, 22 aa, Mycobacterium avium
PSVMGSLPRLAAASGKTLGPRY

SEQ ID NO: 130352 - protein, 23 aa, Mycobacterium avium
PSWDTGLNLPKLGNQARQFFDLR

SEQ ID NO: 130353 - protein, 17 aa, Mycobacterium avium
PTALVFEAFAHALASIG

SEQ ID NO: 130354 - protein, 24 aa, Mycobacterium avium
PTAPPTMPPTMPPPPPPPSTPSTG

SEQ ID NO: 130355 - protein, 25 aa, Mycobacterium avium
PTARAIVEVRRLLPEIPLVASGGIR

SEQ ID NO: 130356 - protein, 22 aa, Mycobacterium avium
PTARLVVFKLSGDFDPAQVIKH

SEQ ID NO: 130357 - protein, 17 aa, Mycobacterium avium
PTDPGFWAVTRRADIVT

SEQ ID NO: 130358 - protein, 19 aa, Mycobacterium avium
PTDVHTFAPRAYLADLFYA

SEQ ID NO: 130359 - protein, 31 aa, Mycobacterium avium
PTEAPGFTVPYYWWTFNMPTDHGEVELTDVR

SEQ ID NO: 130360 - protein, 25 aa, Mycobacterium avium
PTEFNDIVAVLALYRPGPMGMNAHN

SEQ ID NO: 130361 - protein, 38 aa, Mycobacterium avium
PTEPEPPYKWIPIMIDPPDHAKWRHVLAEYFSPGRVKG

SEQ ID NO: 130362 - protein, 19 aa, Mycobacterium avium
PTFADTPSGWRVVFGEASR

SEQ ID NO: 130363 - protein, 20 aa, Mycobacterium avium
PTFHLGVLPLDDGGAAVTLV

SEQ ID NO: 130364 - protein, 24 aa, Mycobacterium avium
PTGDAELLLIGWGSSYGPIGEACR

SEQ ID NO: 130365 - protein, 18 aa, Mycobacterium avium
PTGKVRRFALREAILRDE

SEQ ID NO: 130366 - protein, 21 aa, Mycobacterium avium
PTGLLDQLAALYGRPATAVLI

SEQ ID NO: 130367 - protein, 26 aa, Mycobacterium avium
PTGSGKTLAAFLWALDSLAGQSERAP

SEQ ID NO: 130368 - protein, 26 aa, Mycobacterium avium
PTLNNMGTPFLPQWACEPEDVAAAVC

SEQ ID NO: 130369 - protein, 21 aa, Mycobacterium avium
PTLQFTMSYYLRPDELALAER

SEQ ID NO: 130370 - protein, 24 aa, Mycobacterium avium
PTLVDAVRRRDGLPRIAQAVAAPA

SEQ ID NO: 130371 - protein, 18 aa, Mycobacterium avium
PTMDDLFVEVLRAGAESA

SEQ ID NO: 130372 - protein, 22 aa, Mycobacterium avium
PTPMIRCIWCSPRAPPASRKVL

SEQ ID NO: 130373 - protein, 17 aa, Mycobacterium avium
PTPRRRLRYAYPYSGRL

SEQ ID NO: 130374 - protein, 25 aa, Mycobacterium avium
PTRHPYGMALWQNHIERILADWVGE

SEQ ID NO: 130375 - protein, 24 aa, Mycobacterium avium
PTRNAWVPLASWFRHHGARISMVP

SEQ ID NO: 130376 - protein, 22 aa, Mycobacterium avium
PTSAIAVLAVPCRWTELELGAA

SEQ ID NO: 130377 - protein, 24 aa, Mycobacterium avium
PTSPWPTDPAFRRQVFELVDIAFG

SEQ ID NO: 130378 - protein, 22 aa, Mycobacterium avium
PTTALPKMRAEGSGGSESDAAG

SEQ ID NO: 130379 - protein, 17 aa, Mycobacterium avium
PTTAPAALLRPLSPQNT

SEQ ID NO: 130380 - protein, 22 aa, Mycobacterium avium
PTTELLVPSLRMLIGGGAPCPP

SEQ ID NO: 130381 - protein, 27 aa, Mycobacterium avium
PTVAQLLPFVLYETLGPTLPDGLRGAA

SEQ ID NO: 130382 - protein, 28 aa, Mycobacterium avium
PTVAQLLPFVLYETLGPTLPDGLRGAAA

SEQ ID NO: 130383 - protein, 29 aa, Mycobacterium avium
PTVEASLAAALHLIAAKPALDAAVTDLLR

SEQ ID NO: 130384 - protein, 18 aa, Mycobacterium avium
PTVFTAAPGAAWRDNLRA

SEQ ID NO: 130385 - protein, 23 aa, Mycobacterium avium
PTVIDMLANSAFFYGMLRSLSEA

SEQ ID NO: 130386 - protein, 17 aa, Mycobacterium avium
PTVTGAVPTIWNAVLHH

SEQ ID NO: 130387 - protein, 20 aa, Mycobacterium avium
PTVVAWVFGCAFEPYTRGPV

SEQ ID NO: 130388 - protein, 17 aa, Mycobacterium avium
PTWILPKPDRPYTQWER

SEQ ID NO: 130389 - protein, 26 aa, Mycobacterium avium
PTYAFARERFWLGGASLAGAPAGAAP

SEQ ID NO: 130390 - protein, 19 aa, Mycobacterium avium
PTYEVIPTPGAWSDYFRGI

SEQ ID NO: 130391 - protein, 19 aa, Mycobacterium avium
PVADLNIAAWLLDHVDSPA

SEQ ID NO: 130392 - protein, 26 aa, Mycobacterium avium
PVAGATLFVLDAWLRQVPAGVTGELY

SEQ ID NO: 130393 - protein, 18 aa, Mycobacterium avium
PVAGQNWPWGDPHRYSFA

SEQ ID NO: 130394 - protein, 17 aa, Mycobacterium avium
PVAHFDRGQRVEAQFLE

SEQ ID NO: 130395 - protein, 22 aa, Mycobacterium avium
PVARSMLWARLRVSPGELRRRF

SEQ ID NO: 130396 - protein, 22 aa, Mycobacterium avium
PVDAGTWLLVSTSAMADVAATE

SEQ ID NO: 130397 - protein, 20 aa, Mycobacterium avium
PVDFSFRDYLLNLARERSSA

SEQ ID NO: 130398 - protein, 27 aa, Mycobacterium avium
PVDGAGLFVLDAWLRPVPPGVVGELYV

SEQ ID NO: 130399 - protein, 28 aa, Mycobacterium avium
PVDGAGLFVLDAWLRPVPPGVVGELYVG

SEQ ID NO: 130400 - protein, 28 aa, Mycobacterium avium
PVDIKKQMIAWWGPIIDEYYAASEAVGA

SEQ ID NO: 130401 - protein, 33 aa, Mycobacterium avium
PVDRPALRRQVLAPVRLVLGIVRGGLVARLQVD

SEQ ID NO: 130402 - protein, 20 aa, Mycobacterium avium
PVDVRIDVLAKGAPRADSRC

SEQ ID NO: 130403 - protein, 25 aa, Mycobacterium avium
PVDVSNAVVFLASDQARYITGTQIV

SEQ ID NO: 130404 - protein, 25 aa, Mycobacterium avium
PVEAQLYGDLMTILAALATAGGGDH

SEQ ID NO: 130405 - protein, 29 aa, Mycobacterium avium
PVEATPPAAPPPAAPPPGAPPADPGPAPA

SEQ ID NO: 130406 - protein, 23 aa, Mycobacterium avium
PVEGFLPTLLDWCRRNDVLFIAD

SEQ ID NO: 130407 - protein, 40 aa, Mycobacterium avium
PVERTFEFLEWFLETVPITPIWLCPLRLRDHDGWPLYPMR

SEQ ID NO: 130408 - protein, 41 aa, Mycobacterium avium
PVERTLEFLEWFLETVPITPIWLCPLRLRDHDGWPLYPMRP

SEQ ID NO: 130409 - protein, 18 aa, Mycobacterium avium
PVFADRWFQRYSQGDDVC

SEQ ID NO: 130410 - protein, 28 aa, Mycobacterium avium
PVFAIRDPMKFPNLIRAGGRRADNDLHD

SEQ ID NO: 130411 - protein, 18 aa, Mycobacterium avium
PVFGGDPRDGVPRSPASE

SEQ ID NO: 130412 - protein, 17 aa, Mycobacterium avium
PVGIDHATLTRRDADGG

SEQ ID NO: 130413 - protein, 17 aa, Mycobacterium avium
PVHRYFLAAKQAEFALG

SEQ ID NO: 130414 - protein, 25 aa, Mycobacterium avium
PVIADIHFQPKYIFAAIDAGCAAVR

SEQ ID NO: 130415 - protein, 23 aa, Mycobacterium avium
PVIPVAVNCATAPLPTGRRVAGF

SEQ ID NO: 130416 - protein, 24 aa, Mycobacterium avium
PVKRLRQAGVLELLLALANESTGA

SEQ ID NO: 130417 - protein, 25 aa, Mycobacterium avium
PVLAHPHRIALGPLPRPGRPARPRR

SEQ ID NO: 130418 - protein, 17 aa, Mycobacterium avium
PVLAQAAGRLSDELGTI

SEQ ID NO: 130419 - protein, 33 aa, Mycobacterium avium
PVLARSMTKLWARMWLLRFTWQRAIDSGDTSSA

SEQ ID NO: 130420 - protein, 20 aa, Mycobacterium avium
PVLEVVLGILRDLTSGPVNA

SEQ ID NO: 130421 - protein, 18 aa, Mycobacterium avium
PVLRFLLERPVHAKISRD

SEQ ID NO: 130422 - protein, 24 aa, Mycobacterium avium
PVLYQHFTSKLELYLAVLARHVEN

SEQ ID NO: 130423 - protein, 26 aa, Mycobacterium avium
PVMADFWETVLFRAGLYRGSALHAHR

SEQ ID NO: 130424 - protein, 20 aa, Mycobacterium avium
PVNLMTYVTYVFQKLFGYSE

SEQ ID NO: 130425 - protein, 17 aa, Mycobacterium avium
PVPAWSRHRPRCDTRAA

SEQ ID NO: 130426 - protein, 27 aa, Mycobacterium avium
PVPEVPVPRPGWLPWRAAVAARTHCQL

SEQ ID NO: 130427 - protein, 25 aa, Mycobacterium avium
PVPEVPVPRPGWLPWRAAVAARTHR

SEQ ID NO: 130428 - protein, 25 aa, Mycobacterium avium
PVPGAALFVLDGRLRRVPPGVVGEL

SEQ ID NO: 130429 - protein, 27 aa, Mycobacterium avium
PVPGTALLVLDGWLRPVPAGVVGELYV

SEQ ID NO: 130430 - protein, 27 aa, Mycobacterium avium
PVPHAPIAEYFVWFGDEYRIDETDRLL

SEQ ID NO: 130431 - protein, 26 aa, Mycobacterium avium
PVPTCPDWTLRQLFRHVGRGDRWAAQ

SEQ ID NO: 130432 - protein, 33 aa, Mycobacterium avium
PVPTEYDLLRRNQILFTFLHLAASRACTEALLT

SEQ ID NO: 130433 - protein, 18 aa, Mycobacterium avium
PVPVAAYQVSGEYAMICA

SEQ ID NO: 130434 - protein, 17 aa, Mycobacterium avium
PVQIRFGIDFVAASLAD

SEQ ID NO: 130435 - protein, 23 aa, Mycobacterium avium
PVQYVDYTLWQRAQFGELADSGS

SEQ ID NO: 130436 - protein, 21 aa, Mycobacterium avium
PVREEWLNALLDPSPTLVIHD

SEQ ID NO: 130437 - protein, 22 aa, Mycobacterium avium
PVRHIMDQLLVEFTTIGFLSDD

SEQ ID NO: 130438 - protein, 17 aa, Mycobacterium avium
PVRLAEAIRRFGPIFAQ

SEQ ID NO: 130439 - protein, 18 aa, Mycobacterium avium
PVRNRWGLHPARVAATGQ

SEQ ID NO: 130440 - protein, 19 aa, Mycobacterium avium
PVRTKDLMFTGRTLNAQEA

SEQ ID NO: 130441 - protein, 17 aa, Mycobacterium avium
PVRTPFGFHGVFGHLAA

SEQ ID NO: 130442 - protein, 17 aa, Mycobacterium avium
PVRTRDLMFTGRVLTAV

SEQ ID NO: 130443 - protein, 20 aa, Mycobacterium avium
PVRVKLMSLLFTADGTCTTG

SEQ ID NO: 130444 - protein, 33 aa, Mycobacterium avium
PVSALVVFEVMVRPLIRLSLGKRQPMRRIVQAR

SEQ ID NO: 130445 - protein, 26 aa, Mycobacterium avium
PVSTAALFVLDRWLRPAPPGVVGELY

SEQ ID NO: 130446 - protein, 17 aa, Mycobacterium avium
PVSVDALIDGVWGAAPV

SEQ ID NO: 130447 - protein, 18 aa, Mycobacterium avium
PVSVDALIDGVWGAAPVP

SEQ ID NO: 130448 - protein, 17 aa, Mycobacterium avium
PVSVWWSEIARVLRPGG

SEQ ID NO: 130449 - protein, 18 aa, Mycobacterium avium
PVTFVNIFEIPAEQVDDF

SEQ ID NO: 130450 - protein, 18 aa, Mycobacterium avium
PVTLLVNGRVHTPAAPDA

SEQ ID NO: 130451 - protein, 17 aa, Mycobacterium avium
PVTLRLELYPEQLQYIP

SEQ ID NO: 130452 - protein, 25 aa, Mycobacterium avium
PVTRANFYYYFSDKTELFIELGTDT

SEQ ID NO: 130453 - protein, 25 aa, Mycobacterium avium
PVTRSSLPTAQRARKLVYAPKLDGR

SEQ ID NO: 130454 - protein, 17 aa, Mycobacterium avium
PVVFFDGMDAWPSIIAA

SEQ ID NO: 130455 - protein, 25 aa, Mycobacterium avium
PVVSALILRALVTRVPQAALDLPEP

SEQ ID NO: 130456 - protein, 24 aa, Mycobacterium avium
PVVSLFGAQFITWRGIPLIPSDKV

SEQ ID NO: 130457 - protein, 20 aa, Mycobacterium avium
PVVWAMFEWGRRHLPGRHRL

SEQ ID NO: 130458 - protein, 33 aa, Mycobacterium avium
PVWCPLPGTKIEGLYISFLRSPDGVVFEFVERP

SEQ ID NO: 130459 - protein, 17 aa, Mycobacterium avium
PVWGSGILFELDYVLAG

SEQ ID NO: 130460 - protein, 19 aa, Mycobacterium avium
PVWVRGVGLGMDRVMHQHK

SEQ ID NO: 130461 - protein, 21 aa, Mycobacterium avium
PVYERAVLIHDSRLARDMVAA

SEQ ID NO: 130462 - protein, 18 aa, Mycobacterium avium
PWGLAQMPAAIAARTRYF

SEQ ID NO: 130463 - protein, 21 aa, Mycobacterium avium
PWNQWFWTSGKDGHLRIQHCS

SEQ ID NO: 130464 - protein, 19 aa, Mycobacterium avium
PWTGCEGWQARYGDQEISQ

SEQ ID NO: 130465 - protein, 31 aa, Mycobacterium avium
PYAKLFLEAAGDGIWRVYLDDELPAELVGAD

SEQ ID NO: 130466 - protein, 28 aa, Mycobacterium avium
PYAKLLREYLFGWARWFSRRPTTPTCCW

SEQ ID NO: 130467 - protein, 19 aa, Mycobacterium avium
PYARSRPISITDVELAPPG

SEQ ID NO: 130468 - protein, 27 aa, Mycobacterium avium
PYEEPAFDIFALLPPPGDAGLGRIGRL

SEQ ID NO: 130469 - protein, 27 aa, Mycobacterium avium
PYGATIAHGFLTLSLIPGVSKDNYRVE

SEQ ID NO: 130470 - protein, 24 aa, Mycobacterium avium
PYHGRLPPIWIGASGPRMLDIAGR

SEQ ID NO: 130471 - protein, 29 aa, Mycobacterium avium
PYHLLANSMVWLSDRYPRLLLPPVPSWVE

SEQ ID NO: 130472 - protein, 19 aa, Mycobacterium avium
PYHRVYGYPTLYVVDGAAI

SEQ ID NO: 130473 - protein, 19 aa, Mycobacterium avium
PYIRFGNWASPQRDPALAL

SEQ ID NO: 130474 - protein, 22 aa, Mycobacterium avium
PYLAGHGWRLNSVTIRDLFAAN

SEQ ID NO: 130475 - protein, 22 aa, Mycobacterium avium
PYNDIVGWKWTEVPNALGVTDH

SEQ ID NO: 130476 - protein, 21 aa, Mycobacterium avium
PYRRQIFAGVRLAWDVPGARG

SEQ ID NO: 130477 - protein, 20 aa, Mycobacterium avium
PYRVPVRIVFVEQLPRNDVG

SEQ ID NO: 130478 - protein, 18 aa, Mycobacterium avium
PYVYRFGQPVFDRLFYHR

SEQ ID NO: 130479 - protein, 17 aa, Mycobacterium avium
PYVYRFGQPVFDRLFYQ

SEQ ID NO: 130480 - protein, 22 aa, Mycobacterium avium
PYVYSPLVWYIIDGTRVAYKVF

SEQ ID NO: 130481 - protein, 24 aa, Mycobacterium avium
QAAATIRLAIGKVPQIWKDGHVSL

SEQ ID NO: 130482 - protein, 21 aa, Mycobacterium avium
QAACDGPRFRWVQGTQVSCEN

SEQ ID NO: 130483 - protein, 26 aa, Mycobacterium avium
QAAEADGFMSLWYASTVAGDPLVAMA

SEQ ID NO: 130484 - protein, 31 aa, Mycobacterium avium
QAAGIPVVFLTAYYGLSVLAGLRAGQRVLVH

SEQ ID NO: 130485 - protein, 25 aa, Mycobacterium avium
QAALRGVDRLVRFPGPNGLAHEIFT

SEQ ID NO: 130486 - protein, 18 aa, Mycobacterium avium
QACILNSRLLLPEAIHDE

SEQ ID NO: 130487 - protein, 17 aa, Mycobacterium avium
QADLGLAYLFISHDLAV

SEQ ID NO: 130488 - protein, 18 aa, Mycobacterium avium
QADRFWADFCTRLGRPDL

SEQ ID NO: 130489 - protein, 34 aa, Mycobacterium avium
QAESALSYLSCRLTRLLILLHKPSQDTTRKVYTF

SEQ ID NO: 130490 - protein, 17 aa, Mycobacterium avium
QAEVGTATLRWLADHRI

SEQ ID NO: 130491 - protein, 17 aa, Mycobacterium avium
QAGAITPGTKALSTELV

SEQ ID NO: 130492 - protein, 27 aa, Mycobacterium avium
QAGDRAIIARPPFWDITGEHLGVDVDV

SEQ ID NO: 130493 - protein, 21 aa, Mycobacterium avium
QAGFHLVVPRDAVGGTPSGYG

SEQ ID NO: 130494 - protein, 24 aa, Mycobacterium avium
QAGLRTDYLFRLANQRGGIVLGTS

SEQ ID NO: 130495 - protein, 25 aa, Mycobacterium avium
QAGQRRAHQIRPQRQPWVCQQHDGR

SEQ ID NO: 130496 - protein, 21 aa, Mycobacterium avium
QAIEEILRWEPPALQIARYVT

SEQ ID NO: 130497 - protein, 24 aa, Mycobacterium avium
QAIRDLLHRIEALGDIGHDIMLII

SEQ ID NO: 130498 - protein, 29 aa, Mycobacterium avium
QAIVDTLGGPLAWFARRAARSGKPTKVPR

SEQ ID NO: 130499 - protein, 19 aa, Mycobacterium avium
QAKFLTLASLKWVLRNRAY

SEQ ID NO: 130500 - protein, 35 aa, Mycobacterium avium
QAKPGDLLVAGDKKYMLLEPGKFYDLQEYKVVSAD

SEQ ID NO: 130501 - protein, 25 aa, Mycobacterium avium
QALAPVRFFNPIGMRFAKKATRDDI

SEQ ID NO: 130502 - protein, 26 aa, Mycobacterium avium
QALAPVRFFNPIGMRFAKKATREDID

SEQ ID NO: 130503 - protein, 18 aa, Mycobacterium avium
QALDQLLVLGTLLEGHAD

SEQ ID NO: 130504 - protein, 23 aa, Mycobacterium avium
QANHLIAGLIATGAIEVGIACGI

SEQ ID NO: 130505 - protein, 18 aa, Mycobacterium avium
QAPRLRGWGGRLATVLPA

SEQ ID NO: 130506 - protein, 24 aa, Mycobacterium avium
QAPTSAIAFTKRLLNDSPDTDRSG

SEQ ID NO: 130507 - protein, 19 aa, Mycobacterium avium
QAQPATAPVRRVPIVPPES

SEQ ID NO: 130508 - protein, 23 aa, Mycobacterium avium
QAQWEALRRTYLRLGHRVDVIEP

SEQ ID NO: 130509 - protein, 23 aa, Mycobacterium avium
QARGFTPAMALAAGFANTLARWS

SEQ ID NO: 130510 - protein, 20 aa, Mycobacterium avium
QARRAALLNALFAAATETEQ

SEQ ID NO: 130511 - protein, 23 aa, Mycobacterium avium
QARTILGLPVDTMMVSPAAARVV

SEQ ID NO: 130512 - protein, 21 aa, Mycobacterium avium
QASLLVLPVAIDSGEAWVVLR

SEQ ID NO: 130513 - protein, 28 aa, Mycobacterium avium
QASPPDMRLPISLALGWPHRVPGAAACC

SEQ ID NO: 130514 - protein, 25 aa, Mycobacterium avium
QASQKVFDFAPYPGAAPGLPAKVTI

SEQ ID NO: 130515 - protein, 20 aa, Mycobacterium avium
QATAFPVEFLSLGTNGIGVP

SEQ ID NO: 130516 - protein, 36 aa, Mycobacterium avium
QATGAPGRAWLFFGARNRALDFLYADELHGFRESGV

SEQ ID NO: 130517 - protein, 24 aa, Mycobacterium avium
QATIPIVFAVSRVVEVPYAEIVAS

SEQ ID NO: 130518 - protein, 20 aa, Mycobacterium avium
QAVALLLPRSADAIVAILAV

SEQ ID NO: 130519 - protein, 21 aa, Mycobacterium avium
QAVDLASYVFRRAFIAVPSHA

SEQ ID NO: 130520 - protein, 18 aa, Mycobacterium avium
QAVLPDMIEAGWGRIVNI

SEQ ID NO: 130521 - protein, 18 aa, Mycobacterium avium
QAVLPGMLSAGWGRIVNV

SEQ ID NO: 130522 - protein, 17 aa, Mycobacterium avium
QAYGLAGHRVLRMSPES

SEQ ID NO: 130523 - protein, 21 aa, Mycobacterium avium
QCPFHGWVWNGAGRNVHIPYQ

SEQ ID NO: 130524 - protein, 17 aa, Mycobacterium avium
QCPRRWRYLSPAIPADP

SEQ ID NO: 130525 - protein, 20 aa, Mycobacterium avium
QCRPTAEFGYLACAAARDGD

SEQ ID NO: 130526 - protein, 26 aa, Mycobacterium avium
QCRRLDALGIDYEIVPGVPAFAAAAA

SEQ ID NO: 130527 - protein, 23 aa, Mycobacterium avium
QDGSYLAELLLSKGYEVHGLVRR

SEQ ID NO: 130528 - protein, 18 aa, Mycobacterium avium
QDLSALGAELRLGQVFEA

SEQ ID NO: 130529 - protein, 17 aa, Mycobacterium avium
QDPPVSRFLPPNLVNRA

SEQ ID NO: 130530 - protein, 28 aa, Mycobacterium avium
QDVGDAVPALQLVDLLLGQPGRGDVRRG

SEQ ID NO: 130531 - protein, 17 aa, Mycobacterium avium
QDYQLQLVPAMLRELRP

SEQ ID NO: 130532 - protein, 31 aa, Mycobacterium avium
QEAGCILVFHIMPFWYFNAISPAWGQNSDPA

SEQ ID NO: 130533 - protein, 24 aa, Mycobacterium avium
QEAGFAGTQWQLGLLVKIDGKVHR

SEQ ID NO: 130534 - protein, 32 aa, Mycobacterium avium
QEDVYNPLRFLRAAMKWCRKAQTLGTLDDAAA

SEQ ID NO: 130535 - protein, 21 aa, Mycobacterium avium
QEFIGAFWYHYDEAHYDELAA

SEQ ID NO: 130536 - protein, 27 aa, Mycobacterium avium
QEHDLSLLLLRVQAVRSAWGPPQVHRQ

SEQ ID NO: 130537 - protein, 31 aa, Mycobacterium avium
QEIATLERELMFLDRLIGAAKEDLKLNLPAA

SEQ ID NO: 130538 - protein, 23 aa, Mycobacterium avium
QEIEFEHVIARLVELAYSRVDMV

SEQ ID NO: 130539 - protein, 36 aa, Mycobacterium avium
QEIFACYYGARLPAPAPYRGFVTWLAARDVPAARAA

SEQ ID NO: 130540 - protein, 20 aa, Mycobacterium avium
QEMQMLQQMLSSVTGALGGA

SEQ ID NO: 130541 - protein, 24 aa, Mycobacterium avium
QEPRLSWAAGLRDDGITTLLVTDL

SEQ ID NO: 130542 - protein, 19 aa, Mycobacterium avium
QERYPLLEETLELDLSGLS

SEQ ID NO: 130543 - protein, 34 aa, Mycobacterium avium
QETRRILDRLYGYEVTPVLWKKVAPKLSAGRVQS

SEQ ID NO: 130544 - protein, 17 aa, Mycobacterium avium
QFALLLSADEPSDPAGA

SEQ ID NO: 130545 - protein, 26 aa, Mycobacterium avium
QFGPRALLPATVLARWFRTEQARALF

SEQ ID NO: 130546 - protein, 21 aa, Mycobacterium avium
QFHVMLLAVRSEGAAGPAIEF

SEQ ID NO: 130547 - protein, 18 aa, Mycobacterium avium
QFIDYCTNMLYITAAPYV

SEQ ID NO: 130548 - protein, 19 aa, Mycobacterium avium
QFIEPTFAAYHQRGTSRDI

SEQ ID NO: 130549 - protein, 20 aa, Mycobacterium avium
QFLAVHPHLHRPRVIAIDEI

SEQ ID NO: 130550 - protein, 18 aa, Mycobacterium avium
QFLLSLIDSSAVRRASGA

SEQ ID NO: 130551 - protein, 23 aa, Mycobacterium avium
QFQETMRTLDLKLSAWHCNVEKP

SEQ ID NO: 130552 - protein, 27 aa, Mycobacterium avium
QFTAMAWSLMKLATLHLTIKPELLQSP

SEQ ID NO: 130553 - protein, 25 aa, Mycobacterium avium
QFTANPWLPGYMSQALALLTRDTGD

SEQ ID NO: 130554 - protein, 24 aa, Mycobacterium avium
QFTGLDPMLTGRENLVLFGRLRGL

SEQ ID NO: 130555 - protein, 17 aa, Mycobacterium avium
QFTQVWSTLTPAQKDEE

SEQ ID NO: 130556 - protein, 23 aa, Mycobacterium avium
QGDARIWFYVEGRTVYLEQVHTS

SEQ ID NO: 130557 - protein, 17 aa, Mycobacterium avium
QGELRYTDLRKLRGVWL

SEQ ID NO: 130558 - protein, 28 aa, Mycobacterium avium
QGFLFDGALFIVGRIKDLLIINGRNHYP

SEQ ID NO: 130559 - protein, 23 aa, Mycobacterium avium
QGFSLAGEFLVHGRIVYAAGPIG

SEQ ID NO: 130560 - protein, 33 aa, Mycobacterium avium
QGGCMALVLNASKSKYFGAWGPTREEAEAAALA

SEQ ID NO: 130561 - protein, 25 aa, Mycobacterium avium
QGGIRVPGFITWPGFARQGQIGTAF

SEQ ID NO: 130562 - protein, 21 aa, Mycobacterium avium
QGGLRGLLRVIGNEYPQFRTT

SEQ ID NO: 130563 - protein, 17 aa, Mycobacterium avium
QGHVLERLFPGIGKLDE

SEQ ID NO: 130564 - protein, 18 aa, Mycobacterium avium
QGISAELIAAKWGFSRTQ

SEQ ID NO: 130565 - protein, 22 aa, Mycobacterium avium
QGKTRLLRALVGLLDEWTPVIA

SEQ ID NO: 130566 - protein, 20 aa, Mycobacterium avium
QGLIALYRNIAGEHPDWDEY

SEQ ID NO: 130567 - protein, 21 aa, Mycobacterium avium
QGLIALYRNIAGEHPDWDEYR

SEQ ID NO: 130568 - protein, 24 aa, Mycobacterium avium
QGSARFWLFGVIPAWTHHLTIKRL

SEQ ID NO: 130569 - protein, 17 aa, Mycobacterium avium
QGSFLRQLGWHALARGW

SEQ ID NO: 130570 - protein, 24 aa, Mycobacterium avium
QGSKDIFLNILTTNGLCVKFLHDW

SEQ ID NO: 130571 - protein, 23 aa, Mycobacterium avium
QGVLRSKGFCWIASRPDIAAIWS

SEQ ID NO: 130572 - protein, 28 aa, Mycobacterium avium
QGVMSPLGATLWLPISDLAVNGSFYDLG

SEQ ID NO: 130573 - protein, 18 aa, Mycobacterium avium
QGWKPIDGSWRAPGAGPT

SEQ ID NO: 130574 - protein, 23 aa, Mycobacterium avium
QGWLADHAVGGVVLFPGAGFVEL

SEQ ID NO: 130575 - protein, 22 aa, Mycobacterium avium
QGWPTWWSDQFGNQGWDYWDVN

SEQ ID NO: 130576 - protein, 22 aa, Mycobacterium avium
QGWQLITTQLNFERAALGNLGA

SEQ ID NO: 130577 - protein, 27 aa, Mycobacterium avium
QHFSSKDELLLGLFDRTIAQSAQTWRA

SEQ ID NO: 130578 - protein, 28 aa, Mycobacterium avium
QHGLPQRWIDFLRRWDPAGWPSPRATSP

SEQ ID NO: 130579 - protein, 30 aa, Mycobacterium avium
QHGLPQRWIDFLRRWDPAGWPSPRATSPSN

SEQ ID NO: 130580 - protein, 28 aa, Mycobacterium avium
QHGLPQRWIDFLRRWEPAGWPSPRATSP

SEQ ID NO: 130581 - protein, 26 aa, Mycobacterium avium
QHGVVPRNLHFTRLPDEMARINTELF

SEQ ID NO: 130582 - protein, 17 aa, Mycobacterium avium
QHNAEVLGALGLSAQEI

SEQ ID NO: 130583 - protein, 20 aa, Mycobacterium avium
QHPDTFARLGVRPPRGVLLY

SEQ ID NO: 130584 - protein, 22 aa, Mycobacterium avium
QHPLPESLVGDAARFLLEGMPV

SEQ ID NO: 130585 - protein, 18 aa, Mycobacterium avium
QHPPQPFDQRLDGGRVEH

SEQ ID NO: 130586 - protein, 18 aa, Mycobacterium avium
QHPPQPPDQRLDAVRVEH

SEQ ID NO: 130587 - protein, 17 aa, Mycobacterium avium
QHRLCGRHFIAPNGVVV

SEQ ID NO: 130588 - protein, 33 aa, Mycobacterium avium
QHRPNEMLAGLPLIPFIPRWLVRRGESLAMASS

SEQ ID NO: 130589 - protein, 19 aa, Mycobacterium avium
QHSLWPTFADTPSGWRVVF

SEQ ID NO: 130590 - protein, 26 aa, Mycobacterium avium
QHTASRRRVEAALAGRLSTAEITAEE

SEQ ID NO: 130591 - protein, 26 aa, Mycobacterium avium
QHTASRRRVEAALAGRLSTAELTVEE

SEQ ID NO: 130592 - protein, 27 aa, Mycobacterium avium
QHTASRRRVEAALAGRLSTAELTVEEG

SEQ ID NO: 130593 - protein, 24 aa, Mycobacterium avium
QHVEAALCFPLPKFSDIRYDYALA

SEQ ID NO: 130594 - protein, 23 aa, Mycobacterium avium
QIAALESRLQQLDGFIGQAVEME

SEQ ID NO: 130595 - protein, 20 aa, Mycobacterium avium
QIAGTFGRRPLVSVRPSEVQ

SEQ ID NO: 130596 - protein, 22 aa, Mycobacterium avium
QIAQAFVSERIGLAAQAYSSAQ

SEQ ID NO: 130597 - protein, 19 aa, Mycobacterium avium
QIDLRANWMKHLHHANWKM

SEQ ID NO: 130598 - protein, 29 aa, Mycobacterium avium
QIDPDLTTPSLWPKLASVLVAETPVRGAM

SEQ ID NO: 130599 - protein, 17 aa, Mycobacterium avium
QIFRDIVDVNLVGVWNT

SEQ ID NO: 130600 - protein, 17 aa, Mycobacterium avium
QIGRRLARLARTHQVIV

SEQ ID NO: 130601 - protein, 31 aa, Mycobacterium avium
QIHGGIGFTWEHPIHLLLRRARANSVLVGRA

SEQ ID NO: 130602 - protein, 25 aa, Mycobacterium avium
QIHRHLRRYMNWIPADYVDAMAPTT

SEQ ID NO: 130603 - protein, 17 aa, Mycobacterium avium
QIHSGDLVFQWHRRDVH

SEQ ID NO: 130604 - protein, 24 aa, Mycobacterium avium
QIIARIACEIGFSEAFSYSCAEEV

SEQ ID NO: 130605 - protein, 30 aa, Mycobacterium avium
QIRAVYGELLPRTPLRFLLADDPGAGKTIM

SEQ ID NO: 130606 - protein, 17 aa, Mycobacterium avium
QIRKLLLDTPDPLQWDC

SEQ ID NO: 130607 - protein, 18 aa, Mycobacterium avium
QIRKLLLDTPDPLQWDCF

SEQ ID NO: 130608 - protein, 27 aa, Mycobacterium avium
QIRQSVPDWLVWMHGCPGGESVAQVSG

SEQ ID NO: 130609 - protein, 19 aa, Mycobacterium avium
QITALENRLQQLDGFIGQA

SEQ ID NO: 130610 - protein, 30 aa, Mycobacterium avium
QIVESVRMYKLRRYFPPDSRPGQPPVGPPV

SEQ ID NO: 130611 - protein, 29 aa, Mycobacterium avium
QIVILAAGLDSRAWRLAWPAGCVVYEIDQ

SEQ ID NO: 130612 - protein, 19 aa, Mycobacterium avium
QIWASRKIQHLPPHQSRVV

SEQ ID NO: 130613 - protein, 22 aa, Mycobacterium avium
QKNGSYSVVPWVPGGDIKPEHL

SEQ ID NO: 130614 - protein, 25 aa, Mycobacterium avium
QKPQGFKALDITLPMPARWTQVPDP

SEQ ID NO: 130615 - protein, 20 aa, Mycobacterium avium
QKSFHLPKILGGEVIWCQGF

SEQ ID NO: 130616 - protein, 23 aa, Mycobacterium avium
QKSFHLPKILRGEVIWCQGFSEP

SEQ ID NO: 130617 - protein, 21 aa, Mycobacterium avium
QKTFISNGLLSKLVLTAVKTD

SEQ ID NO: 130618 - protein, 18 aa, Mycobacterium avium
QLADAALLFGNVLARLTT

SEQ ID NO: 130619 - protein, 17 aa, Mycobacterium avium
QLAERVQHPLAGGSQRS

SEQ ID NO: 130620 - protein, 20 aa, Mycobacterium avium
QLAHQLIRYGAGPGRCVAVL

SEQ ID NO: 130621 - protein, 23 aa, Mycobacterium avium
QLAKAMDRKVWLPSGGTLVIDRT

SEQ ID NO: 130622 - protein, 17 aa, Mycobacterium avium
QLALYQALIRIGVAERI

SEQ ID NO: 130623 - protein, 25 aa, Mycobacterium avium
QLAMTPAFIRVFGLRSMRGRAVQEL

SEQ ID NO: 130624 - protein, 32 aa, Mycobacterium avium
QLARAELQIVFHTLVRRIPTLQLAIPIEEVPF

SEQ ID NO: 130625 - protein, 33 aa, Mycobacterium avium
QLARAELQIVFHTLVRRIPTLQLAIPIEEVPFK

SEQ ID NO: 130626 - protein, 21 aa, Mycobacterium avium
QLARGYWKRPALTATRFVANP

SEQ ID NO: 130627 - protein, 21 aa, Mycobacterium avium
QLARGYWKRPGLTAARFVANP

SEQ ID NO: 130628 - protein, 32 aa, Mycobacterium avium
QLARMELQIVLPTLLRRVPTLRLAAPLYELPF

SEQ ID NO: 130629 - protein, 24 aa, Mycobacterium avium
QLASDLMRPVLRVPRHPVRLAQFG

SEQ ID NO: 130630 - protein, 17 aa, Mycobacterium avium
QLAWSLRSDARVVVVER

SEQ ID NO: 130631 - protein, 20 aa, Mycobacterium avium
QLAYAAALATAGRFADADRI

SEQ ID NO: 130632 - protein, 25 aa, Mycobacterium avium
QLCAALTRILLPRSRYGEYVAALTD

SEQ ID NO: 130633 - protein, 20 aa, Mycobacterium avium
QLCGNVCATLSVWYAPEQFA

SEQ ID NO: 130634 - protein, 18 aa, Mycobacterium avium
QLCPLFDGTPPPYPGWPD

SEQ ID NO: 130635 - protein, 20 aa, Mycobacterium avium
QLDALPAQLDLIVGAAEVVQ

SEQ ID NO: 130636 - protein, 26 aa, Mycobacterium avium
QLDGGPMRDLLRRMQPTEFNDIVAVL

SEQ ID NO: 130637 - protein, 21 aa, Mycobacterium avium
QLDVIADHFIDAHPFADGGDV

SEQ ID NO: 130638 - protein, 24 aa, Mycobacterium avium
QLEASPAADFDFERSWRAVGPDDV

SEQ ID NO: 130639 - protein, 23 aa, Mycobacterium avium
QLEDWHRPRLEVLAGADADVLAV

SEQ ID NO: 130640 - protein, 20 aa, Mycobacterium avium
QLELKWRAIREDLERRGVGA

SEQ ID NO: 130641 - protein, 22 aa, Mycobacterium avium
QLELKWRAIREDLERRGVGAPI

SEQ ID NO: 130642 - protein, 20 aa, Mycobacterium avium
QLELKWRAIREDLERRGVGV

SEQ ID NO: 130643 - protein, 18 aa, Mycobacterium avium
QLELQWGRTIGMQPSPVT

SEQ ID NO: 130644 - protein, 24 aa, Mycobacterium avium
QLFADWAVYLLVGYEQATLPPDKE

SEQ ID NO: 130645 - protein, 34 aa, Mycobacterium avium
QLGTEVIIVPGLWRDFDHTALAYQLARERAGERP

SEQ ID NO: 130646 - protein, 17 aa, Mycobacterium avium
QLGVDFWVDGVNPPGYT

SEQ ID NO: 130647 - protein, 25 aa, Mycobacterium avium
QLGVLSSLSFKLYTADRTAGALNLF

SEQ ID NO: 130648 - protein, 17 aa, Mycobacterium avium
QLHETSIRRWPSTTQPA

SEQ ID NO: 130649 - protein, 18 aa, Mycobacterium avium
QLHRVHVVHAVVALRGAG

SEQ ID NO: 130650 - protein, 24 aa, Mycobacterium avium
QLIETRYFVNLVTGPIAKNMIQAF

SEQ ID NO: 130651 - protein, 30 aa, Mycobacterium avium
QLITDERITLLHLAPVMLRALLDEITDPRG

SEQ ID NO: 130652 - protein, 20 aa, Mycobacterium avium
QLKAYYLPSEGRRIRLRVSA

SEQ ID NO: 130653 - protein, 20 aa, Mycobacterium avium
QLLERPDTLDVLRLIANAPN

SEQ ID NO: 130654 - protein, 21 aa, Mycobacterium avium
QLLERPDTLNVLRLIANAPNI

SEQ ID NO: 130655 - protein, 24 aa, Mycobacterium avium
QLLERPDTLNVLRLIANAPNIFES

SEQ ID NO: 130656 - protein, 27 aa, Mycobacterium avium
QLLGPKAHKVWKPVIAALHSIVAGGAM

SEQ ID NO: 130657 - protein, 19 aa, Mycobacterium avium
QLLVHPAVRRALAHRHVTQ

SEQ ID NO: 130658 - protein, 26 aa, Mycobacterium avium
QLMAATLAHWGLLTFSAPPTRSAAPL

SEQ ID NO: 130659 - protein, 18 aa, Mycobacterium avium
QLMVLSEVVPDFRTAHEL

SEQ ID NO: 130660 - protein, 23 aa, Mycobacterium avium
QLNAGLLFISYQKDPQDFIRLQN

SEQ ID NO: 130661 - protein, 17 aa, Mycobacterium avium
QLNLILKGDNAGTVEAL

SEQ ID NO: 130662 - protein, 21 aa, Mycobacterium avium
QLNPFALLASQGVPLALGSDA

SEQ ID NO: 130663 - protein, 17 aa, Mycobacterium avium
QLPSLLAEKVKAPTVAP

SEQ ID NO: 130664 - protein, 23 aa, Mycobacterium avium
QLPVAPMGFISTRYYVSMNVADK

SEQ ID NO: 130665 - protein, 17 aa, Mycobacterium avium
QLQHWTHHFDYALVSGP

SEQ ID NO: 130666 - protein, 25 aa, Mycobacterium avium
QLRDRLLIVVAGYCGLRWGELAALR

SEQ ID NO: 130667 - protein, 23 aa, Mycobacterium avium
QLTALTPVRNTLPAWRIEPPAPA

SEQ ID NO: 130668 - protein, 19 aa, Mycobacterium avium
QLTPEALLLRDDRMRMALD

SEQ ID NO: 130669 - protein, 20 aa, Mycobacterium avium
QLWVAGTRPFGPTCVLVRET

SEQ ID NO: 130670 - protein, 22 aa, Mycobacterium avium
QLWVTDLTFVPTWAGVAYVCFI

SEQ ID NO: 130671 - protein, 24 aa, Mycobacterium avium
QMEYMLPRLRGWGESMSRQAGGRA

SEQ ID NO: 130672 - protein, 17 aa, Mycobacterium avium
QMMHTLPVPWVDASDIS

SEQ ID NO: 130673 - protein, 18 aa, Mycobacterium avium
QMRTAAPDFRLFWDNAYA

SEQ ID NO: 130674 - protein, 19 aa, Mycobacterium avium
QMRTAAPDFRLFWDNAYAV

SEQ ID NO: 130675 - protein, 19 aa, Mycobacterium avium
QMTIRVFTGLTLLDTIQGT

SEQ ID NO: 130676 - protein, 18 aa, Mycobacterium avium
QMTMRVFTGLTLLDTIQG

SEQ ID NO: 130677 - protein, 18 aa, Mycobacterium avium
QMWTAYRESPAWGFCMWA

SEQ ID NO: 130678 - protein, 17 aa, Mycobacterium avium
QMYPLVDFLTRSADKIA

SEQ ID NO: 130679 - protein, 17 aa, Mycobacterium avium
QNAEYVFLLTNTDPRRP

SEQ ID NO: 130680 - protein, 18 aa, Mycobacterium avium
QNAEYVFLLTNTDPRRPK

SEQ ID NO: 130681 - protein, 27 aa, Mycobacterium avium
QNAKQRLRECWLWSRAYTISGGSSEMM

SEQ ID NO: 130682 - protein, 23 aa, Mycobacterium avium
QNALPIQILMPEDIANAVAFLVS

SEQ ID NO: 130683 - protein, 23 aa, Mycobacterium avium
QNAMVLQQNFAERTKLLSQLEQA

SEQ ID NO: 130684 - protein, 17 aa, Mycobacterium avium
QNDILMPYLNNLTTEEQ

SEQ ID NO: 130685 - protein, 21 aa, Mycobacterium avium
QNIANLFGEPAAVLTATVASG

SEQ ID NO: 130686 - protein, 17 aa, Mycobacterium avium
QNVCFLYHVLGGGTGDW

SEQ ID NO: 130687 - protein, 22 aa, Mycobacterium avium
QPAPDWFPLLGGHEGAGVVAEV

SEQ ID NO: 130688 - protein, 24 aa, Mycobacterium avium
QPDQALLITIPVTDAPYLGFQLGS

SEQ ID NO: 130689 - protein, 20 aa, Mycobacterium avium
QPETRLAAPLLAKGLPACPG

SEQ ID NO: 130690 - protein, 23 aa, Mycobacterium avium
QPFHEKLTLLWHNHFATSAQKVR

SEQ ID NO: 130691 - protein, 17 aa, Mycobacterium avium
QPFIVVGMPRSGTTHLV

SEQ ID NO: 130692 - protein, 26 aa, Mycobacterium avium
QPGFDDRPFSLFYSLAVLAIGQEHAI

SEQ ID NO: 130693 - protein, 20 aa, Mycobacterium avium
QPGKYYAIFGDSFSGNKAYD

SEQ ID NO: 130694 - protein, 21 aa, Mycobacterium avium
QPGLHRAVFGSGCRALRIWSR

SEQ ID NO: 130695 - protein, 17 aa, Mycobacterium avium
QPGPQRAPRPGIHNSGW

SEQ ID NO: 130696 - protein, 21 aa, Mycobacterium avium
QPGTALPWPAPENTAYIIYTS

SEQ ID NO: 130697 - protein, 19 aa, Mycobacterium avium
QPKVGLQQGVARTVEYFRN

SEQ ID NO: 130698 - protein, 20 aa, Mycobacterium avium
QPLEKLFGTAISRPVIPFFV

SEQ ID NO: 130699 - protein, 18 aa, Mycobacterium avium
QPMRRIVQARTLSPITSV

SEQ ID NO: 130700 - protein, 17 aa, Mycobacterium avium
QPPGPPSAPPTPWTEST

SEQ ID NO: 130701 - protein, 17 aa, Mycobacterium avium
QPPRPPPDTSNPSHRLW

SEQ ID NO: 130702 - protein, 18 aa, Mycobacterium avium
QPPRTLLRGTPTLGERMA

SEQ ID NO: 130703 - protein, 18 aa, Mycobacterium avium
QPRLAELGGRFWFSLDDG

SEQ ID NO: 130704 - protein, 17 aa, Mycobacterium avium
QPRPRCPATRRAEEQLV

SEQ ID NO: 130705 - protein, 22 aa, Mycobacterium avium
QPSGFPVEFLSLGANGIGVPIR

SEQ ID NO: 130706 - protein, 20 aa, Mycobacterium avium
QPSGFPVEFLSLGTNGIGVP

SEQ ID NO: 130707 - protein, 28 aa, Mycobacterium avium
QPSSSALTQRRFGWQPVGPGLLDDLETG

SEQ ID NO: 130708 - protein, 29 aa, Mycobacterium avium
QPSSSALTQRRFGWQPVGPGLLDDLETGV

SEQ ID NO: 130709 - protein, 18 aa, Mycobacterium avium
QPTAWIAEGLFGYLPPEA

SEQ ID NO: 130710 - protein, 18 aa, Mycobacterium avium
QPVPVPHRRLPTAERPGT

SEQ ID NO: 130711 - protein, 19 aa, Mycobacterium avium
QPVTFRLGDIVPGLGASRA

SEQ ID NO: 130712 - protein, 25 aa, Mycobacterium avium
QQAKGEFFVVKLRVTNIGDKSQSFS

SEQ ID NO: 130713 - protein, 26 aa, Mycobacterium avium
QQAWSVRWVILHVINELARHAGHADI

SEQ ID NO: 130714 - protein, 23 aa, Mycobacterium avium
QQELHAIIKALRTAAVNDTKDAL

SEQ ID NO: 130715 - protein, 20 aa, Mycobacterium avium
QQEWLPTMLGGHTIGAYSLS

SEQ ID NO: 130716 - protein, 27 aa, Mycobacterium avium
QQFAPLIDLKWWQKRPGERTELYRRLR

SEQ ID NO: 130717 - protein, 26 aa, Mycobacterium avium
QQFAPLIDLRWWQERPAERSELYRRL

SEQ ID NO: 130718 - protein, 17 aa, Mycobacterium avium
QQGKFLSLLATAMGARR

SEQ ID NO: 130719 - protein, 25 aa, Mycobacterium avium
QQHYPMQPGAYWVPRPLGGTAPTPA

SEQ ID NO: 130720 - protein, 25 aa, Mycobacterium avium
QQKKRFLAPLLRADEFWCQGFSEPG

SEQ ID NO: 130721 - protein, 34 aa, Mycobacterium avium
QQLARAELQIVFHSLVRRIPTLQLAIPIEEVPFK

SEQ ID NO: 130722 - protein, 21 aa, Mycobacterium avium
QQLATAWTGDLVKLLAADRAH

SEQ ID NO: 130723 - protein, 17 aa, Mycobacterium avium
QQLLAYLQAWRELLERW

SEQ ID NO: 130724 - protein, 19 aa, Mycobacterium avium
QQLMLPFQGRPPDAIDAAI

SEQ ID NO: 130725 - protein, 26 aa, Mycobacterium avium
QQQADYFMRLLTGRRGLIDQRLDGYR

SEQ ID NO: 130726 - protein, 27 aa, Mycobacterium avium
QQQKDRFLIPLLRADEFWCQGFSEPGA

SEQ ID NO: 130727 - protein, 17 aa, Mycobacterium avium
QQREFALARLYPESARI

SEQ ID NO: 130728 - protein, 19 aa, Mycobacterium avium
QQRFLSVAEGLPALPPGAA

SEQ ID NO: 130729 - protein, 28 aa, Mycobacterium avium
QQRLAPGTALARVFWPNGRIVVTREAIQ

SEQ ID NO: 130730 - protein, 24 aa, Mycobacterium avium
QQRLPLRATVLLVSGRASFELAQK

SEQ ID NO: 130731 - protein, 24 aa, Mycobacterium avium
QQRRFRGATLRRQTDRHAQAGDGL

SEQ ID NO: 130732 - protein, 18 aa, Mycobacterium avium
QQRRYTLLGLSGLGGRYQ

SEQ ID NO: 130733 - protein, 17 aa, Mycobacterium avium
QQRVRDYIRIGQQEGAR

SEQ ID NO: 130734 - protein, 24 aa, Mycobacterium avium
QQRWLTTTYPGLTPKYLFIGVKQN

SEQ ID NO: 130735 - protein, 18 aa, Mycobacterium avium
QQRYAPLLAALDCPVHLV

SEQ ID NO: 130736 - protein, 22 aa, Mycobacterium avium
QQSRWIIEPVLRLLDCCQESDG

SEQ ID NO: 130737 - protein, 20 aa, Mycobacterium avium
QQTQFLNWRPRSRAAVRAWH

SEQ ID NO: 130738 - protein, 19 aa, Mycobacterium avium
QQVFGMAEGLLNYTRLDDP

SEQ ID NO: 130739 - protein, 18 aa, Mycobacterium avium
QQVFGMAEGLLNYTRPDD

SEQ ID NO: 130740 - protein, 25 aa, Mycobacterium avium
QQVLSRFLHDFAGLGADWTAANIAG

SEQ ID NO: 130741 - protein, 25 aa, Mycobacterium avium
QQVWRRHLAGLPGPTLLAAALGSVE

SEQ ID NO: 130742 - protein, 17 aa, Mycobacterium avium
QRAALPPMHAGRADVIA

SEQ ID NO: 130743 - protein, 18 aa, Mycobacterium avium
QRAPRAPALLVASERNPI

SEQ ID NO: 130744 - protein, 18 aa, Mycobacterium avium
QRAPRAPALLVASERTPI

SEQ ID NO: 130745 - protein, 29 aa, Mycobacterium avium
QRCAEARIFFVDYLTMLPPAGVPAAPLSP

SEQ ID NO: 130746 - protein, 28 aa, Mycobacterium avium
QRCESLRDNLWYLIDAKAATAIAVDDRT

SEQ ID NO: 130747 - protein, 20 aa, Mycobacterium avium
QRDFTLWKGAKPGEPSWPTP

SEQ ID NO: 130748 - protein, 25 aa, Mycobacterium avium
QRDLAYTTIMTVLQRLAKKNLVSQI

SEQ ID NO: 130749 - protein, 18 aa, Mycobacterium avium
QREVGVRSTLARLGLAPN

SEQ ID NO: 130750 - protein, 26 aa, Mycobacterium avium
QRFATAMAPFGFRAAAATPAYGMAEA

SEQ ID NO: 130751 - protein, 20 aa, Mycobacterium avium
QRHKVPRRLLKAARLDLIDL

SEQ ID NO: 130752 - protein, 17 aa, Mycobacterium avium
QRIQLAGLFDPMLAVAT

SEQ ID NO: 130753 - protein, 19 aa, Mycobacterium avium
QRLATQLGYSETVFVDLPA

SEQ ID NO: 130754 - protein, 21 aa, Mycobacterium avium
QRNQWLVVDNIPGGAPIPQEV

SEQ ID NO: 130755 - protein, 18 aa, Mycobacterium avium
QRPRAYHEFGALARHLRF

SEQ ID NO: 130756 - protein, 19 aa, Mycobacterium avium
QRPSWSRVRSAMRGCVVFD

SEQ ID NO: 130757 - protein, 31 aa, Mycobacterium avium
QRRCPDIRLARKRLGWRPRVDYRTGLSTTLA

SEQ ID NO: 130758 - protein, 31 aa, Mycobacterium avium
QRRCPDIRLARQRLGWRPRVDYRTGLSTTLA

SEQ ID NO: 130759 - protein, 21 aa, Mycobacterium avium
QRRDPFERVTFARRSFTIEEQ

SEQ ID NO: 130760 - protein, 24 aa, Mycobacterium avium
QRRLYALMVLMKTADDRLSRGIGT

SEQ ID NO: 130761 - protein, 23 aa, Mycobacterium avium
QRRRRLLDGLPRRRGALGHRVLP

SEQ ID NO: 130762 - protein, 26 aa, Mycobacterium avium
QRRTDRLPFLAPLDWESFEGLLRGRI

SEQ ID NO: 130763 - protein, 17 aa, Mycobacterium avium
QRRYPAWPASQDASLRV

SEQ ID NO: 130764 - protein, 25 aa, Mycobacterium avium
QRSLRDYLNGLQLYRQNMPAPMLAP

SEQ ID NO: 130765 - protein, 22 aa, Mycobacterium avium
QRTVKSLGAQSLQLPKIGADLE

SEQ ID NO: 130766 - protein, 33 aa, Mycobacterium avium
QRVKANLFYRGLVFHRFPVIGDSLYTRTEVVGL

SEQ ID NO: 130767 - protein, 29 aa, Mycobacterium avium
QRVSGRSWRVPVTAFWQAHRDAAATYRAL

SEQ ID NO: 130768 - protein, 21 aa, Mycobacterium avium
QRVTLRPHPRRRQAGVQRAEQ

SEQ ID NO: 130769 - protein, 22 aa, Mycobacterium avium
QRVWREHLAGLPGPTLLAASLG

SEQ ID NO: 130770 - protein, 24 aa, Mycobacterium avium
QRVWREHLAGLPGPTLLAASLGSA

SEQ ID NO: 130771 - protein, 21 aa, Mycobacterium avium
QSAQRWISSLWSLRPDQKNSV

SEQ ID NO: 130772 - protein, 21 aa, Mycobacterium avium
QSDFIGYLVGLAGLADVVHTL

SEQ ID NO: 130773 - protein, 32 aa, Mycobacterium avium
QSESNAMWALSIPVPFIKPVGAGAGGYFAPHV

SEQ ID NO: 130774 - protein, 18 aa, Mycobacterium avium
QSFLAMDPPRHTKLRKLA

SEQ ID NO: 130775 - protein, 24 aa, Mycobacterium avium
QSGRFAFRAGPIFTNLLLADEINR

SEQ ID NO: 130776 - protein, 23 aa, Mycobacterium avium
QSGSIGLGFAIPVDQAKRIADEL

SEQ ID NO: 130777 - protein, 20 aa, Mycobacterium avium
QSIIRLLGGLEPGEHMSRTK

SEQ ID NO: 130778 - protein, 17 aa, Mycobacterium avium
QSLIRWDPVGHAESELT

SEQ ID NO: 130779 - protein, 17 aa, Mycobacterium avium
QSPRLVAYTATKSALSS

SEQ ID NO: 130780 - protein, 21 aa, Mycobacterium avium
QSPVALKYPPRQFGVGKERKM

SEQ ID NO: 130781 - protein, 21 aa, Mycobacterium avium
QSQWGWAWPADRRVLYNRASA

SEQ ID NO: 130782 - protein, 24 aa, Mycobacterium avium
QSRRFYESVFGWPVLLEVPDNADA

SEQ ID NO: 130783 - protein, 20 aa, Mycobacterium avium
QTALTLLHLGTHPNLRQQLI

SEQ ID NO: 130784 - protein, 20 aa, Mycobacterium avium
QTFFTTPHFDGYPAVLVNLA

SEQ ID NO: 130785 - protein, 27 aa, Mycobacterium avium
QTGTWPGYPPLIHPISYAPWAFRRDFN

SEQ ID NO: 130786 - protein, 31 aa, Mycobacterium avium
QTIFEGRMPPRLLNPQVWPRYCERFHDILGV

SEQ ID NO: 130787 - protein, 18 aa, Mycobacterium avium
QTIIDKLAQFKSAAISLL

SEQ ID NO: 130788 - protein, 19 aa, Mycobacterium avium
QTLALYRHDPDGDEVLGSA

SEQ ID NO: 130789 - protein, 17 aa, Mycobacterium avium
QTLLTQPGLSPGDRAQL

SEQ ID NO: 130790 - protein, 28 aa, Mycobacterium avium
QTLTTLMPLRYQDANWWLRARTAGDIGG

SEQ ID NO: 130791 - protein, 20 aa, Mycobacterium avium
QTPCAVVAFASWPQETVLRG

SEQ ID NO: 130792 - protein, 25 aa, Mycobacterium avium
QTPCAVVAFASWPQQTVLRGTLDDI

SEQ ID NO: 130793 - protein, 20 aa, Mycobacterium avium
QTPDLLTFTRADLLRTEETG

SEQ ID NO: 130794 - protein, 23 aa, Mycobacterium avium
QTPIRSILSFELFVDRTSMAALN

SEQ ID NO: 130795 - protein, 30 aa, Mycobacterium avium
QTQAGQYALTYPRRLGFGLGNSVVSLSWRT

SEQ ID NO: 130796 - protein, 17 aa, Mycobacterium avium
QTRGLWYSFTAGSVRVI

SEQ ID NO: 130797 - protein, 27 aa, Mycobacterium avium
QTRYRRILQPFFSPRMIKPLEPDLRRQ

SEQ ID NO: 130798 - protein, 20 aa, Mycobacterium avium
QTVFMYLDYIHHWRHPIRDG

SEQ ID NO: 130799 - protein, 32 aa, Mycobacterium avium
QTWEARIKLDCLFPGLWPSFWGVNEDPLPDGE

SEQ ID NO: 130800 - protein, 24 aa, Mycobacterium avium
QVAELLFDVLGPTALDAGSGAPLH

SEQ ID NO: 130801 - protein, 37 aa, Mycobacterium avium
QVAPGDELVARFPGHQILGIPMRDASRPCHQTRLLSI

SEQ ID NO: 130802 - protein, 17 aa, Mycobacterium avium
QVERRQFGIPDEPRVVG

SEQ ID NO: 130803 - protein, 17 aa, Mycobacterium avium
QVFPIRQFADGIAHTLR

SEQ ID NO: 130804 - protein, 22 aa, Mycobacterium avium
QVGDPLPFGEPALAGGALGSIA

SEQ ID NO: 130805 - protein, 23 aa, Mycobacterium avium
QVGDPLPFGEPALAGGALGSIAK

SEQ ID NO: 130806 - protein, 18 aa, Mycobacterium avium
QVGDRVWAWTLPDGGYGW

SEQ ID NO: 130807 - protein, 17 aa, Mycobacterium avium
QVGLAQTLILNGFLARL

SEQ ID NO: 130808 - protein, 26 aa, Mycobacterium avium
QVHAAILDLLSRICDPLTGIKEVWDL

SEQ ID NO: 130809 - protein, 20 aa, Mycobacterium avium
QVHTPANLVWYPTVDGRVME

SEQ ID NO: 130810 - protein, 18 aa, Mycobacterium avium
QVIELHDCFSANELLLYE

SEQ ID NO: 130811 - protein, 19 aa, Mycobacterium avium
QVLASLAAGLIPVNEVGHQ

SEQ ID NO: 130812 - protein, 20 aa, Mycobacterium avium
QVLMWVNRFDTETTLTVAFP

SEQ ID NO: 130813 - protein, 18 aa, Mycobacterium avium
QVLNSVECLLPFFDRKTA

SEQ ID NO: 130814 - protein, 21 aa, Mycobacterium avium
QVPERQQIFARRLDLPGRGQT

SEQ ID NO: 130815 - protein, 19 aa, Mycobacterium avium
QVPPKMWPADRAAFDRYWE

SEQ ID NO: 130816 - protein, 24 aa, Mycobacterium avium
QVRAGLKAIYLSGWQVAGDANLSG

SEQ ID NO: 130817 - protein, 22 aa, Mycobacterium avium
QVRAVFQVGRATGHQWGPPYDA

SEQ ID NO: 130818 - protein, 21 aa, Mycobacterium avium
QVRESYSRLLHSALARLQADG

SEQ ID NO: 130819 - protein, 20 aa, Mycobacterium avium
QVRESYSRLLHSALARLQGD

SEQ ID NO: 130820 - protein, 27 aa, Mycobacterium avium
QVRGLDAVLPALLARELHPTAVAGFLM

SEQ ID NO: 130821 - protein, 23 aa, Mycobacterium avium
QVSKRLPMWTIYEMLGLPDDQRD

SEQ ID NO: 130822 - protein, 23 aa, Mycobacterium avium
QVSLAGRYLVYVPGASSTGISRK

SEQ ID NO: 130823 - protein, 22 aa, Mycobacterium avium
QVTELLIARCEALLAAGDVASA

SEQ ID NO: 130824 - protein, 19 aa, Mycobacterium avium
QVTKLARTYKPYGPVLSDA

SEQ ID NO: 130825 - protein, 25 aa, Mycobacterium avium
QVTRLSRLWFDALAGICAHVRAGGG

SEQ ID NO: 130826 - protein, 18 aa, Mycobacterium avium
QVVGGPVFVIGLPRTGTT

SEQ ID NO: 130827 - protein, 21 aa, Mycobacterium avium
QVVPTMFVRMLQLSEAVRAGY

SEQ ID NO: 130828 - protein, 19 aa, Mycobacterium avium
QVWCPVCALAALATGDQHP

SEQ ID NO: 130829 - protein, 20 aa, Mycobacterium avium
QWDCTAPCFAAILGDPAVGR

SEQ ID NO: 130830 - protein, 19 aa, Mycobacterium avium
QWEALRRTYLRLGHRVDVI

SEQ ID NO: 130831 - protein, 25 aa, Mycobacterium avium
QWEDVFLQMRNQSYSITWKGAGGDG

SEQ ID NO: 130832 - protein, 18 aa, Mycobacterium avium
QWGALRRTYLRLGHRVDV

SEQ ID NO: 130833 - protein, 20 aa, Mycobacterium avium
QWIEAEVPAAWRSAAAKDPA

SEQ ID NO: 130834 - protein, 24 aa, Mycobacterium avium
QWQPVPVGNWYYATGIVASPANTN

SEQ ID NO: 130835 - protein, 26 aa, Mycobacterium avium
QWSTEAWQRCAYFTEVRRAGGNTART

SEQ ID NO: 130836 - protein, 21 aa, Mycobacterium avium
QWVDWARPEPGHRASPSWLGK

SEQ ID NO: 130837 - protein, 19 aa, Mycobacterium avium
QWVVIDKNKKTVLIKWLIE

SEQ ID NO: 130838 - protein, 19 aa, Mycobacterium avium
QWWAQRFGIEPDLAEALVC

SEQ ID NO: 130839 - protein, 19 aa, Mycobacterium avium
QWWQQQVVLGLQRGGSPPQ

SEQ ID NO: 130840 - protein, 21 aa, Mycobacterium avium
QYADYSLWQRALLGDVADAES

SEQ ID NO: 130841 - protein, 28 aa, Mycobacterium avium
QYFATVSSTPWPEHWPKPSRVEQGGMVF

SEQ ID NO: 130842 - protein, 17 aa, Mycobacterium avium
QYFLEAFDRTETGWRLH

SEQ ID NO: 130843 - protein, 18 aa, Mycobacterium avium
QYIEALDLVLSLQPDRLI

SEQ ID NO: 130844 - protein, 19 aa, Mycobacterium avium
QYLGTVRTIFKLALPDRLP

SEQ ID NO: 130845 - protein, 23 aa, Mycobacterium avium
QYRYESTFLLRGLTELHIEFTQA

SEQ ID NO: 130846 - protein, 23 aa, Mycobacterium avium
QYTKALALQLAPLSIRANAIHPT

SEQ ID NO: 130847 - protein, 19 aa, Mycobacterium avium
QYVWSVPHNVAGLVTALGG

SEQ ID NO: 130848 - protein, 27 aa, Mycobacterium avium
RAAAKGRKLFRRLVHRGELRVEVRGNV

SEQ ID NO: 130849 - protein, 29 aa, Mycobacterium avium
RAAAVNFPDVLFIAGKYQVKIPPPFIPGN

SEQ ID NO: 130850 - protein, 25 aa, Mycobacterium avium
RAADLAFAVLRRPHAALSAALRADP

SEQ ID NO: 130851 - protein, 25 aa, Mycobacterium avium
RAADLAFAVLRRPHAALSTALRADP

SEQ ID NO: 130852 - protein, 25 aa, Mycobacterium avium
RAAEIAGITGLPLLAAIKAQPQLGA

SEQ ID NO: 130853 - protein, 18 aa, Mycobacterium avium
RAAGPYAALGSRAPDAVD

SEQ ID NO: 130854 - protein, 19 aa, Mycobacterium avium
RAAGWDPPRYTTTAFEMAH

SEQ ID NO: 130855 - protein, 17 aa, Mycobacterium avium
RAALAVNWPYALASMLD

SEQ ID NO: 130856 - protein, 25 aa, Mycobacterium avium
RAALSWLRRHAFLVRNLDITPERAD

SEQ ID NO: 130857 - protein, 36 aa, Mycobacterium avium
RAANPHVLTISPPINMNPRWLGAHPAYTLSKYGMTL

SEQ ID NO: 130858 - protein, 23 aa, Mycobacterium avium
RAAPGLRRPALPGPAPPGQVLRR

SEQ ID NO: 130859 - protein, 18 aa, Mycobacterium avium
RAAPRRYPPHPAPGPPGD

SEQ ID NO: 130860 - protein, 30 aa, Mycobacterium avium
RAAPTPVQIPRFLRKLLRELPPAPDTDRSE

SEQ ID NO: 130861 - protein, 18 aa, Mycobacterium avium
RAARFLAEGSNLVEAAAG

SEQ ID NO: 130862 - protein, 27 aa, Mycobacterium avium
RAARWGATPLKAPALEAILAATGGRGA

SEQ ID NO: 130863 - protein, 19 aa, Mycobacterium avium
RAATWAAFPGVHGKAYRAL

SEQ ID NO: 130864 - protein, 25 aa, Mycobacterium avium
RAAVEPLVLMLAPLAPHMAEELWLR

SEQ ID NO: 130865 - protein, 24 aa, Mycobacterium avium
RAAVFLRAADLLAGPWREKIAAAT

SEQ ID NO: 130866 - protein, 21 aa, Mycobacterium avium
RADAVLLVGARLNWLLGHGES

SEQ ID NO: 130867 - protein, 22 aa, Mycobacterium avium
RADFPILKRIMRSGNQLAYLDS

SEQ ID NO: 130868 - protein, 19 aa, Mycobacterium avium
RADGYLELTGRRKELYKSG

SEQ ID NO: 130869 - protein, 17 aa, Mycobacterium avium
RADLHEVQRWCALLEWA

SEQ ID NO: 130870 - protein, 20 aa, Mycobacterium avium
RADLLRRAGRPAEALPWYRI

SEQ ID NO: 130871 - protein, 26 aa, Mycobacterium avium
RADVVFASHHWPTWGRDGIVEFLSLQ

SEQ ID NO: 130872 - protein, 33 aa, Mycobacterium avium
RADVVNAVFMPIPVRIIAALLGLPESDVGEFHR

SEQ ID NO: 130873 - protein, 27 aa, Mycobacterium avium
RADWLAREHPWLLRRDLRTGSAGIDPL

SEQ ID NO: 130874 - protein, 18 aa, Mycobacterium avium
RADWLWRVLGEAGHVALV

SEQ ID NO: 130875 - protein, 18 aa, Mycobacterium avium
RAEDWLIHPGSVGRPLVG

SEQ ID NO: 130876 - protein, 19 aa, Mycobacterium avium
RAEFGWMPAVDAWLGQWDE

SEQ ID NO: 130877 - protein, 17 aa, Mycobacterium avium
RAEIAAGRRYLPAGPNV

SEQ ID NO: 130878 - protein, 23 aa, Mycobacterium avium
RAELFLGGLEDVAQPRRAGDDLR

SEQ ID NO: 130879 - protein, 19 aa, Mycobacterium avium
RAELGLPADWEPLGAIAIG

SEQ ID NO: 130880 - protein, 25 aa, Mycobacterium avium
RAETLVLCLALLHARTPDVPAIAAA

SEQ ID NO: 130881 - protein, 19 aa, Mycobacterium avium
RAEWWYSRAATVMGGTAEV

SEQ ID NO: 130882 - protein, 26 aa, Mycobacterium avium
RAFDLFEPGRPRMRQWMVELAGLFDA

SEQ ID NO: 130883 - protein, 20 aa, Mycobacterium avium
RAFEQEIRLLMQAADREIVT

SEQ ID NO: 130884 - protein, 20 aa, Mycobacterium avium
RAFIAEHAPPIPPRAGVRSA

SEQ ID NO: 130885 - protein, 17 aa, Mycobacterium avium
RAFNPRIIIARGTGLGV

SEQ ID NO: 130886 - protein, 21 aa, Mycobacterium avium
RAGAPFVGPAGRLLARALHDA

SEQ ID NO: 130887 - protein, 21 aa, Mycobacterium avium
RAGAPFVGPAGRLLARALQDA

SEQ ID NO: 130888 - protein, 26 aa, Mycobacterium avium
RAGATHAFFVPPVIARFLDAGEAARA

SEQ ID NO: 130889 - protein, 28 aa, Mycobacterium avium
RAGELLAKPTAWLFGPESHGLPSAVAAA

SEQ ID NO: 130890 - protein, 23 aa, Mycobacterium avium
RAGIPDYGYAFWPGRTVVAEGVE

SEQ ID NO: 130891 - protein, 29 aa, Mycobacterium avium
RAGRKRRHWMWFVFPQLRGLGGSAMADRY

SEQ ID NO: 130892 - protein, 26 aa, Mycobacterium avium
RAGRSGTALLFVSPRERHLLKAIEKA

SEQ ID NO: 130893 - protein, 21 aa, Mycobacterium avium
RAGWLWSRRRGVIAGLSAAAV

SEQ ID NO: 130894 - protein, 21 aa, Mycobacterium avium
RAHRLSNTGALWLGGGGKSLG

SEQ ID NO: 130895 - protein, 20 aa, Mycobacterium avium
RAHRRSFVADRLATGTAALF

SEQ ID NO: 130896 - protein, 20 aa, Mycobacterium avium
RAHTPLWPDVTRMHEVLGRT

SEQ ID NO: 130897 - protein, 20 aa, Mycobacterium avium
RAILDEWKTITGLDRRVDDA

SEQ ID NO: 130898 - protein, 21 aa, Mycobacterium avium
RAIVQIAARRPATGNWQIVVI

SEQ ID NO: 130899 - protein, 22 aa, Mycobacterium avium
RAIWEMYTGWFRHRSTTELYGV

SEQ ID NO: 130900 - protein, 28 aa, Mycobacterium avium
RAKIVDPSWFNWPALPVAMADTIVPDFP

SEQ ID NO: 130901 - protein, 20 aa, Mycobacterium avium
RAKLVRLFPTVMTGTHVELE

SEQ ID NO: 130902 - protein, 22 aa, Mycobacterium avium
RAKVLAAQQAPPLRTETRFDSA

SEQ ID NO: 130903 - protein, 18 aa, Mycobacterium avium
RAKWGPSGTNHFIRRSRA

SEQ ID NO: 130904 - protein, 28 aa, Mycobacterium avium
RALAAPPQRRQWWIDRVTACHGLLVPSS

SEQ ID NO: 130905 - protein, 19 aa, Mycobacterium avium
RALARQPSVLLLDEPLAAL

SEQ ID NO: 130906 - protein, 18 aa, Mycobacterium avium
RALFKTFHAACQAITDVD

SEQ ID NO: 130907 - protein, 20 aa, Mycobacterium avium
RALGFPTRMFTVLFALGACP

SEQ ID NO: 130908 - protein, 23 aa, Mycobacterium avium
RALGPTVIVLEDIDLIVGNRRHH

SEQ ID NO: 130909 - protein, 20 aa, Mycobacterium avium
RALHDLLSCSGVRVLALPVS

SEQ ID NO: 130910 - protein, 17 aa, Mycobacterium avium
RALHRWLQHEVRAPDDV

SEQ ID NO: 130911 - protein, 18 aa, Mycobacterium avium
RALHRWLQHEVRAPDDVR

SEQ ID NO: 130912 - protein, 17 aa, Mycobacterium avium
RALKRLKVVAAFQQSGN

SEQ ID NO: 130913 - protein, 22 aa, Mycobacterium avium
RALMMISSVHPSLGALLSAHQS

SEQ ID NO: 130914 - protein, 29 aa, Mycobacterium avium
RALPDGLTYGLLRYLNPQAGLDVSDPAIA

SEQ ID NO: 130915 - protein, 19 aa, Mycobacterium avium
RALQPLVGQPPRLVAAAVN

SEQ ID NO: 130916 - protein, 17 aa, Mycobacterium avium
RALRLTAIDVDSGELTV

SEQ ID NO: 130917 - protein, 26 aa, Mycobacterium avium
RALSQEFPMLFIEDLLDGDDWAGFTK

SEQ ID NO: 130918 - protein, 18 aa, Mycobacterium avium
RAMRHTIERAMRGQDTIA

SEQ ID NO: 130919 - protein, 45 aa, Mycobacterium avium
RANASGLVRLQWVSARTLTIAPKGPLPLVIFSEPCTLREPAFAIL

SEQ ID NO: 130920 - protein, 46 aa, Mycobacterium avium
RANRMRWPHGRLRYYVAMLAELSQLRLLPFRLVLDGAQEIDAEITL

SEQ ID NO: 130921 - protein, 24 aa, Mycobacterium avium
RAPDDFVHLLLGVASVGAGIARLA

SEQ ID NO: 130922 - protein, 19 aa, Mycobacterium avium
RAPLGSLYHFFPGGKQDLA

SEQ ID NO: 130923 - protein, 29 aa, Mycobacterium avium
RAPSLYNTQPWRWVADGAGLDLLLDTSRV

SEQ ID NO: 130924 - protein, 24 aa, Mycobacterium avium
RAPTTFDWRRPPSPSWKAAWRCWP

SEQ ID NO: 130925 - protein, 18 aa, Mycobacterium avium
RAQAQVVAWWSPAYHEPN

SEQ ID NO: 130926 - protein, 17 aa, Mycobacterium avium
RAQAQWEALRRTYLRLG

SEQ ID NO: 130927 - protein, 18 aa, Mycobacterium avium
RAQGTPLSPGTFLATISG

SEQ ID NO: 130928 - protein, 23 aa, Mycobacterium avium
RAQGTPLSPGTFLATISGAGRPP

SEQ ID NO: 130929 - protein, 24 aa, Mycobacterium avium
RAQGTPLSPGTFLATISGAGRPPV

SEQ ID NO: 130930 - protein, 20 aa, Mycobacterium avium
RAQLLPWTATLKPHYVRITP

SEQ ID NO: 130931 - protein, 19 aa, Mycobacterium avium
RAQLRPVEPPPVASAFDLS

SEQ ID NO: 130932 - protein, 24 aa, Mycobacterium avium
RAREAVDRWLATGGVGTVRINGTE

SEQ ID NO: 130933 - protein, 29 aa, Mycobacterium avium
RARENALLERGLLPSPLLLDDPGVDIVAR

SEQ ID NO: 130934 - protein, 28 aa, Mycobacterium avium
RARHHRARLLALRYRLRHGVGMAGLRGP

SEQ ID NO: 130935 - protein, 23 aa, Mycobacterium avium
RARKSIAQFKLREGMPIGARVTL

SEQ ID NO: 130936 - protein, 20 aa, Mycobacterium avium
RARLAQRLPEYMVPAAVVVL

SEQ ID NO: 130937 - protein, 18 aa, Mycobacterium avium
RARLIERVNNLRVGHSLD

SEQ ID NO: 130938 - protein, 18 aa, Mycobacterium avium
RARLVERINNLRVGHSLD

SEQ ID NO: 130939 - protein, 17 aa, Mycobacterium avium
RARLWKFGMTGARCRAC

SEQ ID NO: 130940 - protein, 22 aa, Mycobacterium avium
RARRFAWKFPDDDGAWLARTCA

SEQ ID NO: 130941 - protein, 22 aa, Mycobacterium avium
RARRLAAFLIGRGLVPGDRVMV

SEQ ID NO: 130942 - protein, 27 aa, Mycobacterium avium
RARRLQPHYIELAFKAAFTRLGGRIAK

SEQ ID NO: 130943 - protein, 24 aa, Mycobacterium avium
RARVASRVLALLPAVAKDQALRSA

SEQ ID NO: 130944 - protein, 21 aa, Mycobacterium avium
RARVLERWTVAPPNPPVTVVQ

SEQ ID NO: 130945 - protein, 22 aa, Mycobacterium avium
RARVLERWTVAPPNPPVTVVQA

SEQ ID NO: 130946 - protein, 18 aa, Mycobacterium avium
RARWERRLGEVGVGELHA

SEQ ID NO: 130947 - protein, 26 aa, Mycobacterium avium
RASCRYMKMITPAALLRCLVEGADEV

SEQ ID NO: 130948 - protein, 21 aa, Mycobacterium avium
RASFTTLPWSKTIVAEMPGIF

SEQ ID NO: 130949 - protein, 31 aa, Mycobacterium avium
RASFYIYFEDKGHLLRRLASRVFGELTDGAR

SEQ ID NO: 130950 - protein, 24 aa, Mycobacterium avium
RASGLPVPEWFPMLGGHEGSGVVE

SEQ ID NO: 130951 - protein, 24 aa, Mycobacterium avium
RASGLPYALFRLGGIISPDTHASI

SEQ ID NO: 130952 - protein, 40 aa, Mycobacterium avium
RASIAGLRYIVYGAAPMPLPLLHRALSTWPGTKFVQVYGQ

SEQ ID NO: 130953 - protein, 25 aa, Mycobacterium avium
RATGLVVVPVMFDRIMDLPAEVRRR

SEQ ID NO: 130954 - protein, 20 aa, Mycobacterium avium
RATKRALWGALEYGLTDACR

SEQ ID NO: 130955 - protein, 20 aa, Mycobacterium avium
RATLALPGGLRWVAVHQPDG

SEQ ID NO: 130956 - protein, 18 aa, Mycobacterium avium
RATLALPSGLRWVAVHQP

SEQ ID NO: 130957 - protein, 24 aa, Mycobacterium avium
RATLDLLANSFFGALGKLLSSHPA

SEQ ID NO: 130958 - protein, 20 aa, Mycobacterium avium
RATLWAAALALDGAADQARS

SEQ ID NO: 130959 - protein, 19 aa, Mycobacterium avium
RATLYRHFATKNDLVLAVL

SEQ ID NO: 130960 - protein, 25 aa, Mycobacterium avium
RATMHRGRPWPAHQPRYMVRSTIAA

SEQ ID NO: 130961 - protein, 17 aa, Mycobacterium avium
RATPGFGAGWTGGVFGA

SEQ ID NO: 130962 - protein, 17 aa, Mycobacterium avium
RATVGTARRLRVGAVGL

SEQ ID NO: 130963 - protein, 28 aa, Mycobacterium avium
RAVACFDAALALWRGIPELPDGRRGTSE

SEQ ID NO: 130964 - protein, 24 aa, Mycobacterium avium
RAVDAVSFRLRRARTLAIAGESGS

SEQ ID NO: 130965 - protein, 22 aa, Mycobacterium avium
RAVEELLRVYPIVQTARKATRD

SEQ ID NO: 130966 - protein, 18 aa, Mycobacterium avium
RAVHLWAAPERVTEAASP

SEQ ID NO: 130967 - protein, 28 aa, Mycobacterium avium
RAVIMAPQGLDYIVAFLGALHAGQVAVP

SEQ ID NO: 130968 - protein, 21 aa, Mycobacterium avium
RAVLPVLQSWLARDGAGTLVV

SEQ ID NO: 130969 - protein, 17 aa, Mycobacterium avium
RAVLVGCERGVLATGLA

SEQ ID NO: 130970 - protein, 17 aa, Mycobacterium avium
RAVLWFSSPSAARQVTG

SEQ ID NO: 130971 - protein, 17 aa, Mycobacterium avium
RAVPDRYLALPDFALDR

SEQ ID NO: 130972 - protein, 19 aa, Mycobacterium avium
RAVTLAALAPRPGERLWDV

SEQ ID NO: 130973 - protein, 20 aa, Mycobacterium avium
RAVTTTPWLTSRHSFSFGDH

SEQ ID NO: 130974 - protein, 18 aa, Mycobacterium avium
RAWFVSEQGRKRILRAEL

SEQ ID NO: 130975 - protein, 18 aa, Mycobacterium avium
RAWLRDTSPLFRTNVEGL

SEQ ID NO: 130976 - protein, 22 aa, Mycobacterium avium
RAWTTEHLVNAASYWSKTADQW

SEQ ID NO: 130977 - protein, 17 aa, Mycobacterium avium
RAYGAAAAHWHTYRNRL

SEQ ID NO: 130978 - protein, 21 aa, Mycobacterium avium
RCARRPGWLGGSFPGDGAALT

SEQ ID NO: 130979 - protein, 24 aa, Mycobacterium avium
RCARRPGWLGGSFPGDGAALTVLA

SEQ ID NO: 130980 - protein, 31 aa, Mycobacterium avium
RCAVVFQEPRLLPWRSLAANVAFGLPRGIER

SEQ ID NO: 130981 - protein, 19 aa, Mycobacterium avium
RCERPFTKWRITFDGFCVK

SEQ ID NO: 130982 - protein, 21 aa, Mycobacterium avium
RCGGITDWLRAAAVAAAHNVD

SEQ ID NO: 130983 - protein, 18 aa, Mycobacterium avium
RCKQSIIRLLGGLEPGEH

SEQ ID NO: 130984 - protein, 25 aa, Mycobacterium avium
RCNLRCSYCMPAEGLDWLPGEQLLT

SEQ ID NO: 130985 - protein, 17 aa, Mycobacterium avium
RCRLGWTVSVLRCSRSR

SEQ ID NO: 130986 - protein, 18 aa, Mycobacterium avium
RCRPGYFDGLLPGPSAVD

SEQ ID NO: 130987 - protein, 20 aa, Mycobacterium avium
RCRPGYFDGLLPGPSAVDGL

SEQ ID NO: 130988 - protein, 17 aa, Mycobacterium avium
RCRVHFLRNVLAQVPKV

SEQ ID NO: 130989 - protein, 34 aa, Mycobacterium avium
RCSDGRFIQLAMLQPTRYWAPVCRLFGLDAAAAD

SEQ ID NO: 130990 - protein, 21 aa, Mycobacterium avium
RCTAAALGLAPRPPWHTARAP

SEQ ID NO: 130991 - protein, 25 aa, Mycobacterium avium
RDAKARWLPPLVSGSLRATTALWNA

SEQ ID NO: 130992 - protein, 18 aa, Mycobacterium avium
RDALRAETLVLCLALLHA

SEQ ID NO: 130993 - protein, 22 aa, Mycobacterium avium
RDAPLLLAFERATTGFGWSRPG

SEQ ID NO: 130994 - protein, 24 aa, Mycobacterium avium
RDDDGLLHPVQRRQRRLDLAQLDA

SEQ ID NO: 130995 - protein, 25 aa, Mycobacterium avium
RDDEAYWLANLPPETTRLPAAPAQR

SEQ ID NO: 130996 - protein, 17 aa, Mycobacterium avium
RDDLAKALLAYFTGHLG

SEQ ID NO: 130997 - protein, 29 aa, Mycobacterium avium
RDDTAARLAGFPPPQLLLNYLGAAHTDGG

SEQ ID NO: 130998 - protein, 22 aa, Mycobacterium avium
RDEDKVVWLSQTTLSVDETMEI

SEQ ID NO: 130999 - protein, 18 aa, Mycobacterium avium
RDELGDWRVILHSPYGLG

SEQ ID NO: 131000 - protein, 26 aa, Mycobacterium avium
RDEPRRPRLFLVSAGNIRDLRGTDDH

SEQ ID NO: 131001 - protein, 23 aa, Mycobacterium avium
RDERRHELFFSNLVARCLEYTRD

SEQ ID NO: 131002 - protein, 28 aa, Mycobacterium avium
RDESTFGNPWLFDVARTPNPHLGFGGGG

SEQ ID NO: 131003 - protein, 20 aa, Mycobacterium avium
RDEVEPLEVLFPGCEFLPLN

SEQ ID NO: 131004 - protein, 17 aa, Mycobacterium avium
RDEWLHRRFGDLVRIVF

SEQ ID NO: 131005 - protein, 19 aa, Mycobacterium avium
RDEWLHRRFGDLVRIVFAL

SEQ ID NO: 131006 - protein, 25 aa, Mycobacterium avium
RDEWPPLYVFGTRTVPQIDLLVGSW

SEQ ID NO: 131007 - protein, 24 aa, Mycobacterium avium
RDFARASFKYGLNAKWPVYLSTKN

SEQ ID NO: 131008 - protein, 29 aa, Mycobacterium avium
RDGEQPLALMIAYLPPGLGKAVEPLLKSA

SEQ ID NO: 131009 - protein, 27 aa, Mycobacterium avium
RDGGRFQKLLRIFANPKLPVIGDYYEP

SEQ ID NO: 131010 - protein, 23 aa, Mycobacterium avium
RDGLADLWDSLSTAWRSVFGTRN

SEQ ID NO: 131011 - protein, 19 aa, Mycobacterium avium
RDGLGIAVPLGVPAAFTEE

SEQ ID NO: 131012 - protein, 18 aa, Mycobacterium avium
RDGMAALLGLARAAGADV

SEQ ID NO: 131013 - protein, 28 aa, Mycobacterium avium
RDGRTDMFVNPWGLWWQEITASDICVVD

SEQ ID NO: 131014 - protein, 33 aa, Mycobacterium avium
RDGVRQVLLPFWNAYSFLALYAPKIGTWRTDSP

SEQ ID NO: 131015 - protein, 40 aa, Mycobacterium avium
RDHDLLDPVLSRSMTRLWARMWLLRFTWQRAIDSGDLTSP

SEQ ID NO: 131016 - protein, 23 aa, Mycobacterium avium
RDHGWPQFADRLLELARAAEPGS

SEQ ID NO: 131017 - protein, 30 aa, Mycobacterium avium
RDHSDYYVLLVEYWLRAQRDPQLRECLIER

SEQ ID NO: 131018 - protein, 22 aa, Mycobacterium avium
RDIDWFESQYLRNSRLDRTDPR

SEQ ID NO: 131019 - protein, 30 aa, Mycobacterium avium
RDIYRDSQLGLFPFRRNLSLFAVDLALLTH

SEQ ID NO: 131020 - protein, 19 aa, Mycobacterium avium
RDKIERRYANAIGAAELAQ

SEQ ID NO: 131021 - protein, 23 aa, Mycobacterium avium
RDKWYSAGWYSDRTCLDAFEAGA

SEQ ID NO: 131022 - protein, 21 aa, Mycobacterium avium
RDLAYWRDRLDQLPSPLSLPV

SEQ ID NO: 131023 - protein, 24 aa, Mycobacterium avium
RDLLKDFYPAAIAAFAGLPEGGLA

SEQ ID NO: 131024 - protein, 22 aa, Mycobacterium avium
RDLWAKLIDAGILSSASATSLG

SEQ ID NO: 131025 - protein, 17 aa, Mycobacterium avium
RDNLLDIWRRDDLAPGC

SEQ ID NO: 131026 - protein, 25 aa, Mycobacterium avium
RDNLLDIWRRDDLAPGCRAPVLIQV

SEQ ID NO: 131027 - protein, 26 aa, Mycobacterium avium
RDNLLDIWRRDDLAPGCRAPVLIQVP

SEQ ID NO: 131028 - protein, 26 aa, Mycobacterium avium
RDPAELRRWGWLITAIDNDDPARAIR

SEQ ID NO: 131029 - protein, 23 aa, Mycobacterium avium
RDPKGYVPIGRNPWRGPPVPYDT

SEQ ID NO: 131030 - protein, 17 aa, Mycobacterium avium
RDQFATTLGISAGSYAA

SEQ ID NO: 131031 - protein, 19 aa, Mycobacterium avium
RDQFATTLGISAGSYAAAE

SEQ ID NO: 131032 - protein, 20 aa, Mycobacterium avium
RDRFLFKINVGYPSPEEERE

SEQ ID NO: 131033 - protein, 25 aa, Mycobacterium avium
RDRPRIFDLFDRILKALAPEAHPRG

SEQ ID NO: 131034 - protein, 26 aa, Mycobacterium avium
RDRVAGLLVLLYSQPAARLVTLKVAD

SEQ ID NO: 131035 - protein, 25 aa, Mycobacterium avium
RDSLLTAWMALPLDVGLSIGTLQRL

SEQ ID NO: 131036 - protein, 26 aa, Mycobacterium avium
RDTDGDWPSFPLPLGDTWSSTRGDLL

SEQ ID NO: 131037 - protein, 25 aa, Mycobacterium avium
RDTPYSGVAAIFRSALEKGEPPRVF

SEQ ID NO: 131038 - protein, 20 aa, Mycobacterium avium
RDVAMLDEDGYLFIGGRSDD

SEQ ID NO: 131039 - protein, 30 aa, Mycobacterium avium
RDVERPLLISRWLDIAFSARSAAMLAPYEL

SEQ ID NO: 131040 - protein, 22 aa, Mycobacterium avium
RDVFAVPELRRMLLPTVREDFR

SEQ ID NO: 131041 - protein, 18 aa, Mycobacterium avium
RDVMDALTFCDLTTGPDG

SEQ ID NO: 131042 - protein, 24 aa, Mycobacterium avium
RDVPPVVWTVLMTSLSRFLVLEQA

SEQ ID NO: 131043 - protein, 17 aa, Mycobacterium avium
RDWDAMARLLTAETTVD

SEQ ID NO: 131044 - protein, 17 aa, Mycobacterium avium
RDYLLPRQRERAALTED

SEQ ID NO: 131045 - protein, 17 aa, Mycobacterium avium
REAAHRVGFFYLTGHGV

SEQ ID NO: 131046 - protein, 18 aa, Mycobacterium avium
REAAHRVGFFYLTGHGVP

SEQ ID NO: 131047 - protein, 25 aa, Mycobacterium avium
REALGPITILVNNAAFTAPGRPPAP

SEQ ID NO: 131048 - protein, 20 aa, Mycobacterium avium
REAMPKLLAMYEAGLIKLDE

SEQ ID NO: 131049 - protein, 21 aa, Mycobacterium avium
RECIATWTGIPIGYVAVHVAS

SEQ ID NO: 131050 - protein, 17 aa, Mycobacterium avium
REEAPIYYNERYDFWAL

SEQ ID NO: 131051 - protein, 20 aa, Mycobacterium avium
REFGRLDIVIANAGIIRLGG

SEQ ID NO: 131052 - protein, 22 aa, Mycobacterium avium
REFSDVFGVLFPGGEGRLRLTD

SEQ ID NO: 131053 - protein, 24 aa, Mycobacterium avium
REGSQFGPYRLWQLVGRGGMGDVY

SEQ ID NO: 131054 - protein, 17 aa, Mycobacterium avium
REHVAALGHHLPQRLGA

SEQ ID NO: 131055 - protein, 20 aa, Mycobacterium avium
REIDLRANWMKHLHHANWKM

SEQ ID NO: 131056 - protein, 26 aa, Mycobacterium avium
REKTMLSWEFPFGFLDQGLSSPIRMP

SEQ ID NO: 131057 - protein, 26 aa, Mycobacterium avium
REKTTLSWEFPFGFLDQGLSSPIRMP

SEQ ID NO: 131058 - protein, 26 aa, Mycobacterium avium
RELADRWQIRRYGFHGTSHRYVSEQA

SEQ ID NO: 131059 - protein, 18 aa, Mycobacterium avium
RELATLRELCDTNAVGSA

SEQ ID NO: 131060 - protein, 24 aa, Mycobacterium avium
RELEGRMYACFAAGPMAAGCEYEI

SEQ ID NO: 131061 - protein, 21 aa, Mycobacterium avium
RELEICYAAIALVTDLDAGVS

SEQ ID NO: 131062 - protein, 18 aa, Mycobacterium avium
RELGITEFMLLQTAVAVV

SEQ ID NO: 131063 - protein, 20 aa, Mycobacterium avium
RELKRANEILKRAASFFGAE

SEQ ID NO: 131064 - protein, 18 aa, Mycobacterium avium
RELTTDWDYAVVGGLTLG

SEQ ID NO: 131065 - protein, 17 aa, Mycobacterium avium
RELVDPVLARALQQPPP

SEQ ID NO: 131066 - protein, 18 aa, Mycobacterium avium
REMKVVLWNRGCEELWGL

SEQ ID NO: 131067 - protein, 23 aa, Mycobacterium avium
REMNLHQLPWPTEILEGLGETEV

SEQ ID NO: 131068 - protein, 22 aa, Mycobacterium avium
REPAPPTAPRPGGMPPWDSTPV

SEQ ID NO: 131069 - protein, 21 aa, Mycobacterium avium
REPMTTALRDALRAETLVLCL

SEQ ID NO: 131070 - protein, 17 aa, Mycobacterium avium
REPYFDPPDVFAAFGDG

SEQ ID NO: 131071 - protein, 26 aa, Mycobacterium avium
REQAILATALRLLETRPFAGISVDDL

SEQ ID NO: 131072 - protein, 19 aa, Mycobacterium avium
REQLLRFIGELDRPGRLTL

SEQ ID NO: 131073 - protein, 17 aa, Mycobacterium avium
REQLRGAARRRAFRLWL

SEQ ID NO: 131074 - protein, 20 aa, Mycobacterium avium
REQLRRHLEACPGCFKHYGL

SEQ ID NO: 131075 - protein, 25 aa, Mycobacterium avium
REQRRIIDDQLALVLWDEVQVHAAA

SEQ ID NO: 131076 - protein, 17 aa, Mycobacterium avium
RERDLAYWRDRLDQLPS

SEQ ID NO: 131077 - protein, 19 aa, Mycobacterium avium
RERGFDVDWTTPALAQAVQ

SEQ ID NO: 131078 - protein, 25 aa, Mycobacterium avium
RERGRLLEFDLAGGPPRVLLDNVPS

SEQ ID NO: 131079 - protein, 17 aa, Mycobacterium avium
RERKVCALWDIANPDKF

SEQ ID NO: 131080 - protein, 26 aa, Mycobacterium avium
RERLAGETVPLGAPLPASVVAAAIRA

SEQ ID NO: 131081 - protein, 22 aa, Mycobacterium avium
RERLGFEVLPLSGGERPPFEVL

SEQ ID NO: 131082 - protein, 17 aa, Mycobacterium avium
RERLPILCGLDLTRKVA

SEQ ID NO: 131083 - protein, 22 aa, Mycobacterium avium
RERLRGWRFYDGFRVDAGAPAR

SEQ ID NO: 131084 - protein, 20 aa, Mycobacterium avium
RESLWFNAGLAVRKIDKRYS

SEQ ID NO: 131085 - protein, 20 aa, Mycobacterium avium
RETDGLVIPAPFDQTALMKS

SEQ ID NO: 131086 - protein, 23 aa, Mycobacterium avium
RETFELGVWRKAPASHRANVLFR

SEQ ID NO: 131087 - protein, 29 aa, Mycobacterium avium
REVFGEEKAVWWQRAVEAWPDYAEYQTKT

SEQ ID NO: 131088 - protein, 18 aa, Mycobacterium avium
REVLFCPDQFLGAHVRRM

SEQ ID NO: 131089 - protein, 17 aa, Mycobacterium avium
REVLYRLADHHLAHIVV

SEQ ID NO: 131090 - protein, 20 aa, Mycobacterium avium
REVRFYGDVAPRLGGPIAPC

SEQ ID NO: 131091 - protein, 19 aa, Mycobacterium avium
REWISYPVDRRRDLLFGLA

SEQ ID NO: 131092 - protein, 22 aa, Mycobacterium avium
REYVGYIVEKRFNLSWSIEGTR

SEQ ID NO: 131093 - protein, 18 aa, Mycobacterium avium
RFAALGRRAYHYRFARVS

SEQ ID NO: 131094 - protein, 18 aa, Mycobacterium avium
RFAPPLVVTAQEIDWAVG

SEQ ID NO: 131095 - protein, 18 aa, Mycobacterium avium
RFAQMRGLITDELVARIG

SEQ ID NO: 131096 - protein, 18 aa, Mycobacterium avium
RFDLFVVGSGFFGLTIAE

SEQ ID NO: 131097 - protein, 20 aa, Mycobacterium avium
RFDPALWRELAASDLLGIAL

SEQ ID NO: 131098 - protein, 17 aa, Mycobacterium avium
RFEAYTYFHPARSVRER

SEQ ID NO: 131099 - protein, 20 aa, Mycobacterium avium
RFEFELDTTRPYAAWMKEVE

SEQ ID NO: 131100 - protein, 17 aa, Mycobacterium avium
RFGADLRMEDVESVSLA

SEQ ID NO: 131101 - protein, 24 aa, Mycobacterium avium
RFGEWMTIFAGWRGPVPDTIGEGT

SEQ ID NO: 131102 - protein, 19 aa, Mycobacterium avium
RFGMRLPTDLGPFPGQPLS

SEQ ID NO: 131103 - protein, 18 aa, Mycobacterium avium
RFGSWLRNSTRGALAMDP

SEQ ID NO: 131104 - protein, 25 aa, Mycobacterium avium
RFIDAAWRAGFGWIDDLNDAAAQPV

SEQ ID NO: 131105 - protein, 17 aa, Mycobacterium avium
RFKSVKRGLHSLAAKDG

SEQ ID NO: 131106 - protein, 17 aa, Mycobacterium avium
RFLADYEAGLEAALCVA

SEQ ID NO: 131107 - protein, 18 aa, Mycobacterium avium
RFLAPVTAGSRVRVRSEL

SEQ ID NO: 131108 - protein, 18 aa, Mycobacterium avium
RFLGKGLTWGELHGRVRA

SEQ ID NO: 131109 - protein, 30 aa, Mycobacterium avium
RFLGMPYAAPPVGDLRWAPPAPPASWAGVR

SEQ ID NO: 131110 - protein, 18 aa, Mycobacterium avium
RFLQNLTHHSWQDHGQAV

SEQ ID NO: 131111 - protein, 18 aa, Mycobacterium avium
RFNPFDVTKVWPHADYPL

SEQ ID NO: 131112 - protein, 26 aa, Mycobacterium avium
RFPGAPDPGSFWRLLRDGREVTRFAG

SEQ ID NO: 131113 - protein, 19 aa, Mycobacterium avium
RFQERMAALAEAVWALPQP

SEQ ID NO: 131114 - protein, 18 aa, Mycobacterium avium
RFSFRRLFTASDVHNYFW

SEQ ID NO: 131115 - protein, 24 aa, Mycobacterium avium
RFSSVMRVHVRSRMILNALRSQVE

SEQ ID NO: 131116 - protein, 24 aa, Mycobacterium avium
RFTVDLLRPALLAPVQIRTSVQRE

SEQ ID NO: 131117 - protein, 20 aa, Mycobacterium avium
RFVGQLYDVFVEHQGLLLTL

SEQ ID NO: 131118 - protein, 19 aa, Mycobacterium avium
RFVHDPTGSRWYRTGDMGC

SEQ ID NO: 131119 - protein, 27 aa, Mycobacterium avium
RFVQLSMLQPTRYWPEFCRLMGLHDLA

SEQ ID NO: 131120 - protein, 17 aa, Mycobacterium avium
RFYLNVEVGKHLSHADL

SEQ ID NO: 131121 - protein, 17 aa, Mycobacterium avium
RGAATRIKRLVLDGLHR

SEQ ID NO: 131122 - protein, 42 aa, Mycobacterium avium
RGADAVWLQRELLRFHGNPTAALFPVVFTSGLGLVDASARAA

SEQ ID NO: 131123 - protein, 24 aa, Mycobacterium avium
RGADRDLLADLYRAWAHGGQIPDE

SEQ ID NO: 131124 - protein, 24 aa, Mycobacterium avium
RGAFYHHFKDKAELFRAVFEDVEN

SEQ ID NO: 131125 - protein, 20 aa, Mycobacterium avium
RGAGWLKVKPVHTLDLVVLA

SEQ ID NO: 131126 - protein, 20 aa, Mycobacterium avium
RGAPIVFRSASPADLFMLIF

SEQ ID NO: 131127 - protein, 17 aa, Mycobacterium avium
RGAQFDVVDLGMALEQV

SEQ ID NO: 131128 - protein, 24 aa, Mycobacterium avium
RGAVAGITRLLTGLGYSGYFELDG

SEQ ID NO: 131129 - protein, 21 aa, Mycobacterium avium
RGCGCGRRWYRRRCASGYDQL

SEQ ID NO: 131130 - protein, 20 aa, Mycobacterium avium
RGDDGRVRRVPPGQPGLLLS

SEQ ID NO: 131131 - protein, 25 aa, Mycobacterium avium
RGDDGRVRRVPPGQPGLLLSPVNRL

SEQ ID NO: 131132 - protein, 17 aa, Mycobacterium avium
RGDKIWVAGYAVRDPSP

SEQ ID NO: 131133 - protein, 17 aa, Mycobacterium avium
RGDPALAGELWLDGADT

SEQ ID NO: 131134 - protein, 18 aa, Mycobacterium avium
RGDRLLVCRTASGWSEVR

SEQ ID NO: 131135 - protein, 19 aa, Mycobacterium avium
RGDRLLVCRTASGWSEVRA

SEQ ID NO: 131136 - protein, 18 aa, Mycobacterium avium
RGDRTRWPAAGGRRRWQA

SEQ ID NO: 131137 - protein, 30 aa, Mycobacterium avium
RGDRWIINGAKTWSTWAFAADYGLCLARTD

SEQ ID NO: 131138 - protein, 25 aa, Mycobacterium avium
RGEHPSLCLFASWAAPDSPAGRRLT

SEQ ID NO: 131139 - protein, 20 aa, Mycobacterium avium
RGEPWPLQDTVRPWDSLNDE

SEQ ID NO: 131140 - protein, 21 aa, Mycobacterium avium
RGERLVNSMFTLSTLVGLSVS

SEQ ID NO: 131141 - protein, 17 aa, Mycobacterium avium
RGERRCTHPVAPATWRS

SEQ ID NO: 131142 - protein, 17 aa, Mycobacterium avium
RGFDVDWTTPALAQAVQ

SEQ ID NO: 131143 - protein, 19 aa, Mycobacterium avium
RGFGIRTPRHWAVLPAGNG

SEQ ID NO: 131144 - protein, 20 aa, Mycobacterium avium
RGFLTSQKARWAARSLLDAT

SEQ ID NO: 131145 - protein, 17 aa, Mycobacterium avium
RGFYLLAGQKLSGSHRL

SEQ ID NO: 131146 - protein, 24 aa, Mycobacterium avium
RGGFTAFWMPQVPGYLDALTAVTL

SEQ ID NO: 131147 - protein, 24 aa, Mycobacterium avium
RGGKVWINVFPDRPLTKKPAETRM

SEQ ID NO: 131148 - protein, 22 aa, Mycobacterium avium
RGGRELWCQLFSEPGAGSDLAS

SEQ ID NO: 131149 - protein, 23 aa, Mycobacterium avium
RGGRSLSAVPFDLAQLGEWATRI

SEQ ID NO: 131150 - protein, 25 aa, Mycobacterium avium
RGGRSLSAVPFDLARLGEWATRITS

SEQ ID NO: 131151 - protein, 18 aa, Mycobacterium avium
RGGRWRAWRSTRSGGSPR

SEQ ID NO: 131152 - protein, 20 aa, Mycobacterium avium
RGGRYGLITLCVAGGMGVAT

SEQ ID NO: 131153 - protein, 26 aa, Mycobacterium avium
RGHDLSDPLWSARLLADAPQEIGAVH

SEQ ID NO: 131154 - protein, 27 aa, Mycobacterium avium
RGHDLSDPLWSARLLADAPQEIGAVHA

SEQ ID NO: 131155 - protein, 21 aa, Mycobacterium avium
RGHPPHLVSLPTNLSGAVSAG

SEQ ID NO: 131156 - protein, 21 aa, Mycobacterium avium
RGHPPHLVSLPTNLSGTVSAG

SEQ ID NO: 131157 - protein, 24 aa, Mycobacterium avium
RGIALRRCPLLNAARRYPTIVCQV

SEQ ID NO: 131158 - protein, 20 aa, Mycobacterium avium
RGIGGLMLESFLVAGAQPLG

SEQ ID NO: 131159 - protein, 17 aa, Mycobacterium avium
RGKRFFHPDGVLAGGVA

SEQ ID NO: 131160 - protein, 30 aa, Mycobacterium avium
RGLGGDATRLLYTLGWHEVPPQPSNDGGAN

SEQ ID NO: 131161 - protein, 29 aa, Mycobacterium avium
RGLMKQKWPERLVLVDEFPLTGLGKVAKS

SEQ ID NO: 131162 - protein, 18 aa, Mycobacterium avium
RGLTMLLIDTDTPGLAVR

SEQ ID NO: 131163 - protein, 21 aa, Mycobacterium avium
RGLWQALSRRDWDAVKTFLSD

SEQ ID NO: 131164 - protein, 18 aa, Mycobacterium avium
RGMPWEFECLVAYPDGTT

SEQ ID NO: 131165 - protein, 24 aa, Mycobacterium avium
RGMTLRDVLVSPPIWFDASEGQVN

SEQ ID NO: 131166 - protein, 25 aa, Mycobacterium avium
RGNDFPPMTIAVLDAAGRLVAFASE

SEQ ID NO: 131167 - protein, 17 aa, Mycobacterium avium
RGPAALRAGRPRCPAAR

SEQ ID NO: 131168 - protein, 27 aa, Mycobacterium avium
RGPDAIIPPTFLTTAGRWAPAGVRVDV

SEQ ID NO: 131169 - protein, 22 aa, Mycobacterium avium
RGPGGGLPITYSRKVFIPVTHL

SEQ ID NO: 131170 - protein, 18 aa, Mycobacterium avium
RGPRRRRWRCWIGRGRRP

SEQ ID NO: 131171 - protein, 18 aa, Mycobacterium avium
RGPVWEEVILHLPDEVRV

SEQ ID NO: 131172 - protein, 19 aa, Mycobacterium avium
RGPVWEEVILHLPDEVRVV

SEQ ID NO: 131173 - protein, 24 aa, Mycobacterium avium
RGQDIGPTLRAAWTGAVLGQANAS

SEQ ID NO: 131174 - protein, 18 aa, Mycobacterium avium
RGQRRRGRRHRLPGAGPV

SEQ ID NO: 131175 - protein, 18 aa, Mycobacterium avium
RGRDLAAGKVITAADVQC

SEQ ID NO: 131176 - protein, 25 aa, Mycobacterium avium
RGREMSQPTWRFGPISGMIETAENL

SEQ ID NO: 131177 - protein, 25 aa, Mycobacterium avium
RGRGPVATVLIQRGTLRVGDSIVAG

SEQ ID NO: 131178 - protein, 22 aa, Mycobacterium avium
RGRHRLAQPVFRPAAGLDDVAG

SEQ ID NO: 131179 - protein, 30 aa, Mycobacterium avium
RGRITIDQFAPQISFFFYTHGDFFEEIAKY

SEQ ID NO: 131180 - protein, 20 aa, Mycobacterium avium
RGRIVGADLLEPLSAYAQID

SEQ ID NO: 131181 - protein, 21 aa, Mycobacterium avium
RGRLPLDATLRRMPVGVVANG

SEQ ID NO: 131182 - protein, 18 aa, Mycobacterium avium
RGRMTIDQFAPQISFFFY

SEQ ID NO: 131183 - protein, 30 aa, Mycobacterium avium
RGRMTIDQFAPQISFFFYTHGDFFEEIAKY

SEQ ID NO: 131184 - protein, 24 aa, Mycobacterium avium
RGRPDLGWFPGLAARLRAADRGRP

SEQ ID NO: 131185 - protein, 22 aa, Mycobacterium avium
RGRRSRVLLAGHLDTVPVAGNL

SEQ ID NO: 131186 - protein, 23 aa, Mycobacterium avium
RGRSLEVIPDHIPWEVAALNEPM

SEQ ID NO: 131187 - protein, 29 aa, Mycobacterium avium
RGRTCHWILEIHLVDRRRGFGGFYEQLLD

SEQ ID NO: 131188 - protein, 25 aa, Mycobacterium avium
RGRTGVFWIREMLPIGELREILSAA

SEQ ID NO: 131189 - protein, 27 aa, Mycobacterium avium
RGRVVDGDDPIWVAGRSAQFGGGDRDD

SEQ ID NO: 131190 - protein, 24 aa, Mycobacterium avium
RGSKDVLMVAWMDDAALARTLETR

SEQ ID NO: 131191 - protein, 29 aa, Mycobacterium avium
RGSLFGPIVQLVFSSVYLGIARGALETAR

SEQ ID NO: 131192 - protein, 26 aa, Mycobacterium avium
RGSTWTRQLPWLTRLGTVYSYDAPWH

SEQ ID NO: 131193 - protein, 27 aa, Mycobacterium avium
RGSYLQMHFALQEAPVFAAPYQVLNEP

SEQ ID NO: 131194 - protein, 28 aa, Mycobacterium avium
RGTAPTGPGFWFPPTVLTPSRTDRCATE

SEQ ID NO: 131195 - protein, 27 aa, Mycobacterium avium
RGTEQLSHSFGLIDILPWGRQEEWQDS

SEQ ID NO: 131196 - protein, 18 aa, Mycobacterium avium
RGTFFCMRAEIAHMIGHG

SEQ ID NO: 131197 - protein, 31 aa, Mycobacterium avium
RGTGKYYSGVKWTWYRPIYAGRPVLAENYTL

SEQ ID NO: 131198 - protein, 20 aa, Mycobacterium avium
RGTHALRFIRSCSAPLTAET

SEQ ID NO: 131199 - protein, 24 aa, Mycobacterium avium
RGTPAALAALRPQPPRRYSQAEHR

SEQ ID NO: 131200 - protein, 23 aa, Mycobacterium avium
RGTPTRLLLLRHGQTELSVQRRY

SEQ ID NO: 131201 - protein, 29 aa, Mycobacterium avium
RGTTAGVRWTFTAFTGEVPFFEVVNEQTV

SEQ ID NO: 131202 - protein, 19 aa, Mycobacterium avium
RGVDKFICAMGVGDGQLIG

SEQ ID NO: 131203 - protein, 19 aa, Mycobacterium avium
RGVDKFICAMGVGDGQLVG

SEQ ID NO: 131204 - protein, 31 aa, Mycobacterium avium
RGVEPDRLTWIMPRDSWLLDRATMQPGALFA

SEQ ID NO: 131205 - protein, 17 aa, Mycobacterium avium
RGVEPTAKLPLAQPNRG

SEQ ID NO: 131206 - protein, 37 aa, Mycobacterium avium
RGVPVFAWKGETLEEYWWAAEQALTWPPLADGTEAPA

SEQ ID NO: 131207 - protein, 25 aa, Mycobacterium avium
RGVSDYPVIGLELRVSVPPGADEAL

SEQ ID NO: 131208 - protein, 18 aa, Mycobacterium avium
RGWGGRLATVLPAGGRLL

SEQ ID NO: 131209 - protein, 17 aa, Mycobacterium avium
RGYGYGPAFQGLTAAWV

SEQ ID NO: 131210 - protein, 18 aa, Mycobacterium avium
RGYRIELGEIRSALAGLD

SEQ ID NO: 131211 - protein, 17 aa, Mycobacterium avium
RGYRRLVDQTPHALSTV

SEQ ID NO: 131212 - protein, 24 aa, Mycobacterium avium
RGYRSLREVVLPLGRLSVITGANG

SEQ ID NO: 131213 - protein, 25 aa, Mycobacterium avium
RHACEYWRAQFKAGNPIDAHIVNTV

SEQ ID NO: 131214 - protein, 22 aa, Mycobacterium avium
RHADIWHTFLPIEQFRIKSQLL

SEQ ID NO: 131215 - protein, 21 aa, Mycobacterium avium
RHAPAPTGPFAARLGPLCPAW

SEQ ID NO: 131216 - protein, 19 aa, Mycobacterium avium
RHAPQAPLQFLRQARRRHS

SEQ ID NO: 131217 - protein, 24 aa, Mycobacterium avium
RHARHYLAIFDHGKALALYHTKRL

SEQ ID NO: 131218 - protein, 25 aa, Mycobacterium avium
RHARHYLAIFDQGKALALYHTKRLA

SEQ ID NO: 131219 - protein, 19 aa, Mycobacterium avium
RHELPWLTPDWVNIDHRRG

SEQ ID NO: 131220 - protein, 25 aa, Mycobacterium avium
RHGRRWRADFAWPASMVLAEYDSVE

SEQ ID NO: 131221 - protein, 26 aa, Mycobacterium avium
RHGWPSSTLPPFRRPNGAPVSSIPPL

SEQ ID NO: 131222 - protein, 36 aa, Mycobacterium avium
RHHPRPPGRRRPGHLAGQRWPARHPAGRGRGRHQPR

SEQ ID NO: 131223 - protein, 19 aa, Mycobacterium avium
RHLPGGVGEYLRLAAQRRD

SEQ ID NO: 131224 - protein, 21 aa, Mycobacterium avium
RHLPGLYERWWAVTPGAVTRD

SEQ ID NO: 131225 - protein, 22 aa, Mycobacterium avium
RHLTELFFDRLKPGGSVTIVSS

SEQ ID NO: 131226 - protein, 20 aa, Mycobacterium avium
RHPAMGFLDGLLDVVRKVVT

SEQ ID NO: 131227 - protein, 17 aa, Mycobacterium avium
RHPDVRQHLIDLSHSCP

SEQ ID NO: 131228 - protein, 21 aa, Mycobacterium avium
RHPFAVYRWVFELDTLDGPAR

SEQ ID NO: 131229 - protein, 18 aa, Mycobacterium avium
RHPSAASAAPRLAAGRRR

SEQ ID NO: 131230 - protein, 20 aa, Mycobacterium avium
RHQRLGPVGLAADAQRQLCG

SEQ ID NO: 131231 - protein, 26 aa, Mycobacterium avium
RHRAKPQLNVLLWQRAKDPQRGAWSL

SEQ ID NO: 131232 - protein, 17 aa, Mycobacterium avium
RHRAVADAALESGVTLH

SEQ ID NO: 131233 - protein, 26 aa, Mycobacterium avium
RHRFDLCHEIPLRAQLFRLAEDEHVL

SEQ ID NO: 131234 - protein, 24 aa, Mycobacterium avium
RHRLRAQFRAIYPDIYLPAHAARS

SEQ ID NO: 131235 - protein, 23 aa, Mycobacterium avium
RHRRRRPRVTLRRGGRQPGGFGR

SEQ ID NO: 131236 - protein, 21 aa, Mycobacterium avium
RHVLCFRTVWESTYAALRLHG

SEQ ID NO: 131237 - protein, 23 aa, Mycobacterium avium
RHVTPRGWYRTLCSTCAAAEGKG

SEQ ID NO: 131238 - protein, 17 aa, Mycobacterium avium
RHVWAIRGALQAPDDPE

SEQ ID NO: 131239 - protein, 17 aa, Mycobacterium avium
RHVWAIRGALQAPDDPK

SEQ ID NO: 131240 - protein, 24 aa, Mycobacterium avium
RHYRKALRRTAGLTLWTGLTCTEI

SEQ ID NO: 131241 - protein, 18 aa, Mycobacterium avium
RIAALRAQARARHGWIMD

SEQ ID NO: 131242 - protein, 19 aa, Mycobacterium avium
RIAREFLIRVVNDAIEHGE

SEQ ID NO: 131243 - protein, 19 aa, Mycobacterium avium
RIARRWEFRQVRLAAQTVA

SEQ ID NO: 131244 - protein, 32 aa, Mycobacterium avium
RIAVDIGYPVLVRPSYVLGGRGMEIVYDEETL

SEQ ID NO: 131245 - protein, 18 aa, Mycobacterium avium
RIDAIKAEMDREVAQYRL

SEQ ID NO: 131246 - protein, 26 aa, Mycobacterium avium
RIDDYQPALSPLLDSYRGRDFVVKCA

SEQ ID NO: 131247 - protein, 26 aa, Mycobacterium avium
RIDDYQPGLSPLLDSYRGRDFVVKCA

SEQ ID NO: 131248 - protein, 18 aa, Mycobacterium avium
RIDGQRPPALDTEKGWFF

SEQ ID NO: 131249 - protein, 18 aa, Mycobacterium avium
RIDPMRVYVQVSLDGDES

SEQ ID NO: 131250 - protein, 19 aa, Mycobacterium avium
RIDVGWFLINCDPDTYRRV

SEQ ID NO: 131251 - protein, 17 aa, Mycobacterium avium
RIEHLRVVRGKRPALHD

SEQ ID NO: 131252 - protein, 20 aa, Mycobacterium avium
RIELWPQLRAAFTPPDEQAS

SEQ ID NO: 131253 - protein, 18 aa, Mycobacterium avium
RIFATPVICLPLVDEAIK

SEQ ID NO: 131254 - protein, 20 aa, Mycobacterium avium
RIFNTYGPGMRADDGRMVPT

SEQ ID NO: 131255 - protein, 17 aa, Mycobacterium avium
RIGRPMKIPAPAARWAF

SEQ ID NO: 131256 - protein, 26 aa, Mycobacterium avium
RIGTQLAYWQDALAGMPERLALPTDR

SEQ ID NO: 131257 - protein, 18 aa, Mycobacterium avium
RIIRLHSCPVRDLARDHP

SEQ ID NO: 131258 - protein, 17 aa, Mycobacterium avium
RILACLPGEYGPNLAVM

SEQ ID NO: 131259 - protein, 25 aa, Mycobacterium avium
RILDEALICHLGYLSGGRPVVLPTT

SEQ ID NO: 131260 - protein, 24 aa, Mycobacterium avium
RIMEELYEPFLRTFHPLIAIDVRS

SEQ ID NO: 131261 - protein, 19 aa, Mycobacterium avium
RIMLEICWEALERAGIDPS

SEQ ID NO: 131262 - protein, 17 aa, Mycobacterium avium
RIMLGATISQLRAEEML

SEQ ID NO: 131263 - protein, 20 aa, Mycobacterium avium
RINAPAWRRAMAARQRINNL

SEQ ID NO: 131264 - protein, 20 aa, Mycobacterium avium
RIPAFMYLTDFRENTLKDVI

SEQ ID NO: 131265 - protein, 33 aa, Mycobacterium avium
RIPHTLYRPTFVKSLVMVPIRKLDPIGAIGNYW

SEQ ID NO: 131266 - protein, 30 aa, Mycobacterium avium
RIPKPKFVLIPTPLWDQLFRPLVAGQRWIA

SEQ ID NO: 131267 - protein, 35 aa, Mycobacterium avium
RIPLRELRRTGLLDKLLLLAGIPETATTDPKISDA

SEQ ID NO: 131268 - protein, 32 aa, Mycobacterium avium
RIPLRELRRTGLLDKLLLLAGMPETATTDAKI

SEQ ID NO: 131269 - protein, 17 aa, Mycobacterium avium
RIPMLAGRRSLNLSNAA

SEQ ID NO: 131270 - protein, 20 aa, Mycobacterium avium
RIPVVNLRRMDLGPSAAAGG

SEQ ID NO: 131271 - protein, 20 aa, Mycobacterium avium
RIPVVNLRRMDLGPSAATGG

SEQ ID NO: 131272 - protein, 18 aa, Mycobacterium avium
RIQLAQFIMRSDLEPDLD

SEQ ID NO: 131273 - protein, 21 aa, Mycobacterium avium
RIRAVTLAALAPRPGERLWDV

SEQ ID NO: 131274 - protein, 23 aa, Mycobacterium avium
RIRGEAPLVIDGHTADVVLAPAI

SEQ ID NO: 131275 - protein, 25 aa, Mycobacterium avium
RIRQPVPLTLSVRPPVLTPAAPPAR

SEQ ID NO: 131276 - protein, 17 aa, Mycobacterium avium
RISYGSAPVPPGLARKA

SEQ ID NO: 131277 - protein, 17 aa, Mycobacterium avium
RITLLQPTRNAKSNYEF

SEQ ID NO: 131278 - protein, 17 aa, Mycobacterium avium
RIVAALTAARPGWREAR

SEQ ID NO: 131279 - protein, 19 aa, Mycobacterium avium
RIVTSRNTILALLDAEVGL

SEQ ID NO: 131280 - protein, 17 aa, Mycobacterium avium
RIWVTEDGLVVMASEAG

SEQ ID NO: 131281 - protein, 17 aa, Mycobacterium avium
RIYAIPNDTGRVVTLLK

SEQ ID NO: 131282 - protein, 18 aa, Mycobacterium avium
RKAFQAAGLTKLADDDFG

SEQ ID NO: 131283 - protein, 17 aa, Mycobacterium avium
RKAVLRGADLRGARTAG

SEQ ID NO: 131284 - protein, 27 aa, Mycobacterium avium
RKFLADKVVRWSLPERWTFVDEIPRTS

SEQ ID NO: 131285 - protein, 28 aa, Mycobacterium avium
RKFRNHMRDMLFLFKGGPSTSPFCAWVN

SEQ ID NO: 131286 - protein, 17 aa, Mycobacterium avium
RKGLMMAMIYRGDYWQV

SEQ ID NO: 131287 - protein, 17 aa, Mycobacterium avium
RKGWYPFNKTLGKAGES

SEQ ID NO: 131288 - protein, 22 aa, Mycobacterium avium
RKHELLLLADEIYDKILYDAAK

SEQ ID NO: 131289 - protein, 21 aa, Mycobacterium avium
RKHELLLLADEIYDKILYDDA

SEQ ID NO: 131290 - protein, 22 aa, Mycobacterium avium
RKHELLLLADEIYDKILYDDAK

SEQ ID NO: 131291 - protein, 18 aa, Mycobacterium avium
RKIPPALDVLIRERPRIT

SEQ ID NO: 131292 - protein, 17 aa, Mycobacterium avium
RKLMATDIGYDEASWRQ

SEQ ID NO: 131293 - protein, 25 aa, Mycobacterium avium
RKMARGDWIVFYSPKTVYPDGEPLQ

SEQ ID NO: 131294 - protein, 19 aa, Mycobacterium avium
RKNVREHMAFARGVHSCPG

SEQ ID NO: 131295 - protein, 21 aa, Mycobacterium avium
RKPVIRLGHNDPRFSGDPAVG

SEQ ID NO: 131296 - protein, 19 aa, Mycobacterium avium
RKQLINRCLSGSGLLRGEP

SEQ ID NO: 131297 - protein, 25 aa, Mycobacterium avium
RKRFAALFRCEVGLSPKAYLRVLRL

SEQ ID NO: 131298 - protein, 20 aa, Mycobacterium avium
RLAAALGLKPERVVWMNQVH

SEQ ID NO: 131299 - protein, 20 aa, Mycobacterium avium
RLAARATLSFAILARRDSVH

SEQ ID NO: 131300 - protein, 26 aa, Mycobacterium avium
RLADRLIPHWVWILGYRIYLWDMRSR

SEQ ID NO: 131301 - protein, 20 aa, Mycobacterium avium
RLADVLAYREELHARRNRFI

SEQ ID NO: 131302 - protein, 17 aa, Mycobacterium avium
RLAEAIRRFGPIFAQYY

SEQ ID NO: 131303 - protein, 17 aa, Mycobacterium avium
RLAEFLSLLFDAPVVIT

SEQ ID NO: 131304 - protein, 19 aa, Mycobacterium avium
RLAELLTGFLARLKTDLQQ

SEQ ID NO: 131305 - protein, 19 aa, Mycobacterium avium
RLAERLLVDVIGLPWEEVH

SEQ ID NO: 131306 - protein, 24 aa, Mycobacterium avium
RLAERLPAYMVPVAVVVLDALPMT

SEQ ID NO: 131307 - protein, 19 aa, Mycobacterium avium
RLAGYLAGRGLEPGERVMV

SEQ ID NO: 131308 - protein, 19 aa, Mycobacterium avium
RLAHLLSGQGAGPGQRVAV

SEQ ID NO: 131309 - protein, 25 aa, Mycobacterium avium
RLAQQREIFAHQLFVDYPGHTSALR

SEQ ID NO: 131310 - protein, 25 aa, Mycobacterium avium
RLARQREIFAHQLFVDYPGHTSALR

SEQ ID NO: 131311 - protein, 18 aa, Mycobacterium avium
RLAVPDRMLTPPPGLTCE

SEQ ID NO: 131312 - protein, 17 aa, Mycobacterium avium
RLDALIFGVGDFSLSQG

SEQ ID NO: 131313 - protein, 17 aa, Mycobacterium avium
RLDETLGLLPTGLERAP

SEQ ID NO: 131314 - protein, 20 aa, Mycobacterium avium
RLDGPSPVNNIPFAAKLTGP

SEQ ID NO: 131315 - protein, 23 aa, Mycobacterium avium
RLDRRVHELIATDPQFAAAQPDP

SEQ ID NO: 131316 - protein, 18 aa, Mycobacterium avium
RLDWAGVFAGLPARRVEL

SEQ ID NO: 131317 - protein, 21 aa, Mycobacterium avium
RLELVQAVPNTLWTPSTSGLH

SEQ ID NO: 131318 - protein, 27 aa, Mycobacterium avium
RLEPYRRMWVLRLLDMALDESAVGAAI

SEQ ID NO: 131319 - protein, 27 aa, Mycobacterium avium
RLEPYRRMWVLRLLDMALDESAVGAAV

SEQ ID NO: 131320 - protein, 27 aa, Mycobacterium avium
RLEPYRRMWVLRLLDMALDESGVGAAI

SEQ ID NO: 131321 - protein, 22 aa, Mycobacterium avium
RLETRLQPPPPTLGPGHWCGMA

SEQ ID NO: 131322 - protein, 17 aa, Mycobacterium avium
RLFDVLFGNARNNIERS

SEQ ID NO: 131323 - protein, 25 aa, Mycobacterium avium
RLGAQITIFRLGSDPGLARFIDQVA

SEQ ID NO: 131324 - protein, 27 aa, Mycobacterium avium
RLGAVQNPVLPIWRESELRFVTAQLGT

SEQ ID NO: 131325 - protein, 20 aa, Mycobacterium avium
RLGDDWLVAPAIAYGASGEH

SEQ ID NO: 131326 - protein, 37 aa, Mycobacterium avium
RLGDTITFVIHIPLSIDLLVDLWLDKQRFVVSGDIAL

SEQ ID NO: 131327 - protein, 17 aa, Mycobacterium avium
RLGIDLRAGRSGGFENL

SEQ ID NO: 131328 - protein, 17 aa, Mycobacterium avium
RLGLRPLARIHTTAVVG

SEQ ID NO: 131329 - protein, 18 aa, Mycobacterium avium
RLGLRPLARIHTTAVVGS

SEQ ID NO: 131330 - protein, 19 aa, Mycobacterium avium
RLGLRPLARIHTTAVVGSE

SEQ ID NO: 131331 - protein, 22 aa, Mycobacterium avium
RLGRLTRPERWSGFGDLGDLAD

SEQ ID NO: 131332 - protein, 26 aa, Mycobacterium avium
RLGRNIVSPFWAVLGFGRASADPGQH

SEQ ID NO: 131333 - protein, 17 aa, Mycobacterium avium
RLGVLQAPLISALGFAF

SEQ ID NO: 131334 - protein, 17 aa, Mycobacterium avium
RLHGAGRVRVLPHVSSV

SEQ ID NO: 131335 - protein, 19 aa, Mycobacterium avium
RLHQQLFADLLAAAGLDTT

SEQ ID NO: 131336 - protein, 20 aa, Mycobacterium avium
RLHRALLGVPAGRKLPWFGP

SEQ ID NO: 131337 - protein, 17 aa, Mycobacterium avium
RLHRVRSWSQLIPDLNV

SEQ ID NO: 131338 - protein, 18 aa, Mycobacterium avium
RLHTPQRYSRRLRPVMYM

SEQ ID NO: 131339 - protein, 27 aa, Mycobacterium avium
RLIAEHGIDTVWFGAAAPLALLAQRAR

SEQ ID NO: 131340 - protein, 20 aa, Mycobacterium avium
RLIRLLELRPDLAQPPPGSI

SEQ ID NO: 131341 - protein, 21 aa, Mycobacterium avium
RLIYSRPLIAAMRRADGFIVL

SEQ ID NO: 131342 - protein, 25 aa, Mycobacterium avium
RLKPRVFYDLVVEVALIRPGPIQGG

SEQ ID NO: 131343 - protein, 18 aa, Mycobacterium avium
RLLDTYVDVLRLPVDIVA

SEQ ID NO: 131344 - protein, 19 aa, Mycobacterium avium
RLLEALGRDKAIHPAPSDT

SEQ ID NO: 131345 - protein, 17 aa, Mycobacterium avium
RLLEFVVRQEPRLNWAI

SEQ ID NO: 131346 - protein, 23 aa, Mycobacterium avium
RLLEHAGFFLEGRLARHAVYPTM

SEQ ID NO: 131347 - protein, 17 aa, Mycobacterium avium
RLLILQDEKVRNRNLIP

SEQ ID NO: 131348 - protein, 18 aa, Mycobacterium avium
RLLLPPVPSWVEELTHEP

SEQ ID NO: 131349 - protein, 25 aa, Mycobacterium avium
RLLQHKPTHWSYPEAAGISAVFTTA

SEQ ID NO: 131350 - protein, 18 aa, Mycobacterium avium
RLLQSCPVCLYAGSIMRD

SEQ ID NO: 131351 - protein, 31 aa, Mycobacterium avium
RLLRDRIHQGWILNALWLLDTGITAAALVRS

SEQ ID NO: 131352 - protein, 17 aa, Mycobacterium avium
RLLRDWARPLREISVLF

SEQ ID NO: 131353 - protein, 18 aa, Mycobacterium avium
RLLVQEVAVGALLVRFAA

SEQ ID NO: 131354 - protein, 18 aa, Mycobacterium avium
RLNALLPGAIMTPLLQEQ

SEQ ID NO: 131355 - protein, 18 aa, Mycobacterium avium
RLNPCLYPTGAFQPQNAE

SEQ ID NO: 131356 - protein, 17 aa, Mycobacterium avium
RLPGYMVPSAVVVLDAL

SEQ ID NO: 131357 - protein, 17 aa, Mycobacterium avium
RLPLRFISAAPIAARSY

SEQ ID NO: 131358 - protein, 18 aa, Mycobacterium avium
RLPPALERGWHARGYYGS

SEQ ID NO: 131359 - protein, 19 aa, Mycobacterium avium
RLPRGLAGHASRAMALMLQ

SEQ ID NO: 131360 - protein, 25 aa, Mycobacterium avium
RLQRFPGAFSPLVAKLVAELGFDGV

SEQ ID NO: 131361 - protein, 20 aa, Mycobacterium avium
RLRATMVPGVKRMPIRLGAG

SEQ ID NO: 131362 - protein, 38 aa, Mycobacterium avium
RLRDRHSRYYRELTPLLKPLPGARALLRRVADLGLQVV

SEQ ID NO: 131363 - protein, 36 aa, Mycobacterium avium
RLRDRHSRYYRELTPLLKPLPGARAMLRRVADLGLQ

SEQ ID NO: 131364 - protein, 18 aa, Mycobacterium avium
RLREAAAALDYPVLLQRG

SEQ ID NO: 131365 - protein, 20 aa, Mycobacterium avium
RLRELVIMRIGWLTGCDYEW

SEQ ID NO: 131366 - protein, 19 aa, Mycobacterium avium
RLRGQATPPPLLALETHGR

SEQ ID NO: 131367 - protein, 22 aa, Mycobacterium avium
RLRIDATWRWASAIATAWQHLR

SEQ ID NO: 131368 - protein, 21 aa, Mycobacterium avium
RLRKYIGAYLAVLGHTDVISF

SEQ ID NO: 131369 - protein, 21 aa, Mycobacterium avium
RLRLCVGVGWLQEELRACGAD

SEQ ID NO: 131370 - protein, 20 aa, Mycobacterium avium
RLRLDVLAQRDFRRPFDLSK

SEQ ID NO: 131371 - protein, 17 aa, Mycobacterium avium
RLRLEAYRRLAAAGSDD

SEQ ID NO: 131372 - protein, 38 aa, Mycobacterium avium
RLRPLTLSAPKPMLPTAGLPFLTHLLSRIAAAGIEHVI

SEQ ID NO: 131373 - protein, 28 aa, Mycobacterium avium
RLRRLPLVMRPLGWLPQPDPRRPGRRAW

SEQ ID NO: 131374 - protein, 18 aa, Mycobacterium avium
RLRRQLACALGQLRDDTG

SEQ ID NO: 131375 - protein, 19 aa, Mycobacterium avium
RLRRRGLLLAVVTNQSGVA

SEQ ID NO: 131376 - protein, 20 aa, Mycobacterium avium
RLRSRRYLMDDLELARGETV

SEQ ID NO: 131377 - protein, 25 aa, Mycobacterium avium
RLRVAAAVAALRRPAGRRARRRGRD

SEQ ID NO: 131378 - protein, 17 aa, Mycobacterium avium
RLRVGAVGLIRSWRARN

SEQ ID NO: 131379 - protein, 19 aa, Mycobacterium avium
RLRVGAVGLIRSWRARNSG

SEQ ID NO: 131380 - protein, 17 aa, Mycobacterium avium
RLRVPEERWVFLHGHAD

SEQ ID NO: 131381 - protein, 20 aa, Mycobacterium avium
RLRYAYPYSGRLGALCPTPQ

SEQ ID NO: 131382 - protein, 18 aa, Mycobacterium avium
RLSMDEFLLRHGFHGPNE

SEQ ID NO: 131383 - protein, 18 aa, Mycobacterium avium
RLSVPPTWASATPAIRLA

SEQ ID NO: 131384 - protein, 17 aa, Mycobacterium avium
RLTAGVLLFTARREVRG

SEQ ID NO: 131385 - protein, 27 aa, Mycobacterium avium
RLTDADLLNFSFLLLVAGNETTRNLIA

SEQ ID NO: 131386 - protein, 18 aa, Mycobacterium avium
RLTELFAYPDSTTEATTE

SEQ ID NO: 131387 - protein, 19 aa, Mycobacterium avium
RLTFRATVQVRVPIIGGKL

SEQ ID NO: 131388 - protein, 19 aa, Mycobacterium avium
RLTGRFFRRRPEESKVLLA

SEQ ID NO: 131389 - protein, 17 aa, Mycobacterium avium
RLTLVEGAGGLLVELGE

SEQ ID NO: 131390 - protein, 17 aa, Mycobacterium avium
RLTLYLSTRDCYATNST

SEQ ID NO: 131391 - protein, 25 aa, Mycobacterium avium
RLTQQLWGAVPWGTAAQPALVPMDA

SEQ ID NO: 131392 - protein, 36 aa, Mycobacterium avium
RLTSTPFAHAGYMFKLWDQLVWGSTLVVPPTPWSAQ

SEQ ID NO: 131393 - protein, 36 aa, Mycobacterium avium
RLTSTPFSHAGYMFKLWDQLVWGSTLVVPPTPWSAQ

SEQ ID NO: 131394 - protein, 22 aa, Mycobacterium avium
RLTTPLLRVRGALRPCDWDTAM

SEQ ID NO: 131395 - protein, 30 aa, Mycobacterium avium
RLTTRVIDLIMPIGKGQRALIVSPPKAGKT

SEQ ID NO: 131396 - protein, 26 aa, Mycobacterium avium
RLTVPGGVTLKAAWLAMIAVAATHLG

SEQ ID NO: 131397 - protein, 17 aa, Mycobacterium avium
RLVACRGTVRVRVLLAP

SEQ ID NO: 131398 - protein, 20 aa, Mycobacterium avium
RLVADGANWSRWAKPIVLHS

SEQ ID NO: 131399 - protein, 21 aa, Mycobacterium avium
RLVDAVAMMDKLRAGPWESEQ

SEQ ID NO: 131400 - protein, 19 aa, Mycobacterium avium
RLVDGRWATWLSSRRWLTL

SEQ ID NO: 131401 - protein, 26 aa, Mycobacterium avium
RLVDTPFLGPALADDLLRHVGADAAA

SEQ ID NO: 131402 - protein, 18 aa, Mycobacterium avium
RLVHPLIVAVQTLFRGQT

SEQ ID NO: 131403 - protein, 17 aa, Mycobacterium avium
RLVSGQLSLLLRRTIDP

SEQ ID NO: 131404 - protein, 18 aa, Mycobacterium avium
RLVSGQLSLLLRRTIDPD

SEQ ID NO: 131405 - protein, 18 aa, Mycobacterium avium
RLVTACVQAGLPVGCLPG

SEQ ID NO: 131406 - protein, 18 aa, Mycobacterium avium
RLVVCDKPSRWLVAEAER

SEQ ID NO: 131407 - protein, 18 aa, Mycobacterium avium
RLVVELTPDEAAALGDEL

SEQ ID NO: 131408 - protein, 19 aa, Mycobacterium avium
RLVVPVRIRRSMLVVHCGP

SEQ ID NO: 131409 - protein, 30 aa, Mycobacterium avium
RLWAAQRKLLAPFFVWVTVGLYDPPVRELM

SEQ ID NO: 131410 - protein, 19 aa, Mycobacterium avium
RLWEALLRGDDFVTEIPPD

SEQ ID NO: 131411 - protein, 17 aa, Mycobacterium avium
RLWTEEPVLPCLYLHGR

SEQ ID NO: 131412 - protein, 18 aa, Mycobacterium avium
RMAPPQIRKLLLDTPDPL

SEQ ID NO: 131413 - protein, 20 aa, Mycobacterium avium
RMDKPLQRYWRDVHVGQMHA

SEQ ID NO: 131414 - protein, 20 aa, Mycobacterium avium
RMGLRVLHRNWRCRYGELDI

SEQ ID NO: 131415 - protein, 26 aa, Mycobacterium avium
RMHKRTRVMILLAAFAGLRAHEIAKV

SEQ ID NO: 131416 - protein, 22 aa, Mycobacterium avium
RMHQWMVELAGLFDAGVLNPLP

SEQ ID NO: 131417 - protein, 21 aa, Mycobacterium avium
RMLMHSIFTYPQSQWKERGIP

SEQ ID NO: 131418 - protein, 17 aa, Mycobacterium avium
RMLVRVPAPRRPGAGGG

SEQ ID NO: 131419 - protein, 18 aa, Mycobacterium avium
RMPGFGLQGPWRDYVGWA

SEQ ID NO: 131420 - protein, 20 aa, Mycobacterium avium
RMPYSWNPNYPARVGVMPRD

SEQ ID NO: 131421 - protein, 17 aa, Mycobacterium avium
RMPYTVGLLGSVPRLDA

SEQ ID NO: 131422 - protein, 18 aa, Mycobacterium avium
RMRANDLWIAGIAASRGL

SEQ ID NO: 131423 - protein, 23 aa, Mycobacterium avium
RMRQWMVELAGLFDAGVLNPLPV

SEQ ID NO: 131424 - protein, 22 aa, Mycobacterium avium
RMSARRFWVRYAAEAAGALTLD

SEQ ID NO: 131425 - protein, 20 aa, Mycobacterium avium
RMSRRLDWARVVAGEAALGA

SEQ ID NO: 131426 - protein, 19 aa, Mycobacterium avium
RMVPTFCLQALRGDPLTVS

SEQ ID NO: 131427 - protein, 19 aa, Mycobacterium avium
RMVQRRRGLALLPEIMGDA

SEQ ID NO: 131428 - protein, 18 aa, Mycobacterium avium
RMVTARARILFPGAIVRA

SEQ ID NO: 131429 - protein, 19 aa, Mycobacterium avium
RMYRTGDLVRWRGDGQLDY

SEQ ID NO: 131430 - protein, 19 aa, Mycobacterium avium
RNALLTAGWPETVPGVTVD

SEQ ID NO: 131431 - protein, 26 aa, Mycobacterium avium
RNAMTPAMYFGIRYAINRVNADPDLA

SEQ ID NO: 131432 - protein, 26 aa, Mycobacterium avium
RNARALREAVPLIPPGQLLVETDAPF

SEQ ID NO: 131433 - protein, 17 aa, Mycobacterium avium
RNFLDDIRRYGATYMNY

SEQ ID NO: 131434 - protein, 19 aa, Mycobacterium avium
RNGALNPNAFRRKEIPVDE

SEQ ID NO: 131435 - protein, 23 aa, Mycobacterium avium
RNIEGWVRRKRPGSAAARAAEAA

SEQ ID NO: 131436 - protein, 24 aa, Mycobacterium avium
RNIEGWVRRKRPGSAAARAAEAAE

SEQ ID NO: 131437 - protein, 19 aa, Mycobacterium avium
RNIEGWVRRKRPRQRGRAS

SEQ ID NO: 131438 - protein, 23 aa, Mycobacterium avium
RNLDTVIIPKARRARDVWWVDVL

SEQ ID NO: 131439 - protein, 33 aa, Mycobacterium avium
RNLDTVIIPKARRARDVWWVDVLLSQLEAKLNL

SEQ ID NO: 131440 - protein, 18 aa, Mycobacterium avium
RNLPLIGAPANPGITGAP

SEQ ID NO: 131441 - protein, 19 aa, Mycobacterium avium
RNLSLFAVDLALLTHSHPH

SEQ ID NO: 131442 - protein, 18 aa, Mycobacterium avium
RNNAPAARPALGFCGSCP

SEQ ID NO: 131443 - protein, 17 aa, Mycobacterium avium
RNPRLVYARLSAYGGNG

SEQ ID NO: 131444 - protein, 24 aa, Mycobacterium avium
RNQSGLVVLLTFGTGIGSAVIHNG

SEQ ID NO: 131445 - protein, 19 aa, Mycobacterium avium
RNRIYPLGEAPMYDLVITM

SEQ ID NO: 131446 - protein, 19 aa, Mycobacterium avium
RNRYWVIPGADHYLQCDAP

SEQ ID NO: 131447 - protein, 18 aa, Mycobacterium avium
RNTAFAFEKFTRATLEHL

SEQ ID NO: 131448 - protein, 18 aa, Mycobacterium avium
RNTIDRLLILQDEKVRHR

SEQ ID NO: 131449 - protein, 23 aa, Mycobacterium avium
RNTYAALRRDAARWLRRGHGVVV

SEQ ID NO: 131450 - protein, 25 aa, Mycobacterium avium
RNTYAALRRDAARWLRRGHGVVVDA

SEQ ID NO: 131451 - protein, 23 aa, Mycobacterium avium
RNTYAALRRDAARWLRRGRGVVV

SEQ ID NO: 131452 - protein, 20 aa, Mycobacterium avium
RNVFAARIHQRWSQGLAKAG

SEQ ID NO: 131453 - protein, 18 aa, Mycobacterium avium
RNVIHWTVTRYDEPKSIE

SEQ ID NO: 131454 - protein, 18 aa, Mycobacterium avium
RNVLLPAGTDYTPPNKWV

SEQ ID NO: 131455 - protein, 17 aa, Mycobacterium avium
RNVLMLEGGQAAGLNPG

SEQ ID NO: 131456 - protein, 23 aa, Mycobacterium avium
RNVRAQALPPGRGLLLSADGDVE

SEQ ID NO: 131457 - protein, 23 aa, Mycobacterium avium
RNVRQLCLPTLRALADELGTTVS

SEQ ID NO: 131458 - protein, 22 aa, Mycobacterium avium
RNWFRGDYANLTLIVDLTLSRI

SEQ ID NO: 131459 - protein, 17 aa, Mycobacterium avium
RPAFVSRSVLVTGGNRG

SEQ ID NO: 131460 - protein, 17 aa, Mycobacterium avium
RPAIHRFPGSMAKRIQA

SEQ ID NO: 131461 - protein, 17 aa, Mycobacterium avium
RPALPFAHWVATHRDLF

SEQ ID NO: 131462 - protein, 19 aa, Mycobacterium avium
RPAPPPRPPTPAPTPPTRP

SEQ ID NO: 131463 - protein, 23 aa, Mycobacterium avium
RPARSWCWVEYAGNMLTPELLDA

SEQ ID NO: 131464 - protein, 24 aa, Mycobacterium avium
RPAVDLYRGLLRNQGWRGSAGFMA

SEQ ID NO: 131465 - protein, 32 aa, Mycobacterium avium
RPAVLPLSFAQSRLWFIDQLHGPSPVYNMAVA

SEQ ID NO: 131466 - protein, 24 aa, Mycobacterium avium
RPDAQVWVLVRRQSLGRFERLSAQ

SEQ ID NO: 131467 - protein, 25 aa, Mycobacterium avium
RPDAQVWVLVRRQSLGRFERLSARG

SEQ ID NO: 131468 - protein, 17 aa, Mycobacterium avium
RPDDIAYLLFTSGTTGA

SEQ ID NO: 131469 - protein, 17 aa, Mycobacterium avium
RPDLLVTAPGANLGFHH

SEQ ID NO: 131470 - protein, 22 aa, Mycobacterium avium
RPEFLNRIDDIIVFHQLTRDEI

SEQ ID NO: 131471 - protein, 22 aa, Mycobacterium avium
RPEQPVPIYVSAFGPQAVRLAA

SEQ ID NO: 131472 - protein, 17 aa, Mycobacterium avium
RPFRADGAYIITGGLGG

SEQ ID NO: 131473 - protein, 17 aa, Mycobacterium avium
RPFVGALTLELPTEADD

SEQ ID NO: 131474 - protein, 18 aa, Mycobacterium avium
RPGFPGGSGYWIPIKGWS

SEQ ID NO: 131475 - protein, 17 aa, Mycobacterium avium
RPGFTLYHSHAGGTRQA

SEQ ID NO: 131476 - protein, 22 aa, Mycobacterium avium
RPGGLAVLSYTVWLGPFGGHEM

SEQ ID NO: 131477 - protein, 19 aa, Mycobacterium avium
RPGHITFGSDWPFAPVAVG

SEQ ID NO: 131478 - protein, 26 aa, Mycobacterium avium
RPGLTASRFVACPFGGAGERMYRTGD

SEQ ID NO: 131479 - protein, 17 aa, Mycobacterium avium
RPGLTVSRDLPKLGYKG

SEQ ID NO: 131480 - protein, 33 aa, Mycobacterium avium
RPGPYPFDPLVSALILRALVTRVPQAALDLPEP

SEQ ID NO: 131481 - protein, 26 aa, Mycobacterium avium
RPGQLGDVLLQFGRPVYLHARAEMVG

SEQ ID NO: 131482 - protein, 21 aa, Mycobacterium avium
RPGVRGVFARLPFEQAVLLTR

SEQ ID NO: 131483 - protein, 17 aa, Mycobacterium avium
RPHDIEAQLRFLADQGV

SEQ ID NO: 131484 - protein, 22 aa, Mycobacterium avium
RPHLATTLLPALLEALVRNVSR

SEQ ID NO: 131485 - protein, 25 aa, Mycobacterium avium
RPHLATTLLPALLEALVRNVSRGLV

SEQ ID NO: 131486 - protein, 19 aa, Mycobacterium avium
RPHPDDPMYLVFTSGSTGK

SEQ ID NO: 131487 - protein, 39 aa, Mycobacterium avium
RPIRRVLKGLPAFTTLTGGAYFFLPGINAMRYLAALGER

SEQ ID NO: 131488 - protein, 23 aa, Mycobacterium avium
RPITTPFSLYDCDVPCDGAIAVI

SEQ ID NO: 131489 - protein, 24 aa, Mycobacterium avium
RPKINTQVYLLDNALRPVPAGVIG

SEQ ID NO: 131490 - protein, 23 aa, Mycobacterium avium
RPKINTRVYLLDNALQPVPPGVI

SEQ ID NO: 131491 - protein, 21 aa, Mycobacterium avium
RPLRTPKHFRRARGRKVDVVL

SEQ ID NO: 131492 - protein, 26 aa, Mycobacterium avium
RPLSEQHFPYVFLDATYCKARVNHRV

SEQ ID NO: 131493 - protein, 25 aa, Mycobacterium avium
RPLTDACEIMLLLKDNLAVHHRELV

SEQ ID NO: 131494 - protein, 28 aa, Mycobacterium avium
RPLTVAVLLRITEVFGVDATFFSSQDDT

SEQ ID NO: 131495 - protein, 27 aa, Mycobacterium avium
RPMKIPAPAARWAFCNGMTAAQRRLTM

SEQ ID NO: 131496 - protein, 17 aa, Mycobacterium avium
RPMTRYFPELVAAVRAE

SEQ ID NO: 131497 - protein, 21 aa, Mycobacterium avium
RPNRPGWFLSPAVVAATNDME

SEQ ID NO: 131498 - protein, 18 aa, Mycobacterium avium
RPPAPDSAPPPADYKSWY

SEQ ID NO: 131499 - protein, 18 aa, Mycobacterium avium
RPPAPPRPTLDAPGADLE

SEQ ID NO: 131500 - protein, 20 aa, Mycobacterium avium
RPPCLAINRTAWNALGAFDE

SEQ ID NO: 131501 - protein, 18 aa, Mycobacterium avium
RPPDWAPLPVQYADYTLW

SEQ ID NO: 131502 - protein, 26 aa, Mycobacterium avium
RPPGRFPSSWPTGWDCRCCRCARWWR

SEQ ID NO: 131503 - protein, 20 aa, Mycobacterium avium
RPPRIPLVSNLTGQLAGPGY

SEQ ID NO: 131504 - protein, 19 aa, Mycobacterium avium
RPQTGIATWIIPSIVAYGT

SEQ ID NO: 131505 - protein, 17 aa, Mycobacterium avium
RPQTVFMYLDYIHHWRH

SEQ ID NO: 131506 - protein, 27 aa, Mycobacterium avium
RPQYRELLQDFLFGLDLDEETRRRARL

SEQ ID NO: 131507 - protein, 20 aa, Mycobacterium avium
RPRCPATRRAEEQLVAVAGE

SEQ ID NO: 131508 - protein, 26 aa, Mycobacterium avium
RPRELKQKFYELLASRLAGRCGLDPA

SEQ ID NO: 131509 - protein, 20 aa, Mycobacterium avium
RPRMKIVGLDALLTTARLVD

SEQ ID NO: 131510 - protein, 21 aa, Mycobacterium avium
RPRSRRPARRPGPRPRPRPAR

SEQ ID NO: 131511 - protein, 20 aa, Mycobacterium avium
RPRSSRMARWWVIWPSVMVK

SEQ ID NO: 131512 - protein, 25 aa, Mycobacterium avium
RPSIRAGEFLIAGAGAGLARRVDDT

SEQ ID NO: 131513 - protein, 31 aa, Mycobacterium avium
RPSRLVVCLDLDWRPQFRVDLVPSYKAHRVA

SEQ ID NO: 131514 - protein, 36 aa, Mycobacterium avium
RPSRLVVCLDLDWRPQFRVDLVPSYKAHRVPEAEPA

SEQ ID NO: 131515 - protein, 19 aa, Mycobacterium avium
RPTPLILGGLHLRASHVRQ

SEQ ID NO: 131516 - protein, 20 aa, Mycobacterium avium
RPTPLILGGLHLRASHVRQR

SEQ ID NO: 131517 - protein, 21 aa, Mycobacterium avium
RPTPLILGGLHLRASHVRQRR

SEQ ID NO: 131518 - protein, 33 aa, Mycobacterium avium
RPTVVPLSFAQNRLWFLDQLQGPSPVYNMAAAL

SEQ ID NO: 131519 - protein, 18 aa, Mycobacterium avium
RPVALQPLQMHSSVVCVT

SEQ ID NO: 131520 - protein, 17 aa, Mycobacterium avium
RPVIPPAILECGVTYHT

SEQ ID NO: 131521 - protein, 25 aa, Mycobacterium avium
RPVPQLLAMGLLRRLDAETVILPRH

SEQ ID NO: 131522 - protein, 20 aa, Mycobacterium avium
RPVVAELQRKFSVSAAETGS

SEQ ID NO: 131523 - protein, 20 aa, Mycobacterium avium
RPYHTIIPGFVTKGGAPVMS

SEQ ID NO: 131524 - protein, 22 aa, Mycobacterium avium
RQAVDVLRRLLDNASLASSLAG

SEQ ID NO: 131525 - protein, 19 aa, Mycobacterium avium
RQCAVPCSRPLPWPARTVS

SEQ ID NO: 131526 - protein, 33 aa, Mycobacterium avium
RQEDVYNPLRFLRAAMKWCRKAQALGTLDDAAA

SEQ ID NO: 131527 - protein, 34 aa, Mycobacterium avium
RQEDVYNPLRFLRAAMKWCRKAQALGTLDDAAAQ

SEQ ID NO: 131528 - protein, 17 aa, Mycobacterium avium
RQEIKRGNLPAIRVGRT

SEQ ID NO: 131529 - protein, 24 aa, Mycobacterium avium
RQEPRLSWAAGLRDDGTTTLVTDL

SEQ ID NO: 131530 - protein, 20 aa, Mycobacterium avium
RQFGKPIGAFQGVKHALADN

SEQ ID NO: 131531 - protein, 23 aa, Mycobacterium avium
RQFQVFLDDVRLPSDALIGAEDA

SEQ ID NO: 131532 - protein, 18 aa, Mycobacterium avium
RQGFSIALIPDGDDPRRE

SEQ ID NO: 131533 - protein, 32 aa, Mycobacterium avium
RQHVGDTVLPRKLIELLLGEPGRRDVGRRQPA

SEQ ID NO: 131534 - protein, 21 aa, Mycobacterium avium
RQPLQWPCVPQSTADRNPIRY

SEQ ID NO: 131535 - protein, 18 aa, Mycobacterium avium
RQPVCRRVEFAVGPGPLA

SEQ ID NO: 131536 - protein, 40 aa, Mycobacterium avium
RQQAERELLAALPRWKRPLGRLLIKLAATFIPLREEGKSA

SEQ ID NO: 131537 - protein, 17 aa, Mycobacterium avium
RQQLRRIGAVALATDTV

SEQ ID NO: 131538 - protein, 23 aa, Mycobacterium avium
RQQQRVRDYIRIGQQEGARLVVG

SEQ ID NO: 131539 - protein, 17 aa, Mycobacterium avium
RQRLITLEAVRVTVIDE

SEQ ID NO: 131540 - protein, 22 aa, Mycobacterium avium
RQRLTLRPTPRRRLRYAYPYSG

SEQ ID NO: 131541 - protein, 29 aa, Mycobacterium avium
RQRLWARSGYLQPHWPAPYGRAADSVEQL

SEQ ID NO: 131542 - protein, 30 aa, Mycobacterium avium
RQRQNSVLQMLLLLLRDPKNLQLAEPARGA

SEQ ID NO: 131543 - protein, 29 aa, Mycobacterium avium
RQRQNSVLQMLLLLLRDPKNLQPAEPARG

SEQ ID NO: 131544 - protein, 21 aa, Mycobacterium avium
RQRRDPLYTLIDDIPVATLIS

SEQ ID NO: 131545 - protein, 19 aa, Mycobacterium avium
RQRRRDGRDAGRRRPPVLT

SEQ ID NO: 131546 - protein, 24 aa, Mycobacterium avium
RQRYGRFFRMAYDVLPPGGIMLLH

SEQ ID NO: 131547 - protein, 20 aa, Mycobacterium avium
RQTDGLVIPAPFDQTALMKS

SEQ ID NO: 131548 - protein, 24 aa, Mycobacterium avium
RQTFRDIIDVNLIGVWNTVEAATP

SEQ ID NO: 131549 - protein, 22 aa, Mycobacterium avium
RQTIYRYFPTHEALLGATALSA

SEQ ID NO: 131550 - protein, 22 aa, Mycobacterium avium
RQVNVIFTRALRPAPATLVRHD

SEQ ID NO: 131551 - protein, 18 aa, Mycobacterium avium
RQVSAPMPGLPTLSEVRA

SEQ ID NO: 131552 - protein, 23 aa, Mycobacterium avium
RQWLEIRYLDSVPDTLWPAVVFT

SEQ ID NO: 131553 - protein, 18 aa, Mycobacterium avium
RQWYDDNDITLRLGSAAR

SEQ ID NO: 131554 - protein, 24 aa, Mycobacterium avium
RQYRDMRILGIGGGTTEILIALSA

SEQ ID NO: 131555 - protein, 20 aa, Mycobacterium avium
RRAGRPAEALPWYRIASQSN

SEQ ID NO: 131556 - protein, 23 aa, Mycobacterium avium
RRAHGLPAISLGWGLWDQASAMT

SEQ ID NO: 131557 - protein, 18 aa, Mycobacterium avium
RRALPRHQRLGPVGLAAD

SEQ ID NO: 131558 - protein, 27 aa, Mycobacterium avium
RRCREVTSLLGLFGRLVEIIGVDCRQL

SEQ ID NO: 131559 - protein, 35 aa, Mycobacterium avium
RRELFDGIGPYNLRYRVWADWDFNIRCFSNPALIT

SEQ ID NO: 131560 - protein, 19 aa, Mycobacterium avium
RRFRVPEERWVFLHGHADM

SEQ ID NO: 131561 - protein, 29 aa, Mycobacterium avium
RRFVESTGIPFLPMSMAKGLLPDAHPQSV

SEQ ID NO: 131562 - protein, 23 aa, Mycobacterium avium
RRGADMLKPCTLELGGKSAAIVL

SEQ ID NO: 131563 - protein, 18 aa, Mycobacterium avium
RRGANVALLARGAAGLQG

SEQ ID NO: 131564 - protein, 28 aa, Mycobacterium avium
RRGIATYLRLGYAPFTLEFGRNGWIADA

SEQ ID NO: 131565 - protein, 20 aa, Mycobacterium avium
RRGRRHRLPGAGPVRHVRVV

SEQ ID NO: 131566 - protein, 22 aa, Mycobacterium avium
RRGVPLLRHQLPAARRAAREDH

SEQ ID NO: 131567 - protein, 17 aa, Mycobacterium avium
RRGVPRRVFRCSHFGRE

SEQ ID NO: 131568 - protein, 19 aa, Mycobacterium avium
RRHFDIAVFAAYELMQRVC

SEQ ID NO: 131569 - protein, 21 aa, Mycobacterium avium
RRHHVFGQPGVQPLPHLRDLG

SEQ ID NO: 131570 - protein, 19 aa, Mycobacterium avium
RRHLVVRQVDLRRADRRQP

SEQ ID NO: 131571 - protein, 19 aa, Mycobacterium avium
RRHPMLRATFPDPGRCLIT

SEQ ID NO: 131572 - protein, 27 aa, Mycobacterium avium
RRHRHWSLPVFVEWASGALIPCSCVGR

SEQ ID NO: 131573 - protein, 28 aa, Mycobacterium avium
RRHRHWSLPVFVEWASGALIPCSCVGRN

SEQ ID NO: 131574 - protein, 21 aa, Mycobacterium avium
RRHSRRTRDAELKISSWHCDV

SEQ ID NO: 131575 - protein, 24 aa, Mycobacterium avium
RRIAAALGPGWPRAVKSTLQMTFS

SEQ ID NO: 131576 - protein, 19 aa, Mycobacterium avium
RRIADWNPRLRFLEQSPAL

SEQ ID NO: 131577 - protein, 18 aa, Mycobacterium avium
RRILFLRTKHQARKLARQ

SEQ ID NO: 131578 - protein, 18 aa, Mycobacterium avium
RRINPAIIYVVGSGFGLK

SEQ ID NO: 131579 - protein, 25 aa, Mycobacterium avium
RRIRSGRLLIFSPYVTHRLHEIWPE

SEQ ID NO: 131580 - protein, 26 aa, Mycobacterium avium
RRLAAVGPIWALGSLRASPGARRHYD

SEQ ID NO: 131581 - protein, 24 aa, Mycobacterium avium
RRLDALGIDYEIVPGVPAFAAAAA

SEQ ID NO: 131582 - protein, 17 aa, Mycobacterium avium
RRLGLMGLLPTTVKTLE

SEQ ID NO: 131583 - protein, 17 aa, Mycobacterium avium
RRLGRPDGRRLPGRARP

SEQ ID NO: 131584 - protein, 17 aa, Mycobacterium avium
RRLLTKAGRRRHLDRDI

SEQ ID NO: 131585 - protein, 20 aa, Mycobacterium avium
RRLMILASEDIGMADPAALQ

SEQ ID NO: 131586 - protein, 20 aa, Mycobacterium avium
RRLRDAFPHAALIEIPDCSA

SEQ ID NO: 131587 - protein, 20 aa, Mycobacterium avium
RRLRPVMYMSALTAIRCDPQ

SEQ ID NO: 131588 - protein, 20 aa, Mycobacterium avium
RRLRQVLHIGGFPMTILDGQ

SEQ ID NO: 131589 - protein, 24 aa, Mycobacterium avium
RRLRSTPALRRLVAQTSLEPRHLV

SEQ ID NO: 131590 - protein, 19 aa, Mycobacterium avium
RRLRVMGQTLERLLPVPPT

SEQ ID NO: 131591 - protein, 20 aa, Mycobacterium avium
RRLRVMGQTLERLLPVPPTA

SEQ ID NO: 131592 - protein, 21 aa, Mycobacterium avium
RRLRYAYPYSGRLGALCPTPQ

SEQ ID NO: 131593 - protein, 21 aa, Mycobacterium avium
RRLTLRPTPRRRLRYAYPYSG

SEQ ID NO: 131594 - protein, 24 aa, Mycobacterium avium
RRLTSWLSSLTGLPVFCIDYRLAP

SEQ ID NO: 131595 - protein, 19 aa, Mycobacterium avium
RRLVSGQLSLLLRRTIDPD

SEQ ID NO: 131596 - protein, 20 aa, Mycobacterium avium
RRMRANDLWIAAIAASRGLP

SEQ ID NO: 131597 - protein, 17 aa, Mycobacterium avium
RRMRDYISIMRQALRGD

SEQ ID NO: 131598 - protein, 19 aa, Mycobacterium avium
RRNFIRRVGISPDQYRKAF

SEQ ID NO: 131599 - protein, 21 aa, Mycobacterium avium
RRNRLLAAGLDLLGDQRPDIS

SEQ ID NO: 131600 - protein, 17 aa, Mycobacterium avium
RRPAAQASIPALFAAQV

SEQ ID NO: 131601 - protein, 20 aa, Mycobacterium avium
RRPGNRTRIDAIKAEMDREV

SEQ ID NO: 131602 - protein, 17 aa, Mycobacterium avium
RRPIVPIGRVAVGAVGD

SEQ ID NO: 131603 - protein, 19 aa, Mycobacterium avium
RRQLHRLAGAVQRPGNVEV

SEQ ID NO: 131604 - protein, 23 aa, Mycobacterium avium
RRQRIQEGVRRGVVALSGRADQP

SEQ ID NO: 131605 - protein, 18 aa, Mycobacterium avium
RRQRPHIHLLAHRQRQHI

SEQ ID NO: 131606 - protein, 25 aa, Mycobacterium avium
RRRAAGLRRLRVTRGGPPCPPRAAA

SEQ ID NO: 131607 - protein, 30 aa, Mycobacterium avium
RRRARIYCPRWVALFRWAKPVLSSRLGEMP

SEQ ID NO: 131608 - protein, 17 aa, Mycobacterium avium
RRREELAALGDKVARRV

SEQ ID NO: 131609 - protein, 24 aa, Mycobacterium avium
RRRGENIGLTTVYRTLQSMAAAGL

SEQ ID NO: 131610 - protein, 25 aa, Mycobacterium avium
RRRGENIGLTTVYRTLQSMAAAGLI

SEQ ID NO: 131611 - protein, 26 aa, Mycobacterium avium
RRRPGPFPVASFGVAELQRPAALCED

SEQ ID NO: 131612 - protein, 23 aa, Mycobacterium avium
RRRPVPGLRWPWVARVGTVVMSW

SEQ ID NO: 131613 - protein, 24 aa, Mycobacterium avium
RRRPVRGLRWPWVARVGTVVMSWR

SEQ ID NO: 131614 - protein, 23 aa, Mycobacterium avium
RRRQPRSADLPRLVADRSAGARF

SEQ ID NO: 131615 - protein, 19 aa, Mycobacterium avium
RRRRGGGLSRRGAAEQQRA

SEQ ID NO: 131616 - protein, 21 aa, Mycobacterium avium
RRRVFMLAVTARRPSVDGTDT

SEQ ID NO: 131617 - protein, 19 aa, Mycobacterium avium
RRRVGHMLLLLVETGVSER

SEQ ID NO: 131618 - protein, 18 aa, Mycobacterium avium
RRRVMRLRTQHAHVVSAA

SEQ ID NO: 131619 - protein, 20 aa, Mycobacterium avium
RRRYNPWSAYGESKLANMLF

SEQ ID NO: 131620 - protein, 27 aa, Mycobacterium avium
RRSADTHLLRYPLPSAWAGDADVALYL

SEQ ID NO: 131621 - protein, 23 aa, Mycobacterium avium
RRSDVFLTNYLPSTRKKLSIDVD

SEQ ID NO: 131622 - protein, 18 aa, Mycobacterium avium
RRSIFVDESVLRMQNLAV

SEQ ID NO: 131623 - protein, 19 aa, Mycobacterium avium
RRSRLGGWGLMSNAAHPGL

SEQ ID NO: 131624 - protein, 32 aa, Mycobacterium avium
RRSRRCFRTSAWWWPPTCRPRRWPTPSARAPG

SEQ ID NO: 131625 - protein, 17 aa, Mycobacterium avium
RRTAVFDPVLHVADLSL

SEQ ID NO: 131626 - protein, 34 aa, Mycobacterium avium
RRTNLTQLNPIPPHLHLLINPPHKLQPPTHTPPH

SEQ ID NO: 131627 - protein, 27 aa, Mycobacterium avium
RRVGIARARQMLLLPQPIGAEEAAALG

SEQ ID NO: 131628 - protein, 26 aa, Mycobacterium avium
RRVGLLLQDALLFPHMSVAANVAFGP

SEQ ID NO: 131629 - protein, 19 aa, Mycobacterium avium
RRVLYAVEDAQNAGFTVGE

SEQ ID NO: 131630 - protein, 24 aa, Mycobacterium avium
RRVPLQHLLGTAAFGPVLLHVGPG

SEQ ID NO: 131631 - protein, 24 aa, Mycobacterium avium
RRVRRGRIQFVRQEPLFAPSVKYS

SEQ ID NO: 131632 - protein, 24 aa, Mycobacterium avium
RRVRRHRALLRAADRAELAAGLAA

SEQ ID NO: 131633 - protein, 24 aa, Mycobacterium avium
RRVRRHRALLRAADRAELAAGLGA

SEQ ID NO: 131634 - protein, 19 aa, Mycobacterium avium
RRVSMLRAGAPWDSDWILE

SEQ ID NO: 131635 - protein, 20 aa, Mycobacterium avium
RRWPGWSRPVASRRSWWSAS

SEQ ID NO: 131636 - protein, 17 aa, Mycobacterium avium
RRYFRDYSWGMRVPRRL

SEQ ID NO: 131637 - protein, 19 aa, Mycobacterium avium
RRYGVRWHYRVPAWSEFVE

SEQ ID NO: 131638 - protein, 20 aa, Mycobacterium avium
RRYGVRWHYRVPAWSEFVEV

SEQ ID NO: 131639 - protein, 21 aa, Mycobacterium avium
RRYGVRWHYRVPAWSEFVEVH

SEQ ID NO: 131640 - protein, 18 aa, Mycobacterium avium
RRYRRYVGFLDGVGPQRR

SEQ ID NO: 131641 - protein, 18 aa, Mycobacterium avium
RSAIRDFLRADRAEFGWM

SEQ ID NO: 131642 - protein, 17 aa, Mycobacterium avium
RSAIVIPLIADGAVLGV

SEQ ID NO: 131643 - protein, 18 aa, Mycobacterium avium
RSALLRAAAERLAELDLA

SEQ ID NO: 131644 - protein, 17 aa, Mycobacterium avium
RSARRRFRRLPAVEVPD

SEQ ID NO: 131645 - protein, 18 aa, Mycobacterium avium
RSARRRFRRLPAVEVPDA

SEQ ID NO: 131646 - protein, 26 aa, Mycobacterium avium
RSASPADLFMLIFTSGTSGEPKAVKC

SEQ ID NO: 131647 - protein, 17 aa, Mycobacterium avium
RSDLLAALPERLHDRAV

SEQ ID NO: 131648 - protein, 22 aa, Mycobacterium avium
RSDLLARLLSRTIDHAATALER

SEQ ID NO: 131649 - protein, 23 aa, Mycobacterium avium
RSDYQLRFRWSAGAVVLWDNRGM

SEQ ID NO: 131650 - protein, 17 aa, Mycobacterium avium
RSFGTLQNVLAASASDL

SEQ ID NO: 131651 - protein, 30 aa, Mycobacterium avium
RSGPERILSTGPLLFAAIRTLGRGPVPDDR

SEQ ID NO: 131652 - protein, 24 aa, Mycobacterium avium
RSGYPLELLVRAAAAGWRVVELDV

SEQ ID NO: 131653 - protein, 22 aa, Mycobacterium avium
RSILQRFEVDWGAAGFADAGLD

SEQ ID NO: 131654 - protein, 17 aa, Mycobacterium avium
RSILTDGFDFVLDLDRS

SEQ ID NO: 131655 - protein, 24 aa, Mycobacterium avium
RSKSHLLVTVLAREFERLDTEFDC

SEQ ID NO: 131656 - protein, 22 aa, Mycobacterium avium
RSLLFVPGDRPDRFTKAASSDA

SEQ ID NO: 131657 - protein, 19 aa, Mycobacterium avium
RSLSVARRIRAGFMGVNGG

SEQ ID NO: 131658 - protein, 19 aa, Mycobacterium avium
RSMELFKTALRLARHRELV

SEQ ID NO: 131659 - protein, 26 aa, Mycobacterium avium
RSPEQLAQTWLGLGPAIVAVTMADRG

SEQ ID NO: 131660 - protein, 21 aa, Mycobacterium avium
RSPKDLPAFCSTILAQFAGAT

SEQ ID NO: 131661 - protein, 22 aa, Mycobacterium avium
RSPLGPGMPAGFPDLSQLPEGL

SEQ ID NO: 131662 - protein, 22 aa, Mycobacterium avium
RSPLPFGRHRWVLDRRPPDIAW

SEQ ID NO: 131663 - protein, 24 aa, Mycobacterium avium
RSPTRPALGVAPTPHAVPGQRNPV

SEQ ID NO: 131664 - protein, 29 aa, Mycobacterium avium
RSQLRGATFLDLPRLPHQLIYATATAAMG

SEQ ID NO: 131665 - protein, 17 aa, Mycobacterium avium
RSQVFPIRQFADGIAHT

SEQ ID NO: 131666 - protein, 21 aa, Mycobacterium avium
RSRAVYRLLMGRGRPIVEGVE

SEQ ID NO: 131667 - protein, 22 aa, Mycobacterium avium
RSRAVYRLLMGRGRPIVEGVEA

SEQ ID NO: 131668 - protein, 24 aa, Mycobacterium avium
RSRAWRRLPDWPPATTERALYLRP

SEQ ID NO: 131669 - protein, 18 aa, Mycobacterium avium
RSRFYDGMRALHGAPDEV

SEQ ID NO: 131670 - protein, 26 aa, Mycobacterium avium
RSRRRARLLALRLRRLHYRHRRPAAG

SEQ ID NO: 131671 - protein, 25 aa, Mycobacterium avium
RSRRRARLLALRLRRLHYRRRRPAA

SEQ ID NO: 131672 - protein, 19 aa, Mycobacterium avium
RSRYSGEIVFWATGSAATP

SEQ ID NO: 131673 - protein, 17 aa, Mycobacterium avium
RSSGAIELTGAWPGLRC

SEQ ID NO: 131674 - protein, 19 aa, Mycobacterium avium
RSSGAIELTGAWPGLRCDV

SEQ ID NO: 131675 - protein, 17 aa, Mycobacterium avium
RSSLVYDMWGAAVNLAH

SEQ ID NO: 131676 - protein, 18 aa, Mycobacterium avium
RSTAEWLKLFGELEIPAA

SEQ ID NO: 131677 - protein, 22 aa, Mycobacterium avium
RSTIYRRFPTKENLFGQVVRRE

SEQ ID NO: 131678 - protein, 31 aa, Mycobacterium avium
RSTLLSMTCNTAIPIMWVGRQPPGTHTAPPV

SEQ ID NO: 131679 - protein, 25 aa, Mycobacterium avium
RSTMAAIEWLFWRSTKKVDNAQRRQ

SEQ ID NO: 131680 - protein, 25 aa, Mycobacterium avium
RSTMTAIEWLFWRSTKKVDNAQRRQ

SEQ ID NO: 131681 - protein, 22 aa, Mycobacterium avium
RSVAAWLWSGRRGVLAGLAAAA

SEQ ID NO: 131682 - protein, 42 aa, Mycobacterium avium
RSVIAGLTTGRWLGPSSLAMASAFAPYMAWMAGAAGRAAETA

SEQ ID NO: 131683 - protein, 20 aa, Mycobacterium avium
RSVIPPLAKKFRVIAPDLLG

SEQ ID NO: 131684 - protein, 24 aa, Mycobacterium avium
RSVLPGGLNWPLDLAVGHDGRLYV

SEQ ID NO: 131685 - protein, 25 aa, Mycobacterium avium
RSVQAALPHLALTKGAIVTTAAYSA

SEQ ID NO: 131686 - protein, 27 aa, Mycobacterium avium
RSVSGGPTLAFGWTKRALAAATLAELE

SEQ ID NO: 131687 - protein, 38 aa, Mycobacterium avium
RSVSHMPQWARRWQRLLFDNGWLLPSQPPEYGGRNATV

SEQ ID NO: 131688 - protein, 19 aa, Mycobacterium avium
RTALAERLPAYLVPAAVVA

SEQ ID NO: 131689 - protein, 23 aa, Mycobacterium avium
RTALRNWLRRVRLDPEQTLNVLV

SEQ ID NO: 131690 - protein, 28 aa, Mycobacterium avium
RTAPPFAVHRFWLDRPVSPRRPAFLGTA

SEQ ID NO: 131691 - protein, 23 aa, Mycobacterium avium
RTDFVAFLDSDVAPRRGWLEALL

SEQ ID NO: 131692 - protein, 17 aa, Mycobacterium avium
RTEIVACRPWLIAEIEA

SEQ ID NO: 131693 - protein, 19 aa, Mycobacterium avium
RTELGLPADWEPLGAIAIG

SEQ ID NO: 131694 - protein, 18 aa, Mycobacterium avium
RTELPFAGHPTVGAAWWL

SEQ ID NO: 131695 - protein, 22 aa, Mycobacterium avium
RTFQLYISLINVLAAAARAGHG

SEQ ID NO: 131696 - protein, 22 aa, Mycobacterium avium
RTGLSTTLAWFAERAGRTGESA

SEQ ID NO: 131697 - protein, 23 aa, Mycobacterium avium
RTGLSTTLAWFAERAGRTGESTQ

SEQ ID NO: 131698 - protein, 18 aa, Mycobacterium avium
RTIAFYPPAFSDTARRQL

SEQ ID NO: 131699 - protein, 25 aa, Mycobacterium avium
RTKGMLMLVYGIDEDAAFNMLKSLS

SEQ ID NO: 131700 - protein, 19 aa, Mycobacterium avium
RTLAPPMGRGWEALAGDEV

SEQ ID NO: 131701 - protein, 20 aa, Mycobacterium avium
RTLAPPMGRGWEALAGDEVW

SEQ ID NO: 131702 - protein, 18 aa, Mycobacterium avium
RTLDLRAGTLTRSAYWRS

SEQ ID NO: 131703 - protein, 25 aa, Mycobacterium avium
RTLTPAIVDAMWASGLMSAFNPIEA

SEQ ID NO: 131704 - protein, 17 aa, Mycobacterium avium
RTMEELFLEVFRRRAEE

SEQ ID NO: 131705 - protein, 28 aa, Mycobacterium avium
RTMGRVYGWLLICEPPQQSLTQLADALS

SEQ ID NO: 131706 - protein, 24 aa, Mycobacterium avium
RTMKDERGFPIDEPPEGDVAEQQR

SEQ ID NO: 131707 - protein, 25 aa, Mycobacterium avium
RTMVLNYYAPLRLIRGIAPGMIERG

SEQ ID NO: 131708 - protein, 21 aa, Mycobacterium avium
RTNRNMLVYLAADEARLQELD

SEQ ID NO: 131709 - protein, 26 aa, Mycobacterium avium
RTNRRPTGGPGQRGRLGPWAVQRRRH

SEQ ID NO: 131710 - protein, 25 aa, Mycobacterium avium
RTNWQVPKHEGLTMFLVPLAHPGVT

SEQ ID NO: 131711 - protein, 25 aa, Mycobacterium avium
RTPPRRQRLLGPPPALRRVEVGPDG

SEQ ID NO: 131712 - protein, 17 aa, Mycobacterium avium
RTPVLFQAGASPRGIRF

SEQ ID NO: 131713 - protein, 17 aa, Mycobacterium avium
RTQRRPVCGRSCALRGL

SEQ ID NO: 131714 - protein, 29 aa, Mycobacterium avium
RTQRSVRALLTGYLLYTLGGDKKYRDFAD

SEQ ID NO: 131715 - protein, 23 aa, Mycobacterium avium
RTRDDLLHPLRAPSLLAVEPPEH

SEQ ID NO: 131716 - protein, 20 aa, Mycobacterium avium
RTRDRFSWTKHLKLALRHQQ

SEQ ID NO: 131717 - protein, 24 aa, Mycobacterium avium
RTREFIRLLRRLWTQDDVTFHGEF

SEQ ID NO: 131718 - protein, 19 aa, Mycobacterium avium
RTREPLMVTNAWLPPELAP

SEQ ID NO: 131719 - protein, 26 aa, Mycobacterium avium
RTRGVLRLMSTVIHALWTGEDASPLI

SEQ ID NO: 131720 - protein, 18 aa, Mycobacterium avium
RTSDGYIAALIYNDKHWN

SEQ ID NO: 131721 - protein, 26 aa, Mycobacterium avium
RTSDGYIAALIYNDKHWNAFMNAVRP

SEQ ID NO: 131722 - protein, 24 aa, Mycobacterium avium
RTSITLVAYSVPEPGWSKIIPAFN

SEQ ID NO: 131723 - protein, 26 aa, Mycobacterium avium
RTSVLQKYFLLSRIPQSVALVNLRAR

SEQ ID NO: 131724 - protein, 25 aa, Mycobacterium avium
RTTIPAGRRVLLLYGSANRDERQYG

SEQ ID NO: 131725 - protein, 24 aa, Mycobacterium avium
RTTPTLLHPRPRSVLGQLAAAVYA

SEQ ID NO: 131726 - protein, 25 aa, Mycobacterium avium
RTVEGHLYRLFTKLGINNRDQLIQL

SEQ ID NO: 131727 - protein, 24 aa, Mycobacterium avium
RTVHGYAYAVLRRAAERAGEAPPR

SEQ ID NO: 131728 - protein, 20 aa, Mycobacterium avium
RTVLVESEPWFVAADACRML

SEQ ID NO: 131729 - protein, 23 aa, Mycobacterium avium
RTVNPKIVYARGSALGPRGAESE

SEQ ID NO: 131730 - protein, 26 aa, Mycobacterium avium
RTVRQFNDLLRVLPPLPEETPQEAPA

SEQ ID NO: 131731 - protein, 25 aa, Mycobacterium avium
RTYDKMSLFIVPAETPGIEIVRNVG

SEQ ID NO: 131732 - protein, 21 aa, Mycobacterium avium
RTYIASWLRRWQERGELADDL

SEQ ID NO: 131733 - protein, 18 aa, Mycobacterium avium
RTYLLSGMLRCGRCGNRL

SEQ ID NO: 131734 - protein, 17 aa, Mycobacterium avium
RVAAPYRVIQFAVNPFK

SEQ ID NO: 131735 - protein, 23 aa, Mycobacterium avium
RVAGHDRFRFYLNVEVGKHLSHA

SEQ ID NO: 131736 - protein, 25 aa, Mycobacterium avium
RVAIARAFVNRPLVLLADEPTGNLD

SEQ ID NO: 131737 - protein, 17 aa, Mycobacterium avium
RVAMMTREYPPEVYGGA

SEQ ID NO: 131738 - protein, 18 aa, Mycobacterium avium
RVAMMTREYPPEVYGGAG

SEQ ID NO: 131739 - protein, 22 aa, Mycobacterium avium
RVDFSPIADGWLLPIFRVDQSA

SEQ ID NO: 131740 - protein, 29 aa, Mycobacterium avium
RVDGWPGQQFALLFVDWLTADPDARADYL

SEQ ID NO: 131741 - protein, 20 aa, Mycobacterium avium
RVDQLPAIWKRLVDGGMESG

SEQ ID NO: 131742 - protein, 21 aa, Mycobacterium avium
RVEAQFLERLVRVDRLGGRAA

SEQ ID NO: 131743 - protein, 24 aa, Mycobacterium avium
RVEIRMPVVVDPEWERPARSVTNG

SEQ ID NO: 131744 - protein, 17 aa, Mycobacterium avium
RVFGANNFPASVLGAVG

SEQ ID NO: 131745 - protein, 27 aa, Mycobacterium avium
RVFVGLDALLLDKLNRLTPASAAKLIW

SEQ ID NO: 131746 - protein, 22 aa, Mycobacterium avium
RVGAPVLFGMGRFLGHDRLADL

SEQ ID NO: 131747 - protein, 17 aa, Mycobacterium avium
RVGAVGLIRSWRARNSG

SEQ ID NO: 131748 - protein, 21 aa, Mycobacterium avium
RVGDWVVDPQWWAARRDEAAA

SEQ ID NO: 131749 - protein, 24 aa, Mycobacterium avium
RVGMARFNAVWTGPETLPLPVEIE

SEQ ID NO: 131750 - protein, 18 aa, Mycobacterium avium
RVGMPVTAVFRPVDDTDP

SEQ ID NO: 131751 - protein, 18 aa, Mycobacterium avium
RVGPIGGQLQPLRQPGQR

SEQ ID NO: 131752 - protein, 18 aa, Mycobacterium avium
RVGRFTGVVLLTGPKDGD

SEQ ID NO: 131753 - protein, 24 aa, Mycobacterium avium
RVHGRVFISVLAYELGRHNSNEGL

SEQ ID NO: 131754 - protein, 17 aa, Mycobacterium avium
RVHLDTARYQLLVQYPN

SEQ ID NO: 131755 - protein, 19 aa, Mycobacterium avium
RVHLLAHDWGSIQAWAAVT

SEQ ID NO: 131756 - protein, 26 aa, Mycobacterium avium
RVHNLGRPPRMLVLLHLDGSADRPAT

SEQ ID NO: 131757 - protein, 19 aa, Mycobacterium avium
RVHQRIRPAVTRVTRIESA

SEQ ID NO: 131758 - protein, 22 aa, Mycobacterium avium
RVHRESLVLDRLVDAGLDVPAE

SEQ ID NO: 131759 - protein, 22 aa, Mycobacterium avium
RVHRPQAVAGLHRPGLGHLERP

SEQ ID NO: 131760 - protein, 17 aa, Mycobacterium avium
RVICFNPMVLGGDTDQV

SEQ ID NO: 131761 - protein, 17 aa, Mycobacterium avium
RVIDVPVKRLDDLNLDD

SEQ ID NO: 131762 - protein, 17 aa, Mycobacterium avium
RVIGMLLGIPESEPVSV

SEQ ID NO: 131763 - protein, 19 aa, Mycobacterium avium
RVIGPVRTRDLMFTGRVLT

SEQ ID NO: 131764 - protein, 18 aa, Mycobacterium avium
RVKRGPLPALERLHRALL

SEQ ID NO: 131765 - protein, 17 aa, Mycobacterium avium
RVKRVTTMKQGVIASAG

SEQ ID NO: 131766 - protein, 17 aa, Mycobacterium avium
RVLAAAARLEPAGPGWA

SEQ ID NO: 131767 - protein, 18 aa, Mycobacterium avium
RVLDRGSGQVRWVPGTEL

SEQ ID NO: 131768 - protein, 22 aa, Mycobacterium avium
RVLEVAQFTFVPSAGAVLADWG

SEQ ID NO: 131769 - protein, 20 aa, Mycobacterium avium
RVLHSAALRRLADKTQVVGP

SEQ ID NO: 131770 - protein, 32 aa, Mycobacterium avium
RVLLQLPNSCQFAVALFGLLRAGAVPVMCLPG

SEQ ID NO: 131771 - protein, 25 aa, Mycobacterium avium
RVLRGWSSLPVRLGPARSLAAAEAG

SEQ ID NO: 131772 - protein, 32 aa, Mycobacterium avium
RVLRLTRVATLPRPLRPLRNAGMRLAAGIPGV

SEQ ID NO: 131773 - protein, 25 aa, Mycobacterium avium
RVLRPSGLLLMSTPNRITFSPGRDT

SEQ ID NO: 131774 - protein, 22 aa, Mycobacterium avium
RVLTGVGAFDPGLGRKAPIYVI

SEQ ID NO: 131775 - protein, 17 aa, Mycobacterium avium
RVLTGVGTFDPGLGRKA

SEQ ID NO: 131776 - protein, 17 aa, Mycobacterium avium
RVLYLVDGRFRIGTVEQ

SEQ ID NO: 131777 - protein, 22 aa, Mycobacterium avium
RVMSRFADLFTAVRVRLGEAVD

SEQ ID NO: 131778 - protein, 24 aa, Mycobacterium avium
RVNAPLPFVTLNTVGPTLIQYGTE

SEQ ID NO: 131779 - protein, 31 aa, Mycobacterium avium
RVPDWVPLPVQYIDYALWQRAQFGDLEDPDS

SEQ ID NO: 131780 - protein, 19 aa, Mycobacterium avium
RVPVRLPEDDLCARAPGWP

SEQ ID NO: 131781 - protein, 18 aa, Mycobacterium avium
RVPYRARVPMTRAALMHR

SEQ ID NO: 131782 - protein, 23 aa, Mycobacterium avium
RVRAHVLFPGGFLNTGIWESWRH

SEQ ID NO: 131783 - protein, 22 aa, Mycobacterium avium
RVRCSMWSTRLLQISARVVGEH

SEQ ID NO: 131784 - protein, 17 aa, Mycobacterium avium
RVRDGVGLVGPLVIPGV

SEQ ID NO: 131785 - protein, 18 aa, Mycobacterium avium
RVRDGVGLVGPLVIPGVT

SEQ ID NO: 131786 - protein, 18 aa, Mycobacterium avium
RVRDYIRIGQQEGARLVV

SEQ ID NO: 131787 - protein, 18 aa, Mycobacterium avium
RVRDYVRIGQQEGARLVV

SEQ ID NO: 131788 - protein, 18 aa, Mycobacterium avium
RVRGGLLEIGRKLNIPPL

SEQ ID NO: 131789 - protein, 18 aa, Mycobacterium avium
RVRPRRVLAAAARLEPAG

SEQ ID NO: 131790 - protein, 17 aa, Mycobacterium avium
RVRRDLASALRSAAAGL

SEQ ID NO: 131791 - protein, 23 aa, Mycobacterium avium
RVRRWWPRRYRRSSVYSKLVSLD

SEQ ID NO: 131792 - protein, 17 aa, Mycobacterium avium
RVRTGQLVLLHVLNAGA

SEQ ID NO: 131793 - protein, 17 aa, Mycobacterium avium
RVRVLDRGSGQVRWVPG

SEQ ID NO: 131794 - protein, 20 aa, Mycobacterium avium
RVRVLLRRTSSTVALDDLDI

SEQ ID NO: 131795 - protein, 18 aa, Mycobacterium avium
RVRVWRRRANGQGRRRGV

SEQ ID NO: 131796 - protein, 21 aa, Mycobacterium avium
RVRYAVEDAMRSGFDVYEDMS

SEQ ID NO: 131797 - protein, 20 aa, Mycobacterium avium
RVSELPYLVPVLEQSFDHPD

SEQ ID NO: 131798 - protein, 27 aa, Mycobacterium avium
RVSGSEAAFLWYLTLDAGDTRTRISPI

SEQ ID NO: 131799 - protein, 30 aa, Mycobacterium avium
RVSIFSATRYEWAILDLAILAVGAVTVPIY

SEQ ID NO: 131800 - protein, 17 aa, Mycobacterium avium
RVTIFKRNTLWSAIFRP

SEQ ID NO: 131801 - protein, 20 aa, Mycobacterium avium
RVTLETPMIVQLAKDRNPAV

SEQ ID NO: 131802 - protein, 17 aa, Mycobacterium avium
RVTPFTPPQRTTNEAGM

SEQ ID NO: 131803 - protein, 18 aa, Mycobacterium avium
RVTRPGGLAVLSYTVWLG

SEQ ID NO: 131804 - protein, 25 aa, Mycobacterium avium
RVVELAAWTFVPAAGAVLADWGADV

SEQ ID NO: 131805 - protein, 18 aa, Mycobacterium avium
RVVGADLLEPLSAYAQID

SEQ ID NO: 131806 - protein, 33 aa, Mycobacterium avium
RVVRQLIASGYIGFFLCPGAAELSFRAGIGVKV

SEQ ID NO: 131807 - protein, 18 aa, Mycobacterium avium
RVWAPKPARLRLDVEGRP

SEQ ID NO: 131808 - protein, 21 aa, Mycobacterium avium
RVYDVVRRLDWPAGYTVRALN

SEQ ID NO: 131809 - protein, 28 aa, Mycobacterium avium
RVYRDRGLLPPPLRVGRIALFNDTHLTR

SEQ ID NO: 131810 - protein, 27 aa, Mycobacterium avium
RVYVELFAKFMRWPVDKFVLRSVSDTG

SEQ ID NO: 131811 - protein, 20 aa, Mycobacterium avium
RWDALWDKLIAACHPDVRAD

SEQ ID NO: 131812 - protein, 20 aa, Mycobacterium avium
RWDALWDKLIAACHPGVRAD

SEQ ID NO: 131813 - protein, 25 aa, Mycobacterium avium
RWDVDGWVGYYYYSFSQAIGGGTSE

SEQ ID NO: 131814 - protein, 18 aa, Mycobacterium avium
RWEPAGWPSPRATSPSNG

SEQ ID NO: 131815 - protein, 19 aa, Mycobacterium avium
RWETPLLNFIREVTADIDF

SEQ ID NO: 131816 - protein, 18 aa, Mycobacterium avium
RWGAAVPWAAILEPAEWM

SEQ ID NO: 131817 - protein, 22 aa, Mycobacterium avium
RWGYHRYWLAEHHFVAVASSAP

SEQ ID NO: 131818 - protein, 17 aa, Mycobacterium avium
RWHDLRHSGAVLAAATG

SEQ ID NO: 131819 - protein, 20 aa, Mycobacterium avium
RWIEIAAEWGRRDYWAQWRA

SEQ ID NO: 131820 - protein, 20 aa, Mycobacterium avium
RWKLARRSIFVDESVLRMQN

SEQ ID NO: 131821 - protein, 18 aa, Mycobacterium avium
RWLADLRARAYRHSRDGR

SEQ ID NO: 131822 - protein, 19 aa, Mycobacterium avium
RWLDLRYVGPAKDTGEGGG

SEQ ID NO: 131823 - protein, 19 aa, Mycobacterium avium
RWLDLRYVGPAKGTGEGGG

SEQ ID NO: 131824 - protein, 26 aa, Mycobacterium avium
RWPESMRPLVRPLAPARYLPDRHRIA

SEQ ID NO: 131825 - protein, 18 aa, Mycobacterium avium
RWPGFGEVSARELVLDTL

SEQ ID NO: 131826 - protein, 22 aa, Mycobacterium avium
RWPLPAAGTPAQLWLRAVAAGG

SEQ ID NO: 131827 - protein, 23 aa, Mycobacterium avium
RWPTRARRRLLRTPRRPGPVIVP

SEQ ID NO: 131828 - protein, 17 aa, Mycobacterium avium
RWRSIPYARPPVGDLRF

SEQ ID NO: 131829 - protein, 27 aa, Mycobacterium avium
RWSTTSRFLLNVPLFGRQALHPDVDFL

SEQ ID NO: 131830 - protein, 18 aa, Mycobacterium avium
RWVTECLRASYPLGHGHG

SEQ ID NO: 131831 - protein, 18 aa, Mycobacterium avium
RWWDGLVANGFHAVHLPE

SEQ ID NO: 131832 - protein, 17 aa, Mycobacterium avium
RYALVVTSPGLAPTAPL

SEQ ID NO: 131833 - protein, 22 aa, Mycobacterium avium
RYEAWSFPDFETGAAALRVVTQ

SEQ ID NO: 131834 - protein, 21 aa, Mycobacterium avium
RYFLAAKQAEFALGGATGQLR

SEQ ID NO: 131835 - protein, 17 aa, Mycobacterium avium
RYFTVRAGSLVAWNSTG

SEQ ID NO: 131836 - protein, 20 aa, Mycobacterium avium
RYFVPRFAAVPITRDTEQAR

SEQ ID NO: 131837 - protein, 23 aa, Mycobacterium avium
RYGAGPYRYFRAPYPEPIEQLKQ

SEQ ID NO: 131838 - protein, 17 aa, Mycobacterium avium
RYGAYPYAIAVREYVDA

SEQ ID NO: 131839 - protein, 17 aa, Mycobacterium avium
RYGAYPYAIAVREYVDG

SEQ ID NO: 131840 - protein, 23 aa, Mycobacterium avium
RYGCRIVTMYGLTEAFPIAVKAL

SEQ ID NO: 131841 - protein, 24 aa, Mycobacterium avium
RYGDRDHFLLTLTTMDRHAFTPAV

SEQ ID NO: 131842 - protein, 18 aa, Mycobacterium avium
RYGFFNSLFILCEPLSAT

SEQ ID NO: 131843 - protein, 21 aa, Mycobacterium avium
RYGNVFTLRLPMWGPVVMVSD

SEQ ID NO: 131844 - protein, 18 aa, Mycobacterium avium
RYGRLDVLVHNAGNVRRA

SEQ ID NO: 131845 - protein, 20 aa, Mycobacterium avium
RYGYYLHNIHFVIAAAALSG

SEQ ID NO: 131846 - protein, 20 aa, Mycobacterium avium
RYHALNPELFYWAHASFVDQ

SEQ ID NO: 131847 - protein, 24 aa, Mycobacterium avium
RYHALNPELFYWAHASFVDQVIYN

SEQ ID NO: 131848 - protein, 20 aa, Mycobacterium avium
RYHTPFGGFKQSGLGRELGP

SEQ ID NO: 131849 - protein, 20 aa, Mycobacterium avium
RYLGWLSGPISWDHGSDPSD

SEQ ID NO: 131850 - protein, 21 aa, Mycobacterium avium
RYNLMFPMRAVKHWNRWCEGA

SEQ ID NO: 131851 - protein, 19 aa, Mycobacterium avium
RYNPWSAYGESKLANLLFV

SEQ ID NO: 131852 - protein, 19 aa, Mycobacterium avium
RYNQLDPYLPDFVMCRAEL

SEQ ID NO: 131853 - protein, 17 aa, Mycobacterium avium
RYQKLIEIAPAQGLSEE

SEQ ID NO: 131854 - protein, 39 aa, Mycobacterium avium
RYQVGLRRSLIAMRSQRYFRLLDSLDAIAARRPGLPGAE

SEQ ID NO: 131855 - protein, 25 aa, Mycobacterium avium
RYRALVQPSFLPANGKWWIDNWISE

SEQ ID NO: 131856 - protein, 27 aa, Mycobacterium avium
RYRDRGRPFLAFLYGIAAHKVADAHRA

SEQ ID NO: 131857 - protein, 17 aa, Mycobacterium avium
RYRMRWSLHGDGARSKR

SEQ ID NO: 131858 - protein, 26 aa, Mycobacterium avium
RYRVDTWSALPHLRTSGHEPKVDWIL

SEQ ID NO: 131859 - protein, 18 aa, Mycobacterium avium
RYSFAPHPISGAAAKLWE

SEQ ID NO: 131860 - protein, 24 aa, Mycobacterium avium
RYSYQLTIYVFRYGDGTAMAMMYP

SEQ ID NO: 131861 - protein, 21 aa, Mycobacterium avium
RYTDIDPARPTILAIHGFPDN

SEQ ID NO: 131862 - protein, 25 aa, Mycobacterium avium
RYTYHVQLAGFFRWLANEDGAPNIM

SEQ ID NO: 131863 - protein, 18 aa, Mycobacterium avium
RYVFYPRTLSPGTLADDL

SEQ ID NO: 131864 - protein, 19 aa, Mycobacterium avium
RYWREAFRLPSMDLTELGR

SEQ ID NO: 131865 - protein, 21 aa, Mycobacterium avium
RYWREAFRLPSMDLTELGRRL

SEQ ID NO: 131866 - protein, 20 aa, Mycobacterium avium
SAAAAPFIAWATTTAGQAEQ

SEQ ID NO: 131867 - protein, 20 aa, Mycobacterium avium
SAAAGWLTDAGVRPGMTVAW

SEQ ID NO: 131868 - protein, 29 aa, Mycobacterium avium
SAAAREVGSVRLVLGWLPAPIDGLDADAF

SEQ ID NO: 131869 - protein, 17 aa, Mycobacterium avium
SAAFFDRFIERVGPFAR

SEQ ID NO: 131870 - protein, 30 aa, Mycobacterium avium
SAAGLIDNRLLWQLDGRYMQALFGETLNAR

SEQ ID NO: 131871 - protein, 17 aa, Mycobacterium avium
SAAHLLLHGILGALVER

SEQ ID NO: 131872 - protein, 20 aa, Mycobacterium avium
SAANWLALNCRRHMQLYGTR

SEQ ID NO: 131873 - protein, 25 aa, Mycobacterium avium
SAANWLAMPAQRYMHDFGLTREHLG

SEQ ID NO: 131874 - protein, 25 aa, Mycobacterium avium
SAANWLAMPAQRYMHDFGLTREQLG

SEQ ID NO: 131875 - protein, 48 aa, Mycobacterium avium
SAANYFSWIPGCKPTYDRWAEYGGPEWTWQPLLPYLRKSATYHDDHGS

SEQ ID NO: 131876 - protein, 24 aa, Mycobacterium avium
SAAVVDWLEPFIDGLRVCLHGCGV

SEQ ID NO: 131877 - protein, 22 aa, Mycobacterium avium
SAAVVDWLQPFIDELRVCLHGC

SEQ ID NO: 131878 - protein, 23 aa, Mycobacterium avium
SADALMELLWGEEPPRTAAKALQ

SEQ ID NO: 131879 - protein, 22 aa, Mycobacterium avium
SADPVFIKRLLDVGAQNLIVPM

SEQ ID NO: 131880 - protein, 30 aa, Mycobacterium avium
SADYEFDLDWRLSGTPPVAPPLFVHTGSIA

SEQ ID NO: 131881 - protein, 30 aa, Mycobacterium avium
SAEAFVAAHVPYLAWLLQNSTNSTAAAREA

SEQ ID NO: 131882 - protein, 20 aa, Mycobacterium avium
SAECFARYLADPHRAILAAE

SEQ ID NO: 131883 - protein, 25 aa, Mycobacterium avium
SAEHRVFLNLLRARFETDKTKWTKI

SEQ ID NO: 131884 - protein, 24 aa, Mycobacterium avium
SAETLRRVFAEHLGLSPKAYRDRF

SEQ ID NO: 131885 - protein, 19 aa, Mycobacterium avium
SAFARYLADYIHEQGWQTY

SEQ ID NO: 131886 - protein, 24 aa, Mycobacterium avium
SAGAATWLLQPGDIDTRLARLLWQ

SEQ ID NO: 131887 - protein, 23 aa, Mycobacterium avium
SAGQHRMWFVQSVDPDSALLNIC

SEQ ID NO: 131888 - protein, 24 aa, Mycobacterium avium
SAHSRTWSVILRAYDALNRREMPP

SEQ ID NO: 131889 - protein, 23 aa, Mycobacterium avium
SAHSRTWSVILRAYDALNRRETP

SEQ ID NO: 131890 - protein, 24 aa, Mycobacterium avium
SAIATYLVTLYTSLAVLTDDALAV

SEQ ID NO: 131891 - protein, 17 aa, Mycobacterium avium
SAIFIGGGLTRPGLLDA

SEQ ID NO: 131892 - protein, 26 aa, Mycobacterium avium
SAIVRPLLRVFFRSWFRVEVSGIENL

SEQ ID NO: 131893 - protein, 28 aa, Mycobacterium avium
SALALKLINNLLFAANAQLLCAATQLGV

SEQ ID NO: 131894 - protein, 22 aa, Mycobacterium avium
SALMGLSQRVWWVCGETFDVPV

SEQ ID NO: 131895 - protein, 21 aa, Mycobacterium avium
SALPDFPITVYYAFKQSEMTD

SEQ ID NO: 131896 - protein, 24 aa, Mycobacterium avium
SALTYANLTRWLRGTERMHDGAMA

SEQ ID NO: 131897 - protein, 19 aa, Mycobacterium avium
SALVEFGLPGLAVDETLGG

SEQ ID NO: 131898 - protein, 21 aa, Mycobacterium avium
SALVHHYFGTKEKLFAAAVQI

SEQ ID NO: 131899 - protein, 20 aa, Mycobacterium avium
SALWEASLFEEHGFSDIKIS

SEQ ID NO: 131900 - protein, 20 aa, Mycobacterium avium
SALYLAGEGAFPADRVKILS

SEQ ID NO: 131901 - protein, 19 aa, Mycobacterium avium
SALYLAGEGAFPAERVKIL

SEQ ID NO: 131902 - protein, 22 aa, Mycobacterium avium
SAMMKATLPRAFVIGPDGSTTV

SEQ ID NO: 131903 - protein, 24 aa, Mycobacterium avium
SAPAAFRRILALADGWLGSFLTPA

SEQ ID NO: 131904 - protein, 17 aa, Mycobacterium avium
SAPARLVVQSLLGRVQL

SEQ ID NO: 131905 - protein, 21 aa, Mycobacterium avium
SAPAVWLIEGLLQYLDEAAVT

SEQ ID NO: 131906 - protein, 17 aa, Mycobacterium avium
SAPDPTLPPLPLAGVRI

SEQ ID NO: 131907 - protein, 19 aa, Mycobacterium avium
SAPDWHRKEWEPFWAAAED

SEQ ID NO: 131908 - protein, 19 aa, Mycobacterium avium
SAPDWHRKEWEPFWAAAEE

SEQ ID NO: 131909 - protein, 19 aa, Mycobacterium avium
SAPEPMRIPQALVVLVKRE

SEQ ID NO: 131910 - protein, 24 aa, Mycobacterium avium
SAPMCDIFLVLAQAPGGLSCFLLP

SEQ ID NO: 131911 - protein, 18 aa, Mycobacterium avium
SAPRLHLVDLQYSDVRLG

SEQ ID NO: 131912 - protein, 17 aa, Mycobacterium avium
SAQLPRLRAYADRLEKA

SEQ ID NO: 131913 - protein, 30 aa, Mycobacterium avium
SARAKLNWWESRALYGWTVLVPRTKDQAGE

SEQ ID NO: 131914 - protein, 21 aa, Mycobacterium avium
SARKQFMLDDVRPPVVVATVE

SEQ ID NO: 131915 - protein, 22 aa, Mycobacterium avium
SARKQFMLDDVRPPVVVATVEA

SEQ ID NO: 131916 - protein, 28 aa, Mycobacterium avium
SASAALIWRRPRWAKRLQPEPIADLLRE

SEQ ID NO: 131917 - protein, 23 aa, Mycobacterium avium
SASATLRLLFANPVIGDFAAKIA

SEQ ID NO: 131918 - protein, 30 aa, Mycobacterium avium
SASHLAQISRRLPTGTALIALIETAAGVLA

SEQ ID NO: 131919 - protein, 28 aa, Mycobacterium avium
SATEWFARMLFSLFTTPSPYLDMGDDDV

SEQ ID NO: 131920 - protein, 19 aa, Mycobacterium avium
SAVAAVVYGLVLEGRETES

SEQ ID NO: 131921 - protein, 17 aa, Mycobacterium avium
SAVFYQVYPRSFADSDG

SEQ ID NO: 131922 - protein, 24 aa, Mycobacterium avium
SAVLAGLFAVWDDIDALLAGLSET

SEQ ID NO: 131923 - protein, 19 aa, Mycobacterium avium
SAWLAALTGAGLAPADCAA

SEQ ID NO: 131924 - protein, 22 aa, Mycobacterium avium
SAYLILDDADMGMALPGCIGAL

SEQ ID NO: 131925 - protein, 20 aa, Mycobacterium avium
SCATCDGFFFKDQDIAVIGG

SEQ ID NO: 131926 - protein, 19 aa, Mycobacterium avium
SCELACAAVCALLPAGSAA

SEQ ID NO: 131927 - protein, 17 aa, Mycobacterium avium
SCFAARDWDAMARLLTA

SEQ ID NO: 131928 - protein, 18 aa, Mycobacterium avium
SCFWQRIAYLYSRFDDLI

SEQ ID NO: 131929 - protein, 17 aa, Mycobacterium avium
SCPAPVVLYFHGGGFVI

SEQ ID NO: 131930 - protein, 26 aa, Mycobacterium avium
SCTIRNDLLVLLRQLHRRAEVERIVV

SEQ ID NO: 131931 - protein, 25 aa, Mycobacterium avium
SDALPLPLIAGYLDRYGIRADKVRI

SEQ ID NO: 131932 - protein, 23 aa, Mycobacterium avium
SDAWSTLRSIRYPSRRRRRDPSR

SEQ ID NO: 131933 - protein, 20 aa, Mycobacterium avium
SDDPAYRGPGAIIPPTFLTS

SEQ ID NO: 131934 - protein, 27 aa, Mycobacterium avium
SDELQFGLNWFPWILRGVYPPPGNPPQ

SEQ ID NO: 131935 - protein, 25 aa, Mycobacterium avium
SDERLIRLLELRPDLAQLPPGSIAA

SEQ ID NO: 131936 - protein, 24 aa, Mycobacterium avium
SDERLIRLLELRPDLAQPPPGSIA

SEQ ID NO: 131937 - protein, 25 aa, Mycobacterium avium
SDESEDLRWWPVDALPADTDHALAY

SEQ ID NO: 131938 - protein, 25 aa, Mycobacterium avium
SDESEDLRWWPVDALPAGTDHALAY

SEQ ID NO: 131939 - protein, 24 aa, Mycobacterium avium
SDESEDLRWWPVDGLPAGTDHALA

SEQ ID NO: 131940 - protein, 23 aa, Mycobacterium avium
SDEYEWVPLRLPPEVTRVSASTR

SEQ ID NO: 131941 - protein, 27 aa, Mycobacterium avium
SDFKGRKVIVYFYPAALTPGCTKQACD

SEQ ID NO: 131942 - protein, 27 aa, Mycobacterium avium
SDFKGRKVIVYFYPAASTPGCTKQACD

SEQ ID NO: 131943 - protein, 20 aa, Mycobacterium avium
SDFLHGKWLVLRRGKRTIAG

SEQ ID NO: 131944 - protein, 19 aa, Mycobacterium avium
SDFPILKETVNGKPLIWFD

SEQ ID NO: 131945 - protein, 24 aa, Mycobacterium avium
SDGSAIPVVAFRLAKDRGYTEFDV

SEQ ID NO: 131946 - protein, 21 aa, Mycobacterium avium
SDHHLPLHPLDSDDLAALAHY

SEQ ID NO: 131947 - protein, 19 aa, Mycobacterium avium
SDHQLAFVNALCSSLLSTR

SEQ ID NO: 131948 - protein, 30 aa, Mycobacterium avium
SDHSRRLWTVLIFMLWHAIFVEHSVVPQIS

SEQ ID NO: 131949 - protein, 24 aa, Mycobacterium avium
SDHYEGFWALVDYASVFEAARDDD

SEQ ID NO: 131950 - protein, 25 aa, Mycobacterium avium
SDIGYNCHLIFRTDLYRRTTIERLA

SEQ ID NO: 131951 - protein, 17 aa, Mycobacterium avium
SDLAYTLARRRAHRPVR

SEQ ID NO: 131952 - protein, 25 aa, Mycobacterium avium
SDLIAALKTLPAHRPWAATLTTDEA

SEQ ID NO: 131953 - protein, 26 aa, Mycobacterium avium
SDLMRPVLRVPHHPVRLARFGPRALL

SEQ ID NO: 131954 - protein, 25 aa, Mycobacterium avium
SDLSELGDWLVLHEAWRGELPDELG

SEQ ID NO: 131955 - protein, 22 aa, Mycobacterium avium
SDLSLMVKAGVQWGLFGGAVEN

SEQ ID NO: 131956 - protein, 34 aa, Mycobacterium avium
SDMTRTFVLTKAADWQLEIYRLVADAQRAGREAL

SEQ ID NO: 131957 - protein, 22 aa, Mycobacterium avium
SDNLAALLVDRGVGPGTLVGLS

SEQ ID NO: 131958 - protein, 24 aa, Mycobacterium avium
SDPAPWVIGGAQIYLLALPHATRC

SEQ ID NO: 131959 - protein, 17 aa, Mycobacterium avium
SDPWTGCEGWQARYGDQ

SEQ ID NO: 131960 - protein, 23 aa, Mycobacterium avium
SDQVYLDLLTGWRDAWELGRTAR

SEQ ID NO: 131961 - protein, 24 aa, Mycobacterium avium
SDQVYLDLLTGWRDAWELGRTVRD

SEQ ID NO: 131962 - protein, 21 aa, Mycobacterium avium
SDRAEFGWQPGVDSWLAGWDE

SEQ ID NO: 131963 - protein, 22 aa, Mycobacterium avium
SDRHYWATVRAANLVWMLGRPA

SEQ ID NO: 131964 - protein, 23 aa, Mycobacterium avium
SDRHYWATVRAANLVWMLGRPAD

SEQ ID NO: 131965 - protein, 23 aa, Mycobacterium avium
SDRLKPWEVIAARLEAAATADLV

SEQ ID NO: 131966 - protein, 30 aa, Mycobacterium avium
SDRPGFARALWAAPLLTPVMRYAAGRLWRD

SEQ ID NO: 131967 - protein, 28 aa, Mycobacterium avium
SDRPLPWAVMHKLTAPTLLTWGRDDRVS

SEQ ID NO: 131968 - protein, 29 aa, Mycobacterium avium
SDRPLPWAVMHKLTAPTLLTWGRDDRVSP

SEQ ID NO: 131969 - protein, 18 aa, Mycobacterium avium
SDRRAREEWLARAIQERY

SEQ ID NO: 131970 - protein, 23 aa, Mycobacterium avium
SDSRFRGYWDDPVATLATLRDGW

SEQ ID NO: 131971 - protein, 26 aa, Mycobacterium avium
SDTIMRIPALPEHLVIVGSGFVAAEF

SEQ ID NO: 131972 - protein, 22 aa, Mycobacterium avium
SDTYVILLSNSIHLRGSPPISN

SEQ ID NO: 131973 - protein, 18 aa, Mycobacterium avium
SDVQAWVKGLQLAPATVG

SEQ ID NO: 131974 - protein, 25 aa, Mycobacterium avium
SDVRPGVPVLFLDTGYHFAETIGTR

SEQ ID NO: 131975 - protein, 25 aa, Mycobacterium avium
SDVRPGVPVLFLDTGYHFPETIGTR

SEQ ID NO: 131976 - protein, 24 aa, Mycobacterium avium
SDWDTYRCLAALQALLFPDRAADM

SEQ ID NO: 131977 - protein, 25 aa, Mycobacterium avium
SDWSPNFDIWPYNTFTSRVTPEMIS

SEQ ID NO: 131978 - protein, 23 aa, Mycobacterium avium
SEDAYFQMPLVPGLGFAGGETMI

SEQ ID NO: 131979 - protein, 27 aa, Mycobacterium avium
SEDGAFWTAFLRSLKSRGLAGVQLVIS

SEQ ID NO: 131980 - protein, 27 aa, Mycobacterium avium
SEDGAFWTAFLRSLKTRGLSGVQLVIS

SEQ ID NO: 131981 - protein, 29 aa, Mycobacterium avium
SEDSTFYGDLFPHAVRWKGTTYLEDGLHR

SEQ ID NO: 131982 - protein, 27 aa, Mycobacterium avium
SEEILAALWALIGYDIPRPIPRISYAD

SEQ ID NO: 131983 - protein, 26 aa, Mycobacterium avium
SEESYLALLDALRWLGLDWDEGPEVG

SEQ ID NO: 131984 - protein, 25 aa, Mycobacterium avium
SEGGIGWIPFYLDRSDRHYTNQKWL

SEQ ID NO: 131985 - protein, 24 aa, Mycobacterium avium
SEHYEGFWALVDYASVFEAARDDD

SEQ ID NO: 131986 - protein, 28 aa, Mycobacterium avium
SEKAVKALWDTILPFAGYAFNKSHAAGY

SEQ ID NO: 131987 - protein, 18 aa, Mycobacterium avium
SELIENPYPYYEALRQRC

SEQ ID NO: 131988 - protein, 18 aa, Mycobacterium avium
SELQRRLTAAGSPLRALA

SEQ ID NO: 131989 - protein, 19 aa, Mycobacterium avium
SELTPFTAGLFADLAAEAG

SEQ ID NO: 131990 - protein, 30 aa, Mycobacterium avium
SENAEIRVAFWEKLLAAVRRRTLAEWQAVF

SEQ ID NO: 131991 - protein, 18 aa, Mycobacterium avium
SENPLIKDPFAQVFLDAA

SEQ ID NO: 131992 - protein, 19 aa, Mycobacterium avium
SEPLWKVVQAHPSAAVFPG

SEQ ID NO: 131993 - protein, 19 aa, Mycobacterium avium
SERAPGTRVLYVSPLKALA

SEQ ID NO: 131994 - protein, 29 aa, Mycobacterium avium
SEREARLLQTIPLRRLGAPREIAHAICAL

SEQ ID NO: 131995 - protein, 27 aa, Mycobacterium avium
SERFDRLWKGAGVLLPLGSPLPDDTVS

SEQ ID NO: 131996 - protein, 20 aa, Mycobacterium avium
SERIVAAPVTFVDIAGLVKG

SEQ ID NO: 131997 - protein, 28 aa, Mycobacterium avium
SERLSEILAAYALLRDPARRADYDREHR

SEQ ID NO: 131998 - protein, 21 aa, Mycobacterium avium
SERVRHLSGVSPLPITGSSDA

SEQ ID NO: 131999 - protein, 20 aa, Mycobacterium avium
SETLTYLLYMATGQAPMIPL

SEQ ID NO: 132000 - protein, 23 aa, Mycobacterium avium
SETQVIVLFPNNPIARQSVTRYL

SEQ ID NO: 132001 - protein, 35 aa, Mycobacterium avium
SETYGLYSSNPWLYPFGSLYLFGVIDPPVGAQTIK

SEQ ID NO: 132002 - protein, 24 aa, Mycobacterium avium
SEVDELWQWGIGQSARIVAAGLDL

SEQ ID NO: 132003 - protein, 17 aa, Mycobacterium avium
SEVSFPKPVFHGDTLYA

SEQ ID NO: 132004 - protein, 24 aa, Mycobacterium avium
SFANELPAQPLLRIAGFGYNEEAT

SEQ ID NO: 132005 - protein, 24 aa, Mycobacterium avium
SFAQNRLWFIDQSQGPSPLYNMAA

SEQ ID NO: 132006 - protein, 22 aa, Mycobacterium avium
SFDAAGFFRTGDLGRWALADSA

SEQ ID NO: 132007 - protein, 19 aa, Mycobacterium avium
SFDLLSGGRFTLGTGAGYL

SEQ ID NO: 132008 - protein, 24 aa, Mycobacterium avium
SFEQKFPNVLSPRTSLLVLGDGRT

SEQ ID NO: 132009 - protein, 29 aa, Mycobacterium avium
SFESHTMSQIFLLRAVLPAMQAAGWGRFV

SEQ ID NO: 132010 - protein, 19 aa, Mycobacterium avium
SFFTEVPDLTHAGFPLAEV

SEQ ID NO: 132011 - protein, 25 aa, Mycobacterium avium
SFLLDHALVDIGVGVRWLRDVQGVD

SEQ ID NO: 132012 - protein, 19 aa, Mycobacterium avium
SFLQSRGIHLPDGSPDDAE

SEQ ID NO: 132013 - protein, 17 aa, Mycobacterium avium
SFLRQLGWHALARGWDG

SEQ ID NO: 132014 - protein, 23 aa, Mycobacterium avium
SFPAPQTYVAPIAFNVVPLAGSL

SEQ ID NO: 132015 - protein, 21 aa, Mycobacterium avium
SFPYTQFLPEFGQCRAVQIDI

SEQ ID NO: 132016 - protein, 20 aa, Mycobacterium avium
SFRALLLLNDELRKSRVHCC

SEQ ID NO: 132017 - protein, 24 aa, Mycobacterium avium
SFTHLLGYALVQAIKKFPNMNRHY

SEQ ID NO: 132018 - protein, 18 aa, Mycobacterium avium
SFTILGVLTGQAAAWAAE

SEQ ID NO: 132019 - protein, 19 aa, Mycobacterium avium
SFTILGVLTGQAAAWAAER

SEQ ID NO: 132020 - protein, 29 aa, Mycobacterium avium
SFTVPVDRPILAPIYLPDIRVACTPYKGA

SEQ ID NO: 132021 - protein, 28 aa, Mycobacterium avium
SFVDDFVLYWGFLALAPVRSGRHLFGPT

SEQ ID NO: 132022 - protein, 26 aa, Mycobacterium avium
SGAAWLLPRLIGLVRTRQLLMLGREI

SEQ ID NO: 132023 - protein, 25 aa, Mycobacterium avium
SGAGERALLPDALYTEAGAGIGDAW

SEQ ID NO: 132024 - protein, 26 aa, Mycobacterium avium
SGALAWAVYLLLSQPGAWAAAAGDVR

SEQ ID NO: 132025 - protein, 26 aa, Mycobacterium avium
SGALAWAVYLLLSQPGAWATAAGEVR

SEQ ID NO: 132026 - protein, 24 aa, Mycobacterium avium
SGALDGLPLTWASRTEQPGGKTSP

SEQ ID NO: 132027 - protein, 28 aa, Mycobacterium avium
SGAPGTFLRFGRFIRQGWMGSDYLVARR

SEQ ID NO: 132028 - protein, 28 aa, Mycobacterium avium
SGAPVSVYFGGVHLLAAAGAINAGDPVV

SEQ ID NO: 132029 - protein, 18 aa, Mycobacterium avium
SGAVALVGWSLGGAAAAG

SEQ ID NO: 132030 - protein, 17 aa, Mycobacterium avium
SGDFWHTDPALLQSQLD

SEQ ID NO: 132031 - protein, 43 aa, Mycobacterium avium
SGDLDPYNLFLTGGLQPARAWTFFLTASLGFIQRFIHAAVTDP

SEQ ID NO: 132032 - protein, 31 aa, Mycobacterium avium
SGDPLLHGIGGTLIRLYGAGRVRVLPHVSSV

SEQ ID NO: 132033 - protein, 18 aa, Mycobacterium avium
SGEALHDRFFRQAERQPD

SEQ ID NO: 132034 - protein, 20 aa, Mycobacterium avium
SGEGCVMLLLKRLDDARRDG

SEQ ID NO: 132035 - protein, 23 aa, Mycobacterium avium
SGELPIVLMTWAGTGSAMDNTGW

SEQ ID NO: 132036 - protein, 20 aa, Mycobacterium avium
SGEPWPLQDTVRPWDSLNDE

SEQ ID NO: 132037 - protein, 31 aa, Mycobacterium avium
SGEQRLSGFLLWQSAYSEMWFTEAHWPAFRR

SEQ ID NO: 132038 - protein, 32 aa, Mycobacterium avium
SGEQRLSGFLLWQSAYSEMWFTEAHWPAFRRV

SEQ ID NO: 132039 - protein, 28 aa, Mycobacterium avium
SGFNLARVVAVELGFDFLPGTTVNRYCS

SEQ ID NO: 132040 - protein, 27 aa, Mycobacterium avium
SGGFVVPFLHPELKWDFRLPRVVSINV

SEQ ID NO: 132041 - protein, 35 aa, Mycobacterium avium
SGGPLPSGPKPLPMGPFIGGDPRWGTAHFASGGPS

SEQ ID NO: 132042 - protein, 25 aa, Mycobacterium avium
SGGRSLSAVPFDLARLGEWATRITS

SEQ ID NO: 132043 - protein, 27 aa, Mycobacterium avium
SGGSFIYVPPGVHVDIPLQAYFRINTE

SEQ ID NO: 132044 - protein, 34 aa, Mycobacterium avium
SGIEWELYYEPTAPMWELLPMKVSGPDGRLLADM

SEQ ID NO: 132045 - protein, 24 aa, Mycobacterium avium
SGIQLDPAVWPYIGAKAGGLPGDL

SEQ ID NO: 132046 - protein, 28 aa, Mycobacterium avium
SGIVGHRFIYTYANGWRYEMYVKNATTI

SEQ ID NO: 132047 - protein, 23 aa, Mycobacterium avium
SGLDARPYRLSWPAGTTVYEIDQ

SEQ ID NO: 132048 - protein, 25 aa, Mycobacterium avium
SGLDSRAYRLPWPAGTVVYEIDQPR

SEQ ID NO: 132049 - protein, 23 aa, Mycobacterium avium
SGLDTRAYRLTWPAGTVVYEIDQ

SEQ ID NO: 132050 - protein, 19 aa, Mycobacterium avium
SGLMQYAYAGAGIKLPRSS

SEQ ID NO: 132051 - protein, 17 aa, Mycobacterium avium
SGLPSRFPNLKICLSEG

SEQ ID NO: 132052 - protein, 23 aa, Mycobacterium avium
SGLSWPYHALGNYLGCPIIGIQQ

SEQ ID NO: 132053 - protein, 19 aa, Mycobacterium avium
SGMTLERRAYLMRKRAEHE

SEQ ID NO: 132054 - protein, 22 aa, Mycobacterium avium
SGNFLWWGTFWVGKHRRDPDNY

SEQ ID NO: 132055 - protein, 23 aa, Mycobacterium avium
SGNGCWGTFVLADARHAVTLPPE

SEQ ID NO: 132056 - protein, 24 aa, Mycobacterium avium
SGPDRLFELIWSAQPSAAVQPVSL

SEQ ID NO: 132057 - protein, 18 aa, Mycobacterium avium
SGPHLNYAGTFLHSARTP

SEQ ID NO: 132058 - protein, 25 aa, Mycobacterium avium
SGPIKAIPKALELAGRKLEDVALFE

SEQ ID NO: 132059 - protein, 19 aa, Mycobacterium avium
SGPLFIGRDTHGLSEPAWV

SEQ ID NO: 132060 - protein, 23 aa, Mycobacterium avium
SGPRLHANWTWAPSALDDQQIAR

SEQ ID NO: 132061 - protein, 24 aa, Mycobacterium avium
SGQERPFPLDLVPRVISAAEWARL

SEQ ID NO: 132062 - protein, 20 aa, Mycobacterium avium
SGRPVGLRPAGALGAEALRP

SEQ ID NO: 132063 - protein, 25 aa, Mycobacterium avium
SGRSGRLRWRWLAGCDARPVDSAGH

SEQ ID NO: 132064 - protein, 18 aa, Mycobacterium avium
SGRVAYTLGLHGPAVTVD

SEQ ID NO: 132065 - protein, 26 aa, Mycobacterium avium
SGSIVFRLMYNPFRAAYERALGVLAA

SEQ ID NO: 132066 - protein, 26 aa, Mycobacterium avium
SGSLDILLAAYSLAATLWQVANPPER

SEQ ID NO: 132067 - protein, 18 aa, Mycobacterium avium
SGSPLLDLGIDWRTYRDA

SEQ ID NO: 132068 - protein, 23 aa, Mycobacterium avium
SGSPLMLDMRKRPHFLITGTSGA

SEQ ID NO: 132069 - protein, 26 aa, Mycobacterium avium
SGSRFLVFMQRYTPAALFISSPDQGA

SEQ ID NO: 132070 - protein, 25 aa, Mycobacterium avium
SGSRGFHIYARIARRWEFRQVRLAA

SEQ ID NO: 132071 - protein, 24 aa, Mycobacterium avium
SGSVPQRLWAKPAITVIGIDATPV

SEQ ID NO: 132072 - protein, 27 aa, Mycobacterium avium
SGTYIAPRGLFHQWGRPKPTKLIAKVR

SEQ ID NO: 132073 - protein, 17 aa, Mycobacterium avium
SGVDLALTPGFHAIQMP

SEQ ID NO: 132074 - protein, 25 aa, Mycobacterium avium
SGVEVRPDRLLTGKLLRCLRSPAQH

SEQ ID NO: 132075 - protein, 24 aa, Mycobacterium avium
SGVVTFGRYFLGGGGAVHGGAIPL

SEQ ID NO: 132076 - protein, 23 aa, Mycobacterium avium
SGYPLELLVRAAAAGWRVVELDV

SEQ ID NO: 132077 - protein, 18 aa, Mycobacterium avium
SHAIALPPEEKCLRMSGW

SEQ ID NO: 132078 - protein, 23 aa, Mycobacterium avium
SHCGWPSFYDPANSDAVILRPDH

SEQ ID NO: 132079 - protein, 22 aa, Mycobacterium avium
SHDRPLDAAALRDWAHTAVSDL

SEQ ID NO: 132080 - protein, 24 aa, Mycobacterium avium
SHGYRFVGILMNPADRRWTETALR

SEQ ID NO: 132081 - protein, 27 aa, Mycobacterium avium
SHPELVGRYRELYSRRAYLPPSYRDML

SEQ ID NO: 132082 - protein, 32 aa, Mycobacterium avium
SHTLRALTVFPDEKFWLLEDFGHRIGTAVEEF

SEQ ID NO: 132083 - protein, 20 aa, Mycobacterium avium
SIAGFQPVPYMAVYSATKAF

SEQ ID NO: 132084 - protein, 17 aa, Mycobacterium avium
SIALIPDGDDPRREIVP

SEQ ID NO: 132085 - protein, 25 aa, Mycobacterium avium
SIAQVDRPLAVSLPTRQCTIDKVTA

SEQ ID NO: 132086 - protein, 17 aa, Mycobacterium avium
SIAVFQPHLYSRTKAFA

SEQ ID NO: 132087 - protein, 18 aa, Mycobacterium avium
SIDILVLAATFLFDTLDG

SEQ ID NO: 132088 - protein, 23 aa, Mycobacterium avium
SIDKIVYLSQYQAQALFSMRVSP

SEQ ID NO: 132089 - protein, 24 aa, Mycobacterium avium
SIDTIEKYLFGKFGMYIRGTRNLP

SEQ ID NO: 132090 - protein, 29 aa, Mycobacterium avium
SIEDLERIYWAFCTHLGYLVSNNSFGHRM

SEQ ID NO: 132091 - protein, 17 aa, Mycobacterium avium
SIEWMSRNLARRDSIIL

SEQ ID NO: 132092 - protein, 28 aa, Mycobacterium avium
SIFAEELRKIWYRTWVFVGHESEVAQPN

SEQ ID NO: 132093 - protein, 26 aa, Mycobacterium avium
SIFDVALRIWRPRWAKWTAHVVRSGG

SEQ ID NO: 132094 - protein, 22 aa, Mycobacterium avium
SIFSIGYPPWTGGVRQFVTGYP

SEQ ID NO: 132095 - protein, 25 aa, Mycobacterium avium
SIGEIFGTLIMGARLVIPRPDGLRD

SEQ ID NO: 132096 - protein, 21 aa, Mycobacterium avium
SIGQFELFLITAAVAEGWAVS

SEQ ID NO: 132097 - protein, 31 aa, Mycobacterium avium
SIGRDRLFLFMSAERWLFKRDGRWRAYQAQV

SEQ ID NO: 132098 - protein, 21 aa, Mycobacterium avium
SIIANRVSYFYDFRGPSVAVD

SEQ ID NO: 132099 - protein, 18 aa, Mycobacterium avium
SIISLLTTEQWTGGGSAA

SEQ ID NO: 132100 - protein, 18 aa, Mycobacterium avium
SIKHRMASVIFSLEMSKS

SEQ ID NO: 132101 - protein, 20 aa, Mycobacterium avium
SIKNMWGLLTVRGRFTDFTG

SEQ ID NO: 132102 - protein, 21 aa, Mycobacterium avium
SILQRFEVDWGAAGFADAGLD

SEQ ID NO: 132103 - protein, 20 aa, Mycobacterium avium
SIPGLISDVLPLFVSGYSGK

SEQ ID NO: 132104 - protein, 20 aa, Mycobacterium avium
SIPPIPCRCAPAPRPIRCVL

SEQ ID NO: 132105 - protein, 17 aa, Mycobacterium avium
SIPVKRLRQAGVLELLL

SEQ ID NO: 132106 - protein, 20 aa, Mycobacterium avium
SIRATHYALTGPLGEMSVID

SEQ ID NO: 132107 - protein, 23 aa, Mycobacterium avium
SITFTTFIPTMLHRTLAILEDGP

SEQ ID NO: 132108 - protein, 27 aa, Mycobacterium avium
SIWEKWIELSPRYFAFWNKWDPGAISA

SEQ ID NO: 132109 - protein, 24 aa, Mycobacterium avium
SKAALFREALVLPFTDFVDEFGRT

SEQ ID NO: 132110 - protein, 24 aa, Mycobacterium avium
SKATIYRRWPSKSELILAAVIEGT

SEQ ID NO: 132111 - protein, 17 aa, Mycobacterium avium
SKEELFNLRFQMATGQL

SEQ ID NO: 132112 - protein, 24 aa, Mycobacterium avium
SKELLPERLVVVDELPRSSGGKVA

SEQ ID NO: 132113 - protein, 28 aa, Mycobacterium avium
SKELRMIGWRVGWIVGPRAIMADIALVG

SEQ ID NO: 132114 - protein, 30 aa, Mycobacterium avium
SKLRERLGFGELRWAVSGAAPIPKETLAFF

SEQ ID NO: 132115 - protein, 24 aa, Mycobacterium avium
SKNITALLDLLIKDGKLAPDFDDE

SEQ ID NO: 132116 - protein, 19 aa, Mycobacterium avium
SKPPQRGLIAHFTAVADAT

SEQ ID NO: 132117 - protein, 23 aa, Mycobacterium avium
SKPTAWIAEGLFGYLAPEAQDRL

SEQ ID NO: 132118 - protein, 18 aa, Mycobacterium avium
SKPVGRVRVWRPSDGIVE

SEQ ID NO: 132119 - protein, 22 aa, Mycobacterium avium
SKQAPFAPLPGDVTHVPYGDTE

SEQ ID NO: 132120 - protein, 17 aa, Mycobacterium avium
SKTRTWQVGAMRDILLA

SEQ ID NO: 132121 - protein, 23 aa, Mycobacterium avium
SKVHLVGYCMGGLLATEIAKCLE

SEQ ID NO: 132122 - protein, 25 aa, Mycobacterium avium
SLADPLAFLLRKEGFEATVVTDGSA

SEQ ID NO: 132123 - protein, 19 aa, Mycobacterium avium
SLALAEELVALLGAGHEPA

SEQ ID NO: 132124 - protein, 17 aa, Mycobacterium avium
SLAPILSRLTERTNRIS

SEQ ID NO: 132125 - protein, 24 aa, Mycobacterium avium
SLARPIDPAPFAAGPFAPVTSASP

SEQ ID NO: 132126 - protein, 18 aa, Mycobacterium avium
SLAVFFLSEPPEGFDTLR

SEQ ID NO: 132127 - protein, 22 aa, Mycobacterium avium
SLCFAGANLIPLRGAPGDLTAF

SEQ ID NO: 132128 - protein, 31 aa, Mycobacterium avium
SLEAAYNLLHAWLQTPLTFAKWDAKPTGSLR

SEQ ID NO: 132129 - protein, 19 aa, Mycobacterium avium
SLGDELMRRFNGAALEVML

SEQ ID NO: 132130 - protein, 28 aa, Mycobacterium avium
SLGHAAPPRFDPAIWPVTAHPDEEGRLC

SEQ ID NO: 132131 - protein, 17 aa, Mycobacterium avium
SLGHFPQSFEYATIGGF

SEQ ID NO: 132132 - protein, 24 aa, Mycobacterium avium
SLGLLDDFPLYDSVFDPVNRVLLP

SEQ ID NO: 132133 - protein, 19 aa, Mycobacterium avium
SLGLLDDFPPYDSVFDPVN

SEQ ID NO: 132134 - protein, 17 aa, Mycobacterium avium
SLGLSLIEAMLLGMPVV

SEQ ID NO: 132135 - protein, 19 aa, Mycobacterium avium
SLGVELAVRTLFEAPTVAS

SEQ ID NO: 132136 - protein, 22 aa, Mycobacterium avium
SLHAVVAVLRRVTAAPFGNVRV

SEQ ID NO: 132137 - protein, 20 aa, Mycobacterium avium
SLIGAWCFIDHYGPAHTRMD

SEQ ID NO: 132138 - protein, 30 aa, Mycobacterium avium
SLIHEIIGRMLPLVLLEGRAWDVGLENLWL

SEQ ID NO: 132139 - protein, 18 aa, Mycobacterium avium
SLLDFYMCYRAYVRGKVR

SEQ ID NO: 132140 - protein, 28 aa, Mycobacterium avium
SLLRPAIEEAIRWMPTDPMFSRWVMADT

SEQ ID NO: 132141 - protein, 35 aa, Mycobacterium avium
SLLVDTLFDLALTREMLTAMRPITASAPITKAVIT

SEQ ID NO: 132142 - protein, 18 aa, Mycobacterium avium
SLLVEIPGLLAWRIDLRA

SEQ ID NO: 132143 - protein, 21 aa, Mycobacterium avium
SLPHPLDVGAPTSFIPPPAGG

SEQ ID NO: 132144 - protein, 25 aa, Mycobacterium avium
SLPVHFVQMWVIPDEAGIDPSYQQH

SEQ ID NO: 132145 - protein, 22 aa, Mycobacterium avium
SLPYFEQFLRREGMRHATANPA

SEQ ID NO: 132146 - protein, 21 aa, Mycobacterium avium
SLRAFYQHFSSKDELLLGLFD

SEQ ID NO: 132147 - protein, 29 aa, Mycobacterium avium
SLRESMLRLHPYPVLRTYSIYAADPDRGA

SEQ ID NO: 132148 - protein, 24 aa, Mycobacterium avium
SLRQKNPAVTARRKLRMICHGIGR

SEQ ID NO: 132149 - protein, 25 aa, Mycobacterium avium
SLRRTCGEFPGFQQYRGTARQREVA

SEQ ID NO: 132150 - protein, 18 aa, Mycobacterium avium
SLSAMRLIAAVNASLNTD

SEQ ID NO: 132151 - protein, 18 aa, Mycobacterium avium
SLSTGPIMQKRKLFTAGK

SEQ ID NO: 132152 - protein, 29 aa, Mycobacterium avium
SLTDYLESLRRLRGLGRRAVLPGHGPDLI

SEQ ID NO: 132153 - protein, 29 aa, Mycobacterium avium
SLTDYLESLRRLRGLGRRAVLPGHGPDLT

SEQ ID NO: 132154 - protein, 30 aa, Mycobacterium avium
SLTDYLESLRRLRGLGRRAVLPGHGPDLTD

SEQ ID NO: 132155 - protein, 24 aa, Mycobacterium avium
SLTKRLARTVFFGAAPTIGSAHKG

SEQ ID NO: 132156 - protein, 17 aa, Mycobacterium avium
SLTKTWALAGLRVGYAL

SEQ ID NO: 132157 - protein, 19 aa, Mycobacterium avium
SLTLLGALAAWTERVRLLT

SEQ ID NO: 132158 - protein, 27 aa, Mycobacterium avium
SLTTKTVGVALRFLPDSWKAAASRVNS

SEQ ID NO: 132159 - protein, 28 aa, Mycobacterium avium
SLTTKTVGVALRFLPDSWKAAASRVNST

SEQ ID NO: 132160 - protein, 33 aa, Mycobacterium avium
SLTVFQRTPIWCFPKLDVPLPAPARWAMRFPGG

SEQ ID NO: 132161 - protein, 24 aa, Mycobacterium avium
SLVKVHDWIPLEAASLVSCGVTTG

SEQ ID NO: 132162 - protein, 17 aa, Mycobacterium avium
SLWELNVPRRDLRMLAA

SEQ ID NO: 132163 - protein, 18 aa, Mycobacterium avium
SLWELNVPRRDLRMLAAR

SEQ ID NO: 132164 - protein, 20 aa, Mycobacterium avium
SMARAMILSIRHADVRDRLA

SEQ ID NO: 132165 - protein, 22 aa, Mycobacterium avium
SMARAMILSIRHADVRDRLARI

SEQ ID NO: 132166 - protein, 18 aa, Mycobacterium avium
SMCSWFTYSTADANKEHV

SEQ ID NO: 132167 - protein, 25 aa, Mycobacterium avium
SMDPYNWFYELVLERYPGAYEPMDA

SEQ ID NO: 132168 - protein, 21 aa, Mycobacterium avium
SMDSSWRKLLLVCEAVAEPGD

SEQ ID NO: 132169 - protein, 20 aa, Mycobacterium avium
SMEPRWFAWVDDMHDWCVSR

SEQ ID NO: 132170 - protein, 20 aa, Mycobacterium avium
SMEWYGFVLAWHERHGRAPY

SEQ ID NO: 132171 - protein, 25 aa, Mycobacterium avium
SMGEIFGTLIMGARLVIPRPDGLRD

SEQ ID NO: 132172 - protein, 17 aa, Mycobacterium avium
SMIEALDLLLEAKDRST

SEQ ID NO: 132173 - protein, 19 aa, Mycobacterium avium
SMIEALDLLLEAKDRSTKK

SEQ ID NO: 132174 - protein, 23 aa, Mycobacterium avium
SMKTWKPPPRANSLRSSMKNSAA

SEQ ID NO: 132175 - protein, 33 aa, Mycobacterium avium
SMLETQILCLTYYPVTYFEVLGRPWRDTRRPTV

SEQ ID NO: 132176 - protein, 23 aa, Mycobacterium avium
SMLTHLAIAMRAAGRGQLVVFSS

SEQ ID NO: 132177 - protein, 18 aa, Mycobacterium avium
SMLYAFSENYVLPLSHDE

SEQ ID NO: 132178 - protein, 21 aa, Mycobacterium avium
SMRAHFFALASFTRAASMAEH

SEQ ID NO: 132179 - protein, 18 aa, Mycobacterium avium
SMRVRVWTAVPPSRPSRG

SEQ ID NO: 132180 - protein, 27 aa, Mycobacterium avium
SMYPDEKEILFPAGSKFYVVSKTVDPQ

SEQ ID NO: 132181 - protein, 25 aa, Mycobacterium avium
SNAAAAARAWLAASSACAAVVLIHP

SEQ ID NO: 132182 - protein, 20 aa, Mycobacterium avium
SNAMFFPEPRCRVLTGVGAF

SEQ ID NO: 132183 - protein, 19 aa, Mycobacterium avium
SNAMFFPEPRCRVLTGVGT

SEQ ID NO: 132184 - protein, 25 aa, Mycobacterium avium
SNDELRAPMEKATPLRRLGDPVDIA

SEQ ID NO: 132185 - protein, 25 aa, Mycobacterium avium
SNGRLIPLGIIPLWDVELAAKEVER

SEQ ID NO: 132186 - protein, 19 aa, Mycobacterium avium
SNIDAFHRALATAAAEVTG

SEQ ID NO: 132187 - protein, 30 aa, Mycobacterium avium
SNISGQRFAGMLVAGVFLREFIADGVGWAH

SEQ ID NO: 132188 - protein, 17 aa, Mycobacterium avium
SNLKCLCRGHHLLKTFW

SEQ ID NO: 132189 - protein, 22 aa, Mycobacterium avium
SNNGINVFLNFSTATLAGFTET

SEQ ID NO: 132190 - protein, 27 aa, Mycobacterium avium
SNRGPEPAPPAIRAELISGGKNTNAGI

SEQ ID NO: 132191 - protein, 17 aa, Mycobacterium avium
SNRLPDLIGLRQAIYRR

SEQ ID NO: 132192 - protein, 17 aa, Mycobacterium avium
SNVAWYMTKLLNEGWQF

SEQ ID NO: 132193 - protein, 18 aa, Mycobacterium avium
SNVAWYMTKLLNEGWQFD

SEQ ID NO: 132194 - protein, 23 aa, Mycobacterium avium
SNVAWYMTTLLNEGWQFDDDHYH

SEQ ID NO: 132195 - protein, 25 aa, Mycobacterium avium
SPANWDAIMGVNVRGVIWGSRAFGT

SEQ ID NO: 132196 - protein, 24 aa, Mycobacterium avium
SPAQPAGPPPPPPPVSDVINALRA

SEQ ID NO: 132197 - protein, 25 aa, Mycobacterium avium
SPEAGWLTGQILRVNGHTLSRIEGY

SEQ ID NO: 132198 - protein, 21 aa, Mycobacterium avium
SPEDYVQWFPESHPPTAEAPA

SEQ ID NO: 132199 - protein, 19 aa, Mycobacterium avium
SPEHVVNLVTFLSSPAAAE

SEQ ID NO: 132200 - protein, 25 aa, Mycobacterium avium
SPEQVKWWWDSLSDAQQRLLIDQHP

SEQ ID NO: 132201 - protein, 18 aa, Mycobacterium avium
SPGDHVVFSFIPSCGRCP

SEQ ID NO: 132202 - protein, 17 aa, Mycobacterium avium
SPGGATRLLAARDGYCA

SEQ ID NO: 132203 - protein, 22 aa, Mycobacterium avium
SPKRLPESLLHYMRTRGQDKVI

SEQ ID NO: 132204 - protein, 28 aa, Mycobacterium avium
SPKTPLARAALPDLMLSPNDIDTALGVT

SEQ ID NO: 132205 - protein, 17 aa, Mycobacterium avium
SPLPIVAASAQGAWITD

SEQ ID NO: 132206 - protein, 20 aa, Mycobacterium avium
SPNSDFFALGGDSLLLAQTI

SEQ ID NO: 132207 - protein, 22 aa, Mycobacterium avium
SPPAELAWVEPLLEATTTLQVA

SEQ ID NO: 132208 - protein, 26 aa, Mycobacterium avium
SPPRRVALLQAFLVRRMRRNAVWPPA

SEQ ID NO: 132209 - protein, 29 aa, Mycobacterium avium
SPPVLLGKEWLEPTAYMMAKFGMTLCALG

SEQ ID NO: 132210 - protein, 19 aa, Mycobacterium avium
SPPYARWSFQHLEDFVPTA

SEQ ID NO: 132211 - protein, 19 aa, Mycobacterium avium
SPQAALRCAVQLQREGVIS

SEQ ID NO: 132212 - protein, 19 aa, Mycobacterium avium
SPQDLVLSKSSRLGKHSRE

SEQ ID NO: 132213 - protein, 28 aa, Mycobacterium avium
SPQSWSTIPGGPFLSFGQAYAWGQNGQG

SEQ ID NO: 132214 - protein, 21 aa, Mycobacterium avium
SPQVRAWIRFAEDNGGTLPSF

SEQ ID NO: 132215 - protein, 20 aa, Mycobacterium avium
SPQVRAWIRFAQDNGGTLPS

SEQ ID NO: 132216 - protein, 25 aa, Mycobacterium avium
SPREVTFYCLDYGGGKLRALEDLAH

SEQ ID NO: 132217 - protein, 21 aa, Mycobacterium avium
SPRLPGVDASLLLPPVRGAVP

SEQ ID NO: 132218 - protein, 20 aa, Mycobacterium avium
SPRRALSELLRRGTKNMPGA

SEQ ID NO: 132219 - protein, 24 aa, Mycobacterium avium
SPRRAYDVRPIVTAILDDETPFDE

SEQ ID NO: 132220 - protein, 23 aa, Mycobacterium avium
SPRSWSTFGQVLTAVGVLKAYAA

SEQ ID NO: 132221 - protein, 18 aa, Mycobacterium avium
SPTPWRAFPVRPCPTWIR

SEQ ID NO: 132222 - protein, 25 aa, Mycobacterium avium
SPTTRSIELLPKQAKDRLLELSIAM

SEQ ID NO: 132223 - protein, 17 aa, Mycobacterium avium
SPVCAPGRIARRSPGKR

SEQ ID NO: 132224 - protein, 18 aa, Mycobacterium avium
SPVLLFETGLPTRYYIDA

SEQ ID NO: 132225 - protein, 35 aa, Mycobacterium avium
SPVPAILTMKLMGLPYDNWHLYANLFHSVMAVSQD

SEQ ID NO: 132226 - protein, 27 aa, Mycobacterium avium
SPVPGAALFVLDRWLQPVPAGVVGELY

SEQ ID NO: 132227 - protein, 28 aa, Mycobacterium avium
SPYGATIAHGFLTLSLIPGVSKDNYRVE

SEQ ID NO: 132228 - protein, 23 aa, Mycobacterium avium
SQAYPQLRPETIRGLIVHSAQWT

SEQ ID NO: 132229 - protein, 25 aa, Mycobacterium avium
SQEAGFAGTQWQLGLLVKIDGKVHR

SEQ ID NO: 132230 - protein, 21 aa, Mycobacterium avium
SQEMQMLQQMLSSVTGALGGA

SEQ ID NO: 132231 - protein, 17 aa, Mycobacterium avium
SQGLLLQLLDPANRADP

SEQ ID NO: 132232 - protein, 24 aa, Mycobacterium avium
SQHEAIEEQFFWPAVRDAIGDGLV

SEQ ID NO: 132233 - protein, 21 aa, Mycobacterium avium
SQHHLWTAWVDGRPFITLHEL

SEQ ID NO: 132234 - protein, 24 aa, Mycobacterium avium
SQHQADAWAIWDPYTAQAEQQIPV

SEQ ID NO: 132235 - protein, 26 aa, Mycobacterium avium
SQLQIHLVGAFRLASAVLPGMLERQR

SEQ ID NO: 132236 - protein, 26 aa, Mycobacterium avium
SQLQIHLVGAFRLASAVLPGMLKRQR

SEQ ID NO: 132237 - protein, 19 aa, Mycobacterium avium
SQPSYPPELDRFTKLGLVP

SEQ ID NO: 132238 - protein, 22 aa, Mycobacterium avium
SQRAWDIERIALLEAAGWAVIR

SEQ ID NO: 132239 - protein, 18 aa, Mycobacterium avium
SQRLLGTREIILIHHTDC

SEQ ID NO: 132240 - protein, 25 aa, Mycobacterium avium
SQTTERLWAAFLRACDLDPTDPEIH

SEQ ID NO: 132241 - protein, 26 aa, Mycobacterium avium
SRACESLYHFAWDEFCDWYVELAKTQ

SEQ ID NO: 132242 - protein, 20 aa, Mycobacterium avium
SRADWLWRVLGEAGHVALVS

SEQ ID NO: 132243 - protein, 32 aa, Mycobacterium avium
SRALMDTHPFGWLPLLSRVLASAQLLPDAVGG

SEQ ID NO: 132244 - protein, 24 aa, Mycobacterium avium
SRAMALMLQDWLPAFDGGPSGAAT

SEQ ID NO: 132245 - protein, 26 aa, Mycobacterium avium
SRAQSRFAWQRIALDALNIYQSLGVH

SEQ ID NO: 132246 - protein, 24 aa, Mycobacterium avium
SRARYLMLRLLERAGEQRVALPSL

SEQ ID NO: 132247 - protein, 32 aa, Mycobacterium avium
SRASFYIYFEDKGHLLRRLASRVFGELTDGAR

SEQ ID NO: 132248 - protein, 18 aa, Mycobacterium avium
SRATLYQYFKGKDEIFLE

SEQ ID NO: 132249 - protein, 20 aa, Mycobacterium avium
SRCRGRPPDWAPLPVQYADY

SEQ ID NO: 132250 - protein, 29 aa, Mycobacterium avium
SRDALDRALIDLATYFRDALMASSGAGAV

SEQ ID NO: 132251 - protein, 23 aa, Mycobacterium avium
SRDITFQLIQLTAAQRPRNPCPQ

SEQ ID NO: 132252 - protein, 17 aa, Mycobacterium avium
SRDLPRPHPDDPMYLVF

SEQ ID NO: 132253 - protein, 31 aa, Mycobacterium avium
SRDRPTLKAKILPIIAGTLFPNALGEIVGMT

SEQ ID NO: 132254 - protein, 30 aa, Mycobacterium avium
SRFIGLGRGYRWLQLIDAAGLPVHDVPRLS

SEQ ID NO: 132255 - protein, 23 aa, Mycobacterium avium
SRGHPPHLVSLPTNLSGAVSAGS

SEQ ID NO: 132256 - protein, 25 aa, Mycobacterium avium
SRHRLRAQFRAIYPDIYLPAHAARS

SEQ ID NO: 132257 - protein, 26 aa, Mycobacterium avium
SRIAPPELFTTLASRYGAAITALAPS

SEQ ID NO: 132258 - protein, 19 aa, Mycobacterium avium
SRIRRYSLELGGKSAAIVL

SEQ ID NO: 132259 - protein, 31 aa, Mycobacterium avium
SRLASVYYAIALPILRTPWRIDPNGAEDEIV

SEQ ID NO: 132260 - protein, 17 aa, Mycobacterium avium
SRLFQEIRELRGLAYSV

SEQ ID NO: 132261 - protein, 17 aa, Mycobacterium avium
SRLGPEAVRLIAETFAQ

SEQ ID NO: 132262 - protein, 20 aa, Mycobacterium avium
SRLRAVIDLKLLREDPDAVR

SEQ ID NO: 132263 - protein, 24 aa, Mycobacterium avium
SRLRELIIMRIGWLTGCDYEWTQH

SEQ ID NO: 132264 - protein, 25 aa, Mycobacterium avium
SRLRELIIMRIGWLTGCDYEWTQHW

SEQ ID NO: 132265 - protein, 22 aa, Mycobacterium avium
SRLWFLDQLQGPSPMYNMAAAL

SEQ ID NO: 132266 - protein, 28 aa, Mycobacterium avium
SRNPKWWGTRPRLDSITYLVLDDAARLP

SEQ ID NO: 132267 - protein, 23 aa, Mycobacterium avium
SRNPVIKVDDLAWLEFQKPDLVR

SEQ ID NO: 132268 - protein, 25 aa, Mycobacterium avium
SRPDLWSPLEYACHLRDVLLVQRER

SEQ ID NO: 132269 - protein, 22 aa, Mycobacterium avium
SRPVIPFFVNAIGVPLGPMHRC

SEQ ID NO: 132270 - protein, 20 aa, Mycobacterium avium
SRRGGWCRCIQIVGALDAAA

SEQ ID NO: 132271 - protein, 17 aa, Mycobacterium avium
SRRPTTPTCCWTRAARS

SEQ ID NO: 132272 - protein, 18 aa, Mycobacterium avium
SRSDLLAALPERLHDRAV

SEQ ID NO: 132273 - protein, 29 aa, Mycobacterium avium
SRSRRRARLLALRLRRLYYRHRRPAAGSA

SEQ ID NO: 132274 - protein, 23 aa, Mycobacterium avium
SRTFGRGPRPLLVSVRSGAALSM

SEQ ID NO: 132275 - protein, 20 aa, Mycobacterium avium
SRTVRRCPPWPPRPSLCCSG

SEQ ID NO: 132276 - protein, 23 aa, Mycobacterium avium
SSAAVELALASYPGFHVTAPPAD

SEQ ID NO: 132277 - protein, 23 aa, Mycobacterium avium
SSAERLIILARETGRWADPVIRN

SEQ ID NO: 132278 - protein, 26 aa, Mycobacterium avium
SSAIFDPDPCLFIETIRLQGKKGRVP

SEQ ID NO: 132279 - protein, 28 aa, Mycobacterium avium
SSATMAALANFFRIKPAYFTDDEYYEKL

SEQ ID NO: 132280 - protein, 18 aa, Mycobacterium avium
SSDVVAWLQSPEAGWLTG

SEQ ID NO: 132281 - protein, 17 aa, Mycobacterium avium
SSEGFPADMPFLIWGYG

SEQ ID NO: 132282 - protein, 20 aa, Mycobacterium avium
SSEIASFFILLVVAGNETTR

SEQ ID NO: 132283 - protein, 26 aa, Mycobacterium avium
SSFLLDHALVDIGVGVRWLREVQGVD

SEQ ID NO: 132284 - protein, 27 aa, Mycobacterium avium
SSGSIVFRLMYNPFRAAYERALGVLAA

SEQ ID NO: 132285 - protein, 27 aa, Mycobacterium avium
SSGSIVFRLMYNPFRAAYERAVGVLAA

SEQ ID NO: 132286 - protein, 26 aa, Mycobacterium avium
SSKNESRWQFGVLGPPGAADAGIGED

SEQ ID NO: 132287 - protein, 20 aa, Mycobacterium avium
SSLFTIAGAALLRGAAANVL

SEQ ID NO: 132288 - protein, 20 aa, Mycobacterium avium
SSLSFKLYTAERTAGALNLF

SEQ ID NO: 132289 - protein, 21 aa, Mycobacterium avium
SSLVRELRGLWGDAVTAHRYS

SEQ ID NO: 132290 - protein, 22 aa, Mycobacterium avium
SSMIEALDLLLEAKDRSTKKEV

SEQ ID NO: 132291 - protein, 21 aa, Mycobacterium avium
SSPEAIYRSLVRRSERLERKK

SEQ ID NO: 132292 - protein, 18 aa, Mycobacterium avium
SSPGPPAWTCGCAPRSSC

SEQ ID NO: 132293 - protein, 22 aa, Mycobacterium avium
SSPLVITGYGIILVLLGDHAGS

SEQ ID NO: 132294 - protein, 22 aa, Mycobacterium avium
SSPVRYIIFTQGHVDHVGGLDS

SEQ ID NO: 132295 - protein, 18 aa, Mycobacterium avium
SSRSRFPMRRGRLACRGL

SEQ ID NO: 132296 - protein, 30 aa, Mycobacterium avium
SSSKQRSRLALWARRLLGEAITQAQYLLAG

SEQ ID NO: 132297 - protein, 22 aa, Mycobacterium avium
SSSPLVITGYGIVLVLLGDHAG

SEQ ID NO: 132298 - protein, 23 aa, Mycobacterium avium
SSSPLVITGYGIVLVLLGDHAGS

SEQ ID NO: 132299 - protein, 26 aa, Mycobacterium avium
SSSVWKLFYRVKSSVLLYVGALGVPQ

SEQ ID NO: 132300 - protein, 18 aa, Mycobacterium avium
SSTNFWESSWLRHQIARN

SEQ ID NO: 132301 - protein, 17 aa, Mycobacterium avium
SSTYKAYALVRQLTRFQ

SEQ ID NO: 132302 - protein, 41 aa, Mycobacterium avium
SSVPPVPGKFYWMTPTQLRWRPLSFWPAHTAVTVDAGGTVT

SEQ ID NO: 132303 - protein, 24 aa, Mycobacterium avium
SSYQRGAPVDFPLGGVVPGFQKAI

SEQ ID NO: 132304 - protein, 25 aa, Mycobacterium avium
SSYQRGAPVDFPLGGVVPGFQKAIA

SEQ ID NO: 132305 - protein, 28 aa, Mycobacterium avium
STAAPLDRRLLLGMLSDLPPGAGVDATS

SEQ ID NO: 132306 - protein, 24 aa, Mycobacterium avium
STALHRRLVELSGNATLTVIVGML

SEQ ID NO: 132307 - protein, 25 aa, Mycobacterium avium
STAQVDRPLAVSLPTRQCTIDKVTA

SEQ ID NO: 132308 - protein, 18 aa, Mycobacterium avium
STCVRVGTALLGRRPLPS

SEQ ID NO: 132309 - protein, 21 aa, Mycobacterium avium
STDELLRLYTPTLGLARTVSR

SEQ ID NO: 132310 - protein, 21 aa, Mycobacterium avium
STDGITYLLIPMDSPGITVRP

SEQ ID NO: 132311 - protein, 24 aa, Mycobacterium avium
STEYDVERYFRDAPLMIVGEGTNE

SEQ ID NO: 132312 - protein, 23 aa, Mycobacterium avium
STILFVHGVYVTGAVWNDVVAEL

SEQ ID NO: 132313 - protein, 17 aa, Mycobacterium avium
STITPFVAHWTERGVVP

SEQ ID NO: 132314 - protein, 20 aa, Mycobacterium avium
STIYRRFPTKKNLFGQVVRR

SEQ ID NO: 132315 - protein, 22 aa, Mycobacterium avium
STPLGLLDCDVPIDGSIAVVVS

SEQ ID NO: 132316 - protein, 17 aa, Mycobacterium avium
STPLTCSNWYRRRPQEP

SEQ ID NO: 132317 - protein, 33 aa, Mycobacterium avium
STQILGVLIRQMGELLLQPMVDAVWDRVAKPTD

SEQ ID NO: 132318 - protein, 37 aa, Mycobacterium avium
STRRDWVRRTLLAAPPPWIDVFIARNFHYLTELHCPA

SEQ ID NO: 132319 - protein, 17 aa, Mycobacterium avium
STRRWHWLDPQTRDALF

SEQ ID NO: 132320 - protein, 20 aa, Mycobacterium avium
STTVAMHLLRHLLRRLLTDA

SEQ ID NO: 132321 - protein, 18 aa, Mycobacterium avium
STVLGYVPTFPFTQNFID

SEQ ID NO: 132322 - protein, 26 aa, Mycobacterium avium
STYFTEQVFPVLTPLAVDPAHPFPFV

SEQ ID NO: 132323 - protein, 34 aa, Mycobacterium avium
STYKAYALVRQLTRFQPRCRLYVAAVGRAQRTLA

SEQ ID NO: 132324 - protein, 19 aa, Mycobacterium avium
SVAAWLWSGRRGVLAGLAA

SEQ ID NO: 132325 - protein, 20 aa, Mycobacterium avium
SVADWLWAGLCLPVVRAAGL

SEQ ID NO: 132326 - protein, 19 aa, Mycobacterium avium
SVAGLVGWGGSVYGATKGG

SEQ ID NO: 132327 - protein, 23 aa, Mycobacterium avium
SVAMGHSYLRYAMAMRERLPQVG

SEQ ID NO: 132328 - protein, 22 aa, Mycobacterium avium
SVAPVPVYATLVLGADTIARHG

SEQ ID NO: 132329 - protein, 24 aa, Mycobacterium avium
SVDGIFYLTHREDVLAALRDPELF

SEQ ID NO: 132330 - protein, 29 aa, Mycobacterium avium
SVDKIMLGSLPDIGFPGDIGLHGPHHYNV

SEQ ID NO: 132331 - protein, 30 aa, Mycobacterium avium
SVEKALSVLPTWIEPQGDPVWCPLPGTKID

SEQ ID NO: 132332 - protein, 34 aa, Mycobacterium avium
SVFTSPVAFLQRPARWMQLLANNSRVFSAAPNFA

SEQ ID NO: 132333 - protein, 24 aa, Mycobacterium avium
SVGAAVVKLRLAIEALVQLASHVT

SEQ ID NO: 132334 - protein, 19 aa, Mycobacterium avium
SVGPTLSKFFTALRERRVL

SEQ ID NO: 132335 - protein, 20 aa, Mycobacterium avium
SVGPTLSKFFTALRERRVLG

SEQ ID NO: 132336 - protein, 23 aa, Mycobacterium avium
SVGQHRMWFVQSVDPDSALLNIC

SEQ ID NO: 132337 - protein, 33 aa, Mycobacterium avium
SVGVISRQVWYQVFAWRPGLIVDLLEAAERCGV

SEQ ID NO: 132338 - protein, 30 aa, Mycobacterium avium
SVHDLAAGLFRAAPWPGVAPLTLFGYSMGG

SEQ ID NO: 132339 - protein, 19 aa, Mycobacterium avium
SVIGLRRRLYDDTENYRMI

SEQ ID NO: 132340 - protein, 25 aa, Mycobacterium avium
SVIWAFKQLWDKGLAYEGYRVLPYC

SEQ ID NO: 132341 - protein, 19 aa, Mycobacterium avium
SVMQDQLPFFADLEASQRA

SEQ ID NO: 132342 - protein, 20 aa, Mycobacterium avium
SVPALMRGYLRLGAQVCGEP

SEQ ID NO: 132343 - protein, 26 aa, Mycobacterium avium
SVPDTLWPAVVFTLVALLDDPVAAGL

SEQ ID NO: 132344 - protein, 17 aa, Mycobacterium avium
SVPIAVNSLWPATTIAS

SEQ ID NO: 132345 - protein, 29 aa, Mycobacterium avium
SVPLRRFIRPRVEVELAFVLGDELRGPGV

SEQ ID NO: 132346 - protein, 19 aa, Mycobacterium avium
SVPPLPGTLEAFIRLIETG

SEQ ID NO: 132347 - protein, 26 aa, Mycobacterium avium
SVQMFGLTLPSPVFMAPIGVIGICAQ

SEQ ID NO: 132348 - protein, 24 aa, Mycobacterium avium
SVQVLCEHPHQWELLRQRPELAMR

SEQ ID NO: 132349 - protein, 24 aa, Mycobacterium avium
SVRGPVHLTVLPRFPEPGSSVEKG

SEQ ID NO: 132350 - protein, 20 aa, Mycobacterium avium
SVRGVFTYKVDEAGLITNMR

SEQ ID NO: 132351 - protein, 23 aa, Mycobacterium avium
SVRGWAVGFGCNLALAADFTVAA

SEQ ID NO: 132352 - protein, 24 aa, Mycobacterium avium
SVRLLGIQNALMQVLLTGNRFKPA

SEQ ID NO: 132353 - protein, 36 aa, Mycobacterium avium
SVSHMPQWARRWQRLLFDNGWLLPSQPPEYGGRNAT

SEQ ID NO: 132354 - protein, 37 aa, Mycobacterium avium
SVSHMPQWARRWQRLLFDNGWLLPSQPPEYGGRNATV

SEQ ID NO: 132355 - protein, 26 aa, Mycobacterium avium
SVSPINIAGWHRFPLRDKVAAVVPAT

SEQ ID NO: 132356 - protein, 28 aa, Mycobacterium avium
SVSTIMQPGMTFTIEPMINLGGLDYEIW

SEQ ID NO: 132357 - protein, 17 aa, Mycobacterium avium
SVTARRVGCWRFVTLHR

SEQ ID NO: 132358 - protein, 31 aa, Mycobacterium avium
SVTLTQLVGLRQALRILLTNPTLGAEEAAAI

SEQ ID NO: 132359 - protein, 26 aa, Mycobacterium avium
SVVDVSLLGLAAWNLSPDVAVSQIHG

SEQ ID NO: 132360 - protein, 19 aa, Mycobacterium avium
SVVFRPAFEFIEQQWRELG

SEQ ID NO: 132361 - protein, 21 aa, Mycobacterium avium
SVVLAELIALAAHHLRDVPPR

SEQ ID NO: 132362 - protein, 19 aa, Mycobacterium avium
SVVPLIVNLNTFGANDFDT

SEQ ID NO: 132363 - protein, 25 aa, Mycobacterium avium
SVVPRSWSGFFRPGPAVVVSPDNFG

SEQ ID NO: 132364 - protein, 25 aa, Mycobacterium avium
SVVQWLHTATLFLLAPSWRYRPHAD

SEQ ID NO: 132365 - protein, 18 aa, Mycobacterium avium
SVWACPRCSAVIANTRAA

SEQ ID NO: 132366 - protein, 24 aa, Mycobacterium avium
SWAQLIEPGLNPLAIRYGQITDIF

SEQ ID NO: 132367 - protein, 27 aa, Mycobacterium avium
SWFTSVIPHVMVPGLAAALRATTARRA

SEQ ID NO: 132368 - protein, 27 aa, Mycobacterium avium
SWFTSVIPHVMVPGLAAALWATTARRA

SEQ ID NO: 132369 - protein, 18 aa, Mycobacterium avium
SWGSYTKVLLTPGEEPTA

SEQ ID NO: 132370 - protein, 18 aa, Mycobacterium avium
SWHILMKGAIVLAAVGDL

SEQ ID NO: 132371 - protein, 25 aa, Mycobacterium avium
SWLEVPLAMRDGLGLRLELKLHDPR

SEQ ID NO: 132372 - protein, 21 aa, Mycobacterium avium
SWLPEAPSVADLGWSDAPAPD

SEQ ID NO: 132373 - protein, 24 aa, Mycobacterium avium
SWQGDLYAYLVRWRDPGIVVEFGS

SEQ ID NO: 132374 - protein, 20 aa, Mycobacterium avium
SWQLEKALPVPVFVQSMAQV

SEQ ID NO: 132375 - protein, 17 aa, Mycobacterium avium
SWRALADVLLSSAVPAA

SEQ ID NO: 132376 - protein, 27 aa, Mycobacterium avium
SWTVDLTTVYAALLLTALAAADTPVRY

SEQ ID NO: 132377 - protein, 28 aa, Mycobacterium avium
SWVILAGPYAYKLKKPVNLGFLDFTSIE

SEQ ID NO: 132378 - protein, 19 aa, Mycobacterium avium
SYALYPHMTVRQNIAFPLT

SEQ ID NO: 132379 - protein, 17 aa, Mycobacterium avium
SYFVLAPRDGGAVRVVE

SEQ ID NO: 132380 - protein, 18 aa, Mycobacterium avium
SYLAGMLTGLRSDAGRRA

SEQ ID NO: 132381 - protein, 20 aa, Mycobacterium avium
SYLPFEGHYELRRAAATHVS

SEQ ID NO: 132382 - protein, 30 aa, Mycobacterium avium
SYLTIGRHPVLLPPTLARLIEQLIARGPVN

SEQ ID NO: 132383 - protein, 28 aa, Mycobacterium avium
SYRGSKNVLLVFFPLAFTGICQGELDQL

SEQ ID NO: 132384 - protein, 17 aa, Mycobacterium avium
SYWTLYTRAACDKDTLR

SEQ ID NO: 132385 - protein, 18 aa, Mycobacterium avium
TAAAAWDALAAELQSAAS

SEQ ID NO: 132386 - protein, 25 aa, Mycobacterium avium
TAAGLDSLIWQCPVVLLGEVRSVGV

SEQ ID NO: 132387 - protein, 25 aa, Mycobacterium avium
TAAIASTLLRLRRPRRHRAVLRAAD

SEQ ID NO: 132388 - protein, 21 aa, Mycobacterium avium
TAALDFLPHALAAAAGRPVFL

SEQ ID NO: 132389 - protein, 23 aa, Mycobacterium avium
TAAPELRLTALQAPAAAAAPPGR

SEQ ID NO: 132390 - protein, 17 aa, Mycobacterium avium
TAAPVPGLGFRNPLPPQ

SEQ ID NO: 132391 - protein, 20 aa, Mycobacterium avium
TAARAARLKWWTTDLQVRTA

SEQ ID NO: 132392 - protein, 23 aa, Mycobacterium avium
TAARRDLLALQQEWRRAADVEAD

SEQ ID NO: 132393 - protein, 23 aa, Mycobacterium avium
TAARRELLALQQEWRRAADVEAD

SEQ ID NO: 132394 - protein, 22 aa, Mycobacterium avium
TAARVIVRLVAEHRWRVGVVAQ

SEQ ID NO: 132395 - protein, 27 aa, Mycobacterium avium
TAASARWRPWRSYATQYLWTTLEHPVN

SEQ ID NO: 132396 - protein, 19 aa, Mycobacterium avium
TAATAFEWGLISYVVDDDA

SEQ ID NO: 132397 - protein, 25 aa, Mycobacterium avium
TACLDAGVRVGCFRPPTVPAGTSRL

SEQ ID NO: 132398 - protein, 23 aa, Mycobacterium avium
TADAELVVPAPPAELRPVHTHRG

SEQ ID NO: 132399 - protein, 27 aa, Mycobacterium avium
TADATPLFVMLLAESWQWGADEAVIRS

SEQ ID NO: 132400 - protein, 26 aa, Mycobacterium avium
TADDHRTLFLPPYVAHGFQTLVDDTE

SEQ ID NO: 132401 - protein, 17 aa, Mycobacterium avium
TADGWFRTGDLGHLDTD

SEQ ID NO: 132402 - protein, 17 aa, Mycobacterium avium
TADLLDRLHWPTQGAPA

SEQ ID NO: 132403 - protein, 22 aa, Mycobacterium avium
TADLVSLLYQAIPAPARRTGGH

SEQ ID NO: 132404 - protein, 20 aa, Mycobacterium avium
TAELAARIKSLGYGAAWIGG

SEQ ID NO: 132405 - protein, 30 aa, Mycobacterium avium
TAEQEALLRTWFAGLFEAGFAGADWPVEYG

SEQ ID NO: 132406 - protein, 24 aa, Mycobacterium avium
TAEQMKMFLTRLGFGSKIVVTGDI

SEQ ID NO: 132407 - protein, 25 aa, Mycobacterium avium
TAEQMKMFLTRLGFGSKIVVTGDIT

SEQ ID NO: 132408 - protein, 17 aa, Mycobacterium avium
TAFLLSDEAEWINGQVW

SEQ ID NO: 132409 - protein, 18 aa, Mycobacterium avium
TAFLLSDEAEWINGQVWY

SEQ ID NO: 132410 - protein, 18 aa, Mycobacterium avium
TAFTPLNYRLSPEGLREL

SEQ ID NO: 132411 - protein, 27 aa, Mycobacterium avium
TAGAHADAYLWIKRPGESDGSCGKGDP

SEQ ID NO: 132412 - protein, 25 aa, Mycobacterium avium
TAGDVLLPIGYDASSPIPAADYVAA

SEQ ID NO: 132413 - protein, 18 aa, Mycobacterium avium
TAGIFRGRTCAVAGHRCL

SEQ ID NO: 132414 - protein, 26 aa, Mycobacterium avium
TAGMLEPLRMYAHIPRLLNAHGRLEQ

SEQ ID NO: 132415 - protein, 26 aa, Mycobacterium avium
TAGMLEPLRMYAHIPRLLNAYGRLEQ

SEQ ID NO: 132416 - protein, 19 aa, Mycobacterium avium
TAGQLIWNNLKQSEDLLKV

SEQ ID NO: 132417 - protein, 26 aa, Mycobacterium avium
TAGQTRLRIVVLIGIPTVKRNLGDEV

SEQ ID NO: 132418 - protein, 22 aa, Mycobacterium avium
TAGSFAMSLYDGGHFYLYDHVE

SEQ ID NO: 132419 - protein, 21 aa, Mycobacterium avium
TAGYLAIGLAIAAGAPVCVAM

SEQ ID NO: 132420 - protein, 23 aa, Mycobacterium avium
TAHATAWYGLHDLARVKAGDKVL

SEQ ID NO: 132421 - protein, 20 aa, Mycobacterium avium
TAHGFIAYDGAIRQGDVYIE

SEQ ID NO: 132422 - protein, 23 aa, Mycobacterium avium
TAIAALWPPMPDTAPPRRAPEPH

SEQ ID NO: 132423 - protein, 19 aa, Mycobacterium avium
TAIFALRRDSWSDTEARPP

SEQ ID NO: 132424 - protein, 23 aa, Mycobacterium avium
TAKPYSVVILKRGPGFGHESAAG

SEQ ID NO: 132425 - protein, 22 aa, Mycobacterium avium
TAKYPVALRLGGLSWGQVVGGD

SEQ ID NO: 132426 - protein, 23 aa, Mycobacterium avium
TALAQRLPVYMVPTAVVALDAIP

SEQ ID NO: 132427 - protein, 18 aa, Mycobacterium avium
TALAVPRPAPAEGGPAPA

SEQ ID NO: 132428 - protein, 18 aa, Mycobacterium avium
TALFLAAQAIRGGLVDCA

SEQ ID NO: 132429 - protein, 23 aa, Mycobacterium avium
TALFRLLELVDDGVGPPAGVLGG

SEQ ID NO: 132430 - protein, 23 aa, Mycobacterium avium
TALGTGFFLTWLTTYTDQNGEVL

SEQ ID NO: 132431 - protein, 32 aa, Mycobacterium avium
TALHTTARLRLVPLRWALACLLIDIGSVEFSS

SEQ ID NO: 132432 - protein, 26 aa, Mycobacterium avium
TALIDPNFELPLRPLARVAHVDFEEP

SEQ ID NO: 132433 - protein, 29 aa, Mycobacterium avium
TALQRYLDKLAGWYDWCRDNLVVGADTLA

SEQ ID NO: 132434 - protein, 25 aa, Mycobacterium avium
TALRRAVAEQAIVPRGLMSHMVYAD

SEQ ID NO: 132435 - protein, 31 aa, Mycobacterium avium
TALTERLPAYLVPAAVLVLDALPLTPSGKLD

SEQ ID NO: 132436 - protein, 19 aa, Mycobacterium avium
TALVPALAKLWAQACEWEP

SEQ ID NO: 132437 - protein, 17 aa, Mycobacterium avium
TALYATTMALFHRERTG

SEQ ID NO: 132438 - protein, 22 aa, Mycobacterium avium
TAMSLAPLAYTLFQRVMRHDPS

SEQ ID NO: 132439 - protein, 18 aa, Mycobacterium avium
TAPADLVLAVNSLAVRHL

SEQ ID NO: 132440 - protein, 23 aa, Mycobacterium avium
TAPAELPSFRRGITGRRHRHWSL

SEQ ID NO: 132441 - protein, 28 aa, Mycobacterium avium
TAPNPMFLAWVISEDLKRLWPSLGTALM

SEQ ID NO: 132442 - protein, 24 aa, Mycobacterium avium
TAPRLLLEVVCARLLLPSASDTEA

SEQ ID NO: 132443 - protein, 24 aa, Mycobacterium avium
TAPRLLLEVVCARLLLPSASDTES

SEQ ID NO: 132444 - protein, 24 aa, Mycobacterium avium
TAPRLLLEVVCARLLLPSASDTET

SEQ ID NO: 132445 - protein, 43 aa, Mycobacterium avium
TAQEILNKWWDPATGTWDWPKVEGFADGIYKTARSIPKDAWLD

SEQ ID NO: 132446 - protein, 20 aa, Mycobacterium avium
TAQVAVYRKALQAADIDATT

SEQ ID NO: 132447 - protein, 24 aa, Mycobacterium avium
TAQVDRPLAVSLPTRQCTIDKVTA

SEQ ID NO: 132448 - protein, 17 aa, Mycobacterium avium
TARDKDAWLTVFADDAV

SEQ ID NO: 132449 - protein, 17 aa, Mycobacterium avium
TARDKEAWLAVFADDAV

SEQ ID NO: 132450 - protein, 17 aa, Mycobacterium avium
TARFERDAIPLLDQLYG

SEQ ID NO: 132451 - protein, 21 aa, Mycobacterium avium
TARGKLLHRLGEIIAREADQL

SEQ ID NO: 132452 - protein, 24 aa, Mycobacterium avium
TARIREHSVWWPVAATPEDMAAAM

SEQ ID NO: 132453 - protein, 23 aa, Mycobacterium avium
TARQPLIAAGMAGLLAGALLECY

SEQ ID NO: 132454 - protein, 19 aa, Mycobacterium avium
TARVRGLAAVQERIGYWGE

SEQ ID NO: 132455 - protein, 23 aa, Mycobacterium avium
TASALTWMVERACQQNLPAQLPA

SEQ ID NO: 132456 - protein, 23 aa, Mycobacterium avium
TASALTWMVERACQQNLPAQPPA

SEQ ID NO: 132457 - protein, 23 aa, Mycobacterium avium
TASALTWMVERACQQNLPAQPSA

SEQ ID NO: 132458 - protein, 29 aa, Mycobacterium avium
TASGFMVPPQWFAMWARRHQHEFGSTCED

SEQ ID NO: 132459 - protein, 28 aa, Mycobacterium avium
TASGFMVPPQWFAMWARRHQHEYGSTSE

SEQ ID NO: 132460 - protein, 22 aa, Mycobacterium avium
TASIFLPSVPNLLQLASELEAQ

SEQ ID NO: 132461 - protein, 20 aa, Mycobacterium avium
TASRFVACPFGAPGARMYRT

SEQ ID NO: 132462 - protein, 30 aa, Mycobacterium avium
TATAGEVYFFPAGHILIYRERTKALELNPA

SEQ ID NO: 132463 - protein, 17 aa, Mycobacterium avium
TATLRVFISERGKIRSR

SEQ ID NO: 132464 - protein, 25 aa, Mycobacterium avium
TATPLDDVFVALKPPPGDHDAPLLK

SEQ ID NO: 132465 - protein, 22 aa, Mycobacterium avium
TATQLRATVTFPGGTTAAGLRE

SEQ ID NO: 132466 - protein, 25 aa, Mycobacterium avium
TATWVRFYDFGAGRLPRFLADLTEG

SEQ ID NO: 132467 - protein, 17 aa, Mycobacterium avium
TATYLAPALDKLGVSAL

SEQ ID NO: 132468 - protein, 18 aa, Mycobacterium avium
TAVGGTPPFITAARGCRL

SEQ ID NO: 132469 - protein, 25 aa, Mycobacterium avium
TAVGVDAWPWVLTGGEDHALVACFP

SEQ ID NO: 132470 - protein, 19 aa, Mycobacterium avium
TAVLIETLVALGAEVRWAS

SEQ ID NO: 132471 - protein, 18 aa, Mycobacterium avium
TAWALPLLGRMWKGYARR

SEQ ID NO: 132472 - protein, 18 aa, Mycobacterium avium
TAWALPLLGRMWQGYARR

SEQ ID NO: 132473 - protein, 27 aa, Mycobacterium avium
TAWRDGQWYTARLRPGPLRPADRRTTV

SEQ ID NO: 132474 - protein, 18 aa, Mycobacterium avium
TAYDLGRRPGLVAAVIAI

SEQ ID NO: 132475 - protein, 18 aa, Mycobacterium avium
TAYLEKFSNHVRAMVLDG

SEQ ID NO: 132476 - protein, 22 aa, Mycobacterium avium
TCAPTYFAVVLAAAPESAGIDL

SEQ ID NO: 132477 - protein, 31 aa, Mycobacterium avium
TCGADPGEILRILRWALLTDEEFSQPGRWAN

SEQ ID NO: 132478 - protein, 17 aa, Mycobacterium avium
TCKYHAWRYSLDGDLTL

SEQ ID NO: 132479 - protein, 23 aa, Mycobacterium avium
TCPELGLRPLLPRLDTPERALRH

SEQ ID NO: 132480 - protein, 33 aa, Mycobacterium avium
TCPNPACGIAMPLVRSWWLGKKKGKEAYVVPSV

SEQ ID NO: 132481 - protein, 17 aa, Mycobacterium avium
TCRFPGCSRPAVICDLD

SEQ ID NO: 132482 - protein, 27 aa, Mycobacterium avium
TCRSHESAWPAAVLVAATMLSVTACGH

SEQ ID NO: 132483 - protein, 17 aa, Mycobacterium avium
TCSNWYRRRPQEPPNAN

SEQ ID NO: 132484 - protein, 26 aa, Mycobacterium avium
TDAAARVLLLWGRRPADPSRIRSRVG

SEQ ID NO: 132485 - protein, 31 aa, Mycobacterium avium
TDDDTLDYFLNLMLRAPFRLAREVLPHLPPG

SEQ ID NO: 132486 - protein, 30 aa, Mycobacterium avium
TDDGLLVPIHWGTFRLAPHPWAEPVERLLA

SEQ ID NO: 132487 - protein, 21 aa, Mycobacterium avium
TDDWLGEWTFSFPQGSMTDEP

SEQ ID NO: 132488 - protein, 17 aa, Mycobacterium avium
TDEIFGPVLCIVRAQNY

SEQ ID NO: 132489 - protein, 20 aa, Mycobacterium avium
TDELLRLYTPTLGLARTVSR

SEQ ID NO: 132490 - protein, 23 aa, Mycobacterium avium
TDEVALPFAWQGVSLHAAGASAV

SEQ ID NO: 132491 - protein, 19 aa, Mycobacterium avium
TDFRYYIPLAKAAEAAGYH

SEQ ID NO: 132492 - protein, 25 aa, Mycobacterium avium
TDGNPPPILDPFAGGGTIPLEAQRL

SEQ ID NO: 132493 - protein, 27 aa, Mycobacterium avium
TDGRWSCVRWGTLTPPFYPEAAEIPAT

SEQ ID NO: 132494 - protein, 25 aa, Mycobacterium avium
TDGVLRLRIPVAEKAKPRKIAVSRN

SEQ ID NO: 132495 - protein, 22 aa, Mycobacterium avium
TDHCDWIILGAMLGDEQGVPLM

SEQ ID NO: 132496 - protein, 20 aa, Mycobacterium avium
TDHGLPVRTPGARLVPGGAH

SEQ ID NO: 132497 - protein, 22 aa, Mycobacterium avium
TDINHAPYFLSINPEILSVDLD

SEQ ID NO: 132498 - protein, 19 aa, Mycobacterium avium
TDIWAQPIGVGYERAQRTA

SEQ ID NO: 132499 - protein, 23 aa, Mycobacterium avium
TDPLDPHVIVLFGATGDLAKRKL

SEQ ID NO: 132500 - protein, 25 aa, Mycobacterium avium
TDPPAVWMRLVVLGVKFREAYGVDA

SEQ ID NO: 132501 - protein, 17 aa, Mycobacterium avium
TDPTLQFTMSYYLRPDE

SEQ ID NO: 132502 - protein, 19 aa, Mycobacterium avium
TDQRLLVKVPAGWSHTAAA

SEQ ID NO: 132503 - protein, 24 aa, Mycobacterium avium
TDQVLFCGLWYDDEFVRTPGGWRM

SEQ ID NO: 132504 - protein, 17 aa, Mycobacterium avium
TDRANRMRWPHGRLRYY

SEQ ID NO: 132505 - protein, 25 aa, Mycobacterium avium
TDRCGPWIIERAIRDVRRGIDGLPE

SEQ ID NO: 132506 - protein, 20 aa, Mycobacterium avium
TDREFASRPWVFDDDPFGDW

SEQ ID NO: 132507 - protein, 17 aa, Mycobacterium avium
TDRGLWVAALRETGRVI

SEQ ID NO: 132508 - protein, 17 aa, Mycobacterium avium
TDRPVWVRGVGLGMDRV

SEQ ID NO: 132509 - protein, 27 aa, Mycobacterium avium
TDRRGKYLWLLLDGCDTALVVHLGMSG

SEQ ID NO: 132510 - protein, 20 aa, Mycobacterium avium
TDRRGLFTALATQGFELLTR

SEQ ID NO: 132511 - protein, 24 aa, Mycobacterium avium
TDRSGRVLTFAFISNDAGPNGRNA

SEQ ID NO: 132512 - protein, 18 aa, Mycobacterium avium
TDSPIYLRSTALRSRREG

SEQ ID NO: 132513 - protein, 28 aa, Mycobacterium avium
TDTAALRKWLLQLHTHPAFTAWRYNSAA

SEQ ID NO: 132514 - protein, 25 aa, Mycobacterium avium
TDTMFFHGLPYPDCPHFTVFDYDSC

SEQ ID NO: 132515 - protein, 25 aa, Mycobacterium avium
TDWQVPKHEGLTMFLVPLAHPGVTI

SEQ ID NO: 132516 - protein, 19 aa, Mycobacterium avium
TDWTATSAEFRKLLAEWKA

SEQ ID NO: 132517 - protein, 17 aa, Mycobacterium avium
TDYGINPLVLGALTPRI

SEQ ID NO: 132518 - protein, 18 aa, Mycobacterium avium
TDYLATLRAWLQAQGDPA

SEQ ID NO: 132519 - protein, 27 aa, Mycobacterium avium
TEAPAEMHFYFPQFRALCMAENATHNL

SEQ ID NO: 132520 - protein, 23 aa, Mycobacterium avium
TEAQMVRLLVQYAAWHLDRDHHM

SEQ ID NO: 132521 - protein, 23 aa, Mycobacterium avium
TEEGTLRMLWVTATNPAVSLPEL

SEQ ID NO: 132522 - protein, 24 aa, Mycobacterium avium
TEEMPIAVPWSLPAVRPVHSGDPD

SEQ ID NO: 132523 - protein, 26 aa, Mycobacterium avium
TEFAQPALFVFEVALAALWESLGVTP

SEQ ID NO: 132524 - protein, 28 aa, Mycobacterium avium
TEFAQPALFVFEVALAALWESLGVTPDV

SEQ ID NO: 132525 - protein, 22 aa, Mycobacterium avium
TEFNDIVAVLALYRPGPMGMNA

SEQ ID NO: 132526 - protein, 23 aa, Mycobacterium avium
TEFNDIVAVLALYRPGPMGMNAH

SEQ ID NO: 132527 - protein, 20 aa, Mycobacterium avium
TEGMLSPWLELDGAADQLAL

SEQ ID NO: 132528 - protein, 25 aa, Mycobacterium avium
TEGRCWRPTTTWWAPTRTSRGIPWC

SEQ ID NO: 132529 - protein, 26 aa, Mycobacterium avium
TEGTWWKHRPIFNQEDPGELLGPKAH

SEQ ID NO: 132530 - protein, 21 aa, Mycobacterium avium
TEHLIRTTWPTMFNPMTYVGM

SEQ ID NO: 132531 - protein, 26 aa, Mycobacterium avium
TEHSPARLRMHQRWPIVMVDEFQDTD

SEQ ID NO: 132532 - protein, 28 aa, Mycobacterium avium
TEHSPARLRMHQRWPIVMVDEFQDTDPV

SEQ ID NO: 132533 - protein, 25 aa, Mycobacterium avium
TEIEEAQILRRVPLAIVPSAQLPNT

SEQ ID NO: 132534 - protein, 22 aa, Mycobacterium avium
TEIHGYGRFTDPHTLAVELNDG

SEQ ID NO: 132535 - protein, 24 aa, Mycobacterium avium
TELAGLARYPRPLAPVAAAAAAGM

SEQ ID NO: 132536 - protein, 23 aa, Mycobacterium avium
TELANIYADEIFAWMARTPVEEI

SEQ ID NO: 132537 - protein, 33 aa, Mycobacterium avium
TELDGLLIWIEKNAHLPLTLRDIARRASSSERT

SEQ ID NO: 132538 - protein, 19 aa, Mycobacterium avium
TELPLLVVDVQRGGPSTGL

SEQ ID NO: 132539 - protein, 20 aa, Mycobacterium avium
TELRRIAALCAAFDVDGMRA

SEQ ID NO: 132540 - protein, 22 aa, Mycobacterium avium
TEMTVMLARLLARTRLRLPAQR

SEQ ID NO: 132541 - protein, 23 aa, Mycobacterium avium
TEMTVMLARLLARTRLRLPAQRL

SEQ ID NO: 132542 - protein, 23 aa, Mycobacterium avium
TENAYFAESFVKRGLVVDGGGCY

SEQ ID NO: 132543 - protein, 24 aa, Mycobacterium avium
TENAYFAESFVKRGLVVDGGGCYL

SEQ ID NO: 132544 - protein, 25 aa, Mycobacterium avium
TENDFVLLCDPPAELRLTGAGVAAL

SEQ ID NO: 132545 - protein, 25 aa, Mycobacterium avium
TENDFVLLCDTPAELRLTAAGVAAL

SEQ ID NO: 132546 - protein, 26 aa, Mycobacterium avium
TEPEILRTNLAAVLLQMAALRLGDIE

SEQ ID NO: 132547 - protein, 18 aa, Mycobacterium avium
TEQAPWPIGYDDVEPYLQ

SEQ ID NO: 132548 - protein, 28 aa, Mycobacterium avium
TEQLHEIVSAYFPLGWQLACHVQGDAGV

SEQ ID NO: 132549 - protein, 41 aa, Mycobacterium avium
TERCFRVFNFIDPPSRLRDPALLPRIVWGNLRARFAAKRHR

SEQ ID NO: 132550 - protein, 40 aa, Mycobacterium avium
TERCFRVFNFIDPPSRLRDPALLPRIVWGNLRARFVAKRH

SEQ ID NO: 132551 - protein, 25 aa, Mycobacterium avium
TERSARAWLFTVARNMIIDDRRSAR

SEQ ID NO: 132552 - protein, 17 aa, Mycobacterium avium
TERTLVTISPLQPAERL

SEQ ID NO: 132553 - protein, 26 aa, Mycobacterium avium
TESWFDHWYRHLVALGVRFVRAAATR

SEQ ID NO: 132554 - protein, 18 aa, Mycobacterium avium
TETTMWVSHSRPLAAGSG

SEQ ID NO: 132555 - protein, 23 aa, Mycobacterium avium
TEVELLSPDGLYRLRPRTGRTHQ

SEQ ID NO: 132556 - protein, 18 aa, Mycobacterium avium
TEVTLRFADGEVVTMHVI

SEQ ID NO: 132557 - protein, 20 aa, Mycobacterium avium
TEWGRPPPRIVAGLPVAVHD

SEQ ID NO: 132558 - protein, 22 aa, Mycobacterium avium
TEWMLGYVRFHRTYRGVIRAWF

SEQ ID NO: 132559 - protein, 22 aa, Mycobacterium avium
TEWYETDYGLWLLGHDVGTKID

SEQ ID NO: 132560 - protein, 23 aa, Mycobacterium avium
TFACGPHHRLLQPGAWTTHKNAR

SEQ ID NO: 132561 - protein, 24 aa, Mycobacterium avium
TFACGPHHRLLQPGAWTTHKNARG

SEQ ID NO: 132562 - protein, 17 aa, Mycobacterium avium
TFAKPYAEWRGMFAGNG

SEQ ID NO: 132563 - protein, 19 aa, Mycobacterium avium
TFATIFAKLVQLDFFRHVD

SEQ ID NO: 132564 - protein, 20 aa, Mycobacterium avium
TFCETSFLYDSRGGRAGCAL

SEQ ID NO: 132565 - protein, 17 aa, Mycobacterium avium
TFDLATEIPLRAWLFRR

SEQ ID NO: 132566 - protein, 17 aa, Mycobacterium avium
TFDWCVTSAFIMSQLVA

SEQ ID NO: 132567 - protein, 18 aa, Mycobacterium avium
TFEDGLLSLAIIDAARRS

SEQ ID NO: 132568 - protein, 20 aa, Mycobacterium avium
TFEQWVDYAPKLSLVRQGIL

SEQ ID NO: 132569 - protein, 28 aa, Mycobacterium avium
TFGDPIGRHAFGQSFLTAMFGVGSVVPA

SEQ ID NO: 132570 - protein, 23 aa, Mycobacterium avium
TFGNFKVLKRLGFNQPYIAMMPQ

SEQ ID NO: 132571 - protein, 18 aa, Mycobacterium avium
TFGPLFGHIPNLVTMRGD

SEQ ID NO: 132572 - protein, 18 aa, Mycobacterium avium
TFGRIGVKVWIYKGDVVG

SEQ ID NO: 132573 - protein, 18 aa, Mycobacterium avium
TFGSDWPFAPVAVGKLFA

SEQ ID NO: 132574 - protein, 18 aa, Mycobacterium avium
TFIAPRDIRFHRDLDVVF

SEQ ID NO: 132575 - protein, 19 aa, Mycobacterium avium
TFLCLQAALPDMVEAGWGR

SEQ ID NO: 132576 - protein, 20 aa, Mycobacterium avium
TFLDQRGLMKQKWPERLVLV

SEQ ID NO: 132577 - protein, 20 aa, Mycobacterium avium
TFLEVSYLLIYGELPDKDQL

SEQ ID NO: 132578 - protein, 26 aa, Mycobacterium avium
TFLLTKACLPYLRRAANPHVLTISPP

SEQ ID NO: 132579 - protein, 25 aa, Mycobacterium avium
TFLTRFARSVTLLHRREEFRASRIM

SEQ ID NO: 132580 - protein, 18 aa, Mycobacterium avium
TFLVPSPLAHIGGSIYAF

SEQ ID NO: 132581 - protein, 19 aa, Mycobacterium avium
TFLVPSPLAHIGGSIYAFE

SEQ ID NO: 132582 - protein, 18 aa, Mycobacterium avium
TFPQWRTQVRLQHALVLL

SEQ ID NO: 132583 - protein, 19 aa, Mycobacterium avium
TFRHMNGFGLHAFSWVNSA

SEQ ID NO: 132584 - protein, 24 aa, Mycobacterium avium
TFRHMNGFGLHAFSWVNSAGEIHW

SEQ ID NO: 132585 - protein, 25 aa, Mycobacterium avium
TFRHMNGFGLHAFSWVNSAGEIHWV

SEQ ID NO: 132586 - protein, 29 aa, Mycobacterium avium
TFRNTGELIGFPFFRGYGGRKLDLTLGRV

SEQ ID NO: 132587 - protein, 24 aa, Mycobacterium avium
TFSDDYLPAWMYRTQESGHRDGAV

SEQ ID NO: 132588 - protein, 25 aa, Mycobacterium avium
TFSLGSWWSGVAWSTIKVPLAIAAL

SEQ ID NO: 132589 - protein, 20 aa, Mycobacterium avium
TFSMLYAFSENYVLPLSHDE

SEQ ID NO: 132590 - protein, 18 aa, Mycobacterium avium
TFTDVSHFFLGQAAKMFA

SEQ ID NO: 132591 - protein, 19 aa, Mycobacterium avium
TFTYGLLYQREADLAQRCR

SEQ ID NO: 132592 - protein, 26 aa, Mycobacterium avium
TFVELSAHPSLLYPLGDIVGDESVVV

SEQ ID NO: 132593 - protein, 20 aa, Mycobacterium avium
TFVVPEMLIPKVTAKIYDLA

SEQ ID NO: 132594 - protein, 28 aa, Mycobacterium avium
TFYFGHVTFFYHLLLKVVEQLYFDGAMP

SEQ ID NO: 132595 - protein, 17 aa, Mycobacterium avium
TGAKLGPFLVPATLSAP

SEQ ID NO: 132596 - protein, 19 aa, Mycobacterium avium
TGAQRYWWSPGVTQVVPNW

SEQ ID NO: 132597 - protein, 26 aa, Mycobacterium avium
TGARPLIYSRGRLHPLPTGTVVGIPS

SEQ ID NO: 132598 - protein, 23 aa, Mycobacterium avium
TGATPYMVLMAAFAALVHRYTGS

SEQ ID NO: 132599 - protein, 23 aa, Mycobacterium avium
TGATPYMVLMAVFGALVHRYTQS

SEQ ID NO: 132600 - protein, 18 aa, Mycobacterium avium
TGAVFIKGTALWLESAVE

SEQ ID NO: 132601 - protein, 23 aa, Mycobacterium avium
TGAVSLILGWCPVPPQGLCADAF

SEQ ID NO: 132602 - protein, 24 aa, Mycobacterium avium
TGAYGALPYLKKSAGSLMFSTPSS

SEQ ID NO: 132603 - protein, 24 aa, Mycobacterium avium
TGDGRGTVYLATRGGYFVLDLGTG

SEQ ID NO: 132604 - protein, 18 aa, Mycobacterium avium
TGDPALWHKRIHASADPG

SEQ ID NO: 132605 - protein, 25 aa, Mycobacterium avium
TGDQPLCPAPVRIPILFGGRADATI

SEQ ID NO: 132606 - protein, 19 aa, Mycobacterium avium
TGDSFFHLAPLGQSGALAG

SEQ ID NO: 132607 - protein, 26 aa, Mycobacterium avium
TGEAELDLVLAILRARQLFGGEQVIP

SEQ ID NO: 132608 - protein, 20 aa, Mycobacterium avium
TGELRAIDALGLRFPSPEMV

SEQ ID NO: 132609 - protein, 19 aa, Mycobacterium avium
TGEPLPPLLAATAAAQRAG

SEQ ID NO: 132610 - protein, 20 aa, Mycobacterium avium
TGEPLPPLLAATAAAQRAGL

SEQ ID NO: 132611 - protein, 30 aa, Mycobacterium avium
TGERRLYAFMAAIGWVFKVKGRWRAYQSQV

SEQ ID NO: 132612 - protein, 18 aa, Mycobacterium avium
TGFDRLRLIQRIVDRLPE

SEQ ID NO: 132613 - protein, 24 aa, Mycobacterium avium
TGGLGGIGLFLAEKLAAAGCGRIV

SEQ ID NO: 132614 - protein, 17 aa, Mycobacterium avium
TGGLIEMRMSTTSIGLT

SEQ ID NO: 132615 - protein, 26 aa, Mycobacterium avium
TGGNHAFYLAIPPKSFPVVCEQLHKS

SEQ ID NO: 132616 - protein, 28 aa, Mycobacterium avium
TGIGLTFNVLLAPLYPAVLLAKQVITLA

SEQ ID NO: 132617 - protein, 22 aa, Mycobacterium avium
TGIQIVPFLARYAQHLYVFQRT

SEQ ID NO: 132618 - protein, 23 aa, Mycobacterium avium
TGIQIVPFLARYAQHLYVFQRTP

SEQ ID NO: 132619 - protein, 25 aa, Mycobacterium avium
TGKSVFLKSLIGLLRPERGSVVIDD

SEQ ID NO: 132620 - protein, 24 aa, Mycobacterium avium
TGKTAAFAIPILSKIDAASTATQA

SEQ ID NO: 132621 - protein, 25 aa, Mycobacterium avium
TGKTAAFAIPILSKIDVASTATQAL

SEQ ID NO: 132622 - protein, 29 aa, Mycobacterium avium
TGKYYAGVKWAWYQPIYAGRPVLVENFTL

SEQ ID NO: 132623 - protein, 17 aa, Mycobacterium avium
TGLDRRVDDALWKRYSA

SEQ ID NO: 132624 - protein, 27 aa, Mycobacterium avium
TGLERILRIATWHYQFHRLRSPFRPKR

SEQ ID NO: 132625 - protein, 31 aa, Mycobacterium avium
TGLERILRIATWHYQFHRLRSPFRPKRPLAD

SEQ ID NO: 132626 - protein, 32 aa, Mycobacterium avium
TGLERILRIATWHYQFHRLRSPFRPKRPLADF

SEQ ID NO: 132627 - protein, 23 aa, Mycobacterium avium
TGLESTMRFILSAKSAYVDGQVF

SEQ ID NO: 132628 - protein, 25 aa, Mycobacterium avium
TGLGYSGYFELDGARRPIAEFDPAV

SEQ ID NO: 132629 - protein, 17 aa, Mycobacterium avium
TGLLWQDVVDRLSDSHR

SEQ ID NO: 132630 - protein, 26 aa, Mycobacterium avium
TGLNNRRGFYLLAGQKLSGSHRLGHA

SEQ ID NO: 132631 - protein, 23 aa, Mycobacterium avium
TGLPALEQYLAKNRKIIAFVNSS

SEQ ID NO: 132632 - protein, 29 aa, Mycobacterium avium
TGLRNLPCHSFWANAAWLEIVLAAADLVT

SEQ ID NO: 132633 - protein, 28 aa, Mycobacterium avium
TGLVDRALIAAYAGGLVPILCLTKTDLA

SEQ ID NO: 132634 - protein, 21 aa, Mycobacterium avium
TGMTGMPMMPPGAMGAGGEGG

SEQ ID NO: 132635 - protein, 27 aa, Mycobacterium avium
TGPEQVKWWWDSLSAAQQRLLIDQHPQ

SEQ ID NO: 132636 - protein, 27 aa, Mycobacterium avium
TGPRAVEMPPLPRVHLQSAVIHGVAQR

SEQ ID NO: 132637 - protein, 21 aa, Mycobacterium avium
TGQIGRFVVADLLADGHAATA

SEQ ID NO: 132638 - protein, 27 aa, Mycobacterium avium
TGQLNTEYFVAPGLWRGFDHGGLARAL

SEQ ID NO: 132639 - protein, 23 aa, Mycobacterium avium
TGQLVVIIHHLAVDGVSWRILLQ

SEQ ID NO: 132640 - protein, 29 aa, Mycobacterium avium
TGQPAWSQWYAGRPLLVTANDYGLRLYNG

SEQ ID NO: 132641 - protein, 34 aa, Mycobacterium avium
TGQVMHQNLPIYRYWFSPDGMLGFDRGTQTASYI

SEQ ID NO: 132642 - protein, 24 aa, Mycobacterium avium
TGRAVLAALRRFGAAPTLCDDDPA

SEQ ID NO: 132643 - protein, 25 aa, Mycobacterium avium
TGRCRPRRPTPWPMPGRSASPTTAR

SEQ ID NO: 132644 - protein, 26 aa, Mycobacterium avium
TGRENLVLFGRLRGLNRRRAKARADE

SEQ ID NO: 132645 - protein, 20 aa, Mycobacterium avium
TGRKIGELVSEPLWKVVQAH

SEQ ID NO: 132646 - protein, 23 aa, Mycobacterium avium
TGRPLAAPPVRKLAKELMVDLGS

SEQ ID NO: 132647 - protein, 18 aa, Mycobacterium avium
TGRRRPHRFRRPNPPGRA

SEQ ID NO: 132648 - protein, 26 aa, Mycobacterium avium
TGRRRRCGWFDAVVARYATRVNGITD

SEQ ID NO: 132649 - protein, 18 aa, Mycobacterium avium
TGRTLTSYPSIRTDLRNA

SEQ ID NO: 132650 - protein, 30 aa, Mycobacterium avium
TGSGTFYTLRCYLDDQPIFLGRNGRISVFT

SEQ ID NO: 132651 - protein, 27 aa, Mycobacterium avium
TGSRPQVLLLPLGPLAENNIRATFASN

SEQ ID NO: 132652 - protein, 26 aa, Mycobacterium avium
TGTERILFTHIAVPVMTRLKQPERQV

SEQ ID NO: 132653 - protein, 27 aa, Mycobacterium avium
TGTHHYRFTLYQLPNDYQLPAGLAGVQ

SEQ ID NO: 132654 - protein, 21 aa, Mycobacterium avium
TGTYAINWYAFDRCCPFGGYK

SEQ ID NO: 132655 - protein, 25 aa, Mycobacterium avium
TGVLQALFIGPMLAAPVILEDRWDP

SEQ ID NO: 132656 - protein, 17 aa, Mycobacterium avium
TGVPKVILNLAPSLWIP

SEQ ID NO: 132657 - protein, 17 aa, Mycobacterium avium
TGVRLSRSFGARGWSPH

SEQ ID NO: 132658 - protein, 28 aa, Mycobacterium avium
TGVSRRHLEIRWDGQVALLSDLNSTNGT

SEQ ID NO: 132659 - protein, 24 aa, Mycobacterium avium
THFARLVHRWRWTAEKDPVKIEHA

SEQ ID NO: 132660 - protein, 26 aa, Mycobacterium avium
THGALRSAWIGYWVPRSATGGGVATA

SEQ ID NO: 132661 - protein, 28 aa, Mycobacterium avium
THLSFVPGWNRRQLRRLIRDLRGLPGPR

SEQ ID NO: 132662 - protein, 24 aa, Mycobacterium avium
THQPIEHLAVLRAIPKLSVVRPAD

SEQ ID NO: 132663 - protein, 28 aa, Mycobacterium avium
THREESMLVARRFAAVAALLRHRVATAD

SEQ ID NO: 132664 - protein, 27 aa, Mycobacterium avium
THREESMLVARRFAAVAALLRHRVATT

SEQ ID NO: 132665 - protein, 26 aa, Mycobacterium avium
THRPVPYLAALPDKLAGRPVMVLDPM

SEQ ID NO: 132666 - protein, 19 aa, Mycobacterium avium
TIAAHKLPAVRLHDARHTC

SEQ ID NO: 132667 - protein, 26 aa, Mycobacterium avium
TIADWTRLPAGTLALLRDALAVHRAF

SEQ ID NO: 132668 - protein, 20 aa, Mycobacterium avium
TIAFPIAHIGGMVYLATALF

SEQ ID NO: 132669 - protein, 32 aa, Mycobacterium avium
TIAHGYLTLSLVPILVQQIYRVTGLAMQVNYG

SEQ ID NO: 132670 - protein, 23 aa, Mycobacterium avium
TIAKLVRELALLWADRSIRVNAV

SEQ ID NO: 132671 - protein, 22 aa, Mycobacterium avium
TIASDRLGLRPLATIRSLGVGR

SEQ ID NO: 132672 - protein, 26 aa, Mycobacterium avium
TIFKRNTLWSAIFRPATIAGVASRRR

SEQ ID NO: 132673 - protein, 29 aa, Mycobacterium avium
TIGDPIADLAWLLMDWRSPRELASCLPNP

SEQ ID NO: 132674 - protein, 18 aa, Mycobacterium avium
TIGIDLRQDWPAALQDAG

SEQ ID NO: 132675 - protein, 18 aa, Mycobacterium avium
TIGLLKTVSDEYAQFGIT

SEQ ID NO: 132676 - protein, 17 aa, Mycobacterium avium
TIGPKVHGGAMLALCAN

SEQ ID NO: 132677 - protein, 21 aa, Mycobacterium avium
TIGYSPARWCWPARRGRCGAP

SEQ ID NO: 132678 - protein, 19 aa, Mycobacterium avium
TILALLDAEVGLGEAVQAG

SEQ ID NO: 132679 - protein, 19 aa, Mycobacterium avium
TILINVTSFFRDPDAWEFV

SEQ ID NO: 132680 - protein, 26 aa, Mycobacterium avium
TIMIPEKHLPLVMPLRYIGIDENTLN

SEQ ID NO: 132681 - protein, 19 aa, Mycobacterium avium
TIMSTTLDIALFLVAQDFP

SEQ ID NO: 132682 - protein, 18 aa, Mycobacterium avium
TIPDLDGIRVLRTFDESL

SEQ ID NO: 132683 - protein, 28 aa, Mycobacterium avium
TIRASQNLIPRLFWTTYQGGRDDLLPFY

SEQ ID NO: 132684 - protein, 19 aa, Mycobacterium avium
TIRGRPIGGRIVREGIANT

SEQ ID NO: 132685 - protein, 27 aa, Mycobacterium avium
TISEQLMPHWLLSLQAEATRRGEAAPQ

SEQ ID NO: 132686 - protein, 18 aa, Mycobacterium avium
TITISSAAKMFNCTGWKI

SEQ ID NO: 132687 - protein, 18 aa, Mycobacterium avium
TITLSRLPEGVYIGLASV

SEQ ID NO: 132688 - protein, 18 aa, Mycobacterium avium
TIVFCGVHFMAETAKILS

SEQ ID NO: 132689 - protein, 19 aa, Mycobacterium avium
TIVINSVVQYFPNAGYLAD

SEQ ID NO: 132690 - protein, 26 aa, Mycobacterium avium
TIVTSFYDWSNIDPKWREAGIFPILS

SEQ ID NO: 132691 - protein, 19 aa, Mycobacterium avium
TIYREPLSLRPFDYLPRPV

SEQ ID NO: 132692 - protein, 18 aa, Mycobacterium avium
TIYSFTGASPRFLLDFSR

SEQ ID NO: 132693 - protein, 25 aa, Mycobacterium avium
TKAMTGYVTALRPLVDHLGGKAVQA

SEQ ID NO: 132694 - protein, 26 aa, Mycobacterium avium
TKCELVHAALVFALPPVPELRSGRSA

SEQ ID NO: 132695 - protein, 27 aa, Mycobacterium avium
TKCELVHAALVFALPPVPELRSGRSAR

SEQ ID NO: 132696 - protein, 30 aa, Mycobacterium avium
TKDDRYVQLMMLQLDKFYPEAMRAIGLPKL

SEQ ID NO: 132697 - protein, 31 aa, Mycobacterium avium
TKDGRWIQLVFLQPDKYWAGFCRRIGLAELA

SEQ ID NO: 132698 - protein, 32 aa, Mycobacterium avium
TKDGRWIQLVFLQPDKYWAGFCRRIGLAELAD

SEQ ID NO: 132699 - protein, 31 aa, Mycobacterium avium
TKDRRWIQLVFLQPDKYWAGFCRRIGLAELA

SEQ ID NO: 132700 - protein, 24 aa, Mycobacterium avium
TKHKYLAAFIGWLEKQRLTQAELV

SEQ ID NO: 132701 - protein, 24 aa, Mycobacterium avium
TKLDLVRYYLSVADGALRGVAGRP

SEQ ID NO: 132702 - protein, 27 aa, Mycobacterium avium
TKRVCRDCGFFLPLSGSLGRMFGVCGN

SEQ ID NO: 132703 - protein, 17 aa, Mycobacterium avium
TKTWALAGLRVGYALGA

SEQ ID NO: 132704 - protein, 21 aa, Mycobacterium avium
TLAAMICHGALSRFPDLKIFC

SEQ ID NO: 132705 - protein, 19 aa, Mycobacterium avium
TLADLACNCAVELKPIIYS

SEQ ID NO: 132706 - protein, 22 aa, Mycobacterium avium
TLAEIWQRHLAIPTPGVDDDFF

SEQ ID NO: 132707 - protein, 17 aa, Mycobacterium avium
TLARRLPGLRLAVPPEQ

SEQ ID NO: 132708 - protein, 21 aa, Mycobacterium avium
TLASALFWGTERVLYIAGLGV

SEQ ID NO: 132709 - protein, 22 aa, Mycobacterium avium
TLAVLYTFRRVRDELVGTATYR

SEQ ID NO: 132710 - protein, 25 aa, Mycobacterium avium
TLAWQRLVPWPDVLPGLTLLKKKFI

SEQ ID NO: 132711 - protein, 17 aa, Mycobacterium avium
TLDLSHVDYLVLDEADE

SEQ ID NO: 132712 - protein, 25 aa, Mycobacterium avium
TLDVNLLGYVRTSRAVLAHLLQQGS

SEQ ID NO: 132713 - protein, 31 aa, Mycobacterium avium
TLDWDDELLSFFTIPRAMLPEIGPSSSPRPF

SEQ ID NO: 132714 - protein, 19 aa, Mycobacterium avium
TLEHPVNHWPPQQPSKGIL

SEQ ID NO: 132715 - protein, 20 aa, Mycobacterium avium
TLFTGAEWLDTARGAGVDAV

SEQ ID NO: 132716 - protein, 29 aa, Mycobacterium avium
TLGAAASLQLWVMMETPRAFLRAEEVASA

SEQ ID NO: 132717 - protein, 19 aa, Mycobacterium avium
TLGALLRRLQPDWSMTFVE

SEQ ID NO: 132718 - protein, 29 aa, Mycobacterium avium
TLGASASLQLWVMMETPRAFLRAEEVASA

SEQ ID NO: 132719 - protein, 26 aa, Mycobacterium avium
TLGGRSMLSHLLHAIAKVAPQHLAVV

SEQ ID NO: 132720 - protein, 18 aa, Mycobacterium avium
TLGPTLPDGLRGAAALWG

SEQ ID NO: 132721 - protein, 21 aa, Mycobacterium avium
TLGTTRWLVAILENHQRPDGS

SEQ ID NO: 132722 - protein, 23 aa, Mycobacterium avium
TLGTTRWLVAILENHQRPDGSVR

SEQ ID NO: 132723 - protein, 19 aa, Mycobacterium avium
TLHAGRLVARRLRAGGVDT

SEQ ID NO: 132724 - protein, 20 aa, Mycobacterium avium
TLIPHLTFDPLRALQAIEQH

SEQ ID NO: 132725 - protein, 29 aa, Mycobacterium avium
TLKEPYSVVGLIFPWNGPIFNANAKLAPA

SEQ ID NO: 132726 - protein, 30 aa, Mycobacterium avium
TLLDEGQRLLIFLPLAHVLARSLTLSAFAN

SEQ ID NO: 132727 - protein, 28 aa, Mycobacterium avium
TLLHTVVEAVKFLLRPDIDHLVGETIVA

SEQ ID NO: 132728 - protein, 21 aa, Mycobacterium avium
TLLLEVAHRWAQSGRRALYIS

SEQ ID NO: 132729 - protein, 19 aa, Mycobacterium avium
TLLLTLAGRFKPSHGTLTV

SEQ ID NO: 132730 - protein, 20 aa, Mycobacterium avium
TLLLTLAGRFKPSHGTLTVL

SEQ ID NO: 132731 - protein, 19 aa, Mycobacterium avium
TLLTRLYGTPIHVHRARDG

SEQ ID NO: 132732 - protein, 46 aa, Mycobacterium avium
TLNEEFPRLIVYRGPRRKGVRYFGPYSHAWAIRETLDLLTRVFPAR

SEQ ID NO: 132733 - protein, 17 aa, Mycobacterium avium
TLNFATFGDPIGRHAFG

SEQ ID NO: 132734 - protein, 29 aa, Mycobacterium avium
TLPGPNQLGAFLFWMVRKRPALQIHLLKS

SEQ ID NO: 132735 - protein, 25 aa, Mycobacterium avium
TLPMPLPTLFNRWYGPFPPIREVRG

SEQ ID NO: 132736 - protein, 26 aa, Mycobacterium avium
TLPMPLPTLFNRWYGPFPPIREVRGQ

SEQ ID NO: 132737 - protein, 17 aa, Mycobacterium avium
TLQLIAEQLSAAGVPVL

SEQ ID NO: 132738 - protein, 21 aa, Mycobacterium avium
TLRAHCYGLLRTIMGTALSDG

SEQ ID NO: 132739 - protein, 23 aa, Mycobacterium avium
TLREAVLYLTGMSQRELYGASYR

SEQ ID NO: 132740 - protein, 20 aa, Mycobacterium avium
TLRHWLATYVEFYDRYSGCI

SEQ ID NO: 132741 - protein, 17 aa, Mycobacterium avium
TLRLYERRGLLTPSRTD

SEQ ID NO: 132742 - protein, 24 aa, Mycobacterium avium
TLRRLGELAVRIKYLEVLCQRSIS

SEQ ID NO: 132743 - protein, 25 aa, Mycobacterium avium
TLRRLGELAVRIKYLEVLCQRSISA

SEQ ID NO: 132744 - protein, 19 aa, Mycobacterium avium
TLRSLYFLSSRVTGGSPHA

SEQ ID NO: 132745 - protein, 32 aa, Mycobacterium avium
TLRSVFLSGDWIPLDLPRRLRRAAPGVRLVAM

SEQ ID NO: 132746 - protein, 19 aa, Mycobacterium avium
TLRVGPTARRLITCASSEQ

SEQ ID NO: 132747 - protein, 19 aa, Mycobacterium avium
TLSHRRAVLSKSPRPDPRL

SEQ ID NO: 132748 - protein, 19 aa, Mycobacterium avium
TLSIGTTALSLKEAKPLPA

SEQ ID NO: 132749 - protein, 30 aa, Mycobacterium avium
TLSVPPTWTAAAPAIRPAALALPATTVTAA

SEQ ID NO: 132750 - protein, 23 aa, Mycobacterium avium
TLVLKPSPLTPLAGLALARIIDE

SEQ ID NO: 132751 - protein, 19 aa, Mycobacterium avium
TLYDKFPALTPEQAAGVIA

SEQ ID NO: 132752 - protein, 17 aa, Mycobacterium avium
TLYQYFKGKDEIFLELL

SEQ ID NO: 132753 - protein, 18 aa, Mycobacterium avium
TMAYPFVRLHQPSAFYGV

SEQ ID NO: 132754 - protein, 30 aa, Mycobacterium avium
TMDSAKRWVTLGFTWNGLRALGVPGDALAS

SEQ ID NO: 132755 - protein, 24 aa, Mycobacterium avium
TMEAWNAPTLLKFLATPALAREYL

SEQ ID NO: 132756 - protein, 24 aa, Mycobacterium avium
TMEAWNDPTLLKFLATPALAREYL

SEQ ID NO: 132757 - protein, 27 aa, Mycobacterium avium
TMEETALWLDLTYDGPAPVVLTGAMRS

SEQ ID NO: 132758 - protein, 23 aa, Mycobacterium avium
TMHPSRYLTLIEDVTAVFLTGVH

SEQ ID NO: 132759 - protein, 24 aa, Mycobacterium avium
TMIERKICGLALYAPRDAIEVTCP

SEQ ID NO: 132760 - protein, 23 aa, Mycobacterium avium
TMLALLGKRGMRRILTEGGPTLL

SEQ ID NO: 132761 - protein, 17 aa, Mycobacterium avium
TMLLIDTDTPGLAVRPI

SEQ ID NO: 132762 - protein, 21 aa, Mycobacterium avium
TMLSWLFSGMFQRYPKLKIAL

SEQ ID NO: 132763 - protein, 25 aa, Mycobacterium avium
TMQGCGVTLPGRRCRLGWTVSVLRC

SEQ ID NO: 132764 - protein, 17 aa, Mycobacterium avium
TMSFLAMDDPAHLRLRT

SEQ ID NO: 132765 - protein, 28 aa, Mycobacterium avium
TMTREVASWWRYATSAPGLARPVDQQFA

SEQ ID NO: 132766 - protein, 30 aa, Mycobacterium avium
TMVLKPAMETPWSALRWGRIIAEKTDIPAG

SEQ ID NO: 132767 - protein, 30 aa, Mycobacterium avium; identical to SEQ ID NO: 22921

SEQ ID NO: 132768 - protein, 17 aa, Mycobacterium avium
TNAARLGIALFGLGNAR

SEQ ID NO: 132769 - protein, 26 aa, Mycobacterium avium
TNATMPYVLALADRGWRAACRSNHAL

SEQ ID NO: 132770 - protein, 20 aa, Mycobacterium avium
TNAVKHFKFTRKDGKRRIHQ

SEQ ID NO: 132771 - protein, 18 aa, Mycobacterium avium
TNEPCLLIGSMTDAIPAE

SEQ ID NO: 132772 - protein, 19 aa, Mycobacterium avium
TNFMGTVPRCAVALGLPPW

SEQ ID NO: 132773 - protein, 23 aa, Mycobacterium avium
TNFREQFRRLAGVSPRSYRSTFR

SEQ ID NO: 132774 - protein, 26 aa, Mycobacterium avium
TNGHLADFVFLLARTNPDKPKHKGLT

SEQ ID NO: 132775 - protein, 26 aa, Mycobacterium avium
TNGLASLPLPAPGLGSGGYSLNAVFS

SEQ ID NO: 132776 - protein, 20 aa, Mycobacterium avium
TNHHIVLDGWSKPLLLQEIF

SEQ ID NO: 132777 - protein, 25 aa, Mycobacterium avium
TNHLGHFALTGLLLALLRAADSARV

SEQ ID NO: 132778 - protein, 22 aa, Mycobacterium avium
TNHPLMISMEFKEGLHGFTDAR

SEQ ID NO: 132779 - protein, 21 aa, Mycobacterium avium
TNLHHALALAGRHLRRHPNAL

SEQ ID NO: 132780 - protein, 24 aa, Mycobacterium avium
TNPIQRMWAGWLPPFGIVEHVGRR

SEQ ID NO: 132781 - protein, 27 aa, Mycobacterium avium
TNRSPRARLLALFDTPSPGDALMRGCP

SEQ ID NO: 132782 - protein, 22 aa, Mycobacterium avium
TNRVRRYVCLKGPDHGGCGRLT

SEQ ID NO: 132783 - protein, 25 aa, Mycobacterium avium
TNSLKLYDVPATPPPIFVAAGGPKS

SEQ ID NO: 132784 - protein, 18 aa, Mycobacterium avium
TNSPTAIRTTKKALWHSL

SEQ ID NO: 132785 - protein, 24 aa, Mycobacterium avium
TNTDTIILIRIPNNGKSATAISIP

SEQ ID NO: 132786 - protein, 24 aa, Mycobacterium avium
TNYGAAYRYCGFGLAQNAGMAPSQ

SEQ ID NO: 132787 - protein, 18 aa, Mycobacterium avium
TPAEVLVRNFWFCAVEDK

SEQ ID NO: 132788 - protein, 33 aa, Mycobacterium avium
TPAHVRPLLMPALQPEIRLAAPLLAKGLPACPG

SEQ ID NO: 132789 - protein, 25 aa, Mycobacterium avium
TPAVGALLSLLTKLSGGKAIAEVGT

SEQ ID NO: 132790 - protein, 19 aa, Mycobacterium avium
TPCAVVAFASWPQETVLRG

SEQ ID NO: 132791 - protein, 24 aa, Mycobacterium avium
TPDGLELLMKLLETADVFVTNLLP

SEQ ID NO: 132792 - protein, 18 aa, Mycobacterium avium
TPDHLLIGVLSDPAALAT

SEQ ID NO: 132793 - protein, 31 aa, Mycobacterium avium
TPDWLREGVRFWLRTALDAELLRWSSAVERA

SEQ ID NO: 132794 - protein, 24 aa, Mycobacterium avium
TPEGLELLMKLLETADVFVTNLLP

SEQ ID NO: 132795 - protein, 20 aa, Mycobacterium avium
TPEGVGWLYNFIRAQGERNY

SEQ ID NO: 132796 - protein, 17 aa, Mycobacterium avium
TPELLQRSRARAAGLGL

SEQ ID NO: 132797 - protein, 26 aa, Mycobacterium avium
TPEMMPLPIALAHRLSRRLTEVRKSG

SEQ ID NO: 132798 - protein, 27 aa, Mycobacterium avium
TPEMMPLPIALAHRLSRRLTEVRKSGV

SEQ ID NO: 132799 - protein, 26 aa, Mycobacterium avium
TPERMPLPIALAHRLSRRLTEVRKNG

SEQ ID NO: 132800 - protein, 31 aa, Mycobacterium avium
TPEYKQVALFSATMPPAIRKLTAKYLHDPLE

SEQ ID NO: 132801 - protein, 20 aa, Mycobacterium avium
TPFGFHGVFGHLAASVVPGC

SEQ ID NO: 132802 - protein, 20 aa, Mycobacterium avium
TPFSAIIAGLTPFLVSRQVV

SEQ ID NO: 132803 - protein, 23 aa, Mycobacterium avium
TPGEGFPLTRLQQAYTLGAAGLN

SEQ ID NO: 132804 - protein, 18 aa, Mycobacterium avium
TPGIVWYSATTQPQGWVR

SEQ ID NO: 132805 - protein, 19 aa, Mycobacterium avium
TPGLDLRTGIACQLRELGV

SEQ ID NO: 132806 - protein, 17 aa, Mycobacterium avium
TPGPPPDGPPGGAPDTP

SEQ ID NO: 132807 - protein, 25 aa, Mycobacterium avium
TPKPAPPLDIWLGGSAPAAFRRIGA

SEQ ID NO: 132808 - protein, 25 aa, Mycobacterium avium
TPKPAPPLDIWLGGSAPAALRRIGA

SEQ ID NO: 132809 - protein, 22 aa, Mycobacterium avium
TPLLVACDLQRPAAVNQLQVVG

SEQ ID NO: 132810 - protein, 33 aa, Mycobacterium avium
TPLWTPADFSLNELIPPLVPGKPLQHFQQACTL

SEQ ID NO: 132811 - protein, 27 aa, Mycobacterium avium
TPPAAPFTPPFMPPAAAPAPMPPAPAD

SEQ ID NO: 132812 - protein, 21 aa, Mycobacterium avium
TPPSFDRYDPLGLDALLSDDE

SEQ ID NO: 132813 - protein, 22 aa, Mycobacterium avium
TPQGFATDLLLRAYAAGAGTAG

SEQ ID NO: 132814 - protein, 19 aa, Mycobacterium avium
TPQGPWLRTGDSGFFFDGE

SEQ ID NO: 132815 - protein, 21 aa, Mycobacterium avium
TPQPLDVLAHVLLAAADEAAR

SEQ ID NO: 132816 - protein, 31 aa, Mycobacterium avium
TPRKVRRLRRLAGLWLAGQDRGWAAIRIDVI

SEQ ID NO: 132817 - protein, 30 aa, Mycobacterium avium
TPRKVRRLRRLAGLWLAGQDRRWAAIRIDV

SEQ ID NO: 132818 - protein, 17 aa, Mycobacterium avium
TPRLADIPGVRLIGTAQ

SEQ ID NO: 132819 - protein, 22 aa, Mycobacterium avium
TPSNWLDFVWLGTDGGATELYT

SEQ ID NO: 132820 - protein, 27 aa, Mycobacterium avium
TPSRRRYPVIAVKAPVTLMRLPRRVRT

SEQ ID NO: 132821 - protein, 29 aa, Mycobacterium avium
TPTKWDNTFLETLYGYEWELTKSPAGAWQ

SEQ ID NO: 132822 - protein, 27 aa, Mycobacterium avium
TPVRHIMDRLLVEFTTIGFLSDDNPGR

SEQ ID NO: 132823 - protein, 18 aa, Mycobacterium avium
TPYPLLRELRRKAAVHPG

SEQ ID NO: 132824 - protein, 27 aa, Mycobacterium avium
TQEGWPDILFYGPGTWGFGNGPNSTNM

SEQ ID NO: 132825 - protein, 24 aa, Mycobacterium avium
TQESTLGLIFHWAKERDRRLVTTD

SEQ ID NO: 132826 - protein, 23 aa, Mycobacterium avium
TQFHSYAFDFSVWEIWGALLHGG

SEQ ID NO: 132827 - protein, 18 aa, Mycobacterium avium
TQGRLLVVPIGENRTIVE

SEQ ID NO: 132828 - protein, 25 aa, Mycobacterium avium
TQGSARFWLFGVIPAWTHHLTIERL

SEQ ID NO: 132829 - protein, 25 aa, Mycobacterium avium
TQGSARFWLFGVIPAWTHHLTIKRL

SEQ ID NO: 132830 - protein, 21 aa, Mycobacterium avium
TQGSFLRQLGWHALARGWDGR

SEQ ID NO: 132831 - protein, 19 aa, Mycobacterium avium
TQHLLSGAARRFKGYALAA

SEQ ID NO: 132832 - protein, 25 aa, Mycobacterium avium
TQLEWLAEALAQRPPSESLFDAVLA

SEQ ID NO: 132833 - protein, 24 aa, Mycobacterium avium
TQLGLGVRRGILLAGPPGVGKTAI

SEQ ID NO: 132834 - protein, 22 aa, Mycobacterium avium
TQLRRAGFEPIGRRFVRAAQRR

SEQ ID NO: 132835 - protein, 17 aa, Mycobacterium avium
TQLSLMRLGIEPAEFAL

SEQ ID NO: 132836 - protein, 28 aa, Mycobacterium avium
TQPALDLDALIGGFRPLFQALDPNKVNS

SEQ ID NO: 132837 - protein, 24 aa, Mycobacterium avium
TQPQGWVRLRTEPALVLPSGPSAQ

SEQ ID NO: 132838 - protein, 25 aa, Mycobacterium avium
TQPQGWVRLRTEPALVLPSGPSAQA

SEQ ID NO: 132839 - protein, 17 aa, Mycobacterium avium
TQPSFDITTLFNGLQPV

SEQ ID NO: 132840 - protein, 25 aa, Mycobacterium avium
TQRDRWQPWNGTGWGKAGDLATATV

SEQ ID NO: 132841 - protein, 21 aa, Mycobacterium avium
TQRIVLSRNPKWWGTRPRLDS

SEQ ID NO: 132842 - protein, 26 aa, Mycobacterium avium
TQRTAWLAEGLLVYLPAEAQDRLFTL

SEQ ID NO: 132843 - protein, 18 aa, Mycobacterium avium
TQVFGLPGMDWPAVRSEA

SEQ ID NO: 132844 - protein, 28 aa, Mycobacterium avium
TRAAVLLAAYTLVLRRWASQDDFLVNVT

SEQ ID NO: 132845 - protein, 18 aa, Mycobacterium avium
TRAMYRIAKRRYGQVPEP

SEQ ID NO: 132846 - protein, 18 aa, Mycobacterium avium
TRCDIRVPRFATVDLTGQ

SEQ ID NO: 132847 - protein, 22 aa, Mycobacterium avium
TRCGRIYWPGSHHAKLLALVER

SEQ ID NO: 132848 - protein, 28 aa, Mycobacterium avium
TRDHMSWPDFIAGLYGRSFRDVVRDAGI

SEQ ID NO: 132849 - protein, 24 aa, Mycobacterium avium
TRDPAHLLLQLGGPVDRHAVAALV

SEQ ID NO: 132850 - protein, 18 aa, Mycobacterium avium
TRDPVLCHSGFQIFGGGV

SEQ ID NO: 132851 - protein, 24 aa, Mycobacterium avium
TRDRWYEAFTETWKDSLSIGWQGN

SEQ ID NO: 132852 - protein, 19 aa, Mycobacterium avium
TRDYRLLTRALVLASTPRA

SEQ ID NO: 132853 - protein, 18 aa, Mycobacterium avium
TREAAAQILTTYLRGIPG

SEQ ID NO: 132854 - protein, 19 aa, Mycobacterium avium
TREIILIHHTDCGMLTFTD

SEQ ID NO: 132855 - protein, 22 aa, Mycobacterium avium
TRFVEHMGSLLQRPVVTISCHD

SEQ ID NO: 132856 - protein, 35 aa, Mycobacterium avium
TRGKDFLFDDLIRTLAQRPLKWRLILTLGEPGDPT

SEQ ID NO: 132857 - protein, 19 aa, Mycobacterium avium
TRGKLKRPGFPGGSGYWIP

SEQ ID NO: 132858 - protein, 26 aa, Mycobacterium avium
TRHGDSWLLNGFKWFASNCAGEAFVV

SEQ ID NO: 132859 - protein, 24 aa, Mycobacterium avium
TRHKARCRQPPTPPIPHSHTHTRH

SEQ ID NO: 132860 - protein, 24 aa, Mycobacterium avium
TRIKRLVLDGLHRPIEEAVASETD

SEQ ID NO: 132861 - protein, 23 aa, Mycobacterium avium
TRIRRCYALPPAPVSRLPATCQS

SEQ ID NO: 132862 - protein, 22 aa, Mycobacterium avium
TRLASLLRRYGMGVPDAARALR

SEQ ID NO: 132863 - protein, 21 aa, Mycobacterium avium
TRLATWVAVPGHTASPAGSIS

SEQ ID NO: 132864 - protein, 19 aa, Mycobacterium avium
TRLLPTGRVRYFPDSEYRG

SEQ ID NO: 132865 - protein, 31 aa, Mycobacterium avium
TRLRDRVLLRFGLHRALRLGKPLQLHVGFGD

SEQ ID NO: 132866 - protein, 22 aa, Mycobacterium avium
TRLRNDALPPTMTYGSRSDSRA

SEQ ID NO: 132867 - protein, 22 aa, Mycobacterium avium
TRLSGLFRTRRFRVYTTDDVVG

SEQ ID NO: 132868 - protein, 32 aa, Mycobacterium avium
TRLTDLFGIEQPILLAPMALVSGGRLAAAVTR

SEQ ID NO: 132869 - protein, 18 aa, Mycobacterium avium
TRLTLSFIVTPHTSINLA

SEQ ID NO: 132870 - protein, 19 aa, Mycobacterium avium
TRLTLSFIVTPHTSINLAT

SEQ ID NO: 132871 - protein, 19 aa, Mycobacterium avium
TRMRVALSALTMAEWFRDE

SEQ ID NO: 132872 - protein, 21 aa, Mycobacterium avium
TRMYRTGDLVRWRADGQLDYL

SEQ ID NO: 132873 - protein, 19 aa, Mycobacterium avium
TRNLIALGTLALIDHPDQF

SEQ ID NO: 132874 - protein, 25 aa, Mycobacterium avium
TRNPLRLKRFGWFEEITPVPLDAAD

SEQ ID NO: 132875 - protein, 23 aa, Mycobacterium avium
TRNPLRLNRFGWFDEITPVPLDA

SEQ ID NO: 132876 - protein, 17 aa, Mycobacterium avium
TRPLRVIQWTTGNIGRR

SEQ ID NO: 132877 - protein, 19 aa, Mycobacterium avium
TRQRAAISTLLETLDDFRS

SEQ ID NO: 132878 - protein, 17 aa, Mycobacterium avium
TRRPPCLAINRTAWNAL

SEQ ID NO: 132879 - protein, 18 aa, Mycobacterium avium
TRRRLRNAPSRVDRGYRY

SEQ ID NO: 132880 - protein, 21 aa, Mycobacterium avium
TRRTIDRLLILQDEKVRNRNL

SEQ ID NO: 132881 - protein, 31 aa, Mycobacterium avium
TRRYVRRQRSWFRRDHRVRWLDAGACSPPRL

SEQ ID NO: 132882 - protein, 17 aa, Mycobacterium avium
TRSAVFAPLSDLGLVMV

SEQ ID NO: 132883 - protein, 18 aa, Mycobacterium avium
TRSAVFAPLSDLGLVMVW

SEQ ID NO: 132884 - protein, 24 aa, Mycobacterium avium
TRSYRYIDYWGTAVTAFDLHAPHT

SEQ ID NO: 132885 - protein, 28 aa, Mycobacterium avium
TRTARMDLAWSLAERWAPDGSPAGIGGA

SEQ ID NO: 132886 - protein, 21 aa, Mycobacterium avium
TRTIGVIPGSCGCANYTTEQL

SEQ ID NO: 132887 - protein, 21 aa, Mycobacterium avium
TRTPALPPRVVYFQPEILSSG

SEQ ID NO: 132888 - protein, 20 aa, Mycobacterium avium
TRVAALAFLAGELLPHAAAE

SEQ ID NO: 132889 - protein, 19 aa, Mycobacterium avium
TRVARPDLLALGALLHDIG

SEQ ID NO: 132890 - protein, 23 aa, Mycobacterium avium
TRVDEYIFFVKIGSAAPAKHSND

SEQ ID NO: 132891 - protein, 20 aa, Mycobacterium avium
TRVRLRVHRIPQAVRYEAWS

SEQ ID NO: 132892 - protein, 18 aa, Mycobacterium avium
TRVVKVVGFVASAPGFNG

SEQ ID NO: 132893 - protein, 17 aa, Mycobacterium avium
TRVWPLLERNKAALADI

SEQ ID NO: 132894 - protein, 17 aa, Mycobacterium avium
TSALRPLRAALAELTPQ

SEQ ID NO: 132895 - protein, 26 aa, Mycobacterium avium
TSAVRREIGVPTVFNLLGPLTNPARP

SEQ ID NO: 132896 - protein, 17 aa, Mycobacterium avium
TSAWTLIELIRHPDVYA

SEQ ID NO: 132897 - protein, 30 aa, Mycobacterium avium
TSDDRYLCINPFFHNFGYKAGILACLQTGA

SEQ ID NO: 132898 - protein, 17 aa, Mycobacterium avium
TSEPWQGPSAAAVTAAA

SEQ ID NO: 132899 - protein, 22 aa, Mycobacterium avium
TSFPGLGMLAGARVLAEIGDDR

SEQ ID NO: 132900 - protein, 27 aa, Mycobacterium avium
TSFTAQAFVSPYLVGVLGAATESSVSG

SEQ ID NO: 132901 - protein, 27 aa, Mycobacterium avium
TSGALAWAVYLLLSQPGAWATAAGEVR

SEQ ID NO: 132902 - protein, 24 aa, Mycobacterium avium
TSGELIRQVQLLSVPPSLSPARVL

SEQ ID NO: 132903 - protein, 33 aa, Mycobacterium avium
TSGEQRLSGFLLWQSAYSEMWFTEAHWPAFRRV

SEQ ID NO: 132904 - protein, 33 aa, Mycobacterium avium
TSGKVGLRLYKGLDWFDMIVALYQQAGEPTPKA

SEQ ID NO: 132905 - protein, 20 aa, Mycobacterium avium
TSGLRPASYFALAEAHGRLG

SEQ ID NO: 132906 - protein, 29 aa, Mycobacterium avium
TSGSRGFPIYARIARRWEFRQVRLAAQTV

SEQ ID NO: 132907 - protein, 17 aa, Mycobacterium avium
TSIPAPGLGALGAGRGG

SEQ ID NO: 132908 - protein, 23 aa, Mycobacterium avium
TSISATHYALTGPLGEMSVIDRF

SEQ ID NO: 132909 - protein, 23 aa, Mycobacterium avium
TSITLVAYSVPEPGWSKIIPAFN

SEQ ID NO: 132910 - protein, 21 aa, Mycobacterium avium
TSKSSTVASLAWLGDKRLERT

SEQ ID NO: 132911 - protein, 28 aa, Mycobacterium avium
TSMADRADWMFTLVRTGPPGRSTDGITY

SEQ ID NO: 132912 - protein, 28 aa, Mycobacterium avium
TSMHFVPSLLGLFLSLPGVSQWRTLRRV

SEQ ID NO: 132913 - protein, 18 aa, Mycobacterium avium
TSPRERFTALKQRLGDAF

SEQ ID NO: 132914 - protein, 17 aa, Mycobacterium avium
TSPWPTDPAFRRQVFQL

SEQ ID NO: 132915 - protein, 22 aa, Mycobacterium avium
TSRVDTLRKYVEATGGELEVSV

SEQ ID NO: 132916 - protein, 20 aa, Mycobacterium avium
TSRVLTTYRKAAPGPHGAAI

SEQ ID NO: 132917 - protein, 22 aa, Mycobacterium avium
TSSAFARYLADYIHEQGWQTYG

SEQ ID NO: 132918 - protein, 17 aa, Mycobacterium avium
TSTADLVSLLYQAIPAP

SEQ ID NO: 132919 - protein, 25 aa, Mycobacterium avium
TSTADLVSLLYQAIPAPARRTGGHP

SEQ ID NO: 132920 - protein, 17 aa, Mycobacterium avium
TSTRYSAGHHPGRAAPS

SEQ ID NO: 132921 - protein, 25 aa, Mycobacterium avium
TSTTLRCIRSWVLDVRHATNGPVPI

SEQ ID NO: 132922 - protein, 23 aa, Mycobacterium avium
TSVIRYHFGSRDGLIRALISYRQ

SEQ ID NO: 132923 - protein, 17 aa, Mycobacterium avium
TSYLRGPSVLVAHGEIS

SEQ ID NO: 132924 - protein, 26 aa, Mycobacterium avium
TTAPQLLAPALLLAVAPFGAIGGFAG

SEQ ID NO: 132925 - protein, 24 aa, Mycobacterium avium
TTASIRYLNLIGDRYLELKRGTSG

SEQ ID NO: 132926 - protein, 24 aa, Mycobacterium avium
TTDKDGIILALLASEILAVTGSTP

SEQ ID NO: 132927 - protein, 24 aa, Mycobacterium avium
TTEMTVMLARLLARTRLRLPAQRL

SEQ ID NO: 132928 - protein, 27 aa, Mycobacterium avium
TTESWFDHWYRHLVALGVRFVRAAATR

SEQ ID NO: 132929 - protein, 28 aa, Mycobacterium avium
TTESWFDHWYRHLVALGVRFVRDAATRL

SEQ ID NO: 132930 - protein, 24 aa, Mycobacterium avium
TTGALAPYLLIENAARGRSLEVIP

SEQ ID NO: 132931 - protein, 22 aa, Mycobacterium avium
TTKAYLYLSGTPFRALATGEFI

SEQ ID NO: 132932 - protein, 28 aa, Mycobacterium avium
TTKRPAPWWWRPSGALFDQFLGAAETEP

SEQ ID NO: 132933 - protein, 19 aa, Mycobacterium avium
TTLGRVHAAYWGSPRLEDG

SEQ ID NO: 132934 - protein, 23 aa, Mycobacterium avium
TTLRYYEQIGLLPAPTRLGGQRR

SEQ ID NO: 132935 - protein, 17 aa, Mycobacterium avium
TTLVGRLTAFISAAVKA

SEQ ID NO: 132936 - protein, 34 aa, Mycobacterium avium
TTLVTDLASGWIPPHLRLPAHVTLLEPAARRHDA

SEQ ID NO: 132937 - protein, 20 aa, Mycobacterium avium
TTNPPLLLATRHLVGDDGTY

SEQ ID NO: 132938 - protein, 26 aa, Mycobacterium avium
TTNTPGMMFPDRWIPNLADQVRAAAL

SEQ ID NO: 132939 - protein, 27 aa, Mycobacterium avium
TTNTQLLWYRPDLVLQPPRTWDAVVTE

SEQ ID NO: 132940 - protein, 18 aa, Mycobacterium avium
TTPALFKRYTCALDYARA

SEQ ID NO: 132941 - protein, 28 aa, Mycobacterium avium
TTPLPARLILRLLNFDESRFMDWVGWVH

SEQ ID NO: 132942 - protein, 19 aa, Mycobacterium avium
TTPPGLLHLAARAYTASGL

SEQ ID NO: 132943 - protein, 17 aa, Mycobacterium avium
TTPPRIAFVFPGQGNQW

SEQ ID NO: 132944 - protein, 19 aa, Mycobacterium avium
TTPPRIAFVFPGQGNQWQA

SEQ ID NO: 132945 - protein, 26 aa, Mycobacterium avium
TTQPQGWVRLRTEPALVLPSGPSAQA

SEQ ID NO: 132946 - protein, 20 aa, Mycobacterium avium
TTRHIPAFKLTRSSAAYWRG

SEQ ID NO: 132947 - protein, 33 aa, Mycobacterium avium
TTRLHYRHKLAARAVWALVGPLHRIVAPRLMRR

SEQ ID NO: 132948 - protein, 23 aa, Mycobacterium avium
TTRVDAVFRKGAYAAGYSGFEGV

SEQ ID NO: 132949 - protein, 27 aa, Mycobacterium avium
TTRVRLMTYILVSGYRSPYLTAKAAAS

SEQ ID NO: 132950 - protein, 25 aa, Mycobacterium avium
TTSTSPPPPWPSPKVCWARTPRRPT

SEQ ID NO: 132951 - protein, 23 aa, Mycobacterium avium
TTTELMNAMYTIEKAGFRGADAL

SEQ ID NO: 132952 - protein, 25 aa, Mycobacterium avium
TTTKPPVDVAFPPPKTRFYGVKTLS

SEQ ID NO: 132953 - protein, 20 aa, Mycobacterium avium
TTTMWRLIDKRIDAARLPGV

SEQ ID NO: 132954 - protein, 27 aa, Mycobacterium avium
TTTYLQALDWYLDHLGLIVSDFLFFPG

SEQ ID NO: 132955 - protein, 20 aa, Mycobacterium avium
TTVATGLIGALRGAGRRVAA

SEQ ID NO: 132956 - protein, 24 aa, Mycobacterium avium
TTVLLAQMFAAGVRRLVLASSMVV

SEQ ID NO: 132957 - protein, 31 aa, Mycobacterium avium
TTVSTVLQAAWAQLLMWLTGQHDVVFGTAVS

SEQ ID NO: 132958 - protein, 22 aa, Mycobacterium avium
TTWPKLKDRPMLGISVLGEEHD

SEQ ID NO: 132959 - protein, 17 aa, Mycobacterium avium
TTYLTEAMAIDRIAPEL

SEQ ID NO: 132960 - protein, 20 aa, Mycobacterium avium
TTYVYAEISPILYSIHNVVN

SEQ ID NO: 132961 - protein, 25 aa, Mycobacterium avium
TVAELRKILDRLPPGMPVLVDAYEA

SEQ ID NO: 132962 - protein, 18 aa, Mycobacterium avium
TVAEPLWLSDAELDGGPS

SEQ ID NO: 132963 - protein, 25 aa, Mycobacterium avium
TVAVARLMLGPGMRIQAPPNLVSRD

SEQ ID NO: 132964 - protein, 17 aa, Mycobacterium avium
TVCKIRIRARGQSVLRL

SEQ ID NO: 132965 - protein, 19 aa, Mycobacterium avium
TVDFLDDPPPLPAPAMPAA

SEQ ID NO: 132966 - protein, 26 aa, Mycobacterium avium
TVDFYSNILGMPLIKSLDLPGGAGQH

SEQ ID NO: 132967 - protein, 25 aa, Mycobacterium avium
TVDRGPLPPVRYGAASLIVVNKLDQ

SEQ ID NO: 132968 - protein, 17 aa, Mycobacterium avium
TVDTWMESPLKPGEVRD

SEQ ID NO: 132969 - protein, 18 aa, Mycobacterium avium
TVDTWMESPLKPGEVRDL

SEQ ID NO: 132970 - protein, 26 aa, Mycobacterium avium
TVEEGKLWLLQTRAAKRSAQAAVRLA

SEQ ID NO: 132971 - protein, 23 aa, Mycobacterium avium
TVEHYLRVPFVLTKCAVPHMRKQ

SEQ ID NO: 132972 - protein, 24 aa, Mycobacterium avium
TVELNASFYRWPKDSTFAGWREQL

SEQ ID NO: 132973 - protein, 21 aa, Mycobacterium avium
TVEWYDFFLYATAAGLVFNKV

SEQ ID NO: 132974 - protein, 17 aa, Mycobacterium avium
TVGARLTVLRRLAHPDD

SEQ ID NO: 132975 - protein, 35 aa, Mycobacterium avium
TVGARRVILIHWDDFFRPLSKPLRALPYAGDDLDS

SEQ ID NO: 132976 - protein, 20 aa, Mycobacterium avium
TVGELLARVRQRSLAAYEHQ

SEQ ID NO: 132977 - protein, 17 aa, Mycobacterium avium
TVGLIADRLLPGGVLHV

SEQ ID NO: 132978 - protein, 18 aa, Mycobacterium avium
TVGLQWWRRFGPDRPLHG

SEQ ID NO: 132979 - protein, 17 aa, Mycobacterium avium
TVGTARRLRVGAVGLIR

SEQ ID NO: 132980 - protein, 18 aa, Mycobacterium avium
TVIAGRWAIAGVLTEEAA

SEQ ID NO: 132981 - protein, 18 aa, Mycobacterium avium
TVIHAVAPVVVGWPVGQL

SEQ ID NO: 132982 - protein, 19 aa, Mycobacterium avium
TVIHAVAPVVVGWPVGQLY

SEQ ID NO: 132983 - protein, 24 aa, Mycobacterium avium
TVKNYVSRLLAKLGMERRTQAAVF

SEQ ID NO: 132984 - protein, 19 aa, Mycobacterium avium
TVLAQPRVRLCDYYTSDLP

SEQ ID NO: 132985 - protein, 17 aa, Mycobacterium avium
TVLPAGGRLLACGNGGS

SEQ ID NO: 132986 - protein, 21 aa, Mycobacterium avium
TVMAAAVIEALFFGSDEFDFA

SEQ ID NO: 132987 - protein, 25 aa, Mycobacterium avium
TVNEHPWLPGFEPPYVIAVVALDEC

SEQ ID NO: 132988 - protein, 22 aa, Mycobacterium avium
TVNFCRSVLRWLRAGYPEGVPG

SEQ ID NO: 132989 - protein, 18 aa, Mycobacterium avium
TVNGYYKAELIYGPARPG

SEQ ID NO: 132990 - protein, 25 aa, Mycobacterium avium
TVNMFVRSLVIHPVEFEPPADYVTP

SEQ ID NO: 132991 - protein, 23 aa, Mycobacterium avium
TVNTLMQMAWALVLSRLTDTDDV

SEQ ID NO: 132992 - protein, 20 aa, Mycobacterium avium
TVNTVLQAAFARLLCALTGQ

SEQ ID NO: 132993 - protein, 25 aa, Mycobacterium avium
TVPRCAVALGLPPWTPAMDIVKAWK

SEQ ID NO: 132994 - protein, 20 aa, Mycobacterium avium
TVPRLAFPTPSGRAVFFARP

SEQ ID NO: 132995 - protein, 17 aa, Mycobacterium avium
TVPTVKFADGSTLTNPS

SEQ ID NO: 132996 - protein, 17 aa, Mycobacterium avium
TVQPLEKLFGTAISRPV

SEQ ID NO: 132997 - protein, 17 aa, Mycobacterium avium
TVQRWKAIRGEAGWMTT

SEQ ID NO: 132998 - protein, 17 aa, Mycobacterium avium
TVRGQRLLQSCPVCLYA

SEQ ID NO: 132999 - protein, 20 aa, Mycobacterium avium
TVRIPVPDLPSPYSLAVVQL

SEQ ID NO: 133000 - protein, 24 aa, Mycobacterium avium
TVRPEVLHAWHLLQRSRGLMPVTA

SEQ ID NO: 133001 - protein, 24 aa, Mycobacterium avium
TVRRAAPFATLPRSIYEATLDLLS

SEQ ID NO: 133002 - protein, 23 aa, Mycobacterium avium
TVRRYRDLGFDRLLFHPTSASVE

SEQ ID NO: 133003 - protein, 27 aa, Mycobacterium avium
TVRVGRHDVRMLLAKNPAGWQEALSMV

SEQ ID NO: 133004 - protein, 20 aa, Mycobacterium avium
TVRYRLRKMAELTNLSLDDA

SEQ ID NO: 133005 - protein, 23 aa, Mycobacterium avium
TVSKLSVPPSWAGATPGGRFQQR

SEQ ID NO: 133006 - protein, 30 aa, Mycobacterium avium
TVSTVLQAAWAQLLMWLTGQHDVVFGTAVS

SEQ ID NO: 133007 - protein, 23 aa, Mycobacterium avium
TVSWSAVAAVVYGLVLEGRETES

SEQ ID NO: 133008 - protein, 23 aa, Mycobacterium avium
TVTAGQSLIWLEAMKMEHTIADP

SEQ ID NO: 133009 - protein, 17 aa, Mycobacterium avium
TVTIGLGPSLFGDRFGL

SEQ ID NO: 133010 - protein, 21 aa, Mycobacterium avium
TVTITWTLPNGWEMTWQGRPD

SEQ ID NO: 133011 - protein, 17 aa, Mycobacterium avium
TVTLPHRPMRYDAELRD

SEQ ID NO: 133012 - protein, 25 aa, Mycobacterium avium
TVTVKTVTNGVLTPGLHGLHVHEIG

SEQ ID NO: 133013 - protein, 17 aa, Mycobacterium avium
TVVAKLLTLFGTEDQKQ

SEQ ID NO: 133014 - protein, 18 aa, Mycobacterium avium
TVVAKLLTLFGTEDQKRA

SEQ ID NO: 133015 - protein, 19 aa, Mycobacterium avium
TVVPPSWRPDLLQPADLVE

SEQ ID NO: 133016 - protein, 18 aa, Mycobacterium avium
TVVTNRPNRRIVIMPSDD

SEQ ID NO: 133017 - protein, 18 aa, Mycobacterium avium
TVVYHYPVTAERSLRWVA

SEQ ID NO: 133018 - protein, 20 aa, Mycobacterium avium
TVYAAISAPLRPGALGGVPI

SEQ ID NO: 133019 - protein, 25 aa, Mycobacterium avium
TVYRQEMLRIFGLPESGLAETLREA

SEQ ID NO: 133020 - protein, 31 aa, Mycobacterium avium
TWEDIAWLRELWGGPFMLKGVMRVDDAKRAV

SEQ ID NO: 133021 - protein, 24 aa, Mycobacterium avium
TWEHDLHLFLRRIKFDEAVDGTVA

SEQ ID NO: 133022 - protein, 26 aa, Mycobacterium avium
TWEHDLHLFLRRIKVDEAFNGSVAEH

SEQ ID NO: 133023 - protein, 28 aa, Mycobacterium avium
TWEHDLHLYLRRVTLYRGMFGTPEEHNL

SEQ ID NO: 133024 - protein, 18 aa, Mycobacterium avium
TWFELLSPEQIVMAYGMT

SEQ ID NO: 133025 - protein, 18 aa, Mycobacterium avium
TWGTILPAEPDDPWSMVF

SEQ ID NO: 133026 - protein, 18 aa, Mycobacterium avium
TWIHETRPLIDDEPLSAF

SEQ ID NO: 133027 - protein, 24 aa, Mycobacterium avium
TWITDGHWADMGLALMRTDPASSR

SEQ ID NO: 133028 - protein, 18 aa, Mycobacterium avium
TWMVLAGVERALALDSEP

SEQ ID NO: 133029 - protein, 18 aa, Mycobacterium avium
TWQVGAMRDILLARREPG

SEQ ID NO: 133030 - protein, 28 aa, Mycobacterium avium
TWTAALIGPWWPAPSTALRAGAQHWSES

SEQ ID NO: 133031 - protein, 17 aa, Mycobacterium avium
TWTRPHPPLYVGGGARA

SEQ ID NO: 133032 - protein, 18 aa, Mycobacterium avium
TWTRPHPPLYVGGGARAT

SEQ ID NO: 133033 - protein, 19 aa, Mycobacterium avium
TWYARFAAQAMTDPAYYNI

SEQ ID NO: 133034 - protein, 17 aa, Mycobacterium avium
TYDHRLIDGADAGRFLT

SEQ ID NO: 133035 - protein, 24 aa, Mycobacterium avium
TYFEPYNDWPYGGPRPLISYAPGT

SEQ ID NO: 133036 - protein, 23 aa, Mycobacterium avium
TYFEPYNDWPYGGPRPLMSYAPG

SEQ ID NO: 133037 - protein, 20 aa, Mycobacterium avium
TYFQAAFRIQSPWSIRNPNG

SEQ ID NO: 133038 - protein, 23 aa, Mycobacterium avium
TYFTEQVFPVLTPLAVDPAHPFP

SEQ ID NO: 133039 - protein, 24 aa, Mycobacterium avium
TYFTEQVFPVLTPLAVDPAHPFPF

SEQ ID NO: 133040 - protein, 19 aa, Mycobacterium avium
TYFVIRPRPRVHARPCLLF

SEQ ID NO: 133041 - protein, 23 aa, Mycobacterium avium
TYGIIQHAEYFTFYASVDHLHID

SEQ ID NO: 133042 - protein, 26 aa, Mycobacterium avium
TYGQDRPADRPLWLGSIKSNIGHTSA

SEQ ID NO: 133043 - protein, 27 aa, Mycobacterium avium
TYGQDRPADRPLWLGSIKSNIGHTSAA

SEQ ID NO: 133044 - protein, 33 aa, Mycobacterium avium
TYIHPEDRFMLKDPIYGLGPRLAQLAAGVFFRE

SEQ ID NO: 133045 - protein, 17 aa, Mycobacterium avium
TYLAPALDKLGVSALVD

SEQ ID NO: 133046 - protein, 17 aa, Mycobacterium avium
TYLNGVVHETLRLYPPG

SEQ ID NO: 133047 - protein, 19 aa, Mycobacterium avium
TYLYTTSLMHCMTVSLAAG

SEQ ID NO: 133048 - protein, 23 aa, Mycobacterium avium
TYMNMVSMMAICFEKMLVSAVRE

SEQ ID NO: 133049 - protein, 17 aa, Mycobacterium avium
TYRFNPFDVTKVWPHAD

SEQ ID NO: 133050 - protein, 19 aa, Mycobacterium avium
TYRFNPFDVTKVWPHADYP

SEQ ID NO: 133051 - protein, 20 aa, Mycobacterium avium
TYRFNPFDVTKVWPHADYPL

SEQ ID NO: 133052 - protein, 17 aa, Mycobacterium avium
TYSTLFMRTYGWGSQVQ

SEQ ID NO: 133053 - protein, 18 aa, Mycobacterium avium
TYSTLFMRTYGWGSQVQN

SEQ ID NO: 133054 - protein, 24 aa, Mycobacterium avium
TYTTQEFPPPLPYKGNRDPKVFQP

SEQ ID NO: 133055 - protein, 34 aa, Mycobacterium avium
TYVALRAEIDNWRWAGVPIFLRAGKALPHKVTEV

SEQ ID NO: 133056 - protein, 22 aa, Mycobacterium avium
VAAAPEFRTLIRGPLDTDRLGA

SEQ ID NO: 133057 - protein, 19 aa, Mycobacterium avium
VAADLLLTGRMFGGAEATA

SEQ ID NO: 133058 - protein, 17 aa, Mycobacterium avium
VAAFRQVIAGRLNKLDP

SEQ ID NO: 133059 - protein, 27 aa, Mycobacterium avium
VAAGAPWFMTLFGRDSLLTAWMALPLD

SEQ ID NO: 133060 - protein, 24 aa, Mycobacterium avium
VAAHAPYLAWLTQASANSAEMAAS

SEQ ID NO: 133061 - protein, 17 aa, Mycobacterium avium
VAALLGCAVLTGGGAVF

SEQ ID NO: 133062 - protein, 26 aa, Mycobacterium avium
VAAPASYFQLAFTRVGLMPDGGASAL

SEQ ID NO: 133063 - protein, 19 aa, Mycobacterium avium
VAAPLRLFTPEMDSFTAHL

SEQ ID NO: 133064 - protein, 20 aa, Mycobacterium avium
VAARRFRWQALVDGEPVITA

SEQ ID NO: 133065 - protein, 21 aa, Mycobacterium avium
VAARRIAWVKLLNSGQTCIAP

SEQ ID NO: 133066 - protein, 25 aa, Mycobacterium avium
VAAVQLPHPALALGLAARQAGLHPL

SEQ ID NO: 133067 - protein, 21 aa, Mycobacterium avium
VAAWRGFSRWLMRAYDVLIDE

SEQ ID NO: 133068 - protein, 22 aa, Mycobacterium avium
VAAYRLLNLRVNATMSSGALGM

SEQ ID NO: 133069 - protein, 25 aa, Mycobacterium avium
VACFDEALALWRGIPELPDGRRGTS

SEQ ID NO: 133070 - protein, 24 aa, Mycobacterium avium
VACFDEALGLWRGIPELPDGRRGT

SEQ ID NO: 133071 - protein, 26 aa, Mycobacterium avium
VACRPWLITEIEAVHPRIIVCLGATA

SEQ ID NO: 133072 - protein, 19 aa, Mycobacterium avium
VACYALPAARRALDLTKTY

SEQ ID NO: 133073 - protein, 17 aa, Mycobacterium avium
VADASDPIGFPAALSTL

SEQ ID NO: 133074 - protein, 18 aa, Mycobacterium avium
VADFPRLGGPAGGTLFYP

SEQ ID NO: 133075 - protein, 25 aa, Mycobacterium avium
VADPSRAARLLGFRAAVQPGDGLRE

SEQ ID NO: 133076 - protein, 26 aa, Mycobacterium avium
VADPSRAARLLGFRAAVQPGDGLREF

SEQ ID NO: 133077 - protein, 20 aa, Mycobacterium avium
VADRPQVFLTLTAPSFGAVH

SEQ ID NO: 133078 - protein, 29 aa, Mycobacterium avium
VADSYTELIPFRLTVLHAAWLIDNGDERA

SEQ ID NO: 133079 - protein, 18 aa, Mycobacterium avium
VADYLTGKGWRVTPHPAR

SEQ ID NO: 133080 - protein, 22 aa, Mycobacterium avium
VAEAREEALRIATAAKREYEAS

SEQ ID NO: 133081 - protein, 23 aa, Mycobacterium avium
VAEAWLQFHVPMSYHGTFTTRVA

SEQ ID NO: 133082 - protein, 19 aa, Mycobacterium avium
VAEEAIVPRGLMSHMVYAD

SEQ ID NO: 133083 - protein, 18 aa, Mycobacterium avium
VAEKALLRRLVEAGTRVV

SEQ ID NO: 133084 - protein, 26 aa, Mycobacterium avium
VAELDRAWRHLPFAAQWHSDNELARH

SEQ ID NO: 133085 - protein, 17 aa, Mycobacterium avium
VAELLCRIILQGLASRP

SEQ ID NO: 133086 - protein, 25 aa, Mycobacterium avium
VAESLRYVAAWNAAFLPSKDLTEGI

SEQ ID NO: 133087 - protein, 26 aa, Mycobacterium avium
VAEWIKVVCFPQRWLDLRYVGPAKDT

SEQ ID NO: 133088 - protein, 31 aa, Mycobacterium avium
VAEWIKVVCFPQRWLDLRYVGPAKDTGEGGG

SEQ ID NO: 133089 - protein, 26 aa, Mycobacterium avium
VAEWIKVVCFPQRWLDLRYVGPAKGT

SEQ ID NO: 133090 - protein, 27 aa, Mycobacterium avium
VAGAPAAFAIPLRESGWLTTGLELPSW

SEQ ID NO: 133091 - protein, 27 aa, Mycobacterium avium
VAGASFFVLDPWLCPAPVGVTGELYVA

SEQ ID NO: 133092 - protein, 19 aa, Mycobacterium avium
VAGGHRRQPGRRLSHGVGG

SEQ ID NO: 133093 - protein, 25 aa, Mycobacterium avium
VAGGLARHVLCFRTLWEATHAELMK

SEQ ID NO: 133094 - protein, 19 aa, Mycobacterium avium
VAGITRLLTGLGYSGYFEL

SEQ ID NO: 133095 - protein, 17 aa, Mycobacterium avium
VAGLLDRLDHMLSYHAM

SEQ ID NO: 133096 - protein, 19 aa, Mycobacterium avium
VAGPGFINLRLEASAQAIV

SEQ ID NO: 133097 - protein, 24 aa, Mycobacterium avium
VAGTALIAGLLKGLLDLGVTPRVN

SEQ ID NO: 133098 - protein, 17 aa, Mycobacterium avium
VAHHRAFARIAPMLWLR

SEQ ID NO: 133099 - protein, 27 aa, Mycobacterium avium
VAIAAHRPTLLGSATPFFVAFMAAQAK

SEQ ID NO: 133100 - protein, 17 aa, Mycobacterium avium
VAILAVLKTGAAYLPID

SEQ ID NO: 133101 - protein, 22 aa, Mycobacterium avium
VAISLFRGPQYVVAILAVLKAG

SEQ ID NO: 133102 - protein, 19 aa, Mycobacterium avium
VALAVPDVGDLLTWRGGSE

SEQ ID NO: 133103 - protein, 22 aa, Mycobacterium avium
VALGCGFRCGFLGLLHMEITRE

SEQ ID NO: 133104 - protein, 18 aa, Mycobacterium avium
VALHLLRSRASADLERQV

SEQ ID NO: 133105 - protein, 23 aa, Mycobacterium avium
VALIVGVPMDFRLGFGAVFGPHT

SEQ ID NO: 133106 - protein, 18 aa, Mycobacterium avium
VALPRVSIFLSLLDAHVQ

SEQ ID NO: 133107 - protein, 18 aa, Mycobacterium avium
VALRAYWEMDRAAANTKK

SEQ ID NO: 133108 - protein, 19 aa, Mycobacterium avium
VALRAYWEMDRAAANTKKI

SEQ ID NO: 133109 - protein, 26 aa, Mycobacterium avium
VAMLALARMPVVQAPVLHLYRCREVC

SEQ ID NO: 133110 - protein, 22 aa, Mycobacterium avium
VANRRLPGFFPRRRSRVPGNDR

SEQ ID NO: 133111 - protein, 25 aa, Mycobacterium avium
VAPHASWMFEYYPMRDLRELPDGSC

SEQ ID NO: 133112 - protein, 18 aa, Mycobacterium avium
VAPIWWNEQPIGAGGFDD

SEQ ID NO: 133113 - protein, 25 aa, Mycobacterium avium
VAPKRVLPVFGLRSAIPAEREVFVV

SEQ ID NO: 133114 - protein, 22 aa, Mycobacterium avium
VAPLFHTRYEPLWALCAELDFT

SEQ ID NO: 133115 - protein, 22 aa, Mycobacterium avium
VAPLFHTRYEPLWALCAELDLT

SEQ ID NO: 133116 - protein, 18 aa, Mycobacterium avium
VAPWIHRGLTSQDVLDTT

SEQ ID NO: 133117 - protein, 19 aa, Mycobacterium avium
VAQYRLRELREAAGYTQTT

SEQ ID NO: 133118 - protein, 19 aa, Mycobacterium avium
VARACPWANRAIIVRRLLG

SEQ ID NO: 133119 - protein, 26 aa, Mycobacterium avium
VARAGAHDLARFYDGIQAAHHGGPAD

SEQ ID NO: 133120 - protein, 18 aa, Mycobacterium avium
VARAVRPPTPGRRLPKSL

SEQ ID NO: 133121 - protein, 17 aa, Mycobacterium avium
VARCTVERLMRANGWRG

SEQ ID NO: 133122 - protein, 18 aa, Mycobacterium avium
VARIAFGPTAPYWSDFDA

SEQ ID NO: 133123 - protein, 22 aa, Mycobacterium avium
VARIAFGPTAPYWSEFEVALLR

SEQ ID NO: 133124 - protein, 17 aa, Mycobacterium avium
VARLLAGIAPRSAAAAG

SEQ ID NO: 133125 - protein, 40 aa, Mycobacterium avium
VARNRYLIYTSPDIRALYAFKRLAWWPYSVVMRQVNVIFT

SEQ ID NO: 133126 - protein, 17 aa, Mycobacterium avium
VARVGTVVMSWRLRTRH

SEQ ID NO: 133127 - protein, 19 aa, Mycobacterium avium
VARVKALLRRRGATATSSS

SEQ ID NO: 133128 - protein, 19 aa, Mycobacterium avium
VATFRRGFAAWVAGLPREE

SEQ ID NO: 133129 - protein, 19 aa, Mycobacterium avium
VATLVEVFRRVDALGLELA

SEQ ID NO: 133130 - protein, 17 aa, Mycobacterium avium
VATRTPALPPRVVYFQP

SEQ ID NO: 133131 - protein, 24 aa, Mycobacterium avium
VAVASKIMPVAPFPRWSGNARGPA

SEQ ID NO: 133132 - protein, 24 aa, Mycobacterium avium
VAVDPPYPVIIGTGLLGELDELLG

SEQ ID NO: 133133 - protein, 21 aa, Mycobacterium avium
VAVFDTGFFHDLPPAAATYAI

SEQ ID NO: 133134 - protein, 19 aa, Mycobacterium avium
VAVHRLLCWGIVATPLTVV

SEQ ID NO: 133135 - protein, 17 aa, Mycobacterium avium
VAVLGLGPIGDMAARIA

SEQ ID NO: 133136 - protein, 18 aa, Mycobacterium avium
VAVLGLGPIGDMAARIAD

SEQ ID NO: 133137 - protein, 18 aa, Mycobacterium avium
VAVQYFATVSSTPWPEHW

SEQ ID NO: 133138 - protein, 28 aa, Mycobacterium avium
VAVRGFPNYFFACGPDPGPQARYIVECL

SEQ ID NO: 133139 - protein, 17 aa, Mycobacterium avium
VAVRPLVLPDIEERFWA

SEQ ID NO: 133140 - protein, 24 aa, Mycobacterium avium
VAVSPAELKNRGGPILLRHSPSNR

SEQ ID NO: 133141 - protein, 23 aa, Mycobacterium avium
VAVVLQALLDRHPMLRLRVQDDG

SEQ ID NO: 133142 - protein, 17 aa, Mycobacterium avium
VAWLANRLAPHGVWLER

SEQ ID NO: 133143 - protein, 31 aa, Mycobacterium avium
VAWLPDSRVLFTGNLFGPLFGHVPNLVTIRG

SEQ ID NO: 133144 - protein, 21 aa, Mycobacterium avium
VAYQLSFHEGSRYPLDRGAAG

SEQ ID NO: 133145 - protein, 18 aa, Mycobacterium avium
VCAPLRDRVLRELTDEAD

SEQ ID NO: 133146 - protein, 17 aa, Mycobacterium avium
VCQLYDSFTSTVLLTVE

SEQ ID NO: 133147 - protein, 23 aa, Mycobacterium avium
VCRRAGLAARYFYESFTDKDEFV

SEQ ID NO: 133148 - protein, 17 aa, Mycobacterium avium
VCTPRRPPRPTPVLQAM

SEQ ID NO: 133149 - protein, 27 aa, Mycobacterium avium
VDAAGVPYFSLAILPGGQRARRAPGAG

SEQ ID NO: 133150 - protein, 18 aa, Mycobacterium avium
VDAARYKVAARRGRDAAA

SEQ ID NO: 133151 - protein, 28 aa, Mycobacterium avium
VDADGVPYFALAILPGGQRARRAPSAGT

SEQ ID NO: 133152 - protein, 28 aa, Mycobacterium avium
VDADGVPYFSLAILPGGQRARRAPGAGT

SEQ ID NO: 133153 - protein, 18 aa, Mycobacterium avium
VDADGYLRLCGRRHDMVV

SEQ ID NO: 133154 - protein, 26 aa, Mycobacterium avium
VDADTSLPLLLIAASLRVGMRDRVEG

SEQ ID NO: 133155 - protein, 24 aa, Mycobacterium avium
VDAGLHALWLQIVEKFVSAGAEEI

SEQ ID NO: 133156 - protein, 24 aa, Mycobacterium avium
VDAGVPLWAVLDDSAPKASAEAPI

SEQ ID NO: 133157 - protein, 17 aa, Mycobacterium avium
VDAGYQCALLAPTEVLA

SEQ ID NO: 133158 - protein, 17 aa, Mycobacterium avium
VDAHHHPAPALPGHERL

SEQ ID NO: 133159 - protein, 17 aa, Mycobacterium avium
VDAIWLNPVTVSPMADH

SEQ ID NO: 133160 - protein, 26 aa, Mycobacterium avium
VDALHRWLVAWADIYDAHAAVFAEFP

SEQ ID NO: 133161 - protein, 18 aa, Mycobacterium avium
VDAMFRDSYMRADAQETV

SEQ ID NO: 133162 - protein, 26 aa, Mycobacterium avium
VDAPDPPLHVWTDNPGDPWAARIAAT

SEQ ID NO: 133163 - protein, 24 aa, Mycobacterium avium
VDASLVKLLAPVLPGLHTVHTVIV

SEQ ID NO: 133164 - protein, 17 aa, Mycobacterium avium
VDASPARRWRRPARPAR

SEQ ID NO: 133165 - protein, 21 aa, Mycobacterium avium
VDASPARRWRRPARPARWRAQ

SEQ ID NO: 133166 - protein, 17 aa, Mycobacterium avium
VDAYVEALLAKQKLLID

SEQ ID NO: 133167 - protein, 25 aa, Mycobacterium avium
VDDALYEMELVGRDFFLFQDKQTER

SEQ ID NO: 133168 - protein, 23 aa, Mycobacterium avium
VDDFGMGLLLKGRQVKKVIASYV

SEQ ID NO: 133169 - protein, 18 aa, Mycobacterium avium
VDDLAAFAQPYLSRLWAR

SEQ ID NO: 133170 - protein, 21 aa, Mycobacterium avium
VDDLLDHLLPPDWRVDMQELD

SEQ ID NO: 133171 - protein, 26 aa, Mycobacterium avium
VDDPALPEPLPDGPVRRAPLGTIAGA

SEQ ID NO: 133172 - protein, 24 aa, Mycobacterium avium
VDDRTRAQRPEWLAAAAAVTAGQP

SEQ ID NO: 133173 - protein, 25 aa, Mycobacterium avium
VDDTLAMFERLLAPGGSLVFIDATA

SEQ ID NO: 133174 - protein, 17 aa, Mycobacterium avium
VDDVGLDSVAFAVGMVA

SEQ ID NO: 133175 - protein, 23 aa, Mycobacterium avium
VDEDGYLFLTDRKAFVIISGGVN

SEQ ID NO: 133176 - protein, 22 aa, Mycobacterium avium
VDEFAVVDPIPGKTLVRVTLHE

SEQ ID NO: 133177 - protein, 17 aa, Mycobacterium avium
VDEFPLTGLGKVAKSEL

SEQ ID NO: 133178 - protein, 24 aa, Mycobacterium avium
VDELERRNARRALITLCIGGGMGV

SEQ ID NO: 133179 - protein, 17 aa, Mycobacterium avium
VDELPLTAMLKPDRLAL

SEQ ID NO: 133180 - protein, 21 aa, Mycobacterium avium
VDFLDDPPPLPAPGTPAAPPA

SEQ ID NO: 133181 - protein, 22 aa, Mycobacterium avium
VDFLDDPPPLPAPGTPAAPPAR

SEQ ID NO: 133182 - protein, 18 aa, Mycobacterium avium
VDFRPANYFGVTALNLVP

SEQ ID NO: 133183 - protein, 31 aa, Mycobacterium avium
VDGAAYLFTNDYEWELLLSKTGWSEADVQQK

SEQ ID NO: 133184 - protein, 26 aa, Mycobacterium avium
VDGAGLFVLDAWLRPVAPGVVGELYV

SEQ ID NO: 133185 - protein, 23 aa, Mycobacterium avium
VDGDPGPFLSWAQLCERAPAGRP

SEQ ID NO: 133186 - protein, 24 aa, Mycobacterium avium
VDGDPGPFLSWAQLCERAPAGRPA

SEQ ID NO: 133187 - protein, 24 aa, Mycobacterium avium
VDGDPLAFKITTQLDLLLAETIVR

SEQ ID NO: 133188 - protein, 24 aa, Mycobacterium avium
VDGHPFGLYVHVPFCVTRCGYCDF

SEQ ID NO: 133189 - protein, 25 aa, Mycobacterium avium
VDGMEALLPVLRPGKQVLLTDQLAD

SEQ ID NO: 133190 - protein, 25 aa, Mycobacterium avium
VDGMEALLPVLRPGKQVLLTDQLAE

SEQ ID NO: 133191 - protein, 26 aa, Mycobacterium avium
VDGVFLPFHLLTLGDMGLMLGEYWDL

SEQ ID NO: 133192 - protein, 34 aa, Mycobacterium avium
VDHDHQHVLVLGYREKLCADWYFGGQVEGVAGDV

SEQ ID NO: 133193 - protein, 25 aa, Mycobacterium avium
VDHHPVRRPPIHQLGRARLGADHQR

SEQ ID NO: 133194 - protein, 25 aa, Mycobacterium avium
VDHPDLKVLLGNTPLWTPADFSLNE

SEQ ID NO: 133195 - protein, 22 aa, Mycobacterium avium
VDHPRLGWRQAPVGQVLADALG

SEQ ID NO: 133196 - protein, 18 aa, Mycobacterium avium
VDHVMTYFFTDGSGLRGF

SEQ ID NO: 133197 - protein, 29 aa, Mycobacterium avium
VDHYAEIGLLGFALITDALGGVDVCLKEP

SEQ ID NO: 133198 - protein, 22 aa, Mycobacterium avium
VDIEFPSPALIYGYGAYEICID

SEQ ID NO: 133199 - protein, 24 aa, Mycobacterium avium
VDKGRWTFGYLMSRATTIGAGTAE

SEQ ID NO: 133200 - protein, 27 aa, Mycobacterium avium
VDKIMLGSLPDIGFPGDIGLHGPHHYN

SEQ ID NO: 133201 - protein, 22 aa, Mycobacterium avium
VDLALLYDGFTFNCVSWLEALG

SEQ ID NO: 133202 - protein, 27 aa, Mycobacterium avium
VDLRDWRQWWHWVPGASWRHPSGPDSD

SEQ ID NO: 133203 - protein, 23 aa, Mycobacterium avium
VDLSRTVGWFTTKYPVALRMGRR

SEQ ID NO: 133204 - protein, 24 aa, Mycobacterium avium
VDLSRTVGWFTTKYPVALRMSRRL

SEQ ID NO: 133205 - protein, 23 aa, Mycobacterium avium
VDLSRTVGWFTTKYPVALTISQR

SEQ ID NO: 133206 - protein, 23 aa, Mycobacterium avium
VDLSRTVGWFTTKYPVALTVGAL

SEQ ID NO: 133207 - protein, 19 aa, Mycobacterium avium
VDMEPFFDAYRAVKPYLIT

SEQ ID NO: 133208 - protein, 25 aa, Mycobacterium avium
VDNALKLLLLLGEQPEIRLSEATRY

SEQ ID NO: 133209 - protein, 17 aa, Mycobacterium avium
VDPGLPVLGMAGSVFFD

SEQ ID NO: 133210 - protein, 24 aa, Mycobacterium avium
VDPKRKVRFLPYGIAVSVLDDDPE

SEQ ID NO: 133211 - protein, 23 aa, Mycobacterium avium
VDPTHITQLLGRMVRTPLARRIP

SEQ ID NO: 133212 - protein, 19 aa, Mycobacterium avium
VDPWVVDELLQRSSGNPLL

SEQ ID NO: 133213 - protein, 20 aa, Mycobacterium avium
VDQPLLDRFDLTYNSASVLA

SEQ ID NO: 133214 - protein, 21 aa, Mycobacterium avium
VDRALFPDFPAFLQAAAAPEA

SEQ ID NO: 133215 - protein, 25 aa, Mycobacterium avium
VDRLGLFFELLGATRTMGRVYGWLL

SEQ ID NO: 133216 - protein, 23 aa, Mycobacterium avium
VDRSAAYAMRWVAKNIVAAGLAE

SEQ ID NO: 133217 - protein, 17 aa, Mycobacterium avium
VDRYGPRIRACELDVTD

SEQ ID NO: 133218 - protein, 17 aa, Mycobacterium avium
VDSLWFSELVYSPAVDP

SEQ ID NO: 133219 - protein, 18 aa, Mycobacterium avium
VDSLWFSELVYSPAVDPV

SEQ ID NO: 133220 - protein, 28 aa, Mycobacterium avium
VDTDMLHSPPMYRAFRPDLPAPTREDAE

SEQ ID NO: 133221 - protein, 29 aa, Mycobacterium avium
VDTEAFHVDLLWLLEIGSNQKIASWATFD

SEQ ID NO: 133222 - protein, 27 aa, Mycobacterium avium
VDTLSVFLQLMLFPDTPRSVLRSLSLH

SEQ ID NO: 133223 - protein, 26 aa, Mycobacterium avium
VDTLSVFLQLTLFPDTPPAVLTSLRL

SEQ ID NO: 133224 - protein, 23 aa, Mycobacterium avium
VDTPPNLALLTTRLQRPGHGFFT

SEQ ID NO: 133225 - protein, 24 aa, Mycobacterium avium
VDTVKARLPVWKHQFFADGTDEWV

SEQ ID NO: 133226 - protein, 26 aa, Mycobacterium avium
VDVALAQHVLPFPAGQIVTRSGPFMA

SEQ ID NO: 133227 - protein, 24 aa, Mycobacterium avium
VDVIPDVLRHRLVLTYDALADEIS

SEQ ID NO: 133228 - protein, 18 aa, Mycobacterium avium
VDVRIDVLAKGAPRADSR

SEQ ID NO: 133229 - protein, 26 aa, Mycobacterium avium
VDVRLRAAQQLPWHPGRCAEVLVGDT

SEQ ID NO: 133230 - protein, 23 aa, Mycobacterium avium
VDVSLLNAAIWQLGPDIVGSGVT

SEQ ID NO: 133231 - protein, 32 aa, Mycobacterium avium
VDVSMFESLLATLPYPMLMAARLKSLGLPTNS

SEQ ID NO: 133232 - protein, 26 aa, Mycobacterium avium
VDWDELARWALIDKALGLDVPEPAET

SEQ ID NO: 133233 - protein, 17 aa, Mycobacterium avium
VDWFPPTHPDRPDAPNM

SEQ ID NO: 133234 - protein, 18 aa, Mycobacterium avium
VDYPGHTSALRPLRASLA

SEQ ID NO: 133235 - protein, 17 aa, Mycobacterium avium
VDYQRLGKMPPLQTGGL

SEQ ID NO: 133236 - protein, 17 aa, Mycobacterium avium
VEAFWGADWSREISVVA

SEQ ID NO: 133237 - protein, 17 aa, Mycobacterium avium
VEAGKLGLLGFSVPERL

SEQ ID NO: 133238 - protein, 17 aa, Mycobacterium avium
VEAWLAAEPFRAPEADE

SEQ ID NO: 133239 - protein, 17 aa, Mycobacterium avium
VEDLAAFAQPYLSRLWA

SEQ ID NO: 133240 - protein, 21 aa, Mycobacterium avium
VEGGYPTTLWARRPATLEAFA

SEQ ID NO: 133241 - protein, 21 aa, Mycobacterium avium
VEGGYPTTLWARRPATLEVFA

SEQ ID NO: 133242 - protein, 21 aa, Mycobacterium avium
VEGSVIAWRPAEPGKQPPGHL

SEQ ID NO: 133243 - protein, 31 aa, Mycobacterium avium
VEHDGRIWYRTGDLVRYWPDGTLEFVGRADH

SEQ ID NO: 133244 - protein, 25 aa, Mycobacterium avium
VEIAEMFRLPPALERAWHARGYYGS

SEQ ID NO: 133245 - protein, 26 aa, Mycobacterium avium
VEIAEMFRLPPALERAWHARGYYGSV

SEQ ID NO: 133246 - protein, 21 aa, Mycobacterium avium
VEIAEMFRLPPALERGWHARG

SEQ ID NO: 133247 - protein, 29 aa, Mycobacterium avium
VEINEAFAPVVLAWLAELGADPVKVNPNG

SEQ ID NO: 133248 - protein, 31 aa, Mycobacterium avium
VEIPKLDLRRKFRAIWIGGRTPPAGAIRDLL

SEQ ID NO: 133249 - protein, 18 aa, Mycobacterium avium
VELAGRWLRPGGLIGIEH

SEQ ID NO: 133250 - protein, 25 aa, Mycobacterium avium
VELCSLTYPGYKPSLAGLVGSALFA

SEQ ID NO: 133251 - protein, 21 aa, Mycobacterium avium
VELFYGRPRTQSSWELVTDAL

SEQ ID NO: 133252 - protein, 18 aa, Mycobacterium avium
VELGFDFLPGTTVNRYCS

SEQ ID NO: 133253 - protein, 21 aa, Mycobacterium avium
VELSTIRLLAKLPTIAAYAYK

SEQ ID NO: 133254 - protein, 35 aa, Mycobacterium avium
VEMAPWLRMPQRGAPLLFFLDAGVPPLSALVNSHL

SEQ ID NO: 133255 - protein, 25 aa, Mycobacterium avium
VEPERLWVGMAVSAVFRPVDVDDPE

SEQ ID NO: 133256 - protein, 20 aa, Mycobacterium avium
VEPLARRALAAEHPGLLRFT

SEQ ID NO: 133257 - protein, 18 aa, Mycobacterium avium
VEPLRNTLAATPQPRVVI

SEQ ID NO: 133258 - protein, 18 aa, Mycobacterium avium
VEPPPVASAFDLSASTPA

SEQ ID NO: 133259 - protein, 22 aa, Mycobacterium avium
VEQFGRLDIVLANAGIAPLAFR

SEQ ID NO: 133260 - protein, 23 aa, Mycobacterium avium
VEQFGRLDIVLANAGIAPLAFRQ

SEQ ID NO: 133261 - protein, 27 aa, Mycobacterium avium
VEQLPRKVAMRLLLTGEPLSAAAARDW

SEQ ID NO: 133262 - protein, 23 aa, Mycobacterium avium
VEQVLDLLRIDPMRSLGVGINDI

SEQ ID NO: 133263 - protein, 17 aa, Mycobacterium avium
VERLAISPKPPPPSWTA

SEQ ID NO: 133264 - protein, 22 aa, Mycobacterium avium
VERLRSLWAGEPLADGTALCGA

SEQ ID NO: 133265 - protein, 27 aa, Mycobacterium avium
VERYAPRIDVPIFLAFGAAADVSPNPY

SEQ ID NO: 133266 - protein, 24 aa, Mycobacterium avium
VESAEPLHWLPAEDEWIWGRATVL

SEQ ID NO: 133267 - protein, 38 aa, Mycobacterium avium
VESAEPLHWLPAQDEWIWPRAMVLSAAYLTGIATAAAA

SEQ ID NO: 133268 - protein, 31 aa, Mycobacterium avium
VESLRVEWWQSCRLPVNWKLATAAFMEGYHV

SEQ ID NO: 133269 - protein, 18 aa, Mycobacterium avium
VESTIRYLHAVQSGARPP

SEQ ID NO: 133270 - protein, 24 aa, Mycobacterium avium
VETGDIWRMPIVRDDPIRDWVKLA

SEQ ID NO: 133271 - protein, 24 aa, Mycobacterium avium
VEVPLIGFAGAPFTLASYLIEGGP

SEQ ID NO: 133272 - protein, 26 aa, Mycobacterium avium
VEYLVDAVFNYPTFSEAYKVAALDVM

SEQ ID NO: 133273 - protein, 17 aa, Mycobacterium avium
VFAAYELMQRVCPDMIG

SEQ ID NO: 133274 - protein, 17 aa, Mycobacterium avium
VFADRWFQRYSQGDDVC

SEQ ID NO: 133275 - protein, 17 aa, Mycobacterium avium
VFDHRATVGTARRLRVG

SEQ ID NO: 133276 - protein, 23 aa, Mycobacterium avium
VFDLEAQLRPGLGLHGQRVVGGF

SEQ ID NO: 133277 - protein, 27 aa, Mycobacterium avium
VFEQADDVWFPLFRPSADGEPSPLPAD

SEQ ID NO: 133278 - protein, 28 aa, Mycobacterium avium
VFEQADDVWFPLFRPSAVGEPGPLPADE

SEQ ID NO: 133279 - protein, 28 aa, Mycobacterium avium
VFEQADDVWFPLFRPSAVGEPGPLPEDE

SEQ ID NO: 133280 - protein, 18 aa, Mycobacterium avium
VFFDEAARRGLRVVAEAF

SEQ ID NO: 133281 - protein, 25 aa, Mycobacterium avium
VFKRNIYIHPFLGDDLKGIIDIMGE

SEQ ID NO: 133282 - protein, 18 aa, Mycobacterium avium
VFLQLLGLPLEDLDRFLL

SEQ ID NO: 133283 - protein, 20 aa, Mycobacterium avium
VFRERFLTCFIADPIGVKLR

SEQ ID NO: 133284 - protein, 17 aa, Mycobacterium avium
VFRLFEELAGKNAGEHL

SEQ ID NO: 133285 - protein, 19 aa, Mycobacterium avium
VFRLVTQPPQRLSMDTLVA

SEQ ID NO: 133286 - protein, 17 aa, Mycobacterium avium
VFRPAFEFIEQQWRELG

SEQ ID NO: 133287 - protein, 17 aa, Mycobacterium avium
VFSLRQPSNGRPLPLYA

SEQ ID NO: 133288 - protein, 19 aa, Mycobacterium avium
VFTHRLRKYIGAYLAVLGH

SEQ ID NO: 133289 - protein, 22 aa, Mycobacterium avium
VFVMDHFYQLPMLGSPDQPMLE

SEQ ID NO: 133290 - protein, 24 aa, Mycobacterium avium
VFVTKFRRKLFTDPMLTFAETTMR

SEQ ID NO: 133291 - protein, 18 aa, Mycobacterium avium
VFWALDNYEADEEATLAA

SEQ ID NO: 133292 - protein, 20 aa, Mycobacterium avium
VFYAPLWSDVDEICRLLRGG

SEQ ID NO: 133293 - protein, 22 aa, Mycobacterium avium
VGAARMLIRRPGPYPFDPLVSA

SEQ ID NO: 133294 - protein, 21 aa, Mycobacterium avium
VGAAWWLREQGSPINTLAVPA

SEQ ID NO: 133295 - protein, 31 aa, Mycobacterium avium
VGAIRLPRRVGWGNAMELLLTGKPMSAERAK

SEQ ID NO: 133296 - protein, 19 aa, Mycobacterium avium
VGALVPRRIKINGAELLAP

SEQ ID NO: 133297 - protein, 23 aa, Mycobacterium avium
VGARRPVMVWIHGGGFLNGASSM

SEQ ID NO: 133298 - protein, 26 aa, Mycobacterium avium
VGAVQVVIEVLPLRDVIAVVGVVADV

SEQ ID NO: 133299 - protein, 23 aa, Mycobacterium avium
VGDAQFGVFGQPLGDLGVRADQG

SEQ ID NO: 133300 - protein, 38 aa, Mycobacterium avium
VGDKTWLDRILTWPNPFLPIFIQEPGEWFGIGPGLTVI

SEQ ID NO: 133301 - protein, 19 aa, Mycobacterium avium
VGDLFVVAVRTAPDRHKGL

SEQ ID NO: 133302 - protein, 24 aa, Mycobacterium avium
VGDLLARLISLRQLSLSVARTLTE

SEQ ID NO: 133303 - protein, 26 aa, Mycobacterium avium
VGDPHYAYKLDWLAALRDSAAAWLRE

SEQ ID NO: 133304 - protein, 26 aa, Mycobacterium avium
VGDPHYAYKLDWLAALRDSAAGWLRE

SEQ ID NO: 133305 - protein, 22 aa, Mycobacterium avium
VGEFHRLAIDLLGFRADMETAM

SEQ ID NO: 133306 - protein, 21 aa, Mycobacterium avium
VGEIWLHGNNIGRGYWGMPEE

SEQ ID NO: 133307 - protein, 22 aa, Mycobacterium avium
VGFCPARGPIPRARNLSARPGC

SEQ ID NO: 133308 - protein, 19 aa, Mycobacterium avium
VGFFKDPVQGFFRALQFTL

SEQ ID NO: 133309 - protein, 26 aa, Mycobacterium avium
VGFFKNVMQLTHPAFLILDSPDGRNK

SEQ ID NO: 133310 - protein, 21 aa, Mycobacterium avium
VGGFTGSYWADLGPAAEVEMT

SEQ ID NO: 133311 - protein, 18 aa, Mycobacterium avium
VGGGFRDVSISGLFHGPR

SEQ ID NO: 133312 - protein, 24 aa, Mycobacterium avium
VGGIVVKLRLAIDALIDLARRVTI

SEQ ID NO: 133313 - protein, 29 aa, Mycobacterium avium
VGGLPGDLKFTLVEPLRLLFKDEVRAVGR

SEQ ID NO: 133314 - protein, 17 aa, Mycobacterium avium
VGGRWRTGTAHLLPDDD

SEQ ID NO: 133315 - protein, 19 aa, Mycobacterium avium
VGIFPNRDAIVRLVGAVLA

SEQ ID NO: 133316 - protein, 32 aa, Mycobacterium avium
VGIRLPQGPAQIAALLGALLARAAYVPLDVGW

SEQ ID NO: 133317 - protein, 18 aa, Mycobacterium avium
VGIVTALVRVEGVPCGLI

SEQ ID NO: 133318 - protein, 27 aa, Mycobacterium avium
VGKGDVVALWLPSGIDYATCYAAAAMI

SEQ ID NO: 133319 - protein, 27 aa, Mycobacterium avium
VGKGDVVVLWLPSGIDYATCYAAAAMI

SEQ ID NO: 133320 - protein, 17 aa, Mycobacterium avium
VGLAFFFRNSALDRTVA

SEQ ID NO: 133321 - protein, 19 aa, Mycobacterium avium
VGLARRAAVWPAPDWTAST

SEQ ID NO: 133322 - protein, 19 aa, Mycobacterium avium
VGLDFFRRLVDGEVAPADP

SEQ ID NO: 133323 - protein, 22 aa, Mycobacterium avium
VGLGAILAFKSLGVGHVVVVDP

SEQ ID NO: 133324 - protein, 19 aa, Mycobacterium avium
VGLGMTRMSLRPGATPLEL

SEQ ID NO: 133325 - protein, 19 aa, Mycobacterium avium
VGLHPFGRFEGKTAMEMAV

SEQ ID NO: 133326 - protein, 26 aa, Mycobacterium avium
VGLMQVWANELAQYWIRVNTIHPTGV

SEQ ID NO: 133327 - protein, 18 aa, Mycobacterium avium
VGMQLELSFIPLYEGDML

SEQ ID NO: 133328 - protein, 19 aa, Mycobacterium avium
VGMQLELSFIPLYEGDMLI

SEQ ID NO: 133329 - protein, 17 aa, Mycobacterium avium
VGNGWHQVTSELSFERS

SEQ ID NO: 133330 - protein, 26 aa, Mycobacterium avium
VGPASARLFVASALARLGPLLVVTAT

SEQ ID NO: 133331 - protein, 20 aa, Mycobacterium avium
VGPFAYLRPGTVLGDDGKLG

SEQ ID NO: 133332 - protein, 30 aa, Mycobacterium avium
VGPSHHWIIRDMLGLPYQKPAAYTRDYLQV

SEQ ID NO: 133333 - protein, 19 aa, Mycobacterium avium
VGPTLSKFFTALRERRVLG

SEQ ID NO: 133334 - protein, 26 aa, Mycobacterium avium
VGQAFLGGVLRCAVTVFGAELGGGQG

SEQ ID NO: 133335 - protein, 21 aa, Mycobacterium avium
VGQHRMWFVQSVDPDSALLNI

SEQ ID NO: 133336 - protein, 26 aa, Mycobacterium avium
VGQMRSLPDYYFYYGGLADKLQGDVI

SEQ ID NO: 133337 - protein, 17 aa, Mycobacterium avium
VGQPVVAIGSPLGLSGT

SEQ ID NO: 133338 - protein, 17 aa, Mycobacterium avium
VGRDQIVAFLTRKWQRE

SEQ ID NO: 133339 - protein, 30 aa, Mycobacterium avium
VGRIRAMQMALLPERLPAAEALSWGLVTAV

SEQ ID NO: 133340 - protein, 17 aa, Mycobacterium avium
VGRLLRHRKLAQRYLTV

SEQ ID NO: 133341 - protein, 21 aa, Mycobacterium avium
VGSCVLFVGTLWHGGGANTTD

SEQ ID NO: 133342 - protein, 17 aa, Mycobacterium avium
VGSDELVFLVIYDPPHV

SEQ ID NO: 133343 - protein, 21 aa, Mycobacterium avium
VGSRYLGWLSGPISWDYGSDP

SEQ ID NO: 133344 - protein, 25 aa, Mycobacterium avium
VGSTVLATGLLLDLTERDPDADKRL

SEQ ID NO: 133345 - protein, 25 aa, Mycobacterium avium
VGTRLGMCGMEYFGHPWEFGPRRTK

SEQ ID NO: 133346 - protein, 18 aa, Mycobacterium avium
VGVDYYRPTGRGAEREIA

SEQ ID NO: 133347 - protein, 19 aa, Mycobacterium avium
VGVGHRWRRRGLGGDGGVG

SEQ ID NO: 133348 - protein, 18 aa, Mycobacterium avium
VGVRRLRNYHSTRNAHYC

SEQ ID NO: 133349 - protein, 27 aa, Mycobacterium avium
VGVSPRTFFRYFPTKESVLFFGEYDFI

SEQ ID NO: 133350 - protein, 35 aa, Mycobacterium avium
VGVVPIAVTNWFGDQPFAVWPWAADKLGGAQPTVL

SEQ ID NO: 133351 - protein, 24 aa, Mycobacterium avium
VGYAPALALLPRRTPDDDIATVAR

SEQ ID NO: 133352 - protein, 21 aa, Mycobacterium avium
VGYAPTLALLPRRTADDDIAT

SEQ ID NO: 133353 - protein, 33 aa, Mycobacterium avium
VGYEATYTRAFRRWSRQFYPPTTSVRARSEGPA

SEQ ID NO: 133354 - protein, 17 aa, Mycobacterium avium
VGYRWFAAKGHVPMFAF

SEQ ID NO: 133355 - protein, 20 aa, Mycobacterium avium
VGYVPALALLPRRTPDDDIA

SEQ ID NO: 133356 - protein, 23 aa, Mycobacterium avium
VHATYLVRHGLVLELIDYSKRRV

SEQ ID NO: 133357 - protein, 20 aa, Mycobacterium avium
VHEALNFAAVFRTPCVFFVQ

SEQ ID NO: 133358 - protein, 21 aa, Mycobacterium avium
VHEWRTWPGYSEQERLAAEFA

SEQ ID NO: 133359 - protein, 24 aa, Mycobacterium avium
VHGESSYFVWLNRGKESLTVDLKQ

SEQ ID NO: 133360 - protein, 26 aa, Mycobacterium avium
VHGGMIPLYYDWLFGMVVSGANCPPT

SEQ ID NO: 133361 - protein, 20 aa, Mycobacterium avium
VHGLWPQALALGYRVAVRPS

SEQ ID NO: 133362 - protein, 18 aa, Mycobacterium avium
VHGRGVRLLINFSLNNEA

SEQ ID NO: 133363 - protein, 27 aa, Mycobacterium avium
VHLYGGYHVIRAAWPHLREQRYGRVVV

SEQ ID NO: 133364 - protein, 18 aa, Mycobacterium avium
VHMFALDALVEAYPDAKF

SEQ ID NO: 133365 - protein, 24 aa, Mycobacterium avium
VHPSGHILVRSCRGGYMHSVALSE

SEQ ID NO: 133366 - protein, 17 aa, Mycobacterium avium
VHQRIRAPLRRVKGHLA

SEQ ID NO: 133367 - protein, 17 aa, Mycobacterium avium
VHRLRALLIELERLYNH

SEQ ID NO: 133368 - protein, 34 aa, Mycobacterium avium
VHTGRWPTDLDLWWAQTIALLPDGRLLVDRSWGR

SEQ ID NO: 133369 - protein, 19 aa, Mycobacterium avium
VHTPSPLRTYSVPVGSTEV

SEQ ID NO: 133370 - protein, 22 aa, Mycobacterium avium
VHVKRLVVCDTPSRWLVAEAER

SEQ ID NO: 133371 - protein, 17 aa, Mycobacterium avium
VHVLSCHPLIAFGTDEQ

SEQ ID NO: 133372 - protein, 27 aa, Mycobacterium avium
VIADDPPLRLLLGSDALSAALAKSHQQ

SEQ ID NO: 133373 - protein, 17 aa, Mycobacterium avium
VIADWPRSSGVGLDQVA

SEQ ID NO: 133374 - protein, 17 aa, Mycobacterium avium
VIAVRYLPDERVWPLPD

SEQ ID NO: 133375 - protein, 23 aa, Mycobacterium avium
VIDLGEAILLPGLMDMEVNLLMG

SEQ ID NO: 133376 - protein, 24 aa, Mycobacterium avium
VIDTAWLSAFAERSRFAEAFRSTG

SEQ ID NO: 133377 - protein, 25 aa, Mycobacterium avium
VIFDRDAIFKVFRRVSSGINPDIEL

SEQ ID NO: 133378 - protein, 19 aa, Mycobacterium avium
VIFVKDKPAWLGRAWRRIG

SEQ ID NO: 133379 - protein, 18 aa, Mycobacterium avium
VIGLMRAFAVELGPHMIR

SEQ ID NO: 133380 - protein, 21 aa, Mycobacterium avium
VIGLVRLLRERADPAVAPWIH

SEQ ID NO: 133381 - protein, 22 aa, Mycobacterium avium
VIGLVRLLRERADPAVAPWIHR

SEQ ID NO: 133382 - protein, 18 aa, Mycobacterium avium
VIGYQGYVELAYRSGRIA

SEQ ID NO: 133383 - protein, 24 aa, Mycobacterium avium
VIHDRLLRVLAYSRLQQHADPARV

SEQ ID NO: 133384 - protein, 17 aa, Mycobacterium avium
VIIRDGLWFDGTGGAAL

SEQ ID NO: 133385 - protein, 18 aa, Mycobacterium avium
VILVGGDATRRAGLAAAA

SEQ ID NO: 133386 - protein, 18 aa, Mycobacterium avium
VIMVRMPGFGLQGPWRDY

SEQ ID NO: 133387 - protein, 17 aa, Mycobacterium avium
VINRFLARFGVAAPFTA

SEQ ID NO: 133388 - protein, 39 aa, Mycobacterium avium
VINRRLQRPLIKLRPKLTSRQRWILSAATLSVIGSVTDH

SEQ ID NO: 133389 - protein, 21 aa, Mycobacterium avium
VIPLPVNCATAPLPTGRRVAE

SEQ ID NO: 133390 - protein, 17 aa, Mycobacterium avium
VIPTALRRLANTAVALG

SEQ ID NO: 133391 - protein, 27 aa, Mycobacterium avium
VIRAIGEHLQLLKGWHPVASVSNGQKR

SEQ ID NO: 133392 - protein, 28 aa, Mycobacterium avium
VIRAMGEHLQLLKGWHPVASVSNGEKRW

SEQ ID NO: 133393 - protein, 17 aa, Mycobacterium avium
VISIPYGAAGSGTFFVR

SEQ ID NO: 133394 - protein, 20 aa, Mycobacterium avium
VISQYPWDMPLHSDELMRTS

SEQ ID NO: 133395 - protein, 24 aa, Mycobacterium avium
VISRLIDWVSFTPLHNVTGEPAIS

SEQ ID NO: 133396 - protein, 18 aa, Mycobacterium avium
VITQALRKIPPALDVLIR

SEQ ID NO: 133397 - protein, 24 aa, Mycobacterium avium
VIVAAALRVLDLFELDRPVRLLGV

SEQ ID NO: 133398 - protein, 26 aa, Mycobacterium avium
VIVERRGLVMLGVRPVPHLATAAVHL

SEQ ID NO: 133399 - protein, 26 aa, Mycobacterium avium
VIYRRIDDAFLDPLQFRADSVLGVAG

SEQ ID NO: 133400 - protein, 24 aa, Mycobacterium avium
VKARPRALLDLAAKADVLLDCFRP

SEQ ID NO: 133401 - protein, 21 aa, Mycobacterium avium
VKAWKGIRYAAPPIGDLRFRA

SEQ ID NO: 133402 - protein, 19 aa, Mycobacterium avium
VKDLVSFLPVLAYDGSHMT

SEQ ID NO: 133403 - protein, 19 aa, Mycobacterium avium
VKDPLYVLAGRDEGYVPFY

SEQ ID NO: 133404 - protein, 18 aa, Mycobacterium avium
VKEDVAIRRLLSTGLERA

SEQ ID NO: 133405 - protein, 25 aa, Mycobacterium avium
VKEVQTYVPGYRLLNEPQFDEPSLN

SEQ ID NO: 133406 - protein, 27 aa, Mycobacterium avium
VKFTTVHMALVRTPMISPTTLYDKFPA

SEQ ID NO: 133407 - protein, 22 aa, Mycobacterium avium
VKGTFDLFEPAGAPYALVVARS

SEQ ID NO: 133408 - protein, 23 aa, Mycobacterium avium
VKHGHEPPFKKWLEHWDPAHDPF

SEQ ID NO: 133409 - protein, 27 aa, Mycobacterium avium
VKLAGFKIPQYWYSVTELPLNSAGKVV

SEQ ID NO: 133410 - protein, 20 aa, Mycobacterium avium
VKLGPSLWHRDFYDAVIVEC

SEQ ID NO: 133411 - protein, 17 aa, Mycobacterium avium
VKPVIPLPVNCATAPLP

SEQ ID NO: 133412 - protein, 25 aa, Mycobacterium avium
VKQALVYYYFPTMDDLFVEVLRAGA

SEQ ID NO: 133413 - protein, 54 aa, Mycobacterium avium
VKRHMVLWRKRFQREYGEPARYIWKLEFQRRGAPHIHLWMAPPISPGRSGRGFA

SEQ ID NO: 133414 - protein, 24 aa, Mycobacterium avium
VKRKFRVPAPNMLLVADFTYVRLA

SEQ ID NO: 133415 - protein, 27 aa, Mycobacterium avium
VKRQTQFTILFVARSPPVHRGSILVAV

SEQ ID NO: 133416 - protein, 29 aa, Mycobacterium avium
VKSRLLQTFTWALVPSQPDAGAPFIVRET

SEQ ID NO: 133417 - protein, 18 aa, Mycobacterium avium
VLAARGPLMDARLTLRRE

SEQ ID NO: 133418 - protein, 19 aa, Mycobacterium avium
VLAAYPGHIARMLRLVFGD

SEQ ID NO: 133419 - protein, 20 aa, Mycobacterium avium
VLAAYPGHIARMLRLVFGGS

SEQ ID NO: 133420 - protein, 18 aa, Mycobacterium avium
VLAGLDWFPRSRHRDMLA

SEQ ID NO: 133421 - protein, 26 aa, Mycobacterium avium
VLAGPKFLVLPPSYLCEEGHLNPYNP

SEQ ID NO: 133422 - protein, 21 aa, Mycobacterium avium
VLAGRALIGAFAGFAVPRAAR

SEQ ID NO: 133423 - protein, 17 aa, Mycobacterium avium
VLAGRRPDPLQATAKEV

SEQ ID NO: 133424 - protein, 25 aa, Mycobacterium avium
VLAIKDMAGLLRAPAAATLVSALKS

SEQ ID NO: 133425 - protein, 22 aa, Mycobacterium avium
VLAIWCMDWPAVAAAAAAELPA

SEQ ID NO: 133426 - protein, 17 aa, Mycobacterium avium
VLAIYNPASKARTWQVG

SEQ ID NO: 133427 - protein, 23 aa, Mycobacterium avium
VLARTALPTMTLLGAQFVMATAA

SEQ ID NO: 133428 - protein, 19 aa, Mycobacterium avium
VLATVRPLASYIAARNWVV

SEQ ID NO: 133429 - protein, 17 aa, Mycobacterium avium
VLAVAQWLRDESAPEPA

SEQ ID NO: 133430 - protein, 25 aa, Mycobacterium avium
VLAVLRKHFRLRPDPAPRGSAPAQL

SEQ ID NO: 133431 - protein, 18 aa, Mycobacterium avium
VLAWPTQHLTDAARHWEA

SEQ ID NO: 133432 - protein, 20 aa, Mycobacterium avium
VLCEHPDQWELLRQRPELAM

SEQ ID NO: 133433 - protein, 19 aa, Mycobacterium avium
VLDCAINWKLAIDTFAENY

SEQ ID NO: 133434 - protein, 22 aa, Mycobacterium avium
VLDLFAENIRYFGSLLPEVSDE

SEQ ID NO: 133435 - protein, 17 aa, Mycobacterium avium
VLDLMQAALLTDTELAQ

SEQ ID NO: 133436 - protein, 22 aa, Mycobacterium avium
VLDRELSWEALVDGGVTALPVP

SEQ ID NO: 133437 - protein, 18 aa, Mycobacterium avium
VLDRIGWLQAQTSRTFGR

SEQ ID NO: 133438 - protein, 24 aa, Mycobacterium avium
VLDRYDYVLIDCQPSLGLLTVNGL

SEQ ID NO: 133439 - protein, 24 aa, Mycobacterium avium
VLDVRPPRLVGIDDSFFDLGGDSL

SEQ ID NO: 133440 - protein, 33 aa, Mycobacterium avium
VLDVVKQILASSYIWFFLAPGAPEWAIRSGATV

SEQ ID NO: 133441 - protein, 34 aa, Mycobacterium avium
VLDVVKQILASSYIWFFLAPSAPEWAIRSGATVK

SEQ ID NO: 133442 - protein, 24 aa, Mycobacterium avium
VLEDYGLTPWPKTSGSRGFHIYAH

SEQ ID NO: 133443 - protein, 22 aa, Mycobacterium avium
VLEMSARHPGNIAALAEIAPPA

SEQ ID NO: 133444 - protein, 18 aa, Mycobacterium avium
VLERLADARRLGHPVWAV

SEQ ID NO: 133445 - protein, 20 aa, Mycobacterium avium
VLFDSLQFAPRYRCADLASE

SEQ ID NO: 133446 - protein, 18 aa, Mycobacterium avium
VLFVTDTIVLPGMVVPIA

SEQ ID NO: 133447 - protein, 22 aa, Mycobacterium avium
VLFVTDTIVLPGMVVPIALDDA

SEQ ID NO: 133448 - protein, 22 aa, Mycobacterium avium
VLGADFIMFASDYPHWDGEWPE

SEQ ID NO: 133449 - protein, 19 aa, Mycobacterium avium
VLGLPKEPDPWKGKPWKDI

SEQ ID NO: 133450 - protein, 28 aa, Mycobacterium avium
VLGTEALLRWQHPTLGLLMPDSFIQVVE

SEQ ID NO: 133451 - protein, 18 aa, Mycobacterium avium
VLHRPAVLPVPSLGPRLL

SEQ ID NO: 133452 - protein, 27 aa, Mycobacterium avium
VLHRPKLGFPVPIRHWLRAGELQDWAY

SEQ ID NO: 133453 - protein, 27 aa, Mycobacterium avium
VLHRQRRPVRGPPAAPAGIRGAQVAHQ

SEQ ID NO: 133454 - protein, 19 aa, Mycobacterium avium
VLIPSPDYPLWTASTSLAG

SEQ ID NO: 133455 - protein, 20 aa, Mycobacterium avium
VLIRDVGIPGFLRATTGLAE

SEQ ID NO: 133456 - protein, 17 aa, Mycobacterium avium
VLITTPESLFLMLTSAA

SEQ ID NO: 133457 - protein, 26 aa, Mycobacterium avium
VLKQALASLPPRWRPHPGARADPDAS

SEQ ID NO: 133458 - protein, 18 aa, Mycobacterium avium
VLLEIGPQPVLTAAALRA

SEQ ID NO: 133459 - protein, 17 aa, Mycobacterium avium
VLLELLIDDLVVVARHA

SEQ ID NO: 133460 - protein, 32 aa, Mycobacterium avium
VLLQLPNGCQFAVALFALLRAGAIPVMCLPGH

SEQ ID NO: 133461 - protein, 17 aa, Mycobacterium avium
VLLRTLPLVVNGASAGA

SEQ ID NO: 133462 - protein, 21 aa, Mycobacterium avium
VLLSGRAALLGLRRAGQVSPG

SEQ ID NO: 133463 - protein, 17 aa, Mycobacterium avium
VLLTKNIALDYGPSGIR

SEQ ID NO: 133464 - protein, 18 aa, Mycobacterium avium
VLNGLERYLRTVASLSHA

SEQ ID NO: 133465 - protein, 23 aa, Mycobacterium avium
VLPARGAVDLGFRLAPPAWLDPG

SEQ ID NO: 133466 - protein, 17 aa, Mycobacterium avium
VLPDTELRRIAALCAAF

SEQ ID NO: 133467 - protein, 30 aa, Mycobacterium avium
VLPERLGFMLHAIIWISVVPQHLTSVAEQI

SEQ ID NO: 133468 - protein, 33 aa, Mycobacterium avium
VLPPPARREVLPPLARRVAPPRPERPALREVRA

SEQ ID NO: 133469 - protein, 23 aa, Mycobacterium avium
VLPQYTMLVRRWEALRYVPSGYA

SEQ ID NO: 133470 - protein, 18 aa, Mycobacterium avium
VLPVLQSWLARDGAGTLV

SEQ ID NO: 133471 - protein, 25 aa, Mycobacterium avium
VLQAAWAQLLVWQTAQHDVAFGTTV

SEQ ID NO: 133472 - protein, 17 aa, Mycobacterium avium
VLQIEGCKTWRVSDGPA

SEQ ID NO: 133473 - protein, 22 aa, Mycobacterium avium
VLQTYPCHPLLQANRVAATANA

SEQ ID NO: 133474 - protein, 18 aa, Mycobacterium avium
VLRAFPQIAQHYRRRFRH

SEQ ID NO: 133475 - protein, 17 aa, Mycobacterium avium
VLRVHLDTARYQLLVQY

SEQ ID NO: 133476 - protein, 21 aa, Mycobacterium avium
VLSRYVEAIVWRTFEQHRLEA

SEQ ID NO: 133477 - protein, 19 aa, Mycobacterium avium
VLSWGRVWELTDEQWDTVI

SEQ ID NO: 133478 - protein, 17 aa, Mycobacterium avium
VLTAAAALLTLDRQARI

SEQ ID NO: 133479 - protein, 18 aa, Mycobacterium avium
VLTAYPHHDPAAVGDWML

SEQ ID NO: 133480 - protein, 25 aa, Mycobacterium avium
VLTNARRPLIVLGKGAAYAQADNEI

SEQ ID NO: 133481 - protein, 17 aa, Mycobacterium avium
VLTTTLSDPSGYGRILR

SEQ ID NO: 133482 - protein, 19 aa, Mycobacterium avium
VLTTTLSDPSGYGRILRTQ

SEQ ID NO: 133483 - protein, 30 aa, Mycobacterium avium
VLVDGFLERYGIPILITYGATEFAGAVAGW

SEQ ID NO: 133484 - protein, 18 aa, Mycobacterium avium
VLVFAHAPRRVVPEIPRW

SEQ ID NO: 133485 - protein, 17 aa, Mycobacterium avium
VLVGCERGVLATGLAGV

SEQ ID NO: 133486 - protein, 19 aa, Mycobacterium avium
VLVGGERPNRPGWFLSPAV

SEQ ID NO: 133487 - protein, 26 aa, Mycobacterium avium
VLVHDAARALTPPALIARVVQALRDG

SEQ ID NO: 133488 - protein, 17 aa, Mycobacterium avium
VLVLERGQAAPAHLGQQ

SEQ ID NO: 133489 - protein, 17 aa, Mycobacterium avium
VLVNNAGILRDAAFKNM

SEQ ID NO: 133490 - protein, 18 aa, Mycobacterium avium
VLVNNVGHWLRHPGGFAD

SEQ ID NO: 133491 - protein, 17 aa, Mycobacterium avium
VLVPFVSAIVTAVSLDD

SEQ ID NO: 133492 - protein, 21 aa, Mycobacterium avium
VLVRNFWFCAVEDKSSFVQRD

SEQ ID NO: 133493 - protein, 17 aa, Mycobacterium avium
VLVSRRPSLTRGGLAAA

SEQ ID NO: 133494 - protein, 17 aa, Mycobacterium avium
VLWDLQRPNPALLTQGM

SEQ ID NO: 133495 - protein, 29 aa, Mycobacterium avium
VLYGRREVLSQLPPFLTGGSMIETVTMES

SEQ ID NO: 133496 - protein, 28 aa, Mycobacterium avium
VMADDPPLRLLLGSDALSAALAKSHQQI

SEQ ID NO: 133497 - protein, 24 aa, Mycobacterium avium
VMAEPLTYFFSDPAARDFVTGVAQ

SEQ ID NO: 133498 - protein, 22 aa, Mycobacterium avium
VMAPFPHMRFPSGWTAYDEDND

SEQ ID NO: 133499 - protein, 17 aa, Mycobacterium avium
VMDFVQQMQKLAGGNVA

SEQ ID NO: 133500 - protein, 17 aa, Mycobacterium avium
VMFTGSPPLAMAELLVV

SEQ ID NO: 133501 - protein, 17 aa, Mycobacterium avium
VMGIFGLVGSEAAVDRR

SEQ ID NO: 133502 - protein, 17 aa, Mycobacterium avium
VMHEKRGLAPQPRPAYI

SEQ ID NO: 133503 - protein, 23 aa, Mycobacterium avium
VMHTHRGLLYQAADTNLVTEANR

SEQ ID NO: 133504 - protein, 17 aa, Mycobacterium avium
VMMAVQRLGIPTGPAMV

SEQ ID NO: 133505 - protein, 28 aa, Mycobacterium avium
VMPHEPKFPFFEYPYIVVLVELEEGVRL

SEQ ID NO: 133506 - protein, 18 aa, Mycobacterium avium
VMPLDWYLHVRHAAEGAI

SEQ ID NO: 133507 - protein, 21 aa, Mycobacterium avium
VMPVLKKWRIFEREDFTGEAA

SEQ ID NO: 133508 - protein, 17 aa, Mycobacterium avium
VMRTRLLPTGRVRYFPD

SEQ ID NO: 133509 - protein, 17 aa, Mycobacterium avium
VMSWRLRTRHGLPVHDI

SEQ ID NO: 133510 - protein, 25 aa, Mycobacterium avium
VMTAHGFDRWLLPTLADGRVALDDA

SEQ ID NO: 133511 - protein, 26 aa, Mycobacterium avium
VMVTVPAIYALLLRHKDFAGNDVSRV

SEQ ID NO: 133512 - protein, 26 aa, Mycobacterium avium
VMVTVPAIYALLLRHKDFAGTDVSRV

SEQ ID NO: 133513 - protein, 26 aa, Mycobacterium avium
VMVTVPAIYALLLRHKDFAGTNVSRV

SEQ ID NO: 133514 - protein, 26 aa, Mycobacterium avium
VMWAARRSGLYYTLINTHLTAAEAAY

SEQ ID NO: 133515 - protein, 27 aa, Mycobacterium avium
VNAAAPGVIRLAPPLIVTEAQIDGFIA

SEQ ID NO: 133516 - protein, 17 aa, Mycobacterium avium
VNCAGVLHRTPLPQETA

SEQ ID NO: 133517 - protein, 17 aa, Mycobacterium avium
VNCLWPQTYIATAAVAN

SEQ ID NO: 133518 - protein, 17 aa, Mycobacterium avium
VNLTGTFLCLQAALPDM

SEQ ID NO: 133519 - protein, 18 aa, Mycobacterium avium
VNLTGTFLCLQAALPDMV

SEQ ID NO: 133520 - protein, 20 aa, Mycobacterium avium
VNLTGTFLVAKAALARMIDQ

SEQ ID NO: 133521 - protein, 18 aa, Mycobacterium avium
VNPIAFPVSHIGGAAMLS

SEQ ID NO: 133522 - protein, 33 aa, Mycobacterium avium
VNPLARSRSNFPRSAPIWKNIAAALAEAQKAGT

SEQ ID NO: 133523 - protein, 23 aa, Mycobacterium avium
VNQGYTMDPFAPFGGVKASGYGR

SEQ ID NO: 133524 - protein, 20 aa, Mycobacterium avium
VNRAARLRSLAAGGQILCSG

SEQ ID NO: 133525 - protein, 28 aa, Mycobacterium avium
VNRYLPRFIRQFPFNVLLHDLDRRIKKG

SEQ ID NO: 133526 - protein, 24 aa, Mycobacterium avium
VNSALRSVALNLLDEHLGHCVTRA

SEQ ID NO: 133527 - protein, 22 aa, Mycobacterium avium
VNSLIDFAVSTYGGLHLAHNNA

SEQ ID NO: 133528 - protein, 25 aa, Mycobacterium avium
VNSPDLDWQSVWDRGWTLAAAAEDK

SEQ ID NO: 133529 - protein, 28 aa, Mycobacterium avium
VNTDMLHSPPMYRAFRPDLPAPTREDAE

SEQ ID NO: 133530 - protein, 28 aa, Mycobacterium avium
VNTDMLHSPPMYRAFRPDLPASTREDAE

SEQ ID NO: 133531 - protein, 26 aa, Mycobacterium avium
VNTPMGGGDMIAALFAAIETNPTLNN

SEQ ID NO: 133532 - protein, 18 aa, Mycobacterium avium
VNVGFWSSVPAGATEGAT

SEQ ID NO: 133533 - protein, 18 aa, Mycobacterium avium
VNVLGVIHGLKAFVPILL

SEQ ID NO: 133534 - protein, 39 aa, Mycobacterium avium
VNVYRESFELHTMSQILLLHAVLPAMQDAGWGRFVHIGS

SEQ ID NO: 133535 - protein, 22 aa, Mycobacterium avium
VNYFGVVELLQAWRPALAAAGN

SEQ ID NO: 133536 - protein, 27 aa, Mycobacterium avium
VNYFGVVELLQAWRPALAAAGNAKVVV

SEQ ID NO: 133537 - protein, 19 aa, Mycobacterium avium
VNYPPMRLARDGRDGNGCY

SEQ ID NO: 133538 - protein, 18 aa, Mycobacterium avium
VNYRLGALGFLDLSALNS

SEQ ID NO: 133539 - protein, 18 aa, Mycobacterium avium
VPAALMWGNPLRSPGYAN

SEQ ID NO: 133540 - protein, 23 aa, Mycobacterium avium
VPAARIAFIVADADLRVVVTDAG

SEQ ID NO: 133541 - protein, 21 aa, Mycobacterium avium
VPAARLQFVLADSAPVAAVTT

SEQ ID NO: 133542 - protein, 17 aa, Mycobacterium avium
VPADFIGFSQPIDDLPT

SEQ ID NO: 133543 - protein, 25 aa, Mycobacterium avium
VPAELEVFAGLPQLAGRPAAEDQNP

SEQ ID NO: 133544 - protein, 32 aa, Mycobacterium avium
VPAEYDLLRRNQILFTFLHLAASRACTEALLS

SEQ ID NO: 133545 - protein, 32 aa, Mycobacterium avium
VPAEYDLLRRNQILFTFLHLAASRACTEALLT

SEQ ID NO: 133546 - protein, 17 aa, Mycobacterium avium
VPALFGAWAQRVPGAVA

SEQ ID NO: 133547 - protein, 26 aa, Mycobacterium avium
VPAPVDADWLLLVELAADHDQTERLA

SEQ ID NO: 133548 - protein, 27 aa, Mycobacterium avium
VPATALADLPLLLLDEGHCLRDQALDV

SEQ ID NO: 133549 - protein, 28 aa, Mycobacterium avium
VPATALADLPLLLLDEGHCLRDQALDVC

SEQ ID NO: 133550 - protein, 17 aa, Mycobacterium avium
VPCRWTELELGAATLSD

SEQ ID NO: 133551 - protein, 17 aa, Mycobacterium avium
VPCRWTELELGAATLTD

SEQ ID NO: 133552 - protein, 19 aa, Mycobacterium avium
VPCWMIFDDGYVRRYVTSA

SEQ ID NO: 133553 - protein, 19 aa, Mycobacterium avium
VPDDPFLQLLGAIEAVFAS

SEQ ID NO: 133554 - protein, 26 aa, Mycobacterium avium
VPDEDPHIPSLYRIYPTTDWHERETY

SEQ ID NO: 133555 - protein, 17 aa, Mycobacterium avium
VPDLWDLADAFPAALKD

SEQ ID NO: 133556 - protein, 31 aa, Mycobacterium avium
VPDNMGMLFRRKLVMFGPREVLLTSDEPVVK

SEQ ID NO: 133557 - protein, 19 aa, Mycobacterium avium
VPDPTRVWPLLERNKAALA

SEQ ID NO: 133558 - protein, 18 aa, Mycobacterium avium
VPDSRDRPTLKAKILPII

SEQ ID NO: 133559 - protein, 26 aa, Mycobacterium avium
VPDVGDLLTWRGGSELFEFADVEVVD

SEQ ID NO: 133560 - protein, 24 aa, Mycobacterium avium
VPEEPRPWTRLPAPTINSALAVHP

SEQ ID NO: 133561 - protein, 25 aa, Mycobacterium avium
VPEHQQVTLWAQRTGGRGKAGSHRL

SEQ ID NO: 133562 - protein, 29 aa, Mycobacterium avium
VPFFTDYARRYTDLPFLIKLEERGDMVPG

SEQ ID NO: 133563 - protein, 25 aa, Mycobacterium avium
VPGAVIRRGVYYRYRLLWRNSCGGV

SEQ ID NO: 133564 - protein, 19 aa, Mycobacterium avium
VPGAYVAGWIKRGPSGFIG

SEQ ID NO: 133565 - protein, 25 aa, Mycobacterium avium
VPGDPRPWFLNRDAVPVTGTAFETD

SEQ ID NO: 133566 - protein, 30 aa, Mycobacterium avium
VPGDVRLLQHKPAHWSYPEAAGISAVFTTA

SEQ ID NO: 133567 - protein, 24 aa, Mycobacterium avium
VPGFPNLFTVFGPYGYVGSSYFAL

SEQ ID NO: 133568 - protein, 18 aa, Mycobacterium avium
VPGLYAAGACAPNLAQDG

SEQ ID NO: 133569 - protein, 18 aa, Mycobacterium avium
VPGNPAFVLVHDAARALT

SEQ ID NO: 133570 - protein, 23 aa, Mycobacterium avium
VPGPPFPLYMAGAKLDSLGPPVM

SEQ ID NO: 133571 - protein, 23 aa, Mycobacterium avium
VPGPQLPLYLLGCEVKAMYPLGP

SEQ ID NO: 133572 - protein, 18 aa, Mycobacterium avium
VPGVRRRGRRRPTGHRGR

SEQ ID NO: 133573 - protein, 17 aa, Mycobacterium avium
VPHAPIVLPPDPGAAAQ

SEQ ID NO: 133574 - protein, 20 aa, Mycobacterium avium
VPHYPAPGGVKLAAGWLVER

SEQ ID NO: 133575 - protein, 26 aa, Mycobacterium avium
VPIVPGAVIFDLPVGGWQCRPTAEFG

SEQ ID NO: 133576 - protein, 17 aa, Mycobacterium avium
VPKAPFLRTVAVWGPSD

SEQ ID NO: 133577 - protein, 17 aa, Mycobacterium avium
VPKVILNLAPSLWIPQH

SEQ ID NO: 133578 - protein, 28 aa, Mycobacterium avium
VPLANLAFFVLDGWLRPVPVGVVGELYV

SEQ ID NO: 133579 - protein, 30 aa, Mycobacterium avium
VPLSFAQNRLWFIDQFQGPSPLYNMAAALR

SEQ ID NO: 133580 - protein, 27 aa, Mycobacterium avium
VPLSFAQSRLWFIGQLHGPSPVHNMAI

SEQ ID NO: 133581 - protein, 18 aa, Mycobacterium avium
VPLTLVHMVNAATVWPQV

SEQ ID NO: 133582 - protein, 19 aa, Mycobacterium avium
VPLTLVHMVNAATVWPQVP

SEQ ID NO: 133583 - protein, 17 aa, Mycobacterium avium
VPNPFGAPGSRMYRTGD

SEQ ID NO: 133584 - protein, 18 aa, Mycobacterium avium
VPNPFGAPGSRMYRTGDL

SEQ ID NO: 133585 - protein, 17 aa, Mycobacterium avium
VPNTLWTPSTSGLHHLG

SEQ ID NO: 133586 - protein, 25 aa, Mycobacterium avium
VPPEDWWLEDLWRRNVWQARHGGYQ

SEQ ID NO: 133587 - protein, 28 aa, Mycobacterium avium
VPPGRLGWGWAKFAFNGWKTLSWVDANI

SEQ ID NO: 133588 - protein, 19 aa, Mycobacterium avium
VPQIDLLVGSWYVSTHPSS

SEQ ID NO: 133589 - protein, 17 aa, Mycobacterium avium
VPSPGMGLSGIWLGAVV

SEQ ID NO: 133590 - protein, 19 aa, Mycobacterium avium
VPSRTVNLGWTSWATRWLS

SEQ ID NO: 133591 - protein, 22 aa, Mycobacterium avium
VPSYRTIFYEELPDCLNALTID

SEQ ID NO: 133592 - protein, 30 aa, Mycobacterium avium
VPTAELLDTYSPELFCMIRNFHDAAPEVAK

SEQ ID NO: 133593 - protein, 26 aa, Mycobacterium avium
VPTPVDADWLLLVELAADHDQTERLA

SEQ ID NO: 133594 - protein, 24 aa, Mycobacterium avium
VPVHFVQMWVIPDEAGIDPSYQQH

SEQ ID NO: 133595 - protein, 17 aa, Mycobacterium avium
VPVMFDRIMDLPAEVRR

SEQ ID NO: 133596 - protein, 20 aa, Mycobacterium avium
VPWQELARRTGASLRWYGVT

SEQ ID NO: 133597 - protein, 41 aa, Mycobacterium avium
VPYSRRTPRLARTRAWTTLQQDGMLFVWNDPEGNPPPPEVT

SEQ ID NO: 133598 - protein, 19 aa, Mycobacterium avium
VQAALPGMLDAEWGRIVNV

SEQ ID NO: 133599 - protein, 18 aa, Mycobacterium avium
VQEDVAVVGLSILSGTHL

SEQ ID NO: 133600 - protein, 19 aa, Mycobacterium avium
VQEVAVGALLVRFAAGDHV

SEQ ID NO: 133601 - protein, 26 aa, Mycobacterium avium
VQFTANPWLPGYMSQALALLTRDTGD

SEQ ID NO: 133602 - protein, 30 aa, Mycobacterium avium
VQHRVRPRLPDGFRFVLRLFGADVQLRRGG

SEQ ID NO: 133603 - protein, 32 aa, Mycobacterium avium
VQIGGGLLLATGKLPRVASAALALTVLPANLG

SEQ ID NO: 133604 - protein, 37 aa, Mycobacterium avium
VQIMTVFVSKGLQYPIVYLPFAFHRNTTDSDVVLFHD

SEQ ID NO: 133605 - protein, 26 aa, Mycobacterium avium
VQKLHGNRLLAPNEYIITLGMHDFEK

SEQ ID NO: 133606 - protein, 34 aa, Mycobacterium avium
VQKLHGNRLLAPNEYIITLGMHDFEKVSADPDLT

SEQ ID NO: 133607 - protein, 28 aa, Mycobacterium avium
VQPRQVLNAALPWSLTMVTTQPGAFSNL

SEQ ID NO: 133608 - protein, 31 aa, Mycobacterium avium
VQQRHRVPRRLQIQLGLRVQVGLQGQQRPAH

SEQ ID NO: 133609 - protein, 20 aa, Mycobacterium avium
VQRLVVLTIAGIEDPVFDEF

SEQ ID NO: 133610 - protein, 19 aa, Mycobacterium avium
VQSLQLHYARTLDLWAQAL

SEQ ID NO: 133611 - protein, 19 aa, Mycobacterium avium
VQTNVEFLRFLLADQRVRA

SEQ ID NO: 133612 - protein, 17 aa, Mycobacterium avium
VQVLCEHPDQWELLRQR

SEQ ID NO: 133613 - protein, 30 aa, Mycobacterium avium
VRAAAVNFPDVLFIAGKYQVKIPPPFIPGN

SEQ ID NO: 133614 - protein, 31 aa, Mycobacterium avium
VRAAAVNFPDVLFIAGKYQVKIPPPFIPGNE

SEQ ID NO: 133615 - protein, 18 aa, Mycobacterium avium
VRAIVRLGFGFPNPPTLV

SEQ ID NO: 133616 - protein, 27 aa, Mycobacterium avium
VRALVDLRVARLLAYRAVSLQDDPAAG

SEQ ID NO: 133617 - protein, 26 aa, Mycobacterium avium
VRALVDLRVARLLAYRAVSLQDDPAS

SEQ ID NO: 133618 - protein, 23 aa, Mycobacterium avium
VRAPGYLSWLMGCDMRGTICITG

SEQ ID NO: 133619 - protein, 39 aa, Mycobacterium avium
VRARRILLDREKSGAWWSTDGLWKEMVSTGWLGLHIDER

SEQ ID NO: 133620 - protein, 18 aa, Mycobacterium avium
VRARWERRLAEAGVGELH

SEQ ID NO: 133621 - protein, 22 aa, Mycobacterium avium
VRATPQSAPPPGAITAQSVTVT

SEQ ID NO: 133622 - protein, 19 aa, Mycobacterium avium
VRAWFVSEQGRKRILRATI

SEQ ID NO: 133623 - protein, 17 aa, Mycobacterium avium
VRAWYRQRPRRPSAAPP

SEQ ID NO: 133624 - protein, 18 aa, Mycobacterium avium
VRCGGPSAGMRLCLKCHS

SEQ ID NO: 133625 - protein, 17 aa, Mycobacterium avium
VRCRATVGEVGNAEQAN

SEQ ID NO: 133626 - protein, 35 aa, Mycobacterium avium
VRDDVRAKLRSSIKRLLVKYRYPPDKQPEAIKLVI

SEQ ID NO: 133627 - protein, 25 aa, Mycobacterium avium
VRDLEYIYCPWHQWGFELATGTTAV

SEQ ID NO: 133628 - protein, 29 aa, Mycobacterium avium
VRDVRYLGSQPWPFPRSLMVGFHAVADPA

SEQ ID NO: 133629 - protein, 30 aa, Mycobacterium avium; identical to SEQ ID NO: 25574

SEQ ID NO: 133630 - protein, 24 aa, Mycobacterium avium
VREAGGVVYLWHAADGSAPSWDPP

SEQ ID NO: 133631 - protein, 21 aa, Mycobacterium avium
VREFGRLDIVLANAGIIRLGG

SEQ ID NO: 133632 - protein, 18 aa, Mycobacterium avium
VRERLPILCGLDLTRKVA

SEQ ID NO: 133633 - protein, 18 aa, Mycobacterium avium
VRESFADAVSWVAKSLPS

SEQ ID NO: 133634 - protein, 26 aa, Mycobacterium avium
VRGGKQPRILFATQAAARPPTFVLFT

SEQ ID NO: 133635 - protein, 27 aa, Mycobacterium avium
VRGLALMAEVWPLRPDCRILACSSVFG

SEQ ID NO: 133636 - protein, 20 aa, Mycobacterium avium
VRGLARPPERVSVNFIPSAF

SEQ ID NO: 133637 - protein, 34 aa, Mycobacterium avium
VRGYLHGLAALGCAPLLVYPASKKPADVRTPQKR

SEQ ID NO: 133638 - protein, 19 aa, Mycobacterium avium
VRHFFYDWDVEVPSSLHIE

SEQ ID NO: 133639 - protein, 18 aa, Mycobacterium avium
VRIAEIGKPAALLRAARA

SEQ ID NO: 133640 - protein, 22 aa, Mycobacterium avium
VRIVTSRNTILALLDAEVGLGE

SEQ ID NO: 133641 - protein, 23 aa, Mycobacterium avium
VRKNGVLPYLRPDGKTQVTIEFE

SEQ ID NO: 133642 - protein, 21 aa, Mycobacterium avium
VRLAGLVAHQEILFGTEGETL

SEQ ID NO: 133643 - protein, 17 aa, Mycobacterium avium
VRLALKLRDEGLIDDME

SEQ ID NO: 133644 - protein, 17 aa, Mycobacterium avium
VRLARFGPRALLPATVL

SEQ ID NO: 133645 - protein, 25 aa, Mycobacterium avium
VRLDPRLRMLVPVNDYPLIDAAGRR

SEQ ID NO: 133646 - protein, 28 aa, Mycobacterium avium
VRLHKQAHLPYLVYLRNPTTGGVFASWG

SEQ ID NO: 133647 - protein, 22 aa, Mycobacterium avium
VRLPHGNGETIRLARGASLSDF

SEQ ID NO: 133648 - protein, 20 aa, Mycobacterium avium
VRPGLQLVAAPWRSKVPTTD

SEQ ID NO: 133649 - protein, 23 aa, Mycobacterium avium
VRPIGLGGFAFPLGEFGARGFQP

SEQ ID NO: 133650 - protein, 23 aa, Mycobacterium avium
VRPPESHAGFRRGLDRRCFRRAQ

SEQ ID NO: 133651 - protein, 22 aa, Mycobacterium avium
VRPTPIMRWLQDIDGPIDEFNQ

SEQ ID NO: 133652 - protein, 20 aa, Mycobacterium avium
VRQEPRLNWAIGDRADGTTI

SEQ ID NO: 133653 - protein, 20 aa, Mycobacterium avium
VRQRYALLGGPIAGMELRIA

SEQ ID NO: 133654 - protein, 17 aa, Mycobacterium avium
VRRALALGVTLFDTAEI

SEQ ID NO: 133655 - protein, 17 aa, Mycobacterium avium
VRRAMRLAGPIYAGDTM

SEQ ID NO: 133656 - protein, 17 aa, Mycobacterium avium
VRRPGWVETSGGHIAAC

SEQ ID NO: 133657 - protein, 20 aa, Mycobacterium avium
VRRWWPRRYRRSSVYSKLVS

SEQ ID NO: 133658 - protein, 28 aa, Mycobacterium avium
VRSARTLPLTPTLARMLKRAKALQAAER

SEQ ID NO: 133659 - protein, 17 aa, Mycobacterium avium
VRSDSMFRGYWQDAAAT

SEQ ID NO: 133660 - protein, 28 aa, Mycobacterium avium
VRSIRNALPLLRAADWGRIVTFAAHSIQ

SEQ ID NO: 133661 - protein, 19 aa, Mycobacterium avium
VRSLAISQRLLGTREIILI

SEQ ID NO: 133662 - protein, 26 aa, Mycobacterium avium
VRSRLMLDIASWRRRRREELAALGDK

SEQ ID NO: 133663 - protein, 20 aa, Mycobacterium avium
VRSVQAALPHLAVNGGAIVT

SEQ ID NO: 133664 - protein, 29 aa, Mycobacterium avium
VRSVRAALPMLRAAEWARIVTLSAHSIQR

SEQ ID NO: 133665 - protein, 20 aa, Mycobacterium avium
VRTLGQLQDWLSGIGALDGR

SEQ ID NO: 133666 - protein, 25 aa, Mycobacterium avium
VRTPGRGWQHRWALSVLHTALGGGL

SEQ ID NO: 133667 - protein, 20 aa, Mycobacterium avium
VRTRALGTDAFRTAAGIAAA

SEQ ID NO: 133668 - protein, 17 aa, Mycobacterium avium
VRVGGRWRTGTAHLLPD

SEQ ID NO: 133669 - protein, 17 aa, Mycobacterium avium
VRVPGGTPIPVYVAAMG

SEQ ID NO: 133670 - protein, 23 aa, Mycobacterium avium
VRVPWSLAPRQRGSRRRPSLLER

SEQ ID NO: 133671 - protein, 19 aa, Mycobacterium avium
VRVQRWLDAMPQYGPGHAE

SEQ ID NO: 133672 - protein, 21 aa, Mycobacterium avium
VRVRDGVGLVGPLVIPGVTSC

SEQ ID NO: 133673 - protein, 18 aa, Mycobacterium avium
VRVRLTELFAYPDSTTEA

SEQ ID NO: 133674 - protein, 28 aa, Mycobacterium avium
VRVSDRIDFWLWLDAGFGDHAVEAWVIE

SEQ ID NO: 133675 - protein, 26 aa, Mycobacterium avium
VRVVDRLLHHLAVDLEERDPAGFGFG

SEQ ID NO: 133676 - protein, 26 aa, Mycobacterium avium
VRVVGALIRLYAPPLVRIAELTTDRY

SEQ ID NO: 133677 - protein, 24 aa, Mycobacterium avium
VRWFDIEPCYVYHPLNAYSEIRDG

SEQ ID NO: 133678 - protein, 23 aa, Mycobacterium avium
VSAADYRAWFATLPAEFTDAVQQ

SEQ ID NO: 133679 - protein, 24 aa, Mycobacterium avium
VSAADYRAWFATLPAEFTGAVQQH

SEQ ID NO: 133680 - protein, 23 aa, Mycobacterium avium
VSAGDYRAWFATLPAEFTDAVQQ

SEQ ID NO: 133681 - protein, 41 aa, Mycobacterium avium
VSAGFMKILGPQFLSRFYGRVINTHPALLPAFPGAHGVAEA

SEQ ID NO: 133682 - protein, 42 aa, Mycobacterium avium
VSAGFMKILGPQFLSRFYGRVINTHPALLPAFPGAHGVAEAL

SEQ ID NO: 133683 - protein, 22 aa, Mycobacterium avium
VSALALPVPSLVISQLLGVPYE

SEQ ID NO: 133684 - protein, 19 aa, Mycobacterium avium
VSDPGLALTPGQPVCHFGV

SEQ ID NO: 133685 - protein, 25 aa, Mycobacterium avium
VSEAYFAALLGLPFVAVMPESTSAA

SEQ ID NO: 133686 - protein, 20 aa, Mycobacterium avium
VSEDRWWEKSPIFEALNTNK

SEQ ID NO: 133687 - protein, 27 aa, Mycobacterium avium
VSEGDYYEDPFWPVVLQACRDANLPVL

SEQ ID NO: 133688 - protein, 22 aa, Mycobacterium avium
VSEPFLVAIPVLQEKDIKVLTV

SEQ ID NO: 133689 - protein, 20 aa, Mycobacterium avium
VSEPLWKVVQAHPSAAVFPG

SEQ ID NO: 133690 - protein, 21 aa, Mycobacterium avium
VSEPLWKVVQAHPSAAVFPGG

SEQ ID NO: 133691 - protein, 24 aa, Mycobacterium avium
VSGIRRWLHTLGFRGHITSKSRRY

SEQ ID NO: 133692 - protein, 24 aa, Mycobacterium avium
VSGPGFLGWEHPPAAAASVTAPAK

SEQ ID NO: 133693 - protein, 27 aa, Mycobacterium avium
VSIGPFGVLTLSDWLQEVWGDVTEIAA

SEQ ID NO: 133694 - protein, 26 aa, Mycobacterium avium
VSIGTEALTLLLIEYGRSAAGWAQRV

SEQ ID NO: 133695 - protein, 17 aa, Mycobacterium avium
VSILELDTLPTHLVIVG

SEQ ID NO: 133696 - protein, 25 aa, Mycobacterium avium
VSILGWVHTPLGTLSLPRVEIRMPV

SEQ ID NO: 133697 - protein, 23 aa, Mycobacterium avium
VSKNFPLRYLVTNTGWGRGLDMR

SEQ ID NO: 133698 - protein, 22 aa, Mycobacterium avium
VSLDELARPGFTLYHSHAGGTR

SEQ ID NO: 133699 - protein, 31 aa, Mycobacterium avium
VSLFDALVEWMSQPLYYGRYGGKAPPRTGAR

SEQ ID NO: 133700 - protein, 26 aa, Mycobacterium avium
VSLHRRWLLVELRSDWTLGTRTYAAG

SEQ ID NO: 133701 - protein, 29 aa, Mycobacterium avium
VSLSPNEFTLLRYFVINAGTVLSKPKILD

SEQ ID NO: 133702 - protein, 18 aa, Mycobacterium avium
VSLWLDRLRRRNPVAHSA

SEQ ID NO: 133703 - protein, 25 aa, Mycobacterium avium
VSPHTSWLDVFAIGAVLPGSFVARA

SEQ ID NO: 133704 - protein, 26 aa, Mycobacterium avium
VSQRHRGEIAFIHYAPTPAEACYREE

SEQ ID NO: 133705 - protein, 24 aa, Mycobacterium avium
VSRADWLWRVLGEAGHVALLSAVR

SEQ ID NO: 133706 - protein, 34 aa, Mycobacterium avium
VSRAPSLAELLPVKAKWGISLGALLRHLHVSGLL

SEQ ID NO: 133707 - protein, 24 aa, Mycobacterium avium
VSRGMIANRISYLLGLRGASMTVD

SEQ ID NO: 133708 - protein, 20 aa, Mycobacterium avium
VSRIILTRPAVEAGERLGFL

SEQ ID NO: 133709 - protein, 21 aa, Mycobacterium avium
VSRIILTRPAVEAGERLGFLP

SEQ ID NO: 133710 - protein, 17 aa, Mycobacterium avium
VSRKTWAAAAPRAGRCG

SEQ ID NO: 133711 - protein, 22 aa, Mycobacterium avium
VSRPTVYRRWPDTRSIVAALLT

SEQ ID NO: 133712 - protein, 21 aa, Mycobacterium avium
VSRRLVLPDPPRRLLRRDELS

SEQ ID NO: 133713 - protein, 20 aa, Mycobacterium avium
VSTDLTPELLQRSRARAAGL

SEQ ID NO: 133714 - protein, 26 aa, Mycobacterium avium
VSTGRFGIHPVLLDAALHALGVADKR

SEQ ID NO: 133715 - protein, 25 aa, Mycobacterium avium
VSVGDYHIPKMVGWTLLGRPVDDAG

SEQ ID NO: 133716 - protein, 24 aa, Mycobacterium avium
VSVGIDLRLDWPKALAQAGFDASA

SEQ ID NO: 133717 - protein, 18 aa, Mycobacterium avium
VSVHGTVISSRRGELSVL

SEQ ID NO: 133718 - protein, 19 aa, Mycobacterium avium
VSVPVRYLPDFSAAAEQVA

SEQ ID NO: 133719 - protein, 17 aa, Mycobacterium avium
VSVWAAHGTADPLVPFK

SEQ ID NO: 133720 - protein, 27 aa, Mycobacterium avium
VTAGEPLDWFCLFSSAAALVGSPGQGA

SEQ ID NO: 133721 - protein, 19 aa, Mycobacterium avium
VTALARWFRVDGDELSYSV

SEQ ID NO: 133722 - protein, 22 aa, Mycobacterium avium
VTALGRWFRIDGDKLSYSVQMG

SEQ ID NO: 133723 - protein, 19 aa, Mycobacterium avium
VTALVPALAKLWAQACEWE

SEQ ID NO: 133724 - protein, 19 aa, Mycobacterium avium
VTARDKDAWLAVFADDAVV

SEQ ID NO: 133725 - protein, 21 aa, Mycobacterium avium
VTARRIGCWRFVTLHRQVDSS

SEQ ID NO: 133726 - protein, 34 aa, Mycobacterium avium
VTASDLLPTGRRLLAAPGLRAVPGLPVCQLRRST

SEQ ID NO: 133727 - protein, 24 aa, Mycobacterium avium
VTASLDPALTLRAAPAIKAFDRPV

SEQ ID NO: 133728 - protein, 24 aa, Mycobacterium avium
VTASRHAHWLNPEPKHLWGSGDSA

SEQ ID NO: 133729 - protein, 25 aa, Mycobacterium avium
VTASRQLPWLAEAEDRAISWIIANQ

SEQ ID NO: 133730 - protein, 22 aa, Mycobacterium avium
VTATPIIEWLRGVNGPVDEFNQ

SEQ ID NO: 133731 - protein, 26 aa, Mycobacterium avium
VTCQKYARRGLITFLGEDVGNPVATA

SEQ ID NO: 133732 - protein, 34 aa, Mycobacterium avium
VTDAWLPPELAPVLTERALRRAPLYELLSANGVA

SEQ ID NO: 133733 - protein, 23 aa, Mycobacterium avium
VTDDLLERLLFEGCTMHAGQACI

SEQ ID NO: 133734 - protein, 19 aa, Mycobacterium avium
VTDTIVLPGMVVPIALDDA

SEQ ID NO: 133735 - protein, 26 aa, Mycobacterium avium
VTDYRQILEFFFQIHDPTTKDRQGND

SEQ ID NO: 133736 - protein, 19 aa, Mycobacterium avium
VTEEYLANRLPVFTLNQLE

SEQ ID NO: 133737 - protein, 30 aa, Mycobacterium avium
VTGHDQLFDTLFLYENYPIDASALLDVHEL

SEQ ID NO: 133738 - protein, 26 aa, Mycobacterium avium
VTGLGGLHFFVVVFPKSGRVANGLVN

SEQ ID NO: 133739 - protein, 18 aa, Mycobacterium avium
VTGPRGEPWPLQDTVRPW

SEQ ID NO: 133740 - protein, 19 aa, Mycobacterium avium
VTGQFGTPAWIISQGPQVL

SEQ ID NO: 133741 - protein, 29 aa, Mycobacterium avium
VTIRAIRVPNPYILATVFSFNGVTPNADA

SEQ ID NO: 133742 - protein, 24 aa, Mycobacterium avium
VTKDLPEIKPPTGGAPVGLGPGGK

SEQ ID NO: 133743 - protein, 17 aa, Mycobacterium avium
VTKVWPHADYPLIDLGT

SEQ ID NO: 133744 - protein, 18 aa, Mycobacterium avium
VTLVAFLREDSMNIYTRA

SEQ ID NO: 133745 - protein, 18 aa, Mycobacterium avium
VTMHPGFGMRRLLDELCA

SEQ ID NO: 133746 - protein, 24 aa, Mycobacterium avium
VTNGLNVLPPNKFPYIPPDAEPDP

SEQ ID NO: 133747 - protein, 27 aa, Mycobacterium avium
VTNVLLAPMYPVIPLAKQLVSLARVSG

SEQ ID NO: 133748 - protein, 34 aa, Mycobacterium avium
VTPGGFLALWAPNVVEWPIIQYGAALAGVVLVAL

SEQ ID NO: 133749 - protein, 20 aa, Mycobacterium avium
VTPILPMIRVAAGRGIDWRA

SEQ ID NO: 133750 - protein, 19 aa, Mycobacterium avium
VTPVVVYLCHRSCDRTAHI

SEQ ID NO: 133751 - protein, 17 aa, Mycobacterium avium
VTQLLEPLDAGLPSPGV

SEQ ID NO: 133752 - protein, 18 aa, Mycobacterium avium
VTQLRRLAPLPPVEPPVT

SEQ ID NO: 133753 - protein, 22 aa, Mycobacterium avium
VTRPNAREHLAFASGIHACLGA

SEQ ID NO: 133754 - protein, 19 aa, Mycobacterium avium
VTRRLVLPDPPRQLLRRDE

SEQ ID NO: 133755 - protein, 20 aa, Mycobacterium avium
VTRVVKVVGFVASAPGFNGQ

SEQ ID NO: 133756 - protein, 23 aa, Mycobacterium avium
VTRVVKVVGFVASAPGFNGQPSV

SEQ ID NO: 133757 - protein, 20 aa, Mycobacterium avium
VTRWGAFLDDVGGFDCDFFG

SEQ ID NO: 133758 - protein, 19 aa, Mycobacterium avium
VTRYPGMYHGFLMRSDATA

SEQ ID NO: 133759 - protein, 25 aa, Mycobacterium avium
VTSPGLAPTAPLPLAAAAAGVPVWG

SEQ ID NO: 133760 - protein, 31 aa, Mycobacterium avium
VTTALWATFNGLLALAWRPGGLQESPETIDR

SEQ ID NO: 133761 - protein, 17 aa, Mycobacterium avium
VTTARVVYLRVPALNAV

SEQ ID NO: 133762 - protein, 19 aa, Mycobacterium avium
VTTKFFGMKVNKYIHDHNI

SEQ ID NO: 133763 - protein, 17 aa, Mycobacterium avium
VTTLAWAALGPAETHEP

SEQ ID NO: 133764 - protein, 22 aa, Mycobacterium avium
VTTLHAALPERVTVIAGISGVA

SEQ ID NO: 133765 - protein, 25 aa, Mycobacterium avium
VTTPGSALLFPTLCTPTGAVSPAKP

SEQ ID NO: 133766 - protein, 18 aa, Mycobacterium avium
VTTTPWLTSRHSFSFGDH

SEQ ID NO: 133767 - protein, 26 aa, Mycobacterium avium
VTVASFLLANYARVLSRWSGTDHFCI

SEQ ID NO: 133768 - protein, 25 aa, Mycobacterium avium
VTVGTNPWLFPGGRSGGHLSANQVG

SEQ ID NO: 133769 - protein, 22 aa, Mycobacterium avium
VTVLQALLDRHAMLRLRVERDD

SEQ ID NO: 133770 - protein, 32 aa, Mycobacterium avium
VVAAFDTELFGHWWYEGPRWLARVLRALPEAG

SEQ ID NO: 133771 - protein, 34 aa, Mycobacterium avium
VVAAIVPWNMPQFLIVTKLIPALLAGCTVVLKPA

SEQ ID NO: 133772 - protein, 18 aa, Mycobacterium avium
VVADALLELGLPGLAVNV

SEQ ID NO: 133773 - protein, 32 aa, Mycobacterium avium
VVAGITPFNFPAMIPLWKAGPALACGNAFVLK

SEQ ID NO: 133774 - protein, 38 aa, Mycobacterium avium
VVAHAFNRWLLDDWTFNYQDRIFPVPAISLNDPALGVQ

SEQ ID NO: 133775 - protein, 19 aa, Mycobacterium avium
VVALDPASWRVILGELGAA

SEQ ID NO: 133776 - protein, 17 aa, Mycobacterium avium
VVANYTAFLALQRAVAR

SEQ ID NO: 133777 - protein, 27 aa, Mycobacterium avium
VVARIDWTRFLPLYQQAGQRSLLAELV

SEQ ID NO: 133778 - protein, 28 aa, Mycobacterium avium
VVATGRPPRWIRPVVDALGFAPIAVCAN

SEQ ID NO: 133779 - protein, 20 aa, Mycobacterium avium
VVATPIMRWLQNMDGPVEQF

SEQ ID NO: 133780 - protein, 28 aa, Mycobacterium avium
VVATRAAYFQLAFSKLGLMLDGGASVLL

SEQ ID NO: 133781 - protein, 23 aa, Mycobacterium avium
VVAVLQALLDRHAMLRLRVDTAA

SEQ ID NO: 133782 - protein, 32 aa, Mycobacterium avium
VVCPGVVHVDLIPLALALLRKGGVCVLTGITP

SEQ ID NO: 133783 - protein, 29 aa, Mycobacterium avium
VVDDLAVFAQPYLNRLWARLHGRDVWQEP

SEQ ID NO: 133784 - protein, 33 aa, Mycobacterium avium
VVDGVVTMLYRVVDLFSAPLPGETWQFIAGAVP

SEQ ID NO: 133785 - protein, 26 aa, Mycobacterium avium
VVDICADLPAIPYALGTEAELAETVR

SEQ ID NO: 133786 - protein, 17 aa, Mycobacterium avium
VVDRAARILARAQGLTS

SEQ ID NO: 133787 - protein, 26 aa, Mycobacterium avium
VVDVFIGYLRRKLEANGGPRLLHTVR

SEQ ID NO: 133788 - protein, 24 aa, Mycobacterium avium
VVDVSLLNAAIWQLGPDIVGSGVT

SEQ ID NO: 133789 - protein, 31 aa, Mycobacterium avium
VVEARSFPVQYFYHLYRSDELQIFLYARPDS

SEQ ID NO: 133790 - protein, 19 aa, Mycobacterium avium
VVELPTALLIDADALRDAA

SEQ ID NO: 133791 - protein, 32 aa, Mycobacterium avium
VVELSDLELFLLRITLALLSNRPILVVGDLEQ

SEQ ID NO: 133792 - protein, 24 aa, Mycobacterium avium
VVELTKVWAGPYAGKLLAMLGAEV

SEQ ID NO: 133793 - protein, 18 aa, Mycobacterium avium
VVERYLQCLAAHDWDGLA

SEQ ID NO: 133794 - protein, 25 aa, Mycobacterium avium
VVGAITPWNFPFEIISNKVGQILAT

SEQ ID NO: 133795 - protein, 31 aa, Mycobacterium avium
VVGAIVPWNTPLFIAALKIGPALAAGCTVVL

SEQ ID NO: 133796 - protein, 26 aa, Mycobacterium avium
VVGDLLDLVFVFVGQQIPDLFDPGQR

SEQ ID NO: 133797 - protein, 22 aa, Mycobacterium avium
VVGLPQRVAAPPAPDVLVDDRH

SEQ ID NO: 133798 - protein, 27 aa, Mycobacterium avium
VVGPDDPAWSLQCDIARQVLALDGVPA

SEQ ID NO: 133799 - protein, 25 aa, Mycobacterium avium
VVGRGFVVRLALDQLPQRAEDGRRD

SEQ ID NO: 133800 - protein, 18 aa, Mycobacterium avium
VVGRLLRHRKLAQRYLTV

SEQ ID NO: 133801 - protein, 27 aa, Mycobacterium avium
VVGRPAAHPGLRRAPPLRLGHRAVTGE

SEQ ID NO: 133802 - protein, 21 aa, Mycobacterium avium
VVGTRFWATPEALVSPKAQQR

SEQ ID NO: 133803 - protein, 21 aa, Mycobacterium avium
VVGTSMVWLVAPRHAEEWLRE

SEQ ID NO: 133804 - protein, 24 aa, Mycobacterium avium
VVLDESQVYLALNKPRGVHSTMSD

SEQ ID NO: 133805 - protein, 17 aa, Mycobacterium avium
VVLHFEGDRNGSLRMVR

SEQ ID NO: 133806 - protein, 18 aa, Mycobacterium avium
VVLHYFLHAEPTGVAAWQ

SEQ ID NO: 133807 - protein, 18 aa, Mycobacterium avium
VVLLTKNIALDYGPSGIR

SEQ ID NO: 133808 - protein, 23 aa, Mycobacterium avium
VVLMAALARLGAVQNPIIPVLRE

SEQ ID NO: 133809 - protein, 18 aa, Mycobacterium avium
VVLRHRNAFGHTGGAGGV

SEQ ID NO: 133810 - protein, 22 aa, Mycobacterium avium
VVMTALARLGAVQNPVLPIWRE

SEQ ID NO: 133811 - protein, 19 aa, Mycobacterium avium
VVNRVWFLDAVRGEVDVYN

SEQ ID NO: 133812 - protein, 17 aa, Mycobacterium avium
VVPARVDALLIGMAERY

SEQ ID NO: 133813 - protein, 17 aa, Mycobacterium avium
VVPDDLPMMLHSYGRDP

SEQ ID NO: 133814 - protein, 33 aa, Mycobacterium avium
VVPHFEKMLYDNALLLRLYAHWARRTCDPLAAR

SEQ ID NO: 133815 - protein, 19 aa, Mycobacterium avium
VVPLSFAQNRLWFIDQSQG

SEQ ID NO: 133816 - protein, 17 aa, Mycobacterium avium
VVPQRRDGVRGAVGAGG

SEQ ID NO: 133817 - protein, 17 aa, Mycobacterium avium
VVQAGLAVLLAKLGASC

SEQ ID NO: 133818 - protein, 30 aa, Mycobacterium avium
VVRLDYEVPLLLSALSPRMLRIAGRFADGV

SEQ ID NO: 133819 - protein, 17 aa, Mycobacterium avium
VVRRRITFLAKSEYFTG

SEQ ID NO: 133820 - protein, 17 aa, Mycobacterium avium
VVSPTPLLVMLTALREG

SEQ ID NO: 133821 - protein, 24 aa, Mycobacterium avium
VVTANGRFTIAAYAAPKTGGLWRE

SEQ ID NO: 133822 - protein, 22 aa, Mycobacterium avium
VVVQPQRLVAGVALRGGVRLVA

SEQ ID NO: 133823 - protein, 24 aa, Mycobacterium avium
VVVSLPVHVADPLEWVRLARIGAT

SEQ ID NO: 133824 - protein, 21 aa, Mycobacterium avium
VVVVSIFVNPLQFSAGEDLDA

SEQ ID NO: 133825 - protein, 18 aa, Mycobacterium avium
VVVYAHGGGFVFCDLDSH

SEQ ID NO: 133826 - protein, 17 aa, Mycobacterium avium
VWDRLFSGLRPAELHRF

SEQ ID NO: 133827 - protein, 18 aa, Mycobacterium avium
VWLALRGLRVLGLDVSPV

SEQ ID NO: 133828 - protein, 24 aa, Mycobacterium avium
VWSQLPGRERAKILWRIGDLIDEH

SEQ ID NO: 133829 - protein, 24 aa, Mycobacterium avium
VWTQFHSYAFDYSVWEIWGALLHG

SEQ ID NO: 133830 - protein, 18 aa, Mycobacterium avium
VWVRGVGLGMDRVMHQHK

SEQ ID NO: 133831 - protein, 19 aa, Mycobacterium avium
VWWSEIARVLRPGGSYFAQ

SEQ ID NO: 133832 - protein, 26 aa, Mycobacterium avium
VYAATRAVLPVLQTWLARDGAGTLVV

SEQ ID NO: 133833 - protein, 20 aa, Mycobacterium avium
VYACPFAIHDRFLAGNVLSD

SEQ ID NO: 133834 - protein, 17 aa, Mycobacterium avium
VYGYHDLAPTPAGANQL

SEQ ID NO: 133835 - protein, 17 aa, Mycobacterium avium
VYLATRGGYFVLDLATG

SEQ ID NO: 133836 - protein, 21 aa, Mycobacterium avium
VYLHTARWTSLGLSLIEAMLL

SEQ ID NO: 133837 - protein, 24 aa, Mycobacterium avium
VYLSPAPLYHTAPSFWSMVVQSLG

SEQ ID NO: 133838 - protein, 18 aa, Mycobacterium avium
VYQINYLRCIGCGFCIEA

SEQ ID NO: 133839 - protein, 19 aa, Mycobacterium avium
VYRDATWVSSYRIDPFDVS

SEQ ID NO: 133840 - protein, 17 aa, Mycobacterium avium
VYRLVHNGELPAVRVGR

SEQ ID NO: 133841 - protein, 17 aa, Mycobacterium avium
VYSIRSPLGAAIAGARP

SEQ ID NO: 133842 - protein, 17 aa, Mycobacterium avium
VYSPLVWYIVDGTRVAY

SEQ ID NO: 133843 - protein, 17 aa, Mycobacterium avium
VYWHNTSRLHSYLGDIP

SEQ ID NO: 133844 - protein, 17 aa, Mycobacterium avium
WAAQQPGFRGERLVNSM

SEQ ID NO: 133845 - protein, 27 aa, Mycobacterium avium
WADLPVQYCDYTLWQRAQFGDLDDPDS

SEQ ID NO: 133846 - protein, 27 aa, Mycobacterium avium
WADLPVQYCDYTLWQRAQFGDLNDPDS

SEQ ID NO: 133847 - protein, 17 aa, Mycobacterium avium
WADRPVVPALAALGVYN

SEQ ID NO: 133848 - protein, 31 aa, Mycobacterium avium
WAEQANRLSWATPFTRVLDWSRAPFAEWFAD

SEQ ID NO: 133849 - protein, 41 aa, Mycobacterium avium
WAGESLLYFTPQVPQLTQLSFGLIAPFIPAAGAPGVAGLAG

SEQ ID NO: 133850 - protein, 29 aa, Mycobacterium avium
WAGNEPSFGVPWLYNYIGQPWKTQHTVDR

SEQ ID NO: 133851 - protein, 29 aa, Mycobacterium avium
WAGSYPDRIIPCQLPWLLDPELGAKMIYE

SEQ ID NO: 133852 - protein, 19 aa, Mycobacterium avium
WAGVFAGLPARRVELPTYA

SEQ ID NO: 133853 - protein, 18 aa, Mycobacterium avium
WAGVRWRNLTGGIVALHA

SEQ ID NO: 133854 - protein, 17 aa, Mycobacterium avium
WAHGPQIDKGARWDPAE

SEQ ID NO: 133855 - protein, 17 aa, Mycobacterium avium
WAKLPHDWIERYEANHE

SEQ ID NO: 133856 - protein, 18 aa, Mycobacterium avium
WALLRAANQFWMLSEPER

SEQ ID NO: 133857 - protein, 21 aa, Mycobacterium avium
WAPAFPDRFGGWDIGVRMEQL

SEQ ID NO: 133858 - protein, 18 aa, Mycobacterium avium
WAPFFADLTRAYAAPGDF

SEQ ID NO: 133859 - protein, 20 aa, Mycobacterium avium
WAPLRVQYADYAAWQRTFLG

SEQ ID NO: 133860 - protein, 21 aa, Mycobacterium avium
WAPLRVQYADYAAWQRTFLGD

SEQ ID NO: 133861 - protein, 20 aa, Mycobacterium avium
WAQDAAAMYGYALASAAAST

SEQ ID NO: 133862 - protein, 19 aa, Mycobacterium avium
WAQDTAAMYGYALASAAAS

SEQ ID NO: 133863 - protein, 24 aa, Mycobacterium avium
WAQRGWLAVRYNLPFRRRRPTGPP

SEQ ID NO: 133864 - protein, 20 aa, Mycobacterium avium
WAQWRAVRVPALLIEAGNSV

SEQ ID NO: 133865 - protein, 33 aa, Mycobacterium avium
WASLRARALAGDDPKLLWLEWSAPEPPEDPAAR

SEQ ID NO: 133866 - protein, 22 aa, Mycobacterium avium
WATQLRMMQAQLLAKIAAAVGN

SEQ ID NO: 133867 - protein, 17 aa, Mycobacterium avium
WCADVVVAAYRPAQVPW

SEQ ID NO: 133868 - protein, 19 aa, Mycobacterium avium
WDALWDKLIAACHPGVRAD

SEQ ID NO: 133869 - protein, 29 aa, Mycobacterium avium
WDAPQEATPPWLQMTKPIICAVNGIACGA

SEQ ID NO: 133870 - protein, 18 aa, Mycobacterium avium
WDAVLKVHLYGGYHVIRA

SEQ ID NO: 133871 - protein, 25 aa, Mycobacterium avium
WDDPYQRAWDIERIALLEAAGWAVI

SEQ ID NO: 133872 - protein, 26 aa, Mycobacterium avium
WDDPYQRAWDIERIALLEAAGWAVIR

SEQ ID NO: 133873 - protein, 17 aa, Mycobacterium avium
WDMLLDQHRLCGRHFIA

SEQ ID NO: 133874 - protein, 31 aa, Mycobacterium avium
WDQAMRLRDLLKFDFYFADSATFRDNIAEEM

SEQ ID NO: 133875 - protein, 34 aa, Mycobacterium avium
WDRFQTLCGIQYYFDTEFQLLRGHLLYAGTEWAL

SEQ ID NO: 133876 - protein, 25 aa, Mycobacterium avium
WDTEGYVLPVLTYTAPHTVADALRW

SEQ ID NO: 133877 - protein, 28 aa, Mycobacterium avium
WDTKCELVHAALVFALPPVPELRSGRSA

SEQ ID NO: 133878 - protein, 17 aa, Mycobacterium avium
WDVASLIRLVDTAHTRA

SEQ ID NO: 133879 - protein, 20 aa, Mycobacterium avium
WDYPLGLVAPANFALHVIRY

SEQ ID NO: 133880 - protein, 31 aa, Mycobacterium avium
WDYTFRLNVGAYFYLTKAALPHLRAGSSIIG

SEQ ID NO: 133881 - protein, 32 aa, Mycobacterium avium
WDYTFRLNVGAYFYLTKAVLPHLRAGSSIIGS

SEQ ID NO: 133882 - protein, 20 aa, Mycobacterium avium
WEALGICDYITKPRITAAIT

SEQ ID NO: 133883 - protein, 21 aa, Mycobacterium avium
WEHAFYLQYKNVKADYVKAFW

SEQ ID NO: 133884 - protein, 23 aa, Mycobacterium avium
WEHDAHLYIRRATVLQAFAGDQD

SEQ ID NO: 133885 - protein, 17 aa, Mycobacterium avium
WFIVDRVKDMIVTGGFN

SEQ ID NO: 133886 - protein, 17 aa, Mycobacterium avium
WFMVSPEVKSALRPVDS

SEQ ID NO: 133887 - protein, 20 aa, Mycobacterium avium
WGELFNIPLTAHFLGGAVIG

SEQ ID NO: 133888 - protein, 20 aa, Mycobacterium avium
WGGAAAMAGGFIYLGGGTPI

SEQ ID NO: 133889 - protein, 39 aa, Mycobacterium avium
WGISNFQIFPNLEILIYGGWYLLYRYWPTSHNTHRFEAY

SEQ ID NO: 133890 - protein, 20 aa, Mycobacterium avium
WGKPPTPLWPDAVGEMCIRQ

SEQ ID NO: 133891 - protein, 26 aa, Mycobacterium avium
WGNAGWIAPALTFPLQPAGVLRDEWQ

SEQ ID NO: 133892 - protein, 29 aa, Mycobacterium avium
WGPNAIHQLIAPNAWRLPFEREWRDPQTL

SEQ ID NO: 133893 - protein, 25 aa, Mycobacterium avium
WGSTGPFRDYKGWEALIMAKTGVMH

SEQ ID NO: 133894 - protein, 24 aa, Mycobacterium avium
WGSTGPFRDYKGWEALVMAKTGVM

SEQ ID NO: 133895 - protein, 23 aa, Mycobacterium avium
WGSTLVVPPTPWSAQGMFDVLRN

SEQ ID NO: 133896 - protein, 18 aa, Mycobacterium avium
WGWRTMCWLNLTDKGEKL

SEQ ID NO: 133897 - protein, 17 aa, Mycobacterium avium
WGYHRYWLAEHHFVAVA

SEQ ID NO: 133898 - protein, 21 aa, Mycobacterium avium
WGYHRYWLAEHHFVAVASSAP

SEQ ID NO: 133899 - protein, 19 aa, Mycobacterium avium
WHEAAVIYLAATLAGMVVN

SEQ ID NO: 133900 - protein, 21 aa, Mycobacterium avium
WHEMAPLPLHAMRRRRRLDVY

SEQ ID NO: 133901 - protein, 32 aa, Mycobacterium avium
WHIDEWCGSYPGRFLPMGLPVLWDPELCAKEI

SEQ ID NO: 133902 - protein, 21 aa, Mycobacterium avium
WHRRRPLWIGVAIGGTVDSAT

SEQ ID NO: 133903 - protein, 17 aa, Mycobacterium avium
WHRVITASGRPARHLRT

SEQ ID NO: 133904 - protein, 26 aa, Mycobacterium avium
WIAAGSPPIYFGFGSSARVASPGDVI

SEQ ID NO: 133905 - protein, 25 aa, Mycobacterium avium
WIAAGTPPIYFGFGSSARVASPGDV

SEQ ID NO: 133906 - protein, 26 aa, Mycobacterium avium
WIAAGTPPIYFGFGSSARVASPGDVI

SEQ ID NO: 133907 - protein, 24 aa, Mycobacterium avium
WIAEGLFGYLPPEAQDRLLDNITA

SEQ ID NO: 133908 - protein, 19 aa, Mycobacterium avium
WIGVGTLDLFYPECLEYAR

SEQ ID NO: 133909 - protein, 17 aa, Mycobacterium avium
WIPTAVDGRLRAACALL

SEQ ID NO: 133910 - protein, 17 aa, Mycobacterium avium
WKSYGGTAYFGCPQRFS

SEQ ID NO: 133911 - protein, 18 aa, Mycobacterium avium
WKYLMAKFNATIDERADP

SEQ ID NO: 133912 - protein, 23 aa, Mycobacterium avium
WLADHGLTTLLAHSLVVLNDSDG

SEQ ID NO: 133913 - protein, 19 aa, Mycobacterium avium
WLDVVGLREFAGHYPRQVS

SEQ ID NO: 133914 - protein, 17 aa, Mycobacterium avium
WLEFDVLLGDVRSLKQK

SEQ ID NO: 133915 - protein, 30 aa, Mycobacterium avium
WLGPASLSMAGAVMPYVSWLTAVAEQCGRA

SEQ ID NO: 133916 - protein, 18 aa, Mycobacterium avium
WLGTLGTLGRAAFQLGVL

SEQ ID NO: 133917 - protein, 17 aa, Mycobacterium avium
WLKQLHGKIVVVKYGGN

SEQ ID NO: 133918 - protein, 17 aa, Mycobacterium avium
WLLAQPEKPDLVFEATS

SEQ ID NO: 133919 - protein, 18 aa, Mycobacterium avium
WLLRPLGVDAFLNEIWAT

SEQ ID NO: 133920 - protein, 19 aa, Mycobacterium avium
WLLRPLGVDAFLNEIWATR

SEQ ID NO: 133921 - protein, 18 aa, Mycobacterium avium
WLLRSLGVDAFLNEIWAT

SEQ ID NO: 133922 - protein, 17 aa, Mycobacterium avium
WLSWIGIDDLIDVYHRA

SEQ ID NO: 133923 - protein, 19 aa, Mycobacterium avium
WMCAPRWESDALFSNLVGG

SEQ ID NO: 133924 - protein, 18 aa, Mycobacterium avium
WMPVGKADGCGCPMWTAP

SEQ ID NO: 133925 - protein, 17 aa, Mycobacterium avium
WMRSLGYRPVLTRHVNE

SEQ ID NO: 133926 - protein, 17 aa, Mycobacterium avium
WMYFNNDLGGHAVRNAL

SEQ ID NO: 133927 - protein, 24 aa, Mycobacterium avium
WNSVPGLMDMLLIAAGDKAGSLPT

SEQ ID NO: 133928 - protein, 25 aa, Mycobacterium avium
WNTEAWQRCAYFTEVRRAGGDTART

SEQ ID NO: 133929 - protein, 26 aa, Mycobacterium avium
WNVFNTIVSNILYNHTLDTAAAAGVA

SEQ ID NO: 133930 - protein, 20 aa, Mycobacterium avium
WPAALRRAGLDPSAPAVWLI

SEQ ID NO: 133931 - protein, 22 aa, Mycobacterium avium
WPGCPSGWRCPPTDPIRRWPTT

SEQ ID NO: 133932 - protein, 18 aa, Mycobacterium avium
WPGFARQGQIGTAFSTVM

SEQ ID NO: 133933 - protein, 22 aa, Mycobacterium avium
WPLQVIPRTPWADQRPTFREAQ

SEQ ID NO: 133934 - protein, 17 aa, Mycobacterium avium
WPSMTRARLAARVDAVV

SEQ ID NO: 133935 - protein, 20 aa, Mycobacterium avium
WPTDPAFRRQVFQLVDIAFG

SEQ ID NO: 133936 - protein, 21 aa, Mycobacterium avium
WPTRARRRLLRTPRRPGPVIV

SEQ ID NO: 133937 - protein, 25 aa, Mycobacterium avium
WPWGDPHRYSFAPHPISGAAAKLWE

SEQ ID NO: 133938 - protein, 17 aa, Mycobacterium avium
WQAHLLDCLVDAQQRDP

SEQ ID NO: 133939 - protein, 28 aa, Mycobacterium avium
WQASYLHNGVVFKALATFPTKSSAGHWL

SEQ ID NO: 133940 - protein, 28 aa, Mycobacterium avium
WQAVGNGVLFPFAATYMKLYACASPADQ

SEQ ID NO: 133941 - protein, 27 aa, Mycobacterium avium
WQDNEGHSMFPWLTLALVGSSTSHVSF

SEQ ID NO: 133942 - protein, 20 aa, Mycobacterium avium
WQDRLDSLQWVIGSILSNID

SEQ ID NO: 133943 - protein, 22 aa, Mycobacterium avium
WQVPKHEGLTMFLVPLAHPGVT

SEQ ID NO: 133944 - protein, 17 aa, Mycobacterium avium
WRAIREDLERRGVGAPI

SEQ ID NO: 133945 - protein, 20 aa, Mycobacterium avium
WRAPSPLPGWDVKAVVSHMI

SEQ ID NO: 133946 - protein, 18 aa, Mycobacterium avium
WRAYRLVAGEAASGWAPL

SEQ ID NO: 133947 - protein, 20 aa, Mycobacterium avium
WRCPPTDPIRRWPTTAAPAC

SEQ ID NO: 133948 - protein, 17 aa, Mycobacterium avium
WRDGRVEQLGWPRVKIH

SEQ ID NO: 133949 - protein, 18 aa, Mycobacterium avium
WRDMDMTMVAAPLGDPHT

SEQ ID NO: 133950 - protein, 18 aa, Mycobacterium avium
WREHGFNLEFGDLGYQGE

SEQ ID NO: 133951 - protein, 29 aa, Mycobacterium avium
WREVHRLRQPVLLIWGREDRVNPLDGALV

SEQ ID NO: 133952 - protein, 18 aa, Mycobacterium avium
WRGEAIRIGFVARTILEP

SEQ ID NO: 133953 - protein, 19 aa, Mycobacterium avium
WRMRPALTARWADAGVEPL

SEQ ID NO: 133954 - protein, 23 aa, Mycobacterium avium
WRNFRGILPAFAPHYRCLVLEFP

SEQ ID NO: 133955 - protein, 23 aa, Mycobacterium avium
WRNRLAQAGVLPGGVWAYEAHRV

SEQ ID NO: 133956 - protein, 17 aa, Mycobacterium avium
WRRALRLATFGLIDLGP

SEQ ID NO: 133957 - protein, 18 aa, Mycobacterium avium
WRRALRLATFGLIDLGPS

SEQ ID NO: 133958 - protein, 20 aa, Mycobacterium avium
WRVVPDVYLLGKALGGGVVP

SEQ ID NO: 133959 - protein, 27 aa, Mycobacterium avium
WSAQDYTPIDHLPYVGPILPNSETIFV

SEQ ID NO: 133960 - protein, 24 aa, Mycobacterium avium
WSDFGFHEYLEVKSILGYAPAQAD

SEQ ID NO: 133961 - protein, 19 aa, Mycobacterium avium
WSLPVLLQEVFAGYYGQRL

SEQ ID NO: 133962 - protein, 17 aa, Mycobacterium avium
WSMPSAEQFTFGYADEH

SEQ ID NO: 133963 - protein, 28 aa, Mycobacterium avium
WSQSARSRGPWPWLQPDRNGAPPVAGLH

SEQ ID NO: 133964 - protein, 19 aa, Mycobacterium avium
WSRWPLQRMALSRYADRQA

SEQ ID NO: 133965 - protein, 17 aa, Mycobacterium avium
WSTLVRHRPTGRRLLIC

SEQ ID NO: 133966 - protein, 21 aa, Mycobacterium avium
WSVDTPALTVSLRGLVDCVVE

SEQ ID NO: 133967 - protein, 21 aa, Mycobacterium avium
WSVTDRITWYSSAAELEQREQ

SEQ ID NO: 133968 - protein, 32 aa, Mycobacterium avium
WSYIGAENIALPSIYYAHRRKVFRRDGMLLAV

SEQ ID NO: 133969 - protein, 17 aa, Mycobacterium avium
WTAQFEHTLLVTDTGVE

SEQ ID NO: 133970 - protein, 17 aa, Mycobacterium avium
WTDDGLPLGVQFVGKLG

SEQ ID NO: 133971 - protein, 31 aa, Mycobacterium avium
WTELHARFGKLPFERLFAPAIAYGRNGFPVS

SEQ ID NO: 133972 - protein, 26 aa, Mycobacterium avium
WTERVRLLTTLIVPQLHDPVLLAKGL

SEQ ID NO: 133973 - protein, 25 aa, Mycobacterium avium
WTGKKALLMHGALWQGTVVATMAGW

SEQ ID NO: 133974 - protein, 21 aa, Mycobacterium avium
WTGRYIYPSHGLRFATRRPED

SEQ ID NO: 133975 - protein, 20 aa, Mycobacterium avium
WTIAYPFVRLHQPSAFYGVN

SEQ ID NO: 133976 - protein, 31 aa, Mycobacterium avium
WTKDHPKKLWRPKVPIIVLVGEPIQPTLGVE

SEQ ID NO: 133977 - protein, 26 aa, Mycobacterium avium
WTTDKDGIILALLASEILAVTGSSPS

SEQ ID NO: 133978 - protein, 26 aa, Mycobacterium avium
WTTDKDGIILALLASEILAVTGSTPS

SEQ ID NO: 133979 - protein, 21 aa, Mycobacterium avium
WTTHGDLALPLLSTARELDEG

SEQ ID NO: 133980 - protein, 19 aa, Mycobacterium avium
WTWVAVSGLNLLYQAYLRV

SEQ ID NO: 133981 - protein, 17 aa, Mycobacterium avium
WTYGLIEEQSRLRGATP

SEQ ID NO: 133982 - protein, 18 aa, Mycobacterium avium
WVAGLPREEVSERAQRLG

SEQ ID NO: 133983 - protein, 18 aa, Mycobacterium avium
WVAHTLHALAWMVPGELA

SEQ ID NO: 133984 - protein, 18 aa, Mycobacterium avium
WVCGWWLNQAGCRRGGGL

SEQ ID NO: 133985 - protein, 17 aa, Mycobacterium avium
WVDPLKLTKQVALLDED

SEQ ID NO: 133986 - protein, 17 aa, Mycobacterium avium
WVERTYGHPCDVGRAGL

SEQ ID NO: 133987 - protein, 18 aa, Mycobacterium avium
WVGAVDRNDDGLATLQQQ

SEQ ID NO: 133988 - protein, 17 aa, Mycobacterium avium
WVMHCHNTYHQVAGMET

SEQ ID NO: 133989 - protein, 17 aa, Mycobacterium avium
WVPDFLSLPIAVENSLK

SEQ ID NO: 133990 - protein, 39 aa, Mycobacterium avium
WVQYDPLGVVLIIGPWNYPLYLSLAPLVAAVAAGNCAVI

SEQ ID NO: 133991 - protein, 28 aa, Mycobacterium avium
WVRALVDLRVARLLAYRAVSLQDDPAAG

SEQ ID NO: 133992 - protein, 19 aa, Mycobacterium avium
WVTAIRRDWAARYTWPRFV

SEQ ID NO: 133993 - protein, 18 aa, Mycobacterium avium
WVTVRSQRLSAFELQART

SEQ ID NO: 133994 - protein, 18 aa, Mycobacterium avium
WVVSRYRDIRAALVDPRL

SEQ ID NO: 133995 - protein, 17 aa, Mycobacterium avium
WVVSWFEHLNLSDVTLF

SEQ ID NO: 133996 - protein, 17 aa, Mycobacterium avium
WVYFTSGTTGRPKAVRH

SEQ ID NO: 133997 - protein, 33 aa, Mycobacterium avium
WYGQGASDSFYRTWYPTPLGPVPTPSPNAYGPP

SEQ ID NO: 133998 - protein, 18 aa, Mycobacterium avium
WYRNIRQTVQFDQTVRSA

SEQ ID NO: 133999 - protein, 22 aa, Mycobacterium avium
YAAKVFLCSEVARWIDEEGLSL

SEQ ID NO: 134000 - protein, 17 aa, Mycobacterium avium
YAALMAGADLVLPDCHL

SEQ ID NO: 134001 - protein, 17 aa, Mycobacterium avium
YAAPSFAPGRPLIEVLR

SEQ ID NO: 134002 - protein, 18 aa, Mycobacterium avium
YAAPSFAPGRPLIEVLRD

SEQ ID NO: 134003 - protein, 18 aa, Mycobacterium avium
YAARTLLRREFGLGMPRL

SEQ ID NO: 134004 - protein, 23 aa, Mycobacterium avium
YAASLLGLPIGAYPHSRPPQAEL

SEQ ID NO: 134005 - protein, 17 aa, Mycobacterium avium
YAATLQALTGRLPGNTD

SEQ ID NO: 134006 - protein, 27 aa, Mycobacterium avium
YADAAIDNRLLWQLDGRDNRLLWQLDG

SEQ ID NO: 134007 - protein, 17 aa, Mycobacterium avium
YADLVRLVDDLAARLRA

SEQ ID NO: 134008 - protein, 20 aa, Mycobacterium avium
YADRRRRLCVALAERGVDAH

SEQ ID NO: 134009 - protein, 24 aa, Mycobacterium avium
YAEALTFAYHRLGRADVGVARIFN

SEQ ID NO: 134010 - protein, 19 aa, Mycobacterium avium
YAERRAELKEIIRSPRSTP

SEQ ID NO: 134011 - protein, 20 aa, Mycobacterium avium
YAEWMRSLGYRPLLTRHVNE

SEQ ID NO: 134012 - protein, 18 aa, Mycobacterium avium
YAEWMRSLGYRPVLTRHV

SEQ ID NO: 134013 - protein, 31 aa, Mycobacterium avium
YAGDVWFPQPPPPHHPWRTMPNHAMTPHISG

SEQ ID NO: 134014 - protein, 17 aa, Mycobacterium avium
YAGTRRYVRRQRSWFRR

SEQ ID NO: 134015 - protein, 18 aa, Mycobacterium avium
YAGTWLLSSSVLADHVER

SEQ ID NO: 134016 - protein, 18 aa, Mycobacterium avium
YALFDAVVALLAAVSAGA

SEQ ID NO: 134017 - protein, 19 aa, Mycobacterium avium
YALFDAVVALLAAVSAGAP

SEQ ID NO: 134018 - protein, 21 aa, Mycobacterium avium
YALFVQLKKVALTRNVLLPAG

SEQ ID NO: 134019 - protein, 21 aa, Mycobacterium avium
YALFVQLKKVALTRNVLLPVG

SEQ ID NO: 134020 - protein, 20 aa, Mycobacterium avium
YALPQSPQLFKQLLMVAGME

SEQ ID NO: 134021 - protein, 26 aa, Mycobacterium avium
YALPSMLLPLWDSEVGAAFIATLRSI

SEQ ID NO: 134022 - protein, 17 aa, Mycobacterium avium
YARDLAPVFGETGRDDR

SEQ ID NO: 134023 - protein, 18 aa, Mycobacterium avium
YARSRPITITDVELAPPG

SEQ ID NO: 134024 - protein, 20 aa, Mycobacterium avium
YARVPLIVLSANRPYELLGT

SEQ ID NO: 134025 - protein, 26 aa, Mycobacterium avium
YASDARTPLTVPPLFAAGAGATAYVV

SEQ ID NO: 134026 - protein, 19 aa, Mycobacterium avium
YAYARASAGVWKLTPFDSP

SEQ ID NO: 134027 - protein, 24 aa, Mycobacterium avium
YCIDVLTQISAVNSALRSVALNLL

SEQ ID NO: 134028 - protein, 19 aa, Mycobacterium avium
YCPRWYFDEVGGGDLSQAG

SEQ ID NO: 134029 - protein, 25 aa, Mycobacterium avium
YCVVDTRAWLRDPAPLFRTNVEGLR

SEQ ID NO: 134030 - protein, 17 aa, Mycobacterium avium
YCVYGARKLWKTARREG

SEQ ID NO: 134031 - protein, 24 aa, Mycobacterium avium
YCYGAAFDAWTGRYLLVLEDLPAE

SEQ ID NO: 134032 - protein, 26 aa, Mycobacterium avium
YDADDPVWLRWNYATVVWGIATAHEL

SEQ ID NO: 134033 - protein, 17 aa, Mycobacterium avium
YDAFRENAATHPARLAL

SEQ ID NO: 134034 - protein, 21 aa, Mycobacterium avium
YDALWTGRRFVVQDTGGWEPD

SEQ ID NO: 134035 - protein, 23 aa, Mycobacterium avium
YDEDQRWIVLARGRLRIVCNLGA

SEQ ID NO: 134036 - protein, 23 aa, Mycobacterium avium
YDELLRFEKTLMAIWRAIQTAGR

SEQ ID NO: 134037 - protein, 26 aa, Mycobacterium avium
YDFVARQWQLLKPRMAPGGWVLFDDI

SEQ ID NO: 134038 - protein, 25 aa, Mycobacterium avium
YDHWVNQAVVLFPSADKAKSFLQTS

SEQ ID NO: 134039 - protein, 29 aa, Mycobacterium avium
YDLKKWIDWSVDLYYWSPSYSQVYTELKK

SEQ ID NO: 134040 - protein, 23 aa, Mycobacterium avium
YDLPFLQQWVYRPPHNEVIAQLR

SEQ ID NO: 134041 - protein, 18 aa, Mycobacterium avium
YDRAWWFARFVADSYGPP

SEQ ID NO: 134042 - protein, 25 aa, Mycobacterium avium
YDVSDEFFALFLDPTMAYTCAFFER

SEQ ID NO: 134043 - protein, 23 aa, Mycobacterium avium
YEARHRPGWLPIPLRSIARLTTA

SEQ ID NO: 134044 - protein, 17 aa, Mycobacterium avium
YEDLGGGAYFIHFAWDS

SEQ ID NO: 134045 - protein, 17 aa, Mycobacterium avium
YEMHHLWTGQDFGDRLP

SEQ ID NO: 134046 - protein, 17 aa, Mycobacterium avium
YEQPYALARRLSTLDHL

SEQ ID NO: 134047 - protein, 17 aa, Mycobacterium avium
YERALKAILSQMEIFTL

SEQ ID NO: 134048 - protein, 23 aa, Mycobacterium avium
YERIKPAFKHWAAVVIHAGEPGA

SEQ ID NO: 134049 - protein, 28 aa, Mycobacterium avium
YERTYQVNYLAPFLLTTQLLDVLLESRA

SEQ ID NO: 134050 - protein, 18 aa, Mycobacterium avium
YERWWAVTPGAVTRDKAW

SEQ ID NO: 134051 - protein, 17 aa, Mycobacterium avium
YETPLLLNVPSFAICCA

SEQ ID NO: 134052 - protein, 18 aa, Mycobacterium avium
YEVMRDIRHFTPAGTVTV

SEQ ID NO: 134053 - protein, 25 aa, Mycobacterium avium
YEVSPNRMLLDPVGYGKTMAGMVEG

SEQ ID NO: 134054 - protein, 18 aa, Mycobacterium avium
YFDQAHFLREFRAFTGVT

SEQ ID NO: 134055 - protein, 26 aa, Mycobacterium avium
YFGAVRMVLALLPHWRERRFGHVVNV

SEQ ID NO: 134056 - protein, 24 aa, Mycobacterium avium
YFGMLTGYGRELFRELAFRVVNRF

SEQ ID NO: 134057 - protein, 18 aa, Mycobacterium avium
YFGTKIMRYMHDHGITEE

SEQ ID NO: 134058 - protein, 18 aa, Mycobacterium avium
YFGTKIMRYMHDHGITEQ

SEQ ID NO: 134059 - protein, 17 aa, Mycobacterium avium
YFLNIKGPELLNKFVGE

SEQ ID NO: 134060 - protein, 18 aa, Mycobacterium avium
YFVIRPRPRVHARPCLLF

SEQ ID NO: 134061 - protein, 24 aa, Mycobacterium avium
YGAAKLGLVGLINSLALEGAKYNI

SEQ ID NO: 134062 - protein, 27 aa, Mycobacterium avium
YGDTKLGLFPFRRNLAFYGVDLGLMSV

SEQ ID NO: 134063 - protein, 26 aa, Mycobacterium avium
YGDTQWSWAQYLRGTAARAAALLGAA

SEQ ID NO: 134064 - protein, 21 aa, Mycobacterium avium
YGGFVFGSFAPDGPSLVEHLG

SEQ ID NO: 134065 - protein, 22 aa, Mycobacterium avium
YGIIQHAEYFTFYASVDHLHID

SEQ ID NO: 134066 - protein, 17 aa, Mycobacterium avium
YGINPLVLGALTPRIAS

SEQ ID NO: 134067 - protein, 24 aa, Mycobacterium avium
YGLDLQLALAMCYELHYRGFTGVD

SEQ ID NO: 134068 - protein, 21 aa, Mycobacterium avium
YGLIVYQEQIMFIAQKVASYT

SEQ ID NO: 134069 - protein, 22 aa, Mycobacterium avium
YGLIVYQEQIMFIAQKVASYTM

SEQ ID NO: 134070 - protein, 23 aa, Mycobacterium avium
YGLIVYQEQIMFIAQKVASYTMG

SEQ ID NO: 134071 - protein, 26 aa, Mycobacterium avium
YGLNAKWPVYLSTKNTILKAYDGMFK

SEQ ID NO: 134072 - protein, 17 aa, Mycobacterium avium
YGPAFQGLTAAWVRGDE

SEQ ID NO: 134073 - protein, 19 aa, Mycobacterium avium
YGPLYPRTPACYGFSIIAK

SEQ ID NO: 134074 - protein, 25 aa, Mycobacterium avium
YGQDRPADRPLWLGSIKSNIGHTSA

SEQ ID NO: 134075 - protein, 30 aa, Mycobacterium avium
YGQGGGIAHRLGMRPSWVLDLNNGGCAAFV

SEQ ID NO: 134076 - protein, 17 aa, Mycobacterium avium
YGQLAWSLRSDARVVVV

SEQ ID NO: 134077 - protein, 21 aa, Mycobacterium avium
YGQRLVAFVVLADGSSATPDA

SEQ ID NO: 134078 - protein, 23 aa, Mycobacterium avium
YGRLDILFNNVGIPTPRLGMIFE

SEQ ID NO: 134079 - protein, 30 aa, Mycobacterium avium
YGSNLLKAILPNRKFPYPKSLYAVEDTLRF

SEQ ID NO: 134080 - protein, 29 aa, Mycobacterium avium
YGVLNVTKAFLPHLLKRPTAHITIVSSMA

SEQ ID NO: 134081 - protein, 23 aa, Mycobacterium avium
YHGRHQLNRWPDGLEKCIGCELC

SEQ ID NO: 134082 - protein, 21 aa, Mycobacterium avium
YHKGIRIASICSGAFTVAAAG

SEQ ID NO: 134083 - protein, 17 aa, Mycobacterium avium
YHMAARYLGLAPPQIMM

SEQ ID NO: 134084 - protein, 20 aa, Mycobacterium avium
YHRQWEPKIPLGRMGRPDEL

SEQ ID NO: 134085 - protein, 19 aa, Mycobacterium avium
YHRYWLAEHHFVAVASSAP

SEQ ID NO: 134086 - protein, 27 aa, Mycobacterium avium
YIDEWCAVAPERYIPLAILPTWDIDAC

SEQ ID NO: 134087 - protein, 24 aa, Mycobacterium avium
YISTALYGVPLPELGYPTYSLKDD

SEQ ID NO: 134088 - protein, 19 aa, Mycobacterium avium
YKFRSDLMNGRIVLGRAGG

SEQ ID NO: 134089 - protein, 24 aa, Mycobacterium avium
YKVPKFIWVTAKQELPFTASGKVK

SEQ ID NO: 134090 - protein, 19 aa, Mycobacterium avium
YLAIFDKGKALALYHTKRL

SEQ ID NO: 134091 - protein, 20 aa, Mycobacterium avium
YLAIFDKGKALALYHTKRLA

SEQ ID NO: 134092 - protein, 20 aa, Mycobacterium avium
YLAMPLFHSNGVAAGWAVAV

SEQ ID NO: 134093 - protein, 17 aa, Mycobacterium avium
YLDDVQSTYPLSYGPQS

SEQ ID NO: 134094 - protein, 28 aa, Mycobacterium avium
YLEMVELKTSWYSFITPLQAGAVAAGST

SEQ ID NO: 134095 - protein, 25 aa, Mycobacterium avium
YLEMVELKTSWYSFITPLQAGTVAA

SEQ ID NO: 134096 - protein, 17 aa, Mycobacterium avium
YLGITGGGGLLLYLQMH

SEQ ID NO: 134097 - protein, 18 aa, Mycobacterium avium
YLHAKSREQVPETLWPVL

SEQ ID NO: 134098 - protein, 19 aa, Mycobacterium avium
YLIDQPLMRNVLADLAVEA

SEQ ID NO: 134099 - protein, 18 aa, Mycobacterium avium
YLIFPALSLRRWRRTLTA

SEQ ID NO: 134100 - protein, 25 aa, Mycobacterium avium
YLNRELSWLDFNARVLALADDNSLP

SEQ ID NO: 134101 - protein, 19 aa, Mycobacterium avium
YLPDERVWPLPDHAFTHDG

SEQ ID NO: 134102 - protein, 17 aa, Mycobacterium avium
YLPGYLDGSEWWGQGFS

SEQ ID NO: 134103 - protein, 24 aa, Mycobacterium avium
YLRAPMSAGYRYLGGAPPLPSTED

SEQ ID NO: 134104 - protein, 18 aa, Mycobacterium avium
YLRELAFRDFYADVLHHR

SEQ ID NO: 134105 - protein, 29 aa, Mycobacterium avium
YLRKGIPGPRWMPRPVWKIVSAPLNAYAR

SEQ ID NO: 134106 - protein, 18 aa, Mycobacterium avium
YLRLCGRRHDMVVRGGEN

SEQ ID NO: 134107 - protein, 19 aa, Mycobacterium avium
YLTCNELVTMPGDARLRIK

SEQ ID NO: 134108 - protein, 19 aa, Mycobacterium avium
YLTDAMAIDRIAPELRKKA

SEQ ID NO: 134109 - protein, 20 aa, Mycobacterium avium
YLTDAMAIDRIAPELRKKAL

SEQ ID NO: 134110 - protein, 20 aa, Mycobacterium avium
YLTEAMAIDRIAPELRKKAL

SEQ ID NO: 134111 - protein, 18 aa, Mycobacterium avium
YLTKAALPHLRAGSSIIG

SEQ ID NO: 134112 - protein, 18 aa, Mycobacterium avium
YMLFVHDVAEHWRSRIPA

SEQ ID NO: 134113 - protein, 17 aa, Mycobacterium avium
YMVPTAVMVLDALPLTG

SEQ ID NO: 134114 - protein, 22 aa, Mycobacterium avium
YNDIVGWKWTEVPNALGVTEHL

SEQ ID NO: 134115 - protein, 19 aa, Mycobacterium avium
YNDLHLTLKHIHWNVVGPN

SEQ ID NO: 134116 - protein, 22 aa, Mycobacterium avium
YNGFFYKVMPPFCIGSSASGVG

SEQ ID NO: 134117 - protein, 21 aa, Mycobacterium avium
YNGFFYKVMPPFCIGTSASGV

SEQ ID NO: 134118 - protein, 22 aa, Mycobacterium avium
YNGFFYKVMPPFCIGTSASGVG

SEQ ID NO: 134119 - protein, 18 aa, Mycobacterium avium
YNIGFVTALLTEAIESGS

SEQ ID NO: 134120 - protein, 20 aa, Mycobacterium avium
YNLPLLQPDPTKPGQRQILG

SEQ ID NO: 134121 - protein, 33 aa, Mycobacterium avium
YNPGAGWTPSPPPLPVQFWPDWVRPEGTPDPPA

SEQ ID NO: 134122 - protein, 17 aa, Mycobacterium avium
YNTGSPWGYSPKGATGV

SEQ ID NO: 134123 - protein, 18 aa, Mycobacterium avium
YNTGSPWGYSPKGATGVP

SEQ ID NO: 134124 - protein, 17 aa, Mycobacterium avium
YPCHPLLQAHRVAAAAN

SEQ ID NO: 134125 - protein, 23 aa, Mycobacterium avium
YPDPPPESLPIKGFLSFDDTRVE

SEQ ID NO: 134126 - protein, 23 aa, Mycobacterium avium
YPDPPPESLPIKGFLSFDETRVE

SEQ ID NO: 134127 - protein, 24 aa, Mycobacterium avium
YPDPPPESLPIKGFLSFDETRVEL

SEQ ID NO: 134128 - protein, 26 aa, Mycobacterium avium
YPEAWIEQMKRIGIFGLAVPEEYGGS

SEQ ID NO: 134129 - protein, 21 aa, Mycobacterium avium
YPETQWRFEYSPESYTGTELE

SEQ ID NO: 134130 - protein, 21 aa, Mycobacterium avium
YPGTIASVAAVALYIGEVLGA

SEQ ID NO: 134131 - protein, 30 aa, Mycobacterium avium
YPHHDPAAVGDWMLLAAIQALIDGHEYLAH

SEQ ID NO: 134132 - protein, 20 aa, Mycobacterium avium
YPSTLGYKGYPKSCCTSLNE

SEQ ID NO: 134133 - protein, 26 aa, Mycobacterium avium
YPTSPWPIDPAFRRQVFELVDIAFGQ

SEQ ID NO: 134134 - protein, 23 aa, Mycobacterium avium
YPVQAGELLFRAQGRSLALTDCL

SEQ ID NO: 134135 - protein, 18 aa, Mycobacterium avium
YPVWHRLREKGPVLPGVL

SEQ ID NO: 134136 - protein, 17 aa, Mycobacterium avium
YQKLIEIAPAQGLSEEL

SEQ ID NO: 134137 - protein, 17 aa, Mycobacterium avium
YQLLVQYPNVNPALLLK

SEQ ID NO: 134138 - protein, 24 aa, Mycobacterium avium
YQTVRPKIISPQYSDYQVLQGGQG

SEQ ID NO: 134139 - protein, 37 aa, Mycobacterium avium
YRARLRPAGRRALLELPGPPAVWRLAAGDAGTLEDLA

SEQ ID NO: 134140 - protein, 20 aa, Mycobacterium avium
YRAVGLPVLADPGAVPPPSL

SEQ ID NO: 134141 - protein, 19 aa, Mycobacterium avium
YRCLVLEFPGFGASDDFGG

SEQ ID NO: 134142 - protein, 25 aa, Mycobacterium avium
YRDRRKLLEMLASGGALTVPELLPG

SEQ ID NO: 134143 - protein, 18 aa, Mycobacterium avium
YREAERIWRNLRLAPIGD

SEQ ID NO: 134144 - protein, 19 aa, Mycobacterium avium
YREATRRLDRHFTISVIDC

SEQ ID NO: 134145 - protein, 17 aa, Mycobacterium avium
YRELYSRGAYLPPSYRD

SEQ ID NO: 134146 - protein, 23 aa, Mycobacterium avium
YRERLGFEVLPLSGGERPPFEVL

SEQ ID NO: 134147 - protein, 27 aa, Mycobacterium avium
YRESPAWGFCMWAITPDQMYSVDIVTA

SEQ ID NO: 134148 - protein, 26 aa, Mycobacterium avium
YRGCMRGRTMWVVPFCMGPLGVEDPK

SEQ ID NO: 134149 - protein, 20 aa, Mycobacterium avium
YRGITLREHLGLAPAPGNAP

SEQ ID NO: 134150 - protein, 28 aa, Mycobacterium avium
YRGPGAIIPPTFLTSAARWAPPGVRVSV

SEQ ID NO: 134151 - protein, 19 aa, Mycobacterium avium
YRHFATKNDLVLAVLQRRE

SEQ ID NO: 134152 - protein, 20 aa, Mycobacterium avium
YRHRDLPPAPPPLSDAQVAA

SEQ ID NO: 134153 - protein, 19 aa, Mycobacterium avium
YRLRHGVGLAGLRGPGSDR

SEQ ID NO: 134154 - protein, 17 aa, Mycobacterium avium
YRLSASVGLVRAPVFDT

SEQ ID NO: 134155 - protein, 17 aa, Mycobacterium avium
YRMKAEFFKTLGHPARI

SEQ ID NO: 134156 - protein, 25 aa, Mycobacterium avium
YRPLDGFVYAITPFNFTSIAGNLPT

SEQ ID NO: 134157 - protein, 24 aa, Mycobacterium avium
YRRAAPHEFIPFSAGLHRCVGAAM

SEQ ID NO: 134158 - protein, 25 aa, Mycobacterium avium
YRRGRRVVVALPFGVGQPVDRPALR

SEQ ID NO: 134159 - protein, 24 aa, Mycobacterium avium
YRRIDDAFLDPLQFRADSVLGVAG

SEQ ID NO: 134160 - protein, 20 aa, Mycobacterium avium
YRSIVPIETELQFDAGVDRV

SEQ ID NO: 134161 - protein, 20 aa, Mycobacterium avium
YRSRYSGEIVFWATGSAATP

SEQ ID NO: 134162 - protein, 23 aa, Mycobacterium avium
YRTGDLVCWGPDGQLRYLGRADE

SEQ ID NO: 134163 - protein, 17 aa, Mycobacterium avium
YRTGDMGCYWRDGTLQF

SEQ ID NO: 134164 - protein, 18 aa, Mycobacterium avium
YRVAVTWGAQPGTLSAVF

SEQ ID NO: 134165 - protein, 22 aa, Mycobacterium avium
YRYDSTFLLRGLTELHIEFTQA

SEQ ID NO: 134166 - protein, 22 aa, Mycobacterium avium
YRYESTFLLRGLTELHIEFTRA

SEQ ID NO: 134167 - protein, 28 aa, Mycobacterium avium
YSAAPMTAAILRRALAVLPDAGFLNLYG

SEQ ID NO: 134168 - protein, 18 aa, Mycobacterium avium
YSERNLQWLTEELQRRAD

SEQ ID NO: 134169 - protein, 18 aa, Mycobacterium avium
YSERNMEWLTEELQRRAD

SEQ ID NO: 134170 - protein, 20 aa, Mycobacterium avium
YSFFTEVPDLTHAGFPLAEV

SEQ ID NO: 134171 - protein, 19 aa, Mycobacterium avium
YSGPTAALTDVWRALRASM

SEQ ID NO: 134172 - protein, 30 aa, Mycobacterium avium
YSGQGYDQGYRPPGGYPPPGGQPAGGPQGY

SEQ ID NO: 134173 - protein, 19 aa, Mycobacterium avium
YSHIPPLRISARYAAEMRR

SEQ ID NO: 134174 - protein, 24 aa, Mycobacterium avium
YSNRAYLIQIRRAGAGTVLIDPVS

SEQ ID NO: 134175 - protein, 28 aa, Mycobacterium avium
YSPAFAALEVERMWPRVWQLACMVDHVA

SEQ ID NO: 134176 - protein, 26 aa, Mycobacterium avium
YSTEYDVERYFRDAPLMIVGEGTNEI

SEQ ID NO: 134177 - protein, 18 aa, Mycobacterium avium
YSVTLDVALLLGDEAYRY

SEQ ID NO: 134178 - protein, 17 aa, Mycobacterium avium
YSWRHQIDVLANAGYHV

SEQ ID NO: 134179 - protein, 20 aa, Mycobacterium avium
YTDTPIYLRSSALRSRREGA

SEQ ID NO: 134180 - protein, 20 aa, Mycobacterium avium
YTELPIARHLQGMWVSWLHE

SEQ ID NO: 134181 - protein, 20 aa, Mycobacterium avium
YTGPQRYWWSPGVTQVVPNW

SEQ ID NO: 134182 - protein, 21 aa, Mycobacterium avium
YTGPQRYWWSPGVTQVVPNWN

SEQ ID NO: 134183 - protein, 31 aa, Mycobacterium avium
YTGQRLPAPAPYRRFVTWLAERDLDAARAAW

SEQ ID NO: 134184 - protein, 26 aa, Mycobacterium avium
YTINRQPWIPGLDPPYIVAMVELADE

SEQ ID NO: 134185 - protein, 26 aa, Mycobacterium avium
YTKGFKFSTYATWWIRQAITRGMADQ

SEQ ID NO: 134186 - protein, 39 aa, Mycobacterium avium
YTLAQPWGVIGAIITWNGPLISLAMKVPAALAAGNTVVI

SEQ ID NO: 134187 - protein, 18 aa, Mycobacterium avium
YTLLKRAFKQRTVDKRYH

SEQ ID NO: 134188 - protein, 23 aa, Mycobacterium avium
YTPAWGAVAVNLLPAPVTLNVSA

SEQ ID NO: 134189 - protein, 18 aa, Mycobacterium avium
YTPVTPREPIREDIDVAV

SEQ ID NO: 134190 - protein, 23 aa, Mycobacterium avium
YTQQLFGYLQAWRQYLEQMAGAS

SEQ ID NO: 134191 - protein, 23 aa, Mycobacterium avium
YTVQKALPLLNDGASIILTGSTT

SEQ ID NO: 134192 - protein, 17 aa, Mycobacterium avium
YTVRYDWPVRTGIMIGR

SEQ ID NO: 134193 - protein, 19 aa, Mycobacterium avium
YTWIHETRPLIDDEPLSAF

SEQ ID NO: 134194 - protein, 20 aa, Mycobacterium avium
YTWIHETRPLIDDEPLSAFT

SEQ ID NO: 134195 - protein, 26 aa, Mycobacterium avium
YVAAHMPYLAWLQLAGALSAEAAAQH

SEQ ID NO: 134196 - protein, 25 aa, Mycobacterium avium
YVAVGALEPAFFAELLRLLEIDPDT

SEQ ID NO: 134197 - protein, 24 aa, Mycobacterium avium
YVDATYWRDMGTPEDFVRGSADLV

SEQ ID NO: 134198 - protein, 17 aa, Mycobacterium avium
YVDVLRLPVDIVAADRF

SEQ ID NO: 134199 - protein, 17 aa, Mycobacterium avium
YVGAASGLLFSSGYAAN

SEQ ID NO: 134200 - protein, 17 aa, Mycobacterium avium
YVGLLLDRSAEAVVAIL

SEQ ID NO: 134201 - protein, 27 aa, Mycobacterium avium
YVGQRPWTPLIGLLSQAADLGLRVIVT

SEQ ID NO: 134202 - protein, 27 aa, Mycobacterium avium
YVGTGGVLLPLLLFSSARANTAFTPLN

SEQ ID NO: 134203 - protein, 23 aa, Mycobacterium avium
YVHADAPPFFVLHGQKDELVPSG

SEQ ID NO: 134204 - protein, 17 aa, Mycobacterium avium
YVILNKPAREFTGNMLL

SEQ ID NO: 134205 - protein, 22 aa, Mycobacterium avium
YVINGRKWWTSGAADPRCKILI

SEQ ID NO: 134206 - protein, 19 aa, Mycobacterium avium
YVKEDVAIRRLLSTGLERA

SEQ ID NO: 134207 - protein, 20 aa, Mycobacterium avium
YVKEDVAIRRLLSTGLERAG

SEQ ID NO: 134208 - protein, 27 aa, Mycobacterium avium
YVNNIRPLYEPGQKQALWLTERRSQVK

SEQ ID NO: 134209 - protein, 18 aa, Mycobacterium avium
YVPHADVEAFRRAVAADG

SEQ ID NO: 134210 - protein, 19 aa, Mycobacterium avium
YVPTFPFTQNFIDRAVRGD

SEQ ID NO: 134211 - protein, 18 aa, Mycobacterium avium
YVRSFYFQDPDGITLEFA

SEQ ID NO: 134212 - protein, 24 aa, Mycobacterium avium
YVSMPLFHSNAVLVGWAVAAACQG

SEQ ID NO: 134213 - protein, 24 aa, Mycobacterium avium
YVTTPGSALLFPSLCVPTGEPARP

SEQ ID NO: 134214 - protein, 17 aa, Mycobacterium avium
YVYPDNLPRVNAHGGPG

SEQ ID NO: 134215 - protein, 36 aa, Mycobacterium avium
YWARQAEWHQALYREGFFGLSWPREYGGQELAPVYD

SEQ ID NO: 134216 - protein, 25 aa, Mycobacterium avium
YWPEFCRLMGLHDLAEDPRFTTLDA

SEQ ID NO: 134217 - protein, 17 aa, Mycobacterium avium
YWQEALAGLPERLALPT

SEQ ID NO: 134218 - protein, 18 aa, Mycobacterium avium
YWVPRPLGGTAPTPAEAA

SEQ ID NO: 134219 - protein, 31 aa, Mycobacterium avium
YYDIVHSHYWLSGQVGWLARDRWAVPLVHTA

SEQ ID NO: 134220 - protein, 26 aa, Mycobacterium avium
YYENYRRYRWDLTLRRDYQRAAFEAG

SEQ ID NO: 134221 - protein, 18 aa, Mycobacterium avium
YYFEPTVLDLPSNANPAA

SEQ ID NO: 134222 - protein, 21 aa, Mycobacterium avium
YYKAELIYGPARSRPWKTVED

SEQ ID NO: 134223 - protein, 18 aa, Mycobacterium avium
HVVWAIDLTSPPAALLIA

SEQ ID NO: 134224 - protein, 18 aa, Mycobacterium avium
EVLPLLYLHGLSTSDFGP

SEQ ID NO: 134225 - protein, 29 aa, Mycobacterium avium
GLMVFCAVLAYSRWRFVRFAADEKASTTL

SEQ ID NO: 134226 - protein, 26 aa, Mycobacterium avium
ITPFNFPAMIPLWKAGPALACGNAFV

SEQ ID NO: 134227 - protein, 24 aa, Mycobacterium avium
SRPVDPVYPILYIDAIRLKIRDGG

SEQ ID NO: 134228 - protein, 17 aa, Mycobacterium avium
SWAEFVPFLAFPVEIRK

SEQ ID NO: 134229 - protein, 22 aa, Mycobacterium avium
AADRPWRLWLPGRPEVSAYRRS

SEQ ID NO: 134230 - protein, 24 aa, Mycobacterium avium
AADWAEMLMRMYIRWAEQHKYPVE

SEQ ID NO: 134231 - protein, 23 aa, Mycobacterium avium
AAEHPWLLGAYLTHTFGVDEVQD

SEQ ID NO: 134232 - protein, 21 aa, Mycobacterium avium
AAFLEYLDMFYNLGIAGRAMR

SEQ ID NO: 134233 - protein, 25 aa, Mycobacterium avium
AAGLRPLRPWRPALVAALTNAGSPA

SEQ ID NO: 134234 - protein, 24 aa, Mycobacterium avium
AAHHRLFSHVPWLASQLLGAVEAY

SEQ ID NO: 134235 - protein, 18 aa, Mycobacterium avium
AAMQGLVALPLLAGYDID

SEQ ID NO: 134236 - protein, 24 aa, Mycobacterium avium
AANSWLDAFTRWRRARGLKATAIA

SEQ ID NO: 134237 - protein, 24 aa, Mycobacterium avium
AAPMPLPLLHRALSTWPGTKFVQV

SEQ ID NO: 134238 - protein, 19 aa, Mycobacterium avium
AAPPPWIDVFIARNFHYLT

SEQ ID NO: 134239 - protein, 17 aa, Mycobacterium avium
AAVLHRTAERRAATFSS

SEQ ID NO: 134240 - protein, 17 aa, Mycobacterium avium
AAYLPLLRVLDTLAGED

SEQ ID NO: 134241 - protein, 22 aa, Mycobacterium avium
AAYNLLHAWLQTPLTFAKWDAK

SEQ ID NO: 134242 - protein, 19 aa, Mycobacterium avium
ADECRVFLSMLGIGPAKLD

SEQ ID NO: 134243 - protein, 19 aa, Mycobacterium avium
ADRLAYVVRLILTGTTQAS

SEQ ID NO: 134244 - protein, 27 aa, Mycobacterium avium
ADSWIQIEQFRLLVLRTAWLIDKHHDY

SEQ ID NO: 134245 - protein, 23 aa, Mycobacterium avium
AEFKAMFQMKFYAVALLRSRGVP

SEQ ID NO: 134246 - protein, 24 aa, Mycobacterium avium
AEGIAWVPYFPLGSAFPGLPKVTD

SEQ ID NO: 134247 - protein, 22 aa, Mycobacterium avium
AEGWQPIFYLPEKARDVWGESL

SEQ ID NO: 134248 - protein, 19 aa, Mycobacterium avium
AELFLPAPLRWLVGATRFA

SEQ ID NO: 134249 - protein, 20 aa, Mycobacterium avium
AEQWRLVLDVNLIGAWNTCA

SEQ ID NO: 134250 - protein, 25 aa, Mycobacterium avium
AESGFPLMPMMVPPPTTSAGTGWRK

SEQ ID NO: 134251 - protein, 18 aa, Mycobacterium avium
AFVLLALQAPVAGDLRAI

SEQ ID NO: 134252 - protein, 23 aa, Mycobacterium avium
AGEHGFRFFPAYYLHIWDLFQRI

SEQ ID NO: 134253 - protein, 20 aa, Mycobacterium avium
AGHQGLCYFAYLAGYREVHE

SEQ ID NO: 134254 - protein, 22 aa, Mycobacterium avium
AGIDWVLAFWGTVLAGGVAVAV

SEQ ID NO: 134255 - protein, 30 aa, Mycobacterium avium
AGMTEPLYLMPWSTMFPLGISAATIGIAEG

SEQ ID NO: 134256 - protein, 18 aa, Mycobacterium avium
AGPDALVVVLLPDGGRGY

SEQ ID NO: 134257 - protein, 25 aa, Mycobacterium avium
AGTLAFFPLWGYATPPAIELAERLA

SEQ ID NO: 134258 - protein, 17 aa, Mycobacterium avium
AHLYLKRLLGYSAFLGG

SEQ ID NO: 134259 - protein, 32 aa, Mycobacterium avium
AHMWFGDLVTMAWWDDLWLNESFATFASVLCQ

SEQ ID NO: 134260 - protein, 19 aa, Mycobacterium avium
AHTPWFHWGTTAVVARLVK

SEQ ID NO: 134261 - protein, 20 aa, Mycobacterium avium
AHVYLRRALTSTELWPVALK

SEQ ID NO: 134262 - protein, 20 aa, Mycobacterium avium
AHWPAFRRVDFLRALRDYSQ

SEQ ID NO: 134263 - protein, 24 aa, Mycobacterium avium
AITPWNFPHQINLAKLGPALAAGN

SEQ ID NO: 134264 - protein, 21 aa, Mycobacterium avium
AKPWLPHFYLGHGIGVNAAEM

SEQ ID NO: 134265 - protein, 23 aa, Mycobacterium avium
AKRPEDFRFLIRLARQQGTRLGR

SEQ ID NO: 134266 - protein, 23 aa, Mycobacterium avium
AKRTSDLIPLCHQLALTGVDVDF

SEQ ID NO: 134267 - protein, 23 aa, Mycobacterium avium
ALAYGDMGLALPLLAPGGVASAL

SEQ ID NO: 134268 - protein, 21 aa, Mycobacterium avium
ALDIDLYLRIAPELFLKRCVV

SEQ ID NO: 134269 - protein, 28 aa, Mycobacterium avium
ALMDTHPFGWLPLLSRVLASAQLLPDAV

SEQ ID NO: 134270 - protein, 21 aa, Mycobacterium avium
ALTAKLRAYWARRLPATIVGR

SEQ ID NO: 134271 - protein, 24 aa, Mycobacterium avium
AMDRLGLLALLTRALERAGTDIVW

SEQ ID NO: 134272 - protein, 23 aa, Mycobacterium avium
ANELLLYEALGLCGPGEAPKLID

SEQ ID NO: 134273 - protein, 24 aa, Mycobacterium avium
ANRARLAMLLATNFFGINYPAIAE

SEQ ID NO: 134274 - protein, 23 aa, Mycobacterium avium
APLDLFLRIIVELFRRHWSSTGQ

SEQ ID NO: 134275 - protein, 19 aa, Mycobacterium avium
APPRFDPAIWPVTAHPDEE

SEQ ID NO: 134276 - protein, 25 aa, Mycobacterium avium
APSDLTIVSWLPFYHDMGLVLGVCA

SEQ ID NO: 134277 - protein, 25 aa, Mycobacterium avium
AQISKPMLYLYYGSKEDLFGACLNR

SEQ ID NO: 134278 - protein, 19 aa, Mycobacterium avium
AQLVGWLEGLFHGIQTALF

SEQ ID NO: 134279 - protein, 19 aa, Mycobacterium avium
AQPWSLRYPLVDGQGNFGS

SEQ ID NO: 134280 - protein, 18 aa, Mycobacterium avium
ARAGLLCLPTLSTHGYEV

SEQ ID NO: 134281 - protein, 19 aa, Mycobacterium avium
ARAWWLLRAAGLDNVRILD

SEQ ID NO: 134282 - protein, 24 aa, Mycobacterium avium
ARDFQRFLIGKLRDIRAVVLNASL

SEQ ID NO: 134283 - protein, 19 aa, Mycobacterium avium
AREKLLAEVLRAASRDGLV

SEQ ID NO: 134284 - protein, 23 aa, Mycobacterium avium
ARKGFFRVPLIRGTITHPVQGEA

SEQ ID NO: 134285 - protein, 18 aa, Mycobacterium avium
ARLDLASVFLYAGSILPG

SEQ ID NO: 134286 - protein, 18 aa, Mycobacterium avium
ARLHTPLPLLAFTAWPEV

SEQ ID NO: 134287 - protein, 17 aa, Mycobacterium avium
ARYPFLVKGYIGPKALK

SEQ ID NO: 134288 - protein, 23 aa, Mycobacterium avium
ASCRYMKMITPAALLRCLVEGAD

SEQ ID NO: 134289 - protein, 18 aa, Mycobacterium avium
ASHHLRWLASANGLLDIP

SEQ ID NO: 134290 - protein, 24 aa, Mycobacterium avium
ASPPVKWPCFYGIDFPSPAELIAN

SEQ ID NO: 134291 - protein, 22 aa, Mycobacterium avium
ASSPLSVPFWEGCRSRQLRYQR

SEQ ID NO: 134292 - protein, 26 aa, Mycobacterium avium
ASTPFDAFIRLISPTRLFTTSFKDIQ

SEQ ID NO: 134293 - protein, 27 aa, Mycobacterium avium
ATHNEPMIPIYIFYSMFGFQRTGDGLW

SEQ ID NO: 134294 - protein, 18 aa, Mycobacterium avium
ATLGFAVLPLLELASEEQ

SEQ ID NO: 134295 - protein, 17 aa, Mycobacterium avium
ATLLDYFPEDFLLVIDE

SEQ ID NO: 134296 - protein, 23 aa, Mycobacterium avium
ATPQRVGWFRFYFEGERWVWSDQ

SEQ ID NO: 134297 - protein, 17 aa, Mycobacterium avium
ATPYLIQPFAHGADIVV

SEQ ID NO: 134298 - protein, 27 aa, Mycobacterium avium
ATRQGIAFIPWFPLAAGPLAAPDGPLQ

SEQ ID NO: 134299 - protein, 23 aa, Mycobacterium avium
ATRRSIFIPILRVAAIDPNAVTL

SEQ ID NO: 134300 - protein, 22 aa, Mycobacterium avium
ATTDLFLERLGLTSLADLPDIA

SEQ ID NO: 134301 - protein, 18 aa, Mycobacterium avium
AVATWLRTMFAIVPLAVG

SEQ ID NO: 134302 - protein, 24 aa, Mycobacterium avium
AVEVALFRLLESWGVRPDFVMGHS

SEQ ID NO: 134303 - protein, 17 aa, Mycobacterium avium
AVIKYPWRRGEGPGTSK

SEQ ID NO: 134304 - protein, 20 aa, Mycobacterium avium
AVKEPWFRDAYRRAWDWADS

SEQ ID NO: 134305 - protein, 25 aa, Mycobacterium avium
AVPHPKWWFDLLTTEPLAFASLDRW

SEQ ID NO: 134306 - protein, 20 aa, Mycobacterium avium
AVVMTYWNPVLRYGVDAFAR

SEQ ID NO: 134307 - protein, 26 aa, Mycobacterium avium
AWHALCWGIIIPAGWWRSGDTALYRY

SEQ ID NO: 134308 - protein, 17 aa, Mycobacterium avium
AWPKLKQHYGERLEQMY

SEQ ID NO: 134309 - protein, 26 aa, Mycobacterium avium
AYAKKFRFPTFLGAFKYYTSYTLKTF

SEQ ID NO: 134310 - protein, 18 aa, Mycobacterium avium
AYLGVRVNAIAPGLIRSA

SEQ ID NO: 134311 - protein, 17 aa, Mycobacterium avium
CRDPARLAGWWAEQFGG

SEQ ID NO: 134312 - protein, 17 aa, Mycobacterium avium
CTLPPPMRLLLDGEVPG

SEQ ID NO: 134313 - protein, 19 aa, Mycobacterium avium
CYDELFIGGQWRKPANPQQ

SEQ ID NO: 134314 - protein, 20 aa, Mycobacterium avium
DAALGLLRRNKIEKLPIVDG

SEQ ID NO: 134315 - protein, 20 aa, Mycobacterium avium
DAALTVRLLLAPEIDVRFGL

SEQ ID NO: 134316 - protein, 21 aa, Mycobacterium avium
DALFFGHGLNIHFGLIKPPAE

SEQ ID NO: 134317 - protein, 23 aa, Mycobacterium avium
DDALNLPWLAMGATGFISVISHV

SEQ ID NO: 134318 - protein, 24 aa, Mycobacterium avium
DDARWDAVLAVNLLAPLRLTEGLV

SEQ ID NO: 134319 - protein, 23 aa, Mycobacterium avium
DDERAMLPTLPLPRARTLANYLA

SEQ ID NO: 134320 - protein, 21 aa, Mycobacterium avium
DDVAALLRWLGNGNFLLLGYQ

SEQ ID NO: 134321 - protein, 25 aa, Mycobacterium avium
DEAAALMIDLFWYGLKGSPEEREAA

SEQ ID NO: 134322 - protein, 17 aa, Mycobacterium avium
DEFGFFVILLAVAGNET

SEQ ID NO: 134323 - protein, 23 aa, Mycobacterium avium
DEFRIQLAWMRLSPPTANPGWSY

SEQ ID NO: 134324 - protein, 20 aa, Mycobacterium avium
DFIEWSISFSQKPFPPPCDI

SEQ ID NO: 134325 - protein, 23 aa, Mycobacterium avium
DFTNIYFYTVLYHALRASNRIAI

SEQ ID NO: 134326 - protein, 26 aa, Mycobacterium avium
DFWFDPLCPWAWITSRWILEVEKVRD

SEQ ID NO: 134327 - protein, 23 aa, Mycobacterium avium
DGSDAMRWFLMASPILRGGNLIV

SEQ ID NO: 134328 - protein, 18 aa, Mycobacterium avium
DGTWKIALRRCTVEWTLQ

SEQ ID NO: 134329 - protein, 25 aa, Mycobacterium avium
DHAGKWRVVFFWPKDFTFVCPTEIA

SEQ ID NO: 134330 - protein, 22 aa, Mycobacterium avium
DHFTPFTLIQLEELGFCGKGEA

SEQ ID NO: 134331 - protein, 20 aa, Mycobacterium avium
DIHFRIEDDLYYPALKEASK

SEQ ID NO: 134332 - protein, 22 aa, Mycobacterium avium
DKFPRAILPRSFDYGFATGLMV

SEQ ID NO: 134333 - protein, 17 aa, Mycobacterium avium
DKRSLVFPVKRLADLGF

SEQ ID NO: 134334 - protein, 23 aa, Mycobacterium avium
DLAAARWWRKPLVRRWYGFLAMQ

SEQ ID NO: 134335 - protein, 22 aa, Mycobacterium avium
DLDWTILGPGRLTLDPPTGRIA

SEQ ID NO: 134336 - protein, 19 aa, Mycobacterium avium
DLKFTLVEPLRLLFKDEVR

SEQ ID NO: 134337 - protein, 20 aa, Mycobacterium avium
DLRFMRFIGQEIFPGGQLPA

SEQ ID NO: 134338 - protein, 22 aa, Mycobacterium avium
DLRINWVWNPPWGPDKITDEGR

SEQ ID NO: 134339 - protein, 22 aa, Mycobacterium avium
DLVSMFAPITRWAAGIPTARAI

SEQ ID NO: 134340 - protein, 19 aa, Mycobacterium avium
DNEAKWFWFEGNFGAYEEN

SEQ ID NO: 134341 - protein, 27 aa, Mycobacterium avium
DNSTLAHLLKFDSILGRLPYDVSLEGE

SEQ ID NO: 134342 - protein, 23 aa, Mycobacterium avium
DPLLDLGWLLATWRQPDGSAVFS

SEQ ID NO: 134343 - protein, 23 aa, Mycobacterium avium
DPRLKRPIPFLPNMIGLITGRAS

SEQ ID NO: 134344 - protein, 24 aa, Mycobacterium avium
DPTAELILIYLIQNLPDLTVDAAT

SEQ ID NO: 134345 - protein, 17 aa, Mycobacterium avium
DPVAVTSLFPLSAAARR

SEQ ID NO: 134346 - protein, 24 aa, Mycobacterium avium
DPVNQVEFFFLRPKDIAIYVGSGE

SEQ ID NO: 134347 - protein, 25 aa, Mycobacterium avium
DQLRGYLRRWLAPAIRQWVQQAAAG

SEQ ID NO: 134348 - protein, 17 aa, Mycobacterium avium
DQWTLLARARALDSMSY

SEQ ID NO: 134349 - protein, 20 aa, Mycobacterium avium
DRAMIAACPLTFPWNVLGWP

SEQ ID NO: 134350 - protein, 19 aa, Mycobacterium avium
DRPNLFIKIPATQAGLPAI

SEQ ID NO: 134351 - protein, 26 aa, Mycobacterium avium
DRYSGWMRAPLRWALRASLAVRARLM

SEQ ID NO: 134352 - protein, 24 aa, Mycobacterium avium
DSAELPLFRYLGGPNAHILPVPMM

SEQ ID NO: 134353 - protein, 23 aa, Mycobacterium avium
DSPMMFLPGVIVAMWGGQVRSLA

SEQ ID NO: 134354 - protein, 23 aa, Mycobacterium avium
DVANLAMFLLSDAAGWITGQCIN

SEQ ID NO: 134355 - protein, 18 aa, Mycobacterium avium
DVFPLPRELVGDGTLFLL

SEQ ID NO: 134356 - protein, 19 aa, Mycobacterium avium
DVLDTWFSSALWPFSTLGW

SEQ ID NO: 134357 - protein, 18 aa, Mycobacterium avium
DVLLFIDNIFRFTQAGSE

SEQ ID NO: 134358 - protein, 19 aa, Mycobacterium avium
DVPTFRMLAGLRGRVPLVS

SEQ ID NO: 134359 - protein, 25 aa, Mycobacterium avium
DVQIDSFEWLIGAPRWREAAIARGD

SEQ ID NO: 134360 - protein, 25 aa, Mycobacterium avium
DVTYPLHRYFLWAKHNELTLGPASA

SEQ ID NO: 134361 - protein, 25 aa, Mycobacterium avium
DWVQHVIWWQVYPLGFVGAYPLPQS

SEQ ID NO: 134362 - protein, 20 aa, Mycobacterium avium
EAFAPVPLAWLAETGADAAR

SEQ ID NO: 134363 - protein, 21 aa, Mycobacterium avium
EALGAPLYWIASNAGLDGAVA

SEQ ID NO: 134364 - protein, 17 aa, Mycobacterium avium
EALRWAMMRGEPLVVLA

SEQ ID NO: 134365 - protein, 23 aa, Mycobacterium avium
EEIYSFLRLLLPAGVETTYRALG

SEQ ID NO: 134366 - protein, 22 aa, Mycobacterium avium
EELLDICFLFLIAGLDTVTDSL

SEQ ID NO: 134367 - protein, 23 aa, Mycobacterium avium
EEQRKQWLEPLLAGEIRSAFSMT

SEQ ID NO: 134368 - protein, 17 aa, Mycobacterium avium
EETAFVLLALQAPVAGD

SEQ ID NO: 134369 - protein, 26 aa, Mycobacterium avium
EEVKFGIEPWFRYFQKVAAFPQMTMP

SEQ ID NO: 134370 - protein, 18 aa, Mycobacterium avium
EFLLSRFRDITLLTFERL

SEQ ID NO: 134371 - protein, 22 aa, Mycobacterium avium
EFNLKRMWLSPNGTIRNILGGT

SEQ ID NO: 134372 - protein, 26 aa, Mycobacterium avium
EGDRGLSWLPFFHDMGLITAMLSPVL

SEQ ID NO: 134373 - protein, 24 aa, Mycobacterium avium
EGDVGWIPYFLWRAEHVYNRHSGW

SEQ ID NO: 134374 - protein, 24 aa, Mycobacterium avium
EGPLPQTRFVLRKALAAHLPVILV

SEQ ID NO: 134375 - protein, 23 aa, Mycobacterium avium
EGPRWFEGLLWFSDMLGEAVHTT

SEQ ID NO: 134376 - protein, 23 aa, Mycobacterium avium
EGPVVGIWRRAPLQALARLHMLA

SEQ ID NO: 134377 - protein, 20 aa, Mycobacterium avium
EHALLLALRKDPQVTGLAIA

SEQ ID NO: 134378 - protein, 26 aa, Mycobacterium avium
EHSDFMSYLNLWRYLREQRKELSGNQ

SEQ ID NO: 134379 - protein, 17 aa, Mycobacterium avium
EIAFIHYAPTPAEACYR

SEQ ID NO: 134380 - protein, 28 aa, Mycobacterium avium
ELAAPVTHIWYFKGVPSRLGYLLDLAPK

SEQ ID NO: 134381 - protein, 24 aa, Mycobacterium avium
ELCALSWTVYSLPGAPVLDHHELG

SEQ ID NO: 134382 - protein, 23 aa, Mycobacterium avium
ELGAALYPGPWLSTAVAAPRALI

SEQ ID NO: 134383 - protein, 23 aa, Mycobacterium avium
ELHFLGAVLWRRGIHRVLREFVE

SEQ ID NO: 134384 - protein, 24 aa, Mycobacterium avium
ELLSYVRGVLYFRTGRWPDVLNQF

SEQ ID NO: 134385 - protein, 17 aa, Mycobacterium avium
ELVGWLRDRTDGDALCL

SEQ ID NO: 134386 - protein, 20 aa, Mycobacterium avium
ELVYDGLWYSPLKAALESFV

SEQ ID NO: 134387 - protein, 17 aa, Mycobacterium avium
ENLFFKEKRYDLARVGR

SEQ ID NO: 134388 - protein, 18 aa, Mycobacterium avium
ENVSPLVVWLGSAEARDV

SEQ ID NO: 134389 - protein, 24 aa, Mycobacterium avium
EPRPGFWPNLVELGWLGLHIDEEY

SEQ ID NO: 134390 - protein, 22 aa, Mycobacterium avium
EPSWSYLYRKMIPVLAGAGHRV

SEQ ID NO: 134391 - protein, 28 aa, Mycobacterium avium
EPWVRDYLLLRGLLGTSILWFELDRDGN

SEQ ID NO: 134392 - protein, 25 aa, Mycobacterium avium
ERVGWQWRLVWYKAVAELLTGDYDS

SEQ ID NO: 134393 - protein, 18 aa, Mycobacterium avium
ERYRTGFFAAPAARRMGA

SEQ ID NO: 134394 - protein, 25 aa, Mycobacterium avium
ESPRETWLRLLLLRAGFPRPRTQLP

SEQ ID NO: 134395 - protein, 18 aa, Mycobacterium avium
ETHWWAHRALWHLIFSGA

SEQ ID NO: 134396 - protein, 26 aa, Mycobacterium avium
ETVYKHGWWLPERPLTPIGAQMNIGY

SEQ ID NO: 134397 - protein, 17 aa, Mycobacterium avium
EVALLKILALQFIMSDP

SEQ ID NO: 134398 - protein, 18 aa, Mycobacterium avium
EVGWSMLPVARSVLRRIG

SEQ ID NO: 134399 - protein, 24 aa, Mycobacterium avium
EVMPEDLIKFGLIPEFIGRLPVVA

SEQ ID NO: 134400 - protein, 23 aa, Mycobacterium avium
EVPPVVVVPYFWSDQYDVKIQCL

SEQ ID NO: 134401 - protein, 25 aa, Mycobacterium avium
EYASRGTWIWPPEPSLRLIADTIEF

SEQ ID NO: 134402 - protein, 19 aa, Mycobacterium avium
EYPGDFWQYARNKVIVAAR

SEQ ID NO: 134403 - protein, 18 aa, Mycobacterium avium
FAADLARMYIRYAERHGW

SEQ ID NO: 134404 - protein, 23 aa, Mycobacterium avium
FFDDLVTPFLGLYRDDNLRPDSS

SEQ ID NO: 134405 - protein, 18 aa, Mycobacterium avium
FGELRWAVSGAAPIPKET

SEQ ID NO: 134406 - protein, 23 aa, Mycobacterium avium
FGGDLLFIGCTPIVWAGPIANWV

SEQ ID NO: 134407 - protein, 23 aa, Mycobacterium avium
FGGGSMFLLLGILSALWERQSSG

SEQ ID NO: 134408 - protein, 18 aa, Mycobacterium avium
FHTVYWPAFLMSAGIELP

SEQ ID NO: 134409 - protein, 18 aa, Mycobacterium avium
FIGLINALSAFPKPLICA

SEQ ID NO: 134410 - protein, 18 aa, Mycobacterium avium
FLGPFLLSSLLARTPYTV

SEQ ID NO: 134411 - protein, 17 aa, Mycobacterium avium
FLHIPFPPVELFMQLPW

SEQ ID NO: 134412 - protein, 19 aa, Mycobacterium avium
FLRRFSLLDSLYLIPPPRI

SEQ ID NO: 134413 - protein, 24 aa, Mycobacterium avium
FMAGLWSVWKPAKDAPPLLSCTII

SEQ ID NO: 134414 - protein, 23 aa, Mycobacterium avium
FMVRNTYIYPPKPSMRIISDIFA

SEQ ID NO: 134415 - protein, 19 aa, Mycobacterium avium
FNDLLLPLRYGQVSLREKM

SEQ ID NO: 134416 - protein, 27 aa, Mycobacterium avium
FPGEPWAVPKFYWSVFATRPFEAAVQA

SEQ ID NO: 134417 - protein, 17 aa, Mycobacterium avium
FPYAWPRKPVLADNVVC

SEQ ID NO: 134418 - protein, 17 aa, Mycobacterium avium
FPYYLETYGFHSIHGRA

SEQ ID NO: 134419 - protein, 17 aa, Mycobacterium avium
FQIDLTWRTICNGFTIA

SEQ ID NO: 134420 - protein, 20 aa, Mycobacterium avium
FQTIIDTWLPLSWSLNMVNR

SEQ ID NO: 134421 - protein, 18 aa, Mycobacterium avium
FRDYGYRRLRAKARLKFL

SEQ ID NO: 134422 - protein, 18 aa, Mycobacterium avium
FTFMTPAAFVRRPGRWIR

SEQ ID NO: 134423 - protein, 21 aa, Mycobacterium avium
FTNDPLLQFRNFSYLDTQLIR

SEQ ID NO: 134424 - protein, 19 aa, Mycobacterium avium
FVKFHWKPRLGVHSLIWDE

SEQ ID NO: 134425 - protein, 23 aa, Mycobacterium avium
GAAIGLLDLLLASGGDLVTVLLG

SEQ ID NO: 134426 - protein, 19 aa, Mycobacterium avium
GADPWWDVAIRLLLKYANL

SEQ ID NO: 134427 - protein, 20 aa, Mycobacterium avium
GAFGPPWPGLGAYGVSKAAL

SEQ ID NO: 134428 - protein, 19 aa, Mycobacterium avium
GAFWANDLLWLMDTRYLRE

SEQ ID NO: 134429 - protein, 24 aa, Mycobacterium avium
GAMAYLVKPFTISDLIPAIELAVS

SEQ ID NO: 134430 - protein, 18 aa, Mycobacterium avium
GDCDQLMPEYLRFVKGVV

SEQ ID NO: 134431 - protein, 19 aa, Mycobacterium avium
GDKSNWWAAYALWVFTLFG

SEQ ID NO: 134432 - protein, 23 aa, Mycobacterium avium
GDRHPHFLTALRKPIIAAINGAC

SEQ ID NO: 134433 - protein, 24 aa, Mycobacterium avium
GEGHPILYVAQMWDWIYPLGDNPD

SEQ ID NO: 134434 - protein, 20 aa, Mycobacterium avium
GEGWFINQHIIWRVGDEDVA

SEQ ID NO: 134435 - protein, 18 aa, Mycobacterium avium
GFHTLRLQTFLTAGPKEA

SEQ ID NO: 134436 - protein, 24 aa, Mycobacterium avium
GGADSLLVFPFDVAIDGGFPGTAT

SEQ ID NO: 134437 - protein, 25 aa, Mycobacterium avium
GGDSRPLYYLEMPPSLFAPIVENLA

SEQ ID NO: 134438 - protein, 23 aa, Mycobacterium avium
GGFEAWLLLRSLGTAGLRFERQC

SEQ ID NO: 134439 - protein, 21 aa, Mycobacterium avium
GGIAHRLGMRPSWVLDLNNGG

SEQ ID NO: 134440 - protein, 19 aa, Mycobacterium avium
GGLVILPQDLPITAVQQTV

SEQ ID NO: 134441 - protein, 24 aa, Mycobacterium avium
GGPPVRFQLLWYPSTMWDASLPSF

SEQ ID NO: 134442 - protein, 24 aa, Mycobacterium avium
GGQEILFPALLPRAPYEATNRWTE

SEQ ID NO: 134443 - protein, 23 aa, Mycobacterium avium
GGRFQKLLRIFANPKLPVIGDYY

SEQ ID NO: 134444 - protein, 20 aa, Mycobacterium avium
GHYYFYRLIAPHPDHLRRFN

SEQ ID NO: 134445 - protein, 19 aa, Mycobacterium avium
GIELPRRVFAHGFLLNRGE

SEQ ID NO: 134446 - protein, 23 aa, Mycobacterium avium
GLDARAYRLPWPAGTTVFEIDQP

SEQ ID NO: 134447 - protein, 24 aa, Mycobacterium avium
GLDRRTPFWPYQLNADLVSLADPE

SEQ ID NO: 134448 - protein, 21 aa, Mycobacterium avium
GLIGPFRVRIPLLLSADDGHQ

SEQ ID NO: 134449 - protein, 24 aa, Mycobacterium avium
GLIIPWNGPFFVAMLKVAPALAAG

SEQ ID NO: 134450 - protein, 17 aa, Mycobacterium avium
GLLCLPTLSTHGYEVVA

SEQ ID NO: 134451 - protein, 18 aa, Mycobacterium avium
GLLPTWGLSVRLPQKVGI

SEQ ID NO: 134452 - protein, 27 aa, Mycobacterium avium
GLLVNFPLSQWLKFAPPIGYGALPKDA

SEQ ID NO: 134453 - protein, 28 aa, Mycobacterium avium
GLRAGVPMLILWLWLDQPVWAEAVSALE

SEQ ID NO: 134454 - protein, 21 aa, Mycobacterium avium
GLRALVRLAIYWGQEALAFGM

SEQ ID NO: 134455 - protein, 24 aa, Mycobacterium avium
GLSGGIVWLPNNPLMRAEGVADSH

SEQ ID NO: 134456 - protein, 18 aa, Mycobacterium avium
GLSLFDYWRDGYKTLHGM

SEQ ID NO: 134457 - protein, 21 aa, Mycobacterium avium
GMFGNIIRLLPPLTISDELLA

SEQ ID NO: 134458 - protein, 19 aa, Mycobacterium avium
GMLFSPGYPGFLRGVAASG

SEQ ID NO: 134459 - protein, 17 aa, Mycobacterium avium
GMVFQRPNPFPAMSIRD

SEQ ID NO: 134460 - protein, 21 aa, Mycobacterium avium
GMVQFVPYFLGARTPPYPTAT

SEQ ID NO: 134461 - protein, 24 aa, Mycobacterium avium
GNNNWFAAYAYWYFKLYGHEKVKL

SEQ ID NO: 134462 - protein, 20 aa, Mycobacterium avium
GNRRWFEQWLLTNLDDALSA

SEQ ID NO: 134463 - protein, 19 aa, Mycobacterium avium
GNSLFINVNCWGRLVTGVG

SEQ ID NO: 134464 - protein, 22 aa, Mycobacterium avium
GPDPLGVLYWQVPKGSTLDSTI

SEQ ID NO: 134465 - protein, 20 aa, Mycobacterium avium
GPPPWHLYRFVLRAAVGVAL

SEQ ID NO: 134466 - protein, 28 aa, Mycobacterium avium
GQHISTLLLTLLFRFMRPLIEHGHVFLA

SEQ ID NO: 134467 - protein, 17 aa, Mycobacterium avium
GQMPIHMRLPKLKGFRN

SEQ ID NO: 134468 - protein, 23 aa, Mycobacterium avium
GRENVFFLHVSLVPYLAPSGELK

SEQ ID NO: 134469 - protein, 20 aa, Mycobacterium avium
GRGYVLRRLLRRVIRSARLL

SEQ ID NO: 134470 - protein, 18 aa, Mycobacterium avium
GRIARVLGPRGLMPNPKT

SEQ ID NO: 134471 - protein, 17 aa, Mycobacterium avium
GRLAKPADIGWAAAFLA

SEQ ID NO: 134472 - protein, 22 aa, Mycobacterium avium
GRPLRIVLVAPPYFDVPPDGYG

SEQ ID NO: 134473 - protein, 19 aa, Mycobacterium avium
GRPVLLMHPWPLSGQSWSA

SEQ ID NO: 134474 - protein, 17 aa, Mycobacterium avium
GRSWPLADVRLLAPILA

SEQ ID NO: 134475 - protein, 23 aa, Mycobacterium avium
GRVSWLFVPRLRADGWLRIGGAD

SEQ ID NO: 134476 - protein, 19 aa, Mycobacterium avium
GRWASIIPQTWIHSLRPPA

SEQ ID NO: 134477 - protein, 18 aa, Mycobacterium avium
GRYLGCVPLQRLLREAPA

SEQ ID NO: 134478 - protein, 26 aa, Mycobacterium avium
GSDYVDLFLIHWPLPTLYGGDFVSTW

SEQ ID NO: 134479 - protein, 18 aa, Mycobacterium avium
GSLLLPPWVLTRYGPDGV

SEQ ID NO: 134480 - protein, 26 aa, Mycobacterium avium
GTADLFLWPTLYLWEFPKPTISQIHG

SEQ ID NO: 134481 - protein, 25 aa, Mycobacterium avium
GTGRRLRRAIPKYGFRPVVMPRPPA

SEQ ID NO: 134482 - protein, 18 aa, Mycobacterium avium
GTMGLILRGSDELKKQVL

SEQ ID NO: 134483 - protein, 20 aa, Mycobacterium avium
GVEVTIVEFLPRALPNEDAD

SEQ ID NO: 134484 - protein, 17 aa, Mycobacterium avium
GVPLRKWTMYNEPVHAM

SEQ ID NO: 134485 - protein, 18 aa, Mycobacterium avium
GWLTLNWPKEYGGQDRSP

SEQ ID NO: 134486 - protein, 17 aa, Mycobacterium avium
GWVRMDFIVPSRGLIGF

SEQ ID NO: 134487 - protein, 19 aa, Mycobacterium avium
GYRRLRAKARLKFLVKDWG

SEQ ID NO: 134488 - protein, 19 aa, Mycobacterium avium
GYTLGNSLRRTLLSSIPGA

SEQ ID NO: 134489 - protein, 25 aa, Mycobacterium avium
HADRFTLLRPLLFTIAYEMLGSATE

SEQ ID NO: 134490 - protein, 23 aa, Mycobacterium avium
HAVLHLLYARFWHKVLYDLGHVS

SEQ ID NO: 134491 - protein, 23 aa, Mycobacterium avium
HCALPLHRRFGLAATARASFAVY

SEQ ID NO: 134492 - protein, 22 aa, Mycobacterium avium
HDDWRWVIDIDLWGSIHAVEAF

SEQ ID NO: 134493 - protein, 17 aa, Mycobacterium avium
HEWLRVLKRLQPRLYSI

SEQ ID NO: 134494 - protein, 18 aa, Mycobacterium avium
HGIQLWVNLPRKDKFTPP

SEQ ID NO: 134495 - protein, 20 aa, Mycobacterium avium
HGLRPLVRLVSWAVAGVAPH

SEQ ID NO: 134496 - protein, 18 aa, Mycobacterium avium
HGWIHNELRRRCGGPPIA

SEQ ID NO: 134497 - protein, 24 aa, Mycobacterium avium
HHRSTYMFLADRYSGWMRAPLRWA

SEQ ID NO: 134498 - protein, 24 aa, Mycobacterium avium
HHSRRGLLLLVGRRRRLLKYVAQI

SEQ ID NO: 134499 - protein, 19 aa, Mycobacterium avium
HIDKWKFTVPFVCGATNLG

SEQ ID NO: 134500 - protein, 20 aa, Mycobacterium avium
HKLLVWDLMRRPKITQLAES

SEQ ID NO: 134501 - protein, 17 aa, Mycobacterium avium
HLLIWTTTPWTLPSNLA

SEQ ID NO: 134502 - protein, 19 aa, Mycobacterium avium
HLRVILHGWLAFTFEICRQ

SEQ ID NO: 134503 - protein, 17 aa, Mycobacterium avium
HLTGLDKTFPLYPTLDD

SEQ ID NO: 134504 - protein, 17 aa, Mycobacterium avium
HMVSFWPDSIWAPEFTD

SEQ ID NO: 134505 - protein, 24 aa, Mycobacterium avium
HPAVRWVRYPYLPSHPQYDLAKRQ

SEQ ID NO: 134506 - protein, 17 aa, Mycobacterium avium
HPRLMPDFWEFPTVSMG

SEQ ID NO: 134507 - protein, 21 aa, Mycobacterium avium
HRVPVWFMRQAGRSLPEYRAL

SEQ ID NO: 134508 - protein, 23 aa, Mycobacterium avium
HSCSLLIPALLSTAATRSATTTG

SEQ ID NO: 134509 - protein, 17 aa, Mycobacterium avium
HTNSVPLYFISPTPFNL

SEQ ID NO: 134510 - protein, 18 aa, Mycobacterium avium
HVSIWPDVPILLVCAHPQ

SEQ ID NO: 134511 - protein, 18 aa, Mycobacterium avium
IAAYAGGLVPILCLTKTD

SEQ ID NO: 134512 - protein, 24 aa, Mycobacterium avium
IAEEYYISFLLDRANRTYLAMCSV

SEQ ID NO: 134513 - protein, 19 aa, Mycobacterium avium
IALALLKRGLPADTALATG

SEQ ID NO: 134514 - protein, 19 aa, Mycobacterium avium
IAWYTVLACFKLGIVIEGT

SEQ ID NO: 134515 - protein, 25 aa, Mycobacterium avium
IDHIIGLFRLWWIPRGSAPTEGTYV

SEQ ID NO: 134516 - protein, 19 aa, Mycobacterium avium
IDLNNWTLLKWLDEPCTFY

SEQ ID NO: 134517 - protein, 22 aa, Mycobacterium avium
IDPRTRWLLRELVYALLVKKDH

SEQ ID NO: 134518 - protein, 23 aa, Mycobacterium avium
IELDGLRLITWRGAARAEQGLPF

SEQ ID NO: 134519 - protein, 17 aa, Mycobacterium avium
IEQLLTIPLAKELAWAP

SEQ ID NO: 134520 - protein, 26 aa, Mycobacterium avium
IFARHPSFVHSFPPMPVQPNGFMTAD

SEQ ID NO: 134521 - protein, 19 aa, Mycobacterium avium
IFSVERYRAVMDAYLAGME

SEQ ID NO: 134522 - protein, 19 aa, Mycobacterium avium
IFSVQYRLPNYYRWLLYEA

SEQ ID NO: 134523 - protein, 18 aa, Mycobacterium avium
IHFQEWWVRYRAQVPTHS

SEQ ID NO: 134524 - protein, 17 aa, Mycobacterium avium
IHYWALDGGWDCFANHY

SEQ ID NO: 134525 - protein, 18 aa, Mycobacterium avium
INLAMTEFKMFYKLPVEG

SEQ ID NO: 134526 - protein, 24 aa, Mycobacterium avium
IRASQNLIPRLFWTTYQGGRDDLL

SEQ ID NO: 134527 - protein, 18 aa, Mycobacterium avium
IRCFGFSPLRLPPDLDFT

SEQ ID NO: 134528 - protein, 24 aa, Mycobacterium avium
ISCGPYRFVYRKRFHKKCETELTV

SEQ ID NO: 134529 - protein, 24 aa, Mycobacterium avium
ITAFNFPVAVWAWNAALALVCGDT

SEQ ID NO: 134530 - protein, 24 aa, Mycobacterium avium
ITGTPWLTAFAQRSPFAEAFRANG

SEQ ID NO: 134531 - protein, 22 aa, Mycobacterium avium
ITPWNFPMPIASWGIAPALAAG

SEQ ID NO: 134532 - protein, 17 aa, Mycobacterium avium
ITVADVPNLFFLLGPNT

SEQ ID NO: 134533 - protein, 19 aa, Mycobacterium avium
IVIGGGMCFTFLAAQGFSV

SEQ ID NO: 134534 - protein, 26 aa, Mycobacterium avium
IVPWNVPQFLIMPKLIPALIAGCTVI

SEQ ID NO: 134535 - protein, 18 aa, Mycobacterium avium
IVVRLLVTAMRHAAVSRE

SEQ ID NO: 134536 - protein, 20 aa, Mycobacterium avium
KAQIYAWRKGIKTLYYIRLR

SEQ ID NO: 134537 - protein, 17 aa, Mycobacterium avium
KCSIRTPWWSTPSLWQP

SEQ ID NO: 134538 - protein, 24 aa, Mycobacterium avium
KDGYGRNFLLPRGLAIVASRGAQK

SEQ ID NO: 134539 - protein, 23 aa, Mycobacterium avium
KDLLPLLEKVIQAGKPLLIIAED

SEQ ID NO: 134540 - protein, 24 aa, Mycobacterium avium
KEMWDAFFEEYLAPVWPLERVKQR

SEQ ID NO: 134541 - protein, 20 aa, Mycobacterium avium
KEPYSVVGLIFPWNGPIFNA

SEQ ID NO: 134542 - protein, 21 aa, Mycobacterium avium
KEWHQYWIDTRLQWYVELGID

SEQ ID NO: 134543 - protein, 22 aa, Mycobacterium avium
KGRILTAMSVFFFGLVDAPNHL

SEQ ID NO: 134544 - protein, 19 aa, Mycobacterium avium
KHIAWYLHGFPAGSELRRA

SEQ ID NO: 134545 - protein, 17 aa, Mycobacterium avium
KLAAWLRGQGHTPLLVA

SEQ ID NO: 134546 - protein, 17 aa, Mycobacterium avium
KLLDVLLAKGLDAPFSC

SEQ ID NO: 134547 - protein, 24 aa, Mycobacterium avium
KMFGENFFYILYFQEPGVADAELN

SEQ ID NO: 134548 - protein, 17 aa, Mycobacterium avium
KMGEMGLFGLPFPEEYG

SEQ ID NO: 134549 - protein, 19 aa, Mycobacterium avium
KRHEILQLELLKPKIAILD

SEQ ID NO: 134550 - protein, 24 aa, Mycobacterium avium
KRQQFLTDLSLLGGLLIASADTAG

SEQ ID NO: 134551 - protein, 21 aa, Mycobacterium avium
KRYMHHYNFPPFSTGETGRVG

SEQ ID NO: 134552 - protein, 18 aa, Mycobacterium avium
KSLTMFLVPLDSPGIDIQ

SEQ ID NO: 134553 - protein, 24 aa, Mycobacterium avium
KSVAAFRLALPRTMLRFAGGREIT

SEQ ID NO: 134554 - protein, 23 aa, Mycobacterium avium
KVKHRTFHYPGGLVDFVKHINRT

SEQ ID NO: 134555 - protein, 22 aa, Mycobacterium avium
KVNMTLLRFISFILKEIYPGGK

SEQ ID NO: 134556 - protein, 23 aa, Mycobacterium avium
LAAMGFKFQFITLAGFHALNYSM

SEQ ID NO: 134557 - protein, 18 aa, Mycobacterium avium
LAERALVPVLPSLEDFPY

SEQ ID NO: 134558 - protein, 25 aa, Mycobacterium avium
LAGILPSFPALLKKQLKGAPMPAPR

SEQ ID NO: 134559 - protein, 24 aa, Mycobacterium avium
LANYFAGALLLPYRRFLDAAERVR

SEQ ID NO: 134560 - protein, 27 aa, Mycobacterium avium
LAPHLVKPMPFLFPLTNRLWERPYIAA

SEQ ID NO: 134561 - protein, 17 aa, Mycobacterium avium
LAPVPWIDQVCTARLLA

SEQ ID NO: 134562 - protein, 25 aa, Mycobacterium avium
LATGHWLRRWWPASRQDGIAGLDRA

SEQ ID NO: 134563 - protein, 25 aa, Mycobacterium avium
LATHLLTHPRLLGALPLLREANRIP

SEQ ID NO: 134564 - protein, 20 aa, Mycobacterium avium
LDHAMWFMRAFRADEWLLYD

SEQ ID NO: 134565 - protein, 22 aa, Mycobacterium avium
LDTRPYRLWWPRGTTVYEIDRP

SEQ ID NO: 134566 - protein, 18 aa, Mycobacterium avium
LEAPLKQIAFNGGLEPGV

SEQ ID NO: 134567 - protein, 17 aa, Mycobacterium avium
LESPLGQLLYAAGSGTL

SEQ ID NO: 134568 - protein, 18 aa, Mycobacterium avium
LFIIGRIKDLLIVYGRNH

SEQ ID NO: 134569 - protein, 24 aa, Mycobacterium avium
LGEIYAMWRINELLNWQVAAAGED

SEQ ID NO: 134570 - protein, 20 aa, Mycobacterium avium
LGIDCIWLPPFYDSPLRDGG

SEQ ID NO: 134571 - protein, 21 aa, Mycobacterium avium
LGLLPFRRNLTFYALDLALMS

SEQ ID NO: 134572 - protein, 25 aa, Mycobacterium avium
LGTNLLGPFALTNLLLPKVRSQIIN

SEQ ID NO: 134573 - protein, 22 aa, Mycobacterium avium
LHAPLDVFLVRKLGVPNWSELA

SEQ ID NO: 134574 - protein, 25 aa, Mycobacterium avium
LHDLYRRWPFFRSVLSNLAQVLAKS

SEQ ID NO: 134575 - protein, 18 aa, Mycobacterium avium
LIGPLRIGLQRAGVPVVL

SEQ ID NO: 134576 - protein, 17 aa, Mycobacterium avium
LIGRIGWTCRDVWWAAT

SEQ ID NO: 134577 - protein, 24 aa, Mycobacterium avium
LINPHPMFVPWLVGPLLTGDGVHL

SEQ ID NO: 134578 - protein, 18 aa, Mycobacterium avium
LIVIPNDRLLQMGDAAVS

SEQ ID NO: 134579 - protein, 21 aa, Mycobacterium avium
LKHRLARSLFLYALCNGWIGE

SEQ ID NO: 134580 - protein, 19 aa, Mycobacterium avium
LKLLRDKQLWFRVARKHGL

SEQ ID NO: 134581 - protein, 25 aa, Mycobacterium avium
LLAAGPVVLFFYPAAMTPGCTKEAC

SEQ ID NO: 134582 - protein, 23 aa, Mycobacterium avium
LLDEAWWFPAIQWPDGRMQFMLN

SEQ ID NO: 134583 - protein, 18 aa, Mycobacterium avium
LLDVAFAHDIRLIASALG

SEQ ID NO: 134584 - protein, 21 aa, Mycobacterium avium
LLKDLDLLEPLRGLLADGLPA

SEQ ID NO: 134585 - protein, 21 aa, Mycobacterium avium
LLPEVAWSWLVEALESRMEHV

SEQ ID NO: 134586 - protein, 19 aa, Mycobacterium avium
LLQDFYLIEQLAAFNRERV

SEQ ID NO: 134587 - protein, 24 aa, Mycobacterium avium
LLVTPALLWLFIRGVRFMYSVDPH

SEQ ID NO: 134588 - protein, 18 aa, Mycobacterium avium
LMWRYYLGPTVGSAAAVP

SEQ ID NO: 134589 - protein, 20 aa, Mycobacterium avium
LPAPAPYRGFVTWLAARDVP

SEQ ID NO: 134590 - protein, 23 aa, Mycobacterium avium
LPPKLVIPMRVIMSVAAILCQLD

SEQ ID NO: 134591 - protein, 24 aa, Mycobacterium avium
LPPSQANFLWLPLGSRTEDFVQEA

SEQ ID NO: 134592 - protein, 17 aa, Mycobacterium avium
LPVWIYQFRISPHPTIE

SEQ ID NO: 134593 - protein, 25 aa, Mycobacterium avium
LQRIKDLVIPPAWKKVWISPHPNGH

SEQ ID NO: 134594 - protein, 24 aa, Mycobacterium avium
LQRVADALWYPLWDANVRLDHSVR

SEQ ID NO: 134595 - protein, 24 aa, Mycobacterium avium
LQSDQPLWAVWRFGTDPAFTQISM

SEQ ID NO: 134596 - protein, 17 aa, Mycobacterium avium
LRALVRRRLAVAHPGYD

SEQ ID NO: 134597 - protein, 19 aa, Mycobacterium avium
LRAMQFLRGGRRWLLKSPQ

SEQ ID NO: 134598 - protein, 18 aa, Mycobacterium avium
LRARNFVMFGPPGRLYTY

SEQ ID NO: 134599 - protein, 23 aa, Mycobacterium avium
LRDKIPLVMLLEGAGFRPTGGHY

SEQ ID NO: 134600 - protein, 19 aa, Mycobacterium avium
LRFGLHRALRLGKPLQLHV

SEQ ID NO: 134601 - protein, 17 aa, Mycobacterium avium
LRFRLRWRDFRVTVDVN

SEQ ID NO: 134602 - protein, 18 aa, Mycobacterium avium
LRIVFVEHAFTWILPLMW

SEQ ID NO: 134603 - protein, 18 aa, Mycobacterium avium
LRLEGSAVFRWAAFEMGK

SEQ ID NO: 134604 - protein, 18 aa, Mycobacterium avium
LRLGIARALILASPDDRP

SEQ ID NO: 134605 - protein, 19 aa, Mycobacterium avium
LRPAFAYWGWRAVATEAPD

SEQ ID NO: 134606 - protein, 25 aa, Mycobacterium avium
LRTEKSVMFVIPWGSHWIIGTTDTD

SEQ ID NO: 134607 - protein, 17 aa, Mycobacterium avium
LSLLLLRVQAVRSAWGP

SEQ ID NO: 134608 - protein, 22 aa, Mycobacterium avium
LSRPTFYFYFKSKEAVVLSLLE

SEQ ID NO: 134609 - protein, 22 aa, Mycobacterium avium
LTELLMIVATYYGLALVLNATD

SEQ ID NO: 134610 - protein, 17 aa, Mycobacterium avium
LTPNLHWPLEYVDSFAG

SEQ ID NO: 134611 - protein, 22 aa, Mycobacterium avium
LVNRILVYLAPTLLGGPVTAVD

SEQ ID NO: 134612 - protein, 21 aa, Mycobacterium avium
LVPQHLMRRLFFTAATVDAAT

SEQ ID NO: 134613 - protein, 18 aa, Mycobacterium avium
LVRPNLLPLLVRKQLELT

SEQ ID NO: 134614 - protein, 21 aa, Mycobacterium avium
LVSFEVFIRPALRAAMGLPDP

SEQ ID NO: 134615 - protein, 17 aa, Mycobacterium avium
LVTLVEWGLPPVAVLRA

SEQ ID NO: 134616 - protein, 17 aa, Mycobacterium avium
LWTLLRVPTLIACGDHD

SEQ ID NO: 134617 - protein, 18 aa, Mycobacterium avium
LYLKRLLGYSAFLGGPDR

SEQ ID NO: 134618 - protein, 21 aa, Mycobacterium avium
LYQSWAAAYLPLLRVLDTLAG

SEQ ID NO: 134619 - protein, 22 aa, Mycobacterium avium
MAHFFYIHFGLPTYFKNVFEGH

SEQ ID NO: 134620 - protein, 24 aa, Mycobacterium avium
MAHYAPFGLLTPAAWVALHAQRYM

SEQ ID NO: 134621 - protein, 25 aa, Mycobacterium avium
MARLLYWGCDVWLNNPLRPLEACGT

SEQ ID NO: 134622 - protein, 17 aa, Mycobacterium avium
MEIIGMLTLLIGGGFDT

SEQ ID NO: 134623 - protein, 17 aa, Mycobacterium avium
MFQAILPLRGKIINVEK

SEQ ID NO: 134624 - protein, 24 aa, Mycobacterium avium
MGLISAYMFILLQGGTTHAMSPLD

SEQ ID NO: 134625 - protein, 22 aa, Mycobacterium avium
MHTLLLDLWRRHGFGVLLVTHD

SEQ ID NO: 134626 - protein, 20 aa, Mycobacterium avium
MPIHMRLPKLKGFRNRFRTE

SEQ ID NO: 134627 - protein, 18 aa, Mycobacterium avium
MPIHVYRWKPTPAGGEFD

SEQ ID NO: 134628 - protein, 18 aa, Mycobacterium avium
MRAIGIPVYLLPGNHDPL

SEQ ID NO: 134629 - protein, 25 aa, Mycobacterium avium
MTGWQRLHFRFGIPAPLLEPLAVER

SEQ ID NO: 134630 - protein, 17 aa, Mycobacterium avium
MTIAKFRAARTVWARVA

SEQ ID NO: 134631 - protein, 25 aa, Mycobacterium avium
NAFGDKVLPLYLPTGLPACTGLIGL

SEQ ID NO: 134632 - protein, 27 aa, Mycobacterium avium
NALYTPAHWKYLTSGLLGLARGTDAGD

SEQ ID NO: 134633 - protein, 20 aa, Mycobacterium avium
NAPVLLGLIGLWYSNFMGAQ

SEQ ID NO: 134634 - protein, 23 aa, Mycobacterium avium
NCEIVPWCRFARKNYFYPDMPKN

SEQ ID NO: 134635 - protein, 25 aa, Mycobacterium avium
NEEVAPWLDLVRKLGLLAATLSDGP

SEQ ID NO: 134636 - protein, 21 aa, Mycobacterium avium
NELEFFFFVLAFAGSDTTKNA

SEQ ID NO: 134637 - protein, 22 aa, Mycobacterium avium
NFMLIGAAFYRDTYRRTERGWK

SEQ ID NO: 134638 - protein, 17 aa, Mycobacterium avium
NGYPRLLCMTRMSTFAE

SEQ ID NO: 134639 - protein, 20 aa, Mycobacterium avium
NKYRLIFDKLRLAPGDRLLD

SEQ ID NO: 134640 - protein, 26 aa, Mycobacterium avium
NLPITLWPGMKIGQLCILRLTSPAEH

SEQ ID NO: 134641 - protein, 20 aa, Mycobacterium avium
NLSGPFAGVPFLLKDLGQEY

SEQ ID NO: 134642 - protein, 19 aa, Mycobacterium avium
NLYLRDLVLALQWVRDNIA

SEQ ID NO: 134643 - protein, 19 aa, Mycobacterium avium
NRAGSARAWWLLRAAGLDN

SEQ ID NO: 134644 - protein, 23 aa, Mycobacterium avium
NRDGILTAAWLRALERFQARALA

SEQ ID NO: 134645 - protein, 24 aa, Mycobacterium avium
NRGSQFYLALYWAQELAAQNDDDE

SEQ ID NO: 134646 - protein, 20 aa, Mycobacterium avium
NTAAWWVCATIPNAVSLGKT

SEQ ID NO: 134647 - protein, 18 aa, Mycobacterium avium
NTGWFKYWSTWGNQFLAA

SEQ ID NO: 134648 - protein, 24 aa, Mycobacterium avium
PADGASNWYLEFARLAPLMEKDVH

SEQ ID NO: 134649 - protein, 27 aa, Mycobacterium avium
PADPPFEGMWWLYVPMAFDDFAIVLII

SEQ ID NO: 134650 - protein, 21 aa, Mycobacterium avium
PAEGLPYRWPHPWLVDPKTAS

SEQ ID NO: 134651 - protein, 17 aa, Mycobacterium avium
PALGIDWPLVAGAAPTL

SEQ ID NO: 134652 - protein, 20 aa, Mycobacterium avium
PALLHLLAEFPSIRTVTVMV

SEQ ID NO: 134653 - protein, 24 aa, Mycobacterium avium
PDQELAFLRPLPVRRLWGVGAVTA

SEQ ID NO: 134654 - protein, 20 aa, Mycobacterium avium
PEPALRLVAVARLRLLCRAA

SEQ ID NO: 134655 - protein, 26 aa, Mycobacterium avium
PEYRTMPMVWYIPPLSPVVDAVSRDG

SEQ ID NO: 134656 - protein, 23 aa, Mycobacterium avium
PFFGDRRKAFLEDLAIVTGGQVI

SEQ ID NO: 134657 - protein, 23 aa, Mycobacterium avium
PGDYLIRPGFWHGAIGVAACWLG

SEQ ID NO: 134658 - protein, 22 aa, Mycobacterium avium
PGKAPAKLLEARFGREAMLDQV

SEQ ID NO: 134659 - protein, 26 aa, Mycobacterium avium
PGPNQLGAFLFWMVRKRPALQIHLLK

SEQ ID NO: 134660 - protein, 17 aa, Mycobacterium avium
PGSGVYALFSNGTNLAS

SEQ ID NO: 134661 - protein, 19 aa, Mycobacterium avium
PGWHALRKLAARITTPLLP

SEQ ID NO: 134662 - protein, 19 aa, Mycobacterium avium
PHFEYALAAYYLILPSEVS

SEQ ID NO: 134663 - protein, 17 aa, Mycobacterium avium
PHLTAMWYAVVDGEIWL

SEQ ID NO: 134664 - protein, 27 aa, Mycobacterium avium
PIGVCGLITPWNWPINQVAVKVYPALA

SEQ ID NO: 134665 - protein, 23 aa, Mycobacterium avium
PILPQQALLYRLCGDRNPLHSDP

SEQ ID NO: 134666 - protein, 23 aa, Mycobacterium avium
PKASVMTHLRWLKALAAFGGIGL

SEQ ID NO: 134667 - protein, 24 aa, Mycobacterium avium
PKHKRLTLFLIPMDRPGFTVRPIP

SEQ ID NO: 134668 - protein, 28 aa, Mycobacterium avium
PKRLGSFMDSRLWRLLLAPGRGIGRLVT

SEQ ID NO: 134669 - protein, 20 aa, Mycobacterium avium
PLLATYAFLPIVRAFAEPAG

SEQ ID NO: 134670 - protein, 21 aa, Mycobacterium avium
PLVLKPWTMPEPLLPVAIAAH

SEQ ID NO: 134671 - protein, 19 aa, Mycobacterium avium
PLVVWLGSAEARDVTGKVF

SEQ ID NO: 134672 - protein, 17 aa, Mycobacterium avium
PLWDQQLPFGIAITSLL

SEQ ID NO: 134673 - protein, 21 aa, Mycobacterium avium
PMDVLWFRLKWRPGDPRELFG

SEQ ID NO: 134674 - protein, 19 aa, Mycobacterium avium
PMFLLYDYSFLPDGAASKA

SEQ ID NO: 134675 - protein, 18 aa, Mycobacterium avium
PMIRYPIPPMIHGATQSA

SEQ ID NO: 134676 - protein, 18 aa, Mycobacterium avium
PNLPWPWGLIDLTARVLL

SEQ ID NO: 134677 - protein, 27 aa, Mycobacterium avium
PPHGWINLHFSLLPAWRGAAPVQAAIA

SEQ ID NO: 134678 - protein, 18 aa, Mycobacterium avium
PPWVGPLDVLVVAGDDPG

SEQ ID NO: 134679 - protein, 18 aa, Mycobacterium avium
PPWWLKPANKLFIRLSRL

SEQ ID NO: 134680 - protein, 19 aa, Mycobacterium avium
PQFWPLWEAAADANLPVAV

SEQ ID NO: 134681 - protein, 17 aa, Mycobacterium avium
PRWVALFRWAKPVLSSR

SEQ ID NO: 134682 - protein, 22 aa, Mycobacterium avium
PSATIALPFDIAGALTGFHTDD

SEQ ID NO: 134683 - protein, 24 aa, Mycobacterium avium
PSGGLLAWLGLAPNTNGPGQPGLA

SEQ ID NO: 134684 - protein, 22 aa, Mycobacterium avium
PSHHYLAAYHWLDAGFGAHAVV

SEQ ID NO: 134685 - protein, 18 aa, Mycobacterium avium
PSMLLPLWDSEVGAAFIA

SEQ ID NO: 134686 - protein, 21 aa, Mycobacterium avium
PVAGLTWLPFLDQRYTAVTGG

SEQ ID NO: 134687 - protein, 18 aa, Mycobacterium avium
PVFRPPLDMARLFGQPRL

SEQ ID NO: 134688 - protein, 22 aa, Mycobacterium avium
PVRVDTWGGWLWINMDPDCEPL

SEQ ID NO: 134689 - protein, 20 aa, Mycobacterium avium
PWWEWAATYERAFSAAYDAL

SEQ ID NO: 134690 - protein, 20 aa, Mycobacterium avium
PYGVDLLLPPKYVGAEQGGI

SEQ ID NO: 134691 - protein, 17 aa, Mycobacterium avium
PYPVTVGYMYIMKLHHL

SEQ ID NO: 134692 - protein, 23 aa, Mycobacterium avium
QALYREGFFGLSWPREYGGQELA

SEQ ID NO: 134693 - protein, 24 aa, Mycobacterium avium
QEDFIGIHFFSPVDKMPLVEIIKG

SEQ ID NO: 134694 - protein, 23 aa, Mycobacterium avium
QEWVRFGWFFLVTRRDPRGLAEW

SEQ ID NO: 134695 - protein, 19 aa, Mycobacterium avium
QHFNLFPHRTVLDNVALAP

SEQ ID NO: 134696 - protein, 21 aa, Mycobacterium avium
QIGYSLLFRLASGSLLGPDRP

SEQ ID NO: 134697 - protein, 25 aa, Mycobacterium avium
QINNVLAFPGVFRGALEAGARRITE

SEQ ID NO: 134698 - protein, 19 aa, Mycobacterium avium
QMLLKIGWPAEDLAGYVDG

SEQ ID NO: 134699 - protein, 24 aa, Mycobacterium avium
QPDDLLIVLFGIALAWANSPHPDA

SEQ ID NO: 134700 - protein, 17 aa, Mycobacterium avium
QQPCRWIFRGRNQRAEQ

SEQ ID NO: 134701 - protein, 25 aa, Mycobacterium avium
QRITPFVLTLRLLVIALRRNEIMNS

SEQ ID NO: 134702 - protein, 26 aa, Mycobacterium avium
QRLALSLILILPFYEPVRLAEDMAVL

SEQ ID NO: 134703 - protein, 18 aa, Mycobacterium avium
QRRLLFWTWLAYGGRLLR

SEQ ID NO: 134704 - protein, 22 aa, Mycobacterium avium
QRRRWLPKIISGEAVLAIAMTE

SEQ ID NO: 134705 - protein, 26 aa, Mycobacterium avium
QSKNPVLQLFIKVLMRLTTRYALQSR

SEQ ID NO: 134706 - protein, 21 aa, Mycobacterium avium
QSLRQFLDPDTLRYLRDFRFG

SEQ ID NO: 134707 - protein, 20 aa, Mycobacterium avium
QVREQLLILPIIGVLDSQRA

SEQ ID NO: 134708 - protein, 19 aa, Mycobacterium avium
QVRLPGFRPGKAPAKLLEA

SEQ ID NO: 134709 - protein, 19 aa, Mycobacterium avium
QVWAMRYTLERAMRGQDTI

SEQ ID NO: 134710 - protein, 19 aa, Mycobacterium avium
QWLTVLQEYLVLVLMGPRS

SEQ ID NO: 134711 - protein, 19 aa, Mycobacterium avium
QWVTSQWRWDTLAARLAGL

SEQ ID NO: 134712 - protein, 19 aa, Mycobacterium avium
QYRLPNYYRWLLYEADHAG

SEQ ID NO: 134713 - protein, 22 aa, Mycobacterium avium
RAAVLAPRLWVPDEFGLCRYLA

SEQ ID NO: 134714 - protein, 23 aa, Mycobacterium avium
RAGKLPVTLFTAGGIATPADAAM

SEQ ID NO: 134715 - protein, 25 aa, Mycobacterium avium
RAKNMFALGLLSWMYGRPIETSEKF

SEQ ID NO: 134716 - protein, 17 aa, Mycobacterium avium
RAQQPCRWIFRGRNQRA

SEQ ID NO: 134717 - protein, 21 aa, Mycobacterium avium
RARWVVRVITSLLLFPGHDEA

SEQ ID NO: 134718 - protein, 28 aa, Mycobacterium avium
RATQTWRYPPFFHALLDAGVYPPCSAFE

SEQ ID NO: 134719 - protein, 25 aa, Mycobacterium avium
RCAEARIFFVDYLTMLPPAGVPAAP

SEQ ID NO: 134720 - protein, 24 aa, Mycobacterium avium
RDAPLLHWVVFEEEYFRAGAPGRA

SEQ ID NO: 134721 - protein, 23 aa, Mycobacterium avium
RDELYRRWTGLLSYRYIGRKHSS

SEQ ID NO: 134722 - protein, 23 aa, Mycobacterium avium
RDLCALWPVPATSAPHAAPPMPA

SEQ ID NO: 134723 - protein, 23 aa, Mycobacterium avium
REDKPFWWAHFDRLNFPIDEWAD

SEQ ID NO: 134724 - protein, 17 aa, Mycobacterium avium
REVRWRPEHFWKSGTVI

SEQ ID NO: 134725 - protein, 29 aa, Mycobacterium avium
RFAKIFDVNLWAPLLWTSLAVKSWMGEHG

SEQ ID NO: 134726 - protein, 18 aa, Mycobacterium avium
RFFAAPGSWTLRALSAAG

SEQ ID NO: 134727 - protein, 24 aa, Mycobacterium avium
RFGSGWWPFLTPPEQIAEKLDYIK

SEQ ID NO: 134728 - protein, 21 aa, Mycobacterium avium
RGQPRLRPPFPAVAGLYGCPT

SEQ ID NO: 134729 - protein, 19 aa, Mycobacterium avium
RGRFRWWGLYTQREQGYDG

SEQ ID NO: 134730 - protein, 19 aa, Mycobacterium avium
RGWRSPLQLLFIDGGHSET

SEQ ID NO: 134731 - protein, 19 aa, Mycobacterium avium
RHVPFRITPLARDAWLRCM

SEQ ID NO: 134732 - protein, 19 aa, Mycobacterium avium
RHVPLGVVAVLTPWNFPHC

SEQ ID NO: 134733 - protein, 17 aa, Mycobacterium avium
RIFYRIGFTPWDGHPLA

SEQ ID NO: 134734 - protein, 21 aa, Mycobacterium avium
RKVEPLRRALRGYAAWVSGLR

SEQ ID NO: 134735 - protein, 18 aa, Mycobacterium avium
RKWLYFDCNWKVALEAFN

SEQ ID NO: 134736 - protein, 17 aa, Mycobacterium avium
RLHPPLIILMRVAKGEF

SEQ ID NO: 134737 - protein, 19 aa, Mycobacterium avium
RLLGVAYAGLLARAARLTD

SEQ ID NO: 134738 - protein, 18 aa, Mycobacterium avium
RLNLPWRRDFNALVYVLS

SEQ ID NO: 134739 - protein, 21 aa, Mycobacterium avium
RLPLYFPTPLRHRFTPEIRAH

SEQ ID NO: 134740 - protein, 21 aa, Mycobacterium avium
RLRWDPTLLFRRLKELHLEFT

SEQ ID NO: 134741 - protein, 21 aa, Mycobacterium avium
RLTLPAKFRDALAGGLMVTKS

SEQ ID NO: 134742 - protein, 19 aa, Mycobacterium avium
RLVPDFLWISTEHTARVSL

SEQ ID NO: 134743 - protein, 21 aa, Mycobacterium avium
RLVRWLLRRKAINSLPPGYAV

SEQ ID NO: 134744 - protein, 23 aa, Mycobacterium avium
RLYAILERVVPLKFLYLPIAVEG

SEQ ID NO: 134745 - protein, 17 aa, Mycobacterium avium
RMLAIMHALDGALATVA

SEQ ID NO: 134746 - protein, 17 aa, Mycobacterium avium
RMLYDYFQQLFAQVTNP

SEQ ID NO: 134747 - protein, 20 aa, Mycobacterium avium
RPIPGPLKWDLTLGVATDTR

SEQ ID NO: 134748 - protein, 21 aa, Mycobacterium avium
RPLITNMIRLLKLPIAVQRRV

SEQ ID NO: 134749 - protein, 28 aa, Mycobacterium avium
RQKRLMTLIHLWLVHRFKADAVIYVTPT

SEQ ID NO: 134750 - protein, 22 aa, Mycobacterium avium
RQLRYFWPRVVGDTGWQLLDSK

SEQ ID NO: 134751 - protein, 19 aa, Mycobacterium avium
RQLYNLDALPDHLIVVGSG

SEQ ID NO: 134752 - protein, 17 aa, Mycobacterium avium
RRALTSTELWPVALKEI

SEQ ID NO: 134753 - protein, 23 aa, Mycobacterium avium
RRDWVRRTLLAAPPPWIDVFIAR

SEQ ID NO: 134754 - protein, 21 aa, Mycobacterium avium
RRLALLLTYQRFLPATGPVAM

SEQ ID NO: 134755 - protein, 18 aa, Mycobacterium avium
RRRDLLFGLADLLRDHFA

SEQ ID NO: 134756 - protein, 21 aa, Mycobacterium avium
RRRVALCKLLLSKPDLLLLDE

SEQ ID NO: 134757 - protein, 17 aa, Mycobacterium avium
RSGALWILNSEALGRIG

SEQ ID NO: 134758 - protein, 19 aa, Mycobacterium avium
RSLVFPVKRLADLGFRVLA

SEQ ID NO: 134759 - protein, 22 aa, Mycobacterium avium
RSRLALWARRLLGEAITQAQYL

SEQ ID NO: 134760 - protein, 26 aa, Mycobacterium avium
RSRTHHYPFRLLPPKTMRALIGRICE

SEQ ID NO: 134761 - protein, 22 aa, Mycobacterium avium
RTPPPPLNLTLDATIHAARTVR

SEQ ID NO: 134762 - protein, 24 aa, Mycobacterium avium
RTRIRPHFFPFTEPSAEVDVWFVG

SEQ ID NO: 134763 - protein, 18 aa, Mycobacterium avium
RTTPLRLFWARDYSDYHP

SEQ ID NO: 134764 - protein, 17 aa, Mycobacterium avium
RVGLLPTWGLSVRLPQK

SEQ ID NO: 134765 - protein, 25 aa, Mycobacterium avium
RVSARVYPALVPLSHPLATVNGAFN

SEQ ID NO: 134766 - protein, 24 aa, Mycobacterium avium
RWTQDSFVPWVWRRLRGLSSYDGR

SEQ ID NO: 134767 - protein, 25 aa, Mycobacterium avium
SALVVFEVMVRPLIRLSLGKRQPMR

SEQ ID NO: 134768 - protein, 25 aa, Mycobacterium avium
SARVEFWAFDLLYLDGRSLLRARYR

SEQ ID NO: 134769 - protein, 17 aa, Mycobacterium avium
SCFLLPRVLPDGTRNRM

SEQ ID NO: 134770 - protein, 26 aa, Mycobacterium avium
SDEAIYSFLRLLLPAGLETTYRSSGN

SEQ ID NO: 134771 - protein, 25 aa, Mycobacterium avium
SDLELYLFFSLLFSAGAETTRNAVA

SEQ ID NO: 134772 - protein, 19 aa, Mycobacterium avium
SDRELFIIGRIKDLLIVYG

SEQ ID NO: 134773 - protein, 23 aa, Mycobacterium avium
SEAIALLRLPLVLPAVQLMGRVL

SEQ ID NO: 134774 - protein, 22 aa, Mycobacterium avium
SFASLVFYSSWFKLHHPAAFCA

SEQ ID NO: 134775 - protein, 26 aa, Mycobacterium avium
SFQLFPNFVILFWGQGWYLTYHYWPT

SEQ ID NO: 134776 - protein, 18 aa, Mycobacterium avium
SGARWYAAPAAPAGPLAS

SEQ ID NO: 134777 - protein, 21 aa, Mycobacterium avium
SGCVLLPGLPYLGLEHRAAWV

SEQ ID NO: 134778 - protein, 18 aa, Mycobacterium avium
SGRDLYFNLSLWSAYDVM

SEQ ID NO: 134779 - protein, 25 aa, Mycobacterium avium
SGSGPAYFFLLVEALVDAGVAAGLS

SEQ ID NO: 134780 - protein, 24 aa, Mycobacterium avium
SIEPWIFMNWRRAAYYLYLAEVID

SEQ ID NO: 134781 - protein, 24 aa, Mycobacterium avium
SLADPLAFLLRKEGFEATVVTDGS

SEQ ID NO: 134782 - protein, 23 aa, Mycobacterium avium
SLDSPPFYDPWFAKARTSGAIQA

SEQ ID NO: 134783 - protein, 22 aa, Mycobacterium avium
SLPDGALMRRAAFGLATEIAAE

SEQ ID NO: 134784 - protein, 25 aa, Mycobacterium avium
SLSHPYLDTVLFLLGVTRGEIEAAD

SEQ ID NO: 134785 - protein, 17 aa, Mycobacterium avium
SLTLLPKLSARAAARYY

SEQ ID NO: 134786 - protein, 22 aa, Mycobacterium avium
SLTLYLQLYLGGFGLELSDIES

SEQ ID NO: 134787 - protein, 33 aa, Mycobacterium avium
SPTPFNLLGIDRWIRNFFYLTYFDSFEGIHSRV

SEQ ID NO: 134788 - protein, 19 aa, Mycobacterium avium
SRELPWRRPIASLNYLLTS

SEQ ID NO: 134789 - protein, 23 aa, Mycobacterium avium
SSMRKFYEAFKPYGLRETAIKPS

SEQ ID NO: 134790 - protein, 28 aa, Mycobacterium avium
SSTPPPPPPLPPTPFPKACPAPGVMQGC

SEQ ID NO: 134791 - protein, 23 aa, Mycobacterium avium
STAAAILGLLPPGGRITAGRIMF

SEQ ID NO: 134792 - protein, 26 aa, Mycobacterium avium
STIRNVWRFWYQIPISLPVIGPRVIS

SEQ ID NO: 134793 - protein, 20 aa, Mycobacterium avium
STTTYPCDVLIFATGFDALT

SEQ ID NO: 134794 - protein, 18 aa, Mycobacterium avium
SVPAFRPGAQFKAVVSGA

SEQ ID NO: 134795 - protein, 26 aa, Mycobacterium avium
TAERGLFDFFFLAEGLRLREHRGKIH

SEQ ID NO: 134796 - protein, 21 aa, Mycobacterium avium
TAPMWELLPMKVSGPDGRLLA

SEQ ID NO: 134797 - protein, 18 aa, Mycobacterium avium
TAQLLPRPIGLIIGLQLS

SEQ ID NO: 134798 - protein, 23 aa, Mycobacterium avium
TAVLPGRPPLATLFLPHNRGKKS

SEQ ID NO: 134799 - protein, 23 aa, Mycobacterium avium
TCPEWVYFWLGAARIGAVSAAIN

SEQ ID NO: 134800 - protein, 23 aa, Mycobacterium avium
TDLAWARITYWRALLAAAVDLAP

SEQ ID NO: 134801 - protein, 23 aa, Mycobacterium avium
TEPRTWLLLVTGKLAFADARRTG

SEQ ID NO: 134802 - protein, 21 aa, Mycobacterium avium
TEYPLLGPWGAARVFGPQKGA

SEQ ID NO: 134803 - protein, 21 aa, Mycobacterium avium
TFEYQALLFIPSHAPFDLFNR

SEQ ID NO: 134804 - protein, 20 aa, Mycobacterium avium
TFPSWPLAHPFRRIAHNGEI

SEQ ID NO: 134805 - protein, 17 aa, Mycobacterium avium
TGDFRFFAAPGSWTLRA

SEQ ID NO: 134806 - protein, 30 aa, Mycobacterium avium
TGIDPAAVSPWWLQRRLLLSGIRATSPAVD

SEQ ID NO: 134807 - protein, 21 aa, Mycobacterium avium
TGQFLWQNIFGVWPVTGEVTA

SEQ ID NO: 134808 - protein, 23 aa, Mycobacterium avium
TGSPFWLRTARTLSFDPLTDVHT

SEQ ID NO: 134809 - protein, 25 aa, Mycobacterium avium
TKGTDPYFFLLQSLATAGLSPADIE

SEQ ID NO: 134810 - protein, 22 aa, Mycobacterium avium
TLDTLLRLLHPVIPFITEALWQ

SEQ ID NO: 134811 - protein, 22 aa, Mycobacterium avium
TLFESLLPRYLTTRVYAALLES

SEQ ID NO: 134812 - protein, 23 aa, Mycobacterium avium
TLGRVLFNELLPVGYPFVNKQMH

SEQ ID NO: 134813 - protein, 27 aa, Mycobacterium avium
TNGWIGHRTLWIPSLLLHTVGAKTGKP

SEQ ID NO: 134814 - protein, 20 aa, Mycobacterium avium
TPLDARYWRRHSRQPVQFAE

SEQ ID NO: 134815 - protein, 19 aa, Mycobacterium avium
TPLGRWWRDMKLARVGGGT

SEQ ID NO: 134816 - protein, 18 aa, Mycobacterium avium
TPMDFLRDTLLWAKLIDK

SEQ ID NO: 134817 - protein, 17 aa, Mycobacterium avium
TPWVWPTMHLNPPNWIA

SEQ ID NO: 134818 - protein, 20 aa, Mycobacterium avium
TPYPPARLEKWWLPGPDRLL

SEQ ID NO: 134819 - protein, 29 aa, Mycobacterium avium
TPYSRMWGAYLTGMWLYRLSLAKAKWHAL

SEQ ID NO: 134820 - protein, 24 aa, Mycobacterium avium
TSKLRFNFFVLKLPIRPPALVAKQ

SEQ ID NO: 134821 - protein, 24 aa, Mycobacterium avium
TSLQLLLTFPFPNFGIKQAVRGDY

SEQ ID NO: 134822 - protein, 21 aa, Mycobacterium avium
TTDPVLAWLYVLDAWEGGLPS

SEQ ID NO: 134823 - protein, 19 aa, Mycobacterium avium
TTNPPVEGAFYWLNNREVR

SEQ ID NO: 134824 - protein, 23 aa, Mycobacterium avium
TVARWLVLYLRRPGGQTQFAAPV

SEQ ID NO: 134825 - protein, 17 aa, Mycobacterium avium
TWHPYQVPAFLAAGYRV

SEQ ID NO: 134826 - protein, 17 aa, Mycobacterium avium
TYATWWIRQAITRAMAD

SEQ ID NO: 134827 - protein, 18 aa, Mycobacterium avium
TYRWPMVPALALTAAMPV

SEQ ID NO: 134828 - protein, 24 aa, Mycobacterium avium
VAAADQLILMRLIIGRAARRHGFR

SEQ ID NO: 134829 - protein, 25 aa, Mycobacterium avium
VAFDILRRWLIALGYDVAFIRNVTD

SEQ ID NO: 134830 - protein, 27 aa, Mycobacterium avium
VAPVYLYRFDYSTPLLRLLMVKAAHAT

SEQ ID NO: 134831 - protein, 22 aa, Mycobacterium avium
VATLFRMWLRDAVRRVAAGALD

SEQ ID NO: 134832 - protein, 18 aa, Mycobacterium avium
VCQDFVHLSLMLLRSMGI

SEQ ID NO: 134833 - protein, 24 aa, Mycobacterium avium
VDAPLPTWTHRRLWLTDGGLESPT

SEQ ID NO: 134834 - protein, 22 aa, Mycobacterium avium
VDDALALMYLFASPDADVVGIA

SEQ ID NO: 134835 - protein, 25 aa, Mycobacterium avium
VDRAAFHWWLVLATLRWGVICRYQA

SEQ ID NO: 134836 - protein, 24 aa, Mycobacterium avium
VDVEFSPFFNALPIRRLGLQERAA

SEQ ID NO: 134837 - protein, 20 aa, Mycobacterium avium
VEHAFTWILPLMWRMDAIYE

SEQ ID NO: 134838 - protein, 18 aa, Mycobacterium avium
VERDTCWPWLQAEWRLIS

SEQ ID NO: 134839 - protein, 20 aa, Mycobacterium avium
VFFVNWFRRGDDGGFLWPGF

SEQ ID NO: 134840 - protein, 24 aa, Mycobacterium avium
VFQEPRLLPWRSLAANVAFGLPRG

SEQ ID NO: 134841 - protein, 18 aa, Mycobacterium avium
VFSQLPRFQALALSAANL

SEQ ID NO: 134842 - protein, 18 aa, Mycobacterium avium
VGIVLLLRDVLARSLFEK

SEQ ID NO: 134843 - protein, 17 aa, Mycobacterium avium
VHAGVLLRYVPLTAKRV

SEQ ID NO: 134844 - protein, 23 aa, Mycobacterium avium
VHRKILLPHLSAKRIRIIEEFAT

SEQ ID NO: 134845 - protein, 18 aa, Mycobacterium avium
VIAANRALLLQLLATNFL

SEQ ID NO: 134846 - protein, 19 aa, Mycobacterium avium
VLAEWFLRRFSLLDSLYLI

SEQ ID NO: 134847 - protein, 18 aa, Mycobacterium avium
VLDRLLMPNYLLSALQAI

SEQ ID NO: 134848 - protein, 21 aa, Mycobacterium avium
VLIDLQFATMWISPTRIHDPD

SEQ ID NO: 134849 - protein, 26 aa, Mycobacterium avium
VLIIGAWNYPFYLTLGPAVGAIAAGN

SEQ ID NO: 134850 - protein, 17 aa, Mycobacterium avium
VLLPFLVTRQLICGAGK

SEQ ID NO: 134851 - protein, 18 aa, Mycobacterium avium
VLLVEYWLRAQRDPQLRE

SEQ ID NO: 134852 - protein, 17 aa, Mycobacterium avium
VLSDWWIRRMVVVRQPF

SEQ ID NO: 134853 - protein, 17 aa, Mycobacterium avium
VMAALREPGIGVIAEVK

SEQ ID NO: 134854 - protein, 25 aa, Mycobacterium avium
VNLGRLAWLLRLFGFDVWWSNDADD

SEQ ID NO: 134855 - protein, 24 aa, Mycobacterium avium
VNPKPLKGMPPFSGPQGPFAGITA

SEQ ID NO: 134856 - protein, 26 aa, Mycobacterium avium
VNRVKTWLQFPQWFYFNIPVNTMVAP

SEQ ID NO: 134857 - protein, 24 aa, Mycobacterium avium
VNVDGFWMLQALLDIRHVAPELRC

SEQ ID NO: 134858 - protein, 24 aa, Mycobacterium avium
VPAFSGLFAPYWRSDARGAIVGLS

SEQ ID NO: 134859 - protein, 17 aa, Mycobacterium avium
VPGDIIWAPAIDGAFVL

SEQ ID NO: 134860 - protein, 17 aa, Mycobacterium avium
VPKVWFHDLIRPEGRPF

SEQ ID NO: 134861 - protein, 19 aa, Mycobacterium avium
VPNRAPVPVLWLGAGERVS

SEQ ID NO: 134862 - protein, 20 aa, Mycobacterium avium
VRDWWSMDWIWSALHLDDGT

SEQ ID NO: 134863 - protein, 18 aa, Mycobacterium avium
VRKLFDVNYFGAVDMIKA

SEQ ID NO: 134864 - protein, 18 aa, Mycobacterium avium
VRLMLDQYWPSVPHVLIE

SEQ ID NO: 134865 - protein, 20 aa, Mycobacterium avium
VRLVRQIPYTVACDLLLTGR

SEQ ID NO: 134866 - protein, 28 aa, Mycobacterium avium
VRPVIFSTFLMWLLADLYTQLPEVGDID

SEQ ID NO: 134867 - protein, 17 aa, Mycobacterium avium
VRTRLVELFDLFDPADP

SEQ ID NO: 134868 - protein, 25 aa, Mycobacterium avium
VRYIDRFVMYYIRTADRLQRTAPWV

SEQ ID NO: 134869 - protein, 17 aa, Mycobacterium avium
VSPLAYFRIDGKLLVIG

SEQ ID NO: 134870 - protein, 20 aa, Mycobacterium avium
VSPVTLRQALLGKVLTVGDA

SEQ ID NO: 134871 - protein, 25 aa, Mycobacterium avium
VSQWKNFFIYAPWSAAMAKSSLGAG

SEQ ID NO: 134872 - protein, 18 aa, Mycobacterium avium
VTGNYRAWRHFIAMRASE

SEQ ID NO: 134873 - protein, 17 aa, Mycobacterium avium
VTSIYWYFRKKDDLLNA

SEQ ID NO: 134874 - protein, 19 aa, Mycobacterium avium
VVAVLTPWNFPHCLNVMKL

SEQ ID NO: 134875 - protein, 30 aa, Mycobacterium avium
VVGQIIPWNFPILMGAWKLAPALAAGNAVV

SEQ ID NO: 134876 - protein, 27 aa, Mycobacterium avium
VVLAVMPWNFPLWQAVRFAAPALMAGN

SEQ ID NO: 134877 - protein, 23 aa, Mycobacterium avium
VVLLMWAGILAYLDRYGYDYVTG

SEQ ID NO: 134878 - protein, 18 aa, Mycobacterium avium
VVRFIGVDGYRWMIRCVV

SEQ ID NO: 134879 - protein, 24 aa, Mycobacterium avium
VWLRPFRNLIYAMPPYICPPDEIA

SEQ ID NO: 134880 - protein, 17 aa, Mycobacterium avium
WAELVYDGLWYSPLKAA

SEQ ID NO: 134881 - protein, 18 aa, Mycobacterium avium
WAHRMTVEYLLTAATPFS

SEQ ID NO: 134882 - protein, 17 aa, Mycobacterium avium
WDLLPGYLIFRSIVPTR

SEQ ID NO: 134883 - protein, 17 aa, Mycobacterium avium
WDLPVPALFGQMRLPSA

SEQ ID NO: 134884 - protein, 17 aa, Mycobacterium avium
WEFALLRGALQRGLPVL

SEQ ID NO: 134885 - protein, 19 aa, Mycobacterium avium
WFMRAFRADEWLLYDQSSP

SEQ ID NO: 134886 - protein, 18 aa, Mycobacterium avium
WFNYFSTWGNQFISSGFP

SEQ ID NO: 134887 - protein, 31 aa, Mycobacterium avium
WGIDSWLFYPNFMLLIWEPGWFLTYHYWPTA

SEQ ID NO: 134888 - protein, 21 aa, Mycobacterium avium
WGPTVPLVGAPWFALSERNSP

SEQ ID NO: 134889 - protein, 24 aa, Mycobacterium avium
WHQLARTFLMYRTQRWPDVLLTAA

SEQ ID NO: 134890 - protein, 18 aa, Mycobacterium avium
WIGNIALSFPYLDTEATR

SEQ ID NO: 134891 - protein, 17 aa, Mycobacterium avium
WIYQFRISPHPTIELAS

SEQ ID NO: 134892 - protein, 25 aa, Mycobacterium avium
WKDGEALFLRCNIWREAAENVAESL

SEQ ID NO: 134893 - protein, 18 aa, Mycobacterium avium
WLGRPGLEHGASADLLCF

SEQ ID NO: 134894 - protein, 18 aa, Mycobacterium avium
WMEIEAFRLLTLQTAWKI

SEQ ID NO: 134895 - protein, 19 aa, Mycobacterium avium
WRDGAWYTARLCPAPLLPE

SEQ ID NO: 134896 - protein, 23 aa, Mycobacterium avium
WRDPRVWWQLRNPFRPSWGEPYT

SEQ ID NO: 134897 - protein, 20 aa, Mycobacterium avium
WSLFSRLLPVLPTTVESSGT

SEQ ID NO: 134898 - protein, 18 aa, Mycobacterium avium
WTTLGQYADWIFCLVRTD

SEQ ID NO: 134899 - protein, 18 aa, Mycobacterium avium
WVDANIWRRVVPKGWFYN

SEQ ID NO: 134900 - protein, 17 aa, Mycobacterium avium
YADWIFCLVRTDPQAPK

SEQ ID NO: 134901 - protein, 18 aa, Mycobacterium avium
YAVGLHLLPDLRLQELAL

SEQ ID NO: 134902 - protein, 18 aa, Mycobacterium avium
YDDLKPLLTFIVAGGLAT

SEQ ID NO: 134903 - protein, 19 aa, Mycobacterium avium
YDILFFWVARMMMFGTFVG

SEQ ID NO: 134904 - protein, 18 aa, Mycobacterium avium
YEFFTPLLRNLGHCARVV

SEQ ID NO: 134905 - protein, 17 aa, Mycobacterium avium
YEPTAPMWELLPMKVSG

SEQ ID NO: 134906 - protein, 18 aa, Mycobacterium avium
YESLTGAPMPRWLAGALA

SEQ ID NO: 134907 - protein, 18 aa, Mycobacterium avium
YEWAILDLAILAVGAVTV

SEQ ID NO: 134908 - protein, 24 aa, Mycobacterium avium
YGGTYNLFHYSLAKLGIEVSFVED

SEQ ID NO: 134909 - protein, 18 aa, Mycobacterium avium
YGLNYWYPFQVTALGLGP

SEQ ID NO: 134910 - protein, 19 aa, Mycobacterium avium
YIGFFLCPGAAELSFRAGI

SEQ ID NO: 134911 - protein, 19 aa, Mycobacterium avium
YKGHLYIAGRIKDLVIIDG

SEQ ID NO: 134912 - protein, 18 aa, Mycobacterium avium
YNYPNQLALAKLAPALAA

SEQ ID NO: 134913 - protein, 18 aa, Mycobacterium avium
YPFQHRQYWFSEQRVPPG

SEQ ID NO: 134914 - protein, 18 aa, Mycobacterium avium
YRRFFSITSLAGLRQEDP

SEQ ID NO: 134915 - protein, 24 aa, Mycobacterium avium
YVHPEIEFFLLKPGPDDGTPPVPV

SEQ ID NO: 134916 - protein, 31 aa, Mycobacterium avium
YVTEVRWWGARPLWFALWSGVFERFPGLRWG

SEQ ID NO: 134917 - protein, 24 aa, Mycobacterium avium
YYAMTGWRLGWLLVPVELRRAVEC

SEQ ID NO: 134918 - protein, 28 aa, Mycobacterium avium
YYDKAGLWPYLEKLGFYLVGYGCTTCIG

SEQ ID NO: 134919 - protein, 18 aa, Mycobacterium avium
AAAAPYVAWLSATAGLAE

SEQ ID NO: 134920 - protein, 17 aa, Mycobacterium avium
AAAMIAAITPYLTWMRT

SEQ ID NO: 134921 - protein, 25 aa, Mycobacterium avium
AAFPRYHPRWAWWLTSVPVLREFLV

SEQ ID NO: 134922 - protein, 21 aa, Mycobacterium avium
AAGDGFARYWLHNGWVTMGGE

SEQ ID NO: 134923 - protein, 19 aa, Mycobacterium avium
AAGSYRAFLTWLAERDLDA

SEQ ID NO: 134924 - protein, 17 aa, Mycobacterium avium
AAHFLEHLLFKSTPTRT

SEQ ID NO: 134925 - protein, 24 aa, Mycobacterium avium
AALQLGWRWLPRRLTLEPLAYNRY

SEQ ID NO: 134926 - protein, 24 aa, Mycobacterium avium
AANYFSWIPGCKPTYDRWAEYGGP

SEQ ID NO: 134927 - protein, 18 aa, Mycobacterium avium
AARRWQWHDLDVSRTALV

SEQ ID NO: 134928 - protein, 17 aa, Mycobacterium avium
AAVWLPDADLRDARALP

SEQ ID NO: 134929 - protein, 23 aa, Mycobacterium avium
ADAPALPVLPWMVSAKSAAALRA

SEQ ID NO: 134930 - protein, 23 aa, Mycobacterium avium
ADAPALPVLPWVVSAKSAAALRA

SEQ ID NO: 134931 - protein, 25 aa, Mycobacterium avium
ADATPLFVMLLAESWRWGADEAVIR

SEQ ID NO: 134932 - protein, 17 aa, Mycobacterium avium
ADDPEWLRWNYATVVWG

SEQ ID NO: 134933 - protein, 24 aa, Mycobacterium avium
ADELGLPTAPFWFAGSLGELEAVG

SEQ ID NO: 134934 - protein, 22 aa, Mycobacterium avium
ADLTWLLSRWTCVFGTPACQGT

SEQ ID NO: 134935 - protein, 23 aa, Mycobacterium avium
ADTWADPWPMYRALRDHDPVHHV

SEQ ID NO: 134936 - protein, 20 aa, Mycobacterium avium
ADTYAYFGGAPLFEYTLAQG

SEQ ID NO: 134937 - protein, 20 aa, Mycobacterium avium
ADVIRYLRWFTFLSADELGE

SEQ ID NO: 134938 - protein, 23 aa, Mycobacterium avium
AEIYVPFSWFEPMWLENLGFAPE

SEQ ID NO: 134939 - protein, 18 aa, Mycobacterium avium
AELLLGMRRFLPSSPTSL

SEQ ID NO: 134940 - protein, 22 aa, Mycobacterium avium
AELRLPLVLVIDTAGPALSAEA

SEQ ID NO: 134941 - protein, 18 aa, Mycobacterium avium
AELVLLPGAARALAALNA

SEQ ID NO: 134942 - protein, 18 aa, Mycobacterium avium
AEQPAVRALLTVLLATAD

SEQ ID NO: 134943 - protein, 17 aa, Mycobacterium avium
AEVARLALFLTSPAARH

SEQ ID NO: 134944 - protein, 26 aa, Mycobacterium avium
AEYGGPEWTWQPLLPYLRKSATYHDD

SEQ ID NO: 134945 - protein, 23 aa, Mycobacterium avium
AEYGITWILPRLAGWGAAMDLLL

SEQ ID NO: 134946 - protein, 17 aa, Mycobacterium avium
AFFVLDDWLRPVPPGVV

SEQ ID NO: 134947 - protein, 19 aa, Mycobacterium avium
AFLARLLELAPFSKILYSS

SEQ ID NO: 134948 - protein, 18 aa, Mycobacterium avium
AFVPLPWPDYYGKAPKAR

SEQ ID NO: 134949 - protein, 23 aa, Mycobacterium avium
AGATLFVLDGWLRPVPAGVTGEL

SEQ ID NO: 134950 - protein, 23 aa, Mycobacterium avium
AGVDTFFVATAPRYSFVSSSLAK

SEQ ID NO: 134951 - protein, 17 aa, Mycobacterium avium
AGVIGPLFRSALRAAEV

SEQ ID NO: 134952 - protein, 17 aa, Mycobacterium avium
AHAPYLAWLERASANSA

SEQ ID NO: 134953 - protein, 17 aa, Mycobacterium avium
AHRFADLGALAFAADAA

SEQ ID NO: 134954 - protein, 17 aa, Mycobacterium avium
AHRLITIILMRCGLRIT

SEQ ID NO: 134955 - protein, 18 aa, Mycobacterium avium
AIILHPYIELHLGKPFFT

SEQ ID NO: 134956 - protein, 19 aa, Mycobacterium avium
AIVRPLLRVFFRSWFRVEV

SEQ ID NO: 134957 - protein, 23 aa, Mycobacterium avium
AKATFLRWAWYAARREELHLDGA

SEQ ID NO: 134958 - protein, 19 aa, Mycobacterium avium
AKRRYGYYVWPLLMDGRLA

SEQ ID NO: 134959 - protein, 29 aa, Mycobacterium avium
ALRTEIDNWRWAGVPIFLRAGKALPHKVT

SEQ ID NO: 134960 - protein, 17 aa, Mycobacterium avium
ALSTYRFPTGWFIVAFG

SEQ ID NO: 134961 - protein, 23 aa, Mycobacterium avium
ANLVAMPLFHVGGIGYALFGIRA

SEQ ID NO: 134962 - protein, 20 aa, Mycobacterium avium
ARAPLAAVWLPDADLRDARA

SEQ ID NO: 134963 - protein, 17 aa, Mycobacterium avium
ARLFPQGLARFIGLRDQ

SEQ ID NO: 134964 - protein, 23 aa, Mycobacterium avium
ARRRAFRLWLDERRAALVRLAPG

SEQ ID NO: 134965 - protein, 17 aa, Mycobacterium avium
ARRRGIPVILRPAVLAK

SEQ ID NO: 134966 - protein, 19 aa, Mycobacterium avium
ASLGLLFLASGHRYGWPVA

SEQ ID NO: 134967 - protein, 22 aa, Mycobacterium avium
ASNWALRPFQRISGWTLVCRGE

SEQ ID NO: 134968 - protein, 20 aa, Mycobacterium avium
ASPTYRMALLRWLSVCDIRD

SEQ ID NO: 134969 - protein, 22 aa, Mycobacterium avium
ASQVLLRWNLQLGNAVIFRSAN

SEQ ID NO: 134970 - protein, 19 aa, Mycobacterium avium
ASRRRVEAALAGRLSTAEL

SEQ ID NO: 134971 - protein, 27 aa, Mycobacterium avium
ATERGLLLTTLWYIRVVDPTTLLVTGL

SEQ ID NO: 134972 - protein, 21 aa, Mycobacterium avium
ATFFLTGLFALLATGAHDGAL

SEQ ID NO: 134973 - protein, 28 aa, Mycobacterium avium
ATGSNPIDILAWLLGFNGQSSGGLGGMF

SEQ ID NO: 134974 - protein, 23 aa, Mycobacterium avium
ATRYHSLTILPESLPPVLEVTAH

SEQ ID NO: 134975 - protein, 22 aa, Mycobacterium avium
AVAMLVAIFRARPSPFYIMDEV

SEQ ID NO: 134976 - protein, 18 aa, Mycobacterium avium
AVARWLVVYLKRAGGQSQ

SEQ ID NO: 134977 - protein, 25 aa, Mycobacterium avium
AVDAVSWWILLEDLNIAWALHRAGQ

SEQ ID NO: 134978 - protein, 17 aa, Mycobacterium avium
AVDPLLPEVAWSWLVEA

SEQ ID NO: 134979 - protein, 22 aa, Mycobacterium avium
AVKAVLALLSPYTAMLFMGEEY

SEQ ID NO: 134980 - protein, 24 aa, Mycobacterium avium
AVPVPTLRPPQARVLLIAALAAGL

SEQ ID NO: 134981 - protein, 23 aa, Mycobacterium avium
AWNVPLFLAVNKLGPALLAGCTV

SEQ ID NO: 134982 - protein, 17 aa, Mycobacterium avium
AWRGFSRWLMRAYDVLI

SEQ ID NO: 134983 - protein, 19 aa, Mycobacterium avium
AWTTGLIRWEDDPQPGWYD

SEQ ID NO: 134984 - protein, 24 aa, Mycobacterium avium
AYEDLAWFCIRAWRFGAPAGLGAG

SEQ ID NO: 134985 - protein, 17 aa, Mycobacterium avium
CFAGWLFTEFPPHVLTG

SEQ ID NO: 134986 - protein, 19 aa, Mycobacterium avium
CTVWSNLVLIAGLRNGQLL

SEQ ID NO: 134987 - protein, 25 aa, Mycobacterium avium
CVRAALPLLRKAQWARIVNFSAHST

SEQ ID NO: 134988 - protein, 19 aa, Mycobacterium avium
CYAGPFFRYERPQAGRYRQ

SEQ ID NO: 134989 - protein, 17 aa, Mycobacterium avium
DADWSLFSRLLPVLPTT

SEQ ID NO: 134990 - protein, 27 aa, Mycobacterium avium
DAPGFTVPYYWWTFNMPTDHGEVELTD

SEQ ID NO: 134991 - protein, 23 aa, Mycobacterium avium
DAQTPTLLFPFAAPRVAGDLSEA

SEQ ID NO: 134992 - protein, 18 aa, Mycobacterium avium
DDEFFVIVRPAPSGTRLL

SEQ ID NO: 134993 - protein, 28 aa, Mycobacterium avium
DDTNLRRLISLFELLRARSQLIIITHQK

SEQ ID NO: 134994 - protein, 24 aa, Mycobacterium avium
DDVVLLLYRHPAPLELNFPADVNQ

SEQ ID NO: 134995 - protein, 21 aa, Mycobacterium avium
DEAWWLPSVFIANGGAVAASL

SEQ ID NO: 134996 - protein, 19 aa, Mycobacterium avium
DEDLRWQPPLWRALVARVA

SEQ ID NO: 134997 - protein, 18 aa, Mycobacterium avium
DESPIVFLRLRKAARKHG

SEQ ID NO: 134998 - protein, 26 aa, Mycobacterium avium
DETLDYFLNLMLRAPFRLAREVLPHL

SEQ ID NO: 134999 - protein, 18 aa, Mycobacterium avium
DFQRAYKELAKQVRLPGF

SEQ ID NO: 135000 - protein, 20 aa, Mycobacterium avium
DGKPFHQLPFALTPGPPIPT

SEQ ID NO: 135001 - protein, 18 aa, Mycobacterium avium
DGTPFPTLYYLTHPALTA

SEQ ID NO: 135002 - protein, 25 aa, Mycobacterium avium
DIRALYAFKRLAWWPYSVAMRQVNV

SEQ ID NO: 135003 - protein, 17 aa, Mycobacterium avium
DLLVRLKAWRLDVAKEQ

SEQ ID NO: 135004 - protein, 18 aa, Mycobacterium avium
DLQAQFQLSYLFVSHDLS

SEQ ID NO: 135005 - protein, 19 aa, Mycobacterium avium
DLTIGFFLHIPFPPVELFM

SEQ ID NO: 135006 - protein, 18 aa, Mycobacterium avium
DLVPIFLNALPAPLIEAS

SEQ ID NO: 135007 - protein, 23 aa, Mycobacterium avium
DNPALALMFFLTSSRIFGRGRGV

SEQ ID NO: 135008 - protein, 17 aa, Mycobacterium avium
DNPLHKVVLARALHLVA

SEQ ID NO: 135009 - protein, 27 aa, Mycobacterium avium
DNPQRVWGWYLWRHYLVADVAPNAGHR

SEQ ID NO: 135010 - protein, 17 aa, Mycobacterium avium
DNPWLFDVARTPNPHLG

SEQ ID NO: 135011 - protein, 19 aa, Mycobacterium avium
DPEWLRWNYATVVWGIATA

SEQ ID NO: 135012 - protein, 18 aa, Mycobacterium avium
DPGQWWALVRIGCAGELL

SEQ ID NO: 135013 - protein, 17 aa, Mycobacterium avium
DPLPWLLADRRAVRVTA

SEQ ID NO: 135014 - protein, 24 aa, Mycobacterium avium
DPQGEPFWFPNWTRLVYAGDGLFS

SEQ ID NO: 135015 - protein, 25 aa, Mycobacterium avium
DPTARLHQIWSLLLPGIVSQASLPY

SEQ ID NO: 135016 - protein, 23 aa, Mycobacterium avium
DRRGKYLWLLLDGRDTALVVHLG

SEQ ID NO: 135017 - protein, 17 aa, Mycobacterium avium
DRVLLRFGLHRALRLGK

SEQ ID NO: 135018 - protein, 27 aa, Mycobacterium avium
DSHCAMASQFTLYALGAGGGGTSGPGA

SEQ ID NO: 135019 - protein, 23 aa, Mycobacterium avium
DSIPALHLLPMAGVLGVLPVLAT

SEQ ID NO: 135020 - protein, 23 aa, Mycobacterium avium
DSRLGLFPFRRNLSLFAVDLALL

SEQ ID NO: 135021 - protein, 24 aa, Mycobacterium avium
DSYTELIPFRLTVLHAAWLIDNGD

SEQ ID NO: 135022 - protein, 20 aa, Mycobacterium avium
DVFIGYLRRKLEANGGPRLL

SEQ ID NO: 135023 - protein, 24 aa, Mycobacterium avium
DVGFYGPTGIFIKVGYRGNLVVSG

SEQ ID NO: 135024 - protein, 17 aa, Mycobacterium avium
DWSVRPQPLVPLYLRRP

SEQ ID NO: 135025 - protein, 19 aa, Mycobacterium avium
DYAGFIWYPELPALDLWRD

SEQ ID NO: 135026 - protein, 18 aa, Mycobacterium avium
DYLRPRAVIYHRGLGPKF

SEQ ID NO: 135027 - protein, 24 aa, Mycobacterium avium
EAIDPVLLDLLRLGTYQLLRTRVD

SEQ ID NO: 135028 - protein, 19 aa, Mycobacterium avium
EALARVFDYTLAIGKTPIV

SEQ ID NO: 135029 - protein, 24 aa, Mycobacterium avium
EEPAFDIFALLPPPGDAGLGRIAR

SEQ ID NO: 135030 - protein, 23 aa, Mycobacterium avium
EFKMFYKLPVEGLDIPKSALGAG

SEQ ID NO: 135031 - protein, 18 aa, Mycobacterium avium
EFRQTELFRLLLPARFGG

SEQ ID NO: 135032 - protein, 20 aa, Mycobacterium avium
EGLQPLIFGLWQMISEYQSA

SEQ ID NO: 135033 - protein, 26 aa, Mycobacterium avium
EKMLYDNALLLRVYAHWARRTGDPLA

SEQ ID NO: 135034 - protein, 19 aa, Mycobacterium avium
ELFGHWWYEGPTWLARVLR

SEQ ID NO: 135035 - protein, 17 aa, Mycobacterium avium
ELIYRPLRHPDGPPQPQ

SEQ ID NO: 135036 - protein, 23 aa, Mycobacterium avium
ELRRLIPPWVTLGSRLAALPKPQ

SEQ ID NO: 135037 - protein, 20 aa, Mycobacterium avium
ELSSFQLHWAPSLRPEGGAV

SEQ ID NO: 135038 - protein, 26 aa, Mycobacterium avium
EMARTVLIELLAWQFASPVRWIETQD

SEQ ID NO: 135039 - protein, 23 aa, Mycobacterium avium
EPQWVPPPPFTWDYRLFAGPHPA

SEQ ID NO: 135040 - protein, 18 aa, Mycobacterium avium
EQIDFWRFNVAFARQILA

SEQ ID NO: 135041 - protein, 18 aa, Mycobacterium avium
EQRRWLAPWYSSVPLQSG

SEQ ID NO: 135042 - protein, 17 aa, Mycobacterium avium
ERAELVRWLLAQGITAE

SEQ ID NO: 135043 - protein, 24 aa, Mycobacterium avium
ERDIRFVRLWFTDVLGFLKSVAIA

SEQ ID NO: 135044 - protein, 18 aa, Mycobacterium avium
EREQWWRRAVQAYPPYAE

SEQ ID NO: 135045 - protein, 17 aa, Mycobacterium avium
ERRWGQLMLALYRAGRQ

SEQ ID NO: 135046 - protein, 22 aa, Mycobacterium avium
ESFRLNPAPWLPVYWVFGGFLR

SEQ ID NO: 135047 - protein, 25 aa, Mycobacterium avium
ESVPMYKLRRYFPPDSRPGQPPVGP

SEQ ID NO: 135048 - protein, 17 aa, Mycobacterium avium
ETDQLFGWIAFEFGVYR

SEQ ID NO: 135049 - protein, 24 aa, Mycobacterium avium
ETLIALARLRELIDRYPLRGIKGP

SEQ ID NO: 135050 - protein, 17 aa, Mycobacterium avium
EVIHYWALDGGWDCFAN

SEQ ID NO: 135051 - protein, 17 aa, Mycobacterium avium
FARGLLNRLFTRAYLPG

SEQ ID NO: 135052 - protein, 20 aa, Mycobacterium avium
FDLDWRLSGIPPVAPPLFVH

SEQ ID NO: 135053 - protein, 17 aa, Mycobacterium avium
FDPAIWPVTAHPDEEGR

SEQ ID NO: 135054 - protein, 17 aa, Mycobacterium avium
FDPFWAHRLLWPDRDYR

SEQ ID NO: 135055 - protein, 24 aa, Mycobacterium avium
FDVAKGLPWPARFPSRVLANDFVE

SEQ ID NO: 135056 - protein, 17 aa, Mycobacterium avium
FFLLADFEALNASLVED

SEQ ID NO: 135057 - protein, 17 aa, Mycobacterium avium
FFQVYWLGGRDAIAERV

SEQ ID NO: 135058 - protein, 17 aa, Mycobacterium avium
FGVPPPDVIRRLGALGL

SEQ ID NO: 135059 - protein, 27 aa, Mycobacterium avium
FHAFAVQMNLIGPLWFAIRAYRQMQTQ

SEQ ID NO: 135060 - protein, 18 aa, Mycobacterium avium
FILDGFPRSLQQAKALHE

SEQ ID NO: 135061 - protein, 19 aa, Mycobacterium avium
FKFALLQTRVDEFYLFVCC

SEQ ID NO: 135062 - protein, 25 aa, Mycobacterium avium
FLADKVVRWWLPERWTFVDEIPRTS

SEQ ID NO: 135063 - protein, 19 aa, Mycobacterium avium
FLVPPYTLGAWLGDGTSAA

SEQ ID NO: 135064 - protein, 17 aa, Mycobacterium avium
FLVQHRSRLRRSAAGLP

SEQ ID NO: 135065 - protein, 17 aa, Mycobacterium avium
FMQLPWRTEIVKGLLGA

SEQ ID NO: 135066 - protein, 17 aa, Mycobacterium avium
FPTWLRIATRMAGWSKR

SEQ ID NO: 135067 - protein, 22 aa, Mycobacterium avium
FRAGRIATIPLGRFADPVEIAH

SEQ ID NO: 135068 - protein, 26 aa, Mycobacterium avium
FRGSKNVLLVFFPLAFTGICQGELDQ

SEQ ID NO: 135069 - protein, 23 aa, Mycobacterium avium
FRLAPPAWLDPGQWWALVRIGCA

SEQ ID NO: 135070 - protein, 24 aa, Mycobacterium avium
FSGKPLVLNIFPSIDTPVCATSVR

SEQ ID NO: 135071 - protein, 18 aa, Mycobacterium avium
FTLGFRFKPWRSAKSIAD

SEQ ID NO: 135072 - protein, 18 aa, Mycobacterium avium
FTNDYEWELLLSKTGWSE

SEQ ID NO: 135073 - protein, 18 aa, Mycobacterium avium
FVLDAWLRPVPPGVVGEL

SEQ ID NO: 135074 - protein, 18 aa, Mycobacterium avium
FVLDDWLRPVPPGVVGEL

SEQ ID NO: 135075 - protein, 24 aa, Mycobacterium avium
FVPAARTFELFTRAPFRGASPATR

SEQ ID NO: 135076 - protein, 17 aa, Mycobacterium avium
FWFADAPDRVPGISSPG

SEQ ID NO: 135077 - protein, 17 aa, Mycobacterium avium
FWTSFFRGFWKMGEMRG

SEQ ID NO: 135078 - protein, 17 aa, Mycobacterium avium
FYEGLLGFQFWWEIDPP

SEQ ID NO: 135079 - protein, 25 aa, Mycobacterium avium
FYKWTQWIFLQIYNAWFDPAANKAR

SEQ ID NO: 135080 - protein, 19 aa, Mycobacterium avium
FYSGFYLPMYWSSRAKLTN

SEQ ID NO: 135081 - protein, 20 aa, Mycobacterium avium
GAALRPWRLARVLPATALTL

SEQ ID NO: 135082 - protein, 26 aa, Mycobacterium avium
GAEVQWWFDLPWSTGFVRPQHPIETI

SEQ ID NO: 135083 - protein, 24 aa, Mycobacterium avium
GAFATLRREAPISFWPAIEMDGFV

SEQ ID NO: 135084 - protein, 29 aa, Mycobacterium avium
GAITPWNSPLLLLTWKLAAGLAAGCTFVV

SEQ ID NO: 135085 - protein, 20 aa, Mycobacterium avium
GCSSRFPYYLETYGFHSIHG

SEQ ID NO: 135086 - protein, 18 aa, Mycobacterium avium
GCVPLQRLLREAPAELVG

SEQ ID NO: 135087 - protein, 24 aa, Mycobacterium avium
GDATRLLYTLGWHEVPPQPSNDGV

SEQ ID NO: 135088 - protein, 17 aa, Mycobacterium avium
GDILLIRTGWWTRYLET

SEQ ID NO: 135089 - protein, 18 aa, Mycobacterium avium
GDITLGERLILSSGFVAV

SEQ ID NO: 135090 - protein, 18 aa, Mycobacterium avium
GFALPIALPQRTVASFTP

SEQ ID NO: 135091 - protein, 24 aa, Mycobacterium avium
GFDCSGLVMWAFQQAGISLPHSSQ

SEQ ID NO: 135092 - protein, 23 aa, Mycobacterium avium
GGILLITHYTRILRYIHPEYVHV

SEQ ID NO: 135093 - protein, 20 aa, Mycobacterium avium
GGPRPLVFFPGDGSLVLGTD

SEQ ID NO: 135094 - protein, 18 aa, Mycobacterium avium
GGRRLFVFLGSTIGNLTP

SEQ ID NO: 135095 - protein, 23 aa, Mycobacterium avium
GGVALPMRLALPGAVNRGNAAQA

SEQ ID NO: 135096 - protein, 17 aa, Mycobacterium avium
GHLTALRRTRVGRFGLE

SEQ ID NO: 135097 - protein, 17 aa, Mycobacterium avium
GHLYRLFTKLGINNRDQ

SEQ ID NO: 135098 - protein, 24 aa, Mycobacterium avium
GIERRALRVILGNPLIAITMLRHD

SEQ ID NO: 135099 - protein, 19 aa, Mycobacterium avium
GIFTFGWGPVLHQLAAGLG

SEQ ID NO: 135100 - protein, 18 aa, Mycobacterium avium
GIPSLILWTAGDQPLWGS

SEQ ID NO: 135101 - protein, 24 aa, Mycobacterium avium
GLDGLSLPLLRSWLSAAAAGGVAR

SEQ ID NO: 135102 - protein, 25 aa, Mycobacterium avium
GLDYVDLYLIHWPAPALGTYVNSFG

SEQ ID NO: 135103 - protein, 18 aa, Mycobacterium avium
GLLLLRHVGDLVNTGWPV

SEQ ID NO: 135104 - protein, 17 aa, Mycobacterium avium
GLLLRLQRQLGLTYLFV

SEQ ID NO: 135105 - protein, 20 aa, Mycobacterium avium
GLMQPWRFIRITDAALRRRI

SEQ ID NO: 135106 - protein, 22 aa, Mycobacterium avium
GLRNLYLLPSSPLQELRKLLPE

SEQ ID NO: 135107 - protein, 19 aa, Mycobacterium avium
GLYMLHRLRQLGIPARVLE

SEQ ID NO: 135108 - protein, 21 aa, Mycobacterium avium
GMPFAFLGKPRRWLRRVPPRY

SEQ ID NO: 135109 - protein, 24 aa, Mycobacterium avium
GPAIRFLLIELPDAHWRLVLTAHH

SEQ ID NO: 135110 - protein, 25 aa, Mycobacterium avium
GPMDRFHRRLLWPIRSSAGEVIGFG

SEQ ID NO: 135111 - protein, 23 aa, Mycobacterium avium
GRKPWLPHFYLGHGIGTYPAEAP

SEQ ID NO: 135112 - protein, 25 aa, Mycobacterium avium
GRKRSHWMWFVFPQLRGLGGSAMAD

SEQ ID NO: 135113 - protein, 18 aa, Mycobacterium avium
GTLKLMRPLFSAGLGGRL

SEQ ID NO: 135114 - protein, 19 aa, Mycobacterium avium
GVMWACVFMRTGARRVHFG

SEQ ID NO: 135115 - protein, 23 aa, Mycobacterium avium
GVNLTFLPFIARAVIDALKIHPN

SEQ ID NO: 135116 - protein, 26 aa, Mycobacterium avium
GYAERMLLSAPLLLPIPNGLDVKHAA

SEQ ID NO: 135117 - protein, 20 aa, Mycobacterium avium
GYPVLVRPSYVLGGRGMEIV

SEQ ID NO: 135118 - protein, 18 aa, Mycobacterium avium
HAFFVPPVIARFLDAGEA

SEQ ID NO: 135119 - protein, 18 aa, Mycobacterium avium
HFALAPQGTLFLGHAEML

SEQ ID NO: 135120 - protein, 17 aa, Mycobacterium avium
HFLEHLLFKSTPTRTAV

SEQ ID NO: 135121 - protein, 17 aa, Mycobacterium avium
HGEPSWSYLYRKMIPVL

SEQ ID NO: 135122 - protein, 17 aa, Mycobacterium avium
HGRDEIWRFTPLRRLRG

SEQ ID NO: 135123 - protein, 20 aa, Mycobacterium avium
HIGGIPYLLKLRPDIPVVGS

SEQ ID NO: 135124 - protein, 23 aa, Mycobacterium avium
HKNLTMFLVPLDSPGIEIQGIRT

SEQ ID NO: 135125 - protein, 17 aa, Mycobacterium avium
HLDYAYYNPLSLVIRDQ

SEQ ID NO: 135126 - protein, 17 aa, Mycobacterium avium
HMLIDALAARLRVAQRN

SEQ ID NO: 135127 - protein, 18 aa, Mycobacterium avium
HRFLAHLPGYQGWQWAVV

SEQ ID NO: 135128 - protein, 21 aa, Mycobacterium avium
HTRGPWRLIIAQHFASADELM

SEQ ID NO: 135129 - protein, 25 aa, Mycobacterium avium
HTTARLRLVPLRWALACLLIDIGSV

SEQ ID NO: 135130 - protein, 17 aa, Mycobacterium avium
ICQMFHTLPIPWVEPID

SEQ ID NO: 135131 - protein, 26 aa, Mycobacterium avium
IDVNYLGPVRLLLGLLPAMRDNGRGH

SEQ ID NO: 135132 - protein, 22 aa, Mycobacterium avium
IGFAVAFCYARFVRRGRKAPGF

SEQ ID NO: 135133 - protein, 17 aa, Mycobacterium avium
IGWTCRDVWWAATQDPR

SEQ ID NO: 135134 - protein, 17 aa, Mycobacterium avium
IHRLFDDLEFRVLRDRL

SEQ ID NO: 135135 - protein, 24 aa, Mycobacterium avium
IIRQPIPPFKWWRGLRARQLLEDY

SEQ ID NO: 135136 - protein, 17 aa, Mycobacterium avium
ILPLTPLQQGLLFHASF

SEQ ID NO: 135137 - protein, 26 aa, Mycobacterium avium
INWTIRTLRFILQELPLLLQVGLSLS

SEQ ID NO: 135138 - protein, 19 aa, Mycobacterium avium
IPLVVLIWEDGGYGLIEWK

SEQ ID NO: 135139 - protein, 18 aa, Mycobacterium avium
IQLTAFLRGLPADGWLRI

SEQ ID NO: 135140 - protein, 26 aa, Mycobacterium avium
IVPWNMPQFLIVTKLIPALLAGCTVV

SEQ ID NO: 135141 - protein, 18 aa, Mycobacterium avium
IVWKLWNSQWVHGRHPRI

SEQ ID NO: 135142 - protein, 18 aa, Mycobacterium avium
IWYPELPALDLWRDLYRR

SEQ ID NO: 135143 - protein, 17 aa, Mycobacterium avium
IYLAGRTADWMRVDGEN

SEQ ID NO: 135144 - protein, 25 aa, Mycobacterium avium
KDGRWIQLVFLQPDKYWAGFCRRIG

SEQ ID NO: 135145 - protein, 17 aa, Mycobacterium avium
KELFLGRFPLELIHPFP

SEQ ID NO: 135146 - protein, 21 aa, Mycobacterium avium
KERWPAFWDWAYKSLPNDSRM

SEQ ID NO: 135147 - protein, 19 aa, Mycobacterium avium
KETLRLHPPLIILMRVAKG

SEQ ID NO: 135148 - protein, 18 aa, Mycobacterium avium
KFGFLLEAFTFGAPPHGG

SEQ ID NO: 135149 - protein, 18 aa, Mycobacterium avium
KFPTARLVVFKLSGDFDP

SEQ ID NO: 135150 - protein, 17 aa, Mycobacterium avium
KILGPQFLSRFYGRVIN

SEQ ID NO: 135151 - protein, 30 aa, Mycobacterium avium
KLLARLFGLPYFPVTPLFPLAGPMGLVPLP

SEQ ID NO: 135152 - protein, 23 aa, Mycobacterium avium
KLRPALFVVPTDAPGFSATPIEM

SEQ ID NO: 135153 - protein, 17 aa, Mycobacterium avium
KNLLPMFAVFKPTVVVS

SEQ ID NO: 135154 - protein, 20 aa, Mycobacterium avium
KPFFASLLEFITSGPVVAAI

SEQ ID NO: 135155 - protein, 19 aa, Mycobacterium avium
KRPSPHWWFDPQDGGNLYG

SEQ ID NO: 135156 - protein, 18 aa, Mycobacterium avium
KVLQALTFLRGPRTWVLK

SEQ ID NO: 135157 - protein, 19 aa, Mycobacterium avium
LADYLFPAAKILEPFGLEN

SEQ ID NO: 135158 - protein, 24 aa, Mycobacterium avium
LAEGGWVLPYLPKPWGRGAGPVEQ

SEQ ID NO: 135159 - protein, 24 aa, Mycobacterium avium
LAELSQLRLLPFRLVLDGAREIDA

SEQ ID NO: 135160 - protein, 20 aa, Mycobacterium avium
LAHLGFFVLDGWLRPVPAGV

SEQ ID NO: 135161 - protein, 17 aa, Mycobacterium avium
LANFFRIKPAYFTDDEY

SEQ ID NO: 135162 - protein, 23 aa, Mycobacterium avium
LANMGVIYWVYPNLILANSPVGV

SEQ ID NO: 135163 - protein, 19 aa, Mycobacterium avium
LARTRAWTTLQQDGMLFVW

SEQ ID NO: 135164 - protein, 20 aa, Mycobacterium avium
LAWLHPPGIDFRPALLAGVQ

SEQ ID NO: 135165 - protein, 19 aa, Mycobacterium avium
LCRGHHLLKTFWGWRDRQL

SEQ ID NO: 135166 - protein, 17 aa, Mycobacterium avium
LDAFARWRHARGAPATA

SEQ ID NO: 135167 - protein, 18 aa, Mycobacterium avium
LDALWTALKTLYPVGIDH

SEQ ID NO: 135168 - protein, 24 aa, Mycobacterium avium
LDEWKWWARWRVIRARAGWLTDEL

SEQ ID NO: 135169 - protein, 21 aa, Mycobacterium avium
LDGANLLPPLRPPANANPNIL

SEQ ID NO: 135170 - protein, 18 aa, Mycobacterium avium
LDPVSFTLTLDGGSYQLY

SEQ ID NO: 135171 - protein, 24 aa, Mycobacterium avium
LDRIPQLAWLLFLKAFDGLEENRE

SEQ ID NO: 135172 - protein, 19 aa, Mycobacterium avium
LDVYRNFWTSFFRGFWKMG

SEQ ID NO: 135173 - protein, 23 aa, Mycobacterium avium
LEAWFMHIPGLKVIVPATPRDGK

SEQ ID NO: 135174 - protein, 18 aa, Mycobacterium avium
LEILIYGGWYLLYRYWPT

SEQ ID NO: 135175 - protein, 24 aa, Mycobacterium avium
LFERSAGNLLLLRGFLTAGVESGA

SEQ ID NO: 135176 - protein, 17 aa, Mycobacterium avium
LGEALALLGWNMSLSNL

SEQ ID NO: 135177 - protein, 28 aa, Mycobacterium avium
LGLDYLDLYLIHWPAPKLGKYVESFEGM

SEQ ID NO: 135178 - protein, 20 aa, Mycobacterium avium
LGPRRALTGEPLPPLLPATA

SEQ ID NO: 135179 - protein, 20 aa, Mycobacterium avium
LGRGYRWLQLIDAAGLPVHD

SEQ ID NO: 135180 - protein, 17 aa, Mycobacterium avium
LHFFNPVPVLPLVELVS

SEQ ID NO: 135181 - protein, 18 aa, Mycobacterium avium
LHTVGMLFSPGYPGFLRG

SEQ ID NO: 135182 - protein, 19 aa, Mycobacterium avium
LIRVFLALWGWPLKDPAAE

SEQ ID NO: 135183 - protein, 27 aa, Mycobacterium avium
LLDQGQRLLIFLPLAHVLARSLTLSAF

SEQ ID NO: 135184 - protein, 24 aa, Mycobacterium avium
LLGQWGIRVVPLHILLDGTDLRDG

SEQ ID NO: 135185 - protein, 17 aa, Mycobacterium avium
LLNVPLFGRQPLHPDVD

SEQ ID NO: 135186 - protein, 18 aa, Mycobacterium avium
LLNYYPHLLALSASSPWW

SEQ ID NO: 135187 - protein, 19 aa, Mycobacterium avium
LLRHEILADLRLVPGFSER

SEQ ID NO: 135188 - protein, 18 aa, Mycobacterium avium
LLVAIMPWEGHNYEDAII

SEQ ID NO: 135189 - protein, 24 aa, Mycobacterium avium
LNGDNPFVLVGWSLGGALAYACAI

SEQ ID NO: 135190 - protein, 31 aa, Mycobacterium avium
LNKACDPGLPLMLWAYDPLAFAGKGRAGIAI

SEQ ID NO: 135191 - protein, 24 aa, Mycobacterium avium
LNLELPFPCVWVTGWSREGGRAAA

SEQ ID NO: 135192 - protein, 19 aa, Mycobacterium avium
LPEVILANRLFPALTFGGS

SEQ ID NO: 135193 - protein, 22 aa, Mycobacterium avium
LPTLIVAPYFRSAIEAAIDGWR

SEQ ID NO: 135194 - protein, 20 aa, Mycobacterium avium
LPTPAVAYLTGAYDADFGVM

SEQ ID NO: 135195 - protein, 20 aa, Mycobacterium avium
LPVYRFVLRAYAAQLVQNHA

SEQ ID NO: 135196 - protein, 17 aa, Mycobacterium avium
LPWEVPLIELGLDSLMA

SEQ ID NO: 135197 - protein, 20 aa, Mycobacterium avium
LQIVLPTLLRRVPTLRLAAP

SEQ ID NO: 135198 - protein, 21 aa, Mycobacterium avium
LRAIPWVLAWSQSRVMLPGWY

SEQ ID NO: 135199 - protein, 24 aa, Mycobacterium avium
LRDWRQWWHWVPGASWRHPFGPDS

SEQ ID NO: 135200 - protein, 23 aa, Mycobacterium avium
LREIVGAYFPLGWQLACHVQGDA

SEQ ID NO: 135201 - protein, 17 aa, Mycobacterium avium
LRNRALLELLYSTGARI

SEQ ID NO: 135202 - protein, 21 aa, Mycobacterium avium
LSDAWVWDMYRPARFVKQVRV

SEQ ID NO: 135203 - protein, 20 aa, Mycobacterium avium
LSEGNYRCRVGHAWTAEALL

SEQ ID NO: 135204 - protein, 17 aa, Mycobacterium avium
LTALRRTRVGRFGLEQA

SEQ ID NO: 135205 - protein, 26 aa, Mycobacterium avium
LTDEAIIAFLRLLLPAGLETTYRSSG

SEQ ID NO: 135206 - protein, 17 aa, Mycobacterium avium
LTTLFPPVRPRQWLEIR

SEQ ID NO: 135207 - protein, 28 aa, Mycobacterium avium
LVDRVQFWMLPLDDPLPWLLADRRAVRV

SEQ ID NO: 135208 - protein, 18 aa, Mycobacterium avium
LVFFPGDGSLVLGTDAPD

SEQ ID NO: 135209 - protein, 23 aa, Mycobacterium avium
LVKDLHLPWQWGAHWFLQQLVDG

SEQ ID NO: 135210 - protein, 31 aa, Mycobacterium avium
LVLDDLHWAAKPTLLLLRHLLRFGEHARVQV

SEQ ID NO: 135211 - protein, 17 aa, Mycobacterium avium
LVLQWLERLELADGKLI

SEQ ID NO: 135212 - protein, 19 aa, Mycobacterium avium
LVNPPLLVPVLRAGLGMVD

SEQ ID NO: 135213 - protein, 18 aa, Mycobacterium avium
LWDTILPFAGYAFNKSHA

SEQ ID NO: 135214 - protein, 17 aa, Mycobacterium avium
LYQLILDYPLRGGKALR

SEQ ID NO: 135215 - protein, 17 aa, Mycobacterium avium
LYWVPPQQFTAERARLA

SEQ ID NO: 135216 - protein, 18 aa, Mycobacterium avium
MDGWSLPILLREILAIYY

SEQ ID NO: 135217 - protein, 18 aa, Mycobacterium avium
MEELIAAFLPLLFPGMEI

SEQ ID NO: 135218 - protein, 20 aa, Mycobacterium avium
MGFIYLMQNLPQERISIAVM

SEQ ID NO: 135219 - protein, 23 aa, Mycobacterium avium
MGKTFAFGVPLLQRITAGTAPRA

SEQ ID NO: 135220 - protein, 20 aa, Mycobacterium avium
MGTPWLTSFAQRSPFAEAFR

SEQ ID NO: 135221 - protein, 22 aa, Mycobacterium avium
MLHSPPMYRAFRPDLPAPTRED

SEQ ID NO: 135222 - protein, 19 aa, Mycobacterium avium
MLWQVPYLPIDPKDVGRTY

SEQ ID NO: 135223 - protein, 29 aa, Mycobacterium avium
MRHLPFYGRWYRFLVLWPGSDKGLDAAEA

SEQ ID NO: 135224 - protein, 23 aa, Mycobacterium avium
MRLPKTILMYPMTLASQAAHIVM

SEQ ID NO: 135225 - protein, 25 aa, Mycobacterium avium
NAMWALSIPVPFIKPVGAGAGGYFA

SEQ ID NO: 135226 - protein, 17 aa, Mycobacterium avium
NDFLIAVARMRALDPVT

SEQ ID NO: 135227 - protein, 22 aa, Mycobacterium avium
NDVPFYFHYLGPGAELGGPEIM

SEQ ID NO: 135228 - protein, 18 aa, Mycobacterium avium
NFELPLRPLARVAHVDFD

SEQ ID NO: 135229 - protein, 19 aa, Mycobacterium avium
NFPVFFIQDGIKFPDFVHA

SEQ ID NO: 135230 - protein, 17 aa, Mycobacterium avium
NGPFFLCRAALPQLLER

SEQ ID NO: 135231 - protein, 22 aa, Mycobacterium avium
NGQFPGPLLRFMQGRRTWVDVY

SEQ ID NO: 135232 - protein, 24 aa, Mycobacterium avium
NPHKIAMLGLTFDDVLLLPAASDV

SEQ ID NO: 135233 - protein, 21 aa, Mycobacterium avium
NPLHPLALRLLRPKQVIMLGR

SEQ ID NO: 135234 - protein, 20 aa, Mycobacterium avium
NPVYFALLARRRMDLYGATL

SEQ ID NO: 135235 - protein, 23 aa, Mycobacterium avium
NSTLCSYLNKLLWILTGNFAKRG

SEQ ID NO: 135236 - protein, 18 aa, Mycobacterium avium
NVVHTRGPWRLIIAQHFA

SEQ ID NO: 135237 - protein, 18 aa, Mycobacterium avium
NYAWLNLRKDRQVDLLKV

SEQ ID NO: 135238 - protein, 20 aa, Mycobacterium avium
PALLGVMPMGGDPDSAMFAA

SEQ ID NO: 135239 - protein, 24 aa, Mycobacterium avium
PAMNFFPATLTPIGLKLPFGEVML

SEQ ID NO: 135240 - protein, 20 aa, Mycobacterium avium
PAWDLPTVFGPIAVTYHLTG

SEQ ID NO: 135241 - protein, 26 aa, Mycobacterium avium
PAYQRWLGTRLPYYANWIRLKSYWGT

SEQ ID NO: 135242 - protein, 26 aa, Mycobacterium avium
PDERWALLPLVPLIPKRVFRRLLGVV

SEQ ID NO: 135243 - protein, 20 aa, Mycobacterium avium
PDQGAWLQPFRPLSALLTAR

SEQ ID NO: 135244 - protein, 24 aa, Mycobacterium avium
PDTTIVSWLPFYHDMGLILGVCAP

SEQ ID NO: 135245 - protein, 18 aa, Mycobacterium avium
PEDLPWEVPLIELGLDSL

SEQ ID NO: 135246 - protein, 17 aa, Mycobacterium avium
PELIPLLQSGRLDVDGI

SEQ ID NO: 135247 - protein, 21 aa, Mycobacterium avium
PFHNMVVIYALFPNIVLSVTI

SEQ ID NO: 135248 - protein, 20 aa, Mycobacterium avium
PFPHFRHPIPPPGRGRVTLL

SEQ ID NO: 135249 - protein, 23 aa, Mycobacterium avium
PGAAFFVLDQWLRPVPAGVVGEL

SEQ ID NO: 135250 - protein, 25 aa, Mycobacterium avium
PGFARALWAAPLLTPVMRYAAGRLW

SEQ ID NO: 135251 - protein, 17 aa, Mycobacterium avium
PGGRLYALPPRGRFVLT

SEQ ID NO: 135252 - protein, 18 aa, Mycobacterium avium
PGWPGFVSTPLHAYRRHF

SEQ ID NO: 135253 - protein, 20 aa, Mycobacterium avium
PIVFLRLRKAARKHGVPVYA

SEQ ID NO: 135254 - protein, 18 aa, Mycobacterium avium
PLHKVVLARALHLVADAP

SEQ ID NO: 135255 - protein, 19 aa, Mycobacterium avium
PLIWRKRLLRKAIDFTDPL

SEQ ID NO: 135256 - protein, 18 aa, Mycobacterium avium
PLRINPWALTGRQSYWES

SEQ ID NO: 135257 - protein, 19 aa, Mycobacterium avium
PLTWPLHISLLLAKEYALT

SEQ ID NO: 135258 - protein, 20 aa, Mycobacterium avium
PPLRLLLGSDALSAALAKSH

SEQ ID NO: 135259 - protein, 20 aa, Mycobacterium avium
PPVLLIMGLGAQLLLWRTAF

SEQ ID NO: 135260 - protein, 23 aa, Mycobacterium avium
PPVLRFFGDLLYFDRYWLEEEQV

SEQ ID NO: 135261 - protein, 17 aa, Mycobacterium avium
PQAWAFVWVVDPPLFEP

SEQ ID NO: 135262 - protein, 23 aa, Mycobacterium avium
PQQRAWLNLVRPLTIVEGFALLS

SEQ ID NO: 135263 - protein, 21 aa, Mycobacterium avium
PQRWIDFLRRWDPAGWPSPRA

SEQ ID NO: 135264 - protein, 23 aa, Mycobacterium avium
PRAGELCAAVRFLVRRDSVVIEL

SEQ ID NO: 135265 - protein, 23 aa, Mycobacterium avium
PRGNLAFRWFLADGVPARPEVEL

SEQ ID NO: 135266 - protein, 18 aa, Mycobacterium avium
PRIPMRFPMYLPGPNRVM

SEQ ID NO: 135267 - protein, 18 aa, Mycobacterium avium
PRKVAMRLLLTGEPLSAA

SEQ ID NO: 135268 - protein, 22 aa, Mycobacterium avium
PRTLPLMRVALAWRGRLGKPVR

SEQ ID NO: 135269 - protein, 17 aa, Mycobacterium avium
PSAWSYPPSLPAGDAAM

SEQ ID NO: 135270 - protein, 24 aa, Mycobacterium avium
PSHKLLIRAGYIRPVAPGLYSWLP

SEQ ID NO: 135271 - protein, 26 aa, Mycobacterium avium
PSSMSMLAAVTPYLTWLTDTATRAEE

SEQ ID NO: 135272 - protein, 17 aa, Mycobacterium avium
PSWLPEAPSVADLGWSD

SEQ ID NO: 135273 - protein, 24 aa, Mycobacterium avium
PTAEAYLGLLRFLLGLDLVDRVQF

SEQ ID NO: 135274 - protein, 24 aa, Mycobacterium avium
PTEFTLLRYFVINAGTVLSKPKIL

SEQ ID NO: 135275 - protein, 19 aa, Mycobacterium avium
PTFVLFTTGFLEAGYRRFL

SEQ ID NO: 135276 - protein, 28 aa, Mycobacterium avium
PTQLPMMLSFLDFRKIPLNGLWAETKFG

SEQ ID NO: 135277 - protein, 22 aa, Mycobacterium avium
PTRMFTVLFALGRLPGWIAHWR

SEQ ID NO: 135278 - protein, 19 aa, Mycobacterium avium
PTRVWGVPAAGLWAHRLGD

SEQ ID NO: 135279 - protein, 21 aa, Mycobacterium avium
PVAPGLYSWLPLGLRVLRRIE

SEQ ID NO: 135280 - protein, 24 aa, Mycobacterium avium
PVGFKWFVDGLIGGTLGFGGEESA

SEQ ID NO: 135281 - protein, 19 aa, Mycobacterium avium
PVIDKDVRRWWRSDSLWQA

SEQ ID NO: 135282 - protein, 20 aa, Mycobacterium avium
PVRSFLLRLGGIRAVGYSPE

SEQ ID NO: 135283 - protein, 24 aa, Mycobacterium avium
PWYLVRYWRLLKFKLANPHIITRG

SEQ ID NO: 135284 - protein, 22 aa, Mycobacterium avium
PYQLSWWVNRFLEIFQTIGRDL

SEQ ID NO: 135285 - protein, 25 aa, Mycobacterium avium
QASGRIKLAWFLLNAARYMPVLVYA

SEQ ID NO: 135286 - protein, 18 aa, Mycobacterium avium
QEGMGFIYLMQNLPQERI

SEQ ID NO: 135287 - protein, 23 aa, Mycobacterium avium
QESTLGLIFHWAKERNWPLVTTD

SEQ ID NO: 135288 - protein, 19 aa, Mycobacterium avium
QFFNEFYALDLVLTQTPSG

SEQ ID NO: 135289 - protein, 20 aa, Mycobacterium avium
QFPALINYFIAWQTYRIINW

SEQ ID NO: 135290 - protein, 21 aa, Mycobacterium avium
QGCLQRLWWLHSGPGEPRVLA

SEQ ID NO: 135291 - protein, 17 aa, Mycobacterium avium
QGFPLPWQLVVGALQAQ

SEQ ID NO: 135292 - protein, 19 aa, Mycobacterium avium
QGIALQVPPYIYAHPDDLL

SEQ ID NO: 135293 - protein, 21 aa, Mycobacterium avium
QLLYWTQVLMIARGLSLDDVY

SEQ ID NO: 135294 - protein, 17 aa, Mycobacterium avium
QMWLPYPGDNVLLCLGM

SEQ ID NO: 135295 - protein, 25 aa, Mycobacterium avium
QNDLPAFDRLLASLPWPLNKTTTVD

SEQ ID NO: 135296 - protein, 23 aa, Mycobacterium avium
QPAGWFRFYFADQRWEWSEQVQR

SEQ ID NO: 135297 - protein, 20 aa, Mycobacterium avium
QPLEWFCLFSSAAALVGSPG

SEQ ID NO: 135298 - protein, 25 aa, Mycobacterium avium
QPVDRPIPRPVPRPGAPRPGAPRPG

SEQ ID NO: 135299 - protein, 22 aa, Mycobacterium avium
QQRLWFIDQLLGPSPIYNMAAA

SEQ ID NO: 135300 - protein, 19 aa, Mycobacterium avium
QRVFYGWAQVWRTKSREAE

SEQ ID NO: 135301 - protein, 20 aa, Mycobacterium avium
QRVGRFRFFLDGHRWEWSDA

SEQ ID NO: 135302 - protein, 21 aa, Mycobacterium avium
QSPIVGIWHSGGARLAEGVKA

SEQ ID NO: 135303 - protein, 19 aa, Mycobacterium avium
QSVLLPRLLNWMSYAPDPD

SEQ ID NO: 135304 - protein, 22 aa, Mycobacterium avium
QTPVWTFLGPRPANWWIRRRLH

SEQ ID NO: 135305 - protein, 23 aa, Mycobacterium avium
QTTKLLNNLLFTANLATAATALS

SEQ ID NO: 135306 - protein, 18 aa, Mycobacterium avium
QVALAWLLAKGPDIVPIP

SEQ ID NO: 135307 - protein, 18 aa, Mycobacterium avium
QVGSPYVWGGAAPGGFDC

SEQ ID NO: 135308 - protein, 19 aa, Mycobacterium avium
QWQALSSQFIGAPPSPGPS

SEQ ID NO: 135309 - protein, 19 aa, Mycobacterium avium
QYRELLQDFLFGLDLDEET

SEQ ID NO: 135310 - protein, 19 aa, Mycobacterium avium
RAALFVLDRWLRPAPPGVV

SEQ ID NO: 135311 - protein, 18 aa, Mycobacterium avium
RALLLCYRQRRWYLEGSY

SEQ ID NO: 135312 - protein, 22 aa, Mycobacterium avium
RDGRWYWHWDPAFMTKPGDDPE

SEQ ID NO: 135313 - protein, 25 aa, Mycobacterium avium
RDIICPPLFLQYAILGVSRLDSLRP

SEQ ID NO: 135314 - protein, 17 aa, Mycobacterium avium
RDPMKFPNLIRAGGRRA

SEQ ID NO: 135315 - protein, 25 aa, Mycobacterium avium
RDWGRAFAWMGMPDEYFASSGNAPI

SEQ ID NO: 135316 - protein, 17 aa, Mycobacterium avium
RERFWLGGASLAGAPAG

SEQ ID NO: 135317 - protein, 24 aa, Mycobacterium avium
RERGYAYFLYPPHAPLTETAYDRL

SEQ ID NO: 135318 - protein, 17 aa, Mycobacterium avium
RERIPLVVLIWEDGGYG

SEQ ID NO: 135319 - protein, 17 aa, Mycobacterium avium
RFFLDGHRWEWSDAVAR

SEQ ID NO: 135320 - protein, 18 aa, Mycobacterium avium
RFGEAFWLPDRGWYAVAL

SEQ ID NO: 135321 - protein, 17 aa, Mycobacterium avium
RGPWQLMPDTFAAFHQP

SEQ ID NO: 135322 - protein, 19 aa, Mycobacterium avium
RGYTLRLPLDVLVVASANP

SEQ ID NO: 135323 - protein, 22 aa, Mycobacterium avium
RIERGLWLTALLRATLTVVRGA

SEQ ID NO: 135324 - protein, 17 aa, Mycobacterium avium
RLGPAAARLRLARPLPL

SEQ ID NO: 135325 - protein, 20 aa, Mycobacterium avium
RLIELFLAHFAIRDWDAMAE

SEQ ID NO: 135326 - protein, 17 aa, Mycobacterium avium
RLIGDLENWLVAITGYD

SEQ ID NO: 135327 - protein, 20 aa, Mycobacterium avium
RLITIILMRCGLRITDALRL

SEQ ID NO: 135328 - protein, 23 aa, Mycobacterium avium
RLLDPQHRLLLETAWRAVEHSGT

SEQ ID NO: 135329 - protein, 17 aa, Mycobacterium avium
RLLEHRLQLQRLKRTHL

SEQ ID NO: 135330 - protein, 17 aa, Mycobacterium avium
RLLGFHWTKVHLDQPGL

SEQ ID NO: 135331 - protein, 17 aa, Mycobacterium avium
RLRYPHWVPAAVAPEQV

SEQ ID NO: 135332 - protein, 28 aa, Mycobacterium avium
RLSPEAVFKPRWLWKFGKTLRPPELRVP

SEQ ID NO: 135333 - protein, 17 aa, Mycobacterium avium
RLTRFLIRHSRGAWREP

SEQ ID NO: 135334 - protein, 19 aa, Mycobacterium avium
RLTWRLLPFMWLDIDEAVK

SEQ ID NO: 135335 - protein, 17 aa, Mycobacterium avium
RLVVFKLSGDFDPAQVI

SEQ ID NO: 135336 - protein, 17 aa, Mycobacterium avium
RNTFQLRRPLLTPLPGT

SEQ ID NO: 135337 - protein, 20 aa, Mycobacterium avium
RPAPWWWRPSGALFDQFLGA

SEQ ID NO: 135338 - protein, 21 aa, Mycobacterium avium
RPHTLLMLALAGWARYLRGYD

SEQ ID NO: 135339 - protein, 20 aa, Mycobacterium avium
RPLVAPIWFVVDDGELAFNT

SEQ ID NO: 135340 - protein, 17 aa, Mycobacterium avium
RPQPLVPLYLRRPDATP

SEQ ID NO: 135341 - protein, 18 aa, Mycobacterium avium
RPVAPYFVPVPELDGLPP

SEQ ID NO: 135342 - protein, 23 aa, Mycobacterium avium
RPVPLWQHVLVGKRLFDLFDYRN

SEQ ID NO: 135343 - protein, 25 aa, Mycobacterium avium
RPVVIGPITFLLLSKGVDGAGAPIE

SEQ ID NO: 135344 - protein, 21 aa, Mycobacterium avium
RQLMRAPIWIYRARGGAVFGS

SEQ ID NO: 135345 - protein, 21 aa, Mycobacterium avium
RQVLLPFWNAYSFLALYAPKV

SEQ ID NO: 135346 - protein, 17 aa, Mycobacterium avium
RRALRGYAAWVSGLRRV

SEQ ID NO: 135347 - protein, 25 aa, Mycobacterium avium
RRGARRLVIAPWFLAPGFITDGVST

SEQ ID NO: 135348 - protein, 20 aa, Mycobacterium avium
RRLHWYVPRSIRLIDVFKGL

SEQ ID NO: 135349 - protein, 23 aa, Mycobacterium avium
RRRRCGWFDAVIARYATRVNGIT

SEQ ID NO: 135350 - protein, 25 aa, Mycobacterium avium
RRVGFVFQFFNLLPTLSAWENVAIP

SEQ ID NO: 135351 - protein, 21 aa, Mycobacterium avium
RRWPECILFERGGDGLISHIS

SEQ ID NO: 135352 - protein, 20 aa, Mycobacterium avium
RSSGNPLLLRGFLTAGRDTG

SEQ ID NO: 135353 - protein, 25 aa, Mycobacterium avium
RVEYKLRDWLFARQRYWGEPFPIVY

SEQ ID NO: 135354 - protein, 20 aa, Mycobacterium avium
RVLAALHGWLAPLPPEGASA

SEQ ID NO: 135355 - protein, 25 aa, Mycobacterium avium
RVVEFMLLYRLFPRSVFYSLRLAEH

SEQ ID NO: 135356 - protein, 17 aa, Mycobacterium avium
RWLAPAAKRLAPRRFWR

SEQ ID NO: 135357 - protein, 17 aa, Mycobacterium avium
RWQLLAGSWLDLPGRPA

SEQ ID NO: 135358 - protein, 19 aa, Mycobacterium avium
RWQRLLFDNGWLLPSQPPE

SEQ ID NO: 135359 - protein, 18 aa, Mycobacterium avium
RYKWRKWLYFDCNWKVAL

SEQ ID NO: 135360 - protein, 18 aa, Mycobacterium avium
RYNEVIHYWALDGGWDCF

SEQ ID NO: 135361 - protein, 17 aa, Mycobacterium avium
RYRAWIRWNAAIMVHRA

SEQ ID NO: 135362 - protein, 21 aa, Mycobacterium avium
RYSMDWYYPILGSAVRGPAAA

SEQ ID NO: 135363 - protein, 22 aa, Mycobacterium avium
RYTWPRFVCALPREFFAAVRAE

SEQ ID NO: 135364 - protein, 18 aa, Mycobacterium avium
SAGVPVLRNGRRAFRMPR

SEQ ID NO: 135365 - protein, 21 aa, Mycobacterium avium
SALGALRLIQAFTPALETAHG

SEQ ID NO: 135366 - protein, 22 aa, Mycobacterium avium
SGWIRTWLDTVLELPWNVRTDD

SEQ ID NO: 135367 - protein, 18 aa, Mycobacterium avium
SIAWLIWHSARVQDIQLA

SEQ ID NO: 135368 - protein, 17 aa, Mycobacterium avium
SIPLHRVARPREIAHAI

SEQ ID NO: 135369 - protein, 20 aa, Mycobacterium avium
SIPTLILFKDGQPVKRIVGA

SEQ ID NO: 135370 - protein, 20 aa, Mycobacterium avium
SIVPHTWLWASPLGPGIRAV

SEQ ID NO: 135371 - protein, 20 aa, Mycobacterium avium
SLQLWVMMETPRAFLRAEEV

SEQ ID NO: 135372 - protein, 22 aa, Mycobacterium avium
SLRTQVPLLLDEYTRNPSTGSF

SEQ ID NO: 135373 - protein, 29 aa, Mycobacterium avium
SRLALRLLGPLLRPLLRTILIVQRRLEGR

SEQ ID NO: 135374 - protein, 23 aa, Mycobacterium avium
SRLTFLAVRRWYGWSAGRIINLD

SEQ ID NO: 135375 - protein, 20 aa, Mycobacterium avium
SRLYQLLRYADYNHFDSDIY

SEQ ID NO: 135376 - protein, 22 aa, Mycobacterium avium
SRRYSPWLAYSQSKLANLLFTS

SEQ ID NO: 135377 - protein, 18 aa, Mycobacterium avium
SRVFALLRNARPVLLNFA

SEQ ID NO: 135378 - protein, 19 aa, Mycobacterium avium
SRVPALPRLGPTDALPRCR

SEQ ID NO: 135379 - protein, 26 aa, Mycobacterium avium
SSGVWELFWPDFPIGGLYKFKVHGAD

SEQ ID NO: 135380 - protein, 21 aa, Mycobacterium avium
STLMNSPFWRAGEGGPGDLNP

SEQ ID NO: 135381 - protein, 22 aa, Mycobacterium avium
STPPLLEVVRPATFLFAAGQET

SEQ ID NO: 135382 - protein, 23 aa, Mycobacterium avium
SVVAPLLSRSLILQLRPLSADDI

SEQ ID NO: 135383 - protein, 22 aa, Mycobacterium avium
TALWDLKGKLLGLPVCRLLGMA

SEQ ID NO: 135384 - protein, 22 aa, Mycobacterium avium
TANIALLHFLDGEKRYIIAPQG

SEQ ID NO: 135385 - protein, 19 aa, Mycobacterium avium
TAWLFLQLVIRMLKDGGRC

SEQ ID NO: 135386 - protein, 21 aa, Mycobacterium avium
TAWPATLDRLLALGGPGARYV

SEQ ID NO: 135387 - protein, 19 aa, Mycobacterium avium
TDEAPLLATYAFLPIVRAF

SEQ ID NO: 135388 - protein, 18 aa, Mycobacterium avium
TDIGWLEMLWMQPVGINS

SEQ ID NO: 135389 - protein, 20 aa, Mycobacterium avium
TELFRLLLPARFGGLEASFP

SEQ ID NO: 135390 - protein, 24 aa, Mycobacterium avium
TERPHYMPLFVAPQPLESSDDDGD

SEQ ID NO: 135391 - protein, 26 aa, Mycobacterium avium
TGKGALLQLGLLQLALRLAVENGFVP

SEQ ID NO: 135392 - protein, 25 aa, Mycobacterium avium
TGPMIKFALFRTGSAEYYWFTTCHH

SEQ ID NO: 135393 - protein, 18 aa, Mycobacterium avium
TITPRWLLHLLNWVPVEA

SEQ ID NO: 135394 - protein, 21 aa, Mycobacterium avium
TLLESFLFYSGFYLPMYWSSR

SEQ ID NO: 135395 - protein, 28 aa, Mycobacterium avium
TLPHPLAHLRAFVLIPWLAVDPDARLTV

SEQ ID NO: 135396 - protein, 19 aa, Mycobacterium avium
TLSDLWFQAARRAGFDVAA

SEQ ID NO: 135397 - protein, 24 aa, Mycobacterium avium
TNLKAWLYRILTNTYINSYRKKQR

SEQ ID NO: 135398 - protein, 19 aa, Mycobacterium avium
TPLFFAQAVGRFVRSRRPG

SEQ ID NO: 135399 - protein, 24 aa, Mycobacterium avium
TPMDPALYLLWAQANVVAGYRYSA

SEQ ID NO: 135400 - protein, 17 aa, Mycobacterium avium
TPSLWQPDLFLLRQIHA

SEQ ID NO: 135401 - protein, 22 aa, Mycobacterium avium
TSGLAFMPSALTPTYCASKAAL

SEQ ID NO: 135402 - protein, 25 aa, Mycobacterium avium
TSTDPLSEIWFLLTGQTTLPTSLGS

SEQ ID NO: 135403 - protein, 19 aa, Mycobacterium avium
TTRYAVFVLSPLRINPWAL

SEQ ID NO: 135404 - protein, 19 aa, Mycobacterium avium
VAALRFFWPRLTPGAFVLL

SEQ ID NO: 135405 - protein, 18 aa, Mycobacterium avium
VACTPWYEPFGIVPLEAM

SEQ ID NO: 135406 - protein, 19 aa, Mycobacterium avium
VAGHWLLARLGKRVLRPGG

SEQ ID NO: 135407 - protein, 17 aa, Mycobacterium avium
VAILLPAHWQTAAVLFG

SEQ ID NO: 135408 - protein, 26 aa, Mycobacterium avium
VDDPLAMYLFDLCTLPLNLAGHCGMS

SEQ ID NO: 135409 - protein, 17 aa, Mycobacterium avium
VDELGGFRIAVRRAKIL

SEQ ID NO: 135410 - protein, 17 aa, Mycobacterium avium
VDLVMPVPGFLIKKGSK

SEQ ID NO: 135411 - protein, 18 aa, Mycobacterium avium
VDRALIAAYAGGLVPILC

SEQ ID NO: 135412 - protein, 22 aa, Mycobacterium avium
VEDGALWLLQTRAAERSAQAAV

SEQ ID NO: 135413 - protein, 26 aa, Mycobacterium avium
VFGPVELTLALLPALRRARGQVVFIN

SEQ ID NO: 135414 - protein, 24 aa, Mycobacterium avium
VFSEEFLLQRPLLTAIRRTEPTVL

SEQ ID NO: 135415 - protein, 17 aa, Mycobacterium avium
VGGFPITFGWLHAVRRG

SEQ ID NO: 135416 - protein, 18 aa, Mycobacterium avium
VGHFGLFFLGFGDQQFLS

SEQ ID NO: 135417 - protein, 20 aa, Mycobacterium avium
VGKYWVIDEIRPARIHANVP

SEQ ID NO: 135418 - protein, 18 aa, Mycobacterium avium
VGLIFPWNGPIFNASAKL

SEQ ID NO: 135419 - protein, 17 aa, Mycobacterium avium
VGLLRQQLAPGQLVHGI

SEQ ID NO: 135420 - protein, 21 aa, Mycobacterium avium
VGLRVVPWLWNAPPTDRRYYP

SEQ ID NO: 135421 - protein, 17 aa, Mycobacterium avium
VGNNFPVFFIQDGIKFP

SEQ ID NO: 135422 - protein, 25 aa, Mycobacterium avium
VIGVSLPLLRTLLARVGLSVSALWA

SEQ ID NO: 135423 - protein, 20 aa, Mycobacterium avium
VLGRLHFALAPQGTLFLGHA

SEQ ID NO: 135424 - protein, 18 aa, Mycobacterium avium
VLLKIRLRQGLPVDLLNP

SEQ ID NO: 135425 - protein, 17 aa, Mycobacterium avium
VLMARHMFTLWAPERAG

SEQ ID NO: 135426 - protein, 17 aa, Mycobacterium avium
VMQLTHPAFLILDSPDG

SEQ ID NO: 135427 - protein, 21 aa, Mycobacterium avium
VMTPTAWWRVPMQSLVAGLPT

SEQ ID NO: 135428 - protein, 23 aa, Mycobacterium avium
VQPQPILAPLTPAAIFLVLTVDD

SEQ ID NO: 135429 - protein, 18 aa, Mycobacterium avium
VQRTWPELIPLLQSGRLD

SEQ ID NO: 135430 - protein, 22 aa, Mycobacterium avium
VRKLPIFGGPFRWEDLEWLRSR

SEQ ID NO: 135431 - protein, 21 aa, Mycobacterium avium
VRMVPRRVLLERLLDGFPTGR

SEQ ID NO: 135432 - protein, 17 aa, Mycobacterium avium
VRPIGFEPLSWVRALAA

SEQ ID NO: 135433 - protein, 19 aa, Mycobacterium avium
VRRYIIGCALRWMRDFHAD

SEQ ID NO: 135434 - protein, 21 aa, Mycobacterium avium
VSPDAFFQFPTSKYGLALDNW

SEQ ID NO: 135435 - protein, 19 aa, Mycobacterium avium
VTEAVLWLAGPRSRYVTGV

SEQ ID NO: 135436 - protein, 18 aa, Mycobacterium avium
VTSRLIELFLAHFAIRDW

SEQ ID NO: 135437 - protein, 18 aa, Mycobacterium avium
VVHGRGERLCWWGGPWPV

SEQ ID NO: 135438 - protein, 23 aa, Mycobacterium avium
VVYEPLLKRLPPDTPMYGFERVE

SEQ ID NO: 135439 - protein, 18 aa, Mycobacterium avium
VYALFSNGTNLASAFSST

SEQ ID NO: 135440 - protein, 17 aa, Mycobacterium avium
VYELLWFLRGDSNVDWL

SEQ ID NO: 135441 - protein, 25 aa, Mycobacterium avium
VYGVDPLILRQAYPVPQAPYGLAGS

SEQ ID NO: 135442 - protein, 17 aa, Mycobacterium avium
WAAFARSALFPALVAGL

SEQ ID NO: 135443 - protein, 19 aa, Mycobacterium avium
WAAYALWVFTLFGHPDVRL

SEQ ID NO: 135444 - protein, 23 aa, Mycobacterium avium
WAEKYGFPLMPIDGILVGTAAMA

SEQ ID NO: 135445 - protein, 25 aa, Mycobacterium avium
WCISRQLWWGHRIPIWYGPNGEQRC

SEQ ID NO: 135446 - protein, 20 aa, Mycobacterium avium
WDDLPWLRSLTDLPLIIKGI

SEQ ID NO: 135447 - protein, 18 aa, Mycobacterium avium
WDTDWFWCSRAFGVQNPR

SEQ ID NO: 135448 - protein, 18 aa, Mycobacterium avium
WERWAFAHLPLAKKLYRT

SEQ ID NO: 135449 - protein, 19 aa, Mycobacterium avium
WIAEGLLPYLPPHAQDRLL

SEQ ID NO: 135450 - protein, 18 aa, Mycobacterium avium
WIDVFIARNFHYLTELHC

SEQ ID NO: 135451 - protein, 26 aa, Mycobacterium avium
WKRFNLFNLVWNTLLALLFEWGVGLQ

SEQ ID NO: 135452 - protein, 17 aa, Mycobacterium avium
WLLKQAFYYSLTTINEA

SEQ ID NO: 135453 - protein, 17 aa, Mycobacterium avium
WLLRPLGVDAFLNEIWA

SEQ ID NO: 135454 - protein, 17 aa, Mycobacterium avium
WLPEAPSVADLGWSDAP

SEQ ID NO: 135455 - protein, 20 aa, Mycobacterium avium
WQTAAVLFGVWWIGAEAVLA

SEQ ID NO: 135456 - protein, 23 aa, Mycobacterium avium
WRAGPLLDYLRKMVFWSDVTPAA

SEQ ID NO: 135457 - protein, 23 aa, Mycobacterium avium
WRDGQWYTARLRPGPLRPADRRT

SEQ ID NO: 135458 - protein, 23 aa, Mycobacterium avium
YAPRLWRYWAEHLDPDRARRDDP

SEQ ID NO: 135459 - protein, 17 aa, Mycobacterium avium
YDMSMARLLYWGCDVWL

SEQ ID NO: 135460 - protein, 18 aa, Mycobacterium avium
YEQLPVYALPLFVRVVDS

SEQ ID NO: 135461 - protein, 17 aa, Mycobacterium avium
YFGGAPLFEYTLAQGIE

SEQ ID NO: 135462 - protein, 18 aa, Mycobacterium avium
YFNLSLWSAYDVMLMHTV

SEQ ID NO: 135463 - protein, 18 aa, Mycobacterium avium
YFVLYRPDQRVGDAAAHR

SEQ ID NO: 135464 - protein, 17 aa, Mycobacterium avium
YLTDLFPILELGTSAKM

SEQ ID NO: 135465 - protein, 29 aa, Mycobacterium avium
YNRRSRFPQRWWWVALTDEAFPRLAVVRA

SEQ ID NO: 135466 - protein, 25 aa, Mycobacterium avium
YQFNALFLDPYLWKLQVGGKRLVQK

SEQ ID NO: 135467 - protein, 18 aa, Mycobacterium avium
YRNQMWLPYPGDNVLLCL

SEQ ID NO: 135468 - protein, 20 aa, Mycobacterium avium
YRQGDWVYLPKATTWRQLPD

SEQ ID NO: 135469 - protein, 22 aa, Mycobacterium avium
YSPFASLFYNTEGLPYFSTGMA

SEQ ID NO: 135470 - protein, 31 aa, Mycobacterium avium
YSPIGAIILPGGWWLLSLQALGLAQNAPGVA

SEQ ID NO: 135471 - protein, 19 aa, Mycobacterium avium
YYRVLELAPWLKWPQPNFP

SEQ ID NO: 135472 - protein, 29 aa, Mycobacterium avium
AAAQLVLALGLFLLRDLPAVQLEARQLFR

SEQ ID NO: 135473 - protein, 23 aa, Mycobacterium avium
AACANLRFFLCRACLLCPVIPML

SEQ ID NO: 135474 - protein, 17 aa, Mycobacterium avium
AAFYRRCRLVTERLWPT

SEQ ID NO: 135475 - protein, 20 aa, Mycobacterium avium
AAGDGFARYWLHNGWVTMGG

SEQ ID NO: 135476 - protein, 20 aa, Mycobacterium avium
AAHEFYIRDVLLDWDRDDPN

SEQ ID NO: 135477 - protein, 20 aa, Mycobacterium avium
AAHFLEHLLFKSTPTRTAVD

SEQ ID NO: 135478 - protein, 20 aa, Mycobacterium avium
AAHRPTLLGSATPFFVAFMA

SEQ ID NO: 135479 - protein, 19 aa, Mycobacterium avium
AAIDNRLLWQLDGRDNRLL

SEQ ID NO: 135480 - protein, 21 aa, Mycobacterium avium
AALQLGWRWLPRRLTLEPLAY

SEQ ID NO: 135481 - protein, 17 aa, Mycobacterium avium
AALQTLFPGPAAAPRVC

SEQ ID NO: 135482 - protein, 19 aa, Mycobacterium avium
AALRQYWTAALASIPDLRF

SEQ ID NO: 135483 - protein, 21 aa, Mycobacterium avium
AANYFSWIPGCKPTYDRWAEY

SEQ ID NO: 135484 - protein, 23 aa, Mycobacterium avium
AAPEAFFIAKLEPLGLPVGPERD

SEQ ID NO: 135485 - protein, 18 aa, Mycobacterium avium
AAPGKAWPFGLPSIGAHG

SEQ ID NO: 135486 - protein, 17 aa, Mycobacterium avium
AAQQLPWHPGRCAEVLV

SEQ ID NO: 135487 - protein, 24 aa, Mycobacterium avium
AARRRAFRLWLDERRAALVRLAPG

SEQ ID NO: 135488 - protein, 18 aa, Mycobacterium avium
AASPALLGVMPMGGDPDS

SEQ ID NO: 135489 - protein, 23 aa, Mycobacterium avium
AASPALLGVMPMGGDPDSAMFAA

SEQ ID NO: 135490 - protein, 23 aa, Mycobacterium avium
AAVNFPDVLFIAGKYQVKIPPPF

SEQ ID NO: 135491 - protein, 17 aa, Mycobacterium avium
AAYALWVFTLFGHPDVR

SEQ ID NO: 135492 - protein, 17 aa, Mycobacterium avium
ACVFMRTGARRVHFGET

SEQ ID NO: 135493 - protein, 18 aa, Mycobacterium avium
ACVFMRTGARRVHFGETE

SEQ ID NO: 135494 - protein, 24 aa, Mycobacterium avium
ADATPLFVMLLAESWQWGADEAVI

SEQ ID NO: 135495 - protein, 19 aa, Mycobacterium avium
ADFFAPWGKLAAVRTPTIA

SEQ ID NO: 135496 - protein, 22 aa, Mycobacterium avium
ADLTWLLSRWTCVFGTPACRGT

SEQ ID NO: 135497 - protein, 24 aa, Mycobacterium avium
ADRVLAALHGWLAPLPPEGASAIV

SEQ ID NO: 135498 - protein, 21 aa, Mycobacterium avium
ADVIRYLRWFTFLSADELGEL

SEQ ID NO: 135499 - protein, 19 aa, Mycobacterium avium
AEGLLYERRLFHSTFATAD

SEQ ID NO: 135500 - protein, 24 aa, Mycobacterium avium
AELDRVWRHLPFAAQWHSDNELAR

SEQ ID NO: 135501 - protein, 20 aa, Mycobacterium avium
AELLLGMRRFLPSSPTSLYV

SEQ ID NO: 135502 - protein, 22 aa, Mycobacterium avium
AEQTWLHGWLLRAGPPSGRPAG

SEQ ID NO: 135503 - protein, 25 aa, Mycobacterium avium
AEYDLLRRNQILFTFLHLAASRACT

SEQ ID NO: 135504 - protein, 19 aa, Mycobacterium avium
AEYGGPEWTWQPLLPYLRK

SEQ ID NO: 135505 - protein, 24 aa, Mycobacterium avium
AFARIAPMLWLRAGARGPIITEIG

SEQ ID NO: 135506 - protein, 23 aa, Mycobacterium avium
AFATLRREAPISFWPAIEMDGFV

SEQ ID NO: 135507 - protein, 24 aa, Mycobacterium avium
AFDTELFGHWWYEGPRWLARVLRA

SEQ ID NO: 135508 - protein, 17 aa, Mycobacterium avium
AFFRQYYNLRALLARLD

SEQ ID NO: 135509 - protein, 18 aa, Mycobacterium avium
AFLARLLELAPFSKILYS

SEQ ID NO: 135510 - protein, 17 aa, Mycobacterium avium
AFLGERIGVRRGAVVDA

SEQ ID NO: 135511 - protein, 17 aa, Mycobacterium avium
AFLGERIGVRRGAVVNA

SEQ ID NO: 135512 - protein, 23 aa, Mycobacterium avium
AGASFFVLDPWLCPAPVGVTGEL

SEQ ID NO: 135513 - protein, 25 aa, Mycobacterium avium
AGDLATPLHLFLERLQPAHRAGDRV

SEQ ID NO: 135514 - protein, 26 aa, Mycobacterium avium
AGRRALLELPGPPAVWRLAAGDAGTL

SEQ ID NO: 135515 - protein, 17 aa, Mycobacterium avium
AGVPVLRNGRRAFRMPR

SEQ ID NO: 135516 - protein, 20 aa, Mycobacterium avium
AGVPYFSLAILPGGQRARRA

SEQ ID NO: 135517 - protein, 23 aa, Mycobacterium avium
AHAFNRWLLDDWTFNYQDRIFPV

SEQ ID NO: 135518 - protein, 17 aa, Mycobacterium avium
AHMPYLAWLQLAGALSA

SEQ ID NO: 135519 - protein, 17 aa, Mycobacterium avium
AIASTLLRLRRPRRHRA

SEQ ID NO: 135520 - protein, 22 aa, Mycobacterium avium
AIDNRLLWQLDGRYMQALFGET

SEQ ID NO: 135521 - protein, 18 aa, Mycobacterium avium
AILATALRLLETRPFAGI

SEQ ID NO: 135522 - protein, 18 aa, Mycobacterium avium
AIPIMWVGRQPPGTHTAP

SEQ ID NO: 135523 - protein, 25 aa, Mycobacterium avium
AKGRRTVWIPWALGPAAAVLRMLPQ

SEQ ID NO: 135524 - protein, 20 aa, Mycobacterium avium
AKILPIIAGTLFPNALGEIV

SEQ ID NO: 135525 - protein, 23 aa, Mycobacterium avium
AKVRGIFLALLDRDPCPTPAETL

SEQ ID NO: 135526 - protein, 19 aa, Mycobacterium avium
ALALMFFLTSSRIFGRGRG

SEQ ID NO: 135527 - protein, 23 aa, Mycobacterium avium
ALAWAVYLLLSQPGAWAAAAGDV

SEQ ID NO: 135528 - protein, 23 aa, Mycobacterium avium
ALAWAVYLLLSQPGAWATAAGEV

SEQ ID NO: 135529 - protein, 18 aa, Mycobacterium avium
ALDLRPTAQLPPKSLRRL

SEQ ID NO: 135530 - protein, 19 aa, Mycobacterium avium
ALEPLFAKTLKWASTTPLD

SEQ ID NO: 135531 - protein, 20 aa, Mycobacterium avium
ALGCFAGWLFTEFPPHVLTG

SEQ ID NO: 135532 - protein, 23 aa, Mycobacterium avium
ALKLINNLLFAANAQLLCAATQL

SEQ ID NO: 135533 - protein, 18 aa, Mycobacterium avium
ALLASWWTETWNAGGGDF

SEQ ID NO: 135534 - protein, 20 aa, Mycobacterium avium
ALPLCVLLGGWLRRQVQPRA

SEQ ID NO: 135535 - protein, 17 aa, Mycobacterium avium
ALPRWLAESVRVPRGSV

SEQ ID NO: 135536 - protein, 21 aa, Mycobacterium avium
ALRFWEVMYPSPPPGLAGPDD

SEQ ID NO: 135537 - protein, 18 aa, Mycobacterium avium
ALRQYWTAALASIPDLRF

SEQ ID NO: 135538 - protein, 17 aa, Mycobacterium avium
ALTFLRGPRTWVLKSPQ

SEQ ID NO: 135539 - protein, 24 aa, Mycobacterium avium
ALWATFNGLLALAWRPGGLQESPE

SEQ ID NO: 135540 - protein, 17 aa, Mycobacterium avium
AMLPIPAQAWTLEVMGP

SEQ ID NO: 135541 - protein, 19 aa, Mycobacterium avium
AMLVAIFRARPSPFYIMDE

SEQ ID NO: 135542 - protein, 20 aa, Mycobacterium avium
AMQMALLPERLPAAEALSWG

SEQ ID NO: 135543 - protein, 30 aa, Mycobacterium avium
AMRHLPFYGRWYRFLVLWPGSDKGLDAAEA

SEQ ID NO: 135544 - protein, 20 aa, Mycobacterium avium
ANFTFPMEFTPFQGGWQLSR

SEQ ID NO: 135545 - protein, 20 aa, Mycobacterium avium
ANIALLHFLDGEKRYIIAPQ

SEQ ID NO: 135546 - protein, 26 aa, Mycobacterium avium
ANPKSWWRAALRFGYHMQFAWYVSLA

SEQ ID NO: 135547 - protein, 22 aa, Mycobacterium avium
ANRARLLVLIATNFFGQNTAAI

SEQ ID NO: 135548 - protein, 23 aa, Mycobacterium avium
ANRARLLVLIATNFFGQNTAAIA

SEQ ID NO: 135549 - protein, 20 aa, Mycobacterium avium
APASYFQLAFTRVGLMPDGG

SEQ ID NO: 135550 - protein, 23 aa, Mycobacterium avium
APDDFRWPFNNPGYWMTPMFTLA

SEQ ID NO: 135551 - protein, 20 aa, Mycobacterium avium
APLQTVGWTAAAPQAGVGTV

SEQ ID NO: 135552 - protein, 17 aa, Mycobacterium avium
APRRGWLEALLGHFCDP

SEQ ID NO: 135553 - protein, 22 aa, Mycobacterium avium
APVSVYFGGVHLLAAAGAINAG

SEQ ID NO: 135554 - protein, 17 aa, Mycobacterium avium
AQPALFVFEVALAALWE

SEQ ID NO: 135555 - protein, 19 aa, Mycobacterium avium
ARARFLHRALPDAWNHVVV

SEQ ID NO: 135556 - protein, 21 aa, Mycobacterium avium
ARDGGWWVFGVAAPALADCLR

SEQ ID NO: 135557 - protein, 26 aa, Mycobacterium avium
ARFRDALFPVWRYHPFFTNTDLPTAE

SEQ ID NO: 135558 - protein, 19 aa, Mycobacterium avium
ARIVLFRKPIERRAKDTVE

SEQ ID NO: 135559 - protein, 17 aa, Mycobacterium avium
ARLGGPGSWLLALPAHH

SEQ ID NO: 135560 - protein, 17 aa, Mycobacterium avium
ARLLALRLRRLYYRHRR

SEQ ID NO: 135561 - protein, 17 aa, Mycobacterium avium
ARLPLPCLIGAPVLFGR

SEQ ID NO: 135562 - protein, 17 aa, Mycobacterium avium
ARRLLDAPAVLGLARDG

SEQ ID NO: 135563 - protein, 24 aa, Mycobacterium avium
ARRRGIPVILRPAVLAKLMDGRTT

SEQ ID NO: 135564 - protein, 20 aa, Mycobacterium avium
ARTFELFTRAPFRGASPATR

SEQ ID NO: 135565 - protein, 17 aa, Mycobacterium avium
ARTRAWTTLQQDGMLFV

SEQ ID NO: 135566 - protein, 18 aa, Mycobacterium avium
ASCRCRTARWPRWRPMFA

SEQ ID NO: 135567 - protein, 25 aa, Mycobacterium avium
ASENAFFMLAFTKIGLMPDGGASAL

SEQ ID NO: 135568 - protein, 20 aa, Mycobacterium avium
ASLGLLFLASGHRYGWPVAE

SEQ ID NO: 135569 - protein, 24 aa, Mycobacterium avium
ASMSMVAAVMPYIAWMTATAEQCQ

SEQ ID NO: 135570 - protein, 18 aa, Mycobacterium avium
ASNWALRPFQRISGWTLV

SEQ ID NO: 135571 - protein, 17 aa, Mycobacterium avium
ASPALLGVMPMGGDPDS

SEQ ID NO: 135572 - protein, 22 aa, Mycobacterium avium
ASQVLLRWNLQLSNAVIFRSAN

SEQ ID NO: 135573 - protein, 18 aa, Mycobacterium avium
ASRRRVEAALAGRLSTAE

SEQ ID NO: 135574 - protein, 18 aa, Mycobacterium avium
ATALRFLGKGLTWGELHG

SEQ ID NO: 135575 - protein, 17 aa, Mycobacterium avium
ATAWLQLATAALIQLRA

SEQ ID NO: 135576 - protein, 26 aa, Mycobacterium avium
ATERGLLLTTLWYIRVVEPTTLLVTG

SEQ ID NO: 135577 - protein, 26 aa, Mycobacterium avium
ATLERELMFLDRLIGAAKEDLKLNLP

SEQ ID NO: 135578 - protein, 24 aa, Mycobacterium avium
ATLYPVRRMVFVGGLLPVPGHSFV

SEQ ID NO: 135579 - protein, 21 aa, Mycobacterium avium
ATMPYVLALADRGWRAACRSD

SEQ ID NO: 135580 - protein, 22 aa, Mycobacterium avium
ATMPYVLALADRGWRAACRSDH

SEQ ID NO: 135581 - protein, 21 aa, Mycobacterium avium
ATMPYVLALADRGWRAACRSN

SEQ ID NO: 135582 - protein, 25 aa, Mycobacterium avium
ATRAAYFQLAFSKLGLMLDGGASVL

SEQ ID NO: 135583 - protein, 23 aa, Mycobacterium avium
ATRALIATLLLLLRVSPDRRVQP

SEQ ID NO: 135584 - protein, 24 aa, Mycobacterium avium
AVDGVSWRILLQDLNIAWAQHHGG

SEQ ID NO: 135585 - protein, 17 aa, Mycobacterium avium
AVFYRYFADKEDLLAAL

SEQ ID NO: 135586 - protein, 18 aa, Mycobacterium avium
AVGDWMLLAAIQALIDGH

SEQ ID NO: 135587 - protein, 19 aa, Mycobacterium avium
AVHRLDAATLFRLALEKAP

SEQ ID NO: 135588 - protein, 22 aa, Mycobacterium avium
AVKALWDTILPFAGYAFNKSHA

SEQ ID NO: 135589 - protein, 17 aa, Mycobacterium avium
AVKAVLALLSPYTAMLF

SEQ ID NO: 135590 - protein, 17 aa, Mycobacterium avium
AVMPYVSWLTAVAEQCG

SEQ ID NO: 135591 - protein, 17 aa, Mycobacterium avium
AVNFPDVLFIAGKYQVK

SEQ ID NO: 135592 - protein, 21 aa, Mycobacterium avium
AVQAPWPLLRTFAAGPALSRE

SEQ ID NO: 135593 - protein, 17 aa, Mycobacterium avium
AVSVRRWTACGAVCGGP

SEQ ID NO: 135594 - protein, 19 aa, Mycobacterium avium
AWRVNCFGAFLGIRAALER

SEQ ID NO: 135595 - protein, 17 aa, Mycobacterium avium
AWTLGFYALHNWMLSLF

SEQ ID NO: 135596 - protein, 18 aa, Mycobacterium avium
AWTLGFYALHNWMLSLFD

SEQ ID NO: 135597 - protein, 18 aa, Mycobacterium avium
AWWRARAWHRPSCTGRRA

SEQ ID NO: 135598 - protein, 23 aa, Mycobacterium avium
AYEDLAWFCIRAWRFGAPAGFGA

SEQ ID NO: 135599 - protein, 18 aa, Mycobacterium avium
AYERHFFPIYPASTKMQS

SEQ ID NO: 135600 - protein, 19 aa, Mycobacterium avium
AYERHFFPIYPASTKMQSW

SEQ ID NO: 135601 - protein, 19 aa, Mycobacterium avium
CADGYVYLYMTSRAHWHGM

SEQ ID NO: 135602 - protein, 20 aa, Mycobacterium avium
CARRLLDAPAVLGLARDGGW

SEQ ID NO: 135603 - protein, 21 aa, Mycobacterium avium
CARRLLDAPAVLGLARDGGWW

SEQ ID NO: 135604 - protein, 17 aa, Mycobacterium avium
CDLLPGYLIFRCIFSNR

SEQ ID NO: 135605 - protein, 28 aa, Mycobacterium avium
CGRAYSPRFLWLWPNARISVMGGEQAAS

SEQ ID NO: 135606 - protein, 17 aa, Mycobacterium avium
CRGHHLLKTFWGWRDRQ

SEQ ID NO: 135607 - protein, 17 aa, Mycobacterium avium
CSWLPLYHDMGLSFLLA

SEQ ID NO: 135608 - protein, 20 aa, Mycobacterium avium
CTVWSNLVLIAGLRNGQRLL

SEQ ID NO: 135609 - protein, 17 aa, Mycobacterium avium
CVPLQRLLREAPAELVG

SEQ ID NO: 135610 - protein, 18 aa, Mycobacterium avium
CYAGPFFRYERPQAGRYR

SEQ ID NO: 135611 - protein, 23 aa, Mycobacterium avium
DADDPVWLRWNYATVVWGIATAH

SEQ ID NO: 135612 - protein, 19 aa, Mycobacterium avium
DADLLNFSFLLLVAGNETT

SEQ ID NO: 135613 - protein, 18 aa, Mycobacterium avium
DADTSLPLLLIAASLRVG

SEQ ID NO: 135614 - protein, 23 aa, Mycobacterium avium
DAFTYMLLLTLEDLGFCPKGEGG

SEQ ID NO: 135615 - protein, 18 aa, Mycobacterium avium
DALLLDKLNRLTPASAAK

SEQ ID NO: 135616 - protein, 25 aa, Mycobacterium avium
DANLVAMPLFHVGGIGYALFGIRAG

SEQ ID NO: 135617 - protein, 17 aa, Mycobacterium avium
DAWVWDMYRPARFVKQV

SEQ ID NO: 135618 - protein, 24 aa, Mycobacterium avium
DDDRPFFAYLPFQAPHWPLQAPDE

SEQ ID NO: 135619 - protein, 19 aa, Mycobacterium avium
DDEFFVIVRPAPSGTRLLL

SEQ ID NO: 135620 - protein, 26 aa, Mycobacterium avium
DDTLDYFLNLMLRAPFRLAREVLPHL

SEQ ID NO: 135621 - protein, 26 aa, Mycobacterium avium
DDVMFTAMPFFWVGGLITGLHAVIHH

SEQ ID NO: 135622 - protein, 23 aa, Mycobacterium avium
DDVVLLLYRHPAPLELNFPADVN

SEQ ID NO: 135623 - protein, 23 aa, Mycobacterium avium
DELIRRRLLREITPPNDKLAIGY

SEQ ID NO: 135624 - protein, 20 aa, Mycobacterium avium
DEPFLLPAHIDLAALRAKFD

SEQ ID NO: 135625 - protein, 18 aa, Mycobacterium avium
DEPFLLPAHIDLAALRVK

SEQ ID NO: 135626 - protein, 23 aa, Mycobacterium avium
DESPIVFLRLRKAARKHGVPVYA

SEQ ID NO: 135627 - protein, 21 aa, Mycobacterium avium
DEVLRPLRLTRLNPLGLNNAA

SEQ ID NO: 135628 - protein, 19 aa, Mycobacterium avium
DFQRAYKELAKQVRLPGFR

SEQ ID NO: 135629 - protein, 17 aa, Mycobacterium avium
DFSVWEIFGALLRGRRL

SEQ ID NO: 135630 - protein, 18 aa, Mycobacterium avium
DFSVWEIFGALLRGRRLL

SEQ ID NO: 135631 - protein, 20 aa, Mycobacterium avium
DGALWLLQTRAAERSAQAAV

SEQ ID NO: 135632 - protein, 17 aa, Mycobacterium avium
DGDWPSFPLPLGDTWSS

SEQ ID NO: 135633 - protein, 18 aa, Mycobacterium avium
DGFSFLTVMWLEALGFCE

SEQ ID NO: 135634 - protein, 18 aa, Mycobacterium avium
DGHVSLGALWRLYSQYPY

SEQ ID NO: 135635 - protein, 20 aa, Mycobacterium avium
DGVPYFALAILPGGQRARRA

SEQ ID NO: 135636 - protein, 20 aa, Mycobacterium avium
DGVPYFSLAILPGGQRARRA

SEQ ID NO: 135637 - protein, 22 aa, Mycobacterium avium
DGVVPLQFLFSGTVFRAGARGF

SEQ ID NO: 135638 - protein, 17 aa, Mycobacterium avium
DHNMVWDFWTSCPETAH

SEQ ID NO: 135639 - protein, 23 aa, Mycobacterium avium
DIAWLRELWGGPFMLKGVMRVDD

SEQ ID NO: 135640 - protein, 23 aa, Mycobacterium avium
DIICPPLFLQYAILGVSRLDSLR

SEQ ID NO: 135641 - protein, 21 aa, Mycobacterium avium
DLAPLLVFLVGEGSGFITGQL

SEQ ID NO: 135642 - protein, 17 aa, Mycobacterium avium
DLDALIGGFRPLFQALD

SEQ ID NO: 135643 - protein, 24 aa, Mycobacterium avium
DLDEDLRWQPPLWRALLARVAADP

SEQ ID NO: 135644 - protein, 17 aa, Mycobacterium avium
DLDWRLSGTPPVAPPLF

SEQ ID NO: 135645 - protein, 21 aa, Mycobacterium avium
DLELLNCLLLLFMAGLDTVSN

SEQ ID NO: 135646 - protein, 19 aa, Mycobacterium avium
DLFLATLNNVPLTVPIVCA

SEQ ID NO: 135647 - protein, 23 aa, Mycobacterium avium
DLPTLIVAPYFRSAIEAAIDGWR

SEQ ID NO: 135648 - protein, 17 aa, Mycobacterium avium
DLQAQFQLSYLFVSHDL

SEQ ID NO: 135649 - protein, 25 aa, Mycobacterium avium
DLRAWRQWWTWMPGACWRQPFGPGS

SEQ ID NO: 135650 - protein, 20 aa, Mycobacterium avium
DLTIGFFLHIPFPPVELFMQ

SEQ ID NO: 135651 - protein, 19 aa, Mycobacterium avium
DLVPIFLNALPAPLIEASD

SEQ ID NO: 135652 - protein, 17 aa, Mycobacterium avium
DLYFNLSLWSAYDVMLM

SEQ ID NO: 135653 - protein, 18 aa, Mycobacterium avium
DNPALALMFFLTSSRIFG

SEQ ID NO: 135654 - protein, 20 aa, Mycobacterium avium
DNPLHKVVLARALHLVADAP

SEQ ID NO: 135655 - protein, 17 aa, Mycobacterium avium
DPPPCAVGFLPPPLMRT

SEQ ID NO: 135656 - protein, 25 aa, Mycobacterium avium
DPRYILWAAWHRSGLQRRWLSVSER

SEQ ID NO: 135657 - protein, 26 aa, Mycobacterium avium
DPTARLHQIWSLLLPGIVSQASLPYF

SEQ ID NO: 135658 - protein, 17 aa, Mycobacterium avium
DQLIGFFVNILVLRNDM

SEQ ID NO: 135659 - protein, 24 aa, Mycobacterium avium
DQQLRLLRNAFAHPAPPAPAPAPA

SEQ ID NO: 135660 - protein, 22 aa, Mycobacterium avium
DRACSWLPLYHDMGLAFLLTSV

SEQ ID NO: 135661 - protein, 24 aa, Mycobacterium avium
DRDQIRLWLDLLLERRPGEIATTA

SEQ ID NO: 135662 - protein, 23 aa, Mycobacterium avium
DRFMLKDPIYGLGPRLAQLAAGV

SEQ ID NO: 135663 - protein, 17 aa, Mycobacterium avium
DRGWYVRPTLFAAAGNA

SEQ ID NO: 135664 - protein, 23 aa, Mycobacterium avium
DRKKLFRGLFRGTGKYYAGVKWA

SEQ ID NO: 135665 - protein, 18 aa, Mycobacterium avium
DRVLLRFGLHRALRLGKP

SEQ ID NO: 135666 - protein, 18 aa, Mycobacterium avium
DRWYWHWDPQFISGTAAF

SEQ ID NO: 135667 - protein, 23 aa, Mycobacterium avium
DSQLGLFPFRRNLSLFAVDLALL

SEQ ID NO: 135668 - protein, 18 aa, Mycobacterium avium
DSYGRFMRIRVFDCWMHE

SEQ ID NO: 135669 - protein, 23 aa, Mycobacterium avium
DTALWDLKGKLLGLPVCRLLGMA

SEQ ID NO: 135670 - protein, 17 aa, Mycobacterium avium
DTLFLYENYPIDASALL

SEQ ID NO: 135671 - protein, 20 aa, Mycobacterium avium
DTRAYFRGECLRRFGADIAA

SEQ ID NO: 135672 - protein, 25 aa, Mycobacterium avium
DVNYLGPVRLLLGLLPAMRDNGRGH

SEQ ID NO: 135673 - protein, 20 aa, Mycobacterium avium
DVVALWLPSGIDYATCYAAA

SEQ ID NO: 135674 - protein, 21 aa, Mycobacterium avium
DWLIATLLTVGWPKGGHHAVR

SEQ ID NO: 135675 - protein, 19 aa, Mycobacterium avium
DWPSFPLPLGDTWSSTRGD

SEQ ID NO: 135676 - protein, 19 aa, Mycobacterium avium
DYGRMRETWLIHLCTDWMG

SEQ ID NO: 135677 - protein, 24 aa, Mycobacterium avium
DYRGLIGPRCRAVWLLTVRAEHVD

SEQ ID NO: 135678 - protein, 23 aa, Mycobacterium avium
EAFHVDLLWLLEIGSNQKIASWA

SEQ ID NO: 135679 - protein, 18 aa, Mycobacterium avium
EALRWPGRRPGGCSTSAR

SEQ ID NO: 135680 - protein, 27 aa, Mycobacterium avium
EAPGFTVPYYWWTFNMPTDHGEVELTD

SEQ ID NO: 135681 - protein, 23 aa, Mycobacterium avium
EAPLLATYALLPVVQTFAAAAGI

SEQ ID NO: 135682 - protein, 21 aa, Mycobacterium avium
EAYLGLLRFLLGLDLVDRVQF

SEQ ID NO: 135683 - protein, 24 aa, Mycobacterium avium
EEPAFDIFALLPPPGDAGLGRIGR

SEQ ID NO: 135684 - protein, 25 aa, Mycobacterium avium
EERDIRFVRLWFTDVLGFLKSVAIA

SEQ ID NO: 135685 - protein, 20 aa, Mycobacterium avium
EFKMFYKLPVEGLDIPKSAL

SEQ ID NO: 135686 - protein, 24 aa, Mycobacterium avium
EFRQTELFRLLLPARFGGLEASFP

SEQ ID NO: 135687 - protein, 17 aa, Mycobacterium avium
EGKLPPALRAKMAENAR

SEQ ID NO: 135688 - protein, 17 aa, Mycobacterium avium
EGKYIPRLGGLAFRDPD

SEQ ID NO: 135689 - protein, 22 aa, Mycobacterium avium
EGVRFWLRTALDAELLRWSSAV

SEQ ID NO: 135690 - protein, 22 aa, Mycobacterium avium
EGVRLARVLPLPVAMRLILMGK

SEQ ID NO: 135691 - protein, 20 aa, Mycobacterium avium
EILAAYALLRDPARRADYDR

SEQ ID NO: 135692 - protein, 19 aa, Mycobacterium avium
EILNKWWDPATGTWDWPKV

SEQ ID NO: 135693 - protein, 20 aa, Mycobacterium avium
EIRVAFWEKLLAAVRRRTLA

SEQ ID NO: 135694 - protein, 21 aa, Mycobacterium avium
EIYVPFSWFEPMWLENLGFAP

SEQ ID NO: 135695 - protein, 22 aa, Mycobacterium avium
EKIDPYLRPLYDALYDMMDPEV

SEQ ID NO: 135696 - protein, 27 aa, Mycobacterium avium
EKMLYDNALLLRLYAHWARRTCDPLAA

SEQ ID NO: 135697 - protein, 21 aa, Mycobacterium avium
ELNVAFQMLYARYPDITAAGE

SEQ ID NO: 135698 - protein, 20 aa, Mycobacterium avium
ELPPHLEWTAPFGALSAANW

SEQ ID NO: 135699 - protein, 24 aa, Mycobacterium avium
ELSDGTLRFLLWAAALLSPQPPSL

SEQ ID NO: 135700 - protein, 25 aa, Mycobacterium avium
ELSDGTLRFLLWAAALLSPQPPSLM

SEQ ID NO: 135701 - protein, 24 aa, Mycobacterium avium
ELSDGTLRFLLWSAALLSPQPPSL

SEQ ID NO: 135702 - protein, 19 aa, Mycobacterium avium
ELSSFQLHWAPSLRPEGGA

SEQ ID NO: 135703 - protein, 23 aa, Mycobacterium avium
EMNAAGFVAWWRNPSRTAKDSLS

SEQ ID NO: 135704 - protein, 17 aa, Mycobacterium avium
ENLVLFGRLRGLNRRRA

SEQ ID NO: 135705 - protein, 22 aa, Mycobacterium avium
ENLVLFGRLRGLNRRRAKARAD

SEQ ID NO: 135706 - protein, 22 aa, Mycobacterium avium
ENLVLFSRLRGLNRRRAKARAD

SEQ ID NO: 135707 - protein, 23 aa, Mycobacterium avium
ENYRSIWMYLKELEFRQGFIDIP

SEQ ID NO: 135708 - protein, 17 aa, Mycobacterium avium
EPFLLPAHIDLAALRVK

SEQ ID NO: 135709 - protein, 18 aa, Mycobacterium avium
EPQWVPPPPFTWDYRLFA

SEQ ID NO: 135710 - protein, 24 aa, Mycobacterium avium
EQADDVWFPLFRPSADGEPSPLPA

SEQ ID NO: 135711 - protein, 24 aa, Mycobacterium avium
EQADDVWFPLFRPSAVGEPGPLPA

SEQ ID NO: 135712 - protein, 24 aa, Mycobacterium avium
EQADDVWFPLFRPSAVGEPGPLPE

SEQ ID NO: 135713 - protein, 17 aa, Mycobacterium avium
EQIDFWRFNVAFARQIL

SEQ ID NO: 135714 - protein, 20 aa, Mycobacterium avium
EQTWLHGWLLRAGPPPGRPA

SEQ ID NO: 135715 - protein, 21 aa, Mycobacterium avium
EQTWLHGWLLRAGPPPGRPAG

SEQ ID NO: 135716 - protein, 18 aa, Mycobacterium avium
EQVKWWWDSLSDAQQRLL

SEQ ID NO: 135717 - protein, 19 aa, Mycobacterium avium
EQVKWWWDSLSDAQQRLLI

SEQ ID NO: 135718 - protein, 22 aa, Mycobacterium avium
ERGRLLEFDLAGGPPRVLLDNV

SEQ ID NO: 135719 - protein, 21 aa, Mycobacterium avium
ERGVLLRAVWLRPAGGDGVLL

SEQ ID NO: 135720 - protein, 22 aa, Mycobacterium avium
ERITLLHLAPVMLRALLDEITD

SEQ ID NO: 135721 - protein, 28 aa, Mycobacterium avium
ERSLNIDFLLGYLRELLPRRPDLKLIIT

SEQ ID NO: 135722 - protein, 30 aa, Mycobacterium avium
ERSLNIDFLLGYLRELLPRRPDLKLIITSA

SEQ ID NO: 135723 - protein, 20 aa, Mycobacterium avium
ESLWAVLARTLPEPWRVEAL

SEQ ID NO: 135724 - protein, 18 aa, Mycobacterium avium
ETDQLFGWIAFEFGVYRY

SEQ ID NO: 135725 - protein, 20 aa, Mycobacterium avium
ETHGAAVRKLWVSAGPPPCV

SEQ ID NO: 135726 - protein, 24 aa, Mycobacterium avium
ETHTALIRLRWAFAAAVYHGEAPA

SEQ ID NO: 135727 - protein, 25 aa, Mycobacterium avium
ETLIALARLRELIDRYPLRGIKGPM

SEQ ID NO: 135728 - protein, 17 aa, Mycobacterium avium
EVTFYCLDYGGGKLRAL

SEQ ID NO: 135729 - protein, 21 aa, Mycobacterium avium
EVYQFVVLFPSPEQASAFLSA

SEQ ID NO: 135730 - protein, 20 aa, Mycobacterium avium
EWHYFFQNNLRWRNLRKITI

SEQ ID NO: 135731 - protein, 24 aa, Mycobacterium avium
EYDLLRRNQILFTFLHLAASRACT

SEQ ID NO: 135732 - protein, 22 aa, Mycobacterium avium
EYGITWILPRLAGWGAAMDLLL

SEQ ID NO: 135733 - protein, 17 aa, Mycobacterium avium
FAHAGYMFKLWDQLVWG

SEQ ID NO: 135734 - protein, 17 aa, Mycobacterium avium
FAQSRLWFIDQLHGPSP

SEQ ID NO: 135735 - protein, 20 aa, Mycobacterium avium
FATLLPLRIIDDMLGVPREH

SEQ ID NO: 135736 - protein, 17 aa, Mycobacterium avium
FDPFWAHRLLWPDREYR

SEQ ID NO: 135737 - protein, 23 aa, Mycobacterium avium
FDVAKGLPWPARFPSRVLANDFV

SEQ ID NO: 135738 - protein, 17 aa, Mycobacterium avium
FFACGPDPGPQARYIVE

SEQ ID NO: 135739 - protein, 18 aa, Mycobacterium avium
FFNEFYALDLVLTQTPSG

SEQ ID NO: 135740 - protein, 17 aa, Mycobacterium avium
FFVDEFPLTGLGKVAKA

SEQ ID NO: 135741 - protein, 19 aa, Mycobacterium avium
FFVLDQWLRPVPAGVVGEL

SEQ ID NO: 135742 - protein, 17 aa, Mycobacterium avium
FGDLLYFDRYWLEEEQV

SEQ ID NO: 135743 - protein, 21 aa, Mycobacterium avium
FGHVLFTWHLPELWRRFTITL

SEQ ID NO: 135744 - protein, 18 aa, Mycobacterium avium
FGNPWLFDVARTPNPHLG

SEQ ID NO: 135745 - protein, 27 aa, Mycobacterium avium
FHAFAVQMNLIGPLWFAIRTYRQMQTQ

SEQ ID NO: 135746 - protein, 17 aa, Mycobacterium avium
FHDLRHYLASLLIARGC

SEQ ID NO: 135747 - protein, 19 aa, Mycobacterium avium
FIGVDGYRWMIRCVVNGTH

SEQ ID NO: 135748 - protein, 17 aa, Mycobacterium avium
FIVAFPPGGRFGVPGID

SEQ ID NO: 135749 - protein, 24 aa, Mycobacterium avium
FKGRKVIVYFYPAALTPGCTKQAC

SEQ ID NO: 135750 - protein, 17 aa, Mycobacterium avium
FLDRLTSIALPRIRDFR

SEQ ID NO: 135751 - protein, 19 aa, Mycobacterium avium
FLERYGIPILITYGATEFA

SEQ ID NO: 135752 - protein, 18 aa, Mycobacterium avium
FLLPDIPVVVWWPDVAPA

SEQ ID NO: 135753 - protein, 22 aa, Mycobacterium avium
FLLTSVLSGMPLWQAPTGAFSA

SEQ ID NO: 135754 - protein, 17 aa, Mycobacterium avium
FLRTIHEMLLSDAFWDD

SEQ ID NO: 135755 - protein, 24 aa, Mycobacterium avium
FLRTIHEMLLSDAFWDDIFRELSI

SEQ ID NO: 135756 - protein, 17 aa, Mycobacterium avium
FLTPRDSLRQRCVAHRL

SEQ ID NO: 135757 - protein, 19 aa, Mycobacterium avium
FMPIPVRIIAALLGLPESD

SEQ ID NO: 135758 - protein, 19 aa, Mycobacterium avium
FNDFLIVVARMRALDPVTS

SEQ ID NO: 135759 - protein, 23 aa, Mycobacterium avium
FNEKQIEFMLKDTPLRRLTTAED

SEQ ID NO: 135760 - protein, 17 aa, Mycobacterium avium
FNLSLWSAYDVMLMHTV

SEQ ID NO: 135761 - protein, 17 aa, Mycobacterium avium
FPTLYYLTHPALTAAAS

SEQ ID NO: 135762 - protein, 18 aa, Mycobacterium avium
FPVFFIQDGIKFPDFVHA

SEQ ID NO: 135763 - protein, 17 aa, Mycobacterium avium
FPVITNPAGGFGTLASA

SEQ ID NO: 135764 - protein, 18 aa, Mycobacterium avium
FQLAFTRVGLMPDGGASA

SEQ ID NO: 135765 - protein, 21 aa, Mycobacterium avium
FRAGRIATIPLGRFADPVEIA

SEQ ID NO: 135766 - protein, 19 aa, Mycobacterium avium
FRFALFATRRDQFYLFACC

SEQ ID NO: 135767 - protein, 20 aa, Mycobacterium avium
FRRRLILPCLRVGAATLACD

SEQ ID NO: 135768 - protein, 25 aa, Mycobacterium avium
FRSWYIMYFQLPWLPERSASWVLPL

SEQ ID NO: 135769 - protein, 17 aa, Mycobacterium avium
FSHAGYMFKLWDQLVWG

SEQ ID NO: 135770 - protein, 19 aa, Mycobacterium avium
FTNDYEWELLLSKTGWSEA

SEQ ID NO: 135771 - protein, 17 aa, Mycobacterium avium
FVDGLIGGTLGFGGEES

SEQ ID NO: 135772 - protein, 19 aa, Mycobacterium avium
FVGLDALLLDKLNRLTPAS

SEQ ID NO: 135773 - protein, 22 aa, Mycobacterium avium
FVGLRVVPWLWNAPPTDRRYYP

SEQ ID NO: 135774 - protein, 17 aa, Mycobacterium avium
FVIVRPAPSGTRLLLSD

SEQ ID NO: 135775 - protein, 17 aa, Mycobacterium avium
FVLDRWLQPVPAGVVGE

SEQ ID NO: 135776 - protein, 18 aa, Mycobacterium avium
FVPAARTFELFTRAPFRG

SEQ ID NO: 135777 - protein, 18 aa, Mycobacterium avium
FWPDFPIGGLYKFKVHGA

SEQ ID NO: 135778 - protein, 19 aa, Mycobacterium avium
FYASWCRLLPAGVDLYGVT

SEQ ID NO: 135779 - protein, 24 aa, Mycobacterium avium
FYKWTQWIFLQIYNAWFDPAANKA

SEQ ID NO: 135780 - protein, 25 aa, Mycobacterium avium
GAALAAFPRYHPRWAWSLTSVPVLR

SEQ ID NO: 135781 - protein, 19 aa, Mycobacterium avium
GAALRPWRLARVLPTTALT

SEQ ID NO: 135782 - protein, 20 aa, Mycobacterium avium
GADFFAPWGKLAALRTPTIA

SEQ ID NO: 135783 - protein, 26 aa, Mycobacterium avium
GAEVQWWFDLPWSAGFVRPQHPIETI

SEQ ID NO: 135784 - protein, 24 aa, Mycobacterium avium
GALAWAVYLLLSQPGAWATAAGEV

SEQ ID NO: 135785 - protein, 17 aa, Mycobacterium avium
GARFFALRPATQLRWTG

SEQ ID NO: 135786 - protein, 27 aa, Mycobacterium avium
GCILVFHIMPFWYFNAISPAWGQNSDP

SEQ ID NO: 135787 - protein, 18 aa, Mycobacterium avium
GCSSRFPYYLETYGFHSI

SEQ ID NO: 135788 - protein, 24 aa, Mycobacterium avium
GDATRLLYTLGWHEVPPQPSNDGG

SEQ ID NO: 135789 - protein, 18 aa, Mycobacterium avium
GDILLIRTGWWTRYLETG

SEQ ID NO: 135790 - protein, 19 aa, Mycobacterium avium
GDITLGERLILSSGFVAVT

SEQ ID NO: 135791 - protein, 25 aa, Mycobacterium avium
GDKTWLDRILTWPNPFLPIFIQEPG

SEQ ID NO: 135792 - protein, 21 aa, Mycobacterium avium
GDQPFAVWPWAADKLGGAQPT

SEQ ID NO: 135793 - protein, 19 aa, Mycobacterium avium
GDRFPLMPIPSWMDNPIDP

SEQ ID NO: 135794 - protein, 20 aa, Mycobacterium avium
GDRFPLMPIPSWMDNPIDPI

SEQ ID NO: 135795 - protein, 21 aa, Mycobacterium avium
GDVVVLWLPSGIDYATCYAAA

SEQ ID NO: 135796 - protein, 17 aa, Mycobacterium avium
GEILRILRWALLTDEEF

SEQ ID NO: 135797 - protein, 23 aa, Mycobacterium avium
GEPLDWFCLFSSAAALVGSPGQG

SEQ ID NO: 135798 - protein, 17 aa, Mycobacterium avium
GEVWSFPPPEHPLSKLG

SEQ ID NO: 135799 - protein, 24 aa, Mycobacterium avium
GFARALWAAPLLTPVMRYAAGRLW

SEQ ID NO: 135800 - protein, 19 aa, Mycobacterium avium
GFLLWQSAYSEMWFTEAHW

SEQ ID NO: 135801 - protein, 18 aa, Mycobacterium avium
GFLTPRDSLRQRCVAHRL

SEQ ID NO: 135802 - protein, 17 aa, Mycobacterium avium
GFRLGITTDWKSRWYAD

SEQ ID NO: 135803 - protein, 17 aa, Mycobacterium avium
GGDMIAALFAAIETNPT

SEQ ID NO: 135804 - protein, 30 aa, Mycobacterium avium
GGGENPFLPVPLADRFGLSKGLPGLAEWTV

SEQ ID NO: 135805 - protein, 22 aa, Mycobacterium avium
GGILLITHYTRILRYIHPEYVH

SEQ ID NO: 135806 - protein, 24 aa, Mycobacterium avium
GGLGAARFGFPNPAPLAAPPGAAG

SEQ ID NO: 135807 - protein, 26 aa, Mycobacterium avium
GGLGAARFGFPNPAPLAAPPGAPGAD

SEQ ID NO: 135808 - protein, 17 aa, Mycobacterium avium
GGMYRNQMWLPYPGDNV

SEQ ID NO: 135809 - protein, 18 aa, Mycobacterium avium
GGMYRNQMWLPYPGDNVL

SEQ ID NO: 135810 - protein, 23 aa, Mycobacterium avium
GGMYRNQMWLPYPGDNVLLCLGM

SEQ ID NO: 135811 - protein, 23 aa, Mycobacterium avium
GGPRPLVFFPGDGSLVLGTDAPD

SEQ ID NO: 135812 - protein, 20 aa, Mycobacterium avium
GGTLKLMRPLFSAGLGGRLG

SEQ ID NO: 135813 - protein, 18 aa, Mycobacterium avium
GHSVAFFIGTAYGSPETA

SEQ ID NO: 135814 - protein, 17 aa, Mycobacterium avium
GIQVALPDGALLRRRSR

SEQ ID NO: 135815 - protein, 24 aa, Mycobacterium avium
GKLRPALFVLPTDAPGFSATPIEM

SEQ ID NO: 135816 - protein, 19 aa, Mycobacterium avium
GKPFHQLPFALTPGPPIPT

SEQ ID NO: 135817 - protein, 17 aa, Mycobacterium avium
GLDARAYRLAWPAGTTV

SEQ ID NO: 135818 - protein, 18 aa, Mycobacterium avium
GLDARAYRLAWPAGTTVF

SEQ ID NO: 135819 - protein, 18 aa, Mycobacterium avium
GLFPFRRNLAFYGVDLGL

SEQ ID NO: 135820 - protein, 21 aa, Mycobacterium avium
GLLVPIHWGTFRLAPHPWAEP

SEQ ID NO: 135821 - protein, 18 aa, Mycobacterium avium
GLPYDNWHLYANLFHAVM

SEQ ID NO: 135822 - protein, 23 aa, Mycobacterium avium
GLTFNVLLAPLYPAVLLAKQVIT

SEQ ID NO: 135823 - protein, 19 aa, Mycobacterium avium
GLVRLQWVSARTLTIAPKG

SEQ ID NO: 135824 - protein, 27 aa, Mycobacterium avium
GLYSSNPWLYPFGSLYLFGVIDPPVGA

SEQ ID NO: 135825 - protein, 22 aa, Mycobacterium avium
GNAQRWFVVWLGTSNDPVDKVA

SEQ ID NO: 135826 - protein, 24 aa, Mycobacterium avium
GNQARQFFDLRQPGYFATGGPSGT

SEQ ID NO: 135827 - protein, 24 aa, Mycobacterium avium
GPDAIIPPTFLTTAGRWAPAGVRV

SEQ ID NO: 135828 - protein, 24 aa, Mycobacterium avium
GPERILSTGPLLLAAIRALSNGPA

SEQ ID NO: 135829 - protein, 24 aa, Mycobacterium avium
GPGAIIPPTFLTSAARWAPPGVRV

SEQ ID NO: 135830 - protein, 20 aa, Mycobacterium avium
GPLLDYLRKMVFWSDVTPAA

SEQ ID NO: 135831 - protein, 17 aa, Mycobacterium avium
GPRTWPRRWPPPTPEVP

SEQ ID NO: 135832 - protein, 19 aa, Mycobacterium avium
GQALRRPLDPGRPPWECWV

SEQ ID NO: 135833 - protein, 21 aa, Mycobacterium avium
GQFPGPLLRFMQGRRTWVDVY

SEQ ID NO: 135834 - protein, 22 aa, Mycobacterium avium
GQGALPGIGFSGGIIGGLEGAA

SEQ ID NO: 135835 - protein, 27 aa, Mycobacterium avium
GQGASDSFYRTWYPTPLGPVPTPSPNA

SEQ ID NO: 135836 - protein, 23 aa, Mycobacterium avium
GQRLPAPAPYRGFVDWLAERDLD

SEQ ID NO: 135837 - protein, 26 aa, Mycobacterium avium
GRAYSPRFLWMWPNARISVMGGEQAA

SEQ ID NO: 135838 - protein, 23 aa, Mycobacterium avium
GRGPGRFWGVYGLKKAIAVAEVA

SEQ ID NO: 135839 - protein, 24 aa, Mycobacterium avium
GRKPWLPHFYLGHGIGPYPADAPM

SEQ ID NO: 135840 - protein, 25 aa, Mycobacterium avium
GRKRRHWMWFVFPQLRGLGGSAMAD

SEQ ID NO: 135841 - protein, 19 aa, Mycobacterium avium
GRLALPQRLERLLRRWLDA

SEQ ID NO: 135842 - protein, 20 aa, Mycobacterium avium
GRLARYWRLLPNVGAHAFDD

SEQ ID NO: 135843 - protein, 21 aa, Mycobacterium avium
GRLARYWRLLPNVGAHAFDDD

SEQ ID NO: 135844 - protein, 18 aa, Mycobacterium avium
GRLPRWWDRLVTNGFHAV

SEQ ID NO: 135845 - protein, 25 aa, Mycobacterium avium
GRPGPFGEMPLFGGAPLMGLPGRGA

SEQ ID NO: 135846 - protein, 20 aa, Mycobacterium avium
GRWYWHWDPAFMASPTDLPV

SEQ ID NO: 135847 - protein, 18 aa, Mycobacterium avium
GRYGLVGILIQLARQRGV

SEQ ID NO: 135848 - protein, 19 aa, Mycobacterium avium
GSAELYRWADRRPILRGVG

SEQ ID NO: 135849 - protein, 17 aa, Mycobacterium avium
GSNGLYQLILDYPLRGG

SEQ ID NO: 135850 - protein, 18 aa, Mycobacterium avium
GSRFYFLTGKGALLQLGL

SEQ ID NO: 135851 - protein, 19 aa, Mycobacterium avium
GSRFYFLTGKGALLQLGLL

SEQ ID NO: 135852 - protein, 25 aa, Mycobacterium avium
GTEQLSHSFGLIDILPWGRQEEWQD

SEQ ID NO: 135853 - protein, 23 aa, Mycobacterium avium
GTGGVLLPLLLFSSARANTAFTP

SEQ ID NO: 135854 - protein, 19 aa, Mycobacterium avium
GVDHLWLHPVLVGRDRWHE

SEQ ID NO: 135855 - protein, 18 aa, Mycobacterium avium
GVFLPFHLLTLGDMGLML

SEQ ID NO: 135856 - protein, 21 aa, Mycobacterium avium
GVMLSALWVGSTGRLVLIIHH

SEQ ID NO: 135857 - protein, 17 aa, Mycobacterium avium
GVRWTFTAFTGEVPFFE

SEQ ID NO: 135858 - protein, 21 aa, Mycobacterium avium
GVSLPLLRTLLTRVGLSVSAL

SEQ ID NO: 135859 - protein, 26 aa, Mycobacterium avium
GVTSEHPLWLFTLRAQSWTADYGTTA

SEQ ID NO: 135860 - protein, 17 aa, Mycobacterium avium
GVYLTLISPLGRFLLAA

SEQ ID NO: 135861 - protein, 20 aa, Mycobacterium avium
GWFASFIPVTFPVAGASFGD

SEQ ID NO: 135862 - protein, 18 aa, Mycobacterium avium
GWLPPAFTPGMLPAVAPL

SEQ ID NO: 135863 - protein, 21 aa, Mycobacterium avium
GWPDILFYGPGTWGFGNGPNS

SEQ ID NO: 135864 - protein, 25 aa, Mycobacterium avium
GYAERMLLSAPLLLPIPNGLDVKHA

SEQ ID NO: 135865 - protein, 18 aa, Mycobacterium avium
HAFFRQYYNLRALLARLD

SEQ ID NO: 135866 - protein, 25 aa, Mycobacterium avium
HAGYMFKLWDQLVWGSTLVVPPTPW

SEQ ID NO: 135867 - protein, 26 aa, Mycobacterium avium
HAGYMFKLWDQLVWGSTLVVPPTPWS

SEQ ID NO: 135868 - protein, 23 aa, Mycobacterium avium
HDGRIWYRTGDLVRYWPDGTLEF

SEQ ID NO: 135869 - protein, 19 aa, Mycobacterium avium
HDHNMVWDFWTSCPETAHL

SEQ ID NO: 135870 - protein, 22 aa, Mycobacterium avium
HDTWNWLIHVLAQRYGSAFTMS

SEQ ID NO: 135871 - protein, 18 aa, Mycobacterium avium
HEFYIRDVLLDWDRDDPN

SEQ ID NO: 135872 - protein, 21 aa, Mycobacterium avium
HEIVSAYFPLGWQLACHVQGD

SEQ ID NO: 135873 - protein, 32 aa, Mycobacterium avium
HERSLNIDFLLGYLRALLPRRPDLKLIITSAT

SEQ ID NO: 135874 - protein, 20 aa, Mycobacterium avium
HGIVGLMRTLANALAPLNIR

SEQ ID NO: 135875 - protein, 20 aa, Mycobacterium avium
HGNRLLAPNEYIITLGMHDF

SEQ ID NO: 135876 - protein, 26 aa, Mycobacterium avium
HGPAIRFLLIELPGAQWRLVLTAHHI

SEQ ID NO: 135877 - protein, 21 aa, Mycobacterium avium
HIGGIPYLLKLRPDIPVVGSK

SEQ ID NO: 135878 - protein, 17 aa, Mycobacterium avium
HIPSLYRIYPTTDWHER

SEQ ID NO: 135879 - protein, 22 aa, Mycobacterium avium
HKIAMLGLTFDDVLLLPAASDV

SEQ ID NO: 135880 - protein, 17 aa, Mycobacterium avium
HLLTLRDMGLMLGEYWD

SEQ ID NO: 135881 - protein, 19 aa, Mycobacterium avium
HLPELWRRFTITLRRALRR

SEQ ID NO: 135882 - protein, 17 aa, Mycobacterium avium
HLRLPAHVTLLEPAARR

SEQ ID NO: 135883 - protein, 25 aa, Mycobacterium avium
HPSTLHLWWARRPLAAARAVLFAQL

SEQ ID NO: 135884 - protein, 17 aa, Mycobacterium avium
HQMWAAQFISYEKPRTW

SEQ ID NO: 135885 - protein, 26 aa, Mycobacterium avium
HSDYPLQALLYSAVLHRFLRWRLAGY

SEQ ID NO: 135886 - protein, 18 aa, Mycobacterium avium
HSMFPWLTLALVGSSTSH

SEQ ID NO: 135887 - protein, 24 aa, Mycobacterium avium
HTLYRKFEEIFLPKFPPPFRAGDL

SEQ ID NO: 135888 - protein, 26 aa, Mycobacterium avium
HTTARLRLVPLRWALACLLIDIGSVE

SEQ ID NO: 135889 - protein, 18 aa, Mycobacterium avium
HVLMARHMFTLWAPERAG

SEQ ID NO: 135890 - protein, 18 aa, Mycobacterium avium
HWTMRYVVSEGDKVTREF

SEQ ID NO: 135891 - protein, 25 aa, Mycobacterium avium
IAEGGWVLPYLPKPWGRAAGPVEQI

SEQ ID NO: 135892 - protein, 18 aa, Mycobacterium avium
IAFVLLQADRFWADFCTR

SEQ ID NO: 135893 - protein, 17 aa, Mycobacterium avium
IAGWHRFPLRDKVAAVV

SEQ ID NO: 135894 - protein, 20 aa, Mycobacterium avium
IARLVPFIEWLRGAYPDQLI

SEQ ID NO: 135895 - protein, 18 aa, Mycobacterium avium
IAWIGYDPPQVPGFDDIG

SEQ ID NO: 135896 - protein, 18 aa, Mycobacterium avium
ICPAAMPLTGFMAAGGLE

SEQ ID NO: 135897 - protein, 18 aa, Mycobacterium avium
ICQMFHTLPIPWVEPIDI

SEQ ID NO: 135898 - protein, 17 aa, Mycobacterium avium
IDVFIARNFHYLTELHC

SEQ ID NO: 135899 - protein, 26 aa, Mycobacterium avium
IDVTYPLHRYFLWAKQIELSLGSAPQ

SEQ ID NO: 135900 - protein, 23 aa, Mycobacterium avium
IERRALRVILGNPLIAITMLRHD

SEQ ID NO: 135901 - protein, 18 aa, Mycobacterium avium
IFTFGWGPVLHQLAAGLG

SEQ ID NO: 135902 - protein, 22 aa, Mycobacterium avium
IGFTWEHPIHLLLRRARANSVL

SEQ ID NO: 135903 - protein, 20 aa, Mycobacterium avium
IGQALRRPLDPGRPPWECWV

SEQ ID NO: 135904 - protein, 20 aa, Mycobacterium avium
IGQALRRPLHPGRPPWECWV

SEQ ID NO: 135905 - protein, 25 aa, Mycobacterium avium
IGRDRLFLFMSAERWLFKRDGRWRA

SEQ ID NO: 135906 - protein, 21 aa, Mycobacterium avium
IGYPVLVRPSYVLGGRGMEIV

SEQ ID NO: 135907 - protein, 17 aa, Mycobacterium avium
IHSVAVNPLFLVLSGGG

SEQ ID NO: 135908 - protein, 23 aa, Mycobacterium avium
IIRQPIPPFKWWRGLRARQLLED

SEQ ID NO: 135909 - protein, 23 aa, Mycobacterium avium
IKNAIDWLSRPFGDGALKGKPLA

SEQ ID NO: 135910 - protein, 22 aa, Mycobacterium avium
IKSPAELVLLPGAARALAALNA

SEQ ID NO: 135911 - protein, 18 aa, Mycobacterium avium
ILAPLTPAAIFLVLTVDD

SEQ ID NO: 135912 - protein, 17 aa, Mycobacterium avium
ILDGFPRSLQQAKALHE

SEQ ID NO: 135913 - protein, 20 aa, Mycobacterium avium
ILHLPTHWPWADHWITLWCN

SEQ ID NO: 135914 - protein, 22 aa, Mycobacterium avium
ILRDYLTDLFPILELGTSAKML

SEQ ID NO: 135915 - protein, 17 aa, Mycobacterium avium
ILRPSPLTPISSLIFGA

SEQ ID NO: 135916 - protein, 18 aa, Mycobacterium avium
IPGPIGWVGIAASTAWEA

SEQ ID NO: 135917 - protein, 18 aa, Mycobacterium avium
IPVPFIKPVGAGAGGYFA

SEQ ID NO: 135918 - protein, 22 aa, Mycobacterium avium
IRNALPLLRAADWGRIVTFAAH

SEQ ID NO: 135919 - protein, 25 aa, Mycobacterium avium
ISRQVWYQVFAWRPGLIVDLLEAAE

SEQ ID NO: 135920 - protein, 17 aa, Mycobacterium avium
ITQGTFYVLFPDVPPIP

SEQ ID NO: 135921 - protein, 23 aa, Mycobacterium avium
ITRAFRRIVLYEPPIPSLGLDVG

SEQ ID NO: 135922 - protein, 24 aa, Mycobacterium avium
ITRAFRRIVLYEPPIPSLGLDVGS

SEQ ID NO: 135923 - protein, 22 aa, Mycobacterium avium
IVAPMFHAWGFSQLLLAASFAC

SEQ ID NO: 135924 - protein, 20 aa, Mycobacterium avium
IVDPSWFNWPALPVAMADTI

SEQ ID NO: 135925 - protein, 17 aa, Mycobacterium avium
IVGLMRTLADALAPLNI

SEQ ID NO: 135926 - protein, 18 aa, Mycobacterium avium
IVGLMRTLANALAPLNIR

SEQ ID NO: 135927 - protein, 17 aa, Mycobacterium avium
IVRPLLRVFFRSWFRVE

SEQ ID NO: 135928 - protein, 25 aa, Mycobacterium avium
IYLEETFLFPPIRKAGIMMPVFVMM

SEQ ID NO: 135929 - protein, 20 aa, Mycobacterium avium
KADPGLLKWLEDPKVGGVEL

SEQ ID NO: 135930 - protein, 18 aa, Mycobacterium avium
KAFDMVFAEALWAELHDK

SEQ ID NO: 135931 - protein, 17 aa, Mycobacterium avium
KAIDIVGTILRPIASGL

SEQ ID NO: 135932 - protein, 21 aa, Mycobacterium avium
KARFLPTRLAAIPALLADVLR

SEQ ID NO: 135933 - protein, 20 aa, Mycobacterium avium
KAVLALLSPYTAMLFMGEEY

SEQ ID NO: 135934 - protein, 19 aa, Mycobacterium avium
KAWPFGLPSIGAHGSYWDN

SEQ ID NO: 135935 - protein, 22 aa, Mycobacterium avium
KDRFLIPLLRADEFWCQGFSEP

SEQ ID NO: 135936 - protein, 25 aa, Mycobacterium avium
KDRRWIQLVFLQPDKYWAGFCRRIG

SEQ ID NO: 135937 - protein, 23 aa, Mycobacterium avium
KERWPAFWDWAYKSLPNDSRMLM

SEQ ID NO: 135938 - protein, 17 aa, Mycobacterium avium
KETLRLHPPLIILMRVA

SEQ ID NO: 135939 - protein, 19 aa, Mycobacterium avium
KFMPQPYGGYILPGSTLDD

SEQ ID NO: 135940 - protein, 21 aa, Mycobacterium avium
KGPAAPPVVPLPPGGPGGGPG

SEQ ID NO: 135941 - protein, 17 aa, Mycobacterium avium
KGRKVIVYFYPAASTPG

SEQ ID NO: 135942 - protein, 19 aa, Mycobacterium avium
KGRKVIVYFYPAASTPGCT

SEQ ID NO: 135943 - protein, 19 aa, Mycobacterium avium
KIDPYLRPLYDALYDMMDP

SEQ ID NO: 135944 - protein, 20 aa, Mycobacterium avium
KIDPYLRPLYDALYDMMDPE

SEQ ID NO: 135945 - protein, 18 aa, Mycobacterium avium
KILRCPLRFPHDLPRPEG

SEQ ID NO: 135946 - protein, 25 aa, Mycobacterium avium
KKLNPRLLTMIIPARWFAGGKGLDE

SEQ ID NO: 135947 - protein, 21 aa, Mycobacterium avium
KLLIRAGYIRPVAPGLYSWLP

SEQ ID NO: 135948 - protein, 20 aa, Mycobacterium avium
KLLLAMLQRREAWEIIDYVN

SEQ ID NO: 135949 - protein, 24 aa, Mycobacterium avium
KMQLESIFRELIFRAPSLRLGEPE

SEQ ID NO: 135950 - protein, 18 aa, Mycobacterium avium
KNLLPMFAVFKPTVVVSV

SEQ ID NO: 135951 - protein, 21 aa, Mycobacterium avium
KPFFASLLEFITSGPVVAAIV

SEQ ID NO: 135952 - protein, 17 aa, Mycobacterium avium
KPFSFRVLVARLRALVR

SEQ ID NO: 135953 - protein, 19 aa, Mycobacterium avium
KPVCFVFDFAPTRALRQLA

SEQ ID NO: 135954 - protein, 23 aa, Mycobacterium avium
KRNRPVLVFVLDAGMPGLTQGKP

SEQ ID NO: 135955 - protein, 23 aa, Mycobacterium avium
KRQRFWVSLYYPLTMRLLCNAIT

SEQ ID NO: 135956 - protein, 18 aa, Mycobacterium avium
KRTRVMILLAAFAGLRAH

SEQ ID NO: 135957 - protein, 17 aa, Mycobacterium avium
KTLAAFLWALDSLAGQA

SEQ ID NO: 135958 - protein, 18 aa, Mycobacterium avium
KTLAAFLWALDSLAGQAE

SEQ ID NO: 135959 - protein, 18 aa, Mycobacterium avium
KTLAAFLWALDSLAGQSE

SEQ ID NO: 135960 - protein, 22 aa, Mycobacterium avium
KVGLRLYKGLDWFDMIVALYQQ

SEQ ID NO: 135961 - protein, 17 aa, Mycobacterium avium
KWWGTRPRLDSITYLVL

SEQ ID NO: 135962 - protein, 23 aa, Mycobacterium avium
KYYAGVKWAWYQPIYAGRPVLVE

SEQ ID NO: 135963 - protein, 18 aa, Mycobacterium avium
LADYLFPAAKILEPFGLE

SEQ ID NO: 135964 - protein, 19 aa, Mycobacterium avium
LAEAIALIRQLWSGSRISF

SEQ ID NO: 135965 - protein, 20 aa, Mycobacterium avium
LAEGLLYERRLFHSTFATAD

SEQ ID NO: 135966 - protein, 21 aa, Mycobacterium avium
LAEGLLYERRLFHSTFATADQ

SEQ ID NO: 135967 - protein, 24 aa, Mycobacterium avium
LAGLRRFHRHLGAGRLARRIECSP

SEQ ID NO: 135968 - protein, 24 aa, Mycobacterium avium
LANLAFFVLDGWLRPVPVGVVGEL

SEQ ID NO: 135969 - protein, 17 aa, Mycobacterium avium
LANMGVIYWVYPNLILA

SEQ ID NO: 135970 - protein, 19 aa, Mycobacterium avium
LAPLTRQGCIPLAIHPAMT

SEQ ID NO: 135971 - protein, 24 aa, Mycobacterium avium
LARDGGWWVFGVAAPALADCLRAV

SEQ ID NO: 135972 - protein, 22 aa, Mycobacterium avium
LARDGGWWVLGVAAPVLADCLR

SEQ ID NO: 135973 - protein, 17 aa, Mycobacterium avium
LCYFAYLAGYREVHEAA

SEQ ID NO: 135974 - protein, 17 aa, Mycobacterium avium
LDAFTHWRRAQGLPATA

SEQ ID NO: 135975 - protein, 24 aa, Mycobacterium avium
LDALWTALKTLYPVGIDYATLTRR

SEQ ID NO: 135976 - protein, 26 aa, Mycobacterium avium
LDEGQRLLIFLPLAHVLARSLTLSAF

SEQ ID NO: 135977 - protein, 19 aa, Mycobacterium avium
LDKLAGWYDWCRDNLVVGA

SEQ ID NO: 135978 - protein, 17 aa, Mycobacterium avium
LDPYLPVEVFAAGLTFD

SEQ ID NO: 135979 - protein, 21 aa, Mycobacterium avium
LDRALIDLATYFRDALMASSG

SEQ ID NO: 135980 - protein, 17 aa, Mycobacterium avium
LDRRLLLGMLSDLPPGA

SEQ ID NO: 135981 - protein, 22 aa, Mycobacterium avium
LELAWTTGLIRWEDDPQPGWYD

SEQ ID NO: 135982 - protein, 21 aa, Mycobacterium avium
LERHILVFEGLQAAGADPGQQ

SEQ ID NO: 135983 - protein, 21 aa, Mycobacterium avium
LERIYWAFCTHLGYLVSNNSF

SEQ ID NO: 135984 - protein, 18 aa, Mycobacterium avium
LFAFGTRLDPRFGSDSSA

SEQ ID NO: 135985 - protein, 18 aa, Mycobacterium avium
LFERSAGNLLLLRGFLTA

SEQ ID NO: 135986 - protein, 30 aa, Mycobacterium avium
LFGHPAFRYVGWGPRLWWWAETMGLRKFSE

SEQ ID NO: 135987 - protein, 19 aa, Mycobacterium avium
LFMQLPWRTEIVKGLLGAD

SEQ ID NO: 135988 - protein, 19 aa, Mycobacterium avium
LFQAAPWPSVAPLTLFGHS

SEQ ID NO: 135989 - protein, 19 aa, Mycobacterium avium
LFRAAPWPGVAPLTLFGYS

SEQ ID NO: 135990 - protein, 26 aa, Mycobacterium avium
LGALAGWYVWAALGLYPATPGTPILT

SEQ ID NO: 135991 - protein, 18 aa, Mycobacterium avium
LGALWRLYSQYPYMPRLR

SEQ ID NO: 135992 - protein, 17 aa, Mycobacterium avium
LGIDWPLVAGAAPTLSE

SEQ ID NO: 135993 - protein, 28 aa, Mycobacterium avium
LGKPLHLHRILLQRSWIAIFWSRFADAV

SEQ ID NO: 135994 - protein, 29 aa, Mycobacterium avium
LGKPLHLHRILLQRSWIAIFWSRFADAVE

SEQ ID NO: 135995 - protein, 26 aa, Mycobacterium avium
LGLDYLDLYLIHWPAPTLGKYVESFE

SEQ ID NO: 135996 - protein, 27 aa, Mycobacterium avium
LGLDYVDLYLIHWPAPALGTYVNSFGG

SEQ ID NO: 135997 - protein, 29 aa, Mycobacterium avium
LGNPLHLHRILLQRSWIAIFWSRFADAVE

SEQ ID NO: 135998 - protein, 19 aa, Mycobacterium avium
LGPALLKFAPGLAAAYLPG

SEQ ID NO: 135999 - protein, 19 aa, Mycobacterium avium
LGPRRALTGEPLPALLPAT

SEQ ID NO: 136000 - protein, 19 aa, Mycobacterium avium
LGRGYRWLQLIDAAGLPVH

SEQ ID NO: 136001 - protein, 19 aa, Mycobacterium avium
LHLDYAYYNPLSLVIRDQQ

SEQ ID NO: 136002 - protein, 18 aa, Mycobacterium avium
LHLFLRRIKVDEAFNGSV

SEQ ID NO: 136003 - protein, 19 aa, Mycobacterium avium
LHRTAWIDDWLPAELNRAG

SEQ ID NO: 136004 - protein, 19 aa, Mycobacterium avium
LHTVGMLFSPGYPGFLRGV

SEQ ID NO: 136005 - protein, 18 aa, Mycobacterium avium
LHWYVPRSIRLIDVFKGL

SEQ ID NO: 136006 - protein, 22 aa, Mycobacterium avium
LIDNRLLWQLDGRYMQALFGET

SEQ ID NO: 136007 - protein, 27 aa, Mycobacterium avium
LIIGPWNYPLYLSLAPLVAAVAAGNCA

SEQ ID NO: 136008 - protein, 18 aa, Mycobacterium avium
LILRLLKFDESRHMDWVH

SEQ ID NO: 136009 - protein, 17 aa, Mycobacterium avium
LIRTGWWTRYLETGNKT

SEQ ID NO: 136010 - protein, 17 aa, Mycobacterium avium
LKVLLGQLPLSAGVGLV

SEQ ID NO: 136011 - protein, 18 aa, Mycobacterium avium
LLAALPRWKRPLGRLLIK

SEQ ID NO: 136012 - protein, 21 aa, Mycobacterium avium
LLAERLFDIYAPGRALPAIVN

SEQ ID NO: 136013 - protein, 17 aa, Mycobacterium avium
LLAPFFVWVTVGLYDPP

SEQ ID NO: 136014 - protein, 24 aa, Mycobacterium avium
LLAQKFAAPLLDRYLGRTGYDSQQ

SEQ ID NO: 136015 - protein, 23 aa, Mycobacterium avium
LLARLFGLPYFPVTPLFPLAGPI

SEQ ID NO: 136016 - protein, 25 aa, Mycobacterium avium
LLATLSLPRRLMLRKLLSFTGAHVR

SEQ ID NO: 136017 - protein, 27 aa, Mycobacterium avium
LLDHALWILVMFAWKRWPIKGARTRTG

SEQ ID NO: 136018 - protein, 19 aa, Mycobacterium avium
LLFVELGKRLAPGPFLACT

SEQ ID NO: 136019 - protein, 19 aa, Mycobacterium avium
LLISRWLDIAFSARSAAML

SEQ ID NO: 136020 - protein, 19 aa, Mycobacterium avium
LLLAMLQRREAWEIIDYVN

SEQ ID NO: 136021 - protein, 25 aa, Mycobacterium avium
LLNLELPFPCVWVTGWSREGGRAAA

SEQ ID NO: 136022 - protein, 19 aa, Mycobacterium avium
LLPTGRRLLAAPGLRAVPG

SEQ ID NO: 136023 - protein, 29 aa, Mycobacterium avium
LLRDRIHQGWILNALWLLDTGITAAALVR

SEQ ID NO: 136024 - protein, 29 aa, Mycobacterium avium
LLRDRIHQGWILNALWLLDTGITAATLVR

SEQ ID NO: 136025 - protein, 18 aa, Mycobacterium avium
LLRTWFAGLFEAGFAGAD

SEQ ID NO: 136026 - protein, 19 aa, Mycobacterium avium
LLVLDGWLRPVPAGVVGEL

SEQ ID NO: 136027 - protein, 17 aa, Mycobacterium avium
LMPHWLLSLQAEATRRG

SEQ ID NO: 136028 - protein, 18 aa, Mycobacterium avium
LMPVFRLSGLTELTTVEA

SEQ ID NO: 136029 - protein, 19 aa, Mycobacterium avium
LNELIPPLVPGKPLQHFQQ

SEQ ID NO: 136030 - protein, 26 aa, Mycobacterium avium
LNPIPPHLHLLINPPHKLQPPTHTPP

SEQ ID NO: 136031 - protein, 18 aa, Mycobacterium avium
LNVAFQMLYARYPDITAA

SEQ ID NO: 136032 - protein, 17 aa, Mycobacterium avium
LNYYPHLLALSASSPWW

SEQ ID NO: 136033 - protein, 17 aa, Mycobacterium avium
LPAHIDLAALRAKFDGG

SEQ ID NO: 136034 - protein, 17 aa, Mycobacterium avium
LPALLARDLHPTAVAGF

SEQ ID NO: 136035 - protein, 23 aa, Mycobacterium avium
LPGPPILWHSLTVALIAGLSRVR

SEQ ID NO: 136036 - protein, 19 aa, Mycobacterium avium
LPRIPMRFPMYLPGPNRVM

SEQ ID NO: 136037 - protein, 18 aa, Mycobacterium avium
LPRPPLFLMASSAAVYGS

SEQ ID NO: 136038 - protein, 30 aa, Mycobacterium avium
LPTQLPMMLSFLDFRKIPLNGLWAETKFGT

SEQ ID NO: 136039 - protein, 21 aa, Mycobacterium avium
LQIHLVGAFRLASAVLPGMLE

SEQ ID NO: 136040 - protein, 18 aa, Mycobacterium avium
LQTVGWTAAAPQAGVGTV

SEQ ID NO: 136041 - protein, 28 aa, Mycobacterium avium
LRAEIDNWRWAGVPIFLRAGKALPHKVT

SEQ ID NO: 136042 - protein, 20 aa, Mycobacterium avium
LRAIPWVLAWSQSRVMLPGW

SEQ ID NO: 136043 - protein, 18 aa, Mycobacterium avium
LRDNLWYLIDAKAATAIA

SEQ ID NO: 136044 - protein, 24 aa, Mycobacterium avium
LRDWRQWWHWVPGASWRHPSGPDS

SEQ ID NO: 136045 - protein, 19 aa, Mycobacterium avium
LRLGLDIMLIGVWNAFQVA

SEQ ID NO: 136046 - protein, 17 aa, Mycobacterium avium
LRMHQRWPIVMVDEFQD

SEQ ID NO: 136047 - protein, 27 aa, Mycobacterium avium
LRMPQRGAPLLFFLDAGVPPLSALVNS

SEQ ID NO: 136048 - protein, 20 aa, Mycobacterium avium
LRNLYLLPSSPLQELRRLLP

SEQ ID NO: 136049 - protein, 24 aa, Mycobacterium avium
LRPADRWWRLIADHGWRPTHMIQD

SEQ ID NO: 136050 - protein, 26 aa, Mycobacterium avium
LRRHIYLEEIFLFPPLREAGIVMPIF

SEQ ID NO: 136051 - protein, 17 aa, Mycobacterium avium
LRRLRLPRRAGPTARHP

SEQ ID NO: 136052 - protein, 17 aa, Mycobacterium avium
LSGFLLWQSAYSEMWFT

SEQ ID NO: 136053 - protein, 17 aa, Mycobacterium avium
LSGLLEALPPNAALLVT

SEQ ID NO: 136054 - protein, 20 aa, Mycobacterium avium
LSLFYVPKYLFDPKTFELGP

SEQ ID NO: 136055 - protein, 28 aa, Mycobacterium avium
LSPEAVFKPRWLWKFGKTLWPPELRVPN

SEQ ID NO: 136056 - protein, 22 aa, Mycobacterium avium
LSRRGFLWWAVVEGLVNAGAPV

SEQ ID NO: 136057 - protein, 18 aa, Mycobacterium avium
LSVLPTWIEPQGDPVWCP

SEQ ID NO: 136058 - protein, 18 aa, Mycobacterium avium
LSYFPPSAWSYPPSLPPG

SEQ ID NO: 136059 - protein, 26 aa, Mycobacterium avium
LTDEAIIAFLRLLLPGGLETTYRSSG

SEQ ID NO: 136060 - protein, 19 aa, Mycobacterium avium
LTDIGWLEMLWMQPVGINS

SEQ ID NO: 136061 - protein, 20 aa, Mycobacterium avium
LTEWFTVDWHRAIVDKWRAA

SEQ ID NO: 136062 - protein, 17 aa, Mycobacterium avium
LTLSWLLRNLSTRHPRS

SEQ ID NO: 136063 - protein, 17 aa, Mycobacterium avium
LTPTLARMLKRAKALQA

SEQ ID NO: 136064 - protein, 20 aa, Mycobacterium avium
LTSALSGMPLWQAPTGAFSA

SEQ ID NO: 136065 - protein, 19 aa, Mycobacterium avium
LTWHLPILFRTPPGYNLLV

SEQ ID NO: 136066 - protein, 19 aa, Mycobacterium avium
LTYGLLRYLNPQAGLDVSD

SEQ ID NO: 136067 - protein, 17 aa, Mycobacterium avium
LVAIMPWEGHNYEDAII

SEQ ID NO: 136068 - protein, 17 aa, Mycobacterium avium
LVAPIWFVVDDGELAFN

SEQ ID NO: 136069 - protein, 17 aa, Mycobacterium avium
LVAWADIYDAHAAVFAE

SEQ ID NO: 136070 - protein, 18 aa, Mycobacterium avium
LVDELGGFRIAVRRAKIL

SEQ ID NO: 136071 - protein, 17 aa, Mycobacterium avium
LVDFWATWCGPCKMVAP

SEQ ID NO: 136072 - protein, 17 aa, Mycobacterium avium
LVGLARARRMLLLGEKV

SEQ ID NO: 136073 - protein, 19 aa, Mycobacterium avium
LVGLRQALRILLTNPTLGA

SEQ ID NO: 136074 - protein, 19 aa, Mycobacterium avium
LVGTLKYTLWRLQERVVGR

SEQ ID NO: 136075 - protein, 17 aa, Mycobacterium avium
LVKYRYPPDKQPEAIKL

SEQ ID NO: 136076 - protein, 20 aa, Mycobacterium avium
LVLFGRLRGLNRRRAKARAD

SEQ ID NO: 136077 - protein, 19 aa, Mycobacterium avium
LVNNLLFTANLATAATALS

SEQ ID NO: 136078 - protein, 17 aa, Mycobacterium avium
LVPPYTLGAWLGDGTSA

SEQ ID NO: 136079 - protein, 20 aa, Mycobacterium avium
LVTQLLVLRRARVLGIAGPG

SEQ ID NO: 136080 - protein, 18 aa, Mycobacterium avium
LWQVPYLPIDPKDVGRTY

SEQ ID NO: 136081 - protein, 17 aa, Mycobacterium avium
LWRDARVQRLYAGTTEI

SEQ ID NO: 136082 - protein, 17 aa, Mycobacterium avium
LYALPPRGRFVLTDTDR

SEQ ID NO: 136083 - protein, 21 aa, Mycobacterium avium
LYDGFTFLTLAWLEALGVCGD

SEQ ID NO: 136084 - protein, 20 aa, Mycobacterium avium
LYPDGRLLDVPLPAWTHRHL

SEQ ID NO: 136085 - protein, 18 aa, Mycobacterium avium
LYQLILDYPLRGGKALRP

SEQ ID NO: 136086 - protein, 17 aa, Mycobacterium avium
MADFWETVLFRAGLYRG

SEQ ID NO: 136087 - protein, 18 aa, Mycobacterium avium
MAPQGLDYIVAFLGALHA

SEQ ID NO: 136088 - protein, 18 aa, Mycobacterium avium
MCGMEYFGHPWEFGPRRT

SEQ ID NO: 136089 - protein, 22 aa, Mycobacterium avium
MDEAWWLPSVFIANGGAVAASL

SEQ ID NO: 136090 - protein, 26 aa, Mycobacterium avium
MDKVDRPYYFFGVLAKLAVLPRFTPM

SEQ ID NO: 136091 - protein, 17 aa, Mycobacterium avium
MEELIAAFLPLLFPGME

SEQ ID NO: 136092 - protein, 19 aa, Mycobacterium avium
MERAGLLLPLGWNPRLPIM

SEQ ID NO: 136093 - protein, 23 aa, Mycobacterium avium
MFESLLATLPYPMLMAARLKSLG

SEQ ID NO: 136094 - protein, 18 aa, Mycobacterium avium
MFHAWGFSQLLLAASFAC

SEQ ID NO: 136095 - protein, 19 aa, Mycobacterium avium
MGEHLQLLKGWHPVASVSN

SEQ ID NO: 136096 - protein, 17 aa, Mycobacterium avium
MGGDYFALSLALEELGK

SEQ ID NO: 136097 - protein, 17 aa, Mycobacterium avium
MGGGDMIAALFAAIETN

SEQ ID NO: 136098 - protein, 19 aa, Mycobacterium avium
MGTPWLTSFAQRSPFAEAF

SEQ ID NO: 136099 - protein, 20 aa, Mycobacterium avium
MHDYFWRWDTDWFWCSRAFG

SEQ ID NO: 136100 - protein, 21 aa, Mycobacterium avium
MHDYFWRWDTDWFWCSRAFGV

SEQ ID NO: 136101 - protein, 24 aa, Mycobacterium avium
MHFVPSLLGLFLSLPGASQWRTLR

SEQ ID NO: 136102 - protein, 26 aa, Mycobacterium avium
MHQNLPIYRYWFSPDGMLGFDRGTQT

SEQ ID NO: 136103 - protein, 23 aa, Mycobacterium avium
MKIPAPAARWAFCNGMTAAQRRL

SEQ ID NO: 136104 - protein, 25 aa, Mycobacterium avium
MLAELSQLRLLPFRLVLDGAQEIDA

SEQ ID NO: 136105 - protein, 17 aa, Mycobacterium avium
MLALWHVAAGLPVGEFP

SEQ ID NO: 136106 - protein, 20 aa, Mycobacterium avium
MLHSPPMYRAFRPDLPASTR

SEQ ID NO: 136107 - protein, 17 aa, Mycobacterium avium
MLRVRFLPDGTQRITPA

SEQ ID NO: 136108 - protein, 19 aa, Mycobacterium avium
MLYEAWLQFGGRAGARQLS

SEQ ID NO: 136109 - protein, 19 aa, Mycobacterium avium
MPQFLIVTKLIPALLAGCT

SEQ ID NO: 136110 - protein, 18 aa, Mycobacterium avium
MRLALDTAGRWGATRVWL

SEQ ID NO: 136111 - protein, 25 aa, Mycobacterium avium
MRLRDLLKFDFYFADSATFRDNIAE

SEQ ID NO: 136112 - protein, 19 aa, Mycobacterium avium
MRYKWRKWLYFDCNWKVAL

SEQ ID NO: 136113 - protein, 20 aa, Mycobacterium avium
MTCNTAIPIMWVGRQPPGTH

SEQ ID NO: 136114 - protein, 17 aa, Mycobacterium avium
MTHAWLITGPPGSGRSV

SEQ ID NO: 136115 - protein, 19 aa, Mycobacterium avium
MVPPQWFAMWARRHQHEFG

SEQ ID NO: 136116 - protein, 18 aa, Mycobacterium avium
MVPPQWFAMWARRHQHEY

SEQ ID NO: 136117 - protein, 24 aa, Mycobacterium avium
NAKQRLRECWLWSRAYTISGGSSE

SEQ ID NO: 136118 - protein, 23 aa, Mycobacterium avium
NAMTPAMYFGIRYAINRVNADPD

SEQ ID NO: 136119 - protein, 21 aa, Mycobacterium avium
NAMWALSIPVPFIKPVGAGAG

SEQ ID NO: 136120 - protein, 19 aa, Mycobacterium avium
NATALRFLGKGLTWGELHG

SEQ ID NO: 136121 - protein, 17 aa, Mycobacterium avium
NCTIAMVDWLFSGKLMQ

SEQ ID NO: 136122 - protein, 20 aa, Mycobacterium avium
NDFVLLCDTPAELRLTAAGV

SEQ ID NO: 136123 - protein, 21 aa, Mycobacterium avium
NDLINRWYYNPDYFKIMSSCA

SEQ ID NO: 136124 - protein, 24 aa, Mycobacterium avium
NEPSFGVPWLYNYIGQPWKTQHTV

SEQ ID NO: 136125 - protein, 17 aa, Mycobacterium avium
NFELPLRPLARVAHVDF

SEQ ID NO: 136126 - protein, 19 aa, Mycobacterium avium
NFPDVLFIAGKYQVKIPPP

SEQ ID NO: 136127 - protein, 20 aa, Mycobacterium avium
NFPDVLFIAGKYQVKIPPPF

SEQ ID NO: 136128 - protein, 30 aa, Mycobacterium avium
NKACDPGLPLMLWAYDPLAFAGKGRAGIAI

SEQ ID NO: 136129 - protein, 23 aa, Mycobacterium avium
NLKAWLYRILTNTYINSYRKKQR

SEQ ID NO: 136130 - protein, 21 aa, Mycobacterium avium
NLLVGTLKYTLWRLQERVVGR

SEQ ID NO: 136131 - protein, 22 aa, Mycobacterium avium
NMGVIYWVYPNLILANSPVGLE

SEQ ID NO: 136132 - protein, 17 aa, Mycobacterium avium
NMVVIYALFPNIVLSVT

SEQ ID NO: 136133 - protein, 18 aa, Mycobacterium avium
NPFLPIFIQEPGEWFGIG

SEQ ID NO: 136134 - protein, 23 aa, Mycobacterium avium
NPVLSILIRRAAIAGPPLAATLH

SEQ ID NO: 136135 - protein, 28 aa, Mycobacterium avium
NRAYTPWYLVRYWRLLKFKLANPHIITR

SEQ ID NO: 136136 - protein, 24 aa, Mycobacterium avium
NRGSQFYLALYWAQELAAQHDDEE

SEQ ID NO: 136137 - protein, 17 aa, Mycobacterium avium
NRLLAPNEYIITLGMHD

SEQ ID NO: 136138 - protein, 19 aa, Mycobacterium avium
NRLLWQLDGRYMQALFGET

SEQ ID NO: 136139 - protein, 17 aa, Mycobacterium avium
NRPHLVLDGLRLAAAVV

SEQ ID NO: 136140 - protein, 18 aa, Mycobacterium avium
NRPHLVLDGLRLAAAVVG

SEQ ID NO: 136141 - protein, 20 aa, Mycobacterium avium
NTRAFLGERIGVRRGAVVNA

SEQ ID NO: 136142 - protein, 21 aa, Mycobacterium avium
NVLLIALHYRVGGSVWGVGDT

SEQ ID NO: 136143 - protein, 19 aa, Mycobacterium avium
NVRRLHYLSVPPKAARAVI

SEQ ID NO: 136144 - protein, 20 aa, Mycobacterium avium
NVRRLHYLSVPPKAARAVIT

SEQ ID NO: 136145 - protein, 24 aa, Mycobacterium avium
NWTIRTLRFILQELPLLLQVGLSL

SEQ ID NO: 136146 - protein, 21 aa, Mycobacterium avium
PAAHPGLRRAPPLRLGHRAVT

SEQ ID NO: 136147 - protein, 27 aa, Mycobacterium avium
PAARPGRWWCWWTASWPGSWSGAAGRC

SEQ ID NO: 136148 - protein, 22 aa, Mycobacterium avium
PAGWFRFYFADQRWEWSEQVQR

SEQ ID NO: 136149 - protein, 19 aa, Mycobacterium avium
PAKLLLQFGRPVHRQPRAA

SEQ ID NO: 136150 - protein, 17 aa, Mycobacterium avium
PALIAFAGGDPWAINRS

SEQ ID NO: 136151 - protein, 24 aa, Mycobacterium avium
PAMNFFPATLTPIGLKVPFGEVML

SEQ ID NO: 136152 - protein, 19 aa, Mycobacterium avium
PAPWWWRPSGALFDQFLGA

SEQ ID NO: 136153 - protein, 17 aa, Mycobacterium avium
PAVKWKAFFNAQAKNPK

SEQ ID NO: 136154 - protein, 17 aa, Mycobacterium avium
PAYLVPAAVLVLDALPL

SEQ ID NO: 136155 - protein, 19 aa, Mycobacterium avium
PDQGAWLQPFRPLSALLTA

SEQ ID NO: 136156 - protein, 26 aa, Mycobacterium avium
PDQPALRALLDLLPIAAGSGTLGDRF

SEQ ID NO: 136157 - protein, 22 aa, Mycobacterium avium
PDTPAHLIDWKRRDWTPDCDAP

SEQ ID NO: 136158 - protein, 22 aa, Mycobacterium avium
PEIFPLLILCIDELGAWAGQGL

SEQ ID NO: 136159 - protein, 21 aa, Mycobacterium avium
PEQVKWWWDSLSAAQQRLLID

SEQ ID NO: 136160 - protein, 23 aa, Mycobacterium avium
PERILSTGPLLFAAIRTLGRGPV

SEQ ID NO: 136161 - protein, 17 aa, Mycobacterium avium
PETWKQAFYARDLAGTV

SEQ ID NO: 136162 - protein, 20 aa, Mycobacterium avium
PEWTWQPLLPYLRKSATYHD

SEQ ID NO: 136163 - protein, 18 aa, Mycobacterium avium
PFHNMVVIYALFPNIVLS

SEQ ID NO: 136164 - protein, 25 aa, Mycobacterium avium
PFLPVPLADQFGLSKGLPGLAEWTV

SEQ ID NO: 136165 - protein, 17 aa, Mycobacterium avium
PGAAFFVLDQWLRPVPA

SEQ ID NO: 136166 - protein, 19 aa, Mycobacterium avium
PGGRLYALPPRGRFVLTDT

SEQ ID NO: 136167 - protein, 20 aa, Mycobacterium avium
PGHLAGQRWPARHPAGRGRG

SEQ ID NO: 136168 - protein, 22 aa, Mycobacterium avium
PGKDLWWFWTGLTPSYPEEGWD

SEQ ID NO: 136169 - protein, 22 aa, Mycobacterium avium
PGLPLLRYMIANRIPFGVVEVK

SEQ ID NO: 136170 - protein, 24 aa, Mycobacterium avium
PGPLGERADWWWYDPFQPQPPPSN

SEQ ID NO: 136171 - protein, 24 aa, Mycobacterium avium
PGPLGERADWWWYDPFQPQPPPTN

SEQ ID NO: 136172 - protein, 26 aa, Mycobacterium avium
PGRYIPLMLIPMWDPKLAAKEMERMA

SEQ ID NO: 136173 - protein, 17 aa, Mycobacterium avium
PGWHLAVLPLTDGGAVV

SEQ ID NO: 136174 - protein, 19 aa, Mycobacterium avium
PHRAIILNCGFTAGGFATA

SEQ ID NO: 136175 - protein, 20 aa, Mycobacterium avium
PHTLLMLALAGWARYLRGYD

SEQ ID NO: 136176 - protein, 20 aa, Mycobacterium avium
PKFVLIPTPLWDQLFRPLVA

SEQ ID NO: 136177 - protein, 20 aa, Mycobacterium avium
PLALMIAYLPPGLGKAVEPL

SEQ ID NO: 136178 - protein, 18 aa, Mycobacterium avium
PLFDPNRLAALWGPTVHL

SEQ ID NO: 136179 - protein, 18 aa, Mycobacterium avium
PLHPLALRLLRPKQVIML

SEQ ID NO: 136180 - protein, 19 aa, Mycobacterium avium
PLKNVLILAFMWLLCWMAE

SEQ ID NO: 136181 - protein, 19 aa, Mycobacterium avium
PLLMPALQPEIRLAAPLLA

SEQ ID NO: 136182 - protein, 18 aa, Mycobacterium avium
PLLQELFAKDPQRAARRL

SEQ ID NO: 136183 - protein, 19 aa, Mycobacterium avium
PLPDPEILAFLYLEARLAD

SEQ ID NO: 136184 - protein, 17 aa, Mycobacterium avium
PLPFVHQSSPLYLAGAA

SEQ ID NO: 136185 - protein, 18 aa, Mycobacterium avium
PLPFVHQSSPLYLAGAAR

SEQ ID NO: 136186 - protein, 19 aa, Mycobacterium avium
PLPFVHQSSPLYLAGAARP

SEQ ID NO: 136187 - protein, 25 aa, Mycobacterium avium
PLRELRRTGLLDKLLLLAGIPETAT

SEQ ID NO: 136188 - protein, 17 aa, Mycobacterium avium
PLSIDLLVDLWLDKQRF

SEQ ID NO: 136189 - protein, 24 aa, Mycobacterium avium
PLTRYLKYELPLVNGVPALGTPGL

SEQ ID NO: 136190 - protein, 18 aa, Mycobacterium avium
PLTWPLHISLLLAKEYAL

SEQ ID NO: 136191 - protein, 23 aa, Mycobacterium avium
PMDPALYLLWAQANVVAGYRYSA

SEQ ID NO: 136192 - protein, 23 aa, Mycobacterium avium
PMDRFHRRLLWPIRSSAGEVIGF

SEQ ID NO: 136193 - protein, 19 aa, Mycobacterium avium
PMFHAWGFSQLLLAASFAC

SEQ ID NO: 136194 - protein, 24 aa, Mycobacterium avium
PNEFTLLRYFVINAGTVLSKPKIL

SEQ ID NO: 136195 - protein, 24 aa, Mycobacterium avium
PNPACGIAMPLVRSWWLGKKKGKE

SEQ ID NO: 136196 - protein, 17 aa, Mycobacterium avium
PPAVWRLAAGDAGTLED

SEQ ID NO: 136197 - protein, 25 aa, Mycobacterium avium
PPDIDLGWWLMFERFLCEALGFTRL

SEQ ID NO: 136198 - protein, 20 aa, Mycobacterium avium
PPEHLIFIFATTEPEKVLPT

SEQ ID NO: 136199 - protein, 17 aa, Mycobacterium avium
PPGHLWRWELSPVNAEL

SEQ ID NO: 136200 - protein, 18 aa, Mycobacterium avium
PPGHLWRWELSPVNAELT

SEQ ID NO: 136201 - protein, 20 aa, Mycobacterium avium
PPHRAIILNCGFTAGGFATA

SEQ ID NO: 136202 - protein, 20 aa, Mycobacterium avium
PPLLEVVRPATFLFAAGQET

SEQ ID NO: 136203 - protein, 17 aa, Mycobacterium avium
PPPLLWAVIQALVSEVW

SEQ ID NO: 136204 - protein, 20 aa, Mycobacterium avium
PPRILTAALVLPIGMLEADL

SEQ ID NO: 136205 - protein, 18 aa, Mycobacterium avium
PPRRVALLQAFLVRRMRR

SEQ ID NO: 136206 - protein, 20 aa, Mycobacterium avium
PPTFVLFTTGFLEAGYRRFL

SEQ ID NO: 136207 - protein, 20 aa, Mycobacterium avium
PPTRVWGVPAAGLWAHRLGD

SEQ ID NO: 136208 - protein, 23 aa, Mycobacterium avium
PQGEPFWFPNWTRLVYAGDGLFS

SEQ ID NO: 136209 - protein, 19 aa, Mycobacterium avium
PRALPSNCRYLLPSLIRSS

SEQ ID NO: 136210 - protein, 17 aa, Mycobacterium avium
PRFLRKLLRELPPAPDT

SEQ ID NO: 136211 - protein, 23 aa, Mycobacterium avium
PRITALPGLWFEAARRVGFDVAA

SEQ ID NO: 136212 - protein, 17 aa, Mycobacterium avium
PRKVAMRLLLTGEPLSA

SEQ ID NO: 136213 - protein, 18 aa, Mycobacterium avium
PRLTHPPGDQLRVLGTEV

SEQ ID NO: 136214 - protein, 17 aa, Mycobacterium avium
PRRQRLLGPPPALRRVE

SEQ ID NO: 136215 - protein, 24 aa, Mycobacterium avium
PRWKRPLGRLLIKLAATFIPLREE

SEQ ID NO: 136216 - protein, 24 aa, Mycobacterium avium
PRYILWAAWHRSGLQRRWLSVSER

SEQ ID NO: 136217 - protein, 18 aa, Mycobacterium avium
PSHKLLIRAGYIRPVAPG

SEQ ID NO: 136218 - protein, 18 aa, Mycobacterium avium
PSSWPTGWDCRCCRCARW

SEQ ID NO: 136219 - protein, 18 aa, Mycobacterium avium
PTAEAYLGLLRFLLGLDL

SEQ ID NO: 136220 - protein, 17 aa, Mycobacterium avium
PTDTRAYFRGECLRRFG

SEQ ID NO: 136221 - protein, 22 aa, Mycobacterium avium
PTDTRAYFRGECLRRFGADIAA

SEQ ID NO: 136222 - protein, 17 aa, Mycobacterium avium
PTLAFGWTKRALAAATL

SEQ ID NO: 136223 - protein, 18 aa, Mycobacterium avium
PTLYRWFASKEELLSAFS

SEQ ID NO: 136224 - protein, 23 aa, Mycobacterium avium
PTSPWPIDPAFRRQVFELVDIAF

SEQ ID NO: 136225 - protein, 23 aa, Mycobacterium avium
PVDFVLLDGWKDLYLPVLELLEP

SEQ ID NO: 136226 - protein, 18 aa, Mycobacterium avium
PVEIMRLCAALWLDACAD

SEQ ID NO: 136227 - protein, 19 aa, Mycobacterium avium
PVLLIMGLGAQLLLWRTAF

SEQ ID NO: 136228 - protein, 20 aa, Mycobacterium avium
PVLRFFGDLLYFDRYWLEEE

SEQ ID NO: 136229 - protein, 21 aa, Mycobacterium avium
PVLSVLIRRAAIAGPPLAATL

SEQ ID NO: 136230 - protein, 26 aa, Mycobacterium avium
PVPGKFYWMTPTQLRWRPLSFWPAHT

SEQ ID NO: 136231 - protein, 17 aa, Mycobacterium avium
PVQIIASLLPPAVKWKA

SEQ ID NO: 136232 - protein, 19 aa, Mycobacterium avium
PVQIPRFLRKLLRELPPAP

SEQ ID NO: 136233 - protein, 22 aa, Mycobacterium avium
PVVFLTAYYGLSVLAGLRAGQR

SEQ ID NO: 136234 - protein, 19 aa, Mycobacterium avium
PVYFALLARRRMDLYGATL

SEQ ID NO: 136235 - protein, 18 aa, Mycobacterium avium
PWNMPQFLIVTKLIPALL

SEQ ID NO: 136236 - protein, 24 aa, Mycobacterium avium
PWNTPLFIAALKIGPALAAGCTVV

SEQ ID NO: 136237 - protein, 24 aa, Mycobacterium avium
PWNTPLFIAALKLGPALAAGCTVV

SEQ ID NO: 136238 - protein, 17 aa, Mycobacterium avium
PWPWLQPNRNDAPPVAG

SEQ ID NO: 136239 - protein, 18 aa, Mycobacterium avium
PWVLAITCPYRDAAERNA

SEQ ID NO: 136240 - protein, 19 aa, Mycobacterium avium
PYIGARFPLARTAAALRHV

SEQ ID NO: 136241 - protein, 22 aa, Mycobacterium avium
QAFLGGVLRCAVTVFGAELGGG

SEQ ID NO: 136242 - protein, 18 aa, Mycobacterium avium
QALTFLRGPRTWVLKSPQ

SEQ ID NO: 136243 - protein, 26 aa, Mycobacterium avium
QASGRIKLAWFLLNAARYMPVLVYAA

SEQ ID NO: 136244 - protein, 23 aa, Mycobacterium avium
QEGMGFIYLMQNLPQERISIAVM

SEQ ID NO: 136245 - protein, 26 aa, Mycobacterium avium
QGAICGSWWWRDFILANGLQARVPAA

SEQ ID NO: 136246 - protein, 20 aa, Mycobacterium avium
QGALPGIGFSGGIIGGLEGA

SEQ ID NO: 136247 - protein, 21 aa, Mycobacterium avium
QGCLQRLWWLHSGPGDPRVLA

SEQ ID NO: 136248 - protein, 18 aa, Mycobacterium avium
QGIALQVPPYIYAHPDDL

SEQ ID NO: 136249 - protein, 25 aa, Mycobacterium avium
QGIYWSFSIGNPWWETIHYGRHQSS

SEQ ID NO: 136250 - protein, 26 aa, Mycobacterium avium
QGSKELFLWPTLRYWEFPKPMIAQVH

SEQ ID NO: 136251 - protein, 18 aa, Mycobacterium avium
QHMLIDALAARLRVAQRN

SEQ ID NO: 136252 - protein, 21 aa, Mycobacterium avium
QHVLVLGYREKLCADWYFGGQ

SEQ ID NO: 136253 - protein, 22 aa, Mycobacterium avium
QIALAWTLSVAPSIALIPGTSS

SEQ ID NO: 136254 - protein, 23 aa, Mycobacterium avium
QIERLLMPLLRGDEWWALGMSEP

SEQ ID NO: 136255 - protein, 20 aa, Mycobacterium avium
QIHLVGAFRLASAVLPGMLE

SEQ ID NO: 136256 - protein, 20 aa, Mycobacterium avium
QIHLVGAFRLASAVLPGMLK

SEQ ID NO: 136257 - protein, 27 aa, Mycobacterium avium
QILASSYIWFFLAPGAPEWAIRSGATV

SEQ ID NO: 136258 - protein, 18 aa, Mycobacterium avium
QIVLPTLLRRVPTLRLAA

SEQ ID NO: 136259 - protein, 19 aa, Mycobacterium avium
QLLYWTQVLMTARGLSLDD

SEQ ID NO: 136260 - protein, 22 aa, Mycobacterium avium
QLYDGFTFLTLAWLEALGVCGD

SEQ ID NO: 136261 - protein, 23 aa, Mycobacterium avium
QLYDGFTFLTLAWLEALGVCGDG

SEQ ID NO: 136262 - protein, 24 aa, Mycobacterium avium
QNDLPAFDRLLASLPWPLNKTTTV

SEQ ID NO: 136263 - protein, 20 aa, Mycobacterium avium
QNRLWFIDQFQGPSPLYNMA

SEQ ID NO: 136264 - protein, 19 aa, Mycobacterium avium
QPLAWWPEVKAQANVVGAV

SEQ ID NO: 136265 - protein, 20 aa, Mycobacterium avium
QPRRFVFWREFPLGPAGKIL

SEQ ID NO: 136266 - protein, 23 aa, Mycobacterium avium
QQASIRLGFSWLLPDPWAQDTVA

SEQ ID NO: 136267 - protein, 18 aa, Mycobacterium avium
QQCVFSFQDGPRGKVWDS

SEQ ID NO: 136268 - protein, 24 aa, Mycobacterium avium
QQFAPLIDLKWWQKRPGERTELYR

SEQ ID NO: 136269 - protein, 22 aa, Mycobacterium avium
QRRFRGATLRRQTDRHAQAGDG

SEQ ID NO: 136270 - protein, 24 aa, Mycobacterium avium
QRSVRALLTGYLLYTLGGDKKYRD

SEQ ID NO: 136271 - protein, 17 aa, Mycobacterium avium
QRSWFRRDHRVRWLDAG

SEQ ID NO: 136272 - protein, 18 aa, Mycobacterium avium
QRSWFRRDHRVRWLDAGA

SEQ ID NO: 136273 - protein, 17 aa, Mycobacterium avium
QSVLLPRLLNWMSYAPD

SEQ ID NO: 136274 - protein, 22 aa, Mycobacterium avium
QTASLRVNFLRPFFAGGTSSYV

SEQ ID NO: 136275 - protein, 27 aa, Mycobacterium avium
QTLVPNTPFFFRLLVGLTKDGTWLQFS

SEQ ID NO: 136276 - protein, 21 aa, Mycobacterium avium
QTPVWTFLGPRPANWWIRRRL

SEQ ID NO: 136277 - protein, 19 aa, Mycobacterium avium
QTQFTILFVARSPPVHRGS

SEQ ID NO: 136278 - protein, 27 aa, Mycobacterium avium
QVLASSYIWFFLAPGAPEWAIRSGATV

SEQ ID NO: 136279 - protein, 21 aa, Mycobacterium avium
QVLLPFWNAYSFLALYAPKIG

SEQ ID NO: 136280 - protein, 18 aa, Mycobacterium avium
QVPLLLDEYTRNPSTGSF

SEQ ID NO: 136281 - protein, 18 aa, Mycobacterium avium
QWVAVRPPPLFGTEPDAR

SEQ ID NO: 136282 - protein, 17 aa, Mycobacterium avium
RAALPMLRAAEWARIVT

SEQ ID NO: 136283 - protein, 23 aa, Mycobacterium avium
RAATAWPAALRPALSTAGFATEL

SEQ ID NO: 136284 - protein, 17 aa, Mycobacterium avium
RAGLQALAWIARGGAEP

SEQ ID NO: 136285 - protein, 17 aa, Mycobacterium avium
RAGPLLDYLRKMVFWSD

SEQ ID NO: 136286 - protein, 22 aa, Mycobacterium avium
RALRFWEVMYPSPPPGLAGPDD

SEQ ID NO: 136287 - protein, 23 aa, Mycobacterium avium
RALRFWEVMYPSPPPGLAGPDDD

SEQ ID NO: 136288 - protein, 20 aa, Mycobacterium avium
RARIVLFRKPIERRAKDTVE

SEQ ID NO: 136289 - protein, 18 aa, Mycobacterium avium
RAWLFRRNHDEHVLVAVV

SEQ ID NO: 136290 - protein, 25 aa, Mycobacterium avium
RAYSPRFLWMWPNARISVMGGEQAA

SEQ ID NO: 136291 - protein, 22 aa, Mycobacterium avium
RCAALGRFAFLLSAAPPRIGSL

SEQ ID NO: 136292 - protein, 17 aa, Mycobacterium avium
RCIRSWVLDVRHATNGP

SEQ ID NO: 136293 - protein, 24 aa, Mycobacterium avium
RCRLVTERLWPTLLEPLRSRRHAR

SEQ ID NO: 136294 - protein, 22 aa, Mycobacterium avium
RDGQWYTARLRPGPLRPADRRT

SEQ ID NO: 136295 - protein, 18 aa, Mycobacterium avium
RDGRFIAFVLLQADRFWA

SEQ ID NO: 136296 - protein, 18 aa, Mycobacterium avium
RDNRFIAFVLLQADRFWA

SEQ ID NO: 136297 - protein, 25 aa, Mycobacterium avium
RDRIHQGWILNALWLLDTGITAAAL

SEQ ID NO: 136298 - protein, 23 aa, Mycobacterium avium
RDYWRARLPSLPPAPKLADMSLL

SEQ ID NO: 136299 - protein, 18 aa, Mycobacterium avium
REIGVPTVFNLLGPLTNP

SEQ ID NO: 136300 - protein, 18 aa, Mycobacterium avium
RELKQKFYELLASRLAGR

SEQ ID NO: 136301 - protein, 22 aa, Mycobacterium avium
RELRRTGLLDKLLLLAGMPETA

SEQ ID NO: 136302 - protein, 23 aa, Mycobacterium avium
RENALLERGLLPSPLLLDDPGVD

SEQ ID NO: 136303 - protein, 17 aa, Mycobacterium avium
REQWWRRAVQAYPPYAE

SEQ ID NO: 136304 - protein, 22 aa, Mycobacterium avium
RERIPLVVLIWEDGGYGLIEWK

SEQ ID NO: 136305 - protein, 24 aa, Mycobacterium avium
RETYDAMFDLWFPAALGARAVVTD

SEQ ID NO: 136306 - protein, 22 aa, Mycobacterium avium
REVASWWRYATSAPGLARPVDQ

SEQ ID NO: 136307 - protein, 17 aa, Mycobacterium avium
REVWGGPFMLKGVMRVD

SEQ ID NO: 136308 - protein, 18 aa, Mycobacterium avium
REVWGGPFMLKGVMRVDD

SEQ ID NO: 136309 - protein, 19 aa, Mycobacterium avium
RFGEAFWLPDRGWYAVALD

SEQ ID NO: 136310 - protein, 20 aa, Mycobacterium avium
RFIAFVLLQADRFWADFCTR

SEQ ID NO: 136311 - protein, 17 aa, Mycobacterium avium
RFPLMPIPSWMDNPIDP

SEQ ID NO: 136312 - protein, 17 aa, Mycobacterium avium
RGCPVRHLILLDALLVI

SEQ ID NO: 136313 - protein, 21 aa, Mycobacterium avium
RGIPVILRPAVLAKLMDGRTT

SEQ ID NO: 136314 - protein, 22 aa, Mycobacterium avium
RGKYLWLLLDGCDTALVVHLGM

SEQ ID NO: 136315 - protein, 25 aa, Mycobacterium avium
RGLFDGALDLWLALTAAALAGAAKR

SEQ ID NO: 136316 - protein, 18 aa, Mycobacterium avium
RGLHVGVLVLRQPGRQPA

SEQ ID NO: 136317 - protein, 17 aa, Mycobacterium avium
RGPLPPVRYGAASLIVV

SEQ ID NO: 136318 - protein, 25 aa, Mycobacterium avium
RGSKNVLLVFFPLAFTGICQGELDQ

SEQ ID NO: 136319 - protein, 19 aa, Mycobacterium avium
RGWLSLRQAEIIRKAWVPP

SEQ ID NO: 136320 - protein, 17 aa, Mycobacterium avium
RIATWHYQFHRLRSPFR

SEQ ID NO: 136321 - protein, 23 aa, Mycobacterium avium
RIERGLWLTALLRATLAVVRGAA

SEQ ID NO: 136322 - protein, 17 aa, Mycobacterium avium
RILDGGLAAWRAAGGRL

SEQ ID NO: 136323 - protein, 17 aa, Mycobacterium avium
RILDGGLAAWRATGGRL

SEQ ID NO: 136324 - protein, 17 aa, Mycobacterium avium
RIVLFRKPIERRAKDTV

SEQ ID NO: 136325 - protein, 19 aa, Mycobacterium avium
RIVRPLPRRPPPPGSPRES

SEQ ID NO: 136326 - protein, 21 aa, Mycobacterium avium
RKKLFRGLFRGTGKYYSGVKW

SEQ ID NO: 136327 - protein, 17 aa, Mycobacterium avium
RLAVSVRRWTACGAVCG

SEQ ID NO: 136328 - protein, 17 aa, Mycobacterium avium
RLDYEVPLLLSALSPRM

SEQ ID NO: 136329 - protein, 22 aa, Mycobacterium avium
RLGFMLHAIIWISVVPQHLTSV

SEQ ID NO: 136330 - protein, 17 aa, Mycobacterium avium
RLGLDIMLIGVWNTFQV

SEQ ID NO: 136331 - protein, 23 aa, Mycobacterium avium
RLLDPQHRLLLETAWRAVEHCGT

SEQ ID NO: 136332 - protein, 20 aa, Mycobacterium avium
RLMRAPIWIYRARGGAVFGS

SEQ ID NO: 136333 - protein, 17 aa, Mycobacterium avium
RLPMTFVLFNNNAHAMC

SEQ ID NO: 136334 - protein, 20 aa, Mycobacterium avium
RLPMYFWVAGWETCRRMLAF

SEQ ID NO: 136335 - protein, 17 aa, Mycobacterium avium
RLQPHYIELAFKAAFTR

SEQ ID NO: 136336 - protein, 20 aa, Mycobacterium avium
RLQQQAVLRIYRGCLALADA

SEQ ID NO: 136337 - protein, 23 aa, Mycobacterium avium
RLRDLLKFDFYFADSATFRDNIA

SEQ ID NO: 136338 - protein, 24 aa, Mycobacterium avium
RLRDLLKFDFYFADSATFRDNIAE

SEQ ID NO: 136339 - protein, 18 aa, Mycobacterium avium
RLRIVVLIGIPTVKRNLG

SEQ ID NO: 136340 - protein, 18 aa, Mycobacterium avium
RLRMHQRWPIVMVDEFQD

SEQ ID NO: 136341 - protein, 22 aa, Mycobacterium avium
RLTFLAVRRWYGWSAGRIINLD

SEQ ID NO: 136342 - protein, 20 aa, Mycobacterium avium
RLVNPPLLVPVLRAGLGMVD

SEQ ID NO: 136343 - protein, 17 aa, Mycobacterium avium
RLYQLLRYADYNHFDSD

SEQ ID NO: 136344 - protein, 17 aa, Mycobacterium avium
RMRHDMYWSGDLAYRDA

SEQ ID NO: 136345 - protein, 19 aa, Mycobacterium avium
RNRPHLVLDGLRLAAAVVG

SEQ ID NO: 136346 - protein, 18 aa, Mycobacterium avium
RPDPLPWHPLGMAIDVMI

SEQ ID NO: 136347 - protein, 21 aa, Mycobacterium avium
RPDPLPWHPLGMAIDVMIPDP

SEQ ID NO: 136348 - protein, 17 aa, Mycobacterium avium
RPFSVFYSLAVLSVGQE

SEQ ID NO: 136349 - protein, 20 aa, Mycobacterium avium
RPLYEPGQKQALWLTERRSQ

SEQ ID NO: 136350 - protein, 20 aa, Mycobacterium avium
RPPRIGIPLKVMYALGLCGD

SEQ ID NO: 136351 - protein, 17 aa, Mycobacterium avium
RPPRMLVLLHLDGSVDR

SEQ ID NO: 136352 - protein, 18 aa, Mycobacterium avium
RPPRRGRRWPPCTASPTW

SEQ ID NO: 136353 - protein, 23 aa, Mycobacterium avium
RPQAYLIYALLVCPTKDGRWLQF

SEQ ID NO: 136354 - protein, 24 aa, Mycobacterium avium
RPQAYLIYALLVCPTKDGRWLQFA

SEQ ID NO: 136355 - protein, 17 aa, Mycobacterium avium
RPRLFLVSAGNIRDLRG

SEQ ID NO: 136356 - protein, 20 aa, Mycobacterium avium
RPSPLTPISSLIFGAAADAA

SEQ ID NO: 136357 - protein, 19 aa, Mycobacterium avium
RPTLKAKILPIIAGTLFPN

SEQ ID NO: 136358 - protein, 24 aa, Mycobacterium avium
RPVPLWQHVLVGKRLFDLFDYRNA

SEQ ID NO: 136359 - protein, 23 aa, Mycobacterium avium
RPVREWCEMWLSAQPVRAPATER

SEQ ID NO: 136360 - protein, 25 aa, Mycobacterium avium
RPVVIGPITFLLLSKGVDGAGGPIE

SEQ ID NO: 136361 - protein, 17 aa, Mycobacterium avium
RQAALNRLLFPGPTKEL

SEQ ID NO: 136362 - protein, 19 aa, Mycobacterium avium
RQGDWVYLPKATTWRQLPD

SEQ ID NO: 136363 - protein, 27 aa, Mycobacterium avium
RQNSVLQMLLLLLRDPKNLQLAEPARG

SEQ ID NO: 136364 - protein, 26 aa, Mycobacterium avium
RQNSVLQMLLLLLRDPKNLQPAEPAR

SEQ ID NO: 136365 - protein, 32 aa, Mycobacterium avium
RQPGVTPLWMAPYAPFGFMTPAAWVALHAQRY

SEQ ID NO: 136366 - protein, 17 aa, Mycobacterium avium
RQQFSLLFTTRVLGGEL

SEQ ID NO: 136367 - protein, 25 aa, Mycobacterium avium
RRCRLVTERLWPTLLEPLRSRRHAR

SEQ ID NO: 136368 - protein, 18 aa, Mycobacterium avium
RRGAPHIHLWMAPPISPG

SEQ ID NO: 136369 - protein, 18 aa, Mycobacterium avium
RRGCPVRHLILLDALLVI

SEQ ID NO: 136370 - protein, 19 aa, Mycobacterium avium
RRGCPVRHLILLDALLVIP

SEQ ID NO: 136371 - protein, 22 aa, Mycobacterium avium
RRGIPVILRPAVLAKLMDGRTT

SEQ ID NO: 136372 - protein, 19 aa, Mycobacterium avium
RRHPMLRVRFLPDGTQRIT

SEQ ID NO: 136373 - protein, 21 aa, Mycobacterium avium
RRIRWGARAMLWQASSLKAVR

SEQ ID NO: 136374 - protein, 20 aa, Mycobacterium avium
RRISIYWTWSYPWESQRDIQ

SEQ ID NO: 136375 - protein, 22 aa, Mycobacterium avium
RRLVRHAHWPEAWYPMRADAGP

SEQ ID NO: 136376 - protein, 18 aa, Mycobacterium avium
RRQAALNRLLFPGPTKEL

SEQ ID NO: 136377 - protein, 20 aa, Mycobacterium avium
RRRCGWFDAVVARYATRVNG

SEQ ID NO: 136378 - protein, 18 aa, Mycobacterium avium
RRTGLLDKLLLLAGIPET

SEQ ID NO: 136379 - protein, 21 aa, Mycobacterium avium
RSAGNLLLLRGFLTAGVESGA

SEQ ID NO: 136380 - protein, 17 aa, Mycobacterium avium
RSEALRQLSLTPGHEHD

SEQ ID NO: 136381 - protein, 23 aa, Mycobacterium avium
RSRPPARWWPAPPARRRGAVVCR

SEQ ID NO: 136382 - protein, 20 aa, Mycobacterium avium
RSSGNPLLLRGFLTAARDTG

SEQ ID NO: 136383 - protein, 21 aa, Mycobacterium avium
RSVRALLTGYLLYTLGGDKRY

SEQ ID NO: 136384 - protein, 17 aa, Mycobacterium avium
RSWRLPWPAGTTVYELD

SEQ ID NO: 136385 - protein, 19 aa, Mycobacterium avium
RTARWPRWRPMFALSRMPC

SEQ ID NO: 136386 - protein, 24 aa, Mycobacterium avium
RTFEFLEWFLETVPITPIWLCPLR

SEQ ID NO: 136387 - protein, 21 aa, Mycobacterium avium
RTIHEMLLSDAFWDDIFRELS

SEQ ID NO: 136388 - protein, 21 aa, Mycobacterium avium
RTIHEMLLSDGFWDDIFRELS

SEQ ID NO: 136389 - protein, 24 aa, Mycobacterium avium
RTLEFLEWFLETVPITPIWLCPLR

SEQ ID NO: 136390 - protein, 17 aa, Mycobacterium avium
RTNLAAVLLQMAALRLG

SEQ ID NO: 136391 - protein, 22 aa, Mycobacterium avium
RTPIWRFPKLDVPLPAPARWAM

SEQ ID NO: 136392 - protein, 19 aa, Mycobacterium avium
RTWPRRWPPPTPEVPAPRC

SEQ ID NO: 136393 - protein, 21 aa, Mycobacterium avium
RVEFAQRLFLALAVLEHPRGF

SEQ ID NO: 136394 - protein, 25 aa, Mycobacterium avium
RVEFKLRDWLFARQRYWGEPFPIVY

SEQ ID NO: 136395 - protein, 17 aa, Mycobacterium avium
RVFALLRNARPVLLNFA

SEQ ID NO: 136396 - protein, 19 aa, Mycobacterium avium
RVFRPLDVDLRWVAALLLR

SEQ ID NO: 136397 - protein, 17 aa, Mycobacterium avium
RVLPIWPDWVRRWPTPS

SEQ ID NO: 136398 - protein, 18 aa, Mycobacterium avium
RVLPIWPDWVRRWPTPSA

SEQ ID NO: 136399 - protein, 17 aa, Mycobacterium avium
RVNFLRPFFAGTESRYE

SEQ ID NO: 136400 - protein, 18 aa, Mycobacterium avium
RVNHWLWRRGARLAARIS

SEQ ID NO: 136401 - protein, 17 aa, Mycobacterium avium
RVRFLPDGTQRITPAVE

SEQ ID NO: 136402 - protein, 22 aa, Mycobacterium avium
RVRLMRWGLVPPWAKAGRDGAP

SEQ ID NO: 136403 - protein, 20 aa, Mycobacterium avium
RWAGVPFYLRTGKRLGRRVT

SEQ ID NO: 136404 - protein, 21 aa, Mycobacterium avium
RWAGVPFYLRTGKRLGRRVTE

SEQ ID NO: 136405 - protein, 25 aa, Mycobacterium avium
RWALLPLVPLIPKPVFRRLLSVVTG

SEQ ID NO: 136406 - protein, 17 aa, Mycobacterium avium
RWFGGLDGFGWAACHSG

SEQ ID NO: 136407 - protein, 20 aa, Mycobacterium avium
RWPECILFERGGDGLISHIS

SEQ ID NO: 136408 - protein, 22 aa, Mycobacterium avium
RWPTDLDLWWAQTIALLPDGRL

SEQ ID NO: 136409 - protein, 17 aa, Mycobacterium avium
RWRAVARSAARQSRRAH

SEQ ID NO: 136410 - protein, 20 aa, Mycobacterium avium
RYNEVIHYWALDGGWDCFAN

SEQ ID NO: 136411 - protein, 21 aa, Mycobacterium avium
RYSMDWYYPILGSAVRGPAAV

SEQ ID NO: 136412 - protein, 20 aa, Mycobacterium avium
RYYRELTPLLKPLPGARALL

SEQ ID NO: 136413 - protein, 21 aa, Mycobacterium avium
SAAGTRWLWDAGIRPGMTIAW

SEQ ID NO: 136414 - protein, 22 aa, Mycobacterium avium
SALGALRLIQAFTPALETAHGS

SEQ ID NO: 136415 - protein, 22 aa, Mycobacterium avium
SAVLHRFLRWRLAGYDPDRHLG

SEQ ID NO: 136416 - protein, 19 aa, Mycobacterium avium
SAWTLGFYALHNWMLSLFD

SEQ ID NO: 136417 - protein, 17 aa, Mycobacterium avium
SCRCRTARWPRWRPMFA

SEQ ID NO: 136418 - protein, 20 aa, Mycobacterium avium
SDDRIFLISPLASVTGVLQA

SEQ ID NO: 136419 - protein, 26 aa, Mycobacterium avium
SDLSDYFYVWLRRSLRSVHPRLLSTM

SEQ ID NO: 136420 - protein, 21 aa, Mycobacterium avium
SDMGEFFMPYPGTRINQDSTP

SEQ ID NO: 136421 - protein, 26 aa, Mycobacterium avium
SDRACSWLPLYHDMGLAFLLTSALSG

SEQ ID NO: 136422 - protein, 25 aa, Mycobacterium avium
SEHEFVLTGLALLGATRPGVESLQS

SEQ ID NO: 136423 - protein, 24 aa, Mycobacterium avium
SEIGQAVSWLYRTSPRGLAGPLPA

SEQ ID NO: 136424 - protein, 22 aa, Mycobacterium avium
SEPLTEAIPLWKRPRTAPSSPA

SEQ ID NO: 136425 - protein, 17 aa, Mycobacterium avium
SFELHTMSQILLLHAVL

SEQ ID NO: 136426 - protein, 20 aa, Mycobacterium avium
SFPVQYFYHLYRSDELQIFL

SEQ ID NO: 136427 - protein, 19 aa, Mycobacterium avium
SFRPSGWTRLWRLGLGSSG

SEQ ID NO: 136428 - protein, 20 aa, Mycobacterium avium
SGKPLVLNIIPSIDTPVCAT

SEQ ID NO: 136429 - protein, 20 aa, Mycobacterium avium
SGLYMLHRLRQLGIPARVLE

SEQ ID NO: 136430 - protein, 17 aa, Mycobacterium avium
SGPLFRFALFATRRDQF

SEQ ID NO: 136431 - protein, 21 aa, Mycobacterium avium
SGVWELFWPDFPIGGLYKFKV

SEQ ID NO: 136432 - protein, 23 aa, Mycobacterium avium
SGVYLTLISPLGRFLLAAAIREA

SEQ ID NO: 136433 - protein, 21 aa, Mycobacterium avium
SGWIPPHLRLPAHVTLLEPAA

SEQ ID NO: 136434 - protein, 17 aa, Mycobacterium avium
SIAWLIWHSARVQDIQL

SEQ ID NO: 136435 - protein, 17 aa, Mycobacterium avium
SIDLLVDLWLDKQRFVV

SEQ ID NO: 136436 - protein, 24 aa, Mycobacterium avium
SIGVRSICYLPLTYDHRLIDGADA

SEQ ID NO: 136437 - protein, 24 aa, Mycobacterium avium
SIGWTWMHYLPPTPGFAFLDHTVI

SEQ ID NO: 136438 - protein, 25 aa, Mycobacterium avium
SKGLQYPIVYLPFAFHRNTTDSDVV

SEQ ID NO: 136439 - protein, 17 aa, Mycobacterium avium
SKLLARLPLLHPEGLRD

SEQ ID NO: 136440 - protein, 23 aa, Mycobacterium avium
SLDGANLLPPLRPPANANPNILP

SEQ ID NO: 136441 - protein, 24 aa, Mycobacterium avium
SLEAWFMHIPGLKVIVPATPRDGK

SEQ ID NO: 136442 - protein, 22 aa, Mycobacterium avium
SLQLWVMMETPRAFLRAEEVAS

SEQ ID NO: 136443 - protein, 20 aa, Mycobacterium avium
SLRDNLWYLIDAKAATAIAV

SEQ ID NO: 136444 - protein, 19 aa, Mycobacterium avium
SLRTQVPLLLDEYTRNPST

SEQ ID NO: 136445 - protein, 19 aa, Mycobacterium avium
SLWQPDLFLLRQIHAAPRL

SEQ ID NO: 136446 - protein, 19 aa, Mycobacterium avium
SMAGAVMPYVSWLTAVAEQ

SEQ ID NO: 136447 - protein, 26 aa, Mycobacterium avium
SMRVPGWWVLDPMRALPVAVGGHPVV

SEQ ID NO: 136448 - protein, 24 aa, Mycobacterium avium
SMTKLWARMWLLRFTWQRAIDSGD

SEQ ID NO: 136449 - protein, 26 aa, Mycobacterium avium
SMTRLWARMWLLRFTWQRAIDSGDLT

SEQ ID NO: 136450 - protein, 17 aa, Mycobacterium avium
SNFPRSAPIWKNIAAAL

SEQ ID NO: 136451 - protein, 23 aa, Mycobacterium avium
SNLLKAILPNRKFPYPKSLYAVE

SEQ ID NO: 136452 - protein, 20 aa, Mycobacterium avium
SPAWGFCMWAIAPDQMYSVE

SEQ ID NO: 136453 - protein, 20 aa, Mycobacterium avium
SPAWGFCMWAITPDQMYSVD

SEQ ID NO: 136454 - protein, 20 aa, Mycobacterium avium
SPIVGIWHSGGARLAEGVKA

SEQ ID NO: 136455 - protein, 22 aa, Mycobacterium avium
SPKESWLRVLLIDAGFPRPQTQ

SEQ ID NO: 136456 - protein, 24 aa, Mycobacterium avium
SPKESWLRVLLIDAGFPRPQTQIA

SEQ ID NO: 136457 - protein, 25 aa, Mycobacterium avium
SPKETWLRLLLIRAGLPRPQTQIPV

SEQ ID NO: 136458 - protein, 18 aa, Mycobacterium avium
SQGFPLPWQLVVGALQAQ

SEQ ID NO: 136459 - protein, 25 aa, Mycobacterium avium
SRERGYAYFLYPPHAPLTETAYDRL

SEQ ID NO: 136460 - protein, 17 aa, Mycobacterium avium
SRFYFLTGKGALLQLGL

SEQ ID NO: 136461 - protein, 22 aa, Mycobacterium avium
SRGWYPIIIALDQALAAIDPAY

SEQ ID NO: 136462 - protein, 20 aa, Mycobacterium avium
SRLWWLLNLVITRGTPPRLE

SEQ ID NO: 136463 - protein, 25 aa, Mycobacterium avium
SRRCFRTSAWWWPPTCRPRRWPTPS

SEQ ID NO: 136464 - protein, 19 aa, Mycobacterium avium
SRRFYESVFGWPVLLEVPD

SEQ ID NO: 136465 - protein, 20 aa, Mycobacterium avium
SRRFYESVFGWPVLLEVPDN

SEQ ID NO: 136466 - protein, 23 aa, Mycobacterium avium
SRRLWTVLIFMLWHAIFVEHSVV

SEQ ID NO: 136467 - protein, 21 aa, Mycobacterium avium
SRRYSPWLAYSQSKLANLLFT

SEQ ID NO: 136468 - protein, 21 aa, Mycobacterium avium
STGIPFLPMSMAKGLLPDAHP

SEQ ID NO: 136469 - protein, 23 aa, Mycobacterium avium
STGRFGIHPVLLDAALHALGVAD

SEQ ID NO: 136470 - protein, 18 aa, Mycobacterium avium
STLLRLRRPRRHRAVLRA

SEQ ID NO: 136471 - protein, 19 aa, Mycobacterium avium
STLRPPQARVLLIAALAAG

SEQ ID NO: 136472 - protein, 17 aa, Mycobacterium avium
STMLWGGQPLPTINPLY

SEQ ID NO: 136473 - protein, 17 aa, Mycobacterium avium
STPPLLEVVRPATFLFA

SEQ ID NO: 136474 - protein, 25 aa, Mycobacterium avium
SVLGQAYLLPFWDKNLERPNGGKGG

SEQ ID NO: 136475 - protein, 20 aa, Mycobacterium avium
SVRALLTGYLLYTLGGDKRY

SEQ ID NO: 136476 - protein, 24 aa, Mycobacterium avium
SVRMYKLRRYFPPDSRPGQPPVGP

SEQ ID NO: 136477 - protein, 24 aa, Mycobacterium avium
SVVAPLLSRSLILQLRPLSADDIR

SEQ ID NO: 136478 - protein, 19 aa, Mycobacterium avium
SVWKLFYRVKSSVLLYVGA

SEQ ID NO: 136479 - protein, 23 aa, Mycobacterium avium
SVYYAIALPILRTPWRIDPNGAE

SEQ ID NO: 136480 - protein, 20 aa, Mycobacterium avium
SWLPFYHDLGLILGICAPIL

SEQ ID NO: 136481 - protein, 18 aa, Mycobacterium avium
SWRVLLEDLNIAWGQHHN

SEQ ID NO: 136482 - protein, 24 aa, Mycobacterium avium
SYPDRIIPCQLPWLLDPELGAKMI

SEQ ID NO: 136483 - protein, 22 aa, Mycobacterium avium
SYTELIPFRLTVLHAAWLIDNG

SEQ ID NO: 136484 - protein, 17 aa, Mycobacterium avium
TAAALMRLALDTAGRWG

SEQ ID NO: 136485 - protein, 23 aa, Mycobacterium avium
TAALRKWLLQLHTHPAFTAWRYN

SEQ ID NO: 136486 - protein, 20 aa, Mycobacterium avium
TAFRLLGLPVIITDNIPAVS

SEQ ID NO: 136487 - protein, 17 aa, Mycobacterium avium
TARWPRWRPMFAPSRMP

SEQ ID NO: 136488 - protein, 19 aa, Mycobacterium avium
TASAIAWIGYDPPQVPGFD

SEQ ID NO: 136489 - protein, 17 aa, Mycobacterium avium
TASPFRWLAWLSESRAT

SEQ ID NO: 136490 - protein, 17 aa, Mycobacterium avium
TCWPWLQAEWRLISEHV

SEQ ID NO: 136491 - protein, 18 aa, Mycobacterium avium
TDEAPLLATYAFLPIVRA

SEQ ID NO: 136492 - protein, 24 aa, Mycobacterium avium
TDNYRSLWMYLKELEFRQGFVDIA

SEQ ID NO: 136493 - protein, 24 aa, Mycobacterium avium
TEAFHVDLLWLLEIGSNQKIAGWA

SEQ ID NO: 136494 - protein, 25 aa, Mycobacterium avium
TEAFHVDLLWLLEIGSNQKIAGWAT

SEQ ID NO: 136495 - protein, 18 aa, Mycobacterium avium
TEALLRWQHPTLGLLMPD

SEQ ID NO: 136496 - protein, 23 aa, Mycobacterium avium
TENDFVLLCDPPAELRLTGAGVA

SEQ ID NO: 136497 - protein, 24 aa, Mycobacterium avium
TETEQTFLLRLLGGELRQGALAGI

SEQ ID NO: 136498 - protein, 20 aa, Mycobacterium avium
TEVRMRVTLSYFVEPNPSSR

SEQ ID NO: 136499 - protein, 19 aa, Mycobacterium avium
TEWFTVDWHRAIVDKWRAA

SEQ ID NO: 136500 - protein, 19 aa, Mycobacterium avium
TEWFTVDWHRAIVDKWRGA

SEQ ID NO: 136501 - protein, 25 aa, Mycobacterium avium
TEYDLLRRNQILFTFLHLAASRACT

SEQ ID NO: 136502 - protein, 25 aa, Mycobacterium avium
TGAPGRAWLFFGARNRALDFLYADE

SEQ ID NO: 136503 - protein, 22 aa, Mycobacterium avium
TGGFSLLHRLPDRPVQRVALDA

SEQ ID NO: 136504 - protein, 25 aa, Mycobacterium avium
TGKGALLQLGLLQLALRLAVENGFV

SEQ ID NO: 136505 - protein, 25 aa, Mycobacterium avium
TGKYYSGVKWTWYRPIYAGRPVLAE

SEQ ID NO: 136506 - protein, 20 aa, Mycobacterium avium
THRFLAHLPGYQGWQWAVVV

SEQ ID NO: 136507 - protein, 20 aa, Mycobacterium avium
THVRLGGPGSWLLALPAHHI

SEQ ID NO: 136508 - protein, 20 aa, Mycobacterium avium
TIQLTAFLRGLPADGWLRII

SEQ ID NO: 136509 - protein, 19 aa, Mycobacterium avium
TKPFSFRVLVARLRALVRR

SEQ ID NO: 136510 - protein, 25 aa, Mycobacterium avium
TLAVNLLGPIRLIATLLPALLRRPH

SEQ ID NO: 136511 - protein, 20 aa, Mycobacterium avium
TLMNSPFWRAGEGGPGDLNP

SEQ ID NO: 136512 - protein, 19 aa, Mycobacterium avium
TLPAFPLPLGDGPVPCDML

SEQ ID NO: 136513 - protein, 27 aa, Mycobacterium avium
TLPHPLAHLRAFVLIPWLAVDPDAQLT

SEQ ID NO: 136514 - protein, 17 aa, Mycobacterium avium
TLRLHPPLIILMRVAKG

SEQ ID NO: 136515 - protein, 17 aa, Mycobacterium avium
TLRRALSVLPRTGFLNL

SEQ ID NO: 136516 - protein, 22 aa, Mycobacterium avium
TLSVFLQLMLFPDTPRSVLRSL

SEQ ID NO: 136517 - protein, 17 aa, Mycobacterium avium
TMISLETCPPMGHPHHH

SEQ ID NO: 136518 - protein, 22 aa, Mycobacterium avium
TMPRHGWWFPANSRRPGQHVLS

SEQ ID NO: 136519 - protein, 20 aa, Mycobacterium avium
TMSQIFLLRAVLPAMQAAGW

SEQ ID NO: 136520 - protein, 17 aa, Mycobacterium avium
TMTAIEWLFWRSTKKVD

SEQ ID NO: 136521 - protein, 24 aa, Mycobacterium avium
TNLRRLISLFELLRARSQLIIITH

SEQ ID NO: 136522 - protein, 24 aa, Mycobacterium avium
TPDDVFLPVIPTPFGFGIWTSHTT

SEQ ID NO: 136523 - protein, 18 aa, Mycobacterium avium
TPLFFAQAVGRFVRSRRP

SEQ ID NO: 136524 - protein, 17 aa, Mycobacterium avium
TPRMRRIRFSGPRLQGL

SEQ ID NO: 136525 - protein, 18 aa, Mycobacterium avium
TPSLPEPASLPSGPSGDL

SEQ ID NO: 136526 - protein, 21 aa, Mycobacterium avium
TPSLWQPDLFLLRQIHAAPRL

SEQ ID NO: 136527 - protein, 22 aa, Mycobacterium avium
TQLRWRPLSFWPAHTAVTVDAG

SEQ ID NO: 136528 - protein, 18 aa, Mycobacterium avium
TQLSFGLIAPFIPAAGAP

SEQ ID NO: 136529 - protein, 20 aa, Mycobacterium avium
TRLTWRLLPFMWLDIDEAVK

SEQ ID NO: 136530 - protein, 21 aa, Mycobacterium avium
TRNDVFAAAWRLALMGLRRGE

SEQ ID NO: 136531 - protein, 24 aa, Mycobacterium avium
TRRVRLMRWGLVPPWAKAGPDGAP

SEQ ID NO: 136532 - protein, 24 aa, Mycobacterium avium
TRRVRLMRWGLVPPWAKAGPGGAP

SEQ ID NO: 136533 - protein, 22 aa, Mycobacterium avium
TRYHSLTILPESLPPVLEVTAH

SEQ ID NO: 136534 - protein, 20 aa, Mycobacterium avium
TRYLPPFPYFMDNPNAFRVL

SEQ ID NO: 136535 - protein, 20 aa, Mycobacterium avium
TSLPLLLIAASLRVGMRDRV

SEQ ID NO: 136536 - protein, 21 aa, Mycobacterium avium
TTELFPIPPWSVAPDVVAAAG

SEQ ID NO: 136537 - protein, 21 aa, Mycobacterium avium
TTLEALWWDRPFTLNGVDIGA

SEQ ID NO: 136538 - protein, 20 aa, Mycobacterium avium
TTRYAVFVLSPLRINPWALT

SEQ ID NO: 136539 - protein, 17 aa, Mycobacterium avium
TVGKYAESLLTLGWAEE

SEQ ID NO: 136540 - protein, 21 aa, Mycobacterium avium
TVIAWIWARTVTCPNPACGIA

SEQ ID NO: 136541 - protein, 19 aa, Mycobacterium avium
TVLPRKLIELLLGEPGRRD

SEQ ID NO: 136542 - protein, 17 aa, Mycobacterium avium
TVNFCRSVLRWLRAGYP

SEQ ID NO: 136543 - protein, 17 aa, Mycobacterium avium
TVPAIYALLLRHKDFAG

SEQ ID NO: 136544 - protein, 19 aa, Mycobacterium avium
TVPEFPNFFIIYGPGTHLA

SEQ ID NO: 136545 - protein, 19 aa, Mycobacterium avium
TWNGPLISLAMKVPAALAA

SEQ ID NO: 136546 - protein, 26 aa, Mycobacterium avium
TWTAALIGPWWPAPSTALRAGAQHWS

SEQ ID NO: 136547 - protein, 17 aa, Mycobacterium avium
TYGLLRYLNPQAGLDVS

SEQ ID NO: 136548 - protein, 19 aa, Mycobacterium avium
TYHVQLAGFFRWLANEDGA

SEQ ID NO: 136549 - protein, 19 aa, Mycobacterium avium
TYKAWFPLTRRWLGFEDAH

SEQ ID NO: 136550 - protein, 23 aa, Mycobacterium avium
TYLQALDWYLDHLGLIVSDFLFF

SEQ ID NO: 136551 - protein, 25 aa, Mycobacterium avium
TYQRWLGTRLPYYANWIRIKSYWGT

SEQ ID NO: 136552 - protein, 19 aa, Mycobacterium avium
VAAHVPYLAWLLQNSTNST

SEQ ID NO: 136553 - protein, 20 aa, Mycobacterium avium
VAHPVLMPVFRLSGLTELTT

SEQ ID NO: 136554 - protein, 17 aa, Mycobacterium avium
VALAWLLAKGPDVVPIP

SEQ ID NO: 136555 - protein, 18 aa, Mycobacterium avium
VALFLPLLAEVEQKIIGC

SEQ ID NO: 136556 - protein, 20 aa, Mycobacterium avium
VAPGLYSWLPLGLRVLRRIE

SEQ ID NO: 136557 - protein, 24 aa, Mycobacterium avium
VAVNLLGPIRLIATLLPALLRRPH

SEQ ID NO: 136558 - protein, 24 aa, Mycobacterium avium
VAWNVPLFLAVNKLGPALLAGCTV

SEQ ID NO: 136559 - protein, 22 aa, Mycobacterium avium
VDAPLLINLVLGGLTPLQSAAR

SEQ ID NO: 136560 - protein, 23 aa, Mycobacterium avium
VDDFVLYWGFLALAPVRSGRHLF

SEQ ID NO: 136561 - protein, 18 aa, Mycobacterium avium
VDDFVLYWGFLALAQVRS

SEQ ID NO: 136562 - protein, 25 aa, Mycobacterium avium
VDDPLAMYLFDLCTLPLNLAGNCGM

SEQ ID NO: 136563 - protein, 18 aa, Mycobacterium avium
VDFVLLDGWKDLYLPVLE

SEQ ID NO: 136564 - protein, 19 aa, Mycobacterium avium
VDFVLLDGWKDLYLPVLEL

SEQ ID NO: 136565 - protein, 17 aa, Mycobacterium avium
VDIGYPVLVRPSYVLGG

SEQ ID NO: 136566 - protein, 21 aa, Mycobacterium avium
VDLLNRFVGLGLRFISAGTDV

SEQ ID NO: 136567 - protein, 19 aa, Mycobacterium avium
VDRALIAAYAGGLVPILCL

SEQ ID NO: 136568 - protein, 27 aa, Mycobacterium avium
VDRVQFWMLPLDDPLPWLLADRRSVRV

SEQ ID NO: 136569 - protein, 17 aa, Mycobacterium avium
VEDGALWLLQTRAAERS

SEQ ID NO: 136570 - protein, 22 aa, Mycobacterium avium
VELFAKFMRWPVDKFVLRSVSD

SEQ ID NO: 136571 - protein, 17 aa, Mycobacterium avium
VELSAHPSLLYPLGDIV

SEQ ID NO: 136572 - protein, 18 aa, Mycobacterium avium
VEMPPLPRVHLQSAVIHG

SEQ ID NO: 136573 - protein, 17 aa, Mycobacterium avium
VEPYLQRACDWAACGRA

SEQ ID NO: 136574 - protein, 23 aa, Mycobacterium avium
VESLWAVLARTLPEPWRVEALVL

SEQ ID NO: 136575 - protein, 27 aa, Mycobacterium avium
VFGPVELTLALLPALRRARGQVVFINS

SEQ ID NO: 136576 - protein, 19 aa, Mycobacterium avium
VFIGYLRRKLEANGGPRLL

SEQ ID NO: 136577 - protein, 19 aa, Mycobacterium avium
VFLPFHLLTLRDMGLMLGE

SEQ ID NO: 136578 - protein, 20 aa, Mycobacterium avium
VFLPFHLLTLRDMGLMLGEY

SEQ ID NO: 136579 - protein, 17 aa, Mycobacterium avium
VFLQYPWQVIPDELIKP

SEQ ID NO: 136580 - protein, 24 aa, Mycobacterium avium
VFQRTPIWCFPKLDVPLPAPARWA

SEQ ID NO: 136581 - protein, 25 aa, Mycobacterium avium
VFQRTPIWCFPKLDVPLPAPARWAM

SEQ ID NO: 136582 - protein, 26 aa, Mycobacterium avium
VFRSWYILYFQLPWLPERSASWVLPL

SEQ ID NO: 136583 - protein, 23 aa, Mycobacterium avium
VFSEEFLLQRPLLTAIRRTEPTV

SEQ ID NO: 136584 - protein, 20 aa, Mycobacterium avium
VGFKWFVDGLIGGTLGFGGE

SEQ ID NO: 136585 - protein, 17 aa, Mycobacterium avium
VGILIQLARQRGVSSFA

SEQ ID NO: 136586 - protein, 18 aa, Mycobacterium avium
VGLIFPWNGPIFNANAKL

SEQ ID NO: 136587 - protein, 21 aa, Mycobacterium avium
VGLMQPWRFIRITDAALRRRI

SEQ ID NO: 136588 - protein, 23 aa, Mycobacterium avium
VGMTYIAQLDWPLADAVRWPAQY

SEQ ID NO: 136589 - protein, 17 aa, Mycobacterium avium
VIVYFYPAASTPGCTKQ

SEQ ID NO: 136590 - protein, 18 aa, Mycobacterium avium
VIVYFYPAASTPGCTKQA

SEQ ID NO: 136591 - protein, 21 aa, Mycobacterium avium
VKDLHLPWQWGAHWFLQQLVD

SEQ ID NO: 136592 - protein, 29 aa, Mycobacterium avium
VKQILASSYIWFFLAPSAPEWAIRSGATV

SEQ ID NO: 136593 - protein, 25 aa, Mycobacterium avium
VLAALRLHYLRWLLFDVGSGLHFQY

SEQ ID NO: 136594 - protein, 30 aa, Mycobacterium avium
VLDDLHWAAKPTLLLLRHLLRFGEHARVQV

SEQ ID NO: 136595 - protein, 18 aa, Mycobacterium avium
VLGGRVFRPLDVDLRWVA

SEQ ID NO: 136596 - protein, 20 aa, Mycobacterium avium
VLGLHFFNPVPVLPLVELVS

SEQ ID NO: 136597 - protein, 23 aa, Mycobacterium avium
VLGRLHFALAPQGTLFLGHAEML

SEQ ID NO: 136598 - protein, 20 aa, Mycobacterium avium
VLILAFMWLLCWMAEGDWPP

SEQ ID NO: 136599 - protein, 18 aa, Mycobacterium avium
VLLKIRLRQGFPVDLLNS

SEQ ID NO: 136600 - protein, 17 aa, Mycobacterium avium
VLLPRLLNWMSYAPDPD

SEQ ID NO: 136601 - protein, 18 aa, Mycobacterium avium
VLPIWRESELRFVTAQLG

SEQ ID NO: 136602 - protein, 20 aa, Mycobacterium avium
VMTPTAWWRVPMQSLVAGLP

SEQ ID NO: 136603 - protein, 17 aa, Mycobacterium avium
VPEFPNFFIIYGPGTHL

SEQ ID NO: 136604 - protein, 18 aa, Mycobacterium avium
VPEFPNFFIIYGPGTHLA

SEQ ID NO: 136605 - protein, 20 aa, Mycobacterium avium
VPHDIPWFPKDLQAWSVRWV

SEQ ID NO: 136606 - protein, 21 aa, Mycobacterium avium
VPHDIPWFPKDLQAWSVRWVI

SEQ ID NO: 136607 - protein, 18 aa, Mycobacterium avium
VPIYQRLQHDCDLGLGHT

SEQ ID NO: 136608 - protein, 20 aa, Mycobacterium avium
VPLIWRKRLLRKAIDFTDPL

SEQ ID NO: 136609 - protein, 23 aa, Mycobacterium avium
VPNFLPLLAERWARQRLTALARV

SEQ ID NO: 136610 - protein, 23 aa, Mycobacterium avium
VPPHPCPLSFILAPTLIAHGTQQ

SEQ ID NO: 136611 - protein, 18 aa, Mycobacterium avium
VPPPPFTWDYRLFAGPHP

SEQ ID NO: 136612 - protein, 17 aa, Mycobacterium avium
VPPPPPPVPPPAPPAPA

SEQ ID NO: 136613 - protein, 22 aa, Mycobacterium avium
VPRRLQIQLGLRVQVGLQGQQR

SEQ ID NO: 136614 - protein, 25 aa, Mycobacterium avium
VPVDRPILAPIYLPDIRVACTPYKG

SEQ ID NO: 136615 - protein, 22 aa, Mycobacterium avium
VQEETWIRVLFAKTAISTGWDC

SEQ ID NO: 136616 - protein, 19 aa, Mycobacterium avium
VQRTWPELIPLLQSGRLDV

SEQ ID NO: 136617 - protein, 24 aa, Mycobacterium avium
VRAALPLLRKAQWARIVTFSAHST

SEQ ID NO: 136618 - protein, 23 aa, Mycobacterium avium
VRKLPIFGGPFRWEDLEWLRSTT

SEQ ID NO: 136619 - protein, 22 aa, Mycobacterium avium
VRMVPRRVLLERLLDGFPPGRI

SEQ ID NO: 136620 - protein, 19 aa, Mycobacterium avium
VRPDRLLTGKLLRCLRSPA

SEQ ID NO: 136621 - protein, 18 aa, Mycobacterium avium
VRPQPLVPLYLRRPDATP

SEQ ID NO: 136622 - protein, 17 aa, Mycobacterium avium
VRRIRLHDARHSCASLM

SEQ ID NO: 136623 - protein, 18 aa, Mycobacterium avium
VRRYIIGCALRWMRDFHA

SEQ ID NO: 136624 - protein, 19 aa, Mycobacterium avium
VRSFLLRLGGIRAVGYSPE

SEQ ID NO: 136625 - protein, 18 aa, Mycobacterium avium
VRVLRRWGPARIAYLLGL

SEQ ID NO: 136626 - protein, 19 aa, Mycobacterium avium
VSFPRVLSELFWIGRYGER

SEQ ID NO: 136627 - protein, 19 aa, Mycobacterium avium
VSPDAFFQFPTSKYGLALD

SEQ ID NO: 136628 - protein, 17 aa, Mycobacterium avium
VTPGWFASFIPVTFPVA

SEQ ID NO: 136629 - protein, 24 aa, Mycobacterium avium
VTSEHPLWLFTLRAQSWADDYGTT

SEQ ID NO: 136630 - protein, 17 aa, Mycobacterium avium
VTSFYDWSNIDPKWREA

SEQ ID NO: 136631 - protein, 18 aa, Mycobacterium avium
VTVIYRWARTADLAAALA

SEQ ID NO: 136632 - protein, 18 aa, Mycobacterium avium
VVEAVKFLLRPDIDHLVG

SEQ ID NO: 136633 - protein, 23 aa, Mycobacterium avium
VVEFMLLDRLFPRSVFYSLRLAE

SEQ ID NO: 136634 - protein, 21 aa, Mycobacterium avium
VVGKYWVIDEIRPARIHANVP

SEQ ID NO: 136635 - protein, 17 aa, Mycobacterium avium
VVHGRGERLCWWGGPWP

SEQ ID NO: 136636 - protein, 18 aa, Mycobacterium avium
VVRQEPRLNWAIGDRADG

SEQ ID NO: 136637 - protein, 23 aa, Mycobacterium avium
VVSIPTLILFKDGQPVKRIVGAK

SEQ ID NO: 136638 - protein, 17 aa, Mycobacterium avium
VYALFSNGTNLASAFSS

SEQ ID NO: 136639 - protein, 19 aa, Mycobacterium avium
WAGVPFYLRTGKRLGRRVT

SEQ ID NO: 136640 - protein, 17 aa, Mycobacterium avium
WALAWFATTRIGAVAVP

SEQ ID NO: 136641 - protein, 17 aa, Mycobacterium avium
WCDPVWLDFPGIAFGRP

SEQ ID NO: 136642 - protein, 25 aa, Mycobacterium avium
WCVSRQLWWGHRIPIWYGPNGEQRC

SEQ ID NO: 136643 - protein, 19 aa, Mycobacterium avium
WDDLPWLRSLTDLPLIIKG

SEQ ID NO: 136644 - protein, 18 aa, Mycobacterium avium
WDLPTVFGPIAVTYHLTG

SEQ ID NO: 136645 - protein, 17 aa, Mycobacterium avium
WFDHWYRHLVALGVRFV

SEQ ID NO: 136646 - protein, 17 aa, Mycobacterium avium
WFFGWLTDRCGSLAAPM

SEQ ID NO: 136647 - protein, 23 aa, Mycobacterium avium
WFGTWHYWWQAHLLDCLVDAQQR

SEQ ID NO: 136648 - protein, 24 aa, Mycobacterium avium
WFGTWHYWWQAHLLDCLVDAQQRD

SEQ ID NO: 136649 - protein, 17 aa, Mycobacterium avium
WHLAVLPLTDGGAVVSL

SEQ ID NO: 136650 - protein, 27 aa, Mycobacterium avium
WHSNTGMVQLFYLLNPPTGAQTVTASV

SEQ ID NO: 136651 - protein, 18 aa, Mycobacterium avium
WIAEGLLPYLPPHAQDRL

SEQ ID NO: 136652 - protein, 18 aa, Mycobacterium avium
WIPGCKPTYDRWAEYGGP

SEQ ID NO: 136653 - protein, 27 aa, Mycobacterium avium
WKRFNLFNLVWNTLLALLFEWGVGLQH

SEQ ID NO: 136654 - protein, 18 aa, Mycobacterium avium
WLAALGFQPGIGGPGSIS

SEQ ID NO: 136655 - protein, 20 aa, Mycobacterium avium
WLIRVFLALWGWPLKDPAAE

SEQ ID NO: 136656 - protein, 17 aa, Mycobacterium avium
WLLARLVGLARARRMLL

SEQ ID NO: 136657 - protein, 17 aa, Mycobacterium avium
WLLICEPPQQSLTQLAD

SEQ ID NO: 136658 - protein, 17 aa, Mycobacterium avium
WLLRSLGVDAFLNEIWA

SEQ ID NO: 136659 - protein, 17 aa, Mycobacterium avium
WLNALTANPLRTVAVTH

SEQ ID NO: 136660 - protein, 18 aa, Mycobacterium avium
WNAYSFLALYAPKIGTWR

SEQ ID NO: 136661 - protein, 18 aa, Mycobacterium avium
WPATLDRLLALGGPGARY

SEQ ID NO: 136662 - protein, 18 aa, Mycobacterium avium
WPELIPLLQSGRLDVDGI

SEQ ID NO: 136663 - protein, 20 aa, Mycobacterium avium
WPERLFFVDEFPLTGLGKVA

SEQ ID NO: 136664 - protein, 18 aa, Mycobacterium avium
WQRLLFDNGWLLPSQPPE

SEQ ID NO: 136665 - protein, 17 aa, Mycobacterium avium
WRWAGVPVYLRTGKRMA

SEQ ID NO: 136666 - protein, 18 aa, Mycobacterium avium
WSPYLGEYVGTCLELPYV

SEQ ID NO: 136667 - protein, 17 aa, Mycobacterium avium
WTRLWRLGLGSSGPHHR

SEQ ID NO: 136668 - protein, 17 aa, Mycobacterium avium
WVGMAVSAVFRPVDVDD

SEQ ID NO: 136669 - protein, 17 aa, Mycobacterium avium
WVLAITCPYRDAAERNA

SEQ ID NO: 136670 - protein, 17 aa, Mycobacterium avium
WWDSLSAAQQRLLIDQH

SEQ ID NO: 136671 - protein, 24 aa, Mycobacterium avium
YAEIGLLGFALITDALGGVDVCLK

SEQ ID NO: 136672 - protein, 17 aa, Mycobacterium avium
YAFMAAIGWVFKVKGRW

SEQ ID NO: 136673 - protein, 19 aa, Mycobacterium avium
YALLAQRWLHVTGAGTDAL

SEQ ID NO: 136674 - protein, 18 aa, Mycobacterium avium
YALTYPRRLGFGLGNSVV

SEQ ID NO: 136675 - protein, 20 aa, Mycobacterium avium
YAMLATGLLALYQLSAEDSW

SEQ ID NO: 136676 - protein, 17 aa, Mycobacterium avium
YATFPFPKPTLSKWLRG

SEQ ID NO: 136677 - protein, 23 aa, Mycobacterium avium
YDDPVMIWLLPDQDTRIAHLSRL

SEQ ID NO: 136678 - protein, 18 aa, Mycobacterium avium
YDMSMARLLYWGCDVWLN

SEQ ID NO: 136679 - protein, 17 aa, Mycobacterium avium
YEQLPVYALPLFVRVVD

SEQ ID NO: 136680 - protein, 20 aa, Mycobacterium avium
YEVARLWRDARVQRLYAGTT

SEQ ID NO: 136681 - protein, 17 aa, Mycobacterium avium
YEWELLLSKTGWSEADV

SEQ ID NO: 136682 - protein, 17 aa, Mycobacterium avium
YFFPAGHILIYRERTKA

SEQ ID NO: 136683 - protein, 17 aa, Mycobacterium avium
YFMRLLTGRRGLIDQRL

SEQ ID NO: 136684 - protein, 23 aa, Mycobacterium avium
YGDFYNFYLCDISIKVNGLQPGG

SEQ ID NO: 136685 - protein, 17 aa, Mycobacterium avium
YGDLFPHAVRWKGTTYL

SEQ ID NO: 136686 - protein, 17 aa, Mycobacterium avium
YGQLLQILKNRLLLTDL

SEQ ID NO: 136687 - protein, 18 aa, Mycobacterium avium
YGQLLQILKNRLLLTDLL

SEQ ID NO: 136688 - protein, 17 aa, Mycobacterium avium
YGWLLICEPPQQSLTQL

SEQ ID NO: 136689 - protein, 17 aa, Mycobacterium avium
YHLMHNLPSERLSIAIS

SEQ ID NO: 136690 - protein, 18 aa, Mycobacterium avium
YKAWFPLTRRWLGFEDAH

SEQ ID NO: 136691 - protein, 18 aa, Mycobacterium avium
YLSCRLTRLLILLHKPSQ

SEQ ID NO: 136692 - protein, 22 aa, Mycobacterium avium
YLSPAPIYHTAPLKWCAGVQAL

SEQ ID NO: 136693 - protein, 19 aa, Mycobacterium avium
YLSYFPPSAWSYPPSLPAG

SEQ ID NO: 136694 - protein, 20 aa, Mycobacterium avium
YLSYFPPSAWSYPPSLPAGD

SEQ ID NO: 136695 - protein, 20 aa, Mycobacterium avium
YLTLISPLGRFLLAAAIREA

SEQ ID NO: 136696 - protein, 26 aa, Mycobacterium avium
YNRRSRFPQRWWWVALTDEAYPRLAV

SEQ ID NO: 136697 - protein, 18 aa, Mycobacterium avium
YNTQPWRWVADGAGLDLL

SEQ ID NO: 136698 - protein, 17 aa, Mycobacterium avium
YNVNLLVGTLKYTLWRL

SEQ ID NO: 136699 - protein, 23 aa, Mycobacterium avium
YPALIGPRCRAVWLLTVGAEQVD

SEQ ID NO: 136700 - protein, 24 aa, Mycobacterium avium
YPDEKEILFPAGSKFYVVSKTVDP

SEQ ID NO: 136701 - protein, 24 aa, Mycobacterium avium
YPRGNLAFRWFLADGVPARPEVEL

SEQ ID NO: 136702 - protein, 17 aa, Mycobacterium avium
YRELLQDFLFGLDLDEE

SEQ ID NO: 136703 - protein, 18 aa, Mycobacterium avium
YRELTPMLKPLPGARALL

SEQ ID NO: 136704 - protein, 23 aa, Mycobacterium avium
YRGLIGPRCRAVWLLTVRAEHVD

SEQ ID NO: 136705 - protein, 24 aa, Mycobacterium avium
YRTGCTWLRTWDAKLWSLHSGGGV

SEQ ID NO: 136706 - protein, 17 aa, Mycobacterium avium
YRVLELAPWLKWPQPNF

SEQ ID NO: 136707 - protein, 21 aa, Mycobacterium avium
YSWGPLSLTLLATALAQLGDT

SEQ ID NO: 136708 - protein, 23 aa, Mycobacterium avium
YTPRLWRYWAEHLDPDRARRDDP

SEQ ID NO: 136709 - protein, 17 aa, Mycobacterium avium
YVDIWQAVKPQRLGLAA

SEQ ID NO: 136710 - protein, 17 aa, Mycobacterium avium
YYRELTPLLKPLPGARA

SEQ ID NO: 136711 - protein, 6 aa, Mycobacterium avium
DAHAGL

SEQ ID NO: 136712 - protein, 9 aa, Mycobacterium avium
DQPDAPAVA

SEQ ID NO: 136713 - protein, 5 aa, Mycobacterium avium
EGGRV

SEQ ID NO: 136714 - protein, 9 aa, Mycobacterium avium
EQNDEWAEG

SEQ ID NO: 136715 - protein, 5 aa, Mycobacterium avium
IRRRT

SEQ ID NO: 136716 - protein, 6 aa, Mycobacterium avium
LDSAGP

SEQ ID NO: 136717 - protein, 9 aa, Mycobacterium avium
LSKSQVSRM

SEQ ID NO: 136718 - protein, 8 aa, Mycobacterium avium
NNPAERLN

SEQ ID NO: 136719 - protein, 6 aa, Mycobacterium avium
RKRAES

SEQ ID NO: 136720 - protein, 6 aa, Mycobacterium avium
SETGPA

SEQ ID NO: 136721 - protein, 16 aa, Mycobacterium avium
TDDNPDIGANDMPALT

SEQ ID NO: 136722 - protein, 7 aa, Mycobacterium avium
VNGDGHR

SEQ ID NO: 136723 - protein, 16 aa, Mycobacterium avium
WGQPTPGRRAQRNGYR

SEQ ID NO: 136724 - protein, 5 aa, Mycobacterium avium
PGGSQ

SEQ ID NO: 136725 - protein, 4 aa, Mycobacterium avium
YSQG

SEQ ID NO: 136726 - protein, 6 aa, Mycobacterium avium
ACPGQT

SEQ ID NO: 136727 - protein, 4 aa, Mycobacterium avium
ASEQ

SEQ ID NO: 136728 - protein, 4 aa, Mycobacterium avium
DGAG

SEQ ID NO: 136729 - protein, 13 aa, Mycobacterium avium
GTGEAPGVGPTGQ

SEQ ID NO: 136730 - protein, 4 aa, Mycobacterium avium
IKPA

SEQ ID NO: 136731 - protein, 8 aa, Mycobacterium avium
LPQSGGLY

SEQ ID NO: 136732 - protein, 11 aa, Mycobacterium avium
AAQSLSGLGEK

SEQ ID NO: 136733 - protein, 8 aa, Mycobacterium avium
AYNGAGGH

SEQ ID NO: 136734 - protein, 8 aa, Mycobacterium avium
DTYADASP

SEQ ID NO: 136735 - protein, 8 aa, Mycobacterium avium
EHAKARGA

SEQ ID NO: 136736 - protein, 7 aa, Mycobacterium avium
GFGNTGA

SEQ ID NO: 136737 - protein, 9 aa, Mycobacterium avium
GKPRPGNYQ

SEQ ID NO: 136738 - protein, 6 aa, Mycobacterium avium
GSKVTY

SEQ ID NO: 136739 - protein, 4 aa, Mycobacterium avium
ITSD

SEQ ID NO: 136740 - protein, 7 aa, Mycobacterium avium
KGGPYLA

SEQ ID NO: 136741 - protein, 6 aa, Mycobacterium avium
LTETSS

SEQ ID NO: 136742 - protein, 9 aa, Mycobacterium avium
NAGSPEVDS

SEQ ID NO: 136743 - protein, 5 aa, Mycobacterium avium
NGSGN

SEQ ID NO: 136744 - protein, 4 aa, Mycobacterium avium
PNGA

SEQ ID NO: 136745 - protein, 10 aa, Mycobacterium avium
PRMPQARKDI

SEQ ID NO: 136746 - protein, 12 aa, Mycobacterium avium
SETVRDGKPAAK

SEQ ID NO: 136747 - protein, 5 aa, Mycobacterium avium
SVTTE

SEQ ID NO: 136748 - protein, 10 aa, Mycobacterium avium
TINAQQKDLD

SEQ ID NO: 136749 - protein, 17 aa, Mycobacterium avium
AAAAADPAGTPNPSDIN

SEQ ID NO: 136750 - protein, 5 aa, Mycobacterium avium
AAAAT

SEQ ID NO: 136751 - protein, 7 aa, Mycobacterium avium
AAADGVA

SEQ ID NO: 136752 - protein, 5 aa, Mycobacterium avium
AAAGE

SEQ ID NO: 136753 - protein, 6 aa, Mycobacterium avium
AAAGSA

SEQ ID NO: 136754 - protein, 12 aa, Mycobacterium avium
AAAKTLTASSQT

SEQ ID NO: 136755 - protein, 10 aa, Mycobacterium avium
AAAQHTRAQP

SEQ ID NO: 136756 - protein, 10 aa, Mycobacterium avium
AAATNSTTAA

SEQ ID NO: 136757 - protein, 9 aa, Mycobacterium avium
AAATPQDDA

SEQ ID NO: 136758 - protein, 4 aa, Mycobacterium avium
AADA

SEQ ID NO: 136759 - protein, 19 aa, Mycobacterium avium
AADDPAAAARRLSSALAAA

SEQ ID NO: 136760 - protein, 6 aa, Mycobacterium avium
AADETD

SEQ ID NO: 136761 - protein, 40 aa, Mycobacterium avium
AADGAWGKGAGKTFKGGVGEGAKGNDGTSAAIKATEGSIT

SEQ ID NO: 136762 - protein, 9 aa, Mycobacterium avium
AADGSEHPD

SEQ ID NO: 136763 - protein, 8 aa, Mycobacterium avium
AADRGKKM

SEQ ID NO: 136764 - protein, 6 aa, Mycobacterium avium
AADTQV

SEQ ID NO: 136765 - protein, 11 aa, Mycobacterium avium
AAEPGDPGADV

SEQ ID NO: 136766 - protein, 7 aa, Mycobacterium avium
AAERVSA

SEQ ID NO: 136767 - protein, 7 aa, Mycobacterium avium
AAFGRDA

SEQ ID NO: 136768 - protein, 6 aa, Mycobacterium avium
AAGGIA

SEQ ID NO: 136769 - protein, 9 aa, Mycobacterium avium
AAGGPATAP

SEQ ID NO: 136770 - protein, 10 aa, Mycobacterium avium
AAGGSPVAGA

SEQ ID NO: 136771 - protein, 8 aa, Mycobacterium avium
AAGKTPVP

SEQ ID NO: 136772 - protein, 19 aa, Mycobacterium avium
AAGNPAPEVAQSIESGDNV

SEQ ID NO: 136773 - protein, 7 aa, Mycobacterium avium
AAGNPGP

SEQ ID NO: 136774 - protein, 5 aa, Mycobacterium avium
AAGPA

SEQ ID NO: 136775 - protein, 10 aa, Mycobacterium avium
AAGQPQQTTM

SEQ ID NO: 136776 - protein, 7 aa, Mycobacterium avium
AAGRAGG

SEQ ID NO: 136777 - protein, 7 aa, Mycobacterium avium
AAGWAGT

SEQ ID NO: 136778 - protein, 11 aa, Mycobacterium avium
AAGYDGDVPGM

SEQ ID NO: 136779 - protein, 10 aa, Mycobacterium avium
AAHGRSSDAA

SEQ ID NO: 136780 - protein, 9 aa, Mycobacterium avium
AAIADTEAQ

SEQ ID NO: 136781 - protein, 8 aa, Mycobacterium avium
AAKAGPLP

SEQ ID NO: 136782 - protein, 10 aa, Mycobacterium avium
AALPQAEARE

SEQ ID NO: 136783 - protein, 4 aa, Mycobacterium avium
AAMG

SEQ ID NO: 136784 - protein, 6 aa, Mycobacterium avium
AANAES

SEQ ID NO: 136785 - protein, 7 aa, Mycobacterium avium
AANDPQG

SEQ ID NO: 136786 - protein, 6 aa, Mycobacterium avium
AANPGV

SEQ ID NO: 136787 - protein, 8 aa, Mycobacterium avium
AANPKVKL

SEQ ID NO: 136788 - protein, 12 aa, Mycobacterium avium
AAPAGAEGNGDD

SEQ ID NO: 136789 - protein, 5 aa, Mycobacterium avium
AAPDV

SEQ ID NO: 136790 - protein, 13 aa, Mycobacterium avium
AAPPARAGCQYGG

SEQ ID NO: 136791 - protein, 6 aa, Mycobacterium avium
AAPPGP

SEQ ID NO: 136792 - protein, 9 aa, Mycobacterium avium
AAPPNNPGC

SEQ ID NO: 136793 - protein, 10 aa, Mycobacterium avium
AAPPNPSPEL

SEQ ID NO: 136794 - protein, 20 aa, Mycobacterium avium
AAPPPAHSSTSNTPAAAPAP

SEQ ID NO: 136795 - protein, 7 aa, Mycobacterium avium
AAPQSWA

SEQ ID NO: 136796 - protein, 8 aa, Mycobacterium avium
AAPTAEQV

SEQ ID NO: 136797 - protein, 5 aa, Mycobacterium avium
AAQEL

SEQ ID NO: 136798 - protein, 12 aa, Mycobacterium avium
AAQGRGTPTLSG

SEQ ID NO: 136799 - protein, 8 aa, Mycobacterium avium
AAQGSDGS

SEQ ID NO: 136800 - protein, 8 aa, Mycobacterium avium
AAQTVPRK

SEQ ID NO: 136801 - protein, 7 aa, Mycobacterium avium
AARAGDA

SEQ ID NO: 136802 - protein, 6 aa, Mycobacterium avium
AARGGR

SEQ ID NO: 136803 - protein, 4 aa, Mycobacterium avium
AARP

SEQ ID NO: 136804 - protein, 7 aa, Mycobacterium avium
AARQRGV

SEQ ID NO: 136805 - protein, 4 aa, Mycobacterium avium
AARR

SEQ ID NO: 136806 - protein, 10 aa, Mycobacterium avium
AARTRYDSFP

SEQ ID NO: 136807 - protein, 11 aa, Mycobacterium avium
AASAAGNPEIR

SEQ ID NO: 136808 - protein, 8 aa, Mycobacterium avium
AASAGAQA

SEQ ID NO: 136809 - protein, 7 aa, Mycobacterium avium
AASGPGT

SEQ ID NO: 136810 - protein, 7 aa, Mycobacterium avium
AASNTAT

SEQ ID NO: 136811 - protein, 6 aa, Mycobacterium avium
AASRAR

SEQ ID NO: 136812 - protein, 4 aa, Mycobacterium avium
AATR

SEQ ID NO: 136813 - protein, 11 aa, Mycobacterium avium
AATTPEAARRL

SEQ ID NO: 136814 - protein, 12 aa, Mycobacterium avium
AAVTGAARAAGY

SEQ ID NO: 136815 - protein, 35 aa, Mycobacterium avium
ACGTSNKSSPTSTSTSTSTVTSTSTSAAPNAEAKV

SEQ ID NO: 136816 - protein, 7 aa, Mycobacterium avium
ADAAPIA

SEQ ID NO: 136817 - protein, 7 aa, Mycobacterium avium
ADAGHQD

SEQ ID NO: 136818 - protein, 7 aa, Mycobacterium avium
ADAVTSA

SEQ ID NO: 136819 - protein, 21 aa, Mycobacterium avium
ADDEHATADAVGKNLGAPVEP

SEQ ID NO: 136820 - protein, 10 aa, Mycobacterium avium
ADGGPPSGRG

SEQ ID NO: 136821 - protein, 7 aa, Mycobacterium avium
ADGPAFN

SEQ ID NO: 136822 - protein, 6 aa, Mycobacterium avium
ADGQYE

SEQ ID NO: 136823 - protein, 5 aa, Mycobacterium avium
ADGRT

SEQ ID NO: 136824 - protein, 7 aa, Mycobacterium avium
ADGTPLT

SEQ ID NO: 136825 - protein, 14 aa, Mycobacterium avium
ADNLRGQGDTARDT

SEQ ID NO: 136826 - protein, 13 aa, Mycobacterium avium
ADPGPAEGYSAAG

SEQ ID NO: 136827 - protein, 10 aa, Mycobacterium avium
ADPKRVDGAP

SEQ ID NO: 136828 - protein, 7 aa, Mycobacterium avium
ADPTNFA

SEQ ID NO: 136829 - protein, 6 aa, Mycobacterium avium
ADQAGM

SEQ ID NO: 136830 - protein, 7 aa, Mycobacterium avium
ADRAAAE

SEQ ID NO: 136831 - protein, 15 aa, Mycobacterium avium
ADRAGGTLPSQSALL

SEQ ID NO: 136832 - protein, 9 aa, Mycobacterium avium
ADSVGKTIA

SEQ ID NO: 136833 - protein, 8 aa, Mycobacterium avium
ADSVQPAD

SEQ ID NO: 136834 - protein, 5 aa, Mycobacterium avium
ADTAQ

SEQ ID NO: 136835 - protein, 11 aa, Mycobacterium avium
ADVPEGSAGIE

SEQ ID NO: 136836 - protein, 11 aa, Mycobacterium avium
ADVPTVQPGTD

SEQ ID NO: 136837 - protein, 22 aa, Mycobacterium avium
AEAEATRRRRTDFSRTDQQRIA

SEQ ID NO: 136838 - protein, 17 aa, Mycobacterium avium
AEAGGPGDPIPNDLQDA

SEQ ID NO: 136839 - protein, 12 aa, Mycobacterium avium
AEDRAAAATTRL

SEQ ID NO: 136840 - protein, 9 aa, Mycobacterium avium
AEGASRHTR

SEQ ID NO: 136841 - protein, 4 aa, Mycobacterium avium
AEPE

SEQ ID NO: 136842 - protein, 17 aa, Mycobacterium avium
AERADTGGTDASASASV

SEQ ID NO: 136843 - protein, 4 aa, Mycobacterium avium
AERH

SEQ ID NO: 136844 - protein, 4 aa, Mycobacterium avium
AETD

SEQ ID NO: 136845 - protein, 7 aa, Mycobacterium avium
AEYAKGP

SEQ ID NO: 136846 - protein, 7 aa, Mycobacterium avium
AFGAAPG

SEQ ID NO: 136847 - protein, 10 aa, Mycobacterium avium
AGAAHATKGP

SEQ ID NO: 136848 - protein, 8 aa, Mycobacterium avium
AGAANQQL

SEQ ID NO: 136849 - protein, 18 aa, Mycobacterium avium
AGADAVGAGRPGGRGGVS

SEQ ID NO: 136850 - protein, 9 aa, Mycobacterium avium
AGAGKTETM

SEQ ID NO: 136851 - protein, 7 aa, Mycobacterium avium
AGAGQAA

SEQ ID NO: 136852 - protein, 10 aa, Mycobacterium avium
AGATGEGAMD

SEQ ID NO: 136853 - protein, 8 aa, Mycobacterium avium
AGDSNPEA

SEQ ID NO: 136854 - protein, 7 aa, Mycobacterium avium
AGDSTTM

SEQ ID NO: 136855 - protein, 9 aa, Mycobacterium avium
AGESPGGDY

SEQ ID NO: 136856 - protein, 6 aa, Mycobacterium avium
AGHGSR

SEQ ID NO: 136857 - protein, 6 aa, Mycobacterium avium
AGKPPF

SEQ ID NO: 136858 - protein, 10 aa, Mycobacterium avium
AGLPDVTPGS

SEQ ID NO: 136859 - protein, 7 aa, Mycobacterium avium
AGLSSDT

SEQ ID NO: 136860 - protein, 15 aa, Mycobacterium avium
AGMAPQAKSGVPATP

SEQ ID NO: 136861 - protein, 12 aa, Mycobacterium avium
AGPGNEWSGHTE

SEQ ID NO: 136862 - protein, 7 aa, Mycobacterium avium
AGPPAEA

SEQ ID NO: 136863 - protein, 7 aa, Mycobacterium avium
AGPRPEM

SEQ ID NO: 136864 - protein, 5 aa, Mycobacterium avium
AGPVP

SEQ ID NO: 136865 - protein, 8 aa, Mycobacterium avium
AGQGGTED

SEQ ID NO: 136866 - protein, 8 aa, Mycobacterium avium
AGQTMRPQ

SEQ ID NO: 136867 - protein, 12 aa, Mycobacterium avium
AGRDGSATGSAA

SEQ ID NO: 136868 - protein, 14 aa, Mycobacterium avium
AGRDPNVAHPPAST

SEQ ID NO: 136869 - protein, 4 aa, Mycobacterium avium
AGRL

SEQ ID NO: 136870 - protein, 7 aa, Mycobacterium avium
AGRPTPE

SEQ ID NO: 136871 - protein, 10 aa, Mycobacterium avium
AGRRESLAGV

SEQ ID NO: 136872 - protein, 10 aa, Mycobacterium avium
AGRSGRRGQG

SEQ ID NO: 136873 - protein, 5 aa, Mycobacterium avium
AGRSQ

SEQ ID NO: 136874 - protein, 7 aa, Mycobacterium avium
AGSAAAE

SEQ ID NO: 136875 - protein, 8 aa, Mycobacterium avium
AGSAGDGW

SEQ ID NO: 136876 - protein, 24 aa, Mycobacterium avium
AGSGGGDPGPGSYPADMLIDWIRV

SEQ ID NO: 136877 - protein, 7 aa, Mycobacterium avium
AGSGTTE

SEQ ID NO: 136878 - protein, 4 aa, Mycobacterium avium
AGSI

SEQ ID NO: 136879 - protein, 8 aa, Mycobacterium avium
AGSRPDKV

SEQ ID NO: 136880 - protein, 8 aa, Mycobacterium avium
AGTGTGKS

SEQ ID NO: 136881 - protein, 10 aa, Mycobacterium avium
AGVGGSPIGC

SEQ ID NO: 136882 - protein, 12 aa, Mycobacterium avium
AGVQPPSNEAPD

SEQ ID NO: 136883 - protein, 13 aa, Mycobacterium avium
AHAAPNPLRPTSI

SEQ ID NO: 136884 - protein, 9 aa, Mycobacterium avium
AHADIDNDQ

SEQ ID NO: 136885 - protein, 7 aa, Mycobacterium avium
AHPDTAR

SEQ ID NO: 136886 - protein, 4 aa, Mycobacterium avium
AHPG

SEQ ID NO: 136887 - protein, 7 aa, Mycobacterium avium
AHPGGSV

SEQ ID NO: 136888 - protein, 9 aa, Mycobacterium avium
AIAAAPAAA

SEQ ID NO: 136889 - protein, 18 aa, Mycobacterium avium
AIAPGASAYDDAHAASDI

SEQ ID NO: 136890 - protein, 15 aa, Mycobacterium avium
AIAQSVTAQSPGQAA

SEQ ID NO: 136891 - protein, 15 aa, Mycobacterium avium
AIARQPADGPTGELT

SEQ ID NO: 136892 - protein, 7 aa, Mycobacterium avium
AIEPDGT

SEQ ID NO: 136893 - protein, 5 aa, Mycobacterium avium
AIPAA

SEQ ID NO: 136894 - protein, 16 aa, Mycobacterium avium
AIPPTAQEIPNPLRGQ

SEQ ID NO: 136895 - protein, 5 aa, Mycobacterium avium
AIPQP

SEQ ID NO: 136896 - protein, 6 aa, Mycobacterium avium
AISDAG

SEQ ID NO: 136897 - protein, 8 aa, Mycobacterium avium
AKAGAGQR

SEQ ID NO: 136898 - protein, 9 aa, Mycobacterium avium
AKANGGEWK

SEQ ID NO: 136899 - protein, 4 aa, Mycobacterium avium
AKGF

SEQ ID NO: 136900 - protein, 4 aa, Mycobacterium avium
AKGN

SEQ ID NO: 136901 - protein, 4 aa, Mycobacterium avium
AKGR

SEQ ID NO: 136902 - protein, 13 aa, Mycobacterium avium
AKHRPGAGFAPLP

SEQ ID NO: 136903 - protein, 8 aa, Mycobacterium avium
AKISGQGN

SEQ ID NO: 136904 - protein, 15 aa, Mycobacterium avium
AKQPNCPLGTDPAKA

SEQ ID NO: 136905 - protein, 15 aa, Mycobacterium avium
AKRAGGNQTAVSTDD

SEQ ID NO: 136906 - protein, 9 aa, Mycobacterium avium
AKRSPRPGH

SEQ ID NO: 136907 - protein, 8 aa, Mycobacterium avium
AKSPYEPA

SEQ ID NO: 136908 - protein, 22 aa, Mycobacterium avium
AKTAGAAPPPALPAPPPSPGIG

SEQ ID NO: 136909 - protein, 8 aa, Mycobacterium avium
AKTTPQRA

SEQ ID NO: 136910 - protein, 6 aa, Mycobacterium avium
AKVTPV

SEQ ID NO: 136911 - protein, 6 aa, Mycobacterium avium
ALAGPE

SEQ ID NO: 136912 - protein, 12 aa, Mycobacterium avium
ALPESARRAPLS

SEQ ID NO: 136913 - protein, 12 aa, Mycobacterium avium
ALPQDAGNQGVS

SEQ ID NO: 136914 - protein, 12 aa, Mycobacterium avium
ALQPTTAGGVNS

SEQ ID NO: 136915 - protein, 6 aa, Mycobacterium avium
ALRSRD

SEQ ID NO: 136916 - protein, 9 aa, Mycobacterium avium
ALSDSDAER

SEQ ID NO: 136917 - protein, 8 aa, Mycobacterium avium
AMQDSDGQ

SEQ ID NO: 136918 - protein, 6 aa, Mycobacterium avium
ANAASK

SEQ ID NO: 136919 - protein, 16 aa, Mycobacterium avium
ANAGPDGLADFPDDHA

SEQ ID NO: 136920 - protein, 17 aa, Mycobacterium avium
ANANNGTRAVGTPGYEA

SEQ ID NO: 136921 - protein, 13 aa, Mycobacterium avium
ANASQGTDHGTAG

SEQ ID NO: 136922 - protein, 8 aa, Mycobacterium avium
ANGEPQHI

SEQ ID NO: 136923 - protein, 16 aa, Mycobacterium avium
ANGTTISGGSSDNTQA

SEQ ID NO: 136924 - protein, 24 aa, Mycobacterium avium
ANQQSSQPNTAPLTSSVPGSERLT

SEQ ID NO: 136925 - protein, 10 aa, Mycobacterium avium
ANRFSKDGQI

SEQ ID NO: 136926 - protein, 8 aa, Mycobacterium avium
ANSAEKLQ

SEQ ID NO: 136927 - protein, 8 aa, Mycobacterium avium
ANTSAGYR

SEQ ID NO: 136928 - protein, 7 aa, Mycobacterium avium
ANVPGDP

SEQ ID NO: 136929 - protein, 9 aa, Mycobacterium avium
APAADRAAV

SEQ ID NO: 136930 - protein, 7 aa, Mycobacterium avium
APAAWGV

SEQ ID NO: 136931 - protein, 13 aa, Mycobacterium avium
APAGADPSPFGTL

SEQ ID NO: 136932 - protein, 6 aa, Mycobacterium avium
APAGGA

SEQ ID NO: 136933 - protein, 8 aa, Mycobacterium avium
APAGPNMA

SEQ ID NO: 136934 - protein, 15 aa, Mycobacterium avium
APAHADPAGTTGSDA

SEQ ID NO: 136935 - protein, 8 aa, Mycobacterium avium
APANGDEL

SEQ ID NO: 136936 - protein, 9 aa, Mycobacterium avium
APARPDCPV

SEQ ID NO: 136937 - protein, 5 aa, Mycobacterium avium
APEPG

SEQ ID NO: 136938 - protein, 6 aa, Mycobacterium avium
APFDAQ

SEQ ID NO: 136939 - protein, 7 aa, Mycobacterium avium
APGFADR

SEQ ID NO: 136940 - protein, 18 aa, Mycobacterium avium
APGGGDARRRDRESTQQV

SEQ ID NO: 136941 - protein, 10 aa, Mycobacterium avium
APGGSATGGF

SEQ ID NO: 136942 - protein, 8 aa, Mycobacterium avium
APGNPKRI

SEQ ID NO: 136943 - protein, 19 aa, Mycobacterium avium
APGNTGQLHDGGPSAARTA

SEQ ID NO: 136944 - protein, 4 aa, Mycobacterium avium
APGT

SEQ ID NO: 136945 - protein, 8 aa, Mycobacterium avium
APGTTVTA

SEQ ID NO: 136946 - protein, 6 aa, Mycobacterium avium
APHGSA

SEQ ID NO: 136947 - protein, 4 aa, Mycobacterium avium
APHS

SEQ ID NO: 136948 - protein, 19 aa, Mycobacterium avium
APIDADRLGDPGAPLGELL

SEQ ID NO: 136949 - protein, 11 aa, Mycobacterium avium
APKVPSPMLGT

SEQ ID NO: 136950 - protein, 12 aa, Mycobacterium avium
APPAQADPGVDE

SEQ ID NO: 136951 - protein, 6 aa, Mycobacterium avium
APPGYI

SEQ ID NO: 136952 - protein, 21 aa, Mycobacterium avium
APPKETNTATGGITASGISGS

SEQ ID NO: 136953 - protein, 6 aa, Mycobacterium avium
APPLNQ

SEQ ID NO: 136954 - protein, 11 aa, Mycobacterium avium
APPRPAERAAE

SEQ ID NO: 136955 - protein, 8 aa, Mycobacterium avium
APQIDSAR

SEQ ID NO: 136956 - protein, 10 aa, Mycobacterium avium
APTLRKTGGH

SEQ ID NO: 136957 - protein, 10 aa, Mycobacterium avium
APTTEGARGS

SEQ ID NO: 136958 - protein, 5 aa, Mycobacterium avium
APVNA

SEQ ID NO: 136959 - protein, 12 aa, Mycobacterium avium
APVSGGVKGAVA

SEQ ID NO: 136960 - protein, 31 aa, Mycobacterium avium
APVTPSNAPTLSGTPTTSTTTPASTGPATPG

SEQ ID NO: 136961 - protein, 5 aa, Mycobacterium avium
AQDDF

SEQ ID NO: 136962 - protein, 6 aa, Mycobacterium avium
AQDDYN

SEQ ID NO: 136963 - protein, 4 aa, Mycobacterium avium
AQGL

SEQ ID NO: 136964 - protein, 8 aa, Mycobacterium avium
AQGNSDSL

SEQ ID NO: 136965 - protein, 7 aa, Mycobacterium avium
AQGPGPI

SEQ ID NO: 136966 - protein, 9 aa, Mycobacterium avium
AQPLADDAE

SEQ ID NO: 136967 - protein, 6 aa, Mycobacterium avium
AQRDSA

SEQ ID NO: 136968 - protein, 12 aa, Mycobacterium avium
AQRKPTIGRDGG

SEQ ID NO: 136969 - protein, 31 aa, Mycobacterium avium
AQRRRTDEPAREVDGARPPEARAGADNQAAR

SEQ ID NO: 136970 - protein, 5 aa, Mycobacterium avium
AQSAM

SEQ ID NO: 136971 - protein, 8 aa, Mycobacterium avium
AQSDGSTI

SEQ ID NO: 136972 - protein, 17 aa, Mycobacterium avium
AQSDRALNIPGEDLPGS

SEQ ID NO: 136973 - protein, 6 aa, Mycobacterium avium
AQSIGG

SEQ ID NO: 136974 - protein, 12 aa, Mycobacterium avium
AQSTPNGVDGYP

SEQ ID NO: 136975 - protein, 9 aa, Mycobacterium avium
AQTARQDPA

SEQ ID NO: 136976 - protein, 9 aa, Mycobacterium avium
AQTKTGSAH

SEQ ID NO: 136977 - protein, 6 aa, Mycobacterium avium
AQTPAG

SEQ ID NO: 136978 - protein, 5 aa, Mycobacterium avium
AQTPK

SEQ ID NO: 136979 - protein, 6 aa, Mycobacterium avium
ARADGD

SEQ ID NO: 136980 - protein, 11 aa, Mycobacterium avium
ARADGVSPPTA

SEQ ID NO: 136981 - protein, 11 aa, Mycobacterium avium
ARAGKGPGGVS

SEQ ID NO: 136982 - protein, 7 aa, Mycobacterium avium
ARAKPPR

SEQ ID NO: 136983 - protein, 9 aa, Mycobacterium avium
ARASSSFDR

SEQ ID NO: 136984 - protein, 10 aa, Mycobacterium avium
ARDDDPADLA

SEQ ID NO: 136985 - protein, 8 aa, Mycobacterium avium
ARDEQQVP

SEQ ID NO: 136986 - protein, 4 aa, Mycobacterium avium
ARDR

SEQ ID NO: 136987 - protein, 8 aa, Mycobacterium avium
ARETIKDP

SEQ ID NO: 136988 - protein, 6 aa, Mycobacterium avium
ARGGIK

SEQ ID NO: 136989 - protein, 10 aa, Mycobacterium avium
ARLPSGADAA

SEQ ID NO: 136990 - protein, 12 aa, Mycobacterium avium
ARNATAAEGLDQ

SEQ ID NO: 136991 - protein, 15 aa, Mycobacterium avium
ARPATAGDPTAQLDS

SEQ ID NO: 136992 - protein, 9 aa, Mycobacterium avium
ARPSTQARR

SEQ ID NO: 136993 - protein, 8 aa, Mycobacterium avium
ARRERGDL

SEQ ID NO: 136994 - protein, 10 aa, Mycobacterium avium
ARSDEHDAAA

SEQ ID NO: 136995 - protein, 6 aa, Mycobacterium avium
ARSGAK

SEQ ID NO: 136996 - protein, 8 aa, Mycobacterium avium
ARTAGSKV

SEQ ID NO: 136997 - protein, 8 aa, Mycobacterium avium
ARTESRGC

SEQ ID NO: 136998 - protein, 11 aa, Mycobacterium avium
ASAAAGDPCGT

SEQ ID NO: 136999 - protein, 8 aa, Mycobacterium avium
ASAGLQHA

SEQ ID NO: 137000 - protein, 7 aa, Mycobacterium avium
ASAQSFK

SEQ ID NO: 137001 - protein, 10 aa, Mycobacterium avium
ASARSGDTNA

SEQ ID NO: 137002 - protein, 7 aa, Mycobacterium avium
ASATNLP

SEQ ID NO: 137003 - protein, 5 aa, Mycobacterium avium
ASDAA

SEQ ID NO: 137004 - protein, 10 aa, Mycobacterium avium
ASEHEGDKRD

SEQ ID NO: 137005 - protein, 9 aa, Mycobacterium avium
ASGIPPANY

SEQ ID NO: 137006 - protein, 8 aa, Mycobacterium avium
ASGNLSGA

SEQ ID NO: 137007 - protein, 6 aa, Mycobacterium avium
ASGRAG

SEQ ID NO: 137008 - protein, 8 aa, Mycobacterium avium
ASGSEGIA

SEQ ID NO: 137009 - protein, 7 aa, Mycobacterium avium
ASHGDKD

SEQ ID NO: 137010 - protein, 48 aa, Mycobacterium avium
ASKARGTWQASRASAGYSSAARRAGDRAGRRARLGSSPELPGARSALS

SEQ ID NO: 137011 - protein, 18 aa, Mycobacterium avium
ASKTGTAEHGSDPRHTPP

SEQ ID NO: 137012 - protein, 13 aa, Mycobacterium avium
ASPAGVPGLRGSE

SEQ ID NO: 137013 - protein, 9 aa, Mycobacterium avium
ASPDEPVST

SEQ ID NO: 137014 - protein, 7 aa, Mycobacterium avium
ASPTLPG

SEQ ID NO: 137015 - protein, 8 aa, Mycobacterium avium
ASSATTLD

SEQ ID NO: 137016 - protein, 5 aa, Mycobacterium avium
ASSDR

SEQ ID NO: 137017 - protein, 8 aa, Mycobacterium avium
ASSGLGAG

SEQ ID NO: 137018 - protein, 11 aa, Mycobacterium avium
ASSTSAANSNA

SEQ ID NO: 137019 - protein, 17 aa, Mycobacterium avium
ASTAGAGVASADPDYGP

SEQ ID NO: 137020 - protein, 8 aa, Mycobacterium avium
ASTGAVDE

SEQ ID NO: 137021 - protein, 14 aa, Mycobacterium avium
ATASVGTPARTVCT

SEQ ID NO: 137022 - protein, 6 aa, Mycobacterium avium
ATDAET

SEQ ID NO: 137023 - protein, 15 aa, Mycobacterium avium
ATDPLRSSARNRGDA

SEQ ID NO: 137024 - protein, 5 aa, Mycobacterium avium
ATDPR

SEQ ID NO: 137025 - protein, 8 aa, Mycobacterium avium
ATDPRQTA

SEQ ID NO: 137026 - protein, 6 aa, Mycobacterium avium
ATGDKI

SEQ ID NO: 137027 - protein, 4 aa, Mycobacterium avium
ATGR

SEQ ID NO: 137028 - protein, 5 aa, Mycobacterium avium
ATGTT

SEQ ID NO: 137029 - protein, 10 aa, Mycobacterium avium
ATLPEERSRE

SEQ ID NO: 137030 - protein, 17 aa, Mycobacterium avium
ATPAGPPPPEVSETQRN

SEQ ID NO: 137031 - protein, 6 aa, Mycobacterium avium
ATPPAV

SEQ ID NO: 137032 - protein, 12 aa, Mycobacterium avium
ATPPQPPQALPN

SEQ ID NO: 137033 - protein, 7 aa, Mycobacterium avium
ATPSQAI

SEQ ID NO: 137034 - protein, 5 aa, Mycobacterium avium
ATQAG

SEQ ID NO: 137035 - protein, 8 aa, Mycobacterium avium
ATQAGNGA

SEQ ID NO: 137036 - protein, 5 aa, Mycobacterium avium
ATQPY

SEQ ID NO: 137037 - protein, 5 aa, Mycobacterium avium
ATRGG

SEQ ID NO: 137038 - protein, 9 aa, Mycobacterium avium
ATRNGRGAN

SEQ ID NO: 137039 - protein, 9 aa, Mycobacterium avium
ATSTQVTAG

SEQ ID NO: 137040 - protein, 9 aa, Mycobacterium avium
ATTDPRPFD

SEQ ID NO: 137041 - protein, 11 aa, Mycobacterium avium
ATTDSPGATAA

SEQ ID NO: 137042 - protein, 10 aa, Mycobacterium avium
ATTKNRKKFR

SEQ ID NO: 137043 - protein, 7 aa, Mycobacterium avium
ATTTFEQ

SEQ ID NO: 137044 - protein, 8 aa, Mycobacterium avium
AVDTRGGK

SEQ ID NO: 137045 - protein, 8 aa, Mycobacterium avium
AVGHDGKT

SEQ ID NO: 137046 - protein, 8 aa, Mycobacterium avium
AVNGTPVA

SEQ ID NO: 137047 - protein, 39 aa, Mycobacterium avium
AVPPPSTSTSTSTVTVTGTPTATSTPTTTVTTPPSLPPG

SEQ ID NO: 137048 - protein, 19 aa, Mycobacterium avium
AVPSDGYLTSGAPGSPPRI

SEQ ID NO: 137049 - protein, 5 aa, Mycobacterium avium
AVPVA

SEQ ID NO: 137050 - protein, 15 aa, Mycobacterium avium
AVSGNSGVDPDQAAR

SEQ ID NO: 137051 - protein, 6 aa, Mycobacterium avium
AVTMDS

SEQ ID NO: 137052 - protein, 5 aa, Mycobacterium avium
AVTSA

SEQ ID NO: 137053 - protein, 11 aa, Mycobacterium avium
AVYAPKAALGH

SEQ ID NO: 137054 - protein, 20 aa, Mycobacterium avium
AWDDDNDAPMGHNGCDTRDD

SEQ ID NO: 137055 - protein, 14 aa, Mycobacterium avium
AYAASKAGLSSLGE

SEQ ID NO: 137056 - protein, 7 aa, Mycobacterium avium
AYESDDG

SEQ ID NO: 137057 - protein, 8 aa, Mycobacterium avium
AYHDARPE

SEQ ID NO: 137058 - protein, 13 aa, Mycobacterium avium
AYNPTGSGAGREQ

SEQ ID NO: 137059 - protein, 18 aa, Mycobacterium avium
CAGGKSLNVGGSDNTLTV

SEQ ID NO: 137060 - protein, 8 aa, Mycobacterium avium
CATGSQLT

SEQ ID NO: 137061 - protein, 19 aa, Mycobacterium avium
CEANSTAPTGGSTGDFESA

SEQ ID NO: 137062 - protein, 12 aa, Mycobacterium avium
CETPQSQGELPV

SEQ ID NO: 137063 - protein, 6 aa, Mycobacterium avium
CGAPGL

SEQ ID NO: 137064 - protein, 4 aa, Mycobacterium avium
CGGG

SEQ ID NO: 137065 - protein, 17 aa, Mycobacterium avium
CGGPGAQVAAEGAENAG

SEQ ID NO: 137066 - protein, 9 aa, Mycobacterium avium
CGGSPQARS

SEQ ID NO: 137067 - protein, 20 aa, Mycobacterium avium
CGHRSSGAGQTTGDPAAAEF

SEQ ID NO: 137068 - protein, 39 aa, Mycobacterium avium
CGSDNNGAGAGAGGSSSSKVSCGGKKALKASGSTAQANA

SEQ ID NO: 137069 - protein, 18 aa, Mycobacterium avium
CGSGGQFAGPGGVPGGQG

SEQ ID NO: 137070 - protein, 5 aa, Mycobacterium avium
CQPLS

SEQ ID NO: 137071 - protein, 8 aa, Mycobacterium avium
CSNNYGPY

SEQ ID NO: 137072 - protein, 12 aa, Mycobacterium avium
CSSGHDAVAQGG

SEQ ID NO: 137073 - protein, 17 aa, Mycobacterium avium
CSSGSKQSGAPLPDPTS

SEQ ID NO: 137074 - protein, 13 aa, Mycobacterium avium
CTPRPDGPGPAAE

SEQ ID NO: 137075 - protein, 11 aa, Mycobacterium avium
CTTDTGDRRAH

SEQ ID NO: 137076 - protein, 6 aa, Mycobacterium avium
DAAAPM

SEQ ID NO: 137077 - protein, 5 aa, Mycobacterium avium
DAANR

SEQ ID NO: 137078 - protein, 10 aa, Mycobacterium avium
DAAPAGTPVR

SEQ ID NO: 137079 - protein, 6 aa, Mycobacterium avium
DAAPDL

SEQ ID NO: 137080 - protein, 17 aa, Mycobacterium avium
DAAPNQGGNAGAAVNGK

SEQ ID NO: 137081 - protein, 25 aa, Mycobacterium avium
DAASAARSAIDTTSDPKAASARAEA

SEQ ID NO: 137082 - protein, 16 aa, Mycobacterium avium
DADGNRGDTRGFDPGR

SEQ ID NO: 137083 - protein, 7 aa, Mycobacterium avium
DAGDHAD

SEQ ID NO: 137084 - protein, 6 aa, Mycobacterium avium
DAGGYK

SEQ ID NO: 137085 - protein, 12 aa, Mycobacterium avium
DAGPQRDTGDDV

SEQ ID NO: 137086 - protein, 10 aa, Mycobacterium avium
DAHDGAEWTY

SEQ ID NO: 137087 - protein, 9 aa, Mycobacterium avium
DALARTDRG

SEQ ID NO: 137088 - protein, 24 aa, Mycobacterium avium
DAPAATAELAATKSSYAGKVNGDW

SEQ ID NO: 137089 - protein, 21 aa, Mycobacterium avium
DAPRQPLGGPPCYGAPICLPG

SEQ ID NO: 137090 - protein, 4 aa, Mycobacterium avium
DAPS

SEQ ID NO: 137091 - protein, 18 aa, Mycobacterium avium
DAQRDANGRFPRDASPDD

SEQ ID NO: 137092 - protein, 8 aa, Mycobacterium avium
DASASSQF

SEQ ID NO: 137093 - protein, 8 aa, Mycobacterium avium
DATRGAGA

SEQ ID NO: 137094 - protein, 8 aa, Mycobacterium avium
DAVSTDDS

SEQ ID NO: 137095 - protein, 5 aa, Mycobacterium avium
DDATH

SEQ ID NO: 137096 - protein, 10 aa, Mycobacterium avium
DDDPSYEQYK

SEQ ID NO: 137097 - protein, 14 aa, Mycobacterium avium
DDGDQSGPPAPGIS

SEQ ID NO: 137098 - protein, 7 aa, Mycobacterium avium
DDGFGGR

SEQ ID NO: 137099 - protein, 7 aa, Mycobacterium avium
DDHSPTF

SEQ ID NO: 137100 - protein, 20 aa, Mycobacterium avium
DDPGAATNALNAAKGQQGAV

SEQ ID NO: 137101 - protein, 32 aa, Mycobacterium avium
DDPGGGGCDANGNCGSGGQDQGPGGGPGGQGC

SEQ ID NO: 137102 - protein, 6 aa, Mycobacterium avium
DDQGEI

SEQ ID NO: 137103 - protein, 7 aa, Mycobacterium avium
DDQGPNL

SEQ ID NO: 137104 - protein, 6 aa, Mycobacterium avium
DDSASV

SEQ ID NO: 137105 - protein, 9 aa, Mycobacterium avium
DDSPNPTDL

SEQ ID NO: 137106 - protein, 8 aa, Mycobacterium avium
DEAQGARA

SEQ ID NO: 137107 - protein, 13 aa, Mycobacterium avium
DEDVTDEDGVTRA

SEQ ID NO: 137108 - protein, 8 aa, Mycobacterium avium
DEEGGRVS

SEQ ID NO: 137109 - protein, 4 aa, Mycobacterium avium
DEEY

SEQ ID NO: 137110 - protein, 6 aa, Mycobacterium avium
DEGRRR

SEQ ID NO: 137111 - protein, 14 aa, Mycobacterium avium
DEQQMGGTLGPSTE

SEQ ID NO: 137112 - protein, 4 aa, Mycobacterium avium
DERV

SEQ ID NO: 137113 - protein, 7 aa, Mycobacterium avium
DESGNEL

SEQ ID NO: 137114 - protein, 9 aa, Mycobacterium avium
DESGTTDNF

SEQ ID NO: 137115 - protein, 18 aa, Mycobacterium avium
DESSTSREEPVPESATES

SEQ ID NO: 137116 - protein, 10 aa, Mycobacterium avium
DETMSGTHTT

SEQ ID NO: 137117 - protein, 4 aa, Mycobacterium avium
DFEE

SEQ ID NO: 137118 - protein, 7 aa, Mycobacterium avium
DGAAVDA

SEQ ID NO: 137119 - protein, 19 aa, Mycobacterium avium
DGAGRGTATVSDTVRPGTT

SEQ ID NO: 137120 - protein, 8 aa, Mycobacterium avium
DGANRGRE

SEQ ID NO: 137121 - protein, 4 aa, Mycobacterium avium
DGAP

SEQ ID NO: 137122 - protein, 8 aa, Mycobacterium avium
DGAYGAED

SEQ ID NO: 137123 - protein, 5 aa, Mycobacterium avium
DGDAN

SEQ ID NO: 137124 - protein, 10 aa, Mycobacterium avium
DGDEQARARP

SEQ ID NO: 137125 - protein, 9 aa, Mycobacterium avium
DGDSGSPGF

SEQ ID NO: 137126 - protein, 6 aa, Mycobacterium avium
DGGGAV

SEQ ID NO: 137127 - protein, 14 aa, Mycobacterium avium
DGGGLPTGARGEDI

SEQ ID NO: 137128 - protein, 6 aa, Mycobacterium avium
DGGGSS

SEQ ID NO: 137129 - protein, 5 aa, Mycobacterium avium
DGGNT

SEQ ID NO: 137130 - protein, 13 aa, Mycobacterium avium
DGKCGKPKQPGHG

SEQ ID NO: 137131 - protein, 8 aa, Mycobacterium avium
DGKPTEGC

SEQ ID NO: 137132 - protein, 7 aa, Mycobacterium avium
DGPAFSQ

SEQ ID NO: 137133 - protein, 9 aa, Mycobacterium avium
DGPVQPDGT

SEQ ID NO: 137134 - protein, 7 aa, Mycobacterium avium
DGQSDAK

SEQ ID NO: 137135 - protein, 5 aa, Mycobacterium avium
DGQTV

SEQ ID NO: 137136 - protein, 9 aa, Mycobacterium avium
DGSDIGGGA

SEQ ID NO: 137137 - protein, 6 aa, Mycobacterium avium
DGSGGT

SEQ ID NO: 137138 - protein, 9 aa, Mycobacterium avium
DGSPASNAA

SEQ ID NO: 137139 - protein, 7 aa, Mycobacterium avium
DGSPVTA

SEQ ID NO: 137140 - protein, 16 aa, Mycobacterium avium
DGSRAGPGINDNGSGV

SEQ ID NO: 137141 - protein, 26 aa, Mycobacterium avium
DGSSTFVNNPTSAMPQDELAARVAAL

SEQ ID NO: 137142 - protein, 5 aa, Mycobacterium avium
DGSVS

SEQ ID NO: 137143 - protein, 8 aa, Mycobacterium avium
DGTPGRID

SEQ ID NO: 137144 - protein, 6 aa, Mycobacterium avium
DGTRNL

SEQ ID NO: 137145 - protein, 10 aa, Mycobacterium avium
DGTSGAPWVS

SEQ ID NO: 137146 - protein, 6 aa, Mycobacterium avium
DGVNSE

SEQ ID NO: 137147 - protein, 4 aa, Mycobacterium avium
DGYR

SEQ ID NO: 137148 - protein, 6 aa, Mycobacterium avium
DHDGGV

SEQ ID NO: 137149 - protein, 4 aa, Mycobacterium avium
DHEQ

SEQ ID NO: 137150 - protein, 5 aa, Mycobacterium avium
DHLGA

SEQ ID NO: 137151 - protein, 8 aa, Mycobacterium avium
DHNPIHTN

SEQ ID NO: 137152 - protein, 7 aa, Mycobacterium avium
DIARAAG

SEQ ID NO: 137153 - protein, 14 aa, Mycobacterium avium
DIQRESGLAPGSGA

SEQ ID NO: 137154 - protein, 10 aa, Mycobacterium avium
DKAAGAPSVA

SEQ ID NO: 137155 - protein, 6 aa, Mycobacterium avium
DKFGGD

SEQ ID NO: 137156 - protein, 10 aa, Mycobacterium avium
DKGSPGEQRF

SEQ ID NO: 137157 - protein, 16 aa, Mycobacterium avium
DKNAKPACTYTLSVTV

SEQ ID NO: 137158 - protein, 8 aa, Mycobacterium avium
DLADGGAA

SEQ ID NO: 137159 - protein, 19 aa, Mycobacterium avium
DLAGTSTRVRARRRDGSWG

SEQ ID NO: 137160 - protein, 5 aa, Mycobacterium avium
DLNAN

SEQ ID NO: 137161 - protein, 9 aa, Mycobacterium avium
DLNANAGKG

SEQ ID NO: 137162 - protein, 10 aa, Mycobacterium avium
DLYGGNEPAR

SEQ ID NO: 137163 - protein, 6 aa, Mycobacterium avium
DNNRQA

SEQ ID NO: 137164 - protein, 10 aa, Mycobacterium avium
DNPTSGPPIR

SEQ ID NO: 137165 - protein, 6 aa, Mycobacterium avium
DNRGAM

SEQ ID NO: 137166 - protein, 12 aa, Mycobacterium avium
DPAAAAHERQRA

SEQ ID NO: 137167 - protein, 11 aa, Mycobacterium avium
DPATAAQTAAN

SEQ ID NO: 137168 - protein, 21 aa, Mycobacterium avium
DPGNGRDQSAQGVSGSGSGGI

SEQ ID NO: 137169 - protein, 29 aa, Mycobacterium avium
DPGTARAATLPQAPAPFEPPTAGKTLPTR

SEQ ID NO: 137170 - protein, 4 aa, Mycobacterium avium
DPPP

SEQ ID NO: 137171 - protein, 8 aa, Mycobacterium avium
DPSQGMGP

SEQ ID NO: 137172 - protein, 7 aa, Mycobacterium avium
DPTAGAA

SEQ ID NO: 137173 - protein, 10 aa, Mycobacterium avium
DPTGKTVVPD

SEQ ID NO: 137174 - protein, 8 aa, Mycobacterium avium
DQGSQAGD

SEQ ID NO: 137175 - protein, 13 aa, Mycobacterium avium
DQPSGTRNMNDYS

SEQ ID NO: 137176 - protein, 7 aa, Mycobacterium avium
DQQKNLD

SEQ ID NO: 137177 - protein, 22 aa, Mycobacterium avium
DQSLPMDARGQPVVPEGSAGIE

SEQ ID NO: 137178 - protein, 8 aa, Mycobacterium avium
DQSPPNQQ

SEQ ID NO: 137179 - protein, 7 aa, Mycobacterium avium
DRARPGA

SEQ ID NO: 137180 - protein, 8 aa, Mycobacterium avium
DRDMATPN

SEQ ID NO: 137181 - protein, 14 aa, Mycobacterium avium
DRPRRASVNELGGS

SEQ ID NO: 137182 - protein, 7 aa, Mycobacterium avium
DRRPGGN

SEQ ID NO: 137183 - protein, 4 aa, Mycobacterium avium
DRTA

SEQ ID NO: 137184 - protein, 8 aa, Mycobacterium avium
DRTEAAIK

SEQ ID NO: 137185 - protein, 4 aa, Mycobacterium avium
DRTG

SEQ ID NO: 137186 - protein, 4 aa, Mycobacterium avium
DRYG

SEQ ID NO: 137187 - protein, 6 aa, Mycobacterium avium
DSETLA

SEQ ID NO: 137188 - protein, 7 aa, Mycobacterium avium
DSGGDGW

SEQ ID NO: 137189 - protein, 8 aa, Mycobacterium avium
DSGGYNAN

SEQ ID NO: 137190 - protein, 10 aa, Mycobacterium avium
DSQADSADTL

SEQ ID NO: 137191 - protein, 26 aa, Mycobacterium avium
DSRQGLSAEQQQQLATGGDIGDGRTD

SEQ ID NO: 137192 - protein, 7 aa, Mycobacterium avium
DTAHGGA

SEQ ID NO: 137193 - protein, 10 aa, Mycobacterium avium
DTETTRKTLS

SEQ ID NO: 137194 - protein, 6 aa, Mycobacterium avium
DTGAPI

SEQ ID NO: 137195 - protein, 10 aa, Mycobacterium avium
DTGPHNYTDD

SEQ ID NO: 137196 - protein, 6 aa, Mycobacterium avium
DTGSPY

SEQ ID NO: 137197 - protein, 13 aa, Mycobacterium avium
DTIGLPATRAAAT

SEQ ID NO: 137198 - protein, 8 aa, Mycobacterium avium
DTLAPAEQ

SEQ ID NO: 137199 - protein, 9 aa, Mycobacterium avium
DTLNSRDAQ

SEQ ID NO: 137200 - protein, 10 aa, Mycobacterium avium
DTQLGPDVTD

SEQ ID NO: 137201 - protein, 5 aa, Mycobacterium avium
DTQSL

SEQ ID NO: 137202 - protein, 8 aa, Mycobacterium avium
DTTYPGAS

SEQ ID NO: 137203 - protein, 7 aa, Mycobacterium avium
DTYPDNT

SEQ ID NO: 137204 - protein, 8 aa, Mycobacterium avium
DVAGGSAD

SEQ ID NO: 137205 - protein, 7 aa, Mycobacterium avium
DVEAAAR

SEQ ID NO: 137206 - protein, 5 aa, Mycobacterium avium
DVPPE

SEQ ID NO: 137207 - protein, 8 aa, Mycobacterium avium
DVPPPDVQ

SEQ ID NO: 137208 - protein, 7 aa, Mycobacterium avium
DVPPTPV

SEQ ID NO: 137209 - protein, 11 aa, Mycobacterium avium
DVSATPAGGQA

SEQ ID NO: 137210 - protein, 4 aa, Mycobacterium avium
DYSP

SEQ ID NO: 137211 - protein, 9 aa, Mycobacterium avium
DYTTAAEDK

SEQ ID NO: 137212 - protein, 14 aa, Mycobacterium avium
EAAAEQQVKGQQAA

SEQ ID NO: 137213 - protein, 7 aa, Mycobacterium avium
EAARRAG

SEQ ID NO: 137214 - protein, 4 aa, Mycobacterium avium
EADA

SEQ ID NO: 137215 - protein, 7 aa, Mycobacterium avium
EADRQSR

SEQ ID NO: 137216 - protein, 7 aa, Mycobacterium avium
EAGPNQV

SEQ ID NO: 137217 - protein, 12 aa, Mycobacterium avium
EAKPGSQSIQGK

SEQ ID NO: 137218 - protein, 7 aa, Mycobacterium avium
EAPGGVM

SEQ ID NO: 137219 - protein, 6 aa, Mycobacterium avium
EAPGVS

SEQ ID NO: 137220 - protein, 28 aa, Mycobacterium avium
EASGSAGKVTVSPVRKPGMTPFLTRIIE

SEQ ID NO: 137221 - protein, 6 aa, Mycobacterium avium
EASRRG

SEQ ID NO: 137222 - protein, 14 aa, Mycobacterium avium
EDDNSNVGASRNQI

SEQ ID NO: 137223 - protein, 5 aa, Mycobacterium avium
EDGLG

SEQ ID NO: 137224 - protein, 4 aa, Mycobacterium avium
EDLG

SEQ ID NO: 137225 - protein, 14 aa, Mycobacterium avium
EDPGNTTSTIYRPG

SEQ ID NO: 137226 - protein, 6 aa, Mycobacterium avium
EDPGYA

SEQ ID NO: 137227 - protein, 6 aa, Mycobacterium avium
EDPQWG

SEQ ID NO: 137228 - protein, 8 aa, Mycobacterium avium
EDRSTPER

SEQ ID NO: 137229 - protein, 7 aa, Mycobacterium avium
EDVAAQR

SEQ ID NO: 137230 - protein, 15 aa, Mycobacterium avium
EEGPGSPRRLPPGAT

SEQ ID NO: 137231 - protein, 13 aa, Mycobacterium avium
EEHPQAAPEQARS

SEQ ID NO: 137232 - protein, 8 aa, Mycobacterium avium
EELPDPHS

SEQ ID NO: 137233 - protein, 5 aa, Mycobacterium avium
EEVRS

SEQ ID NO: 137234 - protein, 7 aa, Mycobacterium avium
EGADTSV

SEQ ID NO: 137235 - protein, 12 aa, Mycobacterium avium
EGEADREHEEQD

SEQ ID NO: 137236 - protein, 11 aa, Mycobacterium avium
EGEGADQVPLG

SEQ ID NO: 137237 - protein, 7 aa, Mycobacterium avium
EGGPSYW

SEQ ID NO: 137238 - protein, 12 aa, Mycobacterium avium
EGKAALSADDRQ

SEQ ID NO: 137239 - protein, 9 aa, Mycobacterium avium
EGRPQPSRI

SEQ ID NO: 137240 - protein, 9 aa, Mycobacterium avium
EGSPAPSVS

SEQ ID NO: 137241 - protein, 6 aa, Mycobacterium avium
EHPAPG

SEQ ID NO: 137242 - protein, 7 aa, Mycobacterium avium
EHSRTDE

SEQ ID NO: 137243 - protein, 10 aa, Mycobacterium avium
EIQTEQESVN

SEQ ID NO: 137244 - protein, 7 aa, Mycobacterium avium
EISDTAS

SEQ ID NO: 137245 - protein, 20 aa, Mycobacterium avium
EKRPSYADTRQQDTKPFNPK

SEQ ID NO: 137246 - protein, 4 aa, Mycobacterium avium
ELAE

SEQ ID NO: 137247 - protein, 9 aa, Mycobacterium avium
ELPTDPQTA

SEQ ID NO: 137248 - protein, 8 aa, Mycobacterium avium
ELPTPDDV

SEQ ID NO: 137249 - protein, 12 aa, Mycobacterium avium
ELTGPGTSGTSR

SEQ ID NO: 137250 - protein, 13 aa, Mycobacterium avium
EMGPVSRAAATEA

SEQ ID NO: 137251 - protein, 11 aa, Mycobacterium avium
ENETDPAPADL

SEQ ID NO: 137252 - protein, 6 aa, Mycobacterium avium
ENIAPA

SEQ ID NO: 137253 - protein, 10 aa, Mycobacterium avium
ENRSESGIIG

SEQ ID NO: 137254 - protein, 8 aa, Mycobacterium avium
ENSANLGG

SEQ ID NO: 137255 - protein, 7 aa, Mycobacterium avium
EPAINGN

SEQ ID NO: 137256 - protein, 9 aa, Mycobacterium avium
EPDSKSSKS

SEQ ID NO: 137257 - protein, 7 aa, Mycobacterium avium
EPEALER

SEQ ID NO: 137258 - protein, 6 aa, Mycobacterium avium
EPGVGK

SEQ ID NO: 137259 - protein, 6 aa, Mycobacterium avium
EPSDAL

SEQ ID NO: 137260 - protein, 5 aa, Mycobacterium avium
EPSTG

SEQ ID NO: 137261 - protein, 10 aa, Mycobacterium avium
EQASSSTQPV

SEQ ID NO: 137262 - protein, 8 aa, Mycobacterium avium
EQDGSKQW

SEQ ID NO: 137263 - protein, 13 aa, Mycobacterium avium
ERAAGEARGRPRV

SEQ ID NO: 137264 - protein, 10 aa, Mycobacterium avium
ERARSRAGQA

SEQ ID NO: 137265 - protein, 5 aa, Mycobacterium avium
ERAVS

SEQ ID NO: 137266 - protein, 4 aa, Mycobacterium avium
ERDS

SEQ ID NO: 137267 - protein, 7 aa, Mycobacterium avium
EREPGRA

SEQ ID NO: 137268 - protein, 7 aa, Mycobacterium avium
ERSLTAE

SEQ ID NO: 137269 - protein, 10 aa, Mycobacterium avium
ERTEDGFGQG

SEQ ID NO: 137270 - protein, 9 aa, Mycobacterium avium
ESAEGRQKY

SEQ ID NO: 137271 - protein, 7 aa, Mycobacterium avium
ESDGGAT

SEQ ID NO: 137272 - protein, 6 aa, Mycobacterium avium
ESSERE

SEQ ID NO: 137273 - protein, 6 aa, Mycobacterium avium
ETERTP

SEQ ID NO: 137274 - protein, 5 aa, Mycobacterium avium
ETGTL

SEQ ID NO: 137275 - protein, 8 aa, Mycobacterium avium
ETHPSEPN

SEQ ID NO: 137276 - protein, 6 aa, Mycobacterium avium
ETQASV

SEQ ID NO: 137277 - protein, 5 aa, Mycobacterium avium
ETSTP

SEQ ID NO: 137278 - protein, 16 aa, Mycobacterium avium
EVATSDADRGQKTPWN

SEQ ID NO: 137279 - protein, 4 aa, Mycobacterium avium
EVDG

SEQ ID NO: 137280 - protein, 4 aa, Mycobacterium avium
EVEN

SEQ ID NO: 137281 - protein, 6 aa, Mycobacterium avium
EVGPDD

SEQ ID NO: 137282 - protein, 11 aa, Mycobacterium avium
EVHAQAQSHGV

SEQ ID NO: 137283 - protein, 8 aa, Mycobacterium avium
EVKDENIT

SEQ ID NO: 137284 - protein, 5 aa, Mycobacterium avium
EVTGS

SEQ ID NO: 137285 - protein, 6 aa, Mycobacterium avium
EYGEKH

SEQ ID NO: 137286 - protein, 7 aa, Mycobacterium avium
EYSGDQA

SEQ ID NO: 137287 - protein, 4 aa, Mycobacterium avium
FDER

SEQ ID NO: 137288 - protein, 9 aa, Mycobacterium avium
FEGHPDNAA

SEQ ID NO: 137289 - protein, 15 aa, Mycobacterium avium
FEPSERALRGNPTTV

SEQ ID NO: 137290 - protein, 8 aa, Mycobacterium avium
FGASRVAP

SEQ ID NO: 137291 - protein, 7 aa, Mycobacterium avium
FGEPGNA

SEQ ID NO: 137292 - protein, 12 aa, Mycobacterium avium
FGTAPNPGTGLP

SEQ ID NO: 137293 - protein, 6 aa, Mycobacterium avium
FNPDRY

SEQ ID NO: 137294 - protein, 10 aa, Mycobacterium avium
FPANAAPSGW

SEQ ID NO: 137295 - protein, 13 aa, Mycobacterium avium
FPGDNGLQPITNQ

SEQ ID NO: 137296 - protein, 11 aa, Mycobacterium avium
FPGGGDNGWGS

SEQ ID NO: 137297 - protein, 8 aa, Mycobacterium avium
FPRPDDPL

SEQ ID NO: 137298 - protein, 11 aa, Mycobacterium avium
FPRSDGTPAPV

SEQ ID NO: 137299 - protein, 10 aa, Mycobacterium avium
FPSPQEAVRE

SEQ ID NO: 137300 - protein, 6 aa, Mycobacterium avium
FSKPGL

SEQ ID NO: 137301 - protein, 9 aa, Mycobacterium avium
FSPEPAAQY

SEQ ID NO: 137302 - protein, 10 aa, Mycobacterium avium
FSSPGSAVAA

SEQ ID NO: 137303 - protein, 4 aa, Mycobacterium avium
FTKP

SEQ ID NO: 137304 - protein, 14 aa, Mycobacterium avium
FVPPTSDALGAPGT

SEQ ID NO: 137305 - protein, 7 aa, Mycobacterium avium
GAAATMP

SEQ ID NO: 137306 - protein, 7 aa, Mycobacterium avium
GAAAVSS

SEQ ID NO: 137307 - protein, 8 aa, Mycobacterium avium
GAAGAAGA

SEQ ID NO: 137308 - protein, 8 aa, Mycobacterium avium
GAALPSAP

SEQ ID NO: 137309 - protein, 8 aa, Mycobacterium avium
GAAMGSSR

SEQ ID NO: 137310 - protein, 5 aa, Mycobacterium avium
GAATG

SEQ ID NO: 137311 - protein, 8 aa, Mycobacterium avium
GACGNTDS

SEQ ID NO: 137312 - protein, 7 aa, Mycobacterium avium
GADATGA

SEQ ID NO: 137313 - protein, 10 aa, Mycobacterium avium
GADDASLRAD

SEQ ID NO: 137314 - protein, 10 aa, Mycobacterium avium
GADGYGTSKA

SEQ ID NO: 137315 - protein, 7 aa, Mycobacterium avium
GADRADA

SEQ ID NO: 137316 - protein, 15 aa, Mycobacterium avium
GADRLSATGGALAAP

SEQ ID NO: 137317 - protein, 6 aa, Mycobacterium avium
GADSPL

SEQ ID NO: 137318 - protein, 5 aa, Mycobacterium avium
GADVG

SEQ ID NO: 137319 - protein, 5 aa, Mycobacterium avium
GAEEY

SEQ ID NO: 137320 - protein, 10 aa, Mycobacterium avium
GAEGKMSADQ

SEQ ID NO: 137321 - protein, 4 aa, Mycobacterium avium
GAGH

SEQ ID NO: 137322 - protein, 12 aa, Mycobacterium avium
GAGKATGDQGRA

SEQ ID NO: 137323 - protein, 5 aa, Mycobacterium avium
GAGQV

SEQ ID NO: 137324 - protein, 7 aa, Mycobacterium avium
GAGSGIG

SEQ ID NO: 137325 - protein, 11 aa, Mycobacterium avium
GAGSPRGSCDT

SEQ ID NO: 137326 - protein, 12 aa, Mycobacterium avium
GAIGGKTGFTNA

SEQ ID NO: 137327 - protein, 16 aa, Mycobacterium avium
GAKCPGPQAAAQSEAG

SEQ ID NO: 137328 - protein, 7 aa, Mycobacterium avium
GALAGGT

SEQ ID NO: 137329 - protein, 10 aa, Mycobacterium avium
GALASTGTAY

SEQ ID NO: 137330 - protein, 4 aa, Mycobacterium avium
GALS

SEQ ID NO: 137331 - protein, 9 aa, Mycobacterium avium
GALTGDDTV

SEQ ID NO: 137332 - protein, 8 aa, Mycobacterium avium
GANKDRDY

SEQ ID NO: 137333 - protein, 8 aa, Mycobacterium avium
GAPAGTVN

SEQ ID NO: 137334 - protein, 7 aa, Mycobacterium avium
GAPPNGV

SEQ ID NO: 137335 - protein, 7 aa, Mycobacterium avium
GAPQPTF

SEQ ID NO: 137336 - protein, 24 aa, Mycobacterium avium
GAPTAAADSTQPAGSIPIPDGPAQ

SEQ ID NO: 137337 - protein, 14 aa, Mycobacterium avium
GAPTAPEDSAADDA

SEQ ID NO: 137338 - protein, 4 aa, Mycobacterium avium
GAQP

SEQ ID NO: 137339 - protein, 21 aa, Mycobacterium avium
GATPGAGPATAAATNAGNGQG

SEQ ID NO: 137340 - protein, 6 aa, Mycobacterium avium
GATTRQ

SEQ ID NO: 137341 - protein, 5 aa, Mycobacterium avium
GAYPG

SEQ ID NO: 137342 - protein, 8 aa, Mycobacterium avium
GCGSDDDG

SEQ ID NO: 137343 - protein, 13 aa, Mycobacterium avium
GCGSKSQPPPTAG

SEQ ID NO: 137344 - protein, 42 aa, Mycobacterium avium
GCGSNNKSQPSTSKTGSATSSTSATSPAAAPPSSPAPATPNE

SEQ ID NO: 137345 - protein, 9 aa, Mycobacterium avium
GCTGPAHPH

SEQ ID NO: 137346 - protein, 9 aa, Mycobacterium avium
GDAAPGPAD

SEQ ID NO: 137347 - protein, 4 aa, Mycobacterium avium
GDAS

SEQ ID NO: 137348 - protein, 8 aa, Mycobacterium avium
GDCTETPD

SEQ ID NO: 137349 - protein, 8 aa, Mycobacterium avium
GDDARTRA

SEQ ID NO: 137350 - protein, 8 aa, Mycobacterium avium
GDDSTSAL

SEQ ID NO: 137351 - protein, 6 aa, Mycobacterium avium
GDFGEN

SEQ ID NO: 137352 - protein, 6 aa, Mycobacterium avium
GDFPES

SEQ ID NO: 137353 - protein, 9 aa, Mycobacterium avium
GDGVQVKNA

SEQ ID NO: 137354 - protein, 24 aa, Mycobacterium avium
GDLTTTPATAAKGNATITLGGSDI

SEQ ID NO: 137355 - protein, 5 aa, Mycobacterium avium
GDMSG

SEQ ID NO: 137356 - protein, 17 aa, Mycobacterium avium
GDQYNAGRHIPQDQARR

SEQ ID NO: 137357 - protein, 13 aa, Mycobacterium avium
GDRADAADDSGTD

SEQ ID NO: 137358 - protein, 18 aa, Mycobacterium avium
GDTIPLKNSSSYPTTEQT

SEQ ID NO: 137359 - protein, 8 aa, Mycobacterium avium
GDTRNRGR

SEQ ID NO: 137360 - protein, 4 aa, Mycobacterium avium
GDWD

SEQ ID NO: 137361 - protein, 11 aa, Mycobacterium avium
GEAAGFGGGGV

SEQ ID NO: 137362 - protein, 11 aa, Mycobacterium avium
GEADKARNVTR

SEQ ID NO: 137363 - protein, 5 aa, Mycobacterium avium
GEEGR

SEQ ID NO: 137364 - protein, 13 aa, Mycobacterium avium
GEHDSVDDAGQKY

SEQ ID NO: 137365 - protein, 4 aa, Mycobacterium avium
GEKR

SEQ ID NO: 137366 - protein, 6 aa, Mycobacterium avium
GEPETC

SEQ ID NO: 137367 - protein, 16 aa, Mycobacterium avium
GEQPSLTDLDNGDLKY

SEQ ID NO: 137368 - protein, 7 aa, Mycobacterium avium
GERAGAA

SEQ ID NO: 137369 - protein, 5 aa, Mycobacterium avium
GETAG

SEQ ID NO: 137370 - protein, 4 aa, Mycobacterium avium
GETG

SEQ ID NO: 137371 - protein, 11 aa, Mycobacterium avium
GETPASLPYTA

SEQ ID NO: 137372 - protein, 5 aa, Mycobacterium avium
GFNGS

SEQ ID NO: 137373 - protein, 21 aa, Mycobacterium avium
GGCDGNPAPLPSGGKTLGAGQ

SEQ ID NO: 137374 - protein, 6 aa, Mycobacterium avium
GGDAAG

SEQ ID NO: 137375 - protein, 20 aa, Mycobacterium avium
GGEPPNPLVPTGTNDSQGGR

SEQ ID NO: 137376 - protein, 4 aa, Mycobacterium avium
GGFA

SEQ ID NO: 137377 - protein, 7 aa, Mycobacterium avium
GGGETAA

SEQ ID NO: 137378 - protein, 16 aa, Mycobacterium avium
GGGNAAGPSKGIDSGA

SEQ ID NO: 137379 - protein, 7 aa, Mycobacterium avium
GGGPDTR

SEQ ID NO: 137380 - protein, 4 aa, Mycobacterium avium
GGHG

SEQ ID NO: 137381 - protein, 48 aa, Mycobacterium avium
GGHGSKPSGATPSSTSTSVSQPKNSAQNATDCTPNVSGGDMPRSDSIA

SEQ ID NO: 137382 - protein, 19 aa, Mycobacterium avium
GGHPGQYGTGHGATSITVA

SEQ ID NO: 137383 - protein, 4 aa, Mycobacterium avium
GGIE

SEQ ID NO: 137384 - protein, 20 aa, Mycobacterium avium
GGNDAPAAAATPSNPGGKIP

SEQ ID NO: 137385 - protein, 8 aa, Mycobacterium avium
GGQHPRYA

SEQ ID NO: 137386 - protein, 5 aa, Mycobacterium avium
GGQSS

SEQ ID NO: 137387 - protein, 4 aa, Mycobacterium avium
GGRS

SEQ ID NO: 137388 - protein, 4 aa, Mycobacterium avium
GGRY

SEQ ID NO: 137389 - protein, 17 aa, Mycobacterium avium
GGSLDGPSKGVGDGANI

SEQ ID NO: 137390 - protein, 8 aa, Mycobacterium avium
GGSPAALR

SEQ ID NO: 137391 - protein, 10 aa, Mycobacterium avium
GGSPDKTAAA

SEQ ID NO: 137392 - protein, 7 aa, Mycobacterium avium
GGSSEYA

SEQ ID NO: 137393 - protein, 19 aa, Mycobacterium avium
GGTADQPFDPNYHQKTDTL

SEQ ID NO: 137394 - protein, 7 aa, Mycobacterium avium
GGTLPPR

SEQ ID NO: 137395 - protein, 22 aa, Mycobacterium avium
GGTLTGLDGTPGPHRGSAVASN

SEQ ID NO: 137396 - protein, 15 aa, Mycobacterium avium
GGVTGNADACYSRYP

SEQ ID NO: 137397 - protein, 5 aa, Mycobacterium avium
GGYDG

SEQ ID NO: 137398 - protein, 9 aa, Mycobacterium avium
GHGASPQAL

SEQ ID NO: 137399 - protein, 15 aa, Mycobacterium avium
GHGHGSGDSHTGGVV

SEQ ID NO: 137400 - protein, 5 aa, Mycobacterium avium
GHGRS

SEQ ID NO: 137401 - protein, 36 aa, Mycobacterium avium
GHNGSNDASINRQVPTGRGGTKDCQASGTATNTGYQ

SEQ ID NO: 137402 - protein, 7 aa, Mycobacterium avium
GHQDTSH

SEQ ID NO: 137403 - protein, 4 aa, Mycobacterium avium
GHTE

SEQ ID NO: 137404 - protein, 9 aa, Mycobacterium avium
GHYTNATDA

SEQ ID NO: 137405 - protein, 5 aa, Mycobacterium avium
GIKSP

SEQ ID NO: 137406 - protein, 20 aa, Mycobacterium avium
GINSANPNKVVTTDFKIVAE

SEQ ID NO: 137407 - protein, 14 aa, Mycobacterium avium
GINYESPDAAVNSG

SEQ ID NO: 137408 - protein, 19 aa, Mycobacterium avium
GIPPAPPPPPEGAPPPVGS

SEQ ID NO: 137409 - protein, 10 aa, Mycobacterium avium
GISKEQVARG

SEQ ID NO: 137410 - protein, 13 aa, Mycobacterium avium
GITYPDPTRAIRA

SEQ ID NO: 137411 - protein, 6 aa, Mycobacterium avium
GKAGCT

SEQ ID NO: 137412 - protein, 5 aa, Mycobacterium avium
GKASP

SEQ ID NO: 137413 - protein, 8 aa, Mycobacterium avium
GKDQNVSG

SEQ ID NO: 137414 - protein, 8 aa, Mycobacterium avium
GKGNTADW

SEQ ID NO: 137415 - protein, 15 aa, Mycobacterium avium
GKQPPSAPAPARPLR

SEQ ID NO: 137416 - protein, 4 aa, Mycobacterium avium
GKRL

SEQ ID NO: 137417 - protein, 7 aa, Mycobacterium avium
GKSPRFT

SEQ ID NO: 137418 - protein, 7 aa, Mycobacterium avium
GLGGPAR

SEQ ID NO: 137419 - protein, 9 aa, Mycobacterium avium
GLTPDDPQY

SEQ ID NO: 137420 - protein, 12 aa, Mycobacterium avium
GLTSTTPPGDGR

SEQ ID NO: 137421 - protein, 6 aa, Mycobacterium avium
GLYGRD

SEQ ID NO: 137422 - protein, 5 aa, Mycobacterium avium
GNATQ

SEQ ID NO: 137423 - protein, 9 aa, Mycobacterium avium
GNGESGPQL

SEQ ID NO: 137424 - protein, 6 aa, Mycobacterium avium
GNPTPA

SEQ ID NO: 137425 - protein, 8 aa, Mycobacterium avium
GNSDQLVP

SEQ ID NO: 137426 - protein, 15 aa, Mycobacterium avium
GNSIQVTKEDNGTAA

SEQ ID NO: 137427 - protein, 6 aa, Mycobacterium avium
GNTAGR

SEQ ID NO: 137428 - protein, 9 aa, Mycobacterium avium
GNTDCPGNA

SEQ ID NO: 137429 - protein, 8 aa, Mycobacterium avium
GNWPSATT

SEQ ID NO: 137430 - protein, 9 aa, Mycobacterium avium
GPAGPAAPT

SEQ ID NO: 137431 - protein, 13 aa, Mycobacterium avium
GPAHADSADQQQA

SEQ ID NO: 137432 - protein, 12 aa, Mycobacterium avium
GPAPVPQPSQDI

SEQ ID NO: 137433 - protein, 8 aa, Mycobacterium avium
GPAQADAA

SEQ ID NO: 137434 - protein, 6 aa, Mycobacterium avium
GPARDG

SEQ ID NO: 137435 - protein, 6 aa, Mycobacterium avium
GPDPAF

SEQ ID NO: 137436 - protein, 8 aa, Mycobacterium avium
GPDPKGAV

SEQ ID NO: 137437 - protein, 6 aa, Mycobacterium avium
GPEATV

SEQ ID NO: 137438 - protein, 7 aa, Mycobacterium avium
GPGPTFD

SEQ ID NO: 137439 - protein, 14 aa, Mycobacterium avium
GPGQAEKSLLPGNP

SEQ ID NO: 137440 - protein, 5 aa, Mycobacterium avium
GPGQV

SEQ ID NO: 137441 - protein, 6 aa, Mycobacterium avium
GPIGTD

SEQ ID NO: 137442 - protein, 5 aa, Mycobacterium avium
GPLSD

SEQ ID NO: 137443 - protein, 7 aa, Mycobacterium avium
GPNQLET

SEQ ID NO: 137444 - protein, 9 aa, Mycobacterium avium
GPNSGPGHN

SEQ ID NO: 137445 - protein, 5 aa, Mycobacterium avium
GPPPD

SEQ ID NO: 137446 - protein, 5 aa, Mycobacterium avium
GPQPL

SEQ ID NO: 137447 - protein, 5 aa, Mycobacterium avium
GPSGF

SEQ ID NO: 137448 - protein, 7 aa, Mycobacterium avium
GPSGQAE

SEQ ID NO: 137449 - protein, 17 aa, Mycobacterium avium
GPTGVIGTNKKDSQDTV

SEQ ID NO: 137450 - protein, 4 aa, Mycobacterium avium
GPTV

SEQ ID NO: 137451 - protein, 14 aa, Mycobacterium avium
GPVNMTGPAPVTNA

SEQ ID NO: 137452 - protein, 5 aa, Mycobacterium avium
GPYRY

SEQ ID NO: 137453 - protein, 10 aa, Mycobacterium avium
GQAARAAGLD

SEQ ID NO: 137454 - protein, 7 aa, Mycobacterium avium
GQAAYNS

SEQ ID NO: 137455 - protein, 15 aa, Mycobacterium avium
GQANQDKGDAAPAQW

SEQ ID NO: 137456 - protein, 6 aa, Mycobacterium avium
GQAPPI

SEQ ID NO: 137457 - protein, 6 aa, Mycobacterium avium
GQGTNS

SEQ ID NO: 137458 - protein, 9 aa, Mycobacterium avium
GQPFGEQSA

SEQ ID NO: 137459 - protein, 18 aa, Mycobacterium avium
GQPVGPRPNPRPDGLTPR

SEQ ID NO: 137460 - protein, 10 aa, Mycobacterium avium
GQQPNPCTYT

SEQ ID NO: 137461 - protein, 12 aa, Mycobacterium avium
GQSPDPKGPAQA

SEQ ID NO: 137462 - protein, 8 aa, Mycobacterium avium
GQTPEQVA

SEQ ID NO: 137463 - protein, 9 aa, Mycobacterium avium
GQVTPTNAT

SEQ ID NO: 137464 - protein, 15 aa, Mycobacterium avium
GRDPRGANVDTTIRP

SEQ ID NO: 137465 - protein, 12 aa, Mycobacterium avium
GRGDDGAPVAEP

SEQ ID NO: 137466 - protein, 8 aa, Mycobacterium avium
GRGDVATT

SEQ ID NO: 137467 - protein, 38 aa, Mycobacterium avium
GRGPQTPMGQSPWTPSGPPLPPAPAGQAPPDPMVPEPP

SEQ ID NO: 137468 - protein, 10 aa, Mycobacterium avium
GRISEESGEL

SEQ ID NO: 137469 - protein, 7 aa, Mycobacterium avium
GRKDYDS

SEQ ID NO: 137470 - protein, 10 aa, Mycobacterium avium
GRLSQAADQY

SEQ ID NO: 137471 - protein, 11 aa, Mycobacterium avium
GRLTDGQGRTV

SEQ ID NO: 137472 - protein, 8 aa, Mycobacterium avium
GRPSERWG

SEQ ID NO: 137473 - protein, 24 aa, Mycobacterium avium
GRQRYRSSGVPGAADLRSALKPLL

SEQ ID NO: 137474 - protein, 8 aa, Mycobacterium avium
GRTTVDSP

SEQ ID NO: 137475 - protein, 9 aa, Mycobacterium avium
GRVPDPALP

SEQ ID NO: 137476 - protein, 13 aa, Mycobacterium avium
GSAARRPPIPGSD

SEQ ID NO: 137477 - protein, 8 aa, Mycobacterium avium
GSAGGLTK

SEQ ID NO: 137478 - protein, 8 aa, Mycobacterium avium
GSALPTRT

SEQ ID NO: 137479 - protein, 7 aa, Mycobacterium avium
GSETADH

SEQ ID NO: 137480 - protein, 5 aa, Mycobacterium avium
GSGAD

SEQ ID NO: 137481 - protein, 10 aa, Mycobacterium avium
GSGEPPGIGG

SEQ ID NO: 137482 - protein, 4 aa, Mycobacterium avium
GSGY

SEQ ID NO: 137483 - protein, 9 aa, Mycobacterium avium
GSGYPRGLA

SEQ ID NO: 137484 - protein, 8 aa, Mycobacterium avium
GSHPRAAA

SEQ ID NO: 137485 - protein, 11 aa, Mycobacterium avium
GSLAAGPALSA

SEQ ID NO: 137486 - protein, 6 aa, Mycobacterium avium
GSPATV

SEQ ID NO: 137487 - protein, 7 aa, Mycobacterium avium
GSPEQTG

SEQ ID NO: 137488 - protein, 8 aa, Mycobacterium avium
GSPKGFTH

SEQ ID NO: 137489 - protein, 6 aa, Mycobacterium avium
GSPRDG

SEQ ID NO: 137490 - protein, 21 aa, Mycobacterium avium
GSRPATSLAGLSRSVDEVLRS

SEQ ID NO: 137491 - protein, 4 aa, Mycobacterium avium
GSTA

SEQ ID NO: 137492 - protein, 11 aa, Mycobacterium avium
GTAEPPGVGGV

SEQ ID NO: 137493 - protein, 6 aa, Mycobacterium avium
GTDAGD

SEQ ID NO: 137494 - protein, 6 aa, Mycobacterium avium
GTDDTR

SEQ ID NO: 137495 - protein, 4 aa, Mycobacterium avium
GTDR

SEQ ID NO: 137496 - protein, 10 aa, Mycobacterium avium
GTGPDGVSGP

SEQ ID NO: 137497 - protein, 15 aa, Mycobacterium avium
GTGTISADGKVGQIG

SEQ ID NO: 137498 - protein, 4 aa, Mycobacterium avium
GTGW

SEQ ID NO: 137499 - protein, 10 aa, Mycobacterium avium
GTHASTSEFN

SEQ ID NO: 137500 - protein, 11 aa, Mycobacterium avium
GTHDGQHIASP

SEQ ID NO: 137501 - protein, 20 aa, Mycobacterium avium
GTHGGVTSGEGAGDNTKPFH

SEQ ID NO: 137502 - protein, 5 aa, Mycobacterium avium
GTIGP

SEQ ID NO: 137503 - protein, 9 aa, Mycobacterium avium
GTNEPPGMG

SEQ ID NO: 137504 - protein, 8 aa, Mycobacterium avium
GTPGADNC

SEQ ID NO: 137505 - protein, 6 aa, Mycobacterium avium
GTPGQD

SEQ ID NO: 137506 - protein, 9 aa, Mycobacterium avium
GTPKSAGFD

SEQ ID NO: 137507 - protein, 15 aa, Mycobacterium avium
GTSPSPRELAQTQTV

SEQ ID NO: 137508 - protein, 6 aa, Mycobacterium avium
GTTGMP

SEQ ID NO: 137509 - protein, 5 aa, Mycobacterium avium
GTTSL

SEQ ID NO: 137510 - protein, 9 aa, Mycobacterium avium
GTTSQPKAV

SEQ ID NO: 137511 - protein, 14 aa, Mycobacterium avium
GTVDPKPAAPGEVH

SEQ ID NO: 137512 - protein, 17 aa, Mycobacterium avium
GTYSPPTNCVLNGQYRC

SEQ ID NO: 137513 - protein, 19 aa, Mycobacterium avium
GVDPKGTVQLESAGSHYTT

SEQ ID NO: 137514 - protein, 13 aa, Mycobacterium avium
GVEPTERGARATM

SEQ ID NO: 137515 - protein, 7 aa, Mycobacterium avium
GVETPAA

SEQ ID NO: 137516 - protein, 10 aa, Mycobacterium avium
GVHPNDAGHQ

SEQ ID NO: 137517 - protein, 7 aa, Mycobacterium avium
GVIPGSR

SEQ ID NO: 137518 - protein, 6 aa, Mycobacterium avium
GVPTHV

SEQ ID NO: 137519 - protein, 9 aa, Mycobacterium avium
GVPTPGLPF

SEQ ID NO: 137520 - protein, 8 aa, Mycobacterium avium
GYATPQGA

SEQ ID NO: 137521 - protein, 7 aa, Mycobacterium avium
GYDPETL

SEQ ID NO: 137522 - protein, 9 aa, Mycobacterium avium
GYHPSAPAY

SEQ ID NO: 137523 - protein, 9 aa, Mycobacterium avium
GYKGPPFTG

SEQ ID NO: 137524 - protein, 7 aa, Mycobacterium avium
GYNPKGA

SEQ ID NO: 137525 - protein, 7 aa, Mycobacterium avium
HADSDDD

SEQ ID NO: 137526 - protein, 17 aa, Mycobacterium avium
HATGTSVGDVAESKAIN

SEQ ID NO: 137527 - protein, 6 aa, Mycobacterium avium
HDAHQS

SEQ ID NO: 137528 - protein, 6 aa, Mycobacterium avium
HDGDTV

SEQ ID NO: 137529 - protein, 6 aa, Mycobacterium avium
HEFSDG

SEQ ID NO: 137530 - protein, 5 aa, Mycobacterium avium
HETDR

SEQ ID NO: 137531 - protein, 18 aa, Mycobacterium avium
HFSDPLNGQPDQRTATAG

SEQ ID NO: 137532 - protein, 6 aa, Mycobacterium avium
HGAGEV

SEQ ID NO: 137533 - protein, 10 aa, Mycobacterium avium
HGAVEDPARV

SEQ ID NO: 137534 - protein, 11 aa, Mycobacterium avium
HGGDGANDTIN

SEQ ID NO: 137535 - protein, 9 aa, Mycobacterium avium
HGNSKIDSI

SEQ ID NO: 137536 - protein, 12 aa, Mycobacterium avium
HGPDGQTVPDRD

SEQ ID NO: 137537 - protein, 5 aa, Mycobacterium avium
HGRGG

SEQ ID NO: 137538 - protein, 16 aa, Mycobacterium avium
HGVSGGAEIRRSDAPR

SEQ ID NO: 137539 - protein, 6 aa, Mycobacterium avium
HHGTYR

SEQ ID NO: 137540 - protein, 12 aa, Mycobacterium avium
HNDGRVSPDNID

SEQ ID NO: 137541 - protein, 7 aa, Mycobacterium avium
HPDDNDK

SEQ ID NO: 137542 - protein, 4 aa, Mycobacterium avium
HPGG

SEQ ID NO: 137543 - protein, 6 aa, Mycobacterium avium
HPGQSP

SEQ ID NO: 137544 - protein, 19 aa, Mycobacterium avium
HQGDQARCENNPGARTAEG

SEQ ID NO: 137545 - protein, 5 aa, Mycobacterium avium
HRPSV

SEQ ID NO: 137546 - protein, 14 aa, Mycobacterium avium
HRRPAPSQSAAQSP

SEQ ID NO: 137547 - protein, 7 aa, Mycobacterium avium
HSRSAIG

SEQ ID NO: 137548 - protein, 6 aa, Mycobacterium avium
HSSNGV

SEQ ID NO: 137549 - protein, 5 aa, Mycobacterium avium
HTEEQ

SEQ ID NO: 137550 - protein, 5 aa, Mycobacterium avium
HTMPP

SEQ ID NO: 137551 - protein, 12 aa, Mycobacterium avium
IADPTRNVKGDS

SEQ ID NO: 137552 - protein, 7 aa, Mycobacterium avium
IAPDDPA

SEQ ID NO: 137553 - protein, 9 aa, Mycobacterium avium
IDEDRRSRE

SEQ ID NO: 137554 - protein, 5 aa, Mycobacterium avium
IDPAQ

SEQ ID NO: 137555 - protein, 12 aa, Mycobacterium avium
IDPGNAADYRRN

SEQ ID NO: 137556 - protein, 9 aa, Mycobacterium avium
IDPPPSIQA

SEQ ID NO: 137557 - protein, 21 aa, Mycobacterium avium
IEGAQAATADGFDADTDLTAT

SEQ ID NO: 137558 - protein, 11 aa, Mycobacterium avium
IEPQSAGSKVT

SEQ ID NO: 137559 - protein, 11 aa, Mycobacterium avium
IGKGAKLGSGK

SEQ ID NO: 137560 - protein, 17 aa, Mycobacterium avium
IGNGPYQLAGGPDGPAW

SEQ ID NO: 137561 - protein, 13 aa, Mycobacterium avium
IGPAAQRCGGNPA

SEQ ID NO: 137562 - protein, 10 aa, Mycobacterium avium
IKEAEGQKQA

SEQ ID NO: 137563 - protein, 7 aa, Mycobacterium avium
IKPRGPS

SEQ ID NO: 137564 - protein, 4 aa, Mycobacterium avium
INGN

SEQ ID NO: 137565 - protein, 25 aa, Mycobacterium avium
INTGGDTKCKDFTTQDEKKQNDEVS

SEQ ID NO: 137566 - protein, 5 aa, Mycobacterium avium
IPASD

SEQ ID NO: 137567 - protein, 9 aa, Mycobacterium avium
IPEHGKDKI

SEQ ID NO: 137568 - protein, 4 aa, Mycobacterium avium
IPGE

SEQ ID NO: 137569 - protein, 5 aa, Mycobacterium avium
IPGSQ

SEQ ID NO: 137570 - protein, 16 aa, Mycobacterium avium
IPPRADGVYTRGGGPV

SEQ ID NO: 137571 - protein, 5 aa, Mycobacterium avium
IPPSA

SEQ ID NO: 137572 - protein, 12 aa, Mycobacterium avium
IRGQRTRTAFSD

SEQ ID NO: 137573 - protein, 9 aa, Mycobacterium avium
IRRPDGSAG

SEQ ID NO: 137574 - protein, 7 aa, Mycobacterium avium
ISDKAAV

SEQ ID NO: 137575 - protein, 10 aa, Mycobacterium avium
ISSSSPRKEQ

SEQ ID NO: 137576 - protein, 7 aa, Mycobacterium avium
ISSTRGS

SEQ ID NO: 137577 - protein, 6 aa, Mycobacterium avium
ISTKDP

SEQ ID NO: 137578 - protein, 8 aa, Mycobacterium avium
ITDGNGKK

SEQ ID NO: 137579 - protein, 13 aa, Mycobacterium avium
ITDPAKRHAAEQT

SEQ ID NO: 137580 - protein, 11 aa, Mycobacterium avium
ITPGPGARNVD

SEQ ID NO: 137581 - protein, 12 aa, Mycobacterium avium
ITSPSTCAVTTF

SEQ ID NO: 137582 - protein, 30 aa, Mycobacterium avium
KAAALGATNTHASTPSGLDGPNGSGSSTAH

SEQ ID NO: 137583 - protein, 10 aa, Mycobacterium avium
KAGGANTAIQ

SEQ ID NO: 137584 - protein, 5 aa, Mycobacterium avium
KAGQA

SEQ ID NO: 137585 - protein, 5 aa, Mycobacterium avium
KALGH

SEQ ID NO: 137586 - protein, 6 aa, Mycobacterium avium
KANQRL

SEQ ID NO: 137587 - protein, 8 aa, Mycobacterium avium
KAQNPGTG

SEQ ID NO: 137588 - protein, 9 aa, Mycobacterium avium
KDAGTPIAN

SEQ ID NO: 137589 - protein, 12 aa, Mycobacterium avium
KDKSGTDPSNVE

SEQ ID NO: 137590 - protein, 6 aa, Mycobacterium avium
KDNGRI

SEQ ID NO: 137591 - protein, 19 aa, Mycobacterium avium
KDNGVSCPGGGTAPTTETY

SEQ ID NO: 137592 - protein, 12 aa, Mycobacterium avium
KDQASKANWPTE

SEQ ID NO: 137593 - protein, 8 aa, Mycobacterium avium
KDQNPGMT

SEQ ID NO: 137594 - protein, 14 aa, Mycobacterium avium
KDRVVDENDRAGTG

SEQ ID NO: 137595 - protein, 6 aa, Mycobacterium avium
KDSVIP

SEQ ID NO: 137596 - protein, 4 aa, Mycobacterium avium
KDTG

SEQ ID NO: 137597 - protein, 12 aa, Mycobacterium avium
KEEDEASKERLE

SEQ ID NO: 137598 - protein, 10 aa, Mycobacterium avium
KFGTGATGRT

SEQ ID NO: 137599 - protein, 10 aa, Mycobacterium avium
KGDAAKTAKT

SEQ ID NO: 137600 - protein, 6 aa, Mycobacterium avium
KGDGRV

SEQ ID NO: 137601 - protein, 19 aa, Mycobacterium avium
KGLAPGGHAAVGASQGGYG

SEQ ID NO: 137602 - protein, 13 aa, Mycobacterium avium
KGMGSGGAKGCPK

SEQ ID NO: 137603 - protein, 24 aa, Mycobacterium avium
KGPDLTTISTTTPYEQRRAVSPQV

SEQ ID NO: 137604 - protein, 6 aa, Mycobacterium avium
KGPGYQ

SEQ ID NO: 137605 - protein, 28 aa, Mycobacterium avium
KGTATGVDMSNPQQPQQVTKSFELDATC

SEQ ID NO: 137606 - protein, 4 aa, Mycobacterium avium
KIAN

SEQ ID NO: 137607 - protein, 8 aa, Mycobacterium avium
KIPSSQMR

SEQ ID NO: 137608 - protein, 5 aa, Mycobacterium avium
KISSD

SEQ ID NO: 137609 - protein, 8 aa, Mycobacterium avium
KKLSAPVG

SEQ ID NO: 137610 - protein, 8 aa, Mycobacterium avium
KLGPSRTA

SEQ ID NO: 137611 - protein, 14 aa, Mycobacterium avium
KLPKNATAKIGQTS

SEQ ID NO: 137612 - protein, 12 aa, Mycobacterium avium
KLQKAAKNGDLP

SEQ ID NO: 137613 - protein, 8 aa, Mycobacterium avium
KLTTPGVA

SEQ ID NO: 137614 - protein, 18 aa, Mycobacterium avium
KNAGDAARMESPDGRAAY

SEQ ID NO: 137615 - protein, 7 aa, Mycobacterium avium
KNDDPVG

SEQ ID NO: 137616 - protein, 5 aa, Mycobacterium avium
KNELR

SEQ ID NO: 137617 - protein, 8 aa, Mycobacterium avium
KNKTPGGG

SEQ ID NO: 137618 - protein, 5 aa, Mycobacterium avium
KNSAG

SEQ ID NO: 137619 - protein, 9 aa, Mycobacterium avium
KNSGGQMTR

SEQ ID NO: 137620 - protein, 12 aa, Mycobacterium avium
KPDLTVGGRPVE

SEQ ID NO: 137621 - protein, 4 aa, Mycobacterium avium
KPEE

SEQ ID NO: 137622 - protein, 9 aa, Mycobacterium avium
KPGAAAANI

SEQ ID NO: 137623 - protein, 8 aa, Mycobacterium avium
KPGRSYTA

SEQ ID NO: 137624 - protein, 10 aa, Mycobacterium avium
KPGSTTITTS

SEQ ID NO: 137625 - protein, 8 aa, Mycobacterium avium
KPTQAGSY

SEQ ID NO: 137626 - protein, 8 aa, Mycobacterium avium
KPVHPGWS

SEQ ID NO: 137627 - protein, 7 aa, Mycobacterium avium
KPWKRAP

SEQ ID NO: 137628 - protein, 12 aa, Mycobacterium avium
KQDAAVKAGLPA

SEQ ID NO: 137629 - protein, 10 aa, Mycobacterium avium
KQFEKTAADP

SEQ ID NO: 137630 - protein, 10 aa, Mycobacterium avium
KQGRTTGNSC

SEQ ID NO: 137631 - protein, 10 aa, Mycobacterium avium
KQNSAVARGA

SEQ ID NO: 137632 - protein, 10 aa, Mycobacterium avium
KQSADATKNV

SEQ ID NO: 137633 - protein, 10 aa, Mycobacterium avium
KQVKPTGSGV

SEQ ID NO: 137634 - protein, 10 aa, Mycobacterium avium
KQVSPAGNAA

SEQ ID NO: 137635 - protein, 5 aa, Mycobacterium avium
KRGGT

SEQ ID NO: 137636 - protein, 7 aa, Mycobacterium avium
KRSVGGV

SEQ ID NO: 137637 - protein, 10 aa, Mycobacterium avium
KSATPSPDNL

SEQ ID NO: 137638 - protein, 6 aa, Mycobacterium avium
KSDGFA

SEQ ID NO: 137639 - protein, 8 aa, Mycobacterium avium
KSGSWDKD

SEQ ID NO: 137640 - protein, 7 aa, Mycobacterium avium
KSLDGAL

SEQ ID NO: 137641 - protein, 6 aa, Mycobacterium avium
KSLTDF

SEQ ID NO: 137642 - protein, 11 aa, Mycobacterium avium
KSQNPGLTNDH

SEQ ID NO: 137643 - protein, 7 aa, Mycobacterium avium
KSTPAMS

SEQ ID NO: 137644 - protein, 7 aa, Mycobacterium avium
KTARNHV

SEQ ID NO: 137645 - protein, 17 aa, Mycobacterium avium
KTDAEKRAAVETTPARK

SEQ ID NO: 137646 - protein, 15 aa, Mycobacterium avium
KTGYAAGAAPITDIW

SEQ ID NO: 137647 - protein, 16 aa, Mycobacterium avium
KTKATPPDQAVDDYRA

SEQ ID NO: 137648 - protein, 6 aa, Mycobacterium avium
KTLVGP

SEQ ID NO: 137649 - protein, 9 aa, Mycobacterium avium
KTPASRRSL

SEQ ID NO: 137650 - protein, 5 aa, Mycobacterium avium
KTPDG

SEQ ID NO: 137651 - protein, 17 aa, Mycobacterium avium
KTSPITVDGTKAVRADA

SEQ ID NO: 137652 - protein, 11 aa, Mycobacterium avium
KVAQQKGAIPG

SEQ ID NO: 137653 - protein, 11 aa, Mycobacterium avium
KVNGPQQPIDI

SEQ ID NO: 137654 - protein, 8 aa, Mycobacterium avium
KVTSGQAD

SEQ ID NO: 137655 - protein, 6 aa, Mycobacterium avium
KYPTTV

SEQ ID NO: 137656 - protein, 6 aa, Mycobacterium avium
KYRGEF

SEQ ID NO: 137657 - protein, 8 aa, Mycobacterium avium
LADPNSRV

SEQ ID NO: 137658 - protein, 9 aa, Mycobacterium avium
LAEQTGKRI

SEQ ID NO: 137659 - protein, 9 aa, Mycobacterium avium
LAGPQTGDA

SEQ ID NO: 137660 - protein, 16 aa, Mycobacterium avium
LAHPRAKSWQSLLVPQ

SEQ ID NO: 137661 - protein, 5 aa, Mycobacterium avium
LANDA

SEQ ID NO: 137662 - protein, 5 aa, Mycobacterium avium
LAPAG

SEQ ID NO: 137663 - protein, 4 aa, Mycobacterium avium
LAPD

SEQ ID NO: 137664 - protein, 11 aa, Mycobacterium avium
LAPPAPSAGQQ

SEQ ID NO: 137665 - protein, 9 aa, Mycobacterium avium
LATPGSVSR

SEQ ID NO: 137666 - protein, 5 aa, Mycobacterium avium
LATPR

SEQ ID NO: 137667 - protein, 8 aa, Mycobacterium avium
LATSPNTA

SEQ ID NO: 137668 - protein, 8 aa, Mycobacterium avium
LDAKNQAI

SEQ ID NO: 137669 - protein, 25 aa, Mycobacterium avium
LDDKARKDLGAPTGNEQKNPDGGVY

SEQ ID NO: 137670 - protein, 8 aa, Mycobacterium avium
LDENGQPH

SEQ ID NO: 137671 - protein, 6 aa, Mycobacterium avium
LDGATA

SEQ ID NO: 137672 - protein, 10 aa, Mycobacterium avium
LDPVNGGGGA

SEQ ID NO: 137673 - protein, 6 aa, Mycobacterium avium
LDSTPS

SEQ ID NO: 137674 - protein, 5 aa, Mycobacterium avium
LDTTQ

SEQ ID NO: 137675 - protein, 22 aa, Mycobacterium avium
LEGGEAFTTEEQPKQLDETEDV

SEQ ID NO: 137676 - protein, 16 aa, Mycobacterium avium
LEPSAAPRGVASSRNT

SEQ ID NO: 137677 - protein, 6 aa, Mycobacterium avium
LFPPGS

SEQ ID NO: 137678 - protein, 5 aa, Mycobacterium avium
LGAPC

SEQ ID NO: 137679 - protein, 12 aa, Mycobacterium avium
LGGSEREGQQQM

SEQ ID NO: 137680 - protein, 4 aa, Mycobacterium avium
LGGT

SEQ ID NO: 137681 - protein, 12 aa, Mycobacterium avium
LGPKSGVSGTSV

SEQ ID NO: 137682 - protein, 4 aa, Mycobacterium avium
LGPN

SEQ ID NO: 137683 - protein, 6 aa, Mycobacterium avium
LGPTPV

SEQ ID NO: 137684 - protein, 7 aa, Mycobacterium avium
LGSAETV

SEQ ID NO: 137685 - protein, 9 aa, Mycobacterium avium
LGSGGSEEQ

SEQ ID NO: 137686 - protein, 38 aa, Mycobacterium avium
LGSSGNSEDDSASPVSSSTATSSASASPTNKPAANQAE

SEQ ID NO: 137687 - protein, 7 aa, Mycobacterium avium
LHDPYTN

SEQ ID NO: 137688 - protein, 12 aa, Mycobacterium avium
LKGPDGDDPPWR

SEQ ID NO: 137689 - protein, 15 aa, Mycobacterium avium
LKRASGLARKHGAEN

SEQ ID NO: 137690 - protein, 8 aa, Mycobacterium avium
LNDSRGDV

SEQ ID NO: 137691 - protein, 13 aa, Mycobacterium avium
LNPPNTQPPHPPY

SEQ ID NO: 137692 - protein, 7 aa, Mycobacterium avium
LNQQRDD

SEQ ID NO: 137693 - protein, 8 aa, Mycobacterium avium
LPAATGYP

SEQ ID NO: 137694 - protein, 7 aa, Mycobacterium avium
LPAGQQL

SEQ ID NO: 137695 - protein, 9 aa, Mycobacterium avium
LPAPGIGSG

SEQ ID NO: 137696 - protein, 6 aa, Mycobacterium avium
LPAQPA

SEQ ID NO: 137697 - protein, 7 aa, Mycobacterium avium
LPAQYGG

SEQ ID NO: 137698 - protein, 8 aa, Mycobacterium avium
LPDPQQAG

SEQ ID NO: 137699 - protein, 10 aa, Mycobacterium avium
LPFNDPGKDC

SEQ ID NO: 137700 - protein, 15 aa, Mycobacterium avium
LPGAADSDVGDTAEL

SEQ ID NO: 137701 - protein, 23 aa, Mycobacterium avium
LPNPRAGASPAPPPAAPSGQSGT

SEQ ID NO: 137702 - protein, 6 aa, Mycobacterium avium
LPPGYE

SEQ ID NO: 137703 - protein, 15 aa, Mycobacterium avium
LPPPGRDGVGSAEQL

SEQ ID NO: 137704 - protein, 6 aa, Mycobacterium avium
LPPPPL

SEQ ID NO: 137705 - protein, 13 aa, Mycobacterium avium
LPPPTAHPPSTQI

SEQ ID NO: 137706 - protein, 16 aa, Mycobacterium avium
LPPQPPLPPDGPDQNC

SEQ ID NO: 137707 - protein, 5 aa, Mycobacterium avium
LPRRP

SEQ ID NO: 137708 - protein, 7 aa, Mycobacterium avium
LPTTATG

SEQ ID NO: 137709 - protein, 17 aa, Mycobacterium avium
LQESTGWAPLSPRGARQ

SEQ ID NO: 137710 - protein, 10 aa, Mycobacterium avium
LQKSSGNSVQ

SEQ ID NO: 137711 - protein, 8 aa, Mycobacterium avium
LQNFSGRA

SEQ ID NO: 137712 - protein, 8 aa, Mycobacterium avium
LRADPRNQ

SEQ ID NO: 137713 - protein, 8 aa, Mycobacterium avium
LRGHGDDL

SEQ ID NO: 137714 - protein, 9 aa, Mycobacterium avium
LRGSRTPDE

SEQ ID NO: 137715 - protein, 7 aa, Mycobacterium avium
LRPGNPI

SEQ ID NO: 137716 - protein, 7 aa, Mycobacterium avium
LRTSDPD

SEQ ID NO: 137717 - protein, 7 aa, Mycobacterium avium
LRTSSGS

SEQ ID NO: 137718 - protein, 6 aa, Mycobacterium avium
LSDSTL

SEQ ID NO: 137719 - protein, 10 aa, Mycobacterium avium
LSEAEAARRL

SEQ ID NO: 137720 - protein, 8 aa, Mycobacterium avium
LSGDEVKD

SEQ ID NO: 137721 - protein, 8 aa, Mycobacterium avium
LSGGGTEV

SEQ ID NO: 137722 - protein, 9 aa, Mycobacterium avium
LSGPTQPQG

SEQ ID NO: 137723 - protein, 13 aa, Mycobacterium avium
LSGQPPGVIVLVA

SEQ ID NO: 137724 - protein, 6 aa, Mycobacterium avium
LSGTPV

SEQ ID NO: 137725 - protein, 17 aa, Mycobacterium avium
LSQPEQKAVAGPVEPDR

SEQ ID NO: 137726 - protein, 6 aa, Mycobacterium avium
LSQSAG

SEQ ID NO: 137727 - protein, 8 aa, Mycobacterium avium
LSRAADSD

SEQ ID NO: 137728 - protein, 11 aa, Mycobacterium avium
LSSERGVTTRE

SEQ ID NO: 137729 - protein, 8 aa, Mycobacterium avium
LSSPEGYK

SEQ ID NO: 137730 - protein, 9 aa, Mycobacterium avium
LTATADGYE

SEQ ID NO: 137731 - protein, 16 aa, Mycobacterium avium
LTGSDTADQSVPADKH

SEQ ID NO: 137732 - protein, 12 aa, Mycobacterium avium
LTKRDASGRAAQ

SEQ ID NO: 137733 - protein, 12 aa, Mycobacterium avium
LTNSRQKFDEQR

SEQ ID NO: 137734 - protein, 7 aa, Mycobacterium avium
LTPDEAA

SEQ ID NO: 137735 - protein, 10 aa, Mycobacterium avium
LTPDGVTGFP

SEQ ID NO: 137736 - protein, 6 aa, Mycobacterium avium
LTPGDI

SEQ ID NO: 137737 - protein, 9 aa, Mycobacterium avium
LTPPYRGGP

SEQ ID NO: 137738 - protein, 8 aa, Mycobacterium avium
LTQGPGFP

SEQ ID NO: 137739 - protein, 5 aa, Mycobacterium avium
LTQSG

SEQ ID NO: 137740 - protein, 14 aa, Mycobacterium avium
MAGYSASSTAATQL

SEQ ID NO: 137741 - protein, 6 aa, Mycobacterium avium
MARGDA

SEQ ID NO: 137742 - protein, 7 aa, Mycobacterium avium
MASEAAE

SEQ ID NO: 137743 - protein, 10 aa, Mycobacterium avium
MGGTENIGGR

SEQ ID NO: 137744 - protein, 5 aa, Mycobacterium avium
MGSDE

SEQ ID NO: 137745 - protein, 7 aa, Mycobacterium avium
MKADREK

SEQ ID NO: 137746 - protein, 8 aa, Mycobacterium avium
MKNPADSA

SEQ ID NO: 137747 - protein, 16 aa, Mycobacterium avium
MNGPSNSYLTARNPDD

SEQ ID NO: 137748 - protein, 7 aa, Mycobacterium avium
MNTLGGK

SEQ ID NO: 137749 - protein, 9 aa, Mycobacterium avium
MPADTTSAV

SEQ ID NO: 137750 - protein, 4 aa, Mycobacterium avium
MPAE

SEQ ID NO: 137751 - protein, 6 aa, Mycobacterium avium
MPNGAA

SEQ ID NO: 137752 - protein, 5 aa, Mycobacterium avium
MRESA

SEQ ID NO: 137753 - protein, 4 aa, Mycobacterium avium
MSGG

SEQ ID NO: 137754 - protein, 5 aa, Mycobacterium avium
MSYET

SEQ ID NO: 137755 - protein, 7 aa, Mycobacterium avium
MTAKSNS

SEQ ID NO: 137756 - protein, 12 aa, Mycobacterium avium
MTRAQQTAAPLA

SEQ ID NO: 137757 - protein, 4 aa, Mycobacterium avium
NAAQ

SEQ ID NO: 137758 - protein, 7 aa, Mycobacterium avium
NADDARN

SEQ ID NO: 137759 - protein, 7 aa, Mycobacterium avium
NADQAEH

SEQ ID NO: 137760 - protein, 7 aa, Mycobacterium avium
NADSSRR

SEQ ID NO: 137761 - protein, 5 aa, Mycobacterium avium
NAGGT

SEQ ID NO: 137762 - protein, 12 aa, Mycobacterium avium
NALDGNGDKLRQ

SEQ ID NO: 137763 - protein, 14 aa, Mycobacterium avium
NANSSMAADSYGEE

SEQ ID NO: 137764 - protein, 8 aa, Mycobacterium avium
NANTHQVN

SEQ ID NO: 137765 - protein, 6 aa, Mycobacterium avium
NATGYG

SEQ ID NO: 137766 - protein, 6 aa, Mycobacterium avium
NDAANT

SEQ ID NO: 137767 - protein, 25 aa, Mycobacterium avium
NDDIGSDGSTPQDRANAAGFRGRAA

SEQ ID NO: 137768 - protein, 6 aa, Mycobacterium avium
NDPPEE

SEQ ID NO: 137769 - protein, 10 aa, Mycobacterium avium
NDSANTVANS

SEQ ID NO: 137770 - protein, 11 aa, Mycobacterium avium
NEGSPGRGPLL

SEQ ID NO: 137771 - protein, 5 aa, Mycobacterium avium
NEQFQ

SEQ ID NO: 137772 - protein, 12 aa, Mycobacterium avium
NFEEATPDLSGS

SEQ ID NO: 137773 - protein, 5 aa, Mycobacterium avium
NGAQV

SEQ ID NO: 137774 - protein, 10 aa, Mycobacterium avium
NGDPDTGAPI

SEQ ID NO: 137775 - protein, 6 aa, Mycobacterium avium
NGEPGL

SEQ ID NO: 137776 - protein, 17 aa, Mycobacterium avium
NGGPADGEEAADRPQEE

SEQ ID NO: 137777 - protein, 7 aa, Mycobacterium avium
NGKGGNP

SEQ ID NO: 137778 - protein, 7 aa, Mycobacterium avium
NGPGYAN

SEQ ID NO: 137779 - protein, 8 aa, Mycobacterium avium
NGPQAPEQ

SEQ ID NO: 137780 - protein, 4 aa, Mycobacterium avium
NGQY

SEQ ID NO: 137781 - protein, 7 aa, Mycobacterium avium
NGTAKEI

SEQ ID NO: 137782 - protein, 5 aa, Mycobacterium avium
NGTHD

SEQ ID NO: 137783 - protein, 13 aa, Mycobacterium avium
NGTPSDLGGDNVP

SEQ ID NO: 137784 - protein, 6 aa, Mycobacterium avium
NHDRIS

SEQ ID NO: 137785 - protein, 9 aa, Mycobacterium avium
NIGQYRDDR

SEQ ID NO: 137786 - protein, 5 aa, Mycobacterium avium
NIPYE

SEQ ID NO: 137787 - protein, 8 aa, Mycobacterium avium
NKGVPGVK

SEQ ID NO: 137788 - protein, 5 aa, Mycobacterium avium
NKVTT

SEQ ID NO: 137789 - protein, 8 aa, Mycobacterium avium
NLEDEGKQ

SEQ ID NO: 137790 - protein, 7 aa, Mycobacterium avium
NLQPSNV

SEQ ID NO: 137791 - protein, 8 aa, Mycobacterium avium
NLTPPQAA

SEQ ID NO: 137792 - protein, 14 aa, Mycobacterium avium
NNLANTPAADSGKR

SEQ ID NO: 137793 - protein, 20 aa, Mycobacterium avium
NNRDNLKQAVRNGDTAAKTL

SEQ ID NO: 137794 - protein, 4 aa, Mycobacterium avium
NPAG

SEQ ID NO: 137795 - protein, 6 aa, Mycobacterium avium
NPAQPD

SEQ ID NO: 137796 - protein, 7 aa, Mycobacterium avium
NPAQYAP

SEQ ID NO: 137797 - protein, 14 aa, Mycobacterium avium
NPASAGAQGNTNVT

SEQ ID NO: 137798 - protein, 7 aa, Mycobacterium avium
NPEERDA

SEQ ID NO: 137799 - protein, 19 aa, Mycobacterium avium
NPGEAPADAPDLTASRAAI

SEQ ID NO: 137800 - protein, 11 aa, Mycobacterium avium
NPGGPGESGIE

SEQ ID NO: 137801 - protein, 8 aa, Mycobacterium avium
NPQPPRRE

SEQ ID NO: 137802 - protein, 6 aa, Mycobacterium avium
NPSDRY

SEQ ID NO: 137803 - protein, 14 aa, Mycobacterium avium
NPSGAAALAGAGGP

SEQ ID NO: 137804 - protein, 6 aa, Mycobacterium avium
NQGAQQ

SEQ ID NO: 137805 - protein, 10 aa, Mycobacterium avium
NQNPAFQGAS

SEQ ID NO: 137806 - protein, 6 aa, Mycobacterium avium
NQPPPC

SEQ ID NO: 137807 - protein, 9 aa, Mycobacterium avium
NQSPNTPDK

SEQ ID NO: 137808 - protein, 7 aa, Mycobacterium avium
NRTPPAL

SEQ ID NO: 137809 - protein, 5 aa, Mycobacterium avium
NRTYG

SEQ ID NO: 137810 - protein, 4 aa, Mycobacterium avium
NSGG

SEQ ID NO: 137811 - protein, 5 aa, Mycobacterium avium
NSGHR

SEQ ID NO: 137812 - protein, 7 aa, Mycobacterium avium
NSSTVPL

SEQ ID NO: 137813 - protein, 8 aa, Mycobacterium avium
NTDNGSID

SEQ ID NO: 137814 - protein, 4 aa, Mycobacterium avium
NTKG

SEQ ID NO: 137815 - protein, 8 aa, Mycobacterium avium
NTKPGQTV

SEQ ID NO: 137816 - protein, 32 aa, Mycobacterium avium
NTNGRGRANQAVTGTVAYPGKQGLSGGGESWS

SEQ ID NO: 137817 - protein, 9 aa, Mycobacterium avium
NTPNEVGSA

SEQ ID NO: 137818 - protein, 9 aa, Mycobacterium avium
NVLPPGETG

SEQ ID NO: 137819 - protein, 6 aa, Mycobacterium avium
NVSADA

SEQ ID NO: 137820 - protein, 4 aa, Mycobacterium avium
NVTT

SEQ ID NO: 137821 - protein, 6 aa, Mycobacterium avium
NYKGSM

SEQ ID NO: 137822 - protein, 6 aa, Mycobacterium avium
NYTTPY

SEQ ID NO: 137823 - protein, 11 aa, Mycobacterium avium
PAAAEQGLAPA

SEQ ID NO: 137824 - protein, 5 aa, Mycobacterium avium
PAAAG

SEQ ID NO: 137825 - protein, 5 aa, Mycobacterium avium
PAAGY

SEQ ID NO: 137826 - protein, 12 aa, Mycobacterium avium
PAAHADNKRLNS

SEQ ID NO: 137827 - protein, 13 aa, Mycobacterium avium
PAATDQEARRAER

SEQ ID NO: 137828 - protein, 5 aa, Mycobacterium avium
PAFST

SEQ ID NO: 137829 - protein, 6 aa, Mycobacterium avium
PAGEVR

SEQ ID NO: 137830 - protein, 6 aa, Mycobacterium avium
PAGGAL

SEQ ID NO: 137831 - protein, 6 aa, Mycobacterium avium
PAIPDR

SEQ ID NO: 137832 - protein, 11 aa, Mycobacterium avium
PALNSPEERPA

SEQ ID NO: 137833 - protein, 11 aa, Mycobacterium avium
PALPQDPRDSA

SEQ ID NO: 137834 - protein, 9 aa, Mycobacterium avium
PANPPALSY

SEQ ID NO: 137835 - protein, 19 aa, Mycobacterium avium
PAPATDTDTVSVTSQAANS

SEQ ID NO: 137836 - protein, 15 aa, Mycobacterium avium
PAPGAAPSSCPEVGS

SEQ ID NO: 137837 - protein, 8 aa, Mycobacterium avium
PASDQWDT

SEQ ID NO: 137838 - protein, 6 aa, Mycobacterium avium
PASSTI

SEQ ID NO: 137839 - protein, 12 aa, Mycobacterium avium
PASTDFSNPDFP

SEQ ID NO: 137840 - protein, 20 aa, Mycobacterium avium
PATNGPSGIRSNAPAPTGKV

SEQ ID NO: 137841 - protein, 11 aa, Mycobacterium avium
PAYRDSGPVMP

SEQ ID NO: 137842 - protein, 8 aa, Mycobacterium avium
PDADTAGM

SEQ ID NO: 137843 - protein, 17 aa, Mycobacterium avium
PDAELTGTDDVNPTDPL

SEQ ID NO: 137844 - protein, 5 aa, Mycobacterium avium
PDDHR

SEQ ID NO: 137845 - protein, 10 aa, Mycobacterium avium
PDDPNGACGV

SEQ ID NO: 137846 - protein, 16 aa, Mycobacterium avium
PDDTGITNAAPGGVGA

SEQ ID NO: 137847 - protein, 4 aa, Mycobacterium avium
PDFR

SEQ ID NO: 137848 - protein, 10 aa, Mycobacterium avium
PDGHGAPPTL

SEQ ID NO: 137849 - protein, 11 aa, Mycobacterium avium
PDGPGSLPANT

SEQ ID NO: 137850 - protein, 12 aa, Mycobacterium avium
PDIPTKQTGGSF

SEQ ID NO: 137851 - protein, 7 aa, Mycobacterium avium
PDNGLGN

SEQ ID NO: 137852 - protein, 10 aa, Mycobacterium avium
PDPNGERAGH

SEQ ID NO: 137853 - protein, 6 aa, Mycobacterium avium
PDQVNA

SEQ ID NO: 137854 - protein, 6 aa, Mycobacterium avium
PDTSLA

SEQ ID NO: 137855 - protein, 6 aa, Mycobacterium avium
PDWPGT

SEQ ID NO: 137856 - protein, 5 aa, Mycobacterium avium
PEQRR

SEQ ID NO: 137857 - protein, 11 aa, Mycobacterium avium
PFPTKAEADAA

SEQ ID NO: 137858 - protein, 12 aa, Mycobacterium avium
PGAPAAGADPCP

SEQ ID NO: 137859 - protein, 7 aa, Mycobacterium avium
PGAPSAG

SEQ ID NO: 137860 - protein, 7 aa, Mycobacterium avium
PGDGHTL

SEQ ID NO: 137861 - protein, 4 aa, Mycobacterium avium
PGEG

SEQ ID NO: 137862 - protein, 17 aa, Mycobacterium avium
PGGAEQTIAESTGPASI

SEQ ID NO: 137863 - protein, 14 aa, Mycobacterium avium
PGGKRPQLPADEEA

SEQ ID NO: 137864 - protein, 10 aa, Mycobacterium avium
PGGLRTSYEP

SEQ ID NO: 137865 - protein, 6 aa, Mycobacterium avium
PGHPAP

SEQ ID NO: 137866 - protein, 19 aa, Mycobacterium avium
PGMAGQTGQLPTMPGQLPS

SEQ ID NO: 137867 - protein, 6 aa, Mycobacterium avium
PGMSSQ

SEQ ID NO: 137868 - protein, 4 aa, Mycobacterium avium
PGNP

SEQ ID NO: 137869 - protein, 4 aa, Mycobacterium avium
PGPL

SEQ ID NO: 137870 - protein, 5 aa, Mycobacterium avium
PGQKK

SEQ ID NO: 137871 - protein, 9 aa, Mycobacterium avium
PGSADANGY

SEQ ID NO: 137872 - protein, 5 aa, Mycobacterium avium
PGVGG

SEQ ID NO: 137873 - protein, 12 aa, Mycobacterium avium
PIPTNDPRGLSY

SEQ ID NO: 137874 - protein, 5 aa, Mycobacterium avium
PITNG

SEQ ID NO: 137875 - protein, 4 aa, Mycobacterium avium
PLAA

SEQ ID NO: 137876 - protein, 11 aa, Mycobacterium avium
PLADNPPGTTI

SEQ ID NO: 137877 - protein, 6 aa, Mycobacterium avium
PLATQA

SEQ ID NO: 137878 - protein, 10 aa, Mycobacterium avium
PLPASAAPCP

SEQ ID NO: 137879 - protein, 15 aa, Mycobacterium avium
PLPEDDTSTPPPPPP

SEQ ID NO: 137880 - protein, 5 aa, Mycobacterium avium
PLPGG

SEQ ID NO: 137881 - protein, 8 aa, Mycobacterium avium
PLPPPGGH

SEQ ID NO: 137882 - protein, 10 aa, Mycobacterium avium
PLSSYNPNTV

SEQ ID NO: 137883 - protein, 10 aa, Mycobacterium avium
PNPNSQNPAE

SEQ ID NO: 137884 - protein, 8 aa, Mycobacterium avium
PPAAPATL

SEQ ID NO: 137885 - protein, 19 aa, Mycobacterium avium
PPAQRRSPASVDAPDRPAA

SEQ ID NO: 137886 - protein, 5 aa, Mycobacterium avium
PPGHE

SEQ ID NO: 137887 - protein, 27 aa, Mycobacterium avium
PPGKSREDVDKANNADFKQSEDSAAYA

SEQ ID NO: 137888 - protein, 6 aa, Mycobacterium avium
PPGQTG

SEQ ID NO: 137889 - protein, 12 aa, Mycobacterium avium
PPKGADSRSYYE

SEQ ID NO: 137890 - protein, 6 aa, Mycobacterium avium
PPPCTT

SEQ ID NO: 137891 - protein, 10 aa, Mycobacterium avium
PPPNQFPAAT

SEQ ID NO: 137892 - protein, 14 aa, Mycobacterium avium
PPQAPSETHWTPPS

SEQ ID NO: 137893 - protein, 13 aa, Mycobacterium avium
PPQTPSPTSLRPD

SEQ ID NO: 137894 - protein, 6 aa, Mycobacterium avium
PPTEEQ

SEQ ID NO: 137895 - protein, 15 aa, Mycobacterium avium
PPTSKPHTISAPGLA

SEQ ID NO: 137896 - protein, 11 aa, Mycobacterium avium
PPVPADPSAPL

SEQ ID NO: 137897 - protein, 15 aa, Mycobacterium avium
PQASGASSQPQLSRE

SEQ ID NO: 137898 - protein, 5 aa, Mycobacterium avium
PQAYT

SEQ ID NO: 137899 - protein, 15 aa, Mycobacterium avium
PQEADALRAAKAAPL

SEQ ID NO: 137900 - protein, 17 aa, Mycobacterium avium
PQGNSAQQRYSPWPASY

SEQ ID NO: 137901 - protein, 5 aa, Mycobacterium avium
PQHRT

SEQ ID NO: 137902 - protein, 16 aa, Mycobacterium avium
PQKGGSWRQTGCSSPL

SEQ ID NO: 137903 - protein, 5 aa, Mycobacterium avium
PQNPE

SEQ ID NO: 137904 - protein, 6 aa, Mycobacterium avium
PQPDGS

SEQ ID NO: 137905 - protein, 10 aa, Mycobacterium avium
PQTGAQPVTG

SEQ ID NO: 137906 - protein, 11 aa, Mycobacterium avium
PQTSASAVNGL

SEQ ID NO: 137907 - protein, 8 aa, Mycobacterium avium
PRDSPITK

SEQ ID NO: 137908 - protein, 8 aa, Mycobacterium avium
PRGLDQPV

SEQ ID NO: 137909 - protein, 7 aa, Mycobacterium avium
PRGPRGE

SEQ ID NO: 137910 - protein, 9 aa, Mycobacterium avium
PRGTSEGQS

SEQ ID NO: 137911 - protein, 8 aa, Mycobacterium avium
PRGVGASR

SEQ ID NO: 137912 - protein, 10 aa, Mycobacterium avium
PRRTDAAGPM

SEQ ID NO: 137913 - protein, 6 aa, Mycobacterium avium
PSAAQA

SEQ ID NO: 137914 - protein, 7 aa, Mycobacterium avium
PSPSMGR

SEQ ID NO: 137915 - protein, 7 aa, Mycobacterium avium
PSRPEPH

SEQ ID NO: 137916 - protein, 5 aa, Mycobacterium avium
PSSGE

SEQ ID NO: 137917 - protein, 7 aa, Mycobacterium avium
PSSGPYK

SEQ ID NO: 137918 - protein, 16 aa, Mycobacterium avium
PSSTSYPPPNQAPGVT

SEQ ID NO: 137919 - protein, 33 aa, Mycobacterium avium
PSVDNGLNPLPADRLPGTPPPISDPLQRPGSGT

SEQ ID NO: 137920 - protein, 5 aa, Mycobacterium avium
PSVED

SEQ ID NO: 137921 - protein, 5 aa, Mycobacterium avium
PTAEG

SEQ ID NO: 137922 - protein, 34 aa, Mycobacterium avium
PTAPTTGADPDAAPPPPEAAPAAEGALPSNPPAI

SEQ ID NO: 137923 - protein, 12 aa, Mycobacterium avium
PTAYDGDSPTEV

SEQ ID NO: 137924 - protein, 17 aa, Mycobacterium avium
PTPAALADPGEWDPTLP

SEQ ID NO: 137925 - protein, 12 aa, Mycobacterium avium
PTPTKPGRAAPG

SEQ ID NO: 137926 - protein, 12 aa, Mycobacterium avium
PTWSRTYSPAPE

SEQ ID NO: 137927 - protein, 12 aa, Mycobacterium avium
PVCTPGGPLALP

SEQ ID NO: 137928 - protein, 14 aa, Mycobacterium avium
PVGDQFGEAGEGVR

SEQ ID NO: 137929 - protein, 13 aa, Mycobacterium avium
PVNVSPDGDSLIL

SEQ ID NO: 137930 - protein, 12 aa, Mycobacterium avium
PVPPGEPARYNP

SEQ ID NO: 137931 - protein, 9 aa, Mycobacterium avium
PWDGPPRDV

SEQ ID NO: 137932 - protein, 8 aa, Mycobacterium avium
PWPTADVP

SEQ ID NO: 137933 - protein, 7 aa, Mycobacterium avium
PWSDPRL

SEQ ID NO: 137934 - protein, 20 aa, Mycobacterium avium
PYDPATGDYIGPDGRRYTES

SEQ ID NO: 137935 - protein, 7 aa, Mycobacterium avium
PYGDNGG

SEQ ID NO: 137936 - protein, 8 aa, Mycobacterium avium
QAAAENID

SEQ ID NO: 137937 - protein, 13 aa, Mycobacterium avium
QAAHTTGAAPGPR

SEQ ID NO: 137938 - protein, 12 aa, Mycobacterium avium
QAEGTDNSHEAD

SEQ ID NO: 137939 - protein, 6 aa, Mycobacterium avium
QAPGID

SEQ ID NO: 137940 - protein, 10 aa, Mycobacterium avium
QAPPPHDPGT

SEQ ID NO: 137941 - protein, 34 aa, Mycobacterium avium
QARTEQVNRESAARLAKQNADKAAADAKASQDAA

SEQ ID NO: 137942 - protein, 9 aa, Mycobacterium avium
QASGGWTDG

SEQ ID NO: 137943 - protein, 9 aa, Mycobacterium avium
QAVGGLGPS

SEQ ID NO: 137944 - protein, 4 aa, Mycobacterium avium
QDAA

SEQ ID NO: 137945 - protein, 7 aa, Mycobacterium avium
QDAGAPV

SEQ ID NO: 137946 - protein, 10 aa, Mycobacterium avium
QDPGQAVSAG

SEQ ID NO: 137947 - protein, 8 aa, Mycobacterium avium
QDTEQTID

SEQ ID NO: 137948 - protein, 7 aa, Mycobacterium avium
QDTGHAQ

SEQ ID NO: 137949 - protein, 6 aa, Mycobacterium avium
QDVPGA

SEQ ID NO: 137950 - protein, 6 aa, Mycobacterium avium
QFRGPN

SEQ ID NO: 137951 - protein, 9 aa, Mycobacterium avium
QGCGGPPCK

SEQ ID NO: 137952 - protein, 4 aa, Mycobacterium avium
QGDY

SEQ ID NO: 137953 - protein, 6 aa, Mycobacterium avium
QGERAA

SEQ ID NO: 137954 - protein, 4 aa, Mycobacterium avium
QGGG

SEQ ID NO: 137955 - protein, 6 aa, Mycobacterium avium
QGGGPH

SEQ ID NO: 137956 - protein, 5 aa, Mycobacterium avium
QGGTL

SEQ ID NO: 137957 - protein, 13 aa, Mycobacterium avium
QGPDIQDRVNNRS

SEQ ID NO: 137958 - protein, 11 aa, Mycobacterium avium
QGPLSAPKARR

SEQ ID NO: 137959 - protein, 6 aa, Mycobacterium avium
QGSPQV

SEQ ID NO: 137960 - protein, 14 aa, Mycobacterium avium
QGTAPELADADPVE

SEQ ID NO: 137961 - protein, 7 aa, Mycobacterium avium
QHKPDAS

SEQ ID NO: 137962 - protein, 5 aa, Mycobacterium avium
QKCPN

SEQ ID NO: 137963 - protein, 13 aa, Mycobacterium avium
QLAGEAGMSPVHG

SEQ ID NO: 137964 - protein, 30 aa, Mycobacterium avium
QLGGSQGQLGYPTSDEVDTPDGAKKSTFEH

SEQ ID NO: 137965 - protein, 9 aa, Mycobacterium avium
QLGPDQHPA

SEQ ID NO: 137966 - protein, 10 aa, Mycobacterium avium
QLGQQQAQTV

SEQ ID NO: 137967 - protein, 15 aa, Mycobacterium avium
QLNDTKKKAIQLCLA

SEQ ID NO: 137968 - protein, 20 aa, Mycobacterium avium
QLPPTDPRYVDGAPGSRVPS

SEQ ID NO: 137969 - protein, 9 aa, Mycobacterium avium
QMPDAKPSA

SEQ ID NO: 137970 - protein, 5 aa, Mycobacterium avium
QNEKN

SEQ ID NO: 137971 - protein, 14 aa, Mycobacterium avium
QNGGADADGLPATN

SEQ ID NO: 137972 - protein, 4 aa, Mycobacterium avium
QNGV

SEQ ID NO: 137973 - protein, 12 aa, Mycobacterium avium
QPADAAQNVVPT

SEQ ID NO: 137974 - protein, 13 aa, Mycobacterium avium
QPADDATARETIT

SEQ ID NO: 137975 - protein, 11 aa, Mycobacterium avium
QPDPDARRPPV

SEQ ID NO: 137976 - protein, 6 aa, Mycobacterium avium
QPGGNF

SEQ ID NO: 137977 - protein, 7 aa, Mycobacterium avium
QPGKTSH

SEQ ID NO: 137978 - protein, 6 aa, Mycobacterium avium
QPNELP

SEQ ID NO: 137979 - protein, 6 aa, Mycobacterium avium
QPPITD

SEQ ID NO: 137980 - protein, 7 aa, Mycobacterium avium
QPPNRSV

SEQ ID NO: 137981 - protein, 8 aa, Mycobacterium avium
QPPPPQSA

SEQ ID NO: 137982 - protein, 25 aa, Mycobacterium avium
QPPSPPPSTPPVRTIPPPSPHEFDQ

SEQ ID NO: 137983 - protein, 11 aa, Mycobacterium avium
QPQRAPAMPAS

SEQ ID NO: 137984 - protein, 11 aa, Mycobacterium avium
QPSSGNGQNYT

SEQ ID NO: 137985 - protein, 5 aa, Mycobacterium avium
QPVTA

SEQ ID NO: 137986 - protein, 9 aa, Mycobacterium avium
QQESNTPDF

SEQ ID NO: 137987 - protein, 18 aa, Mycobacterium avium
QQRAPQESPSLTSDEPTR

SEQ ID NO: 137988 - protein, 7 aa, Mycobacterium avium
QRRVDEE

SEQ ID NO: 137989 - protein, 5 aa, Mycobacterium avium
QSDIS

SEQ ID NO: 137990 - protein, 30 aa, Mycobacterium avium
QSEANASGTIDTEVPGPGLSPEGKGQAEQV

SEQ ID NO: 137991 - protein, 9 aa, Mycobacterium avium
QSGGANSPA

SEQ ID NO: 137992 - protein, 6 aa, Mycobacterium avium
QSGIRT

SEQ ID NO: 137993 - protein, 7 aa, Mycobacterium avium
QSGITYS

SEQ ID NO: 137994 - protein, 15 aa, Mycobacterium avium
QSGMPAQAATFVAAH

SEQ ID NO: 137995 - protein, 8 aa, Mycobacterium avium
QSGRYPEF

SEQ ID NO: 137996 - protein, 6 aa, Mycobacterium avium
QSITKA

SEQ ID NO: 137997 - protein, 10 aa, Mycobacterium avium
QSLSSDPDYQ

SEQ ID NO: 137998 - protein, 7 aa, Mycobacterium avium
QSLTGPS

SEQ ID NO: 137999 - protein, 6 aa, Mycobacterium avium
QSRQPL

SEQ ID NO: 138000 - protein, 6 aa, Mycobacterium avium
QSVANA

SEQ ID NO: 138001 - protein, 10 aa, Mycobacterium avium
QSYGRDPETM

SEQ ID NO: 138002 - protein, 12 aa, Mycobacterium avium
QTATVRAAGGVP

SEQ ID NO: 138003 - protein, 8 aa, Mycobacterium avium
QTKTGSEH

SEQ ID NO: 138004 - protein, 8 aa, Mycobacterium avium
QTQNVSGQ

SEQ ID NO: 138005 - protein, 17 aa, Mycobacterium avium
QVERPPLNQPVPSAQPV

SEQ ID NO: 138006 - protein, 7 aa, Mycobacterium avium
QVQTSGA

SEQ ID NO: 138007 - protein, 8 aa, Mycobacterium avium
QVSGRYTG

SEQ ID NO: 138008 - protein, 12 aa, Mycobacterium avium
QYEHGRDTAPVV

SEQ ID NO: 138009 - protein, 7 aa, Mycobacterium avium
RAAAEAM

SEQ ID NO: 138010 - protein, 14 aa, Mycobacterium avium
RAAEPAADAFADPD

SEQ ID NO: 138011 - protein, 8 aa, Mycobacterium avium
RAAETRHG

SEQ ID NO: 138012 - protein, 6 aa, Mycobacterium avium
RAAQAG

SEQ ID NO: 138013 - protein, 10 aa, Mycobacterium avium
RADAANAMRP

SEQ ID NO: 138014 - protein, 6 aa, Mycobacterium avium
RAGPPE

SEQ ID NO: 138015 - protein, 17 aa, Mycobacterium avium
RAGRPVGTRQLGGRDGE

SEQ ID NO: 138016 - protein, 9 aa, Mycobacterium avium
RANDTGLGP

SEQ ID NO: 138017 - protein, 14 aa, Mycobacterium avium
RAPADTSTAPLPAG

SEQ ID NO: 138018 - protein, 7 aa, Mycobacterium avium
RAQPGTR

SEQ ID NO: 138019 - protein, 10 aa, Mycobacterium avium
RARSGPPGPV

SEQ ID NO: 138020 - protein, 11 aa, Mycobacterium avium
RASEVVANGSA

SEQ ID NO: 138021 - protein, 6 aa, Mycobacterium avium
RATALR

SEQ ID NO: 138022 - protein, 15 aa, Mycobacterium avium
RATDTTVAATKTATA

SEQ ID NO: 138023 - protein, 11 aa, Mycobacterium avium
RAVAQPPGFPN

SEQ ID NO: 138024 - protein, 6 aa, Mycobacterium avium
RAVQSD

SEQ ID NO: 138025 - protein, 10 aa, Mycobacterium avium
RCGSPQYDNG

SEQ ID NO: 138026 - protein, 4 aa, Mycobacterium avium
RDAA

SEQ ID NO: 138027 - protein, 6 aa, Mycobacterium avium
RDASSH

SEQ ID NO: 138028 - protein, 10 aa, Mycobacterium avium
RDDDRGTETV

SEQ ID NO: 138029 - protein, 10 aa, Mycobacterium avium
RDDPDNPMTN

SEQ ID NO: 138030 - protein, 4 aa, Mycobacterium avium
RDEG

SEQ ID NO: 138031 - protein, 19 aa, Mycobacterium avium
RDEQSGNHQDADVQCRVKS

SEQ ID NO: 138032 - protein, 8 aa, Mycobacterium avium
RDGRDGAG

SEQ ID NO: 138033 - protein, 19 aa, Mycobacterium avium
RDNQNSDGHNAQTFCLVKS

SEQ ID NO: 138034 - protein, 6 aa, Mycobacterium avium
RDPDDF

SEQ ID NO: 138035 - protein, 8 aa, Mycobacterium avium
RDPDSGVQ

SEQ ID NO: 138036 - protein, 8 aa, Mycobacterium avium
RDRDATRT

SEQ ID NO: 138037 - protein, 8 aa, Mycobacterium avium
RDRPLAPG

SEQ ID NO: 138038 - protein, 8 aa, Mycobacterium avium
RDSRITPT

SEQ ID NO: 138039 - protein, 9 aa, Mycobacterium avium
REFGSTTRQ

SEQ ID NO: 138040 - protein, 7 aa, Mycobacterium avium
REHPEDS

SEQ ID NO: 138041 - protein, 11 aa, Mycobacterium avium
RGAPPPPREHG

SEQ ID NO: 138042 - protein, 8 aa, Mycobacterium avium
RGASNKEI

SEQ ID NO: 138043 - protein, 20 aa, Mycobacterium avium
RGDHGATAPAAGPPPTPESY

SEQ ID NO: 138044 - protein, 14 aa, Mycobacterium avium
RGGTGITLNEDLHA

SEQ ID NO: 138045 - protein, 5 aa, Mycobacterium avium
RGMAE

SEQ ID NO: 138046 - protein, 8 aa, Mycobacterium avium
RGPKVGES

SEQ ID NO: 138047 - protein, 13 aa, Mycobacterium avium
RGPLRTDKTPAAV

SEQ ID NO: 138048 - protein, 8 aa, Mycobacterium avium
RGPNGQNY

SEQ ID NO: 138049 - protein, 9 aa, Mycobacterium avium
RGQPGPTTI

SEQ ID NO: 138050 - protein, 8 aa, Mycobacterium avium
RGSRVSAD

SEQ ID NO: 138051 - protein, 8 aa, Mycobacterium avium
RGTDVGQV

SEQ ID NO: 138052 - protein, 6 aa, Mycobacterium avium
RGYPVD

SEQ ID NO: 138053 - protein, 6 aa, Mycobacterium avium
RHTRSS

SEQ ID NO: 138054 - protein, 16 aa, Mycobacterium avium
RIAAPGGAGFAAGNDA

SEQ ID NO: 138055 - protein, 8 aa, Mycobacterium avium
RKEELQKT

SEQ ID NO: 138056 - protein, 12 aa, Mycobacterium avium
RKGNEVAVTTET

SEQ ID NO: 138057 - protein, 6 aa, Mycobacterium avium
RKLPDG

SEQ ID NO: 138058 - protein, 8 aa, Mycobacterium avium
RKNEPAGV

SEQ ID NO: 138059 - protein, 11 aa, Mycobacterium avium
RKRRAYTADEV

SEQ ID NO: 138060 - protein, 13 aa, Mycobacterium avium
RLAPNGDVSPPIR

SEQ ID NO: 138061 - protein, 6 aa, Mycobacterium avium
RLDPAV

SEQ ID NO: 138062 - protein, 12 aa, Mycobacterium avium
RLGTSPEKDVGF

SEQ ID NO: 138063 - protein, 7 aa, Mycobacterium avium
RLSEGTK

SEQ ID NO: 138064 - protein, 7 aa, Mycobacterium avium
RNAKDSL

SEQ ID NO: 138065 - protein, 8 aa, Mycobacterium avium
RNDQGVDP

SEQ ID NO: 138066 - protein, 6 aa, Mycobacterium avium
RNQQSN

SEQ ID NO: 138067 - protein, 9 aa, Mycobacterium avium
RNSGGPPLT

SEQ ID NO: 138068 - protein, 13 aa, Mycobacterium avium
RPADPADLPPGYR

SEQ ID NO: 138069 - protein, 20 aa, Mycobacterium avium
RPAPGNTDPMNGALQCGAPL

SEQ ID NO: 138070 - protein, 7 aa, Mycobacterium avium
RPDRPSV

SEQ ID NO: 138071 - protein, 4 aa, Mycobacterium avium
RPEL

SEQ ID NO: 138072 - protein, 6 aa, Mycobacterium avium
RPGNYA

SEQ ID NO: 138073 - protein, 9 aa, Mycobacterium avium
RPGPLSGSQ

SEQ ID NO: 138074 - protein, 5 aa, Mycobacterium avium
RPGPV

SEQ ID NO: 138075 - protein, 6 aa, Mycobacterium avium
RPMTPD

SEQ ID NO: 138076 - protein, 16 aa, Mycobacterium avium
RPNPDYHGNRKPRNKG

SEQ ID NO: 138077 - protein, 5 aa, Mycobacterium avium
RPNTG

SEQ ID NO: 138078 - protein, 8 aa, Mycobacterium avium
RPTPQGRA

SEQ ID NO: 138079 - protein, 7 aa, Mycobacterium avium
RQGNEYL

SEQ ID NO: 138080 - protein, 16 aa, Mycobacterium avium
RQLDDTTDMKTNKVNP

SEQ ID NO: 138081 - protein, 5 aa, Mycobacterium avium
RQPDI

SEQ ID NO: 138082 - protein, 5 aa, Mycobacterium avium
RQPKL

SEQ ID NO: 138083 - protein, 5 aa, Mycobacterium avium
RQPLT

SEQ ID NO: 138084 - protein, 19 aa, Mycobacterium avium
RQQMRDQSQFQAGDDPVAN

SEQ ID NO: 138085 - protein, 7 aa, Mycobacterium avium
RQQTSGL

SEQ ID NO: 138086 - protein, 4 aa, Mycobacterium avium
RQRI

SEQ ID NO: 138087 - protein, 13 aa, Mycobacterium avium
RQRRQDDAIDPKV

SEQ ID NO: 138088 - protein, 15 aa, Mycobacterium avium
RRARAGVADPNRPTG

SEQ ID NO: 138089 - protein, 10 aa, Mycobacterium avium
RRATAGGETA

SEQ ID NO: 138090 - protein, 9 aa, Mycobacterium avium
RRGGQFDPG

SEQ ID NO: 138091 - protein, 7 aa, Mycobacterium avium
RRNAELD

SEQ ID NO: 138092 - protein, 15 aa, Mycobacterium avium
RRNDPLGRETATPPT

SEQ ID NO: 138093 - protein, 10 aa, Mycobacterium avium
RRPKLYGTGA

SEQ ID NO: 138094 - protein, 11 aa, Mycobacterium avium
RRQVEERREGL

SEQ ID NO: 138095 - protein, 6 aa, Mycobacterium avium
RRSRSF

SEQ ID NO: 138096 - protein, 14 aa, Mycobacterium avium
RRSSDPGSADLNTS

SEQ ID NO: 138097 - protein, 7 aa, Mycobacterium avium
RRTKNNP

SEQ ID NO: 138098 - protein, 7 aa, Mycobacterium avium
RSDDTII

SEQ ID NO: 138099 - protein, 8 aa, Mycobacterium avium
RSGERGAS

SEQ ID NO: 138100 - protein, 8 aa, Mycobacterium avium
RSNGGHNG

SEQ ID NO: 138101 - protein, 10 aa, Mycobacterium avium
RSNQTPRDAG

SEQ ID NO: 138102 - protein, 19 aa, Mycobacterium avium
RSQAARPKTRVIGPDDDPD

SEQ ID NO: 138103 - protein, 6 aa, Mycobacterium avium
RTKTPV

SEQ ID NO: 138104 - protein, 9 aa, Mycobacterium avium
RTSGEDSGA

SEQ ID NO: 138105 - protein, 23 aa, Mycobacterium avium
RTSLSDQPKPPPQKQPKLPPPPT

SEQ ID NO: 138106 - protein, 6 aa, Mycobacterium avium
RTSPAL

SEQ ID NO: 138107 - protein, 9 aa, Mycobacterium avium
RTTSPYDLP

SEQ ID NO: 138108 - protein, 7 aa, Mycobacterium avium
RVEDSTG

SEQ ID NO: 138109 - protein, 6 aa, Mycobacterium avium
RVGGTW

SEQ ID NO: 138110 - protein, 8 aa, Mycobacterium avium
RYAPPPAV

SEQ ID NO: 138111 - protein, 6 aa, Mycobacterium avium
SAAAGA

SEQ ID NO: 138112 - protein, 9 aa, Mycobacterium avium
SAAAQPSAP

SEQ ID NO: 138113 - protein, 7 aa, Mycobacterium avium
SAAEIGA

SEQ ID NO: 138114 - protein, 8 aa, Mycobacterium avium
SAANNFDT

SEQ ID NO: 138115 - protein, 26 aa, Mycobacterium avium
SAAQGWPAQYADAANSGYTSTGGASK

SEQ ID NO: 138116 - protein, 6 aa, Mycobacterium avium
SADDCP

SEQ ID NO: 138117 - protein, 7 aa, Mycobacterium avium
SADGSTV

SEQ ID NO: 138118 - protein, 8 aa, Mycobacterium avium
SAEARRRS

SEQ ID NO: 138119 - protein, 13 aa, Mycobacterium avium
SAFATRPAGLPGL

SEQ ID NO: 138120 - protein, 13 aa, Mycobacterium avium
SAGAGQAPASVHP

SEQ ID NO: 138121 - protein, 9 aa, Mycobacterium avium
SAGDGTAVT

SEQ ID NO: 138122 - protein, 5 aa, Mycobacterium avium
SAGGH

SEQ ID NO: 138123 - protein, 19 aa, Mycobacterium avium
SAGKTAQDTSFDGRSDYDG

SEQ ID NO: 138124 - protein, 13 aa, Mycobacterium avium
SAPATTPKARTGF

SEQ ID NO: 138125 - protein, 7 aa, Mycobacterium avium
SAPEGYG

SEQ ID NO: 138126 - protein, 9 aa, Mycobacterium avium
SAPNDPIDP

SEQ ID NO: 138127 - protein, 16 aa, Mycobacterium avium
SAPPAPDGGAAGPVEL

SEQ ID NO: 138128 - protein, 11 aa, Mycobacterium avium
SAQIGGPAGAD

SEQ ID NO: 138129 - protein, 8 aa, Mycobacterium avium
SAQRARDT

SEQ ID NO: 138130 - protein, 7 aa, Mycobacterium avium
SAQREQL

SEQ ID NO: 138131 - protein, 9 aa, Mycobacterium avium
SAQSDGNTL

SEQ ID NO: 138132 - protein, 14 aa, Mycobacterium avium
SARGTNDSGGALQA

SEQ ID NO: 138133 - protein, 10 aa, Mycobacterium avium
SASNAWDDAG

SEQ ID NO: 138134 - protein, 10 aa, Mycobacterium avium
SASNDEADEL

SEQ ID NO: 138135 - protein, 7 aa, Mycobacterium avium
SASQANV

SEQ ID NO: 138136 - protein, 11 aa, Mycobacterium avium
SASSANLGPGF

SEQ ID NO: 138137 - protein, 8 aa, Mycobacterium avium
SATASADE

SEQ ID NO: 138138 - protein, 6 aa, Mycobacterium avium
SATEDH

SEQ ID NO: 138139 - protein, 16 aa, Mycobacterium avium
SATIGDEGWKTMLGQA

SEQ ID NO: 138140 - protein, 11 aa, Mycobacterium avium
SDADGTSVPAG

SEQ ID NO: 138141 - protein, 20 aa, Mycobacterium avium
SDADNDRLRTEPNVDYSPAG

SEQ ID NO: 138142 - protein, 6 aa, Mycobacterium avium
SDATDE

SEQ ID NO: 138143 - protein, 4 aa, Mycobacterium avium
SDAV

SEQ ID NO: 138144 - protein, 8 aa, Mycobacterium avium
SDEPDDAV

SEQ ID NO: 138145 - protein, 9 aa, Mycobacterium avium
SDEQPPTVD

SEQ ID NO: 138146 - protein, 9 aa, Mycobacterium avium
SDGNPPQVK

SEQ ID NO: 138147 - protein, 9 aa, Mycobacterium avium
SDGSGTTDN

SEQ ID NO: 138148 - protein, 8 aa, Mycobacterium avium
SDLPSSAQ

SEQ ID NO: 138149 - protein, 5 aa, Mycobacterium avium
SDPTN

SEQ ID NO: 138150 - protein, 4 aa, Mycobacterium avium
SDQF

SEQ ID NO: 138151 - protein, 24 aa, Mycobacterium avium
SDVGGGLSAPQSPMLNPNNAPGAA

SEQ ID NO: 138152 - protein, 19 aa, Mycobacterium avium
SDVTNRKQLSDKISEHRRQ

SEQ ID NO: 138153 - protein, 4 aa, Mycobacterium avium
SEDV

SEQ ID NO: 138154 - protein, 7 aa, Mycobacterium avium
SEGERDN

SEQ ID NO: 138155 - protein, 7 aa, Mycobacterium avium
SEGWPGE

SEQ ID NO: 138156 - protein, 11 aa, Mycobacterium avium
SELADQKEKLA

SEQ ID NO: 138157 - protein, 9 aa, Mycobacterium avium
SETYPPGST

SEQ ID NO: 138158 - protein, 14 aa, Mycobacterium avium
SFRDGTRVAATAPD

SEQ ID NO: 138159 - protein, 10 aa, Mycobacterium avium
SGAHRPTPTI

SEQ ID NO: 138160 - protein, 6 aa, Mycobacterium avium
SGANMT

SEQ ID NO: 138161 - protein, 14 aa, Mycobacterium avium
SGAPFNGASLQGKP

SEQ ID NO: 138162 - protein, 9 aa, Mycobacterium avium
SGAPGSTAN

SEQ ID NO: 138163 - protein, 14 aa, Mycobacterium avium
SGAPVSAPRVGGPV

SEQ ID NO: 138164 - protein, 7 aa, Mycobacterium avium
SGCATNG

SEQ ID NO: 138165 - protein, 12 aa, Mycobacterium avium
SGCNPGGPEESF

SEQ ID NO: 138166 - protein, 32 aa, Mycobacterium avium
SGCSSGNKSAPSSSASSSSTSASASSGGAAGT

SEQ ID NO: 138167 - protein, 9 aa, Mycobacterium avium
SGDQVNGFQ

SEQ ID NO: 138168 - protein, 8 aa, Mycobacterium avium
SGDTRLPA

SEQ ID NO: 138169 - protein, 4 aa, Mycobacterium avium
SGGA

SEQ ID NO: 138170 - protein, 8 aa, Mycobacterium avium
SGGIGGNH

SEQ ID NO: 138171 - protein, 8 aa, Mycobacterium avium
SGGLPADQ

SEQ ID NO: 138172 - protein, 4 aa, Mycobacterium avium
SGGW

SEQ ID NO: 138173 - protein, 4 aa, Mycobacterium avium
SGIP

SEQ ID NO: 138174 - protein, 12 aa, Mycobacterium avium
SGKLPNTDTYCP

SEQ ID NO: 138175 - protein, 13 aa, Mycobacterium avium
SGKTGTTEAHRSS

SEQ ID NO: 138176 - protein, 11 aa, Mycobacterium avium
SGLPDHAGDKL

SEQ ID NO: 138177 - protein, 6 aa, Mycobacterium avium
SGPKLG

SEQ ID NO: 138178 - protein, 10 aa, Mycobacterium avium
SGPPANGAPG

SEQ ID NO: 138179 - protein, 13 aa, Mycobacterium avium
SGQEQNPDLTGQS

SEQ ID NO: 138180 - protein, 8 aa, Mycobacterium avium
SGQPHGDK

SEQ ID NO: 138181 - protein, 13 aa, Mycobacterium avium
SGQPLARAADGRD

SEQ ID NO: 138182 - protein, 11 aa, Mycobacterium avium
SGREPRPYREQ

SEQ ID NO: 138183 - protein, 13 aa, Mycobacterium avium
SGRGTGPTEGPAI

SEQ ID NO: 138184 - protein, 21 aa, Mycobacterium avium
SGSDQDPHSYEASPSDAAAIA

SEQ ID NO: 138185 - protein, 4 aa, Mycobacterium avium
SGTQ

SEQ ID NO: 138186 - protein, 7 aa, Mycobacterium avium
SHAGPTI

SEQ ID NO: 138187 - protein, 7 aa, Mycobacterium avium
SHDPEVQ

SEQ ID NO: 138188 - protein, 16 aa, Mycobacterium avium
SHSAQRSAAQAPTQRT

SEQ ID NO: 138189 - protein, 12 aa, Mycobacterium avium
SIAGTDKTGRSV

SEQ ID NO: 138190 - protein, 10 aa, Mycobacterium avium
SIEPQGTQAK

SEQ ID NO: 138191 - protein, 13 aa, Mycobacterium avium
SIPGGPGSGPNSY

SEQ ID NO: 138192 - protein, 11 aa, Mycobacterium avium
SIPGYTPKGTL

SEQ ID NO: 138193 - protein, 18 aa, Mycobacterium avium
SKDAVGGGTAAGSAGAAG

SEQ ID NO: 138194 - protein, 16 aa, Mycobacterium avium
SKEGVAARTKDQLTSA

SEQ ID NO: 138195 - protein, 6 aa, Mycobacterium avium
SKGASM

SEQ ID NO: 138196 - protein, 10 aa, Mycobacterium avium
SKMPPRGLTQ

SEQ ID NO: 138197 - protein, 17 aa, Mycobacterium avium
SKSLKGDGKGGGPIADV

SEQ ID NO: 138198 - protein, 6 aa, Mycobacterium avium
SKSVGA

SEQ ID NO: 138199 - protein, 7 aa, Mycobacterium avium
SKTINTV

SEQ ID NO: 138200 - protein, 9 aa, Mycobacterium avium
SKTQANPLA

SEQ ID NO: 138201 - protein, 10 aa, Mycobacterium avium
SKVTSKGSYV

SEQ ID NO: 138202 - protein, 19 aa, Mycobacterium avium
SLNAGSAYSAPLDPPPPCP

SEQ ID NO: 138203 - protein, 5 aa, Mycobacterium avium
SLPQT

SEQ ID NO: 138204 - protein, 13 aa, Mycobacterium avium
SLQATAQATQTTL

SEQ ID NO: 138205 - protein, 7 aa, Mycobacterium avium
SLSNERK

SEQ ID NO: 138206 - protein, 12 aa, Mycobacterium avium
SMGKPSRPTPIG

SEQ ID NO: 138207 - protein, 6 aa, Mycobacterium avium
SMGQGS

SEQ ID NO: 138208 - protein, 16 aa, Mycobacterium avium
SNAKAEGRETINGQST

SEQ ID NO: 138209 - protein, 30 aa, Mycobacterium avium
SNGKSVDASAPPHAAASATSTSANPAQPTE

SEQ ID NO: 138210 - protein, 7 aa, Mycobacterium avium
SNGNPPL

SEQ ID NO: 138211 - protein, 15 aa, Mycobacterium avium
SNSDPLGAQVRSPDS

SEQ ID NO: 138212 - protein, 16 aa, Mycobacterium avium
SNSSGKAVAGTFNSDR

SEQ ID NO: 138213 - protein, 4 aa, Mycobacterium avium
SNTD

SEQ ID NO: 138214 - protein, 4 aa, Mycobacterium avium
SPAI

SEQ ID NO: 138215 - protein, 5 aa, Mycobacterium avium
SPARE

SEQ ID NO: 138216 - protein, 5 aa, Mycobacterium avium
SPDDA

SEQ ID NO: 138217 - protein, 8 aa, Mycobacterium avium
SPDGDDYT

SEQ ID NO: 138218 - protein, 4 aa, Mycobacterium avium
SPDN

SEQ ID NO: 138219 - protein, 4 aa, Mycobacterium avium
SPFQ

SEQ ID NO: 138220 - protein, 7 aa, Mycobacterium avium
SPGGKTD

SEQ ID NO: 138221 - protein, 17 aa, Mycobacterium avium
SPKCGNGNDPLDKAGAA

SEQ ID NO: 138222 - protein, 10 aa, Mycobacterium avium
SPMDPTEGYR

SEQ ID NO: 138223 - protein, 6 aa, Mycobacterium avium
SPNPGY

SEQ ID NO: 138224 - protein, 9 aa, Mycobacterium avium
SPPAKRQQM

SEQ ID NO: 138225 - protein, 13 aa, Mycobacterium avium
SPRLDDSKPFKPK

SEQ ID NO: 138226 - protein, 7 aa, Mycobacterium avium
SPSYDPN

SEQ ID NO: 138227 - protein, 4 aa, Mycobacterium avium
SQAS

SEQ ID NO: 138228 - protein, 6 aa, Mycobacterium avium
SQEPGV

SEQ ID NO: 138229 - protein, 6 aa, Mycobacterium avium
SQIGSR

SEQ ID NO: 138230 - protein, 10 aa, Mycobacterium avium
SQLSPAPARA

SEQ ID NO: 138231 - protein, 18 aa, Mycobacterium avium
SQSYERGPLGLPTSAEIQ

SEQ ID NO: 138232 - protein, 10 aa, Mycobacterium avium
SRADDSGVGP

SEQ ID NO: 138233 - protein, 6 aa, Mycobacterium avium
SRDGPT

SEQ ID NO: 138234 - protein, 8 aa, Mycobacterium avium
SRDTPRAD

SEQ ID NO: 138235 - protein, 10 aa, Mycobacterium avium
SRNPPSTKTL

SEQ ID NO: 138236 - protein, 12 aa, Mycobacterium avium
SRPGAATESAPE

SEQ ID NO: 138237 - protein, 19 aa, Mycobacterium avium
SRPGTGAETGGFKGDPAFH

SEQ ID NO: 138238 - protein, 4 aa, Mycobacterium avium
SRQQ

SEQ ID NO: 138239 - protein, 6 aa, Mycobacterium avium
SRQRGQ

SEQ ID NO: 138240 - protein, 7 aa, Mycobacterium avium
SRRGGQG

SEQ ID NO: 138241 - protein, 5 aa, Mycobacterium avium
SRTVS

SEQ ID NO: 138242 - protein, 15 aa, Mycobacterium avium
SSADFPDRDATSAMD

SEQ ID NO: 138243 - protein, 16 aa, Mycobacterium avium
SSAGPGLPTAAPDLGH

SEQ ID NO: 138244 - protein, 8 aa, Mycobacterium avium
SSATHPAK

SEQ ID NO: 138245 - protein, 12 aa, Mycobacterium avium
SSCRDQAAAGRD

SEQ ID NO: 138246 - protein, 8 aa, Mycobacterium avium
SSDDGAAE

SEQ ID NO: 138247 - protein, 17 aa, Mycobacterium avium
SSDGQLPAGSTDEQQPS

SEQ ID NO: 138248 - protein, 14 aa, Mycobacterium avium
SSELATQLTQGATA

SEQ ID NO: 138249 - protein, 5 aa, Mycobacterium avium
SSETA

SEQ ID NO: 138250 - protein, 5 aa, Mycobacterium avium
SSGLI

SEQ ID NO: 138251 - protein, 4 aa, Mycobacterium avium
SSLP

SEQ ID NO: 138252 - protein, 6 aa, Mycobacterium avium
SSPDQR

SEQ ID NO: 138253 - protein, 9 aa, Mycobacterium avium
SSPNTPGLR

SEQ ID NO: 138254 - protein, 13 aa, Mycobacterium avium
SSPPLNDVQAGPA

SEQ ID NO: 138255 - protein, 4 aa, Mycobacterium avium
SSRV

SEQ ID NO: 138256 - protein, 7 aa, Mycobacterium avium
SSSLAGV

SEQ ID NO: 138257 - protein, 7 aa, Mycobacterium avium
SSSTLDS

SEQ ID NO: 138258 - protein, 40 aa, Mycobacterium avium
SSTANPPAGSSTTTTKSTATTSAGAAPTTGSGGASTTASI

SEQ ID NO: 138259 - protein, 12 aa, Mycobacterium avium
SSVESGTEIDSR

SEQ ID NO: 138260 - protein, 12 aa, Mycobacterium avium
SSVRRAADLGTD

SEQ ID NO: 138261 - protein, 6 aa, Mycobacterium avium
STAAGY

SEQ ID NO: 138262 - protein, 9 aa, Mycobacterium avium
STAQPLETT

SEQ ID NO: 138263 - protein, 6 aa, Mycobacterium avium
STARAA

SEQ ID NO: 138264 - protein, 9 aa, Mycobacterium avium
STEIKTGPA

SEQ ID NO: 138265 - protein, 8 aa, Mycobacterium avium
STGGSNAT

SEQ ID NO: 138266 - protein, 9 aa, Mycobacterium avium
STGQPPAAA

SEQ ID NO: 138267 - protein, 11 aa, Mycobacterium avium
STGTLQDYGPD

SEQ ID NO: 138268 - protein, 6 aa, Mycobacterium avium
STNAQL

SEQ ID NO: 138269 - protein, 5 aa, Mycobacterium avium
STPDH

SEQ ID NO: 138270 - protein, 9 aa, Mycobacterium avium
STPEQISAA

SEQ ID NO: 138271 - protein, 9 aa, Mycobacterium avium
STSDAEQYY

SEQ ID NO: 138272 - protein, 11 aa, Mycobacterium avium
STVSPSKKISG

SEQ ID NO: 138273 - protein, 9 aa, Mycobacterium avium
SVAGRGMSP

SEQ ID NO: 138274 - protein, 13 aa, Mycobacterium avium
SVDASGRTEYSHS

SEQ ID NO: 138275 - protein, 9 aa, Mycobacterium avium
SVENGLPAA

SEQ ID NO: 138276 - protein, 6 aa, Mycobacterium avium
SVGNDT

SEQ ID NO: 138277 - protein, 7 aa, Mycobacterium avium
SVGSEDR

SEQ ID NO: 138278 - protein, 18 aa, Mycobacterium avium
SVPDGVDPNTVPKPLDPE

SEQ ID NO: 138279 - protein, 15 aa, Mycobacterium avium
SVPEGPGINDNGSGV

SEQ ID NO: 138280 - protein, 14 aa, Mycobacterium avium
SWNPESGDLDPDAL

SEQ ID NO: 138281 - protein, 18 aa, Mycobacterium avium
SYTTGTNEGGLGARSWPS

SEQ ID NO: 138282 - protein, 5 aa, Mycobacterium avium
SYTYP

SEQ ID NO: 138283 - protein, 6 aa, Mycobacterium avium
TAAGRE

SEQ ID NO: 138284 - protein, 8 aa, Mycobacterium avium
TADPANRH

SEQ ID NO: 138285 - protein, 8 aa, Mycobacterium avium
TADRRGQL

SEQ ID NO: 138286 - protein, 11 aa, Mycobacterium avium
TAEAAPDLPQA

SEQ ID NO: 138287 - protein, 6 aa, Mycobacterium avium
TAEGIP

SEQ ID NO: 138288 - protein, 7 aa, Mycobacterium avium
TAEGRGN

SEQ ID NO: 138289 - protein, 20 aa, Mycobacterium avium
TAEQTKQTAMQARTAAAAYE

SEQ ID NO: 138290 - protein, 5 aa, Mycobacterium avium
TAPSV

SEQ ID NO: 138291 - protein, 14 aa, Mycobacterium avium
TAQAWGGSDVSADL

SEQ ID NO: 138292 - protein, 9 aa, Mycobacterium avium
TASTARSVS

SEQ ID NO: 138293 - protein, 16 aa, Mycobacterium avium
TATIPNTGGRVEGSRN

SEQ ID NO: 138294 - protein, 12 aa, Mycobacterium avium
TAVQGDTTPISP

SEQ ID NO: 138295 - protein, 14 aa, Mycobacterium avium
TCESATVSGTNNKI

SEQ ID NO: 138296 - protein, 20 aa, Mycobacterium avium
TCTTNGDKTTIGIGDPTAGL

SEQ ID NO: 138297 - protein, 7 aa, Mycobacterium avium
TDDAAQA

SEQ ID NO: 138298 - protein, 25 aa, Mycobacterium avium
TDFAGSDTPLSGDQYAAAKRRCGGA

SEQ ID NO: 138299 - protein, 11 aa, Mycobacterium avium
TDGGGYPSGHE

SEQ ID NO: 138300 - protein, 9 aa, Mycobacterium avium
TDGSPASEL

SEQ ID NO: 138301 - protein, 7 aa, Mycobacterium avium
TDGSRAA

SEQ ID NO: 138302 - protein, 10 aa, Mycobacterium avium
TDSSGTTDNV

SEQ ID NO: 138303 - protein, 5 aa, Mycobacterium avium
TEDNV

SEQ ID NO: 138304 - protein, 10 aa, Mycobacterium avium
TEPDATTLPR

SEQ ID NO: 138305 - protein, 11 aa, Mycobacterium avium
TESTTLSVASG

SEQ ID NO: 138306 - protein, 8 aa, Mycobacterium avium
TETDPAIA

SEQ ID NO: 138307 - protein, 4 aa, Mycobacterium avium
TGAG

SEQ ID NO: 138308 - protein, 9 aa, Mycobacterium avium
TGAGSGIGQ

SEQ ID NO: 138309 - protein, 15 aa, Mycobacterium avium
TGAGSNDVGYSSPRF

SEQ ID NO: 138310 - protein, 11 aa, Mycobacterium avium
TGAPNPDVAGT

SEQ ID NO: 138311 - protein, 11 aa, Mycobacterium avium
TGAPPDSPEAM

SEQ ID NO: 138312 - protein, 27 aa, Mycobacterium avium
TGAPPTDNPNGQPGVSTTFKDEDGSHA

SEQ ID NO: 138313 - protein, 7 aa, Mycobacterium avium
TGDDPLR

SEQ ID NO: 138314 - protein, 4 aa, Mycobacterium avium
TGDH

SEQ ID NO: 138315 - protein, 6 aa, Mycobacterium avium
TGDSDV

SEQ ID NO: 138316 - protein, 14 aa, Mycobacterium avium
TGEDRGPKPEGAVG

SEQ ID NO: 138317 - protein, 9 aa, Mycobacterium avium
TGEPSSSID

SEQ ID NO: 138318 - protein, 5 aa, Mycobacterium avium
TGETC

SEQ ID NO: 138319 - protein, 6 aa, Mycobacterium avium
TGFDTG

SEQ ID NO: 138320 - protein, 5 aa, Mycobacterium avium
TGKAT

SEQ ID NO: 138321 - protein, 7 aa, Mycobacterium avium
TGLGSSE

SEQ ID NO: 138322 - protein, 4 aa, Mycobacterium avium
TGLS

SEQ ID NO: 138323 - protein, 6 aa, Mycobacterium avium
TGNAPL

SEQ ID NO: 138324 - protein, 9 aa, Mycobacterium avium
TGPPPSPIE

SEQ ID NO: 138325 - protein, 9 aa, Mycobacterium avium
TGPTGQIAT

SEQ ID NO: 138326 - protein, 5 aa, Mycobacterium avium
TGPVG

SEQ ID NO: 138327 - protein, 4 aa, Mycobacterium avium
TGQL

SEQ ID NO: 138328 - protein, 11 aa, Mycobacterium avium
TGSPPPSPKSL

SEQ ID NO: 138329 - protein, 9 aa, Mycobacterium avium
TGTASGKSL

SEQ ID NO: 138330 - protein, 8 aa, Mycobacterium avium
TGVGKTEL

SEQ ID NO: 138331 - protein, 10 aa, Mycobacterium avium
THAGERGTQQ

SEQ ID NO: 138332 - protein, 10 aa, Mycobacterium avium
THDPATPYKA

SEQ ID NO: 138333 - protein, 6 aa, Mycobacterium avium
THNPGM

SEQ ID NO: 138334 - protein, 6 aa, Mycobacterium avium
THPTTG

SEQ ID NO: 138335 - protein, 4 aa, Mycobacterium avium
TIET

SEQ ID NO: 138336 - protein, 18 aa, Mycobacterium avium
TKPDLTPVTDADRAAEAE

SEQ ID NO: 138337 - protein, 7 aa, Mycobacterium avium
TKPGVDP

SEQ ID NO: 138338 - protein, 10 aa, Mycobacterium avium
TKSDYDAATP

SEQ ID NO: 138339 - protein, 5 aa, Mycobacterium avium
TLDGR

SEQ ID NO: 138340 - protein, 8 aa, Mycobacterium avium
TLDTEGNA

SEQ ID NO: 138341 - protein, 6 aa, Mycobacterium avium
TLPDGA

SEQ ID NO: 138342 - protein, 19 aa, Mycobacterium avium
TLRGESDRAERDGDLAKAA

SEQ ID NO: 138343 - protein, 8 aa, Mycobacterium avium
TLSGAGPS

SEQ ID NO: 138344 - protein, 12 aa, Mycobacterium avium
TNECRPPVVPPA

SEQ ID NO: 138345 - protein, 10 aa, Mycobacterium avium
TNETAGNAVN

SEQ ID NO: 138346 - protein, 18 aa, Mycobacterium avium
TNGGQTNTAALSSMPGNA

SEQ ID NO: 138347 - protein, 7 aa, Mycobacterium avium
TNMGGDD

SEQ ID NO: 138348 - protein, 11 aa, Mycobacterium avium
TNPVRAANGRI

SEQ ID NO: 138349 - protein, 5 aa, Mycobacterium avium
TPAEA

SEQ ID NO: 138350 - protein, 14 aa, Mycobacterium avium
TPAGRTAAKTPGSM

SEQ ID NO: 138351 - protein, 8 aa, Mycobacterium avium
TPAPPPER

SEQ ID NO: 138352 - protein, 16 aa, Mycobacterium avium
TPGAVATGTFNAGPDT

SEQ ID NO: 138353 - protein, 10 aa, Mycobacterium avium
TPGGPRTGEL

SEQ ID NO: 138354 - protein, 11 aa, Mycobacterium avium
TPIGDSASAGL

SEQ ID NO: 138355 - protein, 8 aa, Mycobacterium avium
TPPAGSFS

SEQ ID NO: 138356 - protein, 8 aa, Mycobacterium avium
TPPAVTPQ

SEQ ID NO: 138357 - protein, 7 aa, Mycobacterium avium
TPPEHED

SEQ ID NO: 138358 - protein, 6 aa, Mycobacterium avium
TPPLDD

SEQ ID NO: 138359 - protein, 8 aa, Mycobacterium avium
TPRGDGRL

SEQ ID NO: 138360 - protein, 16 aa, Mycobacterium avium
TPRPGTGDHQSRTLRD

SEQ ID NO: 138361 - protein, 5 aa, Mycobacterium avium
TPSGQ

SEQ ID NO: 138362 - protein, 11 aa, Mycobacterium avium
TPTAGSPPWTA

SEQ ID NO: 138363 - protein, 5 aa, Mycobacterium avium
TPTTM

SEQ ID NO: 138364 - protein, 9 aa, Mycobacterium avium
TQARPSEIT

SEQ ID NO: 138365 - protein, 11 aa, Mycobacterium avium
TQLPSGPTVPA

SEQ ID NO: 138366 - protein, 6 aa, Mycobacterium avium
TQPVPS

SEQ ID NO: 138367 - protein, 9 aa, Mycobacterium avium
TQQTAAPLA

SEQ ID NO: 138368 - protein, 20 aa, Mycobacterium avium
TRADGSATGLRTTDGSAIPA

SEQ ID NO: 138369 - protein, 7 aa, Mycobacterium avium
TRGEQAA

SEQ ID NO: 138370 - protein, 4 aa, Mycobacterium avium
TRIG

SEQ ID NO: 138371 - protein, 12 aa, Mycobacterium avium
TRPLKSNIERGA

SEQ ID NO: 138372 - protein, 8 aa, Mycobacterium avium
TRSGNRQL

SEQ ID NO: 138373 - protein, 8 aa, Mycobacterium avium
TRSPARDF

SEQ ID NO: 138374 - protein, 18 aa, Mycobacterium avium
TSAAAQPNASPPESGDLT

SEQ ID NO: 138375 - protein, 8 aa, Mycobacterium avium
TSAGPDAV

SEQ ID NO: 138376 - protein, 14 aa, Mycobacterium avium
TSALNPYTNPEGAL

SEQ ID NO: 138377 - protein, 8 aa, Mycobacterium avium
TSEIRSSN

SEQ ID NO: 138378 - protein, 6 aa, Mycobacterium avium
TSGDAG

SEQ ID NO: 138379 - protein, 4 aa, Mycobacterium avium
TSGY

SEQ ID NO: 138380 - protein, 10 aa, Mycobacterium avium
TSKNAIDKTN

SEQ ID NO: 138381 - protein, 16 aa, Mycobacterium avium
TSPPGQQILAQAGFAK

SEQ ID NO: 138382 - protein, 13 aa, Mycobacterium avium
TSRGTDGVETKQV

SEQ ID NO: 138383 - protein, 11 aa, Mycobacterium avium
TSTGAAAPLGR

SEQ ID NO: 138384 - protein, 6 aa, Mycobacterium avium
TSTSSR

SEQ ID NO: 138385 - protein, 7 aa, Mycobacterium avium
TTDPGAA

SEQ ID NO: 138386 - protein, 5 aa, Mycobacterium avium
TTLPS

SEQ ID NO: 138387 - protein, 7 aa, Mycobacterium avium
TTNPKVT

SEQ ID NO: 138388 - protein, 9 aa, Mycobacterium avium
TTPLSQAQA

SEQ ID NO: 138389 - protein, 7 aa, Mycobacterium avium
TTRTGTK

SEQ ID NO: 138390 - protein, 6 aa, Mycobacterium avium
TTSNPL

SEQ ID NO: 138391 - protein, 5 aa, Mycobacterium avium
TVVGP

SEQ ID NO: 138392 - protein, 11 aa, Mycobacterium avium
TVYTTTEPLGY

SEQ ID NO: 138393 - protein, 8 aa, Mycobacterium avium
TYANDNEM

SEQ ID NO: 138394 - protein, 21 aa, Mycobacterium avium
TYKDGDPKVDKIGQSNTINKG

SEQ ID NO: 138395 - protein, 9 aa, Mycobacterium avium
TYQNPATAI

SEQ ID NO: 138396 - protein, 6 aa, Mycobacterium avium
TYSPPY

SEQ ID NO: 138397 - protein, 11 aa, Mycobacterium avium
VAAAAGKTWEE

SEQ ID NO: 138398 - protein, 15 aa, Mycobacterium avium
VAAEGRAGYAVTGDH

SEQ ID NO: 138399 - protein, 6 aa, Mycobacterium avium
VADPAT

SEQ ID NO: 138400 - protein, 5 aa, Mycobacterium avium
VAGSN

SEQ ID NO: 138401 - protein, 7 aa, Mycobacterium avium
VAHPDGQ

SEQ ID NO: 138402 - protein, 8 aa, Mycobacterium avium
VAPDHPKI

SEQ ID NO: 138403 - protein, 15 aa, Mycobacterium avium
VAPPRVAQAKNGDTH

SEQ ID NO: 138404 - protein, 9 aa, Mycobacterium avium
VAPVDTQRA

SEQ ID NO: 138405 - protein, 11 aa, Mycobacterium avium
VASGELPAQRV

SEQ ID NO: 138406 - protein, 11 aa, Mycobacterium avium
VASGPDLPADL

SEQ ID NO: 138407 - protein, 8 aa, Mycobacterium avium
VDAAPGRI

SEQ ID NO: 138408 - protein, 20 aa, Mycobacterium avium
VDCGGKQTLSASGSTAQANA

SEQ ID NO: 138409 - protein, 7 aa, Mycobacterium avium
VDDQRGV

SEQ ID NO: 138410 - protein, 7 aa, Mycobacterium avium
VDDSVPN

SEQ ID NO: 138411 - protein, 4 aa, Mycobacterium avium
VDGD

SEQ ID NO: 138412 - protein, 7 aa, Mycobacterium avium
VDPDAGR

SEQ ID NO: 138413 - protein, 6 aa, Mycobacterium avium
VDPHRG

SEQ ID NO: 138414 - protein, 9 aa, Mycobacterium avium
VDPNADQIE

SEQ ID NO: 138415 - protein, 15 aa, Mycobacterium avium
VDPRTLPPDAPDDRK

SEQ ID NO: 138416 - protein, 9 aa, Mycobacterium avium
VDPSASPES

SEQ ID NO: 138417 - protein, 10 aa, Mycobacterium avium
VDPTDATRGL

SEQ ID NO: 138418 - protein, 7 aa, Mycobacterium avium
VDQNNGA

SEQ ID NO: 138419 - protein, 8 aa, Mycobacterium avium
VDSQGYAN

SEQ ID NO: 138420 - protein, 21 aa, Mycobacterium avium
VDTGADPQAVAGGWLAEHPLG

SEQ ID NO: 138421 - protein, 12 aa, Mycobacterium avium
VEAGPPTSLPAP

SEQ ID NO: 138422 - protein, 7 aa, Mycobacterium avium
VEPDYSS

SEQ ID NO: 138423 - protein, 17 aa, Mycobacterium avium
VERPAPSNLPKPTPGMD

SEQ ID NO: 138424 - protein, 6 aa, Mycobacterium avium
VETTDS

SEQ ID NO: 138425 - protein, 6 aa, Mycobacterium avium
VGADPL

SEQ ID NO: 138426 - protein, 9 aa, Mycobacterium avium
VGATSKGVC

SEQ ID NO: 138427 - protein, 6 aa, Mycobacterium avium
VGGPSA

SEQ ID NO: 138428 - protein, 15 aa, Mycobacterium avium
VGGSATAGAFSRPGL

SEQ ID NO: 138429 - protein, 10 aa, Mycobacterium avium
VGIPVDDPDG

SEQ ID NO: 138430 - protein, 13 aa, Mycobacterium avium
VGKPDTKISEAPH

SEQ ID NO: 138431 - protein, 16 aa, Mycobacterium avium
VGPAVGKGQPACSDIG

SEQ ID NO: 138432 - protein, 15 aa, Mycobacterium avium
VGRGGASVPLPQPVP

SEQ ID NO: 138433 - protein, 6 aa, Mycobacterium avium
VGSGVA

SEQ ID NO: 138434 - protein, 8 aa, Mycobacterium avium
VGSSETGA

SEQ ID NO: 138435 - protein, 13 aa, Mycobacterium avium
VGSTAELRSATPL

SEQ ID NO: 138436 - protein, 19 aa, Mycobacterium avium
VGTEFQGGVGEGAAKSAGV

SEQ ID NO: 138437 - protein, 17 aa, Mycobacterium avium
VITPEGKQLKARELSGG

SEQ ID NO: 138438 - protein, 12 aa, Mycobacterium avium
VKPPAKQNNSLA

SEQ ID NO: 138439 - protein, 15 aa, Mycobacterium avium
VKPTEGSAPGQPVTA

SEQ ID NO: 138440 - protein, 12 aa, Mycobacterium avium
VNARGGPGGAPG

SEQ ID NO: 138441 - protein, 5 aa, Mycobacterium avium
VNGGF

SEQ ID NO: 138442 - protein, 15 aa, Mycobacterium avium
VNGVPPHDKRHRTRV

SEQ ID NO: 138443 - protein, 7 aa, Mycobacterium avium
VPAASSL

SEQ ID NO: 138444 - protein, 5 aa, Mycobacterium avium
VPAGT

SEQ ID NO: 138445 - protein, 4 aa, Mycobacterium avium
VPAT

SEQ ID NO: 138446 - protein, 12 aa, Mycobacterium avium
VPEPGPSAGKLK

SEQ ID NO: 138447 - protein, 6 aa, Mycobacterium avium
VPESLR

SEQ ID NO: 138448 - protein, 6 aa, Mycobacterium avium
VPESSV

SEQ ID NO: 138449 - protein, 6 aa, Mycobacterium avium
VPGASL

SEQ ID NO: 138450 - protein, 10 aa, Mycobacterium avium
VPGDRARHHA

SEQ ID NO: 138451 - protein, 5 aa, Mycobacterium avium
VPGPS

SEQ ID NO: 138452 - protein, 6 aa, Mycobacterium avium
VPIPAD

SEQ ID NO: 138453 - protein, 7 aa, Mycobacterium avium
VPPAPGI

SEQ ID NO: 138454 - protein, 10 aa, Mycobacterium avium
VPQRSDGELD

SEQ ID NO: 138455 - protein, 8 aa, Mycobacterium avium
VPSQTRDS

SEQ ID NO: 138456 - protein, 31 aa, Mycobacterium avium
VPSSAPGAPNSPAPGAPNSPAPGAPPAPAAH

SEQ ID NO: 138457 - protein, 7 aa, Mycobacterium avium
VQAGPSV

SEQ ID NO: 138458 - protein, 6 aa, Mycobacterium avium
VQRRHN

SEQ ID NO: 138459 - protein, 25 aa, Mycobacterium avium
VQSGQPAKAVGPPADGTYNYNEAGV

SEQ ID NO: 138460 - protein, 4 aa, Mycobacterium avium
VQTP

SEQ ID NO: 138461 - protein, 20 aa, Mycobacterium avium
VRDDRNTNDYQPFIYCLVKS

SEQ ID NO: 138462 - protein, 7 aa, Mycobacterium avium
VRSDGGV

SEQ ID NO: 138463 - protein, 11 aa, Mycobacterium avium
VRSNPNSFGEA

SEQ ID NO: 138464 - protein, 15 aa, Mycobacterium avium
VRTSGMTPYVVRYIE

SEQ ID NO: 138465 - protein, 4 aa, Mycobacterium avium
VSAA

SEQ ID NO: 138466 - protein, 9 aa, Mycobacterium avium
VSAEPPPVR

SEQ ID NO: 138467 - protein, 15 aa, Mycobacterium avium
VSDSIPGSISGKEFN

SEQ ID NO: 138468 - protein, 9 aa, Mycobacterium avium
VSEEPSVTD

SEQ ID NO: 138469 - protein, 8 aa, Mycobacterium avium
VSGDATTG

SEQ ID NO: 138470 - protein, 11 aa, Mycobacterium avium
VSNDSGAAVES

SEQ ID NO: 138471 - protein, 9 aa, Mycobacterium avium
VSPGKPTLT

SEQ ID NO: 138472 - protein, 11 aa, Mycobacterium avium
VSPRPEATGEQ

SEQ ID NO: 138473 - protein, 7 aa, Mycobacterium avium
VSQRDDL

SEQ ID NO: 138474 - protein, 10 aa, Mycobacterium avium
VSSSNPGFTV

SEQ ID NO: 138475 - protein, 10 aa, Mycobacterium avium
VSTFSPADPA

SEQ ID NO: 138476 - protein, 12 aa, Mycobacterium avium
VTAGPQPGNPAP

SEQ ID NO: 138477 - protein, 5 aa, Mycobacterium avium
VTATG

SEQ ID NO: 138478 - protein, 5 aa, Mycobacterium avium
VTDES

SEQ ID NO: 138479 - protein, 11 aa, Mycobacterium avium
VTDKSRQPLYD

SEQ ID NO: 138480 - protein, 11 aa, Mycobacterium avium
VTEDGSPQGAR

SEQ ID NO: 138481 - protein, 6 aa, Mycobacterium avium
VTGPGC

SEQ ID NO: 138482 - protein, 9 aa, Mycobacterium avium
VTGSVPPTV

SEQ ID NO: 138483 - protein, 4 aa, Mycobacterium avium
VTGV

SEQ ID NO: 138484 - protein, 8 aa, Mycobacterium avium
VTPPPGSR

SEQ ID NO: 138485 - protein, 18 aa, Mycobacterium avium
VTRADGGKSGIGRGYGGA

SEQ ID NO: 138486 - protein, 8 aa, Mycobacterium avium
VTSERNAV

SEQ ID NO: 138487 - protein, 8 aa, Mycobacterium avium
VTTGSQAT

SEQ ID NO: 138488 - protein, 9 aa, Mycobacterium avium
VTTNPPVEG

SEQ ID NO: 138489 - protein, 8 aa, Mycobacterium avium
VTTTPDAR

SEQ ID NO: 138490 - protein, 20 aa, Mycobacterium avium
VYDPPGDEPRSERSALGDNH

SEQ ID NO: 138491 - protein, 9 aa, Mycobacterium avium
VYSDGKPVT

SEQ ID NO: 138492 - protein, 19 aa, Mycobacterium avium
VYTDGAASPQWYGTGTEDL

SEQ ID NO: 138493 - protein, 9 aa, Mycobacterium avium
WAGGAQAYK

SEQ ID NO: 138494 - protein, 10 aa, Mycobacterium avium
WDTTADPAVT

SEQ ID NO: 138495 - protein, 4 aa, Mycobacterium avium
WGAD

SEQ ID NO: 138496 - protein, 18 aa, Mycobacterium avium
WGDGPAPWGPGEPPRPAW

SEQ ID NO: 138497 - protein, 17 aa, Mycobacterium avium
WGPKEDPAWARNDPSLQ

SEQ ID NO: 138498 - protein, 12 aa, Mycobacterium avium
WGPSTDPAWKRN

SEQ ID NO: 138499 - protein, 38 aa, Mycobacterium avium
WKGDPNATTSGQGVPQYPPGQDPRLPPPRGTAPAPPPV

SEQ ID NO: 138500 - protein, 12 aa, Mycobacterium avium
WKPGDAEATVTT

SEQ ID NO: 138501 - protein, 13 aa, Mycobacterium avium
WNDGPPPHHPPPN

SEQ ID NO: 138502 - protein, 4 aa, Mycobacterium avium
WNDP

SEQ ID NO: 138503 - protein, 7 aa, Mycobacterium avium
WRNPPRT

SEQ ID NO: 138504 - protein, 10 aa, Mycobacterium avium
WTNGKDPHAD

SEQ ID NO: 138505 - protein, 12 aa, Mycobacterium avium
WTTTADPGTPAD

SEQ ID NO: 138506 - protein, 20 aa, Mycobacterium avium
WYGPPPPGGWDGPPPPGGWN

SEQ ID NO: 138507 - protein, 8 aa, Mycobacterium avium
YAAAGGRN

SEQ ID NO: 138508 - protein, 18 aa, Mycobacterium avium
YADPGTARDYNPDSNESL

SEQ ID NO: 138509 - protein, 5 aa, Mycobacterium avium
YADSG

SEQ ID NO: 138510 - protein, 8 aa, Mycobacterium avium
YAEDTGTV

SEQ ID NO: 138511 - protein, 16 aa, Mycobacterium avium
YARGDVDTRGGSTIEQ

SEQ ID NO: 138512 - protein, 28 aa, Mycobacterium avium
YASATDDQKKALGKPLTGDRNAGKRESG

SEQ ID NO: 138513 - protein, 14 aa, Mycobacterium avium
YATSAPGAFDSNED

SEQ ID NO: 138514 - protein, 12 aa, Mycobacterium avium
YCPGPAVGGSTS

SEQ ID NO: 138515 - protein, 24 aa, Mycobacterium avium
YDPPSSRGRPGPLSGPDLADPAHT

SEQ ID NO: 138516 - protein, 11 aa, Mycobacterium avium
YEASSDNPSGL

SEQ ID NO: 138517 - protein, 19 aa, Mycobacterium avium
YEGTEDTRPVAGTVRSAQG

SEQ ID NO: 138518 - protein, 6 aa, Mycobacterium avium
YERPPL

SEQ ID NO: 138519 - protein, 9 aa, Mycobacterium avium
YFPAPGLQP

SEQ ID NO: 138520 - protein, 5 aa, Mycobacterium avium
YGGSK

SEQ ID NO: 138521 - protein, 13 aa, Mycobacterium avium
YGKTGEAEFPGGS

SEQ ID NO: 138522 - protein, 8 aa, Mycobacterium avium
YNPKTDQV

SEQ ID NO: 138523 - protein, 9 aa, Mycobacterium avium
YNSTDPSSP

SEQ ID NO: 138524 - protein, 21 aa, Mycobacterium avium
YPADDDFAASASAGAGDASAH

SEQ ID NO: 138525 - protein, 7 aa, Mycobacterium avium
YPAGTTV

SEQ ID NO: 138526 - protein, 8 aa, Mycobacterium avium
YPDPQVGT

SEQ ID NO: 138527 - protein, 11 aa, Mycobacterium avium
YPGRPEPGRGS

SEQ ID NO: 138528 - protein, 4 aa, Mycobacterium avium
YPND

SEQ ID NO: 138529 - protein, 13 aa, Mycobacterium avium
YPVPGSVTAGKAE

SEQ ID NO: 138530 - protein, 15 aa, Mycobacterium avium
YQAPDHTGYPASGDL

SEQ ID NO: 138531 - protein, 4 aa, Mycobacterium avium
YQDK

SEQ ID NO: 138532 - protein, 13 aa, Mycobacterium avium
YQGPDSPAPQRGS

SEQ ID NO: 138533 - protein, 7 aa, Mycobacterium avium
YRNGNFP

SEQ ID NO: 138534 - protein, 9 aa, Mycobacterium avium
YRRNDGQWG

SEQ ID NO: 138535 - protein, 7 aa, Mycobacterium avium
YSGSQYN

SEQ ID NO: 138536 - protein, 5 aa, Mycobacterium avium
YSQGA

SEQ ID NO: 138537 - protein, 17 aa, Mycobacterium avium
YSSGDTRGTQFIGYTFC

SEQ ID NO: 138538 - protein, 15 aa, Mycobacterium avium
YSTDLTARAREGKLD

SEQ ID NO: 138539 - protein, 43 aa, Mycobacterium avium
YTANGSGAGISEFNGKQTDFGGSDSPLAPSEYAAAQQRCGSPA

SEQ ID NO: 138540 - protein, 10 aa, Mycobacterium avium
YTANGSGNGI

SEQ ID NO: 138541 - protein, 6 aa, Mycobacterium avium
YTDTDA

SEQ ID NO: 138542 - protein, 8 aa, Mycobacterium avium
YTQPTSTM

SEQ ID NO: 138543 - protein, 28 aa, Mycobacterium avium
YTSGTGQGNASAEKNGNSYKITGTATGV

SEQ ID NO: 138544 - protein, 6 aa, Mycobacterium avium
AAADAD

SEQ ID NO: 138545 - protein, 23 aa, Mycobacterium avium
AAADGGPIGGPPTPGAPGDQTAY

SEQ ID NO: 138546 - protein, 11 aa, Mycobacterium avium
AAAERSRNERA

SEQ ID NO: 138547 - protein, 14 aa, Mycobacterium avium
AAAGNAATKHPGAV

SEQ ID NO: 138548 - protein, 15 aa, Mycobacterium avium
AAAPDPAAGTADPPF

SEQ ID NO: 138549 - protein, 8 aa, Mycobacterium avium
AAARERLE

SEQ ID NO: 138550 - protein, 13 aa, Mycobacterium avium
AAATAGATTKEEV

SEQ ID NO: 138551 - protein, 10 aa, Mycobacterium avium
AAATRRPRPV

SEQ ID NO: 138552 - protein, 4 aa, Mycobacterium avium
AAAV

SEQ ID NO: 138553 - protein, 8 aa, Mycobacterium avium
AADAAQIS

SEQ ID NO: 138554 - protein, 8 aa, Mycobacterium avium
AADDERIA

SEQ ID NO: 138555 - protein, 6 aa, Mycobacterium avium
AADNAN

SEQ ID NO: 138556 - protein, 17 aa, Mycobacterium avium
AADPQAAAQFSASPESV

SEQ ID NO: 138557 - protein, 8 aa, Mycobacterium avium
AAEPPSCA

SEQ ID NO: 138558 - protein, 6 aa, Mycobacterium avium
AAGAGR

SEQ ID NO: 138559 - protein, 8 aa, Mycobacterium avium
AAGALRPQ

SEQ ID NO: 138560 - protein, 16 aa, Mycobacterium avium
AAGLAAAAAPSAPGTV

SEQ ID NO: 138561 - protein, 11 aa, Mycobacterium avium
AAGPASADRDL

SEQ ID NO: 138562 - protein, 9 aa, Mycobacterium avium
AAGPDQPAL

SEQ ID NO: 138563 - protein, 22 aa, Mycobacterium avium
AAGPDSVGHASECSQPSPSAVD

SEQ ID NO: 138564 - protein, 6 aa, Mycobacterium avium
AAGQPS

SEQ ID NO: 138565 - protein, 9 aa, Mycobacterium avium
AAGRSDAAA

SEQ ID NO: 138566 - protein, 8 aa, Mycobacterium avium
AAGSKGLR

SEQ ID NO: 138567 - protein, 19 aa, Mycobacterium avium
AAHGGGEYAPSAELATREQ

SEQ ID NO: 138568 - protein, 7 aa, Mycobacterium avium
AAHQAGV

SEQ ID NO: 138569 - protein, 12 aa, Mycobacterium avium
AAKARADTADPL

SEQ ID NO: 138570 - protein, 15 aa, Mycobacterium avium
AALSPGGGAGKAGQF

SEQ ID NO: 138571 - protein, 24 aa, Mycobacterium avium
AAPAAPAGIDPDRARDKVWQLLNS

SEQ ID NO: 138572 - protein, 7 aa, Mycobacterium avium
AAPAFSA

SEQ ID NO: 138573 - protein, 13 aa, Mycobacterium avium
AAPARAEPQGDDA

SEQ ID NO: 138574 - protein, 6 aa, Mycobacterium avium
AAPDVP

SEQ ID NO: 138575 - protein, 11 aa, Mycobacterium avium
AAPGASGPHHP

SEQ ID NO: 138576 - protein, 4 aa, Mycobacterium avium
AAPR

SEQ ID NO: 138577 - protein, 9 aa, Mycobacterium avium
AAPSAAPRG

SEQ ID NO: 138578 - protein, 5 aa, Mycobacterium avium
AAPTG

SEQ ID NO: 138579 - protein, 8 aa, Mycobacterium avium
AAQAAPTL

SEQ ID NO: 138580 - protein, 10 aa, Mycobacterium avium
AAQGTLTPPH

SEQ ID NO: 138581 - protein, 8 aa, Mycobacterium avium
AAQPGVRS

SEQ ID NO: 138582 - protein, 10 aa, Mycobacterium avium
AARELAEETG

SEQ ID NO: 138583 - protein, 6 aa, Mycobacterium avium
AARRTG

SEQ ID NO: 138584 - protein, 17 aa, Mycobacterium avium
AASNRAGRTSIPDPEAA

SEQ ID NO: 138585 - protein, 6 aa, Mycobacterium avium
AASQSH

SEQ ID NO: 138586 - protein, 10 aa, Mycobacterium avium
AASSPEIDSG

SEQ ID NO: 138587 - protein, 6 aa, Mycobacterium avium
AATDPE

SEQ ID NO: 138588 - protein, 9 aa, Mycobacterium avium
AATGESATA

SEQ ID NO: 138589 - protein, 7 aa, Mycobacterium avium
AATSRGA

SEQ ID NO: 138590 - protein, 9 aa, Mycobacterium avium
AAVPGPGAN

SEQ ID NO: 138591 - protein, 8 aa, Mycobacterium avium
AAYDPANY

SEQ ID NO: 138592 - protein, 22 aa, Mycobacterium avium
ADADTPGGAQPRLASDPAQLGD

SEQ ID NO: 138593 - protein, 12 aa, Mycobacterium avium
ADAKPSPPASYC

SEQ ID NO: 138594 - protein, 8 aa, Mycobacterium avium
ADAPATDA

SEQ ID NO: 138595 - protein, 10 aa, Mycobacterium avium
ADAVGKAAPV

SEQ ID NO: 138596 - protein, 6 aa, Mycobacterium avium
ADDDGY

SEQ ID NO: 138597 - protein, 7 aa, Mycobacterium avium
ADDGRTV

SEQ ID NO: 138598 - protein, 9 aa, Mycobacterium avium
ADDKKNTPL

SEQ ID NO: 138599 - protein, 5 aa, Mycobacterium avium
ADDPA

SEQ ID NO: 138600 - protein, 6 aa, Mycobacterium avium
ADDSQL

SEQ ID NO: 138601 - protein, 18 aa, Mycobacterium avium
ADDVTVDTPYGPPSAPVT

SEQ ID NO: 138602 - protein, 15 aa, Mycobacterium avium
ADENEHTLPQGDDTA

SEQ ID NO: 138603 - protein, 4 aa, Mycobacterium avium
ADER

SEQ ID NO: 138604 - protein, 4 aa, Mycobacterium avium
ADES

SEQ ID NO: 138605 - protein, 8 aa, Mycobacterium avium
ADESPAAA

SEQ ID NO: 138606 - protein, 4 aa, Mycobacterium avium
ADET

SEQ ID NO: 138607 - protein, 14 aa, Mycobacterium avium
ADFPAGPQRLSGPE

SEQ ID NO: 138608 - protein, 11 aa, Mycobacterium avium
ADGANDASNHI

SEQ ID NO: 138609 - protein, 10 aa, Mycobacterium avium
ADGGPASGSG

SEQ ID NO: 138610 - protein, 12 aa, Mycobacterium avium
ADPAPPGASQLP

SEQ ID NO: 138611 - protein, 13 aa, Mycobacterium avium
ADPEVAGSLTTAQ

SEQ ID NO: 138612 - protein, 7 aa, Mycobacterium avium
ADPKLAK

SEQ ID NO: 138613 - protein, 4 aa, Mycobacterium avium
ADPM

SEQ ID NO: 138614 - protein, 6 aa, Mycobacterium avium
ADPQFD

SEQ ID NO: 138615 - protein, 7 aa, Mycobacterium avium
ADPSVPF

SEQ ID NO: 138616 - protein, 10 aa, Mycobacterium avium
ADPSVPGANK

SEQ ID NO: 138617 - protein, 14 aa, Mycobacterium avium
ADQARGATATHYAQ

SEQ ID NO: 138618 - protein, 7 aa, Mycobacterium avium
ADREVAG

SEQ ID NO: 138619 - protein, 4 aa, Mycobacterium avium
ADRR

SEQ ID NO: 138620 - protein, 5 aa, Mycobacterium avium
ADSPV

SEQ ID NO: 138621 - protein, 19 aa, Mycobacterium avium
ADSTSYQKQTPSDAQAITN

SEQ ID NO: 138622 - protein, 8 aa, Mycobacterium avium
ADTGYGGP

SEQ ID NO: 138623 - protein, 12 aa, Mycobacterium avium
ADTTQTTADPAS

SEQ ID NO: 138624 - protein, 7 aa, Mycobacterium avium
ADVTPGS

SEQ ID NO: 138625 - protein, 7 aa, Mycobacterium avium
AEAESGV

SEQ ID NO: 138626 - protein, 6 aa, Mycobacterium avium
AEAGDA

SEQ ID NO: 138627 - protein, 4 aa, Mycobacterium avium
AEAI

SEQ ID NO: 138628 - protein, 10 aa, Mycobacterium avium
AEDDDEPYYP

SEQ ID NO: 138629 - protein, 7 aa, Mycobacterium avium
AEDTRRV

SEQ ID NO: 138630 - protein, 13 aa, Mycobacterium avium
AEIDTADAQNLEE

SEQ ID NO: 138631 - protein, 7 aa, Mycobacterium avium
AEPAGSS

SEQ ID NO: 138632 - protein, 5 aa, Mycobacterium avium
AEPAK

SEQ ID NO: 138633 - protein, 5 aa, Mycobacterium avium
AEPSA

SEQ ID NO: 138634 - protein, 5 aa, Mycobacterium avium
AETDT

SEQ ID NO: 138635 - protein, 19 aa, Mycobacterium avium
AEVTAPANQATFGGGADPL

SEQ ID NO: 138636 - protein, 13 aa, Mycobacterium avium
AGAALGQTVTLTL

SEQ ID NO: 138637 - protein, 33 aa, Mycobacterium avium
AGAAPGAPPPPGGHGAPPAGGPGHGGSQPGDFH

SEQ ID NO: 138638 - protein, 10 aa, Mycobacterium avium
AGAVGADDAI

SEQ ID NO: 138639 - protein, 14 aa, Mycobacterium avium
AGEGVRWSPGVTVV

SEQ ID NO: 138640 - protein, 13 aa, Mycobacterium avium
AGETAAGRKSRHD

SEQ ID NO: 138641 - protein, 7 aa, Mycobacterium avium
AGGLPGD

SEQ ID NO: 138642 - protein, 4 aa, Mycobacterium avium
AGGR

SEQ ID NO: 138643 - protein, 28 aa, Mycobacterium avium
AGGTASADPLPPAPAPVPAPAPANLGPE

SEQ ID NO: 138644 - protein, 23 aa, Mycobacterium avium
AGGTRTAEASPDVPPVSEAAKAA

SEQ ID NO: 138645 - protein, 4 aa, Mycobacterium avium
AGGV

SEQ ID NO: 138646 - protein, 10 aa, Mycobacterium avium
AGHEPGGSAV

SEQ ID NO: 138647 - protein, 11 aa, Mycobacterium avium
AGHHDPSSMTP

SEQ ID NO: 138648 - protein, 6 aa, Mycobacterium avium
AGKAGL

SEQ ID NO: 138649 - protein, 10 aa, Mycobacterium avium
AGKAPAEHAE

SEQ ID NO: 138650 - protein, 10 aa, Mycobacterium avium
AGKSDKPFTY

SEQ ID NO: 138651 - protein, 12 aa, Mycobacterium avium
AGLTGPPTASSL

SEQ ID NO: 138652 - protein, 6 aa, Mycobacterium avium
AGNRVT

SEQ ID NO: 138653 - protein, 12 aa, Mycobacterium avium
AGPAAARTVQTG

SEQ ID NO: 138654 - protein, 5 aa, Mycobacterium avium
AGPNY

SEQ ID NO: 138655 - protein, 15 aa, Mycobacterium avium
AGPPATGANDPCAAS

SEQ ID NO: 138656 - protein, 14 aa, Mycobacterium avium
AGPQGGWGKPPTPL

SEQ ID NO: 138657 - protein, 4 aa, Mycobacterium avium
AGPT

SEQ ID NO: 138658 - protein, 11 aa, Mycobacterium avium
AGPYQRDRGPS

SEQ ID NO: 138659 - protein, 8 aa, Mycobacterium avium
AGRNSDDL

SEQ ID NO: 138660 - protein, 11 aa, Mycobacterium avium
AGRQGSQSVPG

SEQ ID NO: 138661 - protein, 9 aa, Mycobacterium avium
AGSGTLGDR

SEQ ID NO: 138662 - protein, 9 aa, Mycobacterium avium
AGSQNAQGP

SEQ ID NO: 138663 - protein, 23 aa, Mycobacterium avium
AGSSGTLATPDNYDRSDAPSDGI

SEQ ID NO: 138664 - protein, 10 aa, Mycobacterium avium
AGTAGQPVYA

SEQ ID NO: 138665 - protein, 9 aa, Mycobacterium avium
AGTAPRETV

SEQ ID NO: 138666 - protein, 10 aa, Mycobacterium avium
AGTTADEQPL

SEQ ID NO: 138667 - protein, 4 aa, Mycobacterium avium
AGVN

SEQ ID NO: 138668 - protein, 8 aa, Mycobacterium avium
AGWSDDGM

SEQ ID NO: 138669 - protein, 14 aa, Mycobacterium avium
AGYGQGGDIHSPRD

SEQ ID NO: 138670 - protein, 9 aa, Mycobacterium avium
AGYPKPDHS

SEQ ID NO: 138671 - protein, 15 aa, Mycobacterium avium
AGYSRNDDPATAPVQ

SEQ ID NO: 138672 - protein, 7 aa, Mycobacterium avium
AGYTEQD

SEQ ID NO: 138673 - protein, 5 aa, Mycobacterium avium
AHATA

SEQ ID NO: 138674 - protein, 10 aa, Mycobacterium avium
AHDDTERGVP

SEQ ID NO: 138675 - protein, 8 aa, Mycobacterium avium
AHEPPETA

SEQ ID NO: 138676 - protein, 7 aa, Mycobacterium avium
AHPSEPG

SEQ ID NO: 138677 - protein, 16 aa, Mycobacterium avium
AHRNYDGVAQHNTAMW

SEQ ID NO: 138678 - protein, 14 aa, Mycobacterium avium
AIQPGSGEASTANN

SEQ ID NO: 138679 - protein, 9 aa, Mycobacterium avium
AKDGPTYYS

SEQ ID NO: 138680 - protein, 22 aa, Mycobacterium avium
AKGDQPLVTASGGPVYGSGLPS

SEQ ID NO: 138681 - protein, 8 aa, Mycobacterium avium
AKGSSSHA

SEQ ID NO: 138682 - protein, 6 aa, Mycobacterium avium
AKHTGG

SEQ ID NO: 138683 - protein, 9 aa, Mycobacterium avium
AKKAVDAGV

SEQ ID NO: 138684 - protein, 17 aa, Mycobacterium avium
AKPPGPASAPVAARPGL

SEQ ID NO: 138685 - protein, 9 aa, Mycobacterium avium
AKRRTQIRG

SEQ ID NO: 138686 - protein, 11 aa, Mycobacterium avium
AKSSAPRDQPY

SEQ ID NO: 138687 - protein, 8 aa, Mycobacterium avium
AKTTAELE

SEQ ID NO: 138688 - protein, 13 aa, Mycobacterium avium
AKVSASVGSAGHG

SEQ ID NO: 138689 - protein, 13 aa, Mycobacterium avium
AKYGSAIPPRGTE

SEQ ID NO: 138690 - protein, 19 aa, Mycobacterium avium
ALKGTPNESFPKPAEVGGY

SEQ ID NO: 138691 - protein, 6 aa, Mycobacterium avium
ALPAGV

SEQ ID NO: 138692 - protein, 8 aa, Mycobacterium avium
ALPAKDRA

SEQ ID NO: 138693 - protein, 13 aa, Mycobacterium avium
ALPDGASGQPAYL

SEQ ID NO: 138694 - protein, 17 aa, Mycobacterium avium
ALPTSDELAGLLAPTAP

SEQ ID NO: 138695 - protein, 13 aa, Mycobacterium avium
ALRDPGTSEPALT

SEQ ID NO: 138696 - protein, 7 aa, Mycobacterium avium
ALRGREP

SEQ ID NO: 138697 - protein, 9 aa, Mycobacterium avium
ALSAPPPAA

SEQ ID NO: 138698 - protein, 5 aa, Mycobacterium avium
ALTPG

SEQ ID NO: 138699 - protein, 16 aa, Mycobacterium avium
ANANGGNRADGTPGFQ

SEQ ID NO: 138700 - protein, 5 aa, Mycobacterium avium
ANEGE

SEQ ID NO: 138701 - protein, 8 aa, Mycobacterium avium
ANRYARAG

SEQ ID NO: 138702 - protein, 22 aa, Mycobacterium avium
ANSTPYDPDPMRAHSPASSYGA

SEQ ID NO: 138703 - protein, 9 aa, Mycobacterium avium
ANTATTNCT

SEQ ID NO: 138704 - protein, 8 aa, Mycobacterium avium
ANYPDEQP

SEQ ID NO: 138705 - protein, 8 aa, Mycobacterium avium
APADQPLT

SEQ ID NO: 138706 - protein, 7 aa, Mycobacterium avium
APAELAP

SEQ ID NO: 138707 - protein, 17 aa, Mycobacterium avium
APAHADPPPVPDGDDGG

SEQ ID NO: 138708 - protein, 21 aa, Mycobacterium avium
APALRGATAGLGGGLGGGLGN

SEQ ID NO: 138709 - protein, 15 aa, Mycobacterium avium
APAPADGERNPLRDN

SEQ ID NO: 138710 - protein, 38 aa, Mycobacterium avium; identical to SEQ ID NO: 7360

SEQ ID NO: 138711 - protein, 6 aa, Mycobacterium avium
APDPYA

SEQ ID NO: 138712 - protein, 6 aa, Mycobacterium avium
APGAAW

SEQ ID NO: 138713 - protein, 14 aa, Mycobacterium avium
APIKPGDSGGPMVN

SEQ ID NO: 138714 - protein, 20 aa, Mycobacterium avium
APQECGTGGQPTPEGRHRDG

SEQ ID NO: 138715 - protein, 8 aa, Mycobacterium avium
APSGGPGQ

SEQ ID NO: 138716 - protein, 13 aa, Mycobacterium avium
APTPAGANQLESP

SEQ ID NO: 138717 - protein, 10 aa, Mycobacterium avium
APTVAQSDGD

SEQ ID NO: 138718 - protein, 5 aa, Mycobacterium avium
AQAAA

SEQ ID NO: 138719 - protein, 9 aa, Mycobacterium avium
AQADPAADN

SEQ ID NO: 138720 - protein, 13 aa, Mycobacterium avium
AQAGAWQGPSAAS

SEQ ID NO: 138721 - protein, 5 aa, Mycobacterium avium
AQAKA

SEQ ID NO: 138722 - protein, 50 aa, Mycobacterium avium
AQGAAGGLPALPGNPAGASPLGGAAGPAGTPPAVPQPAGPLSGPPRGNTV

SEQ ID NO: 138723 - protein, 8 aa, Mycobacterium avium
AQGQAKAI

SEQ ID NO: 138724 - protein, 8 aa, Mycobacterium avium
AQPKTGAS

SEQ ID NO: 138725 - protein, 18 aa, Mycobacterium avium
AQPSGVGSEPEAAGLDDE

SEQ ID NO: 138726 - protein, 6 aa, Mycobacterium avium
AQPYGG

SEQ ID NO: 138727 - protein, 9 aa, Mycobacterium avium
AQSTDKRVN

SEQ ID NO: 138728 - protein, 4 aa, Mycobacterium avium
AQYK

SEQ ID NO: 138729 - protein, 9 aa, Mycobacterium avium
ARADSTDDA

SEQ ID NO: 138730 - protein, 4 aa, Mycobacterium avium
ARAE

SEQ ID NO: 138731 - protein, 17 aa, Mycobacterium avium
ARARTTNPSTLRGDPAL

SEQ ID NO: 138732 - protein, 7 aa, Mycobacterium avium
ARDNAEA

SEQ ID NO: 138733 - protein, 5 aa, Mycobacterium avium
AREAA

SEQ ID NO: 138734 - protein, 35 aa, Mycobacterium avium; identical to SEQ ID NO: 60971

SEQ ID NO: 138735 - protein, 7 aa, Mycobacterium avium
ARLGSGR

SEQ ID NO: 138736 - protein, 5 aa, Mycobacterium avium
ARNGC

SEQ ID NO: 138737 - protein, 4 aa, Mycobacterium avium
ARPG

SEQ ID NO: 138738 - protein, 7 aa, Mycobacterium avium
ARSDQID

SEQ ID NO: 138739 - protein, 6 aa, Mycobacterium avium
ARSGAP

SEQ ID NO: 138740 - protein, 5 aa, Mycobacterium avium
ARTGL

SEQ ID NO: 138741 - protein, 4 aa, Mycobacterium avium
ARTP

SEQ ID NO: 138742 - protein, 17 aa, Mycobacterium avium
ARTRAFNDAKSRAEQYA

SEQ ID NO: 138743 - protein, 6 aa, Mycobacterium avium
ASAEQI

SEQ ID NO: 138744 - protein, 8 aa, Mycobacterium avium
ASAGTGKT

SEQ ID NO: 138745 - protein, 16 aa, Mycobacterium avium
ASDPAAAQQLNSSPMA

SEQ ID NO: 138746 - protein, 7 aa, Mycobacterium avium
ASEAMST

SEQ ID NO: 138747 - protein, 7 aa, Mycobacterium avium
ASESTPQ

SEQ ID NO: 138748 - protein, 10 aa, Mycobacterium avium
ASGDAGGGQR

SEQ ID NO: 138749 - protein, 8 aa, Mycobacterium avium
ASGGPNCR

SEQ ID NO: 138750 - protein, 6 aa, Mycobacterium avium
ASGLPP

SEQ ID NO: 138751 - protein, 7 aa, Mycobacterium avium
ASGRASN

SEQ ID NO: 138752 - protein, 9 aa, Mycobacterium avium
ASGRSAPVR

SEQ ID NO: 138753 - protein, 8 aa, Mycobacterium avium
ASGVEEGR

SEQ ID NO: 138754 - protein, 5 aa, Mycobacterium avium
ASLAA

SEQ ID NO: 138755 - protein, 12 aa, Mycobacterium avium
ASPSGTAGSWNT

SEQ ID NO: 138756 - protein, 6 aa, Mycobacterium avium
ASQELR

SEQ ID NO: 138757 - protein, 7 aa, Mycobacterium avium
ASREHAR

SEQ ID NO: 138758 - protein, 5 aa, Mycobacterium avium
ASRTA

SEQ ID NO: 138759 - protein, 15 aa, Mycobacterium avium
ASSPIPAADYVAAHP

SEQ ID NO: 138760 - protein, 20 aa, Mycobacterium avium
ASSTDSGDRDDLKPGVPDRS

SEQ ID NO: 138761 - protein, 9 aa, Mycobacterium avium
ASTAGAQGP

SEQ ID NO: 138762 - protein, 8 aa, Mycobacterium avium
ASTTRHRA

SEQ ID NO: 138763 - protein, 10 aa, Mycobacterium avium
ASVANTGQVA

SEQ ID NO: 138764 - protein, 46 aa, Mycobacterium avium
ASVSGNTINVTGTDPSGNTTQTTVTVDDKTKYTKQSSANTDAITPG

SEQ ID NO: 138765 - protein, 6 aa, Mycobacterium avium
ATAGYG

SEQ ID NO: 138766 - protein, 6 aa, Mycobacterium avium
ATAHTG

SEQ ID NO: 138767 - protein, 19 aa, Mycobacterium avium
ATAPGADPSITRTDEGTAR

SEQ ID NO: 138768 - protein, 8 aa, Mycobacterium avium
ATAPSGAR

SEQ ID NO: 138769 - protein, 15 aa, Mycobacterium avium
ATARKPKLRYPAGPL

SEQ ID NO: 138770 - protein, 6 aa, Mycobacterium avium
ATDGAT

SEQ ID NO: 138771 - protein, 4 aa, Mycobacterium avium
ATFG

SEQ ID NO: 138772 - protein, 10 aa, Mycobacterium avium
ATFTGSPAAR

SEQ ID NO: 138773 - protein, 8 aa, Mycobacterium avium
ATGEMSGD

SEQ ID NO: 138774 - protein, 8 aa, Mycobacterium avium
ATGTAGSR

SEQ ID NO: 138775 - protein, 12 aa, Mycobacterium avium
ATHTTRPPSCRQ

SEQ ID NO: 138776 - protein, 7 aa, Mycobacterium avium
ATKGGVG

SEQ ID NO: 138777 - protein, 31 aa, Mycobacterium avium; identical to SEQ ID NO: 61420

SEQ ID NO: 138778 - protein, 16 aa, Mycobacterium avium
ATPPAPEAPPSAGGGP

SEQ ID NO: 138779 - protein, 13 aa, Mycobacterium avium
ATPQSAPPPGAIT

SEQ ID NO: 138780 - protein, 7 aa, Mycobacterium avium
ATPRTDL

SEQ ID NO: 138781 - protein, 5 aa, Mycobacterium avium
ATRHH

SEQ ID NO: 138782 - protein, 16 aa, Mycobacterium avium
ATSEEVREDLGVRDNA

SEQ ID NO: 138783 - protein, 7 aa, Mycobacterium avium
ATSVGDV

SEQ ID NO: 138784 - protein, 9 aa, Mycobacterium avium
ATSVTDTGF

SEQ ID NO: 138785 - protein, 16 aa, Mycobacterium avium
ATTEQHSAGQPPHNTR

SEQ ID NO: 138786 - protein, 5 aa, Mycobacterium avium
ATTGA

SEQ ID NO: 138787 - protein, 12 aa, Mycobacterium avium
ATTNPEGSTGDG

SEQ ID NO: 138788 - protein, 11 aa, Mycobacterium avium
ATVPEGSPAEI

SEQ ID NO: 138789 - protein, 6 aa, Mycobacterium avium
AVGAGT

SEQ ID NO: 138790 - protein, 14 aa, Mycobacterium avium
AVGGPDDPEFHPPR

SEQ ID NO: 138791 - protein, 13 aa, Mycobacterium avium
AVPADTTDTPTPC

SEQ ID NO: 138792 - protein, 14 aa, Mycobacterium avium
AVPGEDEAAADDNN

SEQ ID NO: 138793 - protein, 35 aa, Mycobacterium avium
AVQAGGSGRAAAAHAGRNADPATSAMNTPSAAATA

SEQ ID NO: 138794 - protein, 8 aa, Mycobacterium avium
AVRPATPV

SEQ ID NO: 138795 - protein, 10 aa, Mycobacterium avium
AVTSGSPHFR

SEQ ID NO: 138796 - protein, 10 aa, Mycobacterium avium
AYGGASEGRR

SEQ ID NO: 138797 - protein, 9 aa, Mycobacterium avium
AYGGGGAGN

SEQ ID NO: 138798 - protein, 6 aa, Mycobacterium avium
AYTRTS

SEQ ID NO: 138799 - protein, 7 aa, Mycobacterium avium
AYTSPAD

SEQ ID NO: 138800 - protein, 8 aa, Mycobacterium avium
CANGSGGQ

SEQ ID NO: 138801 - protein, 9 aa, Mycobacterium avium
CATGNTTAK

SEQ ID NO: 138802 - protein, 16 aa, Mycobacterium avium
CEPNSVAPTGGAPGNF

SEQ ID NO: 138803 - protein, 8 aa, Mycobacterium avium
CESGGNWG

SEQ ID NO: 138804 - protein, 11 aa, Mycobacterium avium
CGGKPDPGPLS

SEQ ID NO: 138805 - protein, 23 aa, Mycobacterium avium
CGPPSSTTAGDVTTQTAGCADGR

SEQ ID NO: 138806 - protein, 4 aa, Mycobacterium avium
CPPN

SEQ ID NO: 138807 - protein, 16 aa, Mycobacterium avium
CPTGSADSTPDSPPFP

SEQ ID NO: 138808 - protein, 14 aa, Mycobacterium avium
CRGGGGVVTDRGGT

SEQ ID NO: 138809 - protein, 30 aa, Mycobacterium avium
CSAPRPAAGGGTPSTQTPVTAAPAAAGPNQ

SEQ ID NO: 138810 - protein, 57 aa, Mycobacterium avium
CSKSNNAGQTTSSASSSATSSATSGTSASAAPSESTGTSGAPSSTQINGANGTPYTV

SEQ ID NO: 138811 - protein, 27 aa, Mycobacterium avium
CSPSHPSAAPRPTATRTAAPSAPASRM

SEQ ID NO: 138812 - protein, 18 aa, Mycobacterium avium
DAAEAAPRAAREARENEL

SEQ ID NO: 138813 - protein, 9 aa, Mycobacterium avium
DAASVDAAA

SEQ ID NO: 138814 - protein, 8 aa, Mycobacterium avium
DADAPIDA

SEQ ID NO: 138815 - protein, 9 aa, Mycobacterium avium
DADGQPCPT

SEQ ID NO: 138816 - protein, 6 aa, Mycobacterium avium
DADTYQ

SEQ ID NO: 138817 - protein, 10 aa, Mycobacterium avium
DAESGTAETI

SEQ ID NO: 138818 - protein, 12 aa, Mycobacterium avium
DAGGTVTNFQTG

SEQ ID NO: 138819 - protein, 10 aa, Mycobacterium avium
DAGPAPAYLS

SEQ ID NO: 138820 - protein, 10 aa, Mycobacterium avium
DAGPNGRNAM

SEQ ID NO: 138821 - protein, 7 aa, Mycobacterium avium
DAGRPRN

SEQ ID NO: 138822 - protein, 22 aa, Mycobacterium avium
DAHESPSSWHKDGSSASAGQAA

SEQ ID NO: 138823 - protein, 7 aa, Mycobacterium avium
DAKIGDS

SEQ ID NO: 138824 - protein, 14 aa, Mycobacterium avium
DALPATGAAEGGFN

SEQ ID NO: 138825 - protein, 10 aa, Mycobacterium avium
DANPKVAGDM

SEQ ID NO: 138826 - protein, 4 aa, Mycobacterium avium
DAPI

SEQ ID NO: 138827 - protein, 11 aa, Mycobacterium avium
DAPRAAATDDR

SEQ ID NO: 138828 - protein, 4 aa, Mycobacterium avium
DARP

SEQ ID NO: 138829 - protein, 7 aa, Mycobacterium avium
DCHEAAE

SEQ ID NO: 138830 - protein, 4 aa, Mycobacterium avium
DDGG

SEQ ID NO: 138831 - protein, 8 aa, Mycobacterium avium
DDPAPDAW

SEQ ID NO: 138832 - protein, 25 aa, Mycobacterium avium
DDPNRFTESTPYNPSSPYSATKAAA

SEQ ID NO: 138833 - protein, 8 aa, Mycobacterium avium
DDRPYSAT

SEQ ID NO: 138834 - protein, 5 aa, Mycobacterium avium
DEASN

SEQ ID NO: 138835 - protein, 20 aa, Mycobacterium avium
DEEPHTVAASDGSFHSPGMG

SEQ ID NO: 138836 - protein, 7 aa, Mycobacterium avium
DFPDRPD

SEQ ID NO: 138837 - protein, 14 aa, Mycobacterium avium
DFQGPRDTADNINR

SEQ ID NO: 138838 - protein, 15 aa, Mycobacterium avium
DGAASQGAAEKAAMD

SEQ ID NO: 138839 - protein, 7 aa, Mycobacterium avium
DGAPLDD

SEQ ID NO: 138840 - protein, 13 aa, Mycobacterium avium
DGARFDESAPGQW

SEQ ID NO: 138841 - protein, 16 aa, Mycobacterium avium
DGGERTANITLAEGPP

SEQ ID NO: 138842 - protein, 5 aa, Mycobacterium avium
DGGSG

SEQ ID NO: 138843 - protein, 7 aa, Mycobacterium avium
DGNREGQ

SEQ ID NO: 138844 - protein, 12 aa, Mycobacterium avium
DGPAGSAPDASK

SEQ ID NO: 138845 - protein, 12 aa, Mycobacterium avium
DGPAGSPPDPGK

SEQ ID NO: 138846 - protein, 4 aa, Mycobacterium avium
DGPE

SEQ ID NO: 138847 - protein, 5 aa, Mycobacterium avium
DGPHI

SEQ ID NO: 138848 - protein, 7 aa, Mycobacterium avium
DGPRRFR

SEQ ID NO: 138849 - protein, 13 aa, Mycobacterium avium
DGPSVGESVAEGI

SEQ ID NO: 138850 - protein, 11 aa, Mycobacterium avium
DGPTDTLAPPE

SEQ ID NO: 138851 - protein, 4 aa, Mycobacterium avium
DGQA

SEQ ID NO: 138852 - protein, 10 aa, Mycobacterium avium
DGRTGETTAM

SEQ ID NO: 138853 - protein, 7 aa, Mycobacterium avium
DGSHESL

SEQ ID NO: 138854 - protein, 19 aa, Mycobacterium avium
DGSTVYPGARSANAPYSGG

SEQ ID NO: 138855 - protein, 7 aa, Mycobacterium avium
DGTAFTG

SEQ ID NO: 138856 - protein, 6 aa, Mycobacterium avium
DGTEHR

SEQ ID NO: 138857 - protein, 8 aa, Mycobacterium avium
DGTGPELT

SEQ ID NO: 138858 - protein, 6 aa, Mycobacterium avium
DGTTVA

SEQ ID NO: 138859 - protein, 7 aa, Mycobacterium avium
DGVAATA

SEQ ID NO: 138860 - protein, 6 aa, Mycobacterium avium
DHGGSL

SEQ ID NO: 138861 - protein, 13 aa, Mycobacterium avium
DKARSRATGGSGL

SEQ ID NO: 138862 - protein, 8 aa, Mycobacterium avium
DKVESVQT

SEQ ID NO: 138863 - protein, 6 aa, Mycobacterium avium
DKVYSG

SEQ ID NO: 138864 - protein, 8 aa, Mycobacterium avium
DNPTTGPV

SEQ ID NO: 138865 - protein, 8 aa, Mycobacterium avium
DNRTQLKP

SEQ ID NO: 138866 - protein, 12 aa, Mycobacterium avium
DNTPSGTTVSTS

SEQ ID NO: 138867 - protein, 16 aa, Mycobacterium avium
DPADEALRQATRESLE

SEQ ID NO: 138868 - protein, 4 aa, Mycobacterium avium
DPAG

SEQ ID NO: 138869 - protein, 9 aa, Mycobacterium avium
DPAQTTGDT

SEQ ID NO: 138870 - protein, 23 aa, Mycobacterium avium
DPAQVGGPEKLYRGGRSASQSGC

SEQ ID NO: 138871 - protein, 6 aa, Mycobacterium avium
DPASLP

SEQ ID NO: 138872 - protein, 4 aa, Mycobacterium avium
DPAT

SEQ ID NO: 138873 - protein, 17 aa, Mycobacterium avium
DPDAPAAPTPLAGWKVH

SEQ ID NO: 138874 - protein, 18 aa, Mycobacterium avium
DPDWDEPATTASPRGAGN

SEQ ID NO: 138875 - protein, 6 aa, Mycobacterium avium
DPFAPD

SEQ ID NO: 138876 - protein, 4 aa, Mycobacterium avium
DPGY

SEQ ID NO: 138877 - protein, 5 aa, Mycobacterium avium
DPHDG

SEQ ID NO: 138878 - protein, 6 aa, Mycobacterium avium
DPIVGT

SEQ ID NO: 138879 - protein, 8 aa, Mycobacterium avium
DPLDDGAP

SEQ ID NO: 138880 - protein, 16 aa, Mycobacterium avium
DPLPDAHGARRGVPQG

SEQ ID NO: 138881 - protein, 7 aa, Mycobacterium avium
DPLPDGE

SEQ ID NO: 138882 - protein, 4 aa, Mycobacterium avium
DPRE

SEQ ID NO: 138883 - protein, 33 aa, Mycobacterium avium
DPRFATNSGARPQGAATSKPAPGGPPPLAAPKN

SEQ ID NO: 138884 - protein, 7 aa, Mycobacterium avium
DPRLAGS

SEQ ID NO: 138885 - protein, 4 aa, Mycobacterium avium
DPRM

SEQ ID NO: 138886 - protein, 4 aa, Mycobacterium avium
DPRV

SEQ ID NO: 138887 - protein, 30 aa, Mycobacterium avium
DPSTFGNASPIGGGGTGLGGGSSSGGSGGL

SEQ ID NO: 138888 - protein, 6 aa, Mycobacterium avium
DPWNPS

SEQ ID NO: 138889 - protein, 8 aa, Mycobacterium avium
DQAADDVL

SEQ ID NO: 138890 - protein, 17 aa, Mycobacterium avium
DQASTGVLRQAAATCPA

SEQ ID NO: 138891 - protein, 21 aa, Mycobacterium avium
DQEQGKTEEIAYTPAKTTASV

SEQ ID NO: 138892 - protein, 7 aa, Mycobacterium avium
DQKLPSE

SEQ ID NO: 138893 - protein, 12 aa, Mycobacterium avium
DRAAGKTPDELA

SEQ ID NO: 138894 - protein, 8 aa, Mycobacterium avium
DRDGDKLD

SEQ ID NO: 138895 - protein, 5 aa, Mycobacterium avium
DRPAA

SEQ ID NO: 138896 - protein, 9 aa, Mycobacterium avium
DRPAAQRFT

SEQ ID NO: 138897 - protein, 7 aa, Mycobacterium avium
DRPPSPP

SEQ ID NO: 138898 - protein, 4 aa, Mycobacterium avium
DRTQ

SEQ ID NO: 138899 - protein, 10 aa, Mycobacterium avium
DRTRGRADTY

SEQ ID NO: 138900 - protein, 5 aa, Mycobacterium avium
DRTTQ

SEQ ID NO: 138901 - protein, 4 aa, Mycobacterium avium
DSPL

SEQ ID NO: 138902 - protein, 4 aa, Mycobacterium avium
DSPV

SEQ ID NO: 138903 - protein, 5 aa, Mycobacterium avium
DSTGH

SEQ ID NO: 138904 - protein, 8 aa, Mycobacterium avium
DTARDPGH

SEQ ID NO: 138905 - protein, 4 aa, Mycobacterium avium
DTDI

SEQ ID NO: 138906 - protein, 24 aa, Mycobacterium avium
DTKPPLPGGDPQSSVLNRVEYGNR

SEQ ID NO: 138907 - protein, 23 aa, Mycobacterium avium
DTNADSYGATEAANRVNTSAAAL

SEQ ID NO: 138908 - protein, 7 aa, Mycobacterium avium
DTVPAPV

SEQ ID NO: 138909 - protein, 8 aa, Mycobacterium avium
DVAEPGNR

SEQ ID NO: 138910 - protein, 15 aa, Mycobacterium avium
DVTSGQGRDNAVDTD

SEQ ID NO: 138911 - protein, 6 aa, Mycobacterium avium
DVTTGT

SEQ ID NO: 138912 - protein, 5 aa, Mycobacterium avium
DYDRP

SEQ ID NO: 138913 - protein, 4 aa, Mycobacterium avium
EAAY

SEQ ID NO: 138914 - protein, 12 aa, Mycobacterium avium
EAGEQSDAERPV

SEQ ID NO: 138915 - protein, 11 aa, Mycobacterium avium
EAPAPPQNTPV

SEQ ID NO: 138916 - protein, 13 aa, Mycobacterium avium
EAPDRHRVDEQSL

SEQ ID NO: 138917 - protein, 8 aa, Mycobacterium avium
EAQGVTNG

SEQ ID NO: 138918 - protein, 8 aa, Mycobacterium avium
EAQKPQGF

SEQ ID NO: 138919 - protein, 23 aa, Mycobacterium avium
EAQQSAGPAPGGRSGGPRHAAPS

SEQ ID NO: 138920 - protein, 10 aa, Mycobacterium avium
EATRRGEAAP

SEQ ID NO: 138921 - protein, 16 aa, Mycobacterium avium
EAVQSADGHSLSRPTW

SEQ ID NO: 138922 - protein, 6 aa, Mycobacterium avium
EDAYTY

SEQ ID NO: 138923 - protein, 4 aa, Mycobacterium avium
EDPV

SEQ ID NO: 138924 - protein, 5 aa, Mycobacterium avium
EDPVC

SEQ ID NO: 138925 - protein, 7 aa, Mycobacterium avium
EDPVRRT

SEQ ID NO: 138926 - protein, 4 aa, Mycobacterium avium
EDQR

SEQ ID NO: 138927 - protein, 17 aa, Mycobacterium avium
EDTENAMDRVACGVIGT

SEQ ID NO: 138928 - protein, 7 aa, Mycobacterium avium
EEAMPAD

SEQ ID NO: 138929 - protein, 10 aa, Mycobacterium avium
EEFGGDTAFT

SEQ ID NO: 138930 - protein, 6 aa, Mycobacterium avium
EGAKQA

SEQ ID NO: 138931 - protein, 10 aa, Mycobacterium avium
EGATPESAAT

SEQ ID NO: 138932 - protein, 6 aa, Mycobacterium avium
EGGTAV

SEQ ID NO: 138933 - protein, 4 aa, Mycobacterium avium
EGMP

SEQ ID NO: 138934 - protein, 27 aa, Mycobacterium avium
EGPPDKYETHGRIDSTDWQTGQPKTDN

SEQ ID NO: 138935 - protein, 5 aa, Mycobacterium avium
EGTPP

SEQ ID NO: 138936 - protein, 18 aa, Mycobacterium avium
EGVTDEDVAAAGKTAKQN

SEQ ID NO: 138937 - protein, 7 aa, Mycobacterium avium
EHGSPQV

SEQ ID NO: 138938 - protein, 11 aa, Mycobacterium avium
EIEQRRGDLPN

SEQ ID NO: 138939 - protein, 6 aa, Mycobacterium avium
EKDPVK

SEQ ID NO: 138940 - protein, 12 aa, Mycobacterium avium
ELDPDKARALAN

SEQ ID NO: 138941 - protein, 11 aa, Mycobacterium avium
ELKTPDGRSVA

SEQ ID NO: 138942 - protein, 6 aa, Mycobacterium avium
ELPRGD

SEQ ID NO: 138943 - protein, 5 aa, Mycobacterium avium
ELRTG

SEQ ID NO: 138944 - protein, 5 aa, Mycobacterium avium
ELTPS

SEQ ID NO: 138945 - protein, 9 aa, Mycobacterium avium
ENGVSQNEG

SEQ ID NO: 138946 - protein, 4 aa, Mycobacterium avium
ENPA

SEQ ID NO: 138947 - protein, 9 aa, Mycobacterium avium
ENPGTPKGL

SEQ ID NO: 138948 - protein, 4 aa, Mycobacterium avium
ENPM

SEQ ID NO: 138949 - protein, 5 aa, Mycobacterium avium
EPANA

SEQ ID NO: 138950 - protein, 5 aa, Mycobacterium avium
EPATI

SEQ ID NO: 138951 - protein, 9 aa, Mycobacterium avium
EPGAAPDVQ

SEQ ID NO: 138952 - protein, 6 aa, Mycobacterium avium
EPGQQT

SEQ ID NO: 138953 - protein, 19 aa, Mycobacterium avium
EPGRGPRRYTAGGHRVPAS

SEQ ID NO: 138954 - protein, 7 aa, Mycobacterium avium
EPHSGIR

SEQ ID NO: 138955 - protein, 8 aa, Mycobacterium avium
EPPAPADE

SEQ ID NO: 138956 - protein, 18 aa, Mycobacterium avium
EPRPSSAGCGPGDPGTAF

SEQ ID NO: 138957 - protein, 14 aa, Mycobacterium avium
EPYDDSEDKTRQQL

SEQ ID NO: 138958 - protein, 4 aa, Mycobacterium avium
EQGP

SEQ ID NO: 138959 - protein, 6 aa, Mycobacterium avium
EQGRGK

SEQ ID NO: 138960 - protein, 7 aa, Mycobacterium avium
EQTQAGQ

SEQ ID NO: 138961 - protein, 9 aa, Mycobacterium avium
EQVAEQLSR

SEQ ID NO: 138962 - protein, 17 aa, Mycobacterium avium
EQYDAGQPGSVEQAVRT

SEQ ID NO: 138963 - protein, 6 aa, Mycobacterium avium
ERDETS

SEQ ID NO: 138964 - protein, 42 aa, Mycobacterium avium
ERDQAQAKLEAAKRQLSTPGSGDRWETGSAGAPAPSAGRQWD

SEQ ID NO: 138965 - protein, 9 aa, Mycobacterium avium
ERGSAEPAV

SEQ ID NO: 138966 - protein, 6 aa, Mycobacterium avium
ERQTPL

SEQ ID NO: 138967 - protein, 13 aa, Mycobacterium avium
ERVTAGPAAINQS

SEQ ID NO: 138968 - protein, 9 aa, Mycobacterium avium
ESEAHAKDR

SEQ ID NO: 138969 - protein, 4 aa, Mycobacterium avium
ESFP

SEQ ID NO: 138970 - protein, 16 aa, Mycobacterium avium
ESGHAGGGAVDARGTA

SEQ ID NO: 138971 - protein, 6 aa, Mycobacterium avium
ETAPQC

SEQ ID NO: 138972 - protein, 8 aa, Mycobacterium avium
ETCGTVES

SEQ ID NO: 138973 - protein, 4 aa, Mycobacterium avium
ETGV

SEQ ID NO: 138974 - protein, 13 aa, Mycobacterium avium
ETHPPTRPDSTSI

SEQ ID NO: 138975 - protein, 11 aa, Mycobacterium avium
ETLAAGGDALT

SEQ ID NO: 138976 - protein, 4 aa, Mycobacterium avium
ETRI

SEQ ID NO: 138977 - protein, 8 aa, Mycobacterium avium
EVQPGERL

SEQ ID NO: 138978 - protein, 4 aa, Mycobacterium avium
EVSA

SEQ ID NO: 138979 - protein, 15 aa, Mycobacterium avium
EWPEPAESLPPPYDN

SEQ ID NO: 138980 - protein, 9 aa, Mycobacterium avium
EYASAAEEL

SEQ ID NO: 138981 - protein, 6 aa, Mycobacterium avium
EYNGSI

SEQ ID NO: 138982 - protein, 4 aa, Mycobacterium avium
FAAD

SEQ ID NO: 138983 - protein, 5 aa, Mycobacterium avium
FAGQG

SEQ ID NO: 138984 - protein, 14 aa, Mycobacterium avium
FAPVPGAAGIPNFN

SEQ ID NO: 138985 - protein, 5 aa, Mycobacterium avium
FDPER

SEQ ID NO: 138986 - protein, 26 aa, Mycobacterium avium
FDRSGGDFDISTGNKNGTGGCLAPSG

SEQ ID NO: 138987 - protein, 11 aa, Mycobacterium avium
FEPSRTGRTEL

SEQ ID NO: 138988 - protein, 10 aa, Mycobacterium avium
FGDGALKGKP

SEQ ID NO: 138989 - protein, 10 aa, Mycobacterium avium
FGLPKNSRLG

SEQ ID NO: 138990 - protein, 4 aa, Mycobacterium avium
FPGP

SEQ ID NO: 138991 - protein, 9 aa, Mycobacterium avium
FPSTTAKTT

SEQ ID NO: 138992 - protein, 5 aa, Mycobacterium avium
FQDGN

SEQ ID NO: 138993 - protein, 9 aa, Mycobacterium avium
FQDPPDGAL

SEQ ID NO: 138994 - protein, 4 aa, Mycobacterium avium
FTGL

SEQ ID NO: 138995 - protein, 4 aa, Mycobacterium avium
FTRR

SEQ ID NO: 138996 - protein, 14 aa, Mycobacterium avium
GAAAYRDADTARRA

SEQ ID NO: 138997 - protein, 18 aa, Mycobacterium avium
GAAHADPNVDPRPQPPGI

SEQ ID NO: 138998 - protein, 8 aa, Mycobacterium avium
GAAPNLGS

SEQ ID NO: 138999 - protein, 7 aa, Mycobacterium avium
GAAPTAE

SEQ ID NO: 139000 - protein, 16 aa, Mycobacterium avium
GAASPNHGAVDPEAAP

SEQ ID NO: 139001 - protein, 4 aa, Mycobacterium avium
GAAT

SEQ ID NO: 139002 - protein, 10 aa, Mycobacterium avium
GAATARAGAV

SEQ ID NO: 139003 - protein, 9 aa, Mycobacterium avium
GAATPSYGL

SEQ ID NO: 139004 - protein, 5 aa, Mycobacterium avium
GADKT

SEQ ID NO: 139005 - protein, 6 aa, Mycobacterium avium
GAEPCT

SEQ ID NO: 139006 - protein, 8 aa, Mycobacterium avium
GAEPVGEP

SEQ ID NO: 139007 - protein, 4 aa, Mycobacterium avium
GAER

SEQ ID NO: 139008 - protein, 7 aa, Mycobacterium avium
GAESGAR

SEQ ID NO: 139009 - protein, 7 aa, Mycobacterium avium
GAEVSDT

SEQ ID NO: 139010 - protein, 8 aa, Mycobacterium avium
GAGGGRRP

SEQ ID NO: 139011 - protein, 7 aa, Mycobacterium avium
GAGPAAM

SEQ ID NO: 139012 - protein, 66 aa, Mycobacterium avium
GAGQSVPGYGPSVPGAGPQSPGYGQQSPVYGQTPPGSGPSIHDNAPGPGTAPAPAVPSTPPSQAPL

SEQ ID NO: 139013 - protein, 26 aa, Mycobacterium avium
GAGRGFSSGAGISADDVSDGGGVPPD

SEQ ID NO: 139014 - protein, 53 aa, Mycobacterium avium; identical to SEQ ID NO: 8058

SEQ ID NO: 139015 - protein, 5 aa, Mycobacterium avium
GAGVT

SEQ ID NO: 139016 - protein, 9 aa, Mycobacterium avium
GANGTQDGG

SEQ ID NO: 139017 - protein, 10 aa, Mycobacterium avium
GANVPTPDQL

SEQ ID NO: 139018 - protein, 13 aa, Mycobacterium avium
GAPDALGADPASI

SEQ ID NO: 139019 - protein, 5 aa, Mycobacterium avium
GAPDM

SEQ ID NO: 139020 - protein, 6 aa, Mycobacterium avium
GAPGSI

SEQ ID NO: 139021 - protein, 6 aa, Mycobacterium avium
GAPNPY

SEQ ID NO: 139022 - protein, 7 aa, Mycobacterium avium
GAPPAQL

SEQ ID NO: 139023 - protein, 5 aa, Mycobacterium avium
GAPRL

SEQ ID NO: 139024 - protein, 16 aa, Mycobacterium avium
GAPRYGVKPTVMPKPA

SEQ ID NO: 139025 - protein, 14 aa, Mycobacterium avium
GASLTEAQSKQESG

SEQ ID NO: 139026 - protein, 7 aa, Mycobacterium avium
GASPQQL

SEQ ID NO: 139027 - protein, 7 aa, Mycobacterium avium
GASPRAE

SEQ ID NO: 139028 - protein, 8 aa, Mycobacterium avium
GAWGGRAD

SEQ ID NO: 139029 - protein, 36 aa, Mycobacterium avium
GCGGGGKGSSPGSGSPTPSSSSGAVTGPPPGQPSDY

SEQ ID NO: 139030 - protein, 9 aa, Mycobacterium avium
GCRASPAGG

SEQ ID NO: 139031 - protein, 7 aa, Mycobacterium avium
GCSGQTT

SEQ ID NO: 139032 - protein, 8 aa, Mycobacterium avium
GDELTSRP

SEQ ID NO: 139033 - protein, 4 aa, Mycobacterium avium
GDGP

SEQ ID NO: 139034 - protein, 11 aa, Mycobacterium avium
GDLQGGSTITQ

SEQ ID NO: 139035 - protein, 6 aa, Mycobacterium avium
GDPICS

SEQ ID NO: 139036 - protein, 9 aa, Mycobacterium avium
GDQKGGTEA

SEQ ID NO: 139037 - protein, 19 aa, Mycobacterium avium
GDTATAAQLSDNPNEAREA

SEQ ID NO: 139038 - protein, 18 aa, Mycobacterium avium
GDTGYTKTFAQTGAEHGP

SEQ ID NO: 139039 - protein, 22 aa, Mycobacterium avium
GDVGPNATADGPPSQNPSGITG

SEQ ID NO: 139040 - protein, 9 aa, Mycobacterium avium
GEDNTTITG

SEQ ID NO: 139041 - protein, 6 aa, Mycobacterium avium
GEEPSA

SEQ ID NO: 139042 - protein, 11 aa, Mycobacterium avium
GENAPPGTVST

SEQ ID NO: 139043 - protein, 16 aa, Mycobacterium avium
GENGAPVRRSAGGEAA

SEQ ID NO: 139044 - protein, 9 aa, Mycobacterium avium
GERADPRAV

SEQ ID NO: 139045 - protein, 10 aa, Mycobacterium avium
GERAETPGHD

SEQ ID NO: 139046 - protein, 4 aa, Mycobacterium avium
GEVG

SEQ ID NO: 139047 - protein, 37 aa, Mycobacterium avium; identical to SEQ ID NO: 65236

SEQ ID NO: 139048 - protein, 8 aa, Mycobacterium avium
GFDAAQPT

SEQ ID NO: 139049 - protein, 6 aa, Mycobacterium avium
GGAGSD

SEQ ID NO: 139050 - protein, 6 aa, Mycobacterium avium
GGAPDD

SEQ ID NO: 139051 - protein, 7 aa, Mycobacterium avium
GGAPNPY

SEQ ID NO: 139052 - protein, 9 aa, Mycobacterium avium
GGDATGAEV

SEQ ID NO: 139053 - protein, 7 aa, Mycobacterium avium
GGEEPAT

SEQ ID NO: 139054 - protein, 18 aa, Mycobacterium avium
GGGNQPWTHPDDAPQPAT

SEQ ID NO: 139055 - protein, 15 aa, Mycobacterium avium
GGGTAKEAEKKEQPA

SEQ ID NO: 139056 - protein, 6 aa, Mycobacterium avium
GGIGEK

SEQ ID NO: 139057 - protein, 8 aa, Mycobacterium avium
GGIKPGNA

SEQ ID NO: 139058 - protein, 18 aa, Mycobacterium avium
GGINGPTRGTGTGANTVG

SEQ ID NO: 139059 - protein, 6 aa, Mycobacterium avium
GGNDGI

SEQ ID NO: 139060 - protein, 4 aa, Mycobacterium avium
GGNL

SEQ ID NO: 139061 - protein, 21 aa, Mycobacterium avium
GGPAGPADENWTKQEAGTDRR

SEQ ID NO: 139062 - protein, 8 aa, Mycobacterium avium
GGPQHPEI

SEQ ID NO: 139063 - protein, 4 aa, Mycobacterium avium
GGSF

SEQ ID NO: 139064 - protein, 5 aa, Mycobacterium avium
GGSGR

SEQ ID NO: 139065 - protein, 9 aa, Mycobacterium avium
GGSQSPKES

SEQ ID NO: 139066 - protein, 14 aa, Mycobacterium avium
GHATADPAVTASPG

SEQ ID NO: 139067 - protein, 9 aa, Mycobacterium avium
GHPAPPAVG

SEQ ID NO: 139068 - protein, 12 aa, Mycobacterium avium
GHPDPSSGTIDA

SEQ ID NO: 139069 - protein, 8 aa, Mycobacterium avium
GHPGGAGF

SEQ ID NO: 139070 - protein, 4 aa, Mycobacterium avium
GHTR

SEQ ID NO: 139071 - protein, 17 aa, Mycobacterium avium
GHYQAPGHTGKPESGDL

SEQ ID NO: 139072 - protein, 5 aa, Mycobacterium avium
GIDRQ

SEQ ID NO: 139073 - protein, 14 aa, Mycobacterium avium
GIKYGDADKAAGAG

SEQ ID NO: 139074 - protein, 12 aa, Mycobacterium avium
GIPAPSTALDAT

SEQ ID NO: 139075 - protein, 10 aa, Mycobacterium avium
GIPGDESTSD

SEQ ID NO: 139076 - protein, 13 aa, Mycobacterium avium
GIPGSAGATPIQN

SEQ ID NO: 139077 - protein, 5 aa, Mycobacterium avium
GIRPA

SEQ ID NO: 139078 - protein, 11 aa, Mycobacterium avium
GITGPKFAGPV

SEQ ID NO: 139079 - protein, 7 aa, Mycobacterium avium
GITYQDA

SEQ ID NO: 139080 - protein, 8 aa, Mycobacterium avium
GKDSPDFK

SEQ ID NO: 139081 - protein, 4 aa, Mycobacterium avium
GKLH

SEQ ID NO: 139082 - protein, 5 aa, Mycobacterium avium
GKPAL

SEQ ID NO: 139083 - protein, 4 aa, Mycobacterium avium
GKRA

SEQ ID NO: 139084 - protein, 27 aa, Mycobacterium avium
GKRAATPRECRSTEPYVPQGTNPWYGD

SEQ ID NO: 139085 - protein, 9 aa, Mycobacterium avium
GLARPQQKF

SEQ ID NO: 139086 - protein, 7 aa, Mycobacterium avium
GLDPSAP

SEQ ID NO: 139087 - protein, 5 aa, Mycobacterium avium
GLKGE

SEQ ID NO: 139088 - protein, 8 aa, Mycobacterium avium
GLNVPPEA

SEQ ID NO: 139089 - protein, 12 aa, Mycobacterium avium
GLPGYTGGDGGR

SEQ ID NO: 139090 - protein, 8 aa, Mycobacterium avium
GLPPPQTQ

SEQ ID NO: 139091 - protein, 6 aa, Mycobacterium avium
GLPPVR

SEQ ID NO: 139092 - protein, 6 aa, Mycobacterium avium
GLQTGS

SEQ ID NO: 139093 - protein, 7 aa, Mycobacterium avium
GLYGRSD

SEQ ID NO: 139094 - protein, 14 aa, Mycobacterium avium
GMTTGASQPKTTVQ

SEQ ID NO: 139095 - protein, 14 aa, Mycobacterium avium
GMTTSEQSGPISTT

SEQ ID NO: 139096 - protein, 5 aa, Mycobacterium avium
GNAIT

SEQ ID NO: 139097 - protein, 9 aa, Mycobacterium avium
GNAPDRSKG

SEQ ID NO: 139098 - protein, 8 aa, Mycobacterium avium
GNGEQAER

SEQ ID NO: 139099 - protein, 6 aa, Mycobacterium avium
GNGQTY

SEQ ID NO: 139100 - protein, 10 aa, Mycobacterium avium
GNHQTPNGTY

SEQ ID NO: 139101 - protein, 9 aa, Mycobacterium avium
GNPSGRAGR

SEQ ID NO: 139102 - protein, 7 aa, Mycobacterium avium
GNSADVS

SEQ ID NO: 139103 - protein, 7 aa, Mycobacterium avium
GNSLAPY

SEQ ID NO: 139104 - protein, 7 aa, Mycobacterium avium
GNTPPIF

SEQ ID NO: 139105 - protein, 6 aa, Mycobacterium avium
GPAAGV

SEQ ID NO: 139106 - protein, 51 aa, Mycobacterium avium
GPALADPDPAPADPGAVAAPPGPPAPPDPLAPPPPPDPLAPPPPAAPPAPW

SEQ ID NO: 139107 - protein, 14 aa, Mycobacterium avium
GPATDVLSGNADDI

SEQ ID NO: 139108 - protein, 14 aa, Mycobacterium avium
GPDGKLQTIGKIPN

SEQ ID NO: 139109 - protein, 8 aa, Mycobacterium avium
GPDGQAIN

SEQ ID NO: 139110 - protein, 12 aa, Mycobacterium avium
GPDTPVRDGHPS

SEQ ID NO: 139111 - protein, 9 aa, Mycobacterium avium
GPGGTSFDT

SEQ ID NO: 139112 - protein, 8 aa, Mycobacterium avium
GPLSSERL

SEQ ID NO: 139113 - protein, 8 aa, Mycobacterium avium
GPPETPDR

SEQ ID NO: 139114 - protein, 7 aa, Mycobacterium avium
GPPGTTG

SEQ ID NO: 139115 - protein, 8 aa, Mycobacterium avium
GPPVHDDE

SEQ ID NO: 139116 - protein, 6 aa, Mycobacterium avium
GPQVSS

SEQ ID NO: 139117 - protein, 15 aa, Mycobacterium avium
GPTAGTGTPTGDYGI

SEQ ID NO: 139118 - protein, 7 aa, Mycobacterium avium
GPTEPPL

SEQ ID NO: 139119 - protein, 9 aa, Mycobacterium avium
GPTREEAEA

SEQ ID NO: 139120 - protein, 5 aa, Mycobacterium avium
GPVPL

SEQ ID NO: 139121 - protein, 11 aa, Mycobacterium avium
GPVRGAEGRRW

SEQ ID NO: 139122 - protein, 16 aa, Mycobacterium avium
GQCDGGQSAVTDRDHH

SEQ ID NO: 139123 - protein, 5 aa, Mycobacterium avium
GQDDS

SEQ ID NO: 139124 - protein, 6 aa, Mycobacterium avium
GQGTEF

SEQ ID NO: 139125 - protein, 13 aa, Mycobacterium avium
GQKQDAAIKKGLG

SEQ ID NO: 139126 - protein, 24 aa, Mycobacterium avium
GQQTLQSSNAWDGDNPPGDNPGNV

SEQ ID NO: 139127 - protein, 5 aa, Mycobacterium avium
GQRAM

SEQ ID NO: 139128 - protein, 6 aa, Mycobacterium avium
GQTPGT

SEQ ID NO: 139129 - protein, 7 aa, Mycobacterium avium
GQVAGSP

SEQ ID NO: 139130 - protein, 5 aa, Mycobacterium avium
GRAAV

SEQ ID NO: 139131 - protein, 34 aa, Mycobacterium avium
GRAGRAAAAHAAEAGRPRALAPEPVAHTAPPRAE

SEQ ID NO: 139132 - protein, 8 aa, Mycobacterium avium
GRDPQAVR

SEQ ID NO: 139133 - protein, 9 aa, Mycobacterium avium
GRDRAGARA

SEQ ID NO: 139134 - protein, 8 aa, Mycobacterium avium
GRGPSIGG

SEQ ID NO: 139135 - protein, 6 aa, Mycobacterium avium
GRHRGG

SEQ ID NO: 139136 - protein, 8 aa, Mycobacterium avium
GRPAPTHR

SEQ ID NO: 139137 - protein, 20 aa, Mycobacterium avium
GRPATRATVGADGIATGGAA

SEQ ID NO: 139138 - protein, 7 aa, Mycobacterium avium
GRPGEYD

SEQ ID NO: 139139 - protein, 6 aa, Mycobacterium avium
GRPGKV

SEQ ID NO: 139140 - protein, 5 aa, Mycobacterium avium
GRPRG

SEQ ID NO: 139141 - protein, 9 aa, Mycobacterium avium
GRRPGEPVV

SEQ ID NO: 139142 - protein, 10 aa, Mycobacterium avium
GRSGARAFKD

SEQ ID NO: 139143 - protein, 10 aa, Mycobacterium avium
GRSPGAQQQL

SEQ ID NO: 139144 - protein, 21 aa, Mycobacterium avium
GRTAAGRVGVDPTAADPAGWP

SEQ ID NO: 139145 - protein, 8 aa, Mycobacterium avium
GRYADPAK

SEQ ID NO: 139146 - protein, 11 aa, Mycobacterium avium
GSAAADPPPTQ

SEQ ID NO: 139147 - protein, 10 aa, Mycobacterium avium
GSAAASAGGF

SEQ ID NO: 139148 - protein, 8 aa, Mycobacterium avium
GSDPANPM

SEQ ID NO: 139149 - protein, 6 aa, Mycobacterium avium
GSLEDG

SEQ ID NO: 139150 - protein, 22 aa, Mycobacterium avium
GSLNDASQASTEQARRTTEGWR

SEQ ID NO: 139151 - protein, 8 aa, Mycobacterium avium
GSMGDEAV

SEQ ID NO: 139152 - protein, 9 aa, Mycobacterium avium
GSSGRGREF

SEQ ID NO: 139153 - protein, 7 aa, Mycobacterium avium
GSSPPVH

SEQ ID NO: 139154 - protein, 13 aa, Mycobacterium avium
GSTAYAAPASASL

SEQ ID NO: 139155 - protein, 6 aa, Mycobacterium avium
GSTSVY

SEQ ID NO: 139156 - protein, 5 aa, Mycobacterium avium
GSVGE

SEQ ID NO: 139157 - protein, 5 aa, Mycobacterium avium
GSVGN

SEQ ID NO: 139158 - protein, 17 aa, Mycobacterium avium
GTAGSTGTPKTAALSPD

SEQ ID NO: 139159 - protein, 8 aa, Mycobacterium avium
GTDDPGGL

SEQ ID NO: 139160 - protein, 10 aa, Mycobacterium avium
GTDEPPGVGK

SEQ ID NO: 139161 - protein, 10 aa, Mycobacterium avium
GTGENSARPG

SEQ ID NO: 139162 - protein, 5 aa, Mycobacterium avium
GTGLS

SEQ ID NO: 139163 - protein, 7 aa, Mycobacterium avium
GTGPQVA

SEQ ID NO: 139164 - protein, 8 aa, Mycobacterium avium
GTNAAADW

SEQ ID NO: 139165 - protein, 7 aa, Mycobacterium avium
GTQSERA

SEQ ID NO: 139166 - protein, 8 aa, Mycobacterium avium
GTSAGSAV

SEQ ID NO: 139167 - protein, 6 aa, Mycobacterium avium
GTYRDG

SEQ ID NO: 139168 - protein, 8 aa, Mycobacterium avium
GVEPDPEE

SEQ ID NO: 139169 - protein, 13 aa, Mycobacterium avium
GVGAGGAAIGDAP

SEQ ID NO: 139170 - protein, 6 aa, Mycobacterium avium
GVGRKT

SEQ ID NO: 139171 - protein, 11 aa, Mycobacterium avium
GVNSDAPPHGV

SEQ ID NO: 139172 - protein, 12 aa, Mycobacterium avium
GVPAGKSDRLTG

SEQ ID NO: 139173 - protein, 17 aa, Mycobacterium avium
GVPAPPPPPKAPPSETV

SEQ ID NO: 139174 - protein, 5 aa, Mycobacterium avium
GVPDT

SEQ ID NO: 139175 - protein, 13 aa, Mycobacterium avium
GVPGVGSRSHPDV

SEQ ID NO: 139176 - protein, 24 aa, Mycobacterium avium
GVPPPAGDPVPPVDTHASGRPADQ

SEQ ID NO: 139177 - protein, 12 aa, Mycobacterium avium
GVPSSSAPQAIG

SEQ ID NO: 139178 - protein, 7 aa, Mycobacterium avium
GVPTDPA

SEQ ID NO: 139179 - protein, 8 aa, Mycobacterium avium
GVSAGEGV

SEQ ID NO: 139180 - protein, 6 aa, Mycobacterium avium
GVSQSA

SEQ ID NO: 139181 - protein, 5 aa, Mycobacterium avium
GVSSG

SEQ ID NO: 139182 - protein, 6 aa, Mycobacterium avium
GVYANS

SEQ ID NO: 139183 - protein, 4 aa, Mycobacterium avium
GWTG

SEQ ID NO: 139184 - protein, 21 aa, Mycobacterium avium
GWTTSDVAATDPGVADGAGAG

SEQ ID NO: 139185 - protein, 6 aa, Mycobacterium avium
GYAATS

SEQ ID NO: 139186 - protein, 13 aa, Mycobacterium avium
GYSQGAAVAGYTT

SEQ ID NO: 139187 - protein, 17 aa, Mycobacterium avium
HAASNGKTWEGKSIPGL

SEQ ID NO: 139188 - protein, 11 aa, Mycobacterium avium
HADGPKPNNAY

SEQ ID NO: 139189 - protein, 5 aa, Mycobacterium avium
HADNN

SEQ ID NO: 139190 - protein, 15 aa, Mycobacterium avium
HAVEGYSESLDHETR

SEQ ID NO: 139191 - protein, 6 aa, Mycobacterium avium
HDAGEI

SEQ ID NO: 139192 - protein, 8 aa, Mycobacterium avium
HDERYDRA

SEQ ID NO: 139193 - protein, 14 aa, Mycobacterium avium
HDRDQMTAAAAGPA

SEQ ID NO: 139194 - protein, 7 aa, Mycobacterium avium
HENGRCT

SEQ ID NO: 139195 - protein, 7 aa, Mycobacterium avium
HETTRDD

SEQ ID NO: 139196 - protein, 143 aa, Mycobacterium avium
HGGGGNPGGPGGGPGGQPAGPGGGAGGQHGGNTPPQGGQNNPPQNGPNNAPQNGPNNAPQSGPNNPSQGGPNNAPQNGPNNPPQGGQNEPGGQYPPNQHGQNPPQNGQNQPPYDHDQNPPTPGGPTNAPANTQNPPPPPERQR

SEQ ID NO: 139197 - protein, 19 aa, Mycobacterium avium
HGNATTIGAERRLNPFLEG

SEQ ID NO: 139198 - protein, 10 aa, Mycobacterium avium
HGPNPLPPNG

SEQ ID NO: 139199 - protein, 9 aa, Mycobacterium avium
HGSSIYSSN

SEQ ID NO: 139200 - protein, 6 aa, Mycobacterium avium
HLSNGR

SEQ ID NO: 139201 - protein, 36 aa, Mycobacterium avium
HNAVNDASINRPVPNGRGGSKPCQTSGAAADDGYPE

SEQ ID NO: 139202 - protein, 6 aa, Mycobacterium avium
HPADGR

SEQ ID NO: 139203 - protein, 22 aa, Mycobacterium avium
HPADPSRYHTATRDGVATPLGD

SEQ ID NO: 139204 - protein, 11 aa, Mycobacterium avium
HPAPPPATAYG

SEQ ID NO: 139205 - protein, 8 aa, Mycobacterium avium
HPEGLGPN

SEQ ID NO: 139206 - protein, 7 aa, Mycobacterium avium
HPETNQA

SEQ ID NO: 139207 - protein, 4 aa, Mycobacterium avium
HPGD

SEQ ID NO: 139208 - protein, 32 aa, Mycobacterium avium
HPGGPTGPAGWGPWGPPPAWAPPPPPQPAWAP

SEQ ID NO: 139209 - protein, 26 aa, Mycobacterium avium
HPPAPKPPAAPAQSPPSNTAAVNPAN

SEQ ID NO: 139210 - protein, 6 aa, Mycobacterium avium
HPPDAA

SEQ ID NO: 139211 - protein, 4 aa, Mycobacterium avium
HPPP

SEQ ID NO: 139212 - protein, 6 aa, Mycobacterium avium
HREQAA

SEQ ID NO: 139213 - protein, 10 aa, Mycobacterium avium
HRGPRPGGQA

SEQ ID NO: 139214 - protein, 12 aa, Mycobacterium avium
HRPSRAEPYATR

SEQ ID NO: 139215 - protein, 5 aa, Mycobacterium avium
HRQPG

SEQ ID NO: 139216 - protein, 9 aa, Mycobacterium avium
HSGAPRGSA

SEQ ID NO: 139217 - protein, 7 aa, Mycobacterium avium
HSPGTYP

SEQ ID NO: 139218 - protein, 10 aa, Mycobacterium avium
HSRGLGSSAA

SEQ ID NO: 139219 - protein, 7 aa, Mycobacterium avium
HTPGHTR

SEQ ID NO: 139220 - protein, 41 aa, Mycobacterium avium
HTTGGRSEPTPSGAATPSGSAAGPSSSKPPGPSGAPAAGAA

SEQ ID NO: 139221 - protein, 10 aa, Mycobacterium avium
IAGSSGAERV

SEQ ID NO: 139222 - protein, 6 aa, Mycobacterium avium
IAPGPH

SEQ ID NO: 139223 - protein, 7 aa, Mycobacterium avium
IDGSDAA

SEQ ID NO: 139224 - protein, 10 aa, Mycobacterium avium
IDSQGDSVTA

SEQ ID NO: 139225 - protein, 4 aa, Mycobacterium avium
IDST

SEQ ID NO: 139226 - protein, 4 aa, Mycobacterium avium
IERT

SEQ ID NO: 139227 - protein, 6 aa, Mycobacterium avium
IETADD

SEQ ID NO: 139228 - protein, 10 aa, Mycobacterium avium
IGATSKTLPD

SEQ ID NO: 139229 - protein, 4 aa, Mycobacterium avium
IGQK

SEQ ID NO: 139230 - protein, 4 aa, Mycobacterium avium
IGSR

SEQ ID NO: 139231 - protein, 4 aa, Mycobacterium avium
INGG

SEQ ID NO: 139232 - protein, 9 aa, Mycobacterium avium
INTGNGYHG

SEQ ID NO: 139233 - protein, 19 aa, Mycobacterium avium
IPGSTRPASYQGGSQTQIS

SEQ ID NO: 139234 - protein, 8 aa, Mycobacterium avium
IPQPNGQA

SEQ ID NO: 139235 - protein, 4 aa, Mycobacterium avium
IPSG

SEQ ID NO: 139236 - protein, 25 aa, Mycobacterium avium
IQPTASGAATADVSVSGPKLTSPVT

SEQ ID NO: 139237 - protein, 21 aa, Mycobacterium avium
IQPTTVNSRRTRTPALDAGRE

SEQ ID NO: 139238 - protein, 6 aa, Mycobacterium avium
IRGEGA

SEQ ID NO: 139239 - protein, 11 aa, Mycobacterium avium
IRSGAGSNTVH

SEQ ID NO: 139240 - protein, 7 aa, Mycobacterium avium
ISPGSTL

SEQ ID NO: 139241 - protein, 38 aa, Mycobacterium avium
ISQSVNGACPKPHQPTPGGSSSPAPSLPPSQAPAKPAL

SEQ ID NO: 139242 - protein, 7 aa, Mycobacterium avium
ITRTTTK

SEQ ID NO: 139243 - protein, 10 aa, Mycobacterium avium
KAAGEDHEAG

SEQ ID NO: 139244 - protein, 5 aa, Mycobacterium avium
KADTV

SEQ ID NO: 139245 - protein, 19 aa, Mycobacterium avium
KAGDSAEDAAAQGTEAGRE

SEQ ID NO: 139246 - protein, 6 aa, Mycobacterium avium
KDGRHS

SEQ ID NO: 139247 - protein, 7 aa, Mycobacterium avium
KDISTTE

SEQ ID NO: 139248 - protein, 6 aa, Mycobacterium avium
KDQAGA

SEQ ID NO: 139249 - protein, 8 aa, Mycobacterium avium
KDTGDRAK

SEQ ID NO: 139250 - protein, 7 aa, Mycobacterium avium
KEPPKRV

SEQ ID NO: 139251 - protein, 8 aa, Mycobacterium avium
KGANTGQT

SEQ ID NO: 139252 - protein, 13 aa, Mycobacterium avium
KGQLEGPGPSAGP

SEQ ID NO: 139253 - protein, 13 aa, Mycobacterium avium
KHGPPPSGAAPRQ

SEQ ID NO: 139254 - protein, 7 aa, Mycobacterium avium
KIQAAGA

SEQ ID NO: 139255 - protein, 15 aa, Mycobacterium avium
KLGAPNGRIKATHCS

SEQ ID NO: 139256 - protein, 8 aa, Mycobacterium avium
KLGGAQPT

SEQ ID NO: 139257 - protein, 9 aa, Mycobacterium avium
KNDAPGTPA

SEQ ID NO: 139258 - protein, 8 aa, Mycobacterium avium
KNPDGKRT

SEQ ID NO: 139259 - protein, 7 aa, Mycobacterium avium
KPALVSG

SEQ ID NO: 139260 - protein, 9 aa, Mycobacterium avium
KPGDLRTNQ

SEQ ID NO: 139261 - protein, 14 aa, Mycobacterium avium
KQWQTDPKELPASN

SEQ ID NO: 139262 - protein, 9 aa, Mycobacterium avium
KRAADMPLN

SEQ ID NO: 139263 - protein, 5 aa, Mycobacterium avium
KREAK

SEQ ID NO: 139264 - protein, 16 aa, Mycobacterium avium
KSDGESNFGKIGSPQI

SEQ ID NO: 139265 - protein, 36 aa, Mycobacterium avium; identical to SEQ ID NO: 68066

SEQ ID NO: 139266 - protein, 16 aa, Mycobacterium avium
KTLRRQRTELTDQPEG

SEQ ID NO: 139267 - protein, 6 aa, Mycobacterium avium
LAASPA

SEQ ID NO: 139268 - protein, 5 aa, Mycobacterium avium
LAEPG

SEQ ID NO: 139269 - protein, 24 aa, Mycobacterium avium
LAGGRPSAAKTGTTQLGDTTSNKD

SEQ ID NO: 139270 - protein, 7 aa, Mycobacterium avium
LALPAGA

SEQ ID NO: 139271 - protein, 10 aa, Mycobacterium avium
LANTGAGPVS

SEQ ID NO: 139272 - protein, 11 aa, Mycobacterium avium
LAPASAAPSGL

SEQ ID NO: 139273 - protein, 9 aa, Mycobacterium avium
LAPGQPGPV

SEQ ID NO: 139274 - protein, 6 aa, Mycobacterium avium
LAPIDP

SEQ ID NO: 139275 - protein, 13 aa, Mycobacterium avium
LASGRTPGPLLSI

SEQ ID NO: 139276 - protein, 8 aa, Mycobacterium avium
LDAGDQAG

SEQ ID NO: 139277 - protein, 29 aa, Mycobacterium avium
LDAPATQPPPRPADDLGYRPASREQPFGQ

SEQ ID NO: 139278 - protein, 6 aa, Mycobacterium avium
LDDPVT

SEQ ID NO: 139279 - protein, 5 aa, Mycobacterium avium
LDDQA

SEQ ID NO: 139280 - protein, 7 aa, Mycobacterium avium
LDDRGAA

SEQ ID NO: 139281 - protein, 8 aa, Mycobacterium avium
LDGQDPDM

SEQ ID NO: 139282 - protein, 4 aa, Mycobacterium avium
LDPN

SEQ ID NO: 139283 - protein, 8 aa, Mycobacterium avium
LDPSRPDE

SEQ ID NO: 139284 - protein, 12 aa, Mycobacterium avium
LDSAGPQALRDG

SEQ ID NO: 139285 - protein, 8 aa, Mycobacterium avium
LDSDPRLA

SEQ ID NO: 139286 - protein, 12 aa, Mycobacterium avium
LDTDSADASTLP

SEQ ID NO: 139287 - protein, 7 aa, Mycobacterium avium
LDTNPGD

SEQ ID NO: 139288 - protein, 4 aa, Mycobacterium avium
LGAP

SEQ ID NO: 139289 - protein, 10 aa, Mycobacterium avium
LGDAATAAEF

SEQ ID NO: 139290 - protein, 26 aa, Mycobacterium avium
LGGAGTAGGPATAEAIASAADPRNVE

SEQ ID NO: 139291 - protein, 9 aa, Mycobacterium avium
LGGHNGVPA

SEQ ID NO: 139292 - protein, 16 aa, Mycobacterium avium
LGGPATVAAPSGGGFG

SEQ ID NO: 139293 - protein, 4 aa, Mycobacterium avium
LGPE

SEQ ID NO: 139294 - protein, 5 aa, Mycobacterium avium
LGRGA

SEQ ID NO: 139295 - protein, 12 aa, Mycobacterium avium
LGRKEDASDDSR

SEQ ID NO: 139296 - protein, 6 aa, Mycobacterium avium
LKATGD

SEQ ID NO: 139297 - protein, 11 aa, Mycobacterium avium
LKATPENLKPA

SEQ ID NO: 139298 - protein, 8 aa, Mycobacterium avium
LKPSLTEA

SEQ ID NO: 139299 - protein, 7 aa, Mycobacterium avium
LNDQKNV

SEQ ID NO: 139300 - protein, 13 aa, Mycobacterium avium
LPANATAKIGQTS

SEQ ID NO: 139301 - protein, 9 aa, Mycobacterium avium
LPDSAGAPQ

SEQ ID NO: 139302 - protein, 10 aa, Mycobacterium avium
LPGPRAAAGV

SEQ ID NO: 139303 - protein, 9 aa, Mycobacterium avium
LPPADGSRV

SEQ ID NO: 139304 - protein, 4 aa, Mycobacterium avium
LPPN

SEQ ID NO: 139305 - protein, 10 aa, Mycobacterium avium
LPPRSGRPHD

SEQ ID NO: 139306 - protein, 19 aa, Mycobacterium avium
LPRDPRSQQPWNPEPLAGN

SEQ ID NO: 139307 - protein, 7 aa, Mycobacterium avium
LPRSSGA

SEQ ID NO: 139308 - protein, 41 aa, Mycobacterium avium
LQAGASDTEQLTAAPSIPLPNSTATLENYGGQACGNDPTVS

SEQ ID NO: 139309 - protein, 14 aa, Mycobacterium avium
LQSKNSNLSDDHAN

SEQ ID NO: 139310 - protein, 14 aa, Mycobacterium avium
LQVGSARADPGPFV

SEQ ID NO: 139311 - protein, 6 aa, Mycobacterium avium
LRAGPG

SEQ ID NO: 139312 - protein, 9 aa, Mycobacterium avium
LRAGSPEAP

SEQ ID NO: 139313 - protein, 8 aa, Mycobacterium avium
LREETGLR

SEQ ID NO: 139314 - protein, 22 aa, Mycobacterium avium
LRPEPANADYQRNIEDGTGIPE

SEQ ID NO: 139315 - protein, 7 aa, Mycobacterium avium
LRPGAAL

SEQ ID NO: 139316 - protein, 9 aa, Mycobacterium avium
LRPSNQTKV

SEQ ID NO: 139317 - protein, 21 aa, Mycobacterium avium
LSAATASGVTGFDTATDAVTG

SEQ ID NO: 139318 - protein, 13 aa, Mycobacterium avium
LSEDGKGGPPNNG

SEQ ID NO: 139319 - protein, 7 aa, Mycobacterium avium
LSGQGTS

SEQ ID NO: 139320 - protein, 5 aa, Mycobacterium avium
LSKGY

SEQ ID NO: 139321 - protein, 14 aa, Mycobacterium avium
LSQAPARSIGGRRD

SEQ ID NO: 139322 - protein, 6 aa, Mycobacterium avium
LSQRYP

SEQ ID NO: 139323 - protein, 6 aa, Mycobacterium avium
LSRRGH

SEQ ID NO: 139324 - protein, 22 aa, Mycobacterium avium
LTAATTAGPPAPAAPAAAAGAP

SEQ ID NO: 139325 - protein, 9 aa, Mycobacterium avium
LTDPKAGPL

SEQ ID NO: 139326 - protein, 8 aa, Mycobacterium avium
LTDSQSAK

SEQ ID NO: 139327 - protein, 6 aa, Mycobacterium avium
LTPADD

SEQ ID NO: 139328 - protein, 9 aa, Mycobacterium avium
LTQSPGDVA

SEQ ID NO: 139329 - protein, 10 aa, Mycobacterium avium
MAGTAHSGWT

SEQ ID NO: 139330 - protein, 8 aa, Mycobacterium avium
MDGTSPVD

SEQ ID NO: 139331 - protein, 15 aa, Mycobacterium avium
MDSETANDDAHGSAL

SEQ ID NO: 139332 - protein, 16 aa, Mycobacterium avium
MGDQTGAALSRNGRQV

SEQ ID NO: 139333 - protein, 11 aa, Mycobacterium avium
MPPPYESQYDT

SEQ ID NO: 139334 - protein, 6 aa, Mycobacterium avium
MRTGGS

SEQ ID NO: 139335 - protein, 9 aa, Mycobacterium avium
MTATPEAFN

SEQ ID NO: 139336 - protein, 5 aa, Mycobacterium avium
MTPRA

SEQ ID NO: 139337 - protein, 5 aa, Mycobacterium avium
MVPPQ

SEQ ID NO: 139338 - protein, 19 aa, Mycobacterium avium
NAAPAADPPPAGTTSLGTS

SEQ ID NO: 139339 - protein, 7 aa, Mycobacterium avium
NADTGTI

SEQ ID NO: 139340 - protein, 10 aa, Mycobacterium avium
NALGPHGGNA

SEQ ID NO: 139341 - protein, 4 aa, Mycobacterium avium
NARI

SEQ ID NO: 139342 - protein, 8 aa, Mycobacterium avium
NARSFSDA

SEQ ID NO: 139343 - protein, 4 aa, Mycobacterium avium
NCPN

SEQ ID NO: 139344 - protein, 6 aa, Mycobacterium avium
NDAADR

SEQ ID NO: 139345 - protein, 8 aa, Mycobacterium avium
NDAPLGRI

SEQ ID NO: 139346 - protein, 6 aa, Mycobacterium avium
NDDSVE

SEQ ID NO: 139347 - protein, 11 aa, Mycobacterium avium
NDNNMHDGSIA

SEQ ID NO: 139348 - protein, 10 aa, Mycobacterium avium
NDQTTCASAG

SEQ ID NO: 139349 - protein, 9 aa, Mycobacterium avium
NDSKSDLDA

SEQ ID NO: 139350 - protein, 5 aa, Mycobacterium avium
NEPSF

SEQ ID NO: 139351 - protein, 6 aa, Mycobacterium avium
NFTPKT

SEQ ID NO: 139352 - protein, 9 aa, Mycobacterium avium
NGKPESMAK

SEQ ID NO: 139353 - protein, 12 aa, Mycobacterium avium
NGKPSDLGGDNL

SEQ ID NO: 139354 - protein, 12 aa, Mycobacterium avium
NGNGTELANGDS

SEQ ID NO: 139355 - protein, 5 aa, Mycobacterium avium
NGSTQ

SEQ ID NO: 139356 - protein, 14 aa, Mycobacterium avium
NGTDPAAHLPASPG

SEQ ID NO: 139357 - protein, 5 aa, Mycobacterium avium
NGTHS

SEQ ID NO: 139358 - protein, 15 aa, Mycobacterium avium
NGVYGQTREAKRASL

SEQ ID NO: 139359 - protein, 5 aa, Mycobacterium avium
NHNGT

SEQ ID NO: 139360 - protein, 6 aa, Mycobacterium avium
NHRKGD

SEQ ID NO: 139361 - protein, 11 aa, Mycobacterium avium
NNGKSATAISI

SEQ ID NO: 139362 - protein, 4 aa, Mycobacterium avium
NNSG

SEQ ID NO: 139363 - protein, 8 aa, Mycobacterium avium
NPAGGDTL

SEQ ID NO: 139364 - protein, 5 aa, Mycobacterium avium
NPIEY

SEQ ID NO: 139365 - protein, 7 aa, Mycobacterium avium
NPPDTTA

SEQ ID NO: 139366 - protein, 11 aa, Mycobacterium avium
NPSTAYVAGPQ

SEQ ID NO: 139367 - protein, 12 aa, Mycobacterium avium
NPVPPDGRSDIR

SEQ ID NO: 139368 - protein, 8 aa, Mycobacterium avium
NQDVGQSI

SEQ ID NO: 139369 - protein, 7 aa, Mycobacterium avium
NQLGAGQ

SEQ ID NO: 139370 - protein, 11 aa, Mycobacterium avium
NRGGSRPPAAI

SEQ ID NO: 139371 - protein, 9 aa, Mycobacterium avium
NRGTARSDD

SEQ ID NO: 139372 - protein, 16 aa, Mycobacterium avium
NRPRSFAGAADAVTNR

SEQ ID NO: 139373 - protein, 4 aa, Mycobacterium avium
NRPT

SEQ ID NO: 139374 - protein, 14 aa, Mycobacterium avium
NRQDTVPADGTNPE

SEQ ID NO: 139375 - protein, 4 aa, Mycobacterium avium
NRSI

SEQ ID NO: 139376 - protein, 9 aa, Mycobacterium avium
NRTPPKTQA

SEQ ID NO: 139377 - protein, 4 aa, Mycobacterium avium
NSDG

SEQ ID NO: 139378 - protein, 17 aa, Mycobacterium avium
NSSGGDYKKNDGSADWM

SEQ ID NO: 139379 - protein, 9 aa, Mycobacterium avium
NTAESENLQ

SEQ ID NO: 139380 - protein, 6 aa, Mycobacterium avium
NTATFA

SEQ ID NO: 139381 - protein, 7 aa, Mycobacterium avium
NTDNGRQ

SEQ ID NO: 139382 - protein, 10 aa, Mycobacterium avium
NTGAGPHTTY

SEQ ID NO: 139383 - protein, 10 aa, Mycobacterium avium
NTIDATGVGT

SEQ ID NO: 139384 - protein, 5 aa, Mycobacterium avium
NTTDS

SEQ ID NO: 139385 - protein, 13 aa, Mycobacterium avium
NTTVSRDGLRTAG

SEQ ID NO: 139386 - protein, 6 aa, Mycobacterium avium
NVGPNQ

SEQ ID NO: 139387 - protein, 10 aa, Mycobacterium avium
PAAADSTDDE

SEQ ID NO: 139388 - protein, 18 aa, Mycobacterium avium
PAAERLEAAGAAGEGAAA

SEQ ID NO: 139389 - protein, 7 aa, Mycobacterium avium
PAARSTT

SEQ ID NO: 139390 - protein, 5 aa, Mycobacterium avium
PAAVA

SEQ ID NO: 139391 - protein, 9 aa, Mycobacterium avium
PADSTEEEY

SEQ ID NO: 139392 - protein, 5 aa, Mycobacterium avium
PAGAT

SEQ ID NO: 139393 - protein, 10 aa, Mycobacterium avium
PAGIRTSDGI

SEQ ID NO: 139394 - protein, 8 aa, Mycobacterium avium
PAGVDAPP

SEQ ID NO: 139395 - protein, 6 aa, Mycobacterium avium
PAHARA

SEQ ID NO: 139396 - protein, 12 aa, Mycobacterium avium
PAKRSGGRSGLS

SEQ ID NO: 139397 - protein, 8 aa, Mycobacterium avium
PAPGGRAE

SEQ ID NO: 139398 - protein, 10 aa, Mycobacterium avium
PAPPRGYDGP

SEQ ID NO: 139399 - protein, 5 aa, Mycobacterium avium
PAQDW

SEQ ID NO: 139400 - protein, 11 aa, Mycobacterium avium
PASDDSPSERE

SEQ ID NO: 139401 - protein, 7 aa, Mycobacterium avium
PASGARY

SEQ ID NO: 139402 - protein, 4 aa, Mycobacterium avium
PAST

SEQ ID NO: 139403 - protein, 7 aa, Mycobacterium avium
PATPGTP

SEQ ID NO: 139404 - protein, 6 aa, Mycobacterium avium
PATPPP

SEQ ID NO: 139405 - protein, 5 aa, Mycobacterium avium
PATRA

SEQ ID NO: 139406 - protein, 9 aa, Mycobacterium avium
PAWQPTNAS

SEQ ID NO: 139407 - protein, 9 aa, Mycobacterium avium
PAYATSADD

SEQ ID NO: 139408 - protein, 9 aa, Mycobacterium avium
PDAKDDDVA

SEQ ID NO: 139409 - protein, 13 aa, Mycobacterium avium
PDEGETAEQFTPQ

SEQ ID NO: 139410 - protein, 5 aa, Mycobacterium avium
PDFSG

SEQ ID NO: 139411 - protein, 7 aa, Mycobacterium avium
PDGGASA

SEQ ID NO: 139412 - protein, 9 aa, Mycobacterium avium
PDGSTTVDT

SEQ ID NO: 139413 - protein, 4 aa, Mycobacterium avium
PDTE

SEQ ID NO: 139414 - protein, 10 aa, Mycobacterium avium
PDVSDSDVDD

SEQ ID NO: 139415 - protein, 8 aa, Mycobacterium avium
PEAEKRFN

SEQ ID NO: 139416 - protein, 25 aa, Mycobacterium avium
PEAVGPPRRRSSRMARNRAERGRRR

SEQ ID NO: 139417 - protein, 21 aa, Mycobacterium avium
PEGQKVAPGPIGSNTAAKATV

SEQ ID NO: 139418 - protein, 6 aa, Mycobacterium avium
PEGTQS

SEQ ID NO: 139419 - protein, 21 aa, Mycobacterium avium
PELTEAEQGPAATLSFVRAIK

SEQ ID NO: 139420 - protein, 28 aa, Mycobacterium avium
PETGQNARIGTTSDINPRDPATLQDGGN

SEQ ID NO: 139421 - protein, 11 aa, Mycobacterium avium
PFPGGRPRPGD

SEQ ID NO: 139422 - protein, 7 aa, Mycobacterium avium
PGAAPDI

SEQ ID NO: 139423 - protein, 14 aa, Mycobacterium avium
PGAGVDQPILNVPV

SEQ ID NO: 139424 - protein, 4 aa, Mycobacterium avium
PGAL

SEQ ID NO: 139425 - protein, 12 aa, Mycobacterium avium
PGASAPAPTAAP

SEQ ID NO: 139426 - protein, 14 aa, Mycobacterium avium
PGAYARSHESGRSV

SEQ ID NO: 139427 - protein, 30 aa, Mycobacterium avium
PGCASSPSPQANAANPGRQIDTRTPPGIRA

SEQ ID NO: 139428 - protein, 11 aa, Mycobacterium avium
PGDDYSGSGKR

SEQ ID NO: 139429 - protein, 4 aa, Mycobacterium avium
PGDP

SEQ ID NO: 139430 - protein, 8 aa, Mycobacterium avium
PGGAPIPQ

SEQ ID NO: 139431 - protein, 6 aa, Mycobacterium avium
PGGCGR

SEQ ID NO: 139432 - protein, 6 aa, Mycobacterium avium
PGGIPA

SEQ ID NO: 139433 - protein, 8 aa, Mycobacterium avium
PGGLSGLS

SEQ ID NO: 139434 - protein, 7 aa, Mycobacterium avium
PGHRGSV

SEQ ID NO: 139435 - protein, 20 aa, Mycobacterium avium
PGPGLPKPDPRDATPPYASK

SEQ ID NO: 139436 - protein, 4 aa, Mycobacterium avium
PGPS

SEQ ID NO: 139437 - protein, 4 aa, Mycobacterium avium
PGVR

SEQ ID NO: 139438 - protein, 16 aa, Mycobacterium avium
PGVTPIGPPGAVTVPD

SEQ ID NO: 139439 - protein, 16 aa, Mycobacterium avium
PHIGGNAYSEPEPHTG

SEQ ID NO: 139440 - protein, 7 aa, Mycobacterium avium
PINGATS

SEQ ID NO: 139441 - protein, 9 aa, Mycobacterium avium
PIPTEESPS

SEQ ID NO: 139442 - protein, 8 aa, Mycobacterium avium
PKTGSTVG

SEQ ID NO: 139443 - protein, 12 aa, Mycobacterium avium
PLASRRGEVERG

SEQ ID NO: 139444 - protein, 10 aa, Mycobacterium avium
PLEGDGPARR

SEQ ID NO: 139445 - protein, 5 aa, Mycobacterium avium
PLGPL

SEQ ID NO: 139446 - protein, 11 aa, Mycobacterium avium
PLGQPSDASPR

SEQ ID NO: 139447 - protein, 11 aa, Mycobacterium avium
PLGTATPNAKP

SEQ ID NO: 139448 - protein, 5 aa, Mycobacterium avium
PLPNT

SEQ ID NO: 139449 - protein, 20 aa, Mycobacterium avium
PLPPPPSTPMPPPPPPEPGV

SEQ ID NO: 139450 - protein, 4 aa, Mycobacterium avium
PLQP

SEQ ID NO: 139451 - protein, 9 aa, Mycobacterium avium
PLSAEGSRF

SEQ ID NO: 139452 - protein, 38 aa, Mycobacterium avium; identical to SEQ ID NO: 70322

SEQ ID NO: 139453 - protein, 16 aa, Mycobacterium avium
PLTGPHARPRDDCRES

SEQ ID NO: 139454 - protein, 11 aa, Mycobacterium avium
PLTVPRTPQGR

SEQ ID NO: 139455 - protein, 18 aa, Mycobacterium avium
PNGLSPAPIPQGTESTGT

SEQ ID NO: 139456 - protein, 7 aa, Mycobacterium avium
PNIAGSD

SEQ ID NO: 139457 - protein, 5 aa, Mycobacterium avium
PNTAP

SEQ ID NO: 139458 - protein, 8 aa, Mycobacterium avium
PNTNQGGN

SEQ ID NO: 139459 - protein, 29 aa, Mycobacterium avium
PPAAQPAAAPAAGQDPTPFTGTPPFGPPT

SEQ ID NO: 139460 - protein, 6 aa, Mycobacterium avium
PPEGNR

SEQ ID NO: 139461 - protein, 4 aa, Mycobacterium avium
PPFP

SEQ ID NO: 139462 - protein, 14 aa, Mycobacterium avium
PPFPSSPSPGPTRL

SEQ ID NO: 139463 - protein, 8 aa, Mycobacterium avium
PPLPPTGQ

SEQ ID NO: 139464 - protein, 14 aa, Mycobacterium avium
PPLQTGGLHDGQTA

SEQ ID NO: 139465 - protein, 9 aa, Mycobacterium avium
PPRNVDPDP

SEQ ID NO: 139466 - protein, 7 aa, Mycobacterium avium
PPSDDTV

SEQ ID NO: 139467 - protein, 19 aa, Mycobacterium avium
PPSWAPGGVAPAANATPAQ

SEQ ID NO: 139468 - protein, 22 aa, Mycobacterium avium
PPTPESEPPEAPPAAELPPPPS

SEQ ID NO: 139469 - protein, 28 aa, Mycobacterium avium
PQPPFDSGALGKADAATVARAEEYLTGR

SEQ ID NO: 139470 - protein, 6 aa, Mycobacterium avium
PQPPRT

SEQ ID NO: 139471 - protein, 6 aa, Mycobacterium avium
PQQARK

SEQ ID NO: 139472 - protein, 8 aa, Mycobacterium avium
PRAPGEQR

SEQ ID NO: 139473 - protein, 22 aa, Mycobacterium avium
PRGADGTPEITGTNGSAGPLGL

SEQ ID NO: 139474 - protein, 5 aa, Mycobacterium avium
PRGRQ

SEQ ID NO: 139475 - protein, 9 aa, Mycobacterium avium
PRKKAARRG

SEQ ID NO: 139476 - protein, 9 aa, Mycobacterium avium
PRSRGGDHS

SEQ ID NO: 139477 - protein, 22 aa, Mycobacterium avium
PSARAGREQGRREAAAVAEFLG

SEQ ID NO: 139478 - protein, 11 aa, Mycobacterium avium
PSGGRVNATTD

SEQ ID NO: 139479 - protein, 38 aa, Mycobacterium avium
PSHDSSSSSAPPAVTAVPPPAPSAAPPASPAPPPAGRD

SEQ ID NO: 139480 - protein, 11 aa, Mycobacterium avium
PSLGKGGDDGA

SEQ ID NO: 139481 - protein, 8 aa, Mycobacterium avium
PSQGRGSC

SEQ ID NO: 139482 - protein, 9 aa, Mycobacterium avium
PSTGHDPSH

SEQ ID NO: 139483 - protein, 13 aa, Mycobacterium avium
PSTLDPAVDPKGA

SEQ ID NO: 139484 - protein, 7 aa, Mycobacterium avium
PSTRSVV

SEQ ID NO: 139485 - protein, 7 aa, Mycobacterium avium
PSTTPTS

SEQ ID NO: 139486 - protein, 13 aa, Mycobacterium avium
PTADGEPGNDDLG

SEQ ID NO: 139487 - protein, 7 aa, Mycobacterium avium
PTFPDLT

SEQ ID NO: 139488 - protein, 5 aa, Mycobacterium avium
PTVPQ

SEQ ID NO: 139489 - protein, 10 aa, Mycobacterium avium
PVAADPNLGR

SEQ ID NO: 139490 - protein, 9 aa, Mycobacterium avium
PVASASAQS

SEQ ID NO: 139491 - protein, 5 aa, Mycobacterium avium
PVPDG

SEQ ID NO: 139492 - protein, 4 aa, Mycobacterium avium
PVPG

SEQ ID NO: 139493 - protein, 18 aa, Mycobacterium avium
PVPGPVPTSPANNDFKPG

SEQ ID NO: 139494 - protein, 16 aa, Mycobacterium avium
PYPPDLQHALDVLRDE

SEQ ID NO: 139495 - protein, 47 aa, Mycobacterium avium
PYQGTKSPTQVQATKDGKSYTVTGTGQATTPGQSGTRDVTFGIHVTC

SEQ ID NO: 139496 - protein, 10 aa, Mycobacterium avium
QAAAATDGEW

SEQ ID NO: 139497 - protein, 15 aa, Mycobacterium avium
QAAAQRTADAITEHG

SEQ ID NO: 139498 - protein, 5 aa, Mycobacterium avium
QAAQA

SEQ ID NO: 139499 - protein, 7 aa, Mycobacterium avium
QADRDEL

SEQ ID NO: 139500 - protein, 8 aa, Mycobacterium avium
QAGGTVTT

SEQ ID NO: 139501 - protein, 12 aa, Mycobacterium avium
QALADPKRNTAL

SEQ ID NO: 139502 - protein, 4 aa, Mycobacterium avium
QALT

SEQ ID NO: 139503 - protein, 15 aa, Mycobacterium avium
QARLANDPTAPPPNT

SEQ ID NO: 139504 - protein, 14 aa, Mycobacterium avium
QATRSAKAAGGNNV

SEQ ID NO: 139505 - protein, 9 aa, Mycobacterium avium
QDNNAGFGA

SEQ ID NO: 139506 - protein, 7 aa, Mycobacterium avium
QDVQGND

SEQ ID NO: 139507 - protein, 12 aa, Mycobacterium avium
QEPASGQPARLP

SEQ ID NO: 139508 - protein, 8 aa, Mycobacterium avium
QGDRRAVR

SEQ ID NO: 139509 - protein, 5 aa, Mycobacterium avium
QGGGR

SEQ ID NO: 139510 - protein, 6 aa, Mycobacterium avium
QGGKQM

SEQ ID NO: 139511 - protein, 6 aa, Mycobacterium avium
QGGQLT

SEQ ID NO: 139512 - protein, 6 aa, Mycobacterium avium
QGLSEA

SEQ ID NO: 139513 - protein, 6 aa, Mycobacterium avium
QGSRQF

SEQ ID NO: 139514 - protein, 44 aa, Mycobacterium avium
QGTKPRCCPAPPAAAPTPNATASSAAANPPPAGAPRTASPAEVE

SEQ ID NO: 139515 - protein, 14 aa, Mycobacterium avium
QGWDPSDVDNGDIA

SEQ ID NO: 139516 - protein, 31 aa, Mycobacterium avium
QKQTAPPANPNQPAPPANQPASPTPTAPPVT

SEQ ID NO: 139517 - protein, 20 aa, Mycobacterium avium
QLGYPRDSLGAPGPAPDDSV

SEQ ID NO: 139518 - protein, 6 aa, Mycobacterium avium
QLQSAP

SEQ ID NO: 139519 - protein, 8 aa, Mycobacterium avium
QNPDDQKA

SEQ ID NO: 139520 - protein, 10 aa, Mycobacterium avium
QPGATAMSDK

SEQ ID NO: 139521 - protein, 11 aa, Mycobacterium avium
QPGDSGAPVTV

SEQ ID NO: 139522 - protein, 7 aa, Mycobacterium avium
QPGGDTT

SEQ ID NO: 139523 - protein, 4 aa, Mycobacterium avium
QPLP

SEQ ID NO: 139524 - protein, 23 aa, Mycobacterium avium
QPRTFAQTPAAAIPTSGPTAPQA

SEQ ID NO: 139525 - protein, 7 aa, Mycobacterium avium
QPTPRGY

SEQ ID NO: 139526 - protein, 8 aa, Mycobacterium avium
QQACSSGL

SEQ ID NO: 139527 - protein, 10 aa, Mycobacterium avium
QQAGPQSVNG

SEQ ID NO: 139528 - protein, 21 aa, Mycobacterium avium
QQGYQDNSTTVPYDPAAAGRE

SEQ ID NO: 139529 - protein, 15 aa, Mycobacterium avium
QQPQVGASALESGQV

SEQ ID NO: 139530 - protein, 12 aa, Mycobacterium avium
QQRSQAEGGNGN

SEQ ID NO: 139531 - protein, 13 aa, Mycobacterium avium
QQSPLQPAGAGLT

SEQ ID NO: 139532 - protein, 20 aa, Mycobacterium avium
QRDERSGAPERNRRLDSDAA

SEQ ID NO: 139533 - protein, 18 aa, Mycobacterium avium
QRNPDAQSPAGGVSSSVR

SEQ ID NO: 139534 - protein, 6 aa, Mycobacterium avium
QRPGTD

SEQ ID NO: 139535 - protein, 6 aa, Mycobacterium avium
QRPHDS

SEQ ID NO: 139536 - protein, 7 aa, Mycobacterium avium
QRRDDIS

SEQ ID NO: 139537 - protein, 4 aa, Mycobacterium avium
QRTV

SEQ ID NO: 139538 - protein, 6 aa, Mycobacterium avium
QRVRPE

SEQ ID NO: 139539 - protein, 7 aa, Mycobacterium avium
QSDYARM

SEQ ID NO: 139540 - protein, 4 aa, Mycobacterium avium
QSED

SEQ ID NO: 139541 - protein, 9 aa, Mycobacterium avium
QSGNAGPAV

SEQ ID NO: 139542 - protein, 11 aa, Mycobacterium avium
QSHNGDSGGPV

SEQ ID NO: 139543 - protein, 11 aa, Mycobacterium avium
QSSGGRDQPYQ

SEQ ID NO: 139544 - protein, 22 aa, Mycobacterium avium
QTAPAAPAGLPAQPLPNQQHTP

SEQ ID NO: 139545 - protein, 6 aa, Mycobacterium avium
QTAPPE

SEQ ID NO: 139546 - protein, 12 aa, Mycobacterium avium
QTHTPRTITGPD

SEQ ID NO: 139547 - protein, 9 aa, Mycobacterium avium
QTLSSPATV

SEQ ID NO: 139548 - protein, 9 aa, Mycobacterium avium
RADAGMNSA

SEQ ID NO: 139549 - protein, 7 aa, Mycobacterium avium
RADDGLE

SEQ ID NO: 139550 - protein, 12 aa, Mycobacterium avium
RADPPAPEPEPI

SEQ ID NO: 139551 - protein, 11 aa, Mycobacterium avium
RAGDEEATNTD

SEQ ID NO: 139552 - protein, 4 aa, Mycobacterium avium
RAGP

SEQ ID NO: 139553 - protein, 7 aa, Mycobacterium avium
RAIDSSN

SEQ ID NO: 139554 - protein, 9 aa, Mycobacterium avium
RAKAETASA

SEQ ID NO: 139555 - protein, 6 aa, Mycobacterium avium
RAPAPA

SEQ ID NO: 139556 - protein, 12 aa, Mycobacterium avium
RARRRGRIDPQD

SEQ ID NO: 139557 - protein, 9 aa, Mycobacterium avium
RASLDSAPP

SEQ ID NO: 139558 - protein, 7 aa, Mycobacterium avium
RATITAA

SEQ ID NO: 139559 - protein, 7 aa, Mycobacterium avium
RCSPSDI

SEQ ID NO: 139560 - protein, 7 aa, Mycobacterium avium
RDEKRDL

SEQ ID NO: 139561 - protein, 5 aa, Mycobacterium avium
RDGPR

SEQ ID NO: 139562 - protein, 8 aa, Mycobacterium avium
RDHGPTAT

SEQ ID NO: 139563 - protein, 12 aa, Mycobacterium avium
RDNGIDGPRIPG

SEQ ID NO: 139564 - protein, 12 aa, Mycobacterium avium
RDNNPALTTNGA

SEQ ID NO: 139565 - protein, 17 aa, Mycobacterium avium
RDPRQTLADTFAALSAT

SEQ ID NO: 139566 - protein, 7 aa, Mycobacterium avium
RDTARQK

SEQ ID NO: 139567 - protein, 6 aa, Mycobacterium avium
RDTEAQ

SEQ ID NO: 139568 - protein, 6 aa, Mycobacterium avium
RDVGGP

SEQ ID NO: 139569 - protein, 5 aa, Mycobacterium avium
RDVTN

SEQ ID NO: 139570 - protein, 7 aa, Mycobacterium avium
RDYPTDK

SEQ ID NO: 139571 - protein, 8 aa, Mycobacterium avium
REGGHSRR

SEQ ID NO: 139572 - protein, 6 aa, Mycobacterium avium
REKDGR

SEQ ID NO: 139573 - protein, 10 aa, Mycobacterium avium
REQTRKSVGA

SEQ ID NO: 139574 - protein, 9 aa, Mycobacterium avium
RETGSPPTV

SEQ ID NO: 139575 - protein, 7 aa, Mycobacterium avium
RFAPDGT

SEQ ID NO: 139576 - protein, 7 aa, Mycobacterium avium
RFSTRAE

SEQ ID NO: 139577 - protein, 9 aa, Mycobacterium avium
RGADAEREY

SEQ ID NO: 139578 - protein, 4 aa, Mycobacterium avium
RGAG

SEQ ID NO: 139579 - protein, 8 aa, Mycobacterium avium
RGEVRTEN

SEQ ID NO: 139580 - protein, 8 aa, Mycobacterium avium
RGGHPATL

SEQ ID NO: 139581 - protein, 34 aa, Mycobacterium avium
RGGPPPPPPGPPGPPPPGWGHPGPGGPPPPHGWH

SEQ ID NO: 139582 - protein, 14 aa, Mycobacterium avium
RGPDEPGTWAGADG

SEQ ID NO: 139583 - protein, 13 aa, Mycobacterium avium
RGPETEHLLALAG

SEQ ID NO: 139584 - protein, 4 aa, Mycobacterium avium
RGPL

SEQ ID NO: 139585 - protein, 5 aa, Mycobacterium avium
RGRIP

SEQ ID NO: 139586 - protein, 5 aa, Mycobacterium avium
RGSGQ

SEQ ID NO: 139587 - protein, 22 aa, Mycobacterium avium
RGSGRFRGGSGPDAASADSDAL

SEQ ID NO: 139588 - protein, 6 aa, Mycobacterium avium
RGVGQG

SEQ ID NO: 139589 - protein, 7 aa, Mycobacterium avium
RGVPSAR

SEQ ID NO: 139590 - protein, 4 aa, Mycobacterium avium
RIPA

SEQ ID NO: 139591 - protein, 4 aa, Mycobacterium avium
RKDV

SEQ ID NO: 139592 - protein, 17 aa, Mycobacterium avium
RKTNGLPAASRPHSHLQ

SEQ ID NO: 139593 - protein, 19 aa, Mycobacterium avium
RLAPGGEGPKPGPPEIPPA

SEQ ID NO: 139594 - protein, 6 aa, Mycobacterium avium
RLGGER

SEQ ID NO: 139595 - protein, 8 aa, Mycobacterium avium
RLGQDAGD

SEQ ID NO: 139596 - protein, 10 aa, Mycobacterium avium
RLPGNTDEDR

SEQ ID NO: 139597 - protein, 5 aa, Mycobacterium avium
RNAEQ

SEQ ID NO: 139598 - protein, 7 aa, Mycobacterium avium
RNGTVEK

SEQ ID NO: 139599 - protein, 8 aa, Mycobacterium avium
RNGVSDHS

SEQ ID NO: 139600 - protein, 7 aa, Mycobacterium avium
RNTYPGA

SEQ ID NO: 139601 - protein, 6 aa, Mycobacterium avium
RPDSLN

SEQ ID NO: 139602 - protein, 8 aa, Mycobacterium avium
RPEFPTPV

SEQ ID NO: 139603 - protein, 5 aa, Mycobacterium avium
RPERD

SEQ ID NO: 139604 - protein, 4 aa, Mycobacterium avium
RPNI

SEQ ID NO: 139605 - protein, 11 aa, Mycobacterium avium
RPPYAKRNAAV

SEQ ID NO: 139606 - protein, 10 aa, Mycobacterium avium
RPRPDAPPGT

SEQ ID NO: 139607 - protein, 32 aa, Mycobacterium avium
RPVNGAAAQPPPAPAPPPEPHRPGQTPFDADA

SEQ ID NO: 139608 - protein, 9 aa, Mycobacterium avium
RPVSGPVSR

SEQ ID NO: 139609 - protein, 15 aa, Mycobacterium avium
RQRRPVVSSPDQADG

SEQ ID NO: 139610 - protein, 4 aa, Mycobacterium avium
RQTP

SEQ ID NO: 139611 - protein, 4 aa, Mycobacterium avium
RQVP

SEQ ID NO: 139612 - protein, 6 aa, Mycobacterium avium
RRDPAP

SEQ ID NO: 139613 - protein, 9 aa, Mycobacterium avium
RRPVPNGSG

SEQ ID NO: 139614 - protein, 16 aa, Mycobacterium avium
RRSPVDGDGGVVSGPP

SEQ ID NO: 139615 - protein, 5 aa, Mycobacterium avium
RRSQQ

SEQ ID NO: 139616 - protein, 8 aa, Mycobacterium avium
RRYDGDER

SEQ ID NO: 139617 - protein, 18 aa, Mycobacterium avium
RSCTQCSPHAGVSLPIEL

SEQ ID NO: 139618 - protein, 16 aa, Mycobacterium avium
RSDADQGTGGINGRQA

SEQ ID NO: 139619 - protein, 17 aa, Mycobacterium avium
RSDDRQGPGGLTPQQAD

SEQ ID NO: 139620 - protein, 9 aa, Mycobacterium avium
RSDPAGDYA

SEQ ID NO: 139621 - protein, 13 aa, Mycobacterium avium
RSFGADPAKVTEY

SEQ ID NO: 139622 - protein, 10 aa, Mycobacterium avium
RSNPNPYGKA

SEQ ID NO: 139623 - protein, 18 aa, Mycobacterium avium
RSPSGKADYRWAREQAVD

SEQ ID NO: 139624 - protein, 5 aa, Mycobacterium avium
RSPTG

SEQ ID NO: 139625 - protein, 8 aa, Mycobacterium avium
RSTGQHCG

SEQ ID NO: 139626 - protein, 8 aa, Mycobacterium avium
RTDAPSGL

SEQ ID NO: 139627 - protein, 6 aa, Mycobacterium avium
RTPDYA

SEQ ID NO: 139628 - protein, 7 aa, Mycobacterium avium
RTPPAGA

SEQ ID NO: 139629 - protein, 5 aa, Mycobacterium avium
RTPPI

SEQ ID NO: 139630 - protein, 10 aa, Mycobacterium avium
RTTGRPGTAI

SEQ ID NO: 139631 - protein, 14 aa, Mycobacterium avium
RTTTSGPTPPPAAV

SEQ ID NO: 139632 - protein, 20 aa, Mycobacterium avium
RVPGGTVQEGHDHCAGEGSP

SEQ ID NO: 139633 - protein, 13 aa, Mycobacterium avium
SAAAALAEDGGVE

SEQ ID NO: 139634 - protein, 10 aa, Mycobacterium avium
SAAPPGQPTW

SEQ ID NO: 139635 - protein, 6 aa, Mycobacterium avium
SAARPA

SEQ ID NO: 139636 - protein, 9 aa, Mycobacterium avium
SADDSETVR

SEQ ID NO: 139637 - protein, 7 aa, Mycobacterium avium
SADPAER

SEQ ID NO: 139638 - protein, 7 aa, Mycobacterium avium
SAEPQTS

SEQ ID NO: 139639 - protein, 5 aa, Mycobacterium avium
SAFTA

SEQ ID NO: 139640 - protein, 9 aa, Mycobacterium avium
SAGAPGDPL

SEQ ID NO: 139641 - protein, 9 aa, Mycobacterium avium
SAGKTPTAV

SEQ ID NO: 139642 - protein, 15 aa, Mycobacterium avium
SAHQPPPGGAGPGSV

SEQ ID NO: 139643 - protein, 19 aa, Mycobacterium avium
SAHSAAAAAQHETAGTAYT

SEQ ID NO: 139644 - protein, 14 aa, Mycobacterium avium
SALPPEVTEYGAAN

SEQ ID NO: 139645 - protein, 35 aa, Mycobacterium avium
SANNSTNESGVTAQNAAVTAANANAAANKAVTQSF

SEQ ID NO: 139646 - protein, 6 aa, Mycobacterium avium
SANRDN

SEQ ID NO: 139647 - protein, 4 aa, Mycobacterium avium
SAPA

SEQ ID NO: 139648 - protein, 19 aa, Mycobacterium avium
SAPHTSARTTCPAGPTPAT

SEQ ID NO: 139649 - protein, 7 aa, Mycobacterium avium
SAPPAAA

SEQ ID NO: 139650 - protein, 6 aa, Mycobacterium avium
SAPPQT

SEQ ID NO: 139651 - protein, 17 aa, Mycobacterium avium
SAPQASATCNLSDKDDQ

SEQ ID NO: 139652 - protein, 4 aa, Mycobacterium avium
SAPR

SEQ ID NO: 139653 - protein, 5 aa, Mycobacterium avium
SAQHG

SEQ ID NO: 139654 - protein, 13 aa, Mycobacterium avium
SARVTSPDPEATY

SEQ ID NO: 139655 - protein, 4 aa, Mycobacterium avium
SARW

SEQ ID NO: 139656 - protein, 10 aa, Mycobacterium avium
SASPYVPHSG

SEQ ID NO: 139657 - protein, 7 aa, Mycobacterium avium
SAYPTVE

SEQ ID NO: 139658 - protein, 23 aa, Mycobacterium avium
SDDPAARAEADATVDTLPGPLST

SEQ ID NO: 139659 - protein, 8 aa, Mycobacterium avium
SDETGTRR

SEQ ID NO: 139660 - protein, 6 aa, Mycobacterium avium
SDFGKA

SEQ ID NO: 139661 - protein, 14 aa, Mycobacterium avium
SDGQPLTGSAHRRA

SEQ ID NO: 139662 - protein, 10 aa, Mycobacterium avium
SDGRSVTPVD

SEQ ID NO: 139663 - protein, 6 aa, Mycobacterium avium
SDGSEI

SEQ ID NO: 139664 - protein, 5 aa, Mycobacterium avium
SDGTP

SEQ ID NO: 139665 - protein, 5 aa, Mycobacterium avium
SDLSG

SEQ ID NO: 139666 - protein, 6 aa, Mycobacterium avium
SDPQFQ

SEQ ID NO: 139667 - protein, 9 aa, Mycobacterium avium
SDQNPSNVK

SEQ ID NO: 139668 - protein, 6 aa, Mycobacterium avium
SEAGYT

SEQ ID NO: 139669 - protein, 8 aa, Mycobacterium avium
SEARGPLH

SEQ ID NO: 139670 - protein, 19 aa, Mycobacterium avium
SEATGNAPPPGGPPPSPRA

SEQ ID NO: 139671 - protein, 4 aa, Mycobacterium avium
SEPE

SEQ ID NO: 139672 - protein, 7 aa, Mycobacterium avium
SETAGHT

SEQ ID NO: 139673 - protein, 11 aa, Mycobacterium avium
SEYAGSGSTAV

SEQ ID NO: 139674 - protein, 18 aa, Mycobacterium avium
SFTTTSESPLRDGASYGV

SEQ ID NO: 139675 - protein, 10 aa, Mycobacterium avium
SGAAPGLTAY

SEQ ID NO: 139676 - protein, 8 aa, Mycobacterium avium
SGCPGGGG

SEQ ID NO: 139677 - protein, 7 aa, Mycobacterium avium
SGEGADE

SEQ ID NO: 139678 - protein, 10 aa, Mycobacterium avium
SGELDPDDLE

SEQ ID NO: 139679 - protein, 6 aa, Mycobacterium avium
SGEWSK

SEQ ID NO: 139680 - protein, 6 aa, Mycobacterium avium
SGFTTE

SEQ ID NO: 139681 - protein, 15 aa, Mycobacterium avium
SGGGRVLSEDGRRVT

SEQ ID NO: 139682 - protein, 4 aa, Mycobacterium avium
SGGR

SEQ ID NO: 139683 - protein, 15 aa, Mycobacterium avium
SGKPTKVFGDGTNTR

SEQ ID NO: 139684 - protein, 5 aa, Mycobacterium avium
SGKVD

SEQ ID NO: 139685 - protein, 6 aa, Mycobacterium avium
SGLSVD

SEQ ID NO: 139686 - protein, 7 aa, Mycobacterium avium
SGPAGAL

SEQ ID NO: 139687 - protein, 4 aa, Mycobacterium avium
SGPW

SEQ ID NO: 139688 - protein, 5 aa, Mycobacterium avium
SGQGG

SEQ ID NO: 139689 - protein, 11 aa, Mycobacterium avium
SGQVQGVPDTL

SEQ ID NO: 139690 - protein, 4 aa, Mycobacterium avium
SGRI

SEQ ID NO: 139691 - protein, 12 aa, Mycobacterium avium
SGSSLAGNSRAT

SEQ ID NO: 139692 - protein, 18 aa, Mycobacterium avium
SGTAKPAPNLKPRPLSGA

SEQ ID NO: 139693 - protein, 23 aa, Mycobacterium avium
SGTTTAYPLPHPGDGPAPKPVTL

SEQ ID NO: 139694 - protein, 8 aa, Mycobacterium avium
SGVTPTAV

SEQ ID NO: 139695 - protein, 14 aa, Mycobacterium avium
SHAGHPAPPANAPV

SEQ ID NO: 139696 - protein, 24 aa, Mycobacterium avium
SIAGNAVKAGGNVPRNNNSQQQYP

SEQ ID NO: 139697 - protein, 8 aa, Mycobacterium avium
SKNPTRWG

SEQ ID NO: 139698 - protein, 9 aa, Mycobacterium avium
SKPGTGSTF

SEQ ID NO: 139699 - protein, 9 aa, Mycobacterium avium
SKPLPDGMR

SEQ ID NO: 139700 - protein, 5 aa, Mycobacterium avium
SKSKY

SEQ ID NO: 139701 - protein, 9 aa, Mycobacterium avium
SLPADAVET

SEQ ID NO: 139702 - protein, 6 aa, Mycobacterium avium
SLPQRA

SEQ ID NO: 139703 - protein, 10 aa, Mycobacterium avium
SLPRTSSGKL

SEQ ID NO: 139704 - protein, 9 aa, Mycobacterium avium
SLRKEGRER

SEQ ID NO: 139705 - protein, 7 aa, Mycobacterium avium
SMGTTTT

SEQ ID NO: 139706 - protein, 4 aa, Mycobacterium avium
SNNF

SEQ ID NO: 139707 - protein, 4 aa, Mycobacterium avium
SNPV

SEQ ID NO: 139708 - protein, 13 aa, Mycobacterium avium
SNQDRTGANPTPS

SEQ ID NO: 139709 - protein, 8 aa, Mycobacterium avium
SPALGSPQ

SEQ ID NO: 139710 - protein, 10 aa, Mycobacterium avium
SPDAAAAPLI

SEQ ID NO: 139711 - protein, 11 aa, Mycobacterium avium
SPDRSARLGQH

SEQ ID NO: 139712 - protein, 20 aa, Mycobacterium avium
SPDTAGNYAGYNYDNPRATG

SEQ ID NO: 139713 - protein, 5 aa, Mycobacterium avium
SPEEA

SEQ ID NO: 139714 - protein, 6 aa, Mycobacterium avium
SPEQAS

SEQ ID NO: 139715 - protein, 11 aa, Mycobacterium avium
SPGVVDADPSR

SEQ ID NO: 139716 - protein, 21 aa, Mycobacterium avium
SPIQYGQSEQWSMDGGTAQPH

SEQ ID NO: 139717 - protein, 6 aa, Mycobacterium avium
SPITSV

SEQ ID NO: 139718 - protein, 8 aa, Mycobacterium avium
SPPGQRQQ

SEQ ID NO: 139719 - protein, 4 aa, Mycobacterium avium
SPPL

SEQ ID NO: 139720 - protein, 4 aa, Mycobacterium avium
SPQF

SEQ ID NO: 139721 - protein, 16 aa, Mycobacterium avium
SPVEDVPKHSAEDDAD

SEQ ID NO: 139722 - protein, 7 aa, Mycobacterium avium
SQAGARS

SEQ ID NO: 139723 - protein, 7 aa, Mycobacterium avium
SQKRSER

SEQ ID NO: 139724 - protein, 8 aa, Mycobacterium avium
SQPGADQQ

SEQ ID NO: 139725 - protein, 5 aa, Mycobacterium avium
SQQTP

SEQ ID NO: 139726 - protein, 13 aa, Mycobacterium avium
SQRAGDVGARHDA

SEQ ID NO: 139727 - protein, 17 aa, Mycobacterium avium
SQTDSSLEVRGSGSYDG

SEQ ID NO: 139728 - protein, 5 aa, Mycobacterium avium
SQTIS

SEQ ID NO: 139729 - protein, 5 aa, Mycobacterium avium
SRAGD

SEQ ID NO: 139730 - protein, 6 aa, Mycobacterium avium
SRDSTR

SEQ ID NO: 139731 - protein, 4 aa, Mycobacterium avium
SRGA

SEQ ID NO: 139732 - protein, 13 aa, Mycobacterium avium
SRGGSGSADMSMT

SEQ ID NO: 139733 - protein, 8 aa, Mycobacterium avium
SRPDASST

SEQ ID NO: 139734 - protein, 8 aa, Mycobacterium avium
SRRRRGDN

SEQ ID NO: 139735 - protein, 14 aa, Mycobacterium avium
SRTDAHGNPLSQQE

SEQ ID NO: 139736 - protein, 9 aa, Mycobacterium avium
SSACAAGPR

SEQ ID NO: 139737 - protein, 20 aa, Mycobacterium avium
SSATSTTTTPTTSVTTSTTT

SEQ ID NO: 139738 - protein, 8 aa, Mycobacterium avium
SSGPGPAS

SEQ ID NO: 139739 - protein, 7 aa, Mycobacterium avium
SSGTTDL

SEQ ID NO: 139740 - protein, 7 aa, Mycobacterium avium
SSITPDL

SEQ ID NO: 139741 - protein, 7 aa, Mycobacterium avium
SSLAPGA

SEQ ID NO: 139742 - protein, 26 aa, Mycobacterium avium
SSMDAQNAAAAAPTTSIAPAAADEVS

SEQ ID NO: 139743 - protein, 8 aa, Mycobacterium avium
SSNAERTA

SEQ ID NO: 139744 - protein, 10 aa, Mycobacterium avium
SSNTKQEYRG

SEQ ID NO: 139745 - protein, 6 aa, Mycobacterium avium
SSPLTV

SEQ ID NO: 139746 - protein, 37 aa, Mycobacterium avium
SSPQHASTQPGTTPPVKSAAPTSSGATTTPAPGGGAL

SEQ ID NO: 139747 - protein, 5 aa, Mycobacterium avium
SSQAG

SEQ ID NO: 139748 - protein, 4 aa, Mycobacterium avium
SSQP

SEQ ID NO: 139749 - protein, 19 aa, Mycobacterium avium
SSTFAGKDKTVGPSGACGQ

SEQ ID NO: 139750 - protein, 6 aa, Mycobacterium avium
SSTNYN

SEQ ID NO: 139751 - protein, 14 aa, Mycobacterium avium
SSVAGYSESASAEA

SEQ ID NO: 139752 - protein, 11 aa, Mycobacterium avium
STAGNKAPEHH

SEQ ID NO: 139753 - protein, 4 aa, Mycobacterium avium
STGE

SEQ ID NO: 139754 - protein, 16 aa, Mycobacterium avium
STGGATGSGSSGSSAM

SEQ ID NO: 139755 - protein, 16 aa, Mycobacterium avium
STGLERAEDPLLNGSD

SEQ ID NO: 139756 - protein, 6 aa, Mycobacterium avium
STNLGA

SEQ ID NO: 139757 - protein, 5 aa, Mycobacterium avium
STNPD

SEQ ID NO: 139758 - protein, 10 aa, Mycobacterium avium
STNRGSENLE

SEQ ID NO: 139759 - protein, 7 aa, Mycobacterium avium
STPEQFD

SEQ ID NO: 139760 - protein, 13 aa, Mycobacterium avium
STPPPDGVGAAFS

SEQ ID NO: 139761 - protein, 6 aa, Mycobacterium avium
STRTGV

SEQ ID NO: 139762 - protein, 27 aa, Mycobacterium avium
STSDGVTIGGTAGITPGVTGPVTGVPG

SEQ ID NO: 139763 - protein, 36 aa, Mycobacterium avium
STSHPRSETSAASSLPPATSTPIAPPATTPLPPPEA

SEQ ID NO: 139764 - protein, 8 aa, Mycobacterium avium
STTDPHSR

SEQ ID NO: 139765 - protein, 10 aa, Mycobacterium avium
STTKITEAVP

SEQ ID NO: 139766 - protein, 11 aa, Mycobacterium avium
SVDDQGKRDVS

SEQ ID NO: 139767 - protein, 15 aa, Mycobacterium avium
SVDGPVPHYPAPGGV

SEQ ID NO: 139768 - protein, 5 aa, Mycobacterium avium
SVEPA

SEQ ID NO: 139769 - protein, 6 aa, Mycobacterium avium
SVGATA

SEQ ID NO: 139770 - protein, 28 aa, Mycobacterium avium
SVSASVSASSVTSSVRESQRQQSLTTKA

SEQ ID NO: 139771 - protein, 15 aa, Mycobacterium avium
SVSATDTLTGAQENL

SEQ ID NO: 139772 - protein, 8 aa, Mycobacterium avium
SWGRDPAT

SEQ ID NO: 139773 - protein, 11 aa, Mycobacterium avium
SYAAATAAGWP

SEQ ID NO: 139774 - protein, 6 aa, Mycobacterium avium
SYGARQ

SEQ ID NO: 139775 - protein, 8 aa, Mycobacterium avium
SYPGDGRP

SEQ ID NO: 139776 - protein, 6 aa, Mycobacterium avium
SYTPDN

SEQ ID NO: 139777 - protein, 8 aa, Mycobacterium avium
TAAGGRAT

SEQ ID NO: 139778 - protein, 10 aa, Mycobacterium avium
TAAPAQGAVG

SEQ ID NO: 139779 - protein, 14 aa, Mycobacterium avium
TAATDSYKMSGGQG

SEQ ID NO: 139780 - protein, 8 aa, Mycobacterium avium
TADDATHQ

SEQ ID NO: 139781 - protein, 15 aa, Mycobacterium avium
TADDRVPYAGGPGKA

SEQ ID NO: 139782 - protein, 6 aa, Mycobacterium avium
TADPGV

SEQ ID NO: 139783 - protein, 11 aa, Mycobacterium avium
TAELPTGPGVS

SEQ ID NO: 139784 - protein, 5 aa, Mycobacterium avium
TAELT

SEQ ID NO: 139785 - protein, 9 aa, Mycobacterium avium
TAGNIDRGR

SEQ ID NO: 139786 - protein, 6 aa, Mycobacterium avium
TAGREP

SEQ ID NO: 139787 - protein, 12 aa, Mycobacterium avium
TAGSNDYSPLES

SEQ ID NO: 139788 - protein, 10 aa, Mycobacterium avium
TAPIGGAPAE

SEQ ID NO: 139789 - protein, 8 aa, Mycobacterium avium
TAQAEQQI

SEQ ID NO: 139790 - protein, 31 aa, Mycobacterium avium
TARDNAAAAQHDLEASQQAVKDANAAIAGAQ

SEQ ID NO: 139791 - protein, 11 aa, Mycobacterium avium
TASVDDPAGVR

SEQ ID NO: 139792 - protein, 10 aa, Mycobacterium avium
TAVGPEPAGL

SEQ ID NO: 139793 - protein, 13 aa, Mycobacterium avium
TDADLAKNPDLSV

SEQ ID NO: 139794 - protein, 9 aa, Mycobacterium avium
TDAQQSGAL

SEQ ID NO: 139795 - protein, 8 aa, Mycobacterium avium
TDARGPLG

SEQ ID NO: 139796 - protein, 11 aa, Mycobacterium avium
TDASTNQGPAG

SEQ ID NO: 139797 - protein, 6 aa, Mycobacterium avium
TDCHRD

SEQ ID NO: 139798 - protein, 7 aa, Mycobacterium avium
TDGDGEA

SEQ ID NO: 139799 - protein, 12 aa, Mycobacterium avium
TDIGKKNPQWTG

SEQ ID NO: 139800 - protein, 10 aa, Mycobacterium avium
TDNNGNGARV

SEQ ID NO: 139801 - protein, 8 aa, Mycobacterium avium
TDPGVNYR

SEQ ID NO: 139802 - protein, 5 aa, Mycobacterium avium
TDRSG

SEQ ID NO: 139803 - protein, 8 aa, Mycobacterium avium
TDSPTRSV

SEQ ID NO: 139804 - protein, 9 aa, Mycobacterium avium
TDTPAHRAA

SEQ ID NO: 139805 - protein, 11 aa, Mycobacterium avium
TEAAARNDAKV

SEQ ID NO: 139806 - protein, 4 aa, Mycobacterium avium
TEAD

SEQ ID NO: 139807 - protein, 6 aa, Mycobacterium avium
TESLGR

SEQ ID NO: 139808 - protein, 4 aa, Mycobacterium avium
TETA

SEQ ID NO: 139809 - protein, 5 aa, Mycobacterium avium
TEVTS

SEQ ID NO: 139810 - protein, 8 aa, Mycobacterium avium
TGAAPGQH

SEQ ID NO: 139811 - protein, 5 aa, Mycobacterium avium
TGAGN

SEQ ID NO: 139812 - protein, 9 aa, Mycobacterium avium
TGASEGGFN

SEQ ID NO: 139813 - protein, 5 aa, Mycobacterium avium
TGASG

SEQ ID NO: 139814 - protein, 42 aa, Mycobacterium avium
TGCGSDENHRGTAAPSISGTTGTAGCGGKNKLTAEGSTAQEN

SEQ ID NO: 139815 - protein, 7 aa, Mycobacterium avium
TGEAPRE

SEQ ID NO: 139816 - protein, 8 aa, Mycobacterium avium
TGGDATRI

SEQ ID NO: 139817 - protein, 21 aa, Mycobacterium avium
TGHGAGNAHAPIPAPHAPTVK

SEQ ID NO: 139818 - protein, 17 aa, Mycobacterium avium
TGNGNNLSGYSNPQVDN

SEQ ID NO: 139819 - protein, 9 aa, Mycobacterium avium
TGRAAHTPT

SEQ ID NO: 139820 - protein, 5 aa, Mycobacterium avium
TGRDR

SEQ ID NO: 139821 - protein, 4 aa, Mycobacterium avium
TGRT

SEQ ID NO: 139822 - protein, 16 aa, Mycobacterium avium
TGSAAAQPSPSTARPF

SEQ ID NO: 139823 - protein, 8 aa, Mycobacterium avium
TGSLGRAA

SEQ ID NO: 139824 - protein, 5 aa, Mycobacterium avium
TGSLT

SEQ ID NO: 139825 - protein, 6 aa, Mycobacterium avium
TGTAPQ

SEQ ID NO: 139826 - protein, 9 aa, Mycobacterium avium
TGTGGETVG

SEQ ID NO: 139827 - protein, 11 aa, Mycobacterium avium
TGTGGTAVASE

SEQ ID NO: 139828 - protein, 10 aa, Mycobacterium avium
TGVETSDRQL

SEQ ID NO: 139829 - protein, 14 aa, Mycobacterium avium
TIPGTGKVHASAPS

SEQ ID NO: 139830 - protein, 5 aa, Mycobacterium avium
TKQPL

SEQ ID NO: 139831 - protein, 8 aa, Mycobacterium avium
TLASGGTW

SEQ ID NO: 139832 - protein, 5 aa, Mycobacterium avium
TLNTQ

SEQ ID NO: 139833 - protein, 8 aa, Mycobacterium avium
TLPASAAK

SEQ ID NO: 139834 - protein, 9 aa, Mycobacterium avium
TLPPPTPVG

SEQ ID NO: 139835 - protein, 11 aa, Mycobacterium avium
TLTSRDQINGQ

SEQ ID NO: 139836 - protein, 5 aa, Mycobacterium avium
TNAFP

SEQ ID NO: 139837 - protein, 8 aa, Mycobacterium avium
TNAISPST

SEQ ID NO: 139838 - protein, 8 aa, Mycobacterium avium
TNQPNNAN

SEQ ID NO: 139839 - protein, 11 aa, Mycobacterium avium
TNRAVGGLGPE

SEQ ID NO: 139840 - protein, 13 aa, Mycobacterium avium
TNRLGDAQHPLTA

SEQ ID NO: 139841 - protein, 17 aa, Mycobacterium avium
TNRRKPLNDNDNDSGAQ

SEQ ID NO: 139842 - protein, 6 aa, Mycobacterium avium
TNSEHA

SEQ ID NO: 139843 - protein, 4 aa, Mycobacterium avium
TNSR

SEQ ID NO: 139844 - protein, 9 aa, Mycobacterium avium
TPAAADRAA

SEQ ID NO: 139845 - protein, 11 aa, Mycobacterium avium
TPAVSKADCAD

SEQ ID NO: 139846 - protein, 5 aa, Mycobacterium avium
TPEDM

SEQ ID NO: 139847 - protein, 5 aa, Mycobacterium avium
TPLDR

SEQ ID NO: 139848 - protein, 30 aa, Mycobacterium avium
TPPGGLTGPAVRPAQPSGCAASDYPGALPK

SEQ ID NO: 139849 - protein, 5 aa, Mycobacterium avium
TPPYK

SEQ ID NO: 139850 - protein, 10 aa, Mycobacterium avium
TPQQAPTQVP

SEQ ID NO: 139851 - protein, 22 aa, Mycobacterium avium
TPQYSNPEAGGSAAITGYRASN

SEQ ID NO: 139852 - protein, 5 aa, Mycobacterium avium
TPRTS

SEQ ID NO: 139853 - protein, 4 aa, Mycobacterium avium
TPTA

SEQ ID NO: 139854 - protein, 6 aa, Mycobacterium avium
TPTTQI

SEQ ID NO: 139855 - protein, 5 aa, Mycobacterium avium
TQGQA

SEQ ID NO: 139856 - protein, 5 aa, Mycobacterium avium
TQGRG

SEQ ID NO: 139857 - protein, 7 aa, Mycobacterium avium
TQPGQGD

SEQ ID NO: 139858 - protein, 7 aa, Mycobacterium avium
TRAPTVN

SEQ ID NO: 139859 - protein, 10 aa, Mycobacterium avium
TRDTEQARYD

SEQ ID NO: 139860 - protein, 7 aa, Mycobacterium avium
TRGVDDR

SEQ ID NO: 139861 - protein, 10 aa, Mycobacterium avium
TRLSTGADYE

SEQ ID NO: 139862 - protein, 11 aa, Mycobacterium avium
TRNPRTAEPIP

SEQ ID NO: 139863 - protein, 9 aa, Mycobacterium avium
TRNQTSEQI

SEQ ID NO: 139864 - protein, 10 aa, Mycobacterium avium
TRQANPKLPA

SEQ ID NO: 139865 - protein, 13 aa, Mycobacterium avium
TRRGGSDVRYGTE

SEQ ID NO: 139866 - protein, 13 aa, Mycobacterium avium
TRTGSATVDYTPQ

SEQ ID NO: 139867 - protein, 10 aa, Mycobacterium avium
TRTPDPADAR

SEQ ID NO: 139868 - protein, 30 aa, Mycobacterium avium
TSAAPDTAPVTAVPGGVPSMATAGRGGYGL

SEQ ID NO: 139869 - protein, 9 aa, Mycobacterium avium
TSAFSGPTM

SEQ ID NO: 139870 - protein, 8 aa, Mycobacterium avium
TSAGDPAL

SEQ ID NO: 139871 - protein, 4 aa, Mycobacterium avium
TSFP

SEQ ID NO: 139872 - protein, 6 aa, Mycobacterium avium
TSGPDK

SEQ ID NO: 139873 - protein, 14 aa, Mycobacterium avium
TSGPPQVEAATAGK

SEQ ID NO: 139874 - protein, 8 aa, Mycobacterium avium
TSGVPERQ

SEQ ID NO: 139875 - protein, 4 aa, Mycobacterium avium
TSNA

SEQ ID NO: 139876 - protein, 21 aa, Mycobacterium avium
TSRPPAQLSSTASVTVDGKDR

SEQ ID NO: 139877 - protein, 32 aa, Mycobacterium avium
TSSGGSIYGTPPTYPTPETVPTDPASPYAAGK

SEQ ID NO: 139878 - protein, 7 aa, Mycobacterium avium
TSTVPGG

SEQ ID NO: 139879 - protein, 4 aa, Mycobacterium avium
TTAT

SEQ ID NO: 139880 - protein, 6 aa, Mycobacterium avium
TTGDLA

SEQ ID NO: 139881 - protein, 5 aa, Mycobacterium avium
TTGNM

SEQ ID NO: 139882 - protein, 15 aa, Mycobacterium avium
TTIDPKAQQAAEKAV

SEQ ID NO: 139883 - protein, 12 aa, Mycobacterium avium
TTPAHPSPQKIT

SEQ ID NO: 139884 - protein, 12 aa, Mycobacterium avium
TTPANPSPQKIT

SEQ ID NO: 139885 - protein, 9 aa, Mycobacterium avium
TTRGSQLTP

SEQ ID NO: 139886 - protein, 10 aa, Mycobacterium avium
TTSDQGRADL

SEQ ID NO: 139887 - protein, 6 aa, Mycobacterium avium
TTSGDH

SEQ ID NO: 139888 - protein, 9 aa, Mycobacterium avium
TVGQSTRTT

SEQ ID NO: 139889 - protein, 18 aa, Mycobacterium avium
TVPPDQARAQNQTTGPNG

SEQ ID NO: 139890 - protein, 5 aa, Mycobacterium avium
TYGVP

SEQ ID NO: 139891 - protein, 8 aa, Mycobacterium avium
VAARGGNG

SEQ ID NO: 139892 - protein, 11 aa, Mycobacterium avium
VAASAVSGSVI

SEQ ID NO: 139893 - protein, 7 aa, Mycobacterium avium
VADGARI

SEQ ID NO: 139894 - protein, 4 aa, Mycobacterium avium
VANT

SEQ ID NO: 139895 - protein, 13 aa, Mycobacterium avium
VAPNASETQSMST

SEQ ID NO: 139896 - protein, 16 aa, Mycobacterium avium
VAPPAADTNDNGDFSR

SEQ ID NO: 139897 - protein, 13 aa, Mycobacterium avium
VDAADAPAYGGHN

SEQ ID NO: 139898 - protein, 5 aa, Mycobacterium avium
VDARR

SEQ ID NO: 139899 - protein, 7 aa, Mycobacterium avium
VDDAGAA

SEQ ID NO: 139900 - protein, 9 aa, Mycobacterium avium
VDENAQPPV

SEQ ID NO: 139901 - protein, 5 aa, Mycobacterium avium
VDGNT

SEQ ID NO: 139902 - protein, 8 aa, Mycobacterium avium
VDGRPTGH

SEQ ID NO: 139903 - protein, 6 aa, Mycobacterium avium
VDGVTG

SEQ ID NO: 139904 - protein, 16 aa, Mycobacterium avium
VDPPTGTPPVPPENAP

SEQ ID NO: 139905 - protein, 5 aa, Mycobacterium avium
VDPSK

SEQ ID NO: 139906 - protein, 8 aa, Mycobacterium avium
VDSGAGGA

SEQ ID NO: 139907 - protein, 7 aa, Mycobacterium avium
VEGGGFK

SEQ ID NO: 139908 - protein, 5 aa, Mycobacterium avium
VGAAA

SEQ ID NO: 139909 - protein, 14 aa, Mycobacterium avium
VGAAAPAGADPGPF

SEQ ID NO: 139910 - protein, 10 aa, Mycobacterium avium
VGAGDPAAGV

SEQ ID NO: 139911 - protein, 10 aa, Mycobacterium avium
VGAGQNGLAD

SEQ ID NO: 139912 - protein, 12 aa, Mycobacterium avium
VGGQGGTPNAVA

SEQ ID NO: 139913 - protein, 4 aa, Mycobacterium avium
VGHD

SEQ ID NO: 139914 - protein, 7 aa, Mycobacterium avium
VGPPTTV

SEQ ID NO: 139915 - protein, 5 aa, Mycobacterium avium
VGQGG

SEQ ID NO: 139916 - protein, 7 aa, Mycobacterium avium
VGRGQPL

SEQ ID NO: 139917 - protein, 9 aa, Mycobacterium avium
VGRGTGGDH

SEQ ID NO: 139918 - protein, 20 aa, Mycobacterium avium
VGSGRAAGWATANSQDQANQ

SEQ ID NO: 139919 - protein, 20 aa, Mycobacterium avium
VGTDPAPSVGAGRRDLGFLS

SEQ ID NO: 139920 - protein, 43 aa, Mycobacterium avium
VKARSGDGKAPARKSPAKKTAAKKAPAKKGAAKKAPAKKAASR

SEQ ID NO: 139921 - protein, 9 aa, Mycobacterium avium
VKPSFGPDY

SEQ ID NO: 139922 - protein, 8 aa, Mycobacterium avium
VLPDPGPI

SEQ ID NO: 139923 - protein, 9 aa, Mycobacterium avium
VLPPPATRT

SEQ ID NO: 139924 - protein, 9 aa, Mycobacterium avium
VNDSEAQNF

SEQ ID NO: 139925 - protein, 6 aa, Mycobacterium avium
VNGGDD

SEQ ID NO: 139926 - protein, 5 aa, Mycobacterium avium
VNGNG

SEQ ID NO: 139927 - protein, 9 aa, Mycobacterium avium
VNRPDGLPA

SEQ ID NO: 139928 - protein, 8 aa, Mycobacterium avium
VNRPTPDR

SEQ ID NO: 139929 - protein, 21 aa, Mycobacterium avium
VNSSAKQGEVVGTTPSGATIP

SEQ ID NO: 139930 - protein, 7 aa, Mycobacterium avium
VPAPGTG

SEQ ID NO: 139931 - protein, 7 aa, Mycobacterium avium
VPDPNVP

SEQ ID NO: 139932 - protein, 5 aa, Mycobacterium avium
VPGLS

SEQ ID NO: 139933 - protein, 5 aa, Mycobacterium avium
VPGMP

SEQ ID NO: 139934 - protein, 5 aa, Mycobacterium avium
VPGPQ

SEQ ID NO: 139935 - protein, 19 aa, Mycobacterium avium
VPGQRIDPAAPQKPDPWWR

SEQ ID NO: 139936 - protein, 8 aa, Mycobacterium avium
VPLGKDTR

SEQ ID NO: 139937 - protein, 17 aa, Mycobacterium avium
VPPGVPASAVPPPMPPE

SEQ ID NO: 139938 - protein, 5 aa, Mycobacterium avium
VPPPV

SEQ ID NO: 139939 - protein, 5 aa, Mycobacterium avium
VPPVP

SEQ ID NO: 139940 - protein, 7 aa, Mycobacterium avium
VPRQGAR

SEQ ID NO: 139941 - protein, 4 aa, Mycobacterium avium
VPTT

SEQ ID NO: 139942 - protein, 4 aa, Mycobacterium avium
VQGG

SEQ ID NO: 139943 - protein, 5 aa, Mycobacterium avium
VQTPE

SEQ ID NO: 139944 - protein, 10 aa, Mycobacterium avium
VRAPADPDPF

SEQ ID NO: 139945 - protein, 7 aa, Mycobacterium avium
VRDGSAD

SEQ ID NO: 139946 - protein, 9 aa, Mycobacterium avium
VRRGDQRAT

SEQ ID NO: 139947 - protein, 4 aa, Mycobacterium avium
VRSD

SEQ ID NO: 139948 - protein, 4 aa, Mycobacterium avium
VSCD

SEQ ID NO: 139949 - protein, 10 aa, Mycobacterium avium
VSDTGERGID

SEQ ID NO: 139950 - protein, 6 aa, Mycobacterium avium
VSDTYG

SEQ ID NO: 139951 - protein, 6 aa, Mycobacterium avium
VSKSMG

SEQ ID NO: 139952 - protein, 5 aa, Mycobacterium avium
VSNAG

SEQ ID NO: 139953 - protein, 15 aa, Mycobacterium avium
VSSPATAAAEGGGTT

SEQ ID NO: 139954 - protein, 12 aa, Mycobacterium avium
VSSPPRKITVHR

SEQ ID NO: 139955 - protein, 30 aa, Mycobacterium avium
VSTAGAVSTNDKAPAPSPILTAGSDKPECI

SEQ ID NO: 139956 - protein, 8 aa, Mycobacterium avium
VTARDREV

SEQ ID NO: 139957 - protein, 12 aa, Mycobacterium avium
VTDKSRAVGSSG

SEQ ID NO: 139958 - protein, 5 aa, Mycobacterium avium
VTGGD

SEQ ID NO: 139959 - protein, 12 aa, Mycobacterium avium
VTGTTSDPPFTA

SEQ ID NO: 139960 - protein, 7 aa, Mycobacterium avium
VTNGQTA

SEQ ID NO: 139961 - protein, 18 aa, Mycobacterium avium
VTNGTATPDTRVAPAYRQ

SEQ ID NO: 139962 - protein, 19 aa, Mycobacterium avium
VTPNADAYKPRASDAPDAL

SEQ ID NO: 139963 - protein, 10 aa, Mycobacterium avium
VTQTSATDQT

SEQ ID NO: 139964 - protein, 4 aa, Mycobacterium avium
VTTN

SEQ ID NO: 139965 - protein, 28 aa, Mycobacterium avium
VVDRDGNELSRDTEAAISGPTGGPIEGP

SEQ ID NO: 139966 - protein, 11 aa, Mycobacterium avium
VVSGGSRGIGR

SEQ ID NO: 139967 - protein, 6 aa, Mycobacterium avium
VYEADG

SEQ ID NO: 139968 - protein, 12 aa, Mycobacterium avium
VYGPRQDPHGEA

SEQ ID NO: 139969 - protein, 25 aa, Mycobacterium avium
WKPPAPPQARPDTCKASDGPTADTV

SEQ ID NO: 139970 - protein, 34 aa, Mycobacterium avium
WNKGAGKTFNGGVGTGAVGNTGTAAAVKSTEGAI

SEQ ID NO: 139971 - protein, 5 aa, Mycobacterium avium
WPGPE

SEQ ID NO: 139972 - protein, 7 aa, Mycobacterium avium
WPPKTEE

SEQ ID NO: 139973 - protein, 11 aa, Mycobacterium avium
WPSGPNSSRGH

SEQ ID NO: 139974 - protein, 4 aa, Mycobacterium avium
WRRT

SEQ ID NO: 139975 - protein, 9 aa, Mycobacterium avium
WSAPTSTHV

SEQ ID NO: 139976 - protein, 16 aa, Mycobacterium avium
WTNPSNEGQPVNDSGD

SEQ ID NO: 139977 - protein, 13 aa, Mycobacterium avium
WTTPTSYESRRGE

SEQ ID NO: 139978 - protein, 15 aa, Mycobacterium avium
YASDGKGDGVADPQN

SEQ ID NO: 139979 - protein, 7 aa, Mycobacterium avium
YDEGNAE

SEQ ID NO: 139980 - protein, 6 aa, Mycobacterium avium
YDRGPE

SEQ ID NO: 139981 - protein, 8 aa, Mycobacterium avium
YDRPREDR

SEQ ID NO: 139982 - protein, 23 aa, Mycobacterium avium
YETAAPDPGHAGGATEGPRGTDP

SEQ ID NO: 139983 - protein, 9 aa, Mycobacterium avium
YGGSDANGF

SEQ ID NO: 139984 - protein, 13 aa, Mycobacterium avium
YGGTGYPAGKGAV

SEQ ID NO: 139985 - protein, 8 aa, Mycobacterium avium
YGGVDGNG

SEQ ID NO: 139986 - protein, 4 aa, Mycobacterium avium
YPAN

SEQ ID NO: 139987 - protein, 6 aa, Mycobacterium avium
YPDEQA

SEQ ID NO: 139988 - protein, 10 aa, Mycobacterium avium
YPGAAPGLPA

SEQ ID NO: 139989 - protein, 6 aa, Mycobacterium avium
YPGKHT

SEQ ID NO: 139990 - protein, 5 aa, Mycobacterium avium
YPGRR

SEQ ID NO: 139991 - protein, 5 aa, Mycobacterium avium
YPLPE

SEQ ID NO: 139992 - protein, 7 aa, Mycobacterium avium
YQGPNAR

SEQ ID NO: 139993 - protein, 13 aa, Mycobacterium avium
YRPGPDGGFPPVA

SEQ ID NO: 139994 - protein, 12 aa, Mycobacterium avium
YSGGPTLSPGAA

SEQ ID NO: 139995 - protein, 12 aa, Mycobacterium avium
YSPSADGQQGWS

SEQ ID NO: 139996 - protein, 8 aa, Mycobacterium avium
YSTATADV

SEQ ID NO: 139997 - protein, 4 aa, Mycobacterium avium
YSTT

SEQ ID NO: 139998 - protein, 21 aa, Mycobacterium avium
YTGLPGDPVGPPGAEPPARIP

SEQ ID NO: 139999 - protein, 4 aa, Mycobacterium avium
YTIT

SEQ ID NO: 140000 - protein, 17 aa, Mycobacterium avium
YTPNPNDAPGGPLVERG

SEQ ID NO: 140001 - protein, 20 aa, Mycobacterium avium
YTPNPNDAPGGPLVERGDRN

SEQ ID NO: 140002 - protein, 7 aa, Mycobacterium avium
AAAAGPA

SEQ ID NO: 140003 - protein, 15 aa, Mycobacterium avium
AAAAPAADALAPQYP

SEQ ID NO: 140004 - protein, 14 aa, Mycobacterium avium
AAAEATAPAAGPAV

SEQ ID NO: 140005 - protein, 26 aa, Mycobacterium avium
AAAETGSTGTDSGTQVIPPTAGASEI

SEQ ID NO: 140006 - protein, 10 aa, Mycobacterium avium
AAAGAGRLAG

SEQ ID NO: 140007 - protein, 16 aa, Mycobacterium avium
AAAGAGRLAGAKAGPR

SEQ ID NO: 140008 - protein, 9 aa, Mycobacterium avium
AAAGGTATQ

SEQ ID NO: 140009 - protein, 13 aa, Mycobacterium avium
AAAGNAATKHPAA

SEQ ID NO: 140010 - protein, 6 aa, Mycobacterium avium
AAALGP

SEQ ID NO: 140011 - protein, 15 aa, Mycobacterium avium
AAAPDPGAGTADPPF

SEQ ID NO: 140012 - protein, 11 aa, Mycobacterium avium
AAAPPLPPGRG

SEQ ID NO: 140013 - protein, 9 aa, Mycobacterium avium
AAARESLEQ

SEQ ID NO: 140014 - protein, 11 aa, Mycobacterium avium
AAARNFAESPV

SEQ ID NO: 140015 - protein, 6 aa, Mycobacterium avium
AAARPE

SEQ ID NO: 140016 - protein, 7 aa, Mycobacterium avium
AAASDAG

SEQ ID NO: 140017 - protein, 7 aa, Mycobacterium avium
AAASENW

SEQ ID NO: 140018 - protein, 11 aa, Mycobacterium avium
AAASGKTLGPR

SEQ ID NO: 140019 - protein, 17 aa, Mycobacterium avium
AACGPGRRGLRAPVPDR

SEQ ID NO: 140020 - protein, 9 aa, Mycobacterium avium
AADATAGPQ

SEQ ID NO: 140021 - protein, 5 aa, Mycobacterium avium
AADPV

SEQ ID NO: 140022 - protein, 8 aa, Mycobacterium avium
AADSPRGV

SEQ ID NO: 140023 - protein, 10 aa, Mycobacterium avium
AAEESSVAQA

SEQ ID NO: 140024 - protein, 11 aa, Mycobacterium avium
AAEPAGTGSPL

SEQ ID NO: 140025 - protein, 8 aa, Mycobacterium avium
AAESNPID

SEQ ID NO: 140026 - protein, 9 aa, Mycobacterium avium
AAESNPTDK

SEQ ID NO: 140027 - protein, 20 aa, Mycobacterium avium
AAFQGEPARPAYATAKAGIG

SEQ ID NO: 140028 - protein, 5 aa, Mycobacterium avium
AAGAD

SEQ ID NO: 140029 - protein, 6 aa, Mycobacterium avium
AAGCGA

SEQ ID NO: 140030 - protein, 11 aa, Mycobacterium avium
AAGDGLPSATP

SEQ ID NO: 140031 - protein, 11 aa, Mycobacterium avium
AAGGDAEPGGA

SEQ ID NO: 140032 - protein, 8 aa, Mycobacterium avium
AAGGEIEE

SEQ ID NO: 140033 - protein, 8 aa, Mycobacterium avium
AAGGPDSA

SEQ ID NO: 140034 - protein, 6 aa, Mycobacterium avium
AAGGTE

SEQ ID NO: 140035 - protein, 7 aa, Mycobacterium avium
AAGIPAA

SEQ ID NO: 140036 - protein, 14 aa, Mycobacterium avium
AAGLTSMSEPSPQV

SEQ ID NO: 140037 - protein, 13 aa, Mycobacterium avium
AAGPPKGPAAPPV

SEQ ID NO: 140038 - protein, 8 aa, Mycobacterium avium
AAGSEIEE

SEQ ID NO: 140039 - protein, 5 aa, Mycobacterium avium
AAGSP

SEQ ID NO: 140040 - protein, 6 aa, Mycobacterium avium
AAGSPA

SEQ ID NO: 140041 - protein, 5 aa, Mycobacterium avium
AAGYD

SEQ ID NO: 140042 - protein, 16 aa, Mycobacterium avium
AAGYQPPGGASAPGTY

SEQ ID NO: 140043 - protein, 20 aa, Mycobacterium avium
AAHDHDDHEHGDDHDHDHGF

SEQ ID NO: 140044 - protein, 5 aa, Mycobacterium avium
AAIGQ

SEQ ID NO: 140045 - protein, 11 aa, Mycobacterium avium
AAINPGNSGGA

SEQ ID NO: 140046 - protein, 7 aa, Mycobacterium avium
AAKSHLS

SEQ ID NO: 140047 - protein, 55 aa, Mycobacterium avium
AAKTTAPSSSTPSAPKATSAAGRRYQGVGGSGGGRSSYPPYSPYPPPYRAAWVGS

SEQ ID NO: 140048 - protein, 10 aa, Mycobacterium avium
AALAPTVATR

SEQ ID NO: 140049 - protein, 16 aa, Mycobacterium avium
AALSPGGGAGKAGQFD

SEQ ID NO: 140050 - protein, 4 aa, Mycobacterium avium
AALT

SEQ ID NO: 140051 - protein, 4 aa, Mycobacterium avium
AANP

SEQ ID NO: 140052 - protein, 6 aa, Mycobacterium avium
AANRTQ

SEQ ID NO: 140053 - protein, 18 aa, Mycobacterium avium
AANTGRRCPDPPAPHANP

SEQ ID NO: 140054 - protein, 8 aa, Mycobacterium avium
AAPAFSAA

SEQ ID NO: 140055 - protein, 7 aa, Mycobacterium avium
AAPAPDA

SEQ ID NO: 140056 - protein, 7 aa, Mycobacterium avium
AAPAPEV

SEQ ID NO: 140057 - protein, 7 aa, Mycobacterium avium
AAPDVPG

SEQ ID NO: 140058 - protein, 9 aa, Mycobacterium avium
AAPGLGKTK

SEQ ID NO: 140059 - protein, 10 aa, Mycobacterium avium
AAPGLGKTKI

SEQ ID NO: 140060 - protein, 5 aa, Mycobacterium avium
AAPGP

SEQ ID NO: 140061 - protein, 15 aa, Mycobacterium avium
AAPKNPSAQRLKSGD

SEQ ID NO: 140062 - protein, 14 aa, Mycobacterium avium
AAPKNPSVQRLKSG

SEQ ID NO: 140063 - protein, 10 aa, Mycobacterium avium
AAPLPPGSHS

SEQ ID NO: 140064 - protein, 10 aa, Mycobacterium avium
AAPLPPGSHT

SEQ ID NO: 140065 - protein, 4 aa, Mycobacterium avium
AAPN

SEQ ID NO: 140066 - protein, 9 aa, Mycobacterium avium
AAPNGIPET

SEQ ID NO: 140067 - protein, 6 aa, Mycobacterium avium
AAPPGT

SEQ ID NO: 140068 - protein, 9 aa, Mycobacterium avium
AAPPPAETR

SEQ ID NO: 140069 - protein, 7 aa, Mycobacterium avium
AAPQNRL

SEQ ID NO: 140070 - protein, 9 aa, Mycobacterium avium
AAPSFAPGR

SEQ ID NO: 140071 - protein, 7 aa, Mycobacterium avium
AAPVTPA

SEQ ID NO: 140072 - protein, 7 aa, Mycobacterium avium
AAPYGIP

SEQ ID NO: 140073 - protein, 11 aa, Mycobacterium avium
AAQAEEVSHQA

SEQ ID NO: 140074 - protein, 8 aa, Mycobacterium avium
AAQAQQAL

SEQ ID NO: 140075 - protein, 6 aa, Mycobacterium avium
AAQPPR

SEQ ID NO: 140076 - protein, 9 aa, Mycobacterium avium
AAQSAAPRG

SEQ ID NO: 140077 - protein, 23 aa, Mycobacterium avium
AAQSKSEGTVTDAGLESQRGDSA

SEQ ID NO: 140078 - protein, 6 aa, Mycobacterium avium
AAQTEF

SEQ ID NO: 140079 - protein, 5 aa, Mycobacterium avium
AARAE

SEQ ID NO: 140080 - protein, 6 aa, Mycobacterium avium
AARAGA

SEQ ID NO: 140081 - protein, 12 aa, Mycobacterium avium
AARGDERSATAA

SEQ ID NO: 140082 - protein, 21 aa, Mycobacterium avium
AARGDERSATAAAARLAPAGA

SEQ ID NO: 140083 - protein, 14 aa, Mycobacterium avium
AARQLASGSAPGRR

SEQ ID NO: 140084 - protein, 8 aa, Mycobacterium avium
AARQTADR

SEQ ID NO: 140085 - protein, 7 aa, Mycobacterium avium
AARRDPD

SEQ ID NO: 140086 - protein, 8 aa, Mycobacterium avium
AARTADAT

SEQ ID NO: 140087 - protein, 8 aa, Mycobacterium avium
AARTAEAT

SEQ ID NO: 140088 - protein, 17 aa, Mycobacterium avium
AASARDISGTFRSGGMD

SEQ ID NO: 140089 - protein, 13 aa, Mycobacterium avium
AASAVAPRAYRAA

SEQ ID NO: 140090 - protein, 6 aa, Mycobacterium avium
AASDGT

SEQ ID NO: 140091 - protein, 9 aa, Mycobacterium avium
AASGATADI

SEQ ID NO: 140092 - protein, 10 aa, Mycobacterium avium
AASGATADIT

SEQ ID NO: 140093 - protein, 9 aa, Mycobacterium avium
AASKTAQEH

SEQ ID NO: 140094 - protein, 14 aa, Mycobacterium avium
AASPKTFNAKPGQR

SEQ ID NO: 140095 - protein, 6 aa, Mycobacterium avium
AATAAL

SEQ ID NO: 140096 - protein, 4 aa, Mycobacterium avium
AATD

SEQ ID NO: 140097 - protein, 9 aa, Mycobacterium avium
AATDPQQAT

SEQ ID NO: 140098 - protein, 15 aa, Mycobacterium avium
AATPAETAIPLILFR

SEQ ID NO: 140099 - protein, 15 aa, Mycobacterium avium
AATPAETAIPLMLFR

SEQ ID NO: 140100 - protein, 9 aa, Mycobacterium avium
AATPSRAYA

SEQ ID NO: 140101 - protein, 5 aa, Mycobacterium avium
AATQS

SEQ ID NO: 140102 - protein, 18 aa, Mycobacterium avium
AATTTAATNASTPNPMNT

SEQ ID NO: 140103 - protein, 11 aa, Mycobacterium avium
AAVGSKAAAGA

SEQ ID NO: 140104 - protein, 7 aa, Mycobacterium avium
ACPGERV

SEQ ID NO: 140105 - protein, 43 aa, Mycobacterium avium
ACSPSSPPSSNSSRSPLSRHSRPRRRHRPRPPRSSSPRRIRTR

SEQ ID NO: 140106 - protein, 4 aa, Mycobacterium avium
ADAG

SEQ ID NO: 140107 - protein, 5 aa, Mycobacterium avium
ADAGS

SEQ ID NO: 140108 - protein, 5 aa, Mycobacterium avium
ADDST

SEQ ID NO: 140109 - protein, 9 aa, Mycobacterium avium
ADEDLSTGR

SEQ ID NO: 140110 - protein, 15 aa, Mycobacterium avium
ADENEHSLPQGDDTA

SEQ ID NO: 140111 - protein, 8 aa, Mycobacterium avium
ADEQGRGK

SEQ ID NO: 140112 - protein, 52 aa, Mycobacterium avium
ADEVTAGDPPELPAPGREEPERQQHPEQADGADHPRYGQPPQGIDKRRRPVD

SEQ ID NO: 140113 - protein, 10 aa, Mycobacterium avium
ADGGPGSGSG

SEQ ID NO: 140114 - protein, 10 aa, Mycobacterium avium
ADGPKPNNAY

SEQ ID NO: 140115 - protein, 8 aa, Mycobacterium avium
ADGSSAIA

SEQ ID NO: 140116 - protein, 6 aa, Mycobacterium avium
ADGTPV

SEQ ID NO: 140117 - protein, 7 aa, Mycobacterium avium
ADKVNTI

SEQ ID NO: 140118 - protein, 7 aa, Mycobacterium avium
ADNGSTV

SEQ ID NO: 140119 - protein, 7 aa, Mycobacterium avium
ADPAYTE

SEQ ID NO: 140120 - protein, 7 aa, Mycobacterium avium
ADPDAAG

SEQ ID NO: 140121 - protein, 29 aa, Mycobacterium avium
ADPELGGDRPVHAQGRAAGVGRPVPDGQR

SEQ ID NO: 140122 - protein, 7 aa, Mycobacterium avium
ADPGRRL

SEQ ID NO: 140123 - protein, 7 aa, Mycobacterium avium
ADPNGLN

SEQ ID NO: 140124 - protein, 8 aa, Mycobacterium avium
ADPPGDLG

SEQ ID NO: 140125 - protein, 10 aa, Mycobacterium avium
ADPSRAGDNE

SEQ ID NO: 140126 - protein, 16 aa, Mycobacterium avium
ADPSVSFSNKSNLVQG

SEQ ID NO: 140127 - protein, 6 aa, Mycobacterium avium
ADPTSD

SEQ ID NO: 140128 - protein, 8 aa, Mycobacterium avium
ADQRPYQV

SEQ ID NO: 140129 - protein, 39 aa, Mycobacterium avium
ADREHRDADTPAALAGPRQRADLPPCPAAGTGPGPAALR

SEQ ID NO: 140130 - protein, 6 aa, Mycobacterium avium
ADRTAG

SEQ ID NO: 140131 - protein, 10 aa, Mycobacterium avium
ADSVNKTKEN

SEQ ID NO: 140132 - protein, 7 aa, Mycobacterium avium
ADTGSGS

SEQ ID NO: 140133 - protein, 14 aa, Mycobacterium avium
ADTRTYRDAKSGIE

SEQ ID NO: 140134 - protein, 4 aa, Mycobacterium avium
AEAR

SEQ ID NO: 140135 - protein, 22 aa, Mycobacterium avium
AEARDQARQEATKDRRRAPGTA

SEQ ID NO: 140136 - protein, 22 aa, Mycobacterium avium
AEARDQARQEATKDRRRTPGTA

SEQ ID NO: 140137 - protein, 6 aa, Mycobacterium avium
AEASIG

SEQ ID NO: 140138 - protein, 12 aa, Mycobacterium avium
AEERAATAQGDQ

SEQ ID NO: 140139 - protein, 8 aa, Mycobacterium avium
AEERSVAQ

SEQ ID NO: 140140 - protein, 8 aa, Mycobacterium avium
AEGADPGH

SEQ ID NO: 140141 - protein, 7 aa, Mycobacterium avium
AEGAKQA

SEQ ID NO: 140142 - protein, 8 aa, Mycobacterium avium
AEHRDPEA

SEQ ID NO: 140143 - protein, 4 aa, Mycobacterium avium
AELT

SEQ ID NO: 140144 - protein, 6 aa, Mycobacterium avium
AEPDTQ

SEQ ID NO: 140145 - protein, 7 aa, Mycobacterium avium
AEPDTQR

SEQ ID NO: 140146 - protein, 5 aa, Mycobacterium avium
AEPGS

SEQ ID NO: 140147 - protein, 5 aa, Mycobacterium avium
AEPGT

SEQ ID NO: 140148 - protein, 4 aa, Mycobacterium avium
AEPH

SEQ ID NO: 140149 - protein, 6 aa, Mycobacterium avium
AEPQTS

SEQ ID NO: 140150 - protein, 6 aa, Mycobacterium avium
AEPSAM

SEQ ID NO: 140151 - protein, 5 aa, Mycobacterium avium
AEQSQ

SEQ ID NO: 140152 - protein, 7 aa, Mycobacterium avium
AEQSQSC

SEQ ID NO: 140153 - protein, 16 aa, Mycobacterium avium
AERAQQTATQARAAAA

SEQ ID NO: 140154 - protein, 16 aa, Mycobacterium avium
AERNPVNASTPMLDSV

SEQ ID NO: 140155 - protein, 11 aa, Mycobacterium avium
AERSEIPSALP

SEQ ID NO: 140156 - protein, 16 aa, Mycobacterium avium
AERYNQTNGTPGPDEM

SEQ ID NO: 140157 - protein, 16 aa, Mycobacterium avium
AETAGQKKTLDTNWRS

SEQ ID NO: 140158 - protein, 16 aa, Mycobacterium avium
AETRARRRNDQNVAAG

SEQ ID NO: 140159 - protein, 5 aa, Mycobacterium avium
AETTS

SEQ ID NO: 140160 - protein, 12 aa, Mycobacterium avium
AEYDGDQHRASR

SEQ ID NO: 140161 - protein, 5 aa, Mycobacterium avium
AFQDG

SEQ ID NO: 140162 - protein, 5 aa, Mycobacterium avium
AFTDR

SEQ ID NO: 140163 - protein, 4 aa, Mycobacterium avium
AGAA

SEQ ID NO: 140164 - protein, 11 aa, Mycobacterium avium
AGAAAAAPKDY

SEQ ID NO: 140165 - protein, 5 aa, Mycobacterium avium
AGAAG

SEQ ID NO: 140166 - protein, 10 aa, Mycobacterium avium
AGADGVAAAA

SEQ ID NO: 140167 - protein, 5 aa, Mycobacterium avium
AGADV

SEQ ID NO: 140168 - protein, 7 aa, Mycobacterium avium
AGANAGT

SEQ ID NO: 140169 - protein, 18 aa, Mycobacterium avium
AGAPLAESDQVAPPASAP

SEQ ID NO: 140170 - protein, 6 aa, Mycobacterium avium
AGAPLG

SEQ ID NO: 140171 - protein, 8 aa, Mycobacterium avium
AGAPPADL

SEQ ID NO: 140172 - protein, 12 aa, Mycobacterium avium
AGAQAAGRDVAT

SEQ ID NO: 140173 - protein, 10 aa, Mycobacterium avium
AGAQPRAERR

SEQ ID NO: 140174 - protein, 5 aa, Mycobacterium avium
AGATG

SEQ ID NO: 140175 - protein, 24 aa, Mycobacterium avium
AGCSSNKSNTGASGSSGAPAAAAP

SEQ ID NO: 140176 - protein, 7 aa, Mycobacterium avium
AGCTSPP

SEQ ID NO: 140177 - protein, 9 aa, Mycobacterium avium
AGDDGAPVT

SEQ ID NO: 140178 - protein, 10 aa, Mycobacterium avium
AGDESSGGYN

SEQ ID NO: 140179 - protein, 26 aa, Mycobacterium avium
AGDQPGPAAKPIAVPPAPAPPTPHPA

SEQ ID NO: 140180 - protein, 6 aa, Mycobacterium avium
AGDRGH

SEQ ID NO: 140181 - protein, 7 aa, Mycobacterium avium
AGDRGRE

SEQ ID NO: 140182 - protein, 33 aa, Mycobacterium avium; identical to SEQ ID NO: 7224

SEQ ID NO: 140183 - protein, 7 aa, Mycobacterium avium
AGDTAAG

SEQ ID NO: 140184 - protein, 6 aa, Mycobacterium avium
AGELAS

SEQ ID NO: 140185 - protein, 7 aa, Mycobacterium avium
AGERGTD

SEQ ID NO: 140186 - protein, 9 aa, Mycobacterium avium
AGGAPSPTY

SEQ ID NO: 140187 - protein, 12 aa, Mycobacterium avium
AGGDRRSAPPEV

SEQ ID NO: 140188 - protein, 6 aa, Mycobacterium avium
AGGINV

SEQ ID NO: 140189 - protein, 11 aa, Mycobacterium avium
AGGPTLSPGAA

SEQ ID NO: 140190 - protein, 5 aa, Mycobacterium avium
AGGPV

SEQ ID NO: 140191 - protein, 6 aa, Mycobacterium avium
AGGPVI

SEQ ID NO: 140192 - protein, 7 aa, Mycobacterium avium
AGGTVTT

SEQ ID NO: 140193 - protein, 39 aa, Mycobacterium avium
AGGVWNKGAGKTFNGGVGTGAVGNTGTAAAVKSTEGAIS

SEQ ID NO: 140194 - protein, 32 aa, Mycobacterium avium
AGGYTVSGAASDAGVAVTPTSGQFDADGAASV

SEQ ID NO: 140195 - protein, 32 aa, Mycobacterium avium
AGGYTVSGAASDAGVAVTPTSGQFNAGGAASV

SEQ ID NO: 140196 - protein, 4 aa, Mycobacterium avium
AGHG

SEQ ID NO: 140197 - protein, 10 aa, Mycobacterium avium
AGKGAQARRA

SEQ ID NO: 140198 - protein, 11 aa, Mycobacterium avium
AGKTGTAQQIN

SEQ ID NO: 140199 - protein, 8 aa, Mycobacterium avium
AGLGGQTP

SEQ ID NO: 140200 - protein, 16 aa, Mycobacterium avium
AGLPTATIGGEATVGE

SEQ ID NO: 140201 - protein, 22 aa, Mycobacterium avium
AGLTPDDVDGLASTSQGTLPPV

SEQ ID NO: 140202 - protein, 6 aa, Mycobacterium avium
AGNAYT

SEQ ID NO: 140203 - protein, 26 aa, Mycobacterium avium
AGNHGAASSSTATGSTASPKTPLARG

SEQ ID NO: 140204 - protein, 8 aa, Mycobacterium avium
AGPAAADW

SEQ ID NO: 140205 - protein, 12 aa, Mycobacterium avium
AGPAAARAVQTG

SEQ ID NO: 140206 - protein, 16 aa, Mycobacterium avium
AGPAKIPAPGPGPGQT

SEQ ID NO: 140207 - protein, 9 aa, Mycobacterium avium
AGPARADQA

SEQ ID NO: 140208 - protein, 17 aa, Mycobacterium avium
AGPATSALADNTGELSE

SEQ ID NO: 140209 - protein, 6 aa, Mycobacterium avium
AGPKSV

SEQ ID NO: 140210 - protein, 5 aa, Mycobacterium avium
AGPPL

SEQ ID NO: 140211 - protein, 6 aa, Mycobacterium avium
AGPPPC

SEQ ID NO: 140212 - protein, 7 aa, Mycobacterium avium
AGPSVQN

SEQ ID NO: 140213 - protein, 12 aa, Mycobacterium avium
AGPYQRDRGPSQ

SEQ ID NO: 140214 - protein, 14 aa, Mycobacterium avium
AGQGVRWSPGVTVV

SEQ ID NO: 140215 - protein, 74 aa, Mycobacterium avium
AGQPPLPAPVAEPATPSAAAPTGLPATAGATPIAASAAASGPAPAPTPAPTAATVSSPAPPAPPAPGAAPFAPP

SEQ ID NO: 140216 - protein, 72 aa, Mycobacterium avium
AGQPPLPAPVAEPATPSAAAPTGLPATAGATPIAASAAASVPAPTPAPTAATVSSPAPPAPPAPGAAPFAPP

SEQ ID NO: 140217 - protein, 14 aa, Mycobacterium avium
AGQSASASKVTPFQ

SEQ ID NO: 140218 - protein, 11 aa, Mycobacterium avium
AGRAAETAGQA

SEQ ID NO: 140219 - protein, 9 aa, Mycobacterium avium
AGRAEPRRV

SEQ ID NO: 140220 - protein, 9 aa, Mycobacterium avium
AGREQATGY

SEQ ID NO: 140221 - protein, 10 aa, Mycobacterium avium
AGRPAPPAVG

SEQ ID NO: 140222 - protein, 7 aa, Mycobacterium avium
AGRPPDW

SEQ ID NO: 140223 - protein, 6 aa, Mycobacterium avium
AGRPVQ

SEQ ID NO: 140224 - protein, 19 aa, Mycobacterium avium
AGRTGESAQQLVATTDRRT

SEQ ID NO: 140225 - protein, 5 aa, Mycobacterium avium
AGSGI

SEQ ID NO: 140226 - protein, 6 aa, Mycobacterium avium
AGSGIL

SEQ ID NO: 140227 - protein, 13 aa, Mycobacterium avium
AGSGSHQRPDDRR

SEQ ID NO: 140228 - protein, 15 aa, Mycobacterium avium
AGSPVTIDGDGGAAR

SEQ ID NO: 140229 - protein, 10 aa, Mycobacterium avium
AGSSTVPGVG

SEQ ID NO: 140230 - protein, 7 aa, Mycobacterium avium
AGSTSTI

SEQ ID NO: 140231 - protein, 10 aa, Mycobacterium avium
AGTAADEQPL

SEQ ID NO: 140232 - protein, 11 aa, Mycobacterium avium
AGTAGQPVYAA

SEQ ID NO: 140233 - protein, 8 aa, Mycobacterium avium
AGTDTGPI

SEQ ID NO: 140234 - protein, 4 aa, Mycobacterium avium
AGTH

SEQ ID NO: 140235 - protein, 6 aa, Mycobacterium avium
AGTPDA

SEQ ID NO: 140236 - protein, 13 aa, Mycobacterium avium
AGTVSPSRPDRMT

SEQ ID NO: 140237 - protein, 11 aa, Mycobacterium avium
AGTYRTDGKSG

SEQ ID NO: 140238 - protein, 9 aa, Mycobacterium avium
AGVASADPM

SEQ ID NO: 140239 - protein, 6 aa, Mycobacterium avium
AGVGRT

SEQ ID NO: 140240 - protein, 10 aa, Mycobacterium avium
AGVPGADPAS

SEQ ID NO: 140241 - protein, 10 aa, Mycobacterium avium
AGVPSPPTAW

SEQ ID NO: 140242 - protein, 7 aa, Mycobacterium avium
AGYPKHD

SEQ ID NO: 140243 - protein, 8 aa, Mycobacterium avium
AHADDPPV

SEQ ID NO: 140244 - protein, 6 aa, Mycobacterium avium
AHADPA

SEQ ID NO: 140245 - protein, 15 aa, Mycobacterium avium
AHADPPPVPDGDDGG

SEQ ID NO: 140246 - protein, 6 aa, Mycobacterium avium
AHAPPE

SEQ ID NO: 140247 - protein, 5 aa, Mycobacterium avium
AHARA

SEQ ID NO: 140248 - protein, 14 aa, Mycobacterium avium
AHARRRQRSRRRGD

SEQ ID NO: 140249 - protein, 28 aa, Mycobacterium avium
AHDDASALTRSARPSAKPAAEASVPTPA

SEQ ID NO: 140250 - protein, 19 aa, Mycobacterium avium
AHNGARDPSNVVGAGSVDP

SEQ ID NO: 140251 - protein, 6 aa, Mycobacterium avium
AHPGPF

SEQ ID NO: 140252 - protein, 5 aa, Mycobacterium avium
AHQAG

SEQ ID NO: 140253 - protein, 8 aa, Mycobacterium avium
AHRQRQQP

SEQ ID NO: 140254 - protein, 11 aa, Mycobacterium avium
AIARPSEYSER

SEQ ID NO: 140255 - protein, 11 aa, Mycobacterium avium
AIATERAGKPV

SEQ ID NO: 140256 - protein, 16 aa, Mycobacterium avium
AIGESAANVAAGDGMR

SEQ ID NO: 140257 - protein, 6 aa, Mycobacterium avium
AIGGEP

SEQ ID NO: 140258 - protein, 7 aa, Mycobacterium avium
AIGGESA

SEQ ID NO: 140259 - protein, 8 aa, Mycobacterium avium
AIGSGGPS

SEQ ID NO: 140260 - protein, 10 aa, Mycobacterium avium
AIPARAQGAD

SEQ ID NO: 140261 - protein, 18 aa, Mycobacterium avium
AITTRPPSEPPALGADNG

SEQ ID NO: 140262 - protein, 8 aa, Mycobacterium avium
AKDAGNGA

SEQ ID NO: 140263 - protein, 10 aa, Mycobacterium avium
AKGVSGNAVP

SEQ ID NO: 140264 - protein, 10 aa, Mycobacterium avium
AKNDAPGTPA

SEQ ID NO: 140265 - protein, 9 aa, Mycobacterium avium
AKNGPTYYS

SEQ ID NO: 140266 - protein, 5 aa, Mycobacterium avium
AKNHT

SEQ ID NO: 140267 - protein, 20 aa, Mycobacterium avium
AKPGAGHGRSGAPPAPAGKG

SEQ ID NO: 140268 - protein, 8 aa, Mycobacterium avium
AKPLTRDY

SEQ ID NO: 140269 - protein, 17 aa, Mycobacterium avium
AKPPGPASAPVTARPGL

SEQ ID NO: 140270 - protein, 7 aa, Mycobacterium avium
AKPSSNL

SEQ ID NO: 140271 - protein, 4 aa, Mycobacterium avium
AKRY

SEQ ID NO: 140272 - protein, 13 aa, Mycobacterium avium
AKSDNNGEQRIPK

SEQ ID NO: 140273 - protein, 6 aa, Mycobacterium avium
AKTGNL

SEQ ID NO: 140274 - protein, 11 aa, Mycobacterium avium
AKVDPQGRCEP

SEQ ID NO: 140275 - protein, 10 aa, Mycobacterium avium
ALAPTATTKS

SEQ ID NO: 140276 - protein, 12 aa, Mycobacterium avium
ALGDDDPDDTPA

SEQ ID NO: 140277 - protein, 19 aa, Mycobacterium avium
ALGDNDSDGRLDDQPADAR

SEQ ID NO: 140278 - protein, 9 aa, Mycobacterium avium
ALGPHGGNA

SEQ ID NO: 140279 - protein, 17 aa, Mycobacterium avium
ALGTPDSQSIPVGPSTH

SEQ ID NO: 140280 - protein, 27 aa, Mycobacterium avium
ALGTPDSQSIPVGPSTHTLQSGGTSRT

SEQ ID NO: 140281 - protein, 8 aa, Mycobacterium avium
ALNGTKNI

SEQ ID NO: 140282 - protein, 6 aa, Mycobacterium avium
ALPASV

SEQ ID NO: 140283 - protein, 4 aa, Mycobacterium avium
ALPT

SEQ ID NO: 140284 - protein, 12 aa, Mycobacterium avium
ALPTNTDGGGLS

SEQ ID NO: 140285 - protein, 17 aa, Mycobacterium avium
ALPTSDQLAGLLAPTAP

SEQ ID NO: 140286 - protein, 20 aa, Mycobacterium avium
ALRADEQTHRIAPSREPDDG

SEQ ID NO: 140287 - protein, 16 aa, Mycobacterium avium
ALRPQTTTMSGAPMGG

SEQ ID NO: 140288 - protein, 8 aa, Mycobacterium avium
ALSGEASA

SEQ ID NO: 140289 - protein, 6 aa, Mycobacterium avium
ALSGHH

SEQ ID NO: 140290 - protein, 9 aa, Mycobacterium avium
ANAATTNCT

SEQ ID NO: 140291 - protein, 7 aa, Mycobacterium avium
ANDPTAV

SEQ ID NO: 140292 - protein, 4 aa, Mycobacterium avium
ANGG

SEQ ID NO: 140293 - protein, 6 aa, Mycobacterium avium
ANGTHS

SEQ ID NO: 140294 - protein, 13 aa, Mycobacterium avium
ANLAAEGNAGFDD

SEQ ID NO: 140295 - protein, 21 aa, Mycobacterium avium
ANLAAEGNAGFDDARAAAARQ

SEQ ID NO: 140296 - protein, 6 aa, Mycobacterium avium
ANPWQY

SEQ ID NO: 140297 - protein, 11 aa, Mycobacterium avium
ANQGSDAAGHD

SEQ ID NO: 140298 - protein, 6 aa, Mycobacterium avium
ANRGAR

SEQ ID NO: 140299 - protein, 17 aa, Mycobacterium avium
ANRNPASAASPAAVSAG

SEQ ID NO: 140300 - protein, 12 aa, Mycobacterium avium
ANRNTKQDYNGG

SEQ ID NO: 140301 - protein, 17 aa, Mycobacterium avium
ANTGRRCPEPPAPHANP

SEQ ID NO: 140302 - protein, 16 aa, Mycobacterium avium
ANTNGGNRADGTPGFQ

SEQ ID NO: 140303 - protein, 7 aa, Mycobacterium avium
ANVPPSV

SEQ ID NO: 140304 - protein, 4 aa, Mycobacterium avium
ANYS

SEQ ID NO: 140305 - protein, 9 aa, Mycobacterium avium
APAAAAPNI

SEQ ID NO: 140306 - protein, 5 aa, Mycobacterium avium
APAAL

SEQ ID NO: 140307 - protein, 8 aa, Mycobacterium avium
APADQSLT

SEQ ID NO: 140308 - protein, 6 aa, Mycobacterium avium
APAETA

SEQ ID NO: 140309 - protein, 8 aa, Mycobacterium avium
APAHADDQ

SEQ ID NO: 140310 - protein, 21 aa, Mycobacterium avium
APALRGATAGLGGGLGGDLGN

SEQ ID NO: 140311 - protein, 13 aa, Mycobacterium avium
APANTSAETTHAA

SEQ ID NO: 140312 - protein, 14 aa, Mycobacterium avium
APANTSAETTHAAP

SEQ ID NO: 140313 - protein, 14 aa, Mycobacterium avium
APAPTASAVPGDPM

SEQ ID NO: 140314 - protein, 5 aa, Mycobacterium avium
APARQ

SEQ ID NO: 140315 - protein, 6 aa, Mycobacterium avium
APAVRK

SEQ ID NO: 140316 - protein, 11 aa, Mycobacterium avium
APCDPPPGFGY

SEQ ID NO: 140317 - protein, 27 aa, Mycobacterium avium
APCDPPPGFGYTREGTYKGFPGSTVDR

SEQ ID NO: 140318 - protein, 21 aa, Mycobacterium avium
APCPHGGCPGGAAPKTTGPAR

SEQ ID NO: 140319 - protein, 9 aa, Mycobacterium avium
APDAPAAQV

SEQ ID NO: 140320 - protein, 22 aa, Mycobacterium avium
APECPVETNRRTEVPDSCQTRT

SEQ ID NO: 140321 - protein, 11 aa, Mycobacterium avium
APGARCDQPVK

SEQ ID NO: 140322 - protein, 23 aa, Mycobacterium avium
APGATADPTPQQSPFPTGKAGTT

SEQ ID NO: 140323 - protein, 24 aa, Mycobacterium avium
APGATADPTPQQSPFPTGKSGTTI

SEQ ID NO: 140324 - protein, 4 aa, Mycobacterium avium
APGE

SEQ ID NO: 140325 - protein, 6 aa, Mycobacterium avium
APGKPW

SEQ ID NO: 140326 - protein, 11 aa, Mycobacterium avium
APGPDPTTTVG

SEQ ID NO: 140327 - protein, 6 aa, Mycobacterium avium
APGPHA

SEQ ID NO: 140328 - protein, 13 aa, Mycobacterium avium
APGTQGQGNQCAP

SEQ ID NO: 140329 - protein, 11 aa, Mycobacterium avium
APGVGQPGGSL

SEQ ID NO: 140330 - protein, 4 aa, Mycobacterium avium
APHP

SEQ ID NO: 140331 - protein, 9 aa, Mycobacterium avium
APIAGAPAE

SEQ ID NO: 140332 - protein, 14 aa, Mycobacterium avium
APLPQDPPPAQPVA

SEQ ID NO: 140333 - protein, 24 aa, Mycobacterium avium
APLPQDPPPAQPVAGANVPTSDQL

SEQ ID NO: 140334 - protein, 25 aa, Mycobacterium avium
APLPQDPPPPPPLPPGAPGQLPTAD

SEQ ID NO: 140335 - protein, 25 aa, Mycobacterium avium
APLPQDPPPPPPPPPGAPGQLPTAD

SEQ ID NO: 140336 - protein, 6 aa, Mycobacterium avium
APNAGH

SEQ ID NO: 140337 - protein, 8 aa, Mycobacterium avium
APNLESGG

SEQ ID NO: 140338 - protein, 14 aa, Mycobacterium avium
APPAGVAPQGKLKN

SEQ ID NO: 140339 - protein, 12 aa, Mycobacterium avium
APPAPPEPSQPG

SEQ ID NO: 140340 - protein, 18 aa, Mycobacterium avium
APPGARTENPPDATGGST

SEQ ID NO: 140341 - protein, 27 aa, Mycobacterium avium
APPGGDGHRGAGGDGHRGADGDGKPRR

SEQ ID NO: 140342 - protein, 34 aa, Mycobacterium avium
APPGGDGHRGRDGDGHRGADGDHRGADGDGKPRR

SEQ ID NO: 140343 - protein, 4 aa, Mycobacterium avium
APPP

SEQ ID NO: 140344 - protein, 11 aa, Mycobacterium avium
APPPPPGAPPE

SEQ ID NO: 140345 - protein, 44 aa, Mycobacterium avium
APQATTAATQITPATPGTPGPAPAPAPAQAPAPAPAPAPATSGT

SEQ ID NO: 140346 - protein, 40 aa, Mycobacterium avium
APQATTAATQVTPATPGTPGPAPAPAPAPAPAPAPATSGT

SEQ ID NO: 140347 - protein, 16 aa, Mycobacterium avium
APQECGAGGQPTPDGR

SEQ ID NO: 140348 - protein, 10 aa, Mycobacterium avium
APRNTYQTAD

SEQ ID NO: 140349 - protein, 8 aa, Mycobacterium avium
APRQLGPN

SEQ ID NO: 140350 - protein, 27 aa, Mycobacterium avium
APSAAAAPDCSPSGVNSTVSAVEGSAQ

SEQ ID NO: 140351 - protein, 11 aa, Mycobacterium avium
APSARCDQPVK

SEQ ID NO: 140352 - protein, 5 aa, Mycobacterium avium
APSNL

SEQ ID NO: 140353 - protein, 8 aa, Mycobacterium avium
APTNAVPT

SEQ ID NO: 140354 - protein, 8 aa, Mycobacterium avium
APTQQAPL

SEQ ID NO: 140355 - protein, 19 aa, Mycobacterium avium
APTQQSPLQQLPTQQSPLQ

SEQ ID NO: 140356 - protein, 6 aa, Mycobacterium avium
APTTDR

SEQ ID NO: 140357 - protein, 14 aa, Mycobacterium avium
APVPQDPPPAQPVA

SEQ ID NO: 140358 - protein, 6 aa, Mycobacterium avium
APYATR

SEQ ID NO: 140359 - protein, 6 aa, Mycobacterium avium
APYGIP

SEQ ID NO: 140360 - protein, 6 aa, Mycobacterium avium
AQAAEH

SEQ ID NO: 140361 - protein, 5 aa, Mycobacterium avium
AQATA

SEQ ID NO: 140362 - protein, 16 aa, Mycobacterium avium
AQAVPGEDEAATDDNN

SEQ ID NO: 140363 - protein, 7 aa, Mycobacterium avium
AQDDYNG

SEQ ID NO: 140364 - protein, 6 aa, Mycobacterium avium
AQGRPY

SEQ ID NO: 140365 - protein, 10 aa, Mycobacterium avium
AQKSPAANGV

SEQ ID NO: 140366 - protein, 10 aa, Mycobacterium avium
AQPDDSNPLY

SEQ ID NO: 140367 - protein, 6 aa, Mycobacterium avium
AQPDDY

SEQ ID NO: 140368 - protein, 6 aa, Mycobacterium avium
AQPIPR

SEQ ID NO: 140369 - protein, 9 aa, Mycobacterium avium
AQRDRRVRR

SEQ ID NO: 140370 - protein, 5 aa, Mycobacterium avium
AQRDT

SEQ ID NO: 140371 - protein, 4 aa, Mycobacterium avium
AQRG

SEQ ID NO: 140372 - protein, 5 aa, Mycobacterium avium
AQRGA

SEQ ID NO: 140373 - protein, 18 aa, Mycobacterium avium
AQSKDDGPTRPRLTDRET

SEQ ID NO: 140374 - protein, 4 aa, Mycobacterium avium
AQTL

SEQ ID NO: 140375 - protein, 7 aa, Mycobacterium avium
ARADDPE

SEQ ID NO: 140376 - protein, 7 aa, Mycobacterium avium
ARADGYM

SEQ ID NO: 140377 - protein, 9 aa, Mycobacterium avium
ARADTADPL

SEQ ID NO: 140378 - protein, 6 aa, Mycobacterium avium
ARAPRV

SEQ ID NO: 140379 - protein, 17 aa, Mycobacterium avium
ARAQADDDDPGIPPAPV

SEQ ID NO: 140380 - protein, 19 aa, Mycobacterium avium
ARATASARARRRPDTPAEL

SEQ ID NO: 140381 - protein, 13 aa, Mycobacterium avium
ARDAGRDVSALGK

SEQ ID NO: 140382 - protein, 7 aa, Mycobacterium avium
ARDPATG

SEQ ID NO: 140383 - protein, 9 aa, Mycobacterium avium
ARDRGQPTH

SEQ ID NO: 140384 - protein, 5 aa, Mycobacterium avium
AREQG

SEQ ID NO: 140385 - protein, 4 aa, Mycobacterium avium
ARER

SEQ ID NO: 140386 - protein, 6 aa, Mycobacterium avium
ARGDGL

SEQ ID NO: 140387 - protein, 8 aa, Mycobacterium avium
ARGDGPLA

SEQ ID NO: 140388 - protein, 6 aa, Mycobacterium avium
ARGGAV

SEQ ID NO: 140389 - protein, 12 aa, Mycobacterium avium
ARGGVGASAQRD

SEQ ID NO: 140390 - protein, 7 aa, Mycobacterium avium
ARGGVNT

SEQ ID NO: 140391 - protein, 4 aa, Mycobacterium avium
ARGM

SEQ ID NO: 140392 - protein, 9 aa, Mycobacterium avium
ARPAGRRGA

SEQ ID NO: 140393 - protein, 6 aa, Mycobacterium avium
ARPAVQ

SEQ ID NO: 140394 - protein, 7 aa, Mycobacterium avium
ARPNELT

SEQ ID NO: 140395 - protein, 5 aa, Mycobacterium avium
ARRHD

SEQ ID NO: 140396 - protein, 6 aa, Mycobacterium avium
ARSDQI

SEQ ID NO: 140397 - protein, 7 aa, Mycobacterium avium
ARSDQIS

SEQ ID NO: 140398 - protein, 11 aa, Mycobacterium avium
ARSEHDTASAK

SEQ ID NO: 140399 - protein, 11 aa, Mycobacterium avium
ARSGGALSSVS

SEQ ID NO: 140400 - protein, 31 aa, Mycobacterium avium
ARSPPSRHADERTPAREQASDTDARKRANHV

SEQ ID NO: 140401 - protein, 13 aa, Mycobacterium avium
ARVSSGEALSDTE

SEQ ID NO: 140402 - protein, 4 aa, Mycobacterium avium
ASAA

SEQ ID NO: 140403 - protein, 41 aa, Mycobacterium avium
ASAAATELTPFTEPPRTTESSAAARQSAAVAQSAASDLPAQ

SEQ ID NO: 140404 - protein, 12 aa, Mycobacterium avium
ASADVGGTPSRL

SEQ ID NO: 140405 - protein, 11 aa, Mycobacterium avium
ASAEANNAKAA

SEQ ID NO: 140406 - protein, 11 aa, Mycobacterium avium
ASAKELPTTIS

SEQ ID NO: 140407 - protein, 8 aa, Mycobacterium avium
ASASAPAR

SEQ ID NO: 140408 - protein, 7 aa, Mycobacterium avium
ASASMAS

SEQ ID NO: 140409 - protein, 13 aa, Mycobacterium avium
ASATCNLSDKDDQ

SEQ ID NO: 140410 - protein, 4 aa, Mycobacterium avium
ASAV

SEQ ID NO: 140411 - protein, 18 aa, Mycobacterium avium
ASAVGSAVDSAVDSAVGS

SEQ ID NO: 140412 - protein, 4 aa, Mycobacterium avium
ASDA

SEQ ID NO: 140413 - protein, 8 aa, Mycobacterium avium
ASDEGKGI

SEQ ID NO: 140414 - protein, 17 aa, Mycobacterium avium
ASDPAAAQQLNSSPMAQ

SEQ ID NO: 140415 - protein, 7 aa, Mycobacterium avium
ASDPASV

SEQ ID NO: 140416 - protein, 8 aa, Mycobacterium avium
ASDSHYVR

SEQ ID NO: 140417 - protein, 5 aa, Mycobacterium avium
ASDTA

SEQ ID NO: 140418 - protein, 6 aa, Mycobacterium avium
ASGAEI

SEQ ID NO: 140419 - protein, 9 aa, Mycobacterium avium
ASGARLEPG

SEQ ID NO: 140420 - protein, 18 aa, Mycobacterium avium
ASGDPTSGPAGVPPARKE

SEQ ID NO: 140421 - protein, 6 aa, Mycobacterium avium
ASGEPT

SEQ ID NO: 140422 - protein, 5 aa, Mycobacterium avium
ASGFN

SEQ ID NO: 140423 - protein, 9 aa, Mycobacterium avium
ASGGPNCRG

SEQ ID NO: 140424 - protein, 5 aa, Mycobacterium avium
ASGIG

SEQ ID NO: 140425 - protein, 5 aa, Mycobacterium avium
ASHLD

SEQ ID NO: 140426 - protein, 8 aa, Mycobacterium avium
ASKAELAQ

SEQ ID NO: 140427 - protein, 4 aa, Mycobacterium avium
ASLP

SEQ ID NO: 140428 - protein, 5 aa, Mycobacterium avium
ASMRE

SEQ ID NO: 140429 - protein, 7 aa, Mycobacterium avium
ASPGSSV

SEQ ID NO: 140430 - protein, 9 aa, Mycobacterium avium
ASPPSGAKT

SEQ ID NO: 140431 - protein, 6 aa, Mycobacterium avium
ASPSGN

SEQ ID NO: 140432 - protein, 7 aa, Mycobacterium avium
ASPVDYQ

SEQ ID NO: 140433 - protein, 6 aa, Mycobacterium avium
ASQGAV

SEQ ID NO: 140434 - protein, 5 aa, Mycobacterium avium
ASRDL

SEQ ID NO: 140435 - protein, 9 aa, Mycobacterium avium
ASRLGAKES

SEQ ID NO: 140436 - protein, 6 aa, Mycobacterium avium
ASRTQH

SEQ ID NO: 140437 - protein, 7 aa, Mycobacterium avium
ASSGIGR

SEQ ID NO: 140438 - protein, 10 aa, Mycobacterium avium
ASSSQSSTPL

SEQ ID NO: 140439 - protein, 20 aa, Mycobacterium avium
ASSTDSGDRDDLKPSVPDRS

SEQ ID NO: 140440 - protein, 6 aa, Mycobacterium avium
ASTVDE

SEQ ID NO: 140441 - protein, 6 aa, Mycobacterium avium
ASVDSS

SEQ ID NO: 140442 - protein, 8 aa, Mycobacterium avium
ASVRPGED

SEQ ID NO: 140443 - protein, 47 aa, Mycobacterium avium
ASVSGNTINVTGTDPSGNTTQTTVTVDDKTKYTKQSSANTDAITPGK

SEQ ID NO: 140444 - protein, 7 aa, Mycobacterium avium
ASWPDPD

SEQ ID NO: 140445 - protein, 6 aa, Mycobacterium avium
ASYTTP

SEQ ID NO: 140446 - protein, 7 aa, Mycobacterium avium
ATAAAGL

SEQ ID NO: 140447 - protein, 14 aa, Mycobacterium avium
ATAEVSSAYADAAP

SEQ ID NO: 140448 - protein, 8 aa, Mycobacterium avium
ATAQAAAR

SEQ ID NO: 140449 - protein, 11 aa, Mycobacterium avium
ATAQSAVAPGT

SEQ ID NO: 140450 - protein, 4 aa, Mycobacterium avium
ATAV

SEQ ID NO: 140451 - protein, 6 aa, Mycobacterium avium
ATDADT

SEQ ID NO: 140452 - protein, 18 aa, Mycobacterium avium
ATDPPRKGPDDRHRRHPR

SEQ ID NO: 140453 - protein, 7 aa, Mycobacterium avium
ATEHSPA

SEQ ID NO: 140454 - protein, 8 aa, Mycobacterium avium
ATETDGSK

SEQ ID NO: 140455 - protein, 6 aa, Mycobacterium avium
ATETEQ

SEQ ID NO: 140456 - protein, 5 aa, Mycobacterium avium
ATETL

SEQ ID NO: 140457 - protein, 11 aa, Mycobacterium avium
ATFDGKPVRAG

SEQ ID NO: 140458 - protein, 5 aa, Mycobacterium avium
ATGAF

SEQ ID NO: 140459 - protein, 15 aa, Mycobacterium avium
ATGIGAATAARLAGE

SEQ ID NO: 140460 - protein, 17 aa, Mycobacterium avium
ATGLPTATIGGEATVGE

SEQ ID NO: 140461 - protein, 8 aa, Mycobacterium avium
ATGSGKSE

SEQ ID NO: 140462 - protein, 5 aa, Mycobacterium avium
ATGTF

SEQ ID NO: 140463 - protein, 6 aa, Mycobacterium avium
ATHDPA

SEQ ID NO: 140464 - protein, 12 aa, Mycobacterium avium
ATHTTRPTSCRQ

SEQ ID NO: 140465 - protein, 15 aa, Mycobacterium avium
ATKITEGVDPKPIRQ

SEQ ID NO: 140466 - protein, 5 aa, Mycobacterium avium
ATLAG

SEQ ID NO: 140467 - protein, 10 aa, Mycobacterium avium
ATNAEGANMD

SEQ ID NO: 140468 - protein, 11 aa, Mycobacterium avium
ATNKGLQAIPR

SEQ ID NO: 140469 - protein, 10 aa, Mycobacterium avium
ATPAAAAPNI

SEQ ID NO: 140470 - protein, 6 aa, Mycobacterium avium
ATPETL

SEQ ID NO: 140471 - protein, 8 aa, Mycobacterium avium
ATPTAGSA

SEQ ID NO: 140472 - protein, 8 aa, Mycobacterium avium
ATPTDGSA

SEQ ID NO: 140473 - protein, 18 aa, Mycobacterium avium
ATPVSPLPATNSRRIGQN

SEQ ID NO: 140474 - protein, 7 aa, Mycobacterium avium
ATQDVAD

SEQ ID NO: 140475 - protein, 10 aa, Mycobacterium avium
ATRERDGSRH

SEQ ID NO: 140476 - protein, 9 aa, Mycobacterium avium
ATRRRRGPK

SEQ ID NO: 140477 - protein, 10 aa, Mycobacterium avium
ATSGQDGLST

SEQ ID NO: 140478 - protein, 10 aa, Mycobacterium avium
ATSGQNGLST

SEQ ID NO: 140479 - protein, 105 aa, Mycobacterium avium
ATSHADPEVPTPVPPSTATAPPAAPAPNGQPAPNAQPAPAAPAPNGQPAPAAPAPNDPNAAPPPAGAPPNGAPPAPPNGAPPPPVDPNAPPPPPADPNAGRIPNA

SEQ ID NO: 140480 - protein, 17 aa, Mycobacterium avium
ATSHGALGQAPSVIVLT

SEQ ID NO: 140481 - protein, 5 aa, Mycobacterium avium
ATTAN

SEQ ID NO: 140482 - protein, 6 aa, Mycobacterium avium
ATTGAV

SEQ ID NO: 140483 - protein, 13 aa, Mycobacterium avium
ATTPSAAAATPAA

SEQ ID NO: 140484 - protein, 6 aa, Mycobacterium avium
ATTTYG

SEQ ID NO: 140485 - protein, 5 aa, Mycobacterium avium
AVAAR

SEQ ID NO: 140486 - protein, 9 aa, Mycobacterium avium
AVAARGGNG

SEQ ID NO: 140487 - protein, 5 aa, Mycobacterium avium
AVATR

SEQ ID NO: 140488 - protein, 5 aa, Mycobacterium avium
AVGGA

SEQ ID NO: 140489 - protein, 11 aa, Mycobacterium avium
AVGGTPKDYAE

SEQ ID NO: 140490 - protein, 10 aa, Mycobacterium avium
AVNRGNAAQA

SEQ ID NO: 140491 - protein, 5 aa, Mycobacterium avium
AVNSS

SEQ ID NO: 140492 - protein, 14 aa, Mycobacterium avium
AVPGSQPPPAPAEP

SEQ ID NO: 140493 - protein, 39 aa, Mycobacterium avium
AVPPPGAGFGSKARASVDTRAKSKSPQPDSNAVGAGAAV

SEQ ID NO: 140494 - protein, 56 aa, Mycobacterium avium
AVPPPGVGFGSKARASVDTRAKSKSPQPDSNAVGAGSAVREAAHARRRQRSRRRGE

SEQ ID NO: 140495 - protein, 8 aa, Mycobacterium avium
AVPRQGAR

SEQ ID NO: 140496 - protein, 7 aa, Mycobacterium avium
AVPSRDI

SEQ ID NO: 140497 - protein, 8 aa, Mycobacterium avium
AVRGRGGL

SEQ ID NO: 140498 - protein, 8 aa, Mycobacterium avium
AWDPGAAT

SEQ ID NO: 140499 - protein, 10 aa, Mycobacterium avium
AWDPGAATVV

SEQ ID NO: 140500 - protein, 24 aa, Mycobacterium avium
AWDPGAATVVDSDTRAAETVAEQG

SEQ ID NO: 140501 - protein, 13 aa, Mycobacterium avium
AWPGGRAGRRDID

SEQ ID NO: 140502 - protein, 10 aa, Mycobacterium avium
AWPPSARARP

SEQ ID NO: 140503 - protein, 11 aa, Mycobacterium avium
AWPPSARARPR

SEQ ID NO: 140504 - protein, 5 aa, Mycobacterium avium
AYDSP

SEQ ID NO: 140505 - protein, 16 aa, Mycobacterium avium
AYSGGTERYNGASGAY

SEQ ID NO: 140506 - protein, 4 aa, Mycobacterium avium
AYSP

SEQ ID NO: 140507 - protein, 10 aa, Mycobacterium avium
AYSPPGSPVS

SEQ ID NO: 140508 - protein, 16 aa, Mycobacterium avium
CAADGSVVDAGRAVAG

SEQ ID NO: 140509 - protein, 4 aa, Mycobacterium avium
CAGE

SEQ ID NO: 140510 - protein, 9 aa, Mycobacterium avium
CASGSEGIA

SEQ ID NO: 140511 - protein, 9 aa, Mycobacterium avium
CDSDGAGAT

SEQ ID NO: 140512 - protein, 5 aa, Mycobacterium avium
CEAGG

SEQ ID NO: 140513 - protein, 7 aa, Mycobacterium avium
CGDDGSA

SEQ ID NO: 140514 - protein, 31 aa, Mycobacterium avium
CGGDKNPAASSSAATSTTSAASPSSAAPADY

SEQ ID NO: 140515 - protein, 31 aa, Mycobacterium avium
CGGDKNPAASSSPAASTPSAASPSAGAPADY

SEQ ID NO: 140516 - protein, 31 aa, Mycobacterium avium
CGGDKNPAASSSPAASTPSAASPSSAAPADY

SEQ ID NO: 140517 - protein, 4 aa, Mycobacterium avium
CGPE

SEQ ID NO: 140518 - protein, 13 aa, Mycobacterium avium
CGQSKPDPSRNTR

SEQ ID NO: 140519 - protein, 22 aa, Mycobacterium avium
CGSAQQPAGAPPRPSDVSPNQV

SEQ ID NO: 140520 - protein, 12 aa, Mycobacterium avium
CGSDRPAATTTR

SEQ ID NO: 140521 - protein, 12 aa, Mycobacterium avium
CGSDRPTATTTR

SEQ ID NO: 140522 - protein, 11 aa, Mycobacterium avium
CGTGGGDDLAA

SEQ ID NO: 140523 - protein, 11 aa, Mycobacterium avium
CGTGGGNDLAA

SEQ ID NO: 140524 - protein, 19 aa, Mycobacterium avium
CGTPGTPPCAGPSPLTPEQ

SEQ ID NO: 140525 - protein, 5 aa, Mycobacterium avium
CPGQT

SEQ ID NO: 140526 - protein, 6 aa, Mycobacterium avium
CPLRSP

SEQ ID NO: 140527 - protein, 15 aa, Mycobacterium avium
CPSSRNCSNAMPDSL

SEQ ID NO: 140528 - protein, 4 aa, Mycobacterium avium
CPTK

SEQ ID NO: 140529 - protein, 14 aa, Mycobacterium avium
CQKSRQTRASRDAL

SEQ ID NO: 140530 - protein, 32 aa, Mycobacterium avium
CQQPHKPAPTSSSTTPTTTASPAAPAAPPPTV

SEQ ID NO: 140531 - protein, 13 aa, Mycobacterium avium
CSGTRPAGDPAQI

SEQ ID NO: 140532 - protein, 60 aa, Mycobacterium avium
CSKSNNAGQTTSPASSSATSSATSGTSGTSASAAPSESTGTSGAPSSTQINGANGTPYTV

SEQ ID NO: 140533 - protein, 4 aa, Mycobacterium avium
CTST

SEQ ID NO: 140534 - protein, 14 aa, Mycobacterium avium
DAAAAADAAAQASA

SEQ ID NO: 140535 - protein, 7 aa, Mycobacterium avium
DAADRAK

SEQ ID NO: 140536 - protein, 5 aa, Mycobacterium avium
DADLT

SEQ ID NO: 140537 - protein, 10 aa, Mycobacterium avium
DADSGTAETI

SEQ ID NO: 140538 - protein, 7 aa, Mycobacterium avium
DAGGYKA

SEQ ID NO: 140539 - protein, 7 aa, Mycobacterium avium
DAGPALT

SEQ ID NO: 140540 - protein, 9 aa, Mycobacterium avium
DAGPRPVGA

SEQ ID NO: 140541 - protein, 22 aa, Mycobacterium avium
DAHESPSSWRKDGSSASAGQAA

SEQ ID NO: 140542 - protein, 10 aa, Mycobacterium avium
DALAEEHSAA

SEQ ID NO: 140543 - protein, 14 aa, Mycobacterium avium
DALGTTSDKLASVT

SEQ ID NO: 140544 - protein, 7 aa, Mycobacterium avium
DALQTRK

SEQ ID NO: 140545 - protein, 5 aa, Mycobacterium avium
DALRT

SEQ ID NO: 140546 - protein, 12 aa, Mycobacterium avium
DAMTSDAPPLAP

SEQ ID NO: 140547 - protein, 11 aa, Mycobacterium avium
DAMTSDAPTLA

SEQ ID NO: 140548 - protein, 9 aa, Mycobacterium avium
DANPQTHAD

SEQ ID NO: 140549 - protein, 18 aa, Mycobacterium avium
DAPVTQPPPAPPRPADDL

SEQ ID NO: 140550 - protein, 15 aa, Mycobacterium avium
DAQPSTGLPGPAPDD

SEQ ID NO: 140551 - protein, 6 aa, Mycobacterium avium
DARDGT

SEQ ID NO: 140552 - protein, 8 aa, Mycobacterium avium
DARQQIQD

SEQ ID NO: 140553 - protein, 8 aa, Mycobacterium avium
DASKPNGQ

SEQ ID NO: 140554 - protein, 8 aa, Mycobacterium avium
DASPAVDE

SEQ ID NO: 140555 - protein, 7 aa, Mycobacterium avium
DATGERI

SEQ ID NO: 140556 - protein, 7 aa, Mycobacterium avium
DATPELR

SEQ ID NO: 140557 - protein, 20 aa, Mycobacterium avium
DATRDRGAAAAPPARGTQLT

SEQ ID NO: 140558 - protein, 20 aa, Mycobacterium avium
DATRDRGAAGAPPARGTQLT

SEQ ID NO: 140559 - protein, 21 aa, Mycobacterium avium
DATRDRGAAGAPPARGTQLTE

SEQ ID NO: 140560 - protein, 5 aa, Mycobacterium avium
DAVRN

SEQ ID NO: 140561 - protein, 30 aa, Mycobacterium avium
DAVSADDGAAEAAPFGKADPVAAREALGGA

SEQ ID NO: 140562 - protein, 53 aa, Mycobacterium avium
DAVSAGDGAAEAAPFGKADPVAAREAAGRRAARGAHRLPGAQRPARGQRRRHH

SEQ ID NO: 140563 - protein, 30 aa, Mycobacterium avium
DAVSAGDGAAEAAPFGKADPVAAREALGGA

SEQ ID NO: 140564 - protein, 10 aa, Mycobacterium avium
DAWDTEAETI

SEQ ID NO: 140565 - protein, 6 aa, Mycobacterium avium
DCHEAA

SEQ ID NO: 140566 - protein, 15 aa, Mycobacterium avium
DDAATPGPPATGRAV

SEQ ID NO: 140567 - protein, 4 aa, Mycobacterium avium
DDDE

SEQ ID NO: 140568 - protein, 7 aa, Mycobacterium avium
DDETTMR

SEQ ID NO: 140569 - protein, 8 aa, Mycobacterium avium
DDGDGGPF

SEQ ID NO: 140570 - protein, 4 aa, Mycobacterium avium
DDGN

SEQ ID NO: 140571 - protein, 15 aa, Mycobacterium avium
DDGRAAAEKIETPPW

SEQ ID NO: 140572 - protein, 20 aa, Mycobacterium avium
DDGTIGASGFRDGPARHWTS

SEQ ID NO: 140573 - protein, 17 aa, Mycobacterium avium
DDKGPAEADTIDAVRAL

SEQ ID NO: 140574 - protein, 24 aa, Mycobacterium avium
DDPNRFTESTPYNPSSPYSATKAA

SEQ ID NO: 140575 - protein, 6 aa, Mycobacterium avium
DDPQWG

SEQ ID NO: 140576 - protein, 19 aa, Mycobacterium avium
DDRQPAPGDQPPPPGPGTP

SEQ ID NO: 140577 - protein, 9 aa, Mycobacterium avium
DDRRETLPQ

SEQ ID NO: 140578 - protein, 5 aa, Mycobacterium avium
DDSPV

SEQ ID NO: 140579 - protein, 9 aa, Mycobacterium avium
DDSRSDLDA

SEQ ID NO: 140580 - protein, 7 aa, Mycobacterium avium
DDTARAS

SEQ ID NO: 140581 - protein, 10 aa, Mycobacterium avium
DDVPASLSPE

SEQ ID NO: 140582 - protein, 9 aa, Mycobacterium avium
DEDGGQRPA

SEQ ID NO: 140583 - protein, 21 aa, Mycobacterium avium
DEEPHTVAASDGSFHSPGMGT

SEQ ID NO: 140584 - protein, 8 aa, Mycobacterium avium
DEFGGGAG

SEQ ID NO: 140585 - protein, 14 aa, Mycobacterium avium
DELGAGGISGPPVA

SEQ ID NO: 140586 - protein, 7 aa, Mycobacterium avium
DELGDLD

SEQ ID NO: 140587 - protein, 8 aa, Mycobacterium avium
DELGDLDE

SEQ ID NO: 140588 - protein, 11 aa, Mycobacterium avium
DEPLDPHYGEP

SEQ ID NO: 140589 - protein, 5 aa, Mycobacterium avium
DEQQN

SEQ ID NO: 140590 - protein, 6 aa, Mycobacterium avium
DERENL

SEQ ID NO: 140591 - protein, 8 aa, Mycobacterium avium
DESSATRL

SEQ ID NO: 140592 - protein, 4 aa, Mycobacterium avium
DETK

SEQ ID NO: 140593 - protein, 7 aa, Mycobacterium avium
DETRKSF

SEQ ID NO: 140594 - protein, 7 aa, Mycobacterium avium
DFDPDRA

SEQ ID NO: 140595 - protein, 6 aa, Mycobacterium avium
DFKRPS

SEQ ID NO: 140596 - protein, 10 aa, Mycobacterium avium
DGAPMKPEDF

SEQ ID NO: 140597 - protein, 17 aa, Mycobacterium avium
DGAQPQQGTVRTAPMGR

SEQ ID NO: 140598 - protein, 4 aa, Mycobacterium avium
DGAV

SEQ ID NO: 140599 - protein, 8 aa, Mycobacterium avium
DGCQGDPS

SEQ ID NO: 140600 - protein, 8 aa, Mycobacterium avium
DGDDEQTL

SEQ ID NO: 140601 - protein, 7 aa, Mycobacterium avium
DGDGPVT

SEQ ID NO: 140602 - protein, 11 aa, Mycobacterium avium
DGDHHRSDRRQ

SEQ ID NO: 140603 - protein, 17 aa, Mycobacterium avium
DGFEHTTGTLAPRAAVP

SEQ ID NO: 140604 - protein, 6 aa, Mycobacterium avium
DGGGSY

SEQ ID NO: 140605 - protein, 19 aa, Mycobacterium avium
DGGYTAGRDHGVVELFGFP

SEQ ID NO: 140606 - protein, 6 aa, Mycobacterium avium
DGKPAL

SEQ ID NO: 140607 - protein, 7 aa, Mycobacterium avium
DGLDGQR

SEQ ID NO: 140608 - protein, 9 aa, Mycobacterium avium
DGLTPETAD

SEQ ID NO: 140609 - protein, 12 aa, Mycobacterium avium
DGPTDTLAPPEF

SEQ ID NO: 140610 - protein, 15 aa, Mycobacterium avium
DGPVAAAAPAPAPTG

SEQ ID NO: 140611 - protein, 10 aa, Mycobacterium avium
DGSTSTAPAF

SEQ ID NO: 140612 - protein, 14 aa, Mycobacterium avium
DGTARLAGKSEIGN

SEQ ID NO: 140613 - protein, 12 aa, Mycobacterium avium
DGTAVRQLIRFD

SEQ ID NO: 140614 - protein, 8 aa, Mycobacterium avium
DGTGPALT

SEQ ID NO: 140615 - protein, 6 aa, Mycobacterium avium
DGTLPG

SEQ ID NO: 140616 - protein, 11 aa, Mycobacterium avium
DGTRFTNDQTK

SEQ ID NO: 140617 - protein, 6 aa, Mycobacterium avium
DGVGGT

SEQ ID NO: 140618 - protein, 7 aa, Mycobacterium avium
DGVGGTW

SEQ ID NO: 140619 - protein, 10 aa, Mycobacterium avium
DGVGKSPAQL

SEQ ID NO: 140620 - protein, 20 aa, Mycobacterium avium
DGVGQRRTQSGQIGSTRDTG

SEQ ID NO: 140621 - protein, 7 aa, Mycobacterium avium
DGYGHGA

SEQ ID NO: 140622 - protein, 7 aa, Mycobacterium avium
DHPDRAA

SEQ ID NO: 140623 - protein, 9 aa, Mycobacterium avium
DHPGATTGG

SEQ ID NO: 140624 - protein, 20 aa, Mycobacterium avium
DHPGPVRDKRRRRAAGRPVP

SEQ ID NO: 140625 - protein, 6 aa, Mycobacterium avium
DHTPLT

SEQ ID NO: 140626 - protein, 25 aa, Mycobacterium avium
DKATAATAPSVQTAVGQAAAELGDT

SEQ ID NO: 140627 - protein, 21 aa, Mycobacterium avium
DKHWGTAESDAPPSFGAGSSA

SEQ ID NO: 140628 - protein, 14 aa, Mycobacterium avium
DKKPEGEDRATRAE

SEQ ID NO: 140629 - protein, 14 aa, Mycobacterium avium
DKNQVAGAISSQLG

SEQ ID NO: 140630 - protein, 5 aa, Mycobacterium avium
DKQAV

SEQ ID NO: 140631 - protein, 20 aa, Mycobacterium avium
DLAGEQSRRLDGQRQRNDDL

SEQ ID NO: 140632 - protein, 8 aa, Mycobacterium avium
DLATREEQ

SEQ ID NO: 140633 - protein, 9 aa, Mycobacterium avium
DLDGSKRGP

SEQ ID NO: 140634 - protein, 4 aa, Mycobacterium avium
DLGG

SEQ ID NO: 140635 - protein, 9 aa, Mycobacterium avium
DLGGTDPEL

SEQ ID NO: 140636 - protein, 13 aa, Mycobacterium avium
DLGPASDVSSTSV

SEQ ID NO: 140637 - protein, 5 aa, Mycobacterium avium
DLGPE

SEQ ID NO: 140638 - protein, 9 aa, Mycobacterium avium
DLLDDPDAA

SEQ ID NO: 140639 - protein, 10 aa, Mycobacterium avium
DLLDDPDAAS

SEQ ID NO: 140640 - protein, 13 aa, Mycobacterium avium
DLPANATATLGQT

SEQ ID NO: 140641 - protein, 5 aa, Mycobacterium avium
DLQPG

SEQ ID NO: 140642 - protein, 6 aa, Mycobacterium avium
DLRPDS

SEQ ID NO: 140643 - protein, 6 aa, Mycobacterium avium
DLRREP

SEQ ID NO: 140644 - protein, 9 aa, Mycobacterium avium
DLSDSDVDD

SEQ ID NO: 140645 - protein, 4 aa, Mycobacterium avium
DLYP

SEQ ID NO: 140646 - protein, 13 aa, Mycobacterium avium
DMDGAEPATPNIA

SEQ ID NO: 140647 - protein, 11 aa, Mycobacterium avium
DNLRGQGPDIR

SEQ ID NO: 140648 - protein, 4 aa, Mycobacterium avium
DNNF

SEQ ID NO: 140649 - protein, 6 aa, Mycobacterium avium
DNPTIG

SEQ ID NO: 140650 - protein, 9 aa, Mycobacterium avium
DNPVSVSGV

SEQ ID NO: 140651 - protein, 9 aa, Mycobacterium avium
DNRTQLKPA

SEQ ID NO: 140652 - protein, 4 aa, Mycobacterium avium
DPAA

SEQ ID NO: 140653 - protein, 12 aa, Mycobacterium avium
DPADSGQGDETG

SEQ ID NO: 140654 - protein, 8 aa, Mycobacterium avium
DPAEADYD

SEQ ID NO: 140655 - protein, 8 aa, Mycobacterium avium
DPAGGDTL

SEQ ID NO: 140656 - protein, 14 aa, Mycobacterium avium
DPAPADSSTSTDCY

SEQ ID NO: 140657 - protein, 11 aa, Mycobacterium avium
DPAQVGGPEKL

SEQ ID NO: 140658 - protein, 4 aa, Mycobacterium avium
DPAS

SEQ ID NO: 140659 - protein, 5 aa, Mycobacterium avium
DPDAE

SEQ ID NO: 140660 - protein, 4 aa, Mycobacterium avium
DPDQ

SEQ ID NO: 140661 - protein, 8 aa, Mycobacterium avium
DPDRDATG

SEQ ID NO: 140662 - protein, 16 aa, Mycobacterium avium
DPEQPAPYAEAGWIVH

SEQ ID NO: 140663 - protein, 16 aa, Mycobacterium avium
DPEQPAPYTEAGWIVH

SEQ ID NO: 140664 - protein, 5 aa, Mycobacterium avium
DPERF

SEQ ID NO: 140665 - protein, 8 aa, Mycobacterium avium
DPESAQGI

SEQ ID NO: 140666 - protein, 8 aa, Mycobacterium avium
DPETRTAD

SEQ ID NO: 140667 - protein, 4 aa, Mycobacterium avium
DPFA

SEQ ID NO: 140668 - protein, 10 aa, Mycobacterium avium
DPGAASPKET

SEQ ID NO: 140669 - protein, 7 aa, Mycobacterium avium
DPGESLS

SEQ ID NO: 140670 - protein, 4 aa, Mycobacterium avium
DPGI

SEQ ID NO: 140671 - protein, 27 aa, Mycobacterium avium
DPGIDGARSHYADQKDRIADAGRDPAA

SEQ ID NO: 140672 - protein, 12 aa, Mycobacterium avium
DPGPAGGNTSIR

SEQ ID NO: 140673 - protein, 5 aa, Mycobacterium avium
DPIPG

SEQ ID NO: 140674 - protein, 13 aa, Mycobacterium avium
DPIVGTDGVAATA

SEQ ID NO: 140675 - protein, 13 aa, Mycobacterium avium
DPLASRRGEVERG

SEQ ID NO: 140676 - protein, 8 aa, Mycobacterium avium
DPPKSLTA

SEQ ID NO: 140677 - protein, 34 aa, Mycobacterium avium
DPRFATNSGARPQGAATSKPAPGGPPPLAAPKND

SEQ ID NO: 140678 - protein, 4 aa, Mycobacterium avium
DPRR

SEQ ID NO: 140679 - protein, 6 aa, Mycobacterium avium
DPSRAA

SEQ ID NO: 140680 - protein, 6 aa, Mycobacterium avium
DPTVPG

SEQ ID NO: 140681 - protein, 7 aa, Mycobacterium avium
DPTYGQG

SEQ ID NO: 140682 - protein, 6 aa, Mycobacterium avium
DPVGPR

SEQ ID NO: 140683 - protein, 17 aa, Mycobacterium avium
DQASTGVLRQAAATCPT

SEQ ID NO: 140684 - protein, 16 aa, Mycobacterium avium
DQIPPTPIGQPNHHID

SEQ ID NO: 140685 - protein, 24 aa, Mycobacterium avium
DQKLPSEVVDPPTGTPPVPPENAP

SEQ ID NO: 140686 - protein, 15 aa, Mycobacterium avium
DQPDPPGGATPRDAM

SEQ ID NO: 140687 - protein, 15 aa, Mycobacterium avium
DQPDPPGGVTPRDAM

SEQ ID NO: 140688 - protein, 18 aa, Mycobacterium avium
DQQESHNRDAQVSCLDKS

SEQ ID NO: 140689 - protein, 8 aa, Mycobacterium avium
DQRSAQFS

SEQ ID NO: 140690 - protein, 9 aa, Mycobacterium avium
DRAGHAQQA

SEQ ID NO: 140691 - protein, 6 aa, Mycobacterium avium
DRDNPY

SEQ ID NO: 140692 - protein, 8 aa, Mycobacterium avium
DRGDIGGL

SEQ ID NO: 140693 - protein, 19 aa, Mycobacterium avium
DRGDIGGLSTAAGPEPAGL

SEQ ID NO: 140694 - protein, 13 aa, Mycobacterium avium
DRLGPGEQDARER

SEQ ID NO: 140695 - protein, 8 aa, Mycobacterium avium
DRLTEGAA

SEQ ID NO: 140696 - protein, 8 aa, Mycobacterium avium
DRNGAPPV

SEQ ID NO: 140697 - protein, 51 aa, Mycobacterium avium; identical to SEQ ID NO: 62931

SEQ ID NO: 140698 - protein, 44 aa, Mycobacterium avium
DRPAPPDAPAPDAPPPAPADLPPAPPADATPPAPPADAPAPDGD

SEQ ID NO: 140699 - protein, 7 aa, Mycobacterium avium
DRPINSA

SEQ ID NO: 140700 - protein, 5 aa, Mycobacterium avium
DRPPL

SEQ ID NO: 140701 - protein, 4 aa, Mycobacterium avium
DRRT

SEQ ID NO: 140702 - protein, 6 aa, Mycobacterium avium
DRSGQV

SEQ ID NO: 140703 - protein, 11 aa, Mycobacterium avium
DRSRAKGPSRW

SEQ ID NO: 140704 - protein, 6 aa, Mycobacterium avium
DRTRRQ

SEQ ID NO: 140705 - protein, 9 aa, Mycobacterium avium
DRTTVPPNI

SEQ ID NO: 140706 - protein, 13 aa, Mycobacterium avium
DRVTAGPAAINQS

SEQ ID NO: 140707 - protein, 5 aa, Mycobacterium avium
DSAES

SEQ ID NO: 140708 - protein, 8 aa, Mycobacterium avium
DSAPRVTD

SEQ ID NO: 140709 - protein, 13 aa, Mycobacterium avium
DSAVRSAVGSAVD

SEQ ID NO: 140710 - protein, 6 aa, Mycobacterium avium
DSDPFY

SEQ ID NO: 140711 - protein, 14 aa, Mycobacterium avium
DSDTDGSDREAALP

SEQ ID NO: 140712 - protein, 14 aa, Mycobacterium avium
DSDTHAAEAVAEQG

SEQ ID NO: 140713 - protein, 4 aa, Mycobacterium avium
DSEF

SEQ ID NO: 140714 - protein, 14 aa, Mycobacterium avium
DSETANDDAHGSAL

SEQ ID NO: 140715 - protein, 12 aa, Mycobacterium avium
DSIKRKDPSGVT

SEQ ID NO: 140716 - protein, 14 aa, Mycobacterium avium
DSLGGAGDAQTEFN

SEQ ID NO: 140717 - protein, 17 aa, Mycobacterium avium
DSLRPTPTGRLRDPDRH

SEQ ID NO: 140718 - protein, 4 aa, Mycobacterium avium
DSNQ

SEQ ID NO: 140719 - protein, 16 aa, Mycobacterium avium
DSPKRVSQSMRSAMLG

SEQ ID NO: 140720 - protein, 6 aa, Mycobacterium avium
DSRLAS

SEQ ID NO: 140721 - protein, 23 aa, Mycobacterium avium
DSSASTTFTGTTSSFWSAAGIVL

SEQ ID NO: 140722 - protein, 7 aa, Mycobacterium avium
DTAEDTV

SEQ ID NO: 140723 - protein, 13 aa, Mycobacterium avium
DTAPAAANRGSRV

SEQ ID NO: 140724 - protein, 6 aa, Mycobacterium avium
DTDSLA

SEQ ID NO: 140725 - protein, 12 aa, Mycobacterium avium
DTIAGPASPAAN

SEQ ID NO: 140726 - protein, 4 aa, Mycobacterium avium
DTII

SEQ ID NO: 140727 - protein, 8 aa, Mycobacterium avium
DTKIPSEV

SEQ ID NO: 140728 - protein, 8 aa, Mycobacterium avium
DTQSARTD

SEQ ID NO: 140729 - protein, 10 aa, Mycobacterium avium
DTRDSYSGAD

SEQ ID NO: 140730 - protein, 15 aa, Mycobacterium avium
DTSGAPETGEVPINQ

SEQ ID NO: 140731 - protein, 15 aa, Mycobacterium avium
DTSGRPETGEVPINQ

SEQ ID NO: 140732 - protein, 16 aa, Mycobacterium avium
DTSGTPETGEVPINQD

SEQ ID NO: 140733 - protein, 10 aa, Mycobacterium avium
DTTQDRRSGY

SEQ ID NO: 140734 - protein, 8 aa, Mycobacterium avium
DTYADDGA

SEQ ID NO: 140735 - protein, 15 aa, Mycobacterium avium
DVGQKQDAAIKKGLG

SEQ ID NO: 140736 - protein, 7 aa, Mycobacterium avium
DVNGEPY

SEQ ID NO: 140737 - protein, 14 aa, Mycobacterium avium
DVPDAQDATGGAGS

SEQ ID NO: 140738 - protein, 11 aa, Mycobacterium avium
DVSTEIRGDKV

SEQ ID NO: 140739 - protein, 14 aa, Mycobacterium avium
DVTTAMNETNERQQ

SEQ ID NO: 140740 - protein, 14 aa, Mycobacterium avium
DVTTAMNQTNERQQ

SEQ ID NO: 140741 - protein, 14 aa, Mycobacterium avium
DYSGPGSGLSGTES

SEQ ID NO: 140742 - protein, 15 aa, Mycobacterium avium
DYSGPGSGLSGTESI

SEQ ID NO: 140743 - protein, 7 aa, Mycobacterium avium
EAAGGRN

SEQ ID NO: 140744 - protein, 7 aa, Mycobacterium avium
EAAGHTT

SEQ ID NO: 140745 - protein, 17 aa, Mycobacterium avium
EAARASTKTAEATAQAA

SEQ ID NO: 140746 - protein, 12 aa, Mycobacterium avium
EAAVGSKAAAGA

SEQ ID NO: 140747 - protein, 10 aa, Mycobacterium avium
EADDPGNPGQ

SEQ ID NO: 140748 - protein, 9 aa, Mycobacterium avium
EADGGGPEL

SEQ ID NO: 140749 - protein, 10 aa, Mycobacterium avium
EADNGGNELR

SEQ ID NO: 140750 - protein, 13 aa, Mycobacterium avium
EADQQADGGAARR

SEQ ID NO: 140751 - protein, 5 aa, Mycobacterium avium
EAGAE

SEQ ID NO: 140752 - protein, 19 aa, Mycobacterium avium
EAGHPQRRQQAEDAERYPK

SEQ ID NO: 140753 - protein, 7 aa, Mycobacterium avium
EANGTPV

SEQ ID NO: 140754 - protein, 21 aa, Mycobacterium avium
EARDQARQEATKDRRRAPGTA

SEQ ID NO: 140755 - protein, 11 aa, Mycobacterium avium
EARNGRPPRER

SEQ ID NO: 140756 - protein, 9 aa, Mycobacterium avium
EATAAHSPD

SEQ ID NO: 140757 - protein, 6 aa, Mycobacterium avium
EATESA

SEQ ID NO: 140758 - protein, 6 aa, Mycobacterium avium
EATGGS

SEQ ID NO: 140759 - protein, 7 aa, Mycobacterium avium
EATPKVE

SEQ ID NO: 140760 - protein, 5 aa, Mycobacterium avium
ECSGG

SEQ ID NO: 140761 - protein, 5 aa, Mycobacterium avium
EDAAD

SEQ ID NO: 140762 - protein, 9 aa, Mycobacterium avium
EDKPDDVVR

SEQ ID NO: 140763 - protein, 15 aa, Mycobacterium avium
EDLGSNASNLNKPQF

SEQ ID NO: 140764 - protein, 10 aa, Mycobacterium avium
EDLLDDPDAA

SEQ ID NO: 140765 - protein, 8 aa, Mycobacterium avium
EDPERSAA

SEQ ID NO: 140766 - protein, 5 aa, Mycobacterium avium
EDQRV

SEQ ID NO: 140767 - protein, 6 aa, Mycobacterium avium
EDRPDE

SEQ ID NO: 140768 - protein, 13 aa, Mycobacterium avium
EDVRGEQEPHPVG

SEQ ID NO: 140769 - protein, 10 aa, Mycobacterium avium
EDYPPPPDGD

SEQ ID NO: 140770 - protein, 17 aa, Mycobacterium avium
EEAKAKNPSAPDPQQRL

SEQ ID NO: 140771 - protein, 10 aa, Mycobacterium avium
EEAMPADRQV

SEQ ID NO: 140772 - protein, 7 aa, Mycobacterium avium
EEATGAS

SEQ ID NO: 140773 - protein, 11 aa, Mycobacterium avium
EELRQTDPTRL

SEQ ID NO: 140774 - protein, 6 aa, Mycobacterium avium
EEPPPS

SEQ ID NO: 140775 - protein, 10 aa, Mycobacterium avium
EEPRHGDPIR

SEQ ID NO: 140776 - protein, 19 aa, Mycobacterium avium
EEPRPSSAGCGPGDPGTAF

SEQ ID NO: 140777 - protein, 16 aa, Mycobacterium avium
EEQPQAGAVQAPPGAR

SEQ ID NO: 140778 - protein, 5 aa, Mycobacterium avium
EGAEL

SEQ ID NO: 140779 - protein, 13 aa, Mycobacterium avium
EGALPPPRKKSRR

SEQ ID NO: 140780 - protein, 6 aa, Mycobacterium avium
EGKNAL

SEQ ID NO: 140781 - protein, 17 aa, Mycobacterium avium
EGLPSPGSPVCSAGKYA

SEQ ID NO: 140782 - protein, 18 aa, Mycobacterium avium
EGLPSPGSPVCSAGKYAR

SEQ ID NO: 140783 - protein, 7 aa, Mycobacterium avium
EGPMTPG

SEQ ID NO: 140784 - protein, 27 aa, Mycobacterium avium
EGPPDKYEAHGRIDSTDWQTGQPKTDN

SEQ ID NO: 140785 - protein, 11 aa, Mycobacterium avium
EGRDPAQSLTA

SEQ ID NO: 140786 - protein, 5 aa, Mycobacterium avium
EGRPM

SEQ ID NO: 140787 - protein, 18 aa, Mycobacterium avium
EGVTDEDAAAAGKTAKQN

SEQ ID NO: 140788 - protein, 13 aa, Mycobacterium avium
EGYSGQGTQRLGE

SEQ ID NO: 140789 - protein, 14 aa, Mycobacterium avium
EGYSPTFPGAEDFG

SEQ ID NO: 140790 - protein, 9 aa, Mycobacterium avium
EHAETPGHD

SEQ ID NO: 140791 - protein, 12 aa, Mycobacterium avium
EHGPMGPGAVRS

SEQ ID NO: 140792 - protein, 8 aa, Mycobacterium avium
EKGEPPRV

SEQ ID NO: 140793 - protein, 7 aa, Mycobacterium avium
EKTGGRV

SEQ ID NO: 140794 - protein, 6 aa, Mycobacterium avium
ELAPPH

SEQ ID NO: 140795 - protein, 6 aa, Mycobacterium avium
ELPGCP

SEQ ID NO: 140796 - protein, 6 aa, Mycobacterium avium
ELPTTH

SEQ ID NO: 140797 - protein, 7 aa, Mycobacterium avium
ELSRRGH

SEQ ID NO: 140798 - protein, 9 aa, Mycobacterium avium
EMNRRQEAL

SEQ ID NO: 140799 - protein, 7 aa, Mycobacterium avium
ENIAPAE

SEQ ID NO: 140800 - protein, 8 aa, Mycobacterium avium
EPAEHGMG

SEQ ID NO: 140801 - protein, 10 aa, Mycobacterium avium
EPAKISDADA

SEQ ID NO: 140802 - protein, 10 aa, Mycobacterium avium
EPAKISDEDA

SEQ ID NO: 140803 - protein, 6 aa, Mycobacterium avium
EPANAL

SEQ ID NO: 140804 - protein, 11 aa, Mycobacterium avium
EPATSGRPVGL

SEQ ID NO: 140805 - protein, 4 aa, Mycobacterium avium
EPDR

SEQ ID NO: 140806 - protein, 4 aa, Mycobacterium avium
EPET

SEQ ID NO: 140807 - protein, 55 aa, Mycobacterium avium
EPGGPGGPGGPGGPDHPGGPGGPGGPDHPGGPGGPGGPDHPGGPGGPWHGDPQRG

SEQ ID NO: 140808 - protein, 19 aa, Mycobacterium avium
EPGRGRAATPPAGTGFPRA

SEQ ID NO: 140809 - protein, 18 aa, Mycobacterium avium
EPGSPVPNGVTPPDGAPV

SEQ ID NO: 140810 - protein, 6 aa, Mycobacterium avium
EPIPGT

SEQ ID NO: 140811 - protein, 9 aa, Mycobacterium avium
EPPGGPALG

SEQ ID NO: 140812 - protein, 6 aa, Mycobacterium avium
EPQLGD

SEQ ID NO: 140813 - protein, 10 aa, Mycobacterium avium
EPSAETPSQL

SEQ ID NO: 140814 - protein, 10 aa, Mycobacterium avium
EQADPNFAER

SEQ ID NO: 140815 - protein, 9 aa, Mycobacterium avium
EQLRSEDQN

SEQ ID NO: 140816 - protein, 4 aa, Mycobacterium avium
EQSQ

SEQ ID NO: 140817 - protein, 10 aa, Mycobacterium avium
EQVSGKYTGI

SEQ ID NO: 140818 - protein, 10 aa, Mycobacterium avium
ERAEAETEEL

SEQ ID NO: 140819 - protein, 42 aa, Mycobacterium avium
ERDQAQAKLEAAKRQLSTAGSGDRWETGSAGAPAPSAGRQWD

SEQ ID NO: 140820 - protein, 11 aa, Mycobacterium avium
ERETAKPVINE

SEQ ID NO: 140821 - protein, 10 aa, Mycobacterium avium
ERETGSPPTV

SEQ ID NO: 140822 - protein, 14 aa, Mycobacterium avium
ERGGYDAQGHGNSV

SEQ ID NO: 140823 - protein, 15 aa, Mycobacterium avium
ERGGYGAQGHGNSAP

SEQ ID NO: 140824 - protein, 14 aa, Mycobacterium avium
ERGGYGAQGHGNSV

SEQ ID NO: 140825 - protein, 4 aa, Mycobacterium avium
ERHG

SEQ ID NO: 140826 - protein, 8 aa, Mycobacterium avium
ERLAGQRD

SEQ ID NO: 140827 - protein, 10 aa, Mycobacterium avium
ERPDGGDFAR

SEQ ID NO: 140828 - protein, 8 aa, Mycobacterium avium
ERQSDALG

SEQ ID NO: 140829 - protein, 9 aa, Mycobacterium avium
ERRLGDETQ

SEQ ID NO: 140830 - protein, 10 aa, Mycobacterium avium
ERTDTSSGAG

SEQ ID NO: 140831 - protein, 6 aa, Mycobacterium avium
ETAPRC

SEQ ID NO: 140832 - protein, 32 aa, Mycobacterium avium
ETARDNAAAAQHDLEASQQAVKDANAAIAGAQ

SEQ ID NO: 140833 - protein, 8 aa, Mycobacterium avium
ETDQQGAR

SEQ ID NO: 140834 - protein, 14 aa, Mycobacterium avium
ETGAAHQPVDIPND

SEQ ID NO: 140835 - protein, 8 aa, Mycobacterium avium
ETGSPYAN

SEQ ID NO: 140836 - protein, 4 aa, Mycobacterium avium
ETPD

SEQ ID NO: 140837 - protein, 6 aa, Mycobacterium avium
ETRKSF

SEQ ID NO: 140838 - protein, 5 aa, Mycobacterium avium
ETTAN

SEQ ID NO: 140839 - protein, 12 aa, Mycobacterium avium
ETTDGLTDCDGH

SEQ ID NO: 140840 - protein, 10 aa, Mycobacterium avium
ETTGEQIGPP

SEQ ID NO: 140841 - protein, 4 aa, Mycobacterium avium
EVAE

SEQ ID NO: 140842 - protein, 8 aa, Mycobacterium avium
EVDGSDAA

SEQ ID NO: 140843 - protein, 14 aa, Mycobacterium avium
EVSGRLGNKPDSAT

SEQ ID NO: 140844 - protein, 15 aa, Mycobacterium avium
EVSPTPTPTPQQTLS

SEQ ID NO: 140845 - protein, 9 aa, Mycobacterium avium
EVTARDREV

SEQ ID NO: 140846 - protein, 10 aa, Mycobacterium avium
EVTPLSASAT

SEQ ID NO: 140847 - protein, 12 aa, Mycobacterium avium
EWPSGPNSSRGH

SEQ ID NO: 140848 - protein, 8 aa, Mycobacterium avium
EYEASTDY

SEQ ID NO: 140849 - protein, 5 aa, Mycobacterium avium
FADPE

SEQ ID NO: 140850 - protein, 6 aa, Mycobacterium avium
FANDPA

SEQ ID NO: 140851 - protein, 4 aa, Mycobacterium avium
FARD

SEQ ID NO: 140852 - protein, 18 aa, Mycobacterium avium
FATARDGNKMTAVGDFAT

SEQ ID NO: 140853 - protein, 11 aa, Mycobacterium avium
FDAGPAPAYLS

SEQ ID NO: 140854 - protein, 13 aa, Mycobacterium avium
FDGPAGSAPDASK

SEQ ID NO: 140855 - protein, 7 aa, Mycobacterium avium
FDPGLGR

SEQ ID NO: 140856 - protein, 26 aa, Mycobacterium avium
FDRSGGDFDISTGNKNGTGGCLAPGG

SEQ ID NO: 140857 - protein, 8 aa, Mycobacterium avium
FEQRSKPF

SEQ ID NO: 140858 - protein, 10 aa, Mycobacterium avium
FGAEPGSRLY

SEQ ID NO: 140859 - protein, 24 aa, Mycobacterium avium
FGAPPQSADANAAADQSAAAASAL

SEQ ID NO: 140860 - protein, 11 aa, Mycobacterium avium
FGLPKNSRLGY

SEQ ID NO: 140861 - protein, 9 aa, Mycobacterium avium
FGPNPLDPD

SEQ ID NO: 140862 - protein, 9 aa, Mycobacterium avium
FGPNPLDPG

SEQ ID NO: 140863 - protein, 31 aa, Mycobacterium avium; identical to SEQ ID NO: 5419

SEQ ID NO: 140864 - protein, 10 aa, Mycobacterium avium
FNTAESENLQ

SEQ ID NO: 140865 - protein, 19 aa, Mycobacterium avium
FPEVGSERQDLRQYPGGSL

SEQ ID NO: 140866 - protein, 8 aa, Mycobacterium avium
FPRPQTQI

SEQ ID NO: 140867 - protein, 6 aa, Mycobacterium avium
FQEGTG

SEQ ID NO: 140868 - protein, 13 aa, Mycobacterium avium
FQSPRDTADNINR

SEQ ID NO: 140869 - protein, 9 aa, Mycobacterium avium
FRTNEEPPF

SEQ ID NO: 140870 - protein, 4 aa, Mycobacterium avium
FSGR

SEQ ID NO: 140871 - protein, 10 aa, Mycobacterium avium
FSPKGEGGAF

SEQ ID NO: 140872 - protein, 12 aa, Mycobacterium avium
FTESGEPAGIGG

SEQ ID NO: 140873 - protein, 5 aa, Mycobacterium avium
FTGLP

SEQ ID NO: 140874 - protein, 5 aa, Mycobacterium avium
FTPKT

SEQ ID NO: 140875 - protein, 5 aa, Mycobacterium avium
FTSQA

SEQ ID NO: 140876 - protein, 4 aa, Mycobacterium avium
FYSN

SEQ ID NO: 140877 - protein, 5 aa, Mycobacterium avium
FYSNP

SEQ ID NO: 140878 - protein, 25 aa, Mycobacterium avium
GAAADPAAAPQPAPPPNAAPQLPGL

SEQ ID NO: 140879 - protein, 14 aa, Mycobacterium avium
GAAAPGAFDGPDDF

SEQ ID NO: 140880 - protein, 5 aa, Mycobacterium avium
GAAAT

SEQ ID NO: 140881 - protein, 6 aa, Mycobacterium avium
GAAEAG

SEQ ID NO: 140882 - protein, 5 aa, Mycobacterium avium
GAAGN

SEQ ID NO: 140883 - protein, 9 aa, Mycobacterium avium
GAAGSKGLR

SEQ ID NO: 140884 - protein, 10 aa, Mycobacterium avium
GAAPARARQY

SEQ ID NO: 140885 - protein, 7 aa, Mycobacterium avium
GAAPNLG

SEQ ID NO: 140886 - protein, 42 aa, Mycobacterium avium
GAAPSTSTRSTTRPPISGTQASTASGTPAHTSSRWPTTAPTP

SEQ ID NO: 140887 - protein, 17 aa, Mycobacterium avium
GAASPNHGAVDPEAAPV

SEQ ID NO: 140888 - protein, 14 aa, Mycobacterium avium
GAATKSDAARPAGL

SEQ ID NO: 140889 - protein, 18 aa, Mycobacterium avium
GADGITATSAASTPITAT

SEQ ID NO: 140890 - protein, 5 aa, Mycobacterium avium
GADIN

SEQ ID NO: 140891 - protein, 4 aa, Mycobacterium avium
GADL

SEQ ID NO: 140892 - protein, 8 aa, Mycobacterium avium
GADPAAAV

SEQ ID NO: 140893 - protein, 15 aa, Mycobacterium avium
GAGAGGHGAAGPKYG

SEQ ID NO: 140894 - protein, 4 aa, Mycobacterium avium
GAGI

SEQ ID NO: 140895 - protein, 27 aa, Mycobacterium avium
GAGNHGAASSSTATGSTASPKTPLARG

SEQ ID NO: 140896 - protein, 7 aa, Mycobacterium avium
GAGPGES

SEQ ID NO: 140897 - protein, 66 aa, Mycobacterium avium
GAGQSVPGYGPSVPGVGPQSPGYGQQSPVYGQTPPGSGPSIHDNAPGPGTAPAPAVPSTPPSQAPL

SEQ ID NO: 140898 - protein, 9 aa, Mycobacterium avium
GAGSDNTVT

SEQ ID NO: 140899 - protein, 7 aa, Mycobacterium avium
GAIEPAA

SEQ ID NO: 140900 - protein, 18 aa, Mycobacterium avium
GAIGGAAPAAAKALPGLG

SEQ ID NO: 140901 - protein, 5 aa, Mycobacterium avium
GAIPG

SEQ ID NO: 140902 - protein, 7 aa, Mycobacterium avium
GAKLGRD

SEQ ID NO: 140903 - protein, 25 aa, Mycobacterium avium
GAKQQQISAEASIPAAASVSADPRE

SEQ ID NO: 140904 - protein, 29 aa, Mycobacterium avium
GAKVGSADVAVDGKTYTITGQAQGADMKN

SEQ ID NO: 140905 - protein, 17 aa, Mycobacterium avium
GAPAALADSVRNGDTQV

SEQ ID NO: 140906 - protein, 8 aa, Mycobacterium avium
GAPATPAL

SEQ ID NO: 140907 - protein, 7 aa, Mycobacterium avium
GAPCPSC

SEQ ID NO: 140908 - protein, 5 aa, Mycobacterium avium
GAPRG

SEQ ID NO: 140909 - protein, 12 aa, Mycobacterium avium
GAPRSGKSTALR

SEQ ID NO: 140910 - protein, 4 aa, Mycobacterium avium
GAPV

SEQ ID NO: 140911 - protein, 8 aa, Mycobacterium avium
GAQARAER

SEQ ID NO: 140912 - protein, 7 aa, Mycobacterium avium
GAQRAQR

SEQ ID NO: 140913 - protein, 9 aa, Mycobacterium avium
GAQSAAQAL

SEQ ID NO: 140914 - protein, 7 aa, Mycobacterium avium
GAQSRDE

SEQ ID NO: 140915 - protein, 8 aa, Mycobacterium avium
GAQTDRPT

SEQ ID NO: 140916 - protein, 18 aa, Mycobacterium avium
GARNTPCVEKPGKRAPTA

SEQ ID NO: 140917 - protein, 6 aa, Mycobacterium avium
GASARW

SEQ ID NO: 140918 - protein, 11 aa, Mycobacterium avium
GASPAAPAEAV

SEQ ID NO: 140919 - protein, 18 aa, Mycobacterium avium
GASSGIGAATATALAAEG

SEQ ID NO: 140920 - protein, 18 aa, Mycobacterium avium
GAVGGGAGVGDRFSAGAA

SEQ ID NO: 140921 - protein, 22 aa, Mycobacterium avium
GCAKPTAQHGKSSGPPPPPGKG

SEQ ID NO: 140922 - protein, 36 aa, Mycobacterium avium
GCGGGGKGSSPGSGSPTPPSSSGAVTGPPPGQPSDY

SEQ ID NO: 140923 - protein, 12 aa, Mycobacterium avium
GCGGKPDPGPLS

SEQ ID NO: 140924 - protein, 6 aa, Mycobacterium avium
GCGKTA

SEQ ID NO: 140925 - protein, 46 aa, Mycobacterium avium
GCGSGDSTVAKTPQARTTSETPSITAPATPSAAAAQPGAGQPADPC

SEQ ID NO: 140926 - protein, 45 aa, Mycobacterium avium
GCGSGDSTVAKTPQARTTSETPSITAPATPSAAAAQPGVGQPADP

SEQ ID NO: 140927 - protein, 14 aa, Mycobacterium avium
GCTTPTSYESRRGE

SEQ ID NO: 140928 - protein, 10 aa, Mycobacterium avium
GDDAPDDTPA

SEQ ID NO: 140929 - protein, 10 aa, Mycobacterium avium
GDDDPDDTPA

SEQ ID NO: 140930 - protein, 7 aa, Mycobacterium avium
GDDHRRR

SEQ ID NO: 140931 - protein, 9 aa, Mycobacterium avium
GDEFGGGAG

SEQ ID NO: 140932 - protein, 6 aa, Mycobacterium avium
GDGDRA

SEQ ID NO: 140933 - protein, 10 aa, Mycobacterium avium
GDHHRSDRRQ

SEQ ID NO: 140934 - protein, 5 aa, Mycobacterium avium
GDITG

SEQ ID NO: 140935 - protein, 9 aa, Mycobacterium avium
GDNLAHPKA

SEQ ID NO: 140936 - protein, 11 aa, Mycobacterium avium
GDPADSEIDRR

SEQ ID NO: 140937 - protein, 11 aa, Mycobacterium avium
GDPEFSDPQRR

SEQ ID NO: 140938 - protein, 12 aa, Mycobacterium avium
GDPLTVSGTGLQ

SEQ ID NO: 140939 - protein, 7 aa, Mycobacterium avium
GDPSFTE

SEQ ID NO: 140940 - protein, 9 aa, Mycobacterium avium
GDQADSLGA

SEQ ID NO: 140941 - protein, 4 aa, Mycobacterium avium
GDQS

SEQ ID NO: 140942 - protein, 9 aa, Mycobacterium avium
GDQSTPALA

SEQ ID NO: 140943 - protein, 5 aa, Mycobacterium avium
GDRPA

SEQ ID NO: 140944 - protein, 6 aa, Mycobacterium avium
GDRPAD

SEQ ID NO: 140945 - protein, 5 aa, Mycobacterium avium
GDRPG

SEQ ID NO: 140946 - protein, 4 aa, Mycobacterium avium
GDST

SEQ ID NO: 140947 - protein, 19 aa, Mycobacterium avium
GDTATAAQLSDNPNDAREA

SEQ ID NO: 140948 - protein, 15 aa, Mycobacterium avium
GDTIGLESTAAAATV

SEQ ID NO: 140949 - protein, 22 aa, Mycobacterium avium
GDVGPNVTADGPPSQNPSGITG

SEQ ID NO: 140950 - protein, 4 aa, Mycobacterium avium
GDYP

SEQ ID NO: 140951 - protein, 5 aa, Mycobacterium avium
GEAFG

SEQ ID NO: 140952 - protein, 7 aa, Mycobacterium avium
GEAPGHV

SEQ ID NO: 140953 - protein, 6 aa, Mycobacterium avium
GEAYNT

SEQ ID NO: 140954 - protein, 15 aa, Mycobacterium avium
GEDAEPAALQPVSAP

SEQ ID NO: 140955 - protein, 5 aa, Mycobacterium avium
GEFET

SEQ ID NO: 140956 - protein, 7 aa, Mycobacterium avium
GEGADEV

SEQ ID NO: 140957 - protein, 6 aa, Mycobacterium avium
GEGPCA

SEQ ID NO: 140958 - protein, 5 aa, Mycobacterium avium
GEHPK

SEQ ID NO: 140959 - protein, 21 aa, Mycobacterium avium
GENAPPGTVSTATFTGSPAAR

SEQ ID NO: 140960 - protein, 16 aa, Mycobacterium avium
GENGAPVRRSAGAEAA

SEQ ID NO: 140961 - protein, 5 aa, Mycobacterium avium
GENPY

SEQ ID NO: 140962 - protein, 10 aa, Mycobacterium avium
GEPAHAGTDD

SEQ ID NO: 140963 - protein, 10 aa, Mycobacterium avium
GEPAHGGTDD

SEQ ID NO: 140964 - protein, 4 aa, Mycobacterium avium
GEPI

SEQ ID NO: 140965 - protein, 6 aa, Mycobacterium avium
GEPVST

SEQ ID NO: 140966 - protein, 8 aa, Mycobacterium avium
GEPYSKTN

SEQ ID NO: 140967 - protein, 16 aa, Mycobacterium avium
GESGSRRGKTVRATAQ

SEQ ID NO: 140968 - protein, 8 aa, Mycobacterium avium
GESLANRR

SEQ ID NO: 140969 - protein, 7 aa, Mycobacterium avium
GESTADR

SEQ ID NO: 140970 - protein, 10 aa, Mycobacterium avium
GFDASAPSVW

SEQ ID NO: 140971 - protein, 8 aa, Mycobacterium avium
GGAAAAHP

SEQ ID NO: 140972 - protein, 8 aa, Mycobacterium avium
GGAAARQP

SEQ ID NO: 140973 - protein, 10 aa, Mycobacterium avium
GGAAASAGLP

SEQ ID NO: 140974 - protein, 40 aa, Mycobacterium avium; identical to SEQ ID NO: 65272

SEQ ID NO: 140975 - protein, 13 aa, Mycobacterium avium
GGAATANAFSRPG

SEQ ID NO: 140976 - protein, 10 aa, Mycobacterium avium
GGAESPYETK

SEQ ID NO: 140977 - protein, 9 aa, Mycobacterium avium
GGAGSIGGK

SEQ ID NO: 140978 - protein, 4 aa, Mycobacterium avium
GGAK

SEQ ID NO: 140979 - protein, 9 aa, Mycobacterium avium
GGAQSPKES

SEQ ID NO: 140980 - protein, 20 aa, Mycobacterium avium
GGDIGSDGSTPQDRANRAGF

SEQ ID NO: 140981 - protein, 11 aa, Mycobacterium avium
GGDRRSAPPEV

SEQ ID NO: 140982 - protein, 10 aa, Mycobacterium avium
GGGGTGIAQR

SEQ ID NO: 140983 - protein, 128 aa, Mycobacterium avium
GGGHKGGPSTTSTTTPTTTPSTSVVPSTTPGGGGTVPGGPTGGGGPGGGGGSIPGGPTGGGGPGGGGGSIPGGPTGGGGPGGGGGSIPGGPTGGGGPGGGGGSIPGVGGGGGGPGGGGGCVGNVCGGY

SEQ ID NO: 140984 - protein, 111 aa, Mycobacterium avium
GGGHKGGPSTTSTTTPTTTPSTSVVPSTTPGGGGTVPGGPTGGGGPGGGGGSIPGGPTGGGGPGGGGGSIPGGPTGGGGPGGGGGSIPGVGGGGGGPGGGGGCVGNVCGAY

SEQ ID NO: 140985 - protein, 4 aa, Mycobacterium avium
GGGL

SEQ ID NO: 140986 - protein, 16 aa, Mycobacterium avium
GGGTAKEAEKKEQPAL

SEQ ID NO: 140987 - protein, 9 aa, Mycobacterium avium
GGGTSAPSN

SEQ ID NO: 140988 - protein, 8 aa, Mycobacterium avium
GGGVYTPP

SEQ ID NO: 140989 - protein, 12 aa, Mycobacterium avium
GGGYPTGDEVYL

SEQ ID NO: 140990 - protein, 6 aa, Mycobacterium avium
GGHQPG

SEQ ID NO: 140991 - protein, 9 aa, Mycobacterium avium
GGHTWPGGK

SEQ ID NO: 140992 - protein, 9 aa, Mycobacterium avium
GGIKPGNAV

SEQ ID NO: 140993 - protein, 7 aa, Mycobacterium avium
GGINPGN

SEQ ID NO: 140994 - protein, 4 aa, Mycobacterium avium
GGLG

SEQ ID NO: 140995 - protein, 25 aa, Mycobacterium avium
GGLGPGAGRAAADPPPPPPMPPPPP

SEQ ID NO: 140996 - protein, 6 aa, Mycobacterium avium
GGLGQV

SEQ ID NO: 140997 - protein, 15 aa, Mycobacterium avium
GGMTTGASQPKTTVQ

SEQ ID NO: 140998 - protein, 5 aa, Mycobacterium avium
GGNLA

SEQ ID NO: 140999 - protein, 5 aa, Mycobacterium avium
GGNLR

SEQ ID NO: 141000 - protein, 21 aa, Mycobacterium avium
GGPDHPDRRGHPAPAGRGAAA

SEQ ID NO: 141001 - protein, 12 aa, Mycobacterium avium
GGPKSAKLAGQF

SEQ ID NO: 141002 - protein, 7 aa, Mycobacterium avium
GGPQAVA

SEQ ID NO: 141003 - protein, 8 aa, Mycobacterium avium
GGPQAVAD

SEQ ID NO: 141004 - protein, 8 aa, Mycobacterium avium
GGPTARAA

SEQ ID NO: 141005 - protein, 15 aa, Mycobacterium avium
GGPVAAAAPAPAPTG

SEQ ID NO: 141006 - protein, 4 aa, Mycobacterium avium
GGQL

SEQ ID NO: 141007 - protein, 5 aa, Mycobacterium avium
GGSAA

SEQ ID NO: 141008 - protein, 5 aa, Mycobacterium avium
GGSGG

SEQ ID NO: 141009 - protein, 8 aa, Mycobacterium avium
GGSSDDTV

SEQ ID NO: 141010 - protein, 11 aa, Mycobacterium avium
GGTAPPRTGAR

SEQ ID NO: 141011 - protein, 5 aa, Mycobacterium avium
GGTDG

SEQ ID NO: 141012 - protein, 9 aa, Mycobacterium avium
GGTGAGKTT

SEQ ID NO: 141013 - protein, 5 aa, Mycobacterium avium
GGTRS

SEQ ID NO: 141014 - protein, 6 aa, Mycobacterium avium
GGTRSS

SEQ ID NO: 141015 - protein, 5 aa, Mycobacterium avium
GGTSR

SEQ ID NO: 141016 - protein, 10 aa, Mycobacterium avium
GGVASAGLGL

SEQ ID NO: 141017 - protein, 6 aa, Mycobacterium avium
GHDSKQ

SEQ ID NO: 141018 - protein, 26 aa, Mycobacterium avium
GHGHDGSSGGEPQDPVHSKDPSGDGW

SEQ ID NO: 141019 - protein, 5 aa, Mycobacterium avium
GHGPA

SEQ ID NO: 141020 - protein, 14 aa, Mycobacterium avium
GHIGSDGSSPQARI

SEQ ID NO: 141021 - protein, 9 aa, Mycobacterium avium
GHPATRAAD

SEQ ID NO: 141022 - protein, 9 aa, Mycobacterium avium
GHPGGAGFA

SEQ ID NO: 141023 - protein, 31 aa, Mycobacterium avium; identical to SEQ ID NO: 52625

SEQ ID NO: 141024 - protein, 30 aa, Mycobacterium avium
GHPGQRGPAGAAGRQDRRPAGQHRRRDRQR

SEQ ID NO: 141025 - protein, 14 aa, Mycobacterium avium
GHQWPGGAPSPLAE

SEQ ID NO: 141026 - protein, 14 aa, Mycobacterium avium
GHQWPGGASSPLAE

SEQ ID NO: 141027 - protein, 10 aa, Mycobacterium avium
GHRGRGADRA

SEQ ID NO: 141028 - protein, 14 aa, Mycobacterium avium
GHTVGREKSPSAAL

SEQ ID NO: 141029 - protein, 14 aa, Mycobacterium avium
GHTVGREKSPSDAL

SEQ ID NO: 141030 - protein, 25 aa, Mycobacterium avium
GIDPERTADQLSAEVQKAIDGKGLL

SEQ ID NO: 141031 - protein, 6 aa, Mycobacterium avium
GIGDTG

SEQ ID NO: 141032 - protein, 15 aa, Mycobacterium avium
GIGPARLEKLRALVR

SEQ ID NO: 141033 - protein, 5 aa, Mycobacterium avium
GIGSR

SEQ ID NO: 141034 - protein, 6 aa, Mycobacterium avium
GIPGAI

SEQ ID NO: 141035 - protein, 5 aa, Mycobacterium avium
GIPQG

SEQ ID NO: 141036 - protein, 13 aa, Mycobacterium avium
GIQPTDEPALKQG

SEQ ID NO: 141037 - protein, 6 aa, Mycobacterium avium
GIRAPA

SEQ ID NO: 141038 - protein, 6 aa, Mycobacterium avium
GIRSDS

SEQ ID NO: 141039 - protein, 12 aa, Mycobacterium avium
GITYQDAGNAIT

SEQ ID NO: 141040 - protein, 8 aa, Mycobacterium avium
GKAIAGGL

SEQ ID NO: 141041 - protein, 10 aa, Mycobacterium avium
GKATGDQGQA

SEQ ID NO: 141042 - protein, 9 aa, Mycobacterium avium
GKDPNGSDI

SEQ ID NO: 141043 - protein, 9 aa, Mycobacterium avium
GKGSDAATV

SEQ ID NO: 141044 - protein, 15 aa, Mycobacterium avium
GKGYPVPDPGGPEAP

SEQ ID NO: 141045 - protein, 16 aa, Mycobacterium avium
GKGYPVPDPGGPEAPC

SEQ ID NO: 141046 - protein, 26 aa, Mycobacterium avium
GKPGWPDPSDFTRGYDGGVADAHTAT

SEQ ID NO: 141047 - protein, 5 aa, Mycobacterium avium
GKPHA

SEQ ID NO: 141048 - protein, 12 aa, Mycobacterium avium
GKPQHPSQSVEH

SEQ ID NO: 141049 - protein, 28 aa, Mycobacterium avium
GKRAATPRECRSTEPYVPQGTNPWYGDP

SEQ ID NO: 141050 - protein, 12 aa, Mycobacterium avium
GKSDNNGEQRIP

SEQ ID NO: 141051 - protein, 10 aa, Mycobacterium avium
GKSDRPGRNQ

SEQ ID NO: 141052 - protein, 10 aa, Mycobacterium avium
GKSGRPGRNQ

SEQ ID NO: 141053 - protein, 7 aa, Mycobacterium avium
GKSSNVG

SEQ ID NO: 141054 - protein, 13 aa, Mycobacterium avium
GKTIGAQSRSAIR

SEQ ID NO: 141055 - protein, 6 aa, Mycobacterium avium
GKTNGK

SEQ ID NO: 141056 - protein, 5 aa, Mycobacterium avium
GLAGA

SEQ ID NO: 141057 - protein, 9 aa, Mycobacterium avium
GLAGDSAKI

SEQ ID NO: 141058 - protein, 8 aa, Mycobacterium avium
GLARPQQR

SEQ ID NO: 141059 - protein, 7 aa, Mycobacterium avium
GLATPAA

SEQ ID NO: 141060 - protein, 6 aa, Mycobacterium avium
GLDEDT

SEQ ID NO: 141061 - protein, 16 aa, Mycobacterium avium
GLEGTAGGSSYNAAKG

SEQ ID NO: 141062 - protein, 22 aa, Mycobacterium avium
GLGAGRAAADPPPPPPMPPPPP

SEQ ID NO: 141063 - protein, 42 aa, Mycobacterium avium
GLGEAGAAADGASAAARGAEAEADAAGAAGRVGGLAGARGAL

SEQ ID NO: 141064 - protein, 11 aa, Mycobacterium avium
GLGGAAPGLPG

SEQ ID NO: 141065 - protein, 18 aa, Mycobacterium avium
GLGGPGAASVASGHGNFG

SEQ ID NO: 141066 - protein, 11 aa, Mycobacterium avium
GLGPGGPTNVT

SEQ ID NO: 141067 - protein, 5 aa, Mycobacterium avium
GLGSA

SEQ ID NO: 141068 - protein, 6 aa, Mycobacterium avium
GLGTPP

SEQ ID NO: 141069 - protein, 8 aa, Mycobacterium avium
GLNDQKNV

SEQ ID NO: 141070 - protein, 8 aa, Mycobacterium avium
GLNGTNVD

SEQ ID NO: 141071 - protein, 5 aa, Mycobacterium avium
GLPAP

SEQ ID NO: 141072 - protein, 5 aa, Mycobacterium avium
GLPEL

SEQ ID NO: 141073 - protein, 6 aa, Mycobacterium avium
GLPGSA

SEQ ID NO: 141074 - protein, 16 aa, Mycobacterium avium
GLPSPGSPVCSAGKYA

SEQ ID NO: 141075 - protein, 4 aa, Mycobacterium avium
GLRP

SEQ ID NO: 141076 - protein, 9 aa, Mycobacterium avium
GLRRSGSRC

SEQ ID NO: 141077 - protein, 14 aa, Mycobacterium avium
GLSGPKSERPGFGT

SEQ ID NO: 141078 - protein, 9 aa, Mycobacterium avium
GLSSGQAEV

SEQ ID NO: 141079 - protein, 7 aa, Mycobacterium avium
GLSTAGG

SEQ ID NO: 141080 - protein, 7 aa, Mycobacterium avium
GLTPDTD

SEQ ID NO: 141081 - protein, 6 aa, Mycobacterium avium
GLTRAE

SEQ ID NO: 141082 - protein, 12 aa, Mycobacterium avium
GLTVPGAAPVLP

SEQ ID NO: 141083 - protein, 8 aa, Mycobacterium avium
GLYGRSDL

SEQ ID NO: 141084 - protein, 5 aa, Mycobacterium avium
GMTEA

SEQ ID NO: 141085 - protein, 6 aa, Mycobacterium avium
GMTPRA

SEQ ID NO: 141086 - protein, 13 aa, Mycobacterium avium
GMTTSEQSGPISA

SEQ ID NO: 141087 - protein, 9 aa, Mycobacterium avium
GNDAPLGRI

SEQ ID NO: 141088 - protein, 5 aa, Mycobacterium avium
GNDGI

SEQ ID NO: 141089 - protein, 26 aa, Mycobacterium avium
GNDRRPDESCARDAAEADPGPAKRQV

SEQ ID NO: 141090 - protein, 43 aa, Mycobacterium avium
GNDRRPDESCARDAAEADPGPAKRQVHNAPGGDPAPVQVSADP

SEQ ID NO: 141091 - protein, 9 aa, Mycobacterium avium
GNFDTNDVP

SEQ ID NO: 141092 - protein, 17 aa, Mycobacterium avium
GNGDGAGLTNGLPDEHQ

SEQ ID NO: 141093 - protein, 14 aa, Mycobacterium avium
GNHENELGNGPIGY

SEQ ID NO: 141094 - protein, 4 aa, Mycobacterium avium
GNLV

SEQ ID NO: 141095 - protein, 4 aa, Mycobacterium avium
GNPG

SEQ ID NO: 141096 - protein, 6 aa, Mycobacterium avium
GNPKHI

SEQ ID NO: 141097 - protein, 18 aa, Mycobacterium avium
GNQTDGLPEGPLPLGTPV

SEQ ID NO: 141098 - protein, 7 aa, Mycobacterium avium
GNRDDPH

SEQ ID NO: 141099 - protein, 7 aa, Mycobacterium avium
GNRGHRG

SEQ ID NO: 141100 - protein, 5 aa, Mycobacterium avium
GNRPR

SEQ ID NO: 141101 - protein, 23 aa, Mycobacterium avium
GNTTAAPAQPAQPAQPAQPAQPA

SEQ ID NO: 141102 - protein, 26 aa, Mycobacterium avium
GNTTAAPAQPAQPAQPAQPAQPAQPA

SEQ ID NO: 141103 - protein, 4 aa, Mycobacterium avium
GPAA

SEQ ID NO: 141104 - protein, 11 aa, Mycobacterium avium
GPAAAGAPVEA

SEQ ID NO: 141105 - protein, 15 aa, Mycobacterium avium
GPAAAGAPVEAAAPI

SEQ ID NO: 141106 - protein, 8 aa, Mycobacterium avium
GPAAVSGP

SEQ ID NO: 141107 - protein, 13 aa, Mycobacterium avium
GPAGAAAAAPKDY

SEQ ID NO: 141108 - protein, 5 aa, Mycobacterium avium
GPALG

SEQ ID NO: 141109 - protein, 32 aa, Mycobacterium avium
GPAQGSRGVRPQFGQAAQQRRLAGPRASGDHQ

SEQ ID NO: 141110 - protein, 14 aa, Mycobacterium avium
GPATDVLSGNADEI

SEQ ID NO: 141111 - protein, 4 aa, Mycobacterium avium
GPDY

SEQ ID NO: 141112 - protein, 19 aa, Mycobacterium avium
GPELSRPNASVARDTVVGA

SEQ ID NO: 141113 - protein, 5 aa, Mycobacterium avium
GPEST

SEQ ID NO: 141114 - protein, 14 aa, Mycobacterium avium
GPGGHKLDDGTEDR

SEQ ID NO: 141115 - protein, 89 aa, Mycobacterium avium
GPGGKPIEAPVESAPRPADGTPGAQRSSPPVATSPASPGRAGDSGAGPHGPSSSPAPAAPPGGPVGAHDRAPAPAPAAPAGGPGGLGGV

SEQ ID NO: 141116 - protein, 48 aa, Mycobacterium avium; identical to SEQ ID NO: 8255

SEQ ID NO: 141117 - protein, 11 aa, Mycobacterium avium
GPGRPDVAEGD

SEQ ID NO: 141118 - protein, 6 aa, Mycobacterium avium
GPGTVD

SEQ ID NO: 141119 - protein, 13 aa, Mycobacterium avium
GPHGADPHHGYSD

SEQ ID NO: 141120 - protein, 30 aa, Mycobacterium avium
GPLPGLPDDAPRGKDGCSAVGSPTSLPTDL

SEQ ID NO: 141121 - protein, 13 aa, Mycobacterium avium
GPLRPDTAPRPPA

SEQ ID NO: 141122 - protein, 7 aa, Mycobacterium avium
GPLTSER

SEQ ID NO: 141123 - protein, 7 aa, Mycobacterium avium
GPPEHRT

SEQ ID NO: 141124 - protein, 5 aa, Mycobacterium avium
GPPFP

SEQ ID NO: 141125 - protein, 7 aa, Mycobacterium avium
GQAASWE

SEQ ID NO: 141126 - protein, 10 aa, Mycobacterium avium
GQAGAPPTLP

SEQ ID NO: 141127 - protein, 4 aa, Mycobacterium avium
GQAI

SEQ ID NO: 141128 - protein, 6 aa, Mycobacterium avium
GQDDSR

SEQ ID NO: 141129 - protein, 6 aa, Mycobacterium avium
GQGGAL

SEQ ID NO: 141130 - protein, 15 aa, Mycobacterium avium
GQGPFGPVPDGFPAP

SEQ ID NO: 141131 - protein, 4 aa, Mycobacterium avium
GQGR

SEQ ID NO: 141132 - protein, 8 aa, Mycobacterium avium
GQHGEGRR

SEQ ID NO: 141133 - protein, 8 aa, Mycobacterium avium
GQHQPDRV

SEQ ID NO: 141134 - protein, 12 aa, Mycobacterium avium
GQPGDSGAPVTV

SEQ ID NO: 141135 - protein, 10 aa, Mycobacterium avium
GQPSPDDGFA

SEQ ID NO: 141136 - protein, 7 aa, Mycobacterium avium
GQQTPSF

SEQ ID NO: 141137 - protein, 4 aa, Mycobacterium avium
GQRI

SEQ ID NO: 141138 - protein, 13 aa, Mycobacterium avium
GQRPAGQGQRRHV

SEQ ID NO: 141139 - protein, 11 aa, Mycobacterium avium
GQRRRTTQPVA

SEQ ID NO: 141140 - protein, 4 aa, Mycobacterium avium
GQRT

SEQ ID NO: 141141 - protein, 6 aa, Mycobacterium avium
GQSPGT

SEQ ID NO: 141142 - protein, 31 aa, Mycobacterium avium; identical to SEQ ID NO: 52921

SEQ ID NO: 141143 - protein, 8 aa, Mycobacterium avium
GQWPPGTT

SEQ ID NO: 141144 - protein, 7 aa, Mycobacterium avium
GQYRSGD

SEQ ID NO: 141145 - protein, 12 aa, Mycobacterium avium
GRAAGRGVADDI

SEQ ID NO: 141146 - protein, 38 aa, Mycobacterium avium; identical to SEQ ID NO: 66150

SEQ ID NO: 141147 - protein, 9 aa, Mycobacterium avium
GRGAGGVGQ

SEQ ID NO: 141148 - protein, 30 aa, Mycobacterium avium; identical to SEQ ID NO: 5635

SEQ ID NO: 141149 - protein, 9 aa, Mycobacterium avium
GRGPNAPQV

SEQ ID NO: 141150 - protein, 4 aa, Mycobacterium avium
GRGR

SEQ ID NO: 141151 - protein, 13 aa, Mycobacterium avium
GRHRPRRRRRSGC

SEQ ID NO: 141152 - protein, 5 aa, Mycobacterium avium
GRMTS

SEQ ID NO: 141153 - protein, 8 aa, Mycobacterium avium
GRPAPPHR

SEQ ID NO: 141154 - protein, 5 aa, Mycobacterium avium
GRPEE

SEQ ID NO: 141155 - protein, 5 aa, Mycobacterium avium
GRPGK

SEQ ID NO: 141156 - protein, 4 aa, Mycobacterium avium
GRPP

SEQ ID NO: 141157 - protein, 54 aa, Mycobacterium avium; identical to SEQ ID NO: 52991

SEQ ID NO: 141158 - protein, 22 aa, Mycobacterium avium
GRPVDQQESHNRDAQVSCLDKS

SEQ ID NO: 141159 - protein, 13 aa, Mycobacterium avium
GRPVPGPETEAGP

SEQ ID NO: 141160 - protein, 11 aa, Mycobacterium avium
GRPVSDPPIGV

SEQ ID NO: 141161 - protein, 26 aa, Mycobacterium avium
GRPWRTPSRPFPPPHDPTAPPGRLHH

SEQ ID NO: 141162 - protein, 4 aa, Mycobacterium avium
GRQG

SEQ ID NO: 141163 - protein, 9 aa, Mycobacterium avium
GRQSEEGSG

SEQ ID NO: 141164 - protein, 17 aa, Mycobacterium avium
GRRAVPGPGVERKPGQV

SEQ ID NO: 141165 - protein, 7 aa, Mycobacterium avium
GRRCPAS

SEQ ID NO: 141166 - protein, 7 aa, Mycobacterium avium
GRREPAL

SEQ ID NO: 141167 - protein, 4 aa, Mycobacterium avium
GRRG

SEQ ID NO: 141168 - protein, 6 aa, Mycobacterium avium
GRRRHR

SEQ ID NO: 141169 - protein, 7 aa, Mycobacterium avium
GRRRPGV

SEQ ID NO: 141170 - protein, 8 aa, Mycobacterium avium
GRSARTPA

SEQ ID NO: 141171 - protein, 5 aa, Mycobacterium avium
GRTGA

SEQ ID NO: 141172 - protein, 5 aa, Mycobacterium avium
GRTVA

SEQ ID NO: 141173 - protein, 7 aa, Mycobacterium avium
GRVDDEG

SEQ ID NO: 141174 - protein, 10 aa, Mycobacterium avium
GRVDDKGPYE

SEQ ID NO: 141175 - protein, 8 aa, Mycobacterium avium
GRVPDGED

SEQ ID NO: 141176 - protein, 5 aa, Mycobacterium avium
GSAAA

SEQ ID NO: 141177 - protein, 8 aa, Mycobacterium avium
GSAEPEDA

SEQ ID NO: 141178 - protein, 21 aa, Mycobacterium avium
GSAQQPAGAPPRPSDVPPNQV

SEQ ID NO: 141179 - protein, 21 aa, Mycobacterium avium
GSAQQPAGAPPRPSDVSPNQV

SEQ ID NO: 141180 - protein, 14 aa, Mycobacterium avium
GSARVTSPDPEATY

SEQ ID NO: 141181 - protein, 7 aa, Mycobacterium avium
GSAVDSA

SEQ ID NO: 141182 - protein, 54 aa, Mycobacterium avium
GSAVGSAVGSAVDSAVGSAVDSAVRSAVDSAVGSAVGSAVDSAVDSAVDSAVGS

SEQ ID NO: 141183 - protein, 9 aa, Mycobacterium avium
GSDPANPME

SEQ ID NO: 141184 - protein, 18 aa, Mycobacterium avium
GSGAASYASSGSWSHNAA

SEQ ID NO: 141185 - protein, 15 aa, Mycobacterium avium
GSGAGVQVIDHAAGK

SEQ ID NO: 141186 - protein, 6 aa, Mycobacterium avium
GSGPGF

SEQ ID NO: 141187 - protein, 8 aa, Mycobacterium avium
GSGRRRGK

SEQ ID NO: 141188 - protein, 5 aa, Mycobacterium avium
GSHID

SEQ ID NO: 141189 - protein, 8 aa, Mycobacterium avium
GSMGTTTT

SEQ ID NO: 141190 - protein, 10 aa, Mycobacterium avium
GSPFEDEQDP

SEQ ID NO: 141191 - protein, 8 aa, Mycobacterium avium
GSQDPVQE

SEQ ID NO: 141192 - protein, 9 aa, Mycobacterium avium
GSRPDASST

SEQ ID NO: 141193 - protein, 22 aa, Mycobacterium avium
GSSGTLATPDNYDRSDAPSDGI

SEQ ID NO: 141194 - protein, 5 aa, Mycobacterium avium
GSSPA

SEQ ID NO: 141195 - protein, 7 aa, Mycobacterium avium
GSSTSHV

SEQ ID NO: 141196 - protein, 20 aa, Mycobacterium avium
GSTALSSAGTVSASAGRAGL

SEQ ID NO: 141197 - protein, 20 aa, Mycobacterium avium
GSTETSGAVSRGPLSPPNPL

SEQ ID NO: 141198 - protein, 7 aa, Mycobacterium avium
GSTGDGI

SEQ ID NO: 141199 - protein, 8 aa, Mycobacterium avium
GSTNGTYL

SEQ ID NO: 141200 - protein, 8 aa, Mycobacterium avium
GSVGRPVP

SEQ ID NO: 141201 - protein, 11 aa, Mycobacterium avium
GSVTDAEVNAE

SEQ ID NO: 141202 - protein, 13 aa, Mycobacterium avium
GSWANDSVSCPRS

SEQ ID NO: 141203 - protein, 4 aa, Mycobacterium avium
GSWD

SEQ ID NO: 141204 - protein, 25 aa, Mycobacterium avium
GSYEPGYHSDSTRTYSIGEPSPEVA

SEQ ID NO: 141205 - protein, 7 aa, Mycobacterium avium
GSYTPDN

SEQ ID NO: 141206 - protein, 5 aa, Mycobacterium avium
GTADP

SEQ ID NO: 141207 - protein, 35 aa, Mycobacterium avium
GTAPAAADPPPGLPPMTSGGSGPIIGGGSAAAQAI

SEQ ID NO: 141208 - protein, 36 aa, Mycobacterium avium
GTAPAAADPPPGLPPMTSGGSGPIIGGGSAAAQGIS

SEQ ID NO: 141209 - protein, 6 aa, Mycobacterium avium
GTDPAA

SEQ ID NO: 141210 - protein, 5 aa, Mycobacterium avium
GTDQL

SEQ ID NO: 141211 - protein, 7 aa, Mycobacterium avium
GTEAGRS

SEQ ID NO: 141212 - protein, 9 aa, Mycobacterium avium
GTIGNRDEQ

SEQ ID NO: 141213 - protein, 14 aa, Mycobacterium avium
GTKPGTEVPPISDG

SEQ ID NO: 141214 - protein, 11 aa, Mycobacterium avium
GTLSTGDGREV

SEQ ID NO: 141215 - protein, 11 aa, Mycobacterium avium
GTNGKSTTTRM

SEQ ID NO: 141216 - protein, 10 aa, Mycobacterium avium
GTPGPAEEQK

SEQ ID NO: 141217 - protein, 11 aa, Mycobacterium avium
GTPRTEPPRPL

SEQ ID NO: 141218 - protein, 10 aa, Mycobacterium avium
GTRDKTAEQI

SEQ ID NO: 141219 - protein, 17 aa, Mycobacterium avium
GTSPELKDKLTKAADSM

SEQ ID NO: 141220 - protein, 10 aa, Mycobacterium avium
GTTCQQRSIE

SEQ ID NO: 141221 - protein, 8 aa, Mycobacterium avium
GTTGVPKG

SEQ ID NO: 141222 - protein, 6 aa, Mycobacterium avium
GTVTGG

SEQ ID NO: 141223 - protein, 6 aa, Mycobacterium avium
GTWERN

SEQ ID NO: 141224 - protein, 4 aa, Mycobacterium avium
GVAG

SEQ ID NO: 141225 - protein, 15 aa, Mycobacterium avium
GVDAPSPFGAGPAAE

SEQ ID NO: 141226 - protein, 13 aa, Mycobacterium avium
GVDAPSPFGAGQA

SEQ ID NO: 141227 - protein, 9 aa, Mycobacterium avium
GVDPDPEEL

SEQ ID NO: 141228 - protein, 14 aa, Mycobacterium avium
GVGAGGAAIGDAPL

SEQ ID NO: 141229 - protein, 5 aa, Mycobacterium avium
GVGPV

SEQ ID NO: 141230 - protein, 18 aa, Mycobacterium avium
GVIPGSEPAAVTPSQSAL

SEQ ID NO: 141231 - protein, 9 aa, Mycobacterium avium
GVLAGERPA

SEQ ID NO: 141232 - protein, 4 aa, Mycobacterium avium
GVPF

SEQ ID NO: 141233 - protein, 4 aa, Mycobacterium avium
GVPP

SEQ ID NO: 141234 - protein, 25 aa, Mycobacterium avium
GVPPPAGDPVPPVDTHASGRPADQL

SEQ ID NO: 141235 - protein, 12 aa, Mycobacterium avium
GVPQPHQRITEG

SEQ ID NO: 141236 - protein, 8 aa, Mycobacterium avium
GVPSPPAA

SEQ ID NO: 141237 - protein, 8 aa, Mycobacterium avium
GVPSPPTA

SEQ ID NO: 141238 - protein, 4 aa, Mycobacterium avium
GVQN

SEQ ID NO: 141239 - protein, 22 aa, Mycobacterium avium
GVQTGTQGAGQAASSGQDLGGQ

SEQ ID NO: 141240 - protein, 7 aa, Mycobacterium avium
GVRGTPH

SEQ ID NO: 141241 - protein, 16 aa, Mycobacterium avium
GVRPGPRLPNVEPGGD

SEQ ID NO: 141242 - protein, 16 aa, Mycobacterium avium
GVSKRTPARIDMKAGS

SEQ ID NO: 141243 - protein, 7 aa, Mycobacterium avium
GVSPSDV

SEQ ID NO: 141244 - protein, 7 aa, Mycobacterium avium
GVSQSAQ

SEQ ID NO: 141245 - protein, 8 aa, Mycobacterium avium
GVSTTPDI

SEQ ID NO: 141246 - protein, 10 aa, Mycobacterium avium
GVTPDPDELR

SEQ ID NO: 141247 - protein, 7 aa, Mycobacterium avium
GVYANSK

SEQ ID NO: 141248 - protein, 8 aa, Mycobacterium avium
GWGNQRDG

SEQ ID NO: 141249 - protein, 15 aa, Mycobacterium avium
GWKPGGDGVREKDGK

SEQ ID NO: 141250 - protein, 7 aa, Mycobacterium avium
GYAATSV

SEQ ID NO: 141251 - protein, 18 aa, Mycobacterium avium
GYEKSWADGRGASPADRH

SEQ ID NO: 141252 - protein, 11 aa, Mycobacterium avium
GYGGTGPWRDR

SEQ ID NO: 141253 - protein, 13 aa, Mycobacterium avium
GYRPASREQPFGQ

SEQ ID NO: 141254 - protein, 7 aa, Mycobacterium avium
GYRSRYS

SEQ ID NO: 141255 - protein, 33 aa, Mycobacterium avium
GYSQGAAVAGYTTSAAVPPGVPASAVPPPMPPE

SEQ ID NO: 141256 - protein, 11 aa, Mycobacterium avium
HADPGQPPPPL

SEQ ID NO: 141257 - protein, 8 aa, Mycobacterium avium
HAEPPKFP

SEQ ID NO: 141258 - protein, 12 aa, Mycobacterium avium
HALPDPQQTLPN

SEQ ID NO: 141259 - protein, 10 aa, Mycobacterium avium
HARRSAAALP

SEQ ID NO: 141260 - protein, 17 aa, Mycobacterium avium
HATGTSVGDVAEGKAIN

SEQ ID NO: 141261 - protein, 14 aa, Mycobacterium avium
HAVGPQADERPGPF

SEQ ID NO: 141262 - protein, 9 aa, Mycobacterium avium
HDDGDGGPF

SEQ ID NO: 141263 - protein, 9 aa, Mycobacterium avium
HDDSDGGPF

SEQ ID NO: 141264 - protein, 6 aa, Mycobacterium avium
HDGDAD

SEQ ID NO: 141265 - protein, 7 aa, Mycobacterium avium
HDGQRSE

SEQ ID NO: 141266 - protein, 71 aa, Mycobacterium avium
HDPAPAPAPATPFGGSGGPHDPAAEPEPAAAPAASGSPGDPASVPSGGPHEPASVPAEEPREPVSVPAGGV

SEQ ID NO: 141267 - protein, 6 aa, Mycobacterium avium
HDRDQM

SEQ ID NO: 141268 - protein, 13 aa, Mycobacterium avium
HDSPGDEPTKDDR

SEQ ID NO: 141269 - protein, 4 aa, Mycobacterium avium
HDTW

SEQ ID NO: 141270 - protein, 6 aa, Mycobacterium avium
HDVPDG

SEQ ID NO: 141271 - protein, 4 aa, Mycobacterium avium
HEFP

SEQ ID NO: 141272 - protein, 5 aa, Mycobacterium avium
HEFPD

SEQ ID NO: 141273 - protein, 7 aa, Mycobacterium avium
HENGGCT

SEQ ID NO: 141274 - protein, 6 aa, Mycobacterium avium
HEPNGG

SEQ ID NO: 141275 - protein, 7 aa, Mycobacterium avium
HEPNGGL

SEQ ID NO: 141276 - protein, 8 aa, Mycobacterium avium
HERAGSRP

SEQ ID NO: 141277 - protein, 6 aa, Mycobacterium avium
HETTAS

SEQ ID NO: 141278 - protein, 25 aa, Mycobacterium avium
HGAGGQRGSRDKAEEPATVRVVDDR

SEQ ID NO: 141279 - protein, 7 aa, Mycobacterium avium
HGAVPQT

SEQ ID NO: 141280 - protein, 4 aa, Mycobacterium avium
HGDR

SEQ ID NO: 141281 - protein, 18 aa, Mycobacterium avium
HGGASDAVGGTGPADAHT

SEQ ID NO: 141282 - protein, 160 aa, Mycobacterium avium
HGGGGNPGGPGGGPGGQPAGPGGGAGGQHGGGNTPPQGGQNNPPPNGPNNPPQNGPNNAPQGGQNNPPQGGPNNAPQGGQNNPPQGGPNNAPQNGPNNPPQGGQNEPGGQYPPNQHGQNPPQNGQNQPPYDHDQNPPTPGGPTNAPANTQNPPPPPERQR

SEQ ID NO: 141283 - protein, 6 aa, Mycobacterium avium
HGGPGQ

SEQ ID NO: 141284 - protein, 10 aa, Mycobacterium avium
HGGTDPRDLR

SEQ ID NO: 141285 - protein, 5 aa, Mycobacterium avium
HGREP

SEQ ID NO: 141286 - protein, 15 aa, Mycobacterium avium
HGSRDPRSAANAEAV

SEQ ID NO: 141287 - protein, 8 aa, Mycobacterium avium
HGSVSTIG

SEQ ID NO: 141288 - protein, 5 aa, Mycobacterium avium
HHDPA

SEQ ID NO: 141289 - protein, 10 aa, Mycobacterium avium
HHSPAEPTRT

SEQ ID NO: 141290 - protein, 6 aa, Mycobacterium avium
HKDDIA

SEQ ID NO: 141291 - protein, 12 aa, Mycobacterium avium
HKQSTVRSESAA

SEQ ID NO: 141292 - protein, 9 aa, Mycobacterium avium
HLAATAGSA

SEQ ID NO: 141293 - protein, 14 aa, Mycobacterium avium
HLDSTRRVSPLRAA

SEQ ID NO: 141294 - protein, 18 aa, Mycobacterium avium
HNAAGGDPAPVQVSADPQ

SEQ ID NO: 141295 - protein, 35 aa, Mycobacterium avium
HNAVNDASINRPVPNGRGGSKPCQTSGAAADDGYP

SEQ ID NO: 141296 - protein, 10 aa, Mycobacterium avium
HNNGARAGQL

SEQ ID NO: 141297 - protein, 7 aa, Mycobacterium avium
HNPMPDN

SEQ ID NO: 141298 - protein, 8 aa, Mycobacterium avium
HPDGPPVI

SEQ ID NO: 141299 - protein, 8 aa, Mycobacterium avium
HPDHPGEH

SEQ ID NO: 141300 - protein, 6 aa, Mycobacterium avium
HPEATV

SEQ ID NO: 141301 - protein, 39 aa, Mycobacterium avium; identical to SEQ ID NO: 5717

SEQ ID NO: 141302 - protein, 4 aa, Mycobacterium avium
HPGQ

SEQ ID NO: 141303 - protein, 5 aa, Mycobacterium avium
HPPKA

SEQ ID NO: 141304 - protein, 6 aa, Mycobacterium avium
HPPKTA

SEQ ID NO: 141305 - protein, 26 aa, Mycobacterium avium
HPPPPKPSAAPAQSPPSNTAAVNPAN

SEQ ID NO: 141306 - protein, 6 aa, Mycobacterium avium
HPQEYN

SEQ ID NO: 141307 - protein, 74 aa, Mycobacterium avium
HPTGPNDPGGPGGPGGPGGPGGPPGGPGGPGHPGGPGGPGGPGGPDHPGRPGGPGGPDHPGGPGGPWHGDSQRG

SEQ ID NO: 141308 - protein, 89 aa, Mycobacterium avium
HPTGPNDPGGPGGPGGPGGPPGGPGGPGHPGGPGGPGGPGGPGGPGGPDHPGGPGGPGGPDHPGGPGGPGGPDHPGGPGGPWHGDPQRG

SEQ ID NO: 141309 - protein, 9 aa, Mycobacterium avium
HQGESSAAF

SEQ ID NO: 141310 - protein, 38 aa, Mycobacterium avium
HQGHGAGRDRAGPGHREPRAGGAAQGEDRPVARRDGAV

SEQ ID NO: 141311 - protein, 4 aa, Mycobacterium avium
HRAD

SEQ ID NO: 141312 - protein, 4 aa, Mycobacterium avium
HRAG

SEQ ID NO: 141313 - protein, 6 aa, Mycobacterium avium
HRDGPR

SEQ ID NO: 141314 - protein, 8 aa, Mycobacterium avium
HRDGQDPR

SEQ ID NO: 141315 - protein, 8 aa, Mycobacterium avium
HRDTARQK

SEQ ID NO: 141316 - protein, 5 aa, Mycobacterium avium
HRGAR

SEQ ID NO: 141317 - protein, 16 aa, Mycobacterium avium
HRGGTRPRLRRRPAAA

SEQ ID NO: 141318 - protein, 9 aa, Mycobacterium avium
HRPSRAEPY

SEQ ID NO: 141319 - protein, 4 aa, Mycobacterium avium
HSGR

SEQ ID NO: 141320 - protein, 6 aa, Mycobacterium avium
HSPEPR

SEQ ID NO: 141321 - protein, 8 aa, Mycobacterium avium
HSQSHYAA

SEQ ID NO: 141322 - protein, 6 aa, Mycobacterium avium
HSRERG

SEQ ID NO: 141323 - protein, 6 aa, Mycobacterium avium
HTARAE

SEQ ID NO: 141324 - protein, 8 aa, Mycobacterium avium
HTGGSGSA

SEQ ID NO: 141325 - protein, 7 aa, Mycobacterium avium
HTGVDRA

SEQ ID NO: 141326 - protein, 5 aa, Mycobacterium avium
HTSYP

SEQ ID NO: 141327 - protein, 7 aa, Mycobacterium avium
HVDTAGA

SEQ ID NO: 141328 - protein, 8 aa, Mycobacterium avium
HVDTAGAT

SEQ ID NO: 141329 - protein, 12 aa, Mycobacterium avium
HVPRDSPGRGLS

SEQ ID NO: 141330 - protein, 18 aa, Mycobacterium avium
HYADQKDRIADAGRDPAA

SEQ ID NO: 141331 - protein, 7 aa, Mycobacterium avium
IAATEAE

SEQ ID NO: 141332 - protein, 7 aa, Mycobacterium avium
IAATEAQ

SEQ ID NO: 141333 - protein, 15 aa, Mycobacterium avium
IAPDGTRTEEPRPEG

SEQ ID NO: 141334 - protein, 16 aa, Mycobacterium avium
ICGTGGDDLAAHTSYP

SEQ ID NO: 141335 - protein, 5 aa, Mycobacterium avium
IDADT

SEQ ID NO: 141336 - protein, 23 aa, Mycobacterium avium
IDDAADGYANPADGSEGERRAEG

SEQ ID NO: 141337 - protein, 8 aa, Mycobacterium avium
IDDAGQAP

SEQ ID NO: 141338 - protein, 9 aa, Mycobacterium avium
IDDESRDAV

SEQ ID NO: 141339 - protein, 10 aa, Mycobacterium avium
IDDPSASPLA

SEQ ID NO: 141340 - protein, 12 aa, Mycobacterium avium
IDPADAEAVGRA

SEQ ID NO: 141341 - protein, 8 aa, Mycobacterium avium
IDPGPTVK

SEQ ID NO: 141342 - protein, 6 aa, Mycobacterium avium
IDPQRD

SEQ ID NO: 141343 - protein, 5 aa, Mycobacterium avium
IDTGP

SEQ ID NO: 141344 - protein, 7 aa, Mycobacterium avium
IDTSESI

SEQ ID NO: 141345 - protein, 4 aa, Mycobacterium avium
IESE

SEQ ID NO: 141346 - protein, 10 aa, Mycobacterium avium
IGATGKTLPD

SEQ ID NO: 141347 - protein, 5 aa, Mycobacterium avium
IGDGT

SEQ ID NO: 141348 - protein, 8 aa, Mycobacterium avium
IGDTERQC

SEQ ID NO: 141349 - protein, 8 aa, Mycobacterium avium
IGGPAAGV

SEQ ID NO: 141350 - protein, 6 aa, Mycobacterium avium
IGNPTE

SEQ ID NO: 141351 - protein, 16 aa, Mycobacterium avium
IGPSHSVSKSDVAGQI

SEQ ID NO: 141352 - protein, 13 aa, Mycobacterium avium
IGSATAKRALAEG

SEQ ID NO: 141353 - protein, 9 aa, Mycobacterium avium
IGYQPQRAA

SEQ ID NO: 141354 - protein, 13 aa, Mycobacterium avium
IHKSTVPSQIGPA

SEQ ID NO: 141355 - protein, 5 aa, Mycobacterium avium
INGGG

SEQ ID NO: 141356 - protein, 12 aa, Mycobacterium avium
INPDGSTNIGDS

SEQ ID NO: 141357 - protein, 9 aa, Mycobacterium avium
INSRGAKDT

SEQ ID NO: 141358 - protein, 10 aa, Mycobacterium avium
INSRGAKDTT

SEQ ID NO: 141359 - protein, 5 aa, Mycobacterium avium
IPDAA

SEQ ID NO: 141360 - protein, 5 aa, Mycobacterium avium
IPEEG

SEQ ID NO: 141361 - protein, 6 aa, Mycobacterium avium
IPEGEK

SEQ ID NO: 141362 - protein, 6 aa, Mycobacterium avium
IPTRAP

SEQ ID NO: 141363 - protein, 9 aa, Mycobacterium avium
IQDRADGQA

SEQ ID NO: 141364 - protein, 12 aa, Mycobacterium avium
IQPRGADPLPPH

SEQ ID NO: 141365 - protein, 25 aa, Mycobacterium avium
IQPTAAGSATADVSVSGPKLTSPVT

SEQ ID NO: 141366 - protein, 20 aa, Mycobacterium avium
IRAPSDPGYEPTAPPAMTTP

SEQ ID NO: 141367 - protein, 7 aa, Mycobacterium avium
IRKRGSV

SEQ ID NO: 141368 - protein, 26 aa, Mycobacterium avium
ISGTADGYKTDKPGEPATATFKIVVT

SEQ ID NO: 141369 - protein, 26 aa, Mycobacterium avium
ISGTADGYKTDKPSEPATATFKIVVT

SEQ ID NO: 141370 - protein, 7 aa, Mycobacterium avium
ISKDGQQ

SEQ ID NO: 141371 - protein, 32 aa, Mycobacterium avium
ISPPTVDPGVPPPSGAPGPGQPMEQRAPCTTS

SEQ ID NO: 141372 - protein, 39 aa, Mycobacterium avium
ISQSVNGACPKPHQPTPGGSSSPAPSLPPSQAPAKPALV

SEQ ID NO: 141373 - protein, 9 aa, Mycobacterium avium
ISSNGGTID

SEQ ID NO: 141374 - protein, 12 aa, Mycobacterium avium
ITAASTPWRQDP

SEQ ID NO: 141375 - protein, 25 aa, Mycobacterium avium
ITAASTPWRQDPYRDTQGGSSLADY

SEQ ID NO: 141376 - protein, 12 aa, Mycobacterium avium
ITAGSADDDGAV

SEQ ID NO: 141377 - protein, 4 aa, Mycobacterium avium
ITDP

SEQ ID NO: 141378 - protein, 12 aa, Mycobacterium avium
ITEAAARNDAKV

SEQ ID NO: 141379 - protein, 10 aa, Mycobacterium avium
ITGPKFAGPV

SEQ ID NO: 141380 - protein, 6 aa, Mycobacterium avium
ITRGQE

SEQ ID NO: 141381 - protein, 4 aa, Mycobacterium avium
ITTA

SEQ ID NO: 141382 - protein, 5 aa, Mycobacterium avium
KAGAA

SEQ ID NO: 141383 - protein, 6 aa, Mycobacterium avium
KAGCST

SEQ ID NO: 141384 - protein, 5 aa, Mycobacterium avium
KAGRH

SEQ ID NO: 141385 - protein, 5 aa, Mycobacterium avium
KAPAY

SEQ ID NO: 141386 - protein, 9 aa, Mycobacterium avium
KAPDGTQVA

SEQ ID NO: 141387 - protein, 14 aa, Mycobacterium avium
KAPGAPYQAGRRGA

SEQ ID NO: 141388 - protein, 34 aa, Mycobacterium avium; identical to SEQ ID NO: 53710

SEQ ID NO: 141389 - protein, 24 aa, Mycobacterium avium
KAQSKSEGKVTEAGLESRTENEGQ

SEQ ID NO: 141390 - protein, 7 aa, Mycobacterium avium
KASETVA

SEQ ID NO: 141391 - protein, 9 aa, Mycobacterium avium
KATGGRSSF

SEQ ID NO: 141392 - protein, 17 aa, Mycobacterium avium
KCEPSSVAPTGGAPGDF

SEQ ID NO: 141393 - protein, 26 aa, Mycobacterium avium
KDAPTGPAPTGGPVPGQPVRPGPSGA

SEQ ID NO: 141394 - protein, 17 aa, Mycobacterium avium
KDPSTQPSNIGGGGTTL

SEQ ID NO: 141395 - protein, 14 aa, Mycobacterium avium
KDPSTQPSNIGSGG

SEQ ID NO: 141396 - protein, 17 aa, Mycobacterium avium
KDPSTQPSNIGSGGTTL

SEQ ID NO: 141397 - protein, 9 aa, Mycobacterium avium
KEIEQRRGD

SEQ ID NO: 141398 - protein, 7 aa, Mycobacterium avium
KENPDAH

SEQ ID NO: 141399 - protein, 10 aa, Mycobacterium avium
KEQANAATIQ

SEQ ID NO: 141400 - protein, 11 aa, Mycobacterium avium
KEQVAEQLSRN

SEQ ID NO: 141401 - protein, 4 aa, Mycobacterium avium
KESL

SEQ ID NO: 141402 - protein, 11 aa, Mycobacterium avium
KGEKGEPRWPD

SEQ ID NO: 141403 - protein, 6 aa, Mycobacterium avium
KGKRSA

SEQ ID NO: 141404 - protein, 8 aa, Mycobacterium avium
KGQPRDEM

SEQ ID NO: 141405 - protein, 4 aa, Mycobacterium avium
KGSA

SEQ ID NO: 141406 - protein, 9 aa, Mycobacterium avium
KGTAAGAGA

SEQ ID NO: 141407 - protein, 14 aa, Mycobacterium avium
KIDIGSGSTGGAQQ

SEQ ID NO: 141408 - protein, 8 aa, Mycobacterium avium
KIEPEPDR

SEQ ID NO: 141409 - protein, 9 aa, Mycobacterium avium
KIESSVNSA

SEQ ID NO: 141410 - protein, 4 aa, Mycobacterium avium
KKEL

SEQ ID NO: 141411 - protein, 8 aa, Mycobacterium avium
KKTYDPDS

SEQ ID NO: 141412 - protein, 7 aa, Mycobacterium avium
KLPDPQR

SEQ ID NO: 141413 - protein, 5 aa, Mycobacterium avium
KMPAS

SEQ ID NO: 141414 - protein, 6 aa, Mycobacterium avium
KNAGTE

SEQ ID NO: 141415 - protein, 7 aa, Mycobacterium avium
KNHQASL

SEQ ID NO: 141416 - protein, 9 aa, Mycobacterium avium
KNLEPQSSR

SEQ ID NO: 141417 - protein, 9 aa, Mycobacterium avium
KNPDGKRTI

SEQ ID NO: 141418 - protein, 14 aa, Mycobacterium avium
KNTGSITKIYTQAT

SEQ ID NO: 141419 - protein, 15 aa, Mycobacterium avium
KPDLQGTLGASPGGG

SEQ ID NO: 141420 - protein, 6 aa, Mycobacterium avium
KPFDTD

SEQ ID NO: 141421 - protein, 6 aa, Mycobacterium avium
KPFGTD

SEQ ID NO: 141422 - protein, 18 aa, Mycobacterium avium
KPNQRAPKPNRDDRRDEH

SEQ ID NO: 141423 - protein, 9 aa, Mycobacterium avium
KPPPGDHDA

SEQ ID NO: 141424 - protein, 14 aa, Mycobacterium avium
KPRPDINPDGPTTL

SEQ ID NO: 141425 - protein, 8 aa, Mycobacterium avium
KPSFGPDY

SEQ ID NO: 141426 - protein, 7 aa, Mycobacterium avium
KPVPGAQ

SEQ ID NO: 141427 - protein, 7 aa, Mycobacterium avium
KPYTGEL

SEQ ID NO: 141428 - protein, 4 aa, Mycobacterium avium
KQMR

SEQ ID NO: 141429 - protein, 8 aa, Mycobacterium avium
KRAADMPL

SEQ ID NO: 141430 - protein, 7 aa, Mycobacterium avium
KRGIDPE

SEQ ID NO: 141431 - protein, 19 aa, Mycobacterium avium
KRIDKAERLAEADRHARDV

SEQ ID NO: 141432 - protein, 4 aa, Mycobacterium avium
KRRN

SEQ ID NO: 141433 - protein, 5 aa, Mycobacterium avium
KRSGP

SEQ ID NO: 141434 - protein, 10 aa, Mycobacterium avium
KSAPTDTAST

SEQ ID NO: 141435 - protein, 8 aa, Mycobacterium avium
KSGSRAPW

SEQ ID NO: 141436 - protein, 8 aa, Mycobacterium avium
KSGSTRCQ

SEQ ID NO: 141437 - protein, 8 aa, Mycobacterium avium
KSIADGAS

SEQ ID NO: 141438 - protein, 9 aa, Mycobacterium avium
KSLEPQSSR

SEQ ID NO: 141439 - protein, 13 aa, Mycobacterium avium
KSTADLPKNLEGV

SEQ ID NO: 141440 - protein, 11 aa, Mycobacterium avium
KSTVPSQIGPA

SEQ ID NO: 141441 - protein, 17 aa, Mycobacterium avium
KTAGVQAASRGRFEEAS

SEQ ID NO: 141442 - protein, 6 aa, Mycobacterium avium
KTSSAD

SEQ ID NO: 141443 - protein, 10 aa, Mycobacterium avium
KVAARGGPQC

SEQ ID NO: 141444 - protein, 15 aa, Mycobacterium avium
KVAKDWNTDATKGIP

SEQ ID NO: 141445 - protein, 15 aa, Mycobacterium avium
KVEPATEDPLAAAAP

SEQ ID NO: 141446 - protein, 15 aa, Mycobacterium avium
KVEPATGDPLAAAAP

SEQ ID NO: 141447 - protein, 25 aa, Mycobacterium avium
KVEPNTSASPATPAPGPPNTGPPEV

SEQ ID NO: 141448 - protein, 15 aa, Mycobacterium avium
KVEPTAGDPLAAAAP

SEQ ID NO: 141449 - protein, 5 aa, Mycobacterium avium
KVPAD

SEQ ID NO: 141450 - protein, 11 aa, Mycobacterium avium
KVSDTGERGID

SEQ ID NO: 141451 - protein, 6 aa, Mycobacterium avium
KYPDLS

SEQ ID NO: 141452 - protein, 6 aa, Mycobacterium avium
LAAGAA

SEQ ID NO: 141453 - protein, 8 aa, Mycobacterium avium
LAAGQSPT

SEQ ID NO: 141454 - protein, 21 aa, Mycobacterium avium
LAATGARTGLGGDSRAPVVPE

SEQ ID NO: 141455 - protein, 10 aa, Mycobacterium avium
LADSARDVPG

SEQ ID NO: 141456 - protein, 10 aa, Mycobacterium avium
LAGDERPDGA

SEQ ID NO: 141457 - protein, 4 aa, Mycobacterium avium
LAGG

SEQ ID NO: 141458 - protein, 6 aa, Mycobacterium avium
LAGGGL

SEQ ID NO: 141459 - protein, 9 aa, Mycobacterium avium
LAGPARRGE

SEQ ID NO: 141460 - protein, 7 aa, Mycobacterium avium
LAGPQGV

SEQ ID NO: 141461 - protein, 7 aa, Mycobacterium avium
LAGRALA

SEQ ID NO: 141462 - protein, 9 aa, Mycobacterium avium
LAHGGQPVS

SEQ ID NO: 141463 - protein, 9 aa, Mycobacterium avium
LAKEHSSAI

SEQ ID NO: 141464 - protein, 8 aa, Mycobacterium avium
LANTGAGP

SEQ ID NO: 141465 - protein, 19 aa, Mycobacterium avium
LAPGAEGPSPTPPDVPPAV

SEQ ID NO: 141466 - protein, 4 aa, Mycobacterium avium
LAPL

SEQ ID NO: 141467 - protein, 22 aa, Mycobacterium avium
LAPQPAGAGAAVEPVQKRPGDI

SEQ ID NO: 141468 - protein, 9 aa, Mycobacterium avium
LAQPRGGLT

SEQ ID NO: 141469 - protein, 10 aa, Mycobacterium avium
LARGAAAEAA

SEQ ID NO: 141470 - protein, 12 aa, Mycobacterium avium
LATDPEARQRRE

SEQ ID NO: 141471 - protein, 7 aa, Mycobacterium avium
LATDPTF

SEQ ID NO: 141472 - protein, 8 aa, Mycobacterium avium
LATPDERD

SEQ ID NO: 141473 - protein, 7 aa, Mycobacterium avium
LATPTVT

SEQ ID NO: 141474 - protein, 9 aa, Mycobacterium avium
LDDASAAGL

SEQ ID NO: 141475 - protein, 5 aa, Mycobacterium avium
LDDGE

SEQ ID NO: 141476 - protein, 14 aa, Mycobacterium avium
LDGPPRNTAQIGQP

SEQ ID NO: 141477 - protein, 5 aa, Mycobacterium avium
LDGQA

SEQ ID NO: 141478 - protein, 6 aa, Mycobacterium avium
LDPADE

SEQ ID NO: 141479 - protein, 4 aa, Mycobacterium avium
LDSA

SEQ ID NO: 141480 - protein, 5 aa, Mycobacterium avium
LDSAG

SEQ ID NO: 141481 - protein, 9 aa, Mycobacterium avium
LDSPDQAIG

SEQ ID NO: 141482 - protein, 12 aa, Mycobacterium avium
LGAGGISGPPVA

SEQ ID NO: 141483 - protein, 20 aa, Mycobacterium avium
LGAGGTGKGTAGAMRGAAGA

SEQ ID NO: 141484 - protein, 8 aa, Mycobacterium avium
LGAGPASR

SEQ ID NO: 141485 - protein, 5 aa, Mycobacterium avium
LGDHS

SEQ ID NO: 141486 - protein, 26 aa, Mycobacterium avium
LGGAGAAGGPATAEAIASAADPRNVE

SEQ ID NO: 141487 - protein, 13 aa, Mycobacterium avium
LGGAPAATAVTDS

SEQ ID NO: 141488 - protein, 20 aa, Mycobacterium avium
LGGHNGVPAMADRTRHVLAK

SEQ ID NO: 141489 - protein, 23 aa, Mycobacterium avium
LGGPATVAAPSGAVAAPSGGGVG

SEQ ID NO: 141490 - protein, 11 aa, Mycobacterium avium
LGGTDPAGPLT

SEQ ID NO: 141491 - protein, 10 aa, Mycobacterium avium
LGGTDTSGRS

SEQ ID NO: 141492 - protein, 19 aa, Mycobacterium avium
LGLPAEPDKLGSLAPQANA

SEQ ID NO: 141493 - protein, 9 aa, Mycobacterium avium
LGLSGTVTT

SEQ ID NO: 141494 - protein, 6 aa, Mycobacterium avium
LGPAGA

SEQ ID NO: 141495 - protein, 6 aa, Mycobacterium avium
LGPART

SEQ ID NO: 141496 - protein, 8 aa, Mycobacterium avium
LGPGATTR

SEQ ID NO: 141497 - protein, 5 aa, Mycobacterium avium
LGSAP

SEQ ID NO: 141498 - protein, 8 aa, Mycobacterium avium
LGSSPPVH

SEQ ID NO: 141499 - protein, 14 aa, Mycobacterium avium
LGTDTRTPIPVDTR

SEQ ID NO: 141500 - protein, 7 aa, Mycobacterium avium
LGTNREK

SEQ ID NO: 141501 - protein, 19 aa, Mycobacterium avium
LGYPRDSLGAPGPAPDDSV

SEQ ID NO: 141502 - protein, 9 aa, Mycobacterium avium
LHPEPGSRA

SEQ ID NO: 141503 - protein, 12 aa, Mycobacterium avium
LKATPENLKPAL

SEQ ID NO: 141504 - protein, 7 aa, Mycobacterium avium
LKEGNER

SEQ ID NO: 141505 - protein, 8 aa, Mycobacterium avium
LLGGGAGS

SEQ ID NO: 141506 - protein, 5 aa, Mycobacterium avium
LLPTG

SEQ ID NO: 141507 - protein, 33 aa, Mycobacterium avium; identical to SEQ ID NO: 5883

SEQ ID NO: 141508 - protein, 6 aa, Mycobacterium avium
LNASTQ

SEQ ID NO: 141509 - protein, 7 aa, Mycobacterium avium
LNGRGAR

SEQ ID NO: 141510 - protein, 11 aa, Mycobacterium avium
LNRNGVPPAQY

SEQ ID NO: 141511 - protein, 15 aa, Mycobacterium avium
LPAGGTINSQHTQPA

SEQ ID NO: 141512 - protein, 11 aa, Mycobacterium avium
LPAPGLGSGGY

SEQ ID NO: 141513 - protein, 9 aa, Mycobacterium avium
LPAQAPAVA

SEQ ID NO: 141514 - protein, 10 aa, Mycobacterium avium
LPAQAPAVAP

SEQ ID NO: 141515 - protein, 5 aa, Mycobacterium avium
LPDSL

SEQ ID NO: 141516 - protein, 6 aa, Mycobacterium avium
LPDSRR

SEQ ID NO: 141517 - protein, 5 aa, Mycobacterium avium
LPEGY

SEQ ID NO: 141518 - protein, 4 aa, Mycobacterium avium
LPEQ

SEQ ID NO: 141519 - protein, 6 aa, Mycobacterium avium
LPESDL

SEQ ID NO: 141520 - protein, 16 aa, Mycobacterium avium
LPGADYPPIPPELDIE

SEQ ID NO: 141521 - protein, 22 aa, Mycobacterium avium
LPGCSGKDGHPAATPSSTATLA

SEQ ID NO: 141522 - protein, 22 aa, Mycobacterium avium
LPGCSGKEGHPAATPSSTAALA

SEQ ID NO: 141523 - protein, 22 aa, Mycobacterium avium
LPGCSGKNGHPAATPSSTAALA

SEQ ID NO: 141524 - protein, 6 aa, Mycobacterium avium
LPGGRP

SEQ ID NO: 141525 - protein, 11 aa, Mycobacterium avium
LPGGRPLVSDP

SEQ ID NO: 141526 - protein, 14 aa, Mycobacterium avium
LPGPATALTGDGRG

SEQ ID NO: 141527 - protein, 8 aa, Mycobacterium avium
LPGTDRRA

SEQ ID NO: 141528 - protein, 12 aa, Mycobacterium avium
LPGTKGGGPGAY

SEQ ID NO: 141529 - protein, 6 aa, Mycobacterium avium
LPHSSQ

SEQ ID NO: 141530 - protein, 8 aa, Mycobacterium avium
LPKPQRYP

SEQ ID NO: 141531 - protein, 6 aa, Mycobacterium avium
LPNPNG

SEQ ID NO: 141532 - protein, 4 aa, Mycobacterium avium
LPPA

SEQ ID NO: 141533 - protein, 5 aa, Mycobacterium avium
LPPAA

SEQ ID NO: 141534 - protein, 6 aa, Mycobacterium avium
LPPETR

SEQ ID NO: 141535 - protein, 21 aa, Mycobacterium avium
LPPGGPGGGPGAGTPKTTVTF

SEQ ID NO: 141536 - protein, 7 aa, Mycobacterium avium
LPPPDAR

SEQ ID NO: 141537 - protein, 9 aa, Mycobacterium avium
LPPRRGRPH

SEQ ID NO: 141538 - protein, 6 aa, Mycobacterium avium
LPPVEK

SEQ ID NO: 141539 - protein, 48 aa, Mycobacterium avium; identical to SEQ ID NO: 68700

SEQ ID NO: 141540 - protein, 10 aa, Mycobacterium avium
LPSESEPGYR

SEQ ID NO: 141541 - protein, 6 aa, Mycobacterium avium
LPSKGL

SEQ ID NO: 141542 - protein, 15 aa, Mycobacterium avium
LPSPCTGGGPYNPGN

SEQ ID NO: 141543 - protein, 11 aa, Mycobacterium avium
LPTDPSAVRSA

SEQ ID NO: 141544 - protein, 4 aa, Mycobacterium avium
LPTG

SEQ ID NO: 141545 - protein, 7 aa, Mycobacterium avium
LPTNATG

SEQ ID NO: 141546 - protein, 41 aa, Mycobacterium avium
LQAGASDTEQLTAAPSMPLPNSTATLENYGGQACGNDPTVS

SEQ ID NO: 141547 - protein, 7 aa, Mycobacterium avium
LQDGRRR

SEQ ID NO: 141548 - protein, 10 aa, Mycobacterium avium
LQEPDHRRQR

SEQ ID NO: 141549 - protein, 11 aa, Mycobacterium avium
LQPGATAMSDK

SEQ ID NO: 141550 - protein, 8 aa, Mycobacterium avium
LQPSGHND

SEQ ID NO: 141551 - protein, 13 aa, Mycobacterium avium
LQSGSGEASTANN

SEQ ID NO: 141552 - protein, 9 aa, Mycobacterium avium
LRDDGTTTL

SEQ ID NO: 141553 - protein, 8 aa, Mycobacterium avium
LRDEKRDL

SEQ ID NO: 141554 - protein, 13 aa, Mycobacterium avium
LRDNGIDGPRIPG

SEQ ID NO: 141555 - protein, 7 aa, Mycobacterium avium
LREETGL

SEQ ID NO: 141556 - protein, 15 aa, Mycobacterium avium
LRETAGWPEGESFPT

SEQ ID NO: 141557 - protein, 12 aa, Mycobacterium avium
LRGECGPRQVPD

SEQ ID NO: 141558 - protein, 10 aa, Mycobacterium avium
LRPGGPTNVT

SEQ ID NO: 141559 - protein, 27 aa, Mycobacterium avium
LRPSNQTKVSFTTTSESPLRDGASYGV

SEQ ID NO: 141560 - protein, 4 aa, Mycobacterium avium
LSAR

SEQ ID NO: 141561 - protein, 29 aa, Mycobacterium avium
LSARGSASSRARRKSGEPAPDDLDAPAAA

SEQ ID NO: 141562 - protein, 9 aa, Mycobacterium avium
LSEARGPLH

SEQ ID NO: 141563 - protein, 6 aa, Mycobacterium avium
LSGRQR

SEQ ID NO: 141564 - protein, 16 aa, Mycobacterium avium
LSGTDGSVTYDRGSDG

SEQ ID NO: 141565 - protein, 4 aa, Mycobacterium avium
LSKG

SEQ ID NO: 141566 - protein, 14 aa, Mycobacterium avium
LSKGFGDGQPVAAS

SEQ ID NO: 141567 - protein, 61 aa, Mycobacterium avium
LSNPNKPPRNPPETTTSTNPTTTETSPVTTTETTSTTPTTAAAAPPGVGSSELLGGDAGDI

SEQ ID NO: 141568 - protein, 4 aa, Mycobacterium avium
LSQR

SEQ ID NO: 141569 - protein, 8 aa, Mycobacterium avium
LSTSGPAV

SEQ ID NO: 141570 - protein, 9 aa, Mycobacterium avium
LSTTDPHSR

SEQ ID NO: 141571 - protein, 9 aa, Mycobacterium avium
LTDSQSAKE

SEQ ID NO: 141572 - protein, 9 aa, Mycobacterium avium
LTDTPPETL

SEQ ID NO: 141573 - protein, 12 aa, Mycobacterium avium
LTGDVPASLSPE

SEQ ID NO: 141574 - protein, 10 aa, Mycobacterium avium
LTPDGQPSKF

SEQ ID NO: 141575 - protein, 4 aa, Mycobacterium avium
LTPS

SEQ ID NO: 141576 - protein, 11 aa, Mycobacterium avium
LTRQANPKLPA

SEQ ID NO: 141577 - protein, 10 aa, Mycobacterium avium
LTSRDQINGQ

SEQ ID NO: 141578 - protein, 7 aa, Mycobacterium avium
LTTPART

SEQ ID NO: 141579 - protein, 4 aa, Mycobacterium avium
LVSD

SEQ ID NO: 141580 - protein, 11 aa, Mycobacterium avium
MAGTAHSGWTA

SEQ ID NO: 141581 - protein, 10 aa, Mycobacterium avium
MAKPGAPQAY

SEQ ID NO: 141582 - protein, 7 aa, Mycobacterium avium
MASGPGS

SEQ ID NO: 141583 - protein, 14 aa, Mycobacterium avium
MDDPEPAPASLPNC

SEQ ID NO: 141584 - protein, 19 aa, Mycobacterium avium
MGDRDAVSDLSRSQPTASV

SEQ ID NO: 141585 - protein, 7 aa, Mycobacterium avium
MGTSPYA

SEQ ID NO: 141586 - protein, 53 aa, Mycobacterium avium
MHGGAAAGALPGAAGALPGAAGALPGAAGALPGAAGAAGALPAAAGAAPALPP

SEQ ID NO: 141587 - protein, 60 aa, Mycobacterium avium
MHGGAAAGALPGAAGALPGAAGALPGAAGALPGAAGALPAAAGAAGALPAAAGAAPALPP

SEQ ID NO: 141588 - protein, 4 aa, Mycobacterium avium
MPDG

SEQ ID NO: 141589 - protein, 20 aa, Mycobacterium avium
MPNGRYATDNIGSPAAADTT

SEQ ID NO: 141590 - protein, 20 aa, Mycobacterium avium
MSDEPTQPPNPAGAAAPGVT

SEQ ID NO: 141591 - protein, 10 aa, Mycobacterium avium
MSGGPTTPAM

SEQ ID NO: 141592 - protein, 4 aa, Mycobacterium avium
MSGS

SEQ ID NO: 141593 - protein, 17 aa, Mycobacterium avium
MSTGDAGKRVACGVIGA

SEQ ID NO: 141594 - protein, 10 aa, Mycobacterium avium
MSTSGLSASD

SEQ ID NO: 141595 - protein, 7 aa, Mycobacterium avium
MTTAGYG

SEQ ID NO: 141596 - protein, 15 aa, Mycobacterium avium
NAAPDPELRATAKRA

SEQ ID NO: 141597 - protein, 19 aa, Mycobacterium avium
NADPAVRQRRIESEKVTRV

SEQ ID NO: 141598 - protein, 4 aa, Mycobacterium avium
NAFP

SEQ ID NO: 141599 - protein, 8 aa, Mycobacterium avium
NAIGGESA

SEQ ID NO: 141600 - protein, 13 aa, Mycobacterium avium
NALDGNGEKLRQT

SEQ ID NO: 141601 - protein, 21 aa, Mycobacterium avium
NALGPHGGNAAVYAPKAALGH

SEQ ID NO: 141602 - protein, 7 aa, Mycobacterium avium
NALPDSS

SEQ ID NO: 141603 - protein, 7 aa, Mycobacterium avium
NALPNSS

SEQ ID NO: 141604 - protein, 13 aa, Mycobacterium avium
NALTSTIDRQRGQ

SEQ ID NO: 141605 - protein, 8 aa, Mycobacterium avium
NAPDRSKG

SEQ ID NO: 141606 - protein, 20 aa, Mycobacterium avium
NASTAVTRPAGSGAVARGYT

SEQ ID NO: 141607 - protein, 7 aa, Mycobacterium avium
NASWSRT

SEQ ID NO: 141608 - protein, 11 aa, Mycobacterium avium
NASWSRTYARQ

SEQ ID NO: 141609 - protein, 9 aa, Mycobacterium avium
NATDNPEAY

SEQ ID NO: 141610 - protein, 11 aa, Mycobacterium avium
NATRVGPLSAP

SEQ ID NO: 141611 - protein, 6 aa, Mycobacterium avium
NCGSTH

SEQ ID NO: 141612 - protein, 6 aa, Mycobacterium avium
NDGSAA

SEQ ID NO: 141613 - protein, 13 aa, Mycobacterium avium
NDNNMHDGSIAQA

SEQ ID NO: 141614 - protein, 4 aa, Mycobacterium avium
NDNR

SEQ ID NO: 141615 - protein, 7 aa, Mycobacterium avium
NDPNEVA

SEQ ID NO: 141616 - protein, 7 aa, Mycobacterium avium
NDRPTGT

SEQ ID NO: 141617 - protein, 7 aa, Mycobacterium avium
NDSHYVR

SEQ ID NO: 141618 - protein, 11 aa, Mycobacterium avium
NDVAVSPDTSW

SEQ ID NO: 141619 - protein, 7 aa, Mycobacterium avium
NEGGTAV

SEQ ID NO: 141620 - protein, 4 aa, Mycobacterium avium
NENR

SEQ ID NO: 141621 - protein, 6 aa, Mycobacterium avium
NFGGGT

SEQ ID NO: 141622 - protein, 23 aa, Mycobacterium avium
NFVNSSAKQGEVVGTTPSGATIP

SEQ ID NO: 141623 - protein, 11 aa, Mycobacterium avium
NGDAPSSAAHV

SEQ ID NO: 141624 - protein, 6 aa, Mycobacterium avium
NGEPAQ

SEQ ID NO: 141625 - protein, 6 aa, Mycobacterium avium
NGGEPV

SEQ ID NO: 141626 - protein, 7 aa, Mycobacterium avium
NGGEPVD

SEQ ID NO: 141627 - protein, 13 aa, Mycobacterium avium
NGKPSDLGGDNLP

SEQ ID NO: 141628 - protein, 9 aa, Mycobacterium avium
NGKSESMAK

SEQ ID NO: 141629 - protein, 6 aa, Mycobacterium avium
NGPAGS

SEQ ID NO: 141630 - protein, 11 aa, Mycobacterium avium
NGQASSGGRDC

SEQ ID NO: 141631 - protein, 5 aa, Mycobacterium avium
NGRFT

SEQ ID NO: 141632 - protein, 13 aa, Mycobacterium avium
NGSPRVDGPSVES

SEQ ID NO: 141633 - protein, 14 aa, Mycobacterium avium
NGSPRVDGPSVESV

SEQ ID NO: 141634 - protein, 6 aa, Mycobacterium avium
NGTGYA

SEQ ID NO: 141635 - protein, 4 aa, Mycobacterium avium
NGTH

SEQ ID NO: 141636 - protein, 7 aa, Mycobacterium avium
NGTNPDS

SEQ ID NO: 141637 - protein, 11 aa, Mycobacterium avium
NGTPSELGGAN

SEQ ID NO: 141638 - protein, 7 aa, Mycobacterium avium
NGVETGR

SEQ ID NO: 141639 - protein, 8 aa, Mycobacterium avium
NGVSQNEG

SEQ ID NO: 141640 - protein, 10 aa, Mycobacterium avium
NGYDPSPDVR

SEQ ID NO: 141641 - protein, 6 aa, Mycobacterium avium
NIDRGR

SEQ ID NO: 141642 - protein, 7 aa, Mycobacterium avium
NKPLGNR

SEQ ID NO: 141643 - protein, 5 aa, Mycobacterium avium
NKPSA

SEQ ID NO: 141644 - protein, 7 aa, Mycobacterium avium
NKRPPLR

SEQ ID NO: 141645 - protein, 11 aa, Mycobacterium avium
NKRRGSTQTSN

SEQ ID NO: 141646 - protein, 7 aa, Mycobacterium avium
NKTPPLR

SEQ ID NO: 141647 - protein, 9 aa, Mycobacterium avium
NLGDAAGTY

SEQ ID NO: 141648 - protein, 7 aa, Mycobacterium avium
NLPDPQR

SEQ ID NO: 141649 - protein, 7 aa, Mycobacterium avium
NLPDPRR

SEQ ID NO: 141650 - protein, 4 aa, Mycobacterium avium
NLTF

SEQ ID NO: 141651 - protein, 7 aa, Mycobacterium avium
NNDNGRQ

SEQ ID NO: 141652 - protein, 6 aa, Mycobacterium avium
NNKRGI

SEQ ID NO: 141653 - protein, 6 aa, Mycobacterium avium
NNPSAQ

SEQ ID NO: 141654 - protein, 5 aa, Mycobacterium avium
NNSGV

SEQ ID NO: 141655 - protein, 7 aa, Mycobacterium avium
NNSRSAR

SEQ ID NO: 141656 - protein, 6 aa, Mycobacterium avium
NPAGWQ

SEQ ID NO: 141657 - protein, 8 aa, Mycobacterium avium
NPDRVTHR

SEQ ID NO: 141658 - protein, 8 aa, Mycobacterium avium
NPEATAEA

SEQ ID NO: 141659 - protein, 8 aa, Mycobacterium avium
NPNTPGAM

SEQ ID NO: 141660 - protein, 5 aa, Mycobacterium avium
NPQEF

SEQ ID NO: 141661 - protein, 9 aa, Mycobacterium avium
NPSHRVRGE

SEQ ID NO: 141662 - protein, 5 aa, Mycobacterium avium
NPSRP

SEQ ID NO: 141663 - protein, 5 aa, Mycobacterium avium
NPTRS

SEQ ID NO: 141664 - protein, 9 aa, Mycobacterium avium
NPVPVDPQR

SEQ ID NO: 141665 - protein, 11 aa, Mycobacterium avium
NPVRRTRGDVE

SEQ ID NO: 141666 - protein, 6 aa, Mycobacterium avium
NQTAPH

SEQ ID NO: 141667 - protein, 8 aa, Mycobacterium avium
NRAGRDKA

SEQ ID NO: 141668 - protein, 7 aa, Mycobacterium avium
NRAGRRR

SEQ ID NO: 141669 - protein, 5 aa, Mycobacterium avium
NRDNT

SEQ ID NO: 141670 - protein, 10 aa, Mycobacterium avium
NREALTQPAA

SEQ ID NO: 141671 - protein, 6 aa, Mycobacterium avium
NRRARQ

SEQ ID NO: 141672 - protein, 5 aa, Mycobacterium avium
NRSIG

SEQ ID NO: 141673 - protein, 7 aa, Mycobacterium avium
NSGEELP

SEQ ID NO: 141674 - protein, 5 aa, Mycobacterium avium
NSIAP

SEQ ID NO: 141675 - protein, 5 aa, Mycobacterium avium
NSLAP

SEQ ID NO: 141676 - protein, 4 aa, Mycobacterium avium
NSPD

SEQ ID NO: 141677 - protein, 9 aa, Mycobacterium avium
NSPGSPGPL

SEQ ID NO: 141678 - protein, 7 aa, Mycobacterium avium
NSPPTIS

SEQ ID NO: 141679 - protein, 15 aa, Mycobacterium avium
NSPTLVAGQTLIAPV

SEQ ID NO: 141680 - protein, 9 aa, Mycobacterium avium
NSRRPGDHV

SEQ ID NO: 141681 - protein, 7 aa, Mycobacterium avium
NSVRNTD

SEQ ID NO: 141682 - protein, 7 aa, Mycobacterium avium
NTAADQL

SEQ ID NO: 141683 - protein, 30 aa, Mycobacterium avium; identical to SEQ ID NO: 6024

SEQ ID NO: 141684 - protein, 13 aa, Mycobacterium avium
NTGPAAAAGIAPG

SEQ ID NO: 141685 - protein, 14 aa, Mycobacterium avium
NTGPAAAAGIAPGD

SEQ ID NO: 141686 - protein, 6 aa, Mycobacterium avium
NTLGRR

SEQ ID NO: 141687 - protein, 6 aa, Mycobacterium avium
NTRGAL

SEQ ID NO: 141688 - protein, 13 aa, Mycobacterium avium
NTSNAGAPEQEPR

SEQ ID NO: 141689 - protein, 12 aa, Mycobacterium avium
NTTVSRDGLRTA

SEQ ID NO: 141690 - protein, 8 aa, Mycobacterium avium
NVEGESCG

SEQ ID NO: 141691 - protein, 6 aa, Mycobacterium avium
NVGDGA

SEQ ID NO: 141692 - protein, 11 aa, Mycobacterium avium
NVGLPGESAGL

SEQ ID NO: 141693 - protein, 40 aa, Mycobacterium avium
NWKGDPNATLSGQDVPAPRDPSAPGAGPPPAAPAPPPPPI

SEQ ID NO: 141694 - protein, 10 aa, Mycobacterium avium
PAAAHPADLQ

SEQ ID NO: 141695 - protein, 10 aa, Mycobacterium avium
PAAAYPNENY

SEQ ID NO: 141696 - protein, 12 aa, Mycobacterium avium
PAAKQKSLKTNA

SEQ ID NO: 141697 - protein, 17 aa, Mycobacterium avium
PAASSATAAALPASGGA

SEQ ID NO: 141698 - protein, 8 aa, Mycobacterium avium
PAATSMSA

SEQ ID NO: 141699 - protein, 7 aa, Mycobacterium avium
PADPGAG

SEQ ID NO: 141700 - protein, 10 aa, Mycobacterium avium
PADTGEPPTD

SEQ ID NO: 141701 - protein, 9 aa, Mycobacterium avium
PAEPADDYP

SEQ ID NO: 141702 - protein, 10 aa, Mycobacterium avium
PAEPADDYPR

SEQ ID NO: 141703 - protein, 5 aa, Mycobacterium avium
PAFAD

SEQ ID NO: 141704 - protein, 6 aa, Mycobacterium avium
PAGALG

SEQ ID NO: 141705 - protein, 11 aa, Mycobacterium avium
PAGATEGATNR

SEQ ID NO: 141706 - protein, 27 aa, Mycobacterium avium
PAGTPGSWDNPPAPPPPAEPPPPPPPP

SEQ ID NO: 141707 - protein, 9 aa, Mycobacterium avium
PAHATSADD

SEQ ID NO: 141708 - protein, 5 aa, Mycobacterium avium
PAHPT

SEQ ID NO: 141709 - protein, 7 aa, Mycobacterium avium
PAKLNET

SEQ ID NO: 141710 - protein, 142 aa, Mycobacterium avium
PALSGGATSTPGLASPGLGSPGLGTPGLGTPGLTNPGLTSPGATSPGLTSPGLTSPGLTSPGLTSPGAAPTTPGLTAPGALPTTPGGGVATPGAGLNPALSNPGLTSPAGTAPGLGSPTVAPSEVPIDSGAGLDPGAGGTYP

SEQ ID NO: 141711 - protein, 6 aa, Mycobacterium avium
PALVSG

SEQ ID NO: 141712 - protein, 27 aa, Mycobacterium avium
PAMSGAPGAAPMTAATTGSTGSSSGVP

SEQ ID NO: 141713 - protein, 8 aa, Mycobacterium avium
PAPHAGDA

SEQ ID NO: 141714 - protein, 4 aa, Mycobacterium avium
PAPV

SEQ ID NO: 141715 - protein, 7 aa, Mycobacterium avium
PAQGTLT

SEQ ID NO: 141716 - protein, 34 aa, Mycobacterium avium
PAQLSAPAQADPPPTAPYPTPRTPAPPSDYDAPF

SEQ ID NO: 141717 - protein, 33 aa, Mycobacterium avium
PAQLSAPAQADPPPTAPYPTPRTPSPPSDYDAP

SEQ ID NO: 141718 - protein, 34 aa, Mycobacterium avium
PAQLSAPAQADPPPTAPYPTPRTPSPPSDYDAPF

SEQ ID NO: 141719 - protein, 6 aa, Mycobacterium avium
PASASA

SEQ ID NO: 141720 - protein, 15 aa, Mycobacterium avium
PASEREPYESSAPIE

SEQ ID NO: 141721 - protein, 6 aa, Mycobacterium avium
PASGAR

SEQ ID NO: 141722 - protein, 7 aa, Mycobacterium avium
PATDQWD

SEQ ID NO: 141723 - protein, 4 aa, Mycobacterium avium
PATI

SEQ ID NO: 141724 - protein, 4 aa, Mycobacterium avium
PATL

SEQ ID NO: 141725 - protein, 16 aa, Mycobacterium avium
PATQQIPRSPPTSLNA

SEQ ID NO: 141726 - protein, 16 aa, Mycobacterium avium
PATRANIERAISGEIE

SEQ ID NO: 141727 - protein, 7 aa, Mycobacterium avium
PAVAAPN

SEQ ID NO: 141728 - protein, 5 aa, Mycobacterium avium
PAVAS

SEQ ID NO: 141729 - protein, 19 aa, Mycobacterium avium
PAVPDGIDPATVPKPLTPD

SEQ ID NO: 141730 - protein, 6 aa, Mycobacterium avium
PAVRGP

SEQ ID NO: 141731 - protein, 8 aa, Mycobacterium avium
PAYQPPGA

SEQ ID NO: 141732 - protein, 9 aa, Mycobacterium avium
PAYTGGPAL

SEQ ID NO: 141733 - protein, 20 aa, Mycobacterium avium
PCPHGGCPGGAAPKPTGPAR

SEQ ID NO: 141734 - protein, 20 aa, Mycobacterium avium
PCPHGGCPGGAAPKTTGPAR

SEQ ID NO: 141735 - protein, 10 aa, Mycobacterium avium
PDAKDDDVAG

SEQ ID NO: 141736 - protein, 8 aa, Mycobacterium avium
PDAKIGDS

SEQ ID NO: 141737 - protein, 5 aa, Mycobacterium avium
PDANQ

SEQ ID NO: 141738 - protein, 19 aa, Mycobacterium avium
PDDDAAADLGLGQPSPAPW

SEQ ID NO: 141739 - protein, 13 aa, Mycobacterium avium
PDDGETAEQFTPQ

SEQ ID NO: 141740 - protein, 8 aa, Mycobacterium avium
PDDGRPRN

SEQ ID NO: 141741 - protein, 15 aa, Mycobacterium avium
PDDHREAYGNPDEAV

SEQ ID NO: 141742 - protein, 5 aa, Mycobacterium avium
PDEPW

SEQ ID NO: 141743 - protein, 8 aa, Mycobacterium avium
PDGSVAQT

SEQ ID NO: 141744 - protein, 9 aa, Mycobacterium avium
PDKRTDARV

SEQ ID NO: 141745 - protein, 7 aa, Mycobacterium avium
PDKVYSG

SEQ ID NO: 141746 - protein, 5 aa, Mycobacterium avium
PDNDA

SEQ ID NO: 141747 - protein, 11 aa, Mycobacterium avium
PDPNGERAGHA

SEQ ID NO: 141748 - protein, 53 aa, Mycobacterium avium
PDPNGTRLPNGAPPPAPPVAEGTPDHPGPAVPPGSPCSYTPAADSPPRPGNPL

SEQ ID NO: 141749 - protein, 13 aa, Mycobacterium avium
PDPQSAGDAGRST

SEQ ID NO: 141750 - protein, 19 aa, Mycobacterium avium
PDQASSITPASPTDTPPST

SEQ ID NO: 141751 - protein, 19 aa, Mycobacterium avium
PDQASSITPATPTDTPPST

SEQ ID NO: 141752 - protein, 11 aa, Mycobacterium avium
PDRAPTVSEPA

SEQ ID NO: 141753 - protein, 8 aa, Mycobacterium avium
PDRAVPRT

SEQ ID NO: 141754 - protein, 10 aa, Mycobacterium avium
PDSGSSPETR

SEQ ID NO: 141755 - protein, 8 aa, Mycobacterium avium
PDSRAKDL

SEQ ID NO: 141756 - protein, 8 aa, Mycobacterium avium
PDSRARTW

SEQ ID NO: 141757 - protein, 4 aa, Mycobacterium avium
PDTA

SEQ ID NO: 141758 - protein, 8 aa, Mycobacterium avium
PDTVEQQL

SEQ ID NO: 141759 - protein, 5 aa, Mycobacterium avium
PDVPE

SEQ ID NO: 141760 - protein, 5 aa, Mycobacterium avium
PEAQW

SEQ ID NO: 141761 - protein, 8 aa, Mycobacterium avium
PEGAGATW

SEQ ID NO: 141762 - protein, 11 aa, Mycobacterium avium
PEIKPPTGGAP

SEQ ID NO: 141763 - protein, 6 aa, Mycobacterium avium
PEKDIA

SEQ ID NO: 141764 - protein, 5 aa, Mycobacterium avium
PEPET

SEQ ID NO: 141765 - protein, 13 aa, Mycobacterium avium
PERNADGTPGHSA

SEQ ID NO: 141766 - protein, 7 aa, Mycobacterium avium
PERSGNR

SEQ ID NO: 141767 - protein, 8 aa, Mycobacterium avium
PESRAKDL

SEQ ID NO: 141768 - protein, 4 aa, Mycobacterium avium
PEVG

SEQ ID NO: 141769 - protein, 19 aa, Mycobacterium avium
PFASPRRTTDPGGVTAQQA

SEQ ID NO: 141770 - protein, 11 aa, Mycobacterium avium
PFPGGPPRPGD

SEQ ID NO: 141771 - protein, 16 aa, Mycobacterium avium
PFTPPPDTTDEAGVAR

SEQ ID NO: 141772 - protein, 12 aa, Mycobacterium avium
PGAGPESVATAE

SEQ ID NO: 141773 - protein, 23 aa, Mycobacterium avium
PGARHGRSRRATRYHSRRSVTDM

SEQ ID NO: 141774 - protein, 12 aa, Mycobacterium avium
PGATTGGFGGAG

SEQ ID NO: 141775 - protein, 43 aa, Mycobacterium avium
PGCSHGAPRGAPAPAPARQSGIPAGPAAAPPGAVGLSPGGVTT

SEQ ID NO: 141776 - protein, 43 aa, Mycobacterium avium
PGCSHGAPRGAPTPAPARQTGIPAGPAAAPPGAVGLSPGGVTT

SEQ ID NO: 141777 - protein, 11 aa, Mycobacterium avium
PGDDYSGSGER

SEQ ID NO: 141778 - protein, 9 aa, Mycobacterium avium
PGDERRQSH

SEQ ID NO: 141779 - protein, 4 aa, Mycobacterium avium
PGFD

SEQ ID NO: 141780 - protein, 7 aa, Mycobacterium avium
PGFTATE

SEQ ID NO: 141781 - protein, 4 aa, Mycobacterium avium
PGGF

SEQ ID NO: 141782 - protein, 8 aa, Mycobacterium avium
PGGGRPGG

SEQ ID NO: 141783 - protein, 5 aa, Mycobacterium avium
PGGSF

SEQ ID NO: 141784 - protein, 7 aa, Mycobacterium avium
PGKLQTS

SEQ ID NO: 141785 - protein, 4 aa, Mycobacterium avium
PGLA

SEQ ID NO: 141786 - protein, 5 aa, Mycobacterium avium
PGLAA

SEQ ID NO: 141787 - protein, 6 aa, Mycobacterium avium
PGLKGE

SEQ ID NO: 141788 - protein, 10 aa, Mycobacterium avium
PGMPRDTPYS

SEQ ID NO: 141789 - protein, 9 aa, Mycobacterium avium
PGMRADDGR

SEQ ID NO: 141790 - protein, 44 aa, Mycobacterium avium
PGQLPQDRGERDDRGHRVDGPEQQRAARAVGRDVRRPAGVGGED

SEQ ID NO: 141791 - protein, 7 aa, Mycobacterium avium
PGRGGAD

SEQ ID NO: 141792 - protein, 4 aa, Mycobacterium avium
PGRT

SEQ ID NO: 141793 - protein, 4 aa, Mycobacterium avium
PGSF

SEQ ID NO: 141794 - protein, 11 aa, Mycobacterium avium
PGSNGEPTAQD

SEQ ID NO: 141795 - protein, 9 aa, Mycobacterium avium
PGTSLDPHG

SEQ ID NO: 141796 - protein, 6 aa, Mycobacterium avium
PGVPDE

SEQ ID NO: 141797 - protein, 17 aa, Mycobacterium avium
PGVTPIGPPGAVTVPDG

SEQ ID NO: 141798 - protein, 7 aa, Mycobacterium avium
PGVVDPA

SEQ ID NO: 141799 - protein, 41 aa, Mycobacterium avium
PGYTPPDGGPPPEAPAPPGQPAPADQPPAEPGPPPNPTSNS

SEQ ID NO: 141800 - protein, 41 aa, Mycobacterium avium
PGYTPPDSGPPPEAPAPPGQPAPADQPPAEPGPPPNPTSNS

SEQ ID NO: 141801 - protein, 41 aa, Mycobacterium avium
PGYTPSDGGPPPEAPAPPGQPAPADQPPAEPGPPPNPTSNS

SEQ ID NO: 141802 - protein, 7 aa, Mycobacterium avium
PHPPAGV

SEQ ID NO: 141803 - protein, 6 aa, Mycobacterium avium
PHRSPA

SEQ ID NO: 141804 - protein, 11 aa, Mycobacterium avium
PHSRGLGSSAA

SEQ ID NO: 141805 - protein, 10 aa, Mycobacterium avium
PIADEAEKAA

SEQ ID NO: 141806 - protein, 16 aa, Mycobacterium avium
PIAEDPRLTEAAQQHA

SEQ ID NO: 141807 - protein, 5 aa, Mycobacterium avium
PIPGT

SEQ ID NO: 141808 - protein, 7 aa, Mycobacterium avium
PIRPDGS

SEQ ID NO: 141809 - protein, 8 aa, Mycobacterium avium
PKTAETAA

SEQ ID NO: 141810 - protein, 6 aa, Mycobacterium avium
PKTDAV

SEQ ID NO: 141811 - protein, 15 aa, Mycobacterium avium
PKTESGKLNRPGLPR

SEQ ID NO: 141812 - protein, 4 aa, Mycobacterium avium
PLDD

SEQ ID NO: 141813 - protein, 13 aa, Mycobacterium avium
PLDENDVYEPGEP

SEQ ID NO: 141814 - protein, 13 aa, Mycobacterium avium
PLGPGQPGKAARR

SEQ ID NO: 141815 - protein, 5 aa, Mycobacterium avium
PLPEW

SEQ ID NO: 141816 - protein, 7 aa, Mycobacterium avium
PLPEWAE

SEQ ID NO: 141817 - protein, 15 aa, Mycobacterium avium
PLPEWAEASDSHYVR

SEQ ID NO: 141818 - protein, 6 aa, Mycobacterium avium
PLPNTG

SEQ ID NO: 141819 - protein, 13 aa, Mycobacterium avium
PLPPNARRIEDPD

SEQ ID NO: 141820 - protein, 7 aa, Mycobacterium avium
PLPPQAA

SEQ ID NO: 141821 - protein, 8 aa, Mycobacterium avium
PLPPQAAD

SEQ ID NO: 141822 - protein, 24 aa, Mycobacterium avium
PLPQDPPPPPPPPPGAPGQLPTAD

SEQ ID NO: 141823 - protein, 4 aa, Mycobacterium avium
PLQS

SEQ ID NO: 141824 - protein, 14 aa, Mycobacterium avium
PLSPDPGPPLTLQA

SEQ ID NO: 141825 - protein, 10 aa, Mycobacterium avium
PMTGPPPPLG

SEQ ID NO: 141826 - protein, 11 aa, Mycobacterium avium
PMTGPPPPLGD

SEQ ID NO: 141827 - protein, 5 aa, Mycobacterium avium
PNGAS

SEQ ID NO: 141828 - protein, 18 aa, Mycobacterium avium
PNGLSPAPIPQDTESTGT

SEQ ID NO: 141829 - protein, 5 aa, Mycobacterium avium
PNPGT

SEQ ID NO: 141830 - protein, 15 aa, Mycobacterium avium
PNPPAGGFSPGGHNP

SEQ ID NO: 141831 - protein, 4 aa, Mycobacterium avium
PNTA

SEQ ID NO: 141832 - protein, 8 aa, Mycobacterium avium
PNTETGPF

SEQ ID NO: 141833 - protein, 7 aa, Mycobacterium avium
PNTSPVT

SEQ ID NO: 141834 - protein, 16 aa, Mycobacterium avium
PPAGLGGGAASAGLGG

SEQ ID NO: 141835 - protein, 4 aa, Mycobacterium avium
PPAP

SEQ ID NO: 141836 - protein, 14 aa, Mycobacterium avium
PPAPPEPSPPPQPG

SEQ ID NO: 141837 - protein, 14 aa, Mycobacterium avium
PPAPPEPSPPSQPG

SEQ ID NO: 141838 - protein, 4 aa, Mycobacterium avium
PPAQ

SEQ ID NO: 141839 - protein, 9 aa, Mycobacterium avium
PPAQRRSAA

SEQ ID NO: 141840 - protein, 5 aa, Mycobacterium avium
PPAVS

SEQ ID NO: 141841 - protein, 6 aa, Mycobacterium avium
PPEITD

SEQ ID NO: 141842 - protein, 11 aa, Mycobacterium avium
PPESPSPQRLR

SEQ ID NO: 141843 - protein, 4 aa, Mycobacterium avium
PPEV

SEQ ID NO: 141844 - protein, 5 aa, Mycobacterium avium
PPGRS

SEQ ID NO: 141845 - protein, 10 aa, Mycobacterium avium
PPKDEKPEWA

SEQ ID NO: 141846 - protein, 10 aa, Mycobacterium avium
PPLASTTTDL

SEQ ID NO: 141847 - protein, 60 aa, Mycobacterium avium
PPPALPPPAPALPPPVPASPPPAPRARPPPVPRSRPPLPPLPPRRPSRPRPRPRAATTCP

SEQ ID NO: 141848 - protein, 6 aa, Mycobacterium avium
PPPAVA

SEQ ID NO: 141849 - protein, 9 aa, Mycobacterium avium
PPQPTPIPR

SEQ ID NO: 141850 - protein, 12 aa, Mycobacterium avium
PPQPVEDDDAFD

SEQ ID NO: 141851 - protein, 17 aa, Mycobacterium avium
PPRIQQAADQAAASGAA

SEQ ID NO: 141852 - protein, 16 aa, Mycobacterium avium
PPRPEPARGEDAGTLP

SEQ ID NO: 141853 - protein, 11 aa, Mycobacterium avium
PPRTGKSVQTS

SEQ ID NO: 141854 - protein, 6 aa, Mycobacterium avium
PPTPVP

SEQ ID NO: 141855 - protein, 14 aa, Mycobacterium avium
PPVPAEEVRDPVTA

SEQ ID NO: 141856 - protein, 7 aa, Mycobacterium avium
PQAFTDR

SEQ ID NO: 141857 - protein, 11 aa, Mycobacterium avium
PQARAKRRERM

SEQ ID NO: 141858 - protein, 5 aa, Mycobacterium avium
PQLPP

SEQ ID NO: 141859 - protein, 24 aa, Mycobacterium avium
PQPRTFAQTPAAAIPTSGPTAPQA

SEQ ID NO: 141860 - protein, 6 aa, Mycobacterium avium
PQVPPR

SEQ ID NO: 141861 - protein, 7 aa, Mycobacterium avium
PRAAAGV

SEQ ID NO: 141862 - protein, 9 aa, Mycobacterium avium
PRAAATDDR

SEQ ID NO: 141863 - protein, 20 aa, Mycobacterium avium
PRCSSPGSPRCSCWAPWPCW

SEQ ID NO: 141864 - protein, 4 aa, Mycobacterium avium
PRDD

SEQ ID NO: 141865 - protein, 5 aa, Mycobacterium avium
PRDSL

SEQ ID NO: 141866 - protein, 6 aa, Mycobacterium avium
PREFPD

SEQ ID NO: 141867 - protein, 11 aa, Mycobacterium avium
PRFSSASGTVE

SEQ ID NO: 141868 - protein, 31 aa, Mycobacterium avium
PRGADGTPEITGTNGSAGPLGSPVSDQSSVG

SEQ ID NO: 141869 - protein, 6 aa, Mycobacterium avium
PRGRAV

SEQ ID NO: 141870 - protein, 9 aa, Mycobacterium avium
PRHDAPDGI

SEQ ID NO: 141871 - protein, 13 aa, Mycobacterium avium
PRLDEADATGAGE

SEQ ID NO: 141872 - protein, 7 aa, Mycobacterium avium
PRNPAGK

SEQ ID NO: 141873 - protein, 14 aa, Mycobacterium avium
PRTPALSASPTGLG

SEQ ID NO: 141874 - protein, 9 aa, Mycobacterium avium
PRVDGERGS

SEQ ID NO: 141875 - protein, 6 aa, Mycobacterium avium
PRYGEH

SEQ ID NO: 141876 - protein, 8 aa, Mycobacterium avium
PSAAGAGT

SEQ ID NO: 141877 - protein, 15 aa, Mycobacterium avium
PSAAGAGTCWPSTSG

SEQ ID NO: 141878 - protein, 10 aa, Mycobacterium avium
PSARCDQPVK

SEQ ID NO: 141879 - protein, 12 aa, Mycobacterium avium
PSGGRVNATTDL

SEQ ID NO: 141880 - protein, 7 aa, Mycobacterium avium
PSGPISE

SEQ ID NO: 141881 - protein, 4 aa, Mycobacterium avium
PSGQ

SEQ ID NO: 141882 - protein, 9 aa, Mycobacterium avium
PSGQTTTPY

SEQ ID NO: 141883 - protein, 10 aa, Mycobacterium avium
PSGSGPAPIQ

SEQ ID NO: 141884 - protein, 6 aa, Mycobacterium avium
PSGTEP

SEQ ID NO: 141885 - protein, 5 aa, Mycobacterium avium
PSLPN

SEQ ID NO: 141886 - protein, 5 aa, Mycobacterium avium
PSLPP

SEQ ID NO: 141887 - protein, 10 aa, Mycobacterium avium
PSPLSSGSAK

SEQ ID NO: 141888 - protein, 8 aa, Mycobacterium avium
PSPSDWSP

SEQ ID NO: 141889 - protein, 93 aa, Mycobacterium avium
PSQVPVSAGGSSGEAASVGAHSPSSASSAAPHFESPGRPSEVPAPNGGAHGPGESGPPGGHPPGEPPHGGKPSGDGDGHGGPPDGKDPDGHHV

SEQ ID NO: 141890 - protein, 6 aa, Mycobacterium avium
PSRLRD

SEQ ID NO: 141891 - protein, 7 aa, Mycobacterium avium
PSRQRRH

SEQ ID NO: 141892 - protein, 7 aa, Mycobacterium avium
PSSPVSL

SEQ ID NO: 141893 - protein, 5 aa, Mycobacterium avium
PSTEA

SEQ ID NO: 141894 - protein, 5 aa, Mycobacterium avium
PSTGE

SEQ ID NO: 141895 - protein, 4 aa, Mycobacterium avium
PSTM

SEQ ID NO: 141896 - protein, 7 aa, Mycobacterium avium
PSTPTGV

SEQ ID NO: 141897 - protein, 7 aa, Mycobacterium avium
PSVTAGA

SEQ ID NO: 141898 - protein, 7 aa, Mycobacterium avium
PTAGMES

SEQ ID NO: 141899 - protein, 6 aa, Mycobacterium avium
PTANGW

SEQ ID NO: 141900 - protein, 4 aa, Mycobacterium avium
PTIP

SEQ ID NO: 141901 - protein, 10 aa, Mycobacterium avium
PTLPPPTPVG

SEQ ID NO: 141902 - protein, 4 aa, Mycobacterium avium
PTQD

SEQ ID NO: 141903 - protein, 10 aa, Mycobacterium avium
PTTHTLDGSE

SEQ ID NO: 141904 - protein, 8 aa, Mycobacterium avium
PTVQQPNS

SEQ ID NO: 141905 - protein, 9 aa, Mycobacterium avium
PVAAASAQS

SEQ ID NO: 141906 - protein, 21 aa, Mycobacterium avium
PVAEPTGGPHEPASVPAAGSR

SEQ ID NO: 141907 - protein, 11 aa, Mycobacterium avium
PVAGTNTGESL

SEQ ID NO: 141908 - protein, 23 aa, Mycobacterium avium
PVAPAPAPVAPAAPTAPAPAAAP

SEQ ID NO: 141909 - protein, 12 aa, Mycobacterium avium
PVETPHAAANPL

SEQ ID NO: 141910 - protein, 8 aa, Mycobacterium avium
PVGPRSVY

SEQ ID NO: 141911 - protein, 4 aa, Mycobacterium avium
PVHP

SEQ ID NO: 141912 - protein, 14 aa, Mycobacterium avium
PVKGAQEADSDAYR

SEQ ID NO: 141913 - protein, 9 aa, Mycobacterium avium
PVPAARTSI

SEQ ID NO: 141914 - protein, 7 aa, Mycobacterium avium
PVPDPDD

SEQ ID NO: 141915 - protein, 12 aa, Mycobacterium avium
PVPDPNTPTGSR

SEQ ID NO: 141916 - protein, 17 aa, Mycobacterium avium
PVPGPVPTSPANNDFKP

SEQ ID NO: 141917 - protein, 9 aa, Mycobacterium avium
PVPGQPPVL

SEQ ID NO: 141918 - protein, 8 aa, Mycobacterium avium
PVPPGRAP

SEQ ID NO: 141919 - protein, 26 aa, Mycobacterium avium
PVPTALSAATASGVTGFDTATDAVTG

SEQ ID NO: 141920 - protein, 32 aa, Mycobacterium avium
PVRATAKPCGPPRSAGAATTSRRGWTCWPAAG

SEQ ID NO: 141921 - protein, 5 aa, Mycobacterium avium
PVTNA

SEQ ID NO: 141922 - protein, 6 aa, Mycobacterium avium
PVTNAN

SEQ ID NO: 141923 - protein, 7 aa, Mycobacterium avium
PVYGGES

SEQ ID NO: 141924 - protein, 7 aa, Mycobacterium avium
PWQDDEG

SEQ ID NO: 141925 - protein, 6 aa, Mycobacterium avium
PYGGPR

SEQ ID NO: 141926 - protein, 11 aa, Mycobacterium avium
PYGPFTAGDGG

SEQ ID NO: 141927 - protein, 47 aa, Mycobacterium avium
PYQGTKSPTQVQATKDSKSYTVTGTGQATTPGQSGTRDVTFGIHVTC

SEQ ID NO: 141928 - protein, 15 aa, Mycobacterium avium
QAAAQRTADAITQHG

SEQ ID NO: 141929 - protein, 12 aa, Mycobacterium avium
QAADQAAASGAA

SEQ ID NO: 141930 - protein, 7 aa, Mycobacterium avium
QAAERAG

SEQ ID NO: 141931 - protein, 14 aa, Mycobacterium avium
QAAGGAVNGADTAG

SEQ ID NO: 141932 - protein, 14 aa, Mycobacterium avium
QAASAVGPAGTSYV

SEQ ID NO: 141933 - protein, 9 aa, Mycobacterium avium
QADGRGPAL

SEQ ID NO: 141934 - protein, 7 aa, Mycobacterium avium
QADPVAD

SEQ ID NO: 141935 - protein, 35 aa, Mycobacterium avium
QAGAGSSTLANASAVSATAGATAGAASSRAAEQQR

SEQ ID NO: 141936 - protein, 4 aa, Mycobacterium avium
QAGR

SEQ ID NO: 141937 - protein, 15 aa, Mycobacterium avium
QAPGHTGEPASGDLT

SEQ ID NO: 141938 - protein, 9 aa, Mycobacterium avium
QAQAHPGPF

SEQ ID NO: 141939 - protein, 9 aa, Mycobacterium avium
QAQGQAKAI

SEQ ID NO: 141940 - protein, 11 aa, Mycobacterium avium
QAQNGCPGEPH

SEQ ID NO: 141941 - protein, 13 aa, Mycobacterium avium
QARAAGAAFDPDR

SEQ ID NO: 141942 - protein, 10 aa, Mycobacterium avium
QARDRTTSGV

SEQ ID NO: 141943 - protein, 9 aa, Mycobacterium avium
QATKGRAPF

SEQ ID NO: 141944 - protein, 10 aa, Mycobacterium avium
QAYTPQQAVE

SEQ ID NO: 141945 - protein, 7 aa, Mycobacterium avium
QDENETA

SEQ ID NO: 141946 - protein, 11 aa, Mycobacterium avium
QDGGNLYGPGG

SEQ ID NO: 141947 - protein, 5 aa, Mycobacterium avium
QDNEG

SEQ ID NO: 141948 - protein, 5 aa, Mycobacterium avium
QDTDP

SEQ ID NO: 141949 - protein, 5 aa, Mycobacterium avium
QELGP

SEQ ID NO: 141950 - protein, 47 aa, Mycobacterium avium
QGASNYSAAEAASTLGGGSGALPAASAPADLAAPGPPGTWGKGGPPP

SEQ ID NO: 141951 - protein, 11 aa, Mycobacterium avium
QGGGATASAAE

SEQ ID NO: 141952 - protein, 7 aa, Mycobacterium avium
QGGQLTE

SEQ ID NO: 141953 - protein, 6 aa, Mycobacterium avium
QGGTAG

SEQ ID NO: 141954 - protein, 6 aa, Mycobacterium avium
QGLDTS

SEQ ID NO: 141955 - protein, 7 aa, Mycobacterium avium
QGLRPGR

SEQ ID NO: 141956 - protein, 16 aa, Mycobacterium avium
QGLSDGRPASSPERPP

SEQ ID NO: 141957 - protein, 31 aa, Mycobacterium avium
QGQSGEAAPAAGGPVAGGAPAAGGAVAAGAT

SEQ ID NO: 141958 - protein, 31 aa, Mycobacterium avium
QGQSGEVAPAAGGPVAGGAPAAGGAVAAGAT

SEQ ID NO: 141959 - protein, 9 aa, Mycobacterium avium
QGSDAAGHD

SEQ ID NO: 141960 - protein, 44 aa, Mycobacterium avium
QGTKPRCCPAPPAAAPTPSATASSAAANPPPAGAPRTASPAEVE

SEQ ID NO: 141961 - protein, 8 aa, Mycobacterium avium
QGTRESLE

SEQ ID NO: 141962 - protein, 8 aa, Mycobacterium avium
QGVADPRE

SEQ ID NO: 141963 - protein, 23 aa, Mycobacterium avium
QHAQPHRQQHRQQQHAEHQPHPH

SEQ ID NO: 141964 - protein, 7 aa, Mycobacterium avium
QHDAQAR

SEQ ID NO: 141965 - protein, 6 aa, Mycobacterium avium
QHDDYA

SEQ ID NO: 141966 - protein, 6 aa, Mycobacterium avium
QHPGED

SEQ ID NO: 141967 - protein, 14 aa, Mycobacterium avium
QHRATNDRNHAEEI

SEQ ID NO: 141968 - protein, 8 aa, Mycobacterium avium
QHSPGTYP

SEQ ID NO: 141969 - protein, 12 aa, Mycobacterium avium
QISAGAPGDPLA

SEQ ID NO: 141970 - protein, 6 aa, Mycobacterium avium
QKHSER

SEQ ID NO: 141971 - protein, 5 aa, Mycobacterium avium
QKSDI

SEQ ID NO: 141972 - protein, 5 aa, Mycobacterium avium
QLDPG

SEQ ID NO: 141973 - protein, 13 aa, Mycobacterium avium
QLGAGGISGPPVA

SEQ ID NO: 141974 - protein, 12 aa, Mycobacterium avium
QLGKGDPAKKMP

SEQ ID NO: 141975 - protein, 8 aa, Mycobacterium avium
QLPGPTAT

SEQ ID NO: 141976 - protein, 15 aa, Mycobacterium avium
QLPRGSTAELRTATP

SEQ ID NO: 141977 - protein, 6 aa, Mycobacterium avium
QNAPGV

SEQ ID NO: 141978 - protein, 6 aa, Mycobacterium avium
QNARPE

SEQ ID NO: 141979 - protein, 6 aa, Mycobacterium avium
QNTPAI

SEQ ID NO: 141980 - protein, 8 aa, Mycobacterium avium
QNTPAIAA

SEQ ID NO: 141981 - protein, 8 aa, Mycobacterium avium
QPANPVND

SEQ ID NO: 141982 - protein, 6 aa, Mycobacterium avium
QPARGR

SEQ ID NO: 141983 - protein, 17 aa, Mycobacterium avium
QPATCPDAKPSPPASYC

SEQ ID NO: 141984 - protein, 9 aa, Mycobacterium avium
QPAYQPPRA

SEQ ID NO: 141985 - protein, 9 aa, Mycobacterium avium
QPDNFGPYS

SEQ ID NO: 141986 - protein, 7 aa, Mycobacterium avium
QPETAAV

SEQ ID NO: 141987 - protein, 6 aa, Mycobacterium avium
QPHRPG

SEQ ID NO: 141988 - protein, 4 aa, Mycobacterium avium
QPNI

SEQ ID NO: 141989 - protein, 28 aa, Mycobacterium avium
QPPNNTVPAAPAAARPLPATETPTPLPL

SEQ ID NO: 141990 - protein, 6 aa, Mycobacterium avium
QPPPCN

SEQ ID NO: 141991 - protein, 11 aa, Mycobacterium avium
QPTAPGGTSTL

SEQ ID NO: 141992 - protein, 5 aa, Mycobacterium avium
QPTRG

SEQ ID NO: 141993 - protein, 6 aa, Mycobacterium avium
QPTRGR

SEQ ID NO: 141994 - protein, 13 aa, Mycobacterium avium
QQAADQAAASGAA

SEQ ID NO: 141995 - protein, 10 aa, Mycobacterium avium
QQAKNVSGAH

SEQ ID NO: 141996 - protein, 13 aa, Mycobacterium avium
QQFGRQPDSVTCP

SEQ ID NO: 141997 - protein, 8 aa, Mycobacterium avium
QQHQRGRY

SEQ ID NO: 141998 - protein, 11 aa, Mycobacterium avium
QQLPTQQSPLQ

SEQ ID NO: 141999 - protein, 5 aa, Mycobacterium avium
QQPDF

SEQ ID NO: 142000 - protein, 7 aa, Mycobacterium avium
QQVGDTS

SEQ ID NO: 142001 - protein, 5 aa, Mycobacterium avium
QRAEQ

SEQ ID NO: 142002 - protein, 13 aa, Mycobacterium avium
QRAERLGDPAHES

SEQ ID NO: 142003 - protein, 7 aa, Mycobacterium avium
QRARPRD

SEQ ID NO: 142004 - protein, 4 aa, Mycobacterium avium
QRIA

SEQ ID NO: 142005 - protein, 7 aa, Mycobacterium avium
QRLEPDE

SEQ ID NO: 142006 - protein, 16 aa, Mycobacterium avium
QRNPDAQSPAGGVSSS

SEQ ID NO: 142007 - protein, 5 aa, Mycobacterium avium
QRNSR

SEQ ID NO: 142008 - protein, 7 aa, Mycobacterium avium
QRRAGAE

SEQ ID NO: 142009 - protein, 8 aa, Mycobacterium avium
QRRDDIST

SEQ ID NO: 142010 - protein, 6 aa, Mycobacterium avium
QRTPPI

SEQ ID NO: 142011 - protein, 22 aa, Mycobacterium avium
QRTVGRPGRRLPRGRDRPRLPR

SEQ ID NO: 142012 - protein, 13 aa, Mycobacterium avium
QRVTAGDDDGGWP

SEQ ID NO: 142013 - protein, 7 aa, Mycobacterium avium
QSAARRE

SEQ ID NO: 142014 - protein, 12 aa, Mycobacterium avium
QSAHTASPEQQQ

SEQ ID NO: 142015 - protein, 6 aa, Mycobacterium avium
QSASKL

SEQ ID NO: 142016 - protein, 4 aa, Mycobacterium avium
QSDE

SEQ ID NO: 142017 - protein, 8 aa, Mycobacterium avium
QSGDVTNP

SEQ ID NO: 142018 - protein, 6 aa, Mycobacterium avium
QSGGLY

SEQ ID NO: 142019 - protein, 9 aa, Mycobacterium avium
QSGGNGSPA

SEQ ID NO: 142020 - protein, 5 aa, Mycobacterium avium
QSGIR

SEQ ID NO: 142021 - protein, 10 aa, Mycobacterium avium
QSGPATEASL

SEQ ID NO: 142022 - protein, 9 aa, Mycobacterium avium
QSHQADEQR

SEQ ID NO: 142023 - protein, 8 aa, Mycobacterium avium
QSNSDGTI

SEQ ID NO: 142024 - protein, 8 aa, Mycobacterium avium
QSNSGGTI

SEQ ID NO: 142025 - protein, 6 aa, Mycobacterium avium
QSSGGV

SEQ ID NO: 142026 - protein, 17 aa, Mycobacterium avium
QSTAPAAAPAATPTPAL

SEQ ID NO: 142027 - protein, 15 aa, Mycobacterium avium
QSTTSKDNPDPAMAS

SEQ ID NO: 142028 - protein, 6 aa, Mycobacterium avium
QSYDHS

SEQ ID NO: 142029 - protein, 4 aa, Mycobacterium avium
QTAR

SEQ ID NO: 142030 - protein, 12 aa, Mycobacterium avium
QTDDRGPEGGEG

SEQ ID NO: 142031 - protein, 6 aa, Mycobacterium avium
QTDRMS

SEQ ID NO: 142032 - protein, 5 aa, Mycobacterium avium
QTGLP

SEQ ID NO: 142033 - protein, 6 aa, Mycobacterium avium
QTGPFR

SEQ ID NO: 142034 - protein, 9 aa, Mycobacterium avium
QTGSPLSDL

SEQ ID NO: 142035 - protein, 4 aa, Mycobacterium avium
QTPE

SEQ ID NO: 142036 - protein, 5 aa, Mycobacterium avium
QTRDA

SEQ ID NO: 142037 - protein, 12 aa, Mycobacterium avium
QVDPSKGRCAFV

SEQ ID NO: 142038 - protein, 8 aa, Mycobacterium avium
QVDRSGPA

SEQ ID NO: 142039 - protein, 10 aa, Mycobacterium avium
QVSIDGETHR

SEQ ID NO: 142040 - protein, 7 aa, Mycobacterium avium
QWPPGTT

SEQ ID NO: 142041 - protein, 11 aa, Mycobacterium avium
RAAETRSENPL

SEQ ID NO: 142042 - protein, 48 aa, Mycobacterium avium
RAAHRRGARGVRADGRSDRRRAVAQRPPGGVGGDAAPRRPGHGGLVVD

SEQ ID NO: 142043 - protein, 5 aa, Mycobacterium avium
RAAPA

SEQ ID NO: 142044 - protein, 10 aa, Mycobacterium avium
RAARSTELAD

SEQ ID NO: 142045 - protein, 9 aa, Mycobacterium avium
RAARTADAT

SEQ ID NO: 142046 - protein, 6 aa, Mycobacterium avium
RADGYM

SEQ ID NO: 142047 - protein, 36 aa, Mycobacterium avium; identical to SEQ ID NO: 6329

SEQ ID NO: 142048 - protein, 15 aa, Mycobacterium avium
RAEPGDTGWDEHADD

SEQ ID NO: 142049 - protein, 8 aa, Mycobacterium avium
RAGARGIR

SEQ ID NO: 142050 - protein, 4 aa, Mycobacterium avium
RAGD

SEQ ID NO: 142051 - protein, 6 aa, Mycobacterium avium
RAGDTT

SEQ ID NO: 142052 - protein, 7 aa, Mycobacterium avium
RAGESVS

SEQ ID NO: 142053 - protein, 6 aa, Mycobacterium avium
RAGNGE

SEQ ID NO: 142054 - protein, 7 aa, Mycobacterium avium
RAKDLRS

SEQ ID NO: 142055 - protein, 11 aa, Mycobacterium avium
RANAGRPPGDF

SEQ ID NO: 142056 - protein, 16 aa, Mycobacterium avium
RANGNQLGDPAKAATA

SEQ ID NO: 142057 - protein, 6 aa, Mycobacterium avium
RAPAAA

SEQ ID NO: 142058 - protein, 6 aa, Mycobacterium avium
RAPGGA

SEQ ID NO: 142059 - protein, 23 aa, Mycobacterium avium
RAPLEQPAPAGAAAWRTGPDSEP

SEQ ID NO: 142060 - protein, 4 aa, Mycobacterium avium
RAPR

SEQ ID NO: 142061 - protein, 12 aa, Mycobacterium avium
RAQAAANAAAAR

SEQ ID NO: 142062 - protein, 8 aa, Mycobacterium avium
RARGQPAA

SEQ ID NO: 142063 - protein, 12 aa, Mycobacterium avium
RASGTISDRPAG

SEQ ID NO: 142064 - protein, 38 aa, Mycobacterium avium
RASQAMPAAGTGTPLAPPPPAPGPPRDPAPPAAAAPTM

SEQ ID NO: 142065 - protein, 8 aa, Mycobacterium avium
RATGAAKK

SEQ ID NO: 142066 - protein, 7 aa, Mycobacterium avium
RATTSFE

SEQ ID NO: 142067 - protein, 9 aa, Mycobacterium avium
RAYQDAESA

SEQ ID NO: 142068 - protein, 8 aa, Mycobacterium avium
RCSAPTGV

SEQ ID NO: 142069 - protein, 12 aa, Mycobacterium avium
RDAGGTDKVVWK

SEQ ID NO: 142070 - protein, 10 aa, Mycobacterium avium
RDAGKGIAGT

SEQ ID NO: 142071 - protein, 5 aa, Mycobacterium avium
RDAVD

SEQ ID NO: 142072 - protein, 7 aa, Mycobacterium avium
RDDYSGD

SEQ ID NO: 142073 - protein, 15 aa, Mycobacterium avium
RDESGRVLGPGEPGE

SEQ ID NO: 142074 - protein, 10 aa, Mycobacterium avium
RDFKTNDGYQ

SEQ ID NO: 142075 - protein, 19 aa, Mycobacterium avium
RDGLSEGPGVPMMPSTWDR

SEQ ID NO: 142076 - protein, 7 aa, Mycobacterium avium
RDHPDPD

SEQ ID NO: 142077 - protein, 17 aa, Mycobacterium avium
RDNNPALTTNGAAQFAS

SEQ ID NO: 142078 - protein, 8 aa, Mycobacterium avium
RDPAGAAQ

SEQ ID NO: 142079 - protein, 8 aa, Mycobacterium avium
RDPAGAAR

SEQ ID NO: 142080 - protein, 8 aa, Mycobacterium avium
RDPARAAQ

SEQ ID NO: 142081 - protein, 6 aa, Mycobacterium avium
RDPDRM

SEQ ID NO: 142082 - protein, 8 aa, Mycobacterium avium
RDPRASGE

SEQ ID NO: 142083 - protein, 8 aa, Mycobacterium avium
RDREGTGM

SEQ ID NO: 142084 - protein, 6 aa, Mycobacterium avium
RDRGQV

SEQ ID NO: 142085 - protein, 8 aa, Mycobacterium avium
RDSWPATA

SEQ ID NO: 142086 - protein, 9 aa, Mycobacterium avium
RDTGEREEL

SEQ ID NO: 142087 - protein, 9 aa, Mycobacterium avium
RDTGRTATV

SEQ ID NO: 142088 - protein, 14 aa, Mycobacterium avium
REAPDRHRVDEQSL

SEQ ID NO: 142089 - protein, 8 aa, Mycobacterium avium
RETASQAL

SEQ ID NO: 142090 - protein, 5 aa, Mycobacterium avium
RGAGG

SEQ ID NO: 142091 - protein, 4 aa, Mycobacterium avium
RGDG

SEQ ID NO: 142092 - protein, 7 aa, Mycobacterium avium
RGDIGGL

SEQ ID NO: 142093 - protein, 13 aa, Mycobacterium avium
RGEPHAPRDDEPL

SEQ ID NO: 142094 - protein, 10 aa, Mycobacterium avium
RGGPQRPEIS

SEQ ID NO: 142095 - protein, 5 aa, Mycobacterium avium
RGLEQ

SEQ ID NO: 142096 - protein, 5 aa, Mycobacterium avium
RGPLQ

SEQ ID NO: 142097 - protein, 11 aa, Mycobacterium avium
RGPRVGDPADV

SEQ ID NO: 142098 - protein, 12 aa, Mycobacterium avium
RGQTGDWDAAGR

SEQ ID NO: 142099 - protein, 8 aa, Mycobacterium avium
RGQVAGSP

SEQ ID NO: 142100 - protein, 11 aa, Mycobacterium avium
RGRRSASQSGC

SEQ ID NO: 142101 - protein, 8 aa, Mycobacterium avium
RGSRTPDR

SEQ ID NO: 142102 - protein, 10 aa, Mycobacterium avium
RGTSGVEEGR

SEQ ID NO: 142103 - protein, 14 aa, Mycobacterium avium
RGYATNREESEEGV

SEQ ID NO: 142104 - protein, 6 aa, Mycobacterium avium
RHPPKA

SEQ ID NO: 142105 - protein, 4 aa, Mycobacterium avium
RHPR

SEQ ID NO: 142106 - protein, 33 aa, Mycobacterium avium
RHRRGSARRGRAAGPRRGRRSLPALSAGRPDGR

SEQ ID NO: 142107 - protein, 22 aa, Mycobacterium avium
RHRSETAPVGPASPPGNRIAVR

SEQ ID NO: 142108 - protein, 22 aa, Mycobacterium avium
RHVGGRTGQRVDPDPLGGGGIA

SEQ ID NO: 142109 - protein, 5 aa, Mycobacterium avium
RIDSY

SEQ ID NO: 142110 - protein, 7 aa, Mycobacterium avium
RINDGGA

SEQ ID NO: 142111 - protein, 5 aa, Mycobacterium avium
RIPAD

SEQ ID NO: 142112 - protein, 4 aa, Mycobacterium avium
RIPV

SEQ ID NO: 142113 - protein, 10 aa, Mycobacterium avium
RKAAAAAARP

SEQ ID NO: 142114 - protein, 9 aa, Mycobacterium avium
RKDGSGTLV

SEQ ID NO: 142115 - protein, 7 aa, Mycobacterium avium
RKEFGPA

SEQ ID NO: 142116 - protein, 4 aa, Mycobacterium avium
RKGL

SEQ ID NO: 142117 - protein, 4 aa, Mycobacterium avium
RLAA

SEQ ID NO: 142118 - protein, 7 aa, Mycobacterium avium
RLAGQRD

SEQ ID NO: 142119 - protein, 7 aa, Mycobacterium avium
RLDEGRL

SEQ ID NO: 142120 - protein, 12 aa, Mycobacterium avium
RLDQNGRPLPPE

SEQ ID NO: 142121 - protein, 13 aa, Mycobacterium avium
RLGHPAQANEAIA

SEQ ID NO: 142122 - protein, 9 aa, Mycobacterium avium
RLQEQGEEI

SEQ ID NO: 142123 - protein, 13 aa, Mycobacterium avium
RLSPRAAQRRQRI

SEQ ID NO: 142124 - protein, 14 aa, Mycobacterium avium
RLSPRAAQRRQRIS

SEQ ID NO: 142125 - protein, 7 aa, Mycobacterium avium
RLTQRGS

SEQ ID NO: 142126 - protein, 13 aa, Mycobacterium avium
RMPPPDASQAQLR

SEQ ID NO: 142127 - protein, 5 aa, Mycobacterium avium
RNALR

SEQ ID NO: 142128 - protein, 14 aa, Mycobacterium avium
RNGNRGPGASPQGV

SEQ ID NO: 142129 - protein, 5 aa, Mycobacterium avium
RNPYS

SEQ ID NO: 142130 - protein, 8 aa, Mycobacterium avium
RPADRRPV

SEQ ID NO: 142131 - protein, 9 aa, Mycobacterium avium
RPDAPPGTV

SEQ ID NO: 142132 - protein, 9 aa, Mycobacterium avium
RPDNSPQRF

SEQ ID NO: 142133 - protein, 9 aa, Mycobacterium avium
RPEFPTPVG

SEQ ID NO: 142134 - protein, 13 aa, Mycobacterium avium
RPEHRARQHQAEQ

SEQ ID NO: 142135 - protein, 4 aa, Mycobacterium avium
RPEP

SEQ ID NO: 142136 - protein, 14 aa, Mycobacterium avium
RPGHPGCRASPAGG

SEQ ID NO: 142137 - protein, 9 aa, Mycobacterium avium
RPGSGREAT

SEQ ID NO: 142138 - protein, 8 aa, Mycobacterium avium
RPGVTAEQ

SEQ ID NO: 142139 - protein, 45 aa, Mycobacterium avium; identical to SEQ ID NO: 6450

SEQ ID NO: 142140 - protein, 9 aa, Mycobacterium avium
RPPGQTKPL

SEQ ID NO: 142141 - protein, 4 aa, Mycobacterium avium
RPQT

SEQ ID NO: 142142 - protein, 6 aa, Mycobacterium avium
RPRARG

SEQ ID NO: 142143 - protein, 25 aa, Mycobacterium avium
RPSPRQCPRRRGRVSAADRRFTRAF

SEQ ID NO: 142144 - protein, 13 aa, Mycobacterium avium
RPTASDPTLAPRG

SEQ ID NO: 142145 - protein, 5 aa, Mycobacterium avium
RPTDP

SEQ ID NO: 142146 - protein, 32 aa, Mycobacterium avium
RPVNGAAAQPPPAPAPPPEPHRSGQTPFDADA

SEQ ID NO: 142147 - protein, 14 aa, Mycobacterium avium
RPVSTTGESGNQNT

SEQ ID NO: 142148 - protein, 9 aa, Mycobacterium avium
RQAGRRTAA

SEQ ID NO: 142149 - protein, 5 aa, Mycobacterium avium
RQEPR

SEQ ID NO: 142150 - protein, 9 aa, Mycobacterium avium
RQGGGPARQ

SEQ ID NO: 142151 - protein, 37 aa, Mycobacterium avium
RQGHRRRAHRARRRGDHEHRQPLQDPDRRGGQRALGV

SEQ ID NO: 142152 - protein, 12 aa, Mycobacterium avium
RQPAGPATQATE

SEQ ID NO: 142153 - protein, 6 aa, Mycobacterium avium
RQRDDL

SEQ ID NO: 142154 - protein, 8 aa, Mycobacterium avium
RQRPNDSI

SEQ ID NO: 142155 - protein, 8 aa, Mycobacterium avium
RQRPRGEA

SEQ ID NO: 142156 - protein, 10 aa, Mycobacterium avium
RQRRPGSDPF

SEQ ID NO: 142157 - protein, 13 aa, Mycobacterium avium
RQRRPVVSSPDRV

SEQ ID NO: 142158 - protein, 12 aa, Mycobacterium avium
RQSAAKLSPAGV

SEQ ID NO: 142159 - protein, 13 aa, Mycobacterium avium
RQSAAKLSPAGVE

SEQ ID NO: 142160 - protein, 8 aa, Mycobacterium avium
RQTGRDRL

SEQ ID NO: 142161 - protein, 8 aa, Mycobacterium avium
RRAPRGDE

SEQ ID NO: 142162 - protein, 60 aa, Mycobacterium avium
RRARPAPSTGSSARTASSTPATSRPSALAHPSPSAVAARTPPPPRPSRRARRRRLHLRAR

SEQ ID NO: 142163 - protein, 10 aa, Mycobacterium avium
RRDENDGSFT

SEQ ID NO: 142164 - protein, 6 aa, Mycobacterium avium
RRDGLP

SEQ ID NO: 142165 - protein, 5 aa, Mycobacterium avium
RRHAR

SEQ ID NO: 142166 - protein, 4 aa, Mycobacterium avium
RRHR

SEQ ID NO: 142167 - protein, 9 aa, Mycobacterium avium
RRLGETADQ

SEQ ID NO: 142168 - protein, 8 aa, Mycobacterium avium
RRNGDKLS

SEQ ID NO: 142169 - protein, 7 aa, Mycobacterium avium
RRPATGN

SEQ ID NO: 142170 - protein, 4 aa, Mycobacterium avium
RRRA

SEQ ID NO: 142171 - protein, 7 aa, Mycobacterium avium
RRRRPDA

SEQ ID NO: 142172 - protein, 12 aa, Mycobacterium avium
RRRRRPDRQRPG

SEQ ID NO: 142173 - protein, 16 aa, Mycobacterium avium
RRSDARGPAARPAGTS

SEQ ID NO: 142174 - protein, 18 aa, Mycobacterium avium
RRVGPQPAAAGRRHPGHR

SEQ ID NO: 142175 - protein, 6 aa, Mycobacterium avium
RRVQRS

SEQ ID NO: 142176 - protein, 7 aa, Mycobacterium avium
RRYDGDE

SEQ ID NO: 142177 - protein, 26 aa, Mycobacterium avium
RSAAGRGLGGHEVGTGGGPGRRGGPQ

SEQ ID NO: 142178 - protein, 9 aa, Mycobacterium avium
RSANRSTTK

SEQ ID NO: 142179 - protein, 9 aa, Mycobacterium avium
RSDGSAKLV

SEQ ID NO: 142180 - protein, 10 aa, Mycobacterium avium
RSDGSAKLVT

SEQ ID NO: 142181 - protein, 14 aa, Mycobacterium avium
RSDGSAKLVTTSNA

SEQ ID NO: 142182 - protein, 14 aa, Mycobacterium avium
RSFGADPAKVTEYA

SEQ ID NO: 142183 - protein, 7 aa, Mycobacterium avium
RSGGAER

SEQ ID NO: 142184 - protein, 8 aa, Mycobacterium avium
RSGPKLSG

SEQ ID NO: 142185 - protein, 10 aa, Mycobacterium avium
RSGSTTISTG

SEQ ID NO: 142186 - protein, 18 aa, Mycobacterium avium
RSPSGKADYRWAREQAVN

SEQ ID NO: 142187 - protein, 8 aa, Mycobacterium avium
RSQAGARS

SEQ ID NO: 142188 - protein, 8 aa, Mycobacterium avium
RSRDPSDL

SEQ ID NO: 142189 - protein, 10 aa, Mycobacterium avium
RSRPPAAAHP

SEQ ID NO: 142190 - protein, 16 aa, Mycobacterium avium
RSRPRSPGRACSTTPR

SEQ ID NO: 142191 - protein, 15 aa, Mycobacterium avium
RSRRGGGGLDADRGR

SEQ ID NO: 142192 - protein, 10 aa, Mycobacterium avium
RSSAAARGLT

SEQ ID NO: 142193 - protein, 9 aa, Mycobacterium avium
RSSGEDSGA

SEQ ID NO: 142194 - protein, 7 aa, Mycobacterium avium
RSSGGTM

SEQ ID NO: 142195 - protein, 10 aa, Mycobacterium avium
RSSPSSAGSL

SEQ ID NO: 142196 - protein, 6 aa, Mycobacterium avium
RSTTIA

SEQ ID NO: 142197 - protein, 8 aa, Mycobacterium avium
RTDPSHPV

SEQ ID NO: 142198 - protein, 8 aa, Mycobacterium avium
RTDSSHPV

SEQ ID NO: 142199 - protein, 6 aa, Mycobacterium avium
RTEADV

SEQ ID NO: 142200 - protein, 4 aa, Mycobacterium avium
RTEP

SEQ ID NO: 142201 - protein, 10 aa, Mycobacterium avium
RTGSAGTATA

SEQ ID NO: 142202 - protein, 11 aa, Mycobacterium avium
RTKDQAGEMSE

SEQ ID NO: 142203 - protein, 14 aa, Mycobacterium avium
RTKRDAPGLDTSGL

SEQ ID NO: 142204 - protein, 9 aa, Mycobacterium avium
RTLDRRDEA

SEQ ID NO: 142205 - protein, 5 aa, Mycobacterium avium
RTPAG

SEQ ID NO: 142206 - protein, 7 aa, Mycobacterium avium
RTPAPTM

SEQ ID NO: 142207 - protein, 5 aa, Mycobacterium avium
RTPKA

SEQ ID NO: 142208 - protein, 5 aa, Mycobacterium avium
RTPRR

SEQ ID NO: 142209 - protein, 7 aa, Mycobacterium avium
RTRTTQE

SEQ ID NO: 142210 - protein, 6 aa, Mycobacterium avium
RTTGVG

SEQ ID NO: 142211 - protein, 6 aa, Mycobacterium avium
RTTRIS

SEQ ID NO: 142212 - protein, 17 aa, Mycobacterium avium
RTTRRANGNSASPIGIP

SEQ ID NO: 142213 - protein, 12 aa, Mycobacterium avium
RTTTPGPVSDYT

SEQ ID NO: 142214 - protein, 7 aa, Mycobacterium avium
RTTTPYT

SEQ ID NO: 142215 - protein, 7 aa, Mycobacterium avium
RVERDAA

SEQ ID NO: 142216 - protein, 8 aa, Mycobacterium avium
RVGRPGAV

SEQ ID NO: 142217 - protein, 8 aa, Mycobacterium avium
RVRTPTTT

SEQ ID NO: 142218 - protein, 13 aa, Mycobacterium avium
RVTGPPPQALPGQ

SEQ ID NO: 142219 - protein, 10 aa, Mycobacterium avium
RVTGPPPQVL

SEQ ID NO: 142220 - protein, 8 aa, Mycobacterium avium
RVTGRGAG

SEQ ID NO: 142221 - protein, 6 aa, Mycobacterium avium
RYHPDT

SEQ ID NO: 142222 - protein, 6 aa, Mycobacterium avium
RYKPNA

SEQ ID NO: 142223 - protein, 16 aa, Mycobacterium avium
RYPPEDFTGQAGGAAP

SEQ ID NO: 142224 - protein, 9 aa, Mycobacterium avium
SAAANAGGF

SEQ ID NO: 142225 - protein, 7 aa, Mycobacterium avium
SAAATPL

SEQ ID NO: 142226 - protein, 13 aa, Mycobacterium avium
SAAPEAAGGPGNL

SEQ ID NO: 142227 - protein, 10 aa, Mycobacterium avium
SAASTRGLQP

SEQ ID NO: 142228 - protein, 8 aa, Mycobacterium avium
SAATPSEA

SEQ ID NO: 142229 - protein, 9 aa, Mycobacterium avium
SADAPPLKN

SEQ ID NO: 142230 - protein, 6 aa, Mycobacterium avium
SAEGQQ

SEQ ID NO: 142231 - protein, 13 aa, Mycobacterium avium
SAESGVPTFRDDK

SEQ ID NO: 142232 - protein, 5 aa, Mycobacterium avium
SAFSA

SEQ ID NO: 142233 - protein, 11 aa, Mycobacterium avium
SAGAYPSTERT

SEQ ID NO: 142234 - protein, 37 aa, Mycobacterium avium
SAGGQRDRGAGGVGRPRRAGPAAGRDRPGAVGRPAHA

SEQ ID NO: 142235 - protein, 8 aa, Mycobacterium avium
SAGKTPTA

SEQ ID NO: 142236 - protein, 6 aa, Mycobacterium avium
SAGLGT

SEQ ID NO: 142237 - protein, 7 aa, Mycobacterium avium
SAGLKGH

SEQ ID NO: 142238 - protein, 6 aa, Mycobacterium avium
SAGMGR

SEQ ID NO: 142239 - protein, 7 aa, Mycobacterium avium
SAGQGGK

SEQ ID NO: 142240 - protein, 7 aa, Mycobacterium avium
SAHGINA

SEQ ID NO: 142241 - protein, 5 aa, Mycobacterium avium
SAKQI

SEQ ID NO: 142242 - protein, 6 aa, Mycobacterium avium
SALPPE

SEQ ID NO: 142243 - protein, 10 aa, Mycobacterium avium
SALRAQAAGQ

SEQ ID NO: 142244 - protein, 13 aa, Mycobacterium avium
SANAAASRPRRRP

SEQ ID NO: 142245 - protein, 8 aa, Mycobacterium avium
SANGGNAQ

SEQ ID NO: 142246 - protein, 35 aa, Mycobacterium avium
SANNSTNESGVTAQNAAVSAANANAAANKAVTQSF

SEQ ID NO: 142247 - protein, 12 aa, Mycobacterium avium
SAPADGERNPLR

SEQ ID NO: 142248 - protein, 7 aa, Mycobacterium avium
SAPPALA

SEQ ID NO: 142249 - protein, 9 aa, Mycobacterium avium
SAPPQTPWP

SEQ ID NO: 142250 - protein, 5 aa, Mycobacterium avium
SAPRA

SEQ ID NO: 142251 - protein, 29 aa, Mycobacterium avium
SAPRPAAGGGTPSTQTPVTAPPAAAGPNQ

SEQ ID NO: 142252 - protein, 7 aa, Mycobacterium avium
SAQPGLS

SEQ ID NO: 142253 - protein, 6 aa, Mycobacterium avium
SARLSG

SEQ ID NO: 142254 - protein, 18 aa, Mycobacterium avium
SARMRSSRRSAGSTPPMA

SEQ ID NO: 142255 - protein, 7 aa, Mycobacterium avium
SARSRGP

SEQ ID NO: 142256 - protein, 9 aa, Mycobacterium avium
SASPYVPHS

SEQ ID NO: 142257 - protein, 11 aa, Mycobacterium avium
SASSAAAAQFS

SEQ ID NO: 142258 - protein, 15 aa, Mycobacterium avium
SASTRAMPAPTPFPA

SEQ ID NO: 142259 - protein, 7 aa, Mycobacterium avium
SATGPSL

SEQ ID NO: 142260 - protein, 13 aa, Mycobacterium avium
SATGPSLPVRTPP

SEQ ID NO: 142261 - protein, 11 aa, Mycobacterium avium
SATPSGVSERQ

SEQ ID NO: 142262 - protein, 24 aa, Mycobacterium avium
SAVDSAVGSAVGSAVGSAVGSAVD

SEQ ID NO: 142263 - protein, 8 aa, Mycobacterium avium
SAVDSAVR

SEQ ID NO: 142264 - protein, 5 aa, Mycobacterium avium
SAVPD

SEQ ID NO: 142265 - protein, 6 aa, Mycobacterium avium
SCPPGR

SEQ ID NO: 142266 - protein, 11 aa, Mycobacterium avium
SDAADRALTDA

SEQ ID NO: 142267 - protein, 13 aa, Mycobacterium avium
SDAADRALTDTRA

SEQ ID NO: 142268 - protein, 7 aa, Mycobacterium avium
SDERDDV

SEQ ID NO: 142269 - protein, 6 aa, Mycobacterium avium
SDGGAA

SEQ ID NO: 142270 - protein, 11 aa, Mycobacterium avium
SDGRSVTPVDQ

SEQ ID NO: 142271 - protein, 7 aa, Mycobacterium avium
SDGRTAP

SEQ ID NO: 142272 - protein, 6 aa, Mycobacterium avium
SDLSGK

SEQ ID NO: 142273 - protein, 5 aa, Mycobacterium avium
SDMTE

SEQ ID NO: 142274 - protein, 5 aa, Mycobacterium avium
SDNGG

SEQ ID NO: 142275 - protein, 4 aa, Mycobacterium avium
SDNM

SEQ ID NO: 142276 - protein, 19 aa, Mycobacterium avium
SDPAGGGSRTLPVTLGKAD

SEQ ID NO: 142277 - protein, 11 aa, Mycobacterium avium
SDPALAGQPAP

SEQ ID NO: 142278 - protein, 10 aa, Mycobacterium avium
SDPALAGQQA

SEQ ID NO: 142279 - protein, 6 aa, Mycobacterium avium
SDQRSV

SEQ ID NO: 142280 - protein, 7 aa, Mycobacterium avium
SDQSSVG

SEQ ID NO: 142281 - protein, 8 aa, Mycobacterium avium
SDVTPNDE

SEQ ID NO: 142282 - protein, 7 aa, Mycobacterium avium
SEAESRA

SEQ ID NO: 142283 - protein, 4 aa, Mycobacterium avium
SEED

SEQ ID NO: 142284 - protein, 6 aa, Mycobacterium avium
SELDGH

SEQ ID NO: 142285 - protein, 6 aa, Mycobacterium avium
SENPDN

SEQ ID NO: 142286 - protein, 5 aa, Mycobacterium avium
SEPGP

SEQ ID NO: 142287 - protein, 12 aa, Mycobacterium avium
SEPSREAFERQT

SEQ ID NO: 142288 - protein, 16 aa, Mycobacterium avium
SERGGPAAAQAGRDLD

SEQ ID NO: 142289 - protein, 7 aa, Mycobacterium avium
SERTGTG

SEQ ID NO: 142290 - protein, 5 aa, Mycobacterium avium
SEVSG

SEQ ID NO: 142291 - protein, 15 aa, Mycobacterium avium
SEVYGDPESHPQRES

SEQ ID NO: 142292 - protein, 5 aa, Mycobacterium avium
SGAEI

SEQ ID NO: 142293 - protein, 8 aa, Mycobacterium avium
SGAFADPD

SEQ ID NO: 142294 - protein, 4 aa, Mycobacterium avium
SGAG

SEQ ID NO: 142295 - protein, 8 aa, Mycobacterium avium
SGAPIPPA

SEQ ID NO: 142296 - protein, 8 aa, Mycobacterium avium
SGAPRNDP

SEQ ID NO: 142297 - protein, 11 aa, Mycobacterium avium
SGFDPAKPSAW

SEQ ID NO: 142298 - protein, 21 aa, Mycobacterium avium
SGFTTELTQASSAVGPAGTNY

SEQ ID NO: 142299 - protein, 6 aa, Mycobacterium avium
SGGEQK

SEQ ID NO: 142300 - protein, 4 aa, Mycobacterium avium
SGGF

SEQ ID NO: 142301 - protein, 21 aa, Mycobacterium avium
SGHRHTASTGPTGPPVRGGTL

SEQ ID NO: 142302 - protein, 4 aa, Mycobacterium avium
SGLG

SEQ ID NO: 142303 - protein, 7 aa, Mycobacterium avium
SGLPEGL

SEQ ID NO: 142304 - protein, 8 aa, Mycobacterium avium
SGLPNKTD

SEQ ID NO: 142305 - protein, 9 aa, Mycobacterium avium
SGLPRPQTQ

SEQ ID NO: 142306 - protein, 7 aa, Mycobacterium avium
SGLRPED

SEQ ID NO: 142307 - protein, 6 aa, Mycobacterium avium
SGNPIR

SEQ ID NO: 142308 - protein, 7 aa, Mycobacterium avium
SGPAGTL

SEQ ID NO: 142309 - protein, 6 aa, Mycobacterium avium
SGPATG

SEQ ID NO: 142310 - protein, 6 aa, Mycobacterium avium
SGPYTP

SEQ ID NO: 142311 - protein, 5 aa, Mycobacterium avium
SGSVI

SEQ ID NO: 142312 - protein, 6 aa, Mycobacterium avium
SGTGSL

SEQ ID NO: 142313 - protein, 8 aa, Mycobacterium avium
SGTQSERA

SEQ ID NO: 142314 - protein, 10 aa, Mycobacterium avium
SGTTGRPKGA

SEQ ID NO: 142315 - protein, 8 aa, Mycobacterium avium
SGTTGVPK

SEQ ID NO: 142316 - protein, 10 aa, Mycobacterium avium
SGTTSKPKAV

SEQ ID NO: 142317 - protein, 24 aa, Mycobacterium avium
SGTTTAYPLPHPGDRPAPKPVTLP

SEQ ID NO: 142318 - protein, 14 aa, Mycobacterium avium
SHADHPAPPANAPV

SEQ ID NO: 142319 - protein, 8 aa, Mycobacterium avium
SHGEREPA

SEQ ID NO: 142320 - protein, 13 aa, Mycobacterium avium
SHNPTAPTESKNV

SEQ ID NO: 142321 - protein, 28 aa, Mycobacterium avium
SHRGDGESEQPQGREVRPNRSQREEELS

SEQ ID NO: 142322 - protein, 12 aa, Mycobacterium avium
SHTAGGDEPPRE

SEQ ID NO: 142323 - protein, 24 aa, Mycobacterium avium
SIAGNAVKAGGNVTRNNNSQQQYP

SEQ ID NO: 142324 - protein, 6 aa, Mycobacterium avium
SIEPNQ

SEQ ID NO: 142325 - protein, 5 aa, Mycobacterium avium
SIGQK

SEQ ID NO: 142326 - protein, 6 aa, Mycobacterium avium
SINAGG

SEQ ID NO: 142327 - protein, 6 aa, Mycobacterium avium
SIPATS

SEQ ID NO: 142328 - protein, 5 aa, Mycobacterium avium
SIPGP

SEQ ID NO: 142329 - protein, 18 aa, Mycobacterium avium
SIPTPKIKSGSANPSPKL

SEQ ID NO: 142330 - protein, 6 aa, Mycobacterium avium
SITPDL

SEQ ID NO: 142331 - protein, 8 aa, Mycobacterium avium
SKAPGDKI

SEQ ID NO: 142332 - protein, 14 aa, Mycobacterium avium
SKDGPKGVLCSIRP

SEQ ID NO: 142333 - protein, 6 aa, Mycobacterium avium
SKMTPR

SEQ ID NO: 142334 - protein, 6 aa, Mycobacterium avium
SKNPDN

SEQ ID NO: 142335 - protein, 7 aa, Mycobacterium avium
SKNPDNW

SEQ ID NO: 142336 - protein, 5 aa, Mycobacterium avium
SKPIL

SEQ ID NO: 142337 - protein, 14 aa, Mycobacterium avium
SKPNRRPLRRATSA

SEQ ID NO: 142338 - protein, 9 aa, Mycobacterium avium
SKTGARYSY

SEQ ID NO: 142339 - protein, 10 aa, Mycobacterium avium
SKTGARYSYQ

SEQ ID NO: 142340 - protein, 28 aa, Mycobacterium avium
SLAQPASSSTTATKAATTAASTTSTDPL

SEQ ID NO: 142341 - protein, 8 aa, Mycobacterium avium
SLDGTLPG

SEQ ID NO: 142342 - protein, 7 aa, Mycobacterium avium
SLEGGKQ

SEQ ID NO: 142343 - protein, 5 aa, Mycobacterium avium
SLGDN

SEQ ID NO: 142344 - protein, 8 aa, Mycobacterium avium
SLGGEQSG

SEQ ID NO: 142345 - protein, 10 aa, Mycobacterium avium
SLGSSSDLRV

SEQ ID NO: 142346 - protein, 8 aa, Mycobacterium avium
SLPADAVE

SEQ ID NO: 142347 - protein, 6 aa, Mycobacterium avium
SLPGFD

SEQ ID NO: 142348 - protein, 13 aa, Mycobacterium avium
SLPGFDPNIAGSD

SEQ ID NO: 142349 - protein, 6 aa, Mycobacterium avium
SLPTAT

SEQ ID NO: 142350 - protein, 6 aa, Mycobacterium avium
SMGSEG

SEQ ID NO: 142351 - protein, 7 aa, Mycobacterium avium
SNDPVDK

SEQ ID NO: 142352 - protein, 10 aa, Mycobacterium avium
SNGNGQIVGT

SEQ ID NO: 142353 - protein, 13 aa, Mycobacterium avium
SNIAANARTAKVA

SEQ ID NO: 142354 - protein, 12 aa, Mycobacterium avium
SNKGVKRTGSAA

SEQ ID NO: 142355 - protein, 5 aa, Mycobacterium avium
SNPDE

SEQ ID NO: 142356 - protein, 13 aa, Mycobacterium avium
SNPQGSADAVTVA

SEQ ID NO: 142357 - protein, 4 aa, Mycobacterium avium
SNRQ

SEQ ID NO: 142358 - protein, 10 aa, Mycobacterium avium
SNSSATMSRP

SEQ ID NO: 142359 - protein, 11 aa, Mycobacterium avium
SPAGIRTSDGI

SEQ ID NO: 142360 - protein, 16 aa, Mycobacterium avium
SPAPPRSGRPRRDRNP

SEQ ID NO: 142361 - protein, 6 aa, Mycobacterium avium
SPDTLD

SEQ ID NO: 142362 - protein, 6 aa, Mycobacterium avium
SPGSTP

SEQ ID NO: 142363 - protein, 5 aa, Mycobacterium avium
SPHAN

SEQ ID NO: 142364 - protein, 8 aa, Mycobacterium avium
SPLTPRTS

SEQ ID NO: 142365 - protein, 6 aa, Mycobacterium avium
SPPRVH

SEQ ID NO: 142366 - protein, 6 aa, Mycobacterium avium
SPQRPE

SEQ ID NO: 142367 - protein, 7 aa, Mycobacterium avium
SPQTAQT

SEQ ID NO: 142368 - protein, 17 aa, Mycobacterium avium
SPRGRITRTYREAHTVE

SEQ ID NO: 142369 - protein, 4 aa, Mycobacterium avium
SPSI

SEQ ID NO: 142370 - protein, 25 aa, Mycobacterium avium
SPTPAVPTAGPTTGSTTGSTAAVAN

SEQ ID NO: 142371 - protein, 16 aa, Mycobacterium avium
SPVEDVPKHSADDDAD

SEQ ID NO: 142372 - protein, 12 aa, Mycobacterium avium
SPVTSRTPSRRC

SEQ ID NO: 142373 - protein, 9 aa, Mycobacterium avium
SQAEQEAVS

SEQ ID NO: 142374 - protein, 5 aa, Mycobacterium avium
SQESQ

SEQ ID NO: 142375 - protein, 80 aa, Mycobacterium avium
SQGSPPAGPPPPFGAPPPFAPPPSGPPPFAPPPPDAGPVPAPPAGAAPQAAPSPPAGAAPQAPSPKSAGPTPNAPKKPGP

SEQ ID NO: 142376 - protein, 80 aa, Mycobacterium avium
SQGSPPAGPPPPFGAPPPFAPPPSGPPPFAPPPPDAGPVPAPPAGPAPQAAPAPPAGAAPQAPSPKSAGPTPNAPKKPGP

SEQ ID NO: 142377 - protein, 6 aa, Mycobacterium avium
SQLAGR

SEQ ID NO: 142378 - protein, 5 aa, Mycobacterium avium
SQQSP

SEQ ID NO: 142379 - protein, 4 aa, Mycobacterium avium
SQTA

SEQ ID NO: 142380 - protein, 5 aa, Mycobacterium avium
SQYQN

SEQ ID NO: 142381 - protein, 5 aa, Mycobacterium avium
SRAEQ

SEQ ID NO: 142382 - protein, 10 aa, Mycobacterium avium
SRAMAAGAAP

SEQ ID NO: 142383 - protein, 9 aa, Mycobacterium avium
SRARAAGLP

SEQ ID NO: 142384 - protein, 19 aa, Mycobacterium avium
SRATAFNTQGISADAVANR

SEQ ID NO: 142385 - protein, 7 aa, Mycobacterium avium
SRNKKSI

SEQ ID NO: 142386 - protein, 8 aa, Mycobacterium avium
SRNQNATR

SEQ ID NO: 142387 - protein, 7 aa, Mycobacterium avium
SRPDAVR

SEQ ID NO: 142388 - protein, 7 aa, Mycobacterium avium
SRPGADF

SEQ ID NO: 142389 - protein, 7 aa, Mycobacterium avium
SRPGEYD

SEQ ID NO: 142390 - protein, 18 aa, Mycobacterium avium
SRPRPPPSWKTLRGIWIF

SEQ ID NO: 142391 - protein, 5 aa, Mycobacterium avium
SRRAL

SEQ ID NO: 142392 - protein, 6 aa, Mycobacterium avium
SRRPLQ

SEQ ID NO: 142393 - protein, 14 aa, Mycobacterium avium
SRSTDFPDGHQIAA

SEQ ID NO: 142394 - protein, 17 aa, Mycobacterium avium
SRTDSSLEVRGSGSYDG

SEQ ID NO: 142395 - protein, 20 aa, Mycobacterium avium
SSATSTTTTPTASVTTSTTT

SEQ ID NO: 142396 - protein, 5 aa, Mycobacterium avium
SSEAA

SEQ ID NO: 142397 - protein, 14 aa, Mycobacterium avium
SSGAGAVRANHPDM

SEQ ID NO: 142398 - protein, 38 aa, Mycobacterium avium
SSGGHSAAPASSTAPSASTGTNAQVKVGGADLPGVNPA

SEQ ID NO: 142399 - protein, 22 aa, Mycobacterium avium
SSLAGRAVGGTATRAVAGSTVR

SEQ ID NO: 142400 - protein, 9 aa, Mycobacterium avium
SSNAERTAV

SEQ ID NO: 142401 - protein, 21 aa, Mycobacterium avium
SSNKSNTGASGSSGAPAAAAP

SEQ ID NO: 142402 - protein, 19 aa, Mycobacterium avium
SSNKSNTGASGSSGAPVAA

SEQ ID NO: 142403 - protein, 11 aa, Mycobacterium avium
SSNTKQEYRGA

SEQ ID NO: 142404 - protein, 6 aa, Mycobacterium avium
SSPMTA

SEQ ID NO: 142405 - protein, 15 aa, Mycobacterium avium
SSPQHASSLPGTTPA

SEQ ID NO: 142406 - protein, 7 aa, Mycobacterium avium
SSQGMGP

SEQ ID NO: 142407 - protein, 8 aa, Mycobacterium avium
SSQRDDLT

SEQ ID NO: 142408 - protein, 5 aa, Mycobacterium avium
SSQRQ

SEQ ID NO: 142409 - protein, 13 aa, Mycobacterium avium
SSSCTPGSRAGAS

SEQ ID NO: 142410 - protein, 4 aa, Mycobacterium avium
SSTA

SEQ ID NO: 142411 - protein, 17 aa, Mycobacterium avium
SSTGLERAEDPLLNGSD

SEQ ID NO: 142412 - protein, 7 aa, Mycobacterium avium
SSTNYNG

SEQ ID NO: 142413 - protein, 11 aa, Mycobacterium avium
SSTQGWRDNPQ

SEQ ID NO: 142414 - protein, 13 aa, Mycobacterium avium
SSVAGYSESVSAE

SEQ ID NO: 142415 - protein, 11 aa, Mycobacterium avium
STADRTNGADL

SEQ ID NO: 142416 - protein, 7 aa, Mycobacterium avium
STAGNSI

SEQ ID NO: 142417 - protein, 4 aa, Mycobacterium avium
STAQ

SEQ ID NO: 142418 - protein, 5 aa, Mycobacterium avium
STARP

SEQ ID NO: 142419 - protein, 12 aa, Mycobacterium avium
STARSDLRKGLR

SEQ ID NO: 142420 - protein, 16 aa, Mycobacterium avium
STASSVESALSQGVSQ

SEQ ID NO: 142421 - protein, 16 aa, Mycobacterium avium
STGGRTEPTRTDTERA

SEQ ID NO: 142422 - protein, 19 aa, Mycobacterium avium
STLGPTKYPARRRHDERQP

SEQ ID NO: 142423 - protein, 19 aa, Mycobacterium avium
STLGPTNYPARRRHDERQP

SEQ ID NO: 142424 - protein, 7 aa, Mycobacterium avium
STNGVQV

SEQ ID NO: 142425 - protein, 9 aa, Mycobacterium avium
STNLGAELG

SEQ ID NO: 142426 - protein, 8 aa, Mycobacterium avium
STPEQFDQ

SEQ ID NO: 142427 - protein, 9 aa, Mycobacterium avium
STPPAQTKT

SEQ ID NO: 142428 - protein, 7 aa, Mycobacterium avium
STPTATT

SEQ ID NO: 142429 - protein, 47 aa, Mycobacterium avium
STQVPASTEPTPTSPAPGGPAPSTGPATRSATPTSTAPPSRPADPNA

SEQ ID NO: 142430 - protein, 26 aa, Mycobacterium avium
STSDGVTIGGTAGITPGVTGPVTGVP

SEQ ID NO: 142431 - protein, 5 aa, Mycobacterium avium
STTGF

SEQ ID NO: 142432 - protein, 19 aa, Mycobacterium avium
STVSPSAYPLTRRHDERQP

SEQ ID NO: 142433 - protein, 10 aa, Mycobacterium avium
SVAKEHSSAI

SEQ ID NO: 142434 - protein, 8 aa, Mycobacterium avium
SVDPPRSF

SEQ ID NO: 142435 - protein, 6 aa, Mycobacterium avium
SVGTGI

SEQ ID NO: 142436 - protein, 5 aa, Mycobacterium avium
SVHGD

SEQ ID NO: 142437 - protein, 6 aa, Mycobacterium avium
SVNGND

SEQ ID NO: 142438 - protein, 5 aa, Mycobacterium avium
SVPPP

SEQ ID NO: 142439 - protein, 9 aa, Mycobacterium avium
SVSGGHVGR

SEQ ID NO: 142440 - protein, 10 aa, Mycobacterium avium
SVSGNGNRIA

SEQ ID NO: 142441 - protein, 7 aa, Mycobacterium avium
SVSPKSL

SEQ ID NO: 142442 - protein, 7 aa, Mycobacterium avium
SWDPDAL

SEQ ID NO: 142443 - protein, 12 aa, Mycobacterium avium
SWGPQGADGTGT

SEQ ID NO: 142444 - protein, 17 aa, Mycobacterium avium
SWRSETVSSGTIVDLPC

SEQ ID NO: 142445 - protein, 6 aa, Mycobacterium avium
SYGTLG

SEQ ID NO: 142446 - protein, 5 aa, Mycobacterium avium
SYRAA

SEQ ID NO: 142447 - protein, 7 aa, Mycobacterium avium
TAAETGK

SEQ ID NO: 142448 - protein, 18 aa, Mycobacterium avium
TAAGGHSATLSPQRPVPS

SEQ ID NO: 142449 - protein, 16 aa, Mycobacterium avium
TAAGSTPDPQFQPGEL

SEQ ID NO: 142450 - protein, 21 aa, Mycobacterium avium
TAAHDHDDHEHGDDHDHDHGF

SEQ ID NO: 142451 - protein, 20 aa, Mycobacterium avium
TAAPAQPAQPAQPAQPAQPA

SEQ ID NO: 142452 - protein, 5 aa, Mycobacterium avium
TAAPC

SEQ ID NO: 142453 - protein, 19 aa, Mycobacterium avium
TAAQAEEAASQARAAAAAY

SEQ ID NO: 142454 - protein, 29 aa, Mycobacterium avium
TAAQAEHTANAARAAAAAYESARAATVPP

SEQ ID NO: 142455 - protein, 17 aa, Mycobacterium avium
TAAQAEQTAAQATAAAA

SEQ ID NO: 142456 - protein, 22 aa, Mycobacterium avium
TAASGVVEREQDPLTAAAADQW

SEQ ID NO: 142457 - protein, 40 aa, Mycobacterium avium; identical to SEQ ID NO: 57192

SEQ ID NO: 142458 - protein, 7 aa, Mycobacterium avium
TADANKE

SEQ ID NO: 142459 - protein, 8 aa, Mycobacterium avium
TADGEPGC

SEQ ID NO: 142460 - protein, 4 aa, Mycobacterium avium
TADL

SEQ ID NO: 142461 - protein, 8 aa, Mycobacterium avium
TADPGQRL

SEQ ID NO: 142462 - protein, 12 aa, Mycobacterium avium
TAEAARPHSGRT

SEQ ID NO: 142463 - protein, 7 aa, Mycobacterium avium
TAEARTG

SEQ ID NO: 142464 - protein, 9 aa, Mycobacterium avium
TAEPLRGGG

SEQ ID NO: 142465 - protein, 32 aa, Mycobacterium avium
TAETIQAEGNYPTREACQDAGPGVKASTPGNW

SEQ ID NO: 142466 - protein, 32 aa, Mycobacterium avium
TAETIQTEGNYPTREACQDAGPGVKASTPGNW

SEQ ID NO: 142467 - protein, 16 aa, Mycobacterium avium
TAFNTQGISADAVANR

SEQ ID NO: 142468 - protein, 4 aa, Mycobacterium avium
TAFS

SEQ ID NO: 142469 - protein, 9 aa, Mycobacterium avium
TAFSGREQD

SEQ ID NO: 142470 - protein, 12 aa, Mycobacterium avium
TAGNNDYSPLES

SEQ ID NO: 142471 - protein, 10 aa, Mycobacterium avium
TAGPARADQA

SEQ ID NO: 142472 - protein, 8 aa, Mycobacterium avium
TAGREPYL

SEQ ID NO: 142473 - protein, 15 aa, Mycobacterium avium
TAGVPDALGRERSGV

SEQ ID NO: 142474 - protein, 35 aa, Mycobacterium avium
TAPAAADPPPGLPPMTSGGSRPIIGGGSAAAQGIS

SEQ ID NO: 142475 - protein, 11 aa, Mycobacterium avium
TAPDDTDAVAE

SEQ ID NO: 142476 - protein, 7 aa, Mycobacterium avium
TAPGGRT

SEQ ID NO: 142477 - protein, 35 aa, Mycobacterium avium; identical to SEQ ID NO: 74851

SEQ ID NO: 142478 - protein, 4 aa, Mycobacterium avium
TARP

SEQ ID NO: 142479 - protein, 23 aa, Mycobacterium avium
TARRAREGKISPPPAWMTRRVGG

SEQ ID NO: 142480 - protein, 8 aa, Mycobacterium avium
TASEAMST

SEQ ID NO: 142481 - protein, 25 aa, Mycobacterium avium
TASRPGPRRRWPAPPTSCAVAARAG

SEQ ID NO: 142482 - protein, 10 aa, Mycobacterium avium
TATAGCATNG

SEQ ID NO: 142483 - protein, 22 aa, Mycobacterium avium
TDAAGNKPESVNCPGDLPAKVG

SEQ ID NO: 142484 - protein, 5 aa, Mycobacterium avium
TDAER

SEQ ID NO: 142485 - protein, 8 aa, Mycobacterium avium
TDAKAGPL

SEQ ID NO: 142486 - protein, 5 aa, Mycobacterium avium
TDDGN

SEQ ID NO: 142487 - protein, 11 aa, Mycobacterium avium
TDDVPASLSPE

SEQ ID NO: 142488 - protein, 18 aa, Mycobacterium avium
TDERRAAAVGRLNPFRGA

SEQ ID NO: 142489 - protein, 5 aa, Mycobacterium avium
TDETG

SEQ ID NO: 142490 - protein, 17 aa, Mycobacterium avium
TDETGRVSARDTGEREE

SEQ ID NO: 142491 - protein, 19 aa, Mycobacterium avium
TDETGRVSARDTGEREEPP

SEQ ID NO: 142492 - protein, 7 aa, Mycobacterium avium
TDGSDKY

SEQ ID NO: 142493 - protein, 5 aa, Mycobacterium avium
TDHGP

SEQ ID NO: 142494 - protein, 21 aa, Mycobacterium avium
TDLTADATGAAELSGDPIVDG

SEQ ID NO: 142495 - protein, 7 aa, Mycobacterium avium
TDNAPIA

SEQ ID NO: 142496 - protein, 7 aa, Mycobacterium avium
TDPGVNY

SEQ ID NO: 142497 - protein, 4 aa, Mycobacterium avium
TDRA

SEQ ID NO: 142498 - protein, 8 aa, Mycobacterium avium
TDRAVGGL

SEQ ID NO: 142499 - protein, 10 aa, Mycobacterium avium
TDRSLGAEPL

SEQ ID NO: 142500 - protein, 9 aa, Mycobacterium avium
TDRSLGAES

SEQ ID NO: 142501 - protein, 4 aa, Mycobacterium avium
TDRT

SEQ ID NO: 142502 - protein, 24 aa, Mycobacterium avium
TDSGPEDGGPDDGPVASEASAGQL

SEQ ID NO: 142503 - protein, 5 aa, Mycobacterium avium
TDTGV

SEQ ID NO: 142504 - protein, 9 aa, Mycobacterium avium
TDTRGNPIA

SEQ ID NO: 142505 - protein, 6 aa, Mycobacterium avium
TEDRLA

SEQ ID NO: 142506 - protein, 6 aa, Mycobacterium avium
TEGPYD

SEQ ID NO: 142507 - protein, 11 aa, Mycobacterium avium
TELDGGPFPLT

SEQ ID NO: 142508 - protein, 19 aa, Mycobacterium avium
TEPDAAAPEPAAGVGGGAG

SEQ ID NO: 142509 - protein, 19 aa, Mycobacterium avium
TEPDAAPPEPAAGVGGGAG

SEQ ID NO: 142510 - protein, 8 aa, Mycobacterium avium
TEPRTLPQ

SEQ ID NO: 142511 - protein, 11 aa, Mycobacterium avium
TESGASATHQA

SEQ ID NO: 142512 - protein, 6 aa, Mycobacterium avium
TEVGSR

SEQ ID NO: 142513 - protein, 11 aa, Mycobacterium avium
TGAKSGEPRTV

SEQ ID NO: 142514 - protein, 42 aa, Mycobacterium avium
TGCGSDENHRGTAAPGISGTTGTAGCGGKNKLTAEGSTAQEN

SEQ ID NO: 142515 - protein, 21 aa, Mycobacterium avium
TGERLNEQATTNGYGNYTERH

SEQ ID NO: 142516 - protein, 16 aa, Mycobacterium avium
TGERLNEQATTNTYGS

SEQ ID NO: 142517 - protein, 9 aa, Mycobacterium avium
TGGHAGTPV

SEQ ID NO: 142518 - protein, 20 aa, Mycobacterium avium
TGHDGGAGTVHANNPGEVPA

SEQ ID NO: 142519 - protein, 91 aa, Mycobacterium avium
TGIDPAHAAGPAPAAAAPSAPAPAATPPSAPAPAAAPAPGPVQPATVPAAAPVPPPPAPAAAAPATPGAPDAAPAPAAAPGFGADAPPTQD

SEQ ID NO: 142520 - protein, 26 aa, Mycobacterium avium
TGIDPERTADQLSAEVQKAIDGKGLL

SEQ ID NO: 142521 - protein, 6 aa, Mycobacterium avium
TGIEPG

SEQ ID NO: 142522 - protein, 8 aa, Mycobacterium avium
TGKASHAS

SEQ ID NO: 142523 - protein, 9 aa, Mycobacterium avium
TGKSGTVAL

SEQ ID NO: 142524 - protein, 15 aa, Mycobacterium avium
TGKTPVSKDDAQQHA

SEQ ID NO: 142525 - protein, 5 aa, Mycobacterium avium
TGLYN

SEQ ID NO: 142526 - protein, 6 aa, Mycobacterium avium
TGNGYY

SEQ ID NO: 142527 - protein, 15 aa, Mycobacterium avium
TGPAIARADGDEPQY

SEQ ID NO: 142528 - protein, 12 aa, Mycobacterium avium
TGPQVTAILDGA

SEQ ID NO: 142529 - protein, 5 aa, Mycobacterium avium
TGPSV

SEQ ID NO: 142530 - protein, 4 aa, Mycobacterium avium
TGQT

SEQ ID NO: 142531 - protein, 8 aa, Mycobacterium avium
TGRPARGL

SEQ ID NO: 142532 - protein, 11 aa, Mycobacterium avium
TGRSGARAFKD

SEQ ID NO: 142533 - protein, 14 aa, Mycobacterium avium
TGSAAAQPSPWTAR

SEQ ID NO: 142534 - protein, 23 aa, Mycobacterium avium
TGSPSPSGAGAAEAAPAAAPSIT

SEQ ID NO: 142535 - protein, 11 aa, Mycobacterium avium
TGSRSNGPAAL

SEQ ID NO: 142536 - protein, 10 aa, Mycobacterium avium
TGTAPPPGAP

SEQ ID NO: 142537 - protein, 9 aa, Mycobacterium avium
TGTEPGTPG

SEQ ID NO: 142538 - protein, 29 aa, Mycobacterium avium
THATGSGGGRIAGAAPSVPAANMPPGSVE

SEQ ID NO: 142539 - protein, 17 aa, Mycobacterium avium
THRERRRSGKVSRSGGC

SEQ ID NO: 142540 - protein, 14 aa, Mycobacterium avium
TIHKSTVPSQIGPA

SEQ ID NO: 142541 - protein, 14 aa, Mycobacterium avium
TIPGTGKAHASAPS

SEQ ID NO: 142542 - protein, 8 aa, Mycobacterium avium
TKNDDPVG

SEQ ID NO: 142543 - protein, 4 aa, Mycobacterium avium
TKSA

SEQ ID NO: 142544 - protein, 9 aa, Mycobacterium avium
TKSQPTTPA

SEQ ID NO: 142545 - protein, 11 aa, Mycobacterium avium
TLAEHGAQPAC

SEQ ID NO: 142546 - protein, 10 aa, Mycobacterium avium
TLAGPARRGE

SEQ ID NO: 142547 - protein, 12 aa, Mycobacterium avium
TLASGGTWCPPN

SEQ ID NO: 142548 - protein, 10 aa, Mycobacterium avium
TLDDDERETL

SEQ ID NO: 142549 - protein, 14 aa, Mycobacterium avium
TLGADSPDAQSGSI

SEQ ID NO: 142550 - protein, 35 aa, Mycobacterium avium
TLPGTEEPMASGYPGYPGMPGGGAARSAGAGVPPR

SEQ ID NO: 142551 - protein, 40 aa, Mycobacterium avium
TLPGTEEPMASGYPGYPGMPGGGAARSAGAGVRPATACGS

SEQ ID NO: 142552 - protein, 35 aa, Mycobacterium avium
TLPGTEEPMASGYPGYPGMPGGGAARSAGVGVPPR

SEQ ID NO: 142553 - protein, 6 aa, Mycobacterium avium
TLTPPH

SEQ ID NO: 142554 - protein, 10 aa, Mycobacterium avium
TNDKGTPGAK

SEQ ID NO: 142555 - protein, 4 aa, Mycobacterium avium
TNGA

SEQ ID NO: 142556 - protein, 4 aa, Mycobacterium avium
TNPH

SEQ ID NO: 142557 - protein, 9 aa, Mycobacterium avium
TNRGSENLE

SEQ ID NO: 142558 - protein, 14 aa, Mycobacterium avium
TNSPLQDGEHANGV

SEQ ID NO: 142559 - protein, 6 aa, Mycobacterium avium
TNTAAQ

SEQ ID NO: 142560 - protein, 10 aa, Mycobacterium avium
TNTPTASADT

SEQ ID NO: 142561 - protein, 4 aa, Mycobacterium avium
TPAR

SEQ ID NO: 142562 - protein, 6 aa, Mycobacterium avium
TPARNT

SEQ ID NO: 142563 - protein, 5 aa, Mycobacterium avium
TPARQ

SEQ ID NO: 142564 - protein, 12 aa, Mycobacterium avium
TPAVSKADCADG

SEQ ID NO: 142565 - protein, 4 aa, Mycobacterium avium
TPEG

SEQ ID NO: 142566 - protein, 22 aa, Mycobacterium avium
TPEGQKVAPGPIGSNTAAKATV

SEQ ID NO: 142567 - protein, 7 aa, Mycobacterium avium
TPGQRRK

SEQ ID NO: 142568 - protein, 7 aa, Mycobacterium avium
TPHPVDG

SEQ ID NO: 142569 - protein, 21 aa, Mycobacterium avium
TPIPARGGTPPKQPRPEPEYG

SEQ ID NO: 142570 - protein, 4 aa, Mycobacterium avium
TPKD

SEQ ID NO: 142571 - protein, 12 aa, Mycobacterium avium
TPKHGGRIVVHR

SEQ ID NO: 142572 - protein, 10 aa, Mycobacterium avium
TPNGAQTSRL

SEQ ID NO: 142573 - protein, 12 aa, Mycobacterium avium
TPPATDDPQRRC

SEQ ID NO: 142574 - protein, 13 aa, Mycobacterium avium
TPPDPLPPGRPGD

SEQ ID NO: 142575 - protein, 32 aa, Mycobacterium avium
TPPGGLTGPAVRPAQPSGCAASDYPGAPPKGA

SEQ ID NO: 142576 - protein, 4 aa, Mycobacterium avium
TPQP

SEQ ID NO: 142577 - protein, 4 aa, Mycobacterium avium
TPSD

SEQ ID NO: 142578 - protein, 8 aa, Mycobacterium avium
TPSTPEGG

SEQ ID NO: 142579 - protein, 5 aa, Mycobacterium avium
TQGNT

SEQ ID NO: 142580 - protein, 23 aa, Mycobacterium avium
TQPISPNKSTFGGKGRPFGGKGR

SEQ ID NO: 142581 - protein, 9 aa, Mycobacterium avium
TQPKLADTQ

SEQ ID NO: 142582 - protein, 17 aa, Mycobacterium avium
TQTAQGAAQLAQLVGRP

SEQ ID NO: 142583 - protein, 10 aa, Mycobacterium avium
TRADSGMNSA

SEQ ID NO: 142584 - protein, 15 aa, Mycobacterium avium
TRAGADELVQVAWSP

SEQ ID NO: 142585 - protein, 12 aa, Mycobacterium avium
TRDALTRRGYRD

SEQ ID NO: 142586 - protein, 7 aa, Mycobacterium avium
TRDRIGQ

SEQ ID NO: 142587 - protein, 9 aa, Mycobacterium avium
TREAPPQPV

SEQ ID NO: 142588 - protein, 16 aa, Mycobacterium avium
TREGTYKGFPGSTVDR

SEQ ID NO: 142589 - protein, 6 aa, Mycobacterium avium
TRERQG

SEQ ID NO: 142590 - protein, 5 aa, Mycobacterium avium
TRGPD

SEQ ID NO: 142591 - protein, 22 aa, Mycobacterium avium
TRINQDSTPLNGANGSTGSASY

SEQ ID NO: 142592 - protein, 4 aa, Mycobacterium avium
TRKR

SEQ ID NO: 142593 - protein, 7 aa, Mycobacterium avium
TRLGSGR

SEQ ID NO: 142594 - protein, 23 aa, Mycobacterium avium
TRPLATELDNRKAEVNNDVEQLG

SEQ ID NO: 142595 - protein, 9 aa, Mycobacterium avium
TRRGGSEVR

SEQ ID NO: 142596 - protein, 4 aa, Mycobacterium avium
TSAF

SEQ ID NO: 142597 - protein, 15 aa, Mycobacterium avium
TSAKFSPRTPGGDPL

SEQ ID NO: 142598 - protein, 8 aa, Mycobacterium avium
TSALGQRD

SEQ ID NO: 142599 - protein, 6 aa, Mycobacterium avium
TSCAAS

SEQ ID NO: 142600 - protein, 5 aa, Mycobacterium avium
TSDNM

SEQ ID NO: 142601 - protein, 7 aa, Mycobacterium avium
TSEYQSV

SEQ ID NO: 142602 - protein, 5 aa, Mycobacterium avium
TSGGF

SEQ ID NO: 142603 - protein, 7 aa, Mycobacterium avium
TSGPGEL

SEQ ID NO: 142604 - protein, 4 aa, Mycobacterium avium
TSIG

SEQ ID NO: 142605 - protein, 8 aa, Mycobacterium avium
TSISSGAR

SEQ ID NO: 142606 - protein, 6 aa, Mycobacterium avium
TSLPTN

SEQ ID NO: 142607 - protein, 6 aa, Mycobacterium avium
TSPQDL

SEQ ID NO: 142608 - protein, 5 aa, Mycobacterium avium
TSQGV

SEQ ID NO: 142609 - protein, 5 aa, Mycobacterium avium
TSSYG

SEQ ID NO: 142610 - protein, 11 aa, Mycobacterium avium
TSTTKITEAVP

SEQ ID NO: 142611 - protein, 7 aa, Mycobacterium avium
TSVTETG

SEQ ID NO: 142612 - protein, 4 aa, Mycobacterium avium
TSYP

SEQ ID NO: 142613 - protein, 13 aa, Mycobacterium avium
TTAGRAEQVATQA

SEQ ID NO: 142614 - protein, 72 aa, Mycobacterium avium
TTAPTQQVPQQAPLQQTPAQQAPLQQTPGQQAPLQQTPGQQAPTQQAPLQQVPTQQVPGQQLPTQQAPQQAP

SEQ ID NO: 142615 - protein, 82 aa, Mycobacterium avium
TTAPTQQVPQQAPLQQTPAQQAPLQQTPGQQAPLQQTPGQQLPTQQAPLQQVPGQQVPAQQVPAQQVPGQQLPTQQAPQQAP

SEQ ID NO: 142616 - protein, 8 aa, Mycobacterium avium
TTDAPDEP

SEQ ID NO: 142617 - protein, 7 aa, Mycobacterium avium
TTDLTNE

SEQ ID NO: 142618 - protein, 7 aa, Mycobacterium avium
TTGDLAG

SEQ ID NO: 142619 - protein, 7 aa, Mycobacterium avium
TTGDVRP

SEQ ID NO: 142620 - protein, 5 aa, Mycobacterium avium
TTHDG

SEQ ID NO: 142621 - protein, 5 aa, Mycobacterium avium
TTKER

SEQ ID NO: 142622 - protein, 6 aa, Mycobacterium avium
TTLTPE

SEQ ID NO: 142623 - protein, 7 aa, Mycobacterium avium
TTPARTA

SEQ ID NO: 142624 - protein, 10 aa, Mycobacterium avium
TTPLSPDQAE

SEQ ID NO: 142625 - protein, 11 aa, Mycobacterium avium
TTPLSPDQAEW

SEQ ID NO: 142626 - protein, 5 aa, Mycobacterium avium
TTSGD

SEQ ID NO: 142627 - protein, 11 aa, Mycobacterium avium
TTSPDELGNIQ

SEQ ID NO: 142628 - protein, 10 aa, Mycobacterium avium
TVGLPDGTTV

SEQ ID NO: 142629 - protein, 29 aa, Mycobacterium avium
TVGNGTTGAATAAAADGAATTATIIVVPA

SEQ ID NO: 142630 - protein, 12 aa, Mycobacterium avium
TVHAAPASASLG

SEQ ID NO: 142631 - protein, 7 aa, Mycobacterium avium
TVPRGGV

SEQ ID NO: 142632 - protein, 5 aa, Mycobacterium avium
TVSAR

SEQ ID NO: 142633 - protein, 25 aa, Mycobacterium avium
TVTDTGSGAAGGAAAGAANSTTSSI

SEQ ID NO: 142634 - protein, 15 aa, Mycobacterium avium
TVTPAADGKCPPPAG

SEQ ID NO: 142635 - protein, 15 aa, Mycobacterium avium
TVTPAADGKCPPPTG

SEQ ID NO: 142636 - protein, 8 aa, Mycobacterium avium
TWASPPAL

SEQ ID NO: 142637 - protein, 8 aa, Mycobacterium avium
TWPPKTEE

SEQ ID NO: 142638 - protein, 10 aa, Mycobacterium avium
TWSAPTSTHV

SEQ ID NO: 142639 - protein, 8 aa, Mycobacterium avium
TYDDGAAM

SEQ ID NO: 142640 - protein, 24 aa, Mycobacterium avium
VAAAAGSKKARARRRRRGTATDRA

SEQ ID NO: 142641 - protein, 5 aa, Mycobacterium avium
VAAAT

SEQ ID NO: 142642 - protein, 10 aa, Mycobacterium avium
VAAGESVAPP

SEQ ID NO: 142643 - protein, 28 aa, Mycobacterium avium
VAAGSTPAPKPPPGPGAAKAKPKTGDAV

SEQ ID NO: 142644 - protein, 4 aa, Mycobacterium avium
VADP

SEQ ID NO: 142645 - protein, 26 aa, Mycobacterium avium
VAEPGSDEPTLSGDRPARSAAPQIDE

SEQ ID NO: 142646 - protein, 9 aa, Mycobacterium avium
VAGAAGTST

SEQ ID NO: 142647 - protein, 6 aa, Mycobacterium avium
VAGGGP

SEQ ID NO: 142648 - protein, 10 aa, Mycobacterium avium
VAGTNTGESL

SEQ ID NO: 142649 - protein, 5 aa, Mycobacterium avium
VALPD

SEQ ID NO: 142650 - protein, 20 aa, Mycobacterium avium
VAPAPVAPAAPTAPAPAAAA

SEQ ID NO: 142651 - protein, 30 aa, Mycobacterium avium
VAPDRGDGESEQPQGREVRPNRSQREEELS

SEQ ID NO: 142652 - protein, 6 aa, Mycobacterium avium
VAPERG

SEQ ID NO: 142653 - protein, 13 aa, Mycobacterium avium
VAPGPPPPQPGSP

SEQ ID NO: 142654 - protein, 13 aa, Mycobacterium avium
VAPNGSETQSMST

SEQ ID NO: 142655 - protein, 46 aa, Mycobacterium avium
VAPPTQADPPYRNCTEARKDGRSNIPRGDPAYQPKLDRDNDGIACE

SEQ ID NO: 142656 - protein, 5 aa, Mycobacterium avium
VAPRD

SEQ ID NO: 142657 - protein, 16 aa, Mycobacterium avium
VAPSAADTNDNGDFSR

SEQ ID NO: 142658 - protein, 4 aa, Mycobacterium avium
VDAG

SEQ ID NO: 142659 - protein, 9 aa, Mycobacterium avium
VDDPHIDRD

SEQ ID NO: 142660 - protein, 16 aa, Mycobacterium avium
VDPAPYTASGRAGGGA

SEQ ID NO: 142661 - protein, 7 aa, Mycobacterium avium
VDPARAR

SEQ ID NO: 142662 - protein, 7 aa, Mycobacterium avium
VDPDSRH

SEQ ID NO: 142663 - protein, 5 aa, Mycobacterium avium
VDPED

SEQ ID NO: 142664 - protein, 9 aa, Mycobacterium avium
VDPLDDGAP

SEQ ID NO: 142665 - protein, 4 aa, Mycobacterium avium
VDQA

SEQ ID NO: 142666 - protein, 8 aa, Mycobacterium avium
VDQPDPVD

SEQ ID NO: 142667 - protein, 7 aa, Mycobacterium avium
VDQPNPV

SEQ ID NO: 142668 - protein, 16 aa, Mycobacterium avium
VDSAVDSAVDSAVRSA

SEQ ID NO: 142669 - protein, 13 aa, Mycobacterium avium
VDSSDAVSAAGAG

SEQ ID NO: 142670 - protein, 11 aa, Mycobacterium avium
VEAAHPSGRSI

SEQ ID NO: 142671 - protein, 9 aa, Mycobacterium avium
VEDDGPAHV

SEQ ID NO: 142672 - protein, 11 aa, Mycobacterium avium
VEDPGSPGTQD

SEQ ID NO: 142673 - protein, 7 aa, Mycobacterium avium
VEGESCG

SEQ ID NO: 142674 - protein, 10 aa, Mycobacterium avium
VEPPRSPAQM

SEQ ID NO: 142675 - protein, 5 aa, Mycobacterium avium
VETGR

SEQ ID NO: 142676 - protein, 18 aa, Mycobacterium avium
VETPQSHGAQIQKGPSVR

SEQ ID NO: 142677 - protein, 35 aa, Mycobacterium avium
VETSPPAPDGPPPSPGVPSAGRPGEAPPDVPGTPV

SEQ ID NO: 142678 - protein, 10 aa, Mycobacterium avium
VFPSTTAKTT

SEQ ID NO: 142679 - protein, 11 aa, Mycobacterium avium
VGAGQNGLADN

SEQ ID NO: 142680 - protein, 4 aa, Mycobacterium avium
VGAS

SEQ ID NO: 142681 - protein, 13 aa, Mycobacterium avium
VGDDAKVSNVVFV

SEQ ID NO: 142682 - protein, 25 aa, Mycobacterium avium
VGHDSPIQYGQSEQWSMDGGTAQPH

SEQ ID NO: 142683 - protein, 6 aa, Mycobacterium avium
VGNPVA

SEQ ID NO: 142684 - protein, 5 aa, Mycobacterium avium
VGPGE

SEQ ID NO: 142685 - protein, 9 aa, Mycobacterium avium
VGPSSTPGH

SEQ ID NO: 142686 - protein, 8 aa, Mycobacterium avium
VGRGEGYG

SEQ ID NO: 142687 - protein, 6 aa, Mycobacterium avium
VGRGQP

SEQ ID NO: 142688 - protein, 7 aa, Mycobacterium avium
VGRTAEQ

SEQ ID NO: 142689 - protein, 17 aa, Mycobacterium avium
VGSKLTAEGALAASQSL

SEQ ID NO: 142690 - protein, 10 aa, Mycobacterium avium
VGSSTRHAAE

SEQ ID NO: 142691 - protein, 11 aa, Mycobacterium avium
VGSSTRHAAEY

SEQ ID NO: 142692 - protein, 12 aa, Mycobacterium avium
VGSSTRHTAEYA

SEQ ID NO: 142693 - protein, 5 aa, Mycobacterium avium
VGSVA

SEQ ID NO: 142694 - protein, 20 aa, Mycobacterium avium
VGTDPAPSVRAGRRDLGFLS

SEQ ID NO: 142695 - protein, 4 aa, Mycobacterium avium
VGTG

SEQ ID NO: 142696 - protein, 43 aa, Mycobacterium avium
VKARSGDGKAPAKKSPAKKTAAKKAPAKKGAAKKAPAKKAASR

SEQ ID NO: 142697 - protein, 12 aa, Mycobacterium avium
VKSEGGAHGDAG

SEQ ID NO: 142698 - protein, 5 aa, Mycobacterium avium
VKTAD

SEQ ID NO: 142699 - protein, 8 aa, Mycobacterium avium
VLAGERPA

SEQ ID NO: 142700 - protein, 7 aa, Mycobacterium avium
VLPDPGP

SEQ ID NO: 142701 - protein, 13 aa, Mycobacterium avium
VNEEAKVSKVEFV

SEQ ID NO: 142702 - protein, 4 aa, Mycobacterium avium
VNGG

SEQ ID NO: 142703 - protein, 4 aa, Mycobacterium avium
VNGM

SEQ ID NO: 142704 - protein, 4 aa, Mycobacterium avium
VNGP

SEQ ID NO: 142705 - protein, 10 aa, Mycobacterium avium
VNLGRPDPGL

SEQ ID NO: 142706 - protein, 17 aa, Mycobacterium avium
VNPPAPGLYTTGPAVQP

SEQ ID NO: 142707 - protein, 23 aa, Mycobacterium avium
VNPPPAPQSTDTPHNSVPPPPRV

SEQ ID NO: 142708 - protein, 9 aa, Mycobacterium avium
VNRGPADLS

SEQ ID NO: 142709 - protein, 5 aa, Mycobacterium avium
VNRPT

SEQ ID NO: 142710 - protein, 9 aa, Mycobacterium avium
VNRPTPDRV

SEQ ID NO: 142711 - protein, 18 aa, Mycobacterium avium
VNRSPLDAERAATANNVG

SEQ ID NO: 142712 - protein, 9 aa, Mycobacterium avium
VPAGEQSSL

SEQ ID NO: 142713 - protein, 148 aa, Mycobacterium avium
VPALSGGATSTPGLASPGLGSPGLGSPGLGTPGLGTPGLTNPGLTSPGATSPGLTSPGLTSPGLTSPGLTSPGAAPTTPGLTAPGALPTTPGGGVATPGAGLNPALSNPGLTSPAGTAPGLGSPTVAPSEVPIDSGAGLDPGAGGTYP

SEQ ID NO: 142714 - protein, 11 aa, Mycobacterium avium
VPAPAPPLPGV

SEQ ID NO: 142715 - protein, 10 aa, Mycobacterium avium
VPAPAPPLSG

SEQ ID NO: 142716 - protein, 6 aa, Mycobacterium avium
VPEPGW

SEQ ID NO: 142717 - protein, 14 aa, Mycobacterium avium
VPEPRPGPALNGRS

SEQ ID NO: 142718 - protein, 7 aa, Mycobacterium avium
VPGMPGQ

SEQ ID NO: 142719 - protein, 5 aa, Mycobacterium avium
VPGPV

SEQ ID NO: 142720 - protein, 5 aa, Mycobacterium avium
VPGSC

SEQ ID NO: 142721 - protein, 7 aa, Mycobacterium avium
VPLGKDT

SEQ ID NO: 142722 - protein, 5 aa, Mycobacterium avium
VPPDE

SEQ ID NO: 142723 - protein, 6 aa, Mycobacterium avium
VPPGWT

SEQ ID NO: 142724 - protein, 5 aa, Mycobacterium avium
VPPGY

SEQ ID NO: 142725 - protein, 47 aa, Mycobacterium avium
VPPHPDSPPTGDAPAPPAAGATPAEAPPPAADAPPPAQAAPTNPAEG

SEQ ID NO: 142726 - protein, 5 aa, Mycobacterium avium
VPPSI

SEQ ID NO: 142727 - protein, 8 aa, Mycobacterium avium
VPPTDDPV

SEQ ID NO: 142728 - protein, 10 aa, Mycobacterium avium
VPQPDPAPSI

SEQ ID NO: 142729 - protein, 11 aa, Mycobacterium avium
VPQPDPAPSIL

SEQ ID NO: 142730 - protein, 12 aa, Mycobacterium avium
VPSANADNKRLN

SEQ ID NO: 142731 - protein, 11 aa, Mycobacterium avium
VPSSSAPQAIG

SEQ ID NO: 142732 - protein, 9 aa, Mycobacterium avium
VPVPPTDGL

SEQ ID NO: 142733 - protein, 13 aa, Mycobacterium avium
VQAPEGLQSTATY

SEQ ID NO: 142734 - protein, 7 aa, Mycobacterium avium
VQGTLNA

SEQ ID NO: 142735 - protein, 10 aa, Mycobacterium avium
VQKSSRYPGG

SEQ ID NO: 142736 - protein, 15 aa, Mycobacterium avium
VQPGDGLREFAFAPL

SEQ ID NO: 142737 - protein, 7 aa, Mycobacterium avium
VQPQPSR

SEQ ID NO: 142738 - protein, 5 aa, Mycobacterium avium
VQRNA

SEQ ID NO: 142739 - protein, 8 aa, Mycobacterium avium
VQTAKDST

SEQ ID NO: 142740 - protein, 9 aa, Mycobacterium avium
VRDAGGRIT

SEQ ID NO: 142741 - protein, 7 aa, Mycobacterium avium
VRDPAGL

SEQ ID NO: 142742 - protein, 5 aa, Mycobacterium avium
VRPDP

SEQ ID NO: 142743 - protein, 8 aa, Mycobacterium avium
VRPEAQTV

SEQ ID NO: 142744 - protein, 6 aa, Mycobacterium avium
VRPPSM

SEQ ID NO: 142745 - protein, 11 aa, Mycobacterium avium
VRRGSGDEFAG

SEQ ID NO: 142746 - protein, 6 aa, Mycobacterium avium
VRRPDG

SEQ ID NO: 142747 - protein, 8 aa, Mycobacterium avium
VSADASVR

SEQ ID NO: 142748 - protein, 12 aa, Mycobacterium avium
VSARGGPGGAPG

SEQ ID NO: 142749 - protein, 4 aa, Mycobacterium avium
VSES

SEQ ID NO: 142750 - protein, 10 aa, Mycobacterium avium
VSGAGTTKSL

SEQ ID NO: 142751 - protein, 5 aa, Mycobacterium avium
VSGAS

SEQ ID NO: 142752 - protein, 9 aa, Mycobacterium avium
VSGKDNTVT

SEQ ID NO: 142753 - protein, 19 aa, Mycobacterium avium
VSGTAKPAPNLKPRPLSGA

SEQ ID NO: 142754 - protein, 5 aa, Mycobacterium avium
VSGTL

SEQ ID NO: 142755 - protein, 9 aa, Mycobacterium avium
VSIDGETHR

SEQ ID NO: 142756 - protein, 7 aa, Mycobacterium avium
VSPPGEK

SEQ ID NO: 142757 - protein, 10 aa, Mycobacterium avium
VSQAPYGLAG

SEQ ID NO: 142758 - protein, 4 aa, Mycobacterium avium
VSRP

SEQ ID NO: 142759 - protein, 9 aa, Mycobacterium avium
VSRTSGASL

SEQ ID NO: 142760 - protein, 10 aa, Mycobacterium avium
VSSESDRHRA

SEQ ID NO: 142761 - protein, 14 aa, Mycobacterium avium
VSSPATAAAEVGGT

SEQ ID NO: 142762 - protein, 19 aa, Mycobacterium avium
VSTASPRSSASPSGGPDRP

SEQ ID NO: 142763 - protein, 4 aa, Mycobacterium avium
VSTQ

SEQ ID NO: 142764 - protein, 15 aa, Mycobacterium avium
VTAGGAQLPLGAPKR

SEQ ID NO: 142765 - protein, 15 aa, Mycobacterium avium
VTAPAASGPLAEQPA

SEQ ID NO: 142766 - protein, 6 aa, Mycobacterium avium
VTDESA

SEQ ID NO: 142767 - protein, 6 aa, Mycobacterium avium
VTDSLG

SEQ ID NO: 142768 - protein, 7 aa, Mycobacterium avium
VTDTAAG

SEQ ID NO: 142769 - protein, 5 aa, Mycobacterium avium
VTETA

SEQ ID NO: 142770 - protein, 9 aa, Mycobacterium avium
VTGGSPHAL

SEQ ID NO: 142771 - protein, 17 aa, Mycobacterium avium
VTGPPPMPDQPPPVAND

SEQ ID NO: 142772 - protein, 9 aa, Mycobacterium avium
VTGPPPQVL

SEQ ID NO: 142773 - protein, 12 aa, Mycobacterium avium
VTGSGDEVARTG

SEQ ID NO: 142774 - protein, 46 aa, Mycobacterium avium
VTNGTATPDTRVAPAYRQSVSASVSASSVTSSVRESQRQQSLTTKA

SEQ ID NO: 142775 - protein, 15 aa, Mycobacterium avium
VTPAGGGKATTIPLS

SEQ ID NO: 142776 - protein, 15 aa, Mycobacterium avium
VTPDAGGVAGSMGRS

SEQ ID NO: 142777 - protein, 16 aa, Mycobacterium avium
VTPPPPPGPKTSIETN

SEQ ID NO: 142778 - protein, 11 aa, Mycobacterium avium
VTPTRNGDPVD

SEQ ID NO: 142779 - protein, 14 aa, Mycobacterium avium
VTRGQGRDNAVDTD

SEQ ID NO: 142780 - protein, 4 aa, Mycobacterium avium
VTSG

SEQ ID NO: 142781 - protein, 7 aa, Mycobacterium avium
VTSQNPF

SEQ ID NO: 142782 - protein, 13 aa, Mycobacterium avium
VTTADEAAQAHDA

SEQ ID NO: 142783 - protein, 7 aa, Mycobacterium avium
VTTPART

SEQ ID NO: 142784 - protein, 6 aa, Mycobacterium avium
VTTQAE

SEQ ID NO: 142785 - protein, 16 aa, Mycobacterium avium
VVDSDTRAAETVAEQG

SEQ ID NO: 142786 - protein, 9 aa, Mycobacterium avium
VVGPAGTNY

SEQ ID NO: 142787 - protein, 12 aa, Mycobacterium avium
VVNAGSGNVVRQ

SEQ ID NO: 142788 - protein, 5 aa, Mycobacterium avium
VVPPS

SEQ ID NO: 142789 - protein, 6 aa, Mycobacterium avium
VYPQGR

SEQ ID NO: 142790 - protein, 17 aa, Mycobacterium avium
VYRGDEAPHGDDPAPTV

SEQ ID NO: 142791 - protein, 5 aa, Mycobacterium avium
VYTGN

SEQ ID NO: 142792 - protein, 4 aa, Mycobacterium avium
WAQR

SEQ ID NO: 142793 - protein, 7 aa, Mycobacterium avium
WAQRNDQ

SEQ ID NO: 142794 - protein, 12 aa, Mycobacterium avium
WGDAAGAARARA

SEQ ID NO: 142795 - protein, 7 aa, Mycobacterium avium
WGPPAKP

SEQ ID NO: 142796 - protein, 11 aa, Mycobacterium avium
WGPQGADGTGR

SEQ ID NO: 142797 - protein, 11 aa, Mycobacterium avium
WGPQGADGTGT

SEQ ID NO: 142798 - protein, 15 aa, Mycobacterium avium
WGPSSDPAWQRNDPS

SEQ ID NO: 142799 - protein, 18 aa, Mycobacterium avium
WGTAESDAPPSFGAGSSA

SEQ ID NO: 142800 - protein, 9 aa, Mycobacterium avium
WKPSPGSVY

SEQ ID NO: 142801 - protein, 20 aa, Mycobacterium avium
WPAPRSRPAWARPATAPWCG

SEQ ID NO: 142802 - protein, 19 aa, Mycobacterium avium
WPATAGADPDPGGAANPFG

SEQ ID NO: 142803 - protein, 6 aa, Mycobacterium avium
WPGPER

SEQ ID NO: 142804 - protein, 18 aa, Mycobacterium avium
WPPKGTDRGKGDAVARST

SEQ ID NO: 142805 - protein, 6 aa, Mycobacterium avium
WPSTPG

SEQ ID NO: 142806 - protein, 12 aa, Mycobacterium avium
WRPPYAKRNATV

SEQ ID NO: 142807 - protein, 12 aa, Mycobacterium avium
WRRSPGKTAAVA

SEQ ID NO: 142808 - protein, 8 aa, Mycobacterium avium
WSAADPQL

SEQ ID NO: 142809 - protein, 7 aa, Mycobacterium avium
WSDADNR

SEQ ID NO: 142810 - protein, 7 aa, Mycobacterium avium
WSDFGKA

SEQ ID NO: 142811 - protein, 12 aa, Mycobacterium avium
WSPSRSRTPRCA

SEQ ID NO: 142812 - protein, 10 aa, Mycobacterium avium
WTDPAQRTRD

SEQ ID NO: 142813 - protein, 4 aa, Mycobacterium avium
WTED

SEQ ID NO: 142814 - protein, 65 aa, Mycobacterium avium
WTPPPAPPAAPGGPGAPAPGAPGAPAPGAPAAPGAPAPAAPAPAAPGAPAAPGAPAPAPGQAPAV

SEQ ID NO: 142815 - protein, 10 aa, Mycobacterium avium
WTRDRPGLGA

SEQ ID NO: 142816 - protein, 7 aa, Mycobacterium avium
YAGPGLR

SEQ ID NO: 142817 - protein, 4 aa, Mycobacterium avium
YARQ

SEQ ID NO: 142818 - protein, 5 aa, Mycobacterium avium
YASAR

SEQ ID NO: 142819 - protein, 15 aa, Mycobacterium avium
YAWPPSSWPNQGPAY

SEQ ID NO: 142820 - protein, 15 aa, Mycobacterium avium
YCPRQLESAEAGKGG

SEQ ID NO: 142821 - protein, 17 aa, Mycobacterium avium
YDGDHHRTNRRQYARDQ

SEQ ID NO: 142822 - protein, 6 aa, Mycobacterium avium
YDPDRH

SEQ ID NO: 142823 - protein, 15 aa, Mycobacterium avium
YDPSSGSYVGPDGRM

SEQ ID NO: 142824 - protein, 6 aa, Mycobacterium avium
YEPDRH

SEQ ID NO: 142825 - protein, 23 aa, Mycobacterium avium
YETAAPDPGHAGEATEGPRGTDP

SEQ ID NO: 142826 - protein, 18 aa, Mycobacterium avium
YGASGDQSRGVVDGKPAD

SEQ ID NO: 142827 - protein, 4 aa, Mycobacterium avium
YGGS

SEQ ID NO: 142828 - protein, 7 aa, Mycobacterium avium
YGGVDGN

SEQ ID NO: 142829 - protein, 6 aa, Mycobacterium avium
YGPSGI

SEQ ID NO: 142830 - protein, 12 aa, Mycobacterium avium
YGQPRPQAESSL

SEQ ID NO: 142831 - protein, 15 aa, Mycobacterium avium
YGRDPEGHPYTQEQY

SEQ ID NO: 142832 - protein, 8 aa, Mycobacterium avium
YGRPAPAE

SEQ ID NO: 142833 - protein, 6 aa, Mycobacterium avium
YHPDGD

SEQ ID NO: 142834 - protein, 9 aa, Mycobacterium avium
YHRGGGPKM

SEQ ID NO: 142835 - protein, 19 aa, Mycobacterium avium
YHSGTPSISNSGGSNVVGR

SEQ ID NO: 142836 - protein, 7 aa, Mycobacterium avium
YLPGPSL

SEQ ID NO: 142837 - protein, 18 aa, Mycobacterium avium
YPPFGPPEGAEGKATAQD

SEQ ID NO: 142838 - protein, 10 aa, Mycobacterium avium
YQDNNAGFGA

SEQ ID NO: 142839 - protein, 11 aa, Mycobacterium avium
YQQGTGPAAAV

SEQ ID NO: 142840 - protein, 9 aa, Mycobacterium avium
YQRPTEERA

SEQ ID NO: 142841 - protein, 13 aa, Mycobacterium avium
YRDIQGGSSLADY

SEQ ID NO: 142842 - protein, 19 aa, Mycobacterium avium
YRHATAEPAADILRRLTSA

SEQ ID NO: 142843 - protein, 14 aa, Mycobacterium avium
YSDPPGLAPLPEEE

SEQ ID NO: 142844 - protein, 9 aa, Mycobacterium avium
YSPPGSPVS

SEQ ID NO: 142845 - protein, 4 aa, Mycobacterium avium
YSRG

SEQ ID NO: 142846 - protein, 15 aa, Mycobacterium avium
YSRGDTVLALKELTL

SEQ ID NO: 142847 - protein, 15 aa, Mycobacterium avium
YSRGDTVLALKERTL

SEQ ID NO: 142848 - protein, 14 aa, Mycobacterium avium
YTAPARAEPQGDDA

SEQ ID NO: 142849 - protein, 13 aa, Mycobacterium avium
YTGINGDSTPHSV

SEQ ID NO: 142850 - protein, 5 aa, Mycobacterium avium
YTITG

SEQ ID NO: 142851 - protein, 21 aa, Mycobacterium avium
YTPNPNDAPGGPLVERGDRNC

SEQ ID NO: 142852 - protein, 26 aa, Mycobacterium avium
AANLPGAAWQRCRTHYAANLMSICPK

SEQ ID NO: 142853 - protein, 24 aa, Mycobacterium avium
ANLMSICPKSMWPAVKAMLHSVYD

SEQ ID NO: 142854 - protein, 24 aa, Mycobacterium avium
EWAEGRRYLGLDILTRCRLTTITD

SEQ ID NO: 142855 - protein, 25 aa, Mycobacterium avium
VPKLRKGTYFPDWLLERRKRAESAL

SEQ ID NO: 142856 - protein, 19 aa, Mycobacterium avium
WLLERRKRAESALITVVAD

SEQ ID NO: 142857 - protein, 23 aa, Mycobacterium avium
HAKARGANILARIMGASITSDGY

SEQ ID NO: 142858 - protein, 17 aa, Mycobacterium avium
IQGLAALGDTYADASPD

SEQ ID NO: 142859 - protein, 29 aa, Mycobacterium avium
RPFDRDRTGFVFGEAGALMVIETEEHAKA

SEQ ID NO: 142860 - protein, 20 aa, Mycobacterium avium
AAADMLVRAWVRSYGVRATI

SEQ ID NO: 142861 - protein, 20 aa, Mycobacterium avium
AAAGAYCPDRLSISDGGTNP

SEQ ID NO: 142862 - protein, 34 aa, Mycobacterium avium
AAALPRRPQFALLKGRRNYLCLNKIHNGGPADGE

SEQ ID NO: 142863 - protein, 24 aa, Mycobacterium avium
AAAQCPDIQVVFARGTGEAPGVGP

SEQ ID NO: 142864 - protein, 25 aa, Mycobacterium avium
AADYRRNAAAFGRDADAIAGIEHTI

SEQ ID NO: 142865 - protein, 18 aa, Mycobacterium avium
AAETVAINPAMAISSLEL

SEQ ID NO: 142866 - protein, 25 aa, Mycobacterium avium
AAFSVALAAFALIGGACSKSNNAGQ

SEQ ID NO: 142867 - protein, 23 aa, Mycobacterium avium
AAHATKGPFTWCPGQSMEWPSGP

SEQ ID NO: 142868 - protein, 18 aa, Mycobacterium avium
AAKFTLEVYPRYLKLIPS

SEQ ID NO: 142869 - protein, 20 aa, Mycobacterium avium
AALCVAPMPGAPAAGADPCP

SEQ ID NO: 142870 - protein, 17 aa, Mycobacterium avium
AAPIGRAVIEAALQGGP

SEQ ID NO: 142871 - protein, 32 aa, Mycobacterium avium
AAQQRCGSPAWNLPVVFGPIAITYNVAGLNSL

SEQ ID NO: 142872 - protein, 24 aa, Mycobacterium avium
AARIMARLAARPSTQARRLQQLLG

SEQ ID NO: 142873 - protein, 18 aa, Mycobacterium avium
AARLYLCTDARRERGDLA

SEQ ID NO: 142874 - protein, 18 aa, Mycobacterium avium
AASSLPFSAFPMGNYASL

SEQ ID NO: 142875 - protein, 19 aa, Mycobacterium avium
AATAAVFTGGFVFAGSAAA

SEQ ID NO: 142876 - protein, 18 aa, Mycobacterium avium
AAVCVLAGCSSATHPAKV

SEQ ID NO: 142877 - protein, 23 aa, Mycobacterium avium
AAVESRVGLALTLGVTPPPGSRV

SEQ ID NO: 142878 - protein, 17 aa, Mycobacterium avium
AAVLAARIMARLAARPS

SEQ ID NO: 142879 - protein, 19 aa, Mycobacterium avium
ACADFSRWRANGVGHGAML

SEQ ID NO: 142880 - protein, 20 aa, Mycobacterium avium
ACARAAAVAHSMRVDDIGCV

SEQ ID NO: 142881 - protein, 17 aa, Mycobacterium avium
ACECPRGCPSCVQSPKC

SEQ ID NO: 142882 - protein, 24 aa, Mycobacterium avium
ADAKVKWSAPLGFLAQTPPAVTPQ

SEQ ID NO: 142883 - protein, 17 aa, Mycobacterium avium
ADAVLWAIGRVRPNTGW

SEQ ID NO: 142884 - protein, 23 aa, Mycobacterium avium
ADEVPGVRIARGLAEQTGKRIRL

SEQ ID NO: 142885 - protein, 18 aa, Mycobacterium avium
ADHDLRKAYRNGNFPEQF

SEQ ID NO: 142886 - protein, 18 aa, Mycobacterium avium
ADIAICGGVETKIEAVPI

SEQ ID NO: 142887 - protein, 21 aa, Mycobacterium avium
ADNAKWFYDFSVPGDVVEVRN

SEQ ID NO: 142888 - protein, 18 aa, Mycobacterium avium
ADQVWRRDDLIPLSSSSL

SEQ ID NO: 142889 - protein, 17 aa, Mycobacterium avium
ADYLSWQRNTVGQLQTA

SEQ ID NO: 142890 - protein, 24 aa, Mycobacterium avium
ADYSPEFGCLFAGIERGIKEFAPL

SEQ ID NO: 142891 - protein, 21 aa, Mycobacterium avium
AEAKVSGLIASVAGNSIQVTK

SEQ ID NO: 142892 - protein, 29 aa, Mycobacterium avium
AEDTGTVGYRFTWHLPKNRTWTYDGQLKM

SEQ ID NO: 142893 - protein, 18 aa, Mycobacterium avium
AEERLRYLAEHDDLTGVY

SEQ ID NO: 142894 - protein, 22 aa, Mycobacterium avium
AEHMLRAALIATRLCDRLGLSR

SEQ ID NO: 142895 - protein, 24 aa, Mycobacterium avium
AENLREHRKGLLVDLVTDVSVGND

SEQ ID NO: 142896 - protein, 21 aa, Mycobacterium avium
AENREAMGVTVDRLGSITTAL

SEQ ID NO: 142897 - protein, 22 aa, Mycobacterium avium
AEQGWVCLAIDYRVAPHHRWPR

SEQ ID NO: 142898 - protein, 18 aa, Mycobacterium avium
AFAAKGRDLALCARRADR

SEQ ID NO: 142899 - protein, 25 aa, Mycobacterium avium
AGATAVSLSACGTSNKSSPTSTSTS

SEQ ID NO: 142900 - protein, 17 aa, Mycobacterium avium
AGCAAVVIAAAGCGGGG

SEQ ID NO: 142901 - protein, 18 aa, Mycobacterium avium
AGCVRVVVGRAVMSGPKL

SEQ ID NO: 142902 - protein, 18 aa, Mycobacterium avium
AGGIKPGNAVRVSGMGVG

SEQ ID NO: 142903 - protein, 18 aa, Mycobacterium avium
AGHAGLFTGAPWVVSVDD

SEQ ID NO: 142904 - protein, 24 aa, Mycobacterium avium
AGHGRSGFLLAPWTAEQIVSELAP

SEQ ID NO: 142905 - protein, 17 aa, Mycobacterium avium
AGIPAGGLFSGAEGKMS

SEQ ID NO: 142906 - protein, 25 aa, Mycobacterium avium
AGNPEIRPAHLLMALLTQADGIAAP

SEQ ID NO: 142907 - protein, 27 aa, Mycobacterium avium
AGPPEHLEWIGQWGIFDALRSGTQVVR

SEQ ID NO: 142908 - protein, 18 aa, Mycobacterium avium
AGPVGRVSVTNGIAAAGN

SEQ ID NO: 142909 - protein, 18 aa, Mycobacterium avium
AGVVGWWVNPQAPGIDAC

SEQ ID NO: 142910 - protein, 19 aa, Mycobacterium avium
AHSFVDAWNYGALSTNAQL

SEQ ID NO: 142911 - protein, 25 aa, Mycobacterium avium
AIDPKVRPWRGQWVTLIVTSVGDDA

SEQ ID NO: 142912 - protein, 24 aa, Mycobacterium avium
AIIRDCANTSIGVWSDNSLDRTVV

SEQ ID NO: 142913 - protein, 22 aa, Mycobacterium avium
AISETYPPGSTFKVITTAAALQ

SEQ ID NO: 142914 - protein, 31 aa, Mycobacterium avium
AKRRCGGADAWNLPVVFGPLAITYNLAAVDS

SEQ ID NO: 142915 - protein, 25 aa, Mycobacterium avium
AKRSPRPGHRRIVLRFMTSPIEIKG

SEQ ID NO: 142916 - protein, 21 aa, Mycobacterium avium
ALNMVKCVHWPTGSPPPSPKS

SEQ ID NO: 142917 - protein, 20 aa, Mycobacterium avium
ALPESARRAPLSGMAVGPHR

SEQ ID NO: 142918 - protein, 26 aa, Mycobacterium avium
ALSDVPPELTALIGRDDDRGTETVAV

SEQ ID NO: 142919 - protein, 23 aa, Mycobacterium avium
ALSSREYLASGIFVGSLSGPTQP

SEQ ID NO: 142920 - protein, 20 aa, Mycobacterium avium
ALVICTGVSNGFWRRPTLQS

SEQ ID NO: 142921 - protein, 20 aa, Mycobacterium avium
APCDNYERFIFGRGPSGQAE

SEQ ID NO: 142922 - protein, 19 aa, Mycobacterium avium
APGDWLYFVTIDAAGTTLF

SEQ ID NO: 142923 - protein, 25 aa, Mycobacterium avium
APGHYTLRATVDWQQHKPDASHVVN

SEQ ID NO: 142924 - protein, 34 aa, Mycobacterium avium
APGPHARVDCGLAGTVLRFVPPLAALADAVVEFD

SEQ ID NO: 142925 - protein, 18 aa, Mycobacterium avium
APIILQFDAPISDKAAVE

SEQ ID NO: 142926 - protein, 25 aa, Mycobacterium avium
APLPAGTYCKIPMDATNVVRGARNY

SEQ ID NO: 142927 - protein, 24 aa, Mycobacterium avium
AQAFARTLVGFSYHGPDGQTVPDR

SEQ ID NO: 142928 - protein, 18 aa, Mycobacterium avium
AQTVPRKAARLTIDGATH

SEQ ID NO: 142929 - protein, 20 aa, Mycobacterium avium
ARAAATVLFLALLVLTGCSR

SEQ ID NO: 142930 - protein, 17 aa, Mycobacterium avium
ARAGCQYGGPVLSKCDG

SEQ ID NO: 142931 - protein, 21 aa, Mycobacterium avium
ARASELVRLTSDFGIKESTLR

SEQ ID NO: 142932 - protein, 18 aa, Mycobacterium avium
ARGVRWALSTAPGFADRS

SEQ ID NO: 142933 - protein, 18 aa, Mycobacterium avium
ARPDCPVPAAPAFSAATG

SEQ ID NO: 142934 - protein, 19 aa, Mycobacterium avium
ARVAVFAVAGATAVSLSAC

SEQ ID NO: 142935 - protein, 22 aa, Mycobacterium avium
ASFTGFPARHIPVLRTVDYRSA

SEQ ID NO: 142936 - protein, 24 aa, Mycobacterium avium
ASYDASLRVSWRQLQPVDPRTLPP

SEQ ID NO: 142937 - protein, 23 aa, Mycobacterium avium
ATESAPELTVWPVGTALHQPVWS

SEQ ID NO: 142938 - protein, 21 aa, Mycobacterium avium
ATLEVPGRFQAKGMGSGGAKG

SEQ ID NO: 142939 - protein, 25 aa, Mycobacterium avium
ATSVPRCVGNTLLLNGRTYSPPYTI

SEQ ID NO: 142940 - protein, 18 aa, Mycobacterium avium
AVDFVGWYNAHPNFEEAT

SEQ ID NO: 142941 - protein, 20 aa, Mycobacterium avium
AVEPIIWRTYEQSLPADAVE

SEQ ID NO: 142942 - protein, 17 aa, Mycobacterium avium
AVGELTPSVAALAALAT

SEQ ID NO: 142943 - protein, 17 aa, Mycobacterium avium
AVGSLRPILSAVLAETS

SEQ ID NO: 142944 - protein, 25 aa, Mycobacterium avium
AVILLDRGTCPFAQKEDVAAQRGAV

SEQ ID NO: 142945 - protein, 28 aa, Mycobacterium avium
AVNGLREAARRAGVPVVEVRETLPDGAD

SEQ ID NO: 142946 - protein, 18 aa, Mycobacterium avium
AVQKCPNTKIVLGGYSQG

SEQ ID NO: 142947 - protein, 24 aa, Mycobacterium avium
AVRRRPYTVILFDEIEKAHPDVFD

SEQ ID NO: 142948 - protein, 29 aa, Mycobacterium avium
AVSAPALARRWWAAHGRGAFVAVNGAAAR

SEQ ID NO: 142949 - protein, 19 aa, Mycobacterium avium
AVSEVRAVVRWARSQASTL

SEQ ID NO: 142950 - protein, 17 aa, Mycobacterium avium
AVVCLAGGLLALRFPVF

SEQ ID NO: 142951 - protein, 21 aa, Mycobacterium avium
AVVGIYGRYDWEDRSTPERVR

SEQ ID NO: 142952 - protein, 18 aa, Mycobacterium avium
AYKAWAITPDELILYMPD

SEQ ID NO: 142953 - protein, 19 aa, Mycobacterium avium
AYRNGNFPEQFNVTNIAPA

SEQ ID NO: 142954 - protein, 17 aa, Mycobacterium avium
CAGLRAGALTGDDTVRP

SEQ ID NO: 142955 - protein, 18 aa, Mycobacterium avium
CAIEGFEAVRARLRRHGP

SEQ ID NO: 142956 - protein, 26 aa, Mycobacterium avium
CGGNPAWDLPLVFGPIAITYNLPGNP

SEQ ID NO: 142957 - protein, 17 aa, Mycobacterium avium
CPMLSQPGGNFAAVASS

SEQ ID NO: 142958 - protein, 21 aa, Mycobacterium avium
CVAVYRIMPAEAIGYHSALRF

SEQ ID NO: 142959 - protein, 17 aa, Mycobacterium avium
CWVLPRLDVATPPAVQA

SEQ ID NO: 142960 - protein, 29 aa, Mycobacterium avium
DAALAAAGYLCWRGKDLATPRGWITALRA

SEQ ID NO: 142961 - protein, 20 aa, Mycobacterium avium
DAAPAQWMPPNAAFHCQYAM

SEQ ID NO: 142962 - protein, 24 aa, Mycobacterium avium
DAAPGRITAVLGLHDLMNGGHPGQ

SEQ ID NO: 142963 - protein, 30 aa, Mycobacterium avium
DADGAIWARYGVPWQPAYVFYRADGSSTFV

SEQ ID NO: 142964 - protein, 20 aa, Mycobacterium avium
DAKPSALLDHEARRVSEIDV

SEQ ID NO: 142965 - protein, 26 aa, Mycobacterium avium
DAPLDDWQWTLGINLWGPIHGCHVFT

SEQ ID NO: 142966 - protein, 24 aa, Mycobacterium avium
DATTLPRRHRVVLSRGPYRYDDEL

SEQ ID NO: 142967 - protein, 19 aa, Mycobacterium avium
DELLPMLSTMGFDTSRVGF

SEQ ID NO: 142968 - protein, 23 aa, Mycobacterium avium
DEPVSTGWIGRWLDATGDDPLRA

SEQ ID NO: 142969 - protein, 20 aa, Mycobacterium avium
DETKQFVGRCVDKMGKKFLA

SEQ ID NO: 142970 - protein, 19 aa, Mycobacterium avium
DGLGGVMDYLFGLDRDQLN

SEQ ID NO: 142971 - protein, 22 aa, Mycobacterium avium
DGSHAIKITIGIYDDPGAATNA

SEQ ID NO: 142972 - protein, 18 aa, Mycobacterium avium
DGTPGFQASVDYVAKALR

SEQ ID NO: 142973 - protein, 17 aa, Mycobacterium avium
DHLRAFAAYELQMRESV

SEQ ID NO: 142974 - protein, 24 aa, Mycobacterium avium
DIAEVVSAWTGIPAGRMLEGETAK

SEQ ID NO: 142975 - protein, 17 aa, Mycobacterium avium
DIFHVVIGAENWRQELA

SEQ ID NO: 142976 - protein, 20 aa, Mycobacterium avium
DIPPRADGVYTRGGGPVQRW

SEQ ID NO: 142977 - protein, 22 aa, Mycobacterium avium
DIRARGRLIVGLDIGSNLFSFR

SEQ ID NO: 142978 - protein, 27 aa, Mycobacterium avium
DLPSSAQLPVWLSRAGADVLAAHPIVA

SEQ ID NO: 142979 - protein, 17 aa, Mycobacterium avium
DMAIKLGLRSYADPGTA

SEQ ID NO: 142980 - protein, 23 aa, Mycobacterium avium
DMRRRATMYLTYWTAGDTRNRGR

SEQ ID NO: 142981 - protein, 26 aa, Mycobacterium avium
DNGGWPFYHMEMMLSGIPIPVPPGEP

SEQ ID NO: 142982 - protein, 22 aa, Mycobacterium avium
DNLPAKFLEGFVRTSNLKFQDA

SEQ ID NO: 142983 - protein, 21 aa, Mycobacterium avium
DNLPTCVIKYIPLHTPAVVMS

SEQ ID NO: 142984 - protein, 24 aa, Mycobacterium avium
DNLVWKPTVALGYGRNYTLTITSR

SEQ ID NO: 142985 - protein, 17 aa, Mycobacterium avium
DPARVAQQLALLGDQAA

SEQ ID NO: 142986 - protein, 18 aa, Mycobacterium avium
DPHRGRLAGIVVQLLTLA

SEQ ID NO: 142987 - protein, 19 aa, Mycobacterium avium
DPHSAPVLLGTDGSPASEL

SEQ ID NO: 142988 - protein, 24 aa, Mycobacterium avium
DPIVFAFNCALNIVSSTPEQISAA

SEQ ID NO: 142989 - protein, 17 aa, Mycobacterium avium
DQYFTPQAIVIGHLNHL

SEQ ID NO: 142990 - protein, 19 aa, Mycobacterium avium
DRFDCGRAFLVGDSAHTMP

SEQ ID NO: 142991 - protein, 25 aa, Mycobacterium avium
DRLQVKTIWAARAISVLFPQITTIY

SEQ ID NO: 142992 - protein, 20 aa, Mycobacterium avium
DRYWPAHSTIALTVGGVSTE

SEQ ID NO: 142993 - protein, 20 aa, Mycobacterium avium
DSVAKLGYYSQFRDQSITKA

SEQ ID NO: 142994 - protein, 23 aa, Mycobacterium avium
DTPVVSTLPWFALGDPYVTGHVT

SEQ ID NO: 142995 - protein, 18 aa, Mycobacterium avium
DVAPGMSSQRGWVFLATG

SEQ ID NO: 142996 - protein, 20 aa, Mycobacterium avium
DVRWDMNVCHHWYWVPVGGM

SEQ ID NO: 142997 - protein, 19 aa, Mycobacterium avium
DVYPIVLATYEIVCSKYPG

SEQ ID NO: 142998 - protein, 20 aa, Mycobacterium avium
DWAALYRKAIGWLNNPLGSL

SEQ ID NO: 142999 - protein, 26 aa, Mycobacterium avium
EAGLPMLCLGDRGWQEGWFTGAGFFP

SEQ ID NO: 143000 - protein, 19 aa, Mycobacterium avium
EAHDVCYDLTWGWTPQQIA

SEQ ID NO: 143001 - protein, 21 aa, Mycobacterium avium
EAISALGDHADDIFSTVRNLQ

SEQ ID NO: 143002 - protein, 24 aa, Mycobacterium avium
EALRCLKRRLARIIFGHLHTDHQH

SEQ ID NO: 143003 - protein, 36 aa, Mycobacterium avium
EDLGYGRRQICERLRLLPLRPFRNSYAYTNYGITAA

SEQ ID NO: 143004 - protein, 19 aa, Mycobacterium avium
EGALARRNLVLDTMIENIP

SEQ ID NO: 143005 - protein, 20 aa, Mycobacterium avium
EGKMSADQAKLWGGTADQPF

SEQ ID NO: 143006 - protein, 18 aa, Mycobacterium avium
EHHLDCIVFATGYDVHLT

SEQ ID NO: 143007 - protein, 22 aa, Mycobacterium avium
EILTRYLNLVSFGNNSFGVQDA

SEQ ID NO: 143008 - protein, 24 aa, Mycobacterium avium
ELPRGCIAAGDRAYFCDYVQEYLS

SEQ ID NO: 143009 - protein, 19 aa, Mycobacterium avium
ENLKPALQGVARFSDTLNS

SEQ ID NO: 143010 - protein, 30 aa, Mycobacterium avium
EPGRAAVPWWPWAPLVQLMRVLPPRLTKMF

SEQ ID NO: 143011 - protein, 18 aa, Mycobacterium avium
EPLRRARCIHNYGHSSNG

SEQ ID NO: 143012 - protein, 24 aa, Mycobacterium avium
ERGIKEFAPLLGVRKAGLFTSSSF

SEQ ID NO: 143013 - protein, 20 aa, Mycobacterium avium
ERLFGRRLADFFTGRDPRGA

SEQ ID NO: 143014 - protein, 18 aa, Mycobacterium avium
ESILAGLISAGAEEYLKS

SEQ ID NO: 143015 - protein, 19 aa, Mycobacterium avium
EVFLYPKARNLSFRSLEIL

SEQ ID NO: 143016 - protein, 23 aa, Mycobacterium avium
EVRRFARERSRWVFSNPDMIHLS

SEQ ID NO: 143017 - protein, 25 aa, Mycobacterium avium
EYITKSGFDYTWFVLNAKIIEKEFA

SEQ ID NO: 143018 - protein, 25 aa, Mycobacterium avium
EYVGHAPRFERVVFRGDVAAREFVA

SEQ ID NO: 143019 - protein, 29 aa, Mycobacterium avium
EYVIKRMGSQMGVPYSWGGGSLDGPSKGV

SEQ ID NO: 143020 - protein, 24 aa, Mycobacterium avium
FAAQCIAVNCALGPDPKGAVSALL

SEQ ID NO: 143021 - protein, 19 aa, Mycobacterium avium
FADHNGVDWKGTLTGLAGY

SEQ ID NO: 143022 - protein, 47 aa, Mycobacterium avium
FADIPQFICSSIEAASRARLARVSKLCLQYLNPIIKNRIYNYIPAGI

SEQ ID NO: 143023 - protein, 20 aa, Mycobacterium avium
FAERGFRRASTWLGATAAAI

SEQ ID NO: 143024 - protein, 20 aa, Mycobacterium avium
FATGLPQWFMDGGTVQAHIP

SEQ ID NO: 143025 - protein, 27 aa, Mycobacterium avium
FCVGGRCPDVLMAWELSYAELADRGVL

SEQ ID NO: 143026 - protein, 18 aa, Mycobacterium avium
FGIVEGYGGHGIGRQMHM

SEQ ID NO: 143027 - protein, 25 aa, Mycobacterium avium
FGKRDVMVIHTLLWPDEIRDPDFPI

SEQ ID NO: 143028 - protein, 18 aa, Mycobacterium avium
FGPLEARDELAACEILAD

SEQ ID NO: 143029 - protein, 17 aa, Mycobacterium avium
FGQLRFEDRTGYQAVFT

SEQ ID NO: 143030 - protein, 18 aa, Mycobacterium avium
FHDMPVVPLWNYISVVGW

SEQ ID NO: 143031 - protein, 18 aa, Mycobacterium avium
FHSPGMGTGAVFTHTFSA

SEQ ID NO: 143032 - protein, 19 aa, Mycobacterium avium
FKNTVNGFGIYQPQDQLAW

SEQ ID NO: 143033 - protein, 17 aa, Mycobacterium avium
FLATMVVAGSFAVALIV

SEQ ID NO: 143034 - protein, 22 aa, Mycobacterium avium
FLSSELPDWLAANKGLAPGGHA

SEQ ID NO: 143035 - protein, 17 aa, Mycobacterium avium
FLTQEMPLWMQSNKQVS

SEQ ID NO: 143036 - protein, 34 aa, Mycobacterium avium
FPQPDGSMALWCWWPMPFARSARVSLANTGAGPV

SEQ ID NO: 143037 - protein, 22 aa, Mycobacterium avium
FPVTQWTRWRQPVIGMPTTPRF

SEQ ID NO: 143038 - protein, 18 aa, Mycobacterium avium
FRRASTWLGATAAAIEAC

SEQ ID NO: 143039 - protein, 20 aa, Mycobacterium avium
FSGAQLRGGVQVVDAPQIDS

SEQ ID NO: 143040 - protein, 38 aa, Mycobacterium avium
FSLGGLAYLLAPIAWMLGLRIVPMLAPGSADANGYEFR

SEQ ID NO: 143041 - protein, 21 aa, Mycobacterium avium
FSRNQFLAGRMALFQSGTYNL

SEQ ID NO: 143042 - protein, 24 aa, Mycobacterium avium
FVIVDECHYYRGVFGSHVAMVLRR

SEQ ID NO: 143043 - protein, 25 aa, Mycobacterium avium
FWTPWCPYCNAEAPGVSRVAAANPG

SEQ ID NO: 143044 - protein, 26 aa, Mycobacterium avium
GAEALVRWRHPIWGLLLPDSFIGVAE

SEQ ID NO: 143045 - protein, 19 aa, Mycobacterium avium
GANIVGFDCSGLVLYSFAG

SEQ ID NO: 143046 - protein, 25 aa, Mycobacterium avium
GARAFKDSDAWFLIRAVTEPDATTL

SEQ ID NO: 143047 - protein, 21 aa, Mycobacterium avium
GASKLALQWTRSVKGSLAAGP

SEQ ID NO: 143048 - protein, 18 aa, Mycobacterium avium
GASLITFVPGFAGDAAPG

SEQ ID NO: 143049 - protein, 18 aa, Mycobacterium avium
GATGNCWAVHTNCPVPGP

SEQ ID NO: 143050 - protein, 24 aa, Mycobacterium avium
GAVAGMPRRLVVGAAGAALLSGLI

SEQ ID NO: 143051 - protein, 17 aa, Mycobacterium avium
GAVPRQGARVGVDAPVN

SEQ ID NO: 143052 - protein, 22 aa, Mycobacterium avium
GDRARPGALGIPVLDTSDVTNR

SEQ ID NO: 143053 - protein, 21 aa, Mycobacterium avium
GDTLVRGRIDAVFAESDGGAT

SEQ ID NO: 143054 - protein, 20 aa, Mycobacterium avium
GDVLPLVVAPIAGVLNVGLK

SEQ ID NO: 143055 - protein, 24 aa, Mycobacterium avium
GDYFGFYFCEVLLKLNGKGGNPIF

SEQ ID NO: 143056 - protein, 23 aa, Mycobacterium avium
GELAAKLMRWTGFSADKVARICL

SEQ ID NO: 143057 - protein, 33 aa, Mycobacterium avium
GEVVKRCYAEILPAARPGALFIDSSTISVADAR

SEQ ID NO: 143058 - protein, 19 aa, Mycobacterium avium
GFAGPLLDGFDNLYVGQPG

SEQ ID NO: 143059 - protein, 19 aa, Mycobacterium avium
GFLASLRSAGIGYATPQGA

SEQ ID NO: 143060 - protein, 23 aa, Mycobacterium avium
GGFKGDPAFHGPMRRDWNYLIGS

SEQ ID NO: 143061 - protein, 24 aa, Mycobacterium avium
GGKLWRAVEKNSYAAYFAETNGLF

SEQ ID NO: 143062 - protein, 27 aa, Mycobacterium avium
GGLGARSWPSRAWQVLSARGSRVSADV

SEQ ID NO: 143063 - protein, 17 aa, Mycobacterium avium
GGQARVWVADGRATALR

SEQ ID NO: 143064 - protein, 32 aa, Mycobacterium avium
GGQHPRYAAAPLRLHPDIHLYCAIPQERSLTA

SEQ ID NO: 143065 - protein, 26 aa, Mycobacterium avium
GGVGARIPRVYGRQATEYVIRRGMSQ

SEQ ID NO: 143066 - protein, 33 aa, Mycobacterium avium
GGYGALRLGAKLGPSRTAGICAISPALYTSYAT

SEQ ID NO: 143067 - protein, 19 aa, Mycobacterium avium
GGYKAWALTPDELILYLPD

SEQ ID NO: 143068 - protein, 19 aa, Mycobacterium avium
GHRAAQYWVLKPTYHNSYW

SEQ ID NO: 143069 - protein, 20 aa, Mycobacterium avium
GKQFLGGLGINLGGNDAPAA

SEQ ID NO: 143070 - protein, 25 aa, Mycobacterium avium
GKQLKARELSGGNNLLFRRNSLTGA

SEQ ID NO: 143071 - protein, 25 aa, Mycobacterium avium
GLAVLPRDKIASLLYETSQAVGGLG

SEQ ID NO: 143072 - protein, 19 aa, Mycobacterium avium
GLGGPARAVVHLRRHRDGP

SEQ ID NO: 143073 - protein, 24 aa, Mycobacterium avium
GLGLHAWGALGFGYAEIGTVTAGP

SEQ ID NO: 143074 - protein, 18 aa, Mycobacterium avium
GLGRNFLQQLGILKPDDT

SEQ ID NO: 143075 - protein, 19 aa, Mycobacterium avium
GLLLHYLPEVDLWTGAVVG

SEQ ID NO: 143076 - protein, 27 aa, Mycobacterium avium
GNMIKPMLARGELRLVGATTLDEYRKY

SEQ ID NO: 143077 - protein, 20 aa, Mycobacterium avium
GNPITGWTLVDWDGIRDFRS

SEQ ID NO: 143078 - protein, 18 aa, Mycobacterium avium
GPAVRPAQPSGCAASDYP

SEQ ID NO: 143079 - protein, 19 aa, Mycobacterium avium
GPDGPAWEHNVRIDLRPNP

SEQ ID NO: 143080 - protein, 17 aa, Mycobacterium avium
GPGSYPADMLIDWIRVW

SEQ ID NO: 143081 - protein, 17 aa, Mycobacterium avium
GPLQTAFTTLELRELGE

SEQ ID NO: 143082 - protein, 21 aa, Mycobacterium avium
GQAFWSFGGLFFVDSPEQRRL

SEQ ID NO: 143083 - protein, 27 aa, Mycobacterium avium
GQLKMARDEGRWEVRWTTTALHAKLGE

SEQ ID NO: 143084 - protein, 17 aa, Mycobacterium avium
GRIRYQRVCELDGEVVE

SEQ ID NO: 143085 - protein, 28 aa, Mycobacterium avium
GRITGVAFSSEFAIGVGTMMTVKNPDPL

SEQ ID NO: 143086 - protein, 24 aa, Mycobacterium avium
GRLRRLALSAAINRAQICRQIFAD

SEQ ID NO: 143087 - protein, 22 aa, Mycobacterium avium
GRPRNEHVFYHLGVAKAVAAAV

SEQ ID NO: 143088 - protein, 19 aa, Mycobacterium avium
GRQYMSWITLEDEVRALLF

SEQ ID NO: 143089 - protein, 19 aa, Mycobacterium avium
GRSISLWTPPGVYTVLDKG

SEQ ID NO: 143090 - protein, 19 aa, Mycobacterium avium
GSEKRPSYADTRQQDTKPF

SEQ ID NO: 143091 - protein, 20 aa, Mycobacterium avium
GSITYNEWSFAQAQKLNMAK

SEQ ID NO: 143092 - protein, 24 aa, Mycobacterium avium
GSPDKTAAAPLVIDVTIAQGQVTP

SEQ ID NO: 143093 - protein, 24 aa, Mycobacterium avium
GSPPRIGFSTPYAVACDFYGGPAP

SEQ ID NO: 143094 - protein, 24 aa, Mycobacterium avium
GSQLRAAGALGAIRYVSDRRPGGN

SEQ ID NO: 143095 - protein, 25 aa, Mycobacterium avium
GSTAELRSATPLGDVFVAIKPPVPA

SEQ ID NO: 143096 - protein, 24 aa, Mycobacterium avium
GSYFWQHNWGSPKGFTHPAAHLHQ

SEQ ID NO: 143097 - protein, 24 aa, Mycobacterium avium
GTIGPMSVPATWSAPTSTHVSPLA

SEQ ID NO: 143098 - protein, 26 aa, Mycobacterium avium
GTPAPVLELRTSWRNPPRTLRVANAI

SEQ ID NO: 143099 - protein, 27 aa, Mycobacterium avium
GTSIYAEYRLSSSVRRAADLGTDPFVA

SEQ ID NO: 143100 - protein, 20 aa, Mycobacterium avium
GVASDAAGVVGWWVNPQAPG

SEQ ID NO: 143101 - protein, 23 aa, Mycobacterium avium
GVLAARGPVAAIFASQLIRTQQT

SEQ ID NO: 143102 - protein, 28 aa, Mycobacterium avium
GVMPASMGRPEFPTPVGSYTVLSKERAV

SEQ ID NO: 143103 - protein, 17 aa, Mycobacterium avium
GVRNIPCESKPWKRAPT

SEQ ID NO: 143104 - protein, 20 aa, Mycobacterium avium
GVTLSWGCARDVLALVDDAR

SEQ ID NO: 143105 - protein, 19 aa, Mycobacterium avium
GYSSPRFDAALATAEAAPD

SEQ ID NO: 143106 - protein, 19 aa, Mycobacterium avium
HAHHTLEFDSTVNYPLDRR

SEQ ID NO: 143107 - protein, 18 aa, Mycobacterium avium
HDALGGKSVVVFRTPDAK

SEQ ID NO: 143108 - protein, 18 aa, Mycobacterium avium
HDGKTVAVAGKFSTVSPS

SEQ ID NO: 143109 - protein, 18 aa, Mycobacterium avium
HDIAFWRSQLPAELAWMA

SEQ ID NO: 143110 - protein, 24 aa, Mycobacterium avium
HIPLFAMYPQWGWGTDDAAQALSY

SEQ ID NO: 143111 - protein, 19 aa, Mycobacterium avium
HLLAEALAVVAGDVPLAFA

SEQ ID NO: 143112 - protein, 17 aa, Mycobacterium avium
HNITYRARIDAVTTGSQ

SEQ ID NO: 143113 - protein, 18 aa, Mycobacterium avium
HPAPMLNAGGSWYEMNNG

SEQ ID NO: 143114 - protein, 29 aa, Mycobacterium avium
HTGGFNRNTWGVAMIGNFDDVPPTPVQLR

SEQ ID NO: 143115 - protein, 17 aa, Mycobacterium avium
HVCSLFLDQVHRSKTRI

SEQ ID NO: 143116 - protein, 18 aa, Mycobacterium avium
IAAFAQMRIVMSTKNDDP

SEQ ID NO: 143117 - protein, 17 aa, Mycobacterium avium
IAFGLVNVPVKVYSATE

SEQ ID NO: 143118 - protein, 17 aa, Mycobacterium avium
IAHRVPIDVLRCALADA

SEQ ID NO: 143119 - protein, 25 aa, Mycobacterium avium
IDLVPEYIGNLLLYFEPASSATTLD

SEQ ID NO: 143120 - protein, 18 aa, Mycobacterium avium
IGKRCLLGANAGLGISLG

SEQ ID NO: 143121 - protein, 25 aa, Mycobacterium avium
IGYHSALRFGIEHGKRNMVEPDYSS

SEQ ID NO: 143122 - protein, 25 aa, Mycobacterium avium
IKALQGGAIYAHWQEIGGMNSVLGA

SEQ ID NO: 143123 - protein, 19 aa, Mycobacterium avium
IKTPASRRSLRPVRIGTDI

SEQ ID NO: 143124 - protein, 23 aa, Mycobacterium avium
ILPPGHEGMGWLAQRGYVPLGYK

SEQ ID NO: 143125 - protein, 18 aa, Mycobacterium avium
IMPAEAIGYHSALRFGIE

SEQ ID NO: 143126 - protein, 20 aa, Mycobacterium avium
INVHGYPNLFVMTGPNSGPG

SEQ ID NO: 143127 - protein, 17 aa, Mycobacterium avium
IPALSGQPPGVIVLVAG

SEQ ID NO: 143128 - protein, 17 aa, Mycobacterium avium
IPDRTDVVWLDHEDNRG

SEQ ID NO: 143129 - protein, 24 aa, Mycobacterium avium
IQASDINAPVPFTGAPPTDNPNGQ

SEQ ID NO: 143130 - protein, 24 aa, Mycobacterium avium
IQIIPELVKQAGFVKVFQRTPCWV

SEQ ID NO: 143131 - protein, 25 aa, Mycobacterium avium
IQSTFVGAICRWQAANPAGLIDITR

SEQ ID NO: 143132 - protein, 18 aa, Mycobacterium avium
IRPDDFVGWRADELPTDP

SEQ ID NO: 143133 - protein, 19 aa, Mycobacterium avium
IRRSDAPRLVDLVRETQAS

SEQ ID NO: 143134 - protein, 18 aa, Mycobacterium avium
IRYQRVCELDGEVVEYRD

SEQ ID NO: 143135 - protein, 18 aa, Mycobacterium avium
ISRAEWGADESLRCGSPQ

SEQ ID NO: 143136 - protein, 26 aa, Mycobacterium avium
ITFDKVNTRITVLGMNNTITYKDGDP

SEQ ID NO: 143137 - protein, 33 aa, Mycobacterium avium
ITLGKIREAWNVPRGADGTPEITGTNGSAGPLG

SEQ ID NO: 143138 - protein, 19 aa, Mycobacterium avium
ITVALGFPSGGRVNATTDL

SEQ ID NO: 143139 - protein, 23 aa, Mycobacterium avium
IVGTCPDLGFISAIPQPLRSLAH

SEQ ID NO: 143140 - protein, 20 aa, Mycobacterium avium
IYDPAMRTLIAFGGKYPTTV

SEQ ID NO: 143141 - protein, 20 aa, Mycobacterium avium
IYSGCAVPPLIGYLGSGKLP

SEQ ID NO: 143142 - protein, 19 aa, Mycobacterium avium
IYTYHSKTLGWCDIAYNAL

SEQ ID NO: 143143 - protein, 25 aa, Mycobacterium avium
KARNLSFRSLEILRGMGLGDEVHAV

SEQ ID NO: 143144 - protein, 20 aa, Mycobacterium avium
KDVGFPYRSALVPRRNAELD

SEQ ID NO: 143145 - protein, 31 aa, Mycobacterium avium
KGNTIAWLYSQRRFEVPSDKIANTMKLAIVS

SEQ ID NO: 143146 - protein, 18 aa, Mycobacterium avium
KGPIKVSVLEPGYIESEM

SEQ ID NO: 143147 - protein, 19 aa, Mycobacterium avium
KGVGTEFQGGVGEGAAKSA

SEQ ID NO: 143148 - protein, 19 aa, Mycobacterium avium
KKLSAPVGIRADCLGVQSP

SEQ ID NO: 143149 - protein, 20 aa, Mycobacterium avium
KLNVLGCASVAVALQDMSWS

SEQ ID NO: 143150 - protein, 17 aa, Mycobacterium avium
KNEPAGVAQITLGANKD

SEQ ID NO: 143151 - protein, 17 aa, Mycobacterium avium
KRAMILTAEGMRESAIK

SEQ ID NO: 143152 - protein, 29 aa, Mycobacterium avium
KTLPKFKRYAMSFGECLGSGPFFKAYVAN

SEQ ID NO: 143153 - protein, 22 aa, Mycobacterium avium
KVFQRTPCWVLPRLDVATPPAV

SEQ ID NO: 143154 - protein, 19 aa, Mycobacterium avium
KVQSLWRGGVGHTWEARIK

SEQ ID NO: 143155 - protein, 17 aa, Mycobacterium avium
KVTFSGAQLRGGVQVVD

SEQ ID NO: 143156 - protein, 20 aa, Mycobacterium avium
KYVLWRLQERVVGRGPQTPM

SEQ ID NO: 143157 - protein, 23 aa, Mycobacterium avium
LAAKEIPEVFAYDYQTVERSLSA

SEQ ID NO: 143158 - protein, 19 aa, Mycobacterium avium
LAAMLRRSAQLAGEAGMSP

SEQ ID NO: 143159 - protein, 17 aa, Mycobacterium avium
LAGCSSTANPPAGSSTT

SEQ ID NO: 143160 - protein, 24 aa, Mycobacterium avium
LAKAAELRYGRIPEVEKKLEAALP

SEQ ID NO: 143161 - protein, 25 aa, Mycobacterium avium
LANAKRWGINHVIWRQKIYPGVGGG

SEQ ID NO: 143162 - protein, 31 aa, Mycobacterium avium
LAPVARDARFRWGVAMMPAGPVGRVSVTNGI

SEQ ID NO: 143163 - protein, 23 aa, Mycobacterium avium
LASSCTWQLSLFIPDGVPPPAGD

SEQ ID NO: 143164 - protein, 17 aa, Mycobacterium avium
LAVAASLVISAAMIHAQ

SEQ ID NO: 143165 - protein, 17 aa, Mycobacterium avium
LAVACSAVMASSGCATN

SEQ ID NO: 143166 - protein, 24 aa, Mycobacterium avium
LAVELARSGAKVAISDVDLEGLAH

SEQ ID NO: 143167 - protein, 18 aa, Mycobacterium avium
LAVGAKCTAAALSPGGGA

SEQ ID NO: 143168 - protein, 26 aa, Mycobacterium avium
LAVVAGDVPLAFALAAGSFRDGTRVA

SEQ ID NO: 143169 - protein, 24 aa, Mycobacterium avium
LCSAPLRHCGEGDLYGGNEPARTW

SEQ ID NO: 143170 - protein, 20 aa, Mycobacterium avium
LDLQEGIAFVHAEDPGYATF

SEQ ID NO: 143171 - protein, 25 aa, Mycobacterium avium
LDRQHRVAAVFLRELLATDLQPVVQ

SEQ ID NO: 143172 - protein, 22 aa, Mycobacterium avium
LEDEVRALLFAIFEPALSGPVN

SEQ ID NO: 143173 - protein, 19 aa, Mycobacterium avium
LEFVPANEVDPMLFDRSYF

SEQ ID NO: 143174 - protein, 20 aa, Mycobacterium avium
LEGETAKLLRMEDELGKRVV

SEQ ID NO: 143175 - protein, 22 aa, Mycobacterium avium
LEPLAGLTAMGMWGARHAPEVI

SEQ ID NO: 143176 - protein, 19 aa, Mycobacterium avium
LESLRPCGVDEVVVIGRRG

SEQ ID NO: 143177 - protein, 20 aa, Mycobacterium avium
LGAGMARAFAAKGRDLALCA

SEQ ID NO: 143178 - protein, 18 aa, Mycobacterium avium
LGHDQLRAAHALTAAIPR

SEQ ID NO: 143179 - protein, 24 aa, Mycobacterium avium
LGRHAAEIYAKFAASHGDKDFSAV

SEQ ID NO: 143180 - protein, 24 aa, Mycobacterium avium
LIATRLCDRLGLSRQQRDCVYYTT

SEQ ID NO: 143181 - protein, 24 aa, Mycobacterium avium
LIGESCLFVPVLRSALKSDGFARA

SEQ ID NO: 143182 - protein, 19 aa, Mycobacterium avium
LKCPFTLGHSRAVARLAGQ

SEQ ID NO: 143183 - protein, 19 aa, Mycobacterium avium
LKTPHVFTVPGEHDSVDDA

SEQ ID NO: 143184 - protein, 25 aa, Mycobacterium avium
LLFTEGKALATLEFDGPTDTLAPPE

SEQ ID NO: 143185 - protein, 23 aa, Mycobacterium avium
LMTDMRDPLTIAFHKAKLRADFL

SEQ ID NO: 143186 - protein, 26 aa, Mycobacterium avium
LNAGGLFGVLTNVVWTNRGPCAIEGF

SEQ ID NO: 143187 - protein, 19 aa, Mycobacterium avium
LNVGLKPGLVIVVPVVKKQ

SEQ ID NO: 143188 - protein, 23 aa, Mycobacterium avium
LPAKQWLAHRGFDPVYGARPLRR

SEQ ID NO: 143189 - protein, 18 aa, Mycobacterium avium
LPEPLVVVDARYRDMVGE

SEQ ID NO: 143190 - protein, 17 aa, Mycobacterium avium
LPEVDLWTGAVVGAEAL

SEQ ID NO: 143191 - protein, 24 aa, Mycobacterium avium
LPIVNASGGPNCRGLPDIPTKQTG

SEQ ID NO: 143192 - protein, 23 aa, Mycobacterium avium
LPKRVRERFDLVGFDPRGVGASR

SEQ ID NO: 143193 - protein, 24 aa, Mycobacterium avium
LQANGFDVGKRMGIGSRETYIPAI

SEQ ID NO: 143194 - protein, 19 aa, Mycobacterium avium
LQEWCGYLGSLVGREPVFE

SEQ ID NO: 143195 - protein, 23 aa, Mycobacterium avium
LRELELPAAVFLATGPIGTDRTL

SEQ ID NO: 143196 - protein, 17 aa, Mycobacterium avium
LRGSRTPDEVVFRDELP

SEQ ID NO: 143197 - protein, 19 aa, Mycobacterium avium
LRKRLTGLLGAFRAFSYGS

SEQ ID NO: 143198 - protein, 26 aa, Mycobacterium avium
LRNKTRLAALRVKDFGKRDVMVIHTL

SEQ ID NO: 143199 - protein, 23 aa, Mycobacterium avium
LSFPANAAPSGWTVFSDDQGPNL

SEQ ID NO: 143200 - protein, 21 aa, Mycobacterium avium
LSLAAVFLALAVGVVLGSGFL

SEQ ID NO: 143201 - protein, 33 aa, Mycobacterium avium
LSYADGDIWDWAVDWDTWVAMSALPPPTAHPPS

SEQ ID NO: 143202 - protein, 19 aa, Mycobacterium avium
LTAALGETVGEVFATLHRE

SEQ ID NO: 143203 - protein, 25 aa, Mycobacterium avium
LTGPRWRLGARDLAALWQRARALGG

SEQ ID NO: 143204 - protein, 17 aa, Mycobacterium avium
LVAVVAVGVGLLCMYKV

SEQ ID NO: 143205 - protein, 17 aa, Mycobacterium avium
LVKVETLAQAVDALHAI

SEQ ID NO: 143206 - protein, 29 aa, Mycobacterium avium
LVNAFYTSRCNLIAWDRGVFMPVAQKYFG

SEQ ID NO: 143207 - protein, 19 aa, Mycobacterium avium
LVQGGGFAGPLLDGFDNLY

SEQ ID NO: 143208 - protein, 18 aa, Mycobacterium avium
LVSIMKWLRPGAVIAITK

SEQ ID NO: 143209 - protein, 17 aa, Mycobacterium avium
LWDTIVIAADAPAATAE

SEQ ID NO: 143210 - protein, 26 aa, Mycobacterium avium
LYCMPQLDAQIGWHIKRLAPQAYTRA

SEQ ID NO: 143211 - protein, 25 aa, Mycobacterium avium
LYEGNVVAVLGMPVGKVSKVTSKGS

SEQ ID NO: 143212 - protein, 17 aa, Mycobacterium avium
MASNFALLSAKYYCPHQ

SEQ ID NO: 143213 - protein, 25 aa, Mycobacterium avium
MGWLAQRGYVPLGYKGDAAKTAKTF

SEQ ID NO: 143214 - protein, 23 aa, Mycobacterium avium
MILPSGGAPYVVWPKTKSDYDAA

SEQ ID NO: 143215 - protein, 20 aa, Mycobacterium avium
MKLPATLFGIGEYRVTVDLP

SEQ ID NO: 143216 - protein, 18 aa, Mycobacterium avium
MNNGVPWSDPRLNPTHFN

SEQ ID NO: 143217 - protein, 21 aa, Mycobacterium avium
MPKGVLWRQHDIFMTSFGGRN

SEQ ID NO: 143218 - protein, 17 aa, Mycobacterium avium
MRLTLGVYTYRSCCNDT

SEQ ID NO: 143219 - protein, 17 aa, Mycobacterium avium
MSALPPPTAHPPSTQIP

SEQ ID NO: 143220 - protein, 20 aa, Mycobacterium avium
MSPTMARMFTTIAIQTYCPQ

SEQ ID NO: 143221 - protein, 20 aa, Mycobacterium avium
MSRAFASSCNTTFAELSSKM

SEQ ID NO: 143222 - protein, 23 aa, Mycobacterium avium
MVAGAKYRGEFEERLKAVLDDIK

SEQ ID NO: 143223 - protein, 23 aa, Mycobacterium avium
MVQIPRLVANNTRIWVYCGNGTP

SEQ ID NO: 143224 - protein, 18 aa, Mycobacterium avium
NAAFHCQYAMQFIAVLRG

SEQ ID NO: 143225 - protein, 18 aa, Mycobacterium avium
NDALRPYFDEMFSGRGDV

SEQ ID NO: 143226 - protein, 19 aa, Mycobacterium avium
NEVDPMLFDRSYFLEPDSK

SEQ ID NO: 143227 - protein, 23 aa, Mycobacterium avium
NGKRLPVPLYPGFDTLGTLEYIT

SEQ ID NO: 143228 - protein, 18 aa, Mycobacterium avium
NGKYFPAPGLQPHAAVDI

SEQ ID NO: 143229 - protein, 19 aa, Mycobacterium avium
NGTITRWDDPALALLNASM

SEQ ID NO: 143230 - protein, 23 aa, Mycobacterium avium
NGVDWKGTLTGLAGYARGDVDTR

SEQ ID NO: 143231 - protein, 23 aa, Mycobacterium avium
NKGLRFEFYANLDTAYADLLSGN

SEQ ID NO: 143232 - protein, 20 aa, Mycobacterium avium
NLAQYPAVLVELGNMKNAGD

SEQ ID NO: 143233 - protein, 23 aa, Mycobacterium avium
NLVPGQFGGPVLDADMYDRFLDP

SEQ ID NO: 143234 - protein, 20 aa, Mycobacterium avium
NPPQVKSVGLGNVNGVTLGY

SEQ ID NO: 143235 - protein, 21 aa, Mycobacterium avium
NPSGLRLVKVETLAQAVDALH

SEQ ID NO: 143236 - protein, 24 aa, Mycobacterium avium
NQPPPCLTGFLPASQWRAPADTST

SEQ ID NO: 143237 - protein, 22 aa, Mycobacterium avium
NRGREMLAFATAYREAGVQPPS

SEQ ID NO: 143238 - protein, 28 aa, Mycobacterium avium
NRPTPDRVRELVVAWGKLYPQFGTVAAL

SEQ ID NO: 143239 - protein, 17 aa, Mycobacterium avium
NSIMVWTLMNTRNAKDS

SEQ ID NO: 143240 - protein, 24 aa, Mycobacterium avium
NSMQVCPKAQCPFNTAESENLQIP

SEQ ID NO: 143241 - protein, 24 aa, Mycobacterium avium
NVNYRIVLKPGWRFTDGSPVTAHS

SEQ ID NO: 143242 - protein, 18 aa, Mycobacterium avium
PAAEKFFRALAVGDTATA

SEQ ID NO: 143243 - protein, 17 aa, Mycobacterium avium
PAAQRCGGNPAWDLPLV

SEQ ID NO: 143244 - protein, 24 aa, Mycobacterium avium
PACAALLADARRAVVGDRRLDTLY

SEQ ID NO: 143245 - protein, 18 aa, Mycobacterium avium
PAFNNAYRTFTFDMANGR

SEQ ID NO: 143246 - protein, 18 aa, Mycobacterium avium
PAGPAAPTHITFKDDPGG

SEQ ID NO: 143247 - protein, 17 aa, Mycobacterium avium
PAKNCYEASSDNPSGLR

SEQ ID NO: 143248 - protein, 18 aa, Mycobacterium avium
PALLAVVALTALATGCGH

SEQ ID NO: 143249 - protein, 25 aa, Mycobacterium avium
PALQRDNCKLIDWPIATLSPAGIRT

SEQ ID NO: 143250 - protein, 21 aa, Mycobacterium avium
PAPNLKPRPLSGATVQQVLLD

SEQ ID NO: 143251 - protein, 21 aa, Mycobacterium avium
PAQVLDVWRRKDLPAQPAPVL

SEQ ID NO: 143252 - protein, 27 aa, Mycobacterium avium
PARKLREIRMALTLDKTFTKPEILTRY

SEQ ID NO: 143253 - protein, 17 aa, Mycobacterium avium
PARTWFTAMKPIATNFG

SEQ ID NO: 143254 - protein, 17 aa, Mycobacterium avium
PCATILVAVTALLAGCV

SEQ ID NO: 143255 - protein, 24 aa, Mycobacterium avium
PDARRPPVFAGTIWVQQGAQPLAD

SEQ ID NO: 143256 - protein, 17 aa, Mycobacterium avium
PDASKWAVAKARETIKD

SEQ ID NO: 143257 - protein, 18 aa, Mycobacterium avium
PDKVARLILDSPVALGVN

SEQ ID NO: 143258 - protein, 21 aa, Mycobacterium avium
PDWPGTRLRAAYHDFAAELMA

SEQ ID NO: 143259 - protein, 19 aa, Mycobacterium avium
PEDFWPRQWAHAYVDFAAG

SEQ ID NO: 143260 - protein, 25 aa, Mycobacterium avium
PEFINRLDDVIIFHGLEPGELVQIV

SEQ ID NO: 143261 - protein, 24 aa, Mycobacterium avium
PELGLRPRLAVGIHQPDPDARRPP

SEQ ID NO: 143262 - protein, 17 aa, Mycobacterium avium
PELYLLWGQANTSAGYR

SEQ ID NO: 143263 - protein, 18 aa, Mycobacterium avium
PEMKKQPFSLQMTGPPPS

SEQ ID NO: 143264 - protein, 18 aa, Mycobacterium avium
PEPGRGSNWLIVGSDSRQ

SEQ ID NO: 143265 - protein, 17 aa, Mycobacterium avium
PEVAFAMVQLGLAFDDM

SEQ ID NO: 143266 - protein, 19 aa, Mycobacterium avium
PFNGPGYTVFPVFNLAVAG

SEQ ID NO: 143267 - protein, 19 aa, Mycobacterium avium
PFTVDRWTPDKVFSGGYKA

SEQ ID NO: 143268 - protein, 21 aa, Mycobacterium avium
PGAFLSFPVTQWTRWRQPVIG

SEQ ID NO: 143269 - protein, 18 aa, Mycobacterium avium
PGANQWMMTAEVGVTNFV

SEQ ID NO: 143270 - protein, 30 aa, Mycobacterium avium
PGGSHSWFAGYRGDLAFAALIVGGGSSEYA

SEQ ID NO: 143271 - protein, 19 aa, Mycobacterium avium
PGICDRIPNTAWIDQHAVP

SEQ ID NO: 143272 - protein, 17 aa, Mycobacterium avium
PGNAVRVSGMGVGRVSD

SEQ ID NO: 143273 - protein, 26 aa, Mycobacterium avium
PGPRFRFEELCGAPALPQDPRDSAVV

SEQ ID NO: 143274 - protein, 24 aa, Mycobacterium avium
PGQPSDYGYLLIKPSDVGGGLSAP

SEQ ID NO: 143275 - protein, 19 aa, Mycobacterium avium
PGTTGVWLIIERPNPNSQN

SEQ ID NO: 143276 - protein, 20 aa, Mycobacterium avium
PGVYPLLLVTYEIVCSKGYD

SEQ ID NO: 143277 - protein, 19 aa, Mycobacterium avium
PHIPLGVLAPVLRPEFGGA

SEQ ID NO: 143278 - protein, 26 aa, Mycobacterium avium
PHLVESAPLPWSFTIVTTLPSMSANI

SEQ ID NO: 143279 - protein, 21 aa, Mycobacterium avium
PKARTGFYGYGFNTSVDASGR

SEQ ID NO: 143280 - protein, 23 aa, Mycobacterium avium
PKNSRLGYRETINYATKISSDGI

SEQ ID NO: 143281 - protein, 23 aa, Mycobacterium avium
PLAAPKNDLAWHDCTSRVFADAA

SEQ ID NO: 143282 - protein, 27 aa, Mycobacterium avium
PLDPPPPCPNCHGGGGNPGGPGGGPGG

SEQ ID NO: 143283 - protein, 21 aa, Mycobacterium avium
PLIHGAAQWSVMTAITTGQTV

SEQ ID NO: 143284 - protein, 25 aa, Mycobacterium avium
PLSAPKARRAFALCTPRDVLAKDAG

SEQ ID NO: 143285 - protein, 25 aa, Mycobacterium avium
PMRRDWNYLIGSIKYVLWRLQERVV

SEQ ID NO: 143286 - protein, 19 aa, Mycobacterium avium
PNGQNYRVIDNVAVPNGLS

SEQ ID NO: 143287 - protein, 19 aa, Mycobacterium avium
PNNPGCAVTDYGSLPVQGA

SEQ ID NO: 143288 - protein, 17 aa, Mycobacterium avium
PNQRLPFGVAPTTEGAR

SEQ ID NO: 143289 - protein, 20 aa, Mycobacterium avium
PNQVLSPGFHGLQIHAVGKC

SEQ ID NO: 143290 - protein, 22 aa, Mycobacterium avium
PNRWQVRPGPVAARHWEVEPDL

SEQ ID NO: 143291 - protein, 19 aa, Mycobacterium avium
PPLSARIPLPGGGALMKIP

SEQ ID NO: 143292 - protein, 20 aa, Mycobacterium avium
PPNRSVSSWVRGTIAALRAE

SEQ ID NO: 143293 - protein, 27 aa, Mycobacterium avium
PPVHNAVRFGFWGAEELGLIGSRNYVE

SEQ ID NO: 143294 - protein, 19 aa, Mycobacterium avium
PPVRHCPDDLYVLYTGGTT

SEQ ID NO: 143295 - protein, 18 aa, Mycobacterium avium
PQKGGSWRQTGCSSPLGA

SEQ ID NO: 143296 - protein, 27 aa, Mycobacterium avium
PQQAGMRIVLHFPYAANVHCEIDVDDD

SEQ ID NO: 143297 - protein, 20 aa, Mycobacterium avium
PQYKHAVVMGVNKNKTPGGG

SEQ ID NO: 143298 - protein, 22 aa, Mycobacterium avium
PRGDGRLSGVIPLERTTSPYDL

SEQ ID NO: 143299 - protein, 21 aa, Mycobacterium avium
PRRLPPGATIPLARTSPALDL

SEQ ID NO: 143300 - protein, 19 aa, Mycobacterium avium
PRSDSIAAGKLSFPANAAP

SEQ ID NO: 143301 - protein, 18 aa, Mycobacterium avium
PSAARTAIGYARQKDEMY

SEQ ID NO: 143302 - protein, 22 aa, Mycobacterium avium
PSETHWTPPSGVVMPGQAPPII

SEQ ID NO: 143303 - protein, 18 aa, Mycobacterium avium
PSVAGLDIDAARQRIKEA

SEQ ID NO: 143304 - protein, 18 aa, Mycobacterium avium
PTGSFMFLGPTGVGKTEL

SEQ ID NO: 143305 - protein, 26 aa, Mycobacterium avium
PTITARLNFQLAFGARVGQRLAEARD

SEQ ID NO: 143306 - protein, 20 aa, Mycobacterium avium
PTPLMLPGFAVRAALGEFAD

SEQ ID NO: 143307 - protein, 25 aa, Mycobacterium avium
PTVDFKLRLGHSAFYPLPQAAFRDM

SEQ ID NO: 143308 - protein, 29 aa, Mycobacterium avium
PTYHNSYWFYSCMVAFKTSYGVLQQALYY

SEQ ID NO: 143309 - protein, 23 aa, Mycobacterium avium
PVSAPRVGGPVQRLSQPEQKAVA

SEQ ID NO: 143310 - protein, 22 aa, Mycobacterium avium
PVSNAVRFVFWGAGEDGLGGVM

SEQ ID NO: 143311 - protein, 18 aa, Mycobacterium avium
PVVWAMVMTLALDCGAVV

SEQ ID NO: 143312 - protein, 23 aa, Mycobacterium avium
PYQHVEKFIPRQITNVLTGRRPK

SEQ ID NO: 143313 - protein, 23 aa, Mycobacterium avium
QATKLMQCLANGPGYANAMPTLG

SEQ ID NO: 143314 - protein, 23 aa, Mycobacterium avium
QCGSALMVRRLWAIPTAVLGGMA

SEQ ID NO: 143315 - protein, 24 aa, Mycobacterium avium
QDSWGEENFQVFGHGPAQSVVFHE

SEQ ID NO: 143316 - protein, 23 aa, Mycobacterium avium
QGAIKFAQAVCVSMGNGESGPQL

SEQ ID NO: 143317 - protein, 22 aa, Mycobacterium avium
QGKVASISVVWTNYGAAAATEH

SEQ ID NO: 143318 - protein, 26 aa, Mycobacterium avium
QGSPRDGWTLISWNGKPVHPGWSATR

SEQ ID NO: 143319 - protein, 21 aa, Mycobacterium avium
QIAPYLRSWESVIGHQRTGVY

SEQ ID NO: 143320 - protein, 23 aa, Mycobacterium avium
QKEKLAELTTRWQNEKNAIDVVR

SEQ ID NO: 143321 - protein, 26 aa, Mycobacterium avium
QNFSGRARMSSMLWTFKVQKDNGVSC

SEQ ID NO: 143322 - protein, 17 aa, Mycobacterium avium
QPNPCTYTPSALYDVRS

SEQ ID NO: 143323 - protein, 25 aa, Mycobacterium avium
QPPRREAICQAGLKIFADMILAFPK

SEQ ID NO: 143324 - protein, 25 aa, Mycobacterium avium
QRHTRSSVMSRLWRRPAPGAAPSSC

SEQ ID NO: 143325 - protein, 19 aa, Mycobacterium avium
QRLPFGVAPTTEGARGSDV

SEQ ID NO: 143326 - protein, 18 aa, Mycobacterium avium
QRTGTGWQSLRSGVPTHV

SEQ ID NO: 143327 - protein, 25 aa, Mycobacterium avium
QRVVMPLIVRWGMYGGVRRNDPLGR

SEQ ID NO: 143328 - protein, 25 aa, Mycobacterium avium
QSAKELCNLMHLRQLGCSTGTLQDY

SEQ ID NO: 143329 - protein, 19 aa, Mycobacterium avium
QSIAAYGLFLLRPESTGAP

SEQ ID NO: 143330 - protein, 19 aa, Mycobacterium avium
QSLKGKFVPISKIVSYNST

SEQ ID NO: 143331 - protein, 23 aa, Mycobacterium avium
QTSEIRSSNRLAYLDAHADGQYE

SEQ ID NO: 143332 - protein, 18 aa, Mycobacterium avium
QVANAITVALGFPSGGRV

SEQ ID NO: 143333 - protein, 18 aa, Mycobacterium avium
QVGCRMLVNDVVRDEQSG

SEQ ID NO: 143334 - protein, 22 aa, Mycobacterium avium
QVWGQYCPGKGLAYNPTGSGAG

SEQ ID NO: 143335 - protein, 23 aa, Mycobacterium avium
RAAETRHGRAFGIVEGYGGHGIG

SEQ ID NO: 143336 - protein, 21 aa, Mycobacterium avium
RADHAWDLARLGWALHGSPAT

SEQ ID NO: 143337 - protein, 25 aa, Mycobacterium avium
RAGTGFLAQLCQDWEAATLPAQYGG

SEQ ID NO: 143338 - protein, 17 aa, Mycobacterium avium
RAMRFGPYSSLPHARVE

SEQ ID NO: 143339 - protein, 21 aa, Mycobacterium avium
RAQGFLLSRPIPGEAMEALLS

SEQ ID NO: 143340 - protein, 25 aa, Mycobacterium avium
RAQPGTRVPHVWVRDGVSTLDLVGP

SEQ ID NO: 143341 - protein, 22 aa, Mycobacterium avium
RASARLLGPLASYLVVNVSSPN

SEQ ID NO: 143342 - protein, 25 aa, Mycobacterium avium
RATEAIEYSRFASWKLNPGEAPADA

SEQ ID NO: 143343 - protein, 24 aa, Mycobacterium avium
RAVECGLRAVGVRAAGLVVRCRNA

SEQ ID NO: 143344 - protein, 19 aa, Mycobacterium avium
RAVFLFRSAAELAYDHRDT

SEQ ID NO: 143345 - protein, 28 aa, Mycobacterium avium
RDDLTLGEALTLWLSDTEQLVPRDLIYP

SEQ ID NO: 143346 - protein, 20 aa, Mycobacterium avium
RGAPPPPREHGYGWNDGPPP

SEQ ID NO: 143347 - protein, 19 aa, Mycobacterium avium
RGMTPRAALTKHLLDGDDS

SEQ ID NO: 143348 - protein, 24 aa, Mycobacterium avium
RGPRGELLSGTLLVTGVSPRPEAT

SEQ ID NO: 143349 - protein, 23 aa, Mycobacterium avium
RGVAELLDVLPLTLENLYNTVDQ

SEQ ID NO: 143350 - protein, 30 aa, Mycobacterium avium
RGVLDEATGRWGLRVARVELRSIDPPPSIQ

SEQ ID NO: 143351 - protein, 17 aa, Mycobacterium avium
RHIPVLRTVDYRSALPE

SEQ ID NO: 143352 - protein, 24 aa, Mycobacterium avium
RHIVDVKTAIAWARANVDKFGGDR

SEQ ID NO: 143353 - protein, 22 aa, Mycobacterium avium
RHPEVFRDASPIARVHRNAPPF

SEQ ID NO: 143354 - protein, 24 aa, Mycobacterium avium
RHRDGPRPWLVWVHGAGQGGTEDL

SEQ ID NO: 143355 - protein, 17 aa, Mycobacterium avium
RIIATSVPRCVGNTLLL

SEQ ID NO: 143356 - protein, 21 aa, Mycobacterium avium
RILDRLFAGLMSYDAAGNPAP

SEQ ID NO: 143357 - protein, 20 aa, Mycobacterium avium
RKATALSLVLTLAVASVLVG

SEQ ID NO: 143358 - protein, 18 aa, Mycobacterium avium
RLAAQGWPFDDADQAGDP

SEQ ID NO: 143359 - protein, 24 aa, Mycobacterium avium
RLEGTKVRIGFTVRKGVVLGDRTE

SEQ ID NO: 143360 - protein, 18 aa, Mycobacterium avium
RLGVRWAPPLHDLAEADA

SEQ ID NO: 143361 - protein, 31 aa, Mycobacterium avium
RPHDWPAWAEPEVVGAFAARGIKSPWSHQFT

SEQ ID NO: 143362 - protein, 18 aa, Mycobacterium avium
RPKKLNVLGCASVAVALQ

SEQ ID NO: 143363 - protein, 18 aa, Mycobacterium avium
RQALPMLGPDTAVLTIQN

SEQ ID NO: 143364 - protein, 24 aa, Mycobacterium avium
RQLTPDFRPGCKRMLVSSDYYPAL

SEQ ID NO: 143365 - protein, 24 aa, Mycobacterium avium
RRGMSQIGVPYSWGGGNAAGPSKG

SEQ ID NO: 143366 - protein, 19 aa, Mycobacterium avium
RRLSGEVIDFIELDMPEHT

SEQ ID NO: 143367 - protein, 17 aa, Mycobacterium avium
RRSLRPVRIGTDIFGKT

SEQ ID NO: 143368 - protein, 19 aa, Mycobacterium avium
RRWEFPQGTAPELADADPV

SEQ ID NO: 143369 - protein, 24 aa, Mycobacterium avium
RSDGGVVTPMVHDFIARGPNGQNY

SEQ ID NO: 143370 - protein, 18 aa, Mycobacterium avium
RSLLAGVDVALWVTTDEV

SEQ ID NO: 143371 - protein, 20 aa, Mycobacterium avium
RSREIEVLEFVPANEVDPML

SEQ ID NO: 143372 - protein, 22 aa, Mycobacterium avium
RSRSFARAAARGVIPGSRAGVW

SEQ ID NO: 143373 - protein, 19 aa, Mycobacterium avium
RSSGIPGMAVAIVHGGKVL

SEQ ID NO: 143374 - protein, 18 aa, Mycobacterium avium
RSTWDVPALALIGIGNGA

SEQ ID NO: 143375 - protein, 24 aa, Mycobacterium avium
RTDRWSRRRVTLVGDAGYCPGPAV

SEQ ID NO: 143376 - protein, 17 aa, Mycobacterium avium
RTMLTALAADWPLLHSP

SEQ ID NO: 143377 - protein, 19 aa, Mycobacterium avium
RTTVLLDEIVTLVGRDERL

SEQ ID NO: 143378 - protein, 22 aa, Mycobacterium avium
RVDCGNFDRFYFATKQFVYQLK

SEQ ID NO: 143379 - protein, 23 aa, Mycobacterium avium
RVDGAPLPWTLVLSTTAPSVFPN

SEQ ID NO: 143380 - protein, 19 aa, Mycobacterium avium
RWEAEFGVGRLLGSEGFIA

SEQ ID NO: 143381 - protein, 26 aa, Mycobacterium avium
SAAMGRDIPVAFLAGGPHAVYLLDAF

SEQ ID NO: 143382 - protein, 22 aa, Mycobacterium avium
SAARRPPIPGSDCAGVHYLRTY

SEQ ID NO: 143383 - protein, 29 aa, Mycobacterium avium
SASLSFSSLSGWAQLGLRDRFLALTDAVW

SEQ ID NO: 143384 - protein, 25 aa, Mycobacterium avium
SCDVPSLLYSYSFVKNPTWSRTYSP

SEQ ID NO: 143385 - protein, 17 aa, Mycobacterium avium
SDLNWQQAALLAGMVQS

SEQ ID NO: 143386 - protein, 23 aa, Mycobacterium avium
SDRRPGGNWMLGKPIQVAEARDL

SEQ ID NO: 143387 - protein, 20 aa, Mycobacterium avium
SEAAEAFARRLSTLLCDRLT

SEQ ID NO: 143388 - protein, 21 aa, Mycobacterium avium
SEGWWPTLIGLAMNDSGGYNA

SEQ ID NO: 143389 - protein, 17 aa, Mycobacterium avium
SELIRRGEFDDVDIGVL

SEQ ID NO: 143390 - protein, 21 aa, Mycobacterium avium
SFAQAQKLNMAKIITSAGPDA

SEQ ID NO: 143391 - protein, 22 aa, Mycobacterium avium
SFDAMAAAWGLKGPDGDDPPWR

SEQ ID NO: 143392 - protein, 23 aa, Mycobacterium avium
SGDTRLPAGGMLFIGTPEGQKVA

SEQ ID NO: 143393 - protein, 26 aa, Mycobacterium avium
SGGAKGCPKDTWCVVNAGNYKGSMNV

SEQ ID NO: 143394 - protein, 24 aa, Mycobacterium avium
SGGGESWSALTTMILPSGGAPYVV

SEQ ID NO: 143395 - protein, 17 aa, Mycobacterium avium
SGISGSHGLVFTGTPKS

SEQ ID NO: 143396 - protein, 27 aa, Mycobacterium avium
SGKFEWLDNRVVQWVPDRYWPAHSTIA

SEQ ID NO: 143397 - protein, 22 aa, Mycobacterium avium
SGKRLACGVIAASSATSTTTTP

SEQ ID NO: 143398 - protein, 28 aa, Mycobacterium avium
SGYGALPIYVVFVYFRAPWRKFIPHLHD

SEQ ID NO: 143399 - protein, 22 aa, Mycobacterium avium
SHPRAAAADVRIPLGGGAGIVV

SEQ ID NO: 143400 - protein, 20 aa, Mycobacterium avium
SIGSAFRSGWQGDYPSMIEF

SEQ ID NO: 143401 - protein, 18 aa, Mycobacterium avium
SLPDWPFNGPGYTVFPVF

SEQ ID NO: 143402 - protein, 25 aa, Mycobacterium avium
SLQQAFALSCNTAFVQLGILTGADA

SEQ ID NO: 143403 - protein, 22 aa, Mycobacterium avium
SMGKPSRPTPIGNFTALEKQRS

SEQ ID NO: 143404 - protein, 22 aa, Mycobacterium avium
SNALNLPAHAKVKLAGADVGQL

SEQ ID NO: 143405 - protein, 24 aa, Mycobacterium avium
SPEGYKITAQYAVRVTWSGVYVHS

SEQ ID NO: 143406 - protein, 25 aa, Mycobacterium avium
SQADSADTLGRWAANLNTLAAQTAR

SEQ ID NO: 143407 - protein, 17 aa, Mycobacterium avium
SRGRPGPLSGPDLADPA

SEQ ID NO: 143408 - protein, 19 aa, Mycobacterium avium
SRTPDEVVFRDELPTTATG

SEQ ID NO: 143409 - protein, 19 aa, Mycobacterium avium
SRVSFRIGDAHVSIADDAT

SEQ ID NO: 143410 - protein, 27 aa, Mycobacterium avium
SSAVAVGWPDLMRAARDRPLAPGAGVL

SEQ ID NO: 143411 - protein, 19 aa, Mycobacterium avium
SSFYSDWYKPACGKAGCTT

SEQ ID NO: 143412 - protein, 23 aa, Mycobacterium avium
SSPMAQSYIQRFLASPPAKRQQM

SEQ ID NO: 143413 - protein, 25 aa, Mycobacterium avium
SSSPRKEQAWEFVKFATGPVGQALI

SEQ ID NO: 143414 - protein, 26 aa, Mycobacterium avium
SSVVLFGMPNVRAMNFLNEPPVVIGP

SEQ ID NO: 143415 - protein, 18 aa, Mycobacterium avium
STLLCDRLTIGGHVISRT

SEQ ID NO: 143416 - protein, 25 aa, Mycobacterium avium
STLRNHARWAVLLRGLRFVIVDECH

SEQ ID NO: 143417 - protein, 39 aa, Mycobacterium avium
STSSRFADFLARPNRAVNHIKIGDSWQARFQRNPDAQSP

SEQ ID NO: 143418 - protein, 22 aa, Mycobacterium avium
SVARLVGAPPGYIGYDQGGQLT

SEQ ID NO: 143419 - protein, 25 aa, Mycobacterium avium
SVGALVMSVACSRPGAATESAPELT

SEQ ID NO: 143420 - protein, 23 aa, Mycobacterium avium
TAADLRTSSGSALILHQNANNLA

SEQ ID NO: 143421 - protein, 27 aa, Mycobacterium avium
TAGKLMVFAAASLRPAFTQIAERFKAQ

SEQ ID NO: 143422 - protein, 18 aa, Mycobacterium avium
TAICSPGIDALHAAEHPA

SEQ ID NO: 143423 - protein, 22 aa, Mycobacterium avium
TASIEIGNTINYGSMGTTTTLD

SEQ ID NO: 143424 - protein, 24 aa, Mycobacterium avium
TATPDTRVAPAYRQSVSASVSASS

SEQ ID NO: 143425 - protein, 20 aa, Mycobacterium avium
TDAETTWKLLLDSQSGIRTL

SEQ ID NO: 143426 - protein, 24 aa, Mycobacterium avium
TDAITPGKCLSARGTNDSGGALQA

SEQ ID NO: 143427 - protein, 34 aa, Mycobacterium avium
TDFEEGLRETIDWYRANESWWRPLKDASEARYEE

SEQ ID NO: 143428 - protein, 23 aa, Mycobacterium avium
TDPFVAIVAFPFLPQALRGNYNQ

SEQ ID NO: 143429 - protein, 19 aa, Mycobacterium avium
TGFDFPFAAMGSVHTENHI

SEQ ID NO: 143430 - protein, 23 aa, Mycobacterium avium
TKNVKSVHLVLSIQGKISGLPIK

SEQ ID NO: 143431 - protein, 23 aa, Mycobacterium avium
TKTTWMSGCRSWYLTKDGFNGSM

SEQ ID NO: 143432 - protein, 20 aa, Mycobacterium avium
TLYDELCWAPKHTDFEEGLR

SEQ ID NO: 143433 - protein, 19 aa, Mycobacterium avium
TNGLASLPLPAPGIGSGGY

SEQ ID NO: 143434 - protein, 21 aa, Mycobacterium avium
TNGLFPPGSTFKMITAGAAVD

SEQ ID NO: 143435 - protein, 19 aa, Mycobacterium avium
TNNKITFDKVNTRITVLGM

SEQ ID NO: 143436 - protein, 18 aa, Mycobacterium avium
TPAFEWYNQSGISVAMPV

SEQ ID NO: 143437 - protein, 18 aa, Mycobacterium avium
TPASLPYTAGAKVDCGGK

SEQ ID NO: 143438 - protein, 25 aa, Mycobacterium avium
TPINYRLSAEGIRALIERLPEPLVV

SEQ ID NO: 143439 - protein, 18 aa, Mycobacterium avium
TPKSAGFDHRVSVSVDLS

SEQ ID NO: 143440 - protein, 20 aa, Mycobacterium avium
TPPHAWYIAFAPAQTPKVAV

SEQ ID NO: 143441 - protein, 17 aa, Mycobacterium avium
TPVAVEVPFEMPIGDTL

SEQ ID NO: 143442 - protein, 17 aa, Mycobacterium avium
TRLPAPIRALGTDDTRI

SEQ ID NO: 143443 - protein, 21 aa, Mycobacterium avium
TRTKTPVAFDRVLDMLDKVSK

SEQ ID NO: 143444 - protein, 30 aa, Mycobacterium avium
TSDALGAPGTEVWTFAALKPGSTTITTSYS

SEQ ID NO: 143445 - protein, 25 aa, Mycobacterium avium
TTNPPVEGSWAWLPDEAQGARAHWR

SEQ ID NO: 143446 - protein, 19 aa, Mycobacterium avium
TTPDARWAGALASGRAGYF

SEQ ID NO: 143447 - protein, 24 aa, Mycobacterium avium
TTQLKTAEGIPVANASFEFANGYA

SEQ ID NO: 143448 - protein, 24 aa, Mycobacterium avium
TTTLDCAGGKSLNVGGSDNTLTVT

SEQ ID NO: 143449 - protein, 25 aa, Mycobacterium avium
TVLRITPGLIRRYAVVGGDHNPIHT

SEQ ID NO: 143450 - protein, 21 aa, Mycobacterium avium
TWNTLYRKWLTVLGPAPAPPT

SEQ ID NO: 143451 - protein, 20 aa, Mycobacterium avium
TYNFTFSFEKAGQASVLVPI

SEQ ID NO: 143452 - protein, 22 aa, Mycobacterium avium
VAAALPMFLPAGVCAAASNTAT

SEQ ID NO: 143453 - protein, 23 aa, Mycobacterium avium
VAADLGYQVPTLWSGSLSDSTLI

SEQ ID NO: 143454 - protein, 17 aa, Mycobacterium avium
VAANWQASGGWTDGAHR

SEQ ID NO: 143455 - protein, 18 aa, Mycobacterium avium
VAEWPRRTDAAGPMAALR

SEQ ID NO: 143456 - protein, 19 aa, Mycobacterium avium
VAGAMYWDRVQTRGEQAAR

SEQ ID NO: 143457 - protein, 24 aa, Mycobacterium avium
VATDNRFRFLRVYPNPAQYAPVTG

SEQ ID NO: 143458 - protein, 21 aa, Mycobacterium avium
VAVDPRARWERLYQLVNHVLE

SEQ ID NO: 143459 - protein, 26 aa, Mycobacterium avium
VAVKQGWMCCIGADWMHLSTGVIGAD

SEQ ID NO: 143460 - protein, 23 aa, Mycobacterium avium
VDALRPMMRLVVTNGTAKEIAGC

SEQ ID NO: 143461 - protein, 25 aa, Mycobacterium avium
VDGYPQRFGIPDGLYAEPVAVKQGW

SEQ ID NO: 143462 - protein, 17 aa, Mycobacterium avium
VDMLKIDAGFVREVGTD

SEQ ID NO: 143463 - protein, 24 aa, Mycobacterium avium
VDWSGIPYLRFLASNVGRGQPLAH

SEQ ID NO: 143464 - protein, 26 aa, Mycobacterium avium
VELTPPYRGGPVLKNHDTIGLTRTKT

SEQ ID NO: 143465 - protein, 24 aa, Mycobacterium avium
VEPDRRIGAIFIDGGPLHVCTGSV

SEQ ID NO: 143466 - protein, 18 aa, Mycobacterium avium
VEVSDGWFQHVTLSNSSG

SEQ ID NO: 143467 - protein, 28 aa, Mycobacterium avium
VFNFPANGTHSWPYWNQQLMAMKPDMQQ

SEQ ID NO: 143468 - protein, 21 aa, Mycobacterium avium
VGANLMKFGPLLGELLARAAL

SEQ ID NO: 143469 - protein, 23 aa, Mycobacterium avium
VGDPIQSIYGWRGASATNLPRFT

SEQ ID NO: 143470 - protein, 17 aa, Mycobacterium avium
VGIAAPIILQFDAPISD

SEQ ID NO: 143471 - protein, 17 aa, Mycobacterium avium
VGIKLPHYSGSQYNLGR

SEQ ID NO: 143472 - protein, 20 aa, Mycobacterium avium
VGLSAVAGAMYWDRVQTRGE

SEQ ID NO: 143473 - protein, 18 aa, Mycobacterium avium
VGNWFQPRANPFHRWLDD

SEQ ID NO: 143474 - protein, 17 aa, Mycobacterium avium
VGQIGGITHKMVAAHAA

SEQ ID NO: 143475 - protein, 17 aa, Mycobacterium avium
VIGPPWPTADVPPSMYL

SEQ ID NO: 143476 - protein, 17 aa, Mycobacterium avium
VIKYIPLHTPAVVMSFN

SEQ ID NO: 143477 - protein, 24 aa, Mycobacterium avium
VLAGFPGTVASFWQQAGRSGRRGQ

SEQ ID NO: 143478 - protein, 23 aa, Mycobacterium avium
VLDAPWAPFVVNFNLANVGGPSA

SEQ ID NO: 143479 - protein, 23 aa, Mycobacterium avium
VLFPQITTIYGYREDPLPWHPNG

SEQ ID NO: 143480 - protein, 26 aa, Mycobacterium avium
VLLFTEGRALVTLEFDSAPNDPIDPA

SEQ ID NO: 143481 - protein, 17 aa, Mycobacterium avium
VLVGGFAVVRVKSFFGA

SEQ ID NO: 143482 - protein, 17 aa, Mycobacterium avium
VMSRYALAVQHERGLAM

SEQ ID NO: 143483 - protein, 20 aa, Mycobacterium avium
VPEVAELVAMLRLVADPTAG

SEQ ID NO: 143484 - protein, 22 aa, Mycobacterium avium
VPLDAVYHWPALAGQAAHTTGA

SEQ ID NO: 143485 - protein, 18 aa, Mycobacterium avium
VQFQGGGPHAVYLLDGLR

SEQ ID NO: 143486 - protein, 32 aa, Mycobacterium avium
VQLRAVGRLLGWRLGMDGVDPKGTVQLESAGS

SEQ ID NO: 143487 - protein, 20 aa, Mycobacterium avium
VQRFVPRGPRGELLSGTLLV

SEQ ID NO: 143488 - protein, 23 aa, Mycobacterium avium
VRAFGDFLSYCLVAEGAVDIAAE

SEQ ID NO: 143489 - protein, 22 aa, Mycobacterium avium
VRGARNYPCVDVPGKRAATPRE

SEQ ID NO: 143490 - protein, 17 aa, Mycobacterium avium
VRRLEIEEMALAKEEDE

SEQ ID NO: 143491 - protein, 25 aa, Mycobacterium avium
VRSNCLVEVEVVFFGGRRSSDPGSA

SEQ ID NO: 143492 - protein, 18 aa, Mycobacterium avium
VRVRLAAQGWPFDDADQA

SEQ ID NO: 143493 - protein, 20 aa, Mycobacterium avium
VRYRVRRIEKLLSVSLADPE

SEQ ID NO: 143494 - protein, 24 aa, Mycobacterium avium
VSPAGVRGHFEWADDNTVVRFVPN

SEQ ID NO: 143495 - protein, 20 aa, Mycobacterium avium
VSVARFSAALAPHGSATLLA

SEQ ID NO: 143496 - protein, 24 aa, Mycobacterium avium
VTAVGWPRRLLRRLLAPTDPVLAS

SEQ ID NO: 143497 - protein, 17 aa, Mycobacterium avium
VTHVYPQLVDIIRERNL

SEQ ID NO: 143498 - protein, 25 aa, Mycobacterium avium
VVGHYVKARLDTMTVTAQFDSAAGL

SEQ ID NO: 143499 - protein, 19 aa, Mycobacterium avium
VVIGRRGPLQTAFTTLELR

SEQ ID NO: 143500 - protein, 26 aa, Mycobacterium avium
VVKKQFRGPNPWVMVSNFHVKIDGCV

SEQ ID NO: 143501 - protein, 18 aa, Mycobacterium avium
VVNDLEFTVRLKAPTVDF

SEQ ID NO: 143502 - protein, 26 aa, Mycobacterium avium
VVSCGAMAFNFMKLPATLFGIGEYRV

SEQ ID NO: 143503 - protein, 24 aa, Mycobacterium avium
VVTCQRPVPCGAAAHRVEDSTGVH

SEQ ID NO: 143504 - protein, 24 aa, Mycobacterium avium
VVVAGRPSERWGQEVVAVVALSDG

SEQ ID NO: 143505 - protein, 24 aa, Mycobacterium avium
VVVINIWGQWCGPCRSEVSQLQQV

SEQ ID NO: 143506 - protein, 20 aa, Mycobacterium avium
WALSTAPGFADRSCDPLALP

SEQ ID NO: 143507 - protein, 24 aa, Mycobacterium avium
WARDYWIPFDRFRRLDGVRTVQAT

SEQ ID NO: 143508 - protein, 25 aa, Mycobacterium avium
WDDIQKQLKRASGLARKHGAENVTV

SEQ ID NO: 143509 - protein, 23 aa, Mycobacterium avium
WDGAWDPTLPMIPSANVPGDPIA

SEQ ID NO: 143510 - protein, 17 aa, Mycobacterium avium
WFVGRPDLIGADGVHPN

SEQ ID NO: 143511 - protein, 22 aa, Mycobacterium avium
WGVPSNIAGMVVFIDPGHNGSN

SEQ ID NO: 143512 - protein, 18 aa, Mycobacterium avium
WHRGMAVDLHLMIFGDST

SEQ ID NO: 143513 - protein, 18 aa, Mycobacterium avium
WHTWRCQWDEAGIRFWKD

SEQ ID NO: 143514 - protein, 18 aa, Mycobacterium avium
WKADAVYLDPRWTNGKDP

SEQ ID NO: 143515 - protein, 25 aa, Mycobacterium avium
WLDYELDVAKLLDFPLMTDMRDPLT

SEQ ID NO: 143516 - protein, 19 aa, Mycobacterium avium
WMMTAEVGVTNFVPSMDLT

SEQ ID NO: 143517 - protein, 31 aa, Mycobacterium avium
WPGEERLLRLGLESLRLWREGGFLDGLPGRL

SEQ ID NO: 143518 - protein, 22 aa, Mycobacterium avium
WPTADVPPSMYLIRDILGGAAG

SEQ ID NO: 143519 - protein, 26 aa, Mycobacterium avium
WQASELYAPLQAWQRMGQPTIAINAN

SEQ ID NO: 143520 - protein, 18 aa, Mycobacterium avium
WQASGGWTDGAHRLGTSP

SEQ ID NO: 143521 - protein, 27 aa, Mycobacterium avium
WRFGVPLVCLLAGLLLAATHGVSGGAE

SEQ ID NO: 143522 - protein, 20 aa, Mycobacterium avium
WRRKDLPAQPAPVLIFVPGG

SEQ ID NO: 143523 - protein, 17 aa, Mycobacterium avium
WSDPRLNPTHFNFDNAA

SEQ ID NO: 143524 - protein, 19 aa, Mycobacterium avium
WTFKVQKDNGVSCPGGGTA

SEQ ID NO: 143525 - protein, 27 aa, Mycobacterium avium
WVQKFYGAECLFELGDLPGAADSDVGD

SEQ ID NO: 143526 - protein, 37 aa, Mycobacterium avium
YAAVTGLRYRNHVPLTYPFALTFPALMSLVTGFDFPF

SEQ ID NO: 143527 - protein, 20 aa, Mycobacterium avium
YAGSRPDKVARLILDSPVAL

SEQ ID NO: 143528 - protein, 19 aa, Mycobacterium avium
YAIPGCYNPSVLPVERPKK

SEQ ID NO: 143529 - protein, 19 aa, Mycobacterium avium
YAVLSLPTTLIFDADGRQR

SEQ ID NO: 143530 - protein, 18 aa, Mycobacterium avium
YDQTYTWSGSAVGHDGKT

SEQ ID NO: 143531 - protein, 19 aa, Mycobacterium avium
YEPIWPRHGIRIIPGPSSL

SEQ ID NO: 143532 - protein, 18 aa, Mycobacterium avium
YFRAPWRKFIPHLHDGDG

SEQ ID NO: 143533 - protein, 34 aa, Mycobacterium avium
YGGSKVGLPLVRRALELLPHVGFVNAYGLTETSS

SEQ ID NO: 143534 - protein, 18 aa, Mycobacterium avium
YGPDFGLTYILDGLSAMG

SEQ ID NO: 143535 - protein, 25 aa, Mycobacterium avium
YKPACGKAGCTTYKWETFLTSELPQ

SEQ ID NO: 143536 - protein, 23 aa, Mycobacterium avium
YLAQLRAAGLTWPPKTEEALIAE

SEQ ID NO: 143537 - protein, 18 aa, Mycobacterium avium
YLSRAGISKEQVARGGYL

SEQ ID NO: 143538 - protein, 23 aa, Mycobacterium avium
YPSMIEFLAPLFATGAGSNDVGY

SEQ ID NO: 143539 - protein, 18 aa, Mycobacterium avium
YRTFTFDMASGRRVQLAD

SEQ ID NO: 143540 - protein, 23 aa, Mycobacterium avium
YSAPCALTGMTVGQVMDDAEMGP

SEQ ID NO: 143541 - protein, 18 aa, Mycobacterium avium
YSGAYKAWAITPDELILY

SEQ ID NO: 143542 - protein, 24 aa, Mycobacterium avium
YTTPYRWTPDAKIGDSAIVKQTSH

SEQ ID NO: 143543 - protein, 19 aa, Mycobacterium avium
YTTQAAAFVASKLMGAGQS

SEQ ID NO: 143544 - protein, 24 aa, Mycobacterium avium
AAAETLLSLGCHRAQGFLLSRPLD

SEQ ID NO: 143545 - protein, 26 aa, Mycobacterium avium
AAAPDVPGRFVVAAAMVRHLLTDPVL

SEQ ID NO: 143546 - protein, 20 aa, Mycobacterium avium
AAAQCPDVQVVFARGTGEAP

SEQ ID NO: 143547 - protein, 19 aa, Mycobacterium avium
AAATEHWVAGYKLVDFSGA

SEQ ID NO: 143548 - protein, 17 aa, Mycobacterium avium
AACERLGVRWAPPLHDL

SEQ ID NO: 143549 - protein, 18 aa, Mycobacterium avium
AACRAAGIDPVRQPIPVV

SEQ ID NO: 143550 - protein, 19 aa, Mycobacterium avium
AADWERPVVEQFTRHGQLW

SEQ ID NO: 143551 - protein, 32 aa, Mycobacterium avium
AAFQFITELVLLDWPTHLAQLASWLPTQPQLL

SEQ ID NO: 143552 - protein, 24 aa, Mycobacterium avium
AALLLALCWPIAPAAAPDPAAGTA

SEQ ID NO: 143553 - protein, 19 aa, Mycobacterium avium
AALRGREPMAAAMDYVATF

SEQ ID NO: 143554 - protein, 19 aa, Mycobacterium avium
AAMRLPGAWATPPAPEAPP

SEQ ID NO: 143555 - protein, 20 aa, Mycobacterium avium
AAPGAAWRDNLRAVGAATAR

SEQ ID NO: 143556 - protein, 21 aa, Mycobacterium avium
AAVLVLLPIVTFAMAYFIVDI

SEQ ID NO: 143557 - protein, 35 aa, Mycobacterium avium
AAVVVLGWYYLRIPSLAGIGRYTLYAELPQSGGLY

SEQ ID NO: 143558 - protein, 17 aa, Mycobacterium avium
AAWLIVDVRDLAALHAA

SEQ ID NO: 143559 - protein, 24 aa, Mycobacterium avium
ADAEARVLLARRFHNDAVRDTLAL

SEQ ID NO: 143560 - protein, 18 aa, Mycobacterium avium
ADAGHFLVAYPDGLGRAW

SEQ ID NO: 143561 - protein, 19 aa, Mycobacterium avium
ADGQQGWSEVPGLTVPGAA

SEQ ID NO: 143562 - protein, 17 aa, Mycobacterium avium
ADIKATTVFGGKYVSLT

SEQ ID NO: 143563 - protein, 21 aa, Mycobacterium avium
ADSSRRLWDTIVIAADAPAAT

SEQ ID NO: 143564 - protein, 22 aa, Mycobacterium avium
ADVMVYPGMEIRQDNRVCTLGY

SEQ ID NO: 143565 - protein, 18 aa, Mycobacterium avium
ADYARMWVQAAGTMATYQ

SEQ ID NO: 143566 - protein, 17 aa, Mycobacterium avium
AEFLQAATLRPGNPITV

SEQ ID NO: 143567 - protein, 17 aa, Mycobacterium avium
AEGSRFAADYGSLNDAS

SEQ ID NO: 143568 - protein, 17 aa, Mycobacterium avium
AEPCTLTGYAAVDSGAG

SEQ ID NO: 143569 - protein, 24 aa, Mycobacterium avium
AFGEYRCRADQAGLYCVNYARQSA

SEQ ID NO: 143570 - protein, 18 aa, Mycobacterium avium
AFSKPGLPVEYLEVPSPS

SEQ ID NO: 143571 - protein, 23 aa, Mycobacterium avium
AFTAGHCRGGGGVVTDRGGTVIG

SEQ ID NO: 143572 - protein, 23 aa, Mycobacterium avium
AFTASPFRWLAWLSESRATITAA

SEQ ID NO: 143573 - protein, 17 aa, Mycobacterium avium
AGADIVFVEAPHDAGEI

SEQ ID NO: 143574 - protein, 20 aa, Mycobacterium avium
AGAVLDRAGRFLPFETPFTW

SEQ ID NO: 143575 - protein, 26 aa, Mycobacterium avium
AGCKSWVQLPVHARLGPPVHDDETLA

SEQ ID NO: 143576 - protein, 20 aa, Mycobacterium avium
AGDVLLPIGYDASSPIPAAD

SEQ ID NO: 143577 - protein, 21 aa, Mycobacterium avium
AGFPLGWVHDVVWAPRPVSGP

SEQ ID NO: 143578 - protein, 27 aa, Mycobacterium avium
AGISIRRAPAPAWSHFTFNGAPGSILA

SEQ ID NO: 143579 - protein, 24 aa, Mycobacterium avium
AGLNICQQISWGAPPAQLEGLALQ

SEQ ID NO: 143580 - protein, 17 aa, Mycobacterium avium
AGLQTGSSFKVFCLIAA

SEQ ID NO: 143581 - protein, 25 aa, Mycobacterium avium
AGNKAPEHHEFKQAAVMSDLPGELM

SEQ ID NO: 143582 - protein, 27 aa, Mycobacterium avium
AGPQRLSGPEALSFVRQRHELPRGDLD

SEQ ID NO: 143583 - protein, 18 aa, Mycobacterium avium
AGRGMSPTMARMFTTIAI

SEQ ID NO: 143584 - protein, 18 aa, Mycobacterium avium
AGTTSLGTSIGWAQNVGA

SEQ ID NO: 143585 - protein, 17 aa, Mycobacterium avium
AHDCPNTKMVLGGYSQG

SEQ ID NO: 143586 - protein, 27 aa, Mycobacterium avium
AHDETRKSFGIAGARVVESIKLSVPFK

SEQ ID NO: 143587 - protein, 19 aa, Mycobacterium avium
AHLGADGWATTTFGLADLF

SEQ ID NO: 143588 - protein, 17 aa, Mycobacterium avium
AHWRPEHYYAPGTTVTA

SEQ ID NO: 143589 - protein, 17 aa, Mycobacterium avium
AIGRLPGIVVTPQPEML

SEQ ID NO: 143590 - protein, 17 aa, Mycobacterium avium
AIIRLEPSVGMPVGDVG

SEQ ID NO: 143591 - protein, 25 aa, Mycobacterium avium
AIPDAVRYSVRFGKPVVLPATTGLY

SEQ ID NO: 143592 - protein, 24 aa, Mycobacterium avium
AIPPRGTEAVVLKVVQNTGAGPHT

SEQ ID NO: 143593 - protein, 18 aa, Mycobacterium avium
AITGYRASNAVAVKIHPP

SEQ ID NO: 143594 - protein, 21 aa, Mycobacterium avium
AKRSGGRSGLSVHGQARLLSE

SEQ ID NO: 143595 - protein, 24 aa, Mycobacterium avium
ALAAMLTSCTWRGIADVPLPVGRG

SEQ ID NO: 143596 - protein, 18 aa, Mycobacterium avium
ALASRAGDHVDFLAHDRV

SEQ ID NO: 143597 - protein, 20 aa, Mycobacterium avium
ALDLGCWYPTTAAVAGIDAL

SEQ ID NO: 143598 - protein, 28 aa, Mycobacterium avium
ALERARPVLEPMAGKIIHCGAAGAGQAA

SEQ ID NO: 143599 - protein, 18 aa, Mycobacterium avium
ALGGHWRYQTYLRAEGLD

SEQ ID NO: 143600 - protein, 21 aa, Mycobacterium avium
ALHPRIDIISSLAGRVPDPAL

SEQ ID NO: 143601 - protein, 17 aa, Mycobacterium avium
ALIGIVGCTSVTNGTAT

SEQ ID NO: 143602 - protein, 23 aa, Mycobacterium avium
ALLIKGAIPMRFSDGGAPENQHV

SEQ ID NO: 143603 - protein, 17 aa, Mycobacterium avium
ALLVLCGLAAVPAILVA

SEQ ID NO: 143604 - protein, 19 aa, Mycobacterium avium
ALQAAQFSAYGTWYQQVSA

SEQ ID NO: 143605 - protein, 21 aa, Mycobacterium avium
ALTPGQPVCHFGVITGETCGT

SEQ ID NO: 143606 - protein, 24 aa, Mycobacterium avium
ALTRAQAQVVAWWSPAYHEPNGGL

SEQ ID NO: 143607 - protein, 19 aa, Mycobacterium avium
ALVDALGGVRVCPQAPMHD

SEQ ID NO: 143608 - protein, 20 aa, Mycobacterium avium
ANASFEFANGYATVTVEAGP

SEQ ID NO: 143609 - protein, 23 aa, Mycobacterium avium
APFTLEFGRNGWIADASITLEWS

SEQ ID NO: 143610 - protein, 18 aa, Mycobacterium avium
APGQPGPVPVVFLAIDRF

SEQ ID NO: 143611 - protein, 22 aa, Mycobacterium avium
APHIAMTVAMLRQAGVDVDDSV

SEQ ID NO: 143612 - protein, 19 aa, Mycobacterium avium
APLVQRLSEMMDHSDNVLA

SEQ ID NO: 143613 - protein, 18 aa, Mycobacterium avium
APQTAWADDDFVALAVSV

SEQ ID NO: 143614 - protein, 20 aa, Mycobacterium avium
APWCGPCDRVRRVVDQVCAD

SEQ ID NO: 143615 - protein, 22 aa, Mycobacterium avium
AQACAELGLPHLVLARPAWDPG

SEQ ID NO: 143616 - protein, 24 aa, Mycobacterium avium
AQAEWEVESAIYVYAPDLIPKIKD

SEQ ID NO: 143617 - protein, 17 aa, Mycobacterium avium
AQAGAVWDDVVLTAIEH

SEQ ID NO: 143618 - protein, 18 aa, Mycobacterium avium
AQGVDVFDAPGLTRALEG

SEQ ID NO: 143619 - protein, 17 aa, Mycobacterium avium
AQNVLGWAAAYATGVVP

SEQ ID NO: 143620 - protein, 17 aa, Mycobacterium avium
AQPSGCAASDYPGALPK

SEQ ID NO: 143621 - protein, 19 aa, Mycobacterium avium
AQTPAGCSLMEWENTDNGR

SEQ ID NO: 143622 - protein, 20 aa, Mycobacterium avium
ARAKPPRCAVLADPGNGRDQ

SEQ ID NO: 143623 - protein, 18 aa, Mycobacterium avium
ARAMLGFMDAELRLDYRD

SEQ ID NO: 143624 - protein, 18 aa, Mycobacterium avium
ARHIFDFADRFPTVTAAC

SEQ ID NO: 143625 - protein, 20 aa, Mycobacterium avium
ARSGAPWRFGTDDPGGLCER

SEQ ID NO: 143626 - protein, 23 aa, Mycobacterium avium
ARTDARGPLGLDAAIERANRYAR

SEQ ID NO: 143627 - protein, 22 aa, Mycobacterium avium
ASAVSRLARRGGFLEVRPEAEK

SEQ ID NO: 143628 - protein, 24 aa, Mycobacterium avium
ASCAVPGAWPPVAIGGRRYMDGGV

SEQ ID NO: 143629 - protein, 17 aa, Mycobacterium avium
ASFAEWIDRGRPAPTHR

SEQ ID NO: 143630 - protein, 18 aa, Mycobacterium avium
ASFDRPAPPDAPAPDAPP

SEQ ID NO: 143631 - protein, 22 aa, Mycobacterium avium
ASPESVSFLRQFLASPPGQRQQ

SEQ ID NO: 143632 - protein, 21 aa, Mycobacterium avium
ATALIYHAAFAPRVAEILPDL

SEQ ID NO: 143633 - protein, 20 aa, Mycobacterium avium
ATAYGQWQGGWVDFDGTSLQ

SEQ ID NO: 143634 - protein, 33 aa, Mycobacterium avium; identical to SEQ ID NO: 15295

SEQ ID NO: 143635 - protein, 26 aa, Mycobacterium avium
ATFAAYYRWDVYCFTTAGDVLLPIGY

SEQ ID NO: 143636 - protein, 28 aa, Mycobacterium avium
ATFGDPIGRHAFGQSFLTAMFGVGSVVP

SEQ ID NO: 143637 - protein, 17 aa, Mycobacterium avium
ATTHWRAADLLKGLGAR

SEQ ID NO: 143638 - protein, 19 aa, Mycobacterium avium
AVGLAACSTSHPRSETSAA

SEQ ID NO: 143639 - protein, 17 aa, Mycobacterium avium
AVGTRLSPRAAQRRQRI

SEQ ID NO: 143640 - protein, 24 aa, Mycobacterium avium
AVLPGPRAAAGVAGMSVFLDPGHN

SEQ ID NO: 143641 - protein, 27 aa, Mycobacterium avium
AVREAVLALRARKGMVLDAADHDTWSV

SEQ ID NO: 143642 - protein, 19 aa, Mycobacterium avium
AWQPLPTWFERLAAAGVRA

SEQ ID NO: 143643 - protein, 34 aa, Mycobacterium avium
AYTSPADPLWWVVRALELFSDFQQFGALLQENPA

SEQ ID NO: 143644 - protein, 18 aa, Mycobacterium avium
CADAKPSPPASYCPATNT

SEQ ID NO: 143645 - protein, 17 aa, Mycobacterium avium
CAGFERFATAMAPFGFD

SEQ ID NO: 143646 - protein, 17 aa, Mycobacterium avium
CAHRAAPPPAHSSTSNT

SEQ ID NO: 143647 - protein, 24 aa, Mycobacterium avium
CIATLLMGLPVLAMTACSSPQHAS

SEQ ID NO: 143648 - protein, 20 aa, Mycobacterium avium
CINISPANAKWFFDNFGPGD

SEQ ID NO: 143649 - protein, 19 aa, Mycobacterium avium
CLTAGAWPAYWLGNDDQGE

SEQ ID NO: 143650 - protein, 21 aa, Mycobacterium avium
CSKYPGFDVAKAVKAFLQAAI

SEQ ID NO: 143651 - protein, 18 aa, Mycobacterium avium
CYFPHPQRVVCGGISIAG

SEQ ID NO: 143652 - protein, 23 aa, Mycobacterium avium
DAGAVPSFLGYHGYPASICASVN

SEQ ID NO: 143653 - protein, 22 aa, Mycobacterium avium
DAILTPRVNAGYSRNDDPATAP

SEQ ID NO: 143654 - protein, 23 aa, Mycobacterium avium
DALAKLGARNMRLTLGVYTYRSC

SEQ ID NO: 143655 - protein, 26 aa, Mycobacterium avium
DDGTRCLLRNGGAWGGRADGYVGVYG

SEQ ID NO: 143656 - protein, 25 aa, Mycobacterium avium
DDLGALAGWYVWAALGLYPATPGTP

SEQ ID NO: 143657 - protein, 20 aa, Mycobacterium avium
DDLKPGVPDRSWSQVSVSAR

SEQ ID NO: 143658 - protein, 26 aa, Mycobacterium avium
DELSAWTRKHFPGAVQTHFWSAQDYT

SEQ ID NO: 143659 - protein, 21 aa, Mycobacterium avium
DEVLYRPLGMTSTSSRFADFL

SEQ ID NO: 143660 - protein, 28 aa, Mycobacterium avium
DGMQQGCGGPPCKGAVVALEPSTGKILA

SEQ ID NO: 143661 - protein, 24 aa, Mycobacterium avium
DHSIRATVLVAEWPPRNVDPDPLG

SEQ ID NO: 143662 - protein, 26 aa, Mycobacterium avium
DHSRRLWTVLIFMLWHAIFVEHSVVP

SEQ ID NO: 143663 - protein, 26 aa, Mycobacterium avium
DITTRTGTKYAVRWQDYDTGAPITAQ

SEQ ID NO: 143664 - protein, 18 aa, Mycobacterium avium
DIVLAWAAQSGRYPEFNA

SEQ ID NO: 143665 - protein, 19 aa, Mycobacterium avium
DKAWECPLHGSRFAPDGTL

SEQ ID NO: 143666 - protein, 20 aa, Mycobacterium avium
DKLIWAEGFSLPLTQSPGDV

SEQ ID NO: 143667 - protein, 20 aa, Mycobacterium avium
DLLVRFETAVRWARAHPQQW

SEQ ID NO: 143668 - protein, 17 aa, Mycobacterium avium
DMASGRRVQLADLTTSN

SEQ ID NO: 143669 - protein, 23 aa, Mycobacterium avium
DNGRQRWCVRLVQGGGFAGPLLD

SEQ ID NO: 143670 - protein, 18 aa, Mycobacterium avium
DNIARYAPPPAVYAPLPE

SEQ ID NO: 143671 - protein, 19 aa, Mycobacterium avium
DPCAVNLAAPTIVKVVSEL

SEQ ID NO: 143672 - protein, 23 aa, Mycobacterium avium
DPNLGRLGGRITDAITGKELWQV

SEQ ID NO: 143673 - protein, 22 aa, Mycobacterium avium
DQADGWLRRWLQRDKAAGAPSV

SEQ ID NO: 143674 - protein, 24 aa, Mycobacterium avium
DQIAGLKPDLIVAINAGLDADTYQ

SEQ ID NO: 143675 - protein, 24 aa, Mycobacterium avium
DQLDALCALGLQSRVVGAALPDGA

SEQ ID NO: 143676 - protein, 22 aa, Mycobacterium avium
DQVFPKRCGHLPDKQVVDAAVF

SEQ ID NO: 143677 - protein, 23 aa, Mycobacterium avium
DREQLRLIAWELIANRGGSRPPA

SEQ ID NO: 143678 - protein, 18 aa, Mycobacterium avium
DRGAVLLLRGSDPALAGQ

SEQ ID NO: 143679 - protein, 17 aa, Mycobacterium avium
DRGRPAPTHRRWSQYLS

SEQ ID NO: 143680 - protein, 20 aa, Mycobacterium avium
DRLAALSAEINRLGGDCTET

SEQ ID NO: 143681 - protein, 25 aa, Mycobacterium avium
DRTLWPDRLWLAIARSPAREIDLTP

SEQ ID NO: 143682 - protein, 17 aa, Mycobacterium avium
DRYEVHHGVRITDSALV

SEQ ID NO: 143683 - protein, 20 aa, Mycobacterium avium
DSGGDGWTVARRGRVLAFVG

SEQ ID NO: 143684 - protein, 21 aa, Mycobacterium avium
DTPTPCWSDQIAVTAAPAQGA

SEQ ID NO: 143685 - protein, 24 aa, Mycobacterium avium
DVGCSWLPLYHDMGLSFLLASALG

SEQ ID NO: 143686 - protein, 27 aa, Mycobacterium avium
DVLSRPQIQVGMPFCKIGAVTGETCGA

SEQ ID NO: 143687 - protein, 21 aa, Mycobacterium avium
DVVVCAVGLFGAAKLPDIDGL

SEQ ID NO: 143688 - protein, 26 aa, Mycobacterium avium
DYIKVPMPYRRSMRISVESHLEYYHV

SEQ ID NO: 143689 - protein, 19 aa, Mycobacterium avium
EAAEGRWFADQVRSNPNPY

SEQ ID NO: 143690 - protein, 19 aa, Mycobacterium avium
EAAEGRWFADQVRSNPNSF

SEQ ID NO: 143691 - protein, 20 aa, Mycobacterium avium
EAFEAIRCVRSLQHQKYVAI

SEQ ID NO: 143692 - protein, 19 aa, Mycobacterium avium
EALLAVASMLEGLGSSMDA

SEQ ID NO: 143693 - protein, 33 aa, Mycobacterium avium
EAQKPQGFKALDITLPMPARWTQVPDPNVPDAF

SEQ ID NO: 143694 - protein, 26 aa, Mycobacterium avium
EAQLDRFAIRLELRYLSERDETSMLR

SEQ ID NO: 143695 - protein, 29 aa, Mycobacterium avium
EARIKLDCLFPGLWPSFWGVNEDPLPDGE

SEQ ID NO: 143696 - protein, 17 aa, Mycobacterium avium
EELPVQLVVRSVGYRGV

SEQ ID NO: 143697 - protein, 20 aa, Mycobacterium avium
EFANGYATVTVEAGPNQVLS

SEQ ID NO: 143698 - protein, 19 aa, Mycobacterium avium
EFGVRVSVVEPAYTRTSFE

SEQ ID NO: 143699 - protein, 18 aa, Mycobacterium avium
EFYFVYRTQRFEPSRTGR

SEQ ID NO: 143700 - protein, 17 aa, Mycobacterium avium
EGQEWVLGHCEAHGVAV

SEQ ID NO: 143701 - protein, 20 aa, Mycobacterium avium
EIPPAVSAYTGLPGDPVGPP

SEQ ID NO: 143702 - protein, 20 aa, Mycobacterium avium
EIYRNPWMVLREDDIRRPDG

SEQ ID NO: 143703 - protein, 18 aa, Mycobacterium avium
EKRREVFLYPKARNLSFR

SEQ ID NO: 143704 - protein, 26 aa, Mycobacterium avium
EKTAADPRFRFFGNVSVGEHVQASEL

SEQ ID NO: 143705 - protein, 21 aa, Mycobacterium avium
ELACALGLFPPTEEQAAVIAA

SEQ ID NO: 143706 - protein, 17 aa, Mycobacterium avium
ELAKALADFLFDDERAM

SEQ ID NO: 143707 - protein, 23 aa, Mycobacterium avium
ELHRRLPADLSILTPAPATDTDT

SEQ ID NO: 143708 - protein, 17 aa, Mycobacterium avium
ELLEAAVAHRIESIVTA

SEQ ID NO: 143709 - protein, 23 aa, Mycobacterium avium
ELNLPTLHGVVVRRSYAAAHPEV

SEQ ID NO: 143710 - protein, 18 aa, Mycobacterium avium
ELQAAFLESPWAARTPVA

SEQ ID NO: 143711 - protein, 24 aa, Mycobacterium avium
ELSKALRLSSERGVTTREQLTTII

SEQ ID NO: 143712 - protein, 20 aa, Mycobacterium avium
ENGRCTAGFAAQGSDGSYYL

SEQ ID NO: 143713 - protein, 42 aa, Mycobacterium avium
ENLPRVNARGGPGGAPGCWQPITHDLWPAPELVIDSGNSLAP

SEQ ID NO: 143714 - protein, 20 aa, Mycobacterium avium
EPAGLPSVFVYDGHPGGAGF

SEQ ID NO: 143715 - protein, 20 aa, Mycobacterium avium
EPPETARLVGFHGAATPAET

SEQ ID NO: 143716 - protein, 25 aa, Mycobacterium avium
EPSFGVPWLYNYIGQPWKTQHTVDR

SEQ ID NO: 143717 - protein, 17 aa, Mycobacterium avium
EPYATRTVEPWGVVTQK

SEQ ID NO: 143718 - protein, 27 aa, Mycobacterium avium
ERGRRRRRFALRAALALLVVVVLAGVF

SEQ ID NO: 143719 - protein, 19 aa, Mycobacterium avium
ESFPGLGMDGPSVGESVAE

SEQ ID NO: 143720 - protein, 18 aa, Mycobacterium avium
ETSMLRRRLERGSAEPAV

SEQ ID NO: 143721 - protein, 21 aa, Mycobacterium avium
FAARSLRTIAHMTRLRGADTV

SEQ ID NO: 143722 - protein, 18 aa, Mycobacterium avium
FATIPVLDGAGWSDDGMQ

SEQ ID NO: 143723 - protein, 17 aa, Mycobacterium avium
FDASGLMQYAYAGAGIK

SEQ ID NO: 143724 - protein, 23 aa, Mycobacterium avium
FDNYLRRCDFSKVSIAPKVPSPM

SEQ ID NO: 143725 - protein, 22 aa, Mycobacterium avium
FDPERARRLWAQADAISAWSGS

SEQ ID NO: 143726 - protein, 25 aa, Mycobacterium avium
FDYAEGRLGWRTLDFEVEVLPIGDF

SEQ ID NO: 143727 - protein, 23 aa, Mycobacterium avium
FGLADLFAAAGLPELTEAEQGPA

SEQ ID NO: 143728 - protein, 17 aa, Mycobacterium avium
FGPFSYNTFTVIPVFNW

SEQ ID NO: 143729 - protein, 19 aa, Mycobacterium avium
FGPLLGELLARAALSDDIP

SEQ ID NO: 143730 - protein, 17 aa, Mycobacterium avium
FGVNFGFLRHNDHSIRA

SEQ ID NO: 143731 - protein, 24 aa, Mycobacterium avium
FGWLGDAFPLSALTQIYKSDGESN

SEQ ID NO: 143732 - protein, 23 aa, Mycobacterium avium
FHGLQIHAVGKCEANSTAPTGGS

SEQ ID NO: 143733 - protein, 23 aa, Mycobacterium avium
FLAIDRFKVINGRLGQDAGDRFI

SEQ ID NO: 143734 - protein, 27 aa, Mycobacterium avium
FLQAATLRPGNPITVAGIEVGHVTSMK

SEQ ID NO: 143735 - protein, 18 aa, Mycobacterium avium
FNDQFTAAVNKIYNSGHR

SEQ ID NO: 143736 - protein, 21 aa, Mycobacterium avium
FNLPNGLAIDSWMCAISGRAK

SEQ ID NO: 143737 - protein, 17 aa, Mycobacterium avium
FPALMSLVTGFDFPFAA

SEQ ID NO: 143738 - protein, 18 aa, Mycobacterium avium
FRAGCPVVAVAVEAGEQS

SEQ ID NO: 143739 - protein, 18 aa, Mycobacterium avium
FRATSIGDWAQRNDQYFE

SEQ ID NO: 143740 - protein, 20 aa, Mycobacterium avium
FSFAPNASWSRTYARQPEIL

SEQ ID NO: 143741 - protein, 28 aa, Mycobacterium avium
FSTRAESRWFASAGFSLVNMTGYPEAVL

SEQ ID NO: 143742 - protein, 18 aa, Mycobacterium avium
FTKGGPYLARGAHDLVPT

SEQ ID NO: 143743 - protein, 21 aa, Mycobacterium avium
FTLEVYPRYLKLIPSNVNADI

SEQ ID NO: 143744 - protein, 21 aa, Mycobacterium avium
FTPKTSLTMLASRAGLVMDPG

SEQ ID NO: 143745 - protein, 18 aa, Mycobacterium avium
FTYLSAAHYCPKYITGED

SEQ ID NO: 143746 - protein, 25 aa, Mycobacterium avium
FVAQILRLFGIDWDPVEGTLNGLPY

SEQ ID NO: 143747 - protein, 19 aa, Mycobacterium avium
FVLNLAVAKSGSWDKDLAA

SEQ ID NO: 143748 - protein, 17 aa, Mycobacterium avium
FVPNRYWPAHGHVSVGV

SEQ ID NO: 143749 - protein, 19 aa, Mycobacterium avium
FVYRTQRFEPSRTGRTELE

SEQ ID NO: 143750 - protein, 17 aa, Mycobacterium avium
FWVKDGQNYLPFGTAAG

SEQ ID NO: 143751 - protein, 23 aa, Mycobacterium avium
FYGPEGTQSVAMYLGNNQMLEVG

SEQ ID NO: 143752 - protein, 18 aa, Mycobacterium avium
FYPVNEYGGYQLGSSTFA

SEQ ID NO: 143753 - protein, 19 aa, Mycobacterium avium
FYSNPGFDFSGFARAVNNN

SEQ ID NO: 143754 - protein, 24 aa, Mycobacterium avium
GAAATMPRRLAIAAVGASLLSGVA

SEQ ID NO: 143755 - protein, 17 aa, Mycobacterium avium
GACTSRPPAQLSSTASV

SEQ ID NO: 143756 - protein, 21 aa, Mycobacterium avium
GAELGGWVMRSACADFSRWRA

SEQ ID NO: 143757 - protein, 21 aa, Mycobacterium avium
GAEPPARIPGAAMPLPPPPST

SEQ ID NO: 143758 - protein, 19 aa, Mycobacterium avium
GAFAARVAPFNVNFRYVKS

SEQ ID NO: 143759 - protein, 18 aa, Mycobacterium avium
GAGGTYPILGDPSTFGNA

SEQ ID NO: 143760 - protein, 17 aa, Mycobacterium avium
GAIAFASPLSYPVIADQ

SEQ ID NO: 143761 - protein, 26 aa, Mycobacterium avium
GALGRLRPLFRTGLGARLGSGRQYMS

SEQ ID NO: 143762 - protein, 20 aa, Mycobacterium avium
GALPRWAFANAATGEMSGDS

SEQ ID NO: 143763 - protein, 18 aa, Mycobacterium avium
GAVDGLLSGFSQRAGDVG

SEQ ID NO: 143764 - protein, 20 aa, Mycobacterium avium
GAVPLPRAWAGDAPIGHIGD

SEQ ID NO: 143765 - protein, 25 aa, Mycobacterium avium
GCGLLHCEHDTWLLTVMGVGGEEPA

SEQ ID NO: 143766 - protein, 20 aa, Mycobacterium avium
GCQSDTFAAIAPVAGTLLTD

SEQ ID NO: 143767 - protein, 18 aa, Mycobacterium avium
GCSAPRPAAGGGTPSTQT

SEQ ID NO: 143768 - protein, 26 aa, Mycobacterium avium
GDLKRSCLDIGLAARVLGWQPKVGLQ

SEQ ID NO: 143769 - protein, 23 aa, Mycobacterium avium
GDLPLEVARAFVGPDVLLGLSSH

SEQ ID NO: 143770 - protein, 32 aa, Mycobacterium avium
GEKRSWLRARGLKLFPLVGWAERGGYGAQGHG

SEQ ID NO: 143771 - protein, 24 aa, Mycobacterium avium
GEVLRLRWRKGCMPVPQRVIRARV

SEQ ID NO: 143772 - protein, 22 aa, Mycobacterium avium
GFANACGVAHALPQMPQVRYEV

SEQ ID NO: 143773 - protein, 18 aa, Mycobacterium avium
GFDCSGLVLYSFAGVGIK

SEQ ID NO: 143774 - protein, 17 aa, Mycobacterium avium
GFLLSRPLDSAGMEALL

SEQ ID NO: 143775 - protein, 22 aa, Mycobacterium avium
GFRAPRRRWGSLVGIQPDGLEV

SEQ ID NO: 143776 - protein, 17 aa, Mycobacterium avium
GFVLAATHLPGAFEDVV

SEQ ID NO: 143777 - protein, 20 aa, Mycobacterium avium
GGAPGNFLSAGGHYQAPGHT

SEQ ID NO: 143778 - protein, 17 aa, Mycobacterium avium
GGDYIKVPMPYRRSMRI

SEQ ID NO: 143779 - protein, 19 aa, Mycobacterium avium
GGEPVDCAGFERFATAMAP

SEQ ID NO: 143780 - protein, 22 aa, Mycobacterium avium
GGERRAAICRELTKVHEEVVRG

SEQ ID NO: 143781 - protein, 24 aa, Mycobacterium avium
GGFGGVDGLRRWLRDEHIDAVVDA

SEQ ID NO: 143782 - protein, 17 aa, Mycobacterium avium
GGGCNVIELTIAGKSDK

SEQ ID NO: 143783 - protein, 19 aa, Mycobacterium avium
GGINWGSSITPDLASHVAA

SEQ ID NO: 143784 - protein, 27 aa, Mycobacterium avium
GGKIPRVYGRQAIEYVIKRMGSQMGVP

SEQ ID NO: 143785 - protein, 20 aa, Mycobacterium avium
GGPYLARGAHDLVPTAQLLD

SEQ ID NO: 143786 - protein, 25 aa, Mycobacterium avium
GGRMDWARAFASWSPHELSGLATAV

SEQ ID NO: 143787 - protein, 22 aa, Mycobacterium avium
GGSRPPAAIPLASPGVVDADPS

SEQ ID NO: 143788 - protein, 23 aa, Mycobacterium avium
GGTRSSIWYKAFNYNLGTKQPLT

SEQ ID NO: 143789 - protein, 18 aa, Mycobacterium avium
GGTTVVFDNYLRRCDFSK

SEQ ID NO: 143790 - protein, 19 aa, Mycobacterium avium
GGVDVCLKEPVFEPLSGAD

SEQ ID NO: 143791 - protein, 21 aa, Mycobacterium avium
GGVLLPVLIFTAARAGVAFTP

SEQ ID NO: 143792 - protein, 20 aa, Mycobacterium avium
GIDMALRLVELLVDRQAAQA

SEQ ID NO: 143793 - protein, 22 aa, Mycobacterium avium
GIGAKPYWRPPYAKRNAAVDAV

SEQ ID NO: 143794 - protein, 25 aa, Mycobacterium avium
GIGEKRFELAAGEFLLFPTVAHSHA

SEQ ID NO: 143795 - protein, 23 aa, Mycobacterium avium
GIGEYRVTVDLPQSGGLYQTSVV

SEQ ID NO: 143796 - protein, 18 aa, Mycobacterium avium
GKAVCGLLARGVSGLQLL

SEQ ID NO: 143797 - protein, 18 aa, Mycobacterium avium
GKELWQVADDMPLVPAST

SEQ ID NO: 143798 - protein, 20 aa, Mycobacterium avium
GKLCSLFLGPGLRVLNFNNL

SEQ ID NO: 143799 - protein, 19 aa, Mycobacterium avium
GKLDESFPGLGMDGPSVGE

SEQ ID NO: 143800 - protein, 22 aa, Mycobacterium avium
GKSARTLLIWMSIAAVALLLAG

SEQ ID NO: 143801 - protein, 17 aa, Mycobacterium avium
GLCVRKLRNRGAVVIVG

SEQ ID NO: 143802 - protein, 19 aa, Mycobacterium avium
GLGAGVAWFDTKLHREPVL

SEQ ID NO: 143803 - protein, 21 aa, Mycobacterium avium
GLGGLECLSGIPGSAGATPIQ

SEQ ID NO: 143804 - protein, 17 aa, Mycobacterium avium
GLLSSAVAVGWPDLMRA

SEQ ID NO: 143805 - protein, 18 aa, Mycobacterium avium
GLPPEVVYLYNGPGGTSF

SEQ ID NO: 143806 - protein, 23 aa, Mycobacterium avium
GLQYPIVYLPFAFHRNTTDSDVV

SEQ ID NO: 143807 - protein, 26 aa, Mycobacterium avium
GLSGLSTDVKFHWNGNAVELIGNTPA

SEQ ID NO: 143808 - protein, 19 aa, Mycobacterium avium
GLSVPPSWAPGGVAPAANA

SEQ ID NO: 143809 - protein, 18 aa, Mycobacterium avium
GLTGWVGIGVAVLVVAGV

SEQ ID NO: 143810 - protein, 18 aa, Mycobacterium avium
GMLACNCYVLAQRPGTDA

SEQ ID NO: 143811 - protein, 24 aa, Mycobacterium avium
GNAPDRSKGVVVLLFTEGKALATL

SEQ ID NO: 143812 - protein, 29 aa, Mycobacterium avium
GPAADAMAFAAARYLTWLRATAEQTKQTA

SEQ ID NO: 143813 - protein, 25 aa, Mycobacterium avium
GPIELVKTSGGWRIDRLPNGVFLDW

SEQ ID NO: 143814 - protein, 18 aa, Mycobacterium avium
GPLARRLSLLKKFAPEAV

SEQ ID NO: 143815 - protein, 19 aa, Mycobacterium avium
GPSIGGLSVPPSWAPGGVA

SEQ ID NO: 143816 - protein, 17 aa, Mycobacterium avium
GPTRLRVPDLLYATDQA

SEQ ID NO: 143817 - protein, 25 aa, Mycobacterium avium
GQAIDLLKGLVMPAITQGMHGGAAA

SEQ ID NO: 143818 - protein, 17 aa, Mycobacterium avium
GQAIDVRGPALGVLERM

SEQ ID NO: 143819 - protein, 17 aa, Mycobacterium avium
GQAPPIISRAEWGADES

SEQ ID NO: 143820 - protein, 26 aa, Mycobacterium avium
GQLQSAPRFANWVDRRFNAALRPGLV

SEQ ID NO: 143821 - protein, 18 aa, Mycobacterium avium
GQPCPTYTDLLVNPPDTT

SEQ ID NO: 143822 - protein, 32 aa, Mycobacterium avium
GQVQALSQFVAWPGLLVFQGKAKLLYDGAELN

SEQ ID NO: 143823 - protein, 29 aa, Mycobacterium avium
GQVRWVPGTELEFGYRTSVFKRRADDGLE

SEQ ID NO: 143824 - protein, 20 aa, Mycobacterium avium
GRAAYAAAVTAGIVAFLNAK

SEQ ID NO: 143825 - protein, 25 aa, Mycobacterium avium
GRFLPFETPFTWAGMQYYTQMPASD

SEQ ID NO: 143826 - protein, 26 aa, Mycobacterium avium
GRTTGNSCGVTWGMGQTPGTIVMQVC

SEQ ID NO: 143827 - protein, 18 aa, Mycobacterium avium
GSADVFFLLGVGDDEALR

SEQ ID NO: 143828 - protein, 18 aa, Mycobacterium avium
GSIAAVDFVGWYNAHPNF

SEQ ID NO: 143829 - protein, 25 aa, Mycobacterium avium
GSIPAVIKNAIDWLSRPFGDGALKG

SEQ ID NO: 143830 - protein, 18 aa, Mycobacterium avium
GSKRELLEAAVAHRIESI

SEQ ID NO: 143831 - protein, 19 aa, Mycobacterium avium
GSSITPDLASHVAAVATFG

SEQ ID NO: 143832 - protein, 20 aa, Mycobacterium avium
GSVLEVRTAISYVGIEGARA

SEQ ID NO: 143833 - protein, 19 aa, Mycobacterium avium
GSVVFGFNRLSIIDIAHSH

SEQ ID NO: 143834 - protein, 22 aa, Mycobacterium avium
GTARLAVEQGRAALAVNWPYAL

SEQ ID NO: 143835 - protein, 17 aa, Mycobacterium avium
GTGRWAFGQEVADPATV

SEQ ID NO: 143836 - protein, 21 aa, Mycobacterium avium
GTHDWPYWGAQLQAMKPDLQS

SEQ ID NO: 143837 - protein, 23 aa, Mycobacterium avium
GTIREFLQSKGVKFEAQKPQGFK

SEQ ID NO: 143838 - protein, 24 aa, Mycobacterium avium
GTNPELRWKVGPVTNANGMLSSQV

SEQ ID NO: 143839 - protein, 21 aa, Mycobacterium avium
GTVIVNLRMGLVVDGAGVTVF

SEQ ID NO: 143840 - protein, 25 aa, Mycobacterium avium
GVDKFPRMVDYVLPTGVRIADADRV

SEQ ID NO: 143841 - protein, 18 aa, Mycobacterium avium
GVGCGSGGQFAGPGGVPG

SEQ ID NO: 143842 - protein, 18 aa, Mycobacterium avium
GVPDRSWSQVSVSARECL

SEQ ID NO: 143843 - protein, 20 aa, Mycobacterium avium
GVPFDPDFQGPRDTADNINR

SEQ ID NO: 143844 - protein, 21 aa, Mycobacterium avium
GVRRPRRFLAAVFVVVAVAGA

SEQ ID NO: 143845 - protein, 24 aa, Mycobacterium avium
GVSSSVRDMARWLMMLLDNGTHDG

SEQ ID NO: 143846 - protein, 19 aa, Mycobacterium avium
GVYANDYWGPAVITEHDGA

SEQ ID NO: 143847 - protein, 19 aa, Mycobacterium avium
GVYHRPHFVQKVVNSDGQV

SEQ ID NO: 143848 - protein, 19 aa, Mycobacterium avium
GYAHPGQVLGLTFTRKAAG

SEQ ID NO: 143849 - protein, 18 aa, Mycobacterium avium
GYDGPPLFVANPVDHVVT

SEQ ID NO: 143850 - protein, 20 aa, Mycobacterium avium
GYLERRLADITTRTGTKYAV

SEQ ID NO: 143851 - protein, 18 aa, Mycobacterium avium
GYRIPADAAAHVHSVSAV

SEQ ID NO: 143852 - protein, 25 aa, Mycobacterium avium
HAAFAPRVAEILPDLPRLRVLIQIA

SEQ ID NO: 143853 - protein, 18 aa, Mycobacterium avium
HAGPTILGQDWLFADEQG

SEQ ID NO: 143854 - protein, 26 aa, Mycobacterium avium
HAQGTKPRCCPAPPAAAPTPNATASS

SEQ ID NO: 143855 - protein, 23 aa, Mycobacterium avium
HARVESIARTWAHAGFDAAAVTD

SEQ ID NO: 143856 - protein, 22 aa, Mycobacterium avium
HAVCMVGLVEPRLRVAITSGQC

SEQ ID NO: 143857 - protein, 21 aa, Mycobacterium avium
HDARPELAYAPQDVLHLDQQL

SEQ ID NO: 143858 - protein, 24 aa, Mycobacterium avium
HGLAEGIAAWLLDRDRPAALGLVG

SEQ ID NO: 143859 - protein, 24 aa, Mycobacterium avium
HGNSVPRFHITWGTGPALVEIFAR

SEQ ID NO: 143860 - protein, 23 aa, Mycobacterium avium
HHPPPNWYGPPPPGGWDGPPPPG

SEQ ID NO: 143861 - protein, 22 aa, Mycobacterium avium
HLRPGGCGRDYRILSVAMLEVT

SEQ ID NO: 143862 - protein, 21 aa, Mycobacterium avium
HLVARQATFHAMFAALTELVD

SEQ ID NO: 143863 - protein, 18 aa, Mycobacterium avium
HRAVTLVFTLAGGAEPCT

SEQ ID NO: 143864 - protein, 20 aa, Mycobacterium avium
HRDGRLAVMTKVHHAGVDGV

SEQ ID NO: 143865 - protein, 22 aa, Mycobacterium avium
HREHHNLPALRDWLRRQRDERS

SEQ ID NO: 143866 - protein, 19 aa, Mycobacterium avium
HTGGAVVCLVSLTHPAPPP

SEQ ID NO: 143867 - protein, 27 aa, Mycobacterium avium
HTTYKSFNWDQAYRKEIVWTAAADDKK

SEQ ID NO: 143868 - protein, 18 aa, Mycobacterium avium
IAAVALLLAGCVRVVVGR

SEQ ID NO: 143869 - protein, 25 aa, Mycobacterium avium
IADFPDRPDNMFALANTLMGLATGH

SEQ ID NO: 143870 - protein, 18 aa, Mycobacterium avium
IADLHKVGISFQDPGQAV

SEQ ID NO: 143871 - protein, 17 aa, Mycobacterium avium
IALACDVVLASENAFFM

SEQ ID NO: 143872 - protein, 21 aa, Mycobacterium avium
IAMEKRWRKVLGERRLTELRE

SEQ ID NO: 143873 - protein, 28 aa, Mycobacterium avium
IANGIDAPALWPGLPVRPVKGEVLRLRW

SEQ ID NO: 143874 - protein, 22 aa, Mycobacterium avium
IAQDCTRQFGGRFAIQQISLPR

SEQ ID NO: 143875 - protein, 24 aa, Mycobacterium avium
IARSFAAALGLQFTRVQFTPDLLP

SEQ ID NO: 143876 - protein, 29 aa, Mycobacterium avium
IAVTNWFGDQPFAVWPWAADKLGGAQPTV

SEQ ID NO: 143877 - protein, 18 aa, Mycobacterium avium
IDGYRVLTDPVWSERCSP

SEQ ID NO: 143878 - protein, 20 aa, Mycobacterium avium
IDRGRQLAVLTCGQSPDPKG

SEQ ID NO: 143879 - protein, 20 aa, Mycobacterium avium
IELLRRARDSLAHHKSVADL

SEQ ID NO: 143880 - protein, 25 aa, Mycobacterium avium
IGAFGRLDALINCAGIAEPAGSSIL

SEQ ID NO: 143881 - protein, 21 aa, Mycobacterium avium
IGGSFGQYGGVWAHDETRKSF

SEQ ID NO: 143882 - protein, 22 aa, Mycobacterium avium
IGIGDPTAGLGAVVSNGNPPLV

SEQ ID NO: 143883 - protein, 17 aa, Mycobacterium avium
IGLALLGAPAAPMVVPA

SEQ ID NO: 143884 - protein, 27 aa, Mycobacterium avium
IGRGHTRNCRLHWVQIIPTIASESTPQ

SEQ ID NO: 143885 - protein, 17 aa, Mycobacterium avium
IKATTVFGGKYVSLTTP

SEQ ID NO: 143886 - protein, 18 aa, Mycobacterium avium
IKATTVFGGKYVSLTTPA

SEQ ID NO: 143887 - protein, 17 aa, Mycobacterium avium
IKAVSAYGGGGAGNRIL

SEQ ID NO: 143888 - protein, 23 aa, Mycobacterium avium
IKDANAIAAAWNDVVLSPDTSLA

SEQ ID NO: 143889 - protein, 17 aa, Mycobacterium avium
ILTQPFDIDTVPKIFRG

SEQ ID NO: 143890 - protein, 25 aa, Mycobacterium avium
IMIPEKHLPLVMPLKYIGIDENTLN

SEQ ID NO: 143891 - protein, 18 aa, Mycobacterium avium
IPAGGLFSGAEGKMSADQ

SEQ ID NO: 143892 - protein, 18 aa, Mycobacterium avium
IPLPGGGALMKIPGEGDL

SEQ ID NO: 143893 - protein, 25 aa, Mycobacterium avium
IQNLSGFSGMYSRGGSGSADMSMTG

SEQ ID NO: 143894 - protein, 24 aa, Mycobacterium avium
IRTTGRPGTAIGLSEGAFVVDGEQ

SEQ ID NO: 143895 - protein, 21 aa, Mycobacterium avium
ISEQLMPHWLLSLQAEATRRG

SEQ ID NO: 143896 - protein, 17 aa, Mycobacterium avium
ISSLELVNQWYANPDDM

SEQ ID NO: 143897 - protein, 28 aa, Mycobacterium avium
ITGFDCSGLMRYGFAGVGVLIPRFSGDQ

SEQ ID NO: 143898 - protein, 22 aa, Mycobacterium avium
ITKACAPAGITVSGVTLDSAGP

SEQ ID NO: 143899 - protein, 19 aa, Mycobacterium avium
IVVSVVNWADCLVAMQQRE

SEQ ID NO: 143900 - protein, 17 aa, Mycobacterium avium
IWIGGRTPPAGAIRDLL

SEQ ID NO: 143901 - protein, 19 aa, Mycobacterium avium
IWVEIGRGHTRNCRLHWVQ

SEQ ID NO: 143902 - protein, 31 aa, Mycobacterium avium; identical to SEQ ID NO: 99027

SEQ ID NO: 143903 - protein, 28 aa, Mycobacterium avium
KAKELVIATKMSGEWSKDEVLQSYLNII

SEQ ID NO: 143904 - protein, 20 aa, Mycobacterium avium
KALADFLFDDERAMVRIDMS

SEQ ID NO: 143905 - protein, 19 aa, Mycobacterium avium
KALPAKDRAAQVFPQTVPP

SEQ ID NO: 143906 - protein, 18 aa, Mycobacterium avium
KATLPRAFVIGPDGSTTV

SEQ ID NO: 143907 - protein, 20 aa, Mycobacterium avium
KDGRQLVIRDLFYDAQGSRQ

SEQ ID NO: 143908 - protein, 18 aa, Mycobacterium avium
KELPDIYQVLARQGLNGD

SEQ ID NO: 143909 - protein, 19 aa, Mycobacterium avium
KFAPEAVLDRGIRKTNGLP

SEQ ID NO: 143910 - protein, 20 aa, Mycobacterium avium
KFAVTKDGRHSLTHYDTVEA

SEQ ID NO: 143911 - protein, 20 aa, Mycobacterium avium
KGGVGLAGYVERRGIATYLR

SEQ ID NO: 143912 - protein, 23 aa, Mycobacterium avium
KHMRADVTVGAFLSGGIDSTAIA

SEQ ID NO: 143913 - protein, 17 aa, Mycobacterium avium
KKAARRGWLDSLADERR

SEQ ID NO: 143914 - protein, 25 aa, Mycobacterium avium
KLVGNFDPREAITHGYVDSQKLPAW

SEQ ID NO: 143915 - protein, 18 aa, Mycobacterium avium
KPGLVIVVPVVKKQFRGP

SEQ ID NO: 143916 - protein, 28 aa, Mycobacterium avium
KRIGSFADLARPGLTVVTCQRPVPCGAA

SEQ ID NO: 143917 - protein, 17 aa, Mycobacterium avium
KRVVRDLPPGYEVTTGI

SEQ ID NO: 143918 - protein, 17 aa, Mycobacterium avium
KRYTCALDYAQADRDEL

SEQ ID NO: 143919 - protein, 30 aa, Mycobacterium avium
KSSYAGKVNGDWRPVAVGANGTTISGGSSD

SEQ ID NO: 143920 - protein, 29 aa, Mycobacterium avium
KTFVGAAARGGRRLVIAMMYGLIKEGGPS

SEQ ID NO: 143921 - protein, 19 aa, Mycobacterium avium
KTPDGWTLGLGARDEQQVP

SEQ ID NO: 143922 - protein, 21 aa, Mycobacterium avium
KVAEVKPSFGPDYKVSDTGER

SEQ ID NO: 143923 - protein, 17 aa, Mycobacterium avium
LAAGRYLAANGFAADRD

SEQ ID NO: 143924 - protein, 26 aa, Mycobacterium avium
LAEAAPCPHGGCPGGAAPKTTGPARV

SEQ ID NO: 143925 - protein, 20 aa, Mycobacterium avium
LAGAMPVILAAGAVLPGPRA

SEQ ID NO: 143926 - protein, 24 aa, Mycobacterium avium
LAGASALAVILLWAAPGHATADPA

SEQ ID NO: 143927 - protein, 23 aa, Mycobacterium avium
LAGGLLALRFPVFIDAYDQFGLQ

SEQ ID NO: 143928 - protein, 19 aa, Mycobacterium avium
LAGRLWDLPGWARAGHRLL

SEQ ID NO: 143929 - protein, 24 aa, Mycobacterium avium
LAIDSWMCAISGRAKEFNMIQYFK

SEQ ID NO: 143930 - protein, 17 aa, Mycobacterium avium
LANGPGYANAMPTLGPI

SEQ ID NO: 143931 - protein, 18 aa, Mycobacterium avium
LAPPEFVNDVGQKQDAAI

SEQ ID NO: 143932 - protein, 18 aa, Mycobacterium avium
LASMGRGPSIGGLSVPPS

SEQ ID NO: 143933 - protein, 17 aa, Mycobacterium avium
LATLCDFIADCAPAHLL

SEQ ID NO: 143934 - protein, 18 aa, Mycobacterium avium
LATMEAQIGVTLAVRTTR

SEQ ID NO: 143935 - protein, 20 aa, Mycobacterium avium
LDAGRELAKALGLDPNAVTV

SEQ ID NO: 143936 - protein, 27 aa, Mycobacterium avium
LDALGWKLHGRFREKDGRQLVIRDLFY

SEQ ID NO: 143937 - protein, 26 aa, Mycobacterium avium
LDARPYRLSWPAGTTVYEIDQPEVIA

SEQ ID NO: 143938 - protein, 21 aa, Mycobacterium avium
LDCEVRAAAAAGWAGTEHLDA

SEQ ID NO: 143939 - protein, 25 aa, Mycobacterium avium
LDEHRPEVVFHLAAQIDVRHSVADP

SEQ ID NO: 143940 - protein, 23 aa, Mycobacterium avium
LDFRPKHKLAVLVVSVTPLAEPV

SEQ ID NO: 143941 - protein, 21 aa, Mycobacterium avium
LDRNTTLWASWALAGPTHRAY

SEQ ID NO: 143942 - protein, 19 aa, Mycobacterium avium
LDSGPWRKLSANRDNRVYV

SEQ ID NO: 143943 - protein, 18 aa, Mycobacterium avium
LDVPYTRIHEFRHFHTER

SEQ ID NO: 143944 - protein, 27 aa, Mycobacterium avium
LEAAVQRSVVISAGWDVMDFVQQMQKL

SEQ ID NO: 143945 - protein, 18 aa, Mycobacterium avium
LEALWWDRPFTLNGVDIG

SEQ ID NO: 143946 - protein, 21 aa, Mycobacterium avium
LEDGQMCRLRAAGPNYTINMV

SEQ ID NO: 143947 - protein, 23 aa, Mycobacterium avium
LEFIQFHPTMLFAPGAGGGRRPL

SEQ ID NO: 143948 - protein, 17 aa, Mycobacterium avium
LEKELVRDPAAVADVDE

SEQ ID NO: 143949 - protein, 19 aa, Mycobacterium avium
LESGCYARIRPGAAPDITR

SEQ ID NO: 143950 - protein, 22 aa, Mycobacterium avium
LGAKLGRLVMRSACAQFGQWRS

SEQ ID NO: 143951 - protein, 18 aa, Mycobacterium avium
LGDMVAELIELSRLQGAE

SEQ ID NO: 143952 - protein, 18 aa, Mycobacterium avium
LGGMSLWLAPTSAFTASP

SEQ ID NO: 143953 - protein, 17 aa, Mycobacterium avium
LGGSLEDGQMCRLRAAG

SEQ ID NO: 143954 - protein, 25 aa, Mycobacterium avium
LGSGPFFKAYVANLVPGQFGGPVLD

SEQ ID NO: 143955 - protein, 19 aa, Mycobacterium avium
LIFTAARAGVAFTPINYRL

SEQ ID NO: 143956 - protein, 20 aa, Mycobacterium avium
LIGALKLILTQPFDIDTVPK

SEQ ID NO: 143957 - protein, 17 aa, Mycobacterium avium
LIGESNVEVTLTGPIAA

SEQ ID NO: 143958 - protein, 19 aa, Mycobacterium avium
LIGGFRPLFRALDPDQVNA

SEQ ID NO: 143959 - protein, 22 aa, Mycobacterium avium
LLAPAVLLGWPAAAEPPSCAAL

SEQ ID NO: 143960 - protein, 17 aa, Mycobacterium avium
LLDALARADVVAAEDTR

SEQ ID NO: 143961 - protein, 19 aa, Mycobacterium avium
LLFTFTLIAVFGQLRFEDR

SEQ ID NO: 143962 - protein, 26 aa, Mycobacterium avium
LLSAALRLFAAKGYAATSVADIQRES

SEQ ID NO: 143963 - protein, 17 aa, Mycobacterium avium
LMELFNIDERTLNTQGL

SEQ ID NO: 143964 - protein, 51 aa, Mycobacterium avium; identical to SEQ ID NO: 100214

SEQ ID NO: 143965 - protein, 19 aa, Mycobacterium avium
LMVPLPVPGCTAVGAIENI

SEQ ID NO: 143966 - protein, 20 aa, Mycobacterium avium
LPADDVLACYADRLTDRSLG

SEQ ID NO: 143967 - protein, 18 aa, Mycobacterium avium
LPAGRLRDALGVREVAYS

SEQ ID NO: 143968 - protein, 19 aa, Mycobacterium avium
LPAQRVDESLVRVATMKGR

SEQ ID NO: 143969 - protein, 25 aa, Mycobacterium avium
LPASPGDFFDLVGMAHWRALDEKYA

SEQ ID NO: 143970 - protein, 23 aa, Mycobacterium avium
LPDLPRLRVLIQIADESGNELLD

SEQ ID NO: 143971 - protein, 17 aa, Mycobacterium avium
LPEAQLDRFAIRLELRY

SEQ ID NO: 143972 - protein, 19 aa, Mycobacterium avium
LPQSGGLYRTANVTYRGIT

SEQ ID NO: 143973 - protein, 21 aa, Mycobacterium avium
LPSDFDFVLNLAVAKSGSWDK

SEQ ID NO: 143974 - protein, 25 aa, Mycobacterium avium
LPSHRWPRRALRLTAIDVDTGELTV

SEQ ID NO: 143975 - protein, 31 aa, Mycobacterium avium
LPSRPEPHALLGNAFHAWVQKFYGAECLFEL

SEQ ID NO: 143976 - protein, 19 aa, Mycobacterium avium
LPTGRRLLAAPGLRAVPGL

SEQ ID NO: 143977 - protein, 20 aa, Mycobacterium avium
LPTQPQLLLVPALVAAAPFG

SEQ ID NO: 143978 - protein, 17 aa, Mycobacterium avium
LPVDGYTAWLQNMAAHE

SEQ ID NO: 143979 - protein, 26 aa, Mycobacterium avium
LPVDSVAVATRFPGPITDLQLSRDST

SEQ ID NO: 143980 - protein, 21 aa, Mycobacterium avium
LPVPGCTAVGAIENITAVESG

SEQ ID NO: 143981 - protein, 18 aa, Mycobacterium avium
LPVQLVVRSVGYRGVPTP

SEQ ID NO: 143982 - protein, 17 aa, Mycobacterium avium
LPYRVAFSTFTSGPPQV

SEQ ID NO: 143983 - protein, 20 aa, Mycobacterium avium
LQALQCPLKELGKASPYLIG

SEQ ID NO: 143984 - protein, 20 aa, Mycobacterium avium
LRAGELLEWAYSMVASSQAG

SEQ ID NO: 143985 - protein, 26 aa, Mycobacterium avium
LRAVNIGAVLPPLAVGAKCTAAALSP

SEQ ID NO: 143986 - protein, 18 aa, Mycobacterium avium
LRAVPGLPVCQLRRSTGQ

SEQ ID NO: 143987 - protein, 20 aa, Mycobacterium avium
LRLNTRVCALDAAGHTVGLA

SEQ ID NO: 143988 - protein, 17 aa, Mycobacterium avium
LRRKFRAIWIGGRTPPA

SEQ ID NO: 143989 - protein, 27 aa, Mycobacterium avium
LRTIGIDLRQDWPAALQDAGFDAAQPT

SEQ ID NO: 143990 - protein, 18 aa, Mycobacterium avium
LRVAGAVLDRAGRFLPFE

SEQ ID NO: 143991 - protein, 19 aa, Mycobacterium avium
LRVPAVWVAGVALGASMLG

SEQ ID NO: 143992 - protein, 22 aa, Mycobacterium avium
LSASSARWPACANRQDTVPADG

SEQ ID NO: 143993 - protein, 19 aa, Mycobacterium avium
LSGLHLGKVLSISEATGNA

SEQ ID NO: 143994 - protein, 18 aa, Mycobacterium avium
LSPAGVEPFGCLRSTPPP

SEQ ID NO: 143995 - protein, 18 aa, Mycobacterium avium
LTALPMRRAIVMVICGKA

SEQ ID NO: 143996 - protein, 17 aa, Mycobacterium avium
LTDPVWSERCSPSDIVG

SEQ ID NO: 143997 - protein, 25 aa, Mycobacterium avium
LTPDYPFRCKRVLLGDDYYRALQRD

SEQ ID NO: 143998 - protein, 18 aa, Mycobacterium avium
LTSKLLVRQGDRRAVRSV

SEQ ID NO: 143999 - protein, 28 aa, Mycobacterium avium
LTSLSLQCKLPISIPQALGMVQQAQGAA

SEQ ID NO: 144000 - protein, 18 aa, Mycobacterium avium
LTTKAVRTACAALVTTSK

SEQ ID NO: 144001 - protein, 19 aa, Mycobacterium avium
LVDECIGAFGRLDALINCA

SEQ ID NO: 144002 - protein, 28 aa, Mycobacterium avium
LVPAAPFVAGALKLGLTAPFNIDDVAQV

SEQ ID NO: 144003 - protein, 19 aa, Mycobacterium avium
LVTARAIQLVPAYSGGPTL

SEQ ID NO: 144004 - protein, 18 aa, Mycobacterium avium
LWAGVAVSDLEFIQFHPT

SEQ ID NO: 144005 - protein, 18 aa, Mycobacterium avium
LYFEGDLDASVANTGQVA

SEQ ID NO: 144006 - protein, 18 aa, Mycobacterium avium
MAHDCPNTKMVLGGYSQG

SEQ ID NO: 144007 - protein, 31 aa, Mycobacterium avium; identical to SEQ ID NO: 100933

SEQ ID NO: 144008 - protein, 25 aa, Mycobacterium avium
MAVDYQRLGKMPPLQTGGLHDGQTA

SEQ ID NO: 144009 - protein, 21 aa, Mycobacterium avium
MDPDVLLREFLKATADPANRH

SEQ ID NO: 144010 - protein, 17 aa, Mycobacterium avium
MDPELYLLWGQANTSAG

SEQ ID NO: 144011 - protein, 24 aa, Mycobacterium avium
MDRWSRGRVALVGDAGYCCSPLSG

SEQ ID NO: 144012 - protein, 25 aa, Mycobacterium avium
MGEGAVLGGAYPGYGIYASADGYVA

SEQ ID NO: 144013 - protein, 27 aa, Mycobacterium avium
MGPMQFIPETWRLYAVDAHNDGRVSPD

SEQ ID NO: 144014 - protein, 18 aa, Mycobacterium avium
MHWGEEGFEFSRDGAEYF

SEQ ID NO: 144015 - protein, 20 aa, Mycobacterium avium
MINTTCSYDQAMRAVHAENP

SEQ ID NO: 144016 - protein, 25 aa, Mycobacterium avium
MIVLCAGAGVGTWLLVGRGGPQHPE

SEQ ID NO: 144017 - protein, 18 aa, Mycobacterium avium
MLFPHLYGPLPVNAVIAV

SEQ ID NO: 144018 - protein, 21 aa, Mycobacterium avium
MLTALAADWPLLHSPACAALL

SEQ ID NO: 144019 - protein, 20 aa, Mycobacterium avium
MPCSRWRRYDKLRRFPDGLL

SEQ ID NO: 144020 - protein, 21 aa, Mycobacterium avium
MPDRILAAAVCYQSGREPRPY

SEQ ID NO: 144021 - protein, 20 aa, Mycobacterium avium
MPIAALIIIAAGSQLSPAPA

SEQ ID NO: 144022 - protein, 19 aa, Mycobacterium avium
MPYAKIATRGGVVPLTNET

SEQ ID NO: 144023 - protein, 19 aa, Mycobacterium avium
MQDRLVWQAASLLLAYPDD

SEQ ID NO: 144024 - protein, 22 aa, Mycobacterium avium
MRAQFLCHWQFAELGRPGKVSW

SEQ ID NO: 144025 - protein, 17 aa, Mycobacterium avium
MRKAKELVIATKMSGEW

SEQ ID NO: 144026 - protein, 25 aa, Mycobacterium avium
MSLNTSYYRLMLKLKGGPQAVADAA

SEQ ID NO: 144027 - protein, 26 aa, Mycobacterium avium
MTAGLPLLRRACTALAAVLVAAGCGH

SEQ ID NO: 144028 - protein, 25 aa, Mycobacterium avium
MTGEAPRELGLLIGIVPGRPRGCGL

SEQ ID NO: 144029 - protein, 24 aa, Mycobacterium avium
MVVPELQRRGLFRTEYRSATLRGH

SEQ ID NO: 144030 - protein, 26 aa, Mycobacterium avium
NANGLKIVSCYQYGKGNTADWLGGAS

SEQ ID NO: 144031 - protein, 18 aa, Mycobacterium avium
NARIKAVSAYGGGGAGNR

SEQ ID NO: 144032 - protein, 18 aa, Mycobacterium avium
NEVYNIFNGRGEAIRALL

SEQ ID NO: 144033 - protein, 18 aa, Mycobacterium avium
NEYAKLLIQASDINAPVP

SEQ ID NO: 144034 - protein, 25 aa, Mycobacterium avium
NFNNLPIPINIFLQKSVDPSKILYS

SEQ ID NO: 144035 - protein, 19 aa, Mycobacterium avium
NGDSLAFGEYRCRADQAGL

SEQ ID NO: 144036 - protein, 25 aa, Mycobacterium avium
NGYHVGGIFIGSWTDLTIFQGPLAD

SEQ ID NO: 144037 - protein, 23 aa, Mycobacterium avium
NMNTEALSGLGLIANPVSAVPVI

SEQ ID NO: 144038 - protein, 22 aa, Mycobacterium avium
NNFPGATVPFGMVQYSPDTAGN

SEQ ID NO: 144039 - protein, 28 aa, Mycobacterium avium
NPGDPICSGGYQWASHLSYVPGLTNQAA

SEQ ID NO: 144040 - protein, 23 aa, Mycobacterium avium
NPMEISEAVFVEGRAMVDLESDC

SEQ ID NO: 144041 - protein, 18 aa, Mycobacterium avium
NPRMLSIAQFWDRAANHD

SEQ ID NO: 144042 - protein, 17 aa, Mycobacterium avium
NRLYRGRDDLVLLHVDP

SEQ ID NO: 144043 - protein, 19 aa, Mycobacterium avium
NRYARAGADIVFVEAPHDA

SEQ ID NO: 144044 - protein, 25 aa, Mycobacterium avium
NYGGLTVYSGEWWHFDGPGAGVDQP

SEQ ID NO: 144045 - protein, 30 aa, Mycobacterium avium
PAAAGDLRLEWPLRPPPVVVRAFDAPAQDW

SEQ ID NO: 144046 - protein, 19 aa, Mycobacterium avium
PAALRRAGLDPSAPAVWLI

SEQ ID NO: 144047 - protein, 20 aa, Mycobacterium avium
PAAPMVVPAVATADPGVRAM

SEQ ID NO: 144048 - protein, 23 aa, Mycobacterium avium
PADAKAVIVASNLVSARYVQLSP

SEQ ID NO: 144049 - protein, 18 aa, Mycobacterium avium
PADPAVDVLDRFRAAGTV

SEQ ID NO: 144050 - protein, 18 aa, Mycobacterium avium
PAHLLAAVRGAEPVGEPV

SEQ ID NO: 144051 - protein, 17 aa, Mycobacterium avium
PAIPQHHLVALDDPEHN

SEQ ID NO: 144052 - protein, 26 aa, Mycobacterium avium
PAPGGVKLAAGWLVERAGFGKGYPVP

SEQ ID NO: 144053 - protein, 22 aa, Mycobacterium avium
PAPTHRRWSQYLSWVADHVGMT

SEQ ID NO: 144054 - protein, 25 aa, Mycobacterium avium
PASNITRLPVRYTFDNRYFSDTYEG

SEQ ID NO: 144055 - protein, 26 aa, Mycobacterium avium
PATRLLRPSIMWRAARARGADHPGTA

SEQ ID NO: 144056 - protein, 28 aa, Mycobacterium avium
PAVDPKGALARWNWVLDGMVETKALPAK

SEQ ID NO: 144057 - protein, 21 aa, Mycobacterium avium
PAVDVLDRFRAAGTVDPKPAA

SEQ ID NO: 144058 - protein, 22 aa, Mycobacterium avium
PCSYDRGPECLTVEAIPQPNGQ

SEQ ID NO: 144059 - protein, 26 aa, Mycobacterium avium
PDGLPAIEDLHIWTAESVRADRLDFR

SEQ ID NO: 144060 - protein, 25 aa, Mycobacterium avium
PDGVRCVVQFFPSHDVYSWDPATMS

SEQ ID NO: 144061 - protein, 17 aa, Mycobacterium avium
PDTYGFNGIDPAQTTGD

SEQ ID NO: 144062 - protein, 22 aa, Mycobacterium avium
PEIEGTPPLIARAFNKYVDRVL

SEQ ID NO: 144063 - protein, 20 aa, Mycobacterium avium
PEVTEYGAANGFTLAEMTAG

SEQ ID NO: 144064 - protein, 20 aa, Mycobacterium avium
PFVVDRWTPDKVYSGAYKAW

SEQ ID NO: 144065 - protein, 21 aa, Mycobacterium avium
PGGPLALPSHDEMVSPAHLSY

SEQ ID NO: 144066 - protein, 35 aa, Mycobacterium avium
PGGWDGPPPPGGWNRPWDGPPRDVAVARADFGPFS

SEQ ID NO: 144067 - protein, 18 aa, Mycobacterium avium
PGHPGCRASPAGGACLHW

SEQ ID NO: 144068 - protein, 23 aa, Mycobacterium avium
PGHTRGSMCFRVSSDKQVVFTGD

SEQ ID NO: 144069 - protein, 18 aa, Mycobacterium avium
PGLKIAFTAGHCRGGGGV

SEQ ID NO: 144070 - protein, 19 aa, Mycobacterium avium
PGPPEIPPAVSAYTGLPGD

SEQ ID NO: 144071 - protein, 17 aa, Mycobacterium avium
PGPVAARHWEVEPDLTN

SEQ ID NO: 144072 - protein, 17 aa, Mycobacterium avium
PGQVLGLTFTRKAAGQL

SEQ ID NO: 144073 - protein, 19 aa, Mycobacterium avium
PGTVRLAAVGAPLPQDPPP

SEQ ID NO: 144074 - protein, 20 aa, Mycobacterium avium
PHLYGPLPVNAVIAVTDYRP

SEQ ID NO: 144075 - protein, 20 aa, Mycobacterium avium
PHMPKVPIADVLGAERAVSS

SEQ ID NO: 144076 - protein, 22 aa, Mycobacterium avium
PKLAKKLGLQRQWLHARSLSFA

SEQ ID NO: 144077 - protein, 17 aa, Mycobacterium avium
PKLFGPLGVGFVPHTRF

SEQ ID NO: 144078 - protein, 20 aa, Mycobacterium avium
PKLGQAVEWTPCRAANPKVK

SEQ ID NO: 144079 - protein, 33 aa, Mycobacterium avium
PLAYAWDMGAYAWPGPERLRFANDPANLLAVDG

SEQ ID NO: 144080 - protein, 24 aa, Mycobacterium avium
PLNRDPRLAGSINDVGIFVPTDEQ

SEQ ID NO: 144081 - protein, 24 aa, Mycobacterium avium
PLTGLRLRIEFDGRTTVDSPLGEF

SEQ ID NO: 144082 - protein, 21 aa, Mycobacterium avium
PMASGYPGYPGMPGGGAARSA

SEQ ID NO: 144083 - protein, 27 aa, Mycobacterium avium
PNAYTVYFAMKFNRPFISYGSWDGSTV

SEQ ID NO: 144084 - protein, 19 aa, Mycobacterium avium
PNIELAEAAGLSLADGGVL

SEQ ID NO: 144085 - protein, 19 aa, Mycobacterium avium
PPCWHVSGAALFRRQLRYV

SEQ ID NO: 144086 - protein, 26 aa, Mycobacterium avium
PPGQPTWYRGAARISDLVEQIRRSGV

SEQ ID NO: 144087 - protein, 23 aa, Mycobacterium avium
PPPEALTDVLGRLADPSVPGANK

SEQ ID NO: 144088 - protein, 23 aa, Mycobacterium avium
PPPPERQRYAALNPPNTQPPHPP

SEQ ID NO: 144089 - protein, 18 aa, Mycobacterium avium
PPRAELQAAMSRDASVVR

SEQ ID NO: 144090 - protein, 20 aa, Mycobacterium avium
PPTGQHWRLLSTVKELDPAW

SEQ ID NO: 144091 - protein, 19 aa, Mycobacterium avium
PPVRTSLYSDPQFQTKYPM

SEQ ID NO: 144092 - protein, 17 aa, Mycobacterium avium
PQDQARRGDLIFYGPGG

SEQ ID NO: 144093 - protein, 19 aa, Mycobacterium avium
PQDQLAWLGKITCDRLDHG

SEQ ID NO: 144094 - protein, 19 aa, Mycobacterium avium
PQFESWQAVMAQVYVDGRS

SEQ ID NO: 144095 - protein, 23 aa, Mycobacterium avium
PQGHLLVFWDCYRPHDVQVKMFS

SEQ ID NO: 144096 - protein, 23 aa, Mycobacterium avium
PRAWRRLHARLTRLGVGVHPGHR

SEQ ID NO: 144097 - protein, 25 aa, Mycobacterium avium
PSAPLLKAGDTIGLPATRAAATVES

SEQ ID NO: 144098 - protein, 25 aa, Mycobacterium avium
PSDARCLVHQSMAPGLAAAAGALRP

SEQ ID NO: 144099 - protein, 17 aa, Mycobacterium avium
PSEVPIDSGAGLDPGAG

SEQ ID NO: 144100 - protein, 18 aa, Mycobacterium avium
PTFSGLMVPLPVPGCTAV

SEQ ID NO: 144101 - protein, 24 aa, Mycobacterium avium
PVADPALVPLFFVAREARKHVKVV

SEQ ID NO: 144102 - protein, 18 aa, Mycobacterium avium
PVGIRADCLGVQSPLPEW

SEQ ID NO: 144103 - protein, 25 aa, Mycobacterium avium
PVVPLWNYISVVGWSGEVSHVTVTW

SEQ ID NO: 144104 - protein, 22 aa, Mycobacterium avium
QADCFAGVYLFWVADGKSPRFT

SEQ ID NO: 144105 - protein, 17 aa, Mycobacterium avium
QALFAQFSRQWQQCNGM

SEQ ID NO: 144106 - protein, 19 aa, Mycobacterium avium
QARSITVTFVRHAQSEANA

SEQ ID NO: 144107 - protein, 25 aa, Mycobacterium avium
QAYQFPMGLGLVSQFFGKYFSPEEA

SEQ ID NO: 144108 - protein, 19 aa, Mycobacterium avium
QFAPVPGAAGIPNFNPGLT

SEQ ID NO: 144109 - protein, 20 aa, Mycobacterium avium
QGHVLERLFPGIGKLDESFP

SEQ ID NO: 144110 - protein, 22 aa, Mycobacterium avium
QGKPAVLWFWTPWCPYCNAEAP

SEQ ID NO: 144111 - protein, 19 aa, Mycobacterium avium
QGPAGWLRAKTGSLTAINA

SEQ ID NO: 144112 - protein, 23 aa, Mycobacterium avium
QGPNARLAVNVGVITKACAPAGI

SEQ ID NO: 144113 - protein, 18 aa, Mycobacterium avium
QHQADAWAIWDPYTAQAE

SEQ ID NO: 144114 - protein, 18 aa, Mycobacterium avium
QKLADLFAAAGQLQSAPR

SEQ ID NO: 144115 - protein, 23 aa, Mycobacterium avium
QLARARALLLGRDYVIPEDVKAL

SEQ ID NO: 144116 - protein, 22 aa, Mycobacterium avium
QLIRHTAWFGAAVGFAVTGGEV

SEQ ID NO: 144117 - protein, 17 aa, Mycobacterium avium
QLPAGVVQINRRNYLMV

SEQ ID NO: 144118 - protein, 24 aa, Mycobacterium avium
QLTPAGLIVADWAARLLEVAHEID

SEQ ID NO: 144119 - protein, 18 aa, Mycobacterium avium
QPAIAVAGMLGRPGEYDE

SEQ ID NO: 144120 - protein, 21 aa, Mycobacterium avium
QPGPVPVVFLAIDRFKVINGR

SEQ ID NO: 144121 - protein, 25 aa, Mycobacterium avium
QPPPRPADDLGYRPASREQPFGQNI

SEQ ID NO: 144122 - protein, 18 aa, Mycobacterium avium
QPRANPFHRWLDDTYPVP

SEQ ID NO: 144123 - protein, 24 aa, Mycobacterium avium
QQRDCVYYTTLVMWIGCHADSHEY

SEQ ID NO: 144124 - protein, 24 aa, Mycobacterium avium
QRAVIPRDHIKSVLESADVVIWTT

SEQ ID NO: 144125 - protein, 23 aa, Mycobacterium avium
QRVVCGGISIAGRWDTTADPAVT

SEQ ID NO: 144126 - protein, 19 aa, Mycobacterium avium
QSAHRLGLCVRKLRNRGAV

SEQ ID NO: 144127 - protein, 25 aa, Mycobacterium avium
QSGRFAFRAGPIFTNLLLADEINRT

SEQ ID NO: 144128 - protein, 19 aa, Mycobacterium avium
QSRLEPILLAATRRGGSDV

SEQ ID NO: 144129 - protein, 21 aa, Mycobacterium avium
QTAPPECRFIYAETATFGRDL

SEQ ID NO: 144130 - protein, 26 aa, Mycobacterium avium
QTGSSFKVFCLIAALEQGIGLGYQVD

SEQ ID NO: 144131 - protein, 26 aa, Mycobacterium avium
QVECNCVGIKPGRSYTARQLLDALLL

SEQ ID NO: 144132 - protein, 22 aa, Mycobacterium avium
QVGADLRGRYRVVLLDEYQDTG

SEQ ID NO: 144133 - protein, 17 aa, Mycobacterium avium
QVTKELMELFNIDERTL

SEQ ID NO: 144134 - protein, 19 aa, Mycobacterium avium
RAAAAPIRQAWQLSTNPDL

SEQ ID NO: 144135 - protein, 28 aa, Mycobacterium avium
RAAAELRTGKPWFAIGGIDAQRLPEVLD

SEQ ID NO: 144136 - protein, 19 aa, Mycobacterium avium
RAADLLKGLGARYVEQRVV

SEQ ID NO: 144137 - protein, 19 aa, Mycobacterium avium
RAAIKPADVKFVYLQPADA

SEQ ID NO: 144138 - protein, 19 aa, Mycobacterium avium
RADGYVGVYGCGGAGSDLA

SEQ ID NO: 144139 - protein, 23 aa, Mycobacterium avium
RADLRRVRELTAGAVGANIALLF

SEQ ID NO: 144140 - protein, 20 aa, Mycobacterium avium
RAELLAALSVAIDLGLGQPA

SEQ ID NO: 144141 - protein, 17 aa, Mycobacterium avium
RAGAVALATLTIAAASS

SEQ ID NO: 144142 - protein, 19 aa, Mycobacterium avium
RAGVAFTPINYRLSAEGIR

SEQ ID NO: 144143 - protein, 22 aa, Mycobacterium avium
RARAVLPSSFLGSGLTEAAYRG

SEQ ID NO: 144144 - protein, 24 aa, Mycobacterium avium
RASPAGGACLHWGAMWGPASGARY

SEQ ID NO: 144145 - protein, 17 aa, Mycobacterium avium
RDSDFRAGCPVVAVAVE

SEQ ID NO: 144146 - protein, 23 aa, Mycobacterium avium
REATEIPSVIARFGGDEFGVVPA

SEQ ID NO: 144147 - protein, 24 aa, Mycobacterium avium
REEWTRFARHWDRLAPDPYAAELG

SEQ ID NO: 144148 - protein, 19 aa, Mycobacterium avium
REFASRWAELIFTGDPGID

SEQ ID NO: 144149 - protein, 24 aa, Mycobacterium avium
RELFCARDPFGIKPLFVATGTGGT

SEQ ID NO: 144150 - protein, 21 aa, Mycobacterium avium
RESGVVFQQFEGGVITAKNDA

SEQ ID NO: 144151 - protein, 21 aa, Mycobacterium avium
RFGELREGVWMRPDNIDTQLG

SEQ ID NO: 144152 - protein, 23 aa, Mycobacterium avium
RFVTFVRGAMYWSPQTGAQPVTG

SEQ ID NO: 144153 - protein, 24 aa, Mycobacterium avium
RGAPDMAASLWIGDLGAEAVQSAD

SEQ ID NO: 144154 - protein, 19 aa, Mycobacterium avium
RGGEWKFAVTKDGRHSLTH

SEQ ID NO: 144155 - protein, 20 aa, Mycobacterium avium
RGPSQWLLRLSGTQSERAEL

SEQ ID NO: 144156 - protein, 19 aa, Mycobacterium avium
RGSGEPPGIGGIGQPFVDA

SEQ ID NO: 144157 - protein, 20 aa, Mycobacterium avium
RHLAESLAGWQERYPDVTVH

SEQ ID NO: 144158 - protein, 19 aa, Mycobacterium avium
RIHRELGFNIAMPVQPGHG

SEQ ID NO: 144159 - protein, 17 aa, Mycobacterium avium
RISAFQMGFLNGASACA

SEQ ID NO: 144160 - protein, 19 aa, Mycobacterium avium
RLAAPLLWEPGVPTDPASM

SEQ ID NO: 144161 - protein, 19 aa, Mycobacterium avium
RLALTDFPPNFNILHIDGN

SEQ ID NO: 144162 - protein, 20 aa, Mycobacterium avium
RLDDELATYLAALRDAASAA

SEQ ID NO: 144163 - protein, 26 aa, Mycobacterium avium
RLLSEEDRRFAVVFAHDQSDYARMEA

SEQ ID NO: 144164 - protein, 19 aa, Mycobacterium avium
RLPGAIRWTSNALRQARDY

SEQ ID NO: 144165 - protein, 18 aa, Mycobacterium avium
RLRDALGVREVAYSRGDT

SEQ ID NO: 144166 - protein, 20 aa, Mycobacterium avium
RLSAVFASLTLATALIAGCS

SEQ ID NO: 144167 - protein, 24 aa, Mycobacterium avium
RLTDPKAGPLIAVKLHILTRKTLG

SEQ ID NO: 144168 - protein, 21 aa, Mycobacterium avium
RLTGGAWLHVRLPEAPAPPQN

SEQ ID NO: 144169 - protein, 24 aa, Mycobacterium avium
RMAGEGWVRPQLLEYMRTAPDFYF

SEQ ID NO: 144170 - protein, 26 aa, Mycobacterium avium
RMLDIRTAHVALRVLHDGSMGDEAVT

SEQ ID NO: 144171 - protein, 23 aa, Mycobacterium avium
RNDGQWGGAMLVAAKSATPSPDN

SEQ ID NO: 144172 - protein, 17 aa, Mycobacterium avium
RNFHIVTCRQLEWRRMI

SEQ ID NO: 144173 - protein, 25 aa, Mycobacterium avium
RPFGDRLVGWDTYRRLDLLPYLSAD

SEQ ID NO: 144174 - protein, 19 aa, Mycobacterium avium
RQTPRLLGYRDHHRAGPWS

SEQ ID NO: 144175 - protein, 18 aa, Mycobacterium avium
RRADDGLEIPSVVLEVEF

SEQ ID NO: 144176 - protein, 17 aa, Mycobacterium avium
RRGDLIFYGPGGSQHVT

SEQ ID NO: 144177 - protein, 22 aa, Mycobacterium avium
RRNRFRLIVFAWITAMVTGLMF

SEQ ID NO: 144178 - protein, 17 aa, Mycobacterium avium
RRRAPGTAIALRDKEIE

SEQ ID NO: 144179 - protein, 18 aa, Mycobacterium avium
RRRIFAGLIAAALPGAAV

SEQ ID NO: 144180 - protein, 25 aa, Mycobacterium avium
RRSEMLQRLGWIVVRVVAGDRPADI

SEQ ID NO: 144181 - protein, 20 aa, Mycobacterium avium
RRSWQGLTLLVAAMVLTSCG

SEQ ID NO: 144182 - protein, 19 aa, Mycobacterium avium
RRTQIAIGAVIALIVFGVA

SEQ ID NO: 144183 - protein, 23 aa, Mycobacterium avium
RRTTEGWRRRGLDMDIAALTYPG

SEQ ID NO: 144184 - protein, 17 aa, Mycobacterium avium
RSTARAAATVLFLALLV

SEQ ID NO: 144185 - protein, 17 aa, Mycobacterium avium
RTGVCAAKPPGPASAPV

SEQ ID NO: 144186 - protein, 17 aa, Mycobacterium avium
RTQLLCEAVDFAGEYVA

SEQ ID NO: 144187 - protein, 17 aa, Mycobacterium avium
RVDESLVRVATMKGRGP

SEQ ID NO: 144188 - protein, 24 aa, Mycobacterium avium
RVPNPYILATVFSFNGVTPNADAY

SEQ ID NO: 144189 - protein, 17 aa, Mycobacterium avium
RVVGAATALGVLALGAG

SEQ ID NO: 144190 - protein, 18 aa, Mycobacterium avium
RYLGAPVSVVSPWYGAKA

SEQ ID NO: 144191 - protein, 21 aa, Mycobacterium avium
SAARRAGDRAGRRARLGSSPE

SEQ ID NO: 144192 - protein, 20 aa, Mycobacterium avium
SADVRFGAPSAFATRPAGLP

SEQ ID NO: 144193 - protein, 19 aa, Mycobacterium avium
SAEYLRLLRRHNVAATLSG

SEQ ID NO: 144194 - protein, 32 aa, Mycobacterium avium
SAFATRPAGLPGLRQKYGLDIKPGNFVAIDDG

SEQ ID NO: 144195 - protein, 20 aa, Mycobacterium avium
SAGLCGAAIALSPDAAAAPL

SEQ ID NO: 144196 - protein, 23 aa, Mycobacterium avium
SALHHPCCGDLVYGADPKLAKKL

SEQ ID NO: 144197 - protein, 22 aa, Mycobacterium avium
SALIVSRLHKIFGSEDLNANAG

SEQ ID NO: 144198 - protein, 18 aa, Mycobacterium avium
SAPAWTVKVGRLGAPDAV

SEQ ID NO: 144199 - protein, 18 aa, Mycobacterium avium
SDLRGKAIAVAKGSSSHA

SEQ ID NO: 144200 - protein, 18 aa, Mycobacterium avium
SDWKLEFDMPAGQSVLHT

SEQ ID NO: 144201 - protein, 21 aa, Mycobacterium avium
SEAAKAAGFVDIRSVIPDAVL

SEQ ID NO: 144202 - protein, 19 aa, Mycobacterium avium
SGFSQRAGDVGARHDASHF

SEQ ID NO: 144203 - protein, 17 aa, Mycobacterium avium
SGPKLGQAVEWTPCRAA

SEQ ID NO: 144204 - protein, 17 aa, Mycobacterium avium
SGRFLDRNTTLWASWAL

SEQ ID NO: 144205 - protein, 23 aa, Mycobacterium avium
SILADRALRVAVSKGIDRQTIAK

SEQ ID NO: 144206 - protein, 19 aa, Mycobacterium avium
SLADFVKRQNIGSFTLGPI

SEQ ID NO: 144207 - protein, 18 aa, Mycobacterium avium
SLILRGGGIPNLEVLQNE

SEQ ID NO: 144208 - protein, 17 aa, Mycobacterium avium
SLLQDWTQFAAPAVFGI

SEQ ID NO: 144209 - protein, 22 aa, Mycobacterium avium
SNGNPPLVHSVGLGTVNGVALG

SEQ ID NO: 144210 - protein, 25 aa, Mycobacterium avium
SPGSPVCSAGKYARKHVPWANFTNV

SEQ ID NO: 144211 - protein, 19 aa, Mycobacterium avium
SPSGWVYIVADSFTRRDPV

SEQ ID NO: 144212 - protein, 24 aa, Mycobacterium avium
SPVRTAGMAPYMVRVLGTTAPTQQ

SEQ ID NO: 144213 - protein, 18 aa, Mycobacterium avium
SQKLPAWQPTNASMADFG

SEQ ID NO: 144214 - protein, 24 aa, Mycobacterium avium
SRNPKWWGTRPRLDSITYLVLDDA

SEQ ID NO: 144215 - protein, 18 aa, Mycobacterium avium
SRRGETYYILLAGTAADF

SEQ ID NO: 144216 - protein, 24 aa, Mycobacterium avium
SRTVSGQLTLLVPFIDRIRARVDL

SEQ ID NO: 144217 - protein, 25 aa, Mycobacterium avium
SRVVARLRPRDVAVVEISRAQGVDV

SEQ ID NO: 144218 - protein, 20 aa, Mycobacterium avium
SRYALAVQHERGLAMQSPWT

SEQ ID NO: 144219 - protein, 18 aa, Mycobacterium avium
STLDELRIFVSQWDTRAR

SEQ ID NO: 144220 - protein, 21 aa, Mycobacterium avium
STSIWSRRRVLLLNSTYEPLT

SEQ ID NO: 144221 - protein, 23 aa, Mycobacterium avium
SVAPCDPPPGFGYTREGTYKGFP

SEQ ID NO: 144222 - protein, 18 aa, Mycobacterium avium
SVPAGFTRIAAFRGGVTG

SEQ ID NO: 144223 - protein, 24 aa, Mycobacterium avium
SVWGEYPAAVSWQATSEEVREDLG

SEQ ID NO: 144224 - protein, 17 aa, Mycobacterium avium
SYTFIAYLGDYYAFTTL

SEQ ID NO: 144225 - protein, 26 aa, Mycobacterium avium
TAADPAGWPRLDWSMDAALLLAALAS

SEQ ID NO: 144226 - protein, 23 aa, Mycobacterium avium
TAGAFSRPGLPVEYLQVPSAAMG

SEQ ID NO: 144227 - protein, 22 aa, Mycobacterium avium
TARQLLDALLLVSGNDAANTLA

SEQ ID NO: 144228 - protein, 18 aa, Mycobacterium avium
TAVRWARAHPQQWAQSYA

SEQ ID NO: 144229 - protein, 26 aa, Mycobacterium avium
TCRQLEWRRMIDIGADFSGAKVAVDE

SEQ ID NO: 144230 - protein, 18 aa, Mycobacterium avium
TDAFTRDELLAGNKTALM

SEQ ID NO: 144231 - protein, 25 aa, Mycobacterium avium
TDDPGGLCERLGWSATVTDVAEPGN

SEQ ID NO: 144232 - protein, 27 aa, Mycobacterium avium
TDVLTRLRGMFAFALWDTVTRELFCAR

SEQ ID NO: 144233 - protein, 34 aa, Mycobacterium avium
TDVVIARGLSQRGVPFSWAGGGINGPTRGTGTGA

SEQ ID NO: 144234 - protein, 23 aa, Mycobacterium avium
TDYTFPAECKYTTHAGLASEYAG

SEQ ID NO: 144235 - protein, 30 aa, Mycobacterium avium
TGHTWLPESIIRTGGTLAFSLAAYPDKHWG

SEQ ID NO: 144236 - protein, 26 aa, Mycobacterium avium
TGIPVAAAPKVIWGLAADARAKPPRC

SEQ ID NO: 144237 - protein, 22 aa, Mycobacterium avium
TGKKALLMHGALWQGTVVATMA

SEQ ID NO: 144238 - protein, 22 aa, Mycobacterium avium
TGLRIAHYAEIGFGGFAALVDA

SEQ ID NO: 144239 - protein, 29 aa, Mycobacterium avium
TGYLQRMSTILGRRVWENAGSPEVDSNRL

SEQ ID NO: 144240 - protein, 25 aa, Mycobacterium avium
THQPWVVSFQLNWPRDHGPTATGWM

SEQ ID NO: 144241 - protein, 23 aa, Mycobacterium avium
TITGWATSGGFCDKPNAYTVYFA

SEQ ID NO: 144242 - protein, 24 aa, Mycobacterium avium
TLARADIRGPYVINADGAPLDDRF

SEQ ID NO: 144243 - protein, 19 aa, Mycobacterium avium
TLDIMSLDVVWTAEFAEAG

SEQ ID NO: 144244 - protein, 20 aa, Mycobacterium avium
TLEVYPRYLKLIPSNVNADI

SEQ ID NO: 144245 - protein, 18 aa, Mycobacterium avium
TPDGRSVATATFDFTGGY

SEQ ID NO: 144246 - protein, 33 aa, Mycobacterium avium; identical to SEQ ID NO: 105316

SEQ ID NO: 144247 - protein, 28 aa, Mycobacterium avium
TQGRGAWPVCGGPLSGPTPRDVPAPAGL

SEQ ID NO: 144248 - protein, 25 aa, Mycobacterium avium
TRAVIKVMTILGSRYLELVPDGPGS

SEQ ID NO: 144249 - protein, 17 aa, Mycobacterium avium
TREYYPAGTTVNVQAKL

SEQ ID NO: 144250 - protein, 22 aa, Mycobacterium avium
TRGGGPVQRWHRGMAVDLHLMI

SEQ ID NO: 144251 - protein, 20 aa, Mycobacterium avium
TRRASFRRLAACCTALSACL

SEQ ID NO: 144252 - protein, 20 aa, Mycobacterium avium
TRYFVPRFAAVPITRDTEQA

SEQ ID NO: 144253 - protein, 18 aa, Mycobacterium avium
TSDLGWTAPLYMSDGQMW

SEQ ID NO: 144254 - protein, 20 aa, Mycobacterium avium
TSLGTSIGWAQNVGAAASDF

SEQ ID NO: 144255 - protein, 24 aa, Mycobacterium avium
TSTIYRPGTRFAVTIPSVDPHRGR

SEQ ID NO: 144256 - protein, 25 aa, Mycobacterium avium
TTASPRGAGNLGFAGTAPRETVAAA

SEQ ID NO: 144257 - protein, 24 aa, Mycobacterium avium
TTYYPPFHVARTFASLDHLSGGRA

SEQ ID NO: 144258 - protein, 17 aa, Mycobacterium avium
TVALVWLLIGVFAAWQR

SEQ ID NO: 144259 - protein, 17 aa, Mycobacterium avium
TVKRLEAAVQRSVVISA

SEQ ID NO: 144260 - protein, 31 aa, Mycobacterium avium; identical to SEQ ID NO: 105514

SEQ ID NO: 144261 - protein, 21 aa, Mycobacterium avium
TVVPDPRYVAVPDHDQLATEL

SEQ ID NO: 144262 - protein, 18 aa, Mycobacterium avium
TWFERLAAAGVRARAVLP

SEQ ID NO: 144263 - protein, 19 aa, Mycobacterium avium
VAAAALARTESRGCHHREE

SEQ ID NO: 144264 - protein, 27 aa, Mycobacterium avium
VAAMVLTSCGWKGISNVSIPGGPGSGP

SEQ ID NO: 144265 - protein, 23 aa, Mycobacterium avium
VAEHDLRPGAALTAADVRLEKRL

SEQ ID NO: 144266 - protein, 18 aa, Mycobacterium avium
VAGCSPAINLVPETGQNA

SEQ ID NO: 144267 - protein, 30 aa, Mycobacterium avium
VAMVLRRLLRLCARYASAPAVIFASATTDS

SEQ ID NO: 144268 - protein, 29 aa, Mycobacterium avium
VAPSELVGPVWRRDEVFEFNGSLIDSEEF

SEQ ID NO: 144269 - protein, 21 aa, Mycobacterium avium
VAQAVKARVPARVYTVQLGGF

SEQ ID NO: 144270 - protein, 22 aa, Mycobacterium avium
VAQMLERIVALMPLGAAVVDAH

SEQ ID NO: 144271 - protein, 24 aa, Mycobacterium avium
VARHELEGLLVLPPATRANIERAI

SEQ ID NO: 144272 - protein, 24 aa, Mycobacterium avium
VASPCAYFLVYESTAGNKAPEHHE

SEQ ID NO: 144273 - protein, 17 aa, Mycobacterium avium
VATATFDFTGGYVTVTV

SEQ ID NO: 144274 - protein, 17 aa, Mycobacterium avium
VAVGFGFANACGVAHAL

SEQ ID NO: 144275 - protein, 26 aa, Mycobacterium avium
VCGLLARGVSGLQLLNDLRDNNPALT

SEQ ID NO: 144276 - protein, 17 aa, Mycobacterium avium
VCGRAKELITLAGRNIF

SEQ ID NO: 144277 - protein, 17 aa, Mycobacterium avium
VCHHWYWVPVGGMGNVG

SEQ ID NO: 144278 - protein, 18 aa, Mycobacterium avium
VDAAREAARLAARGDERS

SEQ ID NO: 144279 - protein, 17 aa, Mycobacterium avium
VDFSGAIVRSLPATVNL

SEQ ID NO: 144280 - protein, 23 aa, Mycobacterium avium
VDGQLGAPFVWPLVANAGESPGG

SEQ ID NO: 144281 - protein, 17 aa, Mycobacterium avium
VDGYTAWLQNMAAHENI

SEQ ID NO: 144282 - protein, 24 aa, Mycobacterium avium
VDHYAEIGLLGFALITDALGGVDV

SEQ ID NO: 144283 - protein, 22 aa, Mycobacterium avium
VDTHFARLVHRWRWTAEKDPVK

SEQ ID NO: 144284 - protein, 21 aa, Mycobacterium avium
VEKTFPMSMGMTAGNHQTPNG

SEQ ID NO: 144285 - protein, 18 aa, Mycobacterium avium
VEPFGCLRSTPPPDGVGA

SEQ ID NO: 144286 - protein, 25 aa, Mycobacterium avium
VFFESPRRLPACLQDAVERLGGERR

SEQ ID NO: 144287 - protein, 18 aa, Mycobacterium avium
VGLLCMYKVHQFSEPEPV

SEQ ID NO: 144288 - protein, 19 aa, Mycobacterium avium
VGLLLTGCVSRTTTSGPTP

SEQ ID NO: 144289 - protein, 18 aa, Mycobacterium avium
VGLQQGVARTVEYFRNQH

SEQ ID NO: 144290 - protein, 18 aa, Mycobacterium avium
VGTAVKAFLQSTVGAGQN

SEQ ID NO: 144291 - protein, 17 aa, Mycobacterium avium
VIERAAAAFDRWTDLIA

SEQ ID NO: 144292 - protein, 18 aa, Mycobacterium avium
VILAAGAVLPGPRAAAGV

SEQ ID NO: 144293 - protein, 24 aa, Mycobacterium avium
VKLPAGALCGKLAVPVDYDHLDGD

SEQ ID NO: 144294 - protein, 25 aa, Mycobacterium avium
VLAVGCGGGHKGGPSTTSTTTPTTT

SEQ ID NO: 144295 - protein, 18 aa, Mycobacterium avium
VLDGAGWSDDGMQSVVRV

SEQ ID NO: 144296 - protein, 17 aa, Mycobacterium avium
VLGCHFESRNPPSTKTL

SEQ ID NO: 144297 - protein, 31 aa, Mycobacterium avium
VLHRPKLGFPVPIRHWLRAGELLEWAYSMVA

SEQ ID NO: 144298 - protein, 21 aa, Mycobacterium avium
VLVHLCGAKQWARARRRGRID

SEQ ID NO: 144299 - protein, 17 aa, Mycobacterium avium
VNEYGGYQLGSSTFAGK

SEQ ID NO: 144300 - protein, 21 aa, Mycobacterium avium
VPGRPRGCGLLHCEHDTWLLT

SEQ ID NO: 144301 - protein, 19 aa, Mycobacterium avium
VPIGRKLLYSAPVPALLEL

SEQ ID NO: 144302 - protein, 17 aa, Mycobacterium avium
VPNWERCEDGTAFTGQQ

SEQ ID NO: 144303 - protein, 24 aa, Mycobacterium avium
VPPTHKWARRSRVVTARELAQTPL

SEQ ID NO: 144304 - protein, 23 aa, Mycobacterium avium
VQAGLPVGCLPGPSAVMTALAVS

SEQ ID NO: 144305 - protein, 19 aa, Mycobacterium avium
VRGGVYWDAYRDPVSNVVL

SEQ ID NO: 144306 - protein, 20 aa, Mycobacterium avium
VRGRLRGIPNVTLRDEHCVT

SEQ ID NO: 144307 - protein, 17 aa, Mycobacterium avium
VRQVLAWMGSRQGNEYL

SEQ ID NO: 144308 - protein, 18 aa, Mycobacterium avium
VRSAIAAAAAGLAVVAIS

SEQ ID NO: 144309 - protein, 18 aa, Mycobacterium avium
VRTACAALVTTSKNAIDK

SEQ ID NO: 144310 - protein, 18 aa, Mycobacterium avium
VRTAISYVGIEGARANLA

SEQ ID NO: 144311 - protein, 17 aa, Mycobacterium avium
VSIALACDVVLASENAF

SEQ ID NO: 144312 - protein, 41 aa, Mycobacterium avium
VSSVPPVPGKFYWMTPTQLRWRPLSFWPAHTAVTVDAGGTV

SEQ ID NO: 144313 - protein, 20 aa, Mycobacterium avium
VTALLAALGRRYDGDERLSV

SEQ ID NO: 144314 - protein, 23 aa, Mycobacterium avium
VTDRGGTVIGRMAAFRDNTPSGT

SEQ ID NO: 144315 - protein, 28 aa, Mycobacterium avium
VVTFAKPYAEWRGMFAGNGMLLPKSMTA

SEQ ID NO: 144316 - protein, 19 aa, Mycobacterium avium
VWGIARFTDAAARERLEQA

SEQ ID NO: 144317 - protein, 19 aa, Mycobacterium avium
VWQAASLLLAYPDDGFGGR

SEQ ID NO: 144318 - protein, 23 aa, Mycobacterium avium
VWTAEFAEAGWALPLSDDPAARA

SEQ ID NO: 144319 - protein, 17 aa, Mycobacterium avium
VYLDARHIFDFADRFPT

SEQ ID NO: 144320 - protein, 25 aa, Mycobacterium avium
WAAREAAMRHCPLTIVHAVSTPTTM

SEQ ID NO: 144321 - protein, 18 aa, Mycobacterium avium
WAEPVERLLAAAEPAKVK

SEQ ID NO: 144322 - protein, 20 aa, Mycobacterium avium
WEVESAIYVYAPDLIPKIKA

SEQ ID NO: 144323 - protein, 20 aa, Mycobacterium avium
WFDVRDGLRAGSPEAPVVYT

SEQ ID NO: 144324 - protein, 24 aa, Mycobacterium avium
WGPIHGCHVFTPILRDAAPSAAPR

SEQ ID NO: 144325 - protein, 17 aa, Mycobacterium avium
WHDPYVHASLLAQNNTR

SEQ ID NO: 144326 - protein, 18 aa, Mycobacterium avium
WLPLLGAVVLLAAACSRV

SEQ ID NO: 144327 - protein, 20 aa, Mycobacterium avium
WQGWAAGPQGGWGKPPTPLW

SEQ ID NO: 144328 - protein, 25 aa, Mycobacterium avium
WRIDRLPNGVFLDWQQFQATYKRNT

SEQ ID NO: 144329 - protein, 18 aa, Mycobacterium avium
WSQYLSWVADHVGMTVVH

SEQ ID NO: 144330 - protein, 18 aa, Mycobacterium avium
WTAPLYMSDGQMWKVKHE

SEQ ID NO: 144331 - protein, 17 aa, Mycobacterium avium
WTLSWDQWRRGSALKPT

SEQ ID NO: 144332 - protein, 19 aa, Mycobacterium avium
WVAGYKLVDFSGAIVRSLP

SEQ ID NO: 144333 - protein, 17 aa, Mycobacterium avium
WVHDVVWAPRPVSGPVS

SEQ ID NO: 144334 - protein, 19 aa, Mycobacterium avium
WVMRSACADFSRWRANGVG

SEQ ID NO: 144335 - protein, 22 aa, Mycobacterium avium
YAAATAAGWPAAAVPADTTDTP

SEQ ID NO: 144336 - protein, 26 aa, Mycobacterium avium
YALTYPRRLGFGLGNSVVSLSWRTGD

SEQ ID NO: 144337 - protein, 24 aa, Mycobacterium avium
YATRTVEPWGVVTQKGRWYLVGHD

SEQ ID NO: 144338 - protein, 18 aa, Mycobacterium avium
YEGLPVDGYTAWLQNMAA

SEQ ID NO: 144339 - protein, 21 aa, Mycobacterium avium
YFAPGEMLPAFGGPVQAQVPR

SEQ ID NO: 144340 - protein, 23 aa, Mycobacterium avium
YGRTELPGLFAAGEVARTGLHGA

SEQ ID NO: 144341 - protein, 24 aa, Mycobacterium avium
YGSGLPSDIWKATMDGALKGTPNE

SEQ ID NO: 144342 - protein, 23 aa, Mycobacterium avium
YHAFAGSLLRDYGLLLPVEPDTR

SEQ ID NO: 144343 - protein, 18 aa, Mycobacterium avium
YITARFLPDKAIDLVDEA

SEQ ID NO: 144344 - protein, 17 aa, Mycobacterium avium
YLAANGFAADRDHAIYA

SEQ ID NO: 144345 - protein, 20 aa, Mycobacterium avium
YLAQLKKIGVAWQPGGDTTL

SEQ ID NO: 144346 - protein, 17 aa, Mycobacterium avium
YLSCATPAAADRAATVL

SEQ ID NO: 144347 - protein, 24 aa, Mycobacterium avium
YLSEARGPLHTDLQALQCPLKELG

SEQ ID NO: 144348 - protein, 17 aa, Mycobacterium avium
YNIFNGRGEAIRALLGK

SEQ ID NO: 144349 - protein, 21 aa, Mycobacterium avium
YPGDGRPALLQVRSGSSLAGN

SEQ ID NO: 144350 - protein, 21 aa, Mycobacterium avium
YRIAYQASQKVFGFAPYPGAA

SEQ ID NO: 144351 - protein, 17 aa, Mycobacterium avium
YRTSVFKRRADDGLEIP

SEQ ID NO: 144352 - protein, 17 aa, Mycobacterium avium
YTAEFLQAATLRPGNPI

SEQ ID NO: 144353 - protein, 19 aa, Mycobacterium avium
YTAVTTLRIMDGVRVPVGS

SEQ ID NO: 144354 - protein, 19 aa, Mycobacterium avium
YTLYAELPQSGGLYRTANV

SEQ ID NO: 144355 - protein, 17 aa, Mycobacterium avium
AAAALARTESRGCHHRE

SEQ ID NO: 144356 - protein, 23 aa, Mycobacterium avium
AAAARLAPAGARVDLRRDGDLLV

SEQ ID NO: 144357 - protein, 27 aa, Mycobacterium avium
AAAARPEYVHLWAGSGYRHATAEPAAD

SEQ ID NO: 144358 - protein, 19 aa, Mycobacterium avium
AAALGPLAVPASWTSVIPA

SEQ ID NO: 144359 - protein, 20 aa, Mycobacterium avium
AAALREWRGPVLDDLHNFAF

SEQ ID NO: 144360 - protein, 19 aa, Mycobacterium avium
AAAQKVWAQAGFRPVDPAV

SEQ ID NO: 144361 - protein, 18 aa, Mycobacterium avium
AAARAADPVAEFADPEDV

SEQ ID NO: 144362 - protein, 27 aa, Mycobacterium avium
AAARTWEVHGGTSLAGYVVPQRPIADE

SEQ ID NO: 144363 - protein, 19 aa, Mycobacterium avium
AAATEHWVPGYKLVDFSGA

SEQ ID NO: 144364 - protein, 23 aa, Mycobacterium avium
AAAVRLGPAGARVDLRRDGDLLV

SEQ ID NO: 144365 - protein, 19 aa, Mycobacterium avium
AACSAPRPAAGGGTPSTQT

SEQ ID NO: 144366 - protein, 23 aa, Mycobacterium avium
AADARAKPPRCAVLADPGNGRDQ

SEQ ID NO: 144367 - protein, 19 aa, Mycobacterium avium
AAEALAWGLVTAVYPADEF

SEQ ID NO: 144368 - protein, 19 aa, Mycobacterium avium
AAEALSWGLVTAVYPADEF

SEQ ID NO: 144369 - protein, 26 aa, Mycobacterium avium
AAELHTGKPWFAIGGIDAQRLPEVLD

SEQ ID NO: 144370 - protein, 17 aa, Mycobacterium avium
AAFPGRALAVFADDRSL

SEQ ID NO: 144371 - protein, 17 aa, Mycobacterium avium
AAFPLAWTTLYADIAAT

SEQ ID NO: 144372 - protein, 22 aa, Mycobacterium avium
AAGAGTCWPSTPGSLLCVDNPW

SEQ ID NO: 144373 - protein, 18 aa, Mycobacterium avium
AAGDGMRAAYQGVQTGTQ

SEQ ID NO: 144374 - protein, 32 aa, Mycobacterium avium; identical to SEQ ID NO: 86500

SEQ ID NO: 144375 - protein, 17 aa, Mycobacterium avium
AAGMLVAGCGAGNHGAA

SEQ ID NO: 144376 - protein, 21 aa, Mycobacterium avium
AAGVRRLVLASSMVVYGQGGY

SEQ ID NO: 144377 - protein, 23 aa, Mycobacterium avium
AAGVRRLVLASSMVVYGQGGYRC

SEQ ID NO: 144378 - protein, 17 aa, Mycobacterium avium
AAHYCPKYITGEDRGPK

SEQ ID NO: 144379 - protein, 25 aa, Mycobacterium avium
AAIESCPPGRVEVVANYTAFLALQR

SEQ ID NO: 144380 - protein, 26 aa, Mycobacterium avium
AAIPDAARYSVRFGKPVVLPATTGLY

SEQ ID NO: 144381 - protein, 17 aa, Mycobacterium avium
AAITFGVGALDPADEAL

SEQ ID NO: 144382 - protein, 24 aa, Mycobacterium avium
AAKNGDLPLSFDVTNIQPTAAGSA

SEQ ID NO: 144383 - protein, 23 aa, Mycobacterium avium
AAKNGDLPLSFDVTNIQPTASGA

SEQ ID NO: 144384 - protein, 23 aa, Mycobacterium avium
AALAGLSGWLGYRAYQQHDAQAR

SEQ ID NO: 144385 - protein, 17 aa, Mycobacterium avium
AALIGWAAAEGASRHTR

SEQ ID NO: 144386 - protein, 24 aa, Mycobacterium avium
AALLLALCWPIAPAAAPDPGAGTA

SEQ ID NO: 144387 - protein, 24 aa, Mycobacterium avium
AALQARLAALAFEGALVATVPLPA

SEQ ID NO: 144388 - protein, 18 aa, Mycobacterium avium
AALRRWMDRYASFVATKR

SEQ ID NO: 144389 - protein, 25 aa, Mycobacterium avium
AALTMPTRGWWFPANSRRPGDHVHS

SEQ ID NO: 144390 - protein, 18 aa, Mycobacterium avium
AALTRLGYEADMSDEPTQ

SEQ ID NO: 144391 - protein, 24 aa, Mycobacterium avium
AAPDVPGRFVAAAAMVRHLLTDPV

SEQ ID NO: 144392 - protein, 19 aa, Mycobacterium avium
AAPFIAWATTTAGRAEQVA

SEQ ID NO: 144393 - protein, 17 aa, Mycobacterium avium
AAPGLALVRAAAELHTG

SEQ ID NO: 144394 - protein, 17 aa, Mycobacterium avium
AAPGLALVRAAAELRTG

SEQ ID NO: 144395 - protein, 18 aa, Mycobacterium avium
AAPGLALVRAAAELRTGK

SEQ ID NO: 144396 - protein, 20 aa, Mycobacterium avium
AAPGLPGFAIGTVLRIIRAD

SEQ ID NO: 144397 - protein, 17 aa, Mycobacterium avium
AAPLVVMLHGGFGNGEQ

SEQ ID NO: 144398 - protein, 17 aa, Mycobacterium avium
AARAVGRDVRRPAGVGG

SEQ ID NO: 144399 - protein, 21 aa, Mycobacterium avium
AARAVLRAVVCQLAVLHAPDR

SEQ ID NO: 144400 - protein, 18 aa, Mycobacterium avium
AARPLRLANVVPDTVSSV

SEQ ID NO: 144401 - protein, 22 aa, Mycobacterium avium
AARYLCSGGLNLRDQSQVLTAI

SEQ ID NO: 144402 - protein, 23 aa, Mycobacterium avium
AARYLCSGGLNLRDQSQVLTAIL

SEQ ID NO: 144403 - protein, 18 aa, Mycobacterium avium
AASARPAVQGAIIRTFKN

SEQ ID NO: 144404 - protein, 19 aa, Mycobacterium avium
AASLAGRALAGAGVRTVGN

SEQ ID NO: 144405 - protein, 25 aa, Mycobacterium avium
AASPKETWLRLLLIDAGIPVPATQI

SEQ ID NO: 144406 - protein, 18 aa, Mycobacterium avium
AATLPGYMMPSSLTVLDA

SEQ ID NO: 144407 - protein, 23 aa, Mycobacterium avium
AATTCPACSPSSPPSSNSSRSPL

SEQ ID NO: 144408 - protein, 19 aa, Mycobacterium avium
AATVPPALVAANRAQLRVL

SEQ ID NO: 144409 - protein, 17 aa, Mycobacterium avium
AAVALLARRADRLAELQ

SEQ ID NO: 144410 - protein, 35 aa, Mycobacterium avium
AAVVVLGWYYLRIPSLAGIGRYTLYVELPQSGGLY

SEQ ID NO: 144411 - protein, 17 aa, Mycobacterium avium
ACGVCLLAKDCPSFGLG

SEQ ID NO: 144412 - protein, 21 aa, Mycobacterium avium
ADADCDLGRFRGHKTAGVQAA

SEQ ID NO: 144413 - protein, 18 aa, Mycobacterium avium
ADAKAIIVAQNLVSARYV

SEQ ID NO: 144414 - protein, 17 aa, Mycobacterium avium
ADARAKPPRCAVLADPG

SEQ ID NO: 144415 - protein, 17 aa, Mycobacterium avium
ADASGLPPEVVYLYNGP

SEQ ID NO: 144416 - protein, 25 aa, Mycobacterium avium
ADAWLNRQLSGYANWALANNSLLIV

SEQ ID NO: 144417 - protein, 17 aa, Mycobacterium avium
ADFVKRQNIGSFTLGPI

SEQ ID NO: 144418 - protein, 17 aa, Mycobacterium avium
ADGALIDLVRPGDVVDV

SEQ ID NO: 144419 - protein, 24 aa, Mycobacterium avium
ADGKCPPPAGFFGTVASVDGNTIA

SEQ ID NO: 144420 - protein, 22 aa, Mycobacterium avium
ADGKCPPPTGFFGTVASVDGNT

SEQ ID NO: 144421 - protein, 27 aa, Mycobacterium avium
ADIFLREVQDVWTWVRPYFDDRATGAA

SEQ ID NO: 144422 - protein, 28 aa, Mycobacterium avium
ADLGGTWDLFKYPGIRSDSDMFTLGFRF

SEQ ID NO: 144423 - protein, 17 aa, Mycobacterium avium
ADLLRRAAPNAALVAIV

SEQ ID NO: 144424 - protein, 18 aa, Mycobacterium avium
ADLPPCPAAGTGPGPAAL

SEQ ID NO: 144425 - protein, 25 aa, Mycobacterium avium
ADPPGDLGPRFTFVPADVTDESAVA

SEQ ID NO: 144426 - protein, 20 aa, Mycobacterium avium
ADPRRIVVLAGDQLDALCAL

SEQ ID NO: 144427 - protein, 17 aa, Mycobacterium avium
ADRSCDPLALPRLAVGG

SEQ ID NO: 144428 - protein, 18 aa, Mycobacterium avium
ADRSCDPLALPRLAVGGD

SEQ ID NO: 144429 - protein, 20 aa, Mycobacterium avium
ADSSRRLWDTIVIAADAPAA

SEQ ID NO: 144430 - protein, 21 aa, Mycobacterium avium
ADTTLTRFAGIGVRTVLSHGS

SEQ ID NO: 144431 - protein, 21 aa, Mycobacterium avium
ADTTLTRFAGIGVRTVLSHRS

SEQ ID NO: 144432 - protein, 18 aa, Mycobacterium avium
ADVKPSFGPDYKVSDTGE

SEQ ID NO: 144433 - protein, 17 aa, Mycobacterium avium
AEADAGHFLVAYPDGLG

SEQ ID NO: 144434 - protein, 21 aa, Mycobacterium avium
AEAEIACGRADGVIGELEALV

SEQ ID NO: 144435 - protein, 29 aa, Mycobacterium avium
AEFLQAATLRPGNPITVAGIEVGHVTSMK

SEQ ID NO: 144436 - protein, 26 aa, Mycobacterium avium
AELDRAWRHLPFAAQWHSDNELARHR

SEQ ID NO: 144437 - protein, 19 aa, Mycobacterium avium
AELEARGWTIVRVSADMLR

SEQ ID NO: 144438 - protein, 20 aa, Mycobacterium avium
AEMPGIFAYVVAQGDGPFIG

SEQ ID NO: 144439 - protein, 17 aa, Mycobacterium avium
AEMWAQDAAAMYAYAAA

SEQ ID NO: 144440 - protein, 26 aa, Mycobacterium avium
AEPGTCWSATTAAPCTRCRRSDARGP

SEQ ID NO: 144441 - protein, 18 aa, Mycobacterium avium
AEPPKFPDLDAFQPVDPA

SEQ ID NO: 144442 - protein, 26 aa, Mycobacterium avium
AEPYAIRTVEPWGVVTQKGRWYLVGH

SEQ ID NO: 144443 - protein, 25 aa, Mycobacterium avium
AERVRLLAETAPVLWGDLPTLPLYR

SEQ ID NO: 144444 - protein, 24 aa, Mycobacterium avium
AESAGYWWPNRDFVMVCDTPAVLH

SEQ ID NO: 144445 - protein, 26 aa, Mycobacterium avium
AESGVGWNYLAAINFIETRFGSIVGA

SEQ ID NO: 144446 - protein, 20 aa, Mycobacterium avium
AESIQAWTPPPAPPAAPGGP

SEQ ID NO: 144447 - protein, 25 aa, Mycobacterium avium
AETREMIKTGGFDAVCFTSSSTVRN

SEQ ID NO: 144448 - protein, 20 aa, Mycobacterium avium
AEYAEMWAQDAAAMYEYAAG

SEQ ID NO: 144449 - protein, 17 aa, Mycobacterium avium
AFSKPGLPVEYLEVPSP

SEQ ID NO: 144450 - protein, 19 aa, Mycobacterium avium
AGAGKWVCTTLQGGKQMSD

SEQ ID NO: 144451 - protein, 20 aa, Mycobacterium avium
AGAGTCWPSTSGSLLCVDNP

SEQ ID NO: 144452 - protein, 21 aa, Mycobacterium avium
AGAPLGYPAIHHLTSPLRKAA

SEQ ID NO: 144453 - protein, 18 aa, Mycobacterium avium
AGDTIGLPATRAAATVES

SEQ ID NO: 144454 - protein, 18 aa, Mycobacterium avium
AGGRITAGALRWRDGSWL

SEQ ID NO: 144455 - protein, 29 aa, Mycobacterium avium
AGLDARSWRLPWPAGTTVYELDQPRVLEF

SEQ ID NO: 144456 - protein, 29 aa, Mycobacterium avium
AGLGTARFVGAMAVPPTWQGSMPAYIATP

SEQ ID NO: 144457 - protein, 17 aa, Mycobacterium avium
AGLLGVITTPAYATSAD

SEQ ID NO: 144458 - protein, 17 aa, Mycobacterium avium
AGLPFWPQGKIYDAYFT

SEQ ID NO: 144459 - protein, 19 aa, Mycobacterium avium
AGLRDLGCMSLTMSEAAPF

SEQ ID NO: 144460 - protein, 24 aa, Mycobacterium avium
AGNDLPLAAGMAFSIEPGIYFPGR

SEQ ID NO: 144461 - protein, 17 aa, Mycobacterium avium
AGPAKIPAPGPGPGQTA

SEQ ID NO: 144462 - protein, 19 aa, Mycobacterium avium
AGPQGGWGKPPTPLWPDAV

SEQ ID NO: 144463 - protein, 18 aa, Mycobacterium avium
AGPRRGRRSLPALSAGRP

SEQ ID NO: 144464 - protein, 21 aa, Mycobacterium avium
AGRALAGAGVRTVGNGTTGAA

SEQ ID NO: 144465 - protein, 19 aa, Mycobacterium avium
AGRGMSPTMARMFTTIAIQ

SEQ ID NO: 144466 - protein, 24 aa, Mycobacterium avium
AGRRRFGHPATRAADRAFAAVPAA

SEQ ID NO: 144467 - protein, 20 aa, Mycobacterium avium
AGSADVFFLLGVGDDEALRW

SEQ ID NO: 144468 - protein, 25 aa, Mycobacterium avium
AGSMGRSTLVGSLSVPPGWTTAAPV

SEQ ID NO: 144469 - protein, 24 aa, Mycobacterium avium
AGTYRGMMNTVVWNNPENMRLFGK

SEQ ID NO: 144470 - protein, 19 aa, Mycobacterium avium
AHPPPPKPSAAPAQSPPSN

SEQ ID NO: 144471 - protein, 18 aa, Mycobacterium avium
AHVLCGRGNRGHRGLDLA

SEQ ID NO: 144472 - protein, 23 aa, Mycobacterium avium
AIDSWMCAISGRAKEFNMIQYFK

SEQ ID NO: 144473 - protein, 26 aa, Mycobacterium avium
AIFTAVCLLFTFTLIAVFGQLRFEDR

SEQ ID NO: 144474 - protein, 20 aa, Mycobacterium avium
AIILNCGFNAGGFATARDGN

SEQ ID NO: 144475 - protein, 18 aa, Mycobacterium avium
AIVEGLRRAYPIGEAVTY

SEQ ID NO: 144476 - protein, 26 aa, Mycobacterium avium
AKAGGLPGDLTFSWYAVDKTHQPWVV

SEQ ID NO: 144477 - protein, 20 aa, Mycobacterium avium
AKELITLAGRNIFPTEIETV

SEQ ID NO: 144478 - protein, 25 aa, Mycobacterium avium
AKGPSRWGAHMQLHVSAGMGTSPYA

SEQ ID NO: 144479 - protein, 23 aa, Mycobacterium avium
ALAAGASARWASRVTGRGAGAMI

SEQ ID NO: 144480 - protein, 24 aa, Mycobacterium avium
ALALSPYPLWCGFATVLSTHIWRL

SEQ ID NO: 144481 - protein, 20 aa, Mycobacterium avium
ALARLREWEAAGGPVIEESV

SEQ ID NO: 144482 - protein, 21 aa, Mycobacterium avium
ALCDARGGAVAPVVTGQYRSG

SEQ ID NO: 144483 - protein, 21 aa, Mycobacterium avium
ALCRLAFAARAGWQRWEAEFG

SEQ ID NO: 144484 - protein, 27 aa, Mycobacterium avium
ALERARPVLEPMAGKIIHCGAAGAGQA

SEQ ID NO: 144485 - protein, 25 aa, Mycobacterium avium
ALEVGRCRVAGFLPDFEAQAVTWEA

SEQ ID NO: 144486 - protein, 20 aa, Mycobacterium avium
ALGAGLPGCSGKDGHPAATP

SEQ ID NO: 144487 - protein, 20 aa, Mycobacterium avium
ALGAGLPGCSGKEGHPAATP

SEQ ID NO: 144488 - protein, 19 aa, Mycobacterium avium
ALGAGLPGCSGKNGHPAAT

SEQ ID NO: 144489 - protein, 30 aa, Mycobacterium avium
ALGEAYIGLIPRTDHGPMLKDGQRIATEAV

SEQ ID NO: 144490 - protein, 18 aa, Mycobacterium avium
ALGGHWRYQTYIRAEGLD

SEQ ID NO: 144491 - protein, 19 aa, Mycobacterium avium
ALGLGRLEKELVRDPAAVA

SEQ ID NO: 144492 - protein, 19 aa, Mycobacterium avium
ALIRGIHRGVADWPVSAPH

SEQ ID NO: 144493 - protein, 17 aa, Mycobacterium avium
ALPAEPIHVVFRNDESG

SEQ ID NO: 144494 - protein, 23 aa, Mycobacterium avium
ALPVAGVAHAECNQDVGQSIDSY

SEQ ID NO: 144495 - protein, 21 aa, Mycobacterium avium
ALQAIPRDNLRTVIDETDRAV

SEQ ID NO: 144496 - protein, 20 aa, Mycobacterium avium
ALQAIPRDNLRTVIDETNRA

SEQ ID NO: 144497 - protein, 21 aa, Mycobacterium avium
ALQAIPRDNLRTVIDETNRAV

SEQ ID NO: 144498 - protein, 21 aa, Mycobacterium avium
ALTRWQHPTLGLLMPDSFIQV

SEQ ID NO: 144499 - protein, 21 aa, Mycobacterium avium
AMAAGAAPYVGWLHTTAERAQ

SEQ ID NO: 144500 - protein, 28 aa, Mycobacterium avium
AMGPMQFIPETWRLYAVDAHNDGRVSPD

SEQ ID NO: 144501 - protein, 22 aa, Mycobacterium avium
AMKRAGAAFSRLDRDGIAERIP

SEQ ID NO: 144502 - protein, 23 aa, Mycobacterium avium
AMKRAGAAFSRLDRDGIAERIPF

SEQ ID NO: 144503 - protein, 23 aa, Mycobacterium avium
ANAFSRPGLPVEYLQVPSAGMGR

SEQ ID NO: 144504 - protein, 21 aa, Mycobacterium avium
ANARLAAALVRASLDDDVRRR

SEQ ID NO: 144505 - protein, 25 aa, Mycobacterium avium
ANASFEFANGYATVTVEAGPNQVLS

SEQ ID NO: 144506 - protein, 18 aa, Mycobacterium avium
APATEWFGNRGWTAVGTP

SEQ ID NO: 144507 - protein, 17 aa, Mycobacterium avium
APATLALDYQRQAKVEN

SEQ ID NO: 144508 - protein, 25 aa, Mycobacterium avium
APGVWALCHSLAFDVSVWEIFGALV

SEQ ID NO: 144509 - protein, 21 aa, Mycobacterium avium
APHIAMTVAMLRQAGVDVDDS

SEQ ID NO: 144510 - protein, 20 aa, Mycobacterium avium
APLLGVLGTISWQPRVPAVA

SEQ ID NO: 144511 - protein, 22 aa, Mycobacterium avium
APPGARCGWPARPRCSSPGSPR

SEQ ID NO: 144512 - protein, 23 aa, Mycobacterium avium
APREFPDAATMFAAVRAGQLTAG

SEQ ID NO: 144513 - protein, 23 aa, Mycobacterium avium
APWCGPCDRVRRVVDQVCADLGG

SEQ ID NO: 144514 - protein, 23 aa, Mycobacterium avium
APYGLAGSRALAWVSQTVSNIVI

SEQ ID NO: 144515 - protein, 25 aa, Mycobacterium avium
AQAEWEVESAIYVYAPDLIPKIKDQ

SEQ ID NO: 144516 - protein, 27 aa, Mycobacterium avium
AQALMPRLAGSAVIPVMTAEASAKELP

SEQ ID NO: 144517 - protein, 18 aa, Mycobacterium avium
AQARRAALLNALFAAATE

SEQ ID NO: 144518 - protein, 21 aa, Mycobacterium avium
AQGRAAGVGRPVPDGQRHLSR

SEQ ID NO: 144519 - protein, 19 aa, Mycobacterium avium
AQLPLSLTDITGILKTFNS

SEQ ID NO: 144520 - protein, 17 aa, Mycobacterium avium
AQPSGCAASDYPGAPPK

SEQ ID NO: 144521 - protein, 32 aa, Mycobacterium avium
AQPVYFGYWAARGVDVTPFFAVLNGPRIAAPG

SEQ ID NO: 144522 - protein, 25 aa, Mycobacterium avium
AQSPKESWLRVLLIDAGFPRPQTQI

SEQ ID NO: 144523 - protein, 23 aa, Mycobacterium avium
AQTLERFTALVLPASGEPTVVVP

SEQ ID NO: 144524 - protein, 19 aa, Mycobacterium avium
AQTPAGCSLMEWENNDNGR

SEQ ID NO: 144525 - protein, 20 aa, Mycobacterium avium
AQVVRILPTDAAFMTRSCGI

SEQ ID NO: 144526 - protein, 19 aa, Mycobacterium avium
ARAFSGVKIACVGESTADR

SEQ ID NO: 144527 - protein, 20 aa, Mycobacterium avium
ARAGVAFTPINYRLSAEGIR

SEQ ID NO: 144528 - protein, 24 aa, Mycobacterium avium
ARAREVDILVADWVAGKTLSEAMA

SEQ ID NO: 144529 - protein, 28 aa, Mycobacterium avium
ARFRVDRPIRVTGWPPKGTDRGKGDAVA

SEQ ID NO: 144530 - protein, 18 aa, Mycobacterium avium
ARGLRNAFIDAHEAGAPL

SEQ ID NO: 144531 - protein, 17 aa, Mycobacterium avium
ARGMKGVSPLAVSKYMP

SEQ ID NO: 144532 - protein, 20 aa, Mycobacterium avium
ARGPLHTDLQALQCPLKELG

SEQ ID NO: 144533 - protein, 26 aa, Mycobacterium avium
ARGYWKRPGLTAARFVANPFGAEPGS

SEQ ID NO: 144534 - protein, 23 aa, Mycobacterium avium
ARIGPMSVPAGWTAATGNPVAAA

SEQ ID NO: 144535 - protein, 23 aa, Mycobacterium avium
ARLQELKGLVHADDWTRDRPGLG

SEQ ID NO: 144536 - protein, 24 aa, Mycobacterium avium
ARLVKAGKVAKDWNTDATKGIPFG

SEQ ID NO: 144537 - protein, 20 aa, Mycobacterium avium
ARPAVQGAIIRTFKNAERNP

SEQ ID NO: 144538 - protein, 21 aa, Mycobacterium avium
ARQLLDALLLVSGNDAANTLA

SEQ ID NO: 144539 - protein, 19 aa, Mycobacterium avium
ARRGDLIFYGPGGSQHVTM

SEQ ID NO: 144540 - protein, 19 aa, Mycobacterium avium
ARTGYRLAKQFGVRLPPRR

SEQ ID NO: 144541 - protein, 17 aa, Mycobacterium avium
ARVAAPYRVIQFAVNPF

SEQ ID NO: 144542 - protein, 18 aa, Mycobacterium avium
ARVAAPYRVIQFAVNPFK

SEQ ID NO: 144543 - protein, 17 aa, Mycobacterium avium
ASAWTHVFEQLFTDVDG

SEQ ID NO: 144544 - protein, 17 aa, Mycobacterium avium
ASFAEWIDRGRPAPPHR

SEQ ID NO: 144545 - protein, 17 aa, Mycobacterium avium
ASGFLVRQTFFRPLTIT

SEQ ID NO: 144546 - protein, 17 aa, Mycobacterium avium
ASGPGSIVVEGRDIGTV

SEQ ID NO: 144547 - protein, 23 aa, Mycobacterium avium
ASIAGPVLAYWLTRYGFEVTVVE

SEQ ID NO: 144548 - protein, 19 aa, Mycobacterium avium
ASLSKGYGLNNCTAGNIDR

SEQ ID NO: 144549 - protein, 19 aa, Mycobacterium avium
ASRARCWTGPAVSCRSRPR

SEQ ID NO: 144550 - protein, 20 aa, Mycobacterium avium
ASVPPPLIAANRMQVSQLQA

SEQ ID NO: 144551 - protein, 20 aa, Mycobacterium avium
ASVTCVRTGGKIDIGSGSTG

SEQ ID NO: 144552 - protein, 21 aa, Mycobacterium avium
ATALIYHAAFAPRVAEILPEL

SEQ ID NO: 144553 - protein, 17 aa, Mycobacterium avium
ATLRLDLDPGVRLPANA

SEQ ID NO: 144554 - protein, 20 aa, Mycobacterium avium
ATNGLASLPLPAPGLGSGGY

SEQ ID NO: 144555 - protein, 17 aa, Mycobacterium avium
ATTRLSAPLAAGRNLQI

SEQ ID NO: 144556 - protein, 18 aa, Mycobacterium avium
AVAALLCGAAIVTNTPTA

SEQ ID NO: 144557 - protein, 18 aa, Mycobacterium avium
AVAQRADGVLVLGSADGA

SEQ ID NO: 144558 - protein, 17 aa, Mycobacterium avium
AVFASLTLATALIAGCS

SEQ ID NO: 144559 - protein, 18 aa, Mycobacterium avium
AVGGLGPELSRIVDGSTA

SEQ ID NO: 144560 - protein, 19 aa, Mycobacterium avium
AVGGLGPELSRIVDGSTAL

SEQ ID NO: 144561 - protein, 20 aa, Mycobacterium avium
AVGRDVRRPAGVGGEDVDVL

SEQ ID NO: 144562 - protein, 17 aa, Mycobacterium avium
AVNEADYARMWVQAAGT

SEQ ID NO: 144563 - protein, 18 aa, Mycobacterium avium
AVNEADYARMWVQAAGTM

SEQ ID NO: 144564 - protein, 22 aa, Mycobacterium avium
AVPAALLRWGVDQFDADQRPYQ

SEQ ID NO: 144565 - protein, 18 aa, Mycobacterium avium
AVQACAKPGAGHGRSGAP

SEQ ID NO: 144566 - protein, 25 aa, Mycobacterium avium
AVRPEPFGALLYHFGTRKLSFLKNR

SEQ ID NO: 144567 - protein, 18 aa, Mycobacterium avium
AVTGLRPGGPTNVTVADS

SEQ ID NO: 144568 - protein, 33 aa, Mycobacterium avium
AVVTFSEPYPAWKELFNNILPAHIVKDVPGGFA

SEQ ID NO: 144569 - protein, 20 aa, Mycobacterium avium
AWRRHRWPEVHGLAEGIAAW

SEQ ID NO: 144570 - protein, 17 aa, Mycobacterium avium
CAIVAGEAPAIRIYEDD

SEQ ID NO: 144571 - protein, 17 aa, Mycobacterium avium
CDGHGTLLAGLVAGQPS

SEQ ID NO: 144572 - protein, 25 aa, Mycobacterium avium
CDGPIRPDGSWKRCMFAHGQYGGGV

SEQ ID NO: 144573 - protein, 17 aa, Mycobacterium avium
CELDFELPLAGGDRRSA

SEQ ID NO: 144574 - protein, 21 aa, Mycobacterium avium
CEVKAMYPLGPIFHGSGLNIT

SEQ ID NO: 144575 - protein, 17 aa, Mycobacterium avium
CGQNQWLDIAMPLRLDK

SEQ ID NO: 144576 - protein, 23 aa, Mycobacterium avium
CLAGGLLALRFPVFIDAYDQFGL

SEQ ID NO: 144577 - protein, 20 aa, Mycobacterium avium
CLLAKDCPSFGLGPTEPPLA

SEQ ID NO: 144578 - protein, 20 aa, Mycobacterium avium
CLTAGAWPAYWLGNDDQGEI

SEQ ID NO: 144579 - protein, 20 aa, Mycobacterium avium
CNCVGIKPGRSYTARQLLDA

SEQ ID NO: 144580 - protein, 22 aa, Mycobacterium avium
CNLTELELQWGRTIGQLPSPCT

SEQ ID NO: 144581 - protein, 19 aa, Mycobacterium avium
CQDFARLAIACLRAHGLAA

SEQ ID NO: 144582 - protein, 21 aa, Mycobacterium avium
CRAACPGERVTGVAGRAAHRR

SEQ ID NO: 144583 - protein, 19 aa, Mycobacterium avium
CRDGFTAVNVCSGQPISIL

SEQ ID NO: 144584 - protein, 18 aa, Mycobacterium avium
CSAARPASVLQIHGTADD

SEQ ID NO: 144585 - protein, 18 aa, Mycobacterium avium
CSPSAAGAGTCWPSTPGS

SEQ ID NO: 144586 - protein, 18 aa, Mycobacterium avium
CSPSAAGAGTCWPSTSGS

SEQ ID NO: 144587 - protein, 24 aa, Mycobacterium avium
CWQVTRKGIPMTIDDRALHVGREQ

SEQ ID NO: 144588 - protein, 19 aa, Mycobacterium avium
CYFPHPQRVVCGGISIAGR

SEQ ID NO: 144589 - protein, 22 aa, Mycobacterium avium
DAAHCPAYFQLLVKSLLQPGLL

SEQ ID NO: 144590 - protein, 22 aa, Mycobacterium avium
DAANAMRPDAIVSIHADGGPAS

SEQ ID NO: 144591 - protein, 23 aa, Mycobacterium avium
DAANAMRPDAIVSIHADGGPASG

SEQ ID NO: 144592 - protein, 22 aa, Mycobacterium avium
DAANAMRPDAIVSIHADGGPGS

SEQ ID NO: 144593 - protein, 18 aa, Mycobacterium avium
DADTTWKLLLDSQSGIRK

SEQ ID NO: 144594 - protein, 17 aa, Mycobacterium avium
DAGGYKADAMWGPSSDP

SEQ ID NO: 144595 - protein, 18 aa, Mycobacterium avium
DAGRSTWYTVDRTVYVAL

SEQ ID NO: 144596 - protein, 25 aa, Mycobacterium avium
DALAKLGARNMRLTLGVYTYRSCCN

SEQ ID NO: 144597 - protein, 25 aa, Mycobacterium avium
DALVRRIRAVPPFREKLADSPLNLD

SEQ ID NO: 144598 - protein, 25 aa, Mycobacterium avium
DAQSGSIGLGFAIPVDQAKRIADEL

SEQ ID NO: 144599 - protein, 18 aa, Mycobacterium avium
DAREWVRLVAAERVTTAT

SEQ ID NO: 144600 - protein, 24 aa, Mycobacterium avium
DAVAARAATLWRFTAGAVDQPDPV

SEQ ID NO: 144601 - protein, 27 aa, Mycobacterium avium
DAVARQEPRLSWAAGLRDDGTTTLVTD

SEQ ID NO: 144602 - protein, 24 aa, Mycobacterium avium
DAVRPGVVVLLNLSRDQLDRVGEI

SEQ ID NO: 144603 - protein, 20 aa, Mycobacterium avium
DAWPPSARARPRLHRVDIPA

SEQ ID NO: 144604 - protein, 24 aa, Mycobacterium avium
DDEGHAMFPWLTLALVGSATSHVS

SEQ ID NO: 144605 - protein, 21 aa, Mycobacterium avium
DDFQKRSGPFIEVVKKAQSKS

SEQ ID NO: 144606 - protein, 24 aa, Mycobacterium avium
DDGYPEHAFTWAVVGLINASLNQM

SEQ ID NO: 144607 - protein, 25 aa, Mycobacterium avium
DDGYPEHAFTWAVVGLINASLNQMG

SEQ ID NO: 144608 - protein, 18 aa, Mycobacterium avium
DDLKPSVPDRSWSQVSVS

SEQ ID NO: 144609 - protein, 34 aa, Mycobacterium avium
DDYAELPGCPGSVCAGKIKQAYGLAYQQSLNAQA

SEQ ID NO: 144610 - protein, 20 aa, Mycobacterium avium
DDYLAILDIRPFTRGHTLVL

SEQ ID NO: 144611 - protein, 17 aa, Mycobacterium avium
DEMRAIVQIAARRPATG

SEQ ID NO: 144612 - protein, 20 aa, Mycobacterium avium
DEVESLWAVLARTLPEPWRV

SEQ ID NO: 144613 - protein, 21 aa, Mycobacterium avium
DFFSDHDRLFLGMQPGATTGG

SEQ ID NO: 144614 - protein, 18 aa, Mycobacterium avium
DFGPFSYNTFTVIPVFNW

SEQ ID NO: 144615 - protein, 19 aa, Mycobacterium avium
DFVVIAGLQDGLWPNTVPR

SEQ ID NO: 144616 - protein, 24 aa, Mycobacterium avium
DGDHIMVVLALAMREAGELASDTL

SEQ ID NO: 144617 - protein, 26 aa, Mycobacterium avium
DGDLSRFYVRFGRYEMKNSGAFADPD

SEQ ID NO: 144618 - protein, 19 aa, Mycobacterium avium
DGGDFARGYDHSVHGDSSY

SEQ ID NO: 144619 - protein, 17 aa, Mycobacterium avium
DGGRFSITYLIDSNQDR

SEQ ID NO: 144620 - protein, 33 aa, Mycobacterium avium
DGGVEAVVLLSGYRVMPQWVKIRNVDGFTGSYW

SEQ ID NO: 144621 - protein, 34 aa, Mycobacterium avium
DGGVEAVVLLSGYRVMPQWVKIRNVDGFTGSYWQ

SEQ ID NO: 144622 - protein, 21 aa, Mycobacterium avium
DGIGLALICHRIGDVYNALAS

SEQ ID NO: 144623 - protein, 17 aa, Mycobacterium avium
DGLGRAWNAGTCCGEPA

SEQ ID NO: 144624 - protein, 18 aa, Mycobacterium avium
DGLGRAWNAGTCCGEPAH

SEQ ID NO: 144625 - protein, 17 aa, Mycobacterium avium
DGLPRIAQAVAAPAVRK

SEQ ID NO: 144626 - protein, 21 aa, Mycobacterium avium
DGRAAYAAAVTAGIVAFLNAK

SEQ ID NO: 144627 - protein, 17 aa, Mycobacterium avium
DGSEIAKLIPPEGNRVD

SEQ ID NO: 144628 - protein, 21 aa, Mycobacterium avium
DGSGADSLWFAPLFSQDALDL

SEQ ID NO: 144629 - protein, 21 aa, Mycobacterium avium
DGSGADSLWFAPLFSQEALDL

SEQ ID NO: 144630 - protein, 22 aa, Mycobacterium avium
DGSGADSLWFAPLFSQEALDLL

SEQ ID NO: 144631 - protein, 22 aa, Mycobacterium avium
DGVRIPPRIIKATIAPDGTRTE

SEQ ID NO: 144632 - protein, 20 aa, Mycobacterium avium
DHPTSVHWHGISLRNDMDGA

SEQ ID NO: 144633 - protein, 27 aa, Mycobacterium avium
DIAVDMLEMLPTPWGLVRSGVAPDHPK

SEQ ID NO: 144634 - protein, 17 aa, Mycobacterium avium
DIYQVLARQGLNGDYFG

SEQ ID NO: 144635 - protein, 17 aa, Mycobacterium avium
DKAAGAGKWVCTTLQGG

SEQ ID NO: 144636 - protein, 18 aa, Mycobacterium avium
DKGGHTWPGGKQYLPAAV

SEQ ID NO: 144637 - protein, 18 aa, Mycobacterium avium
DKVVTALASEEWLGSASA

SEQ ID NO: 144638 - protein, 17 aa, Mycobacterium avium
DKYKVPADVKAAILSPS

SEQ ID NO: 144639 - protein, 25 aa, Mycobacterium avium
DLAGRLWDLLGWARAGHRLLDEMAA

SEQ ID NO: 144640 - protein, 19 aa, Mycobacterium avium
DLIETGWDVERIMAERNAE

SEQ ID NO: 144641 - protein, 23 aa, Mycobacterium avium
DLRLMPRYVRTITGWQLSRVEEA

SEQ ID NO: 144642 - protein, 18 aa, Mycobacterium avium
DMAERVAALAAHAPPERL

SEQ ID NO: 144643 - protein, 18 aa, Mycobacterium avium
DMASGRRVQLADLTTSNP

SEQ ID NO: 144644 - protein, 22 aa, Mycobacterium avium
DMTRRASLDSAPPVFVAPVYGY

SEQ ID NO: 144645 - protein, 24 aa, Mycobacterium avium
DMTRRASLDSAPPVFVAPVYGYLV

SEQ ID NO: 144646 - protein, 25 aa, Mycobacterium avium
DNEGHSMFPWLTLALVGSSTSHVSF

SEQ ID NO: 144647 - protein, 22 aa, Mycobacterium avium
DNGIKIFGPGGHKLDDGTEDRI

SEQ ID NO: 144648 - protein, 22 aa, Mycobacterium avium
DNGRQRWCVRLVQGGGFAGPLL

SEQ ID NO: 144649 - protein, 27 aa, Mycobacterium avium
DNPQRVWGWYLWRHYLVADVAPNAGHR

SEQ ID NO: 144650 - protein, 17 aa, Mycobacterium avium
DPDFPILDKKVEIKPAE

SEQ ID NO: 144651 - protein, 29 aa, Mycobacterium avium
DPENFWRSAGLPAFRWPDPNGTRLPNGAP

SEQ ID NO: 144652 - protein, 18 aa, Mycobacterium avium
DPGPAKRQVHNAAGGDPA

SEQ ID NO: 144653 - protein, 19 aa, Mycobacterium avium
DPIYGLGPRLAQLAAGAFF

SEQ ID NO: 144654 - protein, 22 aa, Mycobacterium avium
DPLAAAAPDWYARLIEHQNVLT

SEQ ID NO: 144655 - protein, 24 aa, Mycobacterium avium
DPNVPDAFAVIADRHGSSIYSSNA

SEQ ID NO: 144656 - protein, 24 aa, Mycobacterium avium
DPQVPPRVAALPGPATALTGDGRG

SEQ ID NO: 144657 - protein, 18 aa, Mycobacterium avium
DRGRPAPPHRRWSQYLSW

SEQ ID NO: 144658 - protein, 21 aa, Mycobacterium avium
DRHLPRLGDVVVVCSADTAVL

SEQ ID NO: 144659 - protein, 20 aa, Mycobacterium avium
DRHLPRLGDVVVVCSGDTAV

SEQ ID NO: 144660 - protein, 26 aa, Mycobacterium avium
DRTLWPDRLWLAIAHSPAREIDLTPW

SEQ ID NO: 144661 - protein, 22 aa, Mycobacterium avium
DRVDGWLRRWLQRDKAAGAPSV

SEQ ID NO: 144662 - protein, 19 aa, Mycobacterium avium
DSFTRRDPVVLYRVTPQAF

SEQ ID NO: 144663 - protein, 24 aa, Mycobacterium avium
DSGALFVRVGDTWHPVLNLASARL

SEQ ID NO: 144664 - protein, 19 aa, Mycobacterium avium
DSGGDGWTVARRGRVLAFV

SEQ ID NO: 144665 - protein, 23 aa, Mycobacterium avium
DSPRGVADLVTISSTAGWVARPN

SEQ ID NO: 144666 - protein, 25 aa, Mycobacterium avium
DSRAYRLDWPAATTIFELDQPQVLD

SEQ ID NO: 144667 - protein, 22 aa, Mycobacterium avium
DTLTADVGIEFTAPDVTTAMNE

SEQ ID NO: 144668 - protein, 22 aa, Mycobacterium avium
DTLTADVGIEFTAPDVTTAMNQ

SEQ ID NO: 144669 - protein, 26 aa, Mycobacterium avium
DTRALIKVMTILGSRYLELVPDGPGS

SEQ ID NO: 144670 - protein, 19 aa, Mycobacterium avium
DVDAGDVNFHFKVDEQPQP

SEQ ID NO: 144671 - protein, 20 aa, Mycobacterium avium
DVGEWFGRHGWDVRVTPSDE

SEQ ID NO: 144672 - protein, 28 aa, Mycobacterium avium
DVLSRPQIQVGMPFCKIGAVTGETCGAI

SEQ ID NO: 144673 - protein, 20 aa, Mycobacterium avium
DVPGGFAAGLARALPVTGGQ

SEQ ID NO: 144674 - protein, 22 aa, Mycobacterium avium
DVRLEKRLAATVPEGSPAEIGA

SEQ ID NO: 144675 - protein, 23 aa, Mycobacterium avium
DVRLEKRLAATVPEGSPAEIGAV

SEQ ID NO: 144676 - protein, 20 aa, Mycobacterium avium
DVRTARIVTPRVMQLTLRAT

SEQ ID NO: 144677 - protein, 23 aa, Mycobacterium avium
DVRVRRALQLGIDRRAVVDTVLS

SEQ ID NO: 144678 - protein, 18 aa, Mycobacterium avium
DVSHGCINISPANAKWFF

SEQ ID NO: 144679 - protein, 21 aa, Mycobacterium avium
DWTRDRPGLGAGEVAFDAATL

SEQ ID NO: 144680 - protein, 21 aa, Mycobacterium avium
DYPARVVAVGADRDCLATQIA

SEQ ID NO: 144681 - protein, 23 aa, Mycobacterium avium
EAALPSPFCYEIAQWAGEDAEPA

SEQ ID NO: 144682 - protein, 20 aa, Mycobacterium avium
EADVLWDLASRLEGRMTAIG

SEQ ID NO: 144683 - protein, 22 aa, Mycobacterium avium
EALCRLAFAARAGWQRWEAEFG

SEQ ID NO: 144684 - protein, 20 aa, Mycobacterium avium
EALKRLPTYATELGEVVGSG

SEQ ID NO: 144685 - protein, 36 aa, Mycobacterium avium
EANNAKAAVRLGSDMGEFFMPYPGTRINQDSTPLNG

SEQ ID NO: 144686 - protein, 23 aa, Mycobacterium avium
EDGGQRPALAVGVHQAVQTDDRG

SEQ ID NO: 144687 - protein, 17 aa, Mycobacterium avium
EEARKLIAEQAAEIDTA

SEQ ID NO: 144688 - protein, 22 aa, Mycobacterium avium
EEQKLPLNVTWVNLTTGKSGTV

SEQ ID NO: 144689 - protein, 17 aa, Mycobacterium avium
EEWTRFARDPLLHKVIR

SEQ ID NO: 144690 - protein, 25 aa, Mycobacterium avium
EFEACQAVGLPVVWQDDADVPFAYH

SEQ ID NO: 144691 - protein, 25 aa, Mycobacterium avium
EFEACQAVGLPVVWQDDAEVPFAYH

SEQ ID NO: 144692 - protein, 22 aa, Mycobacterium avium
EFNLPNGLAIDSWMCAISGRAK

SEQ ID NO: 144693 - protein, 22 aa, Mycobacterium avium
EGAVLGGAYPGYGIYASADGYV

SEQ ID NO: 144694 - protein, 24 aa, Mycobacterium avium
EGERRAEGRFALYSVADAHDDASA

SEQ ID NO: 144695 - protein, 20 aa, Mycobacterium avium
EGHIYRACQRVGAQSRDELA

SEQ ID NO: 144696 - protein, 21 aa, Mycobacterium avium
EGPMTPGALAIRERVRPPSMT

SEQ ID NO: 144697 - protein, 25 aa, Mycobacterium avium
EHLVQLRIGDAIRRIRVAHHGAQRA

SEQ ID NO: 144698 - protein, 20 aa, Mycobacterium avium
EHPWDFTEFLNAARALTKRD

SEQ ID NO: 144699 - protein, 19 aa, Mycobacterium avium
EHPWGFSEFLNAARALTKR

SEQ ID NO: 144700 - protein, 25 aa, Mycobacterium avium
EITYSEDWLRPGYTPPDGGPPPEAP

SEQ ID NO: 144701 - protein, 24 aa, Mycobacterium avium
EITYSEDWLRPGYTPPDSGPPPEA

SEQ ID NO: 144702 - protein, 25 aa, Mycobacterium avium
EITYSEDWLRPGYTPSDGGPPPEAP

SEQ ID NO: 144703 - protein, 17 aa, Mycobacterium avium
EKRREVFLYPKARNLSF

SEQ ID NO: 144704 - protein, 25 aa, Mycobacterium avium
EKTAADPRFRFFGNVSVGEHVQASE

SEQ ID NO: 144705 - protein, 21 aa, Mycobacterium avium
ELACALALFPPTEEQAAVIAA

SEQ ID NO: 144706 - protein, 17 aa, Mycobacterium avium
ELAKALADFLFDDKRAM

SEQ ID NO: 144707 - protein, 28 aa, Mycobacterium avium
ELEYVEMWLRDVAAMLGYHAGAQSAAQA

SEQ ID NO: 144708 - protein, 19 aa, Mycobacterium avium
ELGDMGLVPAMTVKCTVAL

SEQ ID NO: 144709 - protein, 27 aa, Mycobacterium avium
ELHAAASCYRSVIAGLTTGRWLGPSSL

SEQ ID NO: 144710 - protein, 18 aa, Mycobacterium avium
ELHRRLPADLSILTPAPA

SEQ ID NO: 144711 - protein, 21 aa, Mycobacterium avium
ELPETMLDAAPAMAVNGQQGM

SEQ ID NO: 144712 - protein, 27 aa, Mycobacterium avium
ELRALLPRERLKRITAHSIGSRAALET

SEQ ID NO: 144713 - protein, 24 aa, Mycobacterium avium
ELSKALRLSSERGVTTREQLTTIV

SEQ ID NO: 144714 - protein, 40 aa, Mycobacterium avium
ENLPRVNARGGPGGAPGCWQPITHDLWPAPELVMDTGNSL

SEQ ID NO: 144715 - protein, 27 aa, Mycobacterium avium
ENMRLFGKFLDRIQAFLDTRGPDVKVL

SEQ ID NO: 144716 - protein, 30 aa, Mycobacterium avium; identical to SEQ ID NO: 15606

SEQ ID NO: 144717 - protein, 25 aa, Mycobacterium avium
EPDRVRITFWLNDKYKVPADVKAAI

SEQ ID NO: 144718 - protein, 18 aa, Mycobacterium avium
EPGLRAGAVQSHQVDVAR

SEQ ID NO: 144719 - protein, 20 aa, Mycobacterium avium
EPPTDFAAMLAMAEPSLPPA

SEQ ID NO: 144720 - protein, 24 aa, Mycobacterium avium
EQMWASDVAAMFGYHADASAAVAK

SEQ ID NO: 144721 - protein, 32 aa, Mycobacterium avium
EQQCALIAWRSMLPCNWLGMQVPAGTPGSWDN

SEQ ID NO: 144722 - protein, 22 aa, Mycobacterium avium
EQRRGDLPNALRVDTSGAPETG

SEQ ID NO: 144723 - protein, 22 aa, Mycobacterium avium
EQRRGDLPNALRVDTSGTPETG

SEQ ID NO: 144724 - protein, 23 aa, Mycobacterium avium
EQRRGDLPYALRVDTSGRPETGE

SEQ ID NO: 144725 - protein, 19 aa, Mycobacterium avium
ERAGAAFSRLDRDGIAERI

SEQ ID NO: 144726 - protein, 23 aa, Mycobacterium avium
ERFGVDDVRAFDLLRRLSQESQV

SEQ ID NO: 144727 - protein, 20 aa, Mycobacterium avium
ERLPGAIRWTSNALRQARDY

SEQ ID NO: 144728 - protein, 18 aa, Mycobacterium avium
ERMDRIQALMARIDPDRA

SEQ ID NO: 144729 - protein, 27 aa, Mycobacterium avium
ERNAEVRRCAIEKMGWDQFVLAAGLKL

SEQ ID NO: 144730 - protein, 19 aa, Mycobacterium avium
ERPALDLEGIFAGLERFSP

SEQ ID NO: 144731 - protein, 26 aa, Mycobacterium avium
ERRLRVVVRVTLRLLLAVLLAPGWPL

SEQ ID NO: 144732 - protein, 17 aa, Mycobacterium avium
ERSGNRWDISAPRNTYQ

SEQ ID NO: 144733 - protein, 17 aa, Mycobacterium avium
ERVAPSILMGRREGLSR

SEQ ID NO: 144734 - protein, 24 aa, Mycobacterium avium
ERVRLLAETAPVLWGDLPTLPLYR

SEQ ID NO: 144735 - protein, 25 aa, Mycobacterium avium
ESAKLCVQYLAPIIKNRQVNFPPLG

SEQ ID NO: 144736 - protein, 25 aa, Mycobacterium avium
ESGVGWNYLAAINFIETRFGSIVGA

SEQ ID NO: 144737 - protein, 23 aa, Mycobacterium avium
ESLCRLAFAARAGWQRWEAEFGV

SEQ ID NO: 144738 - protein, 17 aa, Mycobacterium avium
ESLPLASIFKLYVLHAL

SEQ ID NO: 144739 - protein, 29 aa, Mycobacterium avium
ESLPLASIFKLYVLHALAGAVTAGRVSWD

SEQ ID NO: 144740 - protein, 32 aa, Mycobacterium avium; identical to SEQ ID NO: 87944

SEQ ID NO: 144741 - protein, 17 aa, Mycobacterium avium
ESVLSGLGLQWHGPAAD

SEQ ID NO: 144742 - protein, 25 aa, Mycobacterium avium
ESVLSGLGLQWHGPAADAMAFAAAR

SEQ ID NO: 144743 - protein, 27 aa, Mycobacterium avium
ETGKLCAEYAGPGLRTANLNYLPIPTN

SEQ ID NO: 144744 - protein, 22 aa, Mycobacterium avium
ETICRYRLPVTVVILNNGGVYR

SEQ ID NO: 144745 - protein, 19 aa, Mycobacterium avium
EVGSRAWAAMYLGTPSTPE

SEQ ID NO: 144746 - protein, 20 aa, Mycobacterium avium
EVKAMYPLGPIFHGSGLNIT

SEQ ID NO: 144747 - protein, 20 aa, Mycobacterium avium
EVLQRIPSVQVVFIGQRRGE

SEQ ID NO: 144748 - protein, 20 aa, Mycobacterium avium
EVLYRPLGMTSTSSRFADFL

SEQ ID NO: 144749 - protein, 23 aa, Mycobacterium avium
EVNAEREMCQWFNAQYEPLKLQI

SEQ ID NO: 144750 - protein, 22 aa, Mycobacterium avium
EVRGAEVVDLLAALNTGHDGGA

SEQ ID NO: 144751 - protein, 19 aa, Mycobacterium avium
EWGAVLARIDMGWEEWKVG

SEQ ID NO: 144752 - protein, 17 aa, Mycobacterium avium
EYAEMWAQDAAAMYAYA

SEQ ID NO: 144753 - protein, 17 aa, Mycobacterium avium
FAAIAVNAYCPDQASSI

SEQ ID NO: 144754 - protein, 20 aa, Mycobacterium avium
FAARSLRTIAHMTRLRGADT

SEQ ID NO: 144755 - protein, 19 aa, Mycobacterium avium
FADRPLAPIDPSAMVGQVG

SEQ ID NO: 144756 - protein, 19 aa, Mycobacterium avium
FADRSCDPLALPRLAVGGD

SEQ ID NO: 144757 - protein, 18 aa, Mycobacterium avium
FAFTYTVTGADGITATSA

SEQ ID NO: 144758 - protein, 18 aa, Mycobacterium avium
FAGAGVLALAGLVTIGVG

SEQ ID NO: 144759 - protein, 25 aa, Mycobacterium avium
FAGGYAVSVCKTVTLTVDGVAMRVT

SEQ ID NO: 144760 - protein, 17 aa, Mycobacterium avium
FAGIGVRTVLSHGSHLD

SEQ ID NO: 144761 - protein, 18 aa, Mycobacterium avium
FAGIGVRTVLSHRSHLDA

SEQ ID NO: 144762 - protein, 19 aa, Mycobacterium avium
FARDPLLHKVIRLLSRIAA

SEQ ID NO: 144763 - protein, 17 aa, Mycobacterium avium
FCAGAGLAPQPAGAGAA

SEQ ID NO: 144764 - protein, 17 aa, Mycobacterium avium
FDAVCFTSSSTVRNLVG

SEQ ID NO: 144765 - protein, 22 aa, Mycobacterium avium
FDNYLRRCDFSKVSIAPKVPSP

SEQ ID NO: 144766 - protein, 18 aa, Mycobacterium avium
FDPDRARRLWAQADAISA

SEQ ID NO: 144767 - protein, 25 aa, Mycobacterium avium
FEASHMRFWFGAVYGRACRLTGRID

SEQ ID NO: 144768 - protein, 24 aa, Mycobacterium avium
FGFANACGVAHALPQMSQVRYEVN

SEQ ID NO: 144769 - protein, 18 aa, Mycobacterium avium
FGGARVVLTAGYPALSPV

SEQ ID NO: 144770 - protein, 18 aa, Mycobacterium avium
FGGLSCGCSGTRPAGDPA

SEQ ID NO: 144771 - protein, 24 aa, Mycobacterium avium
FGHSMGGVVAFEFARVAEANGTPV

SEQ ID NO: 144772 - protein, 17 aa, Mycobacterium avium
FGIAMITPLVFAGAVSA

SEQ ID NO: 144773 - protein, 24 aa, Mycobacterium avium
FGIGEYRVTVDLPQSGGLYQTSVV

SEQ ID NO: 144774 - protein, 19 aa, Mycobacterium avium
FGPLLGELLARAALSGDIP

SEQ ID NO: 144775 - protein, 24 aa, Mycobacterium avium
FGPNPLDPGCRVPSARAGREQGRR

SEQ ID NO: 144776 - protein, 17 aa, Mycobacterium avium
FHAWVQKFYGAECLFEL

SEQ ID NO: 144777 - protein, 19 aa, Mycobacterium avium
FIADLHKVGISFQDPGQAV

SEQ ID NO: 144778 - protein, 29 aa, Mycobacterium avium
FKAIVANLLPYQVLQPWVDAAFKKRGIDP

SEQ ID NO: 144779 - protein, 21 aa, Mycobacterium avium
FKGIGDTGADIFLREVQDVWT

SEQ ID NO: 144780 - protein, 24 aa, Mycobacterium avium
FLGEPPVVIGPLFQDKTLKVCATE

SEQ ID NO: 144781 - protein, 17 aa, Mycobacterium avium
FLKDLRDAGITYQDAGN

SEQ ID NO: 144782 - protein, 23 aa, Mycobacterium avium
FLSSGPYAFPVAVLSMFNVLWAL

SEQ ID NO: 144783 - protein, 17 aa, Mycobacterium avium
FNDQFTAAVNKIYNSGH

SEQ ID NO: 144784 - protein, 23 aa, Mycobacterium avium
FNKGGPYLARGAHDLVPTAQLLD

SEQ ID NO: 144785 - protein, 18 aa, Mycobacterium avium
FNLTKGWITPAVRIGRRS

SEQ ID NO: 144786 - protein, 18 aa, Mycobacterium avium
FPSGLLVMGDALCSLDPT

SEQ ID NO: 144787 - protein, 25 aa, Mycobacterium avium
FPTITAETLLAWNPDVIVASNARVA

SEQ ID NO: 144788 - protein, 22 aa, Mycobacterium avium
FPVAVLSMFNVLWALAPATPVM

SEQ ID NO: 144789 - protein, 23 aa, Mycobacterium avium
FQHVWASDHIQPWQDDEGHAMFP

SEQ ID NO: 144790 - protein, 21 aa, Mycobacterium avium
FRAPRRRWGSLVGIQPDGLEV

SEQ ID NO: 144791 - protein, 20 aa, Mycobacterium avium
FRVIGEPGLRAGAVQSHQVD

SEQ ID NO: 144792 - protein, 27 aa, Mycobacterium avium
FSIEPGIYFPGRWGARIEDIVVVTDDG

SEQ ID NO: 144793 - protein, 23 aa, Mycobacterium avium
FTGEHPKDHIAFIRDNLVVEAPI

SEQ ID NO: 144794 - protein, 20 aa, Mycobacterium avium
FTIRDGVSFSDHTPLTAEVV

SEQ ID NO: 144795 - protein, 18 aa, Mycobacterium avium
FTVAGPWVGVAAPGERIV

SEQ ID NO: 144796 - protein, 36 aa, Mycobacterium avium
FVAALLHRAASPAVWLNPWRWYAAPRAVADSLTVDR

SEQ ID NO: 144797 - protein, 22 aa, Mycobacterium avium
FVTFVRGAMYWSPQTGAQPVTG

SEQ ID NO: 144798 - protein, 23 aa, Mycobacterium avium
GAAATMPRRLAIAAVGASLLSGV

SEQ ID NO: 144799 - protein, 23 aa, Mycobacterium avium
GADLCQQLSWGASPQQLEGLALQ

SEQ ID NO: 144800 - protein, 33 aa, Mycobacterium avium
GAGATWGGLVKNAWKESFVNAAVNPQEFAQARL

SEQ ID NO: 144801 - protein, 18 aa, Mycobacterium avium
GAGRWLAVAASLVISAAM

SEQ ID NO: 144802 - protein, 19 aa, Mycobacterium avium
GAGTAWLYFKEYLPDKRTD

SEQ ID NO: 144803 - protein, 19 aa, Mycobacterium avium
GAITLWLGLVANVGQVLNG

SEQ ID NO: 144804 - protein, 25 aa, Mycobacterium avium
GALGRLRPLFRTGLGTRLGSGRQYM

SEQ ID NO: 144805 - protein, 25 aa, Mycobacterium avium
GALTLSPYPLWCGFATVLSTHIWRL

SEQ ID NO: 144806 - protein, 17 aa, Mycobacterium avium
GANPWQYGQQGILLNSD

SEQ ID NO: 144807 - protein, 24 aa, Mycobacterium avium
GAPPTLPPFMLADGVTSLNAAYAV

SEQ ID NO: 144808 - protein, 19 aa, Mycobacterium avium
GAPPVAGLHLQFGKNAGTE

SEQ ID NO: 144809 - protein, 18 aa, Mycobacterium avium
GAPTPAPARQTGIPAGPA

SEQ ID NO: 144810 - protein, 23 aa, Mycobacterium avium
GASEIPLDFRILDTILGAQTTFR

SEQ ID NO: 144811 - protein, 18 aa, Mycobacterium avium
GATTMAADAAGRVLVVDT

SEQ ID NO: 144812 - protein, 17 aa, Mycobacterium avium
GAVLLACLMIVLCAGAG

SEQ ID NO: 144813 - protein, 20 aa, Mycobacterium avium
GCGWKPPAPPQARPDTCKAS

SEQ ID NO: 144814 - protein, 24 aa, Mycobacterium avium
GCSDSRVAAELIFDQGLGDMFVVR

SEQ ID NO: 144815 - protein, 20 aa, Mycobacterium avium
GCSFAGLLFFQPVVRCAEPS

SEQ ID NO: 144816 - protein, 26 aa, Mycobacterium avium
GDEPPREWRMRIEVRSVGDDAKVSNV

SEQ ID NO: 144817 - protein, 17 aa, Mycobacterium avium
GDIARMLQQGWQRLVAS

SEQ ID NO: 144818 - protein, 19 aa, Mycobacterium avium
GDKITLTFSDPAGGGSRTL

SEQ ID NO: 144819 - protein, 23 aa, Mycobacterium avium
GDLPLDVARAFVGPDVLLGLSSH

SEQ ID NO: 144820 - protein, 17 aa, Mycobacterium avium
GDNGWGSWAGQLGAMSG

SEQ ID NO: 144821 - protein, 19 aa, Mycobacterium avium
GDNIARYAPPPAVYAPLPE

SEQ ID NO: 144822 - protein, 23 aa, Mycobacterium avium
GDPLAAAAPDWYARLIEHQNVLT

SEQ ID NO: 144823 - protein, 17 aa, Mycobacterium avium
GDPTAGLGAVVSNGNPP

SEQ ID NO: 144824 - protein, 20 aa, Mycobacterium avium
GDSIPGPVIRAAIGDEVAVT

SEQ ID NO: 144825 - protein, 18 aa, Mycobacterium avium
GDVAGLHAAASRWHGFAA

SEQ ID NO: 144826 - protein, 21 aa, Mycobacterium avium
GEAMSGFAHITGQAGAPPTLP

SEQ ID NO: 144827 - protein, 23 aa, Mycobacterium avium
GEDLSWLWDVRFEHFNDAFQTTP

SEQ ID NO: 144828 - protein, 18 aa, Mycobacterium avium
GEDVRIAGITVGRVKDLS

SEQ ID NO: 144829 - protein, 32 aa, Mycobacterium avium
GEKRSWLRARGLKLFPLVGWAERGGYDAQGHG

SEQ ID NO: 144830 - protein, 20 aa, Mycobacterium avium
GEPAMQWIAARFRGEPTAPN

SEQ ID NO: 144831 - protein, 19 aa, Mycobacterium avium
GERVTGVAGRAAHRRGARG

SEQ ID NO: 144832 - protein, 24 aa, Mycobacterium avium
GEVLRLRWRKGCMPVPQRVIRARM

SEQ ID NO: 144833 - protein, 24 aa, Mycobacterium avium
GFHGLQIHAVGKCEANSTAPTGGS

SEQ ID NO: 144834 - protein, 17 aa, Mycobacterium avium
GFLLVLFAGAADREVAG

SEQ ID NO: 144835 - protein, 24 aa, Mycobacterium avium
GFTHGWASDHIQPWQDNEGHSMFP

SEQ ID NO: 144836 - protein, 20 aa, Mycobacterium avium
GGAAPRCWQVTRKGIPMTID

SEQ ID NO: 144837 - protein, 17 aa, Mycobacterium avium
GGAGWRIAAGGLVRFAA

SEQ ID NO: 144838 - protein, 20 aa, Mycobacterium avium
GGALTGVLAVSVGALVMSVA

SEQ ID NO: 144839 - protein, 22 aa, Mycobacterium avium
GGAPGDFLSAGGHFQAPGHTGE

SEQ ID NO: 144840 - protein, 23 aa, Mycobacterium avium
GGDAGDIAYPYYLVNGRIAASPK

SEQ ID NO: 144841 - protein, 28 aa, Mycobacterium avium
GGDYIKVPMPYRRSMRISVESHLEYYHV

SEQ ID NO: 144842 - protein, 18 aa, Mycobacterium avium
GGEELRWQLVDEDACLRP

SEQ ID NO: 144843 - protein, 21 aa, Mycobacterium avium
GGESMTHLAFQLSRISDSIKR

SEQ ID NO: 144844 - protein, 25 aa, Mycobacterium avium
GGFGGVDGLRRWLRDEHIGAVVDAT

SEQ ID NO: 144845 - protein, 17 aa, Mycobacterium avium
GGGAGWRIAAGGLVSFA

SEQ ID NO: 144846 - protein, 28 aa, Mycobacterium avium
GGKIPRVYGRQAIEYVIKRMGSQMGVPY

SEQ ID NO: 144847 - protein, 17 aa, Mycobacterium avium
GGLFKTPALRPICQPCH

SEQ ID NO: 144848 - protein, 25 aa, Mycobacterium avium
GGLSPLAPLRGGYVSAVTPDAGGVA

SEQ ID NO: 144849 - protein, 24 aa, Mycobacterium avium
GGLVKAAWIDTWRLPAAPPGTVKI

SEQ ID NO: 144850 - protein, 18 aa, Mycobacterium avium
GGLVSVVGLVLSACTVNP

SEQ ID NO: 144851 - protein, 18 aa, Mycobacterium avium
GGNRPRWLGADIGQRQFY

SEQ ID NO: 144852 - protein, 25 aa, Mycobacterium avium
GGRLGPARTAAICAVSPALWLSSGA

SEQ ID NO: 144853 - protein, 29 aa, Mycobacterium avium
GGSKVGLPLVRKALDLLPHVGFVNAYGLT

SEQ ID NO: 144854 - protein, 17 aa, Mycobacterium avium
GGTRRCVGAAFANMEMD

SEQ ID NO: 144855 - protein, 32 aa, Mycobacterium avium
GGVEAVVLLSGYRVMPQWVKIRNVDGFTGSYW

SEQ ID NO: 144856 - protein, 21 aa, Mycobacterium avium
GGVLLPVLIFAAARAGVAFTP

SEQ ID NO: 144857 - protein, 26 aa, Mycobacterium avium
GHHPRAWRRLHARLTRLGVGVHPGHR

SEQ ID NO: 144858 - protein, 24 aa, Mycobacterium avium
GIDAQALWPGLPVRPVKGEVLRLR

SEQ ID NO: 144859 - protein, 22 aa, Mycobacterium avium
GIGAKPYWRPPYAKRNATVDAV

SEQ ID NO: 144860 - protein, 22 aa, Mycobacterium avium
GIGATDLCEFVEFPTELLQVCG

SEQ ID NO: 144861 - protein, 22 aa, Mycobacterium avium
GIPGRPWRTPSRPFPPPHDPTA

SEQ ID NO: 144862 - protein, 17 aa, Mycobacterium avium
GIPPREVIAALRRAETV

SEQ ID NO: 144863 - protein, 25 aa, Mycobacterium avium
GIPVAAAPKVIWGLAADARAKPPRC

SEQ ID NO: 144864 - protein, 23 aa, Mycobacterium avium
GIRANVICPGFIETPMAHNVFSI

SEQ ID NO: 144865 - protein, 20 aa, Mycobacterium avium
GKAGQFDAVMTALGDDAPDD

SEQ ID NO: 144866 - protein, 29 aa, Mycobacterium avium
GKAVCGLLARGVSGLQLLNDLRDNNPALT

SEQ ID NO: 144867 - protein, 18 aa, Mycobacterium avium
GKIIHCGAAGAGQAAKVC

SEQ ID NO: 144868 - protein, 21 aa, Mycobacterium avium
GKPAVLWFWTPWCPYCNAEAP

SEQ ID NO: 144869 - protein, 17 aa, Mycobacterium avium
GKQAILHATKIAEEAMP

SEQ ID NO: 144870 - protein, 17 aa, Mycobacterium avium
GKRESGVVFQQFEGGVI

SEQ ID NO: 144871 - protein, 19 aa, Mycobacterium avium
GKRSAWLPLHVLLVDAALT

SEQ ID NO: 144872 - protein, 24 aa, Mycobacterium avium
GLAFATLCTRSYYATRLDGPCNRI

SEQ ID NO: 144873 - protein, 23 aa, Mycobacterium avium
GLGNAICWRLYSGEAPGHVADEL

SEQ ID NO: 144874 - protein, 18 aa, Mycobacterium avium
GLGRCIGTGLAQRGAHVA

SEQ ID NO: 144875 - protein, 17 aa, Mycobacterium avium
GLGRLEKELVRDPAAVA

SEQ ID NO: 144876 - protein, 17 aa, Mycobacterium avium
GLHGLHVHEIGKCEPNS

SEQ ID NO: 144877 - protein, 24 aa, Mycobacterium avium
GLPEGPLPLGTPVTGRLYFDVRNG

SEQ ID NO: 144878 - protein, 27 aa, Mycobacterium avium
GLPELPGVVVRPLLPLTERRLGIAVSA

SEQ ID NO: 144879 - protein, 18 aa, Mycobacterium avium
GLPEVFNDPDLASFNGAV

SEQ ID NO: 144880 - protein, 20 aa, Mycobacterium avium
GLPYFSTGMANTFTQIAKSV

SEQ ID NO: 144881 - protein, 22 aa, Mycobacterium avium
GLQRQWLHARSLSFAHPADGRR

SEQ ID NO: 144882 - protein, 18 aa, Mycobacterium avium
GLRGSEEVLGILLSAIDS

SEQ ID NO: 144883 - protein, 19 aa, Mycobacterium avium
GLRGSEEVLGILLSAIDSR

SEQ ID NO: 144884 - protein, 22 aa, Mycobacterium avium
GLTGWVGIGMAVLVVAGVALAG

SEQ ID NO: 144885 - protein, 17 aa, Mycobacterium avium
GLTRLSATLSQAPARSI

SEQ ID NO: 144886 - protein, 19 aa, Mycobacterium avium
GLTTGRWLGPSSLAMASAF

SEQ ID NO: 144887 - protein, 19 aa, Mycobacterium avium
GLTVGSWLGPAATSMSAAA

SEQ ID NO: 144888 - protein, 18 aa, Mycobacterium avium
GLVKRSRDPSDLRAVLVD

SEQ ID NO: 144889 - protein, 20 aa, Mycobacterium avium
GMAAGSPFALAHTFAQTGPF

SEQ ID NO: 144890 - protein, 24 aa, Mycobacterium avium
GMDARAYRLAWPDGTVVYELDQPE

SEQ ID NO: 144891 - protein, 24 aa, Mycobacterium avium
GMDARAYRLAWPDGTVVYELDQPH

SEQ ID NO: 144892 - protein, 27 aa, Mycobacterium avium
GMQQGCGGPPCKGAVVALEPSTGKILA

SEQ ID NO: 144893 - protein, 24 aa, Mycobacterium avium
GMSDSCQWFKSQFDPLMGQINDFN

SEQ ID NO: 144894 - protein, 17 aa, Mycobacterium avium
GMSNGAMMALRLGCQSD

SEQ ID NO: 144895 - protein, 17 aa, Mycobacterium avium
GNFPEQFNVTNIAPAGP

SEQ ID NO: 144896 - protein, 22 aa, Mycobacterium avium
GNIVGGPMGWESVFTQPGQGDW

SEQ ID NO: 144897 - protein, 30 aa, Mycobacterium avium
GPAADAMAFAAARYLTWLRATAEQTKQTAM

SEQ ID NO: 144898 - protein, 19 aa, Mycobacterium avium
GPALDAVYLPPGRSAYVRA

SEQ ID NO: 144899 - protein, 29 aa, Mycobacterium avium
GPAVRFGDRPGYRFVQRDVCDPGLIDEVG

SEQ ID NO: 144900 - protein, 22 aa, Mycobacterium avium
GPERFYDMVRKFGLGQRTNVGL

SEQ ID NO: 144901 - protein, 19 aa, Mycobacterium avium
GPERRRFANDPANLLAVDG

SEQ ID NO: 144902 - protein, 28 aa, Mycobacterium avium
GPGEPPRPAWDRPLPPPGGHWDYGPIDY

SEQ ID NO: 144903 - protein, 27 aa, Mycobacterium avium
GPGEPPRPAWDRPLPPPGGHWDYGPIN

SEQ ID NO: 144904 - protein, 30 aa, Mycobacterium avium; identical to SEQ ID NO: 97678

SEQ ID NO: 144905 - protein, 26 aa, Mycobacterium avium
GPGGVALPMRLALPGAVNRGNAAQAV

SEQ ID NO: 144906 - protein, 23 aa, Mycobacterium avium
GPGNLLGGMPLAGAGAGGHGAAG

SEQ ID NO: 144907 - protein, 22 aa, Mycobacterium avium
GPKSVRLAGQYGDGWISQAHDI

SEQ ID NO: 144908 - protein, 25 aa, Mycobacterium avium
GPKTAETAAEFGLRVDVQPETAAVG

SEQ ID NO: 144909 - protein, 24 aa, Mycobacterium avium
GPLLGIPGAPAFLGRPLAAAESLC

SEQ ID NO: 144910 - protein, 28 aa, Mycobacterium avium
GPMIADPFTKLHCCIRSDGGAAAVLVSA

SEQ ID NO: 144911 - protein, 20 aa, Mycobacterium avium
GPPPPFGAPPPFAPPPSGPP

SEQ ID NO: 144912 - protein, 19 aa, Mycobacterium avium
GPPVIPRGVCDPIAGLHAA

SEQ ID NO: 144913 - protein, 17 aa, Mycobacterium avium
GPQGGWGKPPTPLWPDA

SEQ ID NO: 144914 - protein, 18 aa, Mycobacterium avium
GQAPPIISRAEWGADESL

SEQ ID NO: 144915 - protein, 23 aa, Mycobacterium avium
GQDPRYILWAAWHQSGLQRRWLS

SEQ ID NO: 144916 - protein, 18 aa, Mycobacterium avium
GQIRDAWPPSARARPRLH

SEQ ID NO: 144917 - protein, 25 aa, Mycobacterium avium
GQIRDAWPPSARARPRLHPVDIPAG

SEQ ID NO: 144918 - protein, 19 aa, Mycobacterium avium
GQKKARVSFIPDRGIVDYN

SEQ ID NO: 144919 - protein, 26 aa, Mycobacterium avium
GQKKARVSFIPDRGIVDYNQLFTATT

SEQ ID NO: 144920 - protein, 21 aa, Mycobacterium avium
GQKKARVSFVPDRGIVDYNQL

SEQ ID NO: 144921 - protein, 21 aa, Mycobacterium avium
GQLRVLPPFLSRKHLPSRLAR

SEQ ID NO: 144922 - protein, 22 aa, Mycobacterium avium
GQLRVLPPFLSRKHLPSRLARL

SEQ ID NO: 144923 - protein, 20 aa, Mycobacterium avium
GQPSKFTVAGPWVGVAAPGE

SEQ ID NO: 144924 - protein, 23 aa, Mycobacterium avium
GRAVFTPSLAGLVLGEYRRIAQS

SEQ ID NO: 144925 - protein, 20 aa, Mycobacterium avium
GRCHACTTTLAGTHADVRRV

SEQ ID NO: 144926 - protein, 29 aa, Mycobacterium avium
GRIPNAVGGFSYVLPAGWVESDASHLDYG

SEQ ID NO: 144927 - protein, 17 aa, Mycobacterium avium
GRKPLRFTSFGDQSTPA

SEQ ID NO: 144928 - protein, 33 aa, Mycobacterium avium
GRPDPGLDLPIVLGGNMIQYNWTINGEPYSKTN

SEQ ID NO: 144929 - protein, 19 aa, Mycobacterium avium
GRPLRCFRAPRRRWGSLVG

SEQ ID NO: 144930 - protein, 18 aa, Mycobacterium avium
GRQAADVVIFALRDLCPN

SEQ ID NO: 144931 - protein, 25 aa, Mycobacterium avium
GRRRRRFALRAALALLVVVVLAGVF

SEQ ID NO: 144932 - protein, 28 aa, Mycobacterium avium
GRRVVLNFWAYWCAPCAAELPAMAEYQR

SEQ ID NO: 144933 - protein, 28 aa, Mycobacterium avium
GRTGIYGHARACGWAIRDGVVGPSSTPG

SEQ ID NO: 144934 - protein, 26 aa, Mycobacterium avium
GRTTGNSCGVTWGMGQSPGTIVMQVC

SEQ ID NO: 144935 - protein, 24 aa, Mycobacterium avium
GRVINIGSVLGFLPQPYGALYAGS

SEQ ID NO: 144936 - protein, 24 aa, Mycobacterium avium
GRVINIGSVLGFLPQPYGTLYAGS

SEQ ID NO: 144937 - protein, 23 aa, Mycobacterium avium
GSAKWNLLAPYAVKSEGGAHGDA

SEQ ID NO: 144938 - protein, 39 aa, Mycobacterium avium
GSAPIKPFWHQLFGGRQWCWWPAFIAYFRDVVELQLDSD

SEQ ID NO: 144939 - protein, 24 aa, Mycobacterium avium
GSFLCTGMPFAFLGKPRRWLRRVP

SEQ ID NO: 144940 - protein, 25 aa, Mycobacterium avium
GSGAHPGLRLDWPDDGTIGASGFRD

SEQ ID NO: 144941 - protein, 24 aa, Mycobacterium avium
GSGPFFKAYVANLVPGQFGGPVLD

SEQ ID NO: 144942 - protein, 17 aa, Mycobacterium avium
GSHGLVFTGTPKSAGFD

SEQ ID NO: 144943 - protein, 18 aa, Mycobacterium avium
GSHSEKWIDLQPGQCVAD

SEQ ID NO: 144944 - protein, 24 aa, Mycobacterium avium
GSIGGKLSVPVAWSGAPATPALGH

SEQ ID NO: 144945 - protein, 24 aa, Mycobacterium avium
GSPLLAGDFVRWCRQVLDLLDQVR

SEQ ID NO: 144946 - protein, 20 aa, Mycobacterium avium
GSPYANEYVWGRQVGDNTIN

SEQ ID NO: 144947 - protein, 21 aa, Mycobacterium avium
GSRAAVSLRFANDVLAELDTR

SEQ ID NO: 144948 - protein, 26 aa, Mycobacterium avium
GSTAELRTATPLGDVFVALKPPPGDH

SEQ ID NO: 144949 - protein, 19 aa, Mycobacterium avium
GSWNTPWSALAPARQAAVI

SEQ ID NO: 144950 - protein, 19 aa, Mycobacterium avium
GSWNTPWSALTPARQAAVI

SEQ ID NO: 144951 - protein, 18 aa, Mycobacterium avium
GTAGSWNTPWSALTPARQ

SEQ ID NO: 144952 - protein, 20 aa, Mycobacterium avium
GTHDWPYWGAQLQAMKPDLQ

SEQ ID NO: 144953 - protein, 25 aa, Mycobacterium avium
GTLKYTLWRLQERVVGRGPNAPQVP

SEQ ID NO: 144954 - protein, 18 aa, Mycobacterium avium
GTQILAAFGQTEMSPVTC

SEQ ID NO: 144955 - protein, 18 aa, Mycobacterium avium
GTSVPRDLIETGWDVERI

SEQ ID NO: 144956 - protein, 19 aa, Mycobacterium avium
GVFAWLYWGAHDELAAQHR

SEQ ID NO: 144957 - protein, 20 aa, Mycobacterium avium
GVFPGPGLPKPDPRDATPPY

SEQ ID NO: 144958 - protein, 18 aa, Mycobacterium avium
GVLPLARRVVAPPVPAEE

SEQ ID NO: 144959 - protein, 19 aa, Mycobacterium avium
GVMRSACADFSRWRANGVG

SEQ ID NO: 144960 - protein, 17 aa, Mycobacterium avium
GVQNPRVRRWWPRRYRR

SEQ ID NO: 144961 - protein, 20 aa, Mycobacterium avium
GVRRPRRFLAAVFVVVAVAG

SEQ ID NO: 144962 - protein, 18 aa, Mycobacterium avium
GVTERRLGDETQLTLDTV

SEQ ID NO: 144963 - protein, 25 aa, Mycobacterium avium
GVVNACRKCGALIQQGASNYSAAEA

SEQ ID NO: 144964 - protein, 19 aa, Mycobacterium avium
GVYANDYWGPAVINEHDGA

SEQ ID NO: 144965 - protein, 17 aa, Mycobacterium avium
GWDIMFNYEELFVATMV

SEQ ID NO: 144966 - protein, 21 aa, Mycobacterium avium
GYAHPGQVLGLTFTRKAAGQL

SEQ ID NO: 144967 - protein, 19 aa, Mycobacterium avium
GYLERRLADITTRTGTKYA

SEQ ID NO: 144968 - protein, 22 aa, Mycobacterium avium
GYPEHVFTWAVVGLINASLNQM

SEQ ID NO: 144969 - protein, 35 aa, Mycobacterium avium
HAAFAPRVAEILPELPRLRVLIQIADESGNELLDG

SEQ ID NO: 144970 - protein, 21 aa, Mycobacterium avium
HAFAGSLLRDYGLLLPVEPDT

SEQ ID NO: 144971 - protein, 17 aa, Mycobacterium avium
HALTPGARHGRSRRATR

SEQ ID NO: 144972 - protein, 23 aa, Mycobacterium avium
HAPPERLLRCIEAVLECREALAV

SEQ ID NO: 144973 - protein, 26 aa, Mycobacterium avium
HAQGTKPRCCPAPPAAAPTPSATASS

SEQ ID NO: 144974 - protein, 27 aa, Mycobacterium avium
HARVESIARTWAHAGFDAVAVTDIAAM

SEQ ID NO: 144975 - protein, 32 aa, Mycobacterium avium
HCETGPSVAWSDGWGLYTWHGTSVPRDLIETG

SEQ ID NO: 144976 - protein, 23 aa, Mycobacterium avium
HDAGKIVLRRSRPLQISLDGHDS

SEQ ID NO: 144977 - protein, 19 aa, Mycobacterium avium
HDHRIATGVLRQWERHTAG

SEQ ID NO: 144978 - protein, 25 aa, Mycobacterium avium
HDITDPKLLAAFGVGARDAGRDVSA

SEQ ID NO: 144979 - protein, 22 aa, Mycobacterium avium
HDSCGAVKAALGAIEEGAIPGG

SEQ ID NO: 144980 - protein, 20 aa, Mycobacterium avium
HEAAEGRWFADQVRSNPNSF

SEQ ID NO: 144981 - protein, 17 aa, Mycobacterium avium
HEFAFTYTVTGADGITA

SEQ ID NO: 144982 - protein, 19 aa, Mycobacterium avium
HEFPDAATMFAAVRAGQLT

SEQ ID NO: 144983 - protein, 17 aa, Mycobacterium avium
HEFPDGATMFAAVRAGQ

SEQ ID NO: 144984 - protein, 17 aa, Mycobacterium avium
HETREFGVRVSVVEPAY

SEQ ID NO: 144985 - protein, 18 aa, Mycobacterium avium
HETREFGVRVSVVEPAYT

SEQ ID NO: 144986 - protein, 24 aa, Mycobacterium avium
HGNSAPRFHITWGTGPALVEIFAR

SEQ ID NO: 144987 - protein, 18 aa, Mycobacterium avium
HGRLRPAHRQRQQPVRLL

SEQ ID NO: 144988 - protein, 28 aa, Mycobacterium avium
HGVEDRPPLPPCWHVSGAALFRRQLRYV

SEQ ID NO: 144989 - protein, 25 aa, Mycobacterium avium
HHPPPNWYGPPPPGGWDGPPPPGGW

SEQ ID NO: 144990 - protein, 25 aa, Mycobacterium avium
HHQGLRPGRHHRLRGHPGQRGPAGA

SEQ ID NO: 144991 - protein, 26 aa, Mycobacterium avium
HIYTCPVGIFPWCASSSEAALAPLFL

SEQ ID NO: 144992 - protein, 20 aa, Mycobacterium avium
HLAESLAGWRERYPDVTVHR

SEQ ID NO: 144993 - protein, 19 aa, Mycobacterium avium
HLDSLRAAVVAHRADLGLA

SEQ ID NO: 144994 - protein, 20 aa, Mycobacterium avium
HLDYGSALLSKVTGPPPMPD

SEQ ID NO: 144995 - protein, 19 aa, Mycobacterium avium
HLGGILYLFVRGMCGPDTP

SEQ ID NO: 144996 - protein, 20 aa, Mycobacterium avium
HLVARQATFHAMFAALTELV

SEQ ID NO: 144997 - protein, 19 aa, Mycobacterium avium
HMTPGQRRKQAWLRELAGW

SEQ ID NO: 144998 - protein, 20 aa, Mycobacterium avium
HPATEHRYLDAAYYAKIGRQ

SEQ ID NO: 144999 - protein, 17 aa, Mycobacterium avium
HQCHDWQHPGGPTGPAG

SEQ ID NO: 145000 - protein, 22 aa, Mycobacterium avium
HQRGRYAAALAGELAEECGGLC

SEQ ID NO: 145001 - protein, 23 aa, Mycobacterium avium
HRSMMIKVSIFAAAMLLVSAGLV

SEQ ID NO: 145002 - protein, 18 aa, Mycobacterium avium
HRTNLSMAVPDVKGLVVG

SEQ ID NO: 145003 - protein, 24 aa, Mycobacterium avium
HSAAPLFHNIAGWLMQRENVPLSP

SEQ ID NO: 145004 - protein, 24 aa, Mycobacterium avium
HSADIRFGAPSAFATRPAGLPGLR

SEQ ID NO: 145005 - protein, 22 aa, Mycobacterium avium
HVPDRLAVVRVDPGESLSDVAH

SEQ ID NO: 145006 - protein, 23 aa, Mycobacterium avium
HVSEAGYTQRLWEAIRAQDVQGN

SEQ ID NO: 145007 - protein, 22 aa, Mycobacterium avium
IAADDFWYLWHQMVSQPGVVDP

SEQ ID NO: 145008 - protein, 28 aa, Mycobacterium avium
IAATEAHYAEMWAQDAAAMYAYAGASAV

SEQ ID NO: 145009 - protein, 24 aa, Mycobacterium avium
IAGARSCVPPDFLFMHTGLALATG

SEQ ID NO: 145010 - protein, 21 aa, Mycobacterium avium
IAGPVLAYWLTRYGFEVTVVE

SEQ ID NO: 145011 - protein, 18 aa, Mycobacterium avium
IARIGRRSVITASGAEIE

SEQ ID NO: 145012 - protein, 20 aa, Mycobacterium avium
IATGVLRQWERHTAGSFAMS

SEQ ID NO: 145013 - protein, 26 aa, Mycobacterium avium
ICGPETLRSLYFLSSRVTGGSPHALR

SEQ ID NO: 145014 - protein, 25 aa, Mycobacterium avium
ICLAEAGWPARVWADTMPADTTSAV

SEQ ID NO: 145015 - protein, 23 aa, Mycobacterium avium
ICLAEAGWPVRVWADTMPADTTS

SEQ ID NO: 145016 - protein, 24 aa, Mycobacterium avium
ICLAEAGWPVRVWADTMPADTTSA

SEQ ID NO: 145017 - protein, 19 aa, Mycobacterium avium
ICVLPIALAPWPATVFTAL

SEQ ID NO: 145018 - protein, 25 aa, Mycobacterium avium
IDPAHPTARIEFMVADAAPIAAITT

SEQ ID NO: 145019 - protein, 23 aa, Mycobacterium avium
IDRVHARVPSFLIPGRTEADVAA

SEQ ID NO: 145020 - protein, 17 aa, Mycobacterium avium
IDTKFGYNNAVGAGTGI

SEQ ID NO: 145021 - protein, 18 aa, Mycobacterium avium
IDVVKRSLNVLSETFNQT

SEQ ID NO: 145022 - protein, 26 aa, Mycobacterium avium
IEAVLECREALAVNVKPKFAVDAMVA

SEQ ID NO: 145023 - protein, 20 aa, Mycobacterium avium
IEGDSAFGFSGMEIETICRY

SEQ ID NO: 145024 - protein, 17 aa, Mycobacterium avium
IEHPEIGFTRLAVGDSL

SEQ ID NO: 145025 - protein, 20 aa, Mycobacterium avium
IELLRRARDSLAHHNSVADL

SEQ ID NO: 145026 - protein, 18 aa, Mycobacterium avium
IGALKLILTQPFDIDTVP

SEQ ID NO: 145027 - protein, 20 aa, Mycobacterium avium
IGATDLCEFVEFPTELLQVC

SEQ ID NO: 145028 - protein, 27 aa, Mycobacterium avium
IGDAFLEPFGKFWVNHREEFIEKVREW

SEQ ID NO: 145029 - protein, 17 aa, Mycobacterium avium
IGGFRPLFRALDPDQVN

SEQ ID NO: 145030 - protein, 23 aa, Mycobacterium avium
IGGHQPGAFAFPTITAETLLAWN

SEQ ID NO: 145031 - protein, 20 aa, Mycobacterium avium
IGGINWGSSITPDLASHVAA

SEQ ID NO: 145032 - protein, 18 aa, Mycobacterium avium
IGIGDPTAGLGAVVSNGN

SEQ ID NO: 145033 - protein, 20 aa, Mycobacterium avium
IGLPEVFNDPDLASFNGAVT

SEQ ID NO: 145034 - protein, 19 aa, Mycobacterium avium
IGTGLAQRGAHVALLARRY

SEQ ID NO: 145035 - protein, 17 aa, Mycobacterium avium
IGTNCLADGSSAIATAL

SEQ ID NO: 145036 - protein, 20 aa, Mycobacterium avium
IGTRIELRLGDPADSEIDRR

SEQ ID NO: 145037 - protein, 22 aa, Mycobacterium avium
IKDANAIAAAWNDVVLSPDTSL

SEQ ID NO: 145038 - protein, 17 aa, Mycobacterium avium
IKPGRSYTARQLLDALL

SEQ ID NO: 145039 - protein, 18 aa, Mycobacterium avium
IKRVVRDLPPGYEVTTGI

SEQ ID NO: 145040 - protein, 26 aa, Mycobacterium avium
ILGIEALTRWQHPTLGLLMPDSFIQV

SEQ ID NO: 145041 - protein, 27 aa, Mycobacterium avium
ILGPLQWKSTARPLAAIVRSDNGGVYV

SEQ ID NO: 145042 - protein, 19 aa, Mycobacterium avium
ILGPPGTTGVVNWMDAESL

SEQ ID NO: 145043 - protein, 18 aa, Mycobacterium avium
ILPTDAAFMTRSCGIWRK

SEQ ID NO: 145044 - protein, 23 aa, Mycobacterium avium
IMRDCSNTAIGVWSENSLDRSVV

SEQ ID NO: 145045 - protein, 17 aa, Mycobacterium avium
INMLGAIAVPLNFRLTA

SEQ ID NO: 145046 - protein, 17 aa, Mycobacterium avium
INRLIPALVKSTAGNSI

SEQ ID NO: 145047 - protein, 24 aa, Mycobacterium avium
INSNRYDPLVPWTAANQLGRDWCA

SEQ ID NO: 145048 - protein, 24 aa, Mycobacterium avium
INWGARGPLQWEAPYGHTLISKYA

SEQ ID NO: 145049 - protein, 17 aa, Mycobacterium avium
IPAGGLFSGAEGKMSAD

SEQ ID NO: 145050 - protein, 23 aa, Mycobacterium avium
IPAPLLATMFDFFYQPGKMPASL

SEQ ID NO: 145051 - protein, 19 aa, Mycobacterium avium
IPLPGGGALMKIPGEGDLL

SEQ ID NO: 145052 - protein, 21 aa, Mycobacterium avium
IPLPPDQNGYVFIETKSGSTR

SEQ ID NO: 145053 - protein, 23 aa, Mycobacterium avium
IQREVVARTGLRDCRTHGRTWDL

SEQ ID NO: 145054 - protein, 23 aa, Mycobacterium avium
IQVRMLTVVGGYYVNLVSLGNKP

SEQ ID NO: 145055 - protein, 21 aa, Mycobacterium avium
IRAGESVSYGHTWTAQRDTNL

SEQ ID NO: 145056 - protein, 19 aa, Mycobacterium avium
IRLLSRIAAALDEVGEWNV

SEQ ID NO: 145057 - protein, 20 aa, Mycobacterium avium
IRMPAFGLDGPWRDRVGFAQ

SEQ ID NO: 145058 - protein, 17 aa, Mycobacterium avium
ISDGSIWDAIAGCEAGG

SEQ ID NO: 145059 - protein, 17 aa, Mycobacterium avium
ISSTAGWVARPNTAVYS

SEQ ID NO: 145060 - protein, 23 aa, Mycobacterium avium
ITGPKFAGPVNKHLVFVNQGGNW

SEQ ID NO: 145061 - protein, 24 aa, Mycobacterium avium
ITGPKFAGPVNKHLVFVNQGGNWV

SEQ ID NO: 145062 - protein, 24 aa, Mycobacterium avium
ITGPKFAGPVTKHLAFVNQGGNWV

SEQ ID NO: 145063 - protein, 18 aa, Mycobacterium avium
ITRDLWPAPELIMDTGNS

SEQ ID NO: 145064 - protein, 17 aa, Mycobacterium avium
ITSAKYGSAIPPRGTEA

SEQ ID NO: 145065 - protein, 24 aa, Mycobacterium avium
ITTRTGTKYAVRWQDYDTGAPITA

SEQ ID NO: 145066 - protein, 17 aa, Mycobacterium avium
IVLAWAAQSGRYPEFNA

SEQ ID NO: 145067 - protein, 23 aa, Mycobacterium avium
IVPEPRPGPALNGRSVDQVLQQC

SEQ ID NO: 145068 - protein, 17 aa, Mycobacterium avium
IYDALHAGDESSGGYNA

SEQ ID NO: 145069 - protein, 19 aa, Mycobacterium avium
IYRNPWMVLREDDIRRPDG

SEQ ID NO: 145070 - protein, 25 aa, Mycobacterium avium
KAAKNGDLPLSFDVTNIQPTASGAA

SEQ ID NO: 145071 - protein, 24 aa, Mycobacterium avium
KAGGLPGDLTFSWYAVDKTHQPWV

SEQ ID NO: 145072 - protein, 19 aa, Mycobacterium avium
KAGQFDAVMTALGDDDPDD

SEQ ID NO: 145073 - protein, 21 aa, Mycobacterium avium
KALPGLGGLGGMLGGGAAAAH

SEQ ID NO: 145074 - protein, 18 aa, Mycobacterium avium
KASTLRLDGLTVVVDCAH

SEQ ID NO: 145075 - protein, 20 aa, Mycobacterium avium
KAVEPITVCLAGDTRDSYSG

SEQ ID NO: 145076 - protein, 18 aa, Mycobacterium avium
KDIAQRLATRVAEAVSAA

SEQ ID NO: 145077 - protein, 17 aa, Mycobacterium avium
KDNIRCNAVAPGFTATE

SEQ ID NO: 145078 - protein, 17 aa, Mycobacterium avium
KELPDIYQVLARQGLNG

SEQ ID NO: 145079 - protein, 17 aa, Mycobacterium avium
KFEFSNGYATVTIETTA

SEQ ID NO: 145080 - protein, 24 aa, Mycobacterium avium
KFTYLSAAHYCPKYITGEDRGPKP

SEQ ID NO: 145081 - protein, 21 aa, Mycobacterium avium
KGEEIVKRFPSSGPYKLQAVL

SEQ ID NO: 145082 - protein, 18 aa, Mycobacterium avium
KHRHMYRLMFGSTSAHGI

SEQ ID NO: 145083 - protein, 21 aa, Mycobacterium avium
KILGPQFLSRFYGRVINTHPA

SEQ ID NO: 145084 - protein, 23 aa, Mycobacterium avium
KKCLLELAELIGFDTAIDERAVE

SEQ ID NO: 145085 - protein, 23 aa, Mycobacterium avium
KKCLLELAELIGFDTAIDERAVQ

SEQ ID NO: 145086 - protein, 23 aa, Mycobacterium avium
KLDYRTYSAQGWTIVANADGTRF

SEQ ID NO: 145087 - protein, 25 aa, Mycobacterium avium
KLPPWNEVLQNLGFSNASTAVTRPA

SEQ ID NO: 145088 - protein, 18 aa, Mycobacterium avium
KLSGKRIIIDPGRGGADH

SEQ ID NO: 145089 - protein, 18 aa, Mycobacterium avium
KNALGRALLSTAAGSTPD

SEQ ID NO: 145090 - protein, 20 aa, Mycobacterium avium
KNFQYTAAAQKVWAQAGFRP

SEQ ID NO: 145091 - protein, 24 aa, Mycobacterium avium
KNLPDPRRIAALDEILCALGHHDD

SEQ ID NO: 145092 - protein, 23 aa, Mycobacterium avium
KNMLCAAAGALPVVSRGSALPTR

SEQ ID NO: 145093 - protein, 17 aa, Mycobacterium avium
KPGFAAALMNKDLGLAM

SEQ ID NO: 145094 - protein, 19 aa, Mycobacterium avium
KPGLKGEEIVKRFPSSGPY

SEQ ID NO: 145095 - protein, 24 aa, Mycobacterium avium
KPRRWLRRVPPRYGEHTAEVLTEL

SEQ ID NO: 145096 - protein, 20 aa, Mycobacterium avium
KRFPSSGPYKLQAVLDGGAV

SEQ ID NO: 145097 - protein, 23 aa, Mycobacterium avium
KRKKELSDVLVLVSRYTASLTEA

SEQ ID NO: 145098 - protein, 17 aa, Mycobacterium avium
KRRLGVLGYDDLLTRLA

SEQ ID NO: 145099 - protein, 21 aa, Mycobacterium avium
KSELLRTIALGMMARNSPDVL

SEQ ID NO: 145100 - protein, 27 aa, Mycobacterium avium
KSSRYPGGLALRFARVLRYRDDKGPAE

SEQ ID NO: 145101 - protein, 18 aa, Mycobacterium avium
KSSYAGKVNGDWRPVAVG

SEQ ID NO: 145102 - protein, 22 aa, Mycobacterium avium
KTLPDFPRLWARMLDTSLPDGE

SEQ ID NO: 145103 - protein, 23 aa, Mycobacterium avium
KTLQLCAVGDPICGTGGGDDLAA

SEQ ID NO: 145104 - protein, 23 aa, Mycobacterium avium
KTLQLCAVGDPICGTGGGNDLAA

SEQ ID NO: 145105 - protein, 25 aa, Mycobacterium avium
KVKLPAGALCGKLAVPVDYDHLDGD

SEQ ID NO: 145106 - protein, 26 aa, Mycobacterium avium
LAAAAPCPHGGCPGGAAPKPTGPARV

SEQ ID NO: 145107 - protein, 19 aa, Mycobacterium avium
LAAAAPDWYAHLVEHQDVL

SEQ ID NO: 145108 - protein, 23 aa, Mycobacterium avium
LAAARRLGAHQAYTPQQAVEARV

SEQ ID NO: 145109 - protein, 18 aa, Mycobacterium avium
LAAVICIAAVLSGCGGKP

SEQ ID NO: 145110 - protein, 22 aa, Mycobacterium avium
LADLVSHFGVNFGFLRHNDHSI

SEQ ID NO: 145111 - protein, 21 aa, Mycobacterium avium
LAEERRLLVAAMGRARRRLLV

SEQ ID NO: 145112 - protein, 17 aa, Mycobacterium avium
LAKQFGVRLPPRRPFGR

SEQ ID NO: 145113 - protein, 18 aa, Mycobacterium avium
LAPGGAGCVIAEDHGAGE

SEQ ID NO: 145114 - protein, 21 aa, Mycobacterium avium
LAQNRIRTWSDWFENNSRSAR

SEQ ID NO: 145115 - protein, 19 aa, Mycobacterium avium
LAQVRARSLAAYDHQDVPF

SEQ ID NO: 145116 - protein, 19 aa, Mycobacterium avium
LARLREWEAAGGPVIEEAV

SEQ ID NO: 145117 - protein, 18 aa, Mycobacterium avium
LARYKLPKAIVFRPVIER

SEQ ID NO: 145118 - protein, 17 aa, Mycobacterium avium
LASALGGMSLWLAPTSA

SEQ ID NO: 145119 - protein, 18 aa, Mycobacterium avium
LATARRLLAEGGTVVGVD

SEQ ID NO: 145120 - protein, 26 aa, Mycobacterium avium
LATLSGCGFRGLNSFNLPGTKGGGPG

SEQ ID NO: 145121 - protein, 26 aa, Mycobacterium avium
LAVGLFRAAPWPGVAPLTLFGHSMGG

SEQ ID NO: 145122 - protein, 18 aa, Mycobacterium avium
LAVPASWTSVIPAAHSAV

SEQ ID NO: 145123 - protein, 19 aa, Mycobacterium avium
LDAAGWKPGGDGVREKDGK

SEQ ID NO: 145124 - protein, 22 aa, Mycobacterium avium
LDAFTLRVGRPVAPMLAQTAAG

SEQ ID NO: 145125 - protein, 17 aa, Mycobacterium avium
LDALIRVVDRVVDEQVP

SEQ ID NO: 145126 - protein, 19 aa, Mycobacterium avium
LDELVGFFVNTLVLRVDLA

SEQ ID NO: 145127 - protein, 22 aa, Mycobacterium avium
LDFMFRHIQPYFTEDINQLVNE

SEQ ID NO: 145128 - protein, 20 aa, Mycobacterium avium
LDGIRPAQSLALVPLAAGGL

SEQ ID NO: 145129 - protein, 23 aa, Mycobacterium avium
LDGIRPAQSLALVPLAAGGLHAS

SEQ ID NO: 145130 - protein, 27 aa, Mycobacterium avium
LDGPLFKFALLQTRVDEFYLFVCCHHI

SEQ ID NO: 145131 - protein, 19 aa, Mycobacterium avium
LDGRAAVYSRVQAVATGMF

SEQ ID NO: 145132 - protein, 18 aa, Mycobacterium avium
LDIPEQIARAGARGIRQA

SEQ ID NO: 145133 - protein, 18 aa, Mycobacterium avium
LDLLDRRQVSALVVNPQT

SEQ ID NO: 145134 - protein, 22 aa, Mycobacterium avium
LDPASASAWAAFTGEHPKDHIA

SEQ ID NO: 145135 - protein, 17 aa, Mycobacterium avium
LDPERFSDLNLANKVAN

SEQ ID NO: 145136 - protein, 17 aa, Mycobacterium avium
LDSAPPVFVAPVYGYLV

SEQ ID NO: 145137 - protein, 18 aa, Mycobacterium avium
LDSKHNWQITDVGGIDAA

SEQ ID NO: 145138 - protein, 23 aa, Mycobacterium avium
LDTGSPYALEYVWGRQVGDNTIN

SEQ ID NO: 145139 - protein, 17 aa, Mycobacterium avium
LDVEGIFAGLERFSPEP

SEQ ID NO: 145140 - protein, 17 aa, Mycobacterium avium
LDYWQMWHYGDSTMAGV

SEQ ID NO: 145141 - protein, 21 aa, Mycobacterium avium
LELTSAAAMRAAVLAGAGPAA

SEQ ID NO: 145142 - protein, 22 aa, Mycobacterium avium
LELTSAAAMRAAVLAGAGPAAM

SEQ ID NO: 145143 - protein, 24 aa, Mycobacterium avium
LESPEVYQFVVLFPSPEQASAFLS

SEQ ID NO: 145144 - protein, 25 aa, Mycobacterium avium
LESPEVYQFVVLFPSPEQASAFLSA

SEQ ID NO: 145145 - protein, 23 aa, Mycobacterium avium
LETLERYGWIVVRVIAEDRPDEI

SEQ ID NO: 145146 - protein, 24 aa, Mycobacterium avium
LFTKGGPYLARGAHDLVPTAQLLD

SEQ ID NO: 145147 - protein, 17 aa, Mycobacterium avium
LGAGVAWFDTKLHREPV

SEQ ID NO: 145148 - protein, 22 aa, Mycobacterium avium
LGAPKRRAVLAMLLIHRNRPVS

SEQ ID NO: 145149 - protein, 17 aa, Mycobacterium avium
LGDIGHDIMLIIDGDAW

SEQ ID NO: 145150 - protein, 23 aa, Mycobacterium avium
LGDLLSRPGVFVFGSNDYFGPHL

SEQ ID NO: 145151 - protein, 17 aa, Mycobacterium avium
LGETVGEVFATLHREHR

SEQ ID NO: 145152 - protein, 18 aa, Mycobacterium avium
LGKDTRALIKVMTILGSR

SEQ ID NO: 145153 - protein, 19 aa, Mycobacterium avium
LGLLFGRPKSNLTFAQNDA

SEQ ID NO: 145154 - protein, 19 aa, Mycobacterium avium
LGLRPRWIDSTAVGGASWE

SEQ ID NO: 145155 - protein, 17 aa, Mycobacterium avium
LGLTAPFNIDDVAQVIR

SEQ ID NO: 145156 - protein, 18 aa, Mycobacterium avium
LGPPGTTGVVNWMDAESL

SEQ ID NO: 145157 - protein, 19 aa, Mycobacterium avium
LGREWDFVVIAGLQDGLWP

SEQ ID NO: 145158 - protein, 17 aa, Mycobacterium avium
LGSGLVISQWCRPPKGA

SEQ ID NO: 145159 - protein, 17 aa, Mycobacterium avium
LGTISWQPRVPAVAVHA

SEQ ID NO: 145160 - protein, 24 aa, Mycobacterium avium
LHAAASRWHGFAAAMNGVQGTLNA

SEQ ID NO: 145161 - protein, 28 aa, Mycobacterium avium
LHGSLFEFRCARCAKPYTGELPAMAEPA

SEQ ID NO: 145162 - protein, 20 aa, Mycobacterium avium
LHPRIDIISSLAGRVPDPAL

SEQ ID NO: 145163 - protein, 17 aa, Mycobacterium avium
LIAVLDMGWEDYLVAAE

SEQ ID NO: 145164 - protein, 19 aa, Mycobacterium avium
LIDATRGTVHLVIGGGGTS

SEQ ID NO: 145165 - protein, 19 aa, Mycobacterium avium
LIFAAARAGVAFTPINYRL

SEQ ID NO: 145166 - protein, 17 aa, Mycobacterium avium
LILFRRAGAPAALADSV

SEQ ID NO: 145167 - protein, 17 aa, Mycobacterium avium
LIVGLDIGSNLFSFRDP

SEQ ID NO: 145168 - protein, 20 aa, Mycobacterium avium
LIVSRLHKIFGSEDLNANAG

SEQ ID NO: 145169 - protein, 18 aa, Mycobacterium avium
LKAAAGVVNACRKCGALI

SEQ ID NO: 145170 - protein, 17 aa, Mycobacterium avium
LKDVVAREQRRIIDDQL

SEQ ID NO: 145171 - protein, 32 aa, Mycobacterium avium
LKPGLKGEEILKRFPSSGPYKLQAVLDGGAVV

SEQ ID NO: 145172 - protein, 32 aa, Mycobacterium avium
LKPGLKGEEIVKRFPSSGPYKLQAVLDGGAVV

SEQ ID NO: 145173 - protein, 18 aa, Mycobacterium avium
LKQNYFFDMRTIRRGRVD

SEQ ID NO: 145174 - protein, 19 aa, Mycobacterium avium
LLAGLGAGVVVNGRDPQAV

SEQ ID NO: 145175 - protein, 19 aa, Mycobacterium avium
LLAGLGAGVVVSGRDPQAV

SEQ ID NO: 145176 - protein, 17 aa, Mycobacterium avium
LLAGLSVHAARIAENLA

SEQ ID NO: 145177 - protein, 27 aa, Mycobacterium avium
LLGACQQWSEAAGHTTVRVRLTDGPHI

SEQ ID NO: 145178 - protein, 25 aa, Mycobacterium avium
LLGACQQWSETAGHTTVRVRLTDGP

SEQ ID NO: 145179 - protein, 25 aa, Mycobacterium avium
LLGACQQWSETAGHTTVRVRLTDGS

SEQ ID NO: 145180 - protein, 19 aa, Mycobacterium avium
LLGGMAMGIVGAPSAAAAP

SEQ ID NO: 145181 - protein, 19 aa, Mycobacterium avium
LLHKVIRLLSRIAAALDEV

SEQ ID NO: 145182 - protein, 20 aa, Mycobacterium avium
LLHKVIRLLSRIAAALDEVG

SEQ ID NO: 145183 - protein, 20 aa, Mycobacterium avium
LLPDRLAHMANRWKAIAFST

SEQ ID NO: 145184 - protein, 17 aa, Mycobacterium avium
LLQGPRFVGTGPQVADQ

SEQ ID NO: 145185 - protein, 24 aa, Mycobacterium avium
LLVDFKGGATFLDYANARHVAAVI

SEQ ID NO: 145186 - protein, 17 aa, Mycobacterium avium
LMILPPLIHGAAQWSVM

SEQ ID NO: 145187 - protein, 18 aa, Mycobacterium avium
LMILPPLIHGAAQWSVMT

SEQ ID NO: 145188 - protein, 21 aa, Mycobacterium avium
LMQTSACWRALSAAPHPRCRR

SEQ ID NO: 145189 - protein, 17 aa, Mycobacterium avium
LNAHPLQAARIVADASG

SEQ ID NO: 145190 - protein, 17 aa, Mycobacterium avium
LNDGYNWKGDPNATLSG

SEQ ID NO: 145191 - protein, 21 aa, Mycobacterium avium
LNDNRVDAIVGWHQAGGNLAT

SEQ ID NO: 145192 - protein, 17 aa, Mycobacterium avium
LNLPPACTTGFLPPAQR

SEQ ID NO: 145193 - protein, 17 aa, Mycobacterium avium
LNSLRWNPAGGDTLRPL

SEQ ID NO: 145194 - protein, 18 aa, Mycobacterium avium
LNSLRWNPAGGDTLRPLL

SEQ ID NO: 145195 - protein, 20 aa, Mycobacterium avium
LNYVWDINVCHTWYVVPDGW

SEQ ID NO: 145196 - protein, 18 aa, Mycobacterium avium
LNYVWDMNVCHTWYVVPD

SEQ ID NO: 145197 - protein, 17 aa, Mycobacterium avium
LPAAAAALTRLGYEADM

SEQ ID NO: 145198 - protein, 17 aa, Mycobacterium avium
LPAGRLRDALGVREVAY

SEQ ID NO: 145199 - protein, 21 aa, Mycobacterium avium
LPAQRVDESLVRVATMKGRGP

SEQ ID NO: 145200 - protein, 20 aa, Mycobacterium avium
LPASGGAVFGEMAAASLAGR

SEQ ID NO: 145201 - protein, 24 aa, Mycobacterium avium
LPGNPRVLSIAQFWDRAANHDRIS

SEQ ID NO: 145202 - protein, 22 aa, Mycobacterium avium
LPGPRAAAGVAGMSVFLDPGHN

SEQ ID NO: 145203 - protein, 18 aa, Mycobacterium avium
LPIGQGLSMTLLQMTGMY

SEQ ID NO: 145204 - protein, 26 aa, Mycobacterium avium
LPLASIFKLYVLHALAGAVTAGRVSW

SEQ ID NO: 145205 - protein, 19 aa, Mycobacterium avium
LPLTERRLGIAVSASASAP

SEQ ID NO: 145206 - protein, 18 aa, Mycobacterium avium
LPQTYALLGRTPRRALRL

SEQ ID NO: 145207 - protein, 25 aa, Mycobacterium avium
LPSDFDFVLNLAVAKSGSWDKDLAA

SEQ ID NO: 145208 - protein, 29 aa, Mycobacterium avium
LPSRPEPHALLGNAFHAWVQKFYGAECLF

SEQ ID NO: 145209 - protein, 23 aa, Mycobacterium avium
LPTRAELLAALSVAIDLGLGQPA

SEQ ID NO: 145210 - protein, 17 aa, Mycobacterium avium
LPTTLIFDADGRQRYRS

SEQ ID NO: 145211 - protein, 22 aa, Mycobacterium avium
LPVAGVAHAECNQDVGQSIDSY

SEQ ID NO: 145212 - protein, 17 aa, Mycobacterium avium
LQAAFLESPWAARTPVA

SEQ ID NO: 145213 - protein, 33 aa, Mycobacterium avium; identical to SEQ ID NO: 100412

SEQ ID NO: 145214 - protein, 17 aa, Mycobacterium avium
LQGIGFAVSRRTMMRRL

SEQ ID NO: 145215 - protein, 25 aa, Mycobacterium avium
LQMMSTVLGRRVWENAGSPEVDSNR

SEQ ID NO: 145216 - protein, 19 aa, Mycobacterium avium
LQPTLPIVLANLVSVTEVL

SEQ ID NO: 145217 - protein, 21 aa, Mycobacterium avium
LQRAQRAACDAVRPGVTAEQV

SEQ ID NO: 145218 - protein, 21 aa, Mycobacterium avium
LQRQWLHARSLSFAHPADGRR

SEQ ID NO: 145219 - protein, 18 aa, Mycobacterium avium
LRAGDALLAQRFFRATAQ

SEQ ID NO: 145220 - protein, 27 aa, Mycobacterium avium
LRAVNIGAVLPPLAVGAKCTAAALSPG

SEQ ID NO: 145221 - protein, 25 aa, Mycobacterium avium
LRDLASRIFTDFTYRSGSTTISTGV

SEQ ID NO: 145222 - protein, 21 aa, Mycobacterium avium
LREIDGLLPTLVRGQGTEFDS

SEQ ID NO: 145223 - protein, 17 aa, Mycobacterium avium
LRGAAATMPRRLAIAAV

SEQ ID NO: 145224 - protein, 19 aa, Mycobacterium avium
LRGLRMVKEECEVDALRKA

SEQ ID NO: 145225 - protein, 17 aa, Mycobacterium avium
LRGSEEVLGILLSAIDS

SEQ ID NO: 145226 - protein, 19 aa, Mycobacterium avium
LRGVLVVSPHTSWLDVFAI

SEQ ID NO: 145227 - protein, 17 aa, Mycobacterium avium
LRGVVCAPDGAVDELER

SEQ ID NO: 145228 - protein, 18 aa, Mycobacterium avium
LRHDWPEALRQAGFDASA

SEQ ID NO: 145229 - protein, 20 aa, Mycobacterium avium
LRLLLAVLLAPGWPLLAVPL

SEQ ID NO: 145230 - protein, 20 aa, Mycobacterium avium
LRLNTRVCALDAAGHTVGLP

SEQ ID NO: 145231 - protein, 21 aa, Mycobacterium avium
LRLRDHDGWPLYPMRPDHTYV

SEQ ID NO: 145232 - protein, 21 aa, Mycobacterium avium
LRMHQRWPIVMVDEFQDTDPV

SEQ ID NO: 145233 - protein, 18 aa, Mycobacterium avium
LRPDSAVVLVLVDQSTTS

SEQ ID NO: 145234 - protein, 17 aa, Mycobacterium avium
LRQAAILEVQRARTVID

SEQ ID NO: 145235 - protein, 20 aa, Mycobacterium avium
LRRLIPPWVTLGSRLAALPK

SEQ ID NO: 145236 - protein, 18 aa, Mycobacterium avium
LRSRCRHVALVTPSTEAI

SEQ ID NO: 145237 - protein, 19 aa, Mycobacterium avium
LRSRRRGVLAGFSAAALHG

SEQ ID NO: 145238 - protein, 21 aa, Mycobacterium avium
LRTLQKLGWIVVRVIAEDKPD

SEQ ID NO: 145239 - protein, 18 aa, Mycobacterium avium
LRVGQPVVAIGSPLGLSG

SEQ ID NO: 145240 - protein, 23 aa, Mycobacterium avium
LSASRWADIRPALRDQIGTRIEL

SEQ ID NO: 145241 - protein, 18 aa, Mycobacterium avium
LSEARGPLHTDLQALQCP

SEQ ID NO: 145242 - protein, 24 aa, Mycobacterium avium
LSGIDRIHHKLGFNIAMPVQPGHG

SEQ ID NO: 145243 - protein, 17 aa, Mycobacterium avium
LSLIEIVGHHGEHAETP

SEQ ID NO: 145244 - protein, 18 aa, Mycobacterium avium
LSLIEIVGHHGERAETPG

SEQ ID NO: 145245 - protein, 28 aa, Mycobacterium avium
LSLLTPRLAQLIAIGGFRNWDRMVKRYL

SEQ ID NO: 145246 - protein, 17 aa, Mycobacterium avium
LSLYTLPISGFGKDPNG

SEQ ID NO: 145247 - protein, 18 aa, Mycobacterium avium
LSPQRPVPSVPITDLVRQ

SEQ ID NO: 145248 - protein, 17 aa, Mycobacterium avium
LSRRYGNVFTLRLPMWG

SEQ ID NO: 145249 - protein, 26 aa, Mycobacterium avium
LSVPPGWTTAAPVLRTVTSVLPAASS

SEQ ID NO: 145250 - protein, 19 aa, Mycobacterium avium
LTACIDPVLNRGFVLEPSG

SEQ ID NO: 145251 - protein, 20 aa, Mycobacterium avium
LTAELALALGAAAARQLASG

SEQ ID NO: 145252 - protein, 17 aa, Mycobacterium avium
LTALAAAMAVTTATAGC

SEQ ID NO: 145253 - protein, 32 aa, Mycobacterium avium
LTGDGRGTVYLATRGGYFVLDLATGRVVRVGV

SEQ ID NO: 145254 - protein, 19 aa, Mycobacterium avium
LTGWLAYRGYQSHQADEQR

SEQ ID NO: 145255 - protein, 17 aa, Mycobacterium avium
LTPFGAPPQSADANAAA

SEQ ID NO: 145256 - protein, 22 aa, Mycobacterium avium
LTRRPDYAWPPSSWPNQGPAYV

SEQ ID NO: 145257 - protein, 19 aa, Mycobacterium avium
LTVGTAFPAADYLAHPGAS

SEQ ID NO: 145258 - protein, 26 aa, Mycobacterium avium
LTYSEDWLRPDYVPPHPDSPPTGDAP

SEQ ID NO: 145259 - protein, 20 aa, Mycobacterium avium
LVAVAEGKNALGRALLSTAA

SEQ ID NO: 145260 - protein, 20 aa, Mycobacterium avium
LVEPRLRVAITSGQCDGGQS

SEQ ID NO: 145261 - protein, 24 aa, Mycobacterium avium
LVGDELRAGPGLVYGYTAELDTAA

SEQ ID NO: 145262 - protein, 25 aa, Mycobacterium avium
LVIRGDRVLVGFSMPGKTIGAQSRS

SEQ ID NO: 145263 - protein, 18 aa, Mycobacterium avium
LVITPGYDLRYLVGSRAQ

SEQ ID NO: 145264 - protein, 17 aa, Mycobacterium avium
LVKSIRAGESVSYGHTW

SEQ ID NO: 145265 - protein, 20 aa, Mycobacterium avium
LVLRCFGVRITVSGNPIRNL

SEQ ID NO: 145266 - protein, 17 aa, Mycobacterium avium
LVPPSRYLAAPQATTAA

SEQ ID NO: 145267 - protein, 18 aa, Mycobacterium avium
LVPPSRYLAAPQATTAAT

SEQ ID NO: 145268 - protein, 20 aa, Mycobacterium avium
LVTARAIQLVPAYAGGPTLS

SEQ ID NO: 145269 - protein, 19 aa, Mycobacterium avium
LWDLPGWARAGHRLLDEMA

SEQ ID NO: 145270 - protein, 20 aa, Mycobacterium avium
LWDLPGWARAGHRLLDEMAA

SEQ ID NO: 145271 - protein, 22 aa, Mycobacterium avium
LYAEMRASLMTRLMPGASAIIV

SEQ ID NO: 145272 - protein, 25 aa, Mycobacterium avium
LYDVPRKVLDWPVRVLVAHNATRER

SEQ ID NO: 145273 - protein, 17 aa, Mycobacterium avium
LYGRVGDRLVLIGVGGI

SEQ ID NO: 145274 - protein, 18 aa, Mycobacterium avium
MAGYGRPAPAEVRDFVPG

SEQ ID NO: 145275 - protein, 25 aa, Mycobacterium avium
MARTWPDKRIDLYFPGETALRGHHP

SEQ ID NO: 145276 - protein, 25 aa, Mycobacterium avium
MARTWPDKRIDLYFPGETALSGHHP

SEQ ID NO: 145277 - protein, 23 aa, Mycobacterium avium
MAVPDVKGLVVGSNVLLRGVAVG

SEQ ID NO: 145278 - protein, 23 aa, Mycobacterium avium
MFFPEPRCRVLTGVGTFDPGLGR

SEQ ID NO: 145279 - protein, 19 aa, Mycobacterium avium
MFGANDFDTAAALRYMVDG

SEQ ID NO: 145280 - protein, 18 aa, Mycobacterium avium
MFNVLWALAPATPVMQAL

SEQ ID NO: 145281 - protein, 24 aa, Mycobacterium avium
MFTLGFRFKPWRSAKSIADGASIK

SEQ ID NO: 145282 - protein, 24 aa, Mycobacterium avium
MGADLCQQLSWGASPQQLEGLALQ

SEQ ID NO: 145283 - protein, 18 aa, Mycobacterium avium
MGLVPAMTVKCTVALVKS

SEQ ID NO: 145284 - protein, 19 aa, Mycobacterium avium
MGSEGQHWMSFPGNHGAVP

SEQ ID NO: 145285 - protein, 26 aa, Mycobacterium avium
MGSLPRLAAASGKTLGPRYGVIPTVM

SEQ ID NO: 145286 - protein, 26 aa, Mycobacterium avium
MGWEEWKVGVEFDGAQHWTDPAQRTR

SEQ ID NO: 145287 - protein, 30 aa, Mycobacterium avium
MHDYIWRWDTDWFWCSRAFGVQNPRVRRWW

SEQ ID NO: 145288 - protein, 20 aa, Mycobacterium avium
MINTTCSYDQAMRAVHAENQ

SEQ ID NO: 145289 - protein, 25 aa, Mycobacterium avium
MIVLCAGAGVGTWLLVGRGGPQRPE

SEQ ID NO: 145290 - protein, 21 aa, Mycobacterium avium
MKLFLIVAGFAAVIGLAVPAR

SEQ ID NO: 145291 - protein, 19 aa, Mycobacterium avium
MLARHVIRSLGSALVMAAS

SEQ ID NO: 145292 - protein, 17 aa, Mycobacterium avium
MLEAAVIAGLTSQGVDA

SEQ ID NO: 145293 - protein, 19 aa, Mycobacterium avium
MLGAIAVPLNFRLTAAEIA

SEQ ID NO: 145294 - protein, 19 aa, Mycobacterium avium
MLQQGWQRLVASILDCDKP

SEQ ID NO: 145295 - protein, 22 aa, Mycobacterium avium
MLTALAADWPLLHSPACAALLA

SEQ ID NO: 145296 - protein, 19 aa, Mycobacterium avium
MLVAVGFGFANACGVAHAL

SEQ ID NO: 145297 - protein, 23 aa, Mycobacterium avium
MNTEVTSGLGLLLNPVATIPVLA

SEQ ID NO: 145298 - protein, 19 aa, Mycobacterium avium
MPIAALIIIAAGSQLSPAP

SEQ ID NO: 145299 - protein, 17 aa, Mycobacterium avium
MPYAKIATRGGVVPLTN

SEQ ID NO: 145300 - protein, 20 aa, Mycobacterium avium
MQDRLVWQAASLLLAYPDDG

SEQ ID NO: 145301 - protein, 25 aa, Mycobacterium avium
MQTLTDCPLRWLAERHGGTDPRDLR

SEQ ID NO: 145302 - protein, 31 aa, Mycobacterium avium; identical to SEQ ID NO: 90099

SEQ ID NO: 145303 - protein, 20 aa, Mycobacterium avium
MSAMFPGTQILAAFGQTEMS

SEQ ID NO: 145304 - protein, 30 aa, Mycobacterium avium
MSDLPGELMGALSQGLSQFGINLPPVPALS

SEQ ID NO: 145305 - protein, 31 aa, Mycobacterium avium
MSDLPGELMGALSQGLSQFGINLPPVPALSG

SEQ ID NO: 145306 - protein, 22 aa, Mycobacterium avium
MSNLGLHLAMRSAGITVRTTGV

SEQ ID NO: 145307 - protein, 19 aa, Mycobacterium avium
MTTRPFMEFHLRRRVKSLP

SEQ ID NO: 145308 - protein, 17 aa, Mycobacterium avium
MVDNVLPTGVRIADADR

SEQ ID NO: 145309 - protein, 22 aa, Mycobacterium avium
MVLTSCGWKGISNVSIPGGPGS

SEQ ID NO: 145310 - protein, 17 aa, Mycobacterium avium
NAAALSYDKVVTALASE

SEQ ID NO: 145311 - protein, 20 aa, Mycobacterium avium
NAAISALVLPSAFRPVPDPN

SEQ ID NO: 145312 - protein, 23 aa, Mycobacterium avium
NAAPQLPGLPALSQLSPLIQQAA

SEQ ID NO: 145313 - protein, 24 aa, Mycobacterium avium
NADRFGIQDAIWRGVYYTPNGAQT

SEQ ID NO: 145314 - protein, 17 aa, Mycobacterium avium
NAGKRESGVVFQQFEGG

SEQ ID NO: 145315 - protein, 25 aa, Mycobacterium avium
NAGKRESGVVFQQFEGGVITAKNDA

SEQ ID NO: 145316 - protein, 25 aa, Mycobacterium avium
NANGLKIVSCYQYGKGNTADWLGGA

SEQ ID NO: 145317 - protein, 26 aa, Mycobacterium avium
NANHVSAVLGRRSLQIAGLVANSNAL

SEQ ID NO: 145318 - protein, 25 aa, Mycobacterium avium
NANHVSAVLGRRSQQIAGLVANSHA

SEQ ID NO: 145319 - protein, 25 aa, Mycobacterium avium
NANHVSAVLGRRSQQIAGLVANSNA

SEQ ID NO: 145320 - protein, 23 aa, Mycobacterium avium
NAPDRSKGVVVLLFTEGKALATL

SEQ ID NO: 145321 - protein, 22 aa, Mycobacterium avium
NAPLPWSAQFTGFGGEVFTVSA

SEQ ID NO: 145322 - protein, 20 aa, Mycobacterium avium
NAPLPWSTQFTGFGGEVFTV

SEQ ID NO: 145323 - protein, 24 aa, Mycobacterium avium
NAVATRAATLWRFTAGAVDQPNPV

SEQ ID NO: 145324 - protein, 22 aa, Mycobacterium avium
NDGQWGGAMLVAAKSATPSPDN

SEQ ID NO: 145325 - protein, 25 aa, Mycobacterium avium
NDSVSCPRSGEVIVREQGHWYSTGA

SEQ ID NO: 145326 - protein, 36 aa, Mycobacterium avium
NFTFPMEFTPFQGGWQLSRHTAETLLALGKSPQAPT

SEQ ID NO: 145327 - protein, 28 aa, Mycobacterium avium
NGMWGAPQLGRWKWHDPYVHASLLAQNN

SEQ ID NO: 145328 - protein, 30 aa, Mycobacterium avium
NGMWGAPQLGRWKWHDPYVHASLLAQNNTR

SEQ ID NO: 145329 - protein, 28 aa, Mycobacterium avium
NGMWGVPQLGRWKWHDPYVHASLLAQNN

SEQ ID NO: 145330 - protein, 25 aa, Mycobacterium avium
NGYHVGGIFIGSWTDLTIFRGPLGD

SEQ ID NO: 145331 - protein, 17 aa, Mycobacterium avium
NHVSSVVLFGMPNVRAM

SEQ ID NO: 145332 - protein, 21 aa, Mycobacterium avium
NIDRGRQLAVLTCGQSPDPKG

SEQ ID NO: 145333 - protein, 18 aa, Mycobacterium avium
NIDTKFGYNNAVGAGTGI

SEQ ID NO: 145334 - protein, 30 aa, Mycobacterium avium
NITGFDCSGLMRYGFAGVGVLIPRFSGDQY

SEQ ID NO: 145335 - protein, 21 aa, Mycobacterium avium
NIVGGPMGWESVFTQPGQGDW

SEQ ID NO: 145336 - protein, 18 aa, Mycobacterium avium
NKRPPLRVGSVTNGQTAH

SEQ ID NO: 145337 - protein, 24 aa, Mycobacterium avium
NMNTEVTSGLGLLLNPVATIPVLA

SEQ ID NO: 145338 - protein, 29 aa, Mycobacterium avium
NPKRIGSFADLTRPGLTVVTCQRPVPCGA

SEQ ID NO: 145339 - protein, 17 aa, Mycobacterium avium
NQIPTVFYGAHVRPGNY

SEQ ID NO: 145340 - protein, 18 aa, Mycobacterium avium
NQIPTVFYGAHVRPGNYA

SEQ ID NO: 145341 - protein, 24 aa, Mycobacterium avium
NQQHTPSLLAMVPGLPPLPNFSFL

SEQ ID NO: 145342 - protein, 19 aa, Mycobacterium avium
NRVAVPVDLRHDWPEALRQ

SEQ ID NO: 145343 - protein, 23 aa, Mycobacterium avium
NSPQRFQVTASRFGRSLDVAAAV

SEQ ID NO: 145344 - protein, 18 aa, Mycobacterium avium
NTVPRGGVLGTQRLLDVL

SEQ ID NO: 145345 - protein, 17 aa, Mycobacterium avium
NVTALPPYLESAYQEFM

SEQ ID NO: 145346 - protein, 29 aa, Mycobacterium avium
PAAAGDLHLEWPLRPPPVVVRAFEAPAQD

SEQ ID NO: 145347 - protein, 20 aa, Mycobacterium avium
PAAHRVWLPPLGRPPELCTL

SEQ ID NO: 145348 - protein, 19 aa, Mycobacterium avium
PAAKFTLEVYPRYLKLIPS

SEQ ID NO: 145349 - protein, 18 aa, Mycobacterium avium
PAAPWRRSPGKTAAVAGA

SEQ ID NO: 145350 - protein, 24 aa, Mycobacterium avium
PAAVGDWMLLAAIQALIDGHEYLA

SEQ ID NO: 145351 - protein, 22 aa, Mycobacterium avium
PACTTGFLPPAQRRSAALEDYP

SEQ ID NO: 145352 - protein, 24 aa, Mycobacterium avium
PADAKAVIVASNLVSARYVQLSPA

SEQ ID NO: 145353 - protein, 24 aa, Mycobacterium avium
PADPAVDVLDRFRAAGTVDPKPAA

SEQ ID NO: 145354 - protein, 21 aa, Mycobacterium avium
PAEEPREPVSVPAGGVHDPVA

SEQ ID NO: 145355 - protein, 17 aa, Mycobacterium avium
PAFEWYYQSGLSVIMPV

SEQ ID NO: 145356 - protein, 17 aa, Mycobacterium avium
PAFLAFPATMLVSTVAA

SEQ ID NO: 145357 - protein, 19 aa, Mycobacterium avium
PAGLPSVFVYDGHPGGAGF

SEQ ID NO: 145358 - protein, 17 aa, Mycobacterium avium
PAIAVAGMLSRPGEYDE

SEQ ID NO: 145359 - protein, 21 aa, Mycobacterium avium
PAKKMPAFADFVGYDHSEVSG

SEQ ID NO: 145360 - protein, 25 aa, Mycobacterium avium
PAKLWTIADLGGWSAADPQLFDKNT

SEQ ID NO: 145361 - protein, 17 aa, Mycobacterium avium
PALAAPALRGATAGLGG

SEQ ID NO: 145362 - protein, 19 aa, Mycobacterium avium
PALHLLPLAGVLGVLPVLA

SEQ ID NO: 145363 - protein, 34 aa, Mycobacterium avium
PALTRSLGFLGTFPFPAETLSKWIRGDYANLTAV

SEQ ID NO: 145364 - protein, 17 aa, Mycobacterium avium
PAPRARPPPVPRSRPPL

SEQ ID NO: 145365 - protein, 17 aa, Mycobacterium avium
PAQRRSAALEDYPPPPD

SEQ ID NO: 145366 - protein, 18 aa, Mycobacterium avium
PAQSLALVPLAAGGLHAS

SEQ ID NO: 145367 - protein, 37 aa, Mycobacterium avium; identical to SEQ ID NO: 90310

SEQ ID NO: 145368 - protein, 27 aa, Mycobacterium avium
PAVLANRARLLVLIATNFFGQNTAAIA

SEQ ID NO: 145369 - protein, 17 aa, Mycobacterium avium
PCAAELPAMAEYQRRAG

SEQ ID NO: 145370 - protein, 17 aa, Mycobacterium avium
PCAQAALQETIVRSDDL

SEQ ID NO: 145371 - protein, 18 aa, Mycobacterium avium
PCDRVRRVVDQVCADLGG

SEQ ID NO: 145372 - protein, 19 aa, Mycobacterium avium
PCTRCRRSDARGPAARPAG

SEQ ID NO: 145373 - protein, 19 aa, Mycobacterium avium
PDAASRLLALIVGTGGDAT

SEQ ID NO: 145374 - protein, 24 aa, Mycobacterium avium
PDDGFVAVIYRWARTADLAAALAA

SEQ ID NO: 145375 - protein, 21 aa, Mycobacterium avium
PDGDLYCRVPQDAPFNVRGAR

SEQ ID NO: 145376 - protein, 28 aa, Mycobacterium avium
PDIAVDMLEMLPTPWGLVRSGVAPDHPK

SEQ ID NO: 145377 - protein, 23 aa, Mycobacterium avium
PDLVVSAGFMKILGPQFLSRFYG

SEQ ID NO: 145378 - protein, 25 aa, Mycobacterium avium
PDPLPWHPLGMAIDVMIPDPESAQG

SEQ ID NO: 145379 - protein, 20 aa, Mycobacterium avium
PDRILAAAVCYQSGREPRPY

SEQ ID NO: 145380 - protein, 21 aa, Mycobacterium avium
PDSRRAVVAPLLLASAYHARL

SEQ ID NO: 145381 - protein, 26 aa, Mycobacterium avium
PDTEFGTRWFADKAFWVKDGQNYLPF

SEQ ID NO: 145382 - protein, 18 aa, Mycobacterium avium
PDTLWTLIGGPRMWRRRP

SEQ ID NO: 145383 - protein, 17 aa, Mycobacterium avium
PDVDWLVVCMHQTAIST

SEQ ID NO: 145384 - protein, 17 aa, Mycobacterium avium
PDVQVVFARGTGEAPGV

SEQ ID NO: 145385 - protein, 19 aa, Mycobacterium avium
PDYPCHRRGIPQGRHVHNF

SEQ ID NO: 145386 - protein, 25 aa, Mycobacterium avium
PEATAEAFAGGWFHSGDLVRMDEDG

SEQ ID NO: 145387 - protein, 36 aa, Mycobacterium avium
PENLPRVSARGGPGGAPGCWQKITRDLWPAPELIMD

SEQ ID NO: 145388 - protein, 19 aa, Mycobacterium avium
PERLPAAEALAWGLVTAVY

SEQ ID NO: 145389 - protein, 18 aa, Mycobacterium avium
PERLPAAEALSWGLVTAV

SEQ ID NO: 145390 - protein, 27 aa, Mycobacterium avium
PESVNCPGDLPAKVGAQLNCEMKVKNR

SEQ ID NO: 145391 - protein, 20 aa, Mycobacterium avium
PEVMEYGAANGFTLAEMTAG

SEQ ID NO: 145392 - protein, 24 aa, Mycobacterium avium
PFGDRLVGWDTYRRLDLLPYLSAD

SEQ ID NO: 145393 - protein, 17 aa, Mycobacterium avium
PFNRRVALATFGIGALA

SEQ ID NO: 145394 - protein, 19 aa, Mycobacterium avium
PFVVDRWTPDKVYSGAYKA

SEQ ID NO: 145395 - protein, 26 aa, Mycobacterium avium
PGEPPRPAWDRPLPPPGGHWDYGPIN

SEQ ID NO: 145396 - protein, 25 aa, Mycobacterium avium
PGEVPARLEALGALGGLDRAALHSQ

SEQ ID NO: 145397 - protein, 24 aa, Mycobacterium avium
PGGPDHPGRPGGPGGPDHPGGPGG

SEQ ID NO: 145398 - protein, 19 aa, Mycobacterium avium
PGGPPRPGDCVLGTVDFKG

SEQ ID NO: 145399 - protein, 17 aa, Mycobacterium avium
PGHRRRLQEPDHRRQRH

SEQ ID NO: 145400 - protein, 17 aa, Mycobacterium avium
PGLGRKAPIYVIEDAPW

SEQ ID NO: 145401 - protein, 24 aa, Mycobacterium avium
PGSRWRCVNIPAISTAGVPDALGR

SEQ ID NO: 145402 - protein, 19 aa, Mycobacterium avium
PGVTRRRLLTTGAVSAALG

SEQ ID NO: 145403 - protein, 21 aa, Mycobacterium avium
PHHPGDTIAVHFRSVDGGERT

SEQ ID NO: 145404 - protein, 17 aa, Mycobacterium avium
PHTSWLDVFAIGAVLPG

SEQ ID NO: 145405 - protein, 24 aa, Mycobacterium avium
PHYGEPLDEHWDFADDPVDLDKIN

SEQ ID NO: 145406 - protein, 24 aa, Mycobacterium avium
PIELVKTSGGWRIDRLPNGVFLDW

SEQ ID NO: 145407 - protein, 18 aa, Mycobacterium avium
PIHGLGPRLAQLAAGAFF

SEQ ID NO: 145408 - protein, 21 aa, Mycobacterium avium
PIVVSVVNWADCLVAMQQREI

SEQ ID NO: 145409 - protein, 25 aa, Mycobacterium avium
PKAALRRWMDRYATFVATKRGMAES

SEQ ID NO: 145410 - protein, 18 aa, Mycobacterium avium
PKFPFPYDQMKGSVTDAE

SEQ ID NO: 145411 - protein, 25 aa, Mycobacterium avium
PKTALRRWMDRYANFVATKRGMAES

SEQ ID NO: 145412 - protein, 22 aa, Mycobacterium avium
PKTDAVRGWLAKTFSRNQNATR

SEQ ID NO: 145413 - protein, 19 aa, Mycobacterium avium
PKTSLTMLASRAGLVMDPG

SEQ ID NO: 145414 - protein, 17 aa, Mycobacterium avium
PKYGFRPTVMARPPFAG

SEQ ID NO: 145415 - protein, 26 aa, Mycobacterium avium
PLAYAWDMGAYAWPGPERRRFANDPA

SEQ ID NO: 145416 - protein, 27 aa, Mycobacterium avium
PLFGTRIQYNIGLGLLFGRPKSNLTFA

SEQ ID NO: 145417 - protein, 17 aa, Mycobacterium avium
PLLARAAAEVGTLARAI

SEQ ID NO: 145418 - protein, 17 aa, Mycobacterium avium
PLPPGSHSEKWIDLQPG

SEQ ID NO: 145419 - protein, 18 aa, Mycobacterium avium
PLWPDAVGEMCIRQIDGK

SEQ ID NO: 145420 - protein, 22 aa, Mycobacterium avium
PMASGYPGYPGMPGGGAARSAG

SEQ ID NO: 145421 - protein, 22 aa, Mycobacterium avium
PMEISEAVFVEGRAMVDLESDC

SEQ ID NO: 145422 - protein, 25 aa, Mycobacterium avium
PNQQHTPSLLAMVPGLPPLPNFSFL

SEQ ID NO: 145423 - protein, 19 aa, Mycobacterium avium
PNRRPLRRATSAMGALRVI

SEQ ID NO: 145424 - protein, 23 aa, Mycobacterium avium
PNVPDAFAVIADRHGSSIYSSNA

SEQ ID NO: 145425 - protein, 19 aa, Mycobacterium avium
PPALGADNGRVHWPPRPEP

SEQ ID NO: 145426 - protein, 26 aa, Mycobacterium avium
PPAPPRPADDLGYRPASREQPFGQNI

SEQ ID NO: 145427 - protein, 24 aa, Mycobacterium avium
PPDARITVSPLGFVAEGRSLIGSY

SEQ ID NO: 145428 - protein, 37 aa, Mycobacterium avium
PPGGWDGPPPPGGWNRPWDGPPRDVAVARADFGPFSY

SEQ ID NO: 145429 - protein, 23 aa, Mycobacterium avium
PPHPHLVKLVARCANVEGVGEVP

SEQ ID NO: 145430 - protein, 20 aa, Mycobacterium avium
PPLGENLFVGAAARPNELTY

SEQ ID NO: 145431 - protein, 19 aa, Mycobacterium avium
PPPPFGAPPPFAPPPSGPP

SEQ ID NO: 145432 - protein, 24 aa, Mycobacterium avium
PPPPPERQRYAALNPPNTQPPHPP

SEQ ID NO: 145433 - protein, 23 aa, Mycobacterium avium
PPSPRAMPMAVPLEPGQQTVKFT

SEQ ID NO: 145434 - protein, 24 aa, Mycobacterium avium
PPSPRAMPMAVPLEPGQQTVKFTV

SEQ ID NO: 145435 - protein, 23 aa, Mycobacterium avium
PPTVRIAPLPVRPVTKSQPTTPA

SEQ ID NO: 145436 - protein, 20 aa, Mycobacterium avium
PPVQNCFIVPGADQIPPTPI

SEQ ID NO: 145437 - protein, 18 aa, Mycobacterium avium
PQDQARRGDLIFYGPGGS

SEQ ID NO: 145438 - protein, 24 aa, Mycobacterium avium
PQRVVCGGISIAGRWDTTADPAVT

SEQ ID NO: 145439 - protein, 20 aa, Mycobacterium avium
PRAAFPLAWTTLYADIAATS

SEQ ID NO: 145440 - protein, 17 aa, Mycobacterium avium
PRANPFHRWLDDTYPVP

SEQ ID NO: 145441 - protein, 34 aa, Mycobacterium avium
PRATSLPCSARWPARRWSPSRSRTPRCASRARCW

SEQ ID NO: 145442 - protein, 18 aa, Mycobacterium avium
PRAYRAAGARVIAINADP

SEQ ID NO: 145443 - protein, 22 aa, Mycobacterium avium
PRGADPLPPHGIIPSGQTTTPY

SEQ ID NO: 145444 - protein, 17 aa, Mycobacterium avium
PRPGDCVLGTVDFKGPG

SEQ ID NO: 145445 - protein, 23 aa, Mycobacterium avium
PRRRADLDAGVFEHRCPIGGEEL

SEQ ID NO: 145446 - protein, 23 aa, Mycobacterium avium
PRTELLDRLGAHLTRHVGPGVEY

SEQ ID NO: 145447 - protein, 19 aa, Mycobacterium avium
PRTLPQNVKAVIRSPSILA

SEQ ID NO: 145448 - protein, 25 aa, Mycobacterium avium
PRVLSAAALVGRLRGVVCAPDGAVD

SEQ ID NO: 145449 - protein, 21 aa, Mycobacterium avium
PRVMANFGLEWDAVRAANPRA

SEQ ID NO: 145450 - protein, 26 aa, Mycobacterium avium
PRVRRWWPRRYRRSSVYSKLVSLDRR

SEQ ID NO: 145451 - protein, 23 aa, Mycobacterium avium
PRVVFGTPVSGFGRTVAADTRTY

SEQ ID NO: 145452 - protein, 33 aa, Mycobacterium avium
PSAFATRPAGLPGLRQKYGLDIKPGNFVAIDDG

SEQ ID NO: 145453 - protein, 20 aa, Mycobacterium avium
PSAPLLKAGDTIGLPATRAA

SEQ ID NO: 145454 - protein, 23 aa, Mycobacterium avium
PSGLALDRFADRPLAPIDPSAMV

SEQ ID NO: 145455 - protein, 24 aa, Mycobacterium avium
PSGVFDWRPPSSLIAALSDLLDAQ

SEQ ID NO: 145456 - protein, 20 aa, Mycobacterium avium
PSGVFDWRPPSSLITALSDL

SEQ ID NO: 145457 - protein, 17 aa, Mycobacterium avium
PSLPPAIVEGLRRAYPI

SEQ ID NO: 145458 - protein, 19 aa, Mycobacterium avium
PSPQRLRAGQVLDAGRVTV

SEQ ID NO: 145459 - protein, 29 aa, Mycobacterium avium
PSRDIPRFVELWRAGRLPVESLVSSTIRL

SEQ ID NO: 145460 - protein, 22 aa, Mycobacterium avium
PSSTPGHRWAWQTRSWSHGERE

SEQ ID NO: 145461 - protein, 24 aa, Mycobacterium avium
PTAWLAEGVLIGFLPPEAEVRLLD

SEQ ID NO: 145462 - protein, 25 aa, Mycobacterium avium
PTAWLAEGVLIGFLPPEAEVRLLDS

SEQ ID NO: 145463 - protein, 26 aa, Mycobacterium avium
PTGLGRIDAVLARAARIGPMSVPAGW

SEQ ID NO: 145464 - protein, 18 aa, Mycobacterium avium
PTGTFTFAELLAHELSVE

SEQ ID NO: 145465 - protein, 18 aa, Mycobacterium avium
PVAALTWQLPAGDQPGPA

SEQ ID NO: 145466 - protein, 24 aa, Mycobacterium avium
PVADLFVIGAAYRRYAIKHRHMYR

SEQ ID NO: 145467 - protein, 27 aa, Mycobacterium avium
PVARRAVEVLRRLYGRVGDRLVLIGVG

SEQ ID NO: 145468 - protein, 29 aa, Mycobacterium avium
PVARRAVEVLRRLYGRVGDRLVLIGVGGI

SEQ ID NO: 145469 - protein, 27 aa, Mycobacterium avium
PVARRAVEVLRRLYGRVGDRLVLISVG

SEQ ID NO: 145470 - protein, 18 aa, Mycobacterium avium
PVDAAACERLGLVNRVTA

SEQ ID NO: 145471 - protein, 18 aa, Mycobacterium avium
PVDRARVYVTGMSNGAMM

SEQ ID NO: 145472 - protein, 19 aa, Mycobacterium avium
PVDRARVYVTGMSNGAMMA

SEQ ID NO: 145473 - protein, 29 aa, Mycobacterium avium
PVLAWLHPPGIDFRPALLAGVQIGLSSQR

SEQ ID NO: 145474 - protein, 25 aa, Mycobacterium avium
PVLYSSKNPDNWRFAPPAPPEPSPP

SEQ ID NO: 145475 - protein, 24 aa, Mycobacterium avium
PVLYSSKNPDNWRFAPPAPPEPSQ

SEQ ID NO: 145476 - protein, 25 aa, Mycobacterium avium
PVPGLEVLGGITLGSERYRFPKNLP

SEQ ID NO: 145477 - protein, 17 aa, Mycobacterium avium
PVPSVPITDLVRQVTAR

SEQ ID NO: 145478 - protein, 28 aa, Mycobacterium avium
PVRNEWGWAEAYLDMGWEEIKVAAEYDG

SEQ ID NO: 145479 - protein, 25 aa, Mycobacterium avium
PVVPLWNYISVVGWSAEVSHVTVTW

SEQ ID NO: 145480 - protein, 21 aa, Mycobacterium avium
PVWDPGFNQWGFWFFGVWIPL

SEQ ID NO: 145481 - protein, 30 aa, Mycobacterium avium
PVYFRYWAARGVDVTPFFAVLNGPRIAAPG

SEQ ID NO: 145482 - protein, 30 aa, Mycobacterium avium
PVYFRYWASRGVDVTPFFAVLNGPRIAAPG

SEQ ID NO: 145483 - protein, 24 aa, Mycobacterium avium
PYGGPRPLISYAPGTQGQGNQCAP

SEQ ID NO: 145484 - protein, 23 aa, Mycobacterium avium
QADCFAGVYLFWVADGKSPRFTL

SEQ ID NO: 145485 - protein, 32 aa, Mycobacterium avium
QALLYSAVLHRFLRWRLAGYEPDRHLGGILYL

SEQ ID NO: 145486 - protein, 17 aa, Mycobacterium avium
QALQCPLKELGKASPYL

SEQ ID NO: 145487 - protein, 27 aa, Mycobacterium avium
QALTCSLKGMFPLALQPPTPVPGLEVL

SEQ ID NO: 145488 - protein, 24 aa, Mycobacterium avium
QAQLRAGSWWSGPDVYVVVDDYDL

SEQ ID NO: 145489 - protein, 18 aa, Mycobacterium avium
QAVAAPAVRKTGVLESEI

SEQ ID NO: 145490 - protein, 17 aa, Mycobacterium avium
QAVMAQVYVDGRSPGAQ

SEQ ID NO: 145491 - protein, 20 aa, Mycobacterium avium
QDFNGWKLKLINGTSPELKD

SEQ ID NO: 145492 - protein, 20 aa, Mycobacterium avium
QDIADAVLFMVTRDRRVAVN

SEQ ID NO: 145493 - protein, 24 aa, Mycobacterium avium
QDIAVLQLRGAAGLPTATIGGEAT

SEQ ID NO: 145494 - protein, 24 aa, Mycobacterium avium
QDIAVLQLRGATGLPTATIGGEAT

SEQ ID NO: 145495 - protein, 18 aa, Mycobacterium avium
QDQLAWLGKITCDRLDHG

SEQ ID NO: 145496 - protein, 26 aa, Mycobacterium avium
QDRFRRWANDNSRIIPRLRRIRDKIE

SEQ ID NO: 145497 - protein, 17 aa, Mycobacterium avium
QEHRRVVAVGPAQGSRG

SEQ ID NO: 145498 - protein, 22 aa, Mycobacterium avium
QEPRSWRMRITVQKVNEEAKVS

SEQ ID NO: 145499 - protein, 23 aa, Mycobacterium avium
QFLCGAVEAASRLGAKESAKLCV

SEQ ID NO: 145500 - protein, 17 aa, Mycobacterium avium
QGHPVVWESAARDVEPL

SEQ ID NO: 145501 - protein, 27 aa, Mycobacterium avium
QIWAKGVELYPGWRKYEVRAGDRHIEA

SEQ ID NO: 145502 - protein, 17 aa, Mycobacterium avium
QLAEFPSGLLVMGDALC

SEQ ID NO: 145503 - protein, 27 aa, Mycobacterium avium
QLGEDYLRLAALGAYGSFFNIYFCSVT

SEQ ID NO: 145504 - protein, 27 aa, Mycobacterium avium
QLIRHTAWFGAAVGFALTGGEVISHVA

SEQ ID NO: 145505 - protein, 19 aa, Mycobacterium avium
QLLVLCMLASKPIDAAIAV

SEQ ID NO: 145506 - protein, 17 aa, Mycobacterium avium
QLWESPELITATQGALL

SEQ ID NO: 145507 - protein, 19 aa, Mycobacterium avium
QMMQPLQSMMGMFANPGAM

SEQ ID NO: 145508 - protein, 20 aa, Mycobacterium avium
QPGKMPASLADYLRGLIQER

SEQ ID NO: 145509 - protein, 17 aa, Mycobacterium avium
QPIPRVGHRLDQLGRRA

SEQ ID NO: 145510 - protein, 40 aa, Mycobacterium avium
QPNNANCTFPMEFTPFQGGWQLSRHTAETLLALGKSPQAP

SEQ ID NO: 145511 - protein, 23 aa, Mycobacterium avium
QPPVCGCGGLIRPDIVWFGEQLP

SEQ ID NO: 145512 - protein, 23 aa, Mycobacterium avium
QPSPAPWPLLTLLPAGPELSRPN

SEQ ID NO: 145513 - protein, 23 aa, Mycobacterium avium
QPSRARLILHVDRHVSIPADAKA

SEQ ID NO: 145514 - protein, 23 aa, Mycobacterium avium
QQGARWQLGYLLRIEGTVDPWLL

SEQ ID NO: 145515 - protein, 18 aa, Mycobacterium avium
QQKFPRLSLIEIVGHHGE

SEQ ID NO: 145516 - protein, 23 aa, Mycobacterium avium
QQRDCVYYTTLVMWVGCHADSHE

SEQ ID NO: 145517 - protein, 26 aa, Mycobacterium avium
QRHELPRGDLDRVVRQQVVMASLAHR

SEQ ID NO: 145518 - protein, 22 aa, Mycobacterium avium
QRIDAAEAMAFVRQRRDENDGS

SEQ ID NO: 145519 - protein, 28 aa, Mycobacterium avium
QSLTCAAGQMIVHGFGVGANFGGGTFTA

SEQ ID NO: 145520 - protein, 19 aa, Mycobacterium avium
QSRLEPILLAATRRGGSEV

SEQ ID NO: 145521 - protein, 20 aa, Mycobacterium avium
QSVCPMLFEPGGSFDAVTAD

SEQ ID NO: 145522 - protein, 19 aa, Mycobacterium avium
QTDRPTVYYAPGPDPTTTV

SEQ ID NO: 145523 - protein, 24 aa, Mycobacterium avium
QTFFRPLTITAYFPSATGIYAGDE

SEQ ID NO: 145524 - protein, 19 aa, Mycobacterium avium
QTLDGRNALGYVRSRDTPR

SEQ ID NO: 145525 - protein, 19 aa, Mycobacterium avium
QTQIPVRNEWGWAEAYLDM

SEQ ID NO: 145526 - protein, 24 aa, Mycobacterium avium
QVGDTSRLLARFPALGGTDTSGRS

SEQ ID NO: 145527 - protein, 18 aa, Mycobacterium avium
RAADVVVLIDGYRQPAGP

SEQ ID NO: 145528 - protein, 26 aa, Mycobacterium avium
RAAEPWEVAATIAFLASDYSSYLTGE

SEQ ID NO: 145529 - protein, 19 aa, Mycobacterium avium
RAAGAAFDPDRGWRLHPQV

SEQ ID NO: 145530 - protein, 18 aa, Mycobacterium avium
RAAGLPVSPRMIFENPTV

SEQ ID NO: 145531 - protein, 29 aa, Mycobacterium avium
RAASPTVWLNPWRWYAAPRAVADALTVDR

SEQ ID NO: 145532 - protein, 17 aa, Mycobacterium avium
RAGLGVSILPSAGLPEL

SEQ ID NO: 145533 - protein, 18 aa, Mycobacterium avium
RAIDACGPPSSTTAGDVT

SEQ ID NO: 145534 - protein, 19 aa, Mycobacterium avium
RAIDACGPPSSTTAGDVTT

SEQ ID NO: 145535 - protein, 23 aa, Mycobacterium avium
RAKDLRSKPVWVLGSAETTSHML

SEQ ID NO: 145536 - protein, 21 aa, Mycobacterium avium
RAKELITLAGRNIFPTEIETV

SEQ ID NO: 145537 - protein, 17 aa, Mycobacterium avium
RALLGGMVAGLIGLAVA

SEQ ID NO: 145538 - protein, 20 aa, Mycobacterium avium
RAPWRLKQNYFFDMRTIRRG

SEQ ID NO: 145539 - protein, 21 aa, Mycobacterium avium
RAQFLCHWQFAELGRPGKLSW

SEQ ID NO: 145540 - protein, 22 aa, Mycobacterium avium
RARHELIAEAFGGKGYHVSTAA

SEQ ID NO: 145541 - protein, 17 aa, Mycobacterium avium
RARLRRHGPVTVYGVDK

SEQ ID NO: 145542 - protein, 29 aa, Mycobacterium avium
RARPRSLVVAGLLPLAGLLGVITTPAHAT

SEQ ID NO: 145543 - protein, 31 aa, Mycobacterium avium
RARPRSLVVAGLLPLAGLLGVITTPAYATSA

SEQ ID NO: 145544 - protein, 28 aa, Mycobacterium avium
RARTWPTWPAPRSRPAWARPATAPWCGP

SEQ ID NO: 145545 - protein, 28 aa, Mycobacterium avium
RASPAGGACLHWGALWGPASGARYLDPL

SEQ ID NO: 145546 - protein, 20 aa, Mycobacterium avium
RAVAELLAGLGAGVVVNGRD

SEQ ID NO: 145547 - protein, 19 aa, Mycobacterium avium
RAVAELLAGLGAGVVVSGR

SEQ ID NO: 145548 - protein, 25 aa, Mycobacterium avium
RAVAKAFAAKGFEVFGTTRNPRTAE

SEQ ID NO: 145549 - protein, 26 aa, Mycobacterium avium
RAVAKAFAAKGFEVFGTTRNPRTAEP

SEQ ID NO: 145550 - protein, 17 aa, Mycobacterium avium
RAVHRCMRAGRITAGSA

SEQ ID NO: 145551 - protein, 17 aa, Mycobacterium avium
RAVLGGMVAGLIGLAVA

SEQ ID NO: 145552 - protein, 18 aa, Mycobacterium avium
RAVWEKFGEFGLDARAFS

SEQ ID NO: 145553 - protein, 18 aa, Mycobacterium avium
RAWGRRLLVGAAAAVTLP

SEQ ID NO: 145554 - protein, 20 aa, Mycobacterium avium
RCGLAAVAAVGCWANASLAT

SEQ ID NO: 145555 - protein, 21 aa, Mycobacterium avium
RCGLAAVAAVGCWASVPTTVT

SEQ ID NO: 145556 - protein, 42 aa, Mycobacterium avium
RCPDIRLARQRLGWRPRVDYRTGLSTTLAWFAERAGRTGESA

SEQ ID NO: 145557 - protein, 17 aa, Mycobacterium avium
RCSLSATAVTAQLRSSA

SEQ ID NO: 145558 - protein, 26 aa, Mycobacterium avium
RDAFERLLQRRVQVIALEAEQHAQPH

SEQ ID NO: 145559 - protein, 24 aa, Mycobacterium avium
RDAGAVPSFLGYHGYPASICASVN

SEQ ID NO: 145560 - protein, 25 aa, Mycobacterium avium
RDALVRRIRAIPPFREKLADSPLNL

SEQ ID NO: 145561 - protein, 19 aa, Mycobacterium avium
RDVSHGCINISPANAKWFF

SEQ ID NO: 145562 - protein, 25 aa, Mycobacterium avium
RDYAHKYLRGSRTPDRVVFRDELPT

SEQ ID NO: 145563 - protein, 21 aa, Mycobacterium avium
REVLARAGAQPRAERREIAID

SEQ ID NO: 145564 - protein, 20 aa, Mycobacterium avium
RFSAGAARHVGGRTGQRVDP

SEQ ID NO: 145565 - protein, 21 aa, Mycobacterium avium
RFSELREGVWMRPDNIDTQLG

SEQ ID NO: 145566 - protein, 19 aa, Mycobacterium avium
RGAPAPAPARQSGIPAGPA

SEQ ID NO: 145567 - protein, 27 aa, Mycobacterium avium
RGEPLPWQDLRAAFTERGWLDLTHTRR

SEQ ID NO: 145568 - protein, 21 aa, Mycobacterium avium
RGGGPVQRWHRGMAVDLHLMI

SEQ ID NO: 145569 - protein, 17 aa, Mycobacterium avium
RGIVDYNQLFTATTLMP

SEQ ID NO: 145570 - protein, 24 aa, Mycobacterium avium
RGLRKLRAALPLVDPGAASPKETW

SEQ ID NO: 145571 - protein, 21 aa, Mycobacterium avium
RGPADLSFGGARVVLTAGYPA

SEQ ID NO: 145572 - protein, 21 aa, Mycobacterium avium
RGPSQWLRRLSGTQSERAELV

SEQ ID NO: 145573 - protein, 26 aa, Mycobacterium avium
RGRHWLADRFRWRRNGFRFAAVRCGG

SEQ ID NO: 145574 - protein, 19 aa, Mycobacterium avium
RGSDGVVIPGSYRNRHRAV

SEQ ID NO: 145575 - protein, 18 aa, Mycobacterium avium
RGSGEPPGIGGIGQPFVD

SEQ ID NO: 145576 - protein, 25 aa, Mycobacterium avium
RHELPRGDLDRVVRQQVVMASLAHR

SEQ ID NO: 145577 - protein, 17 aa, Mycobacterium avium
RHFCAGAGLAPQPAGAG

SEQ ID NO: 145578 - protein, 20 aa, Mycobacterium avium
RHLGGILYLFVRGMCGPDTP

SEQ ID NO: 145579 - protein, 25 aa, Mycobacterium avium
RHRAMLEAFAQWRANTRGALTEVGV

SEQ ID NO: 145580 - protein, 20 aa, Mycobacterium avium
RIAAGGLVSFAARPLRLANV

SEQ ID NO: 145581 - protein, 20 aa, Mycobacterium avium
RIAPEEIKAAGYDGVVNYVS

SEQ ID NO: 145582 - protein, 20 aa, Mycobacterium avium
RIELEPVAPFVTLRHIRFHA

SEQ ID NO: 145583 - protein, 17 aa, Mycobacterium avium
RKEIVWTAAADDKKNTP

SEQ ID NO: 145584 - protein, 17 aa, Mycobacterium avium
RKLWTAAAALLLVGACG

SEQ ID NO: 145585 - protein, 19 aa, Mycobacterium avium
RLAALAAVVLVGLILAGAA

SEQ ID NO: 145586 - protein, 19 aa, Mycobacterium avium
RLAALAAVVLVGLILAGTA

SEQ ID NO: 145587 - protein, 19 aa, Mycobacterium avium
RLAALAAVVLVGLIVAGAA

SEQ ID NO: 145588 - protein, 19 aa, Mycobacterium avium
RLAALSAEINRLGGDCTET

SEQ ID NO: 145589 - protein, 17 aa, Mycobacterium avium
RLCELDFELPLAGGDRR

SEQ ID NO: 145590 - protein, 19 aa, Mycobacterium avium
RLCELDFELPLAGGDRRSA

SEQ ID NO: 145591 - protein, 19 aa, Mycobacterium avium
RLDEELATYLAALRDAASA

SEQ ID NO: 145592 - protein, 20 aa, Mycobacterium avium
RLDGCGLPIIDIADPRIDSY

SEQ ID NO: 145593 - protein, 19 aa, Mycobacterium avium
RLELCTLDPAYRAVFADGS

SEQ ID NO: 145594 - protein, 19 aa, Mycobacterium avium
RLGSGRQYMSWITLEDEVR

SEQ ID NO: 145595 - protein, 26 aa, Mycobacterium avium
RLIGGAYRSLRLLGAMAAVALAASPL

SEQ ID NO: 145596 - protein, 20 aa, Mycobacterium avium
RLLAAPGLRAVPGLPVCQLR

SEQ ID NO: 145597 - protein, 19 aa, Mycobacterium avium
RLLGGELRQGALAGIMADA

SEQ ID NO: 145598 - protein, 23 aa, Mycobacterium avium
RLPEVVTATLALPVEALIADGEA

SEQ ID NO: 145599 - protein, 18 aa, Mycobacterium avium
RLQIPVVQITAFTSPQDL

SEQ ID NO: 145600 - protein, 19 aa, Mycobacterium avium
RLQLIPANVLVNIVATTAF

SEQ ID NO: 145601 - protein, 24 aa, Mycobacterium avium
RLRDPALLPRIVWGNLRARFAAKR

SEQ ID NO: 145602 - protein, 22 aa, Mycobacterium avium
RLREIDGLLPTLVRGQGTEFDS

SEQ ID NO: 145603 - protein, 19 aa, Mycobacterium avium
RLRRYGRYLLRDGVLHPMA

SEQ ID NO: 145604 - protein, 25 aa, Mycobacterium avium
RLVGEELRAGPGLVYGYTAELDTAA

SEQ ID NO: 145605 - protein, 19 aa, Mycobacterium avium
RMVPTFCLQALRGDPLTVS

SEQ ID NO: 145606 - protein, 25 aa, Mycobacterium avium
RNGGLRFAPRADLATREEQITVAEV

SEQ ID NO: 145607 - protein, 17 aa, Mycobacterium avium
RNMRLTLGVYTYRSCCN

SEQ ID NO: 145608 - protein, 26 aa, Mycobacterium avium
RPAPPHRRWSQYLSWVADHVGMNVVH

SEQ ID NO: 145609 - protein, 17 aa, Mycobacterium avium
RPDGGDFARGYDHSVHG

SEQ ID NO: 145610 - protein, 26 aa, Mycobacterium avium
RPDGRHRLLPGQCLTEIALNPLRATP

SEQ ID NO: 145611 - protein, 17 aa, Mycobacterium avium
RPDWTRTVLARRIAAGA

SEQ ID NO: 145612 - protein, 17 aa, Mycobacterium avium
RPDWTRTVLARRVAAGA

SEQ ID NO: 145613 - protein, 19 aa, Mycobacterium avium
RPGKLSWNLEPWRPVVDDA

SEQ ID NO: 145614 - protein, 21 aa, Mycobacterium avium
RPLPPEIYDALHAGDESSGGY

SEQ ID NO: 145615 - protein, 24 aa, Mycobacterium avium
RPPAPWPAPGYPPAWPGSGPAPQW

SEQ ID NO: 145616 - protein, 23 aa, Mycobacterium avium
RPQQKFPRLSLIEIVGHHGERAE

SEQ ID NO: 145617 - protein, 22 aa, Mycobacterium avium
RPQQRFPRLSLIEIVGHHGEHA

SEQ ID NO: 145618 - protein, 21 aa, Mycobacterium avium
RPQTLRKWGLDYESLRAVNER

SEQ ID NO: 145619 - protein, 25 aa, Mycobacterium avium
RPRDLKLRVISWGAAPAPDALLREM

SEQ ID NO: 145620 - protein, 19 aa, Mycobacterium avium
RPSPHWWFDPQDGGNLYGP

SEQ ID NO: 145621 - protein, 25 aa, Mycobacterium avium
RPVGLRPAGALGAEALRPQTTTMSG

SEQ ID NO: 145622 - protein, 21 aa, Mycobacterium avium
RQALRMRPDRIVVGEVRGAEV

SEQ ID NO: 145623 - protein, 21 aa, Mycobacterium avium
RQLADLGARVIKVERPDGGDF

SEQ ID NO: 145624 - protein, 17 aa, Mycobacterium avium
RRAALLNALFAAATETE

SEQ ID NO: 145625 - protein, 18 aa, Mycobacterium avium
RRACTALAAVLVAAGCGH

SEQ ID NO: 145626 - protein, 19 aa, Mycobacterium avium
RRAVLFVGVAAVGAVALPV

SEQ ID NO: 145627 - protein, 17 aa, Mycobacterium avium
RRAYPIGEAVTYHHTAA

SEQ ID NO: 145628 - protein, 18 aa, Mycobacterium avium
RRDPVVLYRATPQAFTDR

SEQ ID NO: 145629 - protein, 18 aa, Mycobacterium avium
RRDPVVLYRVTPQAFTDR

SEQ ID NO: 145630 - protein, 24 aa, Mycobacterium avium
RREPRWPCYAPAAVQLGVLSSLSF

SEQ ID NO: 145631 - protein, 21 aa, Mycobacterium avium
RRGRHRPRRRRRSGCRAACPG

SEQ ID NO: 145632 - protein, 19 aa, Mycobacterium avium
RRKQAWLRELAGWEPDLVV

SEQ ID NO: 145633 - protein, 21 aa, Mycobacterium avium
RRLIPGYVVTPAIKLLSDELV

SEQ ID NO: 145634 - protein, 21 aa, Mycobacterium avium
RRLLAAPGLRAVPGLPVCQLR

SEQ ID NO: 145635 - protein, 19 aa, Mycobacterium avium
RRLPADLSILTPAPATDTD

SEQ ID NO: 145636 - protein, 24 aa, Mycobacterium avium
RRMRPGLDVRLAFLELNAPNFVDV

SEQ ID NO: 145637 - protein, 23 aa, Mycobacterium avium
RRPLGAALRIAFRALTLAGVHGV

SEQ ID NO: 145638 - protein, 19 aa, Mycobacterium avium
RRRPRCDVISLVPEADQQA

SEQ ID NO: 145639 - protein, 18 aa, Mycobacterium avium
RRSAIALATAGALASTGT

SEQ ID NO: 145640 - protein, 20 aa, Mycobacterium avium
RRWMDRYASFVATKRGMAES

SEQ ID NO: 145641 - protein, 27 aa, Mycobacterium avium
RRYGNVFTLRLPMWGPVVMVSDPQLAK

SEQ ID NO: 145642 - protein, 20 aa, Mycobacterium avium
RSARFRPWMPAAGNHENELG

SEQ ID NO: 145643 - protein, 17 aa, Mycobacterium avium
RSLQIAGLVANSNALLA

SEQ ID NO: 145644 - protein, 25 aa, Mycobacterium avium
RSNGLWKPSPGSVYPTLQLLADEGL

SEQ ID NO: 145645 - protein, 18 aa, Mycobacterium avium
RSRDPSDLRAVLVDITPR

SEQ ID NO: 145646 - protein, 18 aa, Mycobacterium avium
RSTARAAATVLFLALLVL

SEQ ID NO: 145647 - protein, 18 aa, Mycobacterium avium
RTEFDGFIAANFDSPLSL

SEQ ID NO: 145648 - protein, 17 aa, Mycobacterium avium
RTLLVIGTFLGGGVATA

SEQ ID NO: 145649 - protein, 18 aa, Mycobacterium avium
RTREYYPAGTTVNVQAKL

SEQ ID NO: 145650 - protein, 23 aa, Mycobacterium avium
RTVSGQLTLLVPFIDRIRARVDL

SEQ ID NO: 145651 - protein, 21 aa, Mycobacterium avium
RVDEFYLFVCCHHIVADGIGL

SEQ ID NO: 145652 - protein, 21 aa, Mycobacterium avium
RVFCIAMLAAGLGVALQPAAV

SEQ ID NO: 145653 - protein, 19 aa, Mycobacterium avium
RVGPLSAPQQWWTQPPNNT

SEQ ID NO: 145654 - protein, 18 aa, Mycobacterium avium
RVKAAVVIEAVGHPAALQ

SEQ ID NO: 145655 - protein, 17 aa, Mycobacterium avium
RVLAFVGANLMKFGPLL

SEQ ID NO: 145656 - protein, 29 aa, Mycobacterium avium
RVQTKNGLALCGFMNSRVPGSCADVNGEP

SEQ ID NO: 145657 - protein, 17 aa, Mycobacterium avium
RVRLTGLIVGVLAGLAA

SEQ ID NO: 145658 - protein, 17 aa, Mycobacterium avium
RVRVGVVGPGTVDTEIF

SEQ ID NO: 145659 - protein, 29 aa, Mycobacterium avium
RWLAMSGSSPALALRVFRAIGRDDLLGDP

SEQ ID NO: 145660 - protein, 25 aa, Mycobacterium avium
RWRASELTRAMATCAAFALAAAVIG

SEQ ID NO: 145661 - protein, 20 aa, Mycobacterium avium
RYAEALTFAYHRLGRADVGV

SEQ ID NO: 145662 - protein, 19 aa, Mycobacterium avium
RYALAVQHERGLAMQSPWT

SEQ ID NO: 145663 - protein, 18 aa, Mycobacterium avium
RYLGAPVSVVSPWYGAKS

SEQ ID NO: 145664 - protein, 32 aa, Mycobacterium avium
RYPKAMYPRMFDRVIARRDAFERLLQRRVQVI

SEQ ID NO: 145665 - protein, 23 aa, Mycobacterium avium
RYWGPPAKPGLILFRRAGAPAAL

SEQ ID NO: 145666 - protein, 20 aa, Mycobacterium avium
SAAALPALPALFVIVDEFSE

SEQ ID NO: 145667 - protein, 22 aa, Mycobacterium avium
SAALRLFAAKGYAATSVADIQR

SEQ ID NO: 145668 - protein, 18 aa, Mycobacterium avium
SAANVAAGDGMRAAYQGV

SEQ ID NO: 145669 - protein, 19 aa, Mycobacterium avium
SAARLAAAFPQVGADLRGR

SEQ ID NO: 145670 - protein, 20 aa, Mycobacterium avium
SAARLAAAFPQVGADLRGRY

SEQ ID NO: 145671 - protein, 22 aa, Mycobacterium avium
SAARRAGDRAGRRARLGSSPEL

SEQ ID NO: 145672 - protein, 19 aa, Mycobacterium avium
SADAPPLKNGDVIARDRTT

SEQ ID NO: 145673 - protein, 23 aa, Mycobacterium avium
SADMLRYRPYDILSRTRNALRAS

SEQ ID NO: 145674 - protein, 22 aa, Mycobacterium avium
SADPREAVVLVFVNQTTIIGKS

SEQ ID NO: 145675 - protein, 18 aa, Mycobacterium avium
SAEYLRLLRRHNVAATLS

SEQ ID NO: 145676 - protein, 19 aa, Mycobacterium avium
SAGEAFGRAAEPWEVAATI

SEQ ID NO: 145677 - protein, 19 aa, Mycobacterium avium
SAGPLGLPVSDQRSVGDVL

SEQ ID NO: 145678 - protein, 18 aa, Mycobacterium avium
SAGPLGLPVSDQSSVGDV

SEQ ID NO: 145679 - protein, 18 aa, Mycobacterium avium
SAGRWLAVAASLVISAAM

SEQ ID NO: 145680 - protein, 17 aa, Mycobacterium avium
SAKELPTTISASSVIVV

SEQ ID NO: 145681 - protein, 20 aa, Mycobacterium avium
SAKLAGQFGDGWITQSGDVT

SEQ ID NO: 145682 - protein, 28 aa, Mycobacterium avium
SALNLPAAWRFSRGDGQLVAVLDTGVRP

SEQ ID NO: 145683 - protein, 24 aa, Mycobacterium avium
SALPGDLHWDRILFCAKEATYKAW

SEQ ID NO: 145684 - protein, 28 aa, Mycobacterium avium
SAMGALRVIRRRSWQGLTLLVAAMVLTS

SEQ ID NO: 145685 - protein, 27 aa, Mycobacterium avium
SANGGNAQRWFVVWLGTSNDPVDKVAA

SEQ ID NO: 145686 - protein, 22 aa, Mycobacterium avium
SARTDLTFTLSERFTESGEPAG

SEQ ID NO: 145687 - protein, 32 aa, Mycobacterium avium
SARTKLNWWESRALYGWTVLVPRTKDQAGEMS

SEQ ID NO: 145688 - protein, 36 aa, Mycobacterium avium
SASAGRAGLVGSLSVPANWASAVPAVRTVAAELPET

SEQ ID NO: 145689 - protein, 24 aa, Mycobacterium avium
SASMASAVAPYVGWMSTTAAQAEE

SEQ ID NO: 145690 - protein, 20 aa, Mycobacterium avium
SAVATRLTPFGAPPQSADAN

SEQ ID NO: 145691 - protein, 17 aa, Mycobacterium avium
SDLPAQLSTLIDVTPTM

SEQ ID NO: 145692 - protein, 17 aa, Mycobacterium avium
SDLRVGQPVVAIGSPLG

SEQ ID NO: 145693 - protein, 18 aa, Mycobacterium avium
SDSALLQRLQVVLRGAQL

SEQ ID NO: 145694 - protein, 17 aa, Mycobacterium avium
SDVPYLKSIGDFADLDV

SEQ ID NO: 145695 - protein, 17 aa, Mycobacterium avium
SDWKLEFDMPAGQSVLH

SEQ ID NO: 145696 - protein, 17 aa, Mycobacterium avium
SEIAKLIPPEGNRVDVN

SEQ ID NO: 145697 - protein, 17 aa, Mycobacterium avium
SEIRMLRECTAEIQHAV

SEQ ID NO: 145698 - protein, 22 aa, Mycobacterium avium
SEITCSFLFACTGYYNYDEGYS

SEQ ID NO: 145699 - protein, 20 aa, Mycobacterium avium
SEIVFEFPVSRRVRPEAQTV

SEQ ID NO: 145700 - protein, 20 aa, Mycobacterium avium
SENPDNWRFAPPAPPEPSPP

SEQ ID NO: 145701 - protein, 33 aa, Mycobacterium avium
SERYRFPKNLPKVAARGGPQCDHELPLAYNTFP

SEQ ID NO: 145702 - protein, 23 aa, Mycobacterium avium
SFAAFAAIIAVAFAYIASFHIDV

SEQ ID NO: 145703 - protein, 25 aa, Mycobacterium avium
SFAGQGVGFGGWYAPVALRVDTASV

SEQ ID NO: 145704 - protein, 26 aa, Mycobacterium avium
SFAGQGVGFGGWYAPVALRVDTASVD

SEQ ID NO: 145705 - protein, 24 aa, Mycobacterium avium
SFFNIYFCSVTIKINGPAGSDILL

SEQ ID NO: 145706 - protein, 18 aa, Mycobacterium avium
SFTRRDPVVLYRATPQAF

SEQ ID NO: 145707 - protein, 19 aa, Mycobacterium avium
SGAIHLLTRIVGLRKATEL

SEQ ID NO: 145708 - protein, 26 aa, Mycobacterium avium
SGAMVLDELIPLLGNQGLDTSRVAFL

SEQ ID NO: 145709 - protein, 21 aa, Mycobacterium avium
SGCGWKPPAPPQARPDTCKAS

SEQ ID NO: 145710 - protein, 23 aa, Mycobacterium avium
SGEPRTVPVYGIPHPEGLALIAS

SEQ ID NO: 145711 - protein, 22 aa, Mycobacterium avium
SGGPDRPVVVSVVGLVHTPGLV

SEQ ID NO: 145712 - protein, 17 aa, Mycobacterium avium
SGHLAAALREWRGPVLD

SEQ ID NO: 145713 - protein, 21 aa, Mycobacterium avium
SGLALDRFADRPLAPIDPSAM

SEQ ID NO: 145714 - protein, 19 aa, Mycobacterium avium
SGPFFKAIVANLLPYQVLQ

SEQ ID NO: 145715 - protein, 22 aa, Mycobacterium avium
SGPKLGQAVEWTPCRAANPKVK

SEQ ID NO: 145716 - protein, 18 aa, Mycobacterium avium
SHLHIEIVPGLAPTNAVP

SEQ ID NO: 145717 - protein, 23 aa, Mycobacterium avium
SHRGRGAFYPAMFQAAIDAGRPV

SEQ ID NO: 145718 - protein, 17 aa, Mycobacterium avium
SHTEKWIDLQPGQCVAD

SEQ ID NO: 145719 - protein, 22 aa, Mycobacterium avium
SIAGPVLAYWLTRYGFEVTVVE

SEQ ID NO: 145720 - protein, 17 aa, Mycobacterium avium
SIGPLGLAGRQGSQSVP

SEQ ID NO: 145721 - protein, 20 aa, Mycobacterium avium
SKPEVYAMVVASTGTEPGTP

SEQ ID NO: 145722 - protein, 20 aa, Mycobacterium avium
SKYPGFDVAKAVKAFLQAAI

SEQ ID NO: 145723 - protein, 28 aa, Mycobacterium avium
SLAANIVGGIDWDGHGLLGLEESMDSVL

SEQ ID NO: 145724 - protein, 17 aa, Mycobacterium avium
SLADFVKRQNIGSFTLG

SEQ ID NO: 145725 - protein, 26 aa, Mycobacterium avium
SLAMASAFAPYMAWMAGAAGRAAETA

SEQ ID NO: 145726 - protein, 17 aa, Mycobacterium avium
SLQDPYHAYTFEHLPDN

SEQ ID NO: 145727 - protein, 24 aa, Mycobacterium avium
SLSDLQPGDVLTFYSDASHAGIYI

SEQ ID NO: 145728 - protein, 18 aa, Mycobacterium avium
SLSKGYGLNNCTAGNIDR

SEQ ID NO: 145729 - protein, 24 aa, Mycobacterium avium
SLTGLRLRIEFDGRTTVDSPLGEF

SEQ ID NO: 145730 - protein, 20 aa, Mycobacterium avium
SLTTKAVRTACAALVTTSKN

SEQ ID NO: 145731 - protein, 23 aa, Mycobacterium avium
SNGNPPLVHSVGLGTVNGVALGF

SEQ ID NO: 145732 - protein, 26 aa, Mycobacterium avium
SNQSVVFRPAFEFIEQQWRELGVVLQ

SEQ ID NO: 145733 - protein, 17 aa, Mycobacterium avium
SPARLRCIRSPDRSARL

SEQ ID NO: 145734 - protein, 17 aa, Mycobacterium avium
SPDTSWQSINRLIPALV

SEQ ID NO: 145735 - protein, 17 aa, Mycobacterium avium
SPGSPRCSCWAPWPCWA

SEQ ID NO: 145736 - protein, 26 aa, Mycobacterium avium
SPGSPVCSAGKYARKHVPWANFTNVP

SEQ ID NO: 145737 - protein, 18 aa, Mycobacterium avium
SPNFDIWPYNTFTSRVTP

SEQ ID NO: 145738 - protein, 25 aa, Mycobacterium avium
SQAAEDWLCLLEAFDQPHRPGVVRA

SEQ ID NO: 145739 - protein, 25 aa, Mycobacterium avium
SQSARSRGPWPWLQPDRNGAPPVAG

SEQ ID NO: 145740 - protein, 25 aa, Mycobacterium avium
SQSPKESWLRVVLTQAGLPPPQTQI

SEQ ID NO: 145741 - protein, 25 aa, Mycobacterium avium
SQSPKESWLRVVLTRAGLPPPQTQI

SEQ ID NO: 145742 - protein, 17 aa, Mycobacterium avium
SRCVPGLHRTELARYPP

SEQ ID NO: 145743 - protein, 23 aa, Mycobacterium avium
SRLASGLFAWRRALVLSAAAALV

SEQ ID NO: 145744 - protein, 20 aa, Mycobacterium avium
SRLDASFLTGTRFECNLTEL

SEQ ID NO: 145745 - protein, 19 aa, Mycobacterium avium
SRPDAVRSLSRLVCGGEPV

SEQ ID NO: 145746 - protein, 22 aa, Mycobacterium avium
SRPDLAFDMVRPGIAVYGLSPV

SEQ ID NO: 145747 - protein, 19 aa, Mycobacterium avium
SRRAVLRLGAGAAVGAVGA

SEQ ID NO: 145748 - protein, 26 aa, Mycobacterium avium
SSLRLWPDRRLSRRGVEIVSRRAPRG

SEQ ID NO: 145749 - protein, 17 aa, Mycobacterium avium
SSSDLRVGQPVVAIGSP

SEQ ID NO: 145750 - protein, 28 aa, Mycobacterium avium
SSTAHRLLAMLAYRGFVRQDPVSKAYLP

SEQ ID NO: 145751 - protein, 26 aa, Mycobacterium avium
SSVVLFGMPNVRAMNFLGEPPVVIGP

SEQ ID NO: 145752 - protein, 20 aa, Mycobacterium avium
STAFLTPRVKPLIITNQPDN

SEQ ID NO: 145753 - protein, 25 aa, Mycobacterium avium
STDPLSEIWFLLTGQTSLPTNLGTL

SEQ ID NO: 145754 - protein, 23 aa, Mycobacterium avium
STIYRPGTRFAVTIPSVDPHRGR

SEQ ID NO: 145755 - protein, 20 aa, Mycobacterium avium
STLPRHCDGLVVGAVAGHPA

SEQ ID NO: 145756 - protein, 22 aa, Mycobacterium avium
STLPRHCDGLVVGTVAGHPAPP

SEQ ID NO: 145757 - protein, 22 aa, Mycobacterium avium
STLPRHCDGLVVGTVAGRPAPP

SEQ ID NO: 145758 - protein, 22 aa, Mycobacterium avium
STVIKADWRAGVSDAMTHKVAS

SEQ ID NO: 145759 - protein, 17 aa, Mycobacterium avium
SVGKVIPTVAARVVDEN

SEQ ID NO: 145760 - protein, 20 aa, Mycobacterium avium
SVHDMARWLMMLLDNGTHDG

SEQ ID NO: 145761 - protein, 18 aa, Mycobacterium avium
SVPDRSWSQVSVSARECL

SEQ ID NO: 145762 - protein, 27 aa, Mycobacterium avium
SVPQWPELEAAALKRIRGPRVGDPADV

SEQ ID NO: 145763 - protein, 23 aa, Mycobacterium avium
SVQTSQVFPVWLLSRDPDAEVIV

SEQ ID NO: 145764 - protein, 25 aa, Mycobacterium avium
SVVPRSWSGFFRPGPAVVVSPANFG

SEQ ID NO: 145765 - protein, 26 aa, Mycobacterium avium
SVVPRSWSGFFRPGPAVVVSPDNFGQ

SEQ ID NO: 145766 - protein, 18 aa, Mycobacterium avium
SYTFIAYLGDYYAFTTLT

SEQ ID NO: 145767 - protein, 24 aa, Mycobacterium avium
TAADALTCARRLAGQRVTAGDDDG

SEQ ID NO: 145768 - protein, 25 aa, Mycobacterium avium
TAAQFWASIHGFVMLELAGYCGDDG

SEQ ID NO: 145769 - protein, 23 aa, Mycobacterium avium
TAEARTGVDVVRLVAGDPLTVDA

SEQ ID NO: 145770 - protein, 24 aa, Mycobacterium avium
TAGAFSRPGLPVEYLQVPSAAMGR

SEQ ID NO: 145771 - protein, 18 aa, Mycobacterium avium
TAGALRWRDGSWLRRPAF

SEQ ID NO: 145772 - protein, 30 aa, Mycobacterium avium; identical to SEQ ID NO: 104923

SEQ ID NO: 145773 - protein, 17 aa, Mycobacterium avium
TAGSWNTPWSALAPARQ

SEQ ID NO: 145774 - protein, 20 aa, Mycobacterium avium
TALASEEWLGSASASMASAV

SEQ ID NO: 145775 - protein, 23 aa, Mycobacterium avium
TALEIAERAGARFVLASTSEVYG

SEQ ID NO: 145776 - protein, 27 aa, Mycobacterium avium
TALNGRGARLGQMFSDLNNFLGKIEPS

SEQ ID NO: 145777 - protein, 22 aa, Mycobacterium avium
TALTRLRIRDGVQLPRGSTAEL

SEQ ID NO: 145778 - protein, 23 aa, Mycobacterium avium
TAQLDRRLFAGFDEDGGQRPALA

SEQ ID NO: 145779 - protein, 17 aa, Mycobacterium avium
TARVPLQVIATGGLATP

SEQ ID NO: 145780 - protein, 20 aa, Mycobacterium avium
TASGAFGGFAARADDPEILY

SEQ ID NO: 145781 - protein, 25 aa, Mycobacterium avium
TATPLRPGVWHAYADHRMAMAGAIV

SEQ ID NO: 145782 - protein, 17 aa, Mycobacterium avium
TAVGLGWRSTRFPGVGY

SEQ ID NO: 145783 - protein, 18 aa, Mycobacterium avium
TAVTTLRIMDGVRVPVGS

SEQ ID NO: 145784 - protein, 21 aa, Mycobacterium avium
TDAKAGPLIAVKLHILTRKTL

SEQ ID NO: 145785 - protein, 21 aa, Mycobacterium avium
TDCRTAVSAAAWTFDLSEREY

SEQ ID NO: 145786 - protein, 25 aa, Mycobacterium avium
TDGKSGCYWARLRSFDTNDIIDNNV

SEQ ID NO: 145787 - protein, 17 aa, Mycobacterium avium
TDLTAFWAGPVATQLLG

SEQ ID NO: 145788 - protein, 17 aa, Mycobacterium avium
TDTFLGRKNMAIQPRGA

SEQ ID NO: 145789 - protein, 25 aa, Mycobacterium avium
TEFNRTRVGLMGALVTVLVVGVGQS

SEQ ID NO: 145790 - protein, 19 aa, Mycobacterium avium
TEITWRWDIHPRSPLTAWA

SEQ ID NO: 145791 - protein, 19 aa, Mycobacterium avium
TERCFRVFNFIDPPSRLRD

SEQ ID NO: 145792 - protein, 17 aa, Mycobacterium avium
TFNSVMGTISGPYTPLG

SEQ ID NO: 145793 - protein, 27 aa, Mycobacterium avium
TFVGAAARGGRRLVIAMMYGLIKEGGP

SEQ ID NO: 145794 - protein, 21 aa, Mycobacterium avium
TGCAIGWAVGRGHRFSVRPSP

SEQ ID NO: 145795 - protein, 20 aa, Mycobacterium avium
TGFPALACEGLVDGTSGAPW

SEQ ID NO: 145796 - protein, 22 aa, Mycobacterium avium
TGLRIAHYAEIGFGGFTALVDA

SEQ ID NO: 145797 - protein, 24 aa, Mycobacterium avium
TGSRWEMDPTLLVSAEVTSQNPFT

SEQ ID NO: 145798 - protein, 20 aa, Mycobacterium avium
TGVGWTGYHTALGRIIISHA

SEQ ID NO: 145799 - protein, 28 aa, Mycobacterium avium
TGYLQRMSTILGRRVWENAGSPEVDSNR

SEQ ID NO: 145800 - protein, 24 aa, Mycobacterium avium
TGYRRLRAWLTRLYRTEFDGFIAA

SEQ ID NO: 145801 - protein, 20 aa, Mycobacterium avium
TIRVPRRSAIALATAGALAS

SEQ ID NO: 145802 - protein, 18 aa, Mycobacterium avium
TKERQCQFMPTIGSTVVP

SEQ ID NO: 145803 - protein, 21 aa, Mycobacterium avium
TKSLPCHAGYLSVSGKDNTVT

SEQ ID NO: 145804 - protein, 18 aa, Mycobacterium avium
TLAGWLLTRRSRRIREID

SEQ ID NO: 145805 - protein, 22 aa, Mycobacterium avium
TLASQAAHIVMRFQQNLAELVI

SEQ ID NO: 145806 - protein, 18 aa, Mycobacterium avium
TLDGRNALAYVRSRDTPR

SEQ ID NO: 145807 - protein, 18 aa, Mycobacterium avium
TLDGRNALGYVRSRDTPR

SEQ ID NO: 145808 - protein, 18 aa, Mycobacterium avium
TLEIVRAGLGVSILPSAG

SEQ ID NO: 145809 - protein, 21 aa, Mycobacterium avium
TLPDFPRLWARMLDASLPDGE

SEQ ID NO: 145810 - protein, 21 aa, Mycobacterium avium
TLPDFPRLWARMLDTSLPDGE

SEQ ID NO: 145811 - protein, 22 aa, Mycobacterium avium
TLQLCAVGDPICGTGGDDLAAH

SEQ ID NO: 145812 - protein, 18 aa, Mycobacterium avium
TLRECLRAGDALLAQRFF

SEQ ID NO: 145813 - protein, 25 aa, Mycobacterium avium
TLTPEYPRLIVCDITGYGGTGPWRD

SEQ ID NO: 145814 - protein, 17 aa, Mycobacterium avium
TNPKVTGSWFWVDGQNA

SEQ ID NO: 145815 - protein, 18 aa, Mycobacterium avium
TPDGWTLGLGARDEQQVP

SEQ ID NO: 145816 - protein, 22 aa, Mycobacterium avium
TPEVGRFDDFFALGGDSILSVQ

SEQ ID NO: 145817 - protein, 22 aa, Mycobacterium avium
TPGGPLALPSHDEMVSPAHLSY

SEQ ID NO: 145818 - protein, 34 aa, Mycobacterium avium
TPHPAPWRWPAPPPWPCWSRWPARSPPSRHADER

SEQ ID NO: 145819 - protein, 19 aa, Mycobacterium avium
TPKLFGPLGVDFVPHTRFT

SEQ ID NO: 145820 - protein, 18 aa, Mycobacterium avium
TPLYGMSSILGIAQTAQG

SEQ ID NO: 145821 - protein, 19 aa, Mycobacterium avium
TQDSMCSWFTYSTADANKE

SEQ ID NO: 145822 - protein, 20 aa, Mycobacterium avium
TRGGQLLVYGVDPLILRQAY

SEQ ID NO: 145823 - protein, 24 aa, Mycobacterium avium
TRGQELYQARGLMEYGSVLGHGAY

SEQ ID NO: 145824 - protein, 20 aa, Mycobacterium avium
TRKPIFGIAMITPLVFAGAV

SEQ ID NO: 145825 - protein, 20 aa, Mycobacterium avium
TRLAARYGCPALQSTQVPAS

SEQ ID NO: 145826 - protein, 20 aa, Mycobacterium avium
TRLRRYGRYLLRDGVLHPMA

SEQ ID NO: 145827 - protein, 22 aa, Mycobacterium avium
TRRKGLWTTLAITTVSGASAVA

SEQ ID NO: 145828 - protein, 24 aa, Mycobacterium avium
TRVQRIYCRLVLRCFGVRITVSGN

SEQ ID NO: 145829 - protein, 18 aa, Mycobacterium avium
TSDIAVIRVQGMSGLTPI

SEQ ID NO: 145830 - protein, 24 aa, Mycobacterium avium
TSIYYLDHEPAIFADYSRNPYSFT

SEQ ID NO: 145831 - protein, 23 aa, Mycobacterium avium
TSLDPHGPVAFWGYSQGGGATAS

SEQ ID NO: 145832 - protein, 25 aa, Mycobacterium avium
TSLSIPSWWQPYVLSVASLTPDGQP

SEQ ID NO: 145833 - protein, 24 aa, Mycobacterium avium
TSPHLQAAVAFKNFQYTAAAQKVW

SEQ ID NO: 145834 - protein, 17 aa, Mycobacterium avium
TSVFRATRAALRYFRDA

SEQ ID NO: 145835 - protein, 18 aa, Mycobacterium avium
TVRHCARIALGELGLPPA

SEQ ID NO: 145836 - protein, 18 aa, Mycobacterium avium
TVRLTVGTAFPAADYLAH

SEQ ID NO: 145837 - protein, 20 aa, Mycobacterium avium
TVVPDPRYVAVPDHDQLATE

SEQ ID NO: 145838 - protein, 19 aa, Mycobacterium avium
TWDLLRLTRMPTVQVDVGY

SEQ ID NO: 145839 - protein, 24 aa, Mycobacterium avium
TWGKGGPPPLLWAVIQALVSEVWP

SEQ ID NO: 145840 - protein, 18 aa, Mycobacterium avium
TWLPPGCTSHFATPTAGS

SEQ ID NO: 145841 - protein, 19 aa, Mycobacterium avium
TWLPPGCTSHFATPTDGSA

SEQ ID NO: 145842 - protein, 32 aa, Mycobacterium avium
TYARAMGPMQFLPGTWARYASDGKGDGVADPQ

SEQ ID NO: 145843 - protein, 25 aa, Mycobacterium avium
TYKAWFPLTRRWLGFEDARITFEAD

SEQ ID NO: 145844 - protein, 35 aa, Mycobacterium avium
VAALLHRAASPAVWLNPWRWYAAPRAVADSLTVDR

SEQ ID NO: 145845 - protein, 19 aa, Mycobacterium avium
VAALLHRAASPTVWLNPWR

SEQ ID NO: 145846 - protein, 17 aa, Mycobacterium avium
VAASCAVPGAWPPVAIG

SEQ ID NO: 145847 - protein, 31 aa, Mycobacterium avium
VAEKKFRIAEAWMRRTIRWIKENLPGADYPP

SEQ ID NO: 145848 - protein, 21 aa, Mycobacterium avium
VAEMPGIFAYVVAQGDGPFIG

SEQ ID NO: 145849 - protein, 20 aa, Mycobacterium avium
VAEPGSPVPNGVTPPDGAPV

SEQ ID NO: 145850 - protein, 23 aa, Mycobacterium avium
VAGTAAAFWLGRHGHSVTVVERH

SEQ ID NO: 145851 - protein, 24 aa, Mycobacterium avium
VAGTAAAFWLGRHGHSVTVVERHR

SEQ ID NO: 145852 - protein, 29 aa, Mycobacterium avium
VAMVLRRLLRLCARYASAPTVIFASATTD

SEQ ID NO: 145853 - protein, 22 aa, Mycobacterium avium
VAQAVKARVPARVYTVQLGGFD

SEQ ID NO: 145854 - protein, 23 aa, Mycobacterium avium
VARCSLALTLLAPQWFTAARADP

SEQ ID NO: 145855 - protein, 28 aa, Mycobacterium avium
VARLACVALCAAALAGCQQPHKPAPTSS

SEQ ID NO: 145856 - protein, 24 aa, Mycobacterium avium
VARRELEGLLVLPPATRANIERAI

SEQ ID NO: 145857 - protein, 29 aa, Mycobacterium avium
VATMAGWRTDFLNQMGLVIADSIKPFDTD

SEQ ID NO: 145858 - protein, 29 aa, Mycobacterium avium
VATMAGWRTDFLNQMGLVIADSIKPFGTD

SEQ ID NO: 145859 - protein, 26 aa, Mycobacterium avium
VAVDMLEMLPTPWGLVRSGVAPDHPK

SEQ ID NO: 145860 - protein, 17 aa, Mycobacterium avium
VAYSRGDTVLALKELTL

SEQ ID NO: 145861 - protein, 17 aa, Mycobacterium avium
VAYSRGDTVLALKERTL

SEQ ID NO: 145862 - protein, 19 aa, Mycobacterium avium
VCDITGYGGTGPWRDRKAY

SEQ ID NO: 145863 - protein, 23 aa, Mycobacterium avium
VCLLARDCPSFGLGPTEPPLAAQ

SEQ ID NO: 145864 - protein, 26 aa, Mycobacterium avium
VCSSGKRALAAVICIAAVLSGCGGKP

SEQ ID NO: 145865 - protein, 24 aa, Mycobacterium avium
VCSSGKRALAAVIGIAAVLSGCGG

SEQ ID NO: 145866 - protein, 23 aa, Mycobacterium avium
VCWLAIVVCCLAAAGLAATGART

SEQ ID NO: 145867 - protein, 19 aa, Mycobacterium avium
VDAFANLLLEERVAAHTAR

SEQ ID NO: 145868 - protein, 18 aa, Mycobacterium avium
VDGHEFAFTYTVTGADGI

SEQ ID NO: 145869 - protein, 24 aa, Mycobacterium avium
VDGQLGAPFVWPLVANAGESPGGD

SEQ ID NO: 145870 - protein, 20 aa, Mycobacterium avium
VDKFPRMVDNVLPTGVRIAD

SEQ ID NO: 145871 - protein, 23 aa, Mycobacterium avium
VDNALKLLLLLGEQPEIRLSEAT

SEQ ID NO: 145872 - protein, 22 aa, Mycobacterium avium
VDNPRYVIGIMMDNPERNADGT

SEQ ID NO: 145873 - protein, 20 aa, Mycobacterium avium
VDPQGRCEPVAGTNTGESLP

SEQ ID NO: 145874 - protein, 17 aa, Mycobacterium avium
VEALLGAFAARVAPFNV

SEQ ID NO: 145875 - protein, 18 aa, Mycobacterium avium
VEAVERIDASGFNNKVTY

SEQ ID NO: 145876 - protein, 19 aa, Mycobacterium avium
VEPRLRVAITSGQCDGGQS

SEQ ID NO: 145877 - protein, 22 aa, Mycobacterium avium
VEPRLWNMSTVLPILQDTTIVA

SEQ ID NO: 145878 - protein, 18 aa, Mycobacterium avium
VETLWSHPVLAGRDRWRE

SEQ ID NO: 145879 - protein, 24 aa, Mycobacterium avium
VFIFDILHCDGIDLLDAPTTDRLA

SEQ ID NO: 145880 - protein, 26 aa, Mycobacterium avium
VFMPIARRQGIEFDLAFEAREIGATL

SEQ ID NO: 145881 - protein, 19 aa, Mycobacterium avium
VFPGPGLPKPDPRDATPPY

SEQ ID NO: 145882 - protein, 21 aa, Mycobacterium avium
VGADLRGRYRVVLLDEYQDTG

SEQ ID NO: 145883 - protein, 26 aa, Mycobacterium avium
VGDGDRAHWDWLKWLPHNRHPTHYDA

SEQ ID NO: 145884 - protein, 17 aa, Mycobacterium avium
VGDRFSAGAARHVGGRT

SEQ ID NO: 145885 - protein, 17 aa, Mycobacterium avium
VGIRADCLGVQSPLPEW

SEQ ID NO: 145886 - protein, 18 aa, Mycobacterium avium
VGLLCMYKVHQFSEPGPV

SEQ ID NO: 145887 - protein, 32 aa, Mycobacterium avium
VGLMIFPVLKLHEKWLGVGRYTVTVQLPEAAG

SEQ ID NO: 145888 - protein, 21 aa, Mycobacterium avium
VGPGERVALLFSRSVDAVVAI

SEQ ID NO: 145889 - protein, 20 aa, Mycobacterium avium
VGPPEHRTNLSMAVPDVKGL

SEQ ID NO: 145890 - protein, 23 aa, Mycobacterium avium
VGRPRRAGPAAGRDRPGAVGRPA

SEQ ID NO: 145891 - protein, 19 aa, Mycobacterium avium
VGTAVKAFLQSTVGAGQNG

SEQ ID NO: 145892 - protein, 24 aa, Mycobacterium avium
VGVDIVWWPGDRGLEQSMGVLPDR

SEQ ID NO: 145893 - protein, 18 aa, Mycobacterium avium
VGVGQSFTSVPMLFATPT

SEQ ID NO: 145894 - protein, 19 aa, Mycobacterium avium
VGVLPTPAVAYLTGAYDAD

SEQ ID NO: 145895 - protein, 20 aa, Mycobacterium avium
VHGDSSYFVWLNRGKESLTL

SEQ ID NO: 145896 - protein, 17 aa, Mycobacterium avium
VIAPWFLAPGFITDGVS

SEQ ID NO: 145897 - protein, 17 aa, Mycobacterium avium
VIPGSYRNRHRAVNGSM

SEQ ID NO: 145898 - protein, 23 aa, Mycobacterium avium
VLADLVSHFGVNFGFLRHNDHSI

SEQ ID NO: 145899 - protein, 20 aa, Mycobacterium avium
VLATDVLRGLRMVKEECEVD

SEQ ID NO: 145900 - protein, 19 aa, Mycobacterium avium
VLGSIEFAVSVLNVPLIVV

SEQ ID NO: 145901 - protein, 18 aa, Mycobacterium avium
VLGWRAQHSQSHYAAAKA

SEQ ID NO: 145902 - protein, 28 aa, Mycobacterium avium
VLPIALSPWPAMVFTALLAALAVAVAVD

SEQ ID NO: 145903 - protein, 23 aa, Mycobacterium avium
VLSGLGLQWHGPAADAMAFAAAR

SEQ ID NO: 145904 - protein, 17 aa, Mycobacterium avium
VLTAGPAAADWPMDDPE

SEQ ID NO: 145905 - protein, 29 aa, Mycobacterium avium
VLTPGFHGVHIHKVGKCEPSSVAPTGGAP

SEQ ID NO: 145906 - protein, 19 aa, Mycobacterium avium
VLTTELPQTYALLGRTPRR

SEQ ID NO: 145907 - protein, 23 aa, Mycobacterium avium
VNAPLPWSAQFTGFGGEVFTVSA

SEQ ID NO: 145908 - protein, 18 aa, Mycobacterium avium
VNLGRPDPGLDLPIVLGG

SEQ ID NO: 145909 - protein, 17 aa, Mycobacterium avium
VNLNMFGANDFDTAAAL

SEQ ID NO: 145910 - protein, 19 aa, Mycobacterium avium
VNVKPKFAVDAMVATIGQQ

SEQ ID NO: 145911 - protein, 24 aa, Mycobacterium avium
VPADVKAAILSPSLVTPRSIQLTP

SEQ ID NO: 145912 - protein, 22 aa, Mycobacterium avium
VPDERIGFVLADAAPIAAITGT

SEQ ID NO: 145913 - protein, 17 aa, Mycobacterium avium
VPDPNTPTGSRWEMDPT

SEQ ID NO: 145914 - protein, 27 aa, Mycobacterium avium
VPDTEFGTRWFADKAFWVKDGQNYLPF

SEQ ID NO: 145915 - protein, 18 aa, Mycobacterium avium
VPEPVLALIGKDLPPVSG

SEQ ID NO: 145916 - protein, 23 aa, Mycobacterium avium
VPHFLGLDYWQMWHYGDSTMAGV

SEQ ID NO: 145917 - protein, 23 aa, Mycobacterium avium
VPHHPGDTIAVHFRSVDGGERTA

SEQ ID NO: 145918 - protein, 21 aa, Mycobacterium avium
VPNFLGLDYWQMWHYGDSTMA

SEQ ID NO: 145919 - protein, 18 aa, Mycobacterium avium
VPVLLMLAALGLGRLEKE

SEQ ID NO: 145920 - protein, 24 aa, Mycobacterium avium
VQEAYRLAASIQRTVMPLDGPLFK

SEQ ID NO: 145921 - protein, 24 aa, Mycobacterium avium
VQIDLGGPVVRTLAFGDSIPGPVI

SEQ ID NO: 145922 - protein, 25 aa, Mycobacterium avium
VQLIRQLWSGLRISFTGHYFQTNSV

SEQ ID NO: 145923 - protein, 19 aa, Mycobacterium avium
VQQNWRLIAVLDMGWEDYL

SEQ ID NO: 145924 - protein, 18 aa, Mycobacterium avium
VRCACRAAGIDDAGQAPY

SEQ ID NO: 145925 - protein, 20 aa, Mycobacterium avium
VRPGYNFANADHALSYGRAI

SEQ ID NO: 145926 - protein, 19 aa, Mycobacterium avium
VRPPLRRRLTPAAVPQLGI

SEQ ID NO: 145927 - protein, 18 aa, Mycobacterium avium
VRPVAVLLTTMFVVAACS

SEQ ID NO: 145928 - protein, 27 aa, Mycobacterium avium
VRRVVGLDCEVRAAAAAGWAGTEHLDA

SEQ ID NO: 145929 - protein, 19 aa, Mycobacterium avium
VRTACAALVTTSKNAIDKT

SEQ ID NO: 145930 - protein, 24 aa, Mycobacterium avium
VSAAARAGALGILAAGYKTVQGIE

SEQ ID NO: 145931 - protein, 19 aa, Mycobacterium avium
VSALNRPVSTTGESGNQNT

SEQ ID NO: 145932 - protein, 26 aa, Mycobacterium avium
VSAQPGLSAKIVFPHPNTETGPFNYE

SEQ ID NO: 145933 - protein, 18 aa, Mycobacterium avium
VSDLRPDSAVVLVLVDQS

SEQ ID NO: 145934 - protein, 22 aa, Mycobacterium avium
VSEAGYTQRLWEAIRAQDVQGN

SEQ ID NO: 145935 - protein, 24 aa, Mycobacterium avium
VSELMIGCAHRAAPPPAHSSTSNT

SEQ ID NO: 145936 - protein, 19 aa, Mycobacterium avium
VSESGRLLFTGADITRGQE

SEQ ID NO: 145937 - protein, 23 aa, Mycobacterium avium
VSGFDPATLWGRQTGRDRLRAPL

SEQ ID NO: 145938 - protein, 17 aa, Mycobacterium avium
VSIPAMFADQVIRAPQA

SEQ ID NO: 145939 - protein, 17 aa, Mycobacterium avium
VSSSVHDMARWLMMLLD

SEQ ID NO: 145940 - protein, 24 aa, Mycobacterium avium
VSVSCAGPLPGLPDDAPRGKDGCS

SEQ ID NO: 145941 - protein, 25 aa, Mycobacterium avium
VTAEIALAVLCTFVISKTLPDSLAT

SEQ ID NO: 145942 - protein, 20 aa, Mycobacterium avium
VTALLAALGRRYDGDERVSV

SEQ ID NO: 145943 - protein, 22 aa, Mycobacterium avium
VTARSRIATSFLDRTVADESLR

SEQ ID NO: 145944 - protein, 26 aa, Mycobacterium avium
VTCQKYARRGLITFLGEDVGNPVATA

SEQ ID NO: 145945 - protein, 24 aa, Mycobacterium avium
VTFSDGRTAPFTVVGADPTSDIAV

SEQ ID NO: 145946 - protein, 17 aa, Mycobacterium avium
VTGSWFWVDGQNVHWRP

SEQ ID NO: 145947 - protein, 25 aa, Mycobacterium avium
VTSGLRPASYFALAEAHGRLGHPAQ

SEQ ID NO: 145948 - protein, 33 aa, Mycobacterium avium; identical to SEQ ID NO: 106540

SEQ ID NO: 145949 - protein, 26 aa, Mycobacterium avium
VVFGDFRFGPESTYHATFVDVSRLKA

SEQ ID NO: 145950 - protein, 24 aa, Mycobacterium avium
VVGVTRLLGGLALAAIAAVAPRAV

SEQ ID NO: 145951 - protein, 24 aa, Mycobacterium avium
VVLPDAPVKIFLTASAETRARRRN

SEQ ID NO: 145952 - protein, 17 aa, Mycobacterium avium
VVLTRRPDYAWPPSSWP

SEQ ID NO: 145953 - protein, 21 aa, Mycobacterium avium
VVRAAAATMFFGETAETLAAG

SEQ ID NO: 145954 - protein, 23 aa, Mycobacterium avium
VVSLSWRTGDDIVVTRTDPSHPV

SEQ ID NO: 145955 - protein, 23 aa, Mycobacterium avium
VVSLSWRTGDDIVVTRTDSSHPV

SEQ ID NO: 145956 - protein, 23 aa, Mycobacterium avium
VVTARSRIATSFLDRTVADESLR

SEQ ID NO: 145957 - protein, 26 aa, Mycobacterium avium
VVVAGLCAGELVASLTAAKTTAPSSS

SEQ ID NO: 145958 - protein, 20 aa, Mycobacterium avium
VWDPGFNQWGFWFFGVWIPL

SEQ ID NO: 145959 - protein, 19 aa, Mycobacterium avium
VWGIARFTDAAARESLEQA

SEQ ID NO: 145960 - protein, 20 aa, Mycobacterium avium
VWQAASLLLAYPDDGFGGRL

SEQ ID NO: 145961 - protein, 20 aa, Mycobacterium avium
VWWSWLVGVLTVVGLGLGLG

SEQ ID NO: 145962 - protein, 26 aa, Mycobacterium avium
VYGVDPLILRQAYPVSQAPYGLAGSR

SEQ ID NO: 145963 - protein, 25 aa, Mycobacterium avium
VYPDVYRLGEWVIPRGYSIIVGIAQ

SEQ ID NO: 145964 - protein, 18 aa, Mycobacterium avium
VYPQGRCEPVAGTNTGES

SEQ ID NO: 145965 - protein, 24 aa, Mycobacterium avium
WAAREAAMRHCPLTIVHAVSTPTT

SEQ ID NO: 145966 - protein, 20 aa, Mycobacterium avium
WDDLLRPGVEVITPSPLSSG

SEQ ID NO: 145967 - protein, 19 aa, Mycobacterium avium
WDERLCLAPDGDFFRTIRH

SEQ ID NO: 145968 - protein, 17 aa, Mycobacterium avium
WDTRARVAAPYRVIQFA

SEQ ID NO: 145969 - protein, 28 aa, Mycobacterium avium
WFLETVPITPIWLCPLRLRDHDGWPLYP

SEQ ID NO: 145970 - protein, 24 aa, Mycobacterium avium
WGPIHGCHVFTPILRDAAQSAAPR

SEQ ID NO: 145971 - protein, 20 aa, Mycobacterium avium
WGSSITPDLASHVAAVATFG

SEQ ID NO: 145972 - protein, 17 aa, Mycobacterium avium
WLNRGKESLTLDLKTLE

SEQ ID NO: 145973 - protein, 21 aa, Mycobacterium avium
WLNRQLSGYANWALANNSLLI

SEQ ID NO: 145974 - protein, 22 aa, Mycobacterium avium
WLNRQLSGYANWALANNSLLIV

SEQ ID NO: 145975 - protein, 25 aa, Mycobacterium avium
WPEGESFPTLPPMMRITLNAILRAV

SEQ ID NO: 145976 - protein, 17 aa, Mycobacterium avium
WPLLGAYSVTKSALDKL

SEQ ID NO: 145977 - protein, 24 aa, Mycobacterium avium
WPRHQLRLPAGHGLLLLTDGLYEG

SEQ ID NO: 145978 - protein, 27 aa, Mycobacterium avium
WPYTELDYARWTWRLRRRDWIHHRCAP

SEQ ID NO: 145979 - protein, 27 aa, Mycobacterium avium
WPYTELDYARWTWRLRRRDWIHHRCVP

SEQ ID NO: 145980 - protein, 19 aa, Mycobacterium avium
WRALSAAPHPRCRRWCHPF

SEQ ID NO: 145981 - protein, 21 aa, Mycobacterium avium
WRIAAGGLVRFAARPLRLASV

SEQ ID NO: 145982 - protein, 24 aa, Mycobacterium avium
WRIDRLPNGVFLDWQQFQATYKRN

SEQ ID NO: 145983 - protein, 20 aa, Mycobacterium avium
WRPVLALVLTAGVVAGCHGG

SEQ ID NO: 145984 - protein, 19 aa, Mycobacterium avium
WRRHRWPEVHGLAEGIAAW

SEQ ID NO: 145985 - protein, 18 aa, Mycobacterium avium
WRVAGHRGGMLAGGILSS

SEQ ID NO: 145986 - protein, 18 aa, Mycobacterium avium
WTEDGQLEFVGRSDHQVQ

SEQ ID NO: 145987 - protein, 19 aa, Mycobacterium avium
WVPGYKLVDFSGAIVRSLP

SEQ ID NO: 145988 - protein, 23 aa, Mycobacterium avium
WVRRSRPRPPPSWKTLRGIWIFP

SEQ ID NO: 145989 - protein, 27 aa, Mycobacterium avium
YAGKVNGDWRPVAVGANGTTISGGSSD

SEQ ID NO: 145990 - protein, 17 aa, Mycobacterium avium
YAPPPAVYAPLPEDDTS

SEQ ID NO: 145991 - protein, 19 aa, Mycobacterium avium
YASSGSWSHNAAGNYVLAF

SEQ ID NO: 145992 - protein, 17 aa, Mycobacterium avium
YEFRRRFDGALQTVYGS

SEQ ID NO: 145993 - protein, 26 aa, Mycobacterium avium
YESVLSGLGLQWHGPAADAMAFAAAR

SEQ ID NO: 145994 - protein, 21 aa, Mycobacterium avium
YEVLQRIPSVQVVFIGQRRGE

SEQ ID NO: 145995 - protein, 25 aa, Mycobacterium avium
YFPLYEGDSFYGLWQQLSNVSAGLK

SEQ ID NO: 145996 - protein, 27 aa, Mycobacterium avium
YGEENFEVFRHASLLSAVFHEAYHADG

SEQ ID NO: 145997 - protein, 26 aa, Mycobacterium avium
YGEENFEVFRHASLLSAVFHEDYHAD

SEQ ID NO: 145998 - protein, 27 aa, Mycobacterium avium
YGEENFEVFRHASLLSAVFHEDYHADG

SEQ ID NO: 145999 - protein, 21 aa, Mycobacterium avium
YGVKVTGCTVHLVDAGTDTGP

SEQ ID NO: 146000 - protein, 18 aa, Mycobacterium avium
YHAGYFVGVSIKAYCPKY

SEQ ID NO: 146001 - protein, 19 aa, Mycobacterium avium
YHAGYFVGVSIKAYCPKYA

SEQ ID NO: 146002 - protein, 23 aa, Mycobacterium avium
YHDARPELAYAPQDVLHLDQQLG

SEQ ID NO: 146003 - protein, 23 aa, Mycobacterium avium
YIAFGGLGPELARFVQGATALAI

SEQ ID NO: 146004 - protein, 19 aa, Mycobacterium avium
YITARFLPDKAIDLVDEAA

SEQ ID NO: 146005 - protein, 19 aa, Mycobacterium avium
YKADAMWGPSSDPAWQRND

SEQ ID NO: 146006 - protein, 18 aa, Mycobacterium avium
YKLLAVAVLLVLALILAL

SEQ ID NO: 146007 - protein, 23 aa, Mycobacterium avium
YLRDYGPLLDRIGKTNGKYLAVM

SEQ ID NO: 146008 - protein, 26 aa, Mycobacterium avium
YLSDPRLQRIFTFQSLYAGVAPRDAL

SEQ ID NO: 146009 - protein, 17 aa, Mycobacterium avium
YMRKRRGGHIMAVTSMG

SEQ ID NO: 146010 - protein, 20 aa, Mycobacterium avium
YPRFGPWGQLDRWRRQYDGV

SEQ ID NO: 146011 - protein, 26 aa, Mycobacterium avium
YQPACGKAGCSTYKWETFLTSELPSY

SEQ ID NO: 146012 - protein, 24 aa, Mycobacterium avium
YRALKEASYRLGARTLYHQFGAPL

SEQ ID NO: 146013 - protein, 17 aa, Mycobacterium avium
YREALRLARDVVNNPSA

SEQ ID NO: 146014 - protein, 21 aa, Mycobacterium avium
YRGRRSASQSGCLGVTAMLQK

SEQ ID NO: 146015 - protein, 17 aa, Mycobacterium avium
YRIPADAAAHVHSVSAV

SEQ ID NO: 146016 - protein, 19 aa, Mycobacterium avium
YRTKVMWWDRRTLAAHADP

SEQ ID NO: 146017 - protein, 19 aa, Mycobacterium avium
YRVAPGHVFVTGMSNGGFM

SEQ ID NO: 146018 - protein, 30 aa, Mycobacterium avium; identical to SEQ ID NO: 92885

SEQ ID NO: 146019 - protein, 17 aa, Mycobacterium avium
YTFTIRDGVSFSDHTPL

SEQ ID NO: 146020 - protein, 19 aa, Mycobacterium avium
YTTPWPLLGAYSVTKSALD

SEQ ID NO: 146021 - protein, 20 aa, Mycobacterium avium
AAAGYLCWRGKDLATPRGWI

SEQ ID NO: 146022 - protein, 18 aa, Mycobacterium avium
AAELRYGRIPEVEKKLEA

SEQ ID NO: 146023 - protein, 17 aa, Mycobacterium avium
AALAAAGYLCWRGKDLA

SEQ ID NO: 146024 - protein, 17 aa, Mycobacterium avium
ADFLARPNRAVNHIKIG

SEQ ID NO: 146025 - protein, 17 aa, Mycobacterium avium
ADPRFRFFGNVSVGEHV

SEQ ID NO: 146026 - protein, 18 aa, Mycobacterium avium
ADTLGRWAANLNTLAAQT

SEQ ID NO: 146027 - protein, 20 aa, Mycobacterium avium
AFKDSDAWFLIRAVTEPDAT

SEQ ID NO: 146028 - protein, 30 aa, Mycobacterium avium
ALPRRPQFALLKGRRNYLCLNKIHNGGPAD

SEQ ID NO: 146029 - protein, 23 aa, Mycobacterium avium
ANAKRWGINHVIWRQKIYPGVGG

SEQ ID NO: 146030 - protein, 26 aa, Mycobacterium avium
APVARDARFRWGVAMMPAGPVGRVSV

SEQ ID NO: 146031 - protein, 21 aa, Mycobacterium avium
APVEPRIPALSGQPPGVIVLV

SEQ ID NO: 146032 - protein, 22 aa, Mycobacterium avium
ARRAVEVLRRLYGRVGDRLVLI

SEQ ID NO: 146033 - protein, 19 aa, Mycobacterium avium
ARRPPVFAGTIWVQQGAQP

SEQ ID NO: 146034 - protein, 18 aa, Mycobacterium avium
ARYGVPWQPAYVFYRADG

SEQ ID NO: 146035 - protein, 18 aa, Mycobacterium avium
AVAVGWPDLMRAARDRPL

SEQ ID NO: 146036 - protein, 19 aa, Mycobacterium avium
AVELARSGAKVAISDVDLE

SEQ ID NO: 146037 - protein, 17 aa, Mycobacterium avium
AVLPRDKIASLLYETSQ

SEQ ID NO: 146038 - protein, 20 aa, Mycobacterium avium
CGGPPCKGAVVALEPSTGKI

SEQ ID NO: 146039 - protein, 18 aa, Mycobacterium avium
DGAIWARYGVPWQPAYVF

SEQ ID NO: 146040 - protein, 18 aa, Mycobacterium avium
DGAPLPWTLVLSTTAPSV

SEQ ID NO: 146041 - protein, 17 aa, Mycobacterium avium
DKVNTRITVLGMNNTIT

SEQ ID NO: 146042 - protein, 24 aa, Mycobacterium avium
DLTLGEALTLWLSDTEQLVPRDLI

SEQ ID NO: 146043 - protein, 23 aa, Mycobacterium avium
DLVPEYIGNLLLYFEPASSATTL

SEQ ID NO: 146044 - protein, 22 aa, Mycobacterium avium
DMLEMLPTPWGLVRSGVAPDHP

SEQ ID NO: 146045 - protein, 22 aa, Mycobacterium avium
DPPPPCPNCHGGGGNPGGPGGG

SEQ ID NO: 146046 - protein, 17 aa, Mycobacterium avium
DVPSLLYSYSFVKNPTW

SEQ ID NO: 146047 - protein, 19 aa, Mycobacterium avium
EALVRWRHPIWGLLLPDSF

SEQ ID NO: 146048 - protein, 19 aa, Mycobacterium avium
EENFEVFRHASLLSAVFHE

SEQ ID NO: 146049 - protein, 21 aa, Mycobacterium avium
EGNVVAVLGMPVGKVSKVTSK

SEQ ID NO: 146050 - protein, 17 aa, Mycobacterium avium
FEEGLRETIDWYRANES

SEQ ID NO: 146051 - protein, 22 aa, Mycobacterium avium
FGVPLVCLLAGLLLAATHGVSG

SEQ ID NO: 146052 - protein, 22 aa, Mycobacterium avium
FNRNTWGVAMIGNFDDVPPTPV

SEQ ID NO: 146053 - protein, 17 aa, Mycobacterium avium
FQRTPCWVLPRLDVATP

SEQ ID NO: 146054 - protein, 19 aa, Mycobacterium avium
FSSLSGWAQLGLRDRFLAL

SEQ ID NO: 146055 - protein, 18 aa, Mycobacterium avium
FTGFPARHIPVLRTVDYR

SEQ ID NO: 146056 - protein, 17 aa, Mycobacterium avium
GAICRWQAANPAGLIDI

SEQ ID NO: 146057 - protein, 18 aa, Mycobacterium avium
GAKLGPSRTAGICAISPA

SEQ ID NO: 146058 - protein, 18 aa, Mycobacterium avium
GAVPSFLGYHGYPASICA

SEQ ID NO: 146059 - protein, 17 aa, Mycobacterium avium
GGESWSALTTMILPSGG

SEQ ID NO: 146060 - protein, 18 aa, Mycobacterium avium
GGLFGVLTNVVWTNRGPC

SEQ ID NO: 146061 - protein, 19 aa, Mycobacterium avium
GGRCPDVLMAWELSYAELA

SEQ ID NO: 146062 - protein, 22 aa, Mycobacterium avium
GGWPFYHMEMMLSGIPIPVPPG

SEQ ID NO: 146063 - protein, 22 aa, Mycobacterium avium
GHYTLRATVDWQQHKPDASHVV

SEQ ID NO: 146064 - protein, 17 aa, Mycobacterium avium
GQLGAPFVWPLVANAGE

SEQ ID NO: 146065 - protein, 19 aa, Mycobacterium avium
GRSGFLLAPWTAEQIVSEL

SEQ ID NO: 146066 - protein, 24 aa, Mycobacterium avium
GTVGYRFTWHLPKNRTWTYDGQLK

SEQ ID NO: 146067 - protein, 18 aa, Mycobacterium avium
GWYYLRIPSLAGIGRYTL

SEQ ID NO: 146068 - protein, 20 aa, Mycobacterium avium
GYPQRFGIPDGLYAEPVAVK

SEQ ID NO: 146069 - protein, 18 aa, Mycobacterium avium
IIRDCANTSIGVWSDNSL

SEQ ID NO: 146070 - protein, 18 aa, Mycobacterium avium
ILLDRGTCPFAQKEDVAA

SEQ ID NO: 146071 - protein, 17 aa, Mycobacterium avium
IVLHFPYAANVHCEIDV

SEQ ID NO: 146072 - protein, 23 aa, Mycobacterium avium
KALQGGAIYAHWQEIGGMNSVLG

SEQ ID NO: 146073 - protein, 19 aa, Mycobacterium avium
KGCPKDTWCVVNAGNYKGS

SEQ ID NO: 146074 - protein, 21 aa, Mycobacterium avium
KLREIRMALTLDKTFTKPEIL

SEQ ID NO: 146075 - protein, 19 aa, Mycobacterium avium
KVNGDWRPVAVGANGTTIS

SEQ ID NO: 146076 - protein, 19 aa, Mycobacterium avium
KVPMPYRRSMRISVESHLE

SEQ ID NO: 146077 - protein, 20 aa, Mycobacterium avium
LAGTVLRFVPPLAALADAVV

SEQ ID NO: 146078 - protein, 18 aa, Mycobacterium avium
LELRTSWRNPPRTLRVAN

SEQ ID NO: 146079 - protein, 22 aa, Mycobacterium avium
LGARSWPSRAWQVLSARGSRVS

SEQ ID NO: 146080 - protein, 17 aa, Mycobacterium avium
LGLRPRLAVGIHQPDPD

SEQ ID NO: 146081 - protein, 18 aa, Mycobacterium avium
LKIVSCYQYGKGNTADWL

SEQ ID NO: 146082 - protein, 19 aa, Mycobacterium avium
LLAPIAWMLGLRIVPMLAP

SEQ ID NO: 146083 - protein, 23 aa, Mycobacterium avium
LLFTEGRALVTLEFDSAPNDPID

SEQ ID NO: 146084 - protein, 19 aa, Mycobacterium avium
LTPPYRGGPVLKNHDTIGL

SEQ ID NO: 146085 - protein, 17 aa, Mycobacterium avium
MPIAALIIIAAGSQLSP

SEQ ID NO: 146086 - protein, 17 aa, Mycobacterium avium
MQVCPKAQCPFNTAESE

SEQ ID NO: 146087 - protein, 17 aa, Mycobacterium avium
MRIVLHFPYAANVHCEI

SEQ ID NO: 146088 - protein, 25 aa, Mycobacterium avium
NAFYTSRCNLIAWDRGVFMPVAQKY

SEQ ID NO: 146089 - protein, 19 aa, Mycobacterium avium
NGTHSWPYWNQQLMAMKPD

SEQ ID NO: 146090 - protein, 21 aa, Mycobacterium avium
NPEIRPAHLLMALLTQADGIA

SEQ ID NO: 146091 - protein, 22 aa, Mycobacterium avium
NPPVEGSWAWLPDEAQGARAHW

SEQ ID NO: 146092 - protein, 28 aa, Mycobacterium avium
PDGSMALWCWWPMPFARSARVSLANTGA

SEQ ID NO: 146093 - protein, 18 aa, Mycobacterium avium
PERQRYAALNPPNTQPPH

SEQ ID NO: 146094 - protein, 24 aa, Mycobacterium avium
PKFKRYAMSFGECLGSGPFFKAYV

SEQ ID NO: 146095 - protein, 20 aa, Mycobacterium avium
PQIQVGMPFCKIGAVTGETC

SEQ ID NO: 146096 - protein, 21 aa, Mycobacterium avium
PRFRFEELCGAPALPQDPRDS

SEQ ID NO: 146097 - protein, 24 aa, Mycobacterium avium
QAATLRPGNPITVAGIEVGHVTSM

SEQ ID NO: 146098 - protein, 19 aa, Mycobacterium avium
QFICSSIEAASRARLARVS

SEQ ID NO: 146099 - protein, 17 aa, Mycobacterium avium
QRDNCKLIDWPIATLSP

SEQ ID NO: 146100 - protein, 19 aa, Mycobacterium avium
RARMSSMLWTFKVQKDNGV

SEQ ID NO: 146101 - protein, 26 aa, Mycobacterium avium
RCGSPAWNLPVVFGPIAITYNVAGLN

SEQ ID NO: 146102 - protein, 19 aa, Mycobacterium avium
RETIDWYRANESWWRPLKD

SEQ ID NO: 146103 - protein, 19 aa, Mycobacterium avium
RKATALSLVLTLAVASVLV

SEQ ID NO: 146104 - protein, 21 aa, Mycobacterium avium
RPAGLPGLRQKYGLDIKPGNF

SEQ ID NO: 146105 - protein, 17 aa, Mycobacterium avium
RRFALRAALALLVVVVL

SEQ ID NO: 146106 - protein, 19 aa, Mycobacterium avium
RRPYTVILFDEIEKAHPDV

SEQ ID NO: 146107 - protein, 17 aa, Mycobacterium avium
RVDCGLAGTVLRFVPPL

SEQ ID NO: 146108 - protein, 17 aa, Mycobacterium avium
SCTWQLSLFIPDGVPPP

SEQ ID NO: 146109 - protein, 25 aa, Mycobacterium avium
SDALGAPGTEVWTFAALKPGSTTIT

SEQ ID NO: 146110 - protein, 23 aa, Mycobacterium avium
SDVPPELTALIGRDDDRGTETVA

SEQ ID NO: 146111 - protein, 20 aa, Mycobacterium avium
SIYAEYRLSSSVRRAADLGT

SEQ ID NO: 146112 - protein, 19 aa, Mycobacterium avium
SMGRPEFPTPVGSYTVLSK

SEQ ID NO: 146113 - protein, 19 aa, Mycobacterium avium
SSAQLPVWLSRAGADVLAA

SEQ ID NO: 146114 - protein, 18 aa, Mycobacterium avium
SVPRCVGNTLLLNGRTYS

SEQ ID NO: 146115 - protein, 20 aa, Mycobacterium avium
TGLRLRIEFDGRTTVDSPLG

SEQ ID NO: 146116 - protein, 24 aa, Mycobacterium avium
TITARLNFQLAFGARVGQRLAEAR

SEQ ID NO: 146117 - protein, 21 aa, Mycobacterium avium
VHNAVRFGFWGAEELGLIGSR

SEQ ID NO: 146118 - protein, 24 aa, Mycobacterium avium
VKKQFRGPNPWVMVSNFHVKIDGC

SEQ ID NO: 146119 - protein, 23 aa, Mycobacterium avium
VKQGWMCCIGADWMHLSTGVIGA

SEQ ID NO: 146120 - protein, 25 aa, Mycobacterium avium
VLDEATGRWGLRVARVELRSIDPPP

SEQ ID NO: 146121 - protein, 19 aa, Mycobacterium avium
VNYRIVLKPGWRFTDGSPV

SEQ ID NO: 146122 - protein, 17 aa, Mycobacterium avium
VPLAFALAAGSFRDGTR

SEQ ID NO: 146123 - protein, 18 aa, Mycobacterium avium
VTQWTRWRQPVIGMPTTP

SEQ ID NO: 146124 - protein, 22 aa, Mycobacterium avium
VVMPLIVRWGMYGGVRRNDPLG

SEQ ID NO: 146125 - protein, 21 aa, Mycobacterium avium
WLRARGLKLFPLVGWAERGGY

SEQ ID NO: 146126 - protein, 19 aa, Mycobacterium avium
WSGIPYLRFLASNVGRGQP

SEQ ID NO: 146127 - protein, 20 aa, Mycobacterium avium
WYRANESWWRPLKDASEARY

SEQ ID NO: 146128 - protein, 18 aa, Mycobacterium avium
YAAAPLRLHPDIHLYCAI

SEQ ID NO: 146129 - protein, 20 aa, Mycobacterium avium
YGALPIYVVFVYFRAPWRKF

SEQ ID NO: 146130 - protein, 30 aa, Mycobacterium avium
YGRRQICERLRLLPLRPFRNSYAYTNYGIT

SEQ ID NO: 146131 - protein, 25 aa, Mycobacterium avium
YKSGQPFLWDRGRELGMTNRLQQVP

SEQ ID NO: 146132 - protein, 25 aa, Mycobacterium avium
YLQRMSTILGRRVWENAGSPEVDSN

SEQ ID NO: 146133 - protein, 17 aa, Mycobacterium avium
YRLSSSVRRAADLGTDP

SEQ ID NO: 146134 - protein, 22 aa, Mycobacterium avium
AAGDLRLEWPLRPPPVVVRAFD

SEQ ID NO: 146135 - protein, 19 aa, Mycobacterium avium
AALRLFAAKGYAATSVADI

SEQ ID NO: 146136 - protein, 17 aa, Mycobacterium avium
AAPKVIWGLAADARAKP

SEQ ID NO: 146137 - protein, 17 aa, Mycobacterium avium
AAVQRSVVISAGWDVMD

SEQ ID NO: 146138 - protein, 18 aa, Mycobacterium avium
ADAKAVIVASNLVSARYV

SEQ ID NO: 146139 - protein, 22 aa, Mycobacterium avium
ADPAGWPRLDWSMDAALLLAAL

SEQ ID NO: 146140 - protein, 20 aa, Mycobacterium avium
AEGRLGWRTLDFEVEVLPIG

SEQ ID NO: 146141 - protein, 18 aa, Mycobacterium avium
AFATRPAGLPGLRQKYGL

SEQ ID NO: 146142 - protein, 17 aa, Mycobacterium avium
AFGRLDALINCAGIAEP

SEQ ID NO: 146143 - protein, 25 aa, Mycobacterium avium
AFQFITELVLLDWPTHLAQLASWLP

SEQ ID NO: 146144 - protein, 23 aa, Mycobacterium avium
AGRGGYGLGAPRYGVKPTVMPKP

SEQ ID NO: 146145 - protein, 18 aa, Mycobacterium avium
AITPGKCLSARGTNDSGG

SEQ ID NO: 146146 - protein, 17 aa, Mycobacterium avium
ALARRWWAAHGRGAFVA

SEQ ID NO: 146147 - protein, 23 aa, Mycobacterium avium
ALGRLRPLFRTGLGARLGSGRQY

SEQ ID NO: 146148 - protein, 23 aa, Mycobacterium avium
ALTYPRRLGFGLGNSVVSLSWRT

SEQ ID NO: 146149 - protein, 20 aa, Mycobacterium avium
APEHHEFKQAAVMSDLPGEL

SEQ ID NO: 146150 - protein, 17 aa, Mycobacterium avium
APRELGLLIGIVPGRPR

SEQ ID NO: 146151 - protein, 21 aa, Mycobacterium avium
ARPYRLSWPAGTTVYEIDQPE

SEQ ID NO: 146152 - protein, 19 aa, Mycobacterium avium
ASNITRLPVRYTFDNRYFS

SEQ ID NO: 146153 - protein, 17 aa, Mycobacterium avium
ASPRGAGNLGFAGTAPR

SEQ ID NO: 146154 - protein, 18 aa, Mycobacterium avium
AVLGGAYPGYGIYASADG

SEQ ID NO: 146155 - protein, 17 aa, Mycobacterium avium
AVLGRRSQQIAGLVANS

SEQ ID NO: 146156 - protein, 17 aa, Mycobacterium avium
AVLVLLPIVTFAMAYFI

SEQ ID NO: 146157 - protein, 21 aa, Mycobacterium avium
AVWLNPWRWYAAPRAVADSLT

SEQ ID NO: 146158 - protein, 19 aa, Mycobacterium avium
CIATLLMGLPVLAMTACSS

SEQ ID NO: 146159 - protein, 18 aa, Mycobacterium avium
CPHGGCPGGAAPKTTGPA

SEQ ID NO: 146160 - protein, 18 aa, Mycobacterium avium
DALCALGLQSRVVGAALP

SEQ ID NO: 146161 - protein, 20 aa, Mycobacterium avium
DAVRYSVRFGKPVVLPATTG

SEQ ID NO: 146162 - protein, 17 aa, Mycobacterium avium
DCTRQFGGRFAIQQISL

SEQ ID NO: 146163 - protein, 18 aa, Mycobacterium avium
DFPDRPDNMFALANTLMG

SEQ ID NO: 146164 - protein, 22 aa, Mycobacterium avium
DIWDWAVDWDTWVAMSALPPPT

SEQ ID NO: 146165 - protein, 22 aa, Mycobacterium avium
DLGALAGWYVWAALGLYPATPG

SEQ ID NO: 146166 - protein, 24 aa, Mycobacterium avium
DLKRSCLDIGLAARVLGWQPKVGL

SEQ ID NO: 146167 - protein, 25 aa, Mycobacterium avium
DVLTRLRGMFAFALWDTVTRELFCA

SEQ ID NO: 146168 - protein, 17 aa, Mycobacterium avium
EAAPCPHGGCPGGAAPK

SEQ ID NO: 146169 - protein, 17 aa, Mycobacterium avium
EALLAVASMLEGLGSSM

SEQ ID NO: 146170 - protein, 17 aa, Mycobacterium avium
EFAEAGWALPLSDDPAA

SEQ ID NO: 146171 - protein, 20 aa, Mycobacterium avium
EFGTRWFADKAFWVKDGQNY

SEQ ID NO: 146172 - protein, 17 aa, Mycobacterium avium
EGTPPLIARAFNKYVDR

SEQ ID NO: 146173 - protein, 22 aa, Mycobacterium avium
EILPAARPGALFIDSSTISVAD

SEQ ID NO: 146174 - protein, 20 aa, Mycobacterium avium
ELACALGLFPPTEEQAAVIA

SEQ ID NO: 146175 - protein, 19 aa, Mycobacterium avium
ESWSALTTMILPSGGAPYV

SEQ ID NO: 146176 - protein, 20 aa, Mycobacterium avium
ETRKSFGIAGARVVESIKLS

SEQ ID NO: 146177 - protein, 18 aa, Mycobacterium avium
EVVKRCYAEILPAARPGA

SEQ ID NO: 146178 - protein, 19 aa, Mycobacterium avium
FAIRLELRYLSERDETSML

SEQ ID NO: 146179 - protein, 22 aa, Mycobacterium avium
FAKPYAEWRGMFAGNGMLLPKS

SEQ ID NO: 146180 - protein, 17 aa, Mycobacterium avium
FDPREAITHGYVDSQKL

SEQ ID NO: 146181 - protein, 18 aa, Mycobacterium avium
FKGDPAFHGPMRRDWNYL

SEQ ID NO: 146182 - protein, 19 aa, Mycobacterium avium
GAGNLGFAGTAPRETVAAA

SEQ ID NO: 146183 - protein, 20 aa, Mycobacterium avium
GCGVSWNLLAGIGRIESGHA

SEQ ID NO: 146184 - protein, 19 aa, Mycobacterium avium
GIKLPRSSGAMYRVGQKIL

SEQ ID NO: 146185 - protein, 24 aa, Mycobacterium avium
GKFEWLDNRVVQWVPDRYWPAHST

SEQ ID NO: 146186 - protein, 19 aa, Mycobacterium avium
GKIREAWNVPRGADGTPEI

SEQ ID NO: 146187 - protein, 17 aa, Mycobacterium avium
GLPAIEDLHIWTAESVR

SEQ ID NO: 146188 - protein, 19 aa, Mycobacterium avium
GPKFAGPVNKHLVFVNQGG

SEQ ID NO: 146189 - protein, 25 aa, Mycobacterium avium
GPQRLSGPEALSFVRQRHELPRGDL

SEQ ID NO: 146190 - protein, 22 aa, Mycobacterium avium
GRAAVPWWPWAPLVQLMRVLPP

SEQ ID NO: 146191 - protein, 18 aa, Mycobacterium avium
GSSFKVFCLIAALEQGIG

SEQ ID NO: 146192 - protein, 21 aa, Mycobacterium avium
GTKPRCCPAPPAAAPTPNATA

SEQ ID NO: 146193 - protein, 23 aa, Mycobacterium avium
GTRCLLRNGGAWGGRADGYVGVY

SEQ ID NO: 146194 - protein, 18 aa, Mycobacterium avium
GVVTPMVHDFIARGPNGQ

SEQ ID NO: 146195 - protein, 20 aa, Mycobacterium avium
HSIRATVLVAEWPPRNVDPD

SEQ ID NO: 146196 - protein, 18 aa, Mycobacterium avium
ICQQISWGAPPAQLEGLA

SEQ ID NO: 146197 - protein, 19 aa, Mycobacterium avium
IDAPALWPGLPVRPVKGEV

SEQ ID NO: 146198 - protein, 17 aa, Mycobacterium avium
IDLLKGLVMPAITQGMH

SEQ ID NO: 146199 - protein, 19 aa, Mycobacterium avium
IDLRQDWPAALQDAGFDAA

SEQ ID NO: 146200 - protein, 17 aa, Mycobacterium avium
IDRLPNGVFLDWQQFQA

SEQ ID NO: 146201 - protein, 18 aa, Mycobacterium avium
IEDLHIWTAESVRADRLD

SEQ ID NO: 146202 - protein, 17 aa, Mycobacterium avium
IKNAIDWLSRPFGDGAL

SEQ ID NO: 146203 - protein, 17 aa, Mycobacterium avium
INAPVPFTGAPPTDNPN

SEQ ID NO: 146204 - protein, 19 aa, Mycobacterium avium
IPSLAGIGRYTLYAELPQS

SEQ ID NO: 146205 - protein, 17 aa, Mycobacterium avium
IRHTAWFGAAVGFAVTG

SEQ ID NO: 146206 - protein, 24 aa, Mycobacterium avium
KALDITLPMPARWTQVPDPNVPDA

SEQ ID NO: 146207 - protein, 19 aa, Mycobacterium avium
KEFAPLLGVRKAGLFTSSS

SEQ ID NO: 146208 - protein, 19 aa, Mycobacterium avium
KLGFPVPIRHWLRAGELLE

SEQ ID NO: 146209 - protein, 17 aa, Mycobacterium avium
KMSGEWSKDEVLQSYLN

SEQ ID NO: 146210 - protein, 17 aa, Mycobacterium avium
KRVRERFDLVGFDPRGV

SEQ ID NO: 146211 - protein, 18 aa, Mycobacterium avium
LAGAMPVILAAGAVLPGP

SEQ ID NO: 146212 - protein, 18 aa, Mycobacterium avium
LAKKLGLQRQWLHARSLS

SEQ ID NO: 146213 - protein, 18 aa, Mycobacterium avium
LARADIRGPYVINADGAP

SEQ ID NO: 146214 - protein, 23 aa, Mycobacterium avium
LDCLFPGLWPSFWGVNEDPLPDG

SEQ ID NO: 146215 - protein, 17 aa, Mycobacterium avium
LEPMAGKIIHCGAAGAG

SEQ ID NO: 146216 - protein, 17 aa, Mycobacterium avium
LGMDGVDPKGTVQLESA

SEQ ID NO: 146217 - protein, 19 aa, Mycobacterium avium
LHHPCCGDLVYGADPKLAK

SEQ ID NO: 146218 - protein, 17 aa, Mycobacterium avium
LLFTFTLIAVFGQLRFE

SEQ ID NO: 146219 - protein, 24 aa, Mycobacterium avium
LNTFRHLYGLDCSHIAPANVYGPR

SEQ ID NO: 146220 - protein, 23 aa, Mycobacterium avium
LPKAIVFRPVIERSPSGKADYRW

SEQ ID NO: 146221 - protein, 19 aa, Mycobacterium avium
LPQQARKGDLIFYGPEGTQ

SEQ ID NO: 146222 - protein, 21 aa, Mycobacterium avium
LRTGKPWFAIGGIDAQRLPEV

SEQ ID NO: 146223 - protein, 22 aa, Mycobacterium avium
LSEEDRRFAVVFAHDQSDYARM

SEQ ID NO: 146224 - protein, 24 aa, Mycobacterium avium
LSGLSTDVKFHWNGNAVELIGNTP

SEQ ID NO: 146225 - protein, 18 aa, Mycobacterium avium
MAFAAARYLTWLRATAEQ

SEQ ID NO: 146226 - protein, 19 aa, Mycobacterium avium
MGPMQFLPGTWARYASDGK

SEQ ID NO: 146227 - protein, 18 aa, Mycobacterium avium
MQQGCGGPPCKGAVVALE

SEQ ID NO: 146228 - protein, 21 aa, Mycobacterium avium
NHVPLTYPFALTFPALMSLVT

SEQ ID NO: 146229 - protein, 19 aa, Mycobacterium avium
NKTRLAALRVKDFGKRDVM

SEQ ID NO: 146230 - protein, 18 aa, Mycobacterium avium
NVPDAFAVIADRHGSSIY

SEQ ID NO: 146231 - protein, 19 aa, Mycobacterium avium
PAWDLPLVFGPIAITYNLP

SEQ ID NO: 146232 - protein, 20 aa, Mycobacterium avium
PDVPGRFVVAAAMVRHLLTD

SEQ ID NO: 146233 - protein, 19 aa, Mycobacterium avium
PEKHLPLVMPLKYIGIDEN

SEQ ID NO: 146234 - protein, 19 aa, Mycobacterium avium
PESIIRTGGTLAFSLAAYP

SEQ ID NO: 146235 - protein, 18 aa, Mycobacterium avium
PGTWARYASDGKGDGVAD

SEQ ID NO: 146236 - protein, 19 aa, Mycobacterium avium
PLEVARAFVGPDVLLGLSS

SEQ ID NO: 146237 - protein, 18 aa, Mycobacterium avium
PMGLGLVSQFFGKYFSPE

SEQ ID NO: 146238 - protein, 22 aa, Mycobacterium avium
PRSSGAMYRVGQKILPQQARKG

SEQ ID NO: 146239 - protein, 23 aa, Mycobacterium avium
QALSQFVAWPGLLVFQGKAKLLY

SEQ ID NO: 146240 - protein, 21 aa, Mycobacterium avium
QFIPETWRLYAVDAHNDGRVS

SEQ ID NO: 146241 - protein, 24 aa, Mycobacterium avium
QKFYGAECLFELGDLPGAADSDVG

SEQ ID NO: 146242 - protein, 19 aa, Mycobacterium avium
QLDRFAIRLELRYLSERDE

SEQ ID NO: 146243 - protein, 23 aa, Mycobacterium avium
QLQSAPRFANWVDRRFNAALRPG

SEQ ID NO: 146244 - protein, 19 aa, Mycobacterium avium
QPWVVSFQLNWPRDHGPTA

SEQ ID NO: 146245 - protein, 17 aa, Mycobacterium avium
QQAFALSCNTAFVQLGI

SEQ ID NO: 146246 - protein, 22 aa, Mycobacterium avium
RAVIPRDHIKSVLESADVVIWT

SEQ ID NO: 146247 - protein, 17 aa, Mycobacterium avium
RGHTRNCRLHWVQIIPT

SEQ ID NO: 146248 - protein, 18 aa, Mycobacterium avium
RGLSQRGVPFSWAGGGIN

SEQ ID NO: 146249 - protein, 18 aa, Mycobacterium avium
RKEQAWEFVKFATGPVGQ

SEQ ID NO: 146250 - protein, 18 aa, Mycobacterium avium
RKGDLIFYGPEGTQSVAM

SEQ ID NO: 146251 - protein, 17 aa, Mycobacterium avium
RKHFPGAVQTHFWSAQD

SEQ ID NO: 146252 - protein, 17 aa, Mycobacterium avium
RLAALAAVVLVGLILAG

SEQ ID NO: 146253 - protein, 20 aa, Mycobacterium avium
RMGSQMGVPYSWGGGSLDGP

SEQ ID NO: 146254 - protein, 18 aa, Mycobacterium avium
RPGGNWMLGKPIQVAEAR

SEQ ID NO: 146255 - protein, 19 aa, Mycobacterium avium
RRLLRLCARYASAPAVIFA

SEQ ID NO: 146256 - protein, 17 aa, Mycobacterium avium
RSATPLGDVFVAIKPPV

SEQ ID NO: 146257 - protein, 23 aa, Mycobacterium avium
RTLWPDRLWLAIARSPAREIDLT

SEQ ID NO: 146258 - protein, 17 aa, Mycobacterium avium
RTWPDKRIDLYFPGETA

SEQ ID NO: 146259 - protein, 17 aa, Mycobacterium avium
RVAPAYRQSVSASVSAS

SEQ ID NO: 146260 - protein, 18 aa, Mycobacterium avium
RVGQKILPQQARKGDLIF

SEQ ID NO: 146261 - protein, 17 aa, Mycobacterium avium
RVVCGGISIAGRWDTTA

SEQ ID NO: 146262 - protein, 25 aa, Mycobacterium avium
SDLPGELMGALSQGLSQFGINLPPV

SEQ ID NO: 146263 - protein, 28 aa, Mycobacterium avium
SKVGLPLVRRALELLPHVGFVNAYGLTE

SEQ ID NO: 146264 - protein, 22 aa, Mycobacterium avium
SPRDGWTLISWNGKPVHPGWSA

SEQ ID NO: 146265 - protein, 22 aa, Mycobacterium avium
SRRLWTVLIFMLWHAIFVEHSV

SEQ ID NO: 146266 - protein, 18 aa, Mycobacterium avium
SSVPPVPGKFYWMTPTQL

SEQ ID NO: 146267 - protein, 18 aa, Mycobacterium avium
TGSPYAIEYVWGRQVGDN

SEQ ID NO: 146268 - protein, 19 aa, Mycobacterium avium
TGTKYAVRWQDYDTGAPIT

SEQ ID NO: 146269 - protein, 24 aa, Mycobacterium avium
TNWFGDQPFAVWPWAADKLGGAQP

SEQ ID NO: 146270 - protein, 17 aa, Mycobacterium avium
TPFQGGWQLSRHTAETL

SEQ ID NO: 146271 - protein, 20 aa, Mycobacterium avium
TPTQLRWRPLSFWPAHTAVT

SEQ ID NO: 146272 - protein, 21 aa, Mycobacterium avium
TRAESRWFASAGFSLVNMTGY

SEQ ID NO: 146273 - protein, 18 aa, Mycobacterium avium
TRGSMCFRVSSDKQVVFT

SEQ ID NO: 146274 - protein, 22 aa, Mycobacterium avium
TRLLRPSIMWRAARARGADHPG

SEQ ID NO: 146275 - protein, 17 aa, Mycobacterium avium
TRVPHVWVRDGVSTLDL

SEQ ID NO: 146276 - protein, 17 aa, Mycobacterium avium
TVKFRIGPDGKLQTIGK

SEQ ID NO: 146277 - protein, 21 aa, Mycobacterium avium
VAKAFAAKGFEVFGTTRNPRT

SEQ ID NO: 146278 - protein, 22 aa, Mycobacterium avium
VASPCAYFLVYESTAGNKAPEH

SEQ ID NO: 146279 - protein, 19 aa, Mycobacterium avium
VAVATRFPGPITDLQLSRD

SEQ ID NO: 146280 - protein, 23 aa, Mycobacterium avium
VDKFPRMVDYVLPTGVRIADADR

SEQ ID NO: 146281 - protein, 23 aa, Mycobacterium avium
VDPKGALARWNWVLDGMVETKAL

SEQ ID NO: 146282 - protein, 18 aa, Mycobacterium avium
VDYQRLGKMPPLQTGGLH

SEQ ID NO: 146283 - protein, 17 aa, Mycobacterium avium
VFCLIAALEQGIGLGYQ

SEQ ID NO: 146284 - protein, 23 aa, Mycobacterium avium
VGAAARGGRRLVIAMMYGLIKEG

SEQ ID NO: 146285 - protein, 18 aa, Mycobacterium avium
VGFGGWYAPVALRVDTAS

SEQ ID NO: 146286 - protein, 17 aa, Mycobacterium avium
VGHAPRFERVVFRGDVA

SEQ ID NO: 146287 - protein, 23 aa, Mycobacterium avium
VGRLLGWRLGMDGVDPKGTVQLE

SEQ ID NO: 146288 - protein, 20 aa, Mycobacterium avium
VLTSCGWKGISNVSIPGGPG

SEQ ID NO: 146289 - protein, 17 aa, Mycobacterium avium
VPDPRYVAVPDHDQLAT

SEQ ID NO: 146290 - protein, 20 aa, Mycobacterium avium
WDMGAYAWPGPERLRFANDP

SEQ ID NO: 146291 - protein, 18 aa, Mycobacterium avium
WFASAGFSLVNMTGYPEA

SEQ ID NO: 146292 - protein, 19 aa, Mycobacterium avium
WMLGLRIVPMLAPGSADAN

SEQ ID NO: 146293 - protein, 17 aa, Mycobacterium avium
WPGLLVFQGKAKLLYDG

SEQ ID NO: 146294 - protein, 19 aa, Mycobacterium avium
WPVCGGPLSGPTPRDVPAP

SEQ ID NO: 146295 - protein, 17 aa, Mycobacterium avium
YGALRLGAKLGPSRTAG

SEQ ID NO: 146296 - protein, 17 aa, Mycobacterium avium
YKSFNWDQAYRKEIVWT

SEQ ID NO: 146297 - protein, 25 aa, Mycobacterium avium
YNTFTVIPVFNWQYGGWGYWFFGVW

SEQ ID NO: 146298 - protein, 17 aa, Mycobacterium avium
AAAPCPHGGCPGGAAPK

SEQ ID NO: 146299 - protein, 18 aa, Mycobacterium avium
AAEDWLCLLEAFDQPHRP

SEQ ID NO: 146300 - protein, 18 aa, Mycobacterium avium
AAGQMIVHGFGVGANFGG

SEQ ID NO: 146301 - protein, 20 aa, Mycobacterium avium
AALAGLSGWLGYRAYQQHDA

SEQ ID NO: 146302 - protein, 17 aa, Mycobacterium avium
AARGVDVTPFFAVLNGP

SEQ ID NO: 146303 - protein, 21 aa, Mycobacterium avium
ACVALCAAALAGCQQPHKPAP

SEQ ID NO: 146304 - protein, 19 aa, Mycobacterium avium
ADAKAVIVASNLVSARYVQ

SEQ ID NO: 146305 - protein, 17 aa, Mycobacterium avium
ADPFTKLHCCIRSDGGA

SEQ ID NO: 146306 - protein, 20 aa, Mycobacterium avium
AEIALAVLCTFVISKTLPDS

SEQ ID NO: 146307 - protein, 21 aa, Mycobacterium avium
AELRTATPLGDVFVALKPPPG

SEQ ID NO: 146308 - protein, 18 aa, Mycobacterium avium
AEVRRCAIEKMGWDQFVL

SEQ ID NO: 146309 - protein, 19 aa, Mycobacterium avium
AFERLLQRRVQVIALEAEQ

SEQ ID NO: 146310 - protein, 17 aa, Mycobacterium avium
AGYWWPNRDFVMVCDTP

SEQ ID NO: 146311 - protein, 20 aa, Mycobacterium avium
AHWQTAAVLFGVWWIGAEAV

SEQ ID NO: 146312 - protein, 24 aa, Mycobacterium avium
AIFTAVCLLFTFTLIAVFGQLRFE

SEQ ID NO: 146313 - protein, 23 aa, Mycobacterium avium
AIILPGGWWLLSLQALGLAQNAP

SEQ ID NO: 146314 - protein, 20 aa, Mycobacterium avium
AILLPAHWQTAAVLFGVWWI

SEQ ID NO: 146315 - protein, 22 aa, Mycobacterium avium
AKLCVQYLAPIIKNRQVNFPPL

SEQ ID NO: 146316 - protein, 20 aa, Mycobacterium avium
AKLWTIADLGGWSAADPQLF

SEQ ID NO: 146317 - protein, 18 aa, Mycobacterium avium
ALARRWWAAHGRGAFVAV

SEQ ID NO: 146318 - protein, 22 aa, Mycobacterium avium
ALGRLRPLFRTGLGTRLGSGRQ

SEQ ID NO: 146319 - protein, 25 aa, Mycobacterium avium
ANGGNAQRWFVVWLGTSNDPVDKVA

SEQ ID NO: 146320 - protein, 19 aa, Mycobacterium avium
AQAQVVAWWSPAYHEPNGG

SEQ ID NO: 146321 - protein, 19 aa, Mycobacterium avium
AQPGLSAKIVFPHPNTETG

SEQ ID NO: 146322 - protein, 18 aa, Mycobacterium avium
ARGPLQWEAPYGHTLISK

SEQ ID NO: 146323 - protein, 17 aa, Mycobacterium avium
ARTGVDVVRLVAGDPLT

SEQ ID NO: 146324 - protein, 25 aa, Mycobacterium avium
ASAGRAGLVGSLSVPANWASAVPAV

SEQ ID NO: 146325 - protein, 21 aa, Mycobacterium avium
ASHMRFWFGAVYGRACRLTGR

SEQ ID NO: 146326 - protein, 23 aa, Mycobacterium avium
ASPKETWLRLLLIDAGIPVPATQ

SEQ ID NO: 146327 - protein, 23 aa, Mycobacterium avium
ATPLRPGVWHAYADHRMAMAGAI

SEQ ID NO: 146328 - protein, 17 aa, Mycobacterium avium
AVGDWMLLAAIQALIDG

SEQ ID NO: 146329 - protein, 24 aa, Mycobacterium avium
AVLHRFLRWRLAGYDPDRHLGGIL

SEQ ID NO: 146330 - protein, 24 aa, Mycobacterium avium
AVLHRFLRWRLAGYEPDRHLGGIL

SEQ ID NO: 146331 - protein, 20 aa, Mycobacterium avium
AVRPGVVVLLNLSRDQLDRV

SEQ ID NO: 146332 - protein, 20 aa, Mycobacterium avium
AWMLGLRIVPMLAPGSADAN

SEQ ID NO: 146333 - protein, 18 aa, Mycobacterium avium
AWRHLPFAAQWHSDNELA

SEQ ID NO: 146334 - protein, 18 aa, Mycobacterium avium
CAVPGAWPPVAIGGRRYM

SEQ ID NO: 146335 - protein, 26 aa, Mycobacterium avium
CETGPSVAWSDGWGLYTWHGTSVPRD

SEQ ID NO: 146336 - protein, 17 aa, Mycobacterium avium
CGFRGLNSFNLPGTKGG

SEQ ID NO: 146337 - protein, 18 aa, Mycobacterium avium
CPHGGCPGGAAPKPTGPA

SEQ ID NO: 146338 - protein, 18 aa, Mycobacterium avium
CREALAVNVKPKFAVDAM

SEQ ID NO: 146339 - protein, 24 aa, Mycobacterium avium
DAFLEPFGKFWVNHREEFIEKVRE

SEQ ID NO: 146340 - protein, 17 aa, Mycobacterium avium
DAQALWPGLPVRPVKGE

SEQ ID NO: 146341 - protein, 22 aa, Mycobacterium avium
DARSWRLPWPAGTTVYELDQPR

SEQ ID NO: 146342 - protein, 17 aa, Mycobacterium avium
DCSGLMRYGFAGVGVLI

SEQ ID NO: 146343 - protein, 18 aa, Mycobacterium avium
DELIPLLGNQGLDTSRVA

SEQ ID NO: 146344 - protein, 23 aa, Mycobacterium avium
DGDRAHWDWLKWLPHNRHPTHYD

SEQ ID NO: 146345 - protein, 22 aa, Mycobacterium avium
DGRHRLLPGQCLTEIALNPLRA

SEQ ID NO: 146346 - protein, 18 aa, Mycobacterium avium
DIRLARQRLGWRPRVDYR

SEQ ID NO: 146347 - protein, 18 aa, Mycobacterium avium
DITDPKLLAAFGVGARDA

SEQ ID NO: 146348 - protein, 17 aa, Mycobacterium avium
DLLSRPGVFVFGSNDYF

SEQ ID NO: 146349 - protein, 20 aa, Mycobacterium avium
DLSRFYVRFGRYEMKNSGAF

SEQ ID NO: 146350 - protein, 21 aa, Mycobacterium avium
DPLSEIWFLLTGQTSLPTNLG

SEQ ID NO: 146351 - protein, 18 aa, Mycobacterium avium
DRFRRWANDNSRIIPRLR

SEQ ID NO: 146352 - protein, 18 aa, Mycobacterium avium
DRPDNMFALANTLMGLAT

SEQ ID NO: 146353 - protein, 19 aa, Mycobacterium avium
DRPDNMFALANTLMGLATG

SEQ ID NO: 146354 - protein, 18 aa, Mycobacterium avium
DSCQWFKSQFDPLMGQIN

SEQ ID NO: 146355 - protein, 17 aa, Mycobacterium avium
DTSRLLARFPALGGTDT

SEQ ID NO: 146356 - protein, 18 aa, Mycobacterium avium
DVPGRFVAAAAMVRHLLT

SEQ ID NO: 146357 - protein, 25 aa, Mycobacterium avium
DYIWRWDTDWFWCSRAFGVQNPRVR

SEQ ID NO: 146358 - protein, 20 aa, Mycobacterium avium
EELRAGPGLVYGYTAELDTA

SEQ ID NO: 146359 - protein, 18 aa, Mycobacterium avium
EFNRTRVGLMGALVTVLV

SEQ ID NO: 146360 - protein, 18 aa, Mycobacterium avium
EFRCARCAKPYTGELPAM

SEQ ID NO: 146361 - protein, 21 aa, Mycobacterium avium
EGHSMFPWLTLALVGSSTSHV

SEQ ID NO: 146362 - protein, 18 aa, Mycobacterium avium
EHHNLPALRDWLRRQRDE

SEQ ID NO: 146363 - protein, 18 aa, Mycobacterium avium
EIPLDFRILDTILGAQTT

SEQ ID NO: 146364 - protein, 20 aa, Mycobacterium avium
ELACALALFPPTEEQAAVIA

SEQ ID NO: 146365 - protein, 18 aa, Mycobacterium avium
ELLDRLGAHLTRHVGPGV

SEQ ID NO: 146366 - protein, 26 aa, Mycobacterium avium
ELPGCPGSVCAGKIKQAYGLAYQQSL

SEQ ID NO: 146367 - protein, 25 aa, Mycobacterium avium
ENFWRSAGLPAFRWPDPNGTRLPNG

SEQ ID NO: 146368 - protein, 17 aa, Mycobacterium avium
EPEYGGLVRFVTRPPAG

SEQ ID NO: 146369 - protein, 22 aa, Mycobacterium avium
EPGIYFPGRWGARIEDIVVVTD

SEQ ID NO: 146370 - protein, 22 aa, Mycobacterium avium
EPPREWRMRIEVRSVGDDAKVS

SEQ ID NO: 146371 - protein, 22 aa, Mycobacterium avium
EPPRPAWDRPLPPPGGHWDYGP

SEQ ID NO: 146372 - protein, 18 aa, Mycobacterium avium
EPRWPCYAPAAVQLGVLS

SEQ ID NO: 146373 - protein, 20 aa, Mycobacterium avium
ESVALLFNRRAEAVVAVLAV

SEQ ID NO: 146374 - protein, 18 aa, Mycobacterium avium
EVPARLEALGALGGLDRA

SEQ ID NO: 146375 - protein, 22 aa, Mycobacterium avium
EYVEMWLRDVAAMLGYHAGAQS

SEQ ID NO: 146376 - protein, 17 aa, Mycobacterium avium
FATRPAGLPGLRQKYGL

SEQ ID NO: 146377 - protein, 23 aa, Mycobacterium avium
FEACQAVGLPVVWQDDADVPFAY

SEQ ID NO: 146378 - protein, 23 aa, Mycobacterium avium
FEACQAVGLPVVWQDDAEVPFAY

SEQ ID NO: 146379 - protein, 17 aa, Mycobacterium avium
FGDFRFGPESTYHATFV

SEQ ID NO: 146380 - protein, 21 aa, Mycobacterium avium
FGDRPGYRFVQRDVCDPGLID

SEQ ID NO: 146381 - protein, 21 aa, Mycobacterium avium
FSVGWGRPDLRSQWEHGSPQV

SEQ ID NO: 146382 - protein, 25 aa, Mycobacterium avium
GATLRRAALVVPRYGVRITVMARPP

SEQ ID NO: 146383 - protein, 23 aa, Mycobacterium avium
GDGRGTVYLATRGGYFVLDLATG

SEQ ID NO: 146384 - protein, 23 aa, Mycobacterium avium
GDIWDWAVDWDTWVAMSALPPPT

SEQ ID NO: 146385 - protein, 20 aa, Mycobacterium avium
GDLHLEWPLRPPPVVVRAFE

SEQ ID NO: 146386 - protein, 23 aa, Mycobacterium avium
GEDYLRLAALGAYGSFFNIYFCS

SEQ ID NO: 146387 - protein, 24 aa, Mycobacterium avium
GEPPRPAWDRPLPPPGGHWDYGPI

SEQ ID NO: 146388 - protein, 18 aa, Mycobacterium avium
GGACLHWGALWGPASGAR

SEQ ID NO: 146389 - protein, 19 aa, Mycobacterium avium
GHAMFPWLTLALVGSATSH

SEQ ID NO: 146390 - protein, 18 aa, Mycobacterium avium
GKPWFAIGGIDAQRLPEV

SEQ ID NO: 146391 - protein, 22 aa, Mycobacterium avium
GLAFATLCTRSYYATRLDGPCN

SEQ ID NO: 146392 - protein, 24 aa, Mycobacterium avium
GLGTARFVGAMAVPPTWQGSMPAY

SEQ ID NO: 146393 - protein, 17 aa, Mycobacterium avium
GLRLDWPDDGTIGASGF

SEQ ID NO: 146394 - protein, 22 aa, Mycobacterium avium
GNSAPRFHITWGTGPALVEIFA

SEQ ID NO: 146395 - protein, 18 aa, Mycobacterium avium
GPADLSFGGARVVLTAGY

SEQ ID NO: 146396 - protein, 20 aa, Mycobacterium avium
GPGGAPGCWQKITRDLWPAP

SEQ ID NO: 146397 - protein, 18 aa, Mycobacterium avium
GPLPLGTPVTGRLYFDVR

SEQ ID NO: 146398 - protein, 19 aa, Mycobacterium avium
GRAAVPWWPWAPLVQLMRV

SEQ ID NO: 146399 - protein, 18 aa, Mycobacterium avium
GRGAWPVCGGPLSGPTPR

SEQ ID NO: 146400 - protein, 23 aa, Mycobacterium avium
GSPRDGWTLISWNGKPVHPGWSA

SEQ ID NO: 146401 - protein, 21 aa, Mycobacterium avium
GTKPRCCPAPPAAAPTPSATA

SEQ ID NO: 146402 - protein, 17 aa, Mycobacterium avium
GTKYAVRWQDYDTGAPI

SEQ ID NO: 146403 - protein, 21 aa, Mycobacterium avium
GVGVPPRYGVRLTVMPRPPAA

SEQ ID NO: 146404 - protein, 18 aa, Mycobacterium avium
GVPPRYGVRLTVMPRPPA

SEQ ID NO: 146405 - protein, 19 aa, Mycobacterium avium
GVVTPMVHDFIARGPNGQN

SEQ ID NO: 146406 - protein, 19 aa, Mycobacterium avium
HAAASCYRSVIAGLTTGRW

SEQ ID NO: 146407 - protein, 30 aa, Mycobacterium avium
HPAPWRWPAPPPWPCWSRWPARSPPSRHAD

SEQ ID NO: 146408 - protein, 19 aa, Mycobacterium avium
HPPGIDFRPALLAGVQIGL

SEQ ID NO: 146409 - protein, 20 aa, Mycobacterium avium
HPTARIEFMVADAAPIAAIT

SEQ ID NO: 146410 - protein, 18 aa, Mycobacterium avium
HRAMLEAFAQWRANTRGA

SEQ ID NO: 146411 - protein, 21 aa, Mycobacterium avium
HSMGGVVAFEFARVAEANGTP

SEQ ID NO: 146412 - protein, 17 aa, Mycobacterium avium
IDAVLARAARIGPMSVP

SEQ ID NO: 146413 - protein, 18 aa, Mycobacterium avium
IDLGGPVVRTLAFGDSIP

SEQ ID NO: 146414 - protein, 24 aa, Mycobacterium avium
IFLREVQDVWTWVRPYFDDRATGA

SEQ ID NO: 146415 - protein, 18 aa, Mycobacterium avium
IGLIPRTDHGPMLKDGQR

SEQ ID NO: 146416 - protein, 23 aa, Mycobacterium avium
IPDAARYSVRFGKPVVLPATTGL

SEQ ID NO: 146417 - protein, 17 aa, Mycobacterium avium
IPIGRAMAVANQIRSGA

SEQ ID NO: 146418 - protein, 18 aa, Mycobacterium avium
IPSLAGIGRYTLYVELPQ

SEQ ID NO: 146419 - protein, 19 aa, Mycobacterium avium
IRPDGSWKRCMFAHGQYGG

SEQ ID NO: 146420 - protein, 17 aa, Mycobacterium avium
ITPGKCLSARGTNDSGG

SEQ ID NO: 146421 - protein, 18 aa, Mycobacterium avium
IVLGGNMIQYNWTINGEP

SEQ ID NO: 146422 - protein, 28 aa, Mycobacterium avium
KAAVRLGSDMGEFFMPYPGTRINQDSTP

SEQ ID NO: 146423 - protein, 17 aa, Mycobacterium avium
KAGCSTYKWETFLTSEL

SEQ ID NO: 146424 - protein, 18 aa, Mycobacterium avium
KEFAPLLGVRKAGLFTSS

SEQ ID NO: 146425 - protein, 17 aa, Mycobacterium avium
KEQAWEFVKFATGPVGQ

SEQ ID NO: 146426 - protein, 23 aa, Mycobacterium avium
KFEWLDNRVVQWVPDRYWPAHST

SEQ ID NO: 146427 - protein, 26 aa, Mycobacterium avium
KKFRIAEAWMRRTIRWIKENLPGADY

SEQ ID NO: 146428 - protein, 20 aa, Mycobacterium avium
KMSGGQGFAIPIGRAMAVAN

SEQ ID NO: 146429 - protein, 18 aa, Mycobacterium avium
KNPDNWRFAPPAPPEPSP

SEQ ID NO: 146430 - protein, 19 aa, Mycobacterium avium
KQMWKGCREVLAATSARLD

SEQ ID NO: 146431 - protein, 20 aa, Mycobacterium avium
KQMWKGCREVLAATSARLDW

SEQ ID NO: 146432 - protein, 21 aa, Mycobacterium avium
KRMGSQMGVPYSWGGGSLDGP

SEQ ID NO: 146433 - protein, 18 aa, Mycobacterium avium
KRVRERFDLVGFDPRGVG

SEQ ID NO: 146434 - protein, 18 aa, Mycobacterium avium
KSGCYWARLRSFDTNDII

SEQ ID NO: 146435 - protein, 26 aa, Mycobacterium avium
KSSRYPGGLALRFARVLRYRDDKGPA

SEQ ID NO: 146436 - protein, 18 aa, Mycobacterium avium
KVGVEFDGAQHWTDPAQR

SEQ ID NO: 146437 - protein, 18 aa, Mycobacterium avium
KYTLWRLQERVVGRGPNA

SEQ ID NO: 146438 - protein, 17 aa, Mycobacterium avium
LAAASGKTLGPRYGVIP

SEQ ID NO: 146439 - protein, 19 aa, Mycobacterium avium
LAEAGWPARVWADTMPADT

SEQ ID NO: 146440 - protein, 17 aa, Mycobacterium avium
LALCWPIAPAAAPDPAA

SEQ ID NO: 146441 - protein, 17 aa, Mycobacterium avium
LALCWPIAPAAAPDPGA

SEQ ID NO: 146442 - protein, 24 aa, Mycobacterium avium
LAMASAFAPYMAWMAGAAGRAAET

SEQ ID NO: 146443 - protein, 19 aa, Mycobacterium avium
LANRARLLVLIATNFFGQN

SEQ ID NO: 146444 - protein, 18 aa, Mycobacterium avium
LAVEVFEAAFAMTVPPPA

SEQ ID NO: 146445 - protein, 17 aa, Mycobacterium avium
LCRLAFAARAGWQRWEA

SEQ ID NO: 146446 - protein, 17 aa, Mycobacterium avium
LFNNILPAHIVKDVPGG

SEQ ID NO: 146447 - protein, 21 aa, Mycobacterium avium
LGKIREAWNVPRGADGTPEIT

SEQ ID NO: 146448 - protein, 17 aa, Mycobacterium avium
LLAAFGVGARDAGRDVS

SEQ ID NO: 146449 - protein, 18 aa, Mycobacterium avium
LLALCWPIAPAAAPDPAA

SEQ ID NO: 146450 - protein, 18 aa, Mycobacterium avium
LLGGMAMGIVGAPSAAAA

SEQ ID NO: 146451 - protein, 24 aa, Mycobacterium avium
LLTPRLAQLIAIGGFRNWDRMVKR

SEQ ID NO: 146452 - protein, 21 aa, Mycobacterium avium
LNGRGARLGQMFSDLNNFLGK

SEQ ID NO: 146453 - protein, 24 aa, Mycobacterium avium
LPKAIVFRPVIERSPSGKADYRWA

SEQ ID NO: 146454 - protein, 19 aa, Mycobacterium avium
LPPWNEVLQNLGFSNASTA

SEQ ID NO: 146455 - protein, 18 aa, Mycobacterium avium
LRAGPGLVYGYTAELDTA

SEQ ID NO: 146456 - protein, 18 aa, Mycobacterium avium
LRDPALLPRIVWGNLRAR

SEQ ID NO: 146457 - protein, 18 aa, Mycobacterium avium
LRLFGIDWDPVEGTLNGL

SEQ ID NO: 146458 - protein, 17 aa, Mycobacterium avium
LRSKPVWVLGSAETTSH

SEQ ID NO: 146459 - protein, 20 aa, Mycobacterium avium
LRVIRRRSWQGLTLLVAAMV

SEQ ID NO: 146460 - protein, 21 aa, Mycobacterium avium
LSDLQPGDVLTFYSDASHAGI

SEQ ID NO: 146461 - protein, 19 aa, Mycobacterium avium
LSIPSWWQPYVLSVASLTP

SEQ ID NO: 146462 - protein, 18 aa, Mycobacterium avium
LSVPANWASAVPAVRTVA

SEQ ID NO: 146463 - protein, 17 aa, Mycobacterium avium
LTGWLAYRGYQSHQADE

SEQ ID NO: 146464 - protein, 18 aa, Mycobacterium avium
LTSCGWKGISNVSIPGGP

SEQ ID NO: 146465 - protein, 17 aa, Mycobacterium avium
LVGPVWRRDEVFEFNGS

SEQ ID NO: 146466 - protein, 18 aa, Mycobacterium avium
LYEGDSFYGLWQQLSNVS

SEQ ID NO: 146467 - protein, 19 aa, Mycobacterium avium
MAFAAARYLTWLRATAEQT

SEQ ID NO: 146468 - protein, 17 aa, Mycobacterium avium
MASAVAPYVGWMSTTAA

SEQ ID NO: 146469 - protein, 17 aa, Mycobacterium avium
MGVPYSWGGGSLDGPSK

SEQ ID NO: 146470 - protein, 17 aa, Mycobacterium avium
MIFPVLKLHEKWLGVGR

SEQ ID NO: 146471 - protein, 19 aa, Mycobacterium avium
MQQGCGGPPCKGAVVALEP

SEQ ID NO: 146472 - protein, 17 aa, Mycobacterium avium
NAAAFGRDADAIAGIEH

SEQ ID NO: 146473 - protein, 20 aa, Mycobacterium avium
NACRKCGALIQQGASNYSAA

SEQ ID NO: 146474 - protein, 21 aa, Mycobacterium avium
NAVGGFSYVLPAGWVESDASH

SEQ ID NO: 146475 - protein, 22 aa, Mycobacterium avium
NGGLRFAPRADLATREEQITVA

SEQ ID NO: 146476 - protein, 20 aa, Mycobacterium avium
NHVPLTYPFALTFPALMSLV

SEQ ID NO: 146477 - protein, 20 aa, Mycobacterium avium
NKTRLAALRVKDFGKRDVMV

SEQ ID NO: 146478 - protein, 19 aa, Mycobacterium avium
NPELRWKVGPVTNANGMLS

SEQ ID NO: 146479 - protein, 20 aa, Mycobacterium avium
NPELRWKVGPVTNANGMLSS

SEQ ID NO: 146480 - protein, 25 aa, Mycobacterium avium
NPQRVWGWYLWRHYLVADVAPNAGH

SEQ ID NO: 146481 - protein, 25 aa, Mycobacterium avium
NWWESRALYGWTVLVPRTKDQAGEM

SEQ ID NO: 146482 - protein, 18 aa, Mycobacterium avium
PAAWRFSRGDGQLVAVLD

SEQ ID NO: 146483 - protein, 18 aa, Mycobacterium avium
PAPPRPADDLGYRPASRE

SEQ ID NO: 146484 - protein, 17 aa, Mycobacterium avium
PAWDLPLVFGPIAITYN

SEQ ID NO: 146485 - protein, 17 aa, Mycobacterium avium
PEHAFTWAVVGLINASL

SEQ ID NO: 146486 - protein, 18 aa, Mycobacterium avium
PEHAFTWAVVGLINASLN

SEQ ID NO: 146487 - protein, 19 aa, Mycobacterium avium
PELPGVVVRPLLPLTERRL

SEQ ID NO: 146488 - protein, 20 aa, Mycobacterium avium
PGDLGPRFTFVPADVTDESA

SEQ ID NO: 146489 - protein, 25 aa, Mycobacterium avium
PGEPPRPAWDRPLPPPGGHWDYGPI

SEQ ID NO: 146490 - protein, 22 aa, Mycobacterium avium
PGLEVLGGITLGSERYRFPKNL

SEQ ID NO: 146491 - protein, 18 aa, Mycobacterium avium
PHFLGLDYWQMWHYGDST

SEQ ID NO: 146492 - protein, 20 aa, Mycobacterium avium
PKESWLRVLLIDAGFPRPQT

SEQ ID NO: 146493 - protein, 23 aa, Mycobacterium avium
PNNANCTFPMEFTPFQGGWQLSR

SEQ ID NO: 146494 - protein, 19 aa, Mycobacterium avium
PQLGRWKWHDPYVHASLLA

SEQ ID NO: 146495 - protein, 20 aa, Mycobacterium avium
PQWPELEAAALKRIRGPRVG

SEQ ID NO: 146496 - protein, 20 aa, Mycobacterium avium
PRLAGSAVIPVMTAEASAKE

SEQ ID NO: 146497 - protein, 20 aa, Mycobacterium avium
PRLQRIFTFQSLYAGVAPRD

SEQ ID NO: 146498 - protein, 17 aa, Mycobacterium avium
PRLSWAAGLRDDGTTTL

SEQ ID NO: 146499 - protein, 17 aa, Mycobacterium avium
PRPGPALNGRSVDQVLQ

SEQ ID NO: 146500 - protein, 27 aa, Mycobacterium avium
PTMYELFSVGWGRPDLRSQWEHGSPQV

SEQ ID NO: 146501 - protein, 24 aa, Mycobacterium avium
QAAHARFVEVAARVNTLLDIAQAN

SEQ ID NO: 146502 - protein, 22 aa, Mycobacterium avium
QFIPETWRLYAVDAHNDGRVSP

SEQ ID NO: 146503 - protein, 23 aa, Mycobacterium avium
QKFYGAECLFELGDLPGAADSDV

SEQ ID NO: 146504 - protein, 17 aa, Mycobacterium avium
QLGRWKWHDPYVHASLL

SEQ ID NO: 146505 - protein, 22 aa, Mycobacterium avium
QSVVFRPAFEFIEQQWRELGVV

SEQ ID NO: 146506 - protein, 17 aa, Mycobacterium avium
QVPPRVAALPGPATALT

SEQ ID NO: 146507 - protein, 18 aa, Mycobacterium avium
RALIKVMTILGSRYLELV

SEQ ID NO: 146508 - protein, 20 aa, Mycobacterium avium
RAQAQVVAWWSPAYHEPNGG

SEQ ID NO: 146509 - protein, 19 aa, Mycobacterium avium
RAYRLDWPAATTIFELDQP

SEQ ID NO: 146510 - protein, 18 aa, Mycobacterium avium
RCGLAAVAAVGCWANASL

SEQ ID NO: 146511 - protein, 18 aa, Mycobacterium avium
RCGLAAVAAVGCWASVPT

SEQ ID NO: 146512 - protein, 17 aa, Mycobacterium avium
RFVELWRAGRLPVESLV

SEQ ID NO: 146513 - protein, 17 aa, Mycobacterium avium
RGAWPVCGGPLSGPTPR

SEQ ID NO: 146514 - protein, 24 aa, Mycobacterium avium
RGYWKRPGLTAARFVANPFGAEPG

SEQ ID NO: 146515 - protein, 18 aa, Mycobacterium avium
RHTAWFGAAVGFALTGGE

SEQ ID NO: 146516 - protein, 19 aa, Mycobacterium avium
RKLQVANRVELARYAIEHG

SEQ ID NO: 146517 - protein, 17 aa, Mycobacterium avium
RLAALAAVVLVGLIVAG

SEQ ID NO: 146518 - protein, 17 aa, Mycobacterium avium
RLFGIDWDPVEGTLNGL

SEQ ID NO: 146519 - protein, 17 aa, Mycobacterium avium
RLIPPWVTLGSRLAALP

SEQ ID NO: 146520 - protein, 18 aa, Mycobacterium avium
RLVKAGKVAKDWNTDATK

SEQ ID NO: 146521 - protein, 21 aa, Mycobacterium avium
RPEYVHLWAGSGYRHATAEPA

SEQ ID NO: 146522 - protein, 17 aa, Mycobacterium avium
RQHRVAAVFLRELLATD

SEQ ID NO: 146523 - protein, 17 aa, Mycobacterium avium
RRAVLFVGVAAVGAVAL

SEQ ID NO: 146524 - protein, 18 aa, Mycobacterium avium
RRLLRLCARYASAPTVIF

SEQ ID NO: 146525 - protein, 17 aa, Mycobacterium avium
RRLRAWLTRLYRTEFDG

SEQ ID NO: 146526 - protein, 19 aa, Mycobacterium avium
RRNAAAFGRDADAIAGIEH

SEQ ID NO: 146527 - protein, 20 aa, Mycobacterium avium
RRNAAAFGRDADAIAGIEHT

SEQ ID NO: 146528 - protein, 19 aa, Mycobacterium avium
RRPGGNWMLGKPIQVAEAR

SEQ ID NO: 146529 - protein, 20 aa, Mycobacterium avium
RSMLPCNWLGMQVPAGTPGS

SEQ ID NO: 146530 - protein, 19 aa, Mycobacterium avium
RSRGPWPWLQPDRNGAPPV

SEQ ID NO: 146531 - protein, 17 aa, Mycobacterium avium
RSWLRARGLKLFPLVGW

SEQ ID NO: 146532 - protein, 17 aa, Mycobacterium avium
RTAGMAPYMVRVLGTTA

SEQ ID NO: 146533 - protein, 25 aa, Mycobacterium avium
RTGIYGHARACGWAIRDGVVGPSST

SEQ ID NO: 146534 - protein, 24 aa, Mycobacterium avium
RTLWPDRLWLAIAHSPAREIDLTP

SEQ ID NO: 146535 - protein, 18 aa, Mycobacterium avium
RTVEPWGVVTQKGRWYLV

SEQ ID NO: 146536 - protein, 17 aa, Mycobacterium avium
SAAFQAAHARFVEVAAR

SEQ ID NO: 146537 - protein, 17 aa, Mycobacterium avium
SALMVRRLWAIPTAVLG

SEQ ID NO: 146538 - protein, 18 aa, Mycobacterium avium
SATTAAPCTRCRRSDARG

SEQ ID NO: 146539 - protein, 19 aa, Mycobacterium avium
SAVLGRRSLQIAGLVANSN

SEQ ID NO: 146540 - protein, 17 aa, Mycobacterium avium
SELPDWLAANKGLAPGG

SEQ ID NO: 146541 - protein, 20 aa, Mycobacterium avium
SGSIGLGFAIPVDQAKRIAD

SEQ ID NO: 146542 - protein, 18 aa, Mycobacterium avium
SHRWPRRALRLTAIDVDT

SEQ ID NO: 146543 - protein, 21 aa, Mycobacterium avium
SIGGKLSVPVAWSGAPATPAL

SEQ ID NO: 146544 - protein, 27 aa, Mycobacterium avium
SKVGLPLVRRALELLPHVGFVNAYGLT

SEQ ID NO: 146545 - protein, 23 aa, Mycobacterium avium
SPADPLWWVVRALELFSDFQQFG

SEQ ID NO: 146546 - protein, 24 aa, Mycobacterium avium
SPADPLWWVVRALELFSDFQQFGA

SEQ ID NO: 146547 - protein, 17 aa, Mycobacterium avium
SPAPWPLLTLLPAGPEL

SEQ ID NO: 146548 - protein, 22 aa, Mycobacterium avium
SRLASGLFAWRRALVLSAAAAL

SEQ ID NO: 146549 - protein, 17 aa, Mycobacterium avium
SRLLARFPALGGTDTSG

SEQ ID NO: 146550 - protein, 17 aa, Mycobacterium avium
STAELRTATPLGDVFVA

SEQ ID NO: 146551 - protein, 18 aa, Mycobacterium avium
STLVGSLSVPPGWTTAAP

SEQ ID NO: 146552 - protein, 22 aa, Mycobacterium avium
SVNCPGDLPAKVGAQLNCEMKV

SEQ ID NO: 146553 - protein, 18 aa, Mycobacterium avium
SWSALTTMILPSGGAPYV

SEQ ID NO: 146554 - protein, 17 aa, Mycobacterium avium
SYWFYSCMVAFKTSYGV

SEQ ID NO: 146555 - protein, 22 aa, Mycobacterium avium
TAHRLLAMLAYRGFVRQDPVSK

SEQ ID NO: 146556 - protein, 18 aa, Mycobacterium avium
TDAVRGWLAKTFSRNQNA

SEQ ID NO: 146557 - protein, 19 aa, Mycobacterium avium
TDCPLRWLAERHGGTDPRD

SEQ ID NO: 146558 - protein, 18 aa, Mycobacterium avium
TDSYKMSGGQGFAIPIGR

SEQ ID NO: 146559 - protein, 20 aa, Mycobacterium avium
TELDYARWTWRLRRRDWIHH

SEQ ID NO: 146560 - protein, 21 aa, Mycobacterium avium
TELDYARWTWRLRRRDWIHHR

SEQ ID NO: 146561 - protein, 17 aa, Mycobacterium avium
TFPFPAETLSKWIRGDY

SEQ ID NO: 146562 - protein, 21 aa, Mycobacterium avium
TGPKFAGPVTKHLAFVNQGGN

SEQ ID NO: 146563 - protein, 18 aa, Mycobacterium avium
THGWASDHIQPWQDNEGH

SEQ ID NO: 146564 - protein, 19 aa, Mycobacterium avium
TMYELFSVGWGRPDLRSQW

SEQ ID NO: 146565 - protein, 18 aa, Mycobacterium avium
TRRKGLWTTLAITTVSGA

SEQ ID NO: 146566 - protein, 18 aa, Mycobacterium avium
TRVGLMGALVTVLVVGVG

SEQ ID NO: 146567 - protein, 18 aa, Mycobacterium avium
TRVPHVWVRDGVSTLDLV

SEQ ID NO: 146568 - protein, 23 aa, Mycobacterium avium
TSGLRPASYFALAEAHGRLGHPA

SEQ ID NO: 146569 - protein, 21 aa, Mycobacterium avium
TSLPCSARWPARRWSPSRSRT

SEQ ID NO: 146570 - protein, 18 aa, Mycobacterium avium
TYRFSVPNPGTYWAHPHT

SEQ ID NO: 146571 - protein, 17 aa, Mycobacterium avium
TYRGMMNTVVWNNPENM

SEQ ID NO: 146572 - protein, 22 aa, Mycobacterium avium
VAGLCAGELVASLTAAKTTAPS

SEQ ID NO: 146573 - protein, 21 aa, Mycobacterium avium
VCWLAIVVCCLAAAGLAATGA

SEQ ID NO: 146574 - protein, 19 aa, Mycobacterium avium
VELYPGWRKYEVRAGDRHI

SEQ ID NO: 146575 - protein, 21 aa, Mycobacterium avium
VGAAARGGRRLVIAMMYGLIK

SEQ ID NO: 146576 - protein, 17 aa, Mycobacterium avium
VGEELRAGPGLVYGYTA

SEQ ID NO: 146577 - protein, 18 aa, Mycobacterium avium
VGHAPRFERVVFRGDVAA

SEQ ID NO: 146578 - protein, 18 aa, Mycobacterium avium
VGIFPWCASSSEAALAPL

SEQ ID NO: 146579 - protein, 18 aa, Mycobacterium avium
VGLFRAAPWPGVAPLTLF

SEQ ID NO: 146580 - protein, 25 aa, Mycobacterium avium
VGRLLGWRLGMDGVDPKGTVQLESA

SEQ ID NO: 146581 - protein, 21 aa, Mycobacterium avium
VLAVGCGGGHKGGPSTTSTTT

SEQ ID NO: 146582 - protein, 22 aa, Mycobacterium avium
VLAVGCGGGHKGGPSTTSTTTP

SEQ ID NO: 146583 - protein, 18 aa, Mycobacterium avium
VLEPMAGKIIHCGAAGAG

SEQ ID NO: 146584 - protein, 17 aa, Mycobacterium avium
VLGRRVWENAGSPEVDS

SEQ ID NO: 146585 - protein, 18 aa, Mycobacterium avium
VLQLRGAAGLPTATIGGE

SEQ ID NO: 146586 - protein, 18 aa, Mycobacterium avium
VLQLRGATGLPTATIGGE

SEQ ID NO: 146587 - protein, 17 aa, Mycobacterium avium
VLVGFSMPGKTIGAQSR

SEQ ID NO: 146588 - protein, 18 aa, Mycobacterium avium
VPWWPWAPLVQLMRVLPP

SEQ ID NO: 146589 - protein, 20 aa, Mycobacterium avium
VQLRIGDAIRRIRVAHHGAQ

SEQ ID NO: 146590 - protein, 19 aa, Mycobacterium avium
VRITFWLNDKYKVPADVKA

SEQ ID NO: 146591 - protein, 22 aa, Mycobacterium avium
VRPEPFGALLYHFGTRKLSFLK

SEQ ID NO: 146592 - protein, 17 aa, Mycobacterium avium
VVKRCYAEILPAARPGA

SEQ ID NO: 146593 - protein, 18 aa, Mycobacterium avium
VVRVTLRLLLAVLLAPGW

SEQ ID NO: 146594 - protein, 20 aa, Mycobacterium avium
VWLNPWRWYAAPRAVADALT

SEQ ID NO: 146595 - protein, 19 aa, Mycobacterium avium
VWWSWLVGVLTVVGLGLGL

SEQ ID NO: 146596 - protein, 18 aa, Mycobacterium avium
WAARGVDVTPFFAVLNGP

SEQ ID NO: 146597 - protein, 18 aa, Mycobacterium avium
WANDNSRIIPRLRRIRDK

SEQ ID NO: 146598 - protein, 17 aa, Mycobacterium avium
WASDHIQPWQDNEGHSM

SEQ ID NO: 146599 - protein, 20 aa, Mycobacterium avium
WASDVAAMFGYHADASAAVA

SEQ ID NO: 146600 - protein, 19 aa, Mycobacterium avium
WASRGVDVTPFFAVLNGPR

SEQ ID NO: 146601 - protein, 17 aa, Mycobacterium avium
WDLPLVFGPIAITYNLP

SEQ ID NO: 146602 - protein, 19 aa, Mycobacterium avium
WDMGAYAWPGPERRRFAND

SEQ ID NO: 146603 - protein, 18 aa, Mycobacterium avium
WDPGFNQWGFWFFGVWIP

SEQ ID NO: 146604 - protein, 18 aa, Mycobacterium avium
WEVHGGTSLAGYVVPQRP

SEQ ID NO: 146605 - protein, 30 aa, Mycobacterium avium
WHQLFGGRQWCWWPAFIAYFRDVVELQLDS

SEQ ID NO: 146606 - protein, 17 aa, Mycobacterium avium
WQYGGWGYWFFGVWVPL

SEQ ID NO: 146607 - protein, 18 aa, Mycobacterium avium
WRPVLALVLTAGVVAGCH

SEQ ID NO: 146608 - protein, 18 aa, Mycobacterium avium
WRTDFLNQMGLVIADSIK

SEQ ID NO: 146609 - protein, 19 aa, Mycobacterium avium
WRTDFLNQMGLVIADSIKP

SEQ ID NO: 146610 - protein, 24 aa, Mycobacterium avium
YAEILPAARPGALFIDSSTISVAD

SEQ ID NO: 146611 - protein, 22 aa, Mycobacterium avium
YKMSGGQGFAIPIGRAMAVANQ

SEQ ID NO: 146612 - protein, 26 aa, Mycobacterium avium
YNTFTVIPVFNWQYGGWGYWFFGVWV

SEQ ID NO: 146613 - protein, 19 aa, Mycobacterium avium
YPFRCKRVLLGDDYYRALQ

SEQ ID NO: 146614 - protein, 20 aa, Mycobacterium avium
YPFRCKRVLLGDDYYRALQR

SEQ ID NO: 146615 - protein, 18 aa, Mycobacterium avium
YPRLIVCDITGYGGTGPW

SEQ ID NO: 146616 - protein, 20 aa, Mycobacterium avium
YSEDWLRPGYTPPDGGPPPE

SEQ ID NO: 146617 - protein, 20 aa, Mycobacterium avium
YSEDWLRPGYTPPDSGPPPE

SEQ ID NO: 146618 - protein, 21 aa, Mycobacterium avium
YSEDWLRPGYTPSDGGPPPEA

SEQ ID NO: 146619 - protein, 24 aa, Mycobacterium avium
AEGRRYLGLDILTRCRLTTITDDN

SEQ ID NO: 146620 - protein, 22 aa, Mycobacterium avium
ANLPGAAWQRCRTHYAANLMSI

SEQ ID NO: 146621 - protein, 25 aa, Mycobacterium avium
HVEAFRHRPLDSAGPFTFVAADALT

SEQ ID NO: 146622 - protein, 26 aa, Mycobacterium avium
LRKGTYFPDWLLERRKRAESALITVV

SEQ ID NO: 146623 - protein, 26 aa, Mycobacterium avium
NLMSICPKSMWPAVKAMLHSVYDQPD

SEQ ID NO: 146624 - protein, 24 aa, Mycobacterium avium
TAREDILAFTAFPKDVWSQIWSNN

SEQ ID NO: 146625 - protein, 25 aa, Mycobacterium avium
AVESILTVLALRDQVVPPTLNLENL

SEQ ID NO: 146626 - protein, 22 aa, Mycobacterium avium
GIAQAWRNIVFGEADIAICGGV

SEQ ID NO: 146627 - protein, 28 aa, Mycobacterium avium
KPAAKFTLEVYPRYLKLIPSNVNADIKA

SEQ ID NO: 146628 - protein, 22 aa, Mycobacterium avium
AAAISHLPHLLAEALAVVAGDV

SEQ ID NO: 146629 - protein, 18 aa, Mycobacterium avium
AAALTLMQHGCHRAQGFL

SEQ ID NO: 146630 - protein, 26 aa, Mycobacterium avium
AAAPLVTLYKQYAVRFGLGYQEEVRS

SEQ ID NO: 146631 - protein, 25 aa, Mycobacterium avium
AAARQALPMLGPDTAVLTIQNGLGS

SEQ ID NO: 146632 - protein, 18 aa, Mycobacterium avium
AAEKFFRALAVGDTATAA

SEQ ID NO: 146633 - protein, 25 aa, Mycobacterium avium
AAFSVALAAFALIGGACSKSNNAGQ

SEQ ID NO: 146634 - protein, 18 aa, Mycobacterium avium
AALPRRPQFALLKGRRNY

SEQ ID NO: 146635 - protein, 17 aa, Mycobacterium avium
AAPLLEAVGVEPATIRA

SEQ ID NO: 146636 - protein, 20 aa, Mycobacterium avium
AARIMARLAARPSTQARRLQ

SEQ ID NO: 146637 - protein, 29 aa, Mycobacterium avium
AASGPGTKLMILPPLIHGAAQWSVMTAIT

SEQ ID NO: 146638 - protein, 18 aa, Mycobacterium avium
AAVLRGAAGPALLDTYHA

SEQ ID NO: 146639 - protein, 18 aa, Mycobacterium avium
ACCTALSACLTLAVTSGQ

SEQ ID NO: 146640 - protein, 23 aa, Mycobacterium avium
ADAVLWAIGRVRPNTGWLPAELL

SEQ ID NO: 146641 - protein, 19 aa, Mycobacterium avium
ADRRYIMVVQSLQPADDAT

SEQ ID NO: 146642 - protein, 21 aa, Mycobacterium avium
ADVFFLLGVGDDEALRWIDTQ

SEQ ID NO: 146643 - protein, 25 aa, Mycobacterium avium
AEIIWTIDAKNILSYLRASNTDVAA

SEQ ID NO: 146644 - protein, 17 aa, Mycobacterium avium
AFAQMRIVMSTKNDDPV

SEQ ID NO: 146645 - protein, 23 aa, Mycobacterium avium
AGAQRRFDTFAAAAYMNGPSNSY

SEQ ID NO: 146646 - protein, 22 aa, Mycobacterium avium
AGATLLGAPLPASAAPCPDIEV

SEQ ID NO: 146647 - protein, 24 aa, Mycobacterium avium
AGIERTLVAYLKSAGKTAQDTSFD

SEQ ID NO: 146648 - protein, 23 aa, Mycobacterium avium
AGLGRNFLQQLGILKPDDTGITN

SEQ ID NO: 146649 - protein, 25 aa, Mycobacterium avium
AGNPGPVAVFYLDLDRLKPINDYLG

SEQ ID NO: 146650 - protein, 25 aa, Mycobacterium avium
AGPEPFLHTNVVGTFTILEAVRRHG

SEQ ID NO: 146651 - protein, 19 aa, Mycobacterium avium
AGQLLRRVRSRLARLAGVG

SEQ ID NO: 146652 - protein, 24 aa, Mycobacterium avium
AGRNVVLMAYSEFGRRVRANASQG

SEQ ID NO: 146653 - protein, 22 aa, Mycobacterium avium
AGSVFKIFTTAAALDMGMGINA

SEQ ID NO: 146654 - protein, 20 aa, Mycobacterium avium
AGVFALSALLDPGTARAATL

SEQ ID NO: 146655 - protein, 22 aa, Mycobacterium avium
AHDVCYDLTWGWTPQQIADDLH

SEQ ID NO: 146656 - protein, 21 aa, Mycobacterium avium
AHNLAWKLAAVLRGAAGPALL

SEQ ID NO: 146657 - protein, 32 aa, Mycobacterium avium
AIGDAPLDDWQWTLGINLWGPIHGCHVFTPIL

SEQ ID NO: 146658 - protein, 17 aa, Mycobacterium avium
AIRVHGLLDKALTDSQS

SEQ ID NO: 146659 - protein, 25 aa, Mycobacterium avium
AISSLELVNQWYANPDDMAIIRDCA

SEQ ID NO: 146660 - protein, 19 aa, Mycobacterium avium
AISVLFPQITTIYGYREDP

SEQ ID NO: 146661 - protein, 19 aa, Mycobacterium avium
AIVSWIDRGGQHPRYAAAP

SEQ ID NO: 146662 - protein, 27 aa, Mycobacterium avium
AKVKWSAPLGFLAQTPPAVTPQGLIVA

SEQ ID NO: 146663 - protein, 34 aa, Mycobacterium avium
ALLRGVTAVGWPRRLLRRLLAPTDPVLASTVFGV

SEQ ID NO: 146664 - protein, 18 aa, Mycobacterium avium
ALQDRWAGQLYWYDGSHV

SEQ ID NO: 146665 - protein, 20 aa, Mycobacterium avium
ALQLGPLAPVSNAVRFVFWG

SEQ ID NO: 146666 - protein, 24 aa, Mycobacterium avium
ALSGQLLRIFQGQGGTLASVLSQT

SEQ ID NO: 146667 - protein, 25 aa, Mycobacterium avium
APAARLLVIGPPWPTADVPPSMYLI

SEQ ID NO: 146668 - protein, 24 aa, Mycobacterium avium
APALARRWWAAHGRGAFVAVNGAA

SEQ ID NO: 146669 - protein, 24 aa, Mycobacterium avium
APHHRWPRHIVDVKTAIAWARANV

SEQ ID NO: 146670 - protein, 19 aa, Mycobacterium avium
APVTGFYSLRYSSTGLERA

SEQ ID NO: 146671 - protein, 18 aa, Mycobacterium avium
AQLQKRLAQRRLTLEVSL

SEQ ID NO: 146672 - protein, 30 aa, Mycobacterium avium
AQVKDPWLRRQLTPDFRPGCKRMLVSSDYY

SEQ ID NO: 146673 - protein, 34 aa, Mycobacterium avium
AQWMPPNAAFHCQYAMQFIAVLRGYALPVDQAST

SEQ ID NO: 146674 - protein, 20 aa, Mycobacterium avium
ARVAVFAVAGATAVSLSACG

SEQ ID NO: 146675 - protein, 28 aa, Mycobacterium avium
ASIYSGCAVPPLIGYLGSGKLPNTDTYC

SEQ ID NO: 146676 - protein, 29 aa, Mycobacterium avium
ASNSLARYKLPKAIVFRPVIERSPSGKAD

SEQ ID NO: 146677 - protein, 23 aa, Mycobacterium avium
ASSLPFSAFPMGNYASLPTVSFV

SEQ ID NO: 146678 - protein, 23 aa, Mycobacterium avium
ASTVFGVRFPGPLGLAAGFDKDG

SEQ ID NO: 146679 - protein, 23 aa, Mycobacterium avium
AVAAALPMFLPAGVCAAASNTAT

SEQ ID NO: 146680 - protein, 18 aa, Mycobacterium avium
AVDSAWHTWRCQWDEAGI

SEQ ID NO: 146681 - protein, 18 aa, Mycobacterium avium
AVEFIPPQTPSPTSLRPD

SEQ ID NO: 146682 - protein, 27 aa, Mycobacterium avium
AVNRPTPLMLPGFAVRAALGEFADEGL

SEQ ID NO: 146683 - protein, 20 aa, Mycobacterium avium
AVQLLRNGVGYKGPPFTGPV

SEQ ID NO: 146684 - protein, 26 aa, Mycobacterium avium
CGLAGTVLRFVPPLAALADAVVEFDG

SEQ ID NO: 146685 - protein, 23 aa, Mycobacterium avium
CPDLGFISAIPQPLRSLAHERCL

SEQ ID NO: 146686 - protein, 27 aa, Mycobacterium avium
CQAGLKIFADMILAFPKDVPPPDVQKM

SEQ ID NO: 146687 - protein, 31 aa, Mycobacterium avium
CVAVYRIMPAEAIGYHSALRFGIEHGKRNMV

SEQ ID NO: 146688 - protein, 17 aa, Mycobacterium avium
DAAPAQWMPPNAAFHCQ

SEQ ID NO: 146689 - protein, 23 aa, Mycobacterium avium
DAKGNTIAWLYSQRRFEVPSDKI

SEQ ID NO: 146690 - protein, 25 aa, Mycobacterium avium
DAQSIAAYGLFLLRPESTGAPVTDQ

SEQ ID NO: 146691 - protein, 22 aa, Mycobacterium avium
DARAVFLFRSAAELAYDHRDTA

SEQ ID NO: 146692 - protein, 28 aa, Mycobacterium avium
DASSTLLAGIYVAALRSYGFAARPATAG

SEQ ID NO: 146693 - protein, 26 aa, Mycobacterium avium
DCGNFDRFYFATKQFVYQLKTPPAGS

SEQ ID NO: 146694 - protein, 18 aa, Mycobacterium avium
DEGYLFIGGRSDDTIIRG

SEQ ID NO: 146695 - protein, 22 aa, Mycobacterium avium
DFKLRLGHSAFYPLPQAAFRDM

SEQ ID NO: 146696 - protein, 17 aa, Mycobacterium avium
DFVLNLAVAKSGSWDKD

SEQ ID NO: 146697 - protein, 34 aa, Mycobacterium avium
DGDIWDWAVDWDTWVAMSALPPPTAHPPSTQIPV

SEQ ID NO: 146698 - protein, 28 aa, Mycobacterium avium
DGHGAPPTLFTPGYYKQLSVPVAVVNPS

SEQ ID NO: 146699 - protein, 20 aa, Mycobacterium avium
DGQLGAPFVWPLVANAGESP

SEQ ID NO: 146700 - protein, 24 aa, Mycobacterium avium
DGTWQRCVAVTRLIPNGASSYLVP

SEQ ID NO: 146701 - protein, 20 aa, Mycobacterium avium
DGYLLTVNYAVRITNRGLFV

SEQ ID NO: 146702 - protein, 24 aa, Mycobacterium avium
DHVDPVVWAMVMTLALDCGAVVVP

SEQ ID NO: 146703 - protein, 22 aa, Mycobacterium avium
DLAALAAAARLPSGADAACARA

SEQ ID NO: 146704 - protein, 19 aa, Mycobacterium avium
DLHLMIFGDSTAAGYGCMC

SEQ ID NO: 146705 - protein, 22 aa, Mycobacterium avium
DLYEGGWYFKDGTHFSDPLNGQ

SEQ ID NO: 146706 - protein, 25 aa, Mycobacterium avium
DNCKLIDWPIATLSPAGIRTSDGIE

SEQ ID NO: 146707 - protein, 26 aa, Mycobacterium avium
DNGGWPFYHMEMMLSGIPIPVPPGEP

SEQ ID NO: 146708 - protein, 23 aa, Mycobacterium avium
DNLDYAVIKFDPAKVTPVANFNG

SEQ ID NO: 146709 - protein, 20 aa, Mycobacterium avium
DPDFPILDKKVEIKPAELKM

SEQ ID NO: 146710 - protein, 21 aa, Mycobacterium avium
DPDYQGLLVDSAQIATWENYV

SEQ ID NO: 146711 - protein, 21 aa, Mycobacterium avium
DPELYLLWGQANTSAGYRYSV

SEQ ID NO: 146712 - protein, 28 aa, Mycobacterium avium
DPRHTPPHAWYIAFAPAQTPKVAVAVLV

SEQ ID NO: 146713 - protein, 26 aa, Mycobacterium avium
DPVLPDELLPPDWPGTRLRAAYHDFA

SEQ ID NO: 146714 - protein, 23 aa, Mycobacterium avium
DQGQDLLGHLVARQATFHAMFAA

SEQ ID NO: 146715 - protein, 26 aa, Mycobacterium avium
DRDYGFLGVAVLDAPWAPFVVNFNLA

SEQ ID NO: 146716 - protein, 23 aa, Mycobacterium avium
DTGAPIELPSLRNLAYGGSKVGL

SEQ ID NO: 146717 - protein, 18 aa, Mycobacterium avium
DTRLLSETELWQLAFDVV

SEQ ID NO: 146718 - protein, 23 aa, Mycobacterium avium
DVTPKLFLPNLSGLTQGPGFPNL

SEQ ID NO: 146719 - protein, 18 aa, Mycobacterium avium
DYLNGVTALLAALGRRYD

SEQ ID NO: 146720 - protein, 24 aa, Mycobacterium avium
DYSDPIVFAFNCALNIVSSTPEQI

SEQ ID NO: 146721 - protein, 22 aa, Mycobacterium avium
DYTTYFMLVNPLLDRWGLRILP

SEQ ID NO: 146722 - protein, 21 aa, Mycobacterium avium
EALRCLKRRLARIIFGHLHTD

SEQ ID NO: 146723 - protein, 21 aa, Mycobacterium avium
EAVPIAAFAQMRIVMSTKNDD

SEQ ID NO: 146724 - protein, 26 aa, Mycobacterium avium
EAVRRRPYTVILFDEIEKAHPDVFDV

SEQ ID NO: 146725 - protein, 24 aa, Mycobacterium avium
EEGPGSPRRLPPGATIPLARTSPA

SEQ ID NO: 146726 - protein, 17 aa, Mycobacterium avium
EGSPGRGPLLAPGSVLA

SEQ ID NO: 146727 - protein, 25 aa, Mycobacterium avium
EIPGLPPITIPLLAPPPPAPGQPPP

SEQ ID NO: 146728 - protein, 26 aa, Mycobacterium avium
EKRREVFLYPKARNLSFRSLEILRGM

SEQ ID NO: 146729 - protein, 18 aa, Mycobacterium avium
EKTAADPRFRFFGNVSVG

SEQ ID NO: 146730 - protein, 22 aa, Mycobacterium avium
ELAAKLMRWTGFSADKVARICL

SEQ ID NO: 146731 - protein, 24 aa, Mycobacterium avium
EMKKQPFSLQMTGPPPSPIERYPL

SEQ ID NO: 146732 - protein, 31 aa, Mycobacterium avium
EPGRAAVPWWPWAPLVQLMRVLPPRLTKMFA

SEQ ID NO: 146733 - protein, 17 aa, Mycobacterium avium
EPLVVVDARYRDMVGEA

SEQ ID NO: 146734 - protein, 28 aa, Mycobacterium avium
EQARARPIAPLLDALRGLGVRIEGTALP

SEQ ID NO: 146735 - protein, 22 aa, Mycobacterium avium
ESLRLWREGGFLDGLPGRLVTA

SEQ ID NO: 146736 - protein, 25 aa, Mycobacterium avium
ESVQIDHIVPLAYAWDMGAYAWPGP

SEQ ID NO: 146737 - protein, 19 aa, Mycobacterium avium
ETTWKLLLDSQSGIRTLDD

SEQ ID NO: 146738 - protein, 23 aa, Mycobacterium avium
EVENPKCHIAWTTLAGIGQVESH

SEQ ID NO: 146739 - protein, 18 aa, Mycobacterium avium
EYVIRRGMSQIGVPYSWG

SEQ ID NO: 146740 - protein, 31 aa, Mycobacterium avium
FGMPNVRAMNFLNEPPVVIGPAYQDKTLKVC

SEQ ID NO: 146741 - protein, 34 aa, Mycobacterium avium
FHGPMRRDWNYLIGSIKYVLWRLQERVVGRGPQT

SEQ ID NO: 146742 - protein, 17 aa, Mycobacterium avium
FIDPIAEHWFVGRPDLI

SEQ ID NO: 146743 - protein, 31 aa, Mycobacterium avium
FNDAMSQQIKDAFNAYIDAAHAVANAIGTHA

SEQ ID NO: 146744 - protein, 24 aa, Mycobacterium avium
FNGPGYTVFPVFNLAVAGSGGGDP

SEQ ID NO: 146745 - protein, 17 aa, Mycobacterium avium
FPVIDGVRYAVPGDRAR

SEQ ID NO: 146746 - protein, 26 aa, Mycobacterium avium
FSDNLPTCVIKYIPLHTPAVVMSFNA

SEQ ID NO: 146747 - protein, 23 aa, Mycobacterium avium
FSHANSIMVWTLMNTRNAKDSLM

SEQ ID NO: 146748 - protein, 17 aa, Mycobacterium avium
FTATAAVTLLIAAGSEA

SEQ ID NO: 146749 - protein, 27 aa, Mycobacterium avium
FTGFPARHIPVLRTVDYRSALPESARR

SEQ ID NO: 146750 - protein, 18 aa, Mycobacterium avium
GADYLSWQRNTVGQLQTA

SEQ ID NO: 146751 - protein, 17 aa, Mycobacterium avium
GAGMARAFAAKGRDLAL

SEQ ID NO: 146752 - protein, 19 aa, Mycobacterium avium
GALGAIRYVSDRRPGGNWM

SEQ ID NO: 146753 - protein, 24 aa, Mycobacterium avium
GALQATSIQLRQAVDGKCGKPKQP

SEQ ID NO: 146754 - protein, 32 aa, Mycobacterium avium
GAPVGNWFQPRANPFHRWLDDTYPVPGSVTAG

SEQ ID NO: 146755 - protein, 19 aa, Mycobacterium avium
GARTVALWEPALRADLVGE

SEQ ID NO: 146756 - protein, 19 aa, Mycobacterium avium
GASLITFVPGFAGDAAPGP

SEQ ID NO: 146757 - protein, 26 aa, Mycobacterium avium
GCTTYKWETFLTSELPQYLSAQKQVK

SEQ ID NO: 146758 - protein, 28 aa, Mycobacterium avium
GDIESEGLLLHYLPEVDLWTGAVVGAEA

SEQ ID NO: 146759 - protein, 19 aa, Mycobacterium avium
GDNHKPLFPTYSISKIAGE

SEQ ID NO: 146760 - protein, 25 aa, Mycobacterium avium
GDTRLPAGGMLFIGTPEGQKVAPGP

SEQ ID NO: 146761 - protein, 27 aa, Mycobacterium avium
GEAMEALLSARWMPMPFLADREASSMG

SEQ ID NO: 146762 - protein, 25 aa, Mycobacterium avium
GECLGSGPFFKAYVANLVPGQFGGP

SEQ ID NO: 146763 - protein, 24 aa, Mycobacterium avium
GFAGSLSGFLYPSSTNYNGAILAG

SEQ ID NO: 146764 - protein, 20 aa, Mycobacterium avium
GFLSDTLLSSLRDEKRDLHT

SEQ ID NO: 146765 - protein, 21 aa, Mycobacterium avium
GFYSLRYSSTGLERAEDPLLN

SEQ ID NO: 146766 - protein, 22 aa, Mycobacterium avium
GGGPHAVYLLDGLRAQDDYNGW

SEQ ID NO: 146767 - protein, 32 aa, Mycobacterium avium
GGSKVGLPLVRRALELLPHVGFVNAYGLTETS

SEQ ID NO: 146768 - protein, 17 aa, Mycobacterium avium
GGYKAWALTPDELILYL

SEQ ID NO: 146769 - protein, 25 aa, Mycobacterium avium
GHEGMGWLAQRGYVPLGYKGDAAKT

SEQ ID NO: 146770 - protein, 24 aa, Mycobacterium avium
GHHPRAWRRLHARLTRLGVGVHPG

SEQ ID NO: 146771 - protein, 25 aa, Mycobacterium avium
GIKEFAPLLGVRKAGLFTSSSFVLG

SEQ ID NO: 146772 - protein, 23 aa, Mycobacterium avium
GIKSPWSHQFTAADLAWSGRHVV

SEQ ID NO: 146773 - protein, 22 aa, Mycobacterium avium
GIPPAPPPPPEGAPPPVGSQVV

SEQ ID NO: 146774 - protein, 22 aa, Mycobacterium avium
GIVVTPQPEMLPTDPHFAPAVV

SEQ ID NO: 146775 - protein, 21 aa, Mycobacterium avium
GKSLAYLVPAIVHALRDDSPV

SEQ ID NO: 146776 - protein, 24 aa, Mycobacterium avium
GLASLPLPAPGIGSGGYLLNAVFS

SEQ ID NO: 146777 - protein, 23 aa, Mycobacterium avium
GLPATNGLFPPGSTFKMITAGAA

SEQ ID NO: 146778 - protein, 19 aa, Mycobacterium avium
GLPSVFVYDGHPGGAGFAE

SEQ ID NO: 146779 - protein, 26 aa, Mycobacterium avium
GLPYTQIVGPNYWWSGDDHSPTFNSM

SEQ ID NO: 146780 - protein, 25 aa, Mycobacterium avium
GLRETIDWYRANESWWRPLKDASEA

SEQ ID NO: 146781 - protein, 25 aa, Mycobacterium avium
GNEPARTWFTAMKPIATNFGPVQLP

SEQ ID NO: 146782 - protein, 28 aa, Mycobacterium avium
GPSLSLVLIDRIPFPRPDDPLLGARQRA

SEQ ID NO: 146783 - protein, 26 aa, Mycobacterium avium
GPTPVRSLMFAAFPQPDGSMALWCWW

SEQ ID NO: 146784 - protein, 31 aa, Mycobacterium avium
GQFLQKYHAPPLAIGPLYQPKTLQLCAVGDP

SEQ ID NO: 146785 - protein, 23 aa, Mycobacterium avium
GRGNRFVVIALETSKALPFNDPG

SEQ ID NO: 146786 - protein, 24 aa, Mycobacterium avium
GSGGYLLNAVFSNALNLPAHAKVK

SEQ ID NO: 146787 - protein, 27 aa, Mycobacterium avium
GSHSWFAGYRGDLAFAALIVGGGSSEY

SEQ ID NO: 146788 - protein, 32 aa, Mycobacterium avium
GSKQWDTFLSSELPDWLAANKGLAPGGHAAVG

SEQ ID NO: 146789 - protein, 27 aa, Mycobacterium avium
GSQAGDLMGIALLTNATPAGPPPPEVS

SEQ ID NO: 146790 - protein, 22 aa, Mycobacterium avium
GSRSLAVYAVKYPASTDFSNPD

SEQ ID NO: 146791 - protein, 23 aa, Mycobacterium avium
GTITRWDDPALALLNASMPAEDI

SEQ ID NO: 146792 - protein, 22 aa, Mycobacterium avium
GVDMANPLQPVNKPFEIDVTCN

SEQ ID NO: 146793 - protein, 18 aa, Mycobacterium avium
GVFMPVAQKYFGDMSVTG

SEQ ID NO: 146794 - protein, 18 aa, Mycobacterium avium
GVVNGTKAFLPHLIASGD

SEQ ID NO: 146795 - protein, 24 aa, Mycobacterium avium
GWFPTRDIAMLDDEGYLFIGGRSD

SEQ ID NO: 146796 - protein, 18 aa, Mycobacterium avium
GYHVGGIFIGSWTDLTIF

SEQ ID NO: 146797 - protein, 19 aa, Mycobacterium avium
GYIPLSADFQAKVSGAVDA

SEQ ID NO: 146798 - protein, 31 aa, Mycobacterium avium
HAAEHPAPGDWLYFVTIDAAGTTLFTKDYQQ

SEQ ID NO: 146799 - protein, 18 aa, Mycobacterium avium
HADRLADWLASRQPKLVT

SEQ ID NO: 146800 - protein, 29 aa, Mycobacterium avium
HDSYLVDWSGIPYLRFLASNVGRGQPLAH

SEQ ID NO: 146801 - protein, 26 aa, Mycobacterium avium
HGCRRRQWPVYPDMDPLGNVAGMMRA

SEQ ID NO: 146802 - protein, 34 aa, Mycobacterium avium
HGPAADAMAFAAARYLTWLRATAEQTKQTAMQAR

SEQ ID NO: 146803 - protein, 23 aa, Mycobacterium avium
HGRSGFLLAPWTAEQIVSELAPV

SEQ ID NO: 146804 - protein, 18 aa, Mycobacterium avium
HLDIGHRTIPNYGGFDLG

SEQ ID NO: 146805 - protein, 22 aa, Mycobacterium avium
HLEWIGQWGIFDALRSGTQVVR

SEQ ID NO: 146806 - protein, 17 aa, Mycobacterium avium
HLRRHRDGPRPWLVWVH

SEQ ID NO: 146807 - protein, 18 aa, Mycobacterium avium
HLTGPPFPVTGLGGRSLA

SEQ ID NO: 146808 - protein, 27 aa, Mycobacterium avium
HPRYAAAPLRLHPDIHLYCAIPQERSL

SEQ ID NO: 146809 - protein, 24 aa, Mycobacterium avium
HPSAPAYALAADALLLALCEALGE

SEQ ID NO: 146810 - protein, 36 aa, Mycobacterium avium
HRAAQYWVLKPTYHNSYWFYSCMVAFKTSYGVLQQA

SEQ ID NO: 146811 - protein, 17 aa, Mycobacterium avium
HSAPWAVRSLGLENVSH

SEQ ID NO: 146812 - protein, 23 aa, Mycobacterium avium
HVSALALFGNPSDRYLGAPVSVV

SEQ ID NO: 146813 - protein, 30 aa, Mycobacterium avium
HVTFPSIYDPAMRTLIAFGGKYPTTVIPST

SEQ ID NO: 146814 - protein, 26 aa, Mycobacterium avium
IAAMQWEKLICNVAYSAPCALTGMTV

SEQ ID NO: 146815 - protein, 24 aa, Mycobacterium avium
IAGPVLAYWLTRYGFEVTVVERAP

SEQ ID NO: 146816 - protein, 18 aa, Mycobacterium avium
IALAAAAAALAAVAIGVV

SEQ ID NO: 146817 - protein, 25 aa, Mycobacterium avium
IDPKVRPWRGQWVTLIVTSVGDDAR

SEQ ID NO: 146818 - protein, 21 aa, Mycobacterium avium
IEDYWRSVYGQSLKGKFVPIS

SEQ ID NO: 146819 - protein, 26 aa, Mycobacterium avium
IERLRSTWDVPALALIGIGNGAQVAL

SEQ ID NO: 146820 - protein, 17 aa, Mycobacterium avium
IFNGTITRWDDPALALL

SEQ ID NO: 146821 - protein, 18 aa, Mycobacterium avium
IGGHLLEEFDSQLTRVEL

SEQ ID NO: 146822 - protein, 19 aa, Mycobacterium avium
IGRQMHMDPFLPNEGSPGR

SEQ ID NO: 146823 - protein, 18 aa, Mycobacterium avium
ILMLCSVVGVAASLTSCH

SEQ ID NO: 146824 - protein, 17 aa, Mycobacterium avium
INASDLNWQQAALLAGM

SEQ ID NO: 146825 - protein, 24 aa, Mycobacterium avium
INGVELPWTFDISTTLPSIVGNVV

SEQ ID NO: 146826 - protein, 25 aa, Mycobacterium avium
IPLHTPAVVMSFNAILADINAKHRP

SEQ ID NO: 146827 - protein, 17 aa, Mycobacterium avium
IQGTGLGFSAPYNMEQF

SEQ ID NO: 146828 - protein, 36 aa, Mycobacterium avium
IVGFDCSGLVLYSFAGVGIKLPHYSGSQYNLGRKIP

SEQ ID NO: 146829 - protein, 33 aa, Mycobacterium avium
IVREQQADCFAGVYLFWVADGKSPRFTLSTADG

SEQ ID NO: 146830 - protein, 18 aa, Mycobacterium avium
IYAHWQEIGGMNSVLGAP

SEQ ID NO: 146831 - protein, 24 aa, Mycobacterium avium
KAITKRITVWPQGPDIQDRVNNRS

SEQ ID NO: 146832 - protein, 29 aa, Mycobacterium avium
KAWALTPDELILYLPDYPVGHDSPIQYGQ

SEQ ID NO: 146833 - protein, 21 aa, Mycobacterium avium
KDSLMNTHPLPNTGRVVINGN

SEQ ID NO: 146834 - protein, 33 aa, Mycobacterium avium
KFEWLDNRVVQWVPDRYWPAHSTIALTVGGVST

SEQ ID NO: 146835 - protein, 24 aa, Mycobacterium avium
KITNWNDPILAALNPGVALPDTKI

SEQ ID NO: 146836 - protein, 25 aa, Mycobacterium avium
KRDVMVIHTLLWPDEIRDPDFPILD

SEQ ID NO: 146837 - protein, 25 aa, Mycobacterium avium
KRVDGAPLPWTLVLSTTAPSVFPNL

SEQ ID NO: 146838 - protein, 17 aa, Mycobacterium avium
KTFPVIDGVRYAVPGDR

SEQ ID NO: 146839 - protein, 24 aa, Mycobacterium avium
KTQAYVVWGKIRDKWNQLGGSQGQ

SEQ ID NO: 146840 - protein, 17 aa, Mycobacterium avium
KVNPGIFTLISQATCVD

SEQ ID NO: 146841 - protein, 19 aa, Mycobacterium avium
LADWLASRQPKLVTTAHWE

SEQ ID NO: 146842 - protein, 24 aa, Mycobacterium avium
LAGLNRLIPPFVKATPSQAISVRG

SEQ ID NO: 146843 - protein, 20 aa, Mycobacterium avium
LAPVSNAVRFVFWGAGEDGL

SEQ ID NO: 146844 - protein, 17 aa, Mycobacterium avium
LAVIALVATLVVMKGGH

SEQ ID NO: 146845 - protein, 25 aa, Mycobacterium avium
LDAPWAPFVVNFNLANVGGPSAGLM

SEQ ID NO: 146846 - protein, 19 aa, Mycobacterium avium
LDVWRRKDLPAQPAPVLIF

SEQ ID NO: 146847 - protein, 27 aa, Mycobacterium avium
LEDEVRALLFAIFEPALSGPVNMTGPA

SEQ ID NO: 146848 - protein, 18 aa, Mycobacterium avium
LEEGIALLNRQLAQRKPT

SEQ ID NO: 146849 - protein, 25 aa, Mycobacterium avium
LEVNTLFQSLIDLLHKIDPVELNGT

SEQ ID NO: 146850 - protein, 30 aa, Mycobacterium avium
LGTDPFVAIVAFPFLPQALRGNYNQLEIKA

SEQ ID NO: 146851 - protein, 34 aa, Mycobacterium avium
LGYGRRQICERLRLLPLRPFRNSYAYTNYGITAA

SEQ ID NO: 146852 - protein, 20 aa, Mycobacterium avium
LIGESCLFVPVLRSALKSDG

SEQ ID NO: 146853 - protein, 17 aa, Mycobacterium avium
LIVAVVLVGGFAVVRVK

SEQ ID NO: 146854 - protein, 20 aa, Mycobacterium avium
LIVLAVPMPALPSMLAHVKE

SEQ ID NO: 146855 - protein, 19 aa, Mycobacterium avium
LKWLLRARPADYALAVSLA

SEQ ID NO: 146856 - protein, 21 aa, Mycobacterium avium
LLAPGSVLAIEPMLTLGTGKT

SEQ ID NO: 146857 - protein, 20 aa, Mycobacterium avium
LLGAWLATVPGLVAELARDE

SEQ ID NO: 146858 - protein, 19 aa, Mycobacterium avium
LLGLGSSALITAAGLLGAP

SEQ ID NO: 146859 - protein, 20 aa, Mycobacterium avium
LLKFAAAAPALLGLGVAGST

SEQ ID NO: 146860 - protein, 22 aa, Mycobacterium avium
LLVSGHHWAATGIKPRGPSDFL

SEQ ID NO: 146861 - protein, 22 aa, Mycobacterium avium
LLWIAVLLAGCSSAGPGLPTAA

SEQ ID NO: 146862 - protein, 24 aa, Mycobacterium avium
LMVRRLWAIPTAVLGGMALTWQAA

SEQ ID NO: 146863 - protein, 17 aa, Mycobacterium avium
LPEPLVVVDARYRDMVG

SEQ ID NO: 146864 - protein, 26 aa, Mycobacterium avium
LPSSAQLPVWLSRAGADVLAAHPIVA

SEQ ID NO: 146865 - protein, 17 aa, Mycobacterium avium
LSALLDPGTARAATLPQ

SEQ ID NO: 146866 - protein, 19 aa, Mycobacterium avium
LSLAAVFLALAVGVVLGSG

SEQ ID NO: 146867 - protein, 18 aa, Mycobacterium avium
LTHWDGDTFTFPLTGENA

SEQ ID NO: 146868 - protein, 26 aa, Mycobacterium avium
LTKTTWMSGCRSWYLTKDGFNGSMYP

SEQ ID NO: 146869 - protein, 23 aa, Mycobacterium avium
LTLGEALTLWLSDTEQLVPRDLI

SEQ ID NO: 146870 - protein, 31 aa, Mycobacterium avium
LTRVELRRTGYLQRMSTILGRRVWENAGSPE

SEQ ID NO: 146871 - protein, 18 aa, Mycobacterium avium
LTVLRTLLQMMGRDPDDF

SEQ ID NO: 146872 - protein, 31 aa, Mycobacterium avium
LVGRILGVRRPRRFLAAVFVVVAVAGAIQLA

SEQ ID NO: 146873 - protein, 18 aa, Mycobacterium avium
LWLAAAAALAVLVAYQAV

SEQ ID NO: 146874 - protein, 26 aa, Mycobacterium avium
MAKSTYLVAPANWLKGDVSDSIPGSI

SEQ ID NO: 146875 - protein, 23 aa, Mycobacterium avium
MEISAKMGVLPRIEDLATGTTRL

SEQ ID NO: 146876 - protein, 17 aa, Mycobacterium avium
MIHGAFSDNLPTCVIKY

SEQ ID NO: 146877 - protein, 20 aa, Mycobacterium avium
MPIAALIIIAAGSQLSPAPA

SEQ ID NO: 146878 - protein, 19 aa, Mycobacterium avium
MTRYSWQSYLIATASFAEW

SEQ ID NO: 146879 - protein, 29 aa, Mycobacterium avium
NAFYTSRCNLIAWDRGVFMPVAQKYFGDM

SEQ ID NO: 146880 - protein, 25 aa, Mycobacterium avium
NDGPEWTCYFPHPQRVVCGGISIAG

SEQ ID NO: 146881 - protein, 23 aa, Mycobacterium avium
NEYAKLLIQASDINAPVPFTGAP

SEQ ID NO: 146882 - protein, 17 aa, Mycobacterium avium
NGAIRVHGLLDKALTDS

SEQ ID NO: 146883 - protein, 25 aa, Mycobacterium avium
NGDYFGFYFCEVLLKLNGKGGNPIF

SEQ ID NO: 146884 - protein, 27 aa, Mycobacterium avium
NGTPYTVEGPILAKYNALDDKARKDLG

SEQ ID NO: 146885 - protein, 25 aa, Mycobacterium avium
NIGGRSISLWTPPGVYTVLDKGNPV

SEQ ID NO: 146886 - protein, 25 aa, Mycobacterium avium
NNMVLAVQQIAIGEAFILAEKLGLS

SEQ ID NO: 146887 - protein, 20 aa, Mycobacterium avium
NNTRVWVWSPTNMGGDDAAM

SEQ ID NO: 146888 - protein, 20 aa, Mycobacterium avium
NTRITVLGMNNTITYKDGDP

SEQ ID NO: 146889 - protein, 19 aa, Mycobacterium avium
NYERFIFGRGPSGQAEACH

SEQ ID NO: 146890 - protein, 24 aa, Mycobacterium avium
PADYFCVGPCWPTPTKPGRAAPGL

SEQ ID NO: 146891 - protein, 27 aa, Mycobacterium avium
PALDLDALIGGFRPLFRALDPDQVNAL

SEQ ID NO: 146892 - protein, 21 aa, Mycobacterium avium
PALLAVVALTALATGCGHRSS

SEQ ID NO: 146893 - protein, 29 aa, Mycobacterium avium
PAMPASAEYLRLLRRHNVAATLSGAGPSL

SEQ ID NO: 146894 - protein, 27 aa, Mycobacterium avium
PANGTHSWPYWNQQLMAMKPDMQQVLL

SEQ ID NO: 146895 - protein, 25 aa, Mycobacterium avium
PAQPAPVLIFVPGGAWVHGKSMGQG

SEQ ID NO: 146896 - protein, 17 aa, Mycobacterium avium
PDDPLLGARQRAVAARG

SEQ ID NO: 146897 - protein, 27 aa, Mycobacterium avium
PDNTAIAIPDWLRPSSTSYPPPNQAPG

SEQ ID NO: 146898 - protein, 26 aa, Mycobacterium avium
PDRSKGVVVLLFTEGKALATLEFDGP

SEQ ID NO: 146899 - protein, 23 aa, Mycobacterium avium
PEFINRLDDVIIFHGLEPGELVQ

SEQ ID NO: 146900 - protein, 25 aa, Mycobacterium avium
PGEYDELPYFFTDQYDLGMEYVGHA

SEQ ID NO: 146901 - protein, 18 aa, Mycobacterium avium
PGFDSIGLALSLIDEITV

SEQ ID NO: 146902 - protein, 32 aa, Mycobacterium avium
PGHVHHNAMRAMRFGPYSSLPHARVESIARTW

SEQ ID NO: 146903 - protein, 26 aa, Mycobacterium avium
PGQPSDYGYLLIKPSDVGGGLSAPQS

SEQ ID NO: 146904 - protein, 18 aa, Mycobacterium avium
PHALLGNAFHAWVQKFYG

SEQ ID NO: 146905 - protein, 17 aa, Mycobacterium avium
PHQVDITTLPWTHTEST

SEQ ID NO: 146906 - protein, 18 aa, Mycobacterium avium
PIGGINWGSSITPDLASH

SEQ ID NO: 146907 - protein, 24 aa, Mycobacterium avium
PISPKMVDALRPMMRLVVTNGTAK

SEQ ID NO: 146908 - protein, 20 aa, Mycobacterium avium
PKGVLWRQHDIFMTSFGGRN

SEQ ID NO: 146909 - protein, 18 aa, Mycobacterium avium
PLDPPPPCPNCHGGGGNP

SEQ ID NO: 146910 - protein, 21 aa, Mycobacterium avium
PLVVAPIAGVLNVGLKPGLVI

SEQ ID NO: 146911 - protein, 20 aa, Mycobacterium avium
PMGQSPWTPSGPPLPPAPAG

SEQ ID NO: 146912 - protein, 33 aa, Mycobacterium avium
PMHGYELRKRLTGLLGAFRAFSYGSLYPALRRM

SEQ ID NO: 146913 - protein, 18 aa, Mycobacterium avium
PPGLWARQTSEIRSSNRL

SEQ ID NO: 146914 - protein, 19 aa, Mycobacterium avium
PPNQQFLQQYLASSPDQRV

SEQ ID NO: 146915 - protein, 23 aa, Mycobacterium avium
PQFDRLYPVSPGKPTLTVAGRGY

SEQ ID NO: 146916 - protein, 31 aa, Mycobacterium avium
PQPDGSMALWCWWPMPFARSARVSLANTGAG

SEQ ID NO: 146917 - protein, 22 aa, Mycobacterium avium
PRDGWTLISWNGKPVHPGWSAT

SEQ ID NO: 146918 - protein, 27 aa, Mycobacterium avium
PSAGRQWDGAWDPTLPMIPSANVPGDP

SEQ ID NO: 146919 - protein, 32 aa, Mycobacterium avium
PTAGKLMVFAAASLRPAFTQIAERFKAQNPGT

SEQ ID NO: 146920 - protein, 17 aa, Mycobacterium avium
PTGKVCRPLGVGPQPLA

SEQ ID NO: 146921 - protein, 28 aa, Mycobacterium avium
PTPTITARLNFQLAFGARVGQRLAEARD

SEQ ID NO: 146922 - protein, 23 aa, Mycobacterium avium
PVANFNGFLISGIGPDPAFGEIA

SEQ ID NO: 146923 - protein, 18 aa, Mycobacterium avium
PVGACRPFDRDRTGFVFG

SEQ ID NO: 146924 - protein, 23 aa, Mycobacterium avium
PVVEFNLPNGLAIDSWMCAISGR

SEQ ID NO: 146925 - protein, 18 aa, Mycobacterium avium
PVVVTFRAPITDPAKRHA

SEQ ID NO: 146926 - protein, 17 aa, Mycobacterium avium
PWYQTEYETAAPDPGHA

SEQ ID NO: 146927 - protein, 22 aa, Mycobacterium avium
QDQLAWLGKITCDRLDHGVDHD

SEQ ID NO: 146928 - protein, 26 aa, Mycobacterium avium
QDTLSTLMELLGKIFAPANPPALSYQ

SEQ ID NO: 146929 - protein, 27 aa, Mycobacterium avium
QFERVRLHPYLTVRILDQVPGLRRLAE

SEQ ID NO: 146930 - protein, 19 aa, Mycobacterium avium
QFVYQLKTPPAGSFSLGGH

SEQ ID NO: 146931 - protein, 17 aa, Mycobacterium avium
QGAVILLDRGTCPFAQK

SEQ ID NO: 146932 - protein, 25 aa, Mycobacterium avium
QIREDWAALYRKAIGWLNNPLGSLV

SEQ ID NO: 146933 - protein, 21 aa, Mycobacterium avium
QKTLPKFKRYAMSFGECLGSG

SEQ ID NO: 146934 - protein, 26 aa, Mycobacterium avium
QLNDIALYLNFTMLGSPNAGFFTDDG

SEQ ID NO: 146935 - protein, 25 aa, Mycobacterium avium
QNYTYKWETFLTQEMPLWMQSNKQV

SEQ ID NO: 146936 - protein, 22 aa, Mycobacterium avium
QPLAHRLSVMATLFANARGHIS

SEQ ID NO: 146937 - protein, 37 aa, Mycobacterium avium
QPQFSLGGLAYLLAPIAWMLGLRIVPMLAPGSADANG

SEQ ID NO: 146938 - protein, 24 aa, Mycobacterium avium
QQAFALSCNTAFVQLGILTGADAL

SEQ ID NO: 146939 - protein, 25 aa, Mycobacterium avium
QQAGMRIVLHFPYAANVHCEIDVDD

SEQ ID NO: 146940 - protein, 23 aa, Mycobacterium avium
QRGVAELLDVLPLTLENLYNTVD

SEQ ID NO: 146941 - protein, 18 aa, Mycobacterium avium
QRLGSGLVISQWCRPPKG

SEQ ID NO: 146942 - protein, 24 aa, Mycobacterium avium
QSGGANSPALYLLDGMRAQDDFNG

SEQ ID NO: 146943 - protein, 21 aa, Mycobacterium avium
QVELTPPYRGGPVLKNHDTIG

SEQ ID NO: 146944 - protein, 25 aa, Mycobacterium avium
RAAKAAPLGILPQPNELPRGCIAAG

SEQ ID NO: 146945 - protein, 18 aa, Mycobacterium avium
RAFAAYELQMRESVRRSR

SEQ ID NO: 146946 - protein, 22 aa, Mycobacterium avium
RAGVAFTPINYRLSAEGIRALI

SEQ ID NO: 146947 - protein, 18 aa, Mycobacterium avium
RAPWRLLQVYEDPGNTTS

SEQ ID NO: 146948 - protein, 30 aa, Mycobacterium avium
RCGGADAWNLPVVFGPLAITYNLAAVDSLV

SEQ ID NO: 146949 - protein, 34 aa, Mycobacterium avium
RCGGNPAWDLPLVFGPIAITYNLPGNPALVVSSD

SEQ ID NO: 146950 - protein, 25 aa, Mycobacterium avium
REIYRNPWMVLREDDIRRPDGSAGI

SEQ ID NO: 146951 - protein, 27 aa, Mycobacterium avium
RELVVAWGKLYPQFGTVAALNMVKCVH

SEQ ID NO: 146952 - protein, 21 aa, Mycobacterium avium
RETHLELERLVHALPAGPYQR

SEQ ID NO: 146953 - protein, 18 aa, Mycobacterium avium
RGEFEERLKAVLDDIKNS

SEQ ID NO: 146954 - protein, 19 aa, Mycobacterium avium
RGQYEQMLNPLFPQGNSAQ

SEQ ID NO: 146955 - protein, 29 aa, Mycobacterium avium
RHDIEQLLVLLPQGIAAMAAIIVPSSNTK

SEQ ID NO: 146956 - protein, 20 aa, Mycobacterium avium
RHRDGPRPWLVWVHGAGQGG

SEQ ID NO: 146957 - protein, 21 aa, Mycobacterium avium
RILDRLFAGLMSYDAAGNPAP

SEQ ID NO: 146958 - protein, 22 aa, Mycobacterium avium
RITNRGLFVHSAPWAVRSLGLE

SEQ ID NO: 146959 - protein, 20 aa, Mycobacterium avium
RKPRNKGLRFEFYANLDTAY

SEQ ID NO: 146960 - protein, 17 aa, Mycobacterium avium
RLLAAAAGLLTVASAFA

SEQ ID NO: 146961 - protein, 19 aa, Mycobacterium avium
RLPVPLYPGFDTLGTLEYI

SEQ ID NO: 146962 - protein, 25 aa, Mycobacterium avium
RLQVKTIWAARAISVLFPQITTIYG

SEQ ID NO: 146963 - protein, 23 aa, Mycobacterium avium
RNLQLLVSALYSSSDLLASFNTN

SEQ ID NO: 146964 - protein, 17 aa, Mycobacterium avium
RPRVKLPSLAKLLRVSH

SEQ ID NO: 146965 - protein, 18 aa, Mycobacterium avium
RPTGSFMFLGPTGVGKTE

SEQ ID NO: 146966 - protein, 28 aa, Mycobacterium avium
RQAAVQLAVYRLAWAALAKVPESSVRTA

SEQ ID NO: 146967 - protein, 18 aa, Mycobacterium avium
RRLAPAARLLVIGPPWPT

SEQ ID NO: 146968 - protein, 18 aa, Mycobacterium avium
RRPPVFAGTIWVQQGAQP

SEQ ID NO: 146969 - protein, 17 aa, Mycobacterium avium
RSAFKPEFINRLDDVII

SEQ ID NO: 146970 - protein, 18 aa, Mycobacterium avium
RSRLARLAGVGLGAASPN

SEQ ID NO: 146971 - protein, 23 aa, Mycobacterium avium
RSSVMSRLWRRPAPGAAPSSCPE

SEQ ID NO: 146972 - protein, 22 aa, Mycobacterium avium
RTDTILLVHLPGVGSGVAPTMV

SEQ ID NO: 146973 - protein, 30 aa, Mycobacterium avium
RTMLTALAADWPLLHSPACAALLADARRAV

SEQ ID NO: 146974 - protein, 27 aa, Mycobacterium avium
RTVSGQLTLLVPFIDRIRARVDLRERV

SEQ ID NO: 146975 - protein, 24 aa, Mycobacterium avium
RVAAVFLRELLATDLQPVVQRVAQ

SEQ ID NO: 146976 - protein, 17 aa, Mycobacterium avium
RVHRNAPPFLVIHGSKD

SEQ ID NO: 146977 - protein, 35 aa, Mycobacterium avium
RVSKLCLQYLNPIIKNRIYNYIPAGINPFVGTQAR

SEQ ID NO: 146978 - protein, 26 aa, Mycobacterium avium
RVVMPLIVRWGMYGGVRRNDPLGRET

SEQ ID NO: 146979 - protein, 18 aa, Mycobacterium avium
RWAGQLYWYDGSHVGHIF

SEQ ID NO: 146980 - protein, 23 aa, Mycobacterium avium
RYITARFLPDKAIDLVDEAASRL

SEQ ID NO: 146981 - protein, 22 aa, Mycobacterium avium
SAVVGLAAVALITVGCSNGKSV

SEQ ID NO: 146982 - protein, 24 aa, Mycobacterium avium
SDNTQAMTVLLFTEGRALVTLEFD

SEQ ID NO: 146983 - protein, 25 aa, Mycobacterium avium
SDYDGFTLAGIPAGGLFSGAEGKMS

SEQ ID NO: 146984 - protein, 26 aa, Mycobacterium avium
SGDNVNYRIVLKPGWRFTDGSPVTAH

SEQ ID NO: 146985 - protein, 30 aa, Mycobacterium avium
SGGSALILAAYYPQQFPYAASLSGFLNPSE

SEQ ID NO: 146986 - protein, 21 aa, Mycobacterium avium
SGLVISQWCRPPKGADSRSYY

SEQ ID NO: 146987 - protein, 24 aa, Mycobacterium avium
SGRQYMSWITLEDEVRALLFAIFE

SEQ ID NO: 146988 - protein, 28 aa, Mycobacterium avium
SGWQGDYPSMIEFLAPLFATGAGSNDVG

SEQ ID NO: 146989 - protein, 24 aa, Mycobacterium avium
SGWTAGHAGLFTGAPWVVSVDDHV

SEQ ID NO: 146990 - protein, 32 aa, Mycobacterium avium
SHEDARFNVSRAALLVVALTERPDLLMAATED

SEQ ID NO: 146991 - protein, 27 aa, Mycobacterium avium
SKGLRTYVQLFVLIAAANDVRCDVASN

SEQ ID NO: 146992 - protein, 26 aa, Mycobacterium avium
SLNQPPPCLTGFLPASQWRAPADTST

SEQ ID NO: 146993 - protein, 17 aa, Mycobacterium avium
SNGFWRRPTLQSAAEIG

SEQ ID NO: 146994 - protein, 20 aa, Mycobacterium avium
SPKSLKVDVLLLGVQNDPIV

SEQ ID NO: 146995 - protein, 27 aa, Mycobacterium avium
SPMAQSYIQRFLASPPAKRQQMAQQIQ

SEQ ID NO: 146996 - protein, 20 aa, Mycobacterium avium
SPPRIGFSTPYAVACDFYGG

SEQ ID NO: 146997 - protein, 21 aa, Mycobacterium avium
SPPVHNAVRFGFWGAEELGLI

SEQ ID NO: 146998 - protein, 24 aa, Mycobacterium avium
SRNEYVVGWIKRGPTGVIGTNKKD

SEQ ID NO: 146999 - protein, 23 aa, Mycobacterium avium
SRRLWDTIVIAADAPAATAELAA

SEQ ID NO: 147000 - protein, 24 aa, Mycobacterium avium
SSCTWQLSLFIPDGVPPPAGDPVP

SEQ ID NO: 147001 - protein, 18 aa, Mycobacterium avium
SVARFSAALAPHGSATLL

SEQ ID NO: 147002 - protein, 28 aa, Mycobacterium avium
SVIRDAGAVPSFLGYHGYPASICASVND

SEQ ID NO: 147003 - protein, 27 aa, Mycobacterium avium
SVTVMALIVLLLLNATMTQVFAADSLR

SEQ ID NO: 147004 - protein, 28 aa, Mycobacterium avium
TAAFDRPEDFWPRQWAHAYVDFAAGEKR

SEQ ID NO: 147005 - protein, 18 aa, Mycobacterium avium
TAIPPLAQPFIETALNQA

SEQ ID NO: 147006 - protein, 29 aa, Mycobacterium avium
TARAAATVLFLALLVLTGCSRSIAGNAVK

SEQ ID NO: 147007 - protein, 17 aa, Mycobacterium avium
TASFTGFPARHIPVLRT

SEQ ID NO: 147008 - protein, 18 aa, Mycobacterium avium
TAVLPNMPALRPTPQGRA

SEQ ID NO: 147009 - protein, 25 aa, Mycobacterium avium
TDAALICVPPYHIAGVSAALSNLYA

SEQ ID NO: 147010 - protein, 17 aa, Mycobacterium avium
TDIFHVVIGAENWRQEL

SEQ ID NO: 147011 - protein, 17 aa, Mycobacterium avium
TEQLVPRDLIYPPGKSR

SEQ ID NO: 147012 - protein, 36 aa, Mycobacterium avium
TGLRYRNHVPLTYPFALTFPALMSLVTGFDFPFAAM

SEQ ID NO: 147013 - protein, 22 aa, Mycobacterium avium
TGPALVEIFARRLRDRSTVRFA

SEQ ID NO: 147014 - protein, 17 aa, Mycobacterium avium
TGPPPSPIERYPLYCNG

SEQ ID NO: 147015 - protein, 25 aa, Mycobacterium avium
TGYQEHTFTWDTALRVRAELTALGV

SEQ ID NO: 147016 - protein, 22 aa, Mycobacterium avium
TLFPLDGPNQLETRALLNCFKS

SEQ ID NO: 147017 - protein, 19 aa, Mycobacterium avium
TLGVHRVLQALTPGGPRTG

SEQ ID NO: 147018 - protein, 23 aa, Mycobacterium avium
TLPSQSALLGSKAIDLCNPNDPI

SEQ ID NO: 147019 - protein, 25 aa, Mycobacterium avium
TLRNHARWAVLLRGLRFVIVDECHY

SEQ ID NO: 147020 - protein, 23 aa, Mycobacterium avium
TPDTRVAPAYRQSVSASVSASSV

SEQ ID NO: 147021 - protein, 31 aa, Mycobacterium avium
TPIIVFSHIPLFAMYPQWGWGTDDAAQALSY

SEQ ID NO: 147022 - protein, 19 aa, Mycobacterium avium
TPSGPPLPPAPAGQAPPDP

SEQ ID NO: 147023 - protein, 22 aa, Mycobacterium avium
TTAALSVPPWALEPVNELGRDH

SEQ ID NO: 147024 - protein, 25 aa, Mycobacterium avium
TVIPVFNWQYGGWGYWFFGVWVPLY

SEQ ID NO: 147025 - protein, 19 aa, Mycobacterium avium
TVRPGTTGVWLIIERPNPN

SEQ ID NO: 147026 - protein, 17 aa, Mycobacterium avium
TWGSYYSAGLFAMNNGV

SEQ ID NO: 147027 - protein, 24 aa, Mycobacterium avium
TYNLAAVDSLVLDAPTLAKIFNGT

SEQ ID NO: 147028 - protein, 18 aa, Mycobacterium avium
TYPFTVDRWTPDKVFSGG

SEQ ID NO: 147029 - protein, 34 aa, Mycobacterium avium
VAADAYDAYLRLHLLSHRLVAPHGLNAGGLFGVL

SEQ ID NO: 147030 - protein, 21 aa, Mycobacterium avium
VAGDVPLAFALAAGSFRDGTR

SEQ ID NO: 147031 - protein, 17 aa, Mycobacterium avium
VAPVRTSGMTPYVVRYI

SEQ ID NO: 147032 - protein, 24 aa, Mycobacterium avium
VASVLVGGKLWRAVEKNSYAAYFA

SEQ ID NO: 147033 - protein, 28 aa, Mycobacterium avium
VATDNRFRFLRVYPNPAQYAPVTGFYSL

SEQ ID NO: 147034 - protein, 18 aa, Mycobacterium avium
VCTPGGPLALPSHDEMVS

SEQ ID NO: 147035 - protein, 25 aa, Mycobacterium avium
VEGRALSMLNDPFLVGGLPATNGPS

SEQ ID NO: 147036 - protein, 25 aa, Mycobacterium avium
VESAPLPWSFTIVTTLPSMSANIVA

SEQ ID NO: 147037 - protein, 19 aa, Mycobacterium avium
VFAGGKLWHTVFGPGDDYS

SEQ ID NO: 147038 - protein, 24 aa, Mycobacterium avium
VFQRTPCWVLPRLDVATPPAVQAL

SEQ ID NO: 147039 - protein, 32 aa, Mycobacterium avium
VGAEALVRWRHPIWGLLLPDSFIGVAESTNLG

SEQ ID NO: 147040 - protein, 18 aa, Mycobacterium avium
VGARIPRVYGRQATEYVI

SEQ ID NO: 147041 - protein, 18 aa, Mycobacterium avium
VGTFTILEAVRRHGVRLH

SEQ ID NO: 147042 - protein, 28 aa, Mycobacterium avium
VGWDTPVVSTLPWFALGDPYVTGHVTVG

SEQ ID NO: 147043 - protein, 19 aa, Mycobacterium avium
VLGFVKFGARRWKPEEINT

SEQ ID NO: 147044 - protein, 19 aa, Mycobacterium avium
VLTPANWNRVIAPGGSATG

SEQ ID NO: 147045 - protein, 25 aa, Mycobacterium avium
VNTLNLRKLGHLGADQLEFVKKDVA

SEQ ID NO: 147046 - protein, 25 aa, Mycobacterium avium
VNVQAKLYGLPFGDGAYGAEDISLN

SEQ ID NO: 147047 - protein, 23 aa, Mycobacterium avium
VPAERIHTLVFALLRGVTAVGWP

SEQ ID NO: 147048 - protein, 25 aa, Mycobacterium avium
VPASSLPDWPFNGPGYTVFPVFNLA

SEQ ID NO: 147049 - protein, 24 aa, Mycobacterium avium
VPEVAELVAMLRLVADPTAGAAAM

SEQ ID NO: 147050 - protein, 26 aa, Mycobacterium avium
VPPENAPVPLWSQPPSPPPSTPPVRT

SEQ ID NO: 147051 - protein, 21 aa, Mycobacterium avium
VPPSMYLIRDILGGAAGAAGA

SEQ ID NO: 147052 - protein, 30 aa, Mycobacterium avium
VPPTPVQLRAVGRLLGWRLGMDGVDPKGTV

SEQ ID NO: 147053 - protein, 24 aa, Mycobacterium avium
VQLGSNYTTPYRWTPDAKIGDSAI

SEQ ID NO: 147054 - protein, 23 aa, Mycobacterium avium
VRGVPVWATLIALLHDGVPVVGA

SEQ ID NO: 147055 - protein, 27 aa, Mycobacterium avium
VSCGAMAFNFMKLPATLFGIGEYRVTV

SEQ ID NO: 147056 - protein, 18 aa, Mycobacterium avium
VSLGIKLLGVGYTHYTAE

SEQ ID NO: 147057 - protein, 40 aa, Mycobacterium avium
VSLPAKQWLAHRGFDPVYGARPLRRLVQQAIGDQLAKQLL

SEQ ID NO: 147058 - protein, 30 aa, Mycobacterium avium
VTLAKPITNGLTYNFTFSFEKAGQASVLVP

SEQ ID NO: 147059 - protein, 28 aa, Mycobacterium avium
VVATEPVAFYLLEASGLVNRTPPALEAA

SEQ ID NO: 147060 - protein, 19 aa, Mycobacterium avium
VVMPGQAPPIISRAEWGAD

SEQ ID NO: 147061 - protein, 24 aa, Mycobacterium avium
VWRVRAFGDFLSYCLVAEGAVDIA

SEQ ID NO: 147062 - protein, 31 aa, Mycobacterium avium
VYGYDQTVFYKSGQPFLWDRGRELGMTNRLQ

SEQ ID NO: 147063 - protein, 17 aa, Mycobacterium avium
WCVRLVQGGGFAGPLLD

SEQ ID NO: 147064 - protein, 17 aa, Mycobacterium avium
WGPWYQTEYETAAPDPG

SEQ ID NO: 147065 - protein, 45 aa, Mycobacterium avium
WNDGPPPHHPPPNWYGPPPPGGWDGPPPPGGWNRPWDGPPRDVAV

SEQ ID NO: 147066 - protein, 21 aa, Mycobacterium avium
WQSYLIATASFAEWIDRGRPA

SEQ ID NO: 147067 - protein, 23 aa, Mycobacterium avium
WRFGVPLVCLLAGLLLAATHGVS

SEQ ID NO: 147068 - protein, 22 aa, Mycobacterium avium
WSALTTMILPSGGAPYVVWPKT

SEQ ID NO: 147069 - protein, 19 aa, Mycobacterium avium
WTENLQLLRPLVDSGQIQL

SEQ ID NO: 147070 - protein, 20 aa, Mycobacterium avium
YATLTPNKWSDFGKASDIYD

SEQ ID NO: 147071 - protein, 19 aa, Mycobacterium avium
YEPIWPRHGIRIIPGPSSL

SEQ ID NO: 147072 - protein, 31 aa, Mycobacterium avium
YGALPIYVVFVYFRAPWRKFIPHLHDGDGVQ

SEQ ID NO: 147073 - protein, 24 aa, Mycobacterium avium
YGGYLRASLPPFWQTTNGAQVRAA

SEQ ID NO: 147074 - protein, 27 aa, Mycobacterium avium
YITKSGFDYTWFVLNAKIIEKEFALSG

SEQ ID NO: 147075 - protein, 24 aa, Mycobacterium avium
YLAQLRAAGLTWPPKTEEALIAEA

SEQ ID NO: 147076 - protein, 21 aa, Mycobacterium avium
YLVHNPAALLGKPVERVVIDP

SEQ ID NO: 147077 - protein, 19 aa, Mycobacterium avium
YREDPLPWHPNGLAIDVMI

SEQ ID NO: 147078 - protein, 19 aa, Mycobacterium avium
YSPWPASYDASLRVSWRQL

SEQ ID NO: 147079 - protein, 23 aa, Mycobacterium avium
YTYHSKTLGWCDIAYNALVDKYG

SEQ ID NO: 147080 - protein, 21 aa, Mycobacterium avium
YWVMSYPLYGVQQAGAKCPGP

SEQ ID NO: 147081 - protein, 26 aa, Mycobacterium avium
AAAGDLRLEWPLRPPPVVVRAFDAPA

SEQ ID NO: 147082 - protein, 35 aa, Mycobacterium avium
AAAMRVLTGPRWRLGARDLAALWQRARALGGAGTA

SEQ ID NO: 147083 - protein, 24 aa, Mycobacterium avium
AAANIAPALAAPALRGATAGLGGG

SEQ ID NO: 147084 - protein, 21 aa, Mycobacterium avium
AAAQPPPAPAPPPEPHRPGQT

SEQ ID NO: 147085 - protein, 26 aa, Mycobacterium avium
AAFQFITELVLLDWPTHLAQLASWLP

SEQ ID NO: 147086 - protein, 22 aa, Mycobacterium avium
AAGIPNFNPGLTAATTAGPPAP

SEQ ID NO: 147087 - protein, 23 aa, Mycobacterium avium
AAGQLDNLPYRVAFSTFTSGPPQ

SEQ ID NO: 147088 - protein, 20 aa, Mycobacterium avium
AAKFTYLSAAHYCPKYITGE

SEQ ID NO: 147089 - protein, 19 aa, Mycobacterium avium
AAKLFGFPTVIAHGMFSAA

SEQ ID NO: 147090 - protein, 24 aa, Mycobacterium avium
AALLLALCWPIAPAAAPDPAAGTA

SEQ ID NO: 147091 - protein, 23 aa, Mycobacterium avium
AANSWNLRTIGDLAPHSADVRFG

SEQ ID NO: 147092 - protein, 32 aa, Mycobacterium avium
AAQPTAWLAEGVLIGFLPPEAEVRLLDSITPL

SEQ ID NO: 147093 - protein, 18 aa, Mycobacterium avium
AAREFVAFWLDADDRVLA

SEQ ID NO: 147094 - protein, 17 aa, Mycobacterium avium
AARMLDIRTAHVALRVL

SEQ ID NO: 147095 - protein, 18 aa, Mycobacterium avium
AATLAGWLLTRRSGRIRE

SEQ ID NO: 147096 - protein, 17 aa, Mycobacterium avium
AAVLAAVSALMIGCAHR

SEQ ID NO: 147097 - protein, 35 aa, Mycobacterium avium
AAVLVLLPIVTFAMAYFIVDIPKPGDLRTNQVSTI

SEQ ID NO: 147098 - protein, 22 aa, Mycobacterium avium
AAVNGKTWAIKGTATGVDMSNP

SEQ ID NO: 147099 - protein, 25 aa, Mycobacterium avium
ADAVPLAPLTTLRVGPTARRLITCA

SEQ ID NO: 147100 - protein, 30 aa, Mycobacterium avium; identical to SEQ ID NO: 123618

SEQ ID NO: 147101 - protein, 24 aa, Mycobacterium avium
ADERRTCVFFESPRRLPACLQDAV

SEQ ID NO: 147102 - protein, 18 aa, Mycobacterium avium
ADLPPGYRTGFHATVPMI

SEQ ID NO: 147103 - protein, 21 aa, Mycobacterium avium
ADVPWETGIFDPLGGSLRIRR

SEQ ID NO: 147104 - protein, 17 aa, Mycobacterium avium
AEPFIQEALDRAAWQHS

SEQ ID NO: 147105 - protein, 22 aa, Mycobacterium avium
AFDRWTDLIAQRFIADGIRRRR

SEQ ID NO: 147106 - protein, 23 aa, Mycobacterium avium
AFKDSDAWFLIRAVTEPDATTLP

SEQ ID NO: 147107 - protein, 25 aa, Mycobacterium avium
AFTGQQTFYFYPVNEYGGYQLGSST

SEQ ID NO: 147108 - protein, 18 aa, Mycobacterium avium
AFTVVPAFTGRVLQALQP

SEQ ID NO: 147109 - protein, 19 aa, Mycobacterium avium
AGAAPPPALPAPPPSPGIG

SEQ ID NO: 147110 - protein, 24 aa, Mycobacterium avium
AGDQAGFPLGWVHDVVWAPRPVSG

SEQ ID NO: 147111 - protein, 20 aa, Mycobacterium avium
AGERLVFGPVTLGLVPVRVT

SEQ ID NO: 147112 - protein, 24 aa, Mycobacterium avium
AGMDARAYRLAWPDGTVVYELDQP

SEQ ID NO: 147113 - protein, 24 aa, Mycobacterium avium
AGMEALLIKGAIPMRFSDGGAPEN

SEQ ID NO: 147114 - protein, 19 aa, Mycobacterium avium
AGNGMLLPKSMTATPEAFN

SEQ ID NO: 147115 - protein, 29 aa, Mycobacterium avium
AGPDQPALRALLDLLPIAAGSGTLGDRFT

SEQ ID NO: 147116 - protein, 20 aa, Mycobacterium avium
AGPQRLSGPEALSFVRQRHE

SEQ ID NO: 147117 - protein, 24 aa, Mycobacterium avium
AGRPTPEMLAYQYLQTLPEMARGD

SEQ ID NO: 147118 - protein, 23 aa, Mycobacterium avium
AGSDLAVLWQPSQGRGSCIDRSA

SEQ ID NO: 147119 - protein, 19 aa, Mycobacterium avium
AGVDAPPTVILSISTQGQA

SEQ ID NO: 147120 - protein, 19 aa, Mycobacterium avium
AIALSVLLSSACSASQVIN

SEQ ID NO: 147121 - protein, 25 aa, Mycobacterium avium
AITDDQLIFYFAPGEMLPAFGGPVQ

SEQ ID NO: 147122 - protein, 25 aa, Mycobacterium avium
AKKLGLQRQWLHARSLSFAHPADGR

SEQ ID NO: 147123 - protein, 19 aa, Mycobacterium avium
AKYVLFTNPENLATAFRAT

SEQ ID NO: 147124 - protein, 24 aa, Mycobacterium avium
ALAERRLVRLLHLGGTAALPSYFE

SEQ ID NO: 147125 - protein, 26 aa, Mycobacterium avium
ALDEGLLPVLPQLSAKHHLLVAAVAD

SEQ ID NO: 147126 - protein, 17 aa, Mycobacterium avium
ALIATRLCDRLGLSRQQ

SEQ ID NO: 147127 - protein, 32 aa, Mycobacterium avium
ALLHRAASPAVWLNPWRWYAAPRAVADSLTVD

SEQ ID NO: 147128 - protein, 25 aa, Mycobacterium avium
ALLSGLLEALPPNAALLVTADHGGL

SEQ ID NO: 147129 - protein, 18 aa, Mycobacterium avium
ALPRWAFANAATGEMSGD

SEQ ID NO: 147130 - protein, 28 aa, Mycobacterium avium
ALRPQGHLLVFWDCYRPHDVQVKMFSLV

SEQ ID NO: 147131 - protein, 18 aa, Mycobacterium avium
ALRRTRWQIWKFQHDNTA

SEQ ID NO: 147132 - protein, 19 aa, Mycobacterium avium
ALSERAYTLLKRAFKQRTV

SEQ ID NO: 147133 - protein, 19 aa, Mycobacterium avium
AMPLPPPPSTPMPPPPPPE

SEQ ID NO: 147134 - protein, 17 aa, Mycobacterium avium
AMPVLRELELPAAVFLA

SEQ ID NO: 147135 - protein, 19 aa, Mycobacterium avium
AMVIDLITIAQAPVAGLIP

SEQ ID NO: 147136 - protein, 23 aa, Mycobacterium avium
AMVLRRLLRLCARYASAPAVIFA

SEQ ID NO: 147137 - protein, 23 aa, Mycobacterium avium
ANAKWFFDNFGPGDPIIVKNSSG

SEQ ID NO: 147138 - protein, 25 aa, Mycobacterium avium
ANDLDKLIWAEGFSLPLTQSPGDVA

SEQ ID NO: 147139 - protein, 25 aa, Mycobacterium avium
ANGIDAPALWPGLPVRPVKGEVLRL

SEQ ID NO: 147140 - protein, 20 aa, Mycobacterium avium
ANHRATLLQGPRFVGTGPQV

SEQ ID NO: 147141 - protein, 32 aa, Mycobacterium avium
ANIALLFNRDPAMLDLLVANDIRFVTTSAGDP

SEQ ID NO: 147142 - protein, 22 aa, Mycobacterium avium
ANNDFKPGFAASLMNKDLGLAM

SEQ ID NO: 147143 - protein, 18 aa, Mycobacterium avium
APEAVLDRGIRKTNGLPA

SEQ ID NO: 147144 - protein, 25 aa, Mycobacterium avium
APGTPAYITLGKIREAWNVPRGADG

SEQ ID NO: 147145 - protein, 21 aa, Mycobacterium avium
APHIAMTVAMLRQAGVDVDDS

SEQ ID NO: 147146 - protein, 23 aa, Mycobacterium avium
APRGSAYHYFPGGRTQLLCEAVD

SEQ ID NO: 147147 - protein, 24 aa, Mycobacterium avium
APSDGIEQLIFAPQGPLSAPKARR

SEQ ID NO: 147148 - protein, 26 aa, Mycobacterium avium
ARDPGHSWIWAIRPCSYDRGPECLTV

SEQ ID NO: 147149 - protein, 23 aa, Mycobacterium avium
ARGGRRLVIAMMYGLIKEGGPSY

SEQ ID NO: 147150 - protein, 25 aa, Mycobacterium avium
ARRRGLYGLLAEGLLTAAAATVIAL

SEQ ID NO: 147151 - protein, 18 aa, Mycobacterium avium
ASARLLGPLASYLVVNVS

SEQ ID NO: 147152 - protein, 20 aa, Mycobacterium avium
ASMLFPHLYGPLPVNAVIAV

SEQ ID NO: 147153 - protein, 22 aa, Mycobacterium avium
ASVPLPQPVPGIASILPANGAV

SEQ ID NO: 147154 - protein, 18 aa, Mycobacterium avium
ATAGKIDFAITGNTPPIF

SEQ ID NO: 147155 - protein, 24 aa, Mycobacterium avium
ATDLCEFVEFPTELLQVCGDSFAG

SEQ ID NO: 147156 - protein, 28 aa, Mycobacterium avium
ATEVDAPLLINLVLGGLTPLQSAARLHE

SEQ ID NO: 147157 - protein, 21 aa, Mycobacterium avium
ATLAMIRFPATGDKIGSLVIN

SEQ ID NO: 147158 - protein, 23 aa, Mycobacterium avium
ATLEQMYGLPKTGYAAGAAPITD

SEQ ID NO: 147159 - protein, 33 aa, Mycobacterium avium
AVAVAAVVVLGWYYLRIPSLAGIGRYTLYAELP

SEQ ID NO: 147160 - protein, 20 aa, Mycobacterium avium
AVAVGWPDLMRAARDRPLAP

SEQ ID NO: 147161 - protein, 17 aa, Mycobacterium avium
AVGGLGPSLRRLVDATQ

SEQ ID NO: 147162 - protein, 27 aa, Mycobacterium avium
AVIGARWQLIAFAAPLLGVLGTISWQP

SEQ ID NO: 147163 - protein, 31 aa, Mycobacterium avium
AVLDRAGRFLPFETPFTWAGMQYYTQMPASD

SEQ ID NO: 147164 - protein, 18 aa, Mycobacterium avium
AVLGLHDLMNGGHPGQYG

SEQ ID NO: 147165 - protein, 23 aa, Mycobacterium avium
AVLLACLMIVLCAGAGVGTWLLV

SEQ ID NO: 147166 - protein, 18 aa, Mycobacterium avium
AVNVYPIGVLKQAPLATQ

SEQ ID NO: 147167 - protein, 18 aa, Mycobacterium avium
AWVNQTVSVLAQYTNRRK

SEQ ID NO: 147168 - protein, 23 aa, Mycobacterium avium
AYAWDMGAYAWPGPERLRFANDP

SEQ ID NO: 147169 - protein, 26 aa, Mycobacterium avium
CAELGLPHLVLARPAWDPGAATVVDS

SEQ ID NO: 147170 - protein, 24 aa, Mycobacterium avium
CHRAQGFLLSRPLDSAGMEALLIK

SEQ ID NO: 147171 - protein, 21 aa, Mycobacterium avium
CIATLLMGLPVLAMTACSSPQ

SEQ ID NO: 147172 - protein, 21 aa, Mycobacterium avium
CLHWGAMWGPASGARYVDPLG

SEQ ID NO: 147173 - protein, 17 aa, Mycobacterium avium
CRAANPKVKLPAGALCG

SEQ ID NO: 147174 - protein, 22 aa, Mycobacterium avium
CTLGYVDPGLKIAFTAGHCRGG

SEQ ID NO: 147175 - protein, 30 aa, Mycobacterium avium
DAQRILFHDMPVVPLWNYISVVGWSGEVSH

SEQ ID NO: 147176 - protein, 21 aa, Mycobacterium avium
DAWQPLPTWFERLAAAGVRAR

SEQ ID NO: 147177 - protein, 24 aa, Mycobacterium avium
DDARFVTFVRGAMYWSPQTGAQPV

SEQ ID NO: 147178 - protein, 31 aa, Mycobacterium avium; identical to SEQ ID NO: 124951

SEQ ID NO: 147179 - protein, 25 aa, Mycobacterium avium
DDPEFHPPRLGDLKRSCLDIGLAAR

SEQ ID NO: 147180 - protein, 19 aa, Mycobacterium avium
DEAGLTRFLGGYLSVVSAP

SEQ ID NO: 147181 - protein, 25 aa, Mycobacterium avium
DELVIVVPPTHKWARRSRVVTAREL

SEQ ID NO: 147182 - protein, 27 aa, Mycobacterium avium
DEVLQSYLNIIYFGRGAYGISAAAKAY

SEQ ID NO: 147183 - protein, 26 aa, Mycobacterium avium
DFGTGYSVLTYLKSLPVDSLKIDKGF

SEQ ID NO: 147184 - protein, 19 aa, Mycobacterium avium
DFSAALQGFTKLLGTPGQD

SEQ ID NO: 147185 - protein, 23 aa, Mycobacterium avium
DGGNLRLALTDFPPNFNILHIDG

SEQ ID NO: 147186 - protein, 18 aa, Mycobacterium avium
DGPPLFVANPVDHVVTLI

SEQ ID NO: 147187 - protein, 20 aa, Mycobacterium avium
DGVTGFPPGLWARQTSEIRS

SEQ ID NO: 147188 - protein, 17 aa, Mycobacterium avium
DIQLAQLQKRLAQRRLT

SEQ ID NO: 147189 - protein, 19 aa, Mycobacterium avium
DKAPAPSPILTAGSDKPEC

SEQ ID NO: 147190 - protein, 17 aa, Mycobacterium avium
DKFPRMVDYVLPTGVRI

SEQ ID NO: 147191 - protein, 21 aa, Mycobacterium avium
DLARRFFRAAAAPIRQAWQLS

SEQ ID NO: 147192 - protein, 20 aa, Mycobacterium avium
DLLVRFETAVRWARAHPQQW

SEQ ID NO: 147193 - protein, 17 aa, Mycobacterium avium
DLTLLPIGAYNTAWPDV

SEQ ID NO: 147194 - protein, 17 aa, Mycobacterium avium
DMHMAIASALNMYDNVL

SEQ ID NO: 147195 - protein, 23 aa, Mycobacterium avium
DMRDPLTIAFHKAKLRADFLRPA

SEQ ID NO: 147196 - protein, 19 aa, Mycobacterium avium
DNEVIVEDWLIQPIAADTV

SEQ ID NO: 147197 - protein, 25 aa, Mycobacterium avium
DNLLKELPDIYQVLARQGLNGDYFG

SEQ ID NO: 147198 - protein, 25 aa, Mycobacterium avium
DNRGAMRPVLRVAPLSVADLLRDRV

SEQ ID NO: 147199 - protein, 26 aa, Mycobacterium avium
DPAGWPRLDWSMDAALLLAALASRAG

SEQ ID NO: 147200 - protein, 18 aa, Mycobacterium avium
DPGFRLVTACVQAGLPVG

SEQ ID NO: 147201 - protein, 24 aa, Mycobacterium avium
DPPPPPPMPPPPPLVWAPPTPESE

SEQ ID NO: 147202 - protein, 18 aa, Mycobacterium avium
DQAGLYCVNYARQSAAKL

SEQ ID NO: 147203 - protein, 20 aa, Mycobacterium avium
DQYGYRKLATAPIGGAPAEV

SEQ ID NO: 147204 - protein, 28 aa, Mycobacterium avium
DRLVGWDTYRRLDLLPYLSADTQSLQLS

SEQ ID NO: 147205 - protein, 19 aa, Mycobacterium avium
DRNFHIVTCRQLEWRRMID

SEQ ID NO: 147206 - protein, 22 aa, Mycobacterium avium
DSLWFAPLFSQEALDLLELGLG

SEQ ID NO: 147207 - protein, 18 aa, Mycobacterium avium
DTLSFYKPTQAGSYPIVL

SEQ ID NO: 147208 - protein, 18 aa, Mycobacterium avium
DTVVYFQVTVPQAAVYEI

SEQ ID NO: 147209 - protein, 17 aa, Mycobacterium avium
DVDALLAERARVTGPPP

SEQ ID NO: 147210 - protein, 20 aa, Mycobacterium avium
DVIGELLHRLPVPRTGAGPG

SEQ ID NO: 147211 - protein, 23 aa, Mycobacterium avium
DWDTYRCLAALQALLFPDRAADM

SEQ ID NO: 147212 - protein, 21 aa, Mycobacterium avium
DYELDVAKLLDFPLMTDMRDP

SEQ ID NO: 147213 - protein, 32 aa, Mycobacterium avium
EAGPNQVLSPGFHGLQIHAVGKCEANSTAPTG

SEQ ID NO: 147214 - protein, 18 aa, Mycobacterium avium
EDAGLRMLLALSSDGRSV

SEQ ID NO: 147215 - protein, 24 aa, Mycobacterium avium
EGALLAALIRRPSTLDPAVDPKGA

SEQ ID NO: 147216 - protein, 31 aa, Mycobacterium avium
EGRALLDRVTPALPVLFANLVSLGDIAVVYR

SEQ ID NO: 147217 - protein, 18 aa, Mycobacterium avium
EHGPFDLTLLPIGAYNTA

SEQ ID NO: 147218 - protein, 24 aa, Mycobacterium avium
EHHNLPALRDWLRRQRDERSGAPE

SEQ ID NO: 147219 - protein, 23 aa, Mycobacterium avium
EIAPFMSYGQFTGNAPLGTCAFW

SEQ ID NO: 147220 - protein, 27 aa, Mycobacterium avium
EIDSRSYTFIAYLGDYYAFTTLTTDPG

SEQ ID NO: 147221 - protein, 19 aa, Mycobacterium avium
EIYLNTFRHLYGLDCSHIA

SEQ ID NO: 147222 - protein, 27 aa, Mycobacterium avium
EKRFELAAGEFLLFPTVAHSHAQRVRP

SEQ ID NO: 147223 - protein, 18 aa, Mycobacterium avium
ELACALGLFPPTEEQAAV

SEQ ID NO: 147224 - protein, 20 aa, Mycobacterium avium
ELGLLIGIVPGRPRGCGLLH

SEQ ID NO: 147225 - protein, 25 aa, Mycobacterium avium
ELTGLLNRRALIAHLDKRLAPGQPG

SEQ ID NO: 147226 - protein, 27 aa, Mycobacterium avium
EMAHTVRNLLAPPLRLRGPVTRADGGK

SEQ ID NO: 147227 - protein, 21 aa, Mycobacterium avium
ENLIRPTGFFRNKASALIRLG

SEQ ID NO: 147228 - protein, 21 aa, Mycobacterium avium
EPAESLPPPYDNRLAQPYGGY

SEQ ID NO: 147229 - protein, 17 aa, Mycobacterium avium
EPIVPAHVLHRPKLGFP

SEQ ID NO: 147230 - protein, 21 aa, Mycobacterium avium
EQSQSWFGAPPTLVINNAGVG

SEQ ID NO: 147231 - protein, 35 aa, Mycobacterium avium
ERGRRRRRFALRAALALLVVVVLAGVFAGGKLWHT

SEQ ID NO: 147232 - protein, 23 aa, Mycobacterium avium
ERLVNLVIALLSTRGYITAEKIR

SEQ ID NO: 147233 - protein, 24 aa, Mycobacterium avium
ERQVDAVALYTPILGLNAMIARHL

SEQ ID NO: 147234 - protein, 26 aa, Mycobacterium avium
ESPEVYQFVVLFPSPEQASAFLSASS

SEQ ID NO: 147235 - protein, 29 aa, Mycobacterium avium
ESVQTTLEALWWDRPFTLNGVDIGASVAT

SEQ ID NO: 147236 - protein, 18 aa, Mycobacterium avium
ETCPPMGHPHHHLHLPHL

SEQ ID NO: 147237 - protein, 23 aa, Mycobacterium avium
EVDPMLFDRSYFLEPDSKSSKSY

SEQ ID NO: 147238 - protein, 25 aa, Mycobacterium avium
EVKAMYPLGPIFHGSGLNITAMSLR

SEQ ID NO: 147239 - protein, 26 aa, Mycobacterium avium
EVLRLRWRKGCMPVPQRVIRARVHGR

SEQ ID NO: 147240 - protein, 18 aa, Mycobacterium avium
EWRRMIDIGADFSGAKVA

SEQ ID NO: 147241 - protein, 27 aa, Mycobacterium avium
FAAYYRWDVYCFTTAGDVLLPIGYDAS

SEQ ID NO: 147242 - protein, 18 aa, Mycobacterium avium
FARERSRWVFSNPDMIHL

SEQ ID NO: 147243 - protein, 30 aa, Mycobacterium avium
FATFGDPIGRHAFGQSFLTAMFGVGSVVPA

SEQ ID NO: 147244 - protein, 21 aa, Mycobacterium avium
FAVLTYLSYTAAFAPIDTVTV

SEQ ID NO: 147245 - protein, 25 aa, Mycobacterium avium
FCARDPFGIKPLFVATGTGGTAVAS

SEQ ID NO: 147246 - protein, 25 aa, Mycobacterium avium
FDRPAPPDAPAPDAPPPAPADLPPA

SEQ ID NO: 147247 - protein, 18 aa, Mycobacterium avium
FEHGTITWKPGDAEATVT

SEQ ID NO: 147248 - protein, 19 aa, Mycobacterium avium
FHTGGFNRNTWGVAMIGNF

SEQ ID NO: 147249 - protein, 18 aa, Mycobacterium avium
FLPLNRDPRLAGSINDVG

SEQ ID NO: 147250 - protein, 25 aa, Mycobacterium avium
FNLNLNLPPPCTTGYLPPAQRRSPA

SEQ ID NO: 147251 - protein, 31 aa, Mycobacterium avium
FNNLPIPINIFLQKSVDPSKILYSEPRLAPG

SEQ ID NO: 147252 - protein, 17 aa, Mycobacterium avium
FPAPELTGPGTSGTSRL

SEQ ID NO: 147253 - protein, 18 aa, Mycobacterium avium
FTAADLRTSSGSALILHQ

SEQ ID NO: 147254 - protein, 30 aa, Mycobacterium avium
FTGNAPLGTCAFWPVPPTSKPHTISAPGLA

SEQ ID NO: 147255 - protein, 18 aa, Mycobacterium avium
FYNKRLFDEAGVPSPPTA

SEQ ID NO: 147256 - protein, 21 aa, Mycobacterium avium
GAALTVALLGACTSRPPAQLS

SEQ ID NO: 147257 - protein, 22 aa, Mycobacterium avium
GAAQFAALASNAYCPHHLAPKG

SEQ ID NO: 147258 - protein, 24 aa, Mycobacterium avium
GAAQFTMIAASAYCPQHLGQRVGP

SEQ ID NO: 147259 - protein, 28 aa, Mycobacterium avium
GAFDMAQFGWLGDAFPLSALTQIYKSDG

SEQ ID NO: 147260 - protein, 23 aa, Mycobacterium avium
GAIWARYGVPWQPAYVFYRADGS

SEQ ID NO: 147261 - protein, 23 aa, Mycobacterium avium
GAPNPYIYPENLPRVNARGGPGG

SEQ ID NO: 147262 - protein, 22 aa, Mycobacterium avium
GAVALVAALLAAAAVLLDYSGQ

SEQ ID NO: 147263 - protein, 18 aa, Mycobacterium avium
GAVPLPRAWAGDAPIGHI

SEQ ID NO: 147264 - protein, 25 aa, Mycobacterium avium
GDFFDLVGMAHWRALDEKYAHTGGR

SEQ ID NO: 147265 - protein, 17 aa, Mycobacterium avium
GDHLRAFAAYELQMRES

SEQ ID NO: 147266 - protein, 17 aa, Mycobacterium avium
GDYYAFTTLTTDPGAAV

SEQ ID NO: 147267 - protein, 22 aa, Mycobacterium avium
GEGLVVWFNTLLASGGGRVLSE

SEQ ID NO: 147268 - protein, 23 aa, Mycobacterium avium
GEGWVRPQLLEYMRTAPDFYFDE

SEQ ID NO: 147269 - protein, 28 aa, Mycobacterium avium
GEKRSWLRARGLKLFPLVGWAERGGYGA

SEQ ID NO: 147270 - protein, 34 aa, Mycobacterium avium; identical to SEQ ID NO: 126783

SEQ ID NO: 147271 - protein, 22 aa, Mycobacterium avium
GGAWLHVRLPEAPAPPQNTPVD

SEQ ID NO: 147272 - protein, 22 aa, Mycobacterium avium
GGCGRDYRILSVAMLEVTFCGF

SEQ ID NO: 147273 - protein, 31 aa, Mycobacterium avium
GGCMALVLNASKSKYFGAWGPTREEAEAAAL

SEQ ID NO: 147274 - protein, 23 aa, Mycobacterium avium
GGNNLLFRRNSLTGAVEVVARGG

SEQ ID NO: 147275 - protein, 20 aa, Mycobacterium avium
GGNWVLQHDAAIALIQAATA

SEQ ID NO: 147276 - protein, 21 aa, Mycobacterium avium
GGPHAVYLLDAFNAAPDVSNW

SEQ ID NO: 147277 - protein, 19 aa, Mycobacterium avium
GHSLSRPTWSLDDVVWVVV

SEQ ID NO: 147278 - protein, 18 aa, Mycobacterium avium
GIALYYNADLLGAAGIDP

SEQ ID NO: 147279 - protein, 19 aa, Mycobacterium avium
GIEDPVFDEFPYYQAKREA

SEQ ID NO: 147280 - protein, 21 aa, Mycobacterium avium
GIGRYTLYAELPQSGGLYRTA

SEQ ID NO: 147281 - protein, 18 aa, Mycobacterium avium
GIGTVKFRIGPDGKLQTI

SEQ ID NO: 147282 - protein, 24 aa, Mycobacterium avium
GIKPGRSYTARQLLDALLLVSGND

SEQ ID NO: 147283 - protein, 19 aa, Mycobacterium avium
GINHVIWRQKIYPGVGGGN

SEQ ID NO: 147284 - protein, 19 aa, Mycobacterium avium
GIQEINAGWYNGKPESMAK

SEQ ID NO: 147285 - protein, 26 aa, Mycobacterium avium
GKASPYLIGALKLILTQPFDIDTVPK

SEQ ID NO: 147286 - protein, 29 aa, Mycobacterium avium
GKSARTLLIWMSIAAVALLLAGCVRVVVG

SEQ ID NO: 147287 - protein, 21 aa, Mycobacterium avium
GLGFSAPYNMEQFVSGIIGAE

SEQ ID NO: 147288 - protein, 18 aa, Mycobacterium avium
GLLCMYKVHQFSEPEPVI

SEQ ID NO: 147289 - protein, 17 aa, Mycobacterium avium
GLTGWVGIGVAVLVVAG

SEQ ID NO: 147290 - protein, 18 aa, Mycobacterium avium
GLYCVNYARQSAAKLSPA

SEQ ID NO: 147291 - protein, 18 aa, Mycobacterium avium
GMAPYMVRVLGTTAPTQQ

SEQ ID NO: 147292 - protein, 20 aa, Mycobacterium avium
GNDLVLDTLSFYKPTQAGSY

SEQ ID NO: 147293 - protein, 28 aa, Mycobacterium avium
GNPEIRPAHLLMALLTQADGIAAPLLEA

SEQ ID NO: 147294 - protein, 29 aa, Mycobacterium avium
GPASISALRLYLPAPADQPLTGLRLRIEF

SEQ ID NO: 147295 - protein, 20 aa, Mycobacterium avium
GPLLAAVVWAGPAQADAAGF

SEQ ID NO: 147296 - protein, 32 aa, Mycobacterium avium; identical to SEQ ID NO: 143822

SEQ ID NO: 147297 - protein, 17 aa, Mycobacterium avium
GQVRWVPGTELEFGYRT

SEQ ID NO: 147298 - protein, 18 aa, Mycobacterium avium
GRAALAVNWPYALASMLD

SEQ ID NO: 147299 - protein, 17 aa, Mycobacterium avium
GRPHDWPAWAEPEVVGA

SEQ ID NO: 147300 - protein, 17 aa, Mycobacterium avium
GRPTGHTWLPESIIRTG

SEQ ID NO: 147301 - protein, 23 aa, Mycobacterium avium
GSADDIFWLSNAYLAAYADSGRL

SEQ ID NO: 147302 - protein, 25 aa, Mycobacterium avium
GSSSPAPSLPPSQAPAKPALVRGSV

SEQ ID NO: 147303 - protein, 27 aa, Mycobacterium avium
GTTVVFDNYLRRCDFSKVSIAPKVPSP

SEQ ID NO: 147304 - protein, 26 aa, Mycobacterium avium
GTVGYRFTWHLPKNRTWTYDGQLKMA

SEQ ID NO: 147305 - protein, 25 aa, Mycobacterium avium
GVARVDAYALLPDAGRPRNEHVFYH

SEQ ID NO: 147306 - protein, 33 aa, Mycobacterium avium
GVAVSDLEFIQFHPTMLFAPGAGGGRRPLVTEA

SEQ ID NO: 147307 - protein, 22 aa, Mycobacterium avium
GVIFLLLGWQALGSSGNSEDDS

SEQ ID NO: 147308 - protein, 21 aa, Mycobacterium avium
GVIGGSGFYIFFGSDADDVTV

SEQ ID NO: 147309 - protein, 17 aa, Mycobacterium avium
GVRCVVQFFPSHDVYSW

SEQ ID NO: 147310 - protein, 64 aa, Mycobacterium avium; identical to SEQ ID NO: 127378

SEQ ID NO: 147311 - protein, 22 aa, Mycobacterium avium
GYPEAVLARELEMCYAAIALVT

SEQ ID NO: 147312 - protein, 24 aa, Mycobacterium avium
GYPEHAFTWAVVGLINASLNQMGV

SEQ ID NO: 147313 - protein, 24 aa, Mycobacterium avium
HGEAGVVAIFAQALLSGKPTKVFG

SEQ ID NO: 147314 - protein, 24 aa, Mycobacterium avium
HGSRTYVLLPQPPNRSVSSWVRGT

SEQ ID NO: 147315 - protein, 24 aa, Mycobacterium avium
HSIRATVLVAEWPPRNVDPDPLGV

SEQ ID NO: 147316 - protein, 32 aa, Mycobacterium avium; identical to SEQ ID NO: 127687

SEQ ID NO: 147317 - protein, 27 aa, Mycobacterium avium
HTVPYRANLWALRKLGVRRVLAPCAVG

SEQ ID NO: 147318 - protein, 25 aa, Mycobacterium avium
HVLERLFPGIGKLDESFPGLGMDGP

SEQ ID NO: 147319 - protein, 18 aa, Mycobacterium avium
HWRYQTYLRAEGLDFDVA

SEQ ID NO: 147320 - protein, 18 aa, Mycobacterium avium
IAGLKPDLIVAINAGLDA

SEQ ID NO: 147321 - protein, 17 aa, Mycobacterium avium
IALVNTLNLRKLGHLGA

SEQ ID NO: 147322 - protein, 19 aa, Mycobacterium avium
IAMEKRWRKVLGERRLTEL

SEQ ID NO: 147323 - protein, 17 aa, Mycobacterium avium
IARSFAAALGLQFTRVQ

SEQ ID NO: 147324 - protein, 26 aa, Mycobacterium avium
IAVDMLEMLPTPWGLVRSGVAPDHPK

SEQ ID NO: 147325 - protein, 33 aa, Mycobacterium avium
IAVTRPLDAPATQPPPRPADDLGYRPASREQPF

SEQ ID NO: 147326 - protein, 29 aa, Mycobacterium avium
IDLVPEYIGNLLLYFEPASSATTLDAVEQ

SEQ ID NO: 147327 - protein, 22 aa, Mycobacterium avium
IDPKLLAGRKLPDGLTFDPAQC

SEQ ID NO: 147328 - protein, 21 aa, Mycobacterium avium
IEVAPGITIPVGPPTTVTLAP

SEQ ID NO: 147329 - protein, 23 aa, Mycobacterium avium
IFIGSWTDLTIFQGPLADIAAKA

SEQ ID NO: 147330 - protein, 25 aa, Mycobacterium avium
IGASLLQDWTQFAAPAVFGIAMRLY

SEQ ID NO: 147331 - protein, 19 aa, Mycobacterium avium
IGAVLPPLAVGAKCTAAAL

SEQ ID NO: 147332 - protein, 24 aa, Mycobacterium avium
IGEAFILAEKLGLSAQSLFDVITG

SEQ ID NO: 147333 - protein, 20 aa, Mycobacterium avium
IGLALLGAPAAPMVVPAVAT

SEQ ID NO: 147334 - protein, 19 aa, Mycobacterium avium
IGTLPAVAPLTGPHARPRD

SEQ ID NO: 147335 - protein, 18 aa, Mycobacterium avium
INDIEDYWRSVYGQSLKG

SEQ ID NO: 147336 - protein, 19 aa, Mycobacterium avium
IPVGPPTTVTLAPAPPAGG

SEQ ID NO: 147337 - protein, 18 aa, Mycobacterium avium
ISELTLWSSAPPQTLWPA

SEQ ID NO: 147338 - protein, 23 aa, Mycobacterium avium
IVGIFNSVWGEYPAAVSWQATSE

SEQ ID NO: 147339 - protein, 25 aa, Mycobacterium avium
IVHVSSFTALFHPDLETLTAELPVV

SEQ ID NO: 147340 - protein, 17 aa, Mycobacterium avium
IVNLRMGLVVDGAGVTV

SEQ ID NO: 147341 - protein, 18 aa, Mycobacterium avium
KHFGSKRELLEAAVAHRI

SEQ ID NO: 147342 - protein, 21 aa, Mycobacterium avium
KHPGAVRQVLAWMGSRQGNEY

SEQ ID NO: 147343 - protein, 24 aa, Mycobacterium avium
KNVKSVHLVLSIQGKISGLPIKTL

SEQ ID NO: 147344 - protein, 23 aa, Mycobacterium avium
KPADVKFVYLQPADALSAFSQHQ

SEQ ID NO: 147345 - protein, 26 aa, Mycobacterium avium
KPNAYTVYFAMKFNRPFISYGSWDGS

SEQ ID NO: 147346 - protein, 26 aa, Mycobacterium avium
KTHQPWVVSFQLNWPRDHGPTATGWM

SEQ ID NO: 147347 - protein, 32 aa, Mycobacterium avium
KTIDWALHDGLGSYFWQHNWGSPKGFTHPAAH

SEQ ID NO: 147348 - protein, 23 aa, Mycobacterium avium
KTPVGAMALLAEALLASADDSET

SEQ ID NO: 147349 - protein, 21 aa, Mycobacterium avium
KTQLMRLATDLGPKSGVSGTS

SEQ ID NO: 147350 - protein, 20 aa, Mycobacterium avium
KTRQQLRRIGAVALATDTVP

SEQ ID NO: 147351 - protein, 25 aa, Mycobacterium avium
KTYGIGAKPYWRPPYAKRNAAVDAV

SEQ ID NO: 147352 - protein, 19 aa, Mycobacterium avium
KVKLPAGALCGKLAVPVDY

SEQ ID NO: 147353 - protein, 23 aa, Mycobacterium avium
LAAGWLVERAGFGKGYPVPDPGG

SEQ ID NO: 147354 - protein, 24 aa, Mycobacterium avium
LADNGYIPIPDAFKSRLSAAINAI

SEQ ID NO: 147355 - protein, 28 aa, Mycobacterium avium
LAGAMPVILAAGAVLPGPRAAAGVAGMS

SEQ ID NO: 147356 - protein, 26 aa, Mycobacterium avium
LAGASALAVILLWAAPGHATADPAVT

SEQ ID NO: 147357 - protein, 19 aa, Mycobacterium avium
LAGRLWDLPGWARAGHRLL

SEQ ID NO: 147358 - protein, 19 aa, Mycobacterium avium
LARLREIDGLLPTLVRGQG

SEQ ID NO: 147359 - protein, 27 aa, Mycobacterium avium
LASENAFFMLAFTKIGLMPDGGASALV

SEQ ID NO: 147360 - protein, 18 aa, Mycobacterium avium
LDELLAGADLLITSMRPS

SEQ ID NO: 147361 - protein, 25 aa, Mycobacterium avium
LDIGLAARVLGWQPKVGLQQGVART

SEQ ID NO: 147362 - protein, 18 aa, Mycobacterium avium
LDIRTAHVALRVLHDGSM

SEQ ID NO: 147363 - protein, 18 aa, Mycobacterium avium
LDRISAFQMGFLNGASAC

SEQ ID NO: 147364 - protein, 19 aa, Mycobacterium avium
LDRYFDYAEGRLGWRTLDF

SEQ ID NO: 147365 - protein, 18 aa, Mycobacterium avium
LELVPDGPGSLPANTIPL

SEQ ID NO: 147366 - protein, 17 aa, Mycobacterium avium
LEWQLVAVAHLSGGVFP

SEQ ID NO: 147367 - protein, 17 aa, Mycobacterium avium
LGAAMRLPGAWATPPAP

SEQ ID NO: 147368 - protein, 25 aa, Mycobacterium avium
LGGAHVLGIPYDQYIRMEGADWFPG

SEQ ID NO: 147369 - protein, 19 aa, Mycobacterium avium
LGLLMPDSFIQVAESINLG

SEQ ID NO: 147370 - protein, 25 aa, Mycobacterium avium
LGSPQPMFPWMTPTPQQAPTQVPGC

SEQ ID NO: 147371 - protein, 22 aa, Mycobacterium avium
LGWKLHGRFREKDGRQLVIRDL

SEQ ID NO: 147372 - protein, 21 aa, Mycobacterium avium
LHATMISLETCPPMGHPHHHL

SEQ ID NO: 147373 - protein, 17 aa, Mycobacterium avium
LHHPCCGDLVYGADPKL

SEQ ID NO: 147374 - protein, 30 aa, Mycobacterium avium
LIDTNFLGLVRLTNAVLPYLRAQGGGRVIN

SEQ ID NO: 147375 - protein, 17 aa, Mycobacterium avium
LIGIVGCTSVTNGTATP

SEQ ID NO: 147376 - protein, 29 aa, Mycobacterium avium
LKMSLNTSYYRLMLKLKGGPQAVADAAHQ

SEQ ID NO: 147377 - protein, 25 aa, Mycobacterium avium
LLAPAVLLGWPAAAEPPSCAALGGS

SEQ ID NO: 147378 - protein, 18 aa, Mycobacterium avium
LLDFPLMTDMRDPLTIAF

SEQ ID NO: 147379 - protein, 19 aa, Mycobacterium avium
LLFTFTLIAVFGQLRFEDR

SEQ ID NO: 147380 - protein, 17 aa, Mycobacterium avium
LLKVMLREPDELGDLDE

SEQ ID NO: 147381 - protein, 17 aa, Mycobacterium avium
LLLAGVGLGAGVAWFDT

SEQ ID NO: 147382 - protein, 18 aa, Mycobacterium avium
LLMHTTFAMLHSLCGLNG

SEQ ID NO: 147383 - protein, 20 aa, Mycobacterium avium
LLMLAVLLAGCAGVPSSSAP

SEQ ID NO: 147384 - protein, 21 aa, Mycobacterium avium
LLSAALRLFAAKGYAATSVAD

SEQ ID NO: 147385 - protein, 24 aa, Mycobacterium avium
LNDLVHPMASLTLLSELMNYDFAQ

SEQ ID NO: 147386 - protein, 28 aa, Mycobacterium avium
LNELGWTLRRPPLPPTGQHWRLLSTVKE

SEQ ID NO: 147387 - protein, 21 aa, Mycobacterium avium
LNLAQYPAVLVELGNMKNAGD

SEQ ID NO: 147388 - protein, 23 aa, Mycobacterium avium
LPHARVESIARTWAHAGFDAAAV

SEQ ID NO: 147389 - protein, 17 aa, Mycobacterium avium
LQGFTKLLGTPGQDGVF

SEQ ID NO: 147390 - protein, 25 aa, Mycobacterium avium
LQNNDLVPYRTLVTTPPVGVMVGHL

SEQ ID NO: 147391 - protein, 20 aa, Mycobacterium avium
LRADRVLICAGVATPKLFGP

SEQ ID NO: 147392 - protein, 24 aa, Mycobacterium avium
LRDNGYLPMTFTANDIAWSDQNPS

SEQ ID NO: 147393 - protein, 18 aa, Mycobacterium avium
LRRHGPVTVYGVDKFPRM

SEQ ID NO: 147394 - protein, 22 aa, Mycobacterium avium
LRVPAVWVAGVALGASMLGAAV

SEQ ID NO: 147395 - protein, 25 aa, Mycobacterium avium
LSAAPPGQPTWYRGAARISDLVEQI

SEQ ID NO: 147396 - protein, 17 aa, Mycobacterium avium
LSILALVTVVSCGAMAF

SEQ ID NO: 147397 - protein, 17 aa, Mycobacterium avium
LSSAVAVGWPDLMRAAR

SEQ ID NO: 147398 - protein, 26 aa, Mycobacterium avium
LTRLRGMFAFALWDTVTRELFCARDP

SEQ ID NO: 147399 - protein, 17 aa, Mycobacterium avium
LTRVRVLDRGSGQVRWV

SEQ ID NO: 147400 - protein, 20 aa, Mycobacterium avium
LVANDRWWGPKAITKRITVW

SEQ ID NO: 147401 - protein, 21 aa, Mycobacterium avium
LVAVVAVGVGLLCMYKVHQFS

SEQ ID NO: 147402 - protein, 29 aa, Mycobacterium avium
LVLLVDGLGWQLLAQLAGDAPLLAAVRAG

SEQ ID NO: 147403 - protein, 23 aa, Mycobacterium avium
LVSQFFGKYFSPEEARKLIAEQA

SEQ ID NO: 147404 - protein, 21 aa, Mycobacterium avium
MALYSPNLWHHLTDGLSELVD

SEQ ID NO: 147405 - protein, 17 aa, Mycobacterium avium
MFSLVPNPAWVARPGAY

SEQ ID NO: 147406 - protein, 25 aa, Mycobacterium avium
MNYGGLTVYSGEWWHFDGPGAGVDQ

SEQ ID NO: 147407 - protein, 25 aa, Mycobacterium avium
MRRRATMYLTYWTAGDTRNRGREML

SEQ ID NO: 147408 - protein, 31 aa, Mycobacterium avium
MVALVPIVVFGVLLAVVTVPFVSLGPGPTFD

SEQ ID NO: 147409 - protein, 18 aa, Mycobacterium avium
MVGLVEPRLRVAITSGQC

SEQ ID NO: 147410 - protein, 18 aa, Mycobacterium avium
MVLLPLVAAHVDVPIVAA

SEQ ID NO: 147411 - protein, 17 aa, Mycobacterium avium
NAHWRPEHYYAPGTTVT

SEQ ID NO: 147412 - protein, 25 aa, Mycobacterium avium
NGQAYQFPMGLGLVSQFFGKYFSPE

SEQ ID NO: 147413 - protein, 20 aa, Mycobacterium avium
NGTHDWPYWGAQLQAMKPDL

SEQ ID NO: 147414 - protein, 17 aa, Mycobacterium avium
NITRLPVRYTFDNRYFS

SEQ ID NO: 147415 - protein, 22 aa, Mycobacterium avium
NLGPELVPPSRYLAAPQATTAA

SEQ ID NO: 147416 - protein, 18 aa, Mycobacterium avium
NMTGYPEAVLARELEMCY

SEQ ID NO: 147417 - protein, 24 aa, Mycobacterium avium
NQGPAGWLRAKTGSLTAINALAGV

SEQ ID NO: 147418 - protein, 18 aa, Mycobacterium avium
NRLAAYLHSQGLGCHTER

SEQ ID NO: 147419 - protein, 17 aa, Mycobacterium avium
NTSSVAFLGDYGGTGYP

SEQ ID NO: 147420 - protein, 23 aa, Mycobacterium avium
NTTLWASWALAGPTHRAYFGGDT

SEQ ID NO: 147421 - protein, 20 aa, Mycobacterium avium
NTVLAALRDTGFITYQGGDH

SEQ ID NO: 147422 - protein, 22 aa, Mycobacterium avium
NTVVRFVPNRYWPAHGHVSVGV

SEQ ID NO: 147423 - protein, 17 aa, Mycobacterium avium
NVAFATIPVLDGAGWSD

SEQ ID NO: 147424 - protein, 18 aa, Mycobacterium avium
NWALANNSLLIVTFDEDD

SEQ ID NO: 147425 - protein, 21 aa, Mycobacterium avium
PAAALWAPQTAWADDDFVALA

SEQ ID NO: 147426 - protein, 27 aa, Mycobacterium avium
PAGGALGRLRPLFRTGLGARLGSGRQY

SEQ ID NO: 147427 - protein, 17 aa, Mycobacterium avium
PAPAPPPEPHRPGQTPF

SEQ ID NO: 147428 - protein, 18 aa, Mycobacterium avium
PARHFSGRFLDRNTTLWA

SEQ ID NO: 147429 - protein, 24 aa, Mycobacterium avium
PATRLLRPSIMWRAARARGADHPG

SEQ ID NO: 147430 - protein, 28 aa, Mycobacterium avium
PAVIKNAIDWLSRPFGDGALKGKPLAVI

SEQ ID NO: 147431 - protein, 26 aa, Mycobacterium avium
PDPLAPPPPPDPLAPPPPAAPPAPWL

SEQ ID NO: 147432 - protein, 17 aa, Mycobacterium avium
PDRLAAPLLWEPGVPTD

SEQ ID NO: 147433 - protein, 22 aa, Mycobacterium avium
PDRPDNMFALANTLMGLATGHT

SEQ ID NO: 147434 - protein, 24 aa, Mycobacterium avium
PDTARRYAVLSLPTTLIFDADGRQ

SEQ ID NO: 147435 - protein, 20 aa, Mycobacterium avium
PEIVWYLDEPVADPALVPLF

SEQ ID NO: 147436 - protein, 24 aa, Mycobacterium avium
PESVSFLRQFLASPPGQRQQMAQM

SEQ ID NO: 147437 - protein, 21 aa, Mycobacterium avium
PFNRRVALATLGIGALAPGVL

SEQ ID NO: 147438 - protein, 19 aa, Mycobacterium avium
PGGVKLAAGWLVERAGFGK

SEQ ID NO: 147439 - protein, 23 aa, Mycobacterium avium
PGNPRMLSIAQFWDRAANHDRIS

SEQ ID NO: 147440 - protein, 17 aa, Mycobacterium avium
PGPFAHLNCACDQPDPP

SEQ ID NO: 147441 - protein, 28 aa, Mycobacterium avium
PGQPGPVPVVFLAIDRFKVINGRLGQDA

SEQ ID NO: 147442 - protein, 25 aa, Mycobacterium avium
PGRSAAWLIVDVRDLAALHAALLEP

SEQ ID NO: 147443 - protein, 17 aa, Mycobacterium avium
PHIPLGVLAPVLRPEFG

SEQ ID NO: 147444 - protein, 30 aa, Mycobacterium avium
PHSRQLVAAQIIWTLARADIRGPYVINADG

SEQ ID NO: 147445 - protein, 26 aa, Mycobacterium avium
PILTVAAPLFDRIEIALPAGKSIRIA

SEQ ID NO: 147446 - protein, 23 aa, Mycobacterium avium
PIVGPLAPGQVLRIGPTAGTGTP

SEQ ID NO: 147447 - protein, 23 aa, Mycobacterium avium
PKGALARWNWVLDGMVETKALPA

SEQ ID NO: 147448 - protein, 30 aa, Mycobacterium avium
PLAPPPPAAPPAPWLPPAAQPAAAPAAGQD

SEQ ID NO: 147449 - protein, 24 aa, Mycobacterium avium
PLARGALPDLMLSPNDIDTALGVT

SEQ ID NO: 147450 - protein, 27 aa, Mycobacterium avium
PLNQFVAQILRLFGIDWDPVEGTLNGL

SEQ ID NO: 147451 - protein, 21 aa, Mycobacterium avium
PLRAVNIGAVLPPLAVGAKCT

SEQ ID NO: 147452 - protein, 30 aa, Mycobacterium avium
PNGEVVKRCYAEILPAARPGALFIDSSTIS

SEQ ID NO: 147453 - protein, 20 aa, Mycobacterium avium
PPPALPAPPPSPGIGVDHEN

SEQ ID NO: 147454 - protein, 20 aa, Mycobacterium avium
PPTTVTLAPAPPAGGPPGGP

SEQ ID NO: 147455 - protein, 22 aa, Mycobacterium avium
PPVFVAPVYGYLVSDLARDVTG

SEQ ID NO: 147456 - protein, 37 aa, Mycobacterium avium
PPVPGKFYWMTPTQLRWRPLSFWPAHTAVTVDAGGTV

SEQ ID NO: 147457 - protein, 26 aa, Mycobacterium avium
PQFQTKYPMYTIIRRQLTDAAVRPAT

SEQ ID NO: 147458 - protein, 24 aa, Mycobacterium avium
PQPLACDNGWWWDPGTNECRPPVV

SEQ ID NO: 147459 - protein, 17 aa, Mycobacterium avium
PQTAWADDDFVALAVSV

SEQ ID NO: 147460 - protein, 19 aa, Mycobacterium avium
PRDSILAAGRYLAANGFAA

SEQ ID NO: 147461 - protein, 23 aa, Mycobacterium avium
PRNEHVFYHLGVAKAVAAAVADR

SEQ ID NO: 147462 - protein, 22 aa, Mycobacterium avium
PSAPAVWLIEGLLQYLDEAAVT

SEQ ID NO: 147463 - protein, 26 aa, Mycobacterium avium
PSDRYLGAPVSVVSPWYGAKAIDLCA

SEQ ID NO: 147464 - protein, 30 aa, Mycobacterium avium
PTAPQALLPPPPLSARIPLPGGGALMKIPG

SEQ ID NO: 147465 - protein, 18 aa, Mycobacterium avium
PTVFTAAPGAAWRDNLRA

SEQ ID NO: 147466 - protein, 20 aa, Mycobacterium avium
PWDGPPRDVAVARADFGPFS

SEQ ID NO: 147467 - protein, 32 aa, Mycobacterium avium
PYEAYTSPADPLWWVVRALELFSDFQQFGALL

SEQ ID NO: 147468 - protein, 23 aa, Mycobacterium avium
QAELAKLFDKRLAKTTPQRAAQI

SEQ ID NO: 147469 - protein, 24 aa, Mycobacterium avium
QAGQYALTYPRRLGFGLGNSVVSL

SEQ ID NO: 147470 - protein, 17 aa, Mycobacterium avium
QAPAKPALVRGSVASVS

SEQ ID NO: 147471 - protein, 25 aa, Mycobacterium avium
QASQKVFGFAPYPGAAPGLPAKVTI

SEQ ID NO: 147472 - protein, 22 aa, Mycobacterium avium
QEPGVYPLLLVTYEIVCSKGYD

SEQ ID NO: 147473 - protein, 25 aa, Mycobacterium avium
QKPQGFKALDITLPMPARWTQVPDP

SEQ ID NO: 147474 - protein, 31 aa, Mycobacterium avium
QLASWLPTQPQLLLVPALVAAAPFGALAGFA

SEQ ID NO: 147475 - protein, 18 aa, Mycobacterium avium
QLIRHTAWFGAAVGFAVT

SEQ ID NO: 147476 - protein, 29 aa, Mycobacterium avium
QNFSGRARMSSMLWTFKVQKDNGVSCPGG

SEQ ID NO: 147477 - protein, 42 aa, Mycobacterium avium
QPGAFLSFPVTQWTRWRQPVIGMPTTPRFLGHGQLLVVTHLG

SEQ ID NO: 147478 - protein, 19 aa, Mycobacterium avium
QPKVGLQQGVARTVEYFRN

SEQ ID NO: 147479 - protein, 32 aa, Mycobacterium avium
QRCGSPAWNLPVVFGPIAITYNVAGLNSLNLD

SEQ ID NO: 147480 - protein, 20 aa, Mycobacterium avium
QRDCVYYTTLVMWIGCHADS

SEQ ID NO: 147481 - protein, 21 aa, Mycobacterium avium
QRNQWLVVDNIPGGAPIPQEV

SEQ ID NO: 147482 - protein, 24 aa, Mycobacterium avium
QSGRFAFRAGPIFTNLLLADEINR

SEQ ID NO: 147483 - protein, 24 aa, Mycobacterium avium
QTLASLSLILRGGGIPNLEVLQNE

SEQ ID NO: 147484 - protein, 31 aa, Mycobacterium avium
QTWEARIKLDCLFPGLWPSFWGVNEDPLPDG

SEQ ID NO: 147485 - protein, 21 aa, Mycobacterium avium
QVEVLPGIQEINAGWYNGKPE

SEQ ID NO: 147486 - protein, 17 aa, Mycobacterium avium
QVLLDGPTLSRMLNQPF

SEQ ID NO: 147487 - protein, 21 aa, Mycobacterium avium
RADHAWDLARLGWALHGSPAT

SEQ ID NO: 147488 - protein, 22 aa, Mycobacterium avium
RAMGPMQFIPETWRLYAVDAHN

SEQ ID NO: 147489 - protein, 41 aa, Mycobacterium avium; identical to SEQ ID NO: 24921

SEQ ID NO: 147490 - protein, 18 aa, Mycobacterium avium
RATALRRAGRPVGTRQLG

SEQ ID NO: 147491 - protein, 19 aa, Mycobacterium avium
RDDCRESLRRPVPNGSGIM

SEQ ID NO: 147492 - protein, 22 aa, Mycobacterium avium
REELPVQLVVRSVGYRGVPTPG

SEQ ID NO: 147493 - protein, 21 aa, Mycobacterium avium
RELEMCYAAIALVTDLDAGVS

SEQ ID NO: 147494 - protein, 18 aa, Mycobacterium avium
RFGASTMVLLPLVAAHVD

SEQ ID NO: 147495 - protein, 26 aa, Mycobacterium avium
RGIATYLRLGYAPFTLEFGRNGWIAD

SEQ ID NO: 147496 - protein, 21 aa, Mycobacterium avium
RGRFYDDYFAAAGKAGLRQVV

SEQ ID NO: 147497 - protein, 22 aa, Mycobacterium avium
RIKLDCLTAGAWPAYWLGNDDQ

SEQ ID NO: 147498 - protein, 17 aa, Mycobacterium avium
RILDQVPGLRRLAEVAG

SEQ ID NO: 147499 - protein, 30 aa, Mycobacterium avium
RKPKLRYPAGPLARRLSLLKKFAPEAVLDR

SEQ ID NO: 147500 - protein, 18 aa, Mycobacterium avium
RLLRLGLESLRLWREGGF

SEQ ID NO: 147501 - protein, 22 aa, Mycobacterium avium
RLSAVFASLTLATALIAGCSSG

SEQ ID NO: 147502 - protein, 17 aa, Mycobacterium avium
RNAAIGTLPAVAPLTGP

SEQ ID NO: 147503 - protein, 22 aa, Mycobacterium avium
RNRGREMLAFATAYREAGVQPP

SEQ ID NO: 147504 - protein, 19 aa, Mycobacterium avium
RPAGLPGLRQKYGLDIKPG

SEQ ID NO: 147505 - protein, 19 aa, Mycobacterium avium
RRALRLTAIDVDTGELTVF

SEQ ID NO: 147506 - protein, 21 aa, Mycobacterium avium
RRGETYYILLAGTAADFCSDL

SEQ ID NO: 147507 - protein, 32 aa, Mycobacterium avium
RRNRFRLIVFAWITAMVTGLMFSVAPTPAALA

SEQ ID NO: 147508 - protein, 17 aa, Mycobacterium avium
RRRIFAGLIAAALPGAA

SEQ ID NO: 147509 - protein, 23 aa, Mycobacterium avium
RRSWQGLTLLVAAMVLTSCGWKG

SEQ ID NO: 147510 - protein, 29 aa, Mycobacterium avium
RRTQIAIGAVIALIVFGVAMCGPSHDSSS

SEQ ID NO: 147511 - protein, 19 aa, Mycobacterium avium
RTIGIDLRQDWPAALQDAG

SEQ ID NO: 147512 - protein, 20 aa, Mycobacterium avium
RTIMDTIAVFPDPATAAQTA

SEQ ID NO: 147513 - protein, 20 aa, Mycobacterium avium
RVAEILPDLPRLRVLIQIAD

SEQ ID NO: 147514 - protein, 25 aa, Mycobacterium avium
RVLAFVGANLMKFGPLLGELLARAA

SEQ ID NO: 147515 - protein, 20 aa, Mycobacterium avium
RVRVLDRGSGQVRWVPGTEL

SEQ ID NO: 147516 - protein, 18 aa, Mycobacterium avium
RVVAPHRLTDPKAGPLIA

SEQ ID NO: 147517 - protein, 20 aa, Mycobacterium avium
RYFVPRFAAVPITRDTEQAR

SEQ ID NO: 147518 - protein, 20 aa, Mycobacterium avium
SALIVSRLHKIFGSEDLNAN

SEQ ID NO: 147519 - protein, 22 aa, Mycobacterium avium
SAMMKATLPRAFVIGPDGSTTV

SEQ ID NO: 147520 - protein, 25 aa, Mycobacterium avium
SDDLTTFYTALYRTLLHPNMFNDAD

SEQ ID NO: 147521 - protein, 30 aa, Mycobacterium avium
SDHSRRLWTVLIFMLWHAIFVEHSVVPQIG

SEQ ID NO: 147522 - protein, 29 aa, Mycobacterium avium
SFAITNDGVIFFFDQGRLLPDSAGAPQVL

SEQ ID NO: 147523 - protein, 31 aa, Mycobacterium avium
SGKLCSLFLGPGLRVLNFNNLPIPINIFLQK

SEQ ID NO: 147524 - protein, 24 aa, Mycobacterium avium
SGLDARPYRLSWPAGTTVYEIDQP

SEQ ID NO: 147525 - protein, 23 aa, Mycobacterium avium
SIGGLSVPPSWAPGGVAPAANAT

SEQ ID NO: 147526 - protein, 27 aa, Mycobacterium avium
SLQGKPAVLWFWTPWCPYCNAEAPGVS

SEQ ID NO: 147527 - protein, 25 aa, Mycobacterium avium
SNKDAWMVGYTPSLSTAVWLGTAKG

SEQ ID NO: 147528 - protein, 27 aa, Mycobacterium avium
SQGLSQFGINLPPVPALSGGATSTPGL

SEQ ID NO: 147529 - protein, 24 aa, Mycobacterium avium
SQHQADAWAIWDPYTAQAEQQIPV

SEQ ID NO: 147530 - protein, 28 aa, Mycobacterium avium
SRNPKWWGTRPRLDSITYLVLDDAARLP

SEQ ID NO: 147531 - protein, 20 aa, Mycobacterium avium
SRPQIQVGMPFCKIGAVTGE

SEQ ID NO: 147532 - protein, 21 aa, Mycobacterium avium
SRRRVTLVGDAGYCPGPAVGG

SEQ ID NO: 147533 - protein, 24 aa, Mycobacterium avium
SSPDQADGWLRRWLQRDKAAGAPS

SEQ ID NO: 147534 - protein, 25 aa, Mycobacterium avium
STPDHKFAVAAAPHQTFQFAVDVPG

SEQ ID NO: 147535 - protein, 34 aa, Mycobacterium avium
STYHAFAGSLLRDYGLLLPVEPDTRLLSETELWQ

SEQ ID NO: 147536 - protein, 19 aa, Mycobacterium avium
SVVLFGMPNVRAMNFLNEP

SEQ ID NO: 147537 - protein, 25 aa, Mycobacterium avium
TAGDVLLPIGYDASSPIPAADYVAA

SEQ ID NO: 147538 - protein, 23 aa, Mycobacterium avium
TAGLPLLRRACTALAAVLVAAGC

SEQ ID NO: 147539 - protein, 29 aa, Mycobacterium avium
TAPVLWGDLPTLPLYRQQRTLLISKKMYA

SEQ ID NO: 147540 - protein, 31 aa, Mycobacterium avium
TASDLLPTGRRLLAAPGLRAVPGLPVCQLRR

SEQ ID NO: 147541 - protein, 23 aa, Mycobacterium avium
TDRSGRVLTFAFISNDAGPNGRN

SEQ ID NO: 147542 - protein, 17 aa, Mycobacterium avium
TFAKPYAEWRGMFAGNG

SEQ ID NO: 147543 - protein, 22 aa, Mycobacterium avium
TGDGIALGLWAGVAVSDLEFIQ

SEQ ID NO: 147544 - protein, 17 aa, Mycobacterium avium
TGKPWFAIGGIDAQRLP

SEQ ID NO: 147545 - protein, 22 aa, Mycobacterium avium
TGMVVLGVWQPGAPSAGLVGLK

SEQ ID NO: 147546 - protein, 20 aa, Mycobacterium avium
TGWIGRWLDATGDDPLRAVN

SEQ ID NO: 147547 - protein, 18 aa, Mycobacterium avium
THAAAVTSLILPAAVSSP

SEQ ID NO: 147548 - protein, 24 aa, Mycobacterium avium
THFARLVHRWRWTAEKDPVKIEHA

SEQ ID NO: 147549 - protein, 17 aa, Mycobacterium avium
THTQLYPSDARCLVHQS

SEQ ID NO: 147550 - protein, 27 aa, Mycobacterium avium
TIMIPEKHLPLVMPLKYIGIDENTLNK

SEQ ID NO: 147551 - protein, 27 aa, Mycobacterium avium
TISEQLMPHWLLSLQAEATRRGEAAPQ

SEQ ID NO: 147552 - protein, 19 aa, Mycobacterium avium
TIWTRCDSYFRSPTGRIVT

SEQ ID NO: 147553 - protein, 26 aa, Mycobacterium avium
TLAADGSILDTWFPAPELTGPGTSGT

SEQ ID NO: 147554 - protein, 17 aa, Mycobacterium avium
TLNFATFGDPIGRHAFG

SEQ ID NO: 147555 - protein, 20 aa, Mycobacterium avium
TLRVGPTARRLITCASSEQV

SEQ ID NO: 147556 - protein, 21 aa, Mycobacterium avium
TMAVDYQRLGKMPPLQTGGLH

SEQ ID NO: 147557 - protein, 29 aa, Mycobacterium avium
TNDGLLVPIHWGTFRLAPHPWAEPVERLL

SEQ ID NO: 147558 - protein, 24 aa, Mycobacterium avium
TNTDTIILIRIPNNGKSATAISIP

SEQ ID NO: 147559 - protein, 25 aa, Mycobacterium avium
TNTQLLWYRPDLVPQPPRTWDAVVT

SEQ ID NO: 147560 - protein, 21 aa, Mycobacterium avium
TPLWRVDDPLATVAPIVQSEL

SEQ ID NO: 147561 - protein, 21 aa, Mycobacterium avium
TQRIVLSRNPKWWGTRPRLDS

SEQ ID NO: 147562 - protein, 17 aa, Mycobacterium avium
TRRASFRRLAACCTALS

SEQ ID NO: 147563 - protein, 26 aa, Mycobacterium avium
TSGGWRIDRLPNGVFLDWQQFQATYK

SEQ ID NO: 147564 - protein, 30 aa, Mycobacterium avium
TSIAQPLTSLSLQCKLPISIPQALGMVQQA

SEQ ID NO: 147565 - protein, 18 aa, Mycobacterium avium
TTLVMWIGCHADSHEYAR

SEQ ID NO: 147566 - protein, 28 aa, Mycobacterium avium
TTNPKVTGSWFWVDGQNAHWRPEHYYAP

SEQ ID NO: 147567 - protein, 20 aa, Mycobacterium avium
TTVAYDKLLLATGSAARRPP

SEQ ID NO: 147568 - protein, 24 aa, Mycobacterium avium
TTVLLAQMFAAGVRRLVLASSMVV

SEQ ID NO: 147569 - protein, 25 aa, Mycobacterium avium
TVALVWLLIGVFAAWQRDYFKNDQT

SEQ ID NO: 147570 - protein, 20 aa, Mycobacterium avium
TVFQRTPPWMVPKDDRPYSA

SEQ ID NO: 147571 - protein, 28 aa, Mycobacterium avium
TVKNPDPLLLLFDPLPNTGIVVIQGSPR

SEQ ID NO: 147572 - protein, 23 aa, Mycobacterium avium
TYNEWSFAQAQKLNMAKIITSAG

SEQ ID NO: 147573 - protein, 18 aa, Mycobacterium avium
VAAGYLLAVAFVGLSAVA

SEQ ID NO: 147574 - protein, 17 aa, Mycobacterium avium
VAAVVVAATFFTTTGHG

SEQ ID NO: 147575 - protein, 19 aa, Mycobacterium avium
VASPCAYFLVYESTAGNKA

SEQ ID NO: 147576 - protein, 25 aa, Mycobacterium avium
VATMAGWRTDFLNQMGLVIADSIKP

SEQ ID NO: 147577 - protein, 21 aa, Mycobacterium avium
VAVATRFPGPITDLQLSRDST

SEQ ID NO: 147578 - protein, 25 aa, Mycobacterium avium
VAVSGFPNFFMLYGPNTNQGGNSIV

SEQ ID NO: 147579 - protein, 26 aa, Mycobacterium avium
VCLVSLTHPAPPPATAYGQWQGGWVD

SEQ ID NO: 147580 - protein, 17 aa, Mycobacterium avium
VCSAGKYARKHVPWANF

SEQ ID NO: 147581 - protein, 17 aa, Mycobacterium avium
VDCGLAGTVLRFVPPLA

SEQ ID NO: 147582 - protein, 29 aa, Mycobacterium avium
VDHYAEIGLLGFALITDALGGVDVCLKEP

SEQ ID NO: 147583 - protein, 31 aa, Mycobacterium avium; identical to SEQ ID NO: 133248

SEQ ID NO: 147584 - protein, 23 aa, Mycobacterium avium
VGGRSFDVYPVNYPASDQWDTGI

SEQ ID NO: 147585 - protein, 20 aa, Mycobacterium avium
VGHRAVTLVFTLAGGAEPCT

SEQ ID NO: 147586 - protein, 25 aa, Mycobacterium avium
VGSIKAIQLKNWIATLTLGINKNVK

SEQ ID NO: 147587 - protein, 35 aa, Mycobacterium avium; identical to SEQ ID NO: 133350

SEQ ID NO: 147588 - protein, 27 aa, Mycobacterium avium
VIKVMTILGSRYLELVPDGPGSLPANT

SEQ ID NO: 147589 - protein, 17 aa, Mycobacterium avium
VKGGVPFLPLNRDPRLA

SEQ ID NO: 147590 - protein, 18 aa, Mycobacterium avium
VLAVGCGGGHKGGPSTTS

SEQ ID NO: 147591 - protein, 34 aa, Mycobacterium avium
VLHRPKLGFPVPIRHWLRAGELLEWAYSMVASSQ

SEQ ID NO: 147592 - protein, 18 aa, Mycobacterium avium
VLSGLGLQWHGPAADAMA

SEQ ID NO: 147593 - protein, 19 aa, Mycobacterium avium
VLSVLSAGALVLSGCGSDN

SEQ ID NO: 147594 - protein, 17 aa, Mycobacterium avium
VMDFVQQMQKLAGGNVA

SEQ ID NO: 147595 - protein, 25 aa, Mycobacterium avium
VNNAPLPWSTTISTTLPSVSANIMA

SEQ ID NO: 147596 - protein, 26 aa, Mycobacterium avium
VPGQLRVLPPFLSRKHLPSRLARLRE

SEQ ID NO: 147597 - protein, 21 aa, Mycobacterium avium
VPHYPAPGGVKLAAGWLVERA

SEQ ID NO: 147598 - protein, 26 aa, Mycobacterium avium
VPIAVLAWALFLPAGSAAADPPPTQV

SEQ ID NO: 147599 - protein, 24 aa, Mycobacterium avium
VPTADHVIELLRRARDSLAHHKSV

SEQ ID NO: 147600 - protein, 18 aa, Mycobacterium avium
VPWQPAYVFYRADGSSTF

SEQ ID NO: 147601 - protein, 18 aa, Mycobacterium avium
VQGHVLERLFPGIGKLDE

SEQ ID NO: 147602 - protein, 21 aa, Mycobacterium avium
VQRLVVLTIAGIEDPVFDEFP

SEQ ID NO: 147603 - protein, 25 aa, Mycobacterium avium
VRDMARWLMMLLDNGTHDGQHIASP

SEQ ID NO: 147604 - protein, 32 aa, Mycobacterium avium
VRLSRPHDWARDYWIPFDRFRRLDGVRTVQAT

SEQ ID NO: 147605 - protein, 20 aa, Mycobacterium avium
VRPLFGQHVVLTNPGVRQLF

SEQ ID NO: 147606 - protein, 23 aa, Mycobacterium avium
VSLGLLPVLVVVLAGCLGGGHAL

SEQ ID NO: 147607 - protein, 21 aa, Mycobacterium avium
VSLQEWCGYLGSLVGREPVFE

SEQ ID NO: 147608 - protein, 20 aa, Mycobacterium avium
VSTAGYFGIGTAAADGGPIG

SEQ ID NO: 147609 - protein, 21 aa, Mycobacterium avium
VTAVPPPAPSAAPPASPAPPP

SEQ ID NO: 147610 - protein, 29 aa, Mycobacterium avium
VTIRAIRVPNPYILATVFSFNGVTPNADA

SEQ ID NO: 147611 - protein, 17 aa, Mycobacterium avium
VTSLILPAAVSSPATAA

SEQ ID NO: 147612 - protein, 21 aa, Mycobacterium avium
VVAVTAAIAPLAACANQQSSQ

SEQ ID NO: 147613 - protein, 23 aa, Mycobacterium avium
VVSLAVNLPGPLAAARLAELGAA

SEQ ID NO: 147614 - protein, 17 aa, Mycobacterium avium
VYGYHDLAPTPAGANQL

SEQ ID NO: 147615 - protein, 29 aa, Mycobacterium avium
VYVGTGGVLLPVLIFTAARAGVAFTPINY

SEQ ID NO: 147616 - protein, 17 aa, Mycobacterium avium
WAADVDALLAERARVTG

SEQ ID NO: 147617 - protein, 29 aa, Mycobacterium avium
WAGNEPSFGVPWLYNYIGQPWKTQHTVDR

SEQ ID NO: 147618 - protein, 24 aa, Mycobacterium avium
WDMNVCHHWYWVPVGGMGNVGQFV

SEQ ID NO: 147619 - protein, 22 aa, Mycobacterium avium
WLPLLGAVVLLAAACSRVVDGA

SEQ ID NO: 147620 - protein, 17 aa, Mycobacterium avium
WNTMSSVTDLIRYYDML

SEQ ID NO: 147621 - protein, 20 aa, Mycobacterium avium
WPAALRRAGLDPSAPAVWLI

SEQ ID NO: 147622 - protein, 27 aa, Mycobacterium avium
WSAQDYTPIDHLPYVGPILPNSETIFV

SEQ ID NO: 147623 - protein, 18 aa, Mycobacterium avium
WSQYLSWVADHVGMTVVH

SEQ ID NO: 147624 - protein, 26 aa, Mycobacterium avium
WTGKKALLMHGALWQGTVVATMAGWR

SEQ ID NO: 147625 - protein, 17 aa, Mycobacterium avium
WVAGYKLVDFSGAIVRS

SEQ ID NO: 147626 - protein, 18 aa, Mycobacterium avium
WVGIGVAVLVVAGVTLAG

SEQ ID NO: 147627 - protein, 27 aa, Mycobacterium avium
YAMTVPPPVIAANRTLLASLVATNIMG

SEQ ID NO: 147628 - protein, 19 aa, Mycobacterium avium
YAQGLRDAGLLPVLKHFPG

SEQ ID NO: 147629 - protein, 19 aa, Mycobacterium avium
YCPQSRLEPILLAATRRGG

SEQ ID NO: 147630 - protein, 17 aa, Mycobacterium avium
YFGIGTAAADGGPIGGP

SEQ ID NO: 147631 - protein, 17 aa, Mycobacterium avium
YLAAINFIETRFGSIVG

SEQ ID NO: 147632 - protein, 22 aa, Mycobacterium avium
YLDARHIFDFADRFPTVTAACR

SEQ ID NO: 147633 - protein, 19 aa, Mycobacterium avium
YLVYNFGPGHPAPMLNAGG

SEQ ID NO: 147634 - protein, 17 aa, Mycobacterium avium
YPILGDPSTFGNASPIG

SEQ ID NO: 147635 - protein, 25 aa, Mycobacterium avium
YVAAHGPYLAWLTRASAHSAAAAAQ

SEQ ID NO: 147636 - protein, 20 aa, Mycobacterium avium
YVRVPYRARVPMTRAALMHR

SEQ ID NO: 147637 - protein, 19 aa, Mycobacterium avium
AAAAQLLERHPPKAALRRW

SEQ ID NO: 147638 - protein, 19 aa, Mycobacterium avium
AAAAQLLQRHPPKAALRRW

SEQ ID NO: 147639 - protein, 18 aa, Mycobacterium avium
AAAAQLLQRHPPKTALRR

SEQ ID NO: 147640 - protein, 27 aa, Mycobacterium avium
AAAGDLHLEWPLRPPPVVVRAFEAPAQ

SEQ ID NO: 147641 - protein, 35 aa, Mycobacterium avium
AAAMRVLTGPRWRLGARDLAALWQRARALGGAGAA

SEQ ID NO: 147642 - protein, 26 aa, Mycobacterium avium
AAARQPAFLAFPATMLVSTVAAALIG

SEQ ID NO: 147643 - protein, 23 aa, Mycobacterium avium
AAEDWLCLLEAFDQPHRPGVVRA

SEQ ID NO: 147644 - protein, 18 aa, Mycobacterium avium
AAFAMTVPPPAVAANRVQ

SEQ ID NO: 147645 - protein, 31 aa, Mycobacterium avium
AAFEAPLPQDPPPPPPPPPGAPGQLPTADQL

SEQ ID NO: 147646 - protein, 31 aa, Mycobacterium avium
AAFGAPLPQDPPPPPPLPPGAPGQLPTADQL

SEQ ID NO: 147647 - protein, 25 aa, Mycobacterium avium
AAGAITLWLGLVANVGQVLNGDAPS

SEQ ID NO: 147648 - protein, 26 aa, Mycobacterium avium
AAHCPAYFQLLVKSLLQPGLLELAQT

SEQ ID NO: 147649 - protein, 31 aa, Mycobacterium avium
AAIFTVPHFLGLDYWQMWHYGDSTMAGVYSA

SEQ ID NO: 147650 - protein, 18 aa, Mycobacterium avium
AAKLFGFPTVIAHGMFSA

SEQ ID NO: 147651 - protein, 18 aa, Mycobacterium avium
AALIATRLCDRLGLSRQQ

SEQ ID NO: 147652 - protein, 23 aa, Mycobacterium avium
AALLLALCWPIAPAAAPDPGAGT

SEQ ID NO: 147653 - protein, 23 aa, Mycobacterium avium
AALPKPQRYPRFGPWGQLDRWRR

SEQ ID NO: 147654 - protein, 26 aa, Mycobacterium avium
AALTMPTRGWWFPANSRRPGDHVHSK

SEQ ID NO: 147655 - protein, 17 aa, Mycobacterium avium
AALVLMAGTLTGPAIAR

SEQ ID NO: 147656 - protein, 22 aa, Mycobacterium avium
AANIAPALAAPALRGATAGLGG

SEQ ID NO: 147657 - protein, 23 aa, Mycobacterium avium
AANSWNLRTIGDLAPHSADIRFG

SEQ ID NO: 147658 - protein, 23 aa, Mycobacterium avium
AAPADYSNLLIKPGDVGPNATAD

SEQ ID NO: 147659 - protein, 24 aa, Mycobacterium avium
AAPADYSNLLIKPGDVGPNVTADG

SEQ ID NO: 147660 - protein, 17 aa, Mycobacterium avium
AAPDWYAHLVEHQDVLT

SEQ ID NO: 147661 - protein, 21 aa, Mycobacterium avium
AAQALMPRLAGSAVIPVMTAE

SEQ ID NO: 147662 - protein, 18 aa, Mycobacterium avium
AAQPPPAPAPPPEPHRSG

SEQ ID NO: 147663 - protein, 18 aa, Mycobacterium avium
AARLAFLVSGGTGAGKTT

SEQ ID NO: 147664 - protein, 18 aa, Mycobacterium avium
AARPEYVHLWAGSGYRHA

SEQ ID NO: 147665 - protein, 17 aa, Mycobacterium avium
AARRHMFTYGTTIEQLA

SEQ ID NO: 147666 - protein, 24 aa, Mycobacterium avium
AARRLRHRLPSRPEPHALLGNAFH

SEQ ID NO: 147667 - protein, 27 aa, Mycobacterium avium
AASPTVWLNPWRWYAAPRAVADALTVD

SEQ ID NO: 147668 - protein, 22 aa, Mycobacterium avium
AASRYHTRSRFLPAGVAPERGL

SEQ ID NO: 147669 - protein, 23 aa, Mycobacterium avium
AATLLGLLRPHVALDGARVVLAR

SEQ ID NO: 147670 - protein, 19 aa, Mycobacterium avium
AATLPYGLSPLVVPQLKTI

SEQ ID NO: 147671 - protein, 24 aa, Mycobacterium avium
AATVPPPVIAANRSLLMTLIATNI

SEQ ID NO: 147672 - protein, 23 aa, Mycobacterium avium
AAYAVMMALYHRDVHGGPGQLID

SEQ ID NO: 147673 - protein, 19 aa, Mycobacterium avium
ACHPGQRGLFLLVEAARQL

SEQ ID NO: 147674 - protein, 17 aa, Mycobacterium avium
ACRALLDALPQRLGDYQ

SEQ ID NO: 147675 - protein, 25 aa, Mycobacterium avium
ADDARFVTFVRGAMYWSPQTGAQPV

SEQ ID NO: 147676 - protein, 27 aa, Mycobacterium avium
ADDGYPEHVFTWAVVGLINASLNQMGV

SEQ ID NO: 147677 - protein, 18 aa, Mycobacterium avium
ADFYTPPDPLPPGRPGDL

SEQ ID NO: 147678 - protein, 22 aa, Mycobacterium avium
ADGRATALRRAGRPVGTRQLGG

SEQ ID NO: 147679 - protein, 17 aa, Mycobacterium avium
ADGWATTTFGLADLFAA

SEQ ID NO: 147680 - protein, 22 aa, Mycobacterium avium
ADGWATTTFGLADLFAAAGLPE

SEQ ID NO: 147681 - protein, 18 aa, Mycobacterium avium
ADIGLPEVFNDPDLASFN

SEQ ID NO: 147682 - protein, 40 aa, Mycobacterium avium
ADLAAPGPPGTWGKGGPPPLLWAVIQALVSEVWPDGDVAG

SEQ ID NO: 147683 - protein, 21 aa, Mycobacterium avium
ADLARALDLLDRRQVSALVVN

SEQ ID NO: 147684 - protein, 24 aa, Mycobacterium avium
ADLFVIGAAYRRYAIKHRHMYRLM

SEQ ID NO: 147685 - protein, 17 aa, Mycobacterium avium
ADLQPLAGGGLGALGVA

SEQ ID NO: 147686 - protein, 20 aa, Mycobacterium avium
ADNAKWFYDFSVPGDVVEVR

SEQ ID NO: 147687 - protein, 23 aa, Mycobacterium avium
ADNGRVHWPPRPEPARGEDAGTL

SEQ ID NO: 147688 - protein, 20 aa, Mycobacterium avium
ADPATFAAYYRWDVYCFTTA

SEQ ID NO: 147689 - protein, 25 aa, Mycobacterium avium
ADPSRAARLLGFRAAVQPGDGLREF

SEQ ID NO: 147690 - protein, 23 aa, Mycobacterium avium
ADRFGIQDAIWRGVYYTPNGAQT

SEQ ID NO: 147691 - protein, 30 aa, Mycobacterium avium
ADRQVPIGRKLLYSAPVPALLELSGAVRML

SEQ ID NO: 147692 - protein, 31 aa, Mycobacterium avium
ADRQVPIGRKLLYSAPVPALLELSGAVRMLV

SEQ ID NO: 147693 - protein, 23 aa, Mycobacterium avium
ADSLWFAPLFSQDALDLLELGLG

SEQ ID NO: 147694 - protein, 24 aa, Mycobacterium avium
ADTTWKLLLDSQSGIRKLEDSFVE

SEQ ID NO: 147695 - protein, 24 aa, Mycobacterium avium
ADTVAYLINVTVRPGYNFANADHA

SEQ ID NO: 147696 - protein, 18 aa, Mycobacterium avium
AEEAIVPRGLMSHMVYAD

SEQ ID NO: 147697 - protein, 22 aa, Mycobacterium avium
AELAKLFDKRLAKTTPQRAAQI

SEQ ID NO: 147698 - protein, 26 aa, Mycobacterium avium
AELARRLIPGYVVTPAIKLLSDELVR

SEQ ID NO: 147699 - protein, 23 aa, Mycobacterium avium
AELGVTRLRRYGRYLLRDGVLHP

SEQ ID NO: 147700 - protein, 24 aa, Mycobacterium avium
AELGVTRLRRYGRYLLRDGVLHPM

SEQ ID NO: 147701 - protein, 34 aa, Mycobacterium avium
AFDEKIALLLDDPVPLVSFTFGIPPREVIAALRR

SEQ ID NO: 147702 - protein, 24 aa, Mycobacterium avium
AFKDSDAWFLIRAVTEPDATTLPR

SEQ ID NO: 147703 - protein, 17 aa, Mycobacterium avium
AFTVVPAFTGRVLQSLQ

SEQ ID NO: 147704 - protein, 19 aa, Mycobacterium avium
AFWVKDGQNYLPFGTAAGA

SEQ ID NO: 147705 - protein, 29 aa, Mycobacterium avium
AFWVKDGQNYLPFGTAAGAGRYLAAHPGG

SEQ ID NO: 147706 - protein, 20 aa, Mycobacterium avium
AGAALFLAGCGWSTPTATTV

SEQ ID NO: 147707 - protein, 24 aa, Mycobacterium avium
AGAAPPPALPAPPPSPGIGVDHEN

SEQ ID NO: 147708 - protein, 22 aa, Mycobacterium avium
AGAIPFLHFPQDDPVVAIEFYR

SEQ ID NO: 147709 - protein, 25 aa, Mycobacterium avium
AGAPPTLPPFMLADGVTSLNAAYAV

SEQ ID NO: 147710 - protein, 25 aa, Mycobacterium avium
AGASEIPLDFRILDTILGAQTTFRS

SEQ ID NO: 147711 - protein, 19 aa, Mycobacterium avium
AGGKVQWVLGNLGAIPTVK

SEQ ID NO: 147712 - protein, 19 aa, Mycobacterium avium
AGGLTLRRIGLSDRLCELD

SEQ ID NO: 147713 - protein, 25 aa, Mycobacterium avium
AGHDFTYRFSVPNPGTYWAHPHTGL

SEQ ID NO: 147714 - protein, 30 aa, Mycobacterium avium
AGHGPAAHRVWLPPLGRPPELCTLLGGAAD

SEQ ID NO: 147715 - protein, 20 aa, Mycobacterium avium
AGHSIRFLVRNPGKLHTSVA

SEQ ID NO: 147716 - protein, 33 aa, Mycobacterium avium
AGIGNMLTGLLLGIPTVIYPLGAFEPGQLLDVL

SEQ ID NO: 147717 - protein, 20 aa, Mycobacterium avium
AGIYIGDGMMIHSSTYGVPV

SEQ ID NO: 147718 - protein, 17 aa, Mycobacterium avium
AGNVVVYHWGSPKVVNA

SEQ ID NO: 147719 - protein, 39 aa, Mycobacterium avium; identical to SEQ ID NO: 118948

SEQ ID NO: 147720 - protein, 24 aa, Mycobacterium avium
AGPPPAAPAPPPPPIAVAEYDPSS

SEQ ID NO: 147721 - protein, 21 aa, Mycobacterium avium
AGPPPPFGAPPPFAPPPSGPP

SEQ ID NO: 147722 - protein, 17 aa, Mycobacterium avium
AGRDALIRGIHRGVADW

SEQ ID NO: 147723 - protein, 22 aa, Mycobacterium avium
AGRFTIVAIATYCPAVIAPLLG

SEQ ID NO: 147724 - protein, 24 aa, Mycobacterium avium
AGSWNTPWSALAPARQAAVIVAAR

SEQ ID NO: 147725 - protein, 17 aa, Mycobacterium avium
AGYALANAKRWGINHVI

SEQ ID NO: 147726 - protein, 18 aa, Mycobacterium avium
AHPKAVPAVIQALGDLLS

SEQ ID NO: 147727 - protein, 18 aa, Mycobacterium avium
AHSKLLPALDIRAQAVSA

SEQ ID NO: 147728 - protein, 40 aa, Mycobacterium avium
AIAAAHPDLILGSQGLTPALYPQLAAIAPTVFTAAPGAAW

SEQ ID NO: 147729 - protein, 41 aa, Mycobacterium avium; identical to SEQ ID NO: 123992

SEQ ID NO: 147730 - protein, 20 aa, Mycobacterium avium
AIALHRALPSALGTLELPTD

SEQ ID NO: 147731 - protein, 30 aa, Mycobacterium avium; identical to SEQ ID NO: 124004

SEQ ID NO: 147732 - protein, 25 aa, Mycobacterium avium
AIGEAFILAEKLGLSAQSLFDVITG

SEQ ID NO: 147733 - protein, 24 aa, Mycobacterium avium
AIHLLTRIVGLRKATELLMLGEPV

SEQ ID NO: 147734 - protein, 17 aa, Mycobacterium avium
AILVVGALALTLIYGQF

SEQ ID NO: 147735 - protein, 17 aa, Mycobacterium avium
AINDTFTKAYAAASENW

SEQ ID NO: 147736 - protein, 19 aa, Mycobacterium avium
AIPGGFVRDVVERVAPSIL

SEQ ID NO: 147737 - protein, 20 aa, Mycobacterium avium
AIPLERVTMPYNLMRALTDA

SEQ ID NO: 147738 - protein, 17 aa, Mycobacterium avium
AISQQLFSFGNPGVVQE

SEQ ID NO: 147739 - protein, 17 aa, Mycobacterium avium
AITPDELILYMPDYPVG

SEQ ID NO: 147740 - protein, 20 aa, Mycobacterium avium
AIVQIAARRPATGNWQIVVI

SEQ ID NO: 147741 - protein, 19 aa, Mycobacterium avium
AKPIAVPPAPAPPTPHPAP

SEQ ID NO: 147742 - protein, 26 aa, Mycobacterium avium
ALAGLSGWLGYRAYQQHDAQARRNLF

SEQ ID NO: 147743 - protein, 17 aa, Mycobacterium avium
ALDMWMQSPPHRAIILN

SEQ ID NO: 147744 - protein, 25 aa, Mycobacterium avium
ALDPSRLQLIPANVLVNIVATTAFG

SEQ ID NO: 147745 - protein, 24 aa, Mycobacterium avium
ALERDPVELPSLRNLAYGGSKVGL

SEQ ID NO: 147746 - protein, 18 aa, Mycobacterium avium
ALGAYRRLKTALAEGLGI

SEQ ID NO: 147747 - protein, 19 aa, Mycobacterium avium
ALGPLAVPASWTSVIPAAH

SEQ ID NO: 147748 - protein, 17 aa, Mycobacterium avium
ALICHRIGDVYNALASG

SEQ ID NO: 147749 - protein, 28 aa, Mycobacterium avium
ALIKVMTILGSRYLELVPDGPGSLPANT

SEQ ID NO: 147750 - protein, 21 aa, Mycobacterium avium
ALIYGQFRGNFTPKTSLTMLA

SEQ ID NO: 147751 - protein, 18 aa, Mycobacterium avium
ALQGFTKLLGTPGQDGVF

SEQ ID NO: 147752 - protein, 30 aa, Mycobacterium avium
ALTCSLKGMFPLALQPPTPVPGLEVLGGIT

SEQ ID NO: 147753 - protein, 20 aa, Mycobacterium avium
ALTFAYHRLGRADVGVARIF

SEQ ID NO: 147754 - protein, 19 aa, Mycobacterium avium
ALVDGLLAILAVGGSLVQV

SEQ ID NO: 147755 - protein, 28 aa, Mycobacterium avium
ALVIEGAFTLPFMAVYYGYPTLSLTQIC

SEQ ID NO: 147756 - protein, 17 aa, Mycobacterium avium
ALVLHYLPEFDMRTGEI

SEQ ID NO: 147757 - protein, 19 aa, Mycobacterium avium
ALVLHYLPEFDMRTGEILG

SEQ ID NO: 147758 - protein, 22 aa, Mycobacterium avium
AMRKLWTAAAALLLVGACGAPT

SEQ ID NO: 147759 - protein, 29 aa, Mycobacterium avium
AMSPAALTALLPGLLDLLSGRMPPPDASQ

SEQ ID NO: 147760 - protein, 23 aa, Mycobacterium avium
ANGTPVRKLWVSAGPPPCVVGDM

SEQ ID NO: 147761 - protein, 36 aa, Mycobacterium avium
ANHYNAHQFNFFNIAYRPPMYRVQTKNGLALCGFMN

SEQ ID NO: 147762 - protein, 24 aa, Mycobacterium avium
ANRVQLATLIATNFFGQNAAAIAA

SEQ ID NO: 147763 - protein, 38 aa, Mycobacterium avium
APAPPTPHPAPWRWPAPPPWPCWSRWPARSPPSRHADE

SEQ ID NO: 147764 - protein, 17 aa, Mycobacterium avium
APFNVNFRYVKSELHYL

SEQ ID NO: 147765 - protein, 20 aa, Mycobacterium avium
APLVPLAQTAPAAPAGLPAQ

SEQ ID NO: 147766 - protein, 31 aa, Mycobacterium avium
APRARPPPVPRSRPPLPPLPPRRPSRPRPRP

SEQ ID NO: 147767 - protein, 32 aa, Mycobacterium avium
APRTPPYKLAGLAILVVGALALALIYGQFRGN

SEQ ID NO: 147768 - protein, 27 aa, Mycobacterium avium
APRTPPYKLAGLAILVVGALALTLIYG

SEQ ID NO: 147769 - protein, 25 aa, Mycobacterium avium
APSDGIEQLIFAPQGPLSAPKARRA

SEQ ID NO: 147770 - protein, 22 aa, Mycobacterium avium
AQAFASLAILYPGRVFLGVGTG

SEQ ID NO: 147771 - protein, 17 aa, Mycobacterium avium
AQALWPGLPVRPVKGEV

SEQ ID NO: 147772 - protein, 19 aa, Mycobacterium avium
AQFAALASNAYCPHHLAPK

SEQ ID NO: 147773 - protein, 24 aa, Mycobacterium avium
AQPVYFRYWAARGVDVTPFFAVLN

SEQ ID NO: 147774 - protein, 27 aa, Mycobacterium avium
AQSPKESWLRVLLIDAGFPRPQTQIPV

SEQ ID NO: 147775 - protein, 17 aa, Mycobacterium avium
AQVVAWWSPAYHEPNGG

SEQ ID NO: 147776 - protein, 21 aa, Mycobacterium avium
ARAFEQEIRLLMQAADREIVT

SEQ ID NO: 147777 - protein, 22 aa, Mycobacterium avium
ARGGRRLVIAMMYGLIKEGGPS

SEQ ID NO: 147778 - protein, 25 aa, Mycobacterium avium
ARIADLLRRAAPNAALVAIVVSWLS

SEQ ID NO: 147779 - protein, 23 aa, Mycobacterium avium
ARIKLDCLTAGAWPAYWLGNDDQ

SEQ ID NO: 147780 - protein, 23 aa, Mycobacterium avium
ARIREHSVWWPVAATPEDMAAAM

SEQ ID NO: 147781 - protein, 25 aa, Mycobacterium avium
ARLQDLGFYTGLVDGYFGLQTHNAL

SEQ ID NO: 147782 - protein, 17 aa, Mycobacterium avium
ARPRLHPVDIPAGQHQH

SEQ ID NO: 147783 - protein, 26 aa, Mycobacterium avium
ARPRSLVVAGLLPLAGLLGVITTPAH

SEQ ID NO: 147784 - protein, 26 aa, Mycobacterium avium
ARPRSLVVAGLLPLAGLLGVITTPAY

SEQ ID NO: 147785 - protein, 29 aa, Mycobacterium avium
ARSCVPPDFLFMHTGLALATGWALAAGGQ

SEQ ID NO: 147786 - protein, 18 aa, Mycobacterium avium
ARSGAPWRFGTDDPGGLC

SEQ ID NO: 147787 - protein, 28 aa, Mycobacterium avium
ASAAPSGLALDRFADRPLAPIDPSAMVG

SEQ ID NO: 147788 - protein, 29 aa, Mycobacterium avium
ASAAPSGLALDRFADRPLAPIDPSAMVGQ

SEQ ID NO: 147789 - protein, 35 aa, Mycobacterium avium; identical to SEQ ID NO: 23410

SEQ ID NO: 147790 - protein, 23 aa, Mycobacterium avium
ASGAPIPPAYFGSLSDLIACEAE

SEQ ID NO: 147791 - protein, 18 aa, Mycobacterium avium
ASHMRFWFGAVYGRACRL

SEQ ID NO: 147792 - protein, 28 aa, Mycobacterium avium
ASIIEAIYPITAALRPFFAAVTGAYSPI

SEQ ID NO: 147793 - protein, 28 aa, Mycobacterium avium
ASLQGKPAVLWFWTPWCPYCNAEAPGVS

SEQ ID NO: 147794 - protein, 26 aa, Mycobacterium avium
ASPKETWLRLLLIDAGIPVPATQIPV

SEQ ID NO: 147795 - protein, 18 aa, Mycobacterium avium
ASTPWRQDPYRDTQGGSS

SEQ ID NO: 147796 - protein, 18 aa, Mycobacterium avium
ASVLIAVAALGTGCSLES

SEQ ID NO: 147797 - protein, 19 aa, Mycobacterium avium
ASYLRDYGPLLDRIGKTNG

SEQ ID NO: 147798 - protein, 24 aa, Mycobacterium avium
ATAALAAAGLLAAAPAFADPQVLQ

SEQ ID NO: 147799 - protein, 26 aa, Mycobacterium avium
ATETEQTFLLRLLGGELRQGALAGIM

SEQ ID NO: 147800 - protein, 26 aa, Mycobacterium avium
ATETPTPLPLPTPIPARGGTPPKQPR

SEQ ID NO: 147801 - protein, 28 aa, Mycobacterium avium
ATGKTLPDFPRLWARMLDTSLPDGEEHG

SEQ ID NO: 147802 - protein, 17 aa, Mycobacterium avium
ATLLWSQSARSRGPWPW

SEQ ID NO: 147803 - protein, 24 aa, Mycobacterium avium
ATLRRAALVVPRYGVRITVMARPP

SEQ ID NO: 147804 - protein, 22 aa, Mycobacterium avium
ATSGRPVGLRPAGALGAEALRP

SEQ ID NO: 147805 - protein, 24 aa, Mycobacterium avium
ATTTYGGMDLLFNVGADMSTIRAD

SEQ ID NO: 147806 - protein, 17 aa, Mycobacterium avium
ATVLLFDVATASADVGG

SEQ ID NO: 147807 - protein, 30 aa, Mycobacterium avium
AVAGRRVVLNFWAYWCAPCAAELPAMAEYQ

SEQ ID NO: 147808 - protein, 19 aa, Mycobacterium avium
AVAGVTYHLADGRAALCDH

SEQ ID NO: 147809 - protein, 24 aa, Mycobacterium avium
AVAKLPPWNEVLQNLGFSNASTAV

SEQ ID NO: 147810 - protein, 35 aa, Mycobacterium avium
AVAVAAVVVLGWYYLRIPSLAGIGRYTLYVELPQS

SEQ ID NO: 147811 - protein, 18 aa, Mycobacterium avium
AVEWTPCRAANPKVKLPA

SEQ ID NO: 147812 - protein, 22 aa, Mycobacterium avium
AVFAICTAFMTASGAFGGFAAR

SEQ ID NO: 147813 - protein, 19 aa, Mycobacterium avium
AVFASLTLATALIAGCSSG

SEQ ID NO: 147814 - protein, 18 aa, Mycobacterium avium
AVFEPIRSARLRANGNQL

SEQ ID NO: 147815 - protein, 30 aa, Mycobacterium avium
AVGAPLPQDPPPPPPPPPGAPGQLPTADQL

SEQ ID NO: 147816 - protein, 22 aa, Mycobacterium avium
AVLAVVGVWAYRTANRLDRLHV

SEQ ID NO: 147817 - protein, 23 aa, Mycobacterium avium
AVLAVVGVWAYRTANRLDRLHVR

SEQ ID NO: 147818 - protein, 19 aa, Mycobacterium avium
AVLGLHDLMNGGHPGQYGT

SEQ ID NO: 147819 - protein, 17 aa, Mycobacterium avium
AVLKTGAAYLPIDPAHP

SEQ ID NO: 147820 - protein, 21 aa, Mycobacterium avium
AVNGKTWAIKGTATGVDMSNP

SEQ ID NO: 147821 - protein, 21 aa, Mycobacterium avium
AVNVQGVLYATRAALPHLVDA

SEQ ID NO: 147822 - protein, 19 aa, Mycobacterium avium
AVNVYPIGVLKQAPLATQA

SEQ ID NO: 147823 - protein, 22 aa, Mycobacterium avium
AVPSWINVFANHYNAHQFNFFN

SEQ ID NO: 147824 - protein, 25 aa, Mycobacterium avium
AVRPEPFGALLYHFGTRKLSFLKNR

SEQ ID NO: 147825 - protein, 31 aa, Mycobacterium avium
AVTDSMPALHLLPLAGVLGVLPVLATDVLRG

SEQ ID NO: 147826 - protein, 37 aa, Mycobacterium avium; identical to SEQ ID NO: 119281

SEQ ID NO: 147827 - protein, 18 aa, Mycobacterium avium
AVTSAQPVYFGYWAARGV

SEQ ID NO: 147828 - protein, 19 aa, Mycobacterium avium
AVTSAQPVYFRYWAARGVD

SEQ ID NO: 147829 - protein, 18 aa, Mycobacterium avium
AVTSAQPVYFRYWASRGV

SEQ ID NO: 147830 - protein, 19 aa, Mycobacterium avium
AWRSMLPCNWLGMQVPAGT

SEQ ID NO: 147831 - protein, 28 aa, Mycobacterium avium
AYAMTVPPPVIAANRTLLASLVATNIMG

SEQ ID NO: 147832 - protein, 19 aa, Mycobacterium avium
AYAWDMGAYAWPGPERRRF

SEQ ID NO: 147833 - protein, 22 aa, Mycobacterium avium
AYGLDILLQPRASQAMPAAGTG

SEQ ID NO: 147834 - protein, 24 aa, Mycobacterium avium
AYVDKVVFRVIGEPGLRAGAVQSH

SEQ ID NO: 147835 - protein, 19 aa, Mycobacterium avium
CADVFMPIARRQGIEFDLA

SEQ ID NO: 147836 - protein, 26 aa, Mycobacterium avium
CAELGVPHLVLARPAWDPGAATVVDS

SEQ ID NO: 147837 - protein, 23 aa, Mycobacterium avium
CAIGWAVGRGHRFSVRPSPRQCP

SEQ ID NO: 147838 - protein, 22 aa, Mycobacterium avium
CATAVGLGWRSTRFPGVGYLSQ

SEQ ID NO: 147839 - protein, 22 aa, Mycobacterium avium
CFDLMFFDDRLAMPGVYGGSVG

SEQ ID NO: 147840 - protein, 23 aa, Mycobacterium avium
CFDLMFFDDRLAMPGVYGGSVGE

SEQ ID NO: 147841 - protein, 27 aa, Mycobacterium avium
CGCGGLIRPDIVWFGEQLPDEPWRRAV

SEQ ID NO: 147842 - protein, 17 aa, Mycobacterium avium
CHTWYVVPDGWGNVPRI

SEQ ID NO: 147843 - protein, 19 aa, Mycobacterium avium
CNPSRPVSVWAAHGTADPL

SEQ ID NO: 147844 - protein, 23 aa, Mycobacterium avium
CRAVLFVGVAAAGAVALPVAAAH

SEQ ID NO: 147845 - protein, 25 aa, Mycobacterium avium
CVGQTLLDFMFRHIQPYFTEDINQL

SEQ ID NO: 147846 - protein, 17 aa, Mycobacterium avium
CVVGDMPELPTTHDGLL

SEQ ID NO: 147847 - protein, 22 aa, Mycobacterium avium
CWQKITRDLWPAPELIMDTGNS

SEQ ID NO: 147848 - protein, 22 aa, Mycobacterium avium
CWQPITHDLWPAPELVIDSGNS

SEQ ID NO: 147849 - protein, 22 aa, Mycobacterium avium
CWQPITHDLWPAPELVMDTGNS

SEQ ID NO: 147850 - protein, 23 aa, Mycobacterium avium
DAALICVPPYHIAGVNAAISNLY

SEQ ID NO: 147851 - protein, 26 aa, Mycobacterium avium
DAERYPKAMYPRMFDRVIARRDAFER

SEQ ID NO: 147852 - protein, 24 aa, Mycobacterium avium
DAGHSIRFLVRNPGKLHTSVAKLG

SEQ ID NO: 147853 - protein, 24 aa, Mycobacterium avium
DAGHSIRFLVRNPGKLQTSVAKLG

SEQ ID NO: 147854 - protein, 17 aa, Mycobacterium avium
DAGLLPVLKHFPGHGHG

SEQ ID NO: 147855 - protein, 22 aa, Mycobacterium avium
DAGLPAPGVWALCHSLAFDVSV

SEQ ID NO: 147856 - protein, 39 aa, Mycobacterium avium
DAGPALTRSLGFLGTFPFPAETLSKWIRGDYANLTAVID

SEQ ID NO: 147857 - protein, 19 aa, Mycobacterium avium
DALVRRIRAIPPFREKLAD

SEQ ID NO: 147858 - protein, 26 aa, Mycobacterium avium
DAPGTPAYITLGKIREAWNVPRGADG

SEQ ID NO: 147859 - protein, 30 aa, Mycobacterium avium
DAQRILFHDMPVVPLWNYISVVGWSAEVSH

SEQ ID NO: 147860 - protein, 17 aa, Mycobacterium avium
DCRRFAVSGRRGRHWLA

SEQ ID NO: 147861 - protein, 31 aa, Mycobacterium avium
DDDPADLAGRLWDLLGWARAGHRLLDEMAAA

SEQ ID NO: 147862 - protein, 25 aa, Mycobacterium avium
DDDYLAILDIRPFTRGHTLVLPKRH

SEQ ID NO: 147863 - protein, 25 aa, Mycobacterium avium
DDGLRPVPVGVVGELYYAGDQLARG

SEQ ID NO: 147864 - protein, 24 aa, Mycobacterium avium
DDLRREPRWPCYAPAAVQLGVLSS

SEQ ID NO: 147865 - protein, 24 aa, Mycobacterium avium
DEARALFDQLQPTLPIVLANLVSV

SEQ ID NO: 147866 - protein, 26 aa, Mycobacterium avium
DEVKTQLMRLATDLGPKSGVSGTSVG

SEQ ID NO: 147867 - protein, 36 aa, Mycobacterium avium
DFAELLVEALTGTAPPPGAPFRALRRVRAVLDAAGC

SEQ ID NO: 147868 - protein, 26 aa, Mycobacterium avium
DFNLNLNLPPPCTTGYLPPAQRRSPA

SEQ ID NO: 147869 - protein, 18 aa, Mycobacterium avium
DFSAALQGFTKLLGTPGQ

SEQ ID NO: 147870 - protein, 25 aa, Mycobacterium avium
DGHPSGVFDWRPPSSLIAALSDLLD

SEQ ID NO: 147871 - protein, 18 aa, Mycobacterium avium
DGLKQFLYGPLDGPPRNT

SEQ ID NO: 147872 - protein, 17 aa, Mycobacterium avium
DGLPVALAARLLAAGHR

SEQ ID NO: 147873 - protein, 29 aa, Mycobacterium avium
DGQDPRYILWAAWHQSGLQRRWLSVSERG

SEQ ID NO: 147874 - protein, 17 aa, Mycobacterium avium
DGRRLLTATLAEPGTLL

SEQ ID NO: 147875 - protein, 19 aa, Mycobacterium avium
DGVTGFPPGLWARQTSEIR

SEQ ID NO: 147876 - protein, 23 aa, Mycobacterium avium
DHDGGVEAVVLLSGYRVMPQWVK

SEQ ID NO: 147877 - protein, 24 aa, Mycobacterium avium
DINTPAFEWYYQSGLSVIMPVGGQ

SEQ ID NO: 147878 - protein, 18 aa, Mycobacterium avium
DLAPLLRAHLPADDVLAC

SEQ ID NO: 147879 - protein, 18 aa, Mycobacterium avium
DLFSTVKNLSILVSALHD

SEQ ID NO: 147880 - protein, 38 aa, Mycobacterium avium
DLHWDRILFCAKEATYKAWFPLTRRWLGFEDARITFEA

SEQ ID NO: 147881 - protein, 23 aa, Mycobacterium avium
DLLKGLVMPAITQGMHGGAAAGA

SEQ ID NO: 147882 - protein, 24 aa, Mycobacterium avium
DLLKGLVMPAITQGMHGGAAAGAL

SEQ ID NO: 147883 - protein, 17 aa, Mycobacterium avium
DLPPGYRTGFHATVPMI

SEQ ID NO: 147884 - protein, 18 aa, Mycobacterium avium
DMFVVRTAGQAIDTAVLG

SEQ ID NO: 147885 - protein, 22 aa, Mycobacterium avium
DMNVCHHWYWVPVGGMGNVGQF

SEQ ID NO: 147886 - protein, 22 aa, Mycobacterium avium
DMRDPLTIAFHKAKLRADFLRP

SEQ ID NO: 147887 - protein, 18 aa, Mycobacterium avium
DNAKWFYDFSVPGDVVEV

SEQ ID NO: 147888 - protein, 19 aa, Mycobacterium avium
DNAKWFYDFSVPGDVVEVR

SEQ ID NO: 147889 - protein, 18 aa, Mycobacterium avium
DNLLKELPDIYQVLARQG

SEQ ID NO: 147890 - protein, 23 aa, Mycobacterium avium
DPADVAALVAFLLSAEGDWINGQ

SEQ ID NO: 147891 - protein, 18 aa, Mycobacterium avium
DPATFAAYYRWDVYCFTT

SEQ ID NO: 147892 - protein, 24 aa, Mycobacterium avium
DPHGPVAFWGYSQGGGATASAAEL

SEQ ID NO: 147893 - protein, 21 aa, Mycobacterium avium
DPKLLAGRKLPDGLTFDPAQC

SEQ ID NO: 147894 - protein, 22 aa, Mycobacterium avium
DPLRAVNIGAVLPPLAVGAKCT

SEQ ID NO: 147895 - protein, 17 aa, Mycobacterium avium
DPLVIVDSRYRDMVGDV

SEQ ID NO: 147896 - protein, 19 aa, Mycobacterium avium
DPREAVVLVFVNQTTIIGK

SEQ ID NO: 147897 - protein, 17 aa, Mycobacterium avium
DQLGLVPERSGNRWDIS

SEQ ID NO: 147898 - protein, 37 aa, Mycobacterium avium
DQQGARWQLGYLLRIEGTVDPWLLEHTIRQVVREAEP

SEQ ID NO: 147899 - protein, 20 aa, Mycobacterium avium
DQYGYRKLATAPIAGAPAEV

SEQ ID NO: 147900 - protein, 22 aa, Mycobacterium avium
DRADHAWDLARLGWALHGSPAT

SEQ ID NO: 147901 - protein, 19 aa, Mycobacterium avium
DRFIDAFAALLREATEIPS

SEQ ID NO: 147902 - protein, 21 aa, Mycobacterium avium
DRLHVRYDLSWQALDGALARR

SEQ ID NO: 147903 - protein, 29 aa, Mycobacterium avium
DRLVGWDTYRRLDLLPYLSADTQSLQLSS

SEQ ID NO: 147904 - protein, 17 aa, Mycobacterium avium
DRRGQLGALLKSTQRVV

SEQ ID NO: 147905 - protein, 19 aa, Mycobacterium avium
DRVHARVPSFLIPGRTEAD

SEQ ID NO: 147906 - protein, 19 aa, Mycobacterium avium
DRVLTELPPLIRHFADTRE

SEQ ID NO: 147907 - protein, 24 aa, Mycobacterium avium
DSRRAVVAPLLLASAYHARLDIPE

SEQ ID NO: 147908 - protein, 22 aa, Mycobacterium avium
DTARRYAVLSLPTTLIFDADGR

SEQ ID NO: 147909 - protein, 29 aa, Mycobacterium avium
DTNLALLPVGYADGIFRSLGGRLQVSING

SEQ ID NO: 147910 - protein, 23 aa, Mycobacterium avium
DTPYSGVAAIFRSALEKGEPPRV

SEQ ID NO: 147911 - protein, 17 aa, Mycobacterium avium
DVDTWLQTLAPPGGDGH

SEQ ID NO: 147912 - protein, 18 aa, Mycobacterium avium
DVLHLDQQLGLNPALKGL

SEQ ID NO: 147913 - protein, 25 aa, Mycobacterium avium
DVLHLDQQLGLNPALKGLAGLWNQR

SEQ ID NO: 147914 - protein, 22 aa, Mycobacterium avium
DVLHLDQQLGLNPALKGMAGLW

SEQ ID NO: 147915 - protein, 18 aa, Mycobacterium avium
DVQVVFARGTGEAPGVGP

SEQ ID NO: 147916 - protein, 31 aa, Mycobacterium avium; identical to SEQ ID NO: 119680

SEQ ID NO: 147917 - protein, 25 aa, Mycobacterium avium
DWPRHQLRLPAGHGLLLLTDGLYEG

SEQ ID NO: 147918 - protein, 19 aa, Mycobacterium avium
DYAAPSFAPGRPLIEVLRD

SEQ ID NO: 147919 - protein, 23 aa, Mycobacterium avium
DYDAEWIVVLDDWTDGVGKSPAQ

SEQ ID NO: 147920 - protein, 24 aa, Mycobacterium avium
EAAFYRLSSLRLWPDRRLSRRGVE

SEQ ID NO: 147921 - protein, 21 aa, Mycobacterium avium
EAALAPLFLAKKLDPERFSDL

SEQ ID NO: 147922 - protein, 26 aa, Mycobacterium avium
EAAQPPRHLLLGSDALRLIRAGRDAV

SEQ ID NO: 147923 - protein, 18 aa, Mycobacterium avium
EAGLTRFLGGYLSVVSAP

SEQ ID NO: 147924 - protein, 31 aa, Mycobacterium avium
EAKLVEAFVHRGILPDSGAIHLLTRIVGLRK

SEQ ID NO: 147925 - protein, 40 aa, Mycobacterium avium; identical to SEQ ID NO: 119720

SEQ ID NO: 147926 - protein, 24 aa, Mycobacterium avium
EDVDVLLDALIRVVDRVVDEQVPV

SEQ ID NO: 147927 - protein, 26 aa, Mycobacterium avium
EFARDPLLHKVIRLLSRIAAALDEVG

SEQ ID NO: 147928 - protein, 25 aa, Mycobacterium avium
EGRALLDRVTPALPVLFANLVSLDD

SEQ ID NO: 147929 - protein, 28 aa, Mycobacterium avium
EGRDIGTVVLPDAPVKIFLTASAETRAR

SEQ ID NO: 147930 - protein, 25 aa, Mycobacterium avium
EGWFPTRDIATLDEAGYLFITGRAD

SEQ ID NO: 147931 - protein, 26 aa, Mycobacterium avium
EIDSRSYTFIAYLGDYYAFTTLTTDP

SEQ ID NO: 147932 - protein, 36 aa, Mycobacterium avium; identical to SEQ ID NO: 22051

SEQ ID NO: 147933 - protein, 20 aa, Mycobacterium avium
ELACALALFPPTEEQAAVIA

SEQ ID NO: 147934 - protein, 29 aa, Mycobacterium avium
ELARLRPPAPWPAPGYPPAWPGSGPAPQW

SEQ ID NO: 147935 - protein, 31 aa, Mycobacterium avium; identical to SEQ ID NO: 125873

SEQ ID NO: 147936 - protein, 20 aa, Mycobacterium avium
ELGDTGRILLRPSGTEPMIR

SEQ ID NO: 147937 - protein, 21 aa, Mycobacterium avium
ELLILVLPLVGATVAVVRAFG

SEQ ID NO: 147938 - protein, 17 aa, Mycobacterium avium
ELVPDGPGSLPANTIPL

SEQ ID NO: 147939 - protein, 18 aa, Mycobacterium avium
EMSPVTCMLLGEDAIRKR

SEQ ID NO: 147940 - protein, 17 aa, Mycobacterium avium
ENPLIKDPFAQVFLDAA

SEQ ID NO: 147941 - protein, 22 aa, Mycobacterium avium
ENVAPLYRRNALSERQLLAINE

SEQ ID NO: 147942 - protein, 23 aa, Mycobacterium avium
ENVVPLYRRNALSERQLLAINEV

SEQ ID NO: 147943 - protein, 24 aa, Mycobacterium avium
ENVVPVYRRNALSERQLLAINEVA

SEQ ID NO: 147944 - protein, 26 aa, Mycobacterium avium
EPDDGFVAVIYRWARTADLAAALAAA

SEQ ID NO: 147945 - protein, 28 aa, Mycobacterium avium
EPEPDRVRITFWLNDKYKVPADVKAAIL

SEQ ID NO: 147946 - protein, 19 aa, Mycobacterium avium
EPGIYFPGRWGARIEDIVV

SEQ ID NO: 147947 - protein, 23 aa, Mycobacterium avium
EPWRVEALVLVAFSAYARGDGPL

SEQ ID NO: 147948 - protein, 24 aa, Mycobacterium avium
EQRRIIDDQLALVLWDEVQVHAAA

SEQ ID NO: 147949 - protein, 25 aa, Mycobacterium avium
EQTLASLSLILRGGGIPNLEVLQNE

SEQ ID NO: 147950 - protein, 26 aa, Mycobacterium avium
ERHDRLAEAIALIRQLWSGSRISFSG

SEQ ID NO: 147951 - protein, 27 aa, Mycobacterium avium
ERHRMGYLQMMSTVLGRRVWENAGSPE

SEQ ID NO: 147952 - protein, 20 aa, Mycobacterium avium
ERLLRLGLESLRLWREGGFL

SEQ ID NO: 147953 - protein, 41 aa, Mycobacterium avium
ERRLRVVVRVTLRLLLAVLLAPGWPLLAVPLPGRTRVQRIY

SEQ ID NO: 147954 - protein, 24 aa, Mycobacterium avium
ERRVDAVALYTPILGLNAMIARHL

SEQ ID NO: 147955 - protein, 17 aa, Mycobacterium avium
ESAKLCVQYLAPIIKNR

SEQ ID NO: 147956 - protein, 35 aa, Mycobacterium avium
ESVHDLAVGLFRAAPWPGVAPLTLFGHSMGGVVAF

SEQ ID NO: 147957 - protein, 24 aa, Mycobacterium avium
EVDPMLFDRSYFLEPDSKSSKSYV

SEQ ID NO: 147958 - protein, 26 aa, Mycobacterium avium
EVESLWAVLARTLPEPWRVEALVLVA

SEQ ID NO: 147959 - protein, 20 aa, Mycobacterium avium
EVLARFRVDRPIRVTGWPPK

SEQ ID NO: 147960 - protein, 26 aa, Mycobacterium avium
EVLRLRWRKGCMPVPQRVIRARMHGR

SEQ ID NO: 147961 - protein, 20 aa, Mycobacterium avium
EVRAQFETNFFGAAATVQSV

SEQ ID NO: 147962 - protein, 20 aa, Mycobacterium avium
EVTRERQGWGAWPVCSGRAG

SEQ ID NO: 147963 - protein, 17 aa, Mycobacterium avium
EWEVESAIYVYAPDLIP

SEQ ID NO: 147964 - protein, 29 aa, Mycobacterium avium
EWTRFARDPLLHKVIRLLSRIAAALDEVG

SEQ ID NO: 147965 - protein, 26 aa, Mycobacterium avium
FAATVPPPVIAANRALLASLIATNVL

SEQ ID NO: 147966 - protein, 25 aa, Mycobacterium avium
FADQKPIIDKALKTIPQALTVLKDE

SEQ ID NO: 147967 - protein, 20 aa, Mycobacterium avium
FAERTDVLALLLRSTYDDGA

SEQ ID NO: 147968 - protein, 18 aa, Mycobacterium avium
FAGFDEDGGQRPALAVGV

SEQ ID NO: 147969 - protein, 21 aa, Mycobacterium avium
FAPGRPLIEVLRDLASRIFTD

SEQ ID NO: 147970 - protein, 24 aa, Mycobacterium avium
FAPPPSGPPPFAPPPPDAGPVPAP

SEQ ID NO: 147971 - protein, 17 aa, Mycobacterium avium
FARERSRWVFSNPDMIH

SEQ ID NO: 147972 - protein, 18 aa, Mycobacterium avium
FASPCVVPLVPGYLSYLA

SEQ ID NO: 147973 - protein, 22 aa, Mycobacterium avium
FAVLTYLSYTVAFAPIDTVTVS

SEQ ID NO: 147974 - protein, 24 aa, Mycobacterium avium
FDKGALTAFLSWLESRPSPRSRRR

SEQ ID NO: 147975 - protein, 19 aa, Mycobacterium avium
FDQGLGDMFVVRTAGQAID

SEQ ID NO: 147976 - protein, 19 aa, Mycobacterium avium
FEHGTITWKPGDAEATVTT

SEQ ID NO: 147977 - protein, 22 aa, Mycobacterium avium
FEPYNDWPYGGPRPLISYAPGT

SEQ ID NO: 147978 - protein, 17 aa, Mycobacterium avium
FGALVRGGAVGGGAGVG

SEQ ID NO: 147979 - protein, 18 aa, Mycobacterium avium
FGAPPPFAPPPSGPPPFA

SEQ ID NO: 147980 - protein, 19 aa, Mycobacterium avium
FGAPPPFAPPPSGPPPFAP

SEQ ID NO: 147981 - protein, 26 aa, Mycobacterium avium
FGTRIQYNIGLGLLFGRPKSNLTFAQ

SEQ ID NO: 147982 - protein, 18 aa, Mycobacterium avium
FHTGGFNRNTWGVAMIGN

SEQ ID NO: 147983 - protein, 17 aa, Mycobacterium avium
FLGLGNMGAPMAANLVA

SEQ ID NO: 147984 - protein, 27 aa, Mycobacterium avium
FLREVQDVWTWVRPYFDDRATGAAKKL

SEQ ID NO: 147985 - protein, 35 aa, Mycobacterium avium
FLSSGPYAFPVAVLSMFNVLWALAPATPVMQALNR

SEQ ID NO: 147986 - protein, 24 aa, Mycobacterium avium
FPTLPPMMRITLNAILRAVFGAEG

SEQ ID NO: 147987 - protein, 27 aa, Mycobacterium avium
FRDQYPVPAKLWTIADLGGWSAADPQL

SEQ ID NO: 147988 - protein, 18 aa, Mycobacterium avium
FRGDYINISLTLDLTYSA

SEQ ID NO: 147989 - protein, 26 aa, Mycobacterium avium
FSEPYPAWKELFNNILPAHIVKDVPG

SEQ ID NO: 147990 - protein, 23 aa, Mycobacterium avium
FTAVCLLFTFTLIAVFGQLRFED

SEQ ID NO: 147991 - protein, 18 aa, Mycobacterium avium
FTIESRALTFQPKRIHKQ

SEQ ID NO: 147992 - protein, 19 aa, Mycobacterium avium
FTMEDLLGGRKTAIIIHAG

SEQ ID NO: 147993 - protein, 21 aa, Mycobacterium avium
FTPKTSLTMLASRAGLVMDPG

SEQ ID NO: 147994 - protein, 24 aa, Mycobacterium avium
FTPKTSLTMLASRAGLVMDPGSKV

SEQ ID NO: 147995 - protein, 18 aa, Mycobacterium avium
FVMVAITVMALVAPVGRG

SEQ ID NO: 147996 - protein, 19 aa, Mycobacterium avium
FVNTLVLRVDLAGDPSFTE

SEQ ID NO: 147997 - protein, 20 aa, Mycobacterium avium
FVRWCRQVLDLLDQVRNAAP

SEQ ID NO: 147998 - protein, 19 aa, Mycobacterium avium
FYNKRLFDEAGVPSPPAAW

SEQ ID NO: 147999 - protein, 27 aa, Mycobacterium avium
GAALTAGPLMLAGMLTATVTAGPARAD

SEQ ID NO: 148000 - protein, 22 aa, Mycobacterium avium
GAAPYVGWLHTTAERAQQTATQ

SEQ ID NO: 148001 - protein, 23 aa, Mycobacterium avium
GAAQFTMIAASAYCPQHLGQRVG

SEQ ID NO: 148002 - protein, 23 aa, Mycobacterium avium
GACLHWGALWGPASGARYLDPLG

SEQ ID NO: 148003 - protein, 24 aa, Mycobacterium avium
GAGTAWLYFKEYLPDKRTDARVAS

SEQ ID NO: 148004 - protein, 18 aa, Mycobacterium avium
GAGWLKVKPVHTLDLVVL

SEQ ID NO: 148005 - protein, 22 aa, Mycobacterium avium
GAHPGLRLDWPDDGTIGASGFR

SEQ ID NO: 148006 - protein, 25 aa, Mycobacterium avium
GAIAVPLNFRLTAAEIAFLVQDCQA

SEQ ID NO: 148007 - protein, 26 aa, Mycobacterium avium
GAIWARYGVPWQPAYVFYRADGSSTF

SEQ ID NO: 148008 - protein, 17 aa, Mycobacterium avium
GALARRAVVARAVAIDA

SEQ ID NO: 148009 - protein, 18 aa, Mycobacterium avium
GALARRAVVARAVAIDAY

SEQ ID NO: 148010 - protein, 18 aa, Mycobacterium avium
GALLLGGRLGPARTAAIC

SEQ ID NO: 148011 - protein, 17 aa, Mycobacterium avium
GALTALATLCAGTAPAA

SEQ ID NO: 148012 - protein, 17 aa, Mycobacterium avium
GALTALATLYAATAPAA

SEQ ID NO: 148013 - protein, 17 aa, Mycobacterium avium
GALTALATLYAGTAPAA

SEQ ID NO: 148014 - protein, 20 aa, Mycobacterium avium
GAMVIDLITIAQAPVAGLIP

SEQ ID NO: 148015 - protein, 23 aa, Mycobacterium avium
GAPADYSNLLIKPGDVGPNATAD

SEQ ID NO: 148016 - protein, 34 aa, Mycobacterium avium
GASGFLVRQTFFRPLTITAYFPSATGIYAGDEIR

SEQ ID NO: 148017 - protein, 28 aa, Mycobacterium avium
GATSKTLPDFPRLWARMLDASLPDGEEH

SEQ ID NO: 148018 - protein, 29 aa, Mycobacterium avium
GATSKTLPDFPRLWARMLDTSLPDGEEHG

SEQ ID NO: 148019 - protein, 20 aa, Mycobacterium avium
GAVALVAALLAAAAVLLDYS

SEQ ID NO: 148020 - protein, 24 aa, Mycobacterium avium
GAVLLACLMIVLCAGAGVGTWLLV

SEQ ID NO: 148021 - protein, 18 aa, Mycobacterium avium
GAVLPPLAVGAKCTAAAL

SEQ ID NO: 148022 - protein, 26 aa, Mycobacterium avium
GCSTYKWETFLTSELPSYLASNKGVK

SEQ ID NO: 148023 - protein, 23 aa, Mycobacterium avium
GCWQPITHDLWPAPELVIDSGNS

SEQ ID NO: 148024 - protein, 20 aa, Mycobacterium avium
GDLPLSFDVTNIQPTAAGSA

SEQ ID NO: 148025 - protein, 24 aa, Mycobacterium avium
GDRAHWDWLKWLPHNRHPTHYDAL

SEQ ID NO: 148026 - protein, 22 aa, Mycobacterium avium
GDSVVPLIVNLNMFGANDFDTA

SEQ ID NO: 148027 - protein, 22 aa, Mycobacterium avium
GDTSRLLARFPALGGTDTSGRS

SEQ ID NO: 148028 - protein, 18 aa, Mycobacterium avium
GDYYAFTTLTTDPGAAVP

SEQ ID NO: 148029 - protein, 21 aa, Mycobacterium avium
GEHLGPVLVFVQPGDERRQSH

SEQ ID NO: 148030 - protein, 25 aa, Mycobacterium avium
GEKRSWLRARGLKLFPLVGWAERGG

SEQ ID NO: 148031 - protein, 18 aa, Mycobacterium avium
GELSVWGLASPPSGAKTV

SEQ ID NO: 148032 - protein, 17 aa, Mycobacterium avium
GEPPRPAWDRPLPPPGG

SEQ ID NO: 148033 - protein, 19 aa, Mycobacterium avium
GERLVFGPVTLGLVPVRVT

SEQ ID NO: 148034 - protein, 29 aa, Mycobacterium avium
GESLPLASIFKLYVLHALAGAVTAGRVSW

SEQ ID NO: 148035 - protein, 19 aa, Mycobacterium avium
GFELVVPRDAVGGTPKDYA

SEQ ID NO: 148036 - protein, 21 aa, Mycobacterium avium
GFLLVLFAGAADREVAGAARL

SEQ ID NO: 148037 - protein, 24 aa, Mycobacterium avium
GGAKHPAWYFNLKAHPEATVTVGR

SEQ ID NO: 148038 - protein, 24 aa, Mycobacterium avium
GGAPNPYIYPENLPRVSARGGPGG

SEQ ID NO: 148039 - protein, 21 aa, Mycobacterium avium
GGAYRSLRLLGAMAAVALAAS

SEQ ID NO: 148040 - protein, 27 aa, Mycobacterium avium
GGDAGDIAYPYYLVNGRIAASPKTFNA

SEQ ID NO: 148041 - protein, 25 aa, Mycobacterium avium
GGDRLTACIDPVLNRGFVLEPSGSW

SEQ ID NO: 148042 - protein, 17 aa, Mycobacterium avium
GGLSACHPGQRGLFLLV

SEQ ID NO: 148043 - protein, 17 aa, Mycobacterium avium
GGLTLRRIGLSDRLCEL

SEQ ID NO: 148044 - protein, 19 aa, Mycobacterium avium
GGNLYGPGGVALPMRLALP

SEQ ID NO: 148045 - protein, 23 aa, Mycobacterium avium
GGPGNLLGGMPLAGAGAGGHGAA

SEQ ID NO: 148046 - protein, 27 aa, Mycobacterium avium
GGVRPDPLPWHPLGMAIDVMIPDPESA

SEQ ID NO: 148047 - protein, 18 aa, Mycobacterium avium
GGYLSFNLNLNLPPACTT

SEQ ID NO: 148048 - protein, 24 aa, Mycobacterium avium
GHARACGWAIRDGVVGPSSTPGHR

SEQ ID NO: 148049 - protein, 20 aa, Mycobacterium avium
GHDVRMLLAKNPAGWQEALS

SEQ ID NO: 148050 - protein, 23 aa, Mycobacterium avium
GHPSGVFDWRPPSSLITALSDLL

SEQ ID NO: 148051 - protein, 24 aa, Mycobacterium avium
GIFIGSWTDLTIFRGPLGDIAAKA

SEQ ID NO: 148052 - protein, 22 aa, Mycobacterium avium
GIGRYTLYVELPQSGGLYRTAN

SEQ ID NO: 148053 - protein, 23 aa, Mycobacterium avium
GIKPGRSYTARQLLDALLLVSGN

SEQ ID NO: 148054 - protein, 19 aa, Mycobacterium avium
GILAYRTYSASMPMPDKVV

SEQ ID NO: 148055 - protein, 18 aa, Mycobacterium avium
GIQEINAGWYNGKSESMA

SEQ ID NO: 148056 - protein, 24 aa, Mycobacterium avium
GIREEWLPLFDQYQVDLVLCGHEH

SEQ ID NO: 148057 - protein, 30 aa, Mycobacterium avium
GKASPYLIGALKLILTQPFDIDTVPKIFRG

SEQ ID NO: 148058 - protein, 18 aa, Mycobacterium avium
GKIKQAYGLAYQQSLNAQ

SEQ ID NO: 148059 - protein, 17 aa, Mycobacterium avium
GKPPTPLWPDAVGEMCI

SEQ ID NO: 148060 - protein, 25 aa, Mycobacterium avium
GKPVPGAQAYLLDDGLRPVPVGVVG

SEQ ID NO: 148061 - protein, 25 aa, Mycobacterium avium
GLADNGYIPIPDAFKSRLSAAINAI

SEQ ID NO: 148062 - protein, 22 aa, Mycobacterium avium
GLAYANLALLLGNAELARGAAA

SEQ ID NO: 148063 - protein, 19 aa, Mycobacterium avium
GLDSRAYRLDWPAATTIFE

SEQ ID NO: 148064 - protein, 19 aa, Mycobacterium avium
GLEWQLVAVARLSGGVFPS

SEQ ID NO: 148065 - protein, 29 aa, Mycobacterium avium
GLGQPSPAPWPLLTLLPAGPELSRPNASV

SEQ ID NO: 148066 - protein, 24 aa, Mycobacterium avium
GLHAAASRWHGFAAAMNGVQGTLN

SEQ ID NO: 148067 - protein, 25 aa, Mycobacterium avium
GLKGEEILKRFPSSGPYKLQAVLDG

SEQ ID NO: 148068 - protein, 18 aa, Mycobacterium avium
GLMFSGMPNFAITFGYTN

SEQ ID NO: 148069 - protein, 21 aa, Mycobacterium avium
GLPGDLTFSWYAVDKTHQPWV

SEQ ID NO: 148070 - protein, 22 aa, Mycobacterium avium
GLPGDLTFSWYAVDKTHQPWVV

SEQ ID NO: 148071 - protein, 18 aa, Mycobacterium avium
GLPVSPRMIFENPTVQQL

SEQ ID NO: 148072 - protein, 24 aa, Mycobacterium avium
GLSAKIVFPHPNTETGPFNYEVTQ

SEQ ID NO: 148073 - protein, 26 aa, Mycobacterium avium
GLTGLYWHGPASRAMAAGAAPYVGWL

SEQ ID NO: 148074 - protein, 17 aa, Mycobacterium avium
GLVITATPLRPGVWHAY

SEQ ID NO: 148075 - protein, 34 aa, Mycobacterium avium
GMPNVRAMNFLGEPPVVIGPLFQDKTLKVCATED

SEQ ID NO: 148076 - protein, 21 aa, Mycobacterium avium
GMVVLGVWQPGAPSAGLVGLK

SEQ ID NO: 148077 - protein, 25 aa, Mycobacterium avium
GNLLAPLVGFLPYASELGLHLIIAR

SEQ ID NO: 148078 - protein, 17 aa, Mycobacterium avium
GNPAPRLFRLPADRALL

SEQ ID NO: 148079 - protein, 23 aa, Mycobacterium avium
GNPAPRLFRLPADRALLNRMGFN

SEQ ID NO: 148080 - protein, 23 aa, Mycobacterium avium
GNPAPRLFRLPADRALLNRMSFN

SEQ ID NO: 148081 - protein, 18 aa, Mycobacterium avium
GNPTPADVLLDLARKQDA

SEQ ID NO: 148082 - protein, 25 aa, Mycobacterium avium
GNSAPRFHITWGTGPALVEIFARRL

SEQ ID NO: 148083 - protein, 25 aa, Mycobacterium avium
GNSVPRFHITWGTGPALVEIFARRL

SEQ ID NO: 148084 - protein, 18 aa, Mycobacterium avium
GNWVLQHDAAIALIQAAT

SEQ ID NO: 148085 - protein, 31 aa, Mycobacterium avium
GPAGWGPWGPPPAWAPPPPPQPAWAPGAQMM

SEQ ID NO: 148086 - protein, 29 aa, Mycobacterium avium
GPASISALRLYLPAPADQSLTGLRLRIEF

SEQ ID NO: 148087 - protein, 26 aa, Mycobacterium avium
GPGGVALPMRLALPGAVNRGNAAQAV

SEQ ID NO: 148088 - protein, 19 aa, Mycobacterium avium
GPHAVYLLDAFNAAPDVSN

SEQ ID NO: 148089 - protein, 27 aa, Mycobacterium avium
GPIGTDRTLWPDRLWLAIAHSPAREID

SEQ ID NO: 148090 - protein, 27 aa, Mycobacterium avium
GPIGTDRTLWPDRLWLAIARSPAREID

SEQ ID NO: 148091 - protein, 28 aa, Mycobacterium avium
GPIGTDRTLWPDRLWLAIARSPAREIDL

SEQ ID NO: 148092 - protein, 27 aa, Mycobacterium avium
GPLAEQPAVRALLTVLLATADGLDGQR

SEQ ID NO: 148093 - protein, 19 aa, Mycobacterium avium
GPNQLVQRVFQPLVQRRGG

SEQ ID NO: 148094 - protein, 19 aa, Mycobacterium avium
GPPPPFGAPPPFAPPPSGP

SEQ ID NO: 148095 - protein, 20 aa, Mycobacterium avium
GPVHPLPRRRADLDAGVFEH

SEQ ID NO: 148096 - protein, 18 aa, Mycobacterium avium
GPVLDDLHNFAFVDAFAN

SEQ ID NO: 148097 - protein, 18 aa, Mycobacterium avium
GQGVGFGGWYAPVALRVD

SEQ ID NO: 148098 - protein, 21 aa, Mycobacterium avium
GQGVGFGGWYAPVALRVDTAS

SEQ ID NO: 148099 - protein, 30 aa, Mycobacterium avium
GQLLVYGVDPLILRQAYPVSQAPYGLAGSR

SEQ ID NO: 148100 - protein, 19 aa, Mycobacterium avium
GQNVHWRPEHYYAPGTTVT

SEQ ID NO: 148101 - protein, 18 aa, Mycobacterium avium
GQPAPKWWFTVGGEVQPG

SEQ ID NO: 148102 - protein, 25 aa, Mycobacterium avium
GQSFTSVPMLFATPTYYAQFTDAGG

SEQ ID NO: 148103 - protein, 19 aa, Mycobacterium avium
GRAVFTPSLAGLVLGEYRR

SEQ ID NO: 148104 - protein, 17 aa, Mycobacterium avium
GRDALIRGIHRGVADWP

SEQ ID NO: 148105 - protein, 25 aa, Mycobacterium avium
GREFASRWAELIFTGDPGIDGARSH

SEQ ID NO: 148106 - protein, 26 aa, Mycobacterium avium
GREFASRWAELIFTGDPGIDVARSHY

SEQ ID NO: 148107 - protein, 20 aa, Mycobacterium avium
GRFQWVVFTSTNAVRAVWEK

SEQ ID NO: 148108 - protein, 18 aa, Mycobacterium avium
GRFTIVAIATYCPAVIAP

SEQ ID NO: 148109 - protein, 20 aa, Mycobacterium avium
GRFTIVAIATYCPAVIAPLL

SEQ ID NO: 148110 - protein, 19 aa, Mycobacterium avium
GRILLRPSGTEPMIRVMVE

SEQ ID NO: 148111 - protein, 23 aa, Mycobacterium avium
GRPTPEMLAYQYLQTLPEMARGD

SEQ ID NO: 148112 - protein, 20 aa, Mycobacterium avium
GRQLEEGCFDLMFFDDRLAM

SEQ ID NO: 148113 - protein, 19 aa, Mycobacterium avium
GRRALVVALAAMLTSCTWR

SEQ ID NO: 148114 - protein, 19 aa, Mycobacterium avium
GRRCPASRRLGLGRAVRQR

SEQ ID NO: 148115 - protein, 33 aa, Mycobacterium avium
GRRRRRFALRAALALLVVVVLAGVFAGGKLWHT

SEQ ID NO: 148116 - protein, 23 aa, Mycobacterium avium
GRSAAWLIVDVRDLAALHAALLE

SEQ ID NO: 148117 - protein, 22 aa, Mycobacterium avium
GSADDIFWLSNAYLAAYADSGR

SEQ ID NO: 148118 - protein, 17 aa, Mycobacterium avium
GSEEVLGILLSAIDSRQ

SEQ ID NO: 148119 - protein, 18 aa, Mycobacterium avium
GSEEVLGILLSAIDSRQA

SEQ ID NO: 148120 - protein, 36 aa, Mycobacterium avium; identical to SEQ ID NO: 127225

SEQ ID NO: 148121 - protein, 31 aa, Mycobacterium avium
GSKVGLPLVRKALDLLPHVGFVNAYGLTETS

SEQ ID NO: 148122 - protein, 18 aa, Mycobacterium avium
GSPAVYLLDGLRAQDDYN

SEQ ID NO: 148123 - protein, 18 aa, Mycobacterium avium
GSRAWAAMYLGTPSTPEG

SEQ ID NO: 148124 - protein, 22 aa, Mycobacterium avium
GSRVPLAGMALPVVSAKTVRIN

SEQ ID NO: 148125 - protein, 30 aa, Mycobacterium avium
GSSSPAPSLPPSQAPAKPALVTGSVASVSG

SEQ ID NO: 148126 - protein, 17 aa, Mycobacterium avium
GTLSLWQGVDVPGPSLS

SEQ ID NO: 148127 - protein, 26 aa, Mycobacterium avium
GTTVVFDNYLRRCDFSKVSIAPKVPS

SEQ ID NO: 148128 - protein, 23 aa, Mycobacterium avium
GVARVDAYALLPDDGRPRNEHVF

SEQ ID NO: 148129 - protein, 21 aa, Mycobacterium avium
GVFAWLYWGAHDELAAQHRAT

SEQ ID NO: 148130 - protein, 21 aa, Mycobacterium avium
GVGLLCMYKVHQFSEPGPVIT

SEQ ID NO: 148131 - protein, 20 aa, Mycobacterium avium
GVLALTGGIAAFAAHQLSGV

SEQ ID NO: 148132 - protein, 17 aa, Mycobacterium avium
GVLFQAKKNHQASLEQI

SEQ ID NO: 148133 - protein, 17 aa, Mycobacterium avium
GVLSVLALAAGVAVGTR

SEQ ID NO: 148134 - protein, 18 aa, Mycobacterium avium
GVLSVLALAAGVAVGTRL

SEQ ID NO: 148135 - protein, 21 aa, Mycobacterium avium
GVNLTGTFLVAKAALARMIDQ

SEQ ID NO: 148136 - protein, 19 aa, Mycobacterium avium
GVPPRYGVRLTVMPRPPAA

SEQ ID NO: 148137 - protein, 19 aa, Mycobacterium avium
GVVTQKGRWYLVGHDRDRD

SEQ ID NO: 148138 - protein, 20 aa, Mycobacterium avium
GVVTQKGRWYLVGHDRDRDA

SEQ ID NO: 148139 - protein, 19 aa, Mycobacterium avium
GVWHAYADHRMAMAGAIVG

SEQ ID NO: 148140 - protein, 19 aa, Mycobacterium avium
GVWQAYADHRMAMAGAIVG

SEQ ID NO: 148141 - protein, 20 aa, Mycobacterium avium
GWATTTFGLADLFAAAGLPE

SEQ ID NO: 148142 - protein, 19 aa, Mycobacterium avium
GWIGRWLDATGDDPLRAVN

SEQ ID NO: 148143 - protein, 33 aa, Mycobacterium avium; identical to SEQ ID NO: 120494

SEQ ID NO: 148144 - protein, 21 aa, Mycobacterium avium
GYGIISAPSVILASGGLGHLY

SEQ ID NO: 148145 - protein, 19 aa, Mycobacterium avium
HAGYFVGVSIKAYCPKYAA

SEQ ID NO: 148146 - protein, 18 aa, Mycobacterium avium
HAMPVLRELELPAAVFLA

SEQ ID NO: 148147 - protein, 24 aa, Mycobacterium avium
HDAGKIVLRRSRPLQISLDGHDSK

SEQ ID NO: 148148 - protein, 26 aa, Mycobacterium avium
HFVEVTLGAFFQIAKAVEPITVCLAG

SEQ ID NO: 148149 - protein, 26 aa, Mycobacterium avium
HGNSVPRFHITWGTGPALVEIFARRL

SEQ ID NO: 148150 - protein, 23 aa, Mycobacterium avium
HGSRTYVLLPQPPNRSVSSWVRG

SEQ ID NO: 148151 - protein, 33 aa, Mycobacterium avium; identical to SEQ ID NO: 127562

SEQ ID NO: 148152 - protein, 17 aa, Mycobacterium avium
HLAASNVAGLLSAAGAP

SEQ ID NO: 148153 - protein, 22 aa, Mycobacterium avium
HLDQQLGLNPALKGLAGLWNQR

SEQ ID NO: 148154 - protein, 26 aa, Mycobacterium avium
HPPDAASRLLALILGTGGDATRIRSV

SEQ ID NO: 148155 - protein, 17 aa, Mycobacterium avium
HPVLAGRDRWREVRAPG

SEQ ID NO: 148156 - protein, 25 aa, Mycobacterium avium
HQREALCRLAFAARAGWQRWEAEFG

SEQ ID NO: 148157 - protein, 26 aa, Mycobacterium avium
HQVNAPLPWSAQFTGFGGEVFTVSAQ

SEQ ID NO: 148158 - protein, 17 aa, Mycobacterium avium
HRLPSRPEPHALLGNAF

SEQ ID NO: 148159 - protein, 25 aa, Mycobacterium avium
HRREALCRLAFAARAGWQRWEAEFG

SEQ ID NO: 148160 - protein, 25 aa, Mycobacterium avium
HRRESLCRLAFAARAGWQRWEAEFG

SEQ ID NO: 148161 - protein, 30 aa, Mycobacterium avium
HRSMMIKVSIFAAAMLLVSAGLVVVFGDFR

SEQ ID NO: 148162 - protein, 22 aa, Mycobacterium avium
HSAAPLFHNIAGWLMQRENVPL

SEQ ID NO: 148163 - protein, 19 aa, Mycobacterium avium
HSEKWIDLQPGQCVADLPP

SEQ ID NO: 148164 - protein, 24 aa, Mycobacterium avium
HSGDMYFPLYEGDSFYGLWQQLSN

SEQ ID NO: 148165 - protein, 23 aa, Mycobacterium avium
HSRQLVAAQIIWTLARADHPGPV

SEQ ID NO: 148166 - protein, 23 aa, Mycobacterium avium
HTAGSFAMSLYDGGHFYLYDHVE

SEQ ID NO: 148167 - protein, 19 aa, Mycobacterium avium
HTGKPWFAIGGIDAQRLPE

SEQ ID NO: 148168 - protein, 19 aa, Mycobacterium avium
HVFTPILRDAAPSAAPRGI

SEQ ID NO: 148169 - protein, 19 aa, Mycobacterium avium
HVLQRFTISQLQQLPQVEV

SEQ ID NO: 148170 - protein, 24 aa, Mycobacterium avium
IAADDFWYLWHQMVSQPGVVDPAG

SEQ ID NO: 148171 - protein, 26 aa, Mycobacterium avium
IAATLPGYMMPSSLTVLDALPKTESG

SEQ ID NO: 148172 - protein, 19 aa, Mycobacterium avium
IAFGGLGPELARFVQGATA

SEQ ID NO: 148173 - protein, 29 aa, Mycobacterium avium
IAFGYAGLPFWPQGKIYDAYFTDAGGINP

SEQ ID NO: 148174 - protein, 17 aa, Mycobacterium avium
IAGRREPALDELVGFFV

SEQ ID NO: 148175 - protein, 19 aa, Mycobacterium avium
IALSVLLSSACSASQVINT

SEQ ID NO: 148176 - protein, 17 aa, Mycobacterium avium
IALYYNADLLGAAGIDP

SEQ ID NO: 148177 - protein, 27 aa, Mycobacterium avium
IAPQLRTFARRHPAVTIRLLEGSKEEI

SEQ ID NO: 148178 - protein, 18 aa, Mycobacterium avium
IARRQGIEFDLAFEAREI

SEQ ID NO: 148179 - protein, 19 aa, Mycobacterium avium
IAVLGRLTTIDKLIDEWTS

SEQ ID NO: 148180 - protein, 28 aa, Mycobacterium avium
IDLVPEYIGNLLLYFEPASSATTLDAVE

SEQ ID NO: 148181 - protein, 20 aa, Mycobacterium avium
IDPAALCGPPLTALSGRWSV

SEQ ID NO: 148182 - protein, 30 aa, Mycobacterium avium; identical to SEQ ID NO: 22284

SEQ ID NO: 148183 - protein, 23 aa, Mycobacterium avium
IDPLARLLEQTLLGYDQLGLVPE

SEQ ID NO: 148184 - protein, 18 aa, Mycobacterium avium
IEALLPPATLRDVEPQLG

SEQ ID NO: 148185 - protein, 24 aa, Mycobacterium avium
IEKMGWDQFVLAAGLKLIDEADDP

SEQ ID NO: 148186 - protein, 18 aa, Mycobacterium avium
IEVLRDLASRIFTDFTYR

SEQ ID NO: 148187 - protein, 18 aa, Mycobacterium avium
IFNTYGPGMRADDGRMVP

SEQ ID NO: 148188 - protein, 25 aa, Mycobacterium avium
IGDAFLEPFGKFWVNHREEFIEKVR

SEQ ID NO: 148189 - protein, 23 aa, Mycobacterium avium
IGGKLSVPVAWSGAPATPALGHA

SEQ ID NO: 148190 - protein, 17 aa, Mycobacterium avium
IGIPGRPWRTPSRPFPP

SEQ ID NO: 148191 - protein, 17 aa, Mycobacterium avium
IGPTAFLGLGVTDNNGN

SEQ ID NO: 148192 - protein, 24 aa, Mycobacterium avium
IHPPDAASRLLALIVGTGGDATRI

SEQ ID NO: 148193 - protein, 17 aa, Mycobacterium avium
IISAPSVILASGGLGHL

SEQ ID NO: 148194 - protein, 18 aa, Mycobacterium avium
IKENLPGADYPPIPPELD

SEQ ID NO: 148195 - protein, 20 aa, Mycobacterium avium
ILAAVKRLYLLGKNDRPTGT

SEQ ID NO: 148196 - protein, 26 aa, Mycobacterium avium
ILGIEALTRWQHPTLGLLMPDSFIQV

SEQ ID NO: 148197 - protein, 18 aa, Mycobacterium avium
ILTNNHVVAAAAGPPKGP

SEQ ID NO: 148198 - protein, 34 aa, Mycobacterium avium
IMTVFVSKGLQYPIVYLPFAFHRNTTDSDVVLFH

SEQ ID NO: 148199 - protein, 18 aa, Mycobacterium avium
INHVIWRQKIYPGVGGGN

SEQ ID NO: 148200 - protein, 26 aa, Mycobacterium avium
INIGSVLGFLPQPYGALYAGSKHAVE

SEQ ID NO: 148201 - protein, 25 aa, Mycobacterium avium
INIGSVLGFLPQPYGTLYAGSKHAV

SEQ ID NO: 148202 - protein, 18 aa, Mycobacterium avium
INSPPTISRTFGPPPGIS

SEQ ID NO: 148203 - protein, 33 aa, Mycobacterium avium; identical to SEQ ID NO: 127978

SEQ ID NO: 148204 - protein, 18 aa, Mycobacterium avium
IPGRPWRTPSRPFPPPHD

SEQ ID NO: 148205 - protein, 17 aa, Mycobacterium avium
IPLVAAPMSGGPTTPAM

SEQ ID NO: 148206 - protein, 18 aa, Mycobacterium avium
IQNVPMLENSQYQNQMIS

SEQ ID NO: 148207 - protein, 17 aa, Mycobacterium avium
IRLPELTSKLLVRQGDR

SEQ ID NO: 148208 - protein, 25 aa, Mycobacterium avium
ISPSTRAVLFHLGQFIPQGVPDTYG

SEQ ID NO: 148209 - protein, 26 aa, Mycobacterium avium
ISPSTRAVLFHLGQFIPQGVPDTYGF

SEQ ID NO: 148210 - protein, 23 aa, Mycobacterium avium
ITAASTPWRQDPYRDIQGGSSLA

SEQ ID NO: 148211 - protein, 20 aa, Mycobacterium avium
ITLVAYSVPEPGWSKIIPAF

SEQ ID NO: 148212 - protein, 24 aa, Mycobacterium avium
ITYNEWSFAQAQKLNMAKIITSAG

SEQ ID NO: 148213 - protein, 25 aa, Mycobacterium avium
IVAFGVLLAVVTVPFVSLGPGPTFD

SEQ ID NO: 148214 - protein, 25 aa, Mycobacterium avium
IVDLAVAFRIPVAPIATPETLPKLD

SEQ ID NO: 148215 - protein, 25 aa, Mycobacterium avium
IVFAWITAMVTGLMFSVAPTPAALA

SEQ ID NO: 148216 - protein, 19 aa, Mycobacterium avium
IVTCRQLEWRRMIDIGADF

SEQ ID NO: 148217 - protein, 18 aa, Mycobacterium avium
IVTGLRLMTRMAQTGSPL

SEQ ID NO: 148218 - protein, 19 aa, Mycobacterium avium
IVTPRVMQLTLRATQPKLA

SEQ ID NO: 148219 - protein, 20 aa, Mycobacterium avium
IYREPLSLKPFDYLPRPVRR

SEQ ID NO: 148220 - protein, 23 aa, Mycobacterium avium
IYVYAPDLIPKIKAQAGQPAPPA

SEQ ID NO: 148221 - protein, 19 aa, Mycobacterium avium
KAALRRWMDRYATFVATKR

SEQ ID NO: 148222 - protein, 25 aa, Mycobacterium avium
KALAESIQAWTPPPAPPAAPGGPGA

SEQ ID NO: 148223 - protein, 25 aa, Mycobacterium avium
KDGQNYLPFGTAAGAGRYLAAHPGS

SEQ ID NO: 148224 - protein, 22 aa, Mycobacterium avium
KDHIAFIRDNLVVEAPIIEEQV

SEQ ID NO: 148225 - protein, 22 aa, Mycobacterium avium
KDWVATLRLDLDPGVRLPANAT

SEQ ID NO: 148226 - protein, 17 aa, Mycobacterium avium
KFGLGQRTNVGLPGESA

SEQ ID NO: 148227 - protein, 28 aa, Mycobacterium avium
KFRIAEAWMRRTIRWIKENLPGADYPPI

SEQ ID NO: 148228 - protein, 28 aa, Mycobacterium avium
KGKRSAWLPLHVLLVDAALTMPTRGWWF

SEQ ID NO: 148229 - protein, 19 aa, Mycobacterium avium
KLCVQYLAPIIKNRQVNFP

SEQ ID NO: 148230 - protein, 22 aa, Mycobacterium avium
KLDNGQYQLPYQGTKSPTQVQA

SEQ ID NO: 148231 - protein, 23 aa, Mycobacterium avium
KLSILEQTLVLYGKGFAGALSGM

SEQ ID NO: 148232 - protein, 23 aa, Mycobacterium avium
KNGLALCGFMNSRVPGSCADVNG

SEQ ID NO: 148233 - protein, 29 aa, Mycobacterium avium
KPSAWIAEGLLIYLPASAQEQLFTGIDGL

SEQ ID NO: 148234 - protein, 22 aa, Mycobacterium avium
KRTIMDTIAVFPDPATAAQTAA

SEQ ID NO: 148235 - protein, 22 aa, Mycobacterium avium
KSLPCHAGYLSVSGKDNTVTLT

SEQ ID NO: 148236 - protein, 24 aa, Mycobacterium avium
KSSRYPGGLALRFARVLRYRDDKG

SEQ ID NO: 148237 - protein, 21 aa, Mycobacterium avium
KTGASLFEPYLSMVQASPSGT

SEQ ID NO: 148238 - protein, 25 aa, Mycobacterium avium
KTYGIGAKPYWRPPYAKRNATVDAV

SEQ ID NO: 148239 - protein, 21 aa, Mycobacterium avium
KVKLPAGALCGKLAVPVDYDH

SEQ ID NO: 148240 - protein, 25 aa, Mycobacterium avium
LAAALALLPATATWASPPALAISPP

SEQ ID NO: 148241 - protein, 26 aa, Mycobacterium avium
LAAEKVTGIFLVPAQWQAVCAEQRAR

SEQ ID NO: 148242 - protein, 28 aa, Mycobacterium avium
LAAGLDARSWRLPWPAGTTVYELDQPRV

SEQ ID NO: 148243 - protein, 17 aa, Mycobacterium avium
LAGYDPDRHLGGILYLF

SEQ ID NO: 148244 - protein, 17 aa, Mycobacterium avium
LAILMFHGVEDRPPLPP

SEQ ID NO: 148245 - protein, 18 aa, Mycobacterium avium
LAVLAVCVVGCGVRHVSA

SEQ ID NO: 148246 - protein, 18 aa, Mycobacterium avium
LCDEVLATPGLCEDPRFV

SEQ ID NO: 148247 - protein, 27 aa, Mycobacterium avium
LDELRRLIPPWVTLGSRLAALPKPQRY

SEQ ID NO: 148248 - protein, 24 aa, Mycobacterium avium
LDGGPFPLTRGQLDIWLAQETDQQ

SEQ ID NO: 148249 - protein, 33 aa, Mycobacterium avium
LDLTALKNIALYLNFDMLASPNPGYFTYGGDQS

SEQ ID NO: 148250 - protein, 17 aa, Mycobacterium avium
LEDLDEFLTERLARYKH

SEQ ID NO: 148251 - protein, 24 aa, Mycobacterium avium
LEFVAAIMGAWLAGAGVSILPGPV

SEQ ID NO: 148252 - protein, 20 aa, Mycobacterium avium
LEFVAAIVGAWLAGAGVSIL

SEQ ID NO: 148253 - protein, 19 aa, Mycobacterium avium
LEYVEMWLRDVAAMLGYHA

SEQ ID NO: 148254 - protein, 22 aa, Mycobacterium avium
LFADPFAARLAGDRGRELLAGA

SEQ ID NO: 148255 - protein, 25 aa, Mycobacterium avium
LFLGVIFLLLGWQALGSSGNSEDDS

SEQ ID NO: 148256 - protein, 26 aa, Mycobacterium avium
LGAPVPVPLGAPLPLGAPVPLAPPVP

SEQ ID NO: 148257 - protein, 27 aa, Mycobacterium avium
LGAYGSFFNIYFCSVTIKINGPAGSDI

SEQ ID NO: 148258 - protein, 18 aa, Mycobacterium avium
LGEDYLRLAALGAYGSFF

SEQ ID NO: 148259 - protein, 17 aa, Mycobacterium avium
LGLTATAVLVGAAVVGC

SEQ ID NO: 148260 - protein, 25 aa, Mycobacterium avium
LGLVDLSPHWIALDPEGAGATWGGL

SEQ ID NO: 148261 - protein, 21 aa, Mycobacterium avium
LGQYLQSFLSSGPYAFPVAVL

SEQ ID NO: 148262 - protein, 26 aa, Mycobacterium avium
LGREWDFVVIAGLQDGLWPNTVPRGG

SEQ ID NO: 148263 - protein, 28 aa, Mycobacterium avium
LGRPDPGLDLPIVLGGNMIQYNWTINGE

SEQ ID NO: 148264 - protein, 25 aa, Mycobacterium avium
LGSDMGEFFMPYPGTRINQDSTPLN

SEQ ID NO: 148265 - protein, 18 aa, Mycobacterium avium
LGSLDAGLPAPGVWALCH

SEQ ID NO: 148266 - protein, 25 aa, Mycobacterium avium
LGTEALTRWQHPTLGLLMPDSFIQV

SEQ ID NO: 148267 - protein, 21 aa, Mycobacterium avium
LIAALPAVLGFVPESSLVLVS

SEQ ID NO: 148268 - protein, 20 aa, Mycobacterium avium
LIDVNLIDPLARLLEQTLLG

SEQ ID NO: 148269 - protein, 19 aa, Mycobacterium avium
LIVRLPDPLVIVDSRYRDM

SEQ ID NO: 148270 - protein, 18 aa, Mycobacterium avium
LIVSRLHKIFGSEDLNAN

SEQ ID NO: 148271 - protein, 20 aa, Mycobacterium avium
LIYGQFRGNFTPKTSLTMLA

SEQ ID NO: 148272 - protein, 24 aa, Mycobacterium avium
LKDWVATLRLDLDPGVRLPANATA

SEQ ID NO: 148273 - protein, 22 aa, Mycobacterium avium
LKELPDIYQVLARQGLNGDYFG

SEQ ID NO: 148274 - protein, 23 aa, Mycobacterium avium
LKLDNGQYQLPYQGTKSPTQVQA

SEQ ID NO: 148275 - protein, 18 aa, Mycobacterium avium
LKLFPLVGWAERGGYDAQ

SEQ ID NO: 148276 - protein, 36 aa, Mycobacterium avium
LLDLHPQVFFMTDLTPGLLPMLQRLQIPVVQITAFT

SEQ ID NO: 148277 - protein, 18 aa, Mycobacterium avium
LLGGMAMGIVGAPSAAAA

SEQ ID NO: 148278 - protein, 19 aa, Mycobacterium avium
LLGSIRRLLTVRRTLARVQ

SEQ ID NO: 148279 - protein, 19 aa, Mycobacterium avium
LLHRAASPTVWLNPWRWYA

SEQ ID NO: 148280 - protein, 20 aa, Mycobacterium avium
LLIGGLTAGVGACSCSIGPS

SEQ ID NO: 148281 - protein, 17 aa, Mycobacterium avium
LLLAGGGLGAGVAWFDT

SEQ ID NO: 148282 - protein, 17 aa, Mycobacterium avium
LLQRHPPKAALRRWMDR

SEQ ID NO: 148283 - protein, 19 aa, Mycobacterium avium
LLSGYRVMPQWVKIRNVDG

SEQ ID NO: 148284 - protein, 18 aa, Mycobacterium avium
LLSSAVAVGWPDLMRAAR

SEQ ID NO: 148285 - protein, 27 aa, Mycobacterium avium
LLVVVRPPLRRRLTPAAVPQLGIVALE

SEQ ID NO: 148286 - protein, 17 aa, Mycobacterium avium
LMRYGFAGVGVLIPRFS

SEQ ID NO: 148287 - protein, 18 aa, Mycobacterium avium
LMTYKGLMFSGMPNFAIT

SEQ ID NO: 148288 - protein, 21 aa, Mycobacterium avium
LNLPPACTTGFLPPAQRRSAA

SEQ ID NO: 148289 - protein, 18 aa, Mycobacterium avium
LNPALKGLAGLWNQRKLA

SEQ ID NO: 148290 - protein, 17 aa, Mycobacterium avium
LNSDWPIGPVGVRTLAA

SEQ ID NO: 148291 - protein, 23 aa, Mycobacterium avium
LNYLPIPTNIILQQIATPGKIIY

SEQ ID NO: 148292 - protein, 17 aa, Mycobacterium avium
LPALSQLSPLIQQAATD

SEQ ID NO: 148293 - protein, 24 aa, Mycobacterium avium
LPGNPRVLSIAQFWDRAANHDRIS

SEQ ID NO: 148294 - protein, 24 aa, Mycobacterium avium
LPHARVESIARTWAHAGFDAVAVT

SEQ ID NO: 148295 - protein, 25 aa, Mycobacterium avium
LPLGAPKRRAVLAMLLIHRNRPVSV

SEQ ID NO: 148296 - protein, 18 aa, Mycobacterium avium
LPPEVVYLYNGPGGTSFD

SEQ ID NO: 148297 - protein, 24 aa, Mycobacterium avium
LPQRASFTTLPWSKTIVAEMPGIF

SEQ ID NO: 148298 - protein, 17 aa, Mycobacterium avium
LQMTGMYQTIANDGVRI

SEQ ID NO: 148299 - protein, 17 aa, Mycobacterium avium
LQVATALCDARGGAVAP

SEQ ID NO: 148300 - protein, 21 aa, Mycobacterium avium
LRADRVLICAGVATPKLFGPL

SEQ ID NO: 148301 - protein, 18 aa, Mycobacterium avium
LREWRGPVLDDLHNFAFV

SEQ ID NO: 148302 - protein, 19 aa, Mycobacterium avium
LRGDPALAGELWLDGADTT

SEQ ID NO: 148303 - protein, 18 aa, Mycobacterium avium
LRLPMWGPVVMVSDPQLA

SEQ ID NO: 148304 - protein, 19 aa, Mycobacterium avium
LRQYLAERNALPDSSLVAS

SEQ ID NO: 148305 - protein, 19 aa, Mycobacterium avium
LRQYLAERNALPNSSLVAS

SEQ ID NO: 148306 - protein, 29 aa, Mycobacterium avium
LSAAALHRTAWIDDWLPAELNRAGRDKAR

SEQ ID NO: 148307 - protein, 26 aa, Mycobacterium avium
LSDPRLQRIFTFQSLYAGVAPRDALA

SEQ ID NO: 148308 - protein, 25 aa, Mycobacterium avium
LSGELRQRQIGVGWAALRSRPPAAA

SEQ ID NO: 148309 - protein, 22 aa, Mycobacterium avium
LSVLIRRAAIAGPPLAATLHTA

SEQ ID NO: 148310 - protein, 29 aa, Mycobacterium avium
LTDEFARDPLLHKVIRLLSRIAAALDEVG

SEQ ID NO: 148311 - protein, 21 aa, Mycobacterium avium
LTGVGTFDPGLGRKAPIYVIE

SEQ ID NO: 148312 - protein, 20 aa, Mycobacterium avium
LTGWLAYRGYQSHQADEQRN

SEQ ID NO: 148313 - protein, 17 aa, Mycobacterium avium
LTMLASRAGLVMDPGSK

SEQ ID NO: 148314 - protein, 33 aa, Mycobacterium avium
LVALICVLPIALAPWPATVFTALLAALAVAVAV

SEQ ID NO: 148315 - protein, 34 aa, Mycobacterium avium
LVALICVLPIALSPWPAMVFTALLAALAVAVAVD

SEQ ID NO: 148316 - protein, 31 aa, Mycobacterium avium; identical to SEQ ID NO: 129231

SEQ ID NO: 148317 - protein, 22 aa, Mycobacterium avium
LVAVVAVGVGLLCMYKVHQFSE

SEQ ID NO: 148318 - protein, 21 aa, Mycobacterium avium
LVDAVRRRDGLPRIAQAVAAP

SEQ ID NO: 148319 - protein, 20 aa, Mycobacterium avium
LVIAPWFLAPGFITDGVSTF

SEQ ID NO: 148320 - protein, 26 aa, Mycobacterium avium
LVLSLILALIYGQFRGAFTPKTSLTM

SEQ ID NO: 148321 - protein, 17 aa, Mycobacterium avium
LVMRSACAQFGQWRSRG

SEQ ID NO: 148322 - protein, 18 aa, Mycobacterium avium
LVSAPLSFASQFFEGLSS

SEQ ID NO: 148323 - protein, 19 aa, Mycobacterium avium
LVTLLDQGPIRMTDLAAHE

SEQ ID NO: 148324 - protein, 21 aa, Mycobacterium avium
LVVVFGDFRFGPESTYHATFV

SEQ ID NO: 148325 - protein, 17 aa, Mycobacterium avium
LWSGRTATLAGLSAAAL

SEQ ID NO: 148326 - protein, 25 aa, Mycobacterium avium
MAHTVRNLLAPPLRLRGPVTRADGG

SEQ ID NO: 148327 - protein, 19 aa, Mycobacterium avium
MASRTAFFDSFFLEATGAG

SEQ ID NO: 148328 - protein, 19 aa, Mycobacterium avium
MEFHLRRRVKSLPNVTFLD

SEQ ID NO: 148329 - protein, 31 aa, Mycobacterium avium
MEIETICRYRLPVTVVILNNGGVYRGDEAPH

SEQ ID NO: 148330 - protein, 18 aa, Mycobacterium avium
MFAFSGILTALYVRATTG

SEQ ID NO: 148331 - protein, 23 aa, Mycobacterium avium
MGADLCQQLSWGASPQQLEGLAL

SEQ ID NO: 148332 - protein, 31 aa, Mycobacterium avium
MGALRVIRRRSWQGLTLLVAAMVLTSCGWKG

SEQ ID NO: 148333 - protein, 23 aa, Mycobacterium avium
MGGLMTVPGLSVYCASKYALEGL

SEQ ID NO: 148334 - protein, 22 aa, Mycobacterium avium
MKLFLIVAGFAAVIGLAVPARA

SEQ ID NO: 148335 - protein, 17 aa, Mycobacterium avium
MLAEKIDIGSMGDYPML

SEQ ID NO: 148336 - protein, 17 aa, Mycobacterium avium
MLAPVVRTYRTPAPTMH

SEQ ID NO: 148337 - protein, 17 aa, Mycobacterium avium
MLLAKNPAGWQEALSMV

SEQ ID NO: 148338 - protein, 18 aa, Mycobacterium avium
MLPCNWLGMQVPAGTPGS

SEQ ID NO: 148339 - protein, 17 aa, Mycobacterium avium
MQLTLRATQPKLADTQV

SEQ ID NO: 148340 - protein, 33 aa, Mycobacterium avium
MQMMQAPMQMMQPLQSMMGMFANPGAMGMGGAA

SEQ ID NO: 148341 - protein, 17 aa, Mycobacterium avium
MQWIAARFRGEPTAPNC

SEQ ID NO: 148342 - protein, 26 aa, Mycobacterium avium
MRRRATMYLTYWTAGDTRNRGREMLA

SEQ ID NO: 148343 - protein, 17 aa, Mycobacterium avium
MTEVLVPHHPGDTIAVH

SEQ ID NO: 148344 - protein, 18 aa, Mycobacterium avium
MVALVPIVAFGVLLAVVT

SEQ ID NO: 148345 - protein, 43 aa, Mycobacterium avium
MVEAMLHSDYPLQALLYSAVLHRFLRWRLAGYDPDRHLGGILY

SEQ ID NO: 148346 - protein, 27 aa, Mycobacterium avium
MWMQSPPHRAIILNCGFNAGGFATARD

SEQ ID NO: 148347 - protein, 17 aa, Mycobacterium avium
MYPMTLASQAAHIVMRF

SEQ ID NO: 148348 - protein, 26 aa, Mycobacterium avium
NANCTFPMEFTPFQGGWQLSRHTAET

SEQ ID NO: 148349 - protein, 22 aa, Mycobacterium avium
NDNSRIIPRLRRIRDKIERVLD

SEQ ID NO: 148350 - protein, 18 aa, Mycobacterium avium
NEEPPFLNKLVINHALPM

SEQ ID NO: 148351 - protein, 28 aa, Mycobacterium avium
NFDLVGLGNAICWRLYSGEAPGHVADEL

SEQ ID NO: 148352 - protein, 31 aa, Mycobacterium avium; identical to SEQ ID NO: 121406

SEQ ID NO: 148353 - protein, 18 aa, Mycobacterium avium
NFYIQFYGYSLTGPQVTA

SEQ ID NO: 148354 - protein, 22 aa, Mycobacterium avium
NGAMMALRLGCQSDTFAAIAPV

SEQ ID NO: 148355 - protein, 23 aa, Mycobacterium avium
NGAMMALRLGCQSDTFAAIAPVA

SEQ ID NO: 148356 - protein, 29 aa, Mycobacterium avium
NGEVVKRCYAEILPAARPGALFIDSSTIS

SEQ ID NO: 148357 - protein, 26 aa, Mycobacterium avium
NGGNAQRWFVVWLGTSNDPVDKVAAK

SEQ ID NO: 148358 - protein, 21 aa, Mycobacterium avium
NGTHDWPYWGAQLQAMKPDLQ

SEQ ID NO: 148359 - protein, 18 aa, Mycobacterium avium
NGVPPAQYPSMLTALRRA

SEQ ID NO: 148360 - protein, 20 aa, Mycobacterium avium
NLAQYPAVLVELGNMKNAGD

SEQ ID NO: 148361 - protein, 20 aa, Mycobacterium avium
NLGILPNLATIPAALPRTPA

SEQ ID NO: 148362 - protein, 26 aa, Mycobacterium avium
NLVDGDHIMVVLALAMREAGELASDT

SEQ ID NO: 148363 - protein, 25 aa, Mycobacterium avium
NLVDLPTIRRIVNERFMSDAPAALD

SEQ ID NO: 148364 - protein, 24 aa, Mycobacterium avium
NNDFKPGFAAALMNKDLGLAMDAV

SEQ ID NO: 148365 - protein, 24 aa, Mycobacterium avium
NNDVGFIGVPFFHIAGIGNMLTGL

SEQ ID NO: 148366 - protein, 29 aa, Mycobacterium avium
NNPENMRLFGKFLDRIQAFLDTRGPDVKV

SEQ ID NO: 148367 - protein, 27 aa, Mycobacterium avium
NPEIRPAHLLMALLTQADGIAAPLLEA

SEQ ID NO: 148368 - protein, 26 aa, Mycobacterium avium
NPGQILRLYDVPRKVLDWPVRVLVAH

SEQ ID NO: 148369 - protein, 17 aa, Mycobacterium avium
NRAIPLERVTMPYNLMR

SEQ ID NO: 148370 - protein, 24 aa, Mycobacterium avium
NRGAMRPVLRVAPLSVADLLRDRV

SEQ ID NO: 148371 - protein, 17 aa, Mycobacterium avium
NRWQVRPGPVAARHWEV

SEQ ID NO: 148372 - protein, 24 aa, Mycobacterium avium
NSLTRICHALTPGARHGRSRRATR

SEQ ID NO: 148373 - protein, 24 aa, Mycobacterium avium
NSVKLYDVPATPPPIFVAAAGPKS

SEQ ID NO: 148374 - protein, 26 aa, Mycobacterium avium
NTGVDFCQRVRAITLLTVCTPFCRIG

SEQ ID NO: 148375 - protein, 21 aa, Mycobacterium avium
NTVLAALRDTGFITYQGGDHL

SEQ ID NO: 148376 - protein, 17 aa, Mycobacterium avium
NVAGLNSLNLDGATAAK

SEQ ID NO: 148377 - protein, 23 aa, Mycobacterium avium
NVKSVHLVLSIQGKISGLPIKTL

SEQ ID NO: 148378 - protein, 18 aa, Mycobacterium avium
NVLAGIPEEGAITLHVAV

SEQ ID NO: 148379 - protein, 17 aa, Mycobacterium avium
NVVVYHWGSPKVVNAGS

SEQ ID NO: 148380 - protein, 36 aa, Mycobacterium avium
NVYGVIPAPLLATMFDFFYQPGKMPASLADYLRGLI

SEQ ID NO: 148381 - protein, 19 aa, Mycobacterium avium
NWNNFWCVPDRNVNGNWKL

SEQ ID NO: 148382 - protein, 20 aa, Mycobacterium avium
NWNNFWCVPDRNVNGNWKLV

SEQ ID NO: 148383 - protein, 25 aa, Mycobacterium avium
PAAAKALPGLGGLGGMLGGGAAAAH

SEQ ID NO: 148384 - protein, 17 aa, Mycobacterium avium
PAAAPLVPLAQTAPAAP

SEQ ID NO: 148385 - protein, 19 aa, Mycobacterium avium
PAAGLAELALSRGAAVVEV

SEQ ID NO: 148386 - protein, 19 aa, Mycobacterium avium
PAAPWRRSPGKTAAVAGAA

SEQ ID NO: 148387 - protein, 28 aa, Mycobacterium avium
PAGGALGRLRPLFRTGLGTRLGSGRQYM

SEQ ID NO: 148388 - protein, 30 aa, Mycobacterium avium
PAGWGPWGPPPAWAPPPPPQPAWAPGAQMM

SEQ ID NO: 148389 - protein, 19 aa, Mycobacterium avium
PALGHAIPVSSISAAPEAA

SEQ ID NO: 148390 - protein, 19 aa, Mycobacterium avium
PAPADLPPAPPADATPPAP

SEQ ID NO: 148391 - protein, 21 aa, Mycobacterium avium
PAPRLFRLPADRALLNRMSFN

SEQ ID NO: 148392 - protein, 24 aa, Mycobacterium avium
PATVPAAAPVPPPPAPAAAAPATP

SEQ ID NO: 148393 - protein, 19 aa, Mycobacterium avium
PCRAANPKVKLPAGALCGK

SEQ ID NO: 148394 - protein, 18 aa, Mycobacterium avium
PCSARWPARRWSPSRSRT

SEQ ID NO: 148395 - protein, 18 aa, Mycobacterium avium
PDEPWHCRGVAFTPKHGG

SEQ ID NO: 148396 - protein, 25 aa, Mycobacterium avium
PDFTLSRPGALIAALPAVLGFVPES

SEQ ID NO: 148397 - protein, 18 aa, Mycobacterium avium
PDGDLYCRVPQDAPFNVR

SEQ ID NO: 148398 - protein, 20 aa, Mycobacterium avium
PDLMRAARDRPLAPGAGVLV

SEQ ID NO: 148399 - protein, 18 aa, Mycobacterium avium
PDNPMVGRPIPTNDPRGL

SEQ ID NO: 148400 - protein, 20 aa, Mycobacterium avium
PDRHLGGILYLFVRGMCGPD

SEQ ID NO: 148401 - protein, 23 aa, Mycobacterium avium
PDRHLGGILYLFVRGMCGPDTPV

SEQ ID NO: 148402 - protein, 24 aa, Mycobacterium avium
PDTEFGTRWFADKAFWVKDGQNYL

SEQ ID NO: 148403 - protein, 25 aa, Mycobacterium avium
PDTEFGTRWFADKAFWVKDGQNYLP

SEQ ID NO: 148404 - protein, 20 aa, Mycobacterium avium
PDVLNLLLVDFKGGATFLDY

SEQ ID NO: 148405 - protein, 24 aa, Mycobacterium avium
PDVPEPVLALIGKDLPPVSGPAPA

SEQ ID NO: 148406 - protein, 18 aa, Mycobacterium avium
PDWYAHLVEHQDVLTLDI

SEQ ID NO: 148407 - protein, 27 aa, Mycobacterium avium
PELPGVVVRPLLPLTERRLGIAVSASA

SEQ ID NO: 148408 - protein, 17 aa, Mycobacterium avium
PETLRSLYFLSSRVTGG

SEQ ID NO: 148409 - protein, 26 aa, Mycobacterium avium
PFAPPPSGPPPFAPPPPDAGPVPAPP

SEQ ID NO: 148410 - protein, 20 aa, Mycobacterium avium
PFNRRVALATFGIGALAPGV

SEQ ID NO: 148411 - protein, 18 aa, Mycobacterium avium
PFVVDRWTPDKVYSGAYK

SEQ ID NO: 148412 - protein, 22 aa, Mycobacterium avium
PGAAPFAPPYAVPPPGAGFGSK

SEQ ID NO: 148413 - protein, 25 aa, Mycobacterium avium
PGLGRKAPIYVIEDAPWSAFRDRDN

SEQ ID NO: 148414 - protein, 23 aa, Mycobacterium avium
PGPQVPLYLLGCEVKAMYPLGPI

SEQ ID NO: 148415 - protein, 26 aa, Mycobacterium avium
PGQPPPPLPLFTPSPSDWSPNFDIWP

SEQ ID NO: 148416 - protein, 24 aa, Mycobacterium avium
PGSVYPTLQLLADEGLITATETDG

SEQ ID NO: 148417 - protein, 22 aa, Mycobacterium avium
PGTTPAVWTGSPSPSGAGAAEA

SEQ ID NO: 148418 - protein, 20 aa, Mycobacterium avium
PGVWHAYADHRMAMAGAIVG

SEQ ID NO: 148419 - protein, 20 aa, Mycobacterium avium
PGYFRRSMHLLPKSGSRAPW

SEQ ID NO: 148420 - protein, 28 aa, Mycobacterium avium
PHHDPAAVGDWMLLAAIQALIDGHEYLA

SEQ ID NO: 148421 - protein, 18 aa, Mycobacterium avium
PHIAMTVAMLRQAGVDVD

SEQ ID NO: 148422 - protein, 18 aa, Mycobacterium avium
PHIPLGVLAPVLRPEFGG

SEQ ID NO: 148423 - protein, 22 aa, Mycobacterium avium
PHTSWLDVFAIGAVLPGSFVAR

SEQ ID NO: 148424 - protein, 17 aa, Mycobacterium avium
PIAVPRIPGLGGAAPGL

SEQ ID NO: 148425 - protein, 17 aa, Mycobacterium avium
PIHGCHVFTPILRDAAP

SEQ ID NO: 148426 - protein, 18 aa, Mycobacterium avium
PIHGCHVFTPILRDAAPS

SEQ ID NO: 148427 - protein, 20 aa, Mycobacterium avium
PKAALRRWMDRYASFVATKR

SEQ ID NO: 148428 - protein, 26 aa, Mycobacterium avium
PKGPAAPPVVPLPPGGPGGGPGAGTP

SEQ ID NO: 148429 - protein, 32 aa, Mycobacterium avium; identical to SEQ ID NO: 121639

SEQ ID NO: 148430 - protein, 19 aa, Mycobacterium avium
PKTALRRWMDRYANFVATK

SEQ ID NO: 148431 - protein, 23 aa, Mycobacterium avium
PKTGASLFEPYLAMVQASPSGTA

SEQ ID NO: 148432 - protein, 18 aa, Mycobacterium avium
PKVESLALVVDGNALAVS

SEQ ID NO: 148433 - protein, 18 aa, Mycobacterium avium
PLDRRRPLWEMWVIEGVA

SEQ ID NO: 148434 - protein, 19 aa, Mycobacterium avium
PLDRRRPLWEMWVIEGVAG

SEQ ID NO: 148435 - protein, 20 aa, Mycobacterium avium
PLGDVFVALKPPPGDHDAPL

SEQ ID NO: 148436 - protein, 21 aa, Mycobacterium avium
PLLAGDFVRWCRQVLDLLDQV

SEQ ID NO: 148437 - protein, 17 aa, Mycobacterium avium
PLLTALLAVTGCTTDTG

SEQ ID NO: 148438 - protein, 19 aa, Mycobacterium avium
PLPHPGDRPAPKPVTLPAG

SEQ ID NO: 148439 - protein, 18 aa, Mycobacterium avium
PLRATPVSPLPATNSRRI

SEQ ID NO: 148440 - protein, 30 aa, Mycobacterium avium; identical to SEQ ID NO: 121664

SEQ ID NO: 148441 - protein, 18 aa, Mycobacterium avium
PLSVFIFDILHCDGIDLL

SEQ ID NO: 148442 - protein, 30 aa, Mycobacterium avium
PLVAQIARLWNTIWDLKPGLKGEEIVKRFP

SEQ ID NO: 148443 - protein, 19 aa, Mycobacterium avium
PLVPLAQTAPAAPAGLPAQ

SEQ ID NO: 148444 - protein, 25 aa, Mycobacterium avium
PMIDMPHYLGYLTRRLTAAGSEIEE

SEQ ID NO: 148445 - protein, 26 aa, Mycobacterium avium
PNLATIPAALPRTPALSASPTGLGRI

SEQ ID NO: 148446 - protein, 28 aa, Mycobacterium avium
PNNANFTFPMEFTPFQGGWQLSRHTAET

SEQ ID NO: 148447 - protein, 20 aa, Mycobacterium avium
PNPYIYPENLPRVNARGGPG

SEQ ID NO: 148448 - protein, 17 aa, Mycobacterium avium
PNQLETRALLNCFKSDG

SEQ ID NO: 148449 - protein, 18 aa, Mycobacterium avium
PNRWQVRPGPVAARHWEV

SEQ ID NO: 148450 - protein, 18 aa, Mycobacterium avium
PPEVRLADLAPLLRAHLP

SEQ ID NO: 148451 - protein, 18 aa, Mycobacterium avium
PPHPHLVKLVARCANVEG

SEQ ID NO: 148452 - protein, 21 aa, Mycobacterium avium
PPLGENLFVGAAARPNELTYS

SEQ ID NO: 148453 - protein, 25 aa, Mycobacterium avium
PPPNAAPQLPGLPALSQLSPLIQQA

SEQ ID NO: 148454 - protein, 24 aa, Mycobacterium avium
PPRPAWDRPLPPPGGHWDYGPIDY

SEQ ID NO: 148455 - protein, 24 aa, Mycobacterium avium
PPTVDGFAISLKLDNGQYQLPYQG

SEQ ID NO: 148456 - protein, 25 aa, Mycobacterium avium
PPTVDGFAISLKLDNGQYQLPYQGT

SEQ ID NO: 148457 - protein, 33 aa, Mycobacterium avium
PPTVDGFAISLKLDNGQYQLPYQGTKSPTQVQA

SEQ ID NO: 148458 - protein, 34 aa, Mycobacterium avium
PPYKLLAVAVLLVLALILALIYGQFRGAFTEKTQ

SEQ ID NO: 148459 - protein, 26 aa, Mycobacterium avium
PPYKLLAVAVLLVLSLILALIYGQFR

SEQ ID NO: 148460 - protein, 25 aa, Mycobacterium avium
PQDIADAVLFMVTRDRRVAVNHMLV

SEQ ID NO: 148461 - protein, 17 aa, Mycobacterium avium
PQRASFTTLPWSKTIVA

SEQ ID NO: 148462 - protein, 18 aa, Mycobacterium avium
PQTSLFGTLSLWQGVDVP

SEQ ID NO: 148463 - protein, 17 aa, Mycobacterium avium
PRAMPMAVPLEPGQQTV

SEQ ID NO: 148464 - protein, 19 aa, Mycobacterium avium
PRATSLPCSARWPARRWSP

SEQ ID NO: 148465 - protein, 24 aa, Mycobacterium avium
PRAVMIRMPAFGLDGPWRDRVGFA

SEQ ID NO: 148466 - protein, 17 aa, Mycobacterium avium
PRGLMSHMVYADQPANP

SEQ ID NO: 148467 - protein, 23 aa, Mycobacterium avium
PRPAWDRPLPPPGGHWDYGPINY

SEQ ID NO: 148468 - protein, 17 aa, Mycobacterium avium
PRRGRPHDWPAWAEPEV

SEQ ID NO: 148469 - protein, 17 aa, Mycobacterium avium
PRRRPRCDVISLVPEAD

SEQ ID NO: 148470 - protein, 32 aa, Mycobacterium avium
PRTEPPRPLLPPPALPPPAPALPPPVPASPPP

SEQ ID NO: 148471 - protein, 19 aa, Mycobacterium avium
PRVAALPGPATALTGDGRG

SEQ ID NO: 148472 - protein, 22 aa, Mycobacterium avium
PSAAMGRDIPVAFLAGGPHAVY

SEQ ID NO: 148473 - protein, 23 aa, Mycobacterium avium
PSAAMGRDIPVAFLAGGPHAVYL

SEQ ID NO: 148474 - protein, 26 aa, Mycobacterium avium
PSDRYLGAPVSVVSPWYGAKSIDLCA

SEQ ID NO: 148475 - protein, 19 aa, Mycobacterium avium
PSLPPAIVEGLRRAYPIGE

SEQ ID NO: 148476 - protein, 20 aa, Mycobacterium avium
PSPWTARPFGDRLVGWDTYR

SEQ ID NO: 148477 - protein, 20 aa, Mycobacterium avium
PSRARLILHVDRHVSIPADA

SEQ ID NO: 148478 - protein, 26 aa, Mycobacterium avium
PSSMTPFPTMYELFSVGWGRPDLRSQ

SEQ ID NO: 148479 - protein, 20 aa, Mycobacterium avium
PSTHTLQWGGTSRTYHLYRP

SEQ ID NO: 148480 - protein, 22 aa, Mycobacterium avium
PSVMGSLPRLAAASGKTLGPRY

SEQ ID NO: 148481 - protein, 19 aa, Mycobacterium avium
PTAPPAMTTPAALALLEGA

SEQ ID NO: 148482 - protein, 31 aa, Mycobacterium avium
PTAPQALLPPPPLSARIPLPGGGALMKIPGE

SEQ ID NO: 148483 - protein, 41 aa, Mycobacterium avium
PVERTFEFLEWFLETVPITPIWLCPLRLRDHDGWPLYPMRP

SEQ ID NO: 148484 - protein, 23 aa, Mycobacterium avium
PVGTALHQPVWSYRGRALVAVTE

SEQ ID NO: 148485 - protein, 17 aa, Mycobacterium avium
PVRVTVLCPTFVKTNIL

SEQ ID NO: 148486 - protein, 24 aa, Mycobacterium avium
PVTAAAIVAWRQTNGRFTSVDQLA

SEQ ID NO: 148487 - protein, 20 aa, Mycobacterium avium
PVTCMLLGEDAIRKRGSVGK

SEQ ID NO: 148488 - protein, 19 aa, Mycobacterium avium
PVYFGYWAARGVDVTPFFA

SEQ ID NO: 148489 - protein, 18 aa, Mycobacterium avium
PWQDLRAAFTERGWLDLT

SEQ ID NO: 148490 - protein, 17 aa, Mycobacterium avium
PYQVLQPWVDAAFKKRG

SEQ ID NO: 148491 - protein, 22 aa, Mycobacterium avium
QARLRTLQKLGWIVVRVIAEDK

SEQ ID NO: 148492 - protein, 20 aa, Mycobacterium avium
QARRAALLNALFAAATETEQ

SEQ ID NO: 148493 - protein, 18 aa, Mycobacterium avium
QAVGGLGPSLRRLVDATQ

SEQ ID NO: 148494 - protein, 18 aa, Mycobacterium avium
QAYGLAYQQSLNAQAAGN

SEQ ID NO: 148495 - protein, 22 aa, Mycobacterium avium
QDIAVLQLRGAAGLPTATIGGE

SEQ ID NO: 148496 - protein, 17 aa, Mycobacterium avium
QDLLLPDDRQPAPGDQP

SEQ ID NO: 148497 - protein, 25 aa, Mycobacterium avium
QDPYHAYTFEHLPDNWTIEVSEVAP

SEQ ID NO: 148498 - protein, 17 aa, Mycobacterium avium
QDVLMWTSNVPSSAPGA

SEQ ID NO: 148499 - protein, 19 aa, Mycobacterium avium
QEPGVYPLLLVTYEIVCSK

SEQ ID NO: 148500 - protein, 18 aa, Mycobacterium avium
QEPRLSWAAGLRDDGTTT

SEQ ID NO: 148501 - protein, 17 aa, Mycobacterium avium
QFLPSTFAGYGQGGDIH

SEQ ID NO: 148502 - protein, 31 aa, Mycobacterium avium
QFTGNAPLGTCAFWPVPPTSKPHTISAPGLA

SEQ ID NO: 148503 - protein, 34 aa, Mycobacterium avium; identical to SEQ ID NO: 121833

SEQ ID NO: 148504 - protein, 25 aa, Mycobacterium avium
QGNDLVLDTLSFYKPTQAGSYPIVL

SEQ ID NO: 148505 - protein, 19 aa, Mycobacterium avium
QGTWERNGGLRFAPRADLA

SEQ ID NO: 148506 - protein, 21 aa, Mycobacterium avium
QIWAKGVELYPGWRKYEVRAG

SEQ ID NO: 148507 - protein, 23 aa, Mycobacterium avium
QLAAPFSLLRRALTYQDNNAGFG

SEQ ID NO: 148508 - protein, 17 aa, Mycobacterium avium
QLHQVNAPLPWSAQFTG

SEQ ID NO: 148509 - protein, 28 aa, Mycobacterium avium
QLHQVNAPLPWSAQFTGFGGEVFTVSAQ

SEQ ID NO: 148510 - protein, 17 aa, Mycobacterium avium
QLHQVNAPLPWSTQFTG

SEQ ID NO: 148511 - protein, 19 aa, Mycobacterium avium
QLIRHTAWFGAAVGFALTG

SEQ ID NO: 148512 - protein, 19 aa, Mycobacterium avium
QLSGYANWALANNSLLIVT

SEQ ID NO: 148513 - protein, 20 aa, Mycobacterium avium
QLSGYANWALANNSLLIVTF

SEQ ID NO: 148514 - protein, 21 aa, Mycobacterium avium
QLSGYANWALANNSLLIVTFD

SEQ ID NO: 148515 - protein, 20 aa, Mycobacterium avium
QLTALTPARNTLPAWRIEPP

SEQ ID NO: 148516 - protein, 23 aa, Mycobacterium avium
QLTALTPVRNTLPAWRIEPPAPA

SEQ ID NO: 148517 - protein, 18 aa, Mycobacterium avium
QLVLLTAVAVAAVVVLGW

SEQ ID NO: 148518 - protein, 24 aa, Mycobacterium avium
QNDDLVPYRTLVTTPPVGVMVGHL

SEQ ID NO: 148519 - protein, 30 aa, Mycobacterium avium
QNFSGRARMSSMLWTFKVQKDNGVSCPGGG

SEQ ID NO: 148520 - protein, 43 aa, Mycobacterium avium
QPGAFLSFPVTQWTRWRQPVIGMPTTPRFLGHGQLLVVTHLGQ

SEQ ID NO: 148521 - protein, 23 aa, Mycobacterium avium
QPLACDNGWWWDPGTNECRPPVV

SEQ ID NO: 148522 - protein, 24 aa, Mycobacterium avium
QPPPAPPRPADDLGYRPASREQPF

SEQ ID NO: 148523 - protein, 21 aa, Mycobacterium avium
QPVYFRYWASRGVDVTPFFAV

SEQ ID NO: 148524 - protein, 26 aa, Mycobacterium avium
QQAIRDLLHRIEALGDIGHDIMLIID

SEQ ID NO: 148525 - protein, 25 aa, Mycobacterium avium
QQHAQLALYQLAVAHGLLGAAGGDA

SEQ ID NO: 148526 - protein, 22 aa, Mycobacterium avium
QQILGPLQWKSTARPLAAIVRS

SEQ ID NO: 148527 - protein, 33 aa, Mycobacterium avium; identical to SEQ ID NO: 22666

SEQ ID NO: 148528 - protein, 17 aa, Mycobacterium avium
QQNWRLIAVLDMGWEDY

SEQ ID NO: 148529 - protein, 33 aa, Mycobacterium avium
QRCGSPAWNLPVVFGPIAITYNVAGLNSLNLDG

SEQ ID NO: 148530 - protein, 17 aa, Mycobacterium avium
QRHPPKTALRRWMDRYA

SEQ ID NO: 148531 - protein, 31 aa, Mycobacterium avium; identical to SEQ ID NO: 130758

SEQ ID NO: 148532 - protein, 33 aa, Mycobacterium avium; identical to SEQ ID NO: 121911

SEQ ID NO: 148533 - protein, 24 aa, Mycobacterium avium
QSGSIGLGFAIPVDQAKRIADELI

SEQ ID NO: 148534 - protein, 25 aa, Mycobacterium avium
QSPKESWLRVVLTQAGLPPPQTQIR

SEQ ID NO: 148535 - protein, 27 aa, Mycobacterium avium
QTDGLPEGPLPLGTPVTGRLYFDVRNG

SEQ ID NO: 148536 - protein, 27 aa, Mycobacterium avium
QTNSLKLYDVPATPPPIFVAAGGPKSA

SEQ ID NO: 148537 - protein, 22 aa, Mycobacterium avium
QTVPGMITGFVPLVLKASPGSS

SEQ ID NO: 148538 - protein, 22 aa, Mycobacterium avium
QTWQDDVFPPVAGIYRDDRRNV

SEQ ID NO: 148539 - protein, 23 aa, Mycobacterium avium
QTWQDDVFPPVAGIYRDDRRNVF

SEQ ID NO: 148540 - protein, 19 aa, Mycobacterium avium
QVCLPFYGALVTNCGLDRS

SEQ ID NO: 148541 - protein, 22 aa, Mycobacterium avium
QVNAPLPWSTQFTGFGGEVFTV

SEQ ID NO: 148542 - protein, 26 aa, Mycobacterium avium
QVNNAPLPWSTTISTTLPSVSANIMA

SEQ ID NO: 148543 - protein, 19 aa, Mycobacterium avium
QVVDRVQWFAVRPDPQSAG

SEQ ID NO: 148544 - protein, 19 aa, Mycobacterium avium
QWGGTSRTYHLYRPQGLSE

SEQ ID NO: 148545 - protein, 31 aa, Mycobacterium avium
RAADRAFAAVPAALLRWGVDQFDADQRPYQV

SEQ ID NO: 148546 - protein, 18 aa, Mycobacterium avium
RAAFTERGWLDLTHTRRE

SEQ ID NO: 148547 - protein, 20 aa, Mycobacterium avium
RAMFEPLLAGLRDLGCMSLT

SEQ ID NO: 148548 - protein, 23 aa, Mycobacterium avium
RAMGPMQFIPETWRLYAVDAHND

SEQ ID NO: 148549 - protein, 18 aa, Mycobacterium avium
RAQAQVVAWWSPAYHEPN

SEQ ID NO: 148550 - protein, 19 aa, Mycobacterium avium
RASARLLGPLASYLVVNVS

SEQ ID NO: 148551 - protein, 28 aa, Mycobacterium avium
RASQLAGRPLSLYTLPISGFGKDPNGSD

SEQ ID NO: 148552 - protein, 24 aa, Mycobacterium avium
RAVVGVTRLLGGLALAAIAAVAPR

SEQ ID NO: 148553 - protein, 20 aa, Mycobacterium avium
RAWGRRLLVGAAAAVTLPGL

SEQ ID NO: 148554 - protein, 33 aa, Mycobacterium avium
RAYQDAESAGYWWPNRDFVMVCDTPAVLHVEAA

SEQ ID NO: 148555 - protein, 19 aa, Mycobacterium avium
RDCVYYTTLVMWVGCHADS

SEQ ID NO: 148556 - protein, 23 aa, Mycobacterium avium
RDTDLMIGALRTLGLRVDGTGPA

SEQ ID NO: 148557 - protein, 23 aa, Mycobacterium avium
RDTDLMIGALRTLGLRVDGTGPE

SEQ ID NO: 148558 - protein, 25 aa, Mycobacterium avium
REIAPFMSYGQFTGNAPLGTCAFWP

SEQ ID NO: 148559 - protein, 23 aa, Mycobacterium avium
REITMPVLSPGSTPLRVLHISDL

SEQ ID NO: 148560 - protein, 20 aa, Mycobacterium avium
REWQDRFRRWANDNSRIIPR

SEQ ID NO: 148561 - protein, 18 aa, Mycobacterium avium
RFIDAFAALLREATEIPS

SEQ ID NO: 148562 - protein, 18 aa, Mycobacterium avium
RFLVRNPGKLHTSVAKLG

SEQ ID NO: 148563 - protein, 18 aa, Mycobacterium avium
RGDPALAGELWLDGADTT

SEQ ID NO: 148564 - protein, 18 aa, Mycobacterium avium
RGEPLPWQDLRAAFTERG

SEQ ID NO: 148565 - protein, 17 aa, Mycobacterium avium
RGGPPPPPPGPPGPPPP

SEQ ID NO: 148566 - protein, 18 aa, Mycobacterium avium
RGGPPPPPPGPPGPPPPG

SEQ ID NO: 148567 - protein, 25 aa, Mycobacterium avium
RGHLNYVWDMNVCHTWYVVPDGWGN

SEQ ID NO: 148568 - protein, 30 aa, Mycobacterium avium
RGHLNYVWDMNVCHTWYVVPDGWGNVPRIA

SEQ ID NO: 148569 - protein, 25 aa, Mycobacterium avium
RGNLEQLLVLLPHGAAAIQAVGVAN

SEQ ID NO: 148570 - protein, 18 aa, Mycobacterium avium
RHHRLRGHPGQRGPAGAA

SEQ ID NO: 148571 - protein, 18 aa, Mycobacterium avium
RIAFRALTLAGVHGVELM

SEQ ID NO: 148572 - protein, 29 aa, Mycobacterium avium
RIKLSDKPMPLFQLLVLCMLASKPIDAAI

SEQ ID NO: 148573 - protein, 23 aa, Mycobacterium avium
RILQLPLSRRLATLPLSATPSGV

SEQ ID NO: 148574 - protein, 26 aa, Mycobacterium avium
RIPFADVPWETGIFDPLGGSLRIRRA

SEQ ID NO: 148575 - protein, 33 aa, Mycobacterium avium
RIVTQWPYTELDYARWTWRLRRRDWIHHRCAPG

SEQ ID NO: 148576 - protein, 34 aa, Mycobacterium avium
RIVTQWPYTELDYARWTWRLRRRDWIHHRCVPSA

SEQ ID NO: 148577 - protein, 21 aa, Mycobacterium avium
RKAILGLLDVDLLAAVGAGSD

SEQ ID NO: 148578 - protein, 25 aa, Mycobacterium avium
RLAALAAVVLVGLILAGAAVLVRNT

SEQ ID NO: 148579 - protein, 24 aa, Mycobacterium avium
RLAALAAVVLVGLILAGTAVLVRN

SEQ ID NO: 148580 - protein, 24 aa, Mycobacterium avium
RLAALAAVVLVGLIVAGAAVLVRN

SEQ ID NO: 148581 - protein, 17 aa, Mycobacterium avium
RLFAGFDEDGGQRPALA

SEQ ID NO: 148582 - protein, 19 aa, Mycobacterium avium
RLHVRYDLSWQALDGALAR

SEQ ID NO: 148583 - protein, 19 aa, Mycobacterium avium
RLRRHGPVTVYGVDKFPRM

SEQ ID NO: 148584 - protein, 31 aa, Mycobacterium avium
RLSRPHDWARDYWIPFDRFRRLDGVRTVQAT

SEQ ID NO: 148585 - protein, 34 aa, Mycobacterium avium
RLTMHDYIWRWDTDWFWCSRAFGVQNPRVRRWWP

SEQ ID NO: 148586 - protein, 18 aa, Mycobacterium avium
RMVAVNVQGVLYATRAAL

SEQ ID NO: 148587 - protein, 20 aa, Mycobacterium avium
RMWRRRPTDPDFCVVRVGMG

SEQ ID NO: 148588 - protein, 25 aa, Mycobacterium avium
RPDWTRTVLARRIAAGALVVLAAIA

SEQ ID NO: 148589 - protein, 25 aa, Mycobacterium avium
RPDWTRTVLARRVAAGALVVLAAIA

SEQ ID NO: 148590 - protein, 26 aa, Mycobacterium avium
RPGLTAARFVANPFGAEPGSRLYRSG

SEQ ID NO: 148591 - protein, 23 aa, Mycobacterium avium
RPPDWDQWWEWGPVFLCSNNNKR

SEQ ID NO: 148592 - protein, 23 aa, Mycobacterium avium
RPRDLKLRVISWGAAPAPDALLR

SEQ ID NO: 148593 - protein, 24 aa, Mycobacterium avium
RPRNEHVFYHLGVAKAVAAAVADR

SEQ ID NO: 148594 - protein, 18 aa, Mycobacterium avium
RPRRRRRSGCRAACPGER

SEQ ID NO: 148595 - protein, 20 aa, Mycobacterium avium
RPVDRRLERLGTHRRRLLTV

SEQ ID NO: 148596 - protein, 21 aa, Mycobacterium avium
RPWDGPPRDVAVARADFGPFS

SEQ ID NO: 148597 - protein, 19 aa, Mycobacterium avium
RQCNVTALPPYLESAYQEF

SEQ ID NO: 148598 - protein, 18 aa, Mycobacterium avium
RQLEEGCFDLMFFDDRLA

SEQ ID NO: 148599 - protein, 18 aa, Mycobacterium avium
RRALVVALAAMLTSCTWR

SEQ ID NO: 148600 - protein, 23 aa, Mycobacterium avium
RRAVLFVGVAAVGAVALPVAAAH

SEQ ID NO: 148601 - protein, 29 aa, Mycobacterium avium
RRDRNPLALIAKPLLGAALAAAVATAWPA

SEQ ID NO: 148602 - protein, 22 aa, Mycobacterium avium
RRGETYYILLAGTAADFCSDLN

SEQ ID NO: 148603 - protein, 21 aa, Mycobacterium avium
RRPLGAALRIAFRALTLAGVH

SEQ ID NO: 148604 - protein, 20 aa, Mycobacterium avium
RRRVTLVGDAGYCPGPAVGG

SEQ ID NO: 148605 - protein, 26 aa, Mycobacterium avium
RSDSDMFTLGFRFKPWRSAKSIADGA

SEQ ID NO: 148606 - protein, 17 aa, Mycobacterium avium
RSHLHIEIVPGLAPTNA

SEQ ID NO: 148607 - protein, 28 aa, Mycobacterium avium
RSLAGGALLLVVLPGGGGLVSGCSTVIG

SEQ ID NO: 148608 - protein, 42 aa, Mycobacterium avium; identical to SEQ ID NO: 131682

SEQ ID NO: 148609 - protein, 24 aa, Mycobacterium avium
RTHGRTWDLLRLTRMPTVQVDVGY

SEQ ID NO: 148610 - protein, 17 aa, Mycobacterium avium
RTSSGSALILHQNANNL

SEQ ID NO: 148611 - protein, 19 aa, Mycobacterium avium
RTWPDKRIDLYFPGETALS

SEQ ID NO: 148612 - protein, 20 aa, Mycobacterium avium
RTYHLYRPQGLSEAAPLVVM

SEQ ID NO: 148613 - protein, 18 aa, Mycobacterium avium
RVDRPIRVTGWPPKGTDR

SEQ ID NO: 148614 - protein, 20 aa, Mycobacterium avium
RVGQPVVAIGSPLGLSGTVT

SEQ ID NO: 148615 - protein, 19 aa, Mycobacterium avium
RVIARRDAFERLLQRRVQV

SEQ ID NO: 148616 - protein, 31 aa, Mycobacterium avium
RVLAFVGANLMKFGPLLGELLARAALSGDIP

SEQ ID NO: 148617 - protein, 18 aa, Mycobacterium avium
RVLTELPPLIRHFADTRE

SEQ ID NO: 148618 - protein, 17 aa, Mycobacterium avium
RVQFYCLDFGGGALSSL

SEQ ID NO: 148619 - protein, 27 aa, Mycobacterium avium
RVVGAATALGVLALGAGLPGCSGKDGH

SEQ ID NO: 148620 - protein, 23 aa, Mycobacterium avium
RVVLARTGLVFSPAGGALGRLRP

SEQ ID NO: 148621 - protein, 24 aa, Mycobacterium avium
RVVLARTGLVFSPAGGALGRLRPL

SEQ ID NO: 148622 - protein, 20 aa, Mycobacterium avium
RWKAIAFSTFQYQLSRKAPA

SEQ ID NO: 148623 - protein, 19 aa, Mycobacterium avium
RWMDRYASFVATKRGMAES

SEQ ID NO: 148624 - protein, 19 aa, Mycobacterium avium
RWMDRYATFVATKRGMAES

SEQ ID NO: 148625 - protein, 17 aa, Mycobacterium avium
RYGFAGVGVLIPRFSGD

SEQ ID NO: 148626 - protein, 21 aa, Mycobacterium avium
RYGNVFTLRLPMWGPVVMVSD

SEQ ID NO: 148627 - protein, 23 aa, Mycobacterium avium
SAAKFTYLSAAHYCPKYITGEDR

SEQ ID NO: 148628 - protein, 21 aa, Mycobacterium avium
SAAMGRDIPVAFLAGGPHAVY

SEQ ID NO: 148629 - protein, 18 aa, Mycobacterium avium
SAGHGLLARGLLGSVSSA

SEQ ID NO: 148630 - protein, 18 aa, Mycobacterium avium
SAGLVPPIDQWSGSTFSN

SEQ ID NO: 148631 - protein, 22 aa, Mycobacterium avium
SAIYVYAPDLIPKIKDQASKAN

SEQ ID NO: 148632 - protein, 30 aa, Mycobacterium avium
SARTKLNWWESRALYGWTVLVPRTKDQAGE

SEQ ID NO: 148633 - protein, 25 aa, Mycobacterium avium
SASTRAMPAPTPFPAPVTIATCPSS

SEQ ID NO: 148634 - protein, 27 aa, Mycobacterium avium
SAVAVGWPDLMRAARDRPLAPGAGVLV

SEQ ID NO: 148635 - protein, 21 aa, Mycobacterium avium
SAYLFSHPDVNAYFTSLKGQP

SEQ ID NO: 148636 - protein, 25 aa, Mycobacterium avium
SDWSPNFDIWPYNTFTSRVTPEMIS

SEQ ID NO: 148637 - protein, 17 aa, Mycobacterium avium
SELTLWSSAPPQTPWPA

SEQ ID NO: 148638 - protein, 22 aa, Mycobacterium avium
SFAAFAAIIAVAFAYIASFHID

SEQ ID NO: 148639 - protein, 20 aa, Mycobacterium avium
SFTALFHPDLETLTAELPVV

SEQ ID NO: 148640 - protein, 18 aa, Mycobacterium avium
SFTTLPWSKTIVAEMPGI

SEQ ID NO: 148641 - protein, 22 aa, Mycobacterium avium
SGAALFRRQLRYVRAHFNVLAL

SEQ ID NO: 148642 - protein, 23 aa, Mycobacterium avium
SGAALFRRQLRYVRAHFNVLALE

SEQ ID NO: 148643 - protein, 23 aa, Mycobacterium avium
SGDGWHRLPDEPLDPHYGEPLDE

SEQ ID NO: 148644 - protein, 24 aa, Mycobacterium avium
SGGNNLLFRRNSLTGAVEVVARGG

SEQ ID NO: 148645 - protein, 27 aa, Mycobacterium avium
SGIEILNQWWHNPAYQAIMRDCSNTAI

SEQ ID NO: 148646 - protein, 24 aa, Mycobacterium avium
SGIQLDPAVWPYIGAKAGGLPGDL

SEQ ID NO: 148647 - protein, 25 aa, Mycobacterium avium
SGIQLDPAVWPYIGAKAGGLPGDLT

SEQ ID NO: 148648 - protein, 22 aa, Mycobacterium avium
SGLGLLLNPVATIPVLASLVGG

SEQ ID NO: 148649 - protein, 25 aa, Mycobacterium avium
SGLRTLLVIGTFLGGGVATAIPARA

SEQ ID NO: 148650 - protein, 28 aa, Mycobacterium avium
SGPFFKAIVANLLPYQVLQPWVDAAFKK

SEQ ID NO: 148651 - protein, 19 aa, Mycobacterium avium
SHTEKWIDLQPGQCVADLP

SEQ ID NO: 148652 - protein, 20 aa, Mycobacterium avium
SIRATHYALTGPLGEMSVID

SEQ ID NO: 148653 - protein, 33 aa, Mycobacterium avium
SKTIDWALHDGLGSYFWQHNWGSPKGFTHPAAH

SEQ ID NO: 148654 - protein, 24 aa, Mycobacterium avium
SLAHHPLVQVLLAWQNFTGLDDAS

SEQ ID NO: 148655 - protein, 18 aa, Mycobacterium avium
SLATVRCLPAAAAALTRL

SEQ ID NO: 148656 - protein, 19 aa, Mycobacterium avium
SLAVNLPGPLAAARLAELG

SEQ ID NO: 148657 - protein, 33 aa, Mycobacterium avium
SLDLTALKDIALYLNFDMLASPNPGYFTYDGDQ

SEQ ID NO: 148658 - protein, 33 aa, Mycobacterium avium
SLDLTALKNIALYLNFDMLASPNPGYFTYDGDQ

SEQ ID NO: 148659 - protein, 19 aa, Mycobacterium avium
SLGLLDDFPPYDSVFDPVN

SEQ ID NO: 148660 - protein, 19 aa, Mycobacterium avium
SLLKKFAPEAVLDRGIRKT

SEQ ID NO: 148661 - protein, 20 aa, Mycobacterium avium
SLLKKFAPEAVLDRGIRKTN

SEQ ID NO: 148662 - protein, 19 aa, Mycobacterium avium
SLNAVFSNALNLPMNAKVK

SEQ ID NO: 148663 - protein, 19 aa, Mycobacterium avium
SLQEWCGYLGSLVGREPVF

SEQ ID NO: 148664 - protein, 27 aa, Mycobacterium avium
SLSASYTTPWPLLGAYSVTKSALDKLV

SEQ ID NO: 148665 - protein, 17 aa, Mycobacterium avium
SLSFKLYTADRTAGALN

SEQ ID NO: 148666 - protein, 19 aa, Mycobacterium avium
SNAMFFPEPRCRVLTGVGT

SEQ ID NO: 148667 - protein, 21 aa, Mycobacterium avium
SNFQTLLQNASWVGPTLADLV

SEQ ID NO: 148668 - protein, 21 aa, Mycobacterium avium
SNRVILNFIPTTNLANIAGAR

SEQ ID NO: 148669 - protein, 19 aa, Mycobacterium avium
SPALWLSSGAAAPGAFDGP

SEQ ID NO: 148670 - protein, 29 aa, Mycobacterium avium
SPDSRARTWPTWPAPRSRPAWARPATAPW

SEQ ID NO: 148671 - protein, 29 aa, Mycobacterium avium
SPVNAAISALVLPSAFRPVPDPNTPTGSR

SEQ ID NO: 148672 - protein, 27 aa, Mycobacterium avium
SQSPKESWLRVVLTRAGLPPPQTQIRV

SEQ ID NO: 148673 - protein, 29 aa, Mycobacterium avium
SRDALDRALIDLATYFRDALMASSGAGAV

SEQ ID NO: 148674 - protein, 24 aa, Mycobacterium avium
SRDTDLMIGALRTLGLRVDGTGPE

SEQ ID NO: 148675 - protein, 32 aa, Mycobacterium avium
SRGHLNYVWDINVCHTWYVVPDGWGNVPRIAL

SEQ ID NO: 148676 - protein, 26 aa, Mycobacterium avium
SRLASGLFAWRRALVLSAAAALVATL

SEQ ID NO: 148677 - protein, 21 aa, Mycobacterium avium
SRPQIQVGMPFCKIGAVTGET

SEQ ID NO: 148678 - protein, 17 aa, Mycobacterium avium
SRRLGLGRAVRQRTVGR

SEQ ID NO: 148679 - protein, 21 aa, Mycobacterium avium
SRVAFLGWSMGGYGALLLGGR

SEQ ID NO: 148680 - protein, 24 aa, Mycobacterium avium
SSMTPFPTMYELFSVGWGRPDLRS

SEQ ID NO: 148681 - protein, 24 aa, Mycobacterium avium
SSPDRVDGWLRRWLQRDKAAGAPS

SEQ ID NO: 148682 - protein, 22 aa, Mycobacterium avium
STPTTMYPPVPYPEALATNLED

SEQ ID NO: 148683 - protein, 23 aa, Mycobacterium avium
STPTTMYPPVPYPEALATNLEDE

SEQ ID NO: 148684 - protein, 20 aa, Mycobacterium avium
STVLPILQDTTIVAAGPSVQ

SEQ ID NO: 148685 - protein, 25 aa, Mycobacterium avium
SVAWSDGWGLYTWHGTSVPRDLIET

SEQ ID NO: 148686 - protein, 19 aa, Mycobacterium avium
SVLALAAGVAVGTRLSPRA

SEQ ID NO: 148687 - protein, 18 aa, Mycobacterium avium
SVLRILRTDIYAPTGAVM

SEQ ID NO: 148688 - protein, 19 aa, Mycobacterium avium
SVPLPQPVPGIASILPANG

SEQ ID NO: 148689 - protein, 24 aa, Mycobacterium avium
SVQTSQVFPVWLLSRDPDAEVIVK

SEQ ID NO: 148690 - protein, 24 aa, Mycobacterium avium
SVRRRQWQLFRPGQRRRTTQPVAG

SEQ ID NO: 148691 - protein, 18 aa, Mycobacterium avium
SVVLFGMPNVRAMNFLNE

SEQ ID NO: 148692 - protein, 25 aa, Mycobacterium avium
SVVPRSWSGFFRPGPAVVVSPANFG

SEQ ID NO: 148693 - protein, 25 aa, Mycobacterium avium
SVVPRSWSGFFRPGPAVVVSPDNFG

SEQ ID NO: 148694 - protein, 20 aa, Mycobacterium avium
SYLVYNFGPGHPAPMLNAGG

SEQ ID NO: 148695 - protein, 17 aa, Mycobacterium avium
TAADLRTSSGSALILHQ

SEQ ID NO: 148696 - protein, 17 aa, Mycobacterium avium
TAAQFWASIHGFVMLEL

SEQ ID NO: 148697 - protein, 25 aa, Mycobacterium avium
TAGSWNTPWSALTPARQAAVIVAAR

SEQ ID NO: 148698 - protein, 20 aa, Mycobacterium avium
TALGRIIISHALPNGAMSLG

SEQ ID NO: 148699 - protein, 19 aa, Mycobacterium avium
TAPAPAAAPLVPLAQTAPA

SEQ ID NO: 148700 - protein, 26 aa, Mycobacterium avium
TAQNPIYTSIYYLDHEPAIFADYSRN

SEQ ID NO: 148701 - protein, 17 aa, Mycobacterium avium
TAQRDTNLALLPVGYAD

SEQ ID NO: 148702 - protein, 24 aa, Mycobacterium avium
TARIREHSVWWPVAATPEDMAAAM

SEQ ID NO: 148703 - protein, 18 aa, Mycobacterium avium
TAWALPLLGRMWKGYARR

SEQ ID NO: 148704 - protein, 17 aa, Mycobacterium avium
TCWPSTPGSLLCVDNPW

SEQ ID NO: 148705 - protein, 19 aa, Mycobacterium avium
TEAVQLIRQLWSGLRISFT

SEQ ID NO: 148706 - protein, 26 aa, Mycobacterium avium
TEHSPARLRMHQRWPIVMVDEFQDTD

SEQ ID NO: 148707 - protein, 41 aa, Mycobacterium avium; identical to SEQ ID NO: 132549

SEQ ID NO: 148708 - protein, 24 aa, Mycobacterium avium
TERTLAAVSLLLNGGGLGQVQDIT

SEQ ID NO: 148709 - protein, 24 aa, Mycobacterium avium
TGDGRGTVYLATRGGYFVLDLATG

SEQ ID NO: 148710 - protein, 30 aa, Mycobacterium avium
TGESLPLASIFKLYVLHALAGAVTAGRVSW

SEQ ID NO: 148711 - protein, 22 aa, Mycobacterium avium
TGLGFSAPYNMEQFVSGIIGAE

SEQ ID NO: 148712 - protein, 21 aa, Mycobacterium avium
TGLSTTLAWFAERAGRTGESA

SEQ ID NO: 148713 - protein, 21 aa, Mycobacterium avium
TGTFTFAELLAHELSVERTSQ

SEQ ID NO: 148714 - protein, 27 aa, Mycobacterium avium
TGTVGYRFTWHLPKNRTWTYDGQLKMA

SEQ ID NO: 148715 - protein, 24 aa, Mycobacterium avium
THAAAITALILPAAVSSPATAAAE

SEQ ID NO: 148716 - protein, 17 aa, Mycobacterium avium
THNIAVDSAWHTWRCQW

SEQ ID NO: 148717 - protein, 19 aa, Mycobacterium avium
TIYREPLSLRPFDYLPRPV

SEQ ID NO: 148718 - protein, 23 aa, Mycobacterium avium
TKDPAVVFVPQPTRGRVVVVDLQ

SEQ ID NO: 148719 - protein, 23 aa, Mycobacterium avium
TKHPAAVRQVLAWMGSRQGNEYL

SEQ ID NO: 148720 - protein, 29 aa, Mycobacterium avium
TLAADGSILDTWFPAPELTGPGTSGTSRL

SEQ ID NO: 148721 - protein, 19 aa, Mycobacterium avium
TLEGQRILRQLLANSDVLV

SEQ ID NO: 148722 - protein, 26 aa, Mycobacterium avium
TLPMPLPTLFNRWYGPFPPIREVRGQ

SEQ ID NO: 148723 - protein, 19 aa, Mycobacterium avium
TLRSLYFLSSRVTGGSPHA

SEQ ID NO: 148724 - protein, 32 aa, Mycobacterium avium
TLVTDLASGWIPPHLRLPAHVTLLEPAARRHD

SEQ ID NO: 148725 - protein, 19 aa, Mycobacterium avium
TLWSHPVLAGRDRWREVRA

SEQ ID NO: 148726 - protein, 26 aa, Mycobacterium avium
TNGLASLPLPAPGLGSGGYSLNAVFS

SEQ ID NO: 148727 - protein, 26 aa, Mycobacterium avium
TPAHTSSRWPTTAPTPRWCSAATRRA

SEQ ID NO: 148728 - protein, 24 aa, Mycobacterium avium
TPDHKFAVAAAPHQTFQFAVDVPG

SEQ ID NO: 148729 - protein, 31 aa, Mycobacterium avium
TPEGGLVKAAWIDTWRLPAAPPGTVKIVVGV

SEQ ID NO: 148730 - protein, 19 aa, Mycobacterium avium
TPKTSLTMLASRAGLVMDP

SEQ ID NO: 148731 - protein, 24 aa, Mycobacterium avium
TQPALDLDALLGGLRPVLKGLDAD

SEQ ID NO: 148732 - protein, 27 aa, Mycobacterium avium
TRKPIFGIAMITPLVFAGAVSATGPSL

SEQ ID NO: 148733 - protein, 23 aa, Mycobacterium avium
TRNRGREMLAFATAYREAGVQPP

SEQ ID NO: 148734 - protein, 22 aa, Mycobacterium avium
TRRKGLWTTLAITTVSGASAVA

SEQ ID NO: 148735 - protein, 24 aa, Mycobacterium avium
TSGLGLLLNPVATIPVLASLVGGI

SEQ ID NO: 148736 - protein, 22 aa, Mycobacterium avium
TSGLRPASYFALAEAHGRLGHP

SEQ ID NO: 148737 - protein, 22 aa, Mycobacterium avium
TSMTEVLVPHHPGDTIAVHFRS

SEQ ID NO: 148738 - protein, 26 aa, Mycobacterium avium
TSSYGRGFLTPRDSLRQRCVAHRLTI

SEQ ID NO: 148739 - protein, 20 aa, Mycobacterium avium
TTGFLPPAQRRSAALEDYPP

SEQ ID NO: 148740 - protein, 18 aa, Mycobacterium avium
TTGIPVAAAPKVIWGLAA

SEQ ID NO: 148741 - protein, 28 aa, Mycobacterium avium
TTNPKVTGSWFWVDGQNVHWRPEHYYAP

SEQ ID NO: 148742 - protein, 28 aa, Mycobacterium avium
TTSTDPLSEIWFLLTGQTSLPTNLGTLV

SEQ ID NO: 148743 - protein, 19 aa, Mycobacterium avium
TTVAYDKLLLATGSAARRP

SEQ ID NO: 148744 - protein, 25 aa, Mycobacterium avium
TVAQMLERIVALMPLGAAVVDAHRD

SEQ ID NO: 148745 - protein, 25 aa, Mycobacterium avium
TVAQMLERIVALMPLGAAVVDAHRG

SEQ ID NO: 148746 - protein, 28 aa, Mycobacterium avium
TVKNPDPLVLLFDPLPNTGIVVIQGSPR

SEQ ID NO: 148747 - protein, 25 aa, Mycobacterium avium
TVRLAAVGAPLPQDPPPAQPVAGAN

SEQ ID NO: 148748 - protein, 29 aa, Mycobacterium avium
TVSLRGYVAAMKYAIPRMLDRGGGAIVNM

SEQ ID NO: 148749 - protein, 17 aa, Mycobacterium avium
TVTAAPLPPGSHSEKWI

SEQ ID NO: 148750 - protein, 24 aa, Mycobacterium avium
TVTVKTVTNGVLTPGLHGLHVHEI

SEQ ID NO: 148751 - protein, 20 aa, Mycobacterium avium
TVVRFVPNRYWPAHGHVSVG

SEQ ID NO: 148752 - protein, 17 aa, Mycobacterium avium
TVVYFQVTVPQAAVYEI

SEQ ID NO: 148753 - protein, 18 aa, Mycobacterium avium
TWPDKRIDLYFPGETALR

SEQ ID NO: 148754 - protein, 17 aa, Mycobacterium avium
TYFEPYNDWPYGGPRPL

SEQ ID NO: 148755 - protein, 18 aa, Mycobacterium avium
TYHLYRPQGLSEAAPLVV

SEQ ID NO: 148756 - protein, 32 aa, Mycobacterium avium
TYIHPEDRFMLKDPIHGLGPRLAQLAAGAFFR

SEQ ID NO: 148757 - protein, 33 aa, Mycobacterium avium
TYIHPEDRFMLKDPIYGLGPRLAQLAAGAFFRE

SEQ ID NO: 148758 - protein, 20 aa, Mycobacterium avium
TYPFVVDRWTPDKVYSGAYK

SEQ ID NO: 148759 - protein, 24 aa, Mycobacterium avium
VAALAAHAPPERLLRCIEAVLECR

SEQ ID NO: 148760 - protein, 19 aa, Mycobacterium avium
VAAREFVAFWLDADDRVLA

SEQ ID NO: 148761 - protein, 20 aa, Mycobacterium avium
VAAVTAAIAPLAACANQQSS

SEQ ID NO: 148762 - protein, 30 aa, Mycobacterium avium
VAEIYDAFTYMLLLTIEDLGFSPKGEGGAF

SEQ ID NO: 148763 - protein, 26 aa, Mycobacterium avium
VAELDRAWRHLPFAAQWHSDNELARH

SEQ ID NO: 148764 - protein, 17 aa, Mycobacterium avium
VAEVTRERQGWGAWPVC

SEQ ID NO: 148765 - protein, 19 aa, Mycobacterium avium
VAMTLLAYAYHDNSAIYGE

SEQ ID NO: 148766 - protein, 17 aa, Mycobacterium avium
VAQAFASLAILNPGRVF

SEQ ID NO: 148767 - protein, 28 aa, Mycobacterium avium
VAQIARLWNTIWDLKPGLKGEEILKRFP

SEQ ID NO: 148768 - protein, 28 aa, Mycobacterium avium
VAQIARLWNTIWDLKPGLKGEEIVKRFP

SEQ ID NO: 148769 - protein, 27 aa, Mycobacterium avium
VARCSLALTLLAPQWFTAARADPPAPE

SEQ ID NO: 148770 - protein, 23 aa, Mycobacterium avium
VATLAMIRFPATGDKIGSLVINP

SEQ ID NO: 148771 - protein, 34 aa, Mycobacterium avium
VATVPLPAVLANRARLLVLIATNFFGQNTAAIAQ

SEQ ID NO: 148772 - protein, 26 aa, Mycobacterium avium
VAVDMLEMLPTPWGLVRSGVAPDHPK

SEQ ID NO: 148773 - protein, 24 aa, Mycobacterium avium
VCWLAIVVCCLAAAGLAATGARTG

SEQ ID NO: 148774 - protein, 31 aa, Mycobacterium avium; identical to SEQ ID NO: 122924

SEQ ID NO: 148775 - protein, 17 aa, Mycobacterium avium
VDKFVVDEPLRAVFTAR

SEQ ID NO: 148776 - protein, 18 aa, Mycobacterium avium
VDKFVVDEPLRAVFTARG

SEQ ID NO: 148777 - protein, 27 aa, Mycobacterium avium
VDKIMLGSLPDIGFPGDIGLHGPHHYN

SEQ ID NO: 148778 - protein, 25 aa, Mycobacterium avium
VDNALKLLLLLGEQPEIRLSEATRY

SEQ ID NO: 148779 - protein, 34 aa, Mycobacterium avium
VEAGPNQVLSPGFHGLQIHAVGKCEANSTAPTGG

SEQ ID NO: 148780 - protein, 41 aa, Mycobacterium avium
VEAMLHSDYPLQALLYSAVLHRFLRWRLAGYEPDRHLGGIL

SEQ ID NO: 148781 - protein, 17 aa, Mycobacterium avium
VEAVVLLSGYRVMPQWV

SEQ ID NO: 148782 - protein, 20 aa, Mycobacterium avium
VEVLPGIQEINAGWYNGKSE

SEQ ID NO: 148783 - protein, 20 aa, Mycobacterium avium
VFHIHLHVLPRRNGDKLSVA

SEQ ID NO: 148784 - protein, 17 aa, Mycobacterium avium
VFTPILRDAAPSAAPRG

SEQ ID NO: 148785 - protein, 17 aa, Mycobacterium avium
VGACRPFDRDRTGFVFG

SEQ ID NO: 148786 - protein, 19 aa, Mycobacterium avium
VGCWASVPTTVTAAPLPPG

SEQ ID NO: 148787 - protein, 23 aa, Mycobacterium avium
VGEYLGLRPRWIDSTAVGGASWE

SEQ ID NO: 148788 - protein, 22 aa, Mycobacterium avium
VGGRSFDVYPVNYPASDQWDTG

SEQ ID NO: 148789 - protein, 21 aa, Mycobacterium avium
VGGRSFDVYPVNYPATDQWDT

SEQ ID NO: 148790 - protein, 27 aa, Mycobacterium avium
VGLMIFPVLKLHEKWLGVGRYTVTVQL

SEQ ID NO: 148791 - protein, 30 aa, Mycobacterium avium
VGRIRAMQMALLPERLPAAEALAWGLVTAV

SEQ ID NO: 148792 - protein, 30 aa, Mycobacterium avium; identical to SEQ ID NO: 133339

SEQ ID NO: 148793 - protein, 26 aa, Mycobacterium avium
VGSIKAIQLKNWIATLTLGINKNVKL

SEQ ID NO: 148794 - protein, 26 aa, Mycobacterium avium
VGTIMALYSPNLWHHLTDGLSELVDH

SEQ ID NO: 148795 - protein, 25 aa, Mycobacterium avium
VHDMARWLMMLLDNGTHDGQHIASP

SEQ ID NO: 148796 - protein, 24 aa, Mycobacterium avium
VHGDSSYFVWLNRGKESLTLDLKT

SEQ ID NO: 148797 - protein, 18 aa, Mycobacterium avium
VHSAKGLEWQLVAVARLS

SEQ ID NO: 148798 - protein, 42 aa, Mycobacterium avium; identical to SEQ ID NO: 123041

SEQ ID NO: 148799 - protein, 17 aa, Mycobacterium avium
VKDIRRLETLERYGWIV

SEQ ID NO: 148800 - protein, 27 aa, Mycobacterium avium
VLAAATLAGWLLTRRSRRIREIDAGPQ

SEQ ID NO: 148801 - protein, 19 aa, Mycobacterium avium
VLAGCVVALGACSSPQHAS

SEQ ID NO: 148802 - protein, 18 aa, Mycobacterium avium
VLALAAGVAVGTRLSPRA

SEQ ID NO: 148803 - protein, 18 aa, Mycobacterium avium
VLFAGAADREVAGAARLI

SEQ ID NO: 148804 - protein, 17 aa, Mycobacterium avium
VLGILLSAIDSRQAVQF

SEQ ID NO: 148805 - protein, 22 aa, Mycobacterium avium
VLLAVLVIFAIVVVAKSVALIP

SEQ ID NO: 148806 - protein, 18 aa, Mycobacterium avium
VLLVVIVALIVGGVAVVR

SEQ ID NO: 148807 - protein, 20 aa, Mycobacterium avium
VLRRLLRLCARYASAPTVIF

SEQ ID NO: 148808 - protein, 18 aa, Mycobacterium avium
VLSDWLFYDRSSPSSAGS

SEQ ID NO: 148809 - protein, 19 aa, Mycobacterium avium
VLSGLGLQWHGPAADAMAF

SEQ ID NO: 148810 - protein, 21 aa, Mycobacterium avium
VLVANDRWWGPKAITKRITVW

SEQ ID NO: 148811 - protein, 21 aa, Mycobacterium avium
VLVTVFTLIRDRPAPVMSAKL

SEQ ID NO: 148812 - protein, 18 aa, Mycobacterium avium
VMSNLGLHLAMRSAGITV

SEQ ID NO: 148813 - protein, 27 aa, Mycobacterium avium
VNGYSPFAGLFYNTEGLPYFSTGMANT

SEQ ID NO: 148814 - protein, 17 aa, Mycobacterium avium
VNKHLVFVNQGGNWVLQ

SEQ ID NO: 148815 - protein, 17 aa, Mycobacterium avium
VNVGFWSSVPAGATEGA

SEQ ID NO: 148816 - protein, 26 aa, Mycobacterium avium
VPDGEDLSWLWDVRFEHFNDAFQTTP

SEQ ID NO: 148817 - protein, 17 aa, Mycobacterium avium
VPELQRRGLFRTEYRSA

SEQ ID NO: 148818 - protein, 22 aa, Mycobacterium avium
VPGPQLPLYLLGCEVKAMYPLG

SEQ ID NO: 148819 - protein, 26 aa, Mycobacterium avium
VPMIDMPHYLGYLTRRLTAAGCEIEE

SEQ ID NO: 148820 - protein, 25 aa, Mycobacterium avium
VPMIDMPHYLGYLTRRLTAAGGEIE

SEQ ID NO: 148821 - protein, 24 aa, Mycobacterium avium
VPSRDIPRFVELWRAGRLPVESLV

SEQ ID NO: 148822 - protein, 24 aa, Mycobacterium avium
VPTADHVIELLRRARDSLAHHNSV

SEQ ID NO: 148823 - protein, 20 aa, Mycobacterium avium
VPVLLMLAALGLGRLEKELV

SEQ ID NO: 148824 - protein, 19 aa, Mycobacterium avium
VQENQHVLQRFTISQLQQL

SEQ ID NO: 148825 - protein, 37 aa, Mycobacterium avium; identical to SEQ ID NO: 133604

SEQ ID NO: 148826 - protein, 18 aa, Mycobacterium avium
VQWLIIAAAQAEVAALQA

SEQ ID NO: 148827 - protein, 20 aa, Mycobacterium avium
VRITRRYSGFLMALDADLVV

SEQ ID NO: 148828 - protein, 24 aa, Mycobacterium avium
VRLAAVGAPLPQDPPPAQPVAGAN

SEQ ID NO: 148829 - protein, 24 aa, Mycobacterium avium
VRPLFGQHVVLTNPGVRRLFMELN

SEQ ID NO: 148830 - protein, 20 aa, Mycobacterium avium
VRPVAVLLTTMFVVAACSNS

SEQ ID NO: 148831 - protein, 22 aa, Mycobacterium avium
VRRWWPRRYRRSSVYSKLVSLD

SEQ ID NO: 148832 - protein, 23 aa, Mycobacterium avium
VRTRLVGLQREMASGPGSIVVEG

SEQ ID NO: 148833 - protein, 23 aa, Mycobacterium avium
VRVGDTWHPVLNLASARLIAASA

SEQ ID NO: 148834 - protein, 21 aa, Mycobacterium avium
VSAAAWTFDLSEREYAQLARA

SEQ ID NO: 148835 - protein, 24 aa, Mycobacterium avium
VSADPRRIVVLAGDQLDALCALGL

SEQ ID NO: 148836 - protein, 42 aa, Mycobacterium avium; identical to SEQ ID NO: 133682

SEQ ID NO: 148837 - protein, 23 aa, Mycobacterium avium
VSALLRVFCIAMLAAGLGVALQP

SEQ ID NO: 148838 - protein, 19 aa, Mycobacterium avium
VSEFVCRLLNYMDAKGFDF

SEQ ID NO: 148839 - protein, 24 aa, Mycobacterium avium
VSGAALFRRQLRYVRAHFNVLALE

SEQ ID NO: 148840 - protein, 25 aa, Mycobacterium avium
VSGRRGRHWLADRFRWRRNGFRFAA

SEQ ID NO: 148841 - protein, 17 aa, Mycobacterium avium
VSHGYINLSPDNAAWYF

SEQ ID NO: 148842 - protein, 17 aa, Mycobacterium avium
VSSLIGIFLVSGSPEQT

SEQ ID NO: 148843 - protein, 24 aa, Mycobacterium avium
VSTPTTMYPPVPYPEALATNLEDE

SEQ ID NO: 148844 - protein, 35 aa, Mycobacterium avium
VSTYHAFAGSLLRDYGLLLPVEPDTRLLSETELWQ

SEQ ID NO: 148845 - protein, 21 aa, Mycobacterium avium
VTALLVGLLVGASGFLVRQTF

SEQ ID NO: 148846 - protein, 26 aa, Mycobacterium avium
VTCQKYARRGLITFLGEDVGNPVATA

SEQ ID NO: 148847 - protein, 18 aa, Mycobacterium avium
VTCRQLEWRRMIDIGADF

SEQ ID NO: 148848 - protein, 20 aa, Mycobacterium avium
VTEVLAVYRGNLEQLLVLLP

SEQ ID NO: 148849 - protein, 26 aa, Mycobacterium avium
VTKDLPEIKPPTGGAPVVLGPGGKPI

SEQ ID NO: 148850 - protein, 26 aa, Mycobacterium avium
VTSLSIPSWWQPYVLSVASLTPDGQP

SEQ ID NO: 148851 - protein, 23 aa, Mycobacterium avium
VTVKTVANGVLTPGLHGLHVHEI

SEQ ID NO: 148852 - protein, 19 aa, Mycobacterium avium
VVAGYLLAVAFVGLSAVAG

SEQ ID NO: 148853 - protein, 17 aa, Mycobacterium avium
VVAPHRLTDAKAGPLIA

SEQ ID NO: 148854 - protein, 26 aa, Mycobacterium avium
VVEEPPPSTVFLLCAPSVDPEDVAIT

SEQ ID NO: 148855 - protein, 18 aa, Mycobacterium avium
VVFRPAFEFIEQQWRELG

SEQ ID NO: 148856 - protein, 26 aa, Mycobacterium avium
VVGAATALGVLALGAGLPGCSGKEGH

SEQ ID NO: 148857 - protein, 26 aa, Mycobacterium avium
VVGAATALGVLALGAGLPGCSGKNGH

SEQ ID NO: 148858 - protein, 26 aa, Mycobacterium avium
VVGDLLDLVFVFVGQQIPDLFDPGQR

SEQ ID NO: 148859 - protein, 17 aa, Mycobacterium avium
VVGLVHTPGLVTLAPGA

SEQ ID NO: 148860 - protein, 23 aa, Mycobacterium avium
VVLARSGLVFSPAGGALGRLRPL

SEQ ID NO: 148861 - protein, 18 aa, Mycobacterium avium
VVLLTKNIALDYGPSGIR

SEQ ID NO: 148862 - protein, 18 aa, Mycobacterium avium
VVLVFVNQTTIIGKSAPT

SEQ ID NO: 148863 - protein, 17 aa, Mycobacterium avium
VVPAQVDALLIGMAERY

SEQ ID NO: 148864 - protein, 17 aa, Mycobacterium avium
VVPLIVNLNTFGANDFD

SEQ ID NO: 148865 - protein, 19 aa, Mycobacterium avium
VVRLNGVFPGPGLPKPDPR

SEQ ID NO: 148866 - protein, 18 aa, Mycobacterium avium
VVTQKGRWYLVGHDRDRD

SEQ ID NO: 148867 - protein, 20 aa, Mycobacterium avium
VWFHGRAVLSDWLFYDRSSP

SEQ ID NO: 148868 - protein, 25 aa, Mycobacterium avium
VWWSWLVGVLTVVGLGLGLGSGVGL

SEQ ID NO: 148869 - protein, 18 aa, Mycobacterium avium
VYPLLLVTYEIVCSKGYD

SEQ ID NO: 148870 - protein, 47 aa, Mycobacterium avium
VYSALGSAPIKPFWHQLFGGRQWCWWPAFIAYFRDVVELQLDSDIWD

SEQ ID NO: 148871 - protein, 28 aa, Mycobacterium avium
VYVGTGGVLLPVLIFAAARAGVAFTPIN

SEQ ID NO: 148872 - protein, 17 aa, Mycobacterium avium
WALANNSLLIVTFDEDD

SEQ ID NO: 148873 - protein, 18 aa, Mycobacterium avium
WDPGFNQWGFWFFGVWIP

SEQ ID NO: 148874 - protein, 18 aa, Mycobacterium avium
WEHPWGFSEFLNAARALT

SEQ ID NO: 148875 - protein, 18 aa, Mycobacterium avium
WGVPQLGRWKWHDPYVHA

SEQ ID NO: 148876 - protein, 17 aa, Mycobacterium avium
WGYQETPVWDPGFNQWG

SEQ ID NO: 148877 - protein, 18 aa, Mycobacterium avium
WHCRGVAFTPKHGGRIVV

SEQ ID NO: 148878 - protein, 18 aa, Mycobacterium avium
WHGDPQRGYFHGAPWGDG

SEQ ID NO: 148879 - protein, 18 aa, Mycobacterium avium
WHGDSQRGYFHGAPWGDG

SEQ ID NO: 148880 - protein, 21 aa, Mycobacterium avium
WLMQRENVPLSPDPGPPLTLQ

SEQ ID NO: 148881 - protein, 21 aa, Mycobacterium avium
WPDLMRAARDRPLAPGAGVLV

SEQ ID NO: 148882 - protein, 20 aa, Mycobacterium avium
WPVGTALHQPVWSYRGHALV

SEQ ID NO: 148883 - protein, 21 aa, Mycobacterium avium
WPVGTALHQPVWSYRGHALVA

SEQ ID NO: 148884 - protein, 27 aa, Mycobacterium avium
WQDDEGHAMFPWLTLALVGSATSHVSF

SEQ ID NO: 148885 - protein, 28 aa, Mycobacterium avium
WQDNEGHSMFPWLTLALVGSSTSHVSFG

SEQ ID NO: 148886 - protein, 22 aa, Mycobacterium avium
WRPVLALVLTAGVVAGCHGGAS

SEQ ID NO: 148887 - protein, 22 aa, Mycobacterium avium
WRTPSRPFPPPHDPTAPPGRLH

SEQ ID NO: 148888 - protein, 19 aa, Mycobacterium avium
WSHNAAGNYVLAFVATDLG

SEQ ID NO: 148889 - protein, 28 aa, Mycobacterium avium
WSQSARSRGPWPWLQPDRNGAPPVAGLH

SEQ ID NO: 148890 - protein, 18 aa, Mycobacterium avium
WSQYLSWVADHVGMNVVH

SEQ ID NO: 148891 - protein, 17 aa, Mycobacterium avium
WTSNVPSSAPGAPNSPA

SEQ ID NO: 148892 - protein, 22 aa, Mycobacterium avium
WVGIGMAVLVVAGVALAGCAGS

SEQ ID NO: 148893 - protein, 18 aa, Mycobacterium avium
YADHRMAMAGAIVGLRVA

SEQ ID NO: 148894 - protein, 26 aa, Mycobacterium avium
YAGDQLARGYWKRPGLTAARFVANPF

SEQ ID NO: 148895 - protein, 20 aa, Mycobacterium avium
YAQGLRDAGLLPVLKHFPGH

SEQ ID NO: 148896 - protein, 18 aa, Mycobacterium avium
YCPQSRLEPILLAATRRG

SEQ ID NO: 148897 - protein, 18 aa, Mycobacterium avium
YDMVRKFGLGQRTNVGLP

SEQ ID NO: 148898 - protein, 20 aa, Mycobacterium avium
YELDVAKLLDFPLMTDMRDP

SEQ ID NO: 148899 - protein, 18 aa, Mycobacterium avium
YGPLLDRIGKTNGKYLAV

SEQ ID NO: 148900 - protein, 18 aa, Mycobacterium avium
YINLSPDNAAWYFNEVNV

SEQ ID NO: 148901 - protein, 17 aa, Mycobacterium avium
YLAHYHLAWFQAINHRA

SEQ ID NO: 148902 - protein, 28 aa, Mycobacterium avium
YLVSYAVNLLCPELIWQLRNSAAGYQPP

SEQ ID NO: 148903 - protein, 19 aa, Mycobacterium avium
YPFVVDRWTPDKVYSGAYK

SEQ ID NO: 148904 - protein, 19 aa, Mycobacterium avium
YQRWYAPAVPMDVAGAPRG

SEQ ID NO: 148905 - protein, 18 aa, Mycobacterium avium
YRLGEWVIPRGYSIIVGI

SEQ ID NO: 148906 - protein, 24 aa, Mycobacterium avium
YRRLRAWLTRLYRTEFDGFIAANF

SEQ ID NO: 148907 - protein, 19 aa, Mycobacterium avium
YRVMPQWVKIRNVDGFTGS

SEQ ID NO: 148908 - protein, 25 aa, Mycobacterium avium
YSANNLMFQLLDRVVYVDPKTDAVR

SEQ ID NO: 148909 - protein, 24 aa, Mycobacterium avium
YTCPVGIFPWCASSSEAALAPLFL

SEQ ID NO: 148910 - protein, 26 aa, Mycobacterium avium
YVDDLIALVGQRLLPGLPGSATVLDV

SEQ ID NO: 148911 - protein, 18 aa, Mycobacterium avium
YVHLWAGSGYRHATAEPA

SEQ ID NO: 148912 - protein, 21 aa, Mycobacterium avium
YVSTLRRLLRSALPNPNGLLA

SEQ ID NO: 148913 - protein, 17 aa, Mycobacterium avium
YVWSVPHNVAGLVTALG

SEQ ID NO: 148914 - protein, 22 aa, Mycobacterium avium
YVYAPDLIPKIKAQAGQPAPPA

SEQ ID NO: 148915 - protein, 18 aa, Mycobacterium avium
AAAPLRLHPDIHLYCAIP

SEQ ID NO: 148916 - protein, 26 aa, Mycobacterium avium
ALVRWRHPIWGLLLPDSFIGVAESTN

SEQ ID NO: 148917 - protein, 23 aa, Mycobacterium avium
APGDWLYFVTIDAAGTTLFTKDY

SEQ ID NO: 148918 - protein, 24 aa, Mycobacterium avium
ARAAATVLFLALLVLTGCSRSIAG

SEQ ID NO: 148919 - protein, 17 aa, Mycobacterium avium
AWGKLYPQFGTVAALNM

SEQ ID NO: 148920 - protein, 23 aa, Mycobacterium avium
DIEQLLVLLPQGIAAMAAIIVPS

SEQ ID NO: 148921 - protein, 22 aa, Mycobacterium avium
DNTQAMTVLLFTEGRALVTLEF

SEQ ID NO: 148922 - protein, 18 aa, Mycobacterium avium
DWAVDWDTWVAMSALPPP

SEQ ID NO: 148923 - protein, 19 aa, Mycobacterium avium
DWDTWVAMSALPPPTAHPP

SEQ ID NO: 148924 - protein, 24 aa, Mycobacterium avium
ESEGLLLHYLPEVDLWTGAVVGAE

SEQ ID NO: 148925 - protein, 22 aa, Mycobacterium avium
EVRALLFAIFEPALSGPVNMTG

SEQ ID NO: 148926 - protein, 18 aa, Mycobacterium avium
FHDMPVVPLWNYISVVGW

SEQ ID NO: 148927 - protein, 21 aa, Mycobacterium avium
GWDTYRRLDLLPYLSADTQSL

SEQ ID NO: 148928 - protein, 23 aa, Mycobacterium avium
HHNAMRAMRFGPYSSLPHARVES

SEQ ID NO: 148929 - protein, 24 aa, Mycobacterium avium
IGDAPLDDWQWTLGINLWGPIHGC

SEQ ID NO: 148930 - protein, 18 aa, Mycobacterium avium
ILGSRYLELVPDGPGSLP

SEQ ID NO: 148931 - protein, 21 aa, Mycobacterium avium
KDPWLRRQLTPDFRPGCKRML

SEQ ID NO: 148932 - protein, 17 aa, Mycobacterium avium
LICVPPYHIAGVSAALS

SEQ ID NO: 148933 - protein, 18 aa, Mycobacterium avium
LKIFADMILAFPKDVPPP

SEQ ID NO: 148934 - protein, 17 aa, Mycobacterium avium
LLWIAVLLAGCSSAGPG

SEQ ID NO: 148935 - protein, 24 aa, Mycobacterium avium
LPIYVVFVYFRAPWRKFIPHLHDG

SEQ ID NO: 148936 - protein, 26 aa, Mycobacterium avium
PDGSMALWCWWPMPFARSARVSLANT

SEQ ID NO: 148937 - protein, 23 aa, Mycobacterium avium
PGTKLMILPPLIHGAAQWSVMTA

SEQ ID NO: 148938 - protein, 18 aa, Mycobacterium avium
PLGFLAQTPPAVTPQGLI

SEQ ID NO: 148939 - protein, 23 aa, Mycobacterium avium
PMRRDWNYLIGSIKYVLWRLQER

SEQ ID NO: 148940 - protein, 22 aa, Mycobacterium avium
QADCFAGVYLFWVADGKSPRFT

SEQ ID NO: 148941 - protein, 21 aa, Mycobacterium avium
QSYIQRFLASPPAKRQQMAQQ

SEQ ID NO: 148942 - protein, 24 aa, Mycobacterium avium
QTVFYKSGQPFLWDRGRELGMTNR

SEQ ID NO: 148943 - protein, 19 aa, Mycobacterium avium
QYWVLKPTYHNSYWFYSCM

SEQ ID NO: 148944 - protein, 17 aa, Mycobacterium avium
RALSMLNDPFLVGGLPA

SEQ ID NO: 148945 - protein, 17 aa, Mycobacterium avium
RARMSSMLWTFKVQKDN

SEQ ID NO: 148946 - protein, 18 aa, Mycobacterium avium
RFALRAALALLVVVVLAG

SEQ ID NO: 148947 - protein, 18 aa, Mycobacterium avium
RHTPPHAWYIAFAPAQTP

SEQ ID NO: 148948 - protein, 17 aa, Mycobacterium avium
RVLTGPRWRLGARDLAA

SEQ ID NO: 148949 - protein, 19 aa, Mycobacterium avium
SQQIKDAFNAYIDAAHAVA

SEQ ID NO: 148950 - protein, 17 aa, Mycobacterium avium
STLMELLGKIFAPANPP

SEQ ID NO: 148951 - protein, 23 aa, Mycobacterium avium
TDNRFRFLRVYPNPAQYAPVTGF

SEQ ID NO: 148952 - protein, 18 aa, Mycobacterium avium
THSWPYWNQQLMAMKPDM

SEQ ID NO: 148953 - protein, 24 aa, Mycobacterium avium
TVSGQLTLLVPFIDRIRARVDLRE

SEQ ID NO: 148954 - protein, 18 aa, Mycobacterium avium
TYVQLFVLIAAANDVRCD

SEQ ID NO: 148955 - protein, 21 aa, Mycobacterium avium
VGWPRRLLRRLLAPTDPVLAS

SEQ ID NO: 148956 - protein, 17 aa, Mycobacterium avium
VLIFVPGGAWVHGKSMG

SEQ ID NO: 148957 - protein, 17 aa, Mycobacterium avium
VQLAVYRLAWAALAKVP

SEQ ID NO: 148958 - protein, 17 aa, Mycobacterium avium
VQWVPDRYWPAHSTIAL

SEQ ID NO: 148959 - protein, 24 aa, Mycobacterium avium
VTVMALIVLLLLNATMTQVFAADS

SEQ ID NO: 148960 - protein, 19 aa, Mycobacterium avium
WRFGVPLVCLLAGLLLAAT

SEQ ID NO: 148961 - protein, 25 aa, Mycobacterium avium
YGRRQICERLRLLPLRPFRNSYAYT

SEQ ID NO: 148962 - protein, 18 aa, Mycobacterium avium
YTFIAYLGDYYAFTTLTT

SEQ ID NO: 148963 - protein, 23 aa, Mycobacterium avium
AAGDLRLEWPLRPPPVVVRAFDA

SEQ ID NO: 148964 - protein, 18 aa, Mycobacterium avium
AAHGPYLAWLTRASAHSA

SEQ ID NO: 148965 - protein, 21 aa, Mycobacterium avium
AALLLALCWPIAPAAAPDPAA

SEQ ID NO: 148966 - protein, 25 aa, Mycobacterium avium
AAVLVLLPIVTFAMAYFIVDIPKPG

SEQ ID NO: 148967 - protein, 25 aa, Mycobacterium avium
AAVVVLGWYYLRIPSLAGIGRYTLY

SEQ ID NO: 148968 - protein, 23 aa, Mycobacterium avium
ADAMAFAAARYLTWLRATAEQTK

SEQ ID NO: 148969 - protein, 24 aa, Mycobacterium avium
AELGLPHLVLARPAWDPGAATVVD

SEQ ID NO: 148970 - protein, 17 aa, Mycobacterium avium
AGDLMGIALLTNATPAG

SEQ ID NO: 148971 - protein, 20 aa, Mycobacterium avium
AGRFLPFETPFTWAGMQYYT

SEQ ID NO: 148972 - protein, 17 aa, Mycobacterium avium
ALLVVALTERPDLLMAA

SEQ ID NO: 148973 - protein, 23 aa, Mycobacterium avium
APDDFRWPFNNPGYWMTPMFTLA

SEQ ID NO: 148974 - protein, 19 aa, Mycobacterium avium
ARPIAPLLDALRGLGVRIE

SEQ ID NO: 148975 - protein, 23 aa, Mycobacterium avium
ARRRGLYGLLAEGLLTAAAATVI

SEQ ID NO: 148976 - protein, 25 aa, Mycobacterium avium
ASENAFFMLAFTKIGLMPDGGASAL

SEQ ID NO: 148977 - protein, 28 aa, Mycobacterium avium
AYDAYLRLHLLSHRLVAPHGLNAGGLFG

SEQ ID NO: 148978 - protein, 25 aa, Mycobacterium avium
DQPALRALLDLLPIAAGSGTLGDRF

SEQ ID NO: 148979 - protein, 23 aa, Mycobacterium avium
DWARDYWIPFDRFRRLDGVRTVQ

SEQ ID NO: 148980 - protein, 25 aa, Mycobacterium avium
EVLQSYLNIIYFGRGAYGISAAAKA

SEQ ID NO: 148981 - protein, 21 aa, Mycobacterium avium
EVYQFVVLFPSPEQASAFLSA

SEQ ID NO: 148982 - protein, 17 aa, Mycobacterium avium
FAMAYFIVDIPKPGDLR

SEQ ID NO: 148983 - protein, 22 aa, Mycobacterium avium
FGDQPFAVWPWAADKLGGAQPT

SEQ ID NO: 148984 - protein, 19 aa, Mycobacterium avium
FTASPFRWLAWLSESRATI

SEQ ID NO: 148985 - protein, 19 aa, Mycobacterium avium
FYWMTPTQLRWRPLSFWPA

SEQ ID NO: 148986 - protein, 17 aa, Mycobacterium avium
GAALTVALLGACTSRPP

SEQ ID NO: 148987 - protein, 18 aa, Mycobacterium avium
GASALAVILLWAAPGHAT

SEQ ID NO: 148988 - protein, 18 aa, Mycobacterium avium
GCSWLPLYHDMGLSFLLA

SEQ ID NO: 148989 - protein, 18 aa, Mycobacterium avium
GFPVPIRHWLRAGELLEW

SEQ ID NO: 148990 - protein, 21 aa, Mycobacterium avium
GLLVPIHWGTFRLAPHPWAEP

SEQ ID NO: 148991 - protein, 21 aa, Mycobacterium avium
GPVPVVFLAIDRFKVINGRLG

SEQ ID NO: 148992 - protein, 23 aa, Mycobacterium avium
GTGGVLLPVLIFTAARAGVAFTP

SEQ ID NO: 148993 - protein, 21 aa, Mycobacterium avium
GVIFLLLGWQALGSSGNSEDD

SEQ ID NO: 148994 - protein, 17 aa, Mycobacterium avium
HCQYAMQFIAVLRGYAL

SEQ ID NO: 148995 - protein, 21 aa, Mycobacterium avium
KALDILVRLTGSGYQRLFGPV

SEQ ID NO: 148996 - protein, 27 aa, Mycobacterium avium
KSARTLLIWMSIAAVALLLAGCVRVVV

SEQ ID NO: 148997 - protein, 20 aa, Mycobacterium avium
KVTGSWFWVDGQNAHWRPEH

SEQ ID NO: 148998 - protein, 17 aa, Mycobacterium avium
KWWGTRPRLDSITYLVL

SEQ ID NO: 148999 - protein, 18 aa, Mycobacterium avium
LAVILLWAAPGHATADPA

SEQ ID NO: 149000 - protein, 17 aa, Mycobacterium avium
LDRAGRFLPFETPFTWA

SEQ ID NO: 149001 - protein, 23 aa, Mycobacterium avium
LEFIQFHPTMLFAPGAGGGRRPL

SEQ ID NO: 149002 - protein, 25 aa, Mycobacterium avium
LGALAGWYVWAALGLYPATPGTPIL

SEQ ID NO: 149003 - protein, 19 aa, Mycobacterium avium
LGGLAYLLAPIAWMLGLRI

SEQ ID NO: 149004 - protein, 17 aa, Mycobacterium avium
LGRLRPLFRTGLGARLG

SEQ ID NO: 149005 - protein, 18 aa, Mycobacterium avium
LPTGRRLLAAPGLRAVPG

SEQ ID NO: 149006 - protein, 25 aa, Mycobacterium avium
LQGKPAVLWFWTPWCPYCNAEAPGV

SEQ ID NO: 149007 - protein, 17 aa, Mycobacterium avium
LSGLLEALPPNAALLVT

SEQ ID NO: 149008 - protein, 17 aa, Mycobacterium avium
NDLVPYRTLVTTPPVGV

SEQ ID NO: 149009 - protein, 21 aa, Mycobacterium avium
NPAWDLPLVFGPIAITYNLPG

SEQ ID NO: 149010 - protein, 22 aa, Mycobacterium avium
NTSYYRLMLKLKGGPQAVADAA

SEQ ID NO: 149011 - protein, 21 aa, Mycobacterium avium
PEKHLPLVMPLKYIGIDENTL

SEQ ID NO: 149012 - protein, 20 aa, Mycobacterium avium
PFVAIVAFPFLPQALRGNYN

SEQ ID NO: 149013 - protein, 17 aa, Mycobacterium avium
PGKFYWMTPTQLRWRPL

SEQ ID NO: 149014 - protein, 26 aa, Mycobacterium avium
PHHPPPNWYGPPPPGGWDGPPPPGGW

SEQ ID NO: 149015 - protein, 24 aa, Mycobacterium avium
PQGHLLVFWDCYRPHDVQVKMFSL

SEQ ID NO: 149016 - protein, 22 aa, Mycobacterium avium
PSFGVPWLYNYIGQPWKTQHTV

SEQ ID NO: 149017 - protein, 18 aa, Mycobacterium avium
PVVFGPIAITYNVAGLNS

SEQ ID NO: 149018 - protein, 20 aa, Mycobacterium avium
PVVSTLPWFALGDPYVTGHV

SEQ ID NO: 149019 - protein, 20 aa, Mycobacterium avium
QFGINLPPVPALSGGATSTP

SEQ ID NO: 149020 - protein, 24 aa, Mycobacterium avium
QIAIGAVIALIVFGVAMCGPSHDS

SEQ ID NO: 149021 - protein, 17 aa, Mycobacterium avium
QLRAVGRLLGWRLGMDG

SEQ ID NO: 149022 - protein, 22 aa, Mycobacterium avium
QPLTSLSLQCKLPISIPQALGM

SEQ ID NO: 149023 - protein, 23 aa, Mycobacterium avium
RRNRFRLIVFAWITAMVTGLMFS

SEQ ID NO: 149024 - protein, 18 aa, Mycobacterium avium
RVLPPFLSRKHLPSRLAR

SEQ ID NO: 149025 - protein, 20 aa, Mycobacterium avium
SLLSLQRPLRQLVPAAPFVA

SEQ ID NO: 149026 - protein, 24 aa, Mycobacterium avium
SPAVWLNPWRWYAAPRAVADSLTV

SEQ ID NO: 149027 - protein, 23 aa, Mycobacterium avium
SRRLWTVLIFMLWHAIFVEHSVV

SEQ ID NO: 149028 - protein, 17 aa, Mycobacterium avium
TCYFPHPQRVVCGGISI

SEQ ID NO: 149029 - protein, 23 aa, Mycobacterium avium
TNFLGLVRLTNAVLPYLRAQGGG

SEQ ID NO: 149030 - protein, 24 aa, Mycobacterium avium
TSPADPLWWVVRALELFSDFQQFG

SEQ ID NO: 149031 - protein, 22 aa, Mycobacterium avium
VDAPLLINLVLGGLTPLQSAAR

SEQ ID NO: 149032 - protein, 25 aa, Mycobacterium avium
VKNPDPLLLLFDPLPNTGIVVIQGS

SEQ ID NO: 149033 - protein, 19 aa, Mycobacterium avium
VLWGDLPTLPLYRQQRTLL

SEQ ID NO: 149034 - protein, 24 aa, Mycobacterium avium
VPIAVLAWALFLPAGSAAADPPPT

SEQ ID NO: 149035 - protein, 24 aa, Mycobacterium avium
VTQWPYTELDYARWTWRLRRRDWI

SEQ ID NO: 149036 - protein, 17 aa, Mycobacterium avium
WGTRPRLDSITYLVLDD

SEQ ID NO: 149037 - protein, 18 aa, Mycobacterium avium
WLPLLGAVVLLAAACSRV

SEQ ID NO: 149038 - protein, 24 aa, Mycobacterium avium
YAEIGLLGFALITDALGGVDVCLK

SEQ ID NO: 149039 - protein, 17 aa, Mycobacterium avium
YPSMIEFLAPLFATGAG

SEQ ID NO: 149040 - protein, 24 aa, Mycobacterium avium
AADAMAFAAARYLTWLRATAEQTK

SEQ ID NO: 149041 - protein, 21 aa, Mycobacterium avium
AALLLALCWPIAPAAAPDPGA

SEQ ID NO: 149042 - protein, 26 aa, Mycobacterium avium
AAVVVLGWYYLRIPSLAGIGRYTLYV

SEQ ID NO: 149043 - protein, 17 aa, Mycobacterium avium
AEQPAVRALLTVLLATA

SEQ ID NO: 149044 - protein, 24 aa, Mycobacterium avium
AFAAVPAALLRWGVDQFDADQRPY

SEQ ID NO: 149045 - protein, 21 aa, Mycobacterium avium
AGAITLWLGLVANVGQVLNGD

SEQ ID NO: 149046 - protein, 23 aa, Mycobacterium avium
AGDLHLEWPLRPPPVVVRAFEAP

SEQ ID NO: 149047 - protein, 18 aa, Mycobacterium avium
AGDLMGIALLTNATPAGP

SEQ ID NO: 149048 - protein, 18 aa, Mycobacterium avium
AHQFNFFNIAYRPPMYRV

SEQ ID NO: 149049 - protein, 19 aa, Mycobacterium avium
AHTSSRWPTTAPTPRWCSA

SEQ ID NO: 149050 - protein, 20 aa, Mycobacterium avium
ALDILVRLTGSGYQRLFGPV

SEQ ID NO: 149051 - protein, 22 aa, Mycobacterium avium
ALDRALIDLATYFRDALMASSG

SEQ ID NO: 149052 - protein, 19 aa, Mycobacterium avium
ALGRLRPLFRTGLGTRLGS

SEQ ID NO: 149053 - protein, 21 aa, Mycobacterium avium
AMQMALLPERLPAAEALAWGL

SEQ ID NO: 149054 - protein, 20 aa, Mycobacterium avium
AMQMALLPERLPAAEALSWG

SEQ ID NO: 149055 - protein, 18 aa, Mycobacterium avium
AMRKLWTAAAALLLVGAC

SEQ ID NO: 149056 - protein, 18 aa, Mycobacterium avium
ANFTFPMEFTPFQGGWQL

SEQ ID NO: 149057 - protein, 22 aa, Mycobacterium avium
ANRARLLVLIATNFFGQNTAAI

SEQ ID NO: 149058 - protein, 23 aa, Mycobacterium avium
APLLATMFDFFYQPGKMPASLAD

SEQ ID NO: 149059 - protein, 19 aa, Mycobacterium avium
ARDPLLHKVIRLLSRIAAA

SEQ ID NO: 149060 - protein, 17 aa, Mycobacterium avium
ARGYWKRPGLTAARFVA

SEQ ID NO: 149061 - protein, 20 aa, Mycobacterium avium
ASGLFAWRRALVLSAAAALV

SEQ ID NO: 149062 - protein, 17 aa, Mycobacterium avium
ATLAGWLLTRRSRRIRE

SEQ ID NO: 149063 - protein, 19 aa, Mycobacterium avium
AVLHRFLRWRLAGYEPDRH

SEQ ID NO: 149064 - protein, 19 aa, Mycobacterium avium
AWLHPPGIDFRPALLAGVQ

SEQ ID NO: 149065 - protein, 22 aa, Mycobacterium avium
AYLLAPIAWMLGLRIVPMLAPG

SEQ ID NO: 149066 - protein, 29 aa, Mycobacterium avium
DAYDAYLRLHLLSHRLVAPHGLNAGGLFG

SEQ ID NO: 149067 - protein, 17 aa, Mycobacterium avium
DFTLSRPGALIAALPAV

SEQ ID NO: 149068 - protein, 17 aa, Mycobacterium avium
DLTTFYTALYRTLLHPN

SEQ ID NO: 149069 - protein, 27 aa, Mycobacterium avium
DNPQRVWGWYLWRHYLVADVAPNAGHR

SEQ ID NO: 149070 - protein, 18 aa, Mycobacterium avium
DWARDYWIPFDRFRRLDG

SEQ ID NO: 149071 - protein, 18 aa, Mycobacterium avium
DYPSMIEFLAPLFATGAG

SEQ ID NO: 149072 - protein, 17 aa, Mycobacterium avium
ELGVPHLVLARPAWDPG

SEQ ID NO: 149073 - protein, 23 aa, Mycobacterium avium
ELRRLIPPWVTLGSRLAALPKPQ

SEQ ID NO: 149074 - protein, 20 aa, Mycobacterium avium
ESLWAVLARTLPEPWRVEAL

SEQ ID NO: 149075 - protein, 18 aa, Mycobacterium avium
FHCQYAMQFIAVLRGYAL

SEQ ID NO: 149076 - protein, 19 aa, Mycobacterium avium
FKFALLQTRVDEFYLFVCC

SEQ ID NO: 149077 - protein, 25 aa, Mycobacterium avium
FLVRQTFFRPLTITAYFPSATGIYA

SEQ ID NO: 149078 - protein, 25 aa, Mycobacterium avium
FPVAVLSMFNVLWALAPATPVMQAL

SEQ ID NO: 149079 - protein, 18 aa, Mycobacterium avium
FTLGFRFKPWRSAKSIAD

SEQ ID NO: 149080 - protein, 18 aa, Mycobacterium avium
GALLLVVLPGGGGLVSGC

SEQ ID NO: 149081 - protein, 18 aa, Mycobacterium avium
GFLLVLFAGAADREVAGA

SEQ ID NO: 149082 - protein, 23 aa, Mycobacterium avium
GGVALPMRLALPGAVNRGNAAQA

SEQ ID NO: 149083 - protein, 23 aa, Mycobacterium avium
GHGPAAHRVWLPPLGRPPELCTL

SEQ ID NO: 149084 - protein, 18 aa, Mycobacterium avium
GLALDRFADRPLAPIDPS

SEQ ID NO: 149085 - protein, 18 aa, Mycobacterium avium
GLILFRRAGAPAALADSV

SEQ ID NO: 149086 - protein, 25 aa, Mycobacterium avium
GLVKAAWIDTWRLPAAPPGTVKIVV

SEQ ID NO: 149087 - protein, 22 aa, Mycobacterium avium
GNAQRWFVVWLGTSNDPVDKVA

SEQ ID NO: 149088 - protein, 22 aa, Mycobacterium avium
GNPAWDLPLVFGPIAITYNLPG

SEQ ID NO: 149089 - protein, 17 aa, Mycobacterium avium
GPPGTWGKGGPPPLLWA

SEQ ID NO: 149090 - protein, 25 aa, Mycobacterium avium
GRRVVLNFWAYWCAPCAAELPAMAE

SEQ ID NO: 149091 - protein, 19 aa, Mycobacterium avium
GTDRTLWPDRLWLAIAHSP

SEQ ID NO: 149092 - protein, 20 aa, Mycobacterium avium
GTDRTLWPDRLWLAIARSPA

SEQ ID NO: 149093 - protein, 22 aa, Mycobacterium avium
GTGGVLLPVLIFAAARAGVAFT

SEQ ID NO: 149094 - protein, 22 aa, Mycobacterium avium
GYAGLPFWPQGKIYDAYFTDAG

SEQ ID NO: 149095 - protein, 18 aa, Mycobacterium avium
HAMFPWLTLALVGSATSH

SEQ ID NO: 149096 - protein, 17 aa, Mycobacterium avium
HDRLAEAIALIRQLWSG

SEQ ID NO: 149097 - protein, 19 aa, Mycobacterium avium
HDYIWRWDTDWFWCSRAFG

SEQ ID NO: 149098 - protein, 17 aa, Mycobacterium avium
HLVLARPAWDPGAATVV

SEQ ID NO: 149099 - protein, 26 aa, Mycobacterium avium
HSDYPLQALLYSAVLHRFLRWRLAGY

SEQ ID NO: 149100 - protein, 17 aa, Mycobacterium avium
IFGIAMITPLVFAGAVS

SEQ ID NO: 149101 - protein, 18 aa, Mycobacterium avium
IGARWQLIAFAAPLLGVL

SEQ ID NO: 149102 - protein, 19 aa, Mycobacterium avium
IGARWQLIAFAAPLLGVLG

SEQ ID NO: 149103 - protein, 23 aa, Mycobacterium avium
IGTDRTLWPDRLWLAIARSPARE

SEQ ID NO: 149104 - protein, 25 aa, Mycobacterium avium
IYDAFTYMLLLTIEDLGFSPKGEGG

SEQ ID NO: 149105 - protein, 24 aa, Mycobacterium avium
KGPAAPPVVPLPPGGPGGGPGAGT

SEQ ID NO: 149106 - protein, 17 aa, Mycobacterium avium
KILGPQFLSRFYGRVIN

SEQ ID NO: 149107 - protein, 17 aa, Mycobacterium avium
KLAGLAILVVGALALAL

SEQ ID NO: 149108 - protein, 21 aa, Mycobacterium avium
KNAIDWLSRPFGDGALKGKPL

SEQ ID NO: 149109 - protein, 22 aa, Mycobacterium avium
KNAIDWLSRPFGDGALKGKPLA

SEQ ID NO: 149110 - protein, 19 aa, Mycobacterium avium
KRPSPHWWFDPQDGGNLYG

SEQ ID NO: 149111 - protein, 19 aa, Mycobacterium avium
LAESIQAWTPPPAPPAAPG

SEQ ID NO: 149112 - protein, 20 aa, Mycobacterium avium
LAGRPLSLYTLPISGFGKDP

SEQ ID NO: 149113 - protein, 18 aa, Mycobacterium avium
LAGWLLTRRSRRIREIDA

SEQ ID NO: 149114 - protein, 24 aa, Mycobacterium avium
LAVGLFRAAPWPGVAPLTLFGHSM

SEQ ID NO: 149115 - protein, 17 aa, Mycobacterium avium
LEVYPRYLKLIPSNVNA

SEQ ID NO: 149116 - protein, 18 aa, Mycobacterium avium
LEVYPRYLKLIPSNVNAD

SEQ ID NO: 149117 - protein, 24 aa, Mycobacterium avium
LFLGVIFLLLGWQALGSSGNSEDD

SEQ ID NO: 149118 - protein, 27 aa, Mycobacterium avium
LGGLAYLLAPIAWMLGLRIVPMLAPGS

SEQ ID NO: 149119 - protein, 17 aa, Mycobacterium avium
LGTCAFWPVPPTSKPHT

SEQ ID NO: 149120 - protein, 19 aa, Mycobacterium avium
LHRTAWIDDWLPAELNRAG

SEQ ID NO: 149121 - protein, 24 aa, Mycobacterium avium
LKDIALYLNFDMLASPNPGYFTYD

SEQ ID NO: 149122 - protein, 24 aa, Mycobacterium avium
LKNIALYLNFDMLASPNPGYFTYD

SEQ ID NO: 149123 - protein, 25 aa, Mycobacterium avium
LKNIALYLNFDMLASPNPGYFTYGG

SEQ ID NO: 149124 - protein, 20 aa, Mycobacterium avium
LLVGTLKYTLWRLQERVVGR

SEQ ID NO: 149125 - protein, 20 aa, Mycobacterium avium
LPTPAVAYLTGAYDADFGVM

SEQ ID NO: 149126 - protein, 19 aa, Mycobacterium avium
LPVVFGPIAITYNVAGLNS

SEQ ID NO: 149127 - protein, 24 aa, Mycobacterium avium
LQGKPAVLWFWTPWCPYCNAEAPG

SEQ ID NO: 149128 - protein, 21 aa, Mycobacterium avium
LQYPIVYLPFAFHRNTTDSDV

SEQ ID NO: 149129 - protein, 17 aa, Mycobacterium avium
LRMHQRWPIVMVDEFQD

SEQ ID NO: 149130 - protein, 18 aa, Mycobacterium avium
LSVLIRRAAIAGPPLAAT

SEQ ID NO: 149131 - protein, 28 aa, Mycobacterium avium
LTRSLGFLGTFPFPAETLSKWIRGDYAN

SEQ ID NO: 149132 - protein, 24 aa, Mycobacterium avium
LVALICVLPIALAPWPATVFTALL

SEQ ID NO: 149133 - protein, 21 aa, Mycobacterium avium
LVALICVLPIALSPWPAMVFT

SEQ ID NO: 149134 - protein, 18 aa, Mycobacterium avium
MKLFLIVAGFAAVIGLAV

SEQ ID NO: 149135 - protein, 18 aa, Mycobacterium avium
MPFAFLGKPRRWLRRVPP

SEQ ID NO: 149136 - protein, 20 aa, Mycobacterium avium
MRLFGKFLDRIQAFLDTRGP

SEQ ID NO: 149137 - protein, 19 aa, Mycobacterium avium
NPIYTSIYYLDHEPAIFAD

SEQ ID NO: 149138 - protein, 19 aa, Mycobacterium avium
PAKPGLILFRRAGAPAALA

SEQ ID NO: 149139 - protein, 17 aa, Mycobacterium avium
PAPWPLLTLLPAGPELS

SEQ ID NO: 149140 - protein, 21 aa, Mycobacterium avium
PDPLVLLFDPLPNTGIVVIQG

SEQ ID NO: 149141 - protein, 21 aa, Mycobacterium avium
PFVAIVAFPFLPQALRGNYNQ

SEQ ID NO: 149142 - protein, 19 aa, Mycobacterium avium
PIGRKLLYSAPVPALLELS

SEQ ID NO: 149143 - protein, 21 aa, Mycobacterium avium
PIKPFWHQLFGGRQWCWWPAF

SEQ ID NO: 149144 - protein, 18 aa, Mycobacterium avium
PKESWLRVVLTRAGLPPP

SEQ ID NO: 149145 - protein, 19 aa, Mycobacterium avium
PLGTCAFWPVPPTSKPHTI

SEQ ID NO: 149146 - protein, 21 aa, Mycobacterium avium
PLQALLYSAVLHRFLRWRLAG

SEQ ID NO: 149147 - protein, 17 aa, Mycobacterium avium
PPAPWPAPGYPPAWPGS

SEQ ID NO: 149148 - protein, 27 aa, Mycobacterium avium
PPHHPPPNWYGPPPPGGWDGPPPPGGW

SEQ ID NO: 149149 - protein, 17 aa, Mycobacterium avium
PPPLLWAVIQALVSEVW

SEQ ID NO: 149150 - protein, 31 aa, Mycobacterium avium
PPTPHPAPWRWPAPPPWPCWSRWPARSPPSR

SEQ ID NO: 149151 - protein, 22 aa, Mycobacterium avium
PPYKLLAVAVLLVLALILALIY

SEQ ID NO: 149152 - protein, 22 aa, Mycobacterium avium
PPYKLLAVAVLLVLSLILALIY

SEQ ID NO: 149153 - protein, 18 aa, Mycobacterium avium
PQDPPPPPPLPPGAPGQL

SEQ ID NO: 149154 - protein, 17 aa, Mycobacterium avium
PWRGQWVTLIVTSVGDD

SEQ ID NO: 149155 - protein, 24 aa, Mycobacterium avium
QDNEGHSMFPWLTLALVGSSTSHV

SEQ ID NO: 149156 - protein, 30 aa, Mycobacterium avium
QLFGGRQWCWWPAFIAYFRDVVELQLDSDI

SEQ ID NO: 149157 - protein, 17 aa, Mycobacterium avium
QLIAFAAPLLGVLGTIS

SEQ ID NO: 149158 - protein, 23 aa, Mycobacterium avium
QTTLEALWWDRPFTLNGVDIGAS

SEQ ID NO: 149159 - protein, 20 aa, Mycobacterium avium
RDYWIPFDRFRRLDGVRTVQ

SEQ ID NO: 149160 - protein, 20 aa, Mycobacterium avium
RFMLKDPIHGLGPRLAQLAA

SEQ ID NO: 149161 - protein, 22 aa, Mycobacterium avium
RFMLKDPIYGLGPRLAQLAAGA

SEQ ID NO: 149162 - protein, 19 aa, Mycobacterium avium
RGFLTPRDSLRQRCVAHRL

SEQ ID NO: 149163 - protein, 20 aa, Mycobacterium avium
RLAEAIALIRQLWSGSRISF

SEQ ID NO: 149164 - protein, 23 aa, Mycobacterium avium
RNPLALIAKPLLGAALAAAVATA

SEQ ID NO: 149165 - protein, 22 aa, Mycobacterium avium
RPDPLPWHPLGMAIDVMIPDPE

SEQ ID NO: 149166 - protein, 23 aa, Mycobacterium avium
RPDWTRTVLARRIAAGALVVLAA

SEQ ID NO: 149167 - protein, 20 aa, Mycobacterium avium
RPDWTRTVLARRVAAGALVV

SEQ ID NO: 149168 - protein, 18 aa, Mycobacterium avium
RPIAPLLDALRGLGVRIE

SEQ ID NO: 149169 - protein, 24 aa, Mycobacterium avium
RTFEFLEWFLETVPITPIWLCPLR

SEQ ID NO: 149170 - protein, 17 aa, Mycobacterium avium
RWRQPVIGMPTTPRFLG

SEQ ID NO: 149171 - protein, 22 aa, Mycobacterium avium
SAVLHRFLRWRLAGYDPDRHLG

SEQ ID NO: 149172 - protein, 19 aa, Mycobacterium avium
SAWLPLHVLLVDAALTMPT

SEQ ID NO: 149173 - protein, 22 aa, Mycobacterium avium
SDMGEFFMPYPGTRINQDSTPL

SEQ ID NO: 149174 - protein, 17 aa, Mycobacterium avium
SDYPLQALLYSAVLHRF

SEQ ID NO: 149175 - protein, 17 aa, Mycobacterium avium
SGPGTKLMILPPLIHGA

SEQ ID NO: 149176 - protein, 18 aa, Mycobacterium avium
SKGLQYPIVYLPFAFHRN

SEQ ID NO: 149177 - protein, 25 aa, Mycobacterium avium
SKGLQYPIVYLPFAFHRNTTDSDVV

SEQ ID NO: 149178 - protein, 22 aa, Mycobacterium avium
SPKESWLRVLLIDAGFPRPQTQ

SEQ ID NO: 149179 - protein, 24 aa, Mycobacterium avium
SPTVWLNPWRWYAAPRAVADALTV

SEQ ID NO: 149180 - protein, 23 aa, Mycobacterium avium
STDPLSEIWFLLTGQTSLPTNLG

SEQ ID NO: 149181 - protein, 18 aa, Mycobacterium avium
TAGPLMLAGMLTATVTAG

SEQ ID NO: 149182 - protein, 25 aa, Mycobacterium avium
TCSLKGMFPLALQPPTPVPGLEVLG

SEQ ID NO: 149183 - protein, 24 aa, Mycobacterium avium
TDSMPALHLLPLAGVLGVLPVLAT

SEQ ID NO: 149184 - protein, 24 aa, Mycobacterium avium
TETEQTFLLRLLGGELRQGALAGI

SEQ ID NO: 149185 - protein, 21 aa, Mycobacterium avium
TPVVSTLPWFALGDPYVTGHV

SEQ ID NO: 149186 - protein, 21 aa, Mycobacterium avium
TTLEALWWDRPFTLNGVDIGA

SEQ ID NO: 149187 - protein, 17 aa, Mycobacterium avium
VAILLPAHWQTAAVLFG

SEQ ID NO: 149188 - protein, 22 aa, Mycobacterium avium
VGLMIFPVLKLHEKWLGVGRYT

SEQ ID NO: 149189 - protein, 17 aa, Mycobacterium avium
VLAGCVVALGACSSPQH

SEQ ID NO: 149190 - protein, 21 aa, Mycobacterium avium
VPIGRKLLYSAPVPALLELSG

SEQ ID NO: 149191 - protein, 18 aa, Mycobacterium avium
VTALLVGLLVGASGFLVR

SEQ ID NO: 149192 - protein, 26 aa, Mycobacterium avium
VTLRLLLAVLLAPGWPLLAVPLPGRT

SEQ ID NO: 149193 - protein, 19 aa, Mycobacterium avium
VWDINVCHTWYVVPDGWGN

SEQ ID NO: 149194 - protein, 18 aa, Mycobacterium avium
VWDMNVCHTWYVVPDGWG

SEQ ID NO: 149195 - protein, 23 aa, Mycobacterium avium
VWWSWLVGVLTVVGLGLGLGSGV

SEQ ID NO: 149196 - protein, 18 aa, Mycobacterium avium
WDTDWFWCSRAFGVQNPR

SEQ ID NO: 149197 - protein, 17 aa, Mycobacterium avium
WQLFRPGQRRRTTQPVA

SEQ ID NO: 149198 - protein, 18 aa, Mycobacterium avium
WQLIAFAAPLLGVLGTIS

SEQ ID NO: 149199 - protein, 20 aa, Mycobacterium avium
WQTAAVLFGVWWIGAEAVLA

SEQ ID NO: 149200 - protein, 21 aa, Mycobacterium avium
WRPVLALVLTAGVVAGCHGGA

SEQ ID NO: 149201 - protein, 22 aa, Mycobacterium avium
YGSFFNIYFCSVTIKINGPAGS

SEQ ID NO: 149202 - protein, 20 aa, Mycobacterium avium
YGVDPLILRQAYPVSQAPYG

SEQ ID NO: 149203 - protein, 18 aa, Mycobacterium avium
YILWAAWHQSGLQRRWLS

SEQ ID NO: 149204 - protein, 18 aa, Mycobacterium avium
YKAWFPLTRRWLGFEDAR

SEQ ID NO: 149205 - protein, 21 aa, Mycobacterium avium
YLLAPIAWMLGLRIVPMLAPG

SEQ ID NO: 149206 - protein, 22 aa, Mycobacterium avium
YSPFAGLFYNTEGLPYFSTGMA

SEQ ID NO: 149207 - protein, 31 aa, Mycobacterium avium; identical to SEQ ID NO: 135470

SEQ ID NO: 149208 - protein, 4 aa, Mycobacterium bovis
TGGV

SEQ ID NO: 149209 - protein, 5 aa, Mycobacterium bovis
AAAAG

SEQ ID NO: 149210 - protein, 5 aa, Mycobacterium bovis
AAGPF

SEQ ID NO: 149211 - protein, 6 aa, Mycobacterium bovis
AAIPGQ

SEQ ID NO: 149212 - protein, 4 aa, Mycobacterium bovis
AAPE

SEQ ID NO: 149213 - protein, 17 aa, Mycobacterium bovis
AGQLPPEPPIWPTTSTP

SEQ ID NO: 149214 - protein, 11 aa, Mycobacterium bovis
APVSGGVVSPQ

SEQ ID NO: 149215 - protein, 6 aa, Mycobacterium bovis
ARSSAL

SEQ ID NO: 149216 - protein, 4 aa, Mycobacterium bovis
ATGA

SEQ ID NO: 149217 - protein, 13 aa, Mycobacterium bovis
AYSHPSTRAALRS

SEQ ID NO: 149218 - protein, 8 aa, Mycobacterium bovis
DAAKNDDS

SEQ ID NO: 149219 - protein, 4 aa, Mycobacterium bovis
DNPQ

SEQ ID NO: 149220 - protein, 9 aa, Mycobacterium bovis
EPAPASTSV

SEQ ID NO: 149221 - protein, 6 aa, Mycobacterium bovis
FGDGAP

SEQ ID NO: 149222 - protein, 9 aa, Mycobacterium bovis
GAAAGAPAA

SEQ ID NO: 149223 - protein, 4 aa, Mycobacterium bovis
GAAG

SEQ ID NO: 149224 - protein, 4 aa, Mycobacterium bovis
GGST

SEQ ID NO: 149225 - protein, 4 aa, Mycobacterium bovis
GTLT

SEQ ID NO: 149226 - protein, 4 aa, Mycobacterium bovis
GVDS

SEQ ID NO: 149227 - protein, 8 aa, Mycobacterium bovis
HASTEYAL

SEQ ID NO: 149228 - protein, 4 aa, Mycobacterium bovis
HEGS

SEQ ID NO: 149229 - protein, 26 aa, Mycobacterium bovis
HTIPERQDQIDRRKAKGSAGGRPPAF

SEQ ID NO: 149230 - protein, 4 aa, Mycobacterium bovis
IPPA

SEQ ID NO: 149231 - protein, 4 aa, Mycobacterium bovis
LGAT

SEQ ID NO: 149232 - protein, 14 aa, Mycobacterium bovis
NESAKRDYDVQGNG

SEQ ID NO: 149233 - protein, 13 aa, Mycobacterium bovis
NKGSYEAARERLT

SEQ ID NO: 149234 - protein, 6 aa, Mycobacterium bovis
PARTPV

SEQ ID NO: 149235 - protein, 10 aa, Mycobacterium bovis
PGANEASNAV

SEQ ID NO: 149236 - protein, 6 aa, Mycobacterium bovis
PSSGSF

SEQ ID NO: 149237 - protein, 4 aa, Mycobacterium bovis
PVPA

SEQ ID NO: 149238 - protein, 7 aa, Mycobacterium bovis
QAADTGA

SEQ ID NO: 149239 - protein, 6 aa, Mycobacterium bovis
QSNGTY

SEQ ID NO: 149240 - protein, 15 aa, Mycobacterium bovis
SADSAAAAGEHEAAA

SEQ ID NO: 149241 - protein, 15 aa, Mycobacterium bovis
SAGPGPGSLQAAAAG

SEQ ID NO: 149242 - protein, 7 aa, Mycobacterium bovis
SDRGAGA

SEQ ID NO: 149243 - protein, 4 aa, Mycobacterium bovis
SSQL

SEQ ID NO: 149244 - protein, 12 aa, Mycobacterium bovis
TAGKESVGQPAG

SEQ ID NO: 149245 - protein, 8 aa, Mycobacterium bovis
TPHTGPAP

SEQ ID NO: 149246 - protein, 4 aa, Mycobacterium bovis
TTPQ

SEQ ID NO: 149247 - protein, 5 aa, Mycobacterium bovis
VGADT

SEQ ID NO: 149248 - protein, 5 aa, Mycobacterium bovis
WQGPS

SEQ ID NO: 149249 - protein, 4 aa, Mycobacterium bovis
GGNG

SEQ ID NO: 149250 - protein, 4 aa, Mycobacterium bovis
GPRY

SEQ ID NO: 149251 - protein, 4 aa, Mycobacterium bovis
PPRL

SEQ ID NO: 149252 - protein, 4 aa, Mycobacterium bovis
TPGA

SEQ ID NO: 149253 - protein, 7 aa, Mycobacterium bovis
YSRKDTT

SEQ ID NO: 149254 - protein, 6 aa, Mycobacterium bovis
AAAPTS

SEQ ID NO: 149255 - protein, 8 aa, Mycobacterium bovis
AADAAHRA

SEQ ID NO: 149256 - protein, 6 aa, Mycobacterium bovis
AAQETL

SEQ ID NO: 149257 - protein, 4 aa, Mycobacterium bovis
AGEA

SEQ ID NO: 149258 - protein, 7 aa, Mycobacterium bovis
ALRPGHN

SEQ ID NO: 149259 - protein, 7 aa, Mycobacterium bovis
ASTGTKV

SEQ ID NO: 149260 - protein, 7 aa, Mycobacterium bovis
ATVDAYD

SEQ ID NO: 149261 - protein, 5 aa, Mycobacterium bovis
AVADR

SEQ ID NO: 149262 - protein, 5 aa, Mycobacterium bovis
DKPGV

SEQ ID NO: 149263 - protein, 11 aa, Mycobacterium bovis
DVRGQSSADAI

SEQ ID NO: 149264 - protein, 21 aa, Mycobacterium bovis
EAPVSAAPRTSAPNSETYTRR

SEQ ID NO: 149265 - protein, 11 aa, Mycobacterium bovis
EVADTSPSPVG

SEQ ID NO: 149266 - protein, 12 aa, Mycobacterium bovis
GADVDAGGSQHN

SEQ ID NO: 149267 - protein, 17 aa, Mycobacterium bovis
GRDQRGAASAANRGPDS

SEQ ID NO: 149268 - protein, 7 aa, Mycobacterium bovis
GSQAPTA

SEQ ID NO: 149269 - protein, 11 aa, Mycobacterium bovis
GTNPPANQTSA

SEQ ID NO: 149270 - protein, 19 aa, Mycobacterium bovis
GTTDGKSQADISEITIYAA

SEQ ID NO: 149271 - protein, 9 aa, Mycobacterium bovis
IDGNPATSW

SEQ ID NO: 149272 - protein, 87 aa, Mycobacterium bovis
KEEEAKKQEAVRRRAANAPAPGAKPKRSPKTAPATNAAAPTEAGDTDDGAESDASTERPADTSNPARRNSGPSARTPRPGVRPKKRK

SEQ ID NO: 149273 - protein, 8 aa, Mycobacterium bovis
KKYGKDRQ

SEQ ID NO: 149274 - protein, 21 aa, Mycobacterium bovis
LNAPTASTSAASSAPPGSVVK

SEQ ID NO: 149275 - protein, 10 aa, Mycobacterium bovis
NASGSSAELV

SEQ ID NO: 149276 - protein, 19 aa, Mycobacterium bovis
NPPAGTGVNRDGIITLRFG

SEQ ID NO: 149277 - protein, 10 aa, Mycobacterium bovis
QANSPSTPEL

SEQ ID NO: 149278 - protein, 25 aa, Mycobacterium bovis
QASVDSPRPAGEVTGTNPPAGTTVP

SEQ ID NO: 149279 - protein, 9 aa, Mycobacterium bovis
QDARTQRRS

SEQ ID NO: 149280 - protein, 9 aa, Mycobacterium bovis
QKPDSTIPP

SEQ ID NO: 149281 - protein, 10 aa, Mycobacterium bovis
QSARSTAAGL

SEQ ID NO: 149282 - protein, 20 aa, Mycobacterium bovis
RSGLAPAERDTAGQPIEPAD

SEQ ID NO: 149283 - protein, 12 aa, Mycobacterium bovis
RSVQGDGGIRSA

SEQ ID NO: 149284 - protein, 8 aa, Mycobacterium bovis
RTTGGFGQ

SEQ ID NO: 149285 - protein, 30 aa, Mycobacterium bovis
SAAGNLSGPRTDPLPRQDLDDTDRDRSIGS

SEQ ID NO: 149286 - protein, 11 aa, Mycobacterium bovis
SASTPTPATLE

SEQ ID NO: 149287 - protein, 8 aa, Mycobacterium bovis
SGGLNKDE

SEQ ID NO: 149288 - protein, 13 aa, Mycobacterium bovis
SGPATKDIPDVAG

SEQ ID NO: 149289 - protein, 16 aa, Mycobacterium bovis
SIARQSAEAAANPQTA

SEQ ID NO: 149290 - protein, 13 aa, Mycobacterium bovis
SPDGGADNPGEAD

SEQ ID NO: 149291 - protein, 4 aa, Mycobacterium bovis
SRTP

SEQ ID NO: 149292 - protein, 18 aa, Mycobacterium bovis
SSRPEPSPRPPSVEVQPR

SEQ ID NO: 149293 - protein, 8 aa, Mycobacterium bovis
TDAERTSL

SEQ ID NO: 149294 - protein, 15 aa, Mycobacterium bovis
TDPAANTSVSAGDEI

SEQ ID NO: 149295 - protein, 12 aa, Mycobacterium bovis
TMPDANPQDDIR

SEQ ID NO: 149296 - protein, 4 aa, Mycobacterium bovis
VGPS

SEQ ID NO: 149297 - protein, 11 aa, Mycobacterium bovis
VSTGPEQREIP

SEQ ID NO: 149298 - protein, 19 aa, Mycobacterium bovis
AAAAASGTDGAEPGAAEPA

SEQ ID NO: 149299 - protein, 9 aa, Mycobacterium bovis
AAAAGLASP

SEQ ID NO: 149300 - protein, 7 aa, Mycobacterium bovis
AAAAGTS

SEQ ID NO: 149301 - protein, 5 aa, Mycobacterium bovis
AAAAT

SEQ ID NO: 149302 - protein, 8 aa, Mycobacterium bovis
AAADEVST

SEQ ID NO: 149303 - protein, 13 aa, Mycobacterium bovis
AAADGDPATAWTA

SEQ ID NO: 149304 - protein, 8 aa, Mycobacterium bovis
AAADKITP

SEQ ID NO: 149305 - protein, 11 aa, Mycobacterium bovis
AAAEASSRAVD

SEQ ID NO: 149306 - protein, 12 aa, Mycobacterium bovis
AAAETADPRRTL

SEQ ID NO: 149307 - protein, 9 aa, Mycobacterium bovis
AAAETQDRW

SEQ ID NO: 149308 - protein, 7 aa, Mycobacterium bovis
AAAGEAS

SEQ ID NO: 149309 - protein, 9 aa, Mycobacterium bovis
AAAGQDAQR

SEQ ID NO: 149310 - protein, 11 aa, Mycobacterium bovis
AAAGTNPTVPT

SEQ ID NO: 149311 - protein, 14 aa, Mycobacterium bovis
AAAHETAAAGYTSA

SEQ ID NO: 149312 - protein, 5 aa, Mycobacterium bovis
AAAKR

SEQ ID NO: 149313 - protein, 7 aa, Mycobacterium bovis
AAANEAA

SEQ ID NO: 149314 - protein, 8 aa, Mycobacterium bovis
AAANQTSA

SEQ ID NO: 149315 - protein, 9 aa, Mycobacterium bovis
AAAPDDRAL

SEQ ID NO: 149316 - protein, 8 aa, Mycobacterium bovis
AAAPGDQR

SEQ ID NO: 149317 - protein, 12 aa, Mycobacterium bovis
AAAPPGPVGSPQ

SEQ ID NO: 149318 - protein, 9 aa, Mycobacterium bovis
AAAQSTEFT

SEQ ID NO: 149319 - protein, 16 aa, Mycobacterium bovis
AAARALDRARGAADPL

SEQ ID NO: 149320 - protein, 7 aa, Mycobacterium bovis
AAARTGA

SEQ ID NO: 149321 - protein, 4 aa, Mycobacterium bovis
AAAS

SEQ ID NO: 149322 - protein, 10 aa, Mycobacterium bovis
AAASAAPQPF

SEQ ID NO: 149323 - protein, 15 aa, Mycobacterium bovis
AAASAPAGAPATAGI

SEQ ID NO: 149324 - protein, 9 aa, Mycobacterium bovis
AAASRSTPT

SEQ ID NO: 149325 - protein, 8 aa, Mycobacterium bovis
AAASVGEQ

SEQ ID NO: 149326 - protein, 13 aa, Mycobacterium bovis
AAATAAGAAGSVR

SEQ ID NO: 149327 - protein, 12 aa, Mycobacterium bovis
AAATGSAARTAA

SEQ ID NO: 149328 - protein, 16 aa, Mycobacterium bovis
AAATPSAAESNRGYRA

SEQ ID NO: 149329 - protein, 16 aa, Mycobacterium bovis
AAAVGGAAEFDADAGR

SEQ ID NO: 149330 - protein, 7 aa, Mycobacterium bovis
AACGPPQ

SEQ ID NO: 149331 - protein, 9 aa, Mycobacterium bovis
AADAPPGRL

SEQ ID NO: 149332 - protein, 11 aa, Mycobacterium bovis
AADGASVPHGP

SEQ ID NO: 149333 - protein, 7 aa, Mycobacterium bovis
AADGESD

SEQ ID NO: 149334 - protein, 7 aa, Mycobacterium bovis
AADGRPA

SEQ ID NO: 149335 - protein, 10 aa, Mycobacterium bovis
AADPEADAAR

SEQ ID NO: 149336 - protein, 16 aa, Mycobacterium bovis
AADPGEVRGAEPRTAG

SEQ ID NO: 149337 - protein, 9 aa, Mycobacterium bovis
AADPSTQTA

SEQ ID NO: 149338 - protein, 7 aa, Mycobacterium bovis
AADPTTC

SEQ ID NO: 149339 - protein, 6 aa, Mycobacterium bovis
AADRRE

SEQ ID NO: 149340 - protein, 4 aa, Mycobacterium bovis
AAEA

SEQ ID NO: 149341 - protein, 15 aa, Mycobacterium bovis
AAEAADKPVQSRTDY

SEQ ID NO: 149342 - protein, 7 aa, Mycobacterium bovis
AAEDAAL

SEQ ID NO: 149343 - protein, 34 aa, Mycobacterium bovis
AAEPAFAPGPADDAALPPAAYPGVPPQVSYPKRR

SEQ ID NO: 149344 - protein, 10 aa, Mycobacterium bovis
AAEQSSEHPL

SEQ ID NO: 149345 - protein, 7 aa, Mycobacterium bovis
AAEQTRP

SEQ ID NO: 149346 - protein, 4 aa, Mycobacterium bovis
AAER

SEQ ID NO: 149347 - protein, 14 aa, Mycobacterium bovis
AAERERPKLGGEER

SEQ ID NO: 149348 - protein, 14 aa, Mycobacterium bovis
AAERERPQLGGEDR

SEQ ID NO: 149349 - protein, 14 aa, Mycobacterium bovis
AAERERSKLGGEER

SEQ ID NO: 149350 - protein, 24 aa, Mycobacterium bovis
AAESASKTPATRRPTAAPDAYADS

SEQ ID NO: 149351 - protein, 7 aa, Mycobacterium bovis
AAGAKQG

SEQ ID NO: 149352 - protein, 8 aa, Mycobacterium bovis
AAGALSGV

SEQ ID NO: 149353 - protein, 6 aa, Mycobacterium bovis
AAGATA

SEQ ID NO: 149354 - protein, 12 aa, Mycobacterium bovis
AAGDGADATARR

SEQ ID NO: 149355 - protein, 5 aa, Mycobacterium bovis
AAGDR

SEQ ID NO: 149356 - protein, 10 aa, Mycobacterium bovis
AAGETAEPEK

SEQ ID NO: 149357 - protein, 7 aa, Mycobacterium bovis
AAGGDER

SEQ ID NO: 149358 - protein, 9 aa, Mycobacterium bovis
AAGGDPEAM

SEQ ID NO: 149359 - protein, 8 aa, Mycobacterium bovis
AAGGGPFA

SEQ ID NO: 149360 - protein, 6 aa, Mycobacterium bovis
AAGGNI

SEQ ID NO: 149361 - protein, 8 aa, Mycobacterium bovis
AAGHPGPG

SEQ ID NO: 149362 - protein, 8 aa, Mycobacterium bovis
AAGKQAPN

SEQ ID NO: 149363 - protein, 7 aa, Mycobacterium bovis
AAGLSEG

SEQ ID NO: 149364 - protein, 5 aa, Mycobacterium bovis
AAGRA

SEQ ID NO: 149365 - protein, 6 aa, Mycobacterium bovis
AAGRPN

SEQ ID NO: 149366 - protein, 7 aa, Mycobacterium bovis
AAGSATD

SEQ ID NO: 149367 - protein, 9 aa, Mycobacterium bovis
AAGTDYADL

SEQ ID NO: 149368 - protein, 5 aa, Mycobacterium bovis
AAGTT

SEQ ID NO: 149369 - protein, 6 aa, Mycobacterium bovis
AAGVGA

SEQ ID NO: 149370 - protein, 12 aa, Mycobacterium bovis
AAHEAVKGTPMA

SEQ ID NO: 149371 - protein, 8 aa, Mycobacterium bovis
AAHGNDPV

SEQ ID NO: 149372 - protein, 10 aa, Mycobacterium bovis
AAKAPLRQTA

SEQ ID NO: 149373 - protein, 18 aa, Mycobacterium bovis
AAKAQANAARKAAARQRR

SEQ ID NO: 149374 - protein, 5 aa, Mycobacterium bovis
AAKPL

SEQ ID NO: 149375 - protein, 6 aa, Mycobacterium bovis
AAKPST

SEQ ID NO: 149376 - protein, 12 aa, Mycobacterium bovis
AAKYGATTESSL

SEQ ID NO: 149377 - protein, 6 aa, Mycobacterium bovis
AALPSA

SEQ ID NO: 149378 - protein, 13 aa, Mycobacterium bovis
AALTASAGNLGDQ

SEQ ID NO: 149379 - protein, 7 aa, Mycobacterium bovis
AALTGTP

SEQ ID NO: 149380 - protein, 4 aa, Mycobacterium bovis
AANA

SEQ ID NO: 149381 - protein, 7 aa, Mycobacterium bovis
AANDESV

SEQ ID NO: 149382 - protein, 14 aa, Mycobacterium bovis
AANGLNRSPSSSSR

SEQ ID NO: 149383 - protein, 17 aa, Mycobacterium bovis
AANKQAKITNDTEVTGA

SEQ ID NO: 149384 - protein, 8 aa, Mycobacterium bovis
AANNDHLK

SEQ ID NO: 149385 - protein, 5 aa, Mycobacterium bovis
AANPA

SEQ ID NO: 149386 - protein, 10 aa, Mycobacterium bovis
AANPAGARRI

SEQ ID NO: 149387 - protein, 9 aa, Mycobacterium bovis
AANPSTGAF

SEQ ID NO: 149388 - protein, 14 aa, Mycobacterium bovis
AAPAGSSKPLPDLP

SEQ ID NO: 149389 - protein, 11 aa, Mycobacterium bovis
AAPASNGPQVH

SEQ ID NO: 149390 - protein, 7 aa, Mycobacterium bovis
AAPELGE

SEQ ID NO: 149391 - protein, 10 aa, Mycobacterium bovis
AAPGHPAASG

SEQ ID NO: 149392 - protein, 6 aa, Mycobacterium bovis
AAPGWE

SEQ ID NO: 149393 - protein, 5 aa, Mycobacterium bovis
AAPLS

SEQ ID NO: 149394 - protein, 27 aa, Mycobacterium bovis
AAPPAGLPGPAPVAATPGLSGGSQPMV

SEQ ID NO: 149395 - protein, 7 aa, Mycobacterium bovis
AAPQTTR

SEQ ID NO: 149396 - protein, 7 aa, Mycobacterium bovis
AAPSPVA

SEQ ID NO: 149397 - protein, 5 aa, Mycobacterium bovis
AAPTA

SEQ ID NO: 149398 - protein, 8 aa, Mycobacterium bovis
AAPTADQV

SEQ ID NO: 149399 - protein, 8 aa, Mycobacterium bovis
AAPYDGSW

SEQ ID NO: 149400 - protein, 11 aa, Mycobacterium bovis
AAQAAAAAAER

SEQ ID NO: 149401 - protein, 19 aa, Mycobacterium bovis
AAQAGETGDMEDAPDVVPT

SEQ ID NO: 149402 - protein, 8 aa, Mycobacterium bovis
AAQEELRK

SEQ ID NO: 149403 - protein, 16 aa, Mycobacterium bovis
AAQHRSTAESYAAEGN

SEQ ID NO: 149404 - protein, 19 aa, Mycobacterium bovis
AAQSSESPQGTPPATEAAP

SEQ ID NO: 149405 - protein, 11 aa, Mycobacterium bovis
AAQTATRDQNV

SEQ ID NO: 149406 - protein, 5 aa, Mycobacterium bovis
AARAG

SEQ ID NO: 149407 - protein, 4 aa, Mycobacterium bovis
AARD

SEQ ID NO: 149408 - protein, 14 aa, Mycobacterium bovis
AARDAQKKGDFAAY

SEQ ID NO: 149409 - protein, 14 aa, Mycobacterium bovis
AARDLRSHPRTGPY

SEQ ID NO: 149410 - protein, 12 aa, Mycobacterium bovis
AARGAQPNTALA

SEQ ID NO: 149411 - protein, 10 aa, Mycobacterium bovis
AARHPSPNAG

SEQ ID NO: 149412 - protein, 9 aa, Mycobacterium bovis
AARQQTPNE

SEQ ID NO: 149413 - protein, 4 aa, Mycobacterium bovis
AARR

SEQ ID NO: 149414 - protein, 8 aa, Mycobacterium bovis
AARTAGAD

SEQ ID NO: 149415 - protein, 7 aa, Mycobacterium bovis
AARTDDS

SEQ ID NO: 149416 - protein, 9 aa, Mycobacterium bovis
AARTDGASA

SEQ ID NO: 149417 - protein, 21 aa, Mycobacterium bovis
AARTEPPEPPGAYSAARGRFN

SEQ ID NO: 149418 - protein, 17 aa, Mycobacterium bovis
AASARSEPGEPVGSTRY

SEQ ID NO: 149419 - protein, 9 aa, Mycobacterium bovis
AASASAAAA

SEQ ID NO: 149420 - protein, 21 aa, Mycobacterium bovis
AASEQPPASVAEDVPPSHDDI

SEQ ID NO: 149421 - protein, 5 aa, Mycobacterium bovis
AASGF

SEQ ID NO: 149422 - protein, 4 aa, Mycobacterium bovis
AASP

SEQ ID NO: 149423 - protein, 13 aa, Mycobacterium bovis
AASPGRRRHREVV

SEQ ID NO: 149424 - protein, 5 aa, Mycobacterium bovis
AASPL

SEQ ID NO: 149425 - protein, 15 aa, Mycobacterium bovis
AASRASGWSRVSPRE

SEQ ID NO: 149426 - protein, 15 aa, Mycobacterium bovis
AASRTREARRASQEA

SEQ ID NO: 149427 - protein, 9 aa, Mycobacterium bovis
AASSANSGF

SEQ ID NO: 149428 - protein, 10 aa, Mycobacterium bovis
AASTAQRSGI

SEQ ID NO: 149429 - protein, 6 aa, Mycobacterium bovis
AATADA

SEQ ID NO: 149430 - protein, 10 aa, Mycobacterium bovis
AATDDGSAGV

SEQ ID NO: 149431 - protein, 11 aa, Mycobacterium bovis
AATGGPPPSLS

SEQ ID NO: 149432 - protein, 10 aa, Mycobacterium bovis
AATGRAPASY

SEQ ID NO: 149433 - protein, 9 aa, Mycobacterium bovis
AATGRTPTL

SEQ ID NO: 149434 - protein, 7 aa, Mycobacterium bovis
AATPTPG

SEQ ID NO: 149435 - protein, 8 aa, Mycobacterium bovis
AATRERRG

SEQ ID NO: 149436 - protein, 6 aa, Mycobacterium bovis
AATTLP

SEQ ID NO: 149437 - protein, 6 aa, Mycobacterium bovis
AATTSA

SEQ ID NO: 149438 - protein, 10 aa, Mycobacterium bovis
AATTTPAGVG

SEQ ID NO: 149439 - protein, 12 aa, Mycobacterium bovis
AATYQDIRDGTK

SEQ ID NO: 149440 - protein, 22 aa, Mycobacterium bovis
AAVGDDRIQQQTTGRTNPETWT

SEQ ID NO: 149441 - protein, 29 aa, Mycobacterium bovis
AAVGESADEADAEAADGVAGHADPEADPV

SEQ ID NO: 149442 - protein, 6 aa, Mycobacterium bovis
AAVGTT

SEQ ID NO: 149443 - protein, 7 aa, Mycobacterium bovis
AAYAAGS

SEQ ID NO: 149444 - protein, 7 aa, Mycobacterium bovis
AAYGGDP

SEQ ID NO: 149445 - protein, 5 aa, Mycobacterium bovis
ACSPG

SEQ ID NO: 149446 - protein, 8 aa, Mycobacterium bovis
ADAAGQLA

SEQ ID NO: 149447 - protein, 4 aa, Mycobacterium bovis
ADAG

SEQ ID NO: 149448 - protein, 7 aa, Mycobacterium bovis
ADAPSSV

SEQ ID NO: 149449 - protein, 4 aa, Mycobacterium bovis
ADAR

SEQ ID NO: 149450 - protein, 9 aa, Mycobacterium bovis
ADARPNASM

SEQ ID NO: 149451 - protein, 4 aa, Mycobacterium bovis
ADAW

SEQ ID NO: 149452 - protein, 11 aa, Mycobacterium bovis
ADDEFSTAERV

SEQ ID NO: 149453 - protein, 9 aa, Mycobacterium bovis
ADDPDAAKA

SEQ ID NO: 149454 - protein, 9 aa, Mycobacterium bovis
ADDSPTGEM

SEQ ID NO: 149455 - protein, 6 aa, Mycobacterium bovis
ADELST

SEQ ID NO: 149456 - protein, 8 aa, Mycobacterium bovis
ADETGGPV

SEQ ID NO: 149457 - protein, 5 aa, Mycobacterium bovis
ADEVS

SEQ ID NO: 149458 - protein, 8 aa, Mycobacterium bovis
ADEVSNQK

SEQ ID NO: 149459 - protein, 5 aa, Mycobacterium bovis
ADGAD

SEQ ID NO: 149460 - protein, 10 aa, Mycobacterium bovis
ADGEPASDWR

SEQ ID NO: 149461 - protein, 4 aa, Mycobacterium bovis
ADGG

SEQ ID NO: 149462 - protein, 15 aa, Mycobacterium bovis
ADGGRDPQYHHDGPD

SEQ ID NO: 149463 - protein, 9 aa, Mycobacterium bovis
ADGKQPSRA

SEQ ID NO: 149464 - protein, 15 aa, Mycobacterium bovis
ADGKTCRFNPWPYPI

SEQ ID NO: 149465 - protein, 9 aa, Mycobacterium bovis
ADGNDNTQA

SEQ ID NO: 149466 - protein, 8 aa, Mycobacterium bovis
ADGRRTHP

SEQ ID NO: 149467 - protein, 8 aa, Mycobacterium bovis
ADGRTAAD

SEQ ID NO: 149468 - protein, 9 aa, Mycobacterium bovis
ADGSHAPEQ

SEQ ID NO: 149469 - protein, 7 aa, Mycobacterium bovis
ADHRRSA

SEQ ID NO: 149470 - protein, 4 aa, Mycobacterium bovis
ADID

SEQ ID NO: 149471 - protein, 9 aa, Mycobacterium bovis
ADKPKTPRG

SEQ ID NO: 149472 - protein, 4 aa, Mycobacterium bovis
ADLP

SEQ ID NO: 149473 - protein, 10 aa, Mycobacterium bovis
ADLSGAGTAF

SEQ ID NO: 149474 - protein, 13 aa, Mycobacterium bovis
ADNALTGEDESAI

SEQ ID NO: 149475 - protein, 7 aa, Mycobacterium bovis
ADNDPVA

SEQ ID NO: 149476 - protein, 15 aa, Mycobacterium bovis
ADNEQRDKLRTVLES

SEQ ID NO: 149477 - protein, 14 aa, Mycobacterium bovis
ADNRDEYQEWLEEP

SEQ ID NO: 149478 - protein, 5 aa, Mycobacterium bovis
ADPAV

SEQ ID NO: 149479 - protein, 8 aa, Mycobacterium bovis
ADPDGTGY

SEQ ID NO: 149480 - protein, 7 aa, Mycobacterium bovis
ADPDRAT

SEQ ID NO: 149481 - protein, 10 aa, Mycobacterium bovis
ADPGASDDQF

SEQ ID NO: 149482 - protein, 8 aa, Mycobacterium bovis
ADPGTTLG

SEQ ID NO: 149483 - protein, 6 aa, Mycobacterium bovis
ADPIPA

SEQ ID NO: 149484 - protein, 61 aa, Mycobacterium bovis
ADPQGGNQGAGSYPPPGYGAPPPPPGYGPPPGTYLPPGYNAPPPPPGYGPPPGPPPPGYPT

SEQ ID NO: 149485 - protein, 20 aa, Mycobacterium bovis
ADPQPSDLGDQSPGADAQAK

SEQ ID NO: 149486 - protein, 7 aa, Mycobacterium bovis
ADPRDDA

SEQ ID NO: 149487 - protein, 17 aa, Mycobacterium bovis
ADPRRRRRYQRARGKGG

SEQ ID NO: 149488 - protein, 7 aa, Mycobacterium bovis
ADPRSRT

SEQ ID NO: 149489 - protein, 6 aa, Mycobacterium bovis
ADPTRC

SEQ ID NO: 149490 - protein, 8 aa, Mycobacterium bovis
ADQAPDAV

SEQ ID NO: 149491 - protein, 10 aa, Mycobacterium bovis
ADQAVSGRQA

SEQ ID NO: 149492 - protein, 5 aa, Mycobacterium bovis
ADQRP

SEQ ID NO: 149493 - protein, 20 aa, Mycobacterium bovis
ADQSSGGVDASEVTAAAGEE

SEQ ID NO: 149494 - protein, 8 aa, Mycobacterium bovis
ADQSTFGE

SEQ ID NO: 149495 - protein, 8 aa, Mycobacterium bovis
ADQYPEAV

SEQ ID NO: 149496 - protein, 11 aa, Mycobacterium bovis
ADRELASQTEA

SEQ ID NO: 149497 - protein, 4 aa, Mycobacterium bovis
ADRG

SEQ ID NO: 149498 - protein, 6 aa, Mycobacterium bovis
ADRNST

SEQ ID NO: 149499 - protein, 15 aa, Mycobacterium bovis
ADRRRTAAISAPQGL

SEQ ID NO: 149500 - protein, 5 aa, Mycobacterium bovis
ADRST

SEQ ID NO: 149501 - protein, 10 aa, Mycobacterium bovis
ADSGNSVTQT

SEQ ID NO: 149502 - protein, 11 aa, Mycobacterium bovis
ADSSRNVKGDS

SEQ ID NO: 149503 - protein, 6 aa, Mycobacterium bovis
ADTADG

SEQ ID NO: 149504 - protein, 5 aa, Mycobacterium bovis
ADTAV

SEQ ID NO: 149505 - protein, 4 aa, Mycobacterium bovis
ADTP

SEQ ID NO: 149506 - protein, 4 aa, Mycobacterium bovis
ADTR

SEQ ID NO: 149507 - protein, 9 aa, Mycobacterium bovis
ADTSGRQAD

SEQ ID NO: 149508 - protein, 16 aa, Mycobacterium bovis
ADTYLDREQGFAFYGH

SEQ ID NO: 149509 - protein, 6 aa, Mycobacterium bovis
ADVPTQ

SEQ ID NO: 149510 - protein, 7 aa, Mycobacterium bovis
AEAEGKF

SEQ ID NO: 149511 - protein, 6 aa, Mycobacterium bovis
AEAEPA

SEQ ID NO: 149512 - protein, 37 aa, Mycobacterium bovis
AEAEPATRPTGASVRGGRSIGSGHPAKRAVAESAPVQ

SEQ ID NO: 149513 - protein, 10 aa, Mycobacterium bovis
AEAPDPQRAV

SEQ ID NO: 149514 - protein, 11 aa, Mycobacterium bovis
AEAQDELAEVS

SEQ ID NO: 149515 - protein, 13 aa, Mycobacterium bovis
AEAQGSAASAKVA

SEQ ID NO: 149516 - protein, 10 aa, Mycobacterium bovis
AEASGLRGDG

SEQ ID NO: 149517 - protein, 10 aa, Mycobacterium bovis
AEAVADAAQL

SEQ ID NO: 149518 - protein, 10 aa, Mycobacterium bovis
AEDDPAPSTL

SEQ ID NO: 149519 - protein, 10 aa, Mycobacterium bovis
AEDIDTRYHP

SEQ ID NO: 149520 - protein, 6 aa, Mycobacterium bovis
AEDPDR

SEQ ID NO: 149521 - protein, 8 aa, Mycobacterium bovis
AEDTTGTV

SEQ ID NO: 149522 - protein, 5 aa, Mycobacterium bovis
AEDTV

SEQ ID NO: 149523 - protein, 6 aa, Mycobacterium bovis
AEEASR

SEQ ID NO: 149524 - protein, 5 aa, Mycobacterium bovis
AEELG

SEQ ID NO: 149525 - protein, 12 aa, Mycobacterium bovis
AEETDEGTLRPT

SEQ ID NO: 149526 - protein, 11 aa, Mycobacterium bovis
AEGRGKAQAAA

SEQ ID NO: 149527 - protein, 4 aa, Mycobacterium bovis
AEHG

SEQ ID NO: 149528 - protein, 14 aa, Mycobacterium bovis
AEHGSSIPDRGRTV

SEQ ID NO: 149529 - protein, 4 aa, Mycobacterium bovis
AEHT

SEQ ID NO: 149530 - protein, 5 aa, Mycobacterium bovis
AEHTD

SEQ ID NO: 149531 - protein, 4 aa, Mycobacterium bovis
AEIG

SEQ ID NO: 149532 - protein, 5 aa, Mycobacterium bovis
AEIGT

SEQ ID NO: 149533 - protein, 27 aa, Mycobacterium bovis
AEKAERHRHPDQAADQLAQSPGSLPGD

SEQ ID NO: 149534 - protein, 6 aa, Mycobacterium bovis
AELSDP

SEQ ID NO: 149535 - protein, 13 aa, Mycobacterium bovis
AEPAEGPDAPSAA

SEQ ID NO: 149536 - protein, 8 aa, Mycobacterium bovis
AEPDPNAG

SEQ ID NO: 149537 - protein, 4 aa, Mycobacterium bovis
AEPG

SEQ ID NO: 149538 - protein, 6 aa, Mycobacterium bovis
AEPGGV

SEQ ID NO: 149539 - protein, 6 aa, Mycobacterium bovis
AEPGHV

SEQ ID NO: 149540 - protein, 6 aa, Mycobacterium bovis
AEPGLR

SEQ ID NO: 149541 - protein, 6 aa, Mycobacterium bovis
AEPGST

SEQ ID NO: 149542 - protein, 23 aa, Mycobacterium bovis
AEPHDTSPALLPQDAKTAAATSR

SEQ ID NO: 149543 - protein, 9 aa, Mycobacterium bovis
AEPRSALSD

SEQ ID NO: 149544 - protein, 6 aa, Mycobacterium bovis
AEPSTA

SEQ ID NO: 149545 - protein, 10 aa, Mycobacterium bovis
AEQDDPDGGA

SEQ ID NO: 149546 - protein, 17 aa, Mycobacterium bovis
AEQESTGIDEAEHAESG

SEQ ID NO: 149547 - protein, 8 aa, Mycobacterium bovis
AEQGKATA

SEQ ID NO: 149548 - protein, 22 aa, Mycobacterium bovis
AEQPARGAKQQPATETSRAGRD

SEQ ID NO: 149549 - protein, 15 aa, Mycobacterium bovis
AEQTRSIDAGDEAPR

SEQ ID NO: 149550 - protein, 6 aa, Mycobacterium bovis
AERAGM

SEQ ID NO: 149551 - protein, 15 aa, Mycobacterium bovis
AERANPRRLADDAKT

SEQ ID NO: 149552 - protein, 9 aa, Mycobacterium bovis
AERERAAAP

SEQ ID NO: 149553 - protein, 17 aa, Mycobacterium bovis
AERQAPAAEPASQGSIA

SEQ ID NO: 149554 - protein, 4 aa, Mycobacterium bovis
AERR

SEQ ID NO: 149555 - protein, 5 aa, Mycobacterium bovis
AERRL

SEQ ID NO: 149556 - protein, 9 aa, Mycobacterium bovis
AERVARTDD

SEQ ID NO: 149557 - protein, 7 aa, Mycobacterium bovis
AESALGQ

SEQ ID NO: 149558 - protein, 12 aa, Mycobacterium bovis
AESGDDSREVIG

SEQ ID NO: 149559 - protein, 10 aa, Mycobacterium bovis
AESITAKEHP

SEQ ID NO: 149560 - protein, 5 aa, Mycobacterium bovis
AESNN

SEQ ID NO: 149561 - protein, 7 aa, Mycobacterium bovis
AESPGEW

SEQ ID NO: 149562 - protein, 31 aa, Mycobacterium bovis
AESPPSAVPPGVLPPGPTPAHPHKPRPAFQD

SEQ ID NO: 149563 - protein, 4 aa, Mycobacterium bovis
AESR

SEQ ID NO: 149564 - protein, 8 aa, Mycobacterium bovis
AETDPRAR

SEQ ID NO: 149565 - protein, 6 aa, Mycobacterium bovis
AETGTG

SEQ ID NO: 149566 - protein, 8 aa, Mycobacterium bovis
AETPGSQW

SEQ ID NO: 149567 - protein, 10 aa, Mycobacterium bovis
AEYASTAAEL

SEQ ID NO: 149568 - protein, 12 aa, Mycobacterium bovis
AEYGATDAQLQS

SEQ ID NO: 149569 - protein, 8 aa, Mycobacterium bovis
AEYPSEHP

SEQ ID NO: 149570 - protein, 8 aa, Mycobacterium bovis
AFADPESE

SEQ ID NO: 149571 - protein, 8 aa, Mycobacterium bovis
AFPGTGSN

SEQ ID NO: 149572 - protein, 32 aa, Mycobacterium bovis
AFPPPAGPPPVTAAPAPPVEVPPPMPPPPPVT

SEQ ID NO: 149573 - protein, 9 aa, Mycobacterium bovis
AFSQAPGDN

SEQ ID NO: 149574 - protein, 4 aa, Mycobacterium bovis
AGAA

SEQ ID NO: 149575 - protein, 5 aa, Mycobacterium bovis
AGAAA

SEQ ID NO: 149576 - protein, 9 aa, Mycobacterium bovis
AGADATSTV

SEQ ID NO: 149577 - protein, 9 aa, Mycobacterium bovis
AGADDQPRY

SEQ ID NO: 149578 - protein, 6 aa, Mycobacterium bovis
AGADRA

SEQ ID NO: 149579 - protein, 12 aa, Mycobacterium bovis
AGADSPPAREVG

SEQ ID NO: 149580 - protein, 5 aa, Mycobacterium bovis
AGAEA

SEQ ID NO: 149581 - protein, 7 aa, Mycobacterium bovis
AGAGATV

SEQ ID NO: 149582 - protein, 11 aa, Mycobacterium bovis
AGAKSQEPRHS

SEQ ID NO: 149583 - protein, 14 aa, Mycobacterium bovis
AGAPDAIDEANTAF

SEQ ID NO: 149584 - protein, 8 aa, Mycobacterium bovis
AGAPEKAA

SEQ ID NO: 149585 - protein, 10 aa, Mycobacterium bovis
AGAPNLPSGY

SEQ ID NO: 149586 - protein, 4 aa, Mycobacterium bovis
AGAQ

SEQ ID NO: 149587 - protein, 5 aa, Mycobacterium bovis
AGASF

SEQ ID NO: 149588 - protein, 5 aa, Mycobacterium bovis
AGASG

SEQ ID NO: 149589 - protein, 10 aa, Mycobacterium bovis
AGAVSADGKA

SEQ ID NO: 149590 - protein, 11 aa, Mycobacterium bovis
AGDEDGKVTTS

SEQ ID NO: 149591 - protein, 8 aa, Mycobacterium bovis
AGDEPIPE

SEQ ID NO: 149592 - protein, 12 aa, Mycobacterium bovis
AGDGSKKDCKQN

SEQ ID NO: 149593 - protein, 7 aa, Mycobacterium bovis
AGDHASV

SEQ ID NO: 149594 - protein, 8 aa, Mycobacterium bovis
AGDNRQYV

SEQ ID NO: 149595 - protein, 6 aa, Mycobacterium bovis
AGDREP

SEQ ID NO: 149596 - protein, 11 aa, Mycobacterium bovis
AGDTTKTASQV

SEQ ID NO: 149597 - protein, 15 aa, Mycobacterium bovis
AGEDHSKTGNPVQSA

SEQ ID NO: 149598 - protein, 4 aa, Mycobacterium bovis
AGEE

SEQ ID NO: 149599 - protein, 12 aa, Mycobacterium bovis
AGEEIPQTKEEI

SEQ ID NO: 149600 - protein, 6 aa, Mycobacterium bovis
AGENRA

SEQ ID NO: 149601 - protein, 6 aa, Mycobacterium bovis
AGEPAA

SEQ ID NO: 149602 - protein, 5 aa, Mycobacterium bovis
AGEPT

SEQ ID NO: 149603 - protein, 5 aa, Mycobacterium bovis
AGEPV

SEQ ID NO: 149604 - protein, 9 aa, Mycobacterium bovis
AGETAEPAK

SEQ ID NO: 149605 - protein, 9 aa, Mycobacterium bovis
AGETIPSDG

SEQ ID NO: 149606 - protein, 10 aa, Mycobacterium bovis
AGETTAPVGP

SEQ ID NO: 149607 - protein, 12 aa, Mycobacterium bovis
AGEVGGKLDEAT

SEQ ID NO: 149608 - protein, 7 aa, Mycobacterium bovis
AGFGGGN

SEQ ID NO: 149609 - protein, 17 aa, Mycobacterium bovis
AGFGSTYADGERLGGRG

SEQ ID NO: 149610 - protein, 6 aa, Mycobacterium bovis
AGFNPE

SEQ ID NO: 149611 - protein, 11 aa, Mycobacterium bovis
AGFSASEQDRV

SEQ ID NO: 149612 - protein, 4 aa, Mycobacterium bovis
AGGA

SEQ ID NO: 149613 - protein, 7 aa, Mycobacterium bovis
AGGAGQP

SEQ ID NO: 149614 - protein, 12 aa, Mycobacterium bovis
AGGASAPEHSQT

SEQ ID NO: 149615 - protein, 5 aa, Mycobacterium bovis
AGGCA

SEQ ID NO: 149616 - protein, 6 aa, Mycobacterium bovis
AGGDIK

SEQ ID NO: 149617 - protein, 16 aa, Mycobacterium bovis
AGGGPSQLASMGSQQA

SEQ ID NO: 149618 - protein, 9 aa, Mycobacterium bovis
AGGGPVGVG

SEQ ID NO: 149619 - protein, 10 aa, Mycobacterium bovis
AGGGTEDAAG

SEQ ID NO: 149620 - protein, 8 aa, Mycobacterium bovis
AGGGVDPR

SEQ ID NO: 149621 - protein, 5 aa, Mycobacterium bovis
AGGIR

SEQ ID NO: 149622 - protein, 5 aa, Mycobacterium bovis
AGGPA

SEQ ID NO: 149623 - protein, 5 aa, Mycobacterium bovis
AGGPV

SEQ ID NO: 149624 - protein, 9 aa, Mycobacterium bovis
AGGRNLSAG

SEQ ID NO: 149625 - protein, 7 aa, Mycobacterium bovis
AGGSDRF

SEQ ID NO: 149626 - protein, 18 aa, Mycobacterium bovis
AGGSEVDQATVTGEPLPV

SEQ ID NO: 149627 - protein, 9 aa, Mycobacterium bovis
AGGSGKTTA

SEQ ID NO: 149628 - protein, 7 aa, Mycobacterium bovis
AGGSRPL

SEQ ID NO: 149629 - protein, 5 aa, Mycobacterium bovis
AGGTP

SEQ ID NO: 149630 - protein, 9 aa, Mycobacterium bovis
AGGTSTAAT

SEQ ID NO: 149631 - protein, 11 aa, Mycobacterium bovis
AGGVPQDEGAK

SEQ ID NO: 149632 - protein, 6 aa, Mycobacterium bovis
AGHDED

SEQ ID NO: 149633 - protein, 14 aa, Mycobacterium bovis
AGHRAPHRGSGFTG

SEQ ID NO: 149634 - protein, 12 aa, Mycobacterium bovis
AGHRSADGRRGV

SEQ ID NO: 149635 - protein, 6 aa, Mycobacterium bovis
AGHSRE

SEQ ID NO: 149636 - protein, 7 aa, Mycobacterium bovis
AGKDSFP

SEQ ID NO: 149637 - protein, 16 aa, Mycobacterium bovis
AGKELSGLSSRDYPGA

SEQ ID NO: 149638 - protein, 6 aa, Mycobacterium bovis
AGKPLT

SEQ ID NO: 149639 - protein, 11 aa, Mycobacterium bovis
AGKSLSDSASG

SEQ ID NO: 149640 - protein, 11 aa, Mycobacterium bovis
AGLAGSQNTGK

SEQ ID NO: 149641 - protein, 19 aa, Mycobacterium bovis
AGLGEATPGVQARQAAGKA

SEQ ID NO: 149642 - protein, 5 aa, Mycobacterium bovis
AGLSA

SEQ ID NO: 149643 - protein, 11 aa, Mycobacterium bovis
AGLTSPAMPAR

SEQ ID NO: 149644 - protein, 8 aa, Mycobacterium bovis
AGNDDPKL

SEQ ID NO: 149645 - protein, 14 aa, Mycobacterium bovis
AGNDGEAGCGNNPM

SEQ ID NO: 149646 - protein, 10 aa, Mycobacterium bovis
AGNGGPPVTR

SEQ ID NO: 149647 - protein, 7 aa, Mycobacterium bovis
AGNGGVA

SEQ ID NO: 149648 - protein, 7 aa, Mycobacterium bovis
AGNKGIA

SEQ ID NO: 149649 - protein, 7 aa, Mycobacterium bovis
AGNPGTI

SEQ ID NO: 149650 - protein, 13 aa, Mycobacterium bovis
AGNQGESLANESV

SEQ ID NO: 149651 - protein, 13 aa, Mycobacterium bovis
AGNQGTPLANESV

SEQ ID NO: 149652 - protein, 6 aa, Mycobacterium bovis
AGNRGL

SEQ ID NO: 149653 - protein, 8 aa, Mycobacterium bovis
AGNRPRGQ

SEQ ID NO: 149654 - protein, 8 aa, Mycobacterium bovis
AGNRRRHD

SEQ ID NO: 149655 - protein, 31 aa, Mycobacterium bovis
AGNTGASGSVSASCDSNPLTDLSRPDDPRNW

SEQ ID NO: 149656 - protein, 20 aa, Mycobacterium bovis
AGNTGGAAQCPPQAPGVTRD

SEQ ID NO: 149657 - protein, 9 aa, Mycobacterium bovis
AGNTVDGTS

SEQ ID NO: 149658 - protein, 6 aa, Mycobacterium bovis
AGPAGR

SEQ ID NO: 149659 - protein, 9 aa, Mycobacterium bovis
AGPAPPGLS

SEQ ID NO: 149660 - protein, 9 aa, Mycobacterium bovis
AGPDGTTAA

SEQ ID NO: 149661 - protein, 5 aa, Mycobacterium bovis
AGPDR

SEQ ID NO: 149662 - protein, 5 aa, Mycobacterium bovis
AGPER

SEQ ID NO: 149663 - protein, 5 aa, Mycobacterium bovis
AGPGL

SEQ ID NO: 149664 - protein, 24 aa, Mycobacterium bovis
AGPGTPARPAHSDSLTAQAERGIE

SEQ ID NO: 149665 - protein, 14 aa, Mycobacterium bovis
AGPHAGDRSPSRTV

SEQ ID NO: 149666 - protein, 5 aa, Mycobacterium bovis
AGPKD

SEQ ID NO: 149667 - protein, 4 aa, Mycobacterium bovis
AGPL

SEQ ID NO: 149668 - protein, 7 aa, Mycobacterium bovis
AGPNPGH

SEQ ID NO: 149669 - protein, 7 aa, Mycobacterium bovis
AGPTGVE

SEQ ID NO: 149670 - protein, 7 aa, Mycobacterium bovis
AGPTRRR

SEQ ID NO: 149671 - protein, 11 aa, Mycobacterium bovis
AGPVRSGRGGR

SEQ ID NO: 149672 - protein, 7 aa, Mycobacterium bovis
AGPYATG

SEQ ID NO: 149673 - protein, 10 aa, Mycobacterium bovis
AGQADSSPGW

SEQ ID NO: 149674 - protein, 4 aa, Mycobacterium bovis
AGQG

SEQ ID NO: 149675 - protein, 14 aa, Mycobacterium bovis
AGQPGNDGFSGVAP

SEQ ID NO: 149676 - protein, 6 aa, Mycobacterium bovis
AGQSYF

SEQ ID NO: 149677 - protein, 4 aa, Mycobacterium bovis
AGQT

SEQ ID NO: 149678 - protein, 8 aa, Mycobacterium bovis
AGRAPVGT

SEQ ID NO: 149679 - protein, 10 aa, Mycobacterium bovis
AGRDHDSGSL

SEQ ID NO: 149680 - protein, 11 aa, Mycobacterium bovis
AGREPPPGLSA

SEQ ID NO: 149681 - protein, 4 aa, Mycobacterium bovis
AGRH

SEQ ID NO: 149682 - protein, 6 aa, Mycobacterium bovis
AGRPVQ

SEQ ID NO: 149683 - protein, 62 aa, Mycobacterium bovis
AGRRPPRPSQTPPPGRAAPAAIPSGTTARVAANSAGRTAASRRSRPATGGHRPPRRTFSSGQ

SEQ ID NO: 149684 - protein, 7 aa, Mycobacterium bovis
AGRRRTQ

SEQ ID NO: 149685 - protein, 29 aa, Mycobacterium bovis
AGRSVQSPASTPPPTPTPPSAPSAGQTRA

SEQ ID NO: 149686 - protein, 7 aa, Mycobacterium bovis
AGRVGPI

SEQ ID NO: 149687 - protein, 8 aa, Mycobacterium bovis
AGRYGADP

SEQ ID NO: 149688 - protein, 11 aa, Mycobacterium bovis
AGSATTANGVA

SEQ ID NO: 149689 - protein, 7 aa, Mycobacterium bovis
AGSGINP

SEQ ID NO: 149690 - protein, 11 aa, Mycobacterium bovis
AGSGSGGEPTV

SEQ ID NO: 149691 - protein, 12 aa, Mycobacterium bovis
AGSGTSERDREE

SEQ ID NO: 149692 - protein, 7 aa, Mycobacterium bovis
AGSKTQT

SEQ ID NO: 149693 - protein, 7 aa, Mycobacterium bovis
AGSNNQT

SEQ ID NO: 149694 - protein, 6 aa, Mycobacterium bovis
AGSPGL

SEQ ID NO: 149695 - protein, 10 aa, Mycobacterium bovis
AGSRLGYQES

SEQ ID NO: 149696 - protein, 8 aa, Mycobacterium bovis
AGSSTRYT

SEQ ID NO: 149697 - protein, 4 aa, Mycobacterium bovis
AGST

SEQ ID NO: 149698 - protein, 17 aa, Mycobacterium bovis
AGSTGGGGKKVPEINAD

SEQ ID NO: 149699 - protein, 13 aa, Mycobacterium bovis
AGSVATDSATPGI

SEQ ID NO: 149700 - protein, 6 aa, Mycobacterium bovis
AGSWQS

SEQ ID NO: 149701 - protein, 9 aa, Mycobacterium bovis
AGTAAPDEI

SEQ ID NO: 149702 - protein, 5 aa, Mycobacterium bovis
AGTAT

SEQ ID NO: 149703 - protein, 9 aa, Mycobacterium bovis
AGTATKERR

SEQ ID NO: 149704 - protein, 8 aa, Mycobacterium bovis
AGTAVHDS

SEQ ID NO: 149705 - protein, 4 aa, Mycobacterium bovis
AGTG

SEQ ID NO: 149706 - protein, 6 aa, Mycobacterium bovis
AGTGGL

SEQ ID NO: 149707 - protein, 36 aa, Mycobacterium bovis
AGTGLADADPTAANEHAAAARATASTLQSAACGSNE

SEQ ID NO: 149708 - protein, 4 aa, Mycobacterium bovis
AGTM

SEQ ID NO: 149709 - protein, 10 aa, Mycobacterium bovis
AGTPLGGPIG

SEQ ID NO: 149710 - protein, 6 aa, Mycobacterium bovis
AGTPLR

SEQ ID NO: 149711 - protein, 4 aa, Mycobacterium bovis
AGTR

SEQ ID NO: 149712 - protein, 8 aa, Mycobacterium bovis
AGTRDADM

SEQ ID NO: 149713 - protein, 6 aa, Mycobacterium bovis
AGTSTD

SEQ ID NO: 149714 - protein, 5 aa, Mycobacterium bovis
AGTTL

SEQ ID NO: 149715 - protein, 7 aa, Mycobacterium bovis
AGTTPSR

SEQ ID NO: 149716 - protein, 9 aa, Mycobacterium bovis
AGVAPSPDQ

SEQ ID NO: 149717 - protein, 6 aa, Mycobacterium bovis
AGVPGA

SEQ ID NO: 149718 - protein, 11 aa, Mycobacterium bovis
AGVQSNDGKAA

SEQ ID NO: 149719 - protein, 29 aa, Mycobacterium bovis
AGVTTDAAAPAAKLPGDQAQSSASKATRL

SEQ ID NO: 149720 - protein, 7 aa, Mycobacterium bovis
AGWRPGP

SEQ ID NO: 149721 - protein, 9 aa, Mycobacterium bovis
AGYGAPAGV

SEQ ID NO: 149722 - protein, 17 aa, Mycobacterium bovis
AGYQTRVSGDGGSISVG

SEQ ID NO: 149723 - protein, 13 aa, Mycobacterium bovis
AHAEPEPKSPPIP

SEQ ID NO: 149724 - protein, 6 aa, Mycobacterium bovis
AHAPER

SEQ ID NO: 149725 - protein, 8 aa, Mycobacterium bovis
AHATSTTA

SEQ ID NO: 149726 - protein, 11 aa, Mycobacterium bovis
AHEADPDGALR

SEQ ID NO: 149727 - protein, 6 aa, Mycobacterium bovis
AHERTD

SEQ ID NO: 149728 - protein, 4 aa, Mycobacterium bovis
AHGT

SEQ ID NO: 149729 - protein, 7 aa, Mycobacterium bovis
AHHRPGI

SEQ ID NO: 149730 - protein, 10 aa, Mycobacterium bovis
AHNPPAGVDN

SEQ ID NO: 149731 - protein, 4 aa, Mycobacterium bovis
AHPE

SEQ ID NO: 149732 - protein, 9 aa, Mycobacterium bovis
AHPGASPAK

SEQ ID NO: 149733 - protein, 7 aa, Mycobacterium bovis
AHPGDAK

SEQ ID NO: 149734 - protein, 5 aa, Mycobacterium bovis
AHQAG

SEQ ID NO: 149735 - protein, 5 aa, Mycobacterium bovis
AHQSG

SEQ ID NO: 149736 - protein, 8 aa, Mycobacterium bovis
AHRPRPAT

SEQ ID NO: 149737 - protein, 6 aa, Mycobacterium bovis
AHRTGA

SEQ ID NO: 149738 - protein, 6 aa, Mycobacterium bovis
AHSGNA

SEQ ID NO: 149739 - protein, 8 aa, Mycobacterium bovis
AIAPPEGR

SEQ ID NO: 149740 - protein, 4 aa, Mycobacterium bovis
AIAQ

SEQ ID NO: 149741 - protein, 9 aa, Mycobacterium bovis
AIEGNAAVP

SEQ ID NO: 149742 - protein, 6 aa, Mycobacterium bovis
AIGAGQ

SEQ ID NO: 149743 - protein, 6 aa, Mycobacterium bovis
AIGPGT

SEQ ID NO: 149744 - protein, 7 aa, Mycobacterium bovis
AIGPSAA

SEQ ID NO: 149745 - protein, 4 aa, Mycobacterium bovis
AIGT

SEQ ID NO: 149746 - protein, 6 aa, Mycobacterium bovis
AIPPNA

SEQ ID NO: 149747 - protein, 6 aa, Mycobacterium bovis
AIPPSA

SEQ ID NO: 149748 - protein, 7 aa, Mycobacterium bovis
AIPSTAT

SEQ ID NO: 149749 - protein, 12 aa, Mycobacterium bovis
AIRAPGDARHTY

SEQ ID NO: 149750 - protein, 6 aa, Mycobacterium bovis
AIRPSY

SEQ ID NO: 149751 - protein, 6 aa, Mycobacterium bovis
AIRSDS

SEQ ID NO: 149752 - protein, 11 aa, Mycobacterium bovis
AISAATKLTGA

SEQ ID NO: 149753 - protein, 6 aa, Mycobacterium bovis
AITGEN

SEQ ID NO: 149754 - protein, 7 aa, Mycobacterium bovis
AITGKST

SEQ ID NO: 149755 - protein, 13 aa, Mycobacterium bovis
AKALSGELSRETL

SEQ ID NO: 149756 - protein, 12 aa, Mycobacterium bovis
AKDDARKQNRTT

SEQ ID NO: 149757 - protein, 9 aa, Mycobacterium bovis
AKDDNSASY

SEQ ID NO: 149758 - protein, 9 aa, Mycobacterium bovis
AKDPTTPAA

SEQ ID NO: 149759 - protein, 12 aa, Mycobacterium bovis
AKERLSSSTVTT

SEQ ID NO: 149760 - protein, 11 aa, Mycobacterium bovis
AKGAQPNTSLA

SEQ ID NO: 149761 - protein, 10 aa, Mycobacterium bovis
AKGGNPQSCG

SEQ ID NO: 149762 - protein, 16 aa, Mycobacterium bovis
AKGGSYATASAVTGTI

SEQ ID NO: 149763 - protein, 6 aa, Mycobacterium bovis
AKGLTR

SEQ ID NO: 149764 - protein, 7 aa, Mycobacterium bovis
AKGNPRL

SEQ ID NO: 149765 - protein, 12 aa, Mycobacterium bovis
AKGPRSAETMGT

SEQ ID NO: 149766 - protein, 13 aa, Mycobacterium bovis
AKKPEDRYASAGD

SEQ ID NO: 149767 - protein, 11 aa, Mycobacterium bovis
AKMDGATPGQA

SEQ ID NO: 149768 - protein, 8 aa, Mycobacterium bovis
AKNAKVST

SEQ ID NO: 149769 - protein, 6 aa, Mycobacterium bovis
AKNGLG

SEQ ID NO: 149770 - protein, 7 aa, Mycobacterium bovis
AKNPEDR

SEQ ID NO: 149771 - protein, 11 aa, Mycobacterium bovis
AKNPENRYQTA

SEQ ID NO: 149772 - protein, 6 aa, Mycobacterium bovis
AKPAAV

SEQ ID NO: 149773 - protein, 8 aa, Mycobacterium bovis
AKPATRRY

SEQ ID NO: 149774 - protein, 14 aa, Mycobacterium bovis
AKPKNSKDTGPALD

SEQ ID NO: 149775 - protein, 7 aa, Mycobacterium bovis
AKPNGEL

SEQ ID NO: 149776 - protein, 14 aa, Mycobacterium bovis
AKPPSTSAVASRTG

SEQ ID NO: 149777 - protein, 5 aa, Mycobacterium bovis
AKQNG

SEQ ID NO: 149778 - protein, 5 aa, Mycobacterium bovis
AKQNS

SEQ ID NO: 149779 - protein, 8 aa, Mycobacterium bovis
AKQPKDRY

SEQ ID NO: 149780 - protein, 4 aa, Mycobacterium bovis
AKQT

SEQ ID NO: 149781 - protein, 7 aa, Mycobacterium bovis
AKREKQK

SEQ ID NO: 149782 - protein, 8 aa, Mycobacterium bovis
AKSAQFSA

SEQ ID NO: 149783 - protein, 6 aa, Mycobacterium bovis
AKSNEQ

SEQ ID NO: 149784 - protein, 10 aa, Mycobacterium bovis
AKTGSRGTPV

SEQ ID NO: 149785 - protein, 7 aa, Mycobacterium bovis
AKTSSVD

SEQ ID NO: 149786 - protein, 4 aa, Mycobacterium bovis
AKVN

SEQ ID NO: 149787 - protein, 11 aa, Mycobacterium bovis
AKYGATTESSL

SEQ ID NO: 149788 - protein, 7 aa, Mycobacterium bovis
AKYPTGP

SEQ ID NO: 149789 - protein, 12 aa, Mycobacterium bovis
ALAGSLSSQGDS

SEQ ID NO: 149790 - protein, 5 aa, Mycobacterium bovis
ALEPE

SEQ ID NO: 149791 - protein, 18 aa, Mycobacterium bovis
ALKGTSNETFPKPTEVGG

SEQ ID NO: 149792 - protein, 8 aa, Mycobacterium bovis
ALLGGSPT

SEQ ID NO: 149793 - protein, 6 aa, Mycobacterium bovis
ALNDPY

SEQ ID NO: 149794 - protein, 10 aa, Mycobacterium bovis
ALPAPPRPTV

SEQ ID NO: 149795 - protein, 10 aa, Mycobacterium bovis
ALPEGSTGPL

SEQ ID NO: 149796 - protein, 14 aa, Mycobacterium bovis
ALPGPFSPSSASVT

SEQ ID NO: 149797 - protein, 14 aa, Mycobacterium bovis
ALPRRASGRIQRDA

SEQ ID NO: 149798 - protein, 10 aa, Mycobacterium bovis
ALPSEPEQDG

SEQ ID NO: 149799 - protein, 21 aa, Mycobacterium bovis
ALPSPDEQAPAKAPPSPYPAR

SEQ ID NO: 149800 - protein, 7 aa, Mycobacterium bovis
ALPSPGV

SEQ ID NO: 149801 - protein, 17 aa, Mycobacterium bovis
ALPSPQNGEQPNPTGPA

SEQ ID NO: 149802 - protein, 4 aa, Mycobacterium bovis
ALPT

SEQ ID NO: 149803 - protein, 5 aa, Mycobacterium bovis
ALPTE

SEQ ID NO: 149804 - protein, 11 aa, Mycobacterium bovis
ALPTGREELAD

SEQ ID NO: 149805 - protein, 5 aa, Mycobacterium bovis
ALPVP

SEQ ID NO: 149806 - protein, 9 aa, Mycobacterium bovis
ALQPPGNPL

SEQ ID NO: 149807 - protein, 7 aa, Mycobacterium bovis
ALSADGR

SEQ ID NO: 149808 - protein, 10 aa, Mycobacterium bovis
ALSDPDQDHA

SEQ ID NO: 149809 - protein, 10 aa, Mycobacterium bovis
ALSDSVAASE

SEQ ID NO: 149810 - protein, 8 aa, Mycobacterium bovis
ALSPNDRA

SEQ ID NO: 149811 - protein, 7 aa, Mycobacterium bovis
ALSPTGQ

SEQ ID NO: 149812 - protein, 11 aa, Mycobacterium bovis
ALSRSTAGDRG

SEQ ID NO: 149813 - protein, 24 aa, Mycobacterium bovis
ALTPESGAGRGAAVDPSSLPRQTN

SEQ ID NO: 149814 - protein, 6 aa, Mycobacterium bovis
AMASGT

SEQ ID NO: 149815 - protein, 8 aa, Mycobacterium bovis
AMGQSRTQ

SEQ ID NO: 149816 - protein, 7 aa, Mycobacterium bovis
AMKGQPG

SEQ ID NO: 149817 - protein, 6 aa, Mycobacterium bovis
AMPPSS

SEQ ID NO: 149818 - protein, 5 aa, Mycobacterium bovis
ANAAP

SEQ ID NO: 149819 - protein, 11 aa, Mycobacterium bovis
ANDPNQNGGYP

SEQ ID NO: 149820 - protein, 8 aa, Mycobacterium bovis
ANEKGRAL

SEQ ID NO: 149821 - protein, 30 aa, Mycobacterium bovis
ANGGGPTVVRNPDGSIATQSLRGNDLGRGG

SEQ ID NO: 149822 - protein, 8 aa, Mycobacterium bovis
ANGGPETA

SEQ ID NO: 149823 - protein, 7 aa, Mycobacterium bovis
ANGSGKT

SEQ ID NO: 149824 - protein, 9 aa, Mycobacterium bovis
ANLTGPAAT

SEQ ID NO: 149825 - protein, 8 aa, Mycobacterium bovis
ANNEDSVY

SEQ ID NO: 149826 - protein, 14 aa, Mycobacterium bovis
ANNRAGNPVGSSYL

SEQ ID NO: 149827 - protein, 5 aa, Mycobacterium bovis
ANPHA

SEQ ID NO: 149828 - protein, 6 aa, Mycobacterium bovis
ANPRAH

SEQ ID NO: 149829 - protein, 7 aa, Mycobacterium bovis
ANPSYTR

SEQ ID NO: 149830 - protein, 7 aa, Mycobacterium bovis
ANQIADP

SEQ ID NO: 149831 - protein, 5 aa, Mycobacterium bovis
ANQLP

SEQ ID NO: 149832 - protein, 18 aa, Mycobacterium bovis
ANRAGSVQWGPSDTYQAT

SEQ ID NO: 149833 - protein, 9 aa, Mycobacterium bovis
ANRDAGSPQ

SEQ ID NO: 149834 - protein, 6 aa, Mycobacterium bovis
ANRDGR

SEQ ID NO: 149835 - protein, 8 aa, Mycobacterium bovis
ANRPPGKL

SEQ ID NO: 149836 - protein, 16 aa, Mycobacterium bovis
ANRSTDAAGDPAEPTA

SEQ ID NO: 149837 - protein, 12 aa, Mycobacterium bovis
ANSGLSGGERQR

SEQ ID NO: 149838 - protein, 7 aa, Mycobacterium bovis
ANSSDDG

SEQ ID NO: 149839 - protein, 18 aa, Mycobacterium bovis
ANSSTTGDDGWKEMLAPA

SEQ ID NO: 149840 - protein, 12 aa, Mycobacterium bovis
ANSYGAAAPRVV

SEQ ID NO: 149841 - protein, 10 aa, Mycobacterium bovis
ANVAAGARTR

SEQ ID NO: 149842 - protein, 25 aa, Mycobacterium bovis
ANYPRADHARREPELPGKQLTGSAR

SEQ ID NO: 149843 - protein, 4 aa, Mycobacterium bovis
APAA

SEQ ID NO: 149844 - protein, 8 aa, Mycobacterium bovis
APAASVGS

SEQ ID NO: 149845 - protein, 4 aa, Mycobacterium bovis
APAE

SEQ ID NO: 149846 - protein, 5 aa, Mycobacterium bovis
APAGA

SEQ ID NO: 149847 - protein, 13 aa, Mycobacterium bovis
APAGVRSPAAVPP

SEQ ID NO: 149848 - protein, 9 aa, Mycobacterium bovis
APANPGAPY

SEQ ID NO: 149849 - protein, 7 aa, Mycobacterium bovis
APANRGR

SEQ ID NO: 149850 - protein, 4 aa, Mycobacterium bovis
APAP

SEQ ID NO: 149851 - protein, 8 aa, Mycobacterium bovis
APAPDGGI

SEQ ID NO: 149852 - protein, 90 aa, Mycobacterium bovis
APAYTPQYQQPADPAYPQQYPQPTPGYAQPEQFGAQPTQLGVPGQYGQYQQPGQYGQPGQYGQPGQYAPPGQYPGQYGPYGQSGQGSKRS

SEQ ID NO: 149853 - protein, 10 aa, Mycobacterium bovis
APDAKPYQGG

SEQ ID NO: 149854 - protein, 13 aa, Mycobacterium bovis
APDAQSDNFSGVA

SEQ ID NO: 149855 - protein, 6 aa, Mycobacterium bovis
APDGGE

SEQ ID NO: 149856 - protein, 12 aa, Mycobacterium bovis
APEATGHGTDEA

SEQ ID NO: 149857 - protein, 8 aa, Mycobacterium bovis
APEEPANL

SEQ ID NO: 149858 - protein, 23 aa, Mycobacterium bovis
APEHGPGMPRVSDGRAPSTPDEV

SEQ ID NO: 149859 - protein, 25 aa, Mycobacterium bovis
APEPEPSGRGPKVPDDADDQQDTEA

SEQ ID NO: 149860 - protein, 22 aa, Mycobacterium bovis
APEPSPDSDAAVKRGARNSLDE

SEQ ID NO: 149861 - protein, 20 aa, Mycobacterium bovis
APERKARALKRAGARSGHPK

SEQ ID NO: 149862 - protein, 6 aa, Mycobacterium bovis
APETLG

SEQ ID NO: 149863 - protein, 8 aa, Mycobacterium bovis
APFAAGAG

SEQ ID NO: 149864 - protein, 8 aa, Mycobacterium bovis
APFKSATK

SEQ ID NO: 149865 - protein, 5 aa, Mycobacterium bovis
APFSA

SEQ ID NO: 149866 - protein, 17 aa, Mycobacterium bovis
APGASSAPPPAPGRPSA

SEQ ID NO: 149867 - protein, 6 aa, Mycobacterium bovis
APGATP

SEQ ID NO: 149868 - protein, 35 aa, Mycobacterium bovis
APGDNSPQQAPTPTVTTTGNPPASNTGGTDASPRL

SEQ ID NO: 149869 - protein, 11 aa, Mycobacterium bovis
APGDPTPSAPP

SEQ ID NO: 149870 - protein, 24 aa, Mycobacterium bovis
APGENIASVSNSGDGALANGLPDA

SEQ ID NO: 149871 - protein, 8 aa, Mycobacterium bovis
APGFDAKE

SEQ ID NO: 149872 - protein, 4 aa, Mycobacterium bovis
APGH

SEQ ID NO: 149873 - protein, 4 aa, Mycobacterium bovis
APGR

SEQ ID NO: 149874 - protein, 12 aa, Mycobacterium bovis
APGSAPAPGDVS

SEQ ID NO: 149875 - protein, 6 aa, Mycobacterium bovis
APGVGK

SEQ ID NO: 149876 - protein, 11 aa, Mycobacterium bovis
APHDVSQDNQI

SEQ ID NO: 149877 - protein, 5 aa, Mycobacterium bovis
APIDH

SEQ ID NO: 149878 - protein, 5 aa, Mycobacterium bovis
APKAG

SEQ ID NO: 149879 - protein, 7 aa, Mycobacterium bovis
APKRPSR

SEQ ID NO: 149880 - protein, 6 aa, Mycobacterium bovis
APLDGG

SEQ ID NO: 149881 - protein, 5 aa, Mycobacterium bovis
APLEE

SEQ ID NO: 149882 - protein, 5 aa, Mycobacterium bovis
APLPK

SEQ ID NO: 149883 - protein, 9 aa, Mycobacterium bovis
APLPSGSTV

SEQ ID NO: 149884 - protein, 4 aa, Mycobacterium bovis
APMP

SEQ ID NO: 149885 - protein, 6 aa, Mycobacterium bovis
APNPAA

SEQ ID NO: 149886 - protein, 8 aa, Mycobacterium bovis
APNQDAQA

SEQ ID NO: 149887 - protein, 15 aa, Mycobacterium bovis
APPAPVPANGEQFGP

SEQ ID NO: 149888 - protein, 6 aa, Mycobacterium bovis
APPAQL

SEQ ID NO: 149889 - protein, 5 aa, Mycobacterium bovis
APPPG

SEQ ID NO: 149890 - protein, 15 aa, Mycobacterium bovis
APPPPAPPAATPTPP

SEQ ID NO: 149891 - protein, 10 aa, Mycobacterium bovis
APPPPPGVPP

SEQ ID NO: 149892 - protein, 5 aa, Mycobacterium bovis
APPRG

SEQ ID NO: 149893 - protein, 7 aa, Mycobacterium bovis
APPSRGT

SEQ ID NO: 149894 - protein, 16 aa, Mycobacterium bovis
APPVDRSHTGPLQPPK

SEQ ID NO: 149895 - protein, 12 aa, Mycobacterium bovis
APQTAGADEPDY

SEQ ID NO: 149896 - protein, 8 aa, Mycobacterium bovis
APRARRSI

SEQ ID NO: 149897 - protein, 11 aa, Mycobacterium bovis
APRPDASYQDI

SEQ ID NO: 149898 - protein, 19 aa, Mycobacterium bovis
APRPGGAMAPASTSSTGGH

SEQ ID NO: 149899 - protein, 9 aa, Mycobacterium bovis
APRPPEVEE

SEQ ID NO: 149900 - protein, 12 aa, Mycobacterium bovis
APRPQVERGGDV

SEQ ID NO: 149901 - protein, 7 aa, Mycobacterium bovis
APRRQHS

SEQ ID NO: 149902 - protein, 6 aa, Mycobacterium bovis
APSAGE

SEQ ID NO: 149903 - protein, 6 aa, Mycobacterium bovis
APSLSQ

SEQ ID NO: 149904 - protein, 5 aa, Mycobacterium bovis
APSNE

SEQ ID NO: 149905 - protein, 6 aa, Mycobacterium bovis
APSPLL

SEQ ID NO: 149906 - protein, 7 aa, Mycobacterium bovis
APSRNGH

SEQ ID NO: 149907 - protein, 12 aa, Mycobacterium bovis
APSTTRASGDSD

SEQ ID NO: 149908 - protein, 5 aa, Mycobacterium bovis
APSYE

SEQ ID NO: 149909 - protein, 14 aa, Mycobacterium bovis
APTKLTSPGINGST

SEQ ID NO: 149910 - protein, 4 aa, Mycobacterium bovis
APTL

SEQ ID NO: 149911 - protein, 11 aa, Mycobacterium bovis
APTPAVPSTAP

SEQ ID NO: 149912 - protein, 8 aa, Mycobacterium bovis
APTPPLGP

SEQ ID NO: 149913 - protein, 5 aa, Mycobacterium bovis
APTTE

SEQ ID NO: 149914 - protein, 13 aa, Mycobacterium bovis
APTTGAAPEIDTA

SEQ ID NO: 149915 - protein, 7 aa, Mycobacterium bovis
APVEPTG

SEQ ID NO: 149916 - protein, 8 aa, Mycobacterium bovis
APVGPDPL

SEQ ID NO: 149917 - protein, 38 aa, Mycobacterium bovis
APVPDKPAAAKEAPAKASKTTARKTSGRRAGTAELRST

SEQ ID NO: 149918 - protein, 4 aa, Mycobacterium bovis
APYG

SEQ ID NO: 149919 - protein, 19 aa, Mycobacterium bovis
APYGPGSARAGADGSGPQG

SEQ ID NO: 149920 - protein, 4 aa, Mycobacterium bovis
APYP

SEQ ID NO: 149921 - protein, 14 aa, Mycobacterium bovis
AQAAASTIRSADRD

SEQ ID NO: 149922 - protein, 8 aa, Mycobacterium bovis
AQAAEQRA

SEQ ID NO: 149923 - protein, 16 aa, Mycobacterium bovis
AQAAKREQAPLPPGAP

SEQ ID NO: 149924 - protein, 8 aa, Mycobacterium bovis
AQAANGAP

SEQ ID NO: 149925 - protein, 6 aa, Mycobacterium bovis
AQAATA

SEQ ID NO: 149926 - protein, 8 aa, Mycobacterium bovis
AQADPGRT

SEQ ID NO: 149927 - protein, 9 aa, Mycobacterium bovis
AQADPPGTV

SEQ ID NO: 149928 - protein, 4 aa, Mycobacterium bovis
AQAG

SEQ ID NO: 149929 - protein, 13 aa, Mycobacterium bovis
AQAGGNWPPPPTE

SEQ ID NO: 149930 - protein, 15 aa, Mycobacterium bovis
AQANTALSNAALSAG

SEQ ID NO: 149931 - protein, 8 aa, Mycobacterium bovis
AQAPGQVT

SEQ ID NO: 149932 - protein, 9 aa, Mycobacterium bovis
AQAPRPAPA

SEQ ID NO: 149933 - protein, 12 aa, Mycobacterium bovis
AQAQKADAQRLA

SEQ ID NO: 149934 - protein, 14 aa, Mycobacterium bovis
AQASLAAAASGAPL

SEQ ID NO: 149935 - protein, 8 aa, Mycobacterium bovis
AQAVGGLG

SEQ ID NO: 149936 - protein, 6 aa, Mycobacterium bovis
AQDDYN

SEQ ID NO: 149937 - protein, 4 aa, Mycobacterium bovis
AQEH

SEQ ID NO: 149938 - protein, 5 aa, Mycobacterium bovis
AQEPQ

SEQ ID NO: 149939 - protein, 5 aa, Mycobacterium bovis
AQGSH

SEQ ID NO: 149940 - protein, 5 aa, Mycobacterium bovis
AQGTL

SEQ ID NO: 149941 - protein, 5 aa, Mycobacterium bovis
AQHSR

SEQ ID NO: 149942 - protein, 4 aa, Mycobacterium bovis
AQII

SEQ ID NO: 149943 - protein, 6 aa, Mycobacterium bovis
AQIPSR

SEQ ID NO: 149944 - protein, 4 aa, Mycobacterium bovis
AQNG

SEQ ID NO: 149945 - protein, 5 aa, Mycobacterium bovis
AQPLG

SEQ ID NO: 149946 - protein, 25 aa, Mycobacterium bovis
AQPNPQPMPPEYKERQRPREHAEWS

SEQ ID NO: 149947 - protein, 6 aa, Mycobacterium bovis
AQPPLG

SEQ ID NO: 149948 - protein, 9 aa, Mycobacterium bovis
AQQARADET

SEQ ID NO: 149949 - protein, 16 aa, Mycobacterium bovis
AQQGAQGAAGSGVRTE

SEQ ID NO: 149950 - protein, 6 aa, Mycobacterium bovis
AQQSYF

SEQ ID NO: 149951 - protein, 6 aa, Mycobacterium bovis
AQRGAS

SEQ ID NO: 149952 - protein, 8 aa, Mycobacterium bovis
AQRRRARR

SEQ ID NO: 149953 - protein, 4 aa, Mycobacterium bovis
AQSR

SEQ ID NO: 149954 - protein, 6 aa, Mycobacterium bovis
AQSSAR

SEQ ID NO: 149955 - protein, 8 aa, Mycobacterium bovis
AQTAGGGS

SEQ ID NO: 149956 - protein, 10 aa, Mycobacterium bovis
AQTAQTDPAV

SEQ ID NO: 149957 - protein, 10 aa, Mycobacterium bovis
AQTQKARAQR

SEQ ID NO: 149958 - protein, 10 aa, Mycobacterium bovis
ARAARQGRLQ

SEQ ID NO: 149959 - protein, 17 aa, Mycobacterium bovis
ARAARQRGNEISGGASA

SEQ ID NO: 149960 - protein, 10 aa, Mycobacterium bovis
ARADSTSPVV

SEQ ID NO: 149961 - protein, 4 aa, Mycobacterium bovis
ARAE

SEQ ID NO: 149962 - protein, 4 aa, Mycobacterium bovis
ARAG

SEQ ID NO: 149963 - protein, 5 aa, Mycobacterium bovis
ARAGD

SEQ ID NO: 149964 - protein, 7 aa, Mycobacterium bovis
ARANTEI

SEQ ID NO: 149965 - protein, 4 aa, Mycobacterium bovis
ARAQ

SEQ ID NO: 149966 - protein, 18 aa, Mycobacterium bovis
ARASTQPHNGEGHAHATD

SEQ ID NO: 149967 - protein, 7 aa, Mycobacterium bovis
ARATGEP

SEQ ID NO: 149968 - protein, 11 aa, Mycobacterium bovis
ARATGKASEAI

SEQ ID NO: 149969 - protein, 17 aa, Mycobacterium bovis
ARATPAGRATGATIDAS

SEQ ID NO: 149970 - protein, 10 aa, Mycobacterium bovis
ARDFATSGLE

SEQ ID NO: 149971 - protein, 8 aa, Mycobacterium bovis
ARDGGQVK

SEQ ID NO: 149972 - protein, 9 aa, Mycobacterium bovis
ARDHQAPAL

SEQ ID NO: 149973 - protein, 5 aa, Mycobacterium bovis
ARDSN

SEQ ID NO: 149974 - protein, 7 aa, Mycobacterium bovis
AREAGRI

SEQ ID NO: 149975 - protein, 8 aa, Mycobacterium bovis
AREAGRVA

SEQ ID NO: 149976 - protein, 8 aa, Mycobacterium bovis
ARENGTVI

SEQ ID NO: 149977 - protein, 4 aa, Mycobacterium bovis
AREP

SEQ ID NO: 149978 - protein, 14 aa, Mycobacterium bovis
AREQAERGLAGSME

SEQ ID NO: 149979 - protein, 10 aa, Mycobacterium bovis
ARERGGGTRF

SEQ ID NO: 149980 - protein, 8 aa, Mycobacterium bovis
ARETRRDH

SEQ ID NO: 149981 - protein, 4 aa, Mycobacterium bovis
ARGA

SEQ ID NO: 149982 - protein, 8 aa, Mycobacterium bovis
ARGAQGLG

SEQ ID NO: 149983 - protein, 19 aa, Mycobacterium bovis
ARGDGADGGVEDPDREVGA

SEQ ID NO: 149984 - protein, 8 aa, Mycobacterium bovis
ARGDRIPD

SEQ ID NO: 149985 - protein, 15 aa, Mycobacterium bovis
ARGESGEQLSDSEIR

SEQ ID NO: 149986 - protein, 9 aa, Mycobacterium bovis
ARGKVAAAP

SEQ ID NO: 149987 - protein, 14 aa, Mycobacterium bovis
ARGPHAPDSLPGGP

SEQ ID NO: 149988 - protein, 5 aa, Mycobacterium bovis
ARGQD

SEQ ID NO: 149989 - protein, 18 aa, Mycobacterium bovis
ARGRIGEEAPLPAGARVD

SEQ ID NO: 149990 - protein, 10 aa, Mycobacterium bovis
ARGRRQFQPP

SEQ ID NO: 149991 - protein, 6 aa, Mycobacterium bovis
ARGTAI

SEQ ID NO: 149992 - protein, 7 aa, Mycobacterium bovis
ARHEPEA

SEQ ID NO: 149993 - protein, 8 aa, Mycobacterium bovis
ARHPGGGV

SEQ ID NO: 149994 - protein, 10 aa, Mycobacterium bovis
ARLPGSAAAA

SEQ ID NO: 149995 - protein, 10 aa, Mycobacterium bovis
ARNAGTSDVA

SEQ ID NO: 149996 - protein, 8 aa, Mycobacterium bovis
ARNPADRY

SEQ ID NO: 149997 - protein, 11 aa, Mycobacterium bovis
ARNPDKALESA

SEQ ID NO: 149998 - protein, 6 aa, Mycobacterium bovis
ARPAET

SEQ ID NO: 149999 - protein, 5 aa, Mycobacterium bovis
ARPAR

SEQ ID NO: 150000 - protein, 8 aa, Mycobacterium bovis
ARPEAGGK

SEQ ID NO: 150001 - protein, 4 aa, Mycobacterium bovis
ARPG

SEQ ID NO: 150002 - protein, 5 aa, Mycobacterium bovis
ARPGT

SEQ ID NO: 150003 - protein, 10 aa, Mycobacterium bovis
ARPPARGVDN

SEQ ID NO: 150004 - protein, 7 aa, Mycobacterium bovis
ARPPKRH

SEQ ID NO: 150005 - protein, 17 aa, Mycobacterium bovis
ARPQPPNAHPVAQPPAQ

SEQ ID NO: 150006 - protein, 6 aa, Mycobacterium bovis
ARPQVR

SEQ ID NO: 150007 - protein, 5 aa, Mycobacterium bovis
ARPSA

SEQ ID NO: 150008 - protein, 14 aa, Mycobacterium bovis
ARPTGLESRDAETL

SEQ ID NO: 150009 - protein, 7 aa, Mycobacterium bovis
ARPTPIS

SEQ ID NO: 150010 - protein, 6 aa, Mycobacterium bovis
ARQAQQ

SEQ ID NO: 150011 - protein, 8 aa, Mycobacterium bovis
ARQPEAQG

SEQ ID NO: 150012 - protein, 6 aa, Mycobacterium bovis
ARQPTA

SEQ ID NO: 150013 - protein, 17 aa, Mycobacterium bovis
ARQTDSGDTQRSGHPSA

SEQ ID NO: 150014 - protein, 10 aa, Mycobacterium bovis
ARRGQEVNAN

SEQ ID NO: 150015 - protein, 13 aa, Mycobacterium bovis
ARRPSQLAAQRDA

SEQ ID NO: 150016 - protein, 6 aa, Mycobacterium bovis
ARRQQG

SEQ ID NO: 150017 - protein, 17 aa, Mycobacterium bovis
ARRREKAGSPPPDKPMT

SEQ ID NO: 150018 - protein, 8 aa, Mycobacterium bovis
ARRRGREY

SEQ ID NO: 150019 - protein, 16 aa, Mycobacterium bovis
ARRRRGIGDRRGRRCG

SEQ ID NO: 150020 - protein, 4 aa, Mycobacterium bovis
ARRS

SEQ ID NO: 150021 - protein, 7 aa, Mycobacterium bovis
ARSDDHH

SEQ ID NO: 150022 - protein, 6 aa, Mycobacterium bovis
ARSELT

SEQ ID NO: 150023 - protein, 8 aa, Mycobacterium bovis
ARSGAQPR

SEQ ID NO: 150024 - protein, 7 aa, Mycobacterium bovis
ARSGKTT

SEQ ID NO: 150025 - protein, 17 aa, Mycobacterium bovis
ARSPDMAEAAAGTGRDV

SEQ ID NO: 150026 - protein, 8 aa, Mycobacterium bovis
ARSQNALG

SEQ ID NO: 150027 - protein, 7 aa, Mycobacterium bovis
ARSSSPH

SEQ ID NO: 150028 - protein, 9 aa, Mycobacterium bovis
ARSVAPGVR

SEQ ID NO: 150029 - protein, 6 aa, Mycobacterium bovis
ARTDGF

SEQ ID NO: 150030 - protein, 4 aa, Mycobacterium bovis
ARTE

SEQ ID NO: 150031 - protein, 6 aa, Mycobacterium bovis
ARTGGL

SEQ ID NO: 150032 - protein, 14 aa, Mycobacterium bovis
ARTPDGSAPSREAL

SEQ ID NO: 150033 - protein, 9 aa, Mycobacterium bovis
ARTVQESGG

SEQ ID NO: 150034 - protein, 9 aa, Mycobacterium bovis
ARVGDNGGR

SEQ ID NO: 150035 - protein, 10 aa, Mycobacterium bovis
ARVSPQRQNT

SEQ ID NO: 150036 - protein, 5 aa, Mycobacterium bovis
ARYQD

SEQ ID NO: 150037 - protein, 11 aa, Mycobacterium bovis
ASAAPTPGGVG

SEQ ID NO: 150038 - protein, 15 aa, Mycobacterium bovis
ASAASEFSEPLPTGA

SEQ ID NO: 150039 - protein, 20 aa, Mycobacterium bovis
ASADAAGAAAQHEAAAAAYT

SEQ ID NO: 150040 - protein, 16 aa, Mycobacterium bovis
ASAESSAEKARDSEDR

SEQ ID NO: 150041 - protein, 5 aa, Mycobacterium bovis
ASAGA

SEQ ID NO: 150042 - protein, 10 aa, Mycobacterium bovis
ASAGSGADGA

SEQ ID NO: 150043 - protein, 7 aa, Mycobacterium bovis
ASAPALG

SEQ ID NO: 150044 - protein, 9 aa, Mycobacterium bovis
ASAQTSARR

SEQ ID NO: 150045 - protein, 8 aa, Mycobacterium bovis
ASATKAKT

SEQ ID NO: 150046 - protein, 5 aa, Mycobacterium bovis
ASATR

SEQ ID NO: 150047 - protein, 12 aa, Mycobacterium bovis
ASATSGVSGLPN

SEQ ID NO: 150048 - protein, 27 aa, Mycobacterium bovis
ASDEPATGAEQAVDTAATPQTPEPQPI

SEQ ID NO: 150049 - protein, 5 aa, Mycobacterium bovis
ASDGY

SEQ ID NO: 150050 - protein, 6 aa, Mycobacterium bovis
ASDLAS

SEQ ID NO: 150051 - protein, 28 aa, Mycobacterium bovis
ASEAHDETEPEVPEKAAPIPDPAKPDEL

SEQ ID NO: 150052 - protein, 5 aa, Mycobacterium bovis
ASEGY

SEQ ID NO: 150053 - protein, 17 aa, Mycobacterium bovis
ASEIPPLPNTSSPKPMS

SEQ ID NO: 150054 - protein, 41 aa, Mycobacterium bovis
ASELGGSQSGGYTYPPGPPPPPYSYGGPFGGPSPRSSSGNR

SEQ ID NO: 150055 - protein, 6 aa, Mycobacterium bovis
ASESAR

SEQ ID NO: 150056 - protein, 6 aa, Mycobacterium bovis
ASETER

SEQ ID NO: 150057 - protein, 16 aa, Mycobacterium bovis
ASGAALASAPRTVPAP

SEQ ID NO: 150058 - protein, 8 aa, Mycobacterium bovis
ASGESKSR

SEQ ID NO: 150059 - protein, 23 aa, Mycobacterium bovis
ASGGNPSPASGGHRRGKPRVPGL

SEQ ID NO: 150060 - protein, 11 aa, Mycobacterium bovis
ASGNVRTEADA

SEQ ID NO: 150061 - protein, 7 aa, Mycobacterium bovis
ASGPGDL

SEQ ID NO: 150062 - protein, 15 aa, Mycobacterium bovis
ASGPRPRPDAVAAEP

SEQ ID NO: 150063 - protein, 5 aa, Mycobacterium bovis
ASGQT

SEQ ID NO: 150064 - protein, 4 aa, Mycobacterium bovis
ASGS

SEQ ID NO: 150065 - protein, 6 aa, Mycobacterium bovis
ASGSTY

SEQ ID NO: 150066 - protein, 7 aa, Mycobacterium bovis
ASHPNGM

SEQ ID NO: 150067 - protein, 12 aa, Mycobacterium bovis
ASINHGNSGGPL

SEQ ID NO: 150068 - protein, 5 aa, Mycobacterium bovis
ASIPG

SEQ ID NO: 150069 - protein, 6 aa, Mycobacterium bovis
ASIPGM

SEQ ID NO: 150070 - protein, 5 aa, Mycobacterium bovis
ASITS

SEQ ID NO: 150071 - protein, 7 aa, Mycobacterium bovis
ASKDNKA

SEQ ID NO: 150072 - protein, 7 aa, Mycobacterium bovis
ASKNSRL

SEQ ID NO: 150073 - protein, 8 aa, Mycobacterium bovis
ASKTGTPS

SEQ ID NO: 150074 - protein, 5 aa, Mycobacterium bovis
ASLAE

SEQ ID NO: 150075 - protein, 7 aa, Mycobacterium bovis
ASLDHPG

SEQ ID NO: 150076 - protein, 6 aa, Mycobacterium bovis
ASLPST

SEQ ID NO: 150077 - protein, 6 aa, Mycobacterium bovis
ASLTEM

SEQ ID NO: 150078 - protein, 11 aa, Mycobacterium bovis
ASNQHYSSRAA

SEQ ID NO: 150079 - protein, 19 aa, Mycobacterium bovis
ASPADPPPPDASASHSPVD

SEQ ID NO: 150080 - protein, 7 aa, Mycobacterium bovis
ASPAPPV

SEQ ID NO: 150081 - protein, 30 aa, Mycobacterium bovis
ASPASAITPPPIDPGALPPDVAGPDQPTEQ

SEQ ID NO: 150082 - protein, 6 aa, Mycobacterium bovis
ASPATR

SEQ ID NO: 150083 - protein, 7 aa, Mycobacterium bovis
ASPDPAL

SEQ ID NO: 150084 - protein, 9 aa, Mycobacterium bovis
ASPDPGPVN

SEQ ID NO: 150085 - protein, 13 aa, Mycobacterium bovis
ASPGASDAASSYP

SEQ ID NO: 150086 - protein, 6 aa, Mycobacterium bovis
ASPGFR

SEQ ID NO: 150087 - protein, 8 aa, Mycobacterium bovis
ASPMGDAE

SEQ ID NO: 150088 - protein, 8 aa, Mycobacterium bovis
ASPPAIGD

SEQ ID NO: 150089 - protein, 6 aa, Mycobacterium bovis
ASPSVS

SEQ ID NO: 150090 - protein, 6 aa, Mycobacterium bovis
ASQDPL

SEQ ID NO: 150091 - protein, 7 aa, Mycobacterium bovis
ASQPGCA

SEQ ID NO: 150092 - protein, 12 aa, Mycobacterium bovis
ASRDTRQGVGAG

SEQ ID NO: 150093 - protein, 5 aa, Mycobacterium bovis
ASRFG

SEQ ID NO: 150094 - protein, 10 aa, Mycobacterium bovis
ASRNNPGPHG

SEQ ID NO: 150095 - protein, 4 aa, Mycobacterium bovis
ASRP

SEQ ID NO: 150096 - protein, 4 aa, Mycobacterium bovis
ASRQ

SEQ ID NO: 150097 - protein, 14 aa, Mycobacterium bovis
ASRQLPAPTTGAGW

SEQ ID NO: 150098 - protein, 14 aa, Mycobacterium bovis
ASRRLRPGRNGIAG

SEQ ID NO: 150099 - protein, 25 aa, Mycobacterium bovis
ASRRPELGASPRAGASRAVKPRPEW

SEQ ID NO: 150100 - protein, 9 aa, Mycobacterium bovis
ASSDPATYG

SEQ ID NO: 150101 - protein, 6 aa, Mycobacterium bovis
ASSDQL

SEQ ID NO: 150102 - protein, 15 aa, Mycobacterium bovis
ASSLRDNARADGRKV

SEQ ID NO: 150103 - protein, 13 aa, Mycobacterium bovis
ASSPAAGTPSDRW

SEQ ID NO: 150104 - protein, 13 aa, Mycobacterium bovis
ASSSVSGRYPNLG

SEQ ID NO: 150105 - protein, 6 aa, Mycobacterium bovis
ASSTPY

SEQ ID NO: 150106 - protein, 11 aa, Mycobacterium bovis
ASTAAASGPAI

SEQ ID NO: 150107 - protein, 5 aa, Mycobacterium bovis
ASTDT

SEQ ID NO: 150108 - protein, 5 aa, Mycobacterium bovis
ASTGL

SEQ ID NO: 150109 - protein, 12 aa, Mycobacterium bovis
ASTLRRSSLESK

SEQ ID NO: 150110 - protein, 5 aa, Mycobacterium bovis
ASTSG

SEQ ID NO: 150111 - protein, 16 aa, Mycobacterium bovis
ASTTAAGPISQNAYGA

SEQ ID NO: 150112 - protein, 13 aa, Mycobacterium bovis
ASTTGTSNGSVNS

SEQ ID NO: 150113 - protein, 4 aa, Mycobacterium bovis
ASVA

SEQ ID NO: 150114 - protein, 4 aa, Mycobacterium bovis
ASWG

SEQ ID NO: 150115 - protein, 7 aa, Mycobacterium bovis
ATAANNS

SEQ ID NO: 150116 - protein, 16 aa, Mycobacterium bovis
ATAAPAAPSGASTTRM

SEQ ID NO: 150117 - protein, 12 aa, Mycobacterium bovis
ATADGADKSGLT

SEQ ID NO: 150118 - protein, 10 aa, Mycobacterium bovis
ATADQDRATD

SEQ ID NO: 150119 - protein, 9 aa, Mycobacterium bovis
ATAKGLSRP

SEQ ID NO: 150120 - protein, 8 aa, Mycobacterium bovis
ATAPADRF

SEQ ID NO: 150121 - protein, 8 aa, Mycobacterium bovis
ATAPRRLS

SEQ ID NO: 150122 - protein, 5 aa, Mycobacterium bovis
ATAQR

SEQ ID NO: 150123 - protein, 4 aa, Mycobacterium bovis
ATAR

SEQ ID NO: 150124 - protein, 8 aa, Mycobacterium bovis
ATARTRRG

SEQ ID NO: 150125 - protein, 8 aa, Mycobacterium bovis
ATASSALA

SEQ ID NO: 150126 - protein, 4 aa, Mycobacterium bovis
ATAT

SEQ ID NO: 150127 - protein, 6 aa, Mycobacterium bovis
ATATAS

SEQ ID NO: 150128 - protein, 9 aa, Mycobacterium bovis
ATDPPPPAL

SEQ ID NO: 150129 - protein, 6 aa, Mycobacterium bovis
ATDRYR

SEQ ID NO: 150130 - protein, 6 aa, Mycobacterium bovis
ATDSAR

SEQ ID NO: 150131 - protein, 7 aa, Mycobacterium bovis
ATEGSGV

SEQ ID NO: 150132 - protein, 8 aa, Mycobacterium bovis
ATELTGGN

SEQ ID NO: 150133 - protein, 5 aa, Mycobacterium bovis
ATEPS

SEQ ID NO: 150134 - protein, 8 aa, Mycobacterium bovis
ATERQQRA

SEQ ID NO: 150135 - protein, 5 aa, Mycobacterium bovis
ATERV

SEQ ID NO: 150136 - protein, 6 aa, Mycobacterium bovis
ATESAL

SEQ ID NO: 150137 - protein, 9 aa, Mycobacterium bovis
ATGGEYGTS

SEQ ID NO: 150138 - protein, 8 aa, Mycobacterium bovis
ATGSTGTT

SEQ ID NO: 150139 - protein, 4 aa, Mycobacterium bovis
ATGT

SEQ ID NO: 150140 - protein, 9 aa, Mycobacterium bovis
ATGTEDGPP

SEQ ID NO: 150141 - protein, 7 aa, Mycobacterium bovis
ATGTSQG

SEQ ID NO: 150142 - protein, 8 aa, Mycobacterium bovis
ATHEQAES

SEQ ID NO: 150143 - protein, 11 aa, Mycobacterium bovis
ATISASASRTL

SEQ ID NO: 150144 - protein, 12 aa, Mycobacterium bovis
ATKDAIKATPLQ

SEQ ID NO: 150145 - protein, 11 aa, Mycobacterium bovis
ATKGASHTSQM

SEQ ID NO: 150146 - protein, 5 aa, Mycobacterium bovis
ATKGK

SEQ ID NO: 150147 - protein, 9 aa, Mycobacterium bovis
ATLAEGAAT

SEQ ID NO: 150148 - protein, 4 aa, Mycobacterium bovis
ATLE

SEQ ID NO: 150149 - protein, 7 aa, Mycobacterium bovis
ATLTGAS

SEQ ID NO: 150150 - protein, 12 aa, Mycobacterium bovis
ATNREVDPDGAV

SEQ ID NO: 150151 - protein, 6 aa, Mycobacterium bovis
ATPAGR

SEQ ID NO: 150152 - protein, 11 aa, Mycobacterium bovis
ATPDNPYPTTT

SEQ ID NO: 150153 - protein, 4 aa, Mycobacterium bovis
ATPE

SEQ ID NO: 150154 - protein, 6 aa, Mycobacterium bovis
ATPGVP

SEQ ID NO: 150155 - protein, 12 aa, Mycobacterium bovis
ATPKASRTTPEA

SEQ ID NO: 150156 - protein, 5 aa, Mycobacterium bovis
ATPRQ

SEQ ID NO: 150157 - protein, 5 aa, Mycobacterium bovis
ATPRS

SEQ ID NO: 150158 - protein, 5 aa, Mycobacterium bovis
ATPVQ

SEQ ID NO: 150159 - protein, 11 aa, Mycobacterium bovis
ATQAPDAGAMS

SEQ ID NO: 150160 - protein, 12 aa, Mycobacterium bovis
ATQLPTQGTTSN

SEQ ID NO: 150161 - protein, 7 aa, Mycobacterium bovis
ATQLTGG

SEQ ID NO: 150162 - protein, 4 aa, Mycobacterium bovis
ATRE

SEQ ID NO: 150163 - protein, 7 aa, Mycobacterium bovis
ATRGRSV

SEQ ID NO: 150164 - protein, 6 aa, Mycobacterium bovis
ATRRRR

SEQ ID NO: 150165 - protein, 17 aa, Mycobacterium bovis
ATSLPPGALAIPQPALS

SEQ ID NO: 150166 - protein, 7 aa, Mycobacterium bovis
ATSSDDG

SEQ ID NO: 150167 - protein, 9 aa, Mycobacterium bovis
ATSSSIGSL

SEQ ID NO: 150168 - protein, 8 aa, Mycobacterium bovis
ATSSVDTR

SEQ ID NO: 150169 - protein, 6 aa, Mycobacterium bovis
ATSTTI

SEQ ID NO: 150170 - protein, 14 aa, Mycobacterium bovis
ATTAAANGLTQSLG

SEQ ID NO: 150171 - protein, 9 aa, Mycobacterium bovis
ATTAEPPAH

SEQ ID NO: 150172 - protein, 8 aa, Mycobacterium bovis
ATTDTPPV

SEQ ID NO: 150173 - protein, 5 aa, Mycobacterium bovis
ATTGL

SEQ ID NO: 150174 - protein, 7 aa, Mycobacterium bovis
ATTNQPI

SEQ ID NO: 150175 - protein, 7 aa, Mycobacterium bovis
ATTPVGG

SEQ ID NO: 150176 - protein, 5 aa, Mycobacterium bovis
ATTQM

SEQ ID NO: 150177 - protein, 7 aa, Mycobacterium bovis
ATTRRDA

SEQ ID NO: 150178 - protein, 21 aa, Mycobacterium bovis
ATTSLPPAEAGQSGSEGEQLA

SEQ ID NO: 150179 - protein, 4 aa, Mycobacterium bovis
ATTT

SEQ ID NO: 150180 - protein, 8 aa, Mycobacterium bovis
ATVAETNN

SEQ ID NO: 150181 - protein, 17 aa, Mycobacterium bovis
AVAANRKDFDPDELESD

SEQ ID NO: 150182 - protein, 6 aa, Mycobacterium bovis
AVAAPT

SEQ ID NO: 150183 - protein, 10 aa, Mycobacterium bovis
AVAAPTTGLA

SEQ ID NO: 150184 - protein, 9 aa, Mycobacterium bovis
AVAASKPAY

SEQ ID NO: 150185 - protein, 7 aa, Mycobacterium bovis
AVDGSAA

SEQ ID NO: 150186 - protein, 28 aa, Mycobacterium bovis
AVDSPADDGVAPRLAGPEGANGEFDTPI

SEQ ID NO: 150187 - protein, 4 aa, Mycobacterium bovis
AVEP

SEQ ID NO: 150188 - protein, 10 aa, Mycobacterium bovis
AVEPTDQGAR

SEQ ID NO: 150189 - protein, 12 aa, Mycobacterium bovis
AVGASRTAEGPH

SEQ ID NO: 150190 - protein, 4 aa, Mycobacterium bovis
AVGE

SEQ ID NO: 150191 - protein, 6 aa, Mycobacterium bovis
AVGGEL

SEQ ID NO: 150192 - protein, 9 aa, Mycobacterium bovis
AVGGGPAQH

SEQ ID NO: 150193 - protein, 7 aa, Mycobacterium bovis
AVGGPST

SEQ ID NO: 150194 - protein, 8 aa, Mycobacterium bovis
AVGPVDDD

SEQ ID NO: 150195 - protein, 8 aa, Mycobacterium bovis
AVKPSYGL

SEQ ID NO: 150196 - protein, 11 aa, Mycobacterium bovis
AVNNGTLPYGN

SEQ ID NO: 150197 - protein, 20 aa, Mycobacterium bovis
AVNQDGASNGLATPNGPAQQ

SEQ ID NO: 150198 - protein, 30 aa, Mycobacterium bovis
AVPEGPDREHPGAALASNGGLHPGRAPRHA

SEQ ID NO: 150199 - protein, 12 aa, Mycobacterium bovis
AVPEPRAHYTGE

SEQ ID NO: 150200 - protein, 7 aa, Mycobacterium bovis
AVPSSRT

SEQ ID NO: 150201 - protein, 20 aa, Mycobacterium bovis
AVPSTQPAPPIRAPGGDAAD

SEQ ID NO: 150202 - protein, 5 aa, Mycobacterium bovis
AVPTR

SEQ ID NO: 150203 - protein, 6 aa, Mycobacterium bovis
AVRRTS

SEQ ID NO: 150204 - protein, 8 aa, Mycobacterium bovis
AVRTSTNE

SEQ ID NO: 150205 - protein, 7 aa, Mycobacterium bovis
AVSAGQR

SEQ ID NO: 150206 - protein, 10 aa, Mycobacterium bovis
AVSATGPAAP

SEQ ID NO: 150207 - protein, 4 aa, Mycobacterium bovis
AVSG

SEQ ID NO: 150208 - protein, 12 aa, Mycobacterium bovis
AVSGETQQKGSQ

SEQ ID NO: 150209 - protein, 8 aa, Mycobacterium bovis
AVSGPAGP

SEQ ID NO: 150210 - protein, 5 aa, Mycobacterium bovis
AVTAA

SEQ ID NO: 150211 - protein, 4 aa, Mycobacterium bovis
AVTP

SEQ ID NO: 150212 - protein, 10 aa, Mycobacterium bovis
AVTPSTTATL

SEQ ID NO: 150213 - protein, 11 aa, Mycobacterium bovis
AVTPTRTDRPA

SEQ ID NO: 150214 - protein, 22 aa, Mycobacterium bovis
AVTSSTALRTSLDGGTDQYQPA

SEQ ID NO: 150215 - protein, 12 aa, Mycobacterium bovis
AWTTGNKRGQAH

SEQ ID NO: 150216 - protein, 9 aa, Mycobacterium bovis
AYAAPGGPD

SEQ ID NO: 150217 - protein, 13 aa, Mycobacterium bovis
AYAGAADGTAFAE

SEQ ID NO: 150218 - protein, 4 aa, Mycobacterium bovis
AYAP

SEQ ID NO: 150219 - protein, 13 aa, Mycobacterium bovis
AYDDKAKKTTKAV

SEQ ID NO: 150220 - protein, 6 aa, Mycobacterium bovis
AYPDNP

SEQ ID NO: 150221 - protein, 9 aa, Mycobacterium bovis
AYPSGGGDY

SEQ ID NO: 150222 - protein, 7 aa, Mycobacterium bovis
AYSDSYN

SEQ ID NO: 150223 - protein, 7 aa, Mycobacterium bovis
AYTTGKY

SEQ ID NO: 150224 - protein, 13 aa, Mycobacterium bovis
AYVPGGTNPWYGD

SEQ ID NO: 150225 - protein, 6 aa, Mycobacterium bovis
CASATA

SEQ ID NO: 150226 - protein, 10 aa, Mycobacterium bovis
CDESLPSPRV

SEQ ID NO: 150227 - protein, 6 aa, Mycobacterium bovis
CDQQGG

SEQ ID NO: 150228 - protein, 8 aa, Mycobacterium bovis
CDTQTDPN

SEQ ID NO: 150229 - protein, 14 aa, Mycobacterium bovis
CGPLSSKEPSRDSY

SEQ ID NO: 150230 - protein, 6 aa, Mycobacterium bovis
CGPPTQ

SEQ ID NO: 150231 - protein, 8 aa, Mycobacterium bovis
CGSTRDGY

SEQ ID NO: 150232 - protein, 5 aa, Mycobacterium bovis
CHDSA

SEQ ID NO: 150233 - protein, 21 aa, Mycobacterium bovis
CKEPSARAPAPAAPTPQRRGS

SEQ ID NO: 150234 - protein, 5 aa, Mycobacterium bovis
CNERA

SEQ ID NO: 150235 - protein, 7 aa, Mycobacterium bovis
CRTGADA

SEQ ID NO: 150236 - protein, 4 aa, Mycobacterium bovis
CSND

SEQ ID NO: 150237 - protein, 5 aa, Mycobacterium bovis
CTPTE

SEQ ID NO: 150238 - protein, 13 aa, Mycobacterium bovis
CVNGRRGNAADHL

SEQ ID NO: 150239 - protein, 4 aa, Mycobacterium bovis
DAAA

SEQ ID NO: 150240 - protein, 6 aa, Mycobacterium bovis
DAAANM

SEQ ID NO: 150241 - protein, 17 aa, Mycobacterium bovis
DAADSVDDTLESTAAGI

SEQ ID NO: 150242 - protein, 8 aa, Mycobacterium bovis
DAAERSYQ

SEQ ID NO: 150243 - protein, 13 aa, Mycobacterium bovis
DAAHDARAMDPKR

SEQ ID NO: 150244 - protein, 4 aa, Mycobacterium bovis
DAAN

SEQ ID NO: 150245 - protein, 8 aa, Mycobacterium bovis
DAANNDDS

SEQ ID NO: 150246 - protein, 7 aa, Mycobacterium bovis
DAAPVTQ

SEQ ID NO: 150247 - protein, 5 aa, Mycobacterium bovis
DAAQR

SEQ ID NO: 150248 - protein, 10 aa, Mycobacterium bovis
DAASPETQAA

SEQ ID NO: 150249 - protein, 6 aa, Mycobacterium bovis
DAASQR

SEQ ID NO: 150250 - protein, 9 aa, Mycobacterium bovis
DADDLGDGF

SEQ ID NO: 150251 - protein, 9 aa, Mycobacterium bovis
DADESSPPV

SEQ ID NO: 150252 - protein, 9 aa, Mycobacterium bovis
DADGHAPGL

SEQ ID NO: 150253 - protein, 8 aa, Mycobacterium bovis
DADKPSMA

SEQ ID NO: 150254 - protein, 6 aa, Mycobacterium bovis
DAEGQR

SEQ ID NO: 150255 - protein, 7 aa, Mycobacterium bovis
DAELPDT

SEQ ID NO: 150256 - protein, 5 aa, Mycobacterium bovis
DAETE

SEQ ID NO: 150257 - protein, 8 aa, Mycobacterium bovis
DAGARTAG

SEQ ID NO: 150258 - protein, 8 aa, Mycobacterium bovis
DAGIDPRT

SEQ ID NO: 150259 - protein, 7 aa, Mycobacterium bovis
DAGRGLG

SEQ ID NO: 150260 - protein, 7 aa, Mycobacterium bovis
DAGSGHK

SEQ ID NO: 150261 - protein, 6 aa, Mycobacterium bovis
DAGTRA

SEQ ID NO: 150262 - protein, 8 aa, Mycobacterium bovis
DAGVDGSV

SEQ ID NO: 150263 - protein, 28 aa, Mycobacterium bovis
DAKPGVKLPQPSSTTTPDLTPRAALTPE

SEQ ID NO: 150264 - protein, 14 aa, Mycobacterium bovis
DALDPASRSLRRGV

SEQ ID NO: 150265 - protein, 8 aa, Mycobacterium bovis
DANGQPLS

SEQ ID NO: 150266 - protein, 12 aa, Mycobacterium bovis
DANYEGEEDVNG

SEQ ID NO: 150267 - protein, 32 aa, Mycobacterium bovis
DAPAGRDPGPVSRPHPSDLQNGDLPADAARGP

SEQ ID NO: 150268 - protein, 6 aa, Mycobacterium bovis
DAPGFS

SEQ ID NO: 150269 - protein, 6 aa, Mycobacterium bovis
DAPGRR

SEQ ID NO: 150270 - protein, 7 aa, Mycobacterium bovis
DAPNAVA

SEQ ID NO: 150271 - protein, 7 aa, Mycobacterium bovis
DAPPGMT

SEQ ID NO: 150272 - protein, 4 aa, Mycobacterium bovis
DAQT

SEQ ID NO: 150273 - protein, 6 aa, Mycobacterium bovis
DARPGD

SEQ ID NO: 150274 - protein, 15 aa, Mycobacterium bovis
DARPSSGSRSAAHGH

SEQ ID NO: 150275 - protein, 21 aa, Mycobacterium bovis
DASALNGTVNGDSVLQGVAED

SEQ ID NO: 150276 - protein, 4 aa, Mycobacterium bovis
DASE

SEQ ID NO: 150277 - protein, 8 aa, Mycobacterium bovis
DASQPSMA

SEQ ID NO: 150278 - protein, 8 aa, Mycobacterium bovis
DASRNDDS

SEQ ID NO: 150279 - protein, 34 aa, Mycobacterium bovis
DATDADDLSPASGRYPQRPAPPRLRSSGGERTRG

SEQ ID NO: 150280 - protein, 4 aa, Mycobacterium bovis
DATG

SEQ ID NO: 150281 - protein, 9 aa, Mycobacterium bovis
DATGQTQEP

SEQ ID NO: 150282 - protein, 4 aa, Mycobacterium bovis
DATH

SEQ ID NO: 150283 - protein, 9 aa, Mycobacterium bovis
DAYAPHESF

SEQ ID NO: 150284 - protein, 4 aa, Mycobacterium bovis
DAYG

SEQ ID NO: 150285 - protein, 5 aa, Mycobacterium bovis
DAYTA

SEQ ID NO: 150286 - protein, 26 aa, Mycobacterium bovis
DDADRETDARTPAPAARHASRSQGRG

SEQ ID NO: 150287 - protein, 5 aa, Mycobacterium bovis
DDAET

SEQ ID NO: 150288 - protein, 6 aa, Mycobacterium bovis
DDAETR

SEQ ID NO: 150289 - protein, 13 aa, Mycobacterium bovis
DDAGDGSAWSAAN

SEQ ID NO: 150290 - protein, 8 aa, Mycobacterium bovis
DDAPVPVN

SEQ ID NO: 150291 - protein, 8 aa, Mycobacterium bovis
DDARRDGD

SEQ ID NO: 150292 - protein, 8 aa, Mycobacterium bovis
DDDEPGGD

SEQ ID NO: 150293 - protein, 7 aa, Mycobacterium bovis
DDEAAAK

SEQ ID NO: 150294 - protein, 8 aa, Mycobacterium bovis
DDFGAAEA

SEQ ID NO: 150295 - protein, 9 aa, Mycobacterium bovis
DDGPGMSQE

SEQ ID NO: 150296 - protein, 39 aa, Mycobacterium bovis
DDGPPAWPSAEVPQDDTATIPEASAGRGSGRRGRRKDTQ

SEQ ID NO: 150297 - protein, 7 aa, Mycobacterium bovis
DDGRAGM

SEQ ID NO: 150298 - protein, 37 aa, Mycobacterium bovis
DDHQSTTSATPTDSASTSPPQAATAPPLPPFKPSANL

SEQ ID NO: 150299 - protein, 7 aa, Mycobacterium bovis
DDHRDAD

SEQ ID NO: 150300 - protein, 27 aa, Mycobacterium bovis
DDIDEELNEDLDKDVDDVAGERRVTND

SEQ ID NO: 150301 - protein, 19 aa, Mycobacterium bovis
DDIEGGEDEDEEGVRTPKV

SEQ ID NO: 150302 - protein, 6 aa, Mycobacterium bovis
DDNPYP

SEQ ID NO: 150303 - protein, 11 aa, Mycobacterium bovis
DDNTPETPAQR

SEQ ID NO: 150304 - protein, 9 aa, Mycobacterium bovis
DDPANTTTP

SEQ ID NO: 150305 - protein, 7 aa, Mycobacterium bovis
DDPDAAG

SEQ ID NO: 150306 - protein, 16 aa, Mycobacterium bovis
DDPDTQLTGAPPGYQQ

SEQ ID NO: 150307 - protein, 7 aa, Mycobacterium bovis
DDPDTSL

SEQ ID NO: 150308 - protein, 6 aa, Mycobacterium bovis
DDPGNI

SEQ ID NO: 150309 - protein, 7 aa, Mycobacterium bovis
DDPKWRT

SEQ ID NO: 150310 - protein, 13 aa, Mycobacterium bovis
DDPNIQQSDRNGA

SEQ ID NO: 150311 - protein, 9 aa, Mycobacterium bovis
DDPRGATPW

SEQ ID NO: 150312 - protein, 8 aa, Mycobacterium bovis
DDRKQTAA

SEQ ID NO: 150313 - protein, 5 aa, Mycobacterium bovis
DDRPR

SEQ ID NO: 150314 - protein, 8 aa, Mycobacterium bovis
DDSSDDCA

SEQ ID NO: 150315 - protein, 13 aa, Mycobacterium bovis
DDTGVREVSTGDD

SEQ ID NO: 150316 - protein, 12 aa, Mycobacterium bovis
DDVDPASTAAVG

SEQ ID NO: 150317 - protein, 4 aa, Mycobacterium bovis
DDVE

SEQ ID NO: 150318 - protein, 6 aa, Mycobacterium bovis
DDYPSS

SEQ ID NO: 150319 - protein, 4 aa, Mycobacterium bovis
DEAT

SEQ ID NO: 150320 - protein, 8 aa, Mycobacterium bovis
DEFGNGPR

SEQ ID NO: 150321 - protein, 6 aa, Mycobacterium bovis
DEGRPR

SEQ ID NO: 150322 - protein, 4 aa, Mycobacterium bovis
DEGV

SEQ ID NO: 150323 - protein, 4 aa, Mycobacterium bovis
DEMA

SEQ ID NO: 150324 - protein, 4 aa, Mycobacterium bovis
DEMG

SEQ ID NO: 150325 - protein, 7 aa, Mycobacterium bovis
DEMSSDH

SEQ ID NO: 150326 - protein, 9 aa, Mycobacterium bovis
DEPADQPQS

SEQ ID NO: 150327 - protein, 13 aa, Mycobacterium bovis
DEPADRPVDHESA

SEQ ID NO: 150328 - protein, 7 aa, Mycobacterium bovis
DEPGYTT

SEQ ID NO: 150329 - protein, 12 aa, Mycobacterium bovis
DEPPTGTAPNQV

SEQ ID NO: 150330 - protein, 9 aa, Mycobacterium bovis
DEPSGPDDL

SEQ ID NO: 150331 - protein, 12 aa, Mycobacterium bovis
DEQAAAGHHGGS

SEQ ID NO: 150332 - protein, 7 aa, Mycobacterium bovis
DEQENTT

SEQ ID NO: 150333 - protein, 5 aa, Mycobacterium bovis
DERGV

SEQ ID NO: 150334 - protein, 18 aa, Mycobacterium bovis
DERKRPVSNGRPARPPVT

SEQ ID NO: 150335 - protein, 7 aa, Mycobacterium bovis
DERTGDL

SEQ ID NO: 150336 - protein, 22 aa, Mycobacterium bovis
DESDVDGYQSRSGPGAASSENR

SEQ ID NO: 150337 - protein, 6 aa, Mycobacterium bovis
DESPHG

SEQ ID NO: 150338 - protein, 10 aa, Mycobacterium bovis
DESQDPEPTQ

SEQ ID NO: 150339 - protein, 11 aa, Mycobacterium bovis
DETTGYGAKNV

SEQ ID NO: 150340 - protein, 4 aa, Mycobacterium bovis
DEVS

SEQ ID NO: 150341 - protein, 14 aa, Mycobacterium bovis
DEYDQAETAPVEDL

SEQ ID NO: 150342 - protein, 6 aa, Mycobacterium bovis
DEYRGQ

SEQ ID NO: 150343 - protein, 5 aa, Mycobacterium bovis
DEYRP

SEQ ID NO: 150344 - protein, 5 aa, Mycobacterium bovis
DFAPG

SEQ ID NO: 150345 - protein, 8 aa, Mycobacterium bovis
DFGKPDGY

SEQ ID NO: 150346 - protein, 14 aa, Mycobacterium bovis
DFGTTITGQPVGTE

SEQ ID NO: 150347 - protein, 14 aa, Mycobacterium bovis
DFSPEEQQGSSQIG

SEQ ID NO: 150348 - protein, 9 aa, Mycobacterium bovis
DGAGRQESV

SEQ ID NO: 150349 - protein, 4 aa, Mycobacterium bovis
DGAH

SEQ ID NO: 150350 - protein, 15 aa, Mycobacterium bovis
DGAKATAVPREPDEA

SEQ ID NO: 150351 - protein, 4 aa, Mycobacterium bovis
DGAN

SEQ ID NO: 150352 - protein, 5 aa, Mycobacterium bovis
DGATG

SEQ ID NO: 150353 - protein, 12 aa, Mycobacterium bovis
DGDAQSAGRRAR

SEQ ID NO: 150354 - protein, 9 aa, Mycobacterium bovis
DGDDADTVE

SEQ ID NO: 150355 - protein, 4 aa, Mycobacterium bovis
DGDI

SEQ ID NO: 150356 - protein, 9 aa, Mycobacterium bovis
DGDYSGAAV

SEQ ID NO: 150357 - protein, 8 aa, Mycobacterium bovis
DGEIGDGP

SEQ ID NO: 150358 - protein, 6 aa, Mycobacterium bovis
DGGAGL

SEQ ID NO: 150359 - protein, 9 aa, Mycobacterium bovis
DGGPPRVES

SEQ ID NO: 150360 - protein, 9 aa, Mycobacterium bovis
DGGQLKKYG

SEQ ID NO: 150361 - protein, 4 aa, Mycobacterium bovis
DGKA

SEQ ID NO: 150362 - protein, 16 aa, Mycobacterium bovis
DGKPATLPISGPPTTH

SEQ ID NO: 150363 - protein, 14 aa, Mycobacterium bovis
DGKPIDFENPSEDA

SEQ ID NO: 150364 - protein, 5 aa, Mycobacterium bovis
DGKPV

SEQ ID NO: 150365 - protein, 4 aa, Mycobacterium bovis
DGLP

SEQ ID NO: 150366 - protein, 4 aa, Mycobacterium bovis
DGMS

SEQ ID NO: 150367 - protein, 6 aa, Mycobacterium bovis
DGPDNS

SEQ ID NO: 150368 - protein, 7 aa, Mycobacterium bovis
DGPGPYT

SEQ ID NO: 150369 - protein, 10 aa, Mycobacterium bovis
DGPGTPEVLG

SEQ ID NO: 150370 - protein, 21 aa, Mycobacterium bovis
DGPGYAGSSPTLGPTKTSSIT

SEQ ID NO: 150371 - protein, 4 aa, Mycobacterium bovis
DGPS

SEQ ID NO: 150372 - protein, 7 aa, Mycobacterium bovis
DGQDPDM

SEQ ID NO: 150373 - protein, 8 aa, Mycobacterium bovis
DGQTRTST

SEQ ID NO: 150374 - protein, 7 aa, Mycobacterium bovis
DGREPEF

SEQ ID NO: 150375 - protein, 5 aa, Mycobacterium bovis
DGRGS

SEQ ID NO: 150376 - protein, 4 aa, Mycobacterium bovis
DGRS

SEQ ID NO: 150377 - protein, 20 aa, Mycobacterium bovis
DGRSAPASSVAVELDGQEPA

SEQ ID NO: 150378 - protein, 5 aa, Mycobacterium bovis
DGSAI

SEQ ID NO: 150379 - protein, 9 aa, Mycobacterium bovis
DGSAPDVSG

SEQ ID NO: 150380 - protein, 5 aa, Mycobacterium bovis
DGSHG

SEQ ID NO: 150381 - protein, 9 aa, Mycobacterium bovis
DGSNDAAAI

SEQ ID NO: 150382 - protein, 7 aa, Mycobacterium bovis
DGSPSYE

SEQ ID NO: 150383 - protein, 8 aa, Mycobacterium bovis
DGSTGPFG

SEQ ID NO: 150384 - protein, 5 aa, Mycobacterium bovis
DGSVA

SEQ ID NO: 150385 - protein, 5 aa, Mycobacterium bovis
DGSVD

SEQ ID NO: 150386 - protein, 8 aa, Mycobacterium bovis
DGTASATA

SEQ ID NO: 150387 - protein, 7 aa, Mycobacterium bovis
DGTPESA

SEQ ID NO: 150388 - protein, 13 aa, Mycobacterium bovis
DGTPLDDRRPGAI

SEQ ID NO: 150389 - protein, 6 aa, Mycobacterium bovis
DGTSKR

SEQ ID NO: 150390 - protein, 10 aa, Mycobacterium bovis
DGVASRTHDD

SEQ ID NO: 150391 - protein, 9 aa, Mycobacterium bovis
DGVGVTGDT

SEQ ID NO: 150392 - protein, 9 aa, Mycobacterium bovis
DGWSNSGGA

SEQ ID NO: 150393 - protein, 5 aa, Mycobacterium bovis
DGYSG

SEQ ID NO: 150394 - protein, 8 aa, Mycobacterium bovis
DHAGTATA

SEQ ID NO: 150395 - protein, 13 aa, Mycobacterium bovis
DHAPGEPHPQPSR

SEQ ID NO: 150396 - protein, 5 aa, Mycobacterium bovis
DHDQM

SEQ ID NO: 150397 - protein, 10 aa, Mycobacterium bovis
DHHANPTRRY

SEQ ID NO: 150398 - protein, 7 aa, Mycobacterium bovis
DHQASVS

SEQ ID NO: 150399 - protein, 11 aa, Mycobacterium bovis
DHQTEAADQIA

SEQ ID NO: 150400 - protein, 5 aa, Mycobacterium bovis
DIADA

SEQ ID NO: 150401 - protein, 6 aa, Mycobacterium bovis
DIDAGG

SEQ ID NO: 150402 - protein, 8 aa, Mycobacterium bovis
DIDKNTAY

SEQ ID NO: 150403 - protein, 10 aa, Mycobacterium bovis
DIPTDARADK

SEQ ID NO: 150404 - protein, 7 aa, Mycobacterium bovis
DIRGTYR

SEQ ID NO: 150405 - protein, 8 aa, Mycobacterium bovis
DISGAGAA

SEQ ID NO: 150406 - protein, 9 aa, Mycobacterium bovis
DISGSGAAI

SEQ ID NO: 150407 - protein, 6 aa, Mycobacterium bovis
DITSET

SEQ ID NO: 150408 - protein, 53 aa, Mycobacterium bovis
DKAQLPAKGTAAKQAQERAPKAAPKAAAPVTPVEAPAEAPQAPAPAAPAAPVK

SEQ ID NO: 150409 - protein, 7 aa, Mycobacterium bovis
DKDIQDA

SEQ ID NO: 150410 - protein, 5 aa, Mycobacterium bovis
DKGPQ

SEQ ID NO: 150411 - protein, 7 aa, Mycobacterium bovis
DKHGHTT

SEQ ID NO: 150412 - protein, 36 aa, Mycobacterium bovis
DKKEDEEGAAAGVAEAERAPIDAGTAASQRGQEGTV

SEQ ID NO: 150413 - protein, 24 aa, Mycobacterium bovis
DKKPPLPGGDPSSSVLNRVEYGNR

SEQ ID NO: 150414 - protein, 8 aa, Mycobacterium bovis
DKPDLQGA

SEQ ID NO: 150415 - protein, 5 aa, Mycobacterium bovis
DKPFE

SEQ ID NO: 150416 - protein, 6 aa, Mycobacterium bovis
DKPIGT

SEQ ID NO: 150417 - protein, 10 aa, Mycobacterium bovis
DKPKQRRAVR

SEQ ID NO: 150418 - protein, 7 aa, Mycobacterium bovis
DKPLGND

SEQ ID NO: 150419 - protein, 5 aa, Mycobacterium bovis
DKQAE

SEQ ID NO: 150420 - protein, 11 aa, Mycobacterium bovis
DKRPKTPPRTV

SEQ ID NO: 150421 - protein, 6 aa, Mycobacterium bovis
DKSHAL

SEQ ID NO: 150422 - protein, 8 aa, Mycobacterium bovis
DKSLPDHQ

SEQ ID NO: 150423 - protein, 7 aa, Mycobacterium bovis
DKTAGQA

SEQ ID NO: 150424 - protein, 5 aa, Mycobacterium bovis
DKVPA

SEQ ID NO: 150425 - protein, 7 aa, Mycobacterium bovis
DLADPSY

SEQ ID NO: 150426 - protein, 6 aa, Mycobacterium bovis
DLAEPQ

SEQ ID NO: 150427 - protein, 7 aa, Mycobacterium bovis
DLASAGS

SEQ ID NO: 150428 - protein, 8 aa, Mycobacterium bovis
DLDPTLRR

SEQ ID NO: 150429 - protein, 4 aa, Mycobacterium bovis
DLEG

SEQ ID NO: 150430 - protein, 14 aa, Mycobacterium bovis
DLERRKREAQQAVQ

SEQ ID NO: 150431 - protein, 5 aa, Mycobacterium bovis
DLGAS

SEQ ID NO: 150432 - protein, 8 aa, Mycobacterium bovis
DLGGQGIR

SEQ ID NO: 150433 - protein, 5 aa, Mycobacterium bovis
DLGQT

SEQ ID NO: 150434 - protein, 9 aa, Mycobacterium bovis
DLGTPKSYH

SEQ ID NO: 150435 - protein, 7 aa, Mycobacterium bovis
DLPARRR

SEQ ID NO: 150436 - protein, 10 aa, Mycobacterium bovis
DLPASGGLYP

SEQ ID NO: 150437 - protein, 17 aa, Mycobacterium bovis
DLPEESRASGFGRSEST

SEQ ID NO: 150438 - protein, 4 aa, Mycobacterium bovis
DLPP

SEQ ID NO: 150439 - protein, 8 aa, Mycobacterium bovis
DLPYPEGV

SEQ ID NO: 150440 - protein, 4 aa, Mycobacterium bovis
DLQP

SEQ ID NO: 150441 - protein, 7 aa, Mycobacterium bovis
DLRNPTD

SEQ ID NO: 150442 - protein, 5 aa, Mycobacterium bovis
DLSGF

SEQ ID NO: 150443 - protein, 4 aa, Mycobacterium bovis
DMRN

SEQ ID NO: 150444 - protein, 5 aa, Mycobacterium bovis
DMRNP

SEQ ID NO: 150445 - protein, 4 aa, Mycobacterium bovis
DMTG

SEQ ID NO: 150446 - protein, 19 aa, Mycobacterium bovis
DNASRGRRRGHLWPTDGSA

SEQ ID NO: 150447 - protein, 7 aa, Mycobacterium bovis
DNATAMG

SEQ ID NO: 150448 - protein, 11 aa, Mycobacterium bovis
DNAVEDEGLQP

SEQ ID NO: 150449 - protein, 12 aa, Mycobacterium bovis
DNDHTQAKTPPV

SEQ ID NO: 150450 - protein, 12 aa, Mycobacterium bovis
DNEADSADRTLS

SEQ ID NO: 150451 - protein, 6 aa, Mycobacterium bovis
DNEGSR

SEQ ID NO: 150452 - protein, 14 aa, Mycobacterium bovis
DNEPQGVAGGGKAV

SEQ ID NO: 150453 - protein, 5 aa, Mycobacterium bovis
DNEYT

SEQ ID NO: 150454 - protein, 4 aa, Mycobacterium bovis
DNGE

SEQ ID NO: 150455 - protein, 4 aa, Mycobacterium bovis
DNGS

SEQ ID NO: 150456 - protein, 11 aa, Mycobacterium bovis
DNGSGVPEGER

SEQ ID NO: 150457 - protein, 7 aa, Mycobacterium bovis
DNHATAA

SEQ ID NO: 150458 - protein, 7 aa, Mycobacterium bovis
DNPAGLS

SEQ ID NO: 150459 - protein, 6 aa, Mycobacterium bovis
DNPDFQ

SEQ ID NO: 150460 - protein, 12 aa, Mycobacterium bovis
DNPGPSDPTTKA

SEQ ID NO: 150461 - protein, 4 aa, Mycobacterium bovis
DNPK

SEQ ID NO: 150462 - protein, 6 aa, Mycobacterium bovis
DNPQRA

SEQ ID NO: 150463 - protein, 7 aa, Mycobacterium bovis
DNPTEGY

SEQ ID NO: 150464 - protein, 5 aa, Mycobacterium bovis
DNQPA

SEQ ID NO: 150465 - protein, 8 aa, Mycobacterium bovis
DNRAAADA

SEQ ID NO: 150466 - protein, 8 aa, Mycobacterium bovis
DNRATADR

SEQ ID NO: 150467 - protein, 10 aa, Mycobacterium bovis
DNRKAEVNND

SEQ ID NO: 150468 - protein, 9 aa, Mycobacterium bovis
DNTGSPDAW

SEQ ID NO: 150469 - protein, 5 aa, Mycobacterium bovis
DNTTA

SEQ ID NO: 150470 - protein, 18 aa, Mycobacterium bovis
DPAGPASSWARTVKPGAT

SEQ ID NO: 150471 - protein, 9 aa, Mycobacterium bovis
DPAKPLPAS

SEQ ID NO: 150472 - protein, 6 aa, Mycobacterium bovis
DPANRG

SEQ ID NO: 150473 - protein, 6 aa, Mycobacterium bovis
DPDEGF

SEQ ID NO: 150474 - protein, 11 aa, Mycobacterium bovis
DPDPDAVGKSY

SEQ ID NO: 150475 - protein, 5 aa, Mycobacterium bovis
DPDQP

SEQ ID NO: 150476 - protein, 6 aa, Mycobacterium bovis
DPDTPV

SEQ ID NO: 150477 - protein, 11 aa, Mycobacterium bovis
DPEDDLTPARY

SEQ ID NO: 150478 - protein, 8 aa, Mycobacterium bovis
DPEDLGAR

SEQ ID NO: 150479 - protein, 7 aa, Mycobacterium bovis
DPEDTSE

SEQ ID NO: 150480 - protein, 6 aa, Mycobacterium bovis
DPEEVR

SEQ ID NO: 150481 - protein, 16 aa, Mycobacterium bovis
DPERTRKSAQRRDEGV

SEQ ID NO: 150482 - protein, 6 aa, Mycobacterium bovis
DPETVQ

SEQ ID NO: 150483 - protein, 6 aa, Mycobacterium bovis
DPGAAV

SEQ ID NO: 150484 - protein, 7 aa, Mycobacterium bovis
DPGETTD

SEQ ID NO: 150485 - protein, 6 aa, Mycobacterium bovis
DPGIPA

SEQ ID NO: 150486 - protein, 7 aa, Mycobacterium bovis
DPGPGVA

SEQ ID NO: 150487 - protein, 10 aa, Mycobacterium bovis
DPGPRRLPYP

SEQ ID NO: 150488 - protein, 8 aa, Mycobacterium bovis
DPGSEQRW

SEQ ID NO: 150489 - protein, 8 aa, Mycobacterium bovis
DPGVDHEH

SEQ ID NO: 150490 - protein, 7 aa, Mycobacterium bovis
DPGVTSP

SEQ ID NO: 150491 - protein, 5 aa, Mycobacterium bovis
DPHNG

SEQ ID NO: 150492 - protein, 7 aa, Mycobacterium bovis
DPHSGDI

SEQ ID NO: 150493 - protein, 13 aa, Mycobacterium bovis
DPIPPSARHEGLS

SEQ ID NO: 150494 - protein, 5 aa, Mycobacterium bovis
DPITA

SEQ ID NO: 150495 - protein, 6 aa, Mycobacterium bovis
DPKRGH

SEQ ID NO: 150496 - protein, 7 aa, Mycobacterium bovis
DPLPGTV

SEQ ID NO: 150497 - protein, 4 aa, Mycobacterium bovis
DPLQ

SEQ ID NO: 150498 - protein, 9 aa, Mycobacterium bovis
DPNGSNTEF

SEQ ID NO: 150499 - protein, 12 aa, Mycobacterium bovis
DPNPTASSYQPP

SEQ ID NO: 150500 - protein, 15 aa, Mycobacterium bovis
DPPAGSYPNPDERRK

SEQ ID NO: 150501 - protein, 14 aa, Mycobacterium bovis
DPPKPVRVAPNPPI

SEQ ID NO: 150502 - protein, 4 aa, Mycobacterium bovis
DPPP

SEQ ID NO: 150503 - protein, 21 aa, Mycobacterium bovis
DPPRKSRTKASEQELASPYRG

SEQ ID NO: 150504 - protein, 5 aa, Mycobacterium bovis
DPPTL

SEQ ID NO: 150505 - protein, 5 aa, Mycobacterium bovis
DPQGL

SEQ ID NO: 150506 - protein, 7 aa, Mycobacterium bovis
DPQRRAQ

SEQ ID NO: 150507 - protein, 16 aa, Mycobacterium bovis
DPRFGYSTSPANVPTP

SEQ ID NO: 150508 - protein, 5 aa, Mycobacterium bovis
DPRLR

SEQ ID NO: 150509 - protein, 4 aa, Mycobacterium bovis
DPSA

SEQ ID NO: 150510 - protein, 11 aa, Mycobacterium bovis
DPSAGSDAATE

SEQ ID NO: 150511 - protein, 8 aa, Mycobacterium bovis
DPSGLTAT

SEQ ID NO: 150512 - protein, 4 aa, Mycobacterium bovis
DPSL

SEQ ID NO: 150513 - protein, 5 aa, Mycobacterium bovis
DPSQT

SEQ ID NO: 150514 - protein, 13 aa, Mycobacterium bovis
DPSRVRRSGGTGL

SEQ ID NO: 150515 - protein, 4 aa, Mycobacterium bovis
DPSV

SEQ ID NO: 150516 - protein, 5 aa, Mycobacterium bovis
DPTEG

SEQ ID NO: 150517 - protein, 5 aa, Mycobacterium bovis
DPTSG

SEQ ID NO: 150518 - protein, 5 aa, Mycobacterium bovis
DPTVA

SEQ ID NO: 150519 - protein, 11 aa, Mycobacterium bovis
DPYRVGPASGL

SEQ ID NO: 150520 - protein, 15 aa, Mycobacterium bovis
DPYTGDEDPQTAQKI

SEQ ID NO: 150521 - protein, 7 aa, Mycobacterium bovis
DQATTAS

SEQ ID NO: 150522 - protein, 6 aa, Mycobacterium bovis
DQDPGQ

SEQ ID NO: 150523 - protein, 4 aa, Mycobacterium bovis
DQER

SEQ ID NO: 150524 - protein, 13 aa, Mycobacterium bovis
DQIQNATSGMDQR

SEQ ID NO: 150525 - protein, 7 aa, Mycobacterium bovis
DQITGRP

SEQ ID NO: 150526 - protein, 9 aa, Mycobacterium bovis
DQLTSRQAT

SEQ ID NO: 150527 - protein, 6 aa, Mycobacterium bovis
DQPDIY

SEQ ID NO: 150528 - protein, 6 aa, Mycobacterium bovis
DQPGGL

SEQ ID NO: 150529 - protein, 8 aa, Mycobacterium bovis
DQPLGEKA

SEQ ID NO: 150530 - protein, 7 aa, Mycobacterium bovis
DQPLGGD

SEQ ID NO: 150531 - protein, 9 aa, Mycobacterium bovis
DQQQAGDRS

SEQ ID NO: 150532 - protein, 9 aa, Mycobacterium bovis
DQRPGAGSL

SEQ ID NO: 150533 - protein, 13 aa, Mycobacterium bovis
DQSPDTSRRLTDE

SEQ ID NO: 150534 - protein, 9 aa, Mycobacterium bovis
DQTDVPESG

SEQ ID NO: 150535 - protein, 7 aa, Mycobacterium bovis
DRAADPM

SEQ ID NO: 150536 - protein, 5 aa, Mycobacterium bovis
DRAAL

SEQ ID NO: 150537 - protein, 6 aa, Mycobacterium bovis
DRAGSA

SEQ ID NO: 150538 - protein, 7 aa, Mycobacterium bovis
DRAPASV

SEQ ID NO: 150539 - protein, 17 aa, Mycobacterium bovis
DRATTAYTNTSGVSSES

SEQ ID NO: 150540 - protein, 8 aa, Mycobacterium bovis
DRCEEKAE

SEQ ID NO: 150541 - protein, 51 aa, Mycobacterium bovis
DRDGESTPAVEETSEADIEREQPGDLAGQAPAAHQVDAEAASAAPEEPAAL

SEQ ID NO: 150542 - protein, 5 aa, Mycobacterium bovis
DRDSG

SEQ ID NO: 150543 - protein, 14 aa, Mycobacterium bovis
DRESELRPPVRSGF

SEQ ID NO: 150544 - protein, 7 aa, Mycobacterium bovis
DRESIDD

SEQ ID NO: 150545 - protein, 4 aa, Mycobacterium bovis
DRFG

SEQ ID NO: 150546 - protein, 11 aa, Mycobacterium bovis
DRGASPATAAR

SEQ ID NO: 150547 - protein, 8 aa, Mycobacterium bovis
DRGGRERH

SEQ ID NO: 150548 - protein, 6 aa, Mycobacterium bovis
DRGNNR

SEQ ID NO: 150549 - protein, 8 aa, Mycobacterium bovis
DRGPGIPV

SEQ ID NO: 150550 - protein, 5 aa, Mycobacterium bovis
DRGPV

SEQ ID NO: 150551 - protein, 9 aa, Mycobacterium bovis
DRGSSMSSK

SEQ ID NO: 150552 - protein, 13 aa, Mycobacterium bovis
DRHGHPDPGPQRR

SEQ ID NO: 150553 - protein, 5 aa, Mycobacterium bovis
DRIGG

SEQ ID NO: 150554 - protein, 8 aa, Mycobacterium bovis
DRKERLDR

SEQ ID NO: 150555 - protein, 11 aa, Mycobacterium bovis
DRMSPQQASRI

SEQ ID NO: 150556 - protein, 4 aa, Mycobacterium bovis
DRNG

SEQ ID NO: 150557 - protein, 6 aa, Mycobacterium bovis
DRNHGP

SEQ ID NO: 150558 - protein, 5 aa, Mycobacterium bovis
DRNQH

SEQ ID NO: 150559 - protein, 8 aa, Mycobacterium bovis
DRPAASEN

SEQ ID NO: 150560 - protein, 27 aa, Mycobacterium bovis
DRPAPAKNTSQAKARAKARKAKAPKLV

SEQ ID NO: 150561 - protein, 7 aa, Mycobacterium bovis
DRPEQPR

SEQ ID NO: 150562 - protein, 9 aa, Mycobacterium bovis
DRPHPTEAD

SEQ ID NO: 150563 - protein, 7 aa, Mycobacterium bovis
DRPNPTS

SEQ ID NO: 150564 - protein, 7 aa, Mycobacterium bovis
DRPPMPP

SEQ ID NO: 150565 - protein, 12 aa, Mycobacterium bovis
DRPPRRADEPRR

SEQ ID NO: 150566 - protein, 4 aa, Mycobacterium bovis
DRQS

SEQ ID NO: 150567 - protein, 16 aa, Mycobacterium bovis
DRRRAAQTKADTEYNA

SEQ ID NO: 150568 - protein, 21 aa, Mycobacterium bovis
DRRVASREDRHADSDYADDEL

SEQ ID NO: 150569 - protein, 12 aa, Mycobacterium bovis
DRSGGYTASSGI

SEQ ID NO: 150570 - protein, 14 aa, Mycobacterium bovis
DRSPRLTASGDPPT

SEQ ID NO: 150571 - protein, 7 aa, Mycobacterium bovis
DRTATGE

SEQ ID NO: 150572 - protein, 7 aa, Mycobacterium bovis
DRTGLTG

SEQ ID NO: 150573 - protein, 5 aa, Mycobacterium bovis
DRTQA

SEQ ID NO: 150574 - protein, 6 aa, Mycobacterium bovis
DRVGGS

SEQ ID NO: 150575 - protein, 31 aa, Mycobacterium bovis
DSAAGEAGDSATEAFDTDSATESTAQKGQRH

SEQ ID NO: 150576 - protein, 9 aa, Mycobacterium bovis
DSAGDMGAA

SEQ ID NO: 150577 - protein, 9 aa, Mycobacterium bovis
DSAREMEHN

SEQ ID NO: 150578 - protein, 7 aa, Mycobacterium bovis
DSDGGTG

SEQ ID NO: 150579 - protein, 18 aa, Mycobacterium bovis
DSDGRGLHDRLTATAVVR

SEQ ID NO: 150580 - protein, 7 aa, Mycobacterium bovis
DSDPQAG

SEQ ID NO: 150581 - protein, 6 aa, Mycobacterium bovis
DSDPTK

SEQ ID NO: 150582 - protein, 7 aa, Mycobacterium bovis
DSEQIRT

SEQ ID NO: 150583 - protein, 9 aa, Mycobacterium bovis
DSGAAAAGA

SEQ ID NO: 150584 - protein, 5 aa, Mycobacterium bovis
DSGFL

SEQ ID NO: 150585 - protein, 7 aa, Mycobacterium bovis
DSGGYNA

SEQ ID NO: 150586 - protein, 4 aa, Mycobacterium bovis
DSGS

SEQ ID NO: 150587 - protein, 5 aa, Mycobacterium bovis
DSKPL

SEQ ID NO: 150588 - protein, 8 aa, Mycobacterium bovis
DSNPTHAG

SEQ ID NO: 150589 - protein, 15 aa, Mycobacterium bovis
DSNTTATSAPPRTKI

SEQ ID NO: 150590 - protein, 9 aa, Mycobacterium bovis
DSPATAPDS

SEQ ID NO: 150591 - protein, 5 aa, Mycobacterium bovis
DSPDG

SEQ ID NO: 150592 - protein, 7 aa, Mycobacterium bovis
DSPEVGT

SEQ ID NO: 150593 - protein, 9 aa, Mycobacterium bovis
DSQGNGGGL

SEQ ID NO: 150594 - protein, 10 aa, Mycobacterium bovis
DSQGSVNVPT

SEQ ID NO: 150595 - protein, 7 aa, Mycobacterium bovis
DSQRRQH

SEQ ID NO: 150596 - protein, 6 aa, Mycobacterium bovis
DSRETW

SEQ ID NO: 150597 - protein, 17 aa, Mycobacterium bovis
DSRPEDYEGAEISDGAG

SEQ ID NO: 150598 - protein, 8 aa, Mycobacterium bovis
DSSAAGAD

SEQ ID NO: 150599 - protein, 5 aa, Mycobacterium bovis
DSSKT

SEQ ID NO: 150600 - protein, 10 aa, Mycobacterium bovis
DSSPDGTGQL

SEQ ID NO: 150601 - protein, 13 aa, Mycobacterium bovis
DSSRARASGGTGL

SEQ ID NO: 150602 - protein, 13 aa, Mycobacterium bovis
DSVRAGIGAARAG

SEQ ID NO: 150603 - protein, 10 aa, Mycobacterium bovis
DSVRESGPVR

SEQ ID NO: 150604 - protein, 6 aa, Mycobacterium bovis
DTADEI

SEQ ID NO: 150605 - protein, 5 aa, Mycobacterium bovis
DTAGL

SEQ ID NO: 150606 - protein, 9 aa, Mycobacterium bovis
DTAKSGDSF

SEQ ID NO: 150607 - protein, 9 aa, Mycobacterium bovis
DTARPSSRP

SEQ ID NO: 150608 - protein, 15 aa, Mycobacterium bovis
DTASDSETSPTAAEP

SEQ ID NO: 150609 - protein, 10 aa, Mycobacterium bovis
DTASELPDGQ

SEQ ID NO: 150610 - protein, 13 aa, Mycobacterium bovis
DTDEQEPADPPRK

SEQ ID NO: 150611 - protein, 34 aa, Mycobacterium bovis
DTDGSQTRGAEPVEGQRTGPEEASNPGSARPRTR

SEQ ID NO: 150612 - protein, 20 aa, Mycobacterium bovis
DTDGYGQRGDRRPPGSEKYY

SEQ ID NO: 150613 - protein, 12 aa, Mycobacterium bovis
DTDPGGQPPGTS

SEQ ID NO: 150614 - protein, 5 aa, Mycobacterium bovis
DTDRD

SEQ ID NO: 150615 - protein, 5 aa, Mycobacterium bovis
DTEEM

SEQ ID NO: 150616 - protein, 7 aa, Mycobacterium bovis
DTGEPVN

SEQ ID NO: 150617 - protein, 10 aa, Mycobacterium bovis
DTGIERPAGT

SEQ ID NO: 150618 - protein, 10 aa, Mycobacterium bovis
DTGTSFGGMG

SEQ ID NO: 150619 - protein, 6 aa, Mycobacterium bovis
DTGVGP

SEQ ID NO: 150620 - protein, 4 aa, Mycobacterium bovis
DTID

SEQ ID NO: 150621 - protein, 10 aa, Mycobacterium bovis
DTLTQGPQQI

SEQ ID NO: 150622 - protein, 7 aa, Mycobacterium bovis
DTPDGGL

SEQ ID NO: 150623 - protein, 7 aa, Mycobacterium bovis
DTPKGVQ

SEQ ID NO: 150624 - protein, 7 aa, Mycobacterium bovis
DTPRAQA

SEQ ID NO: 150625 - protein, 7 aa, Mycobacterium bovis
DTPSQLS

SEQ ID NO: 150626 - protein, 12 aa, Mycobacterium bovis
DTPVARETDYGR

SEQ ID NO: 150627 - protein, 5 aa, Mycobacterium bovis
DTPVP

SEQ ID NO: 150628 - protein, 6 aa, Mycobacterium bovis
DTPVSS

SEQ ID NO: 150629 - protein, 11 aa, Mycobacterium bovis
DTQGADGPAGL

SEQ ID NO: 150630 - protein, 5 aa, Mycobacterium bovis
DTQPH

SEQ ID NO: 150631 - protein, 9 aa, Mycobacterium bovis
DTRGYKPVD

SEQ ID NO: 150632 - protein, 7 aa, Mycobacterium bovis
DTSGPGA

SEQ ID NO: 150633 - protein, 5 aa, Mycobacterium bovis
DTSSA

SEQ ID NO: 150634 - protein, 21 aa, Mycobacterium bovis
DTTEAVTKSVQSQATDRRDAA

SEQ ID NO: 150635 - protein, 21 aa, Mycobacterium bovis
DTTHDRHAAARAERERAELEA

SEQ ID NO: 150636 - protein, 5 aa, Mycobacterium bovis
DTTHV

SEQ ID NO: 150637 - protein, 5 aa, Mycobacterium bovis
DVPRA

SEQ ID NO: 150638 - protein, 5 aa, Mycobacterium bovis
DVRGQ

SEQ ID NO: 150639 - protein, 22 aa, Mycobacterium bovis
DVRPAPPPERTAPILISGSVWS

SEQ ID NO: 150640 - protein, 11 aa, Mycobacterium bovis
DVSAPRRRPEL

SEQ ID NO: 150641 - protein, 15 aa, Mycobacterium bovis
DVTNPAARNETSSPI

SEQ ID NO: 150642 - protein, 12 aa, Mycobacterium bovis
DYEESSDLDDEL

SEQ ID NO: 150643 - protein, 5 aa, Mycobacterium bovis
DYGIE

SEQ ID NO: 150644 - protein, 4 aa, Mycobacterium bovis
DYGT

SEQ ID NO: 150645 - protein, 7 aa, Mycobacterium bovis
DYKTNSY

SEQ ID NO: 150646 - protein, 7 aa, Mycobacterium bovis
DYPQAKR

SEQ ID NO: 150647 - protein, 9 aa, Mycobacterium bovis
DYPVPGAEP

SEQ ID NO: 150648 - protein, 4 aa, Mycobacterium bovis
DYSD

SEQ ID NO: 150649 - protein, 8 aa, Mycobacterium bovis
DYTGPGKR

SEQ ID NO: 150650 - protein, 16 aa, Mycobacterium bovis
EAAEPVSRRRSHAGGL

SEQ ID NO: 150651 - protein, 5 aa, Mycobacterium bovis
EAAKQ

SEQ ID NO: 150652 - protein, 9 aa, Mycobacterium bovis
EAANNPSQF

SEQ ID NO: 150653 - protein, 4 aa, Mycobacterium bovis
EAAP

SEQ ID NO: 150654 - protein, 13 aa, Mycobacterium bovis
EAAQGPISSPIGA

SEQ ID NO: 150655 - protein, 6 aa, Mycobacterium bovis
EAASEH

SEQ ID NO: 150656 - protein, 21 aa, Mycobacterium bovis
EADEDSHIGPAPGYTAARPSL

SEQ ID NO: 150657 - protein, 20 aa, Mycobacterium bovis
EADGRETSGEEPAKWQSART

SEQ ID NO: 150658 - protein, 6 aa, Mycobacterium bovis
EADTRV

SEQ ID NO: 150659 - protein, 9 aa, Mycobacterium bovis
EAEAAEAEA

SEQ ID NO: 150660 - protein, 4 aa, Mycobacterium bovis
EAEG

SEQ ID NO: 150661 - protein, 8 aa, Mycobacterium bovis
EAEGGMGP

SEQ ID NO: 150662 - protein, 8 aa, Mycobacterium bovis
EAERRQWS

SEQ ID NO: 150663 - protein, 6 aa, Mycobacterium bovis
EAGERK

SEQ ID NO: 150664 - protein, 8 aa, Mycobacterium bovis
EAGGKTQG

SEQ ID NO: 150665 - protein, 9 aa, Mycobacterium bovis
EAGHAAEQR

SEQ ID NO: 150666 - protein, 22 aa, Mycobacterium bovis
EAGPAGGPAPVESTDNLWLTRP

SEQ ID NO: 150667 - protein, 7 aa, Mycobacterium bovis
EAGPKRL

SEQ ID NO: 150668 - protein, 11 aa, Mycobacterium bovis
EAGTTQAAESL

SEQ ID NO: 150669 - protein, 8 aa, Mycobacterium bovis
EAHGNPGA

SEQ ID NO: 150670 - protein, 20 aa, Mycobacterium bovis
EAIPGGRTQISGGDPPFTAA

SEQ ID NO: 150671 - protein, 6 aa, Mycobacterium bovis
EAKADV

SEQ ID NO: 150672 - protein, 8 aa, Mycobacterium bovis
EAKATRPL

SEQ ID NO: 150673 - protein, 4 aa, Mycobacterium bovis
EALA

SEQ ID NO: 150674 - protein, 5 aa, Mycobacterium bovis
EALTG

SEQ ID NO: 150675 - protein, 10 aa, Mycobacterium bovis
EAPLEATGRG

SEQ ID NO: 150676 - protein, 6 aa, Mycobacterium bovis
EAPPLT

SEQ ID NO: 150677 - protein, 4 aa, Mycobacterium bovis
EAPQ

SEQ ID NO: 150678 - protein, 11 aa, Mycobacterium bovis
EARATGQNREA

SEQ ID NO: 150679 - protein, 12 aa, Mycobacterium bovis
EARGLGQDRESA

SEQ ID NO: 150680 - protein, 12 aa, Mycobacterium bovis
EARQAGEDKEAA

SEQ ID NO: 150681 - protein, 6 aa, Mycobacterium bovis
EARSEH

SEQ ID NO: 150682 - protein, 4 aa, Mycobacterium bovis
EART

SEQ ID NO: 150683 - protein, 9 aa, Mycobacterium bovis
EASAGEAGQ

SEQ ID NO: 150684 - protein, 10 aa, Mycobacterium bovis
EASAGTPRSP

SEQ ID NO: 150685 - protein, 5 aa, Mycobacterium bovis
EASAQ

SEQ ID NO: 150686 - protein, 7 aa, Mycobacterium bovis
EASPTLP

SEQ ID NO: 150687 - protein, 7 aa, Mycobacterium bovis
EATATRI

SEQ ID NO: 150688 - protein, 23 aa, Mycobacterium bovis
EATGEMSGQADTATTAEARTPAH

SEQ ID NO: 150689 - protein, 5 aa, Mycobacterium bovis
EATME

SEQ ID NO: 150690 - protein, 7 aa, Mycobacterium bovis
EATNTSA

SEQ ID NO: 150691 - protein, 7 aa, Mycobacterium bovis
EATPEDK

SEQ ID NO: 150692 - protein, 6 aa, Mycobacterium bovis
EATSAV

SEQ ID NO: 150693 - protein, 9 aa, Mycobacterium bovis
EAVGGGEAF

SEQ ID NO: 150694 - protein, 9 aa, Mycobacterium bovis
EAVKGTPLQ

SEQ ID NO: 150695 - protein, 6 aa, Mycobacterium bovis
ECGRTT

SEQ ID NO: 150696 - protein, 5 aa, Mycobacterium bovis
ECRAG

SEQ ID NO: 150697 - protein, 24 aa, Mycobacterium bovis
EDAEDYDDYDDYEAADQEAARSAS

SEQ ID NO: 150698 - protein, 9 aa, Mycobacterium bovis
EDAGPAGQQ

SEQ ID NO: 150699 - protein, 7 aa, Mycobacterium bovis
EDDGDAQ

SEQ ID NO: 150700 - protein, 7 aa, Mycobacterium bovis
EDGRTSV

SEQ ID NO: 150701 - protein, 13 aa, Mycobacterium bovis
EDGTADDRLPNQS

SEQ ID NO: 150702 - protein, 14 aa, Mycobacterium bovis
EDNKTYDLSGQTGP

SEQ ID NO: 150703 - protein, 13 aa, Mycobacterium bovis
EDPAGRKADREGL

SEQ ID NO: 150704 - protein, 23 aa, Mycobacterium bovis
EDPKFASSVRGGGFRAPTARRRL

SEQ ID NO: 150705 - protein, 19 aa, Mycobacterium bovis
EDQPFSPAGTATSRAVERS

SEQ ID NO: 150706 - protein, 7 aa, Mycobacterium bovis
EDSAAMG

SEQ ID NO: 150707 - protein, 19 aa, Mycobacterium bovis
EDSRNGIQERIGQKVEAEP

SEQ ID NO: 150708 - protein, 4 aa, Mycobacterium bovis
EDTI

SEQ ID NO: 150709 - protein, 16 aa, Mycobacterium bovis
EDTQRSNRYRATRNRV

SEQ ID NO: 150710 - protein, 4 aa, Mycobacterium bovis
EDTV

SEQ ID NO: 150711 - protein, 5 aa, Mycobacterium bovis
EEADR

SEQ ID NO: 150712 - protein, 9 aa, Mycobacterium bovis
EEAGTAKPK

SEQ ID NO: 150713 - protein, 31 aa, Mycobacterium bovis
EEDDQEAPPTVASGTSRRRRFDTKTAAAVSA

SEQ ID NO: 150714 - protein, 10 aa, Mycobacterium bovis
EEDSEALPVG

SEQ ID NO: 150715 - protein, 17 aa, Mycobacterium bovis
EEEATEDAERQGGSAPL

SEQ ID NO: 150716 - protein, 8 aa, Mycobacterium bovis
EEGDSDSA

SEQ ID NO: 150717 - protein, 7 aa, Mycobacterium bovis
EEPDDPD

SEQ ID NO: 150718 - protein, 10 aa, Mycobacterium bovis
EEQATADRLN

SEQ ID NO: 150719 - protein, 4 aa, Mycobacterium bovis
EEQC

SEQ ID NO: 150720 - protein, 5 aa, Mycobacterium bovis
EERRR

SEQ ID NO: 150721 - protein, 5 aa, Mycobacterium bovis
EESAA

SEQ ID NO: 150722 - protein, 10 aa, Mycobacterium bovis
EESPAGPRTS

SEQ ID NO: 150723 - protein, 6 aa, Mycobacterium bovis
EETGLR

SEQ ID NO: 150724 - protein, 11 aa, Mycobacterium bovis
EETKRPQRDVP

SEQ ID NO: 150725 - protein, 8 aa, Mycobacterium bovis
EEWPAPAT

SEQ ID NO: 150726 - protein, 9 aa, Mycobacterium bovis
EEYGGGGAG

SEQ ID NO: 150727 - protein, 7 aa, Mycobacterium bovis
EFQKSAN

SEQ ID NO: 150728 - protein, 6 aa, Mycobacterium bovis
EFSSDP

SEQ ID NO: 150729 - protein, 14 aa, Mycobacterium bovis
EGAGKPHHTSRPQG

SEQ ID NO: 150730 - protein, 4 aa, Mycobacterium bovis
EGAP

SEQ ID NO: 150731 - protein, 8 aa, Mycobacterium bovis
EGAPADLR

SEQ ID NO: 150732 - protein, 4 aa, Mycobacterium bovis
EGDA

SEQ ID NO: 150733 - protein, 9 aa, Mycobacterium bovis
EGDDCPDST

SEQ ID NO: 150734 - protein, 10 aa, Mycobacterium bovis
EGDGRDSARA

SEQ ID NO: 150735 - protein, 10 aa, Mycobacterium bovis
EGDPATPEGI

SEQ ID NO: 150736 - protein, 6 aa, Mycobacterium bovis
EGDSDS

SEQ ID NO: 150737 - protein, 4 aa, Mycobacterium bovis
EGED

SEQ ID NO: 150738 - protein, 11 aa, Mycobacterium bovis
EGEMSSPSSLS

SEQ ID NO: 150739 - protein, 24 aa, Mycobacterium bovis
EGEPETDLAGDDAEDWSRTGPAER

SEQ ID NO: 150740 - protein, 4 aa, Mycobacterium bovis
EGGA

SEQ ID NO: 150741 - protein, 7 aa, Mycobacterium bovis
EGGDIGD

SEQ ID NO: 150742 - protein, 8 aa, Mycobacterium bovis
EGGPPEVA

SEQ ID NO: 150743 - protein, 9 aa, Mycobacterium bovis
EGGTDHRGR

SEQ ID NO: 150744 - protein, 5 aa, Mycobacterium bovis
EGHAP

SEQ ID NO: 150745 - protein, 5 aa, Mycobacterium bovis
EGMPR

SEQ ID NO: 150746 - protein, 13 aa, Mycobacterium bovis
EGNDDPRTQVATH

SEQ ID NO: 150747 - protein, 8 aa, Mycobacterium bovis
EGNPDGPT

SEQ ID NO: 150748 - protein, 11 aa, Mycobacterium bovis
EGPGVPRGTEE

SEQ ID NO: 150749 - protein, 7 aa, Mycobacterium bovis
EGPMTPK

SEQ ID NO: 150750 - protein, 8 aa, Mycobacterium bovis
EGQEGDRG

SEQ ID NO: 150751 - protein, 6 aa, Mycobacterium bovis
EGRAGA

SEQ ID NO: 150752 - protein, 16 aa, Mycobacterium bovis
EGRDPTDREQESDTEG

SEQ ID NO: 150753 - protein, 5 aa, Mycobacterium bovis
EGREL

SEQ ID NO: 150754 - protein, 8 aa, Mycobacterium bovis
EGSAGQAS

SEQ ID NO: 150755 - protein, 10 aa, Mycobacterium bovis
EGSDGTEIDR

SEQ ID NO: 150756 - protein, 7 aa, Mycobacterium bovis
EGSERTF

SEQ ID NO: 150757 - protein, 5 aa, Mycobacterium bovis
EGSTI

SEQ ID NO: 150758 - protein, 5 aa, Mycobacterium bovis
EGTET

SEQ ID NO: 150759 - protein, 7 aa, Mycobacterium bovis
EGTSTRN

SEQ ID NO: 150760 - protein, 10 aa, Mycobacterium bovis
EGVARRGQLR

SEQ ID NO: 150761 - protein, 7 aa, Mycobacterium bovis
EGVGPAA

SEQ ID NO: 150762 - protein, 9 aa, Mycobacterium bovis
EGYDTETAV

SEQ ID NO: 150763 - protein, 6 aa, Mycobacterium bovis
EHDRSE

SEQ ID NO: 150764 - protein, 9 aa, Mycobacterium bovis
EHERAADTD

SEQ ID NO: 150765 - protein, 4 aa, Mycobacterium bovis
EHGA

SEQ ID NO: 150766 - protein, 5 aa, Mycobacterium bovis
EHGEG

SEQ ID NO: 150767 - protein, 8 aa, Mycobacterium bovis
EHGSTGDR

SEQ ID NO: 150768 - protein, 4 aa, Mycobacterium bovis
EHIP

SEQ ID NO: 150769 - protein, 12 aa, Mycobacterium bovis
EHPDGAGAALSA

SEQ ID NO: 150770 - protein, 6 aa, Mycobacterium bovis
EHPERA

SEQ ID NO: 150771 - protein, 5 aa, Mycobacterium bovis
EHPVP

SEQ ID NO: 150772 - protein, 6 aa, Mycobacterium bovis
EHRAET

SEQ ID NO: 150773 - protein, 8 aa, Mycobacterium bovis
EHRHPSAN

SEQ ID NO: 150774 - protein, 6 aa, Mycobacterium bovis
EHSTAD

SEQ ID NO: 150775 - protein, 5 aa, Mycobacterium bovis
EHTMP

SEQ ID NO: 150776 - protein, 6 aa, Mycobacterium bovis
EIAPPT

SEQ ID NO: 150777 - protein, 8 aa, Mycobacterium bovis
EIDQTRDQ

SEQ ID NO: 150778 - protein, 9 aa, Mycobacterium bovis
EIDREQQRR

SEQ ID NO: 150779 - protein, 6 aa, Mycobacterium bovis
EIEPGA

SEQ ID NO: 150780 - protein, 7 aa, Mycobacterium bovis
EIGRDGL

SEQ ID NO: 150781 - protein, 7 aa, Mycobacterium bovis
EIREGRS

SEQ ID NO: 150782 - protein, 8 aa, Mycobacterium bovis
EKATASAD

SEQ ID NO: 150783 - protein, 7 aa, Mycobacterium bovis
EKATKRR

SEQ ID NO: 150784 - protein, 5 aa, Mycobacterium bovis
EKDGV

SEQ ID NO: 150785 - protein, 9 aa, Mycobacterium bovis
EKELDTDRP

SEQ ID NO: 150786 - protein, 22 aa, Mycobacterium bovis
EKEPEPEPEPKAAAEPAEAPTL

SEQ ID NO: 150787 - protein, 7 aa, Mycobacterium bovis
EKKRTAR

SEQ ID NO: 150788 - protein, 7 aa, Mycobacterium bovis
EKKSLAD

SEQ ID NO: 150789 - protein, 7 aa, Mycobacterium bovis
EKLGDEA

SEQ ID NO: 150790 - protein, 7 aa, Mycobacterium bovis
EKSLAEA

SEQ ID NO: 150791 - protein, 10 aa, Mycobacterium bovis
EKTEPKPDLS

SEQ ID NO: 150792 - protein, 7 aa, Mycobacterium bovis
EKTGTMG

SEQ ID NO: 150793 - protein, 10 aa, Mycobacterium bovis
ELAEGSDRDE

SEQ ID NO: 150794 - protein, 8 aa, Mycobacterium bovis
ELEDDADD

SEQ ID NO: 150795 - protein, 4 aa, Mycobacterium bovis
ELGE

SEQ ID NO: 150796 - protein, 12 aa, Mycobacterium bovis
ELGEPGTPTTGL

SEQ ID NO: 150797 - protein, 15 aa, Mycobacterium bovis
ELGGGDGAVSGDTGL

SEQ ID NO: 150798 - protein, 8 aa, Mycobacterium bovis
ELGPGDAP

SEQ ID NO: 150799 - protein, 9 aa, Mycobacterium bovis
ELGPPKEVT

SEQ ID NO: 150800 - protein, 5 aa, Mycobacterium bovis
ELGPR

SEQ ID NO: 150801 - protein, 4 aa, Mycobacterium bovis
ELNN

SEQ ID NO: 150802 - protein, 38 aa, Mycobacterium bovis
ELQNENKAEASIETPTPVQSQRVDPSAASGQDSTEARP

SEQ ID NO: 150803 - protein, 4 aa, Mycobacterium bovis
ELRP

SEQ ID NO: 150804 - protein, 6 aa, Mycobacterium bovis
ELRPEA

SEQ ID NO: 150805 - protein, 12 aa, Mycobacterium bovis
ELTDPVEQRRRL

SEQ ID NO: 150806 - protein, 5 aa, Mycobacterium bovis
ELTPG

SEQ ID NO: 150807 - protein, 5 aa, Mycobacterium bovis
EMGAD

SEQ ID NO: 150808 - protein, 5 aa, Mycobacterium bovis
EMPGG

SEQ ID NO: 150809 - protein, 10 aa, Mycobacterium bovis
EMSPGGQPWS

SEQ ID NO: 150810 - protein, 7 aa, Mycobacterium bovis
ENARHAG

SEQ ID NO: 150811 - protein, 10 aa, Mycobacterium bovis
ENGNEVPQGA

SEQ ID NO: 150812 - protein, 4 aa, Mycobacterium bovis
ENGS

SEQ ID NO: 150813 - protein, 10 aa, Mycobacterium bovis
ENPTRQGGAQ

SEQ ID NO: 150814 - protein, 9 aa, Mycobacterium bovis
ENRGSQERV

SEQ ID NO: 150815 - protein, 8 aa, Mycobacterium bovis
ENTATARQ

SEQ ID NO: 150816 - protein, 5 aa, Mycobacterium bovis
ENTHG

SEQ ID NO: 150817 - protein, 4 aa, Mycobacterium bovis
ENVR

SEQ ID NO: 150818 - protein, 7 aa, Mycobacterium bovis
EPAKTGA

SEQ ID NO: 150819 - protein, 12 aa, Mycobacterium bovis
EPALASPRRPQA

SEQ ID NO: 150820 - protein, 20 aa, Mycobacterium bovis
EPASTGARTSIGPGAASGQR

SEQ ID NO: 150821 - protein, 20 aa, Mycobacterium bovis
EPDAGSNSHKITTTARRDGS

SEQ ID NO: 150822 - protein, 6 aa, Mycobacterium bovis
EPDEIE

SEQ ID NO: 150823 - protein, 6 aa, Mycobacterium bovis
EPDTNA

SEQ ID NO: 150824 - protein, 30 aa, Mycobacterium bovis
EPEEDCDTQPLRASRPAAAAASRSGAGGPL

SEQ ID NO: 150825 - protein, 14 aa, Mycobacterium bovis
EPEESPEPEPELPN

SEQ ID NO: 150826 - protein, 11 aa, Mycobacterium bovis
EPEPQAPEVPE

SEQ ID NO: 150827 - protein, 10 aa, Mycobacterium bovis
EPGARPGSGA

SEQ ID NO: 150828 - protein, 19 aa, Mycobacterium bovis
EPGTGSPQPTGTILAELPL

SEQ ID NO: 150829 - protein, 10 aa, Mycobacterium bovis
EPPIPQPAAA

SEQ ID NO: 150830 - protein, 74 aa, Mycobacterium bovis
EPPTPPTPASAAEPSMSAGVSESPMPNSTSTVAASPSTPSSKPEPGSIDPSLEPADEATNPAGQPAPETPVSPT

SEQ ID NO: 150831 - protein, 8 aa, Mycobacterium bovis
EPPYRGGP

SEQ ID NO: 150832 - protein, 19 aa, Mycobacterium bovis
EPQGWKSEERAGDRTVADR

SEQ ID NO: 150833 - protein, 9 aa, Mycobacterium bovis
EPQRDPVAP

SEQ ID NO: 150834 - protein, 15 aa, Mycobacterium bovis
EPRLQPPNGYKDTTV

SEQ ID NO: 150835 - protein, 8 aa, Mycobacterium bovis
EPRTEGGV

SEQ ID NO: 150836 - protein, 10 aa, Mycobacterium bovis
EPSEAQTVSA

SEQ ID NO: 150837 - protein, 5 aa, Mycobacterium bovis
EPSTD

SEQ ID NO: 150838 - protein, 12 aa, Mycobacterium bovis
EPTLTPRASLGR

SEQ ID NO: 150839 - protein, 15 aa, Mycobacterium bovis
EPTTADDVDAGYRGD

SEQ ID NO: 150840 - protein, 22 aa, Mycobacterium bovis
EPTYEPQRRRARPSEPTNPTHH

SEQ ID NO: 150841 - protein, 15 aa, Mycobacterium bovis
EQAPEPDPDELPATG

SEQ ID NO: 150842 - protein, 10 aa, Mycobacterium bovis
EQDKTTNPAS

SEQ ID NO: 150843 - protein, 5 aa, Mycobacterium bovis
EQETA

SEQ ID NO: 150844 - protein, 13 aa, Mycobacterium bovis
EQETTRRGAAVAP

SEQ ID NO: 150845 - protein, 5 aa, Mycobacterium bovis
EQGRG

SEQ ID NO: 150846 - protein, 25 aa, Mycobacterium bovis
EQGSNEPEAPDGSGRGGGDGLPHDS

SEQ ID NO: 150847 - protein, 8 aa, Mycobacterium bovis
EQLGPDYA

SEQ ID NO: 150848 - protein, 8 aa, Mycobacterium bovis
EQVTSPQC

SEQ ID NO: 150849 - protein, 15 aa, Mycobacterium bovis
ERADEKTRLGPAETP

SEQ ID NO: 150850 - protein, 8 aa, Mycobacterium bovis
ERAEQTAD

SEQ ID NO: 150851 - protein, 10 aa, Mycobacterium bovis
ERAPRAARRR

SEQ ID NO: 150852 - protein, 10 aa, Mycobacterium bovis
ERASSTAPAD

SEQ ID NO: 150853 - protein, 8 aa, Mycobacterium bovis
ERDADKPA

SEQ ID NO: 150854 - protein, 4 aa, Mycobacterium bovis
ERDQ

SEQ ID NO: 150855 - protein, 12 aa, Mycobacterium bovis
ERDTGSLSGGEL

SEQ ID NO: 150856 - protein, 7 aa, Mycobacterium bovis
EREAPTE

SEQ ID NO: 150857 - protein, 6 aa, Mycobacterium bovis
EREPAE

SEQ ID NO: 150858 - protein, 5 aa, Mycobacterium bovis
EREST

SEQ ID NO: 150859 - protein, 9 aa, Mycobacterium bovis
ERGETRHSG

SEQ ID NO: 150860 - protein, 12 aa, Mycobacterium bovis
ERGPRLGPPPVM

SEQ ID NO: 150861 - protein, 10 aa, Mycobacterium bovis
ERGRKEPSSE

SEQ ID NO: 150862 - protein, 11 aa, Mycobacterium bovis
ERGTELGGQER

SEQ ID NO: 150863 - protein, 6 aa, Mycobacterium bovis
ERGTGG

SEQ ID NO: 150864 - protein, 12 aa, Mycobacterium bovis
ERHDGASREIDR

SEQ ID NO: 150865 - protein, 8 aa, Mycobacterium bovis
ERHERSTH

SEQ ID NO: 150866 - protein, 10 aa, Mycobacterium bovis
ERIDADTGLT

SEQ ID NO: 150867 - protein, 19 aa, Mycobacterium bovis
ERIGEESPTPAISDLHDHD

SEQ ID NO: 150868 - protein, 13 aa, Mycobacterium bovis
ERIPPPTGLARRA

SEQ ID NO: 150869 - protein, 14 aa, Mycobacterium bovis
ERLGSGATAGEGTQ

SEQ ID NO: 150870 - protein, 9 aa, Mycobacterium bovis
ERNEEDPAR

SEQ ID NO: 150871 - protein, 9 aa, Mycobacterium bovis
ERNNNDGSV

SEQ ID NO: 150872 - protein, 23 aa, Mycobacterium bovis
ERPALEPRRQPAERSAPRGFADH

SEQ ID NO: 150873 - protein, 11 aa, Mycobacterium bovis
ERPGAGTAGPM

SEQ ID NO: 150874 - protein, 14 aa, Mycobacterium bovis
ERPGTLAPPPSTFG

SEQ ID NO: 150875 - protein, 37 aa, Mycobacterium bovis
ERQQGGADEADGAGETGVAEEADVDYPEEAPEESQAV

SEQ ID NO: 150876 - protein, 10 aa, Mycobacterium bovis
ERQRKAQQAI

SEQ ID NO: 150877 - protein, 10 aa, Mycobacterium bovis
ERRAKQAKRR

SEQ ID NO: 150878 - protein, 11 aa, Mycobacterium bovis
ERRKTQRELSQ

SEQ ID NO: 150879 - protein, 7 aa, Mycobacterium bovis
ERRTAPF

SEQ ID NO: 150880 - protein, 17 aa, Mycobacterium bovis
ERSGEVNAKPGTKSGDR

SEQ ID NO: 150881 - protein, 10 aa, Mycobacterium bovis
ERTPSHDEAR

SEQ ID NO: 150882 - protein, 7 aa, Mycobacterium bovis
ERTTGDK

SEQ ID NO: 150883 - protein, 9 aa, Mycobacterium bovis
ERVEANTST

SEQ ID NO: 150884 - protein, 10 aa, Mycobacterium bovis
ERVSAATKAV

SEQ ID NO: 150885 - protein, 10 aa, Mycobacterium bovis
ESAITGESAP

SEQ ID NO: 150886 - protein, 9 aa, Mycobacterium bovis
ESALTGESL

SEQ ID NO: 150887 - protein, 13 aa, Mycobacterium bovis
ESALTGESTPVHK

SEQ ID NO: 150888 - protein, 8 aa, Mycobacterium bovis
ESAPAQMP

SEQ ID NO: 150889 - protein, 5 aa, Mycobacterium bovis
ESARP

SEQ ID NO: 150890 - protein, 5 aa, Mycobacterium bovis
ESCGG

SEQ ID NO: 150891 - protein, 10 aa, Mycobacterium bovis
ESCGTAPDLK

SEQ ID NO: 150892 - protein, 11 aa, Mycobacterium bovis
ESDGDGTTVES

SEQ ID NO: 150893 - protein, 10 aa, Mycobacterium bovis
ESDPASTEGI

SEQ ID NO: 150894 - protein, 6 aa, Mycobacterium bovis
ESEASR

SEQ ID NO: 150895 - protein, 9 aa, Mycobacterium bovis
ESGDTPHVA

SEQ ID NO: 150896 - protein, 6 aa, Mycobacterium bovis
ESGFAR

SEQ ID NO: 150897 - protein, 8 aa, Mycobacterium bovis
ESGKEHKG

SEQ ID NO: 150898 - protein, 5 aa, Mycobacterium bovis
ESGMS

SEQ ID NO: 150899 - protein, 6 aa, Mycobacterium bovis
ESGSPT

SEQ ID NO: 150900 - protein, 5 aa, Mycobacterium bovis
ESHAT

SEQ ID NO: 150901 - protein, 18 aa, Mycobacterium bovis
ESIETAATGQPRPASGAY

SEQ ID NO: 150902 - protein, 7 aa, Mycobacterium bovis
ESITDPN

SEQ ID NO: 150903 - protein, 12 aa, Mycobacterium bovis
ESLGGAADSDLG

SEQ ID NO: 150904 - protein, 6 aa, Mycobacterium bovis
ESLPQT

SEQ ID NO: 150905 - protein, 7 aa, Mycobacterium bovis
ESLSGRD

SEQ ID NO: 150906 - protein, 6 aa, Mycobacterium bovis
ESLSQE

SEQ ID NO: 150907 - protein, 15 aa, Mycobacterium bovis
ESPSPTPGRRTVTAR

SEQ ID NO: 150908 - protein, 7 aa, Mycobacterium bovis
ESRERQA

SEQ ID NO: 150909 - protein, 6 aa, Mycobacterium bovis
ESSRGY

SEQ ID NO: 150910 - protein, 17 aa, Mycobacterium bovis
ESTADSDNDRDPPTDPN

SEQ ID NO: 150911 - protein, 12 aa, Mycobacterium bovis
ESTDGLTDCDGH

SEQ ID NO: 150912 - protein, 12 aa, Mycobacterium bovis
ESTGGGRRRRRG

SEQ ID NO: 150913 - protein, 6 aa, Mycobacterium bovis
ESTRAD

SEQ ID NO: 150914 - protein, 5 aa, Mycobacterium bovis
ESVAP

SEQ ID NO: 150915 - protein, 16 aa, Mycobacterium bovis
ESVPVEKTAGDRVAGA

SEQ ID NO: 150916 - protein, 5 aa, Mycobacterium bovis
ESYTS

SEQ ID NO: 150917 - protein, 9 aa, Mycobacterium bovis
ETAAAGAPR

SEQ ID NO: 150918 - protein, 6 aa, Mycobacterium bovis
ETAAGV

SEQ ID NO: 150919 - protein, 5 aa, Mycobacterium bovis
ETARF

SEQ ID NO: 150920 - protein, 13 aa, Mycobacterium bovis
ETCNGDSARRSGN

SEQ ID NO: 150921 - protein, 11 aa, Mycobacterium bovis
ETDSNGTPQLR

SEQ ID NO: 150922 - protein, 8 aa, Mycobacterium bovis
ETEAASRT

SEQ ID NO: 150923 - protein, 7 aa, Mycobacterium bovis
ETGATVS

SEQ ID NO: 150924 - protein, 5 aa, Mycobacterium bovis
ETGPE

SEQ ID NO: 150925 - protein, 16 aa, Mycobacterium bovis
ETKGNPWGQNASDRTN

SEQ ID NO: 150926 - protein, 11 aa, Mycobacterium bovis
ETLTSDQTAKL

SEQ ID NO: 150927 - protein, 7 aa, Mycobacterium bovis
ETNRAPF

SEQ ID NO: 150928 - protein, 16 aa, Mycobacterium bovis
ETPPQPPTGGAAAAIP

SEQ ID NO: 150929 - protein, 6 aa, Mycobacterium bovis
ETRSPT

SEQ ID NO: 150930 - protein, 11 aa, Mycobacterium bovis
ETSDTQRDTVK

SEQ ID NO: 150931 - protein, 6 aa, Mycobacterium bovis
ETSRQA

SEQ ID NO: 150932 - protein, 6 aa, Mycobacterium bovis
ETTREV

SEQ ID NO: 150933 - protein, 7 aa, Mycobacterium bovis
ETVEGRG

SEQ ID NO: 150934 - protein, 5 aa, Mycobacterium bovis
ETYSQ

SEQ ID NO: 150935 - protein, 9 aa, Mycobacterium bovis
EVAGGDPET

SEQ ID NO: 150936 - protein, 15 aa, Mycobacterium bovis
EVATSDTDRAQRTPW

SEQ ID NO: 150937 - protein, 13 aa, Mycobacterium bovis
EVEQAEVGGSPRH

SEQ ID NO: 150938 - protein, 5 aa, Mycobacterium bovis
EVGAG

SEQ ID NO: 150939 - protein, 42 aa, Mycobacterium bovis
EVGEAEAETEVREAQPGRGERHAAAAAAGTDVEGDGAAEARV

SEQ ID NO: 150940 - protein, 8 aa, Mycobacterium bovis
EVPAEDPT

SEQ ID NO: 150941 - protein, 9 aa, Mycobacterium bovis
EVRDPARTI

SEQ ID NO: 150942 - protein, 6 aa, Mycobacterium bovis
EVRPEA

SEQ ID NO: 150943 - protein, 15 aa, Mycobacterium bovis
EVRPSKGLQVFSFTY

SEQ ID NO: 150944 - protein, 7 aa, Mycobacterium bovis
EVSDREG

SEQ ID NO: 150945 - protein, 7 aa, Mycobacterium bovis
EVSQGKL

SEQ ID NO: 150946 - protein, 21 aa, Mycobacterium bovis
EVSRTGSATASTFPSAGRCAP

SEQ ID NO: 150947 - protein, 11 aa, Mycobacterium bovis
EVSTDHAERER

SEQ ID NO: 150948 - protein, 9 aa, Mycobacterium bovis
EVTRDGESA

SEQ ID NO: 150949 - protein, 5 aa, Mycobacterium bovis
EYAEE

SEQ ID NO: 150950 - protein, 9 aa, Mycobacterium bovis
EYAPASKRG

SEQ ID NO: 150951 - protein, 11 aa, Mycobacterium bovis
EYATEPDGSMP

SEQ ID NO: 150952 - protein, 15 aa, Mycobacterium bovis
EYPTDQYSANDPKLN

SEQ ID NO: 150953 - protein, 9 aa, Mycobacterium bovis
FADPAGGTG

SEQ ID NO: 150954 - protein, 8 aa, Mycobacterium bovis
FADTGEGG

SEQ ID NO: 150955 - protein, 6 aa, Mycobacterium bovis
FAGSGS

SEQ ID NO: 150956 - protein, 29 aa, Mycobacterium bovis
FDAAPDADSEGDSKAAKTDEPRPAKRSTL

SEQ ID NO: 150957 - protein, 7 aa, Mycobacterium bovis
FDDKGRP

SEQ ID NO: 150958 - protein, 6 aa, Mycobacterium bovis
FDPNSK

SEQ ID NO: 150959 - protein, 5 aa, Mycobacterium bovis
FDSDT

SEQ ID NO: 150960 - protein, 4 aa, Mycobacterium bovis
FDTP

SEQ ID NO: 150961 - protein, 13 aa, Mycobacterium bovis
FDTRRGELAPQPV

SEQ ID NO: 150962 - protein, 8 aa, Mycobacterium bovis
FDTSDDEQ

SEQ ID NO: 150963 - protein, 6 aa, Mycobacterium bovis
FENPDF

SEQ ID NO: 150964 - protein, 5 aa, Mycobacterium bovis
FETER

SEQ ID NO: 150965 - protein, 10 aa, Mycobacterium bovis
FGAGPRDQHR

SEQ ID NO: 150966 - protein, 10 aa, Mycobacterium bovis
FGESGTDPDF

SEQ ID NO: 150967 - protein, 25 aa, Mycobacterium bovis
FGGGGVAPSGGGDDKHVKATSAADA

SEQ ID NO: 150968 - protein, 5 aa, Mycobacterium bovis
FGGGT

SEQ ID NO: 150969 - protein, 14 aa, Mycobacterium bovis
FGGPATAGAFSRPG

SEQ ID NO: 150970 - protein, 6 aa, Mycobacterium bovis
FGGPGD

SEQ ID NO: 150971 - protein, 22 aa, Mycobacterium bovis
FGGSSNAPGSSPDGGFLGGGGR

SEQ ID NO: 150972 - protein, 8 aa, Mycobacterium bovis
FGQAQNQA

SEQ ID NO: 150973 - protein, 6 aa, Mycobacterium bovis
FGQSGQ

SEQ ID NO: 150974 - protein, 7 aa, Mycobacterium bovis
FGRSGGR

SEQ ID NO: 150975 - protein, 4 aa, Mycobacterium bovis
FGST

SEQ ID NO: 150976 - protein, 4 aa, Mycobacterium bovis
FGTA

SEQ ID NO: 150977 - protein, 6 aa, Mycobacterium bovis
FHDPPW

SEQ ID NO: 150978 - protein, 4 aa, Mycobacterium bovis
FKGP

SEQ ID NO: 150979 - protein, 7 aa, Mycobacterium bovis
FNPSTVG

SEQ ID NO: 150980 - protein, 9 aa, Mycobacterium bovis
FPEAKEKAR

SEQ ID NO: 150981 - protein, 6 aa, Mycobacterium bovis
FPGPAE

SEQ ID NO: 150982 - protein, 11 aa, Mycobacterium bovis
FPKGPARNAAT

SEQ ID NO: 150983 - protein, 17 aa, Mycobacterium bovis
FPPEPVAPDAGSTPRVS

SEQ ID NO: 150984 - protein, 4 aa, Mycobacterium bovis
FPPG

SEQ ID NO: 150985 - protein, 7 aa, Mycobacterium bovis
FPSNTES

SEQ ID NO: 150986 - protein, 4 aa, Mycobacterium bovis
FPSR

SEQ ID NO: 150987 - protein, 5 aa, Mycobacterium bovis
FPSSN

SEQ ID NO: 150988 - protein, 15 aa, Mycobacterium bovis
FQPQENAASDRTDAE

SEQ ID NO: 150989 - protein, 4 aa, Mycobacterium bovis
FSDG

SEQ ID NO: 150990 - protein, 6 aa, Mycobacterium bovis
FSGPQI

SEQ ID NO: 150991 - protein, 6 aa, Mycobacterium bovis
FSGSQI

SEQ ID NO: 150992 - protein, 7 aa, Mycobacterium bovis
FSPEDTA

SEQ ID NO: 150993 - protein, 8 aa, Mycobacterium bovis
FSPGEQVT

SEQ ID NO: 150994 - protein, 11 aa, Mycobacterium bovis
FSPSAPAAAVD

SEQ ID NO: 150995 - protein, 9 aa, Mycobacterium bovis
FSTSDPPDK

SEQ ID NO: 150996 - protein, 12 aa, Mycobacterium bovis
FSTSNDDAAKFD

SEQ ID NO: 150997 - protein, 4 aa, Mycobacterium bovis
FTGG

SEQ ID NO: 150998 - protein, 8 aa, Mycobacterium bovis
FTNPDAAV

SEQ ID NO: 150999 - protein, 7 aa, Mycobacterium bovis
FTPAQAT

SEQ ID NO: 151000 - protein, 5 aa, Mycobacterium bovis
FTPKT

SEQ ID NO: 151001 - protein, 11 aa, Mycobacterium bovis
FTPNGIPADVT

SEQ ID NO: 151002 - protein, 9 aa, Mycobacterium bovis
FTPNGVPEH

SEQ ID NO: 151003 - protein, 25 aa, Mycobacterium bovis
FTPQASAVPGSDAERQAERAGATQT

SEQ ID NO: 151004 - protein, 8 aa, Mycobacterium bovis
FTQGDTRT

SEQ ID NO: 151005 - protein, 12 aa, Mycobacterium bovis
FTSDPGAKPDGI

SEQ ID NO: 151006 - protein, 15 aa, Mycobacterium bovis
FTSGSQNMTGRWAAP

SEQ ID NO: 151007 - protein, 13 aa, Mycobacterium bovis
GAAAATAIAATTP

SEQ ID NO: 151008 - protein, 11 aa, Mycobacterium bovis
GAAAGRATAKA

SEQ ID NO: 151009 - protein, 5 aa, Mycobacterium bovis
GAAEP

SEQ ID NO: 151010 - protein, 6 aa, Mycobacterium bovis
GAAEYR

SEQ ID NO: 151011 - protein, 16 aa, Mycobacterium bovis
GAAGGALAALASRRQS

SEQ ID NO: 151012 - protein, 7 aa, Mycobacterium bovis
GAAGIGP

SEQ ID NO: 151013 - protein, 9 aa, Mycobacterium bovis
GAAPTTGYT

SEQ ID NO: 151014 - protein, 9 aa, Mycobacterium bovis
GAARPARRS

SEQ ID NO: 151015 - protein, 8 aa, Mycobacterium bovis
GAASSSCS

SEQ ID NO: 151016 - protein, 9 aa, Mycobacterium bovis
GAATAGGGA

SEQ ID NO: 151017 - protein, 9 aa, Mycobacterium bovis
GADASSSEI

SEQ ID NO: 151018 - protein, 21 aa, Mycobacterium bovis
GADGLQTPSPGAVSGSLEGGA

SEQ ID NO: 151019 - protein, 12 aa, Mycobacterium bovis
GADGSAGSEDAD

SEQ ID NO: 151020 - protein, 18 aa, Mycobacterium bovis
GADLGTAQTKATNASETL

SEQ ID NO: 151021 - protein, 12 aa, Mycobacterium bovis
GADSATSDLAER

SEQ ID NO: 151022 - protein, 14 aa, Mycobacterium bovis
GAEAAAQREATPLV

SEQ ID NO: 151023 - protein, 8 aa, Mycobacterium bovis
GAEANSPV

SEQ ID NO: 151024 - protein, 8 aa, Mycobacterium bovis
GAEFGAGP

SEQ ID NO: 151025 - protein, 5 aa, Mycobacterium bovis
GAEIP

SEQ ID NO: 151026 - protein, 6 aa, Mycobacterium bovis
GAETEL

SEQ ID NO: 151027 - protein, 11 aa, Mycobacterium bovis
GAGAGTPDDFD

SEQ ID NO: 151028 - protein, 8 aa, Mycobacterium bovis
GAGAPAPA

SEQ ID NO: 151029 - protein, 9 aa, Mycobacterium bovis
GAGDAGHAK

SEQ ID NO: 151030 - protein, 7 aa, Mycobacterium bovis
GAGGNSY

SEQ ID NO: 151031 - protein, 15 aa, Mycobacterium bovis
GAGGTPNAPSNGTAS

SEQ ID NO: 151032 - protein, 9 aa, Mycobacterium bovis
GAGIGDGVA

SEQ ID NO: 151033 - protein, 7 aa, Mycobacterium bovis
GAGLHEA

SEQ ID NO: 151034 - protein, 4 aa, Mycobacterium bovis
GAGQ

SEQ ID NO: 151035 - protein, 6 aa, Mycobacterium bovis
GAGRPR

SEQ ID NO: 151036 - protein, 4 aa, Mycobacterium bovis
GAGT

SEQ ID NO: 151037 - protein, 6 aa, Mycobacterium bovis
GAGYQP

SEQ ID NO: 151038 - protein, 25 aa, Mycobacterium bovis
GAKRPGAKKAAPTPAAPAAPAAPVK

SEQ ID NO: 151039 - protein, 4 aa, Mycobacterium bovis
GALA

SEQ ID NO: 151040 - protein, 17 aa, Mycobacterium bovis
GALGGKTGYTDDAGQTF

SEQ ID NO: 151041 - protein, 13 aa, Mycobacterium bovis
GALPKTTSGKISR

SEQ ID NO: 151042 - protein, 5 aa, Mycobacterium bovis
GALRP

SEQ ID NO: 151043 - protein, 7 aa, Mycobacterium bovis
GANPQDA

SEQ ID NO: 151044 - protein, 9 aa, Mycobacterium bovis
GAPALPNAT

SEQ ID NO: 151045 - protein, 16 aa, Mycobacterium bovis
GAPARRRRRRRGDSDA

SEQ ID NO: 151046 - protein, 9 aa, Mycobacterium bovis
GAPGAPGLD

SEQ ID NO: 151047 - protein, 25 aa, Mycobacterium bovis
GAPGSAPREYDTDTSKYTYTGAGGV

SEQ ID NO: 151048 - protein, 12 aa, Mycobacterium bovis
GAPGSGKSTLAS

SEQ ID NO: 151049 - protein, 13 aa, Mycobacterium bovis
GAPPYRADSAGTL

SEQ ID NO: 151050 - protein, 7 aa, Mycobacterium bovis
GAPQQSW

SEQ ID NO: 151051 - protein, 6 aa, Mycobacterium bovis
GAPTPI

SEQ ID NO: 151052 - protein, 6 aa, Mycobacterium bovis
GAPTTV

SEQ ID NO: 151053 - protein, 5 aa, Mycobacterium bovis
GAPTY

SEQ ID NO: 151054 - protein, 21 aa, Mycobacterium bovis
GAPVAPETPAEDADAETLSDS

SEQ ID NO: 151055 - protein, 8 aa, Mycobacterium bovis
GAQLGAGP

SEQ ID NO: 151056 - protein, 7 aa, Mycobacterium bovis
GAQPGLS

SEQ ID NO: 151057 - protein, 9 aa, Mycobacterium bovis
GARDANDYE

SEQ ID NO: 151058 - protein, 7 aa, Mycobacterium bovis
GARDRQG

SEQ ID NO: 151059 - protein, 9 aa, Mycobacterium bovis
GARGPGGDT

SEQ ID NO: 151060 - protein, 5 aa, Mycobacterium bovis
GARPG

SEQ ID NO: 151061 - protein, 17 aa, Mycobacterium bovis
GARRATANQFERPAKGA

SEQ ID NO: 151062 - protein, 26 aa, Mycobacterium bovis
GARRPLRTRPRNKSPITAAGTEVIER

SEQ ID NO: 151063 - protein, 27 aa, Mycobacterium bovis
GARRPPRPAPVASPAAAVAPTPKTSRE

SEQ ID NO: 151064 - protein, 8 aa, Mycobacterium bovis
GARSGEPQ

SEQ ID NO: 151065 - protein, 8 aa, Mycobacterium bovis
GARTRGGY

SEQ ID NO: 151066 - protein, 9 aa, Mycobacterium bovis
GASATASGL

SEQ ID NO: 151067 - protein, 6 aa, Mycobacterium bovis
GASATV

SEQ ID NO: 151068 - protein, 5 aa, Mycobacterium bovis
GASER

SEQ ID NO: 151069 - protein, 5 aa, Mycobacterium bovis
GASSG

SEQ ID NO: 151070 - protein, 9 aa, Mycobacterium bovis
GASSGVASN

SEQ ID NO: 151071 - protein, 12 aa, Mycobacterium bovis
GASSQGAQTYRE

SEQ ID NO: 151072 - protein, 5 aa, Mycobacterium bovis
GASVT

SEQ ID NO: 151073 - protein, 5 aa, Mycobacterium bovis
GATAR

SEQ ID NO: 151074 - protein, 6 aa, Mycobacterium bovis
GATGPG

SEQ ID NO: 151075 - protein, 6 aa, Mycobacterium bovis
GATGSF

SEQ ID NO: 151076 - protein, 9 aa, Mycobacterium bovis
GATPDTDYA

SEQ ID NO: 151077 - protein, 12 aa, Mycobacterium bovis
GATPPAAPAAPA

SEQ ID NO: 151078 - protein, 12 aa, Mycobacterium bovis
GATQPVGTGACV

SEQ ID NO: 151079 - protein, 8 aa, Mycobacterium bovis
GATTAAAA

SEQ ID NO: 151080 - protein, 8 aa, Mycobacterium bovis
GATTPGPV

SEQ ID NO: 151081 - protein, 7 aa, Mycobacterium bovis
GATVSSR

SEQ ID NO: 151082 - protein, 9 aa, Mycobacterium bovis
GAVASSSGI

SEQ ID NO: 151083 - protein, 7 aa, Mycobacterium bovis
GAVPGSP

SEQ ID NO: 151084 - protein, 5 aa, Mycobacterium bovis
GAVST

SEQ ID NO: 151085 - protein, 18 aa, Mycobacterium bovis
GAWPTDGPPQTGTLGSGQ

SEQ ID NO: 151086 - protein, 13 aa, Mycobacterium bovis
GAYRATKVGSEAY

SEQ ID NO: 151087 - protein, 5 aa, Mycobacterium bovis
GCGPG

SEQ ID NO: 151088 - protein, 7 aa, Mycobacterium bovis
GDADPLG

SEQ ID NO: 151089 - protein, 8 aa, Mycobacterium bovis
GDAGSGTL

SEQ ID NO: 151090 - protein, 7 aa, Mycobacterium bovis
GDAPVPA

SEQ ID NO: 151091 - protein, 7 aa, Mycobacterium bovis
GDATKSD

SEQ ID NO: 151092 - protein, 7 aa, Mycobacterium bovis
GDDRPAY

SEQ ID NO: 151093 - protein, 11 aa, Mycobacterium bovis
GDEAKKPGDRV

SEQ ID NO: 151094 - protein, 6 aa, Mycobacterium bovis
GDEEVR

SEQ ID NO: 151095 - protein, 13 aa, Mycobacterium bovis
GDEQAVGAPLTTT

SEQ ID NO: 151096 - protein, 4 aa, Mycobacterium bovis
GDEY

SEQ ID NO: 151097 - protein, 9 aa, Mycobacterium bovis
GDFGSGTTT

SEQ ID NO: 151098 - protein, 7 aa, Mycobacterium bovis
GDGAKDE

SEQ ID NO: 151099 - protein, 8 aa, Mycobacterium bovis
GDGANDAA

SEQ ID NO: 151100 - protein, 4 aa, Mycobacterium bovis
GDGL

SEQ ID NO: 151101 - protein, 5 aa, Mycobacterium bovis
GDGLA

SEQ ID NO: 151102 - protein, 6 aa, Mycobacterium bovis
GDGPQV

SEQ ID NO: 151103 - protein, 16 aa, Mycobacterium bovis
GDGPRAASTAGPVDQV

SEQ ID NO: 151104 - protein, 11 aa, Mycobacterium bovis
GDGRRTARPTR

SEQ ID NO: 151105 - protein, 9 aa, Mycobacterium bovis
GDGTADCDA

SEQ ID NO: 151106 - protein, 12 aa, Mycobacterium bovis
GDGTNDAPALAQ

SEQ ID NO: 151107 - protein, 4 aa, Mycobacterium bovis
GDGV

SEQ ID NO: 151108 - protein, 11 aa, Mycobacterium bovis
GDGVNDAPALR

SEQ ID NO: 151109 - protein, 6 aa, Mycobacterium bovis
GDIAPT

SEQ ID NO: 151110 - protein, 6 aa, Mycobacterium bovis
GDKTTL

SEQ ID NO: 151111 - protein, 10 aa, Mycobacterium bovis
GDLDEDSWQD

SEQ ID NO: 151112 - protein, 13 aa, Mycobacterium bovis
GDLGSTQSKQAYA

SEQ ID NO: 151113 - protein, 4 aa, Mycobacterium bovis
GDLR

SEQ ID NO: 151114 - protein, 9 aa, Mycobacterium bovis
GDNARTAAA

SEQ ID NO: 151115 - protein, 5 aa, Mycobacterium bovis
GDNAV

SEQ ID NO: 151116 - protein, 7 aa, Mycobacterium bovis
GDNGRAA

SEQ ID NO: 151117 - protein, 46 aa, Mycobacterium bovis
GDNKSTTATSPATSAPTSQPFSQQTATGCTPNVSGGVQPIGDSISA

SEQ ID NO: 151118 - protein, 15 aa, Mycobacterium bovis
GDNPATAKAIAQEAG

SEQ ID NO: 151119 - protein, 9 aa, Mycobacterium bovis
GDNPESAAA

SEQ ID NO: 151120 - protein, 6 aa, Mycobacterium bovis
GDNPQT

SEQ ID NO: 151121 - protein, 5 aa, Mycobacterium bovis
GDPAN

SEQ ID NO: 151122 - protein, 8 aa, Mycobacterium bovis
GDPATPEG

SEQ ID NO: 151123 - protein, 8 aa, Mycobacterium bovis
GDPDAPPT

SEQ ID NO: 151124 - protein, 7 aa, Mycobacterium bovis
GDPDSQR

SEQ ID NO: 151125 - protein, 6 aa, Mycobacterium bovis
GDPEGQ

SEQ ID NO: 151126 - protein, 9 aa, Mycobacterium bovis
GDPETHRRT

SEQ ID NO: 151127 - protein, 8 aa, Mycobacterium bovis
GDPGNGEG

SEQ ID NO: 151128 - protein, 13 aa, Mycobacterium bovis
GDPKGDGTGGPGY

SEQ ID NO: 151129 - protein, 5 aa, Mycobacterium bovis
GDPLS

SEQ ID NO: 151130 - protein, 7 aa, Mycobacterium bovis
GDPMSQA

SEQ ID NO: 151131 - protein, 16 aa, Mycobacterium bovis
GDPNPQAARLPARARG

SEQ ID NO: 151132 - protein, 13 aa, Mycobacterium bovis
GDPPKKRSAANTH

SEQ ID NO: 151133 - protein, 9 aa, Mycobacterium bovis
GDPQSPEGI

SEQ ID NO: 151134 - protein, 6 aa, Mycobacterium bovis
GDPSDS

SEQ ID NO: 151135 - protein, 7 aa, Mycobacterium bovis
GDPVGDH

SEQ ID NO: 151136 - protein, 10 aa, Mycobacterium bovis
GDQPPREGSG

SEQ ID NO: 151137 - protein, 4 aa, Mycobacterium bovis
GDRE

SEQ ID NO: 151138 - protein, 7 aa, Mycobacterium bovis
GDRIPAD

SEQ ID NO: 151139 - protein, 10 aa, Mycobacterium bovis
GDRMAPGAQS

SEQ ID NO: 151140 - protein, 8 aa, Mycobacterium bovis
GDRPLTPA

SEQ ID NO: 151141 - protein, 5 aa, Mycobacterium bovis
GDRSA

SEQ ID NO: 151142 - protein, 8 aa, Mycobacterium bovis
GDSSKVRV

SEQ ID NO: 151143 - protein, 8 aa, Mycobacterium bovis
GDSTTAVG

SEQ ID NO: 151144 - protein, 12 aa, Mycobacterium bovis
GDTGLDSGRPQS

SEQ ID NO: 151145 - protein, 10 aa, Mycobacterium bovis
GDTGLTSTGS

SEQ ID NO: 151146 - protein, 5 aa, Mycobacterium bovis
GDTIG

SEQ ID NO: 151147 - protein, 6 aa, Mycobacterium bovis
GDTPAR

SEQ ID NO: 151148 - protein, 8 aa, Mycobacterium bovis
GDTRNRGR

SEQ ID NO: 151149 - protein, 7 aa, Mycobacterium bovis
GDVTETI

SEQ ID NO: 151150 - protein, 13 aa, Mycobacterium bovis
GDYDEAELEQQLD

SEQ ID NO: 151151 - protein, 5 aa, Mycobacterium bovis
GDYNV

SEQ ID NO: 151152 - protein, 13 aa, Mycobacterium bovis
GEAAPQSPAEPVA

SEQ ID NO: 151153 - protein, 15 aa, Mycobacterium bovis
GEADPIAKDAGDTVM

SEQ ID NO: 151154 - protein, 5 aa, Mycobacterium bovis
GEAIR

SEQ ID NO: 151155 - protein, 10 aa, Mycobacterium bovis
GEAQAPRKDP

SEQ ID NO: 151156 - protein, 8 aa, Mycobacterium bovis
GEDGGLPR

SEQ ID NO: 151157 - protein, 5 aa, Mycobacterium bovis
GEDPL

SEQ ID NO: 151158 - protein, 7 aa, Mycobacterium bovis
GEEAGYH

SEQ ID NO: 151159 - protein, 4 aa, Mycobacterium bovis
GEFG

SEQ ID NO: 151160 - protein, 18 aa, Mycobacterium bovis
GEGFENTTGTLAPRAAVP

SEQ ID NO: 151161 - protein, 6 aa, Mycobacterium bovis
GEGIGA

SEQ ID NO: 151162 - protein, 8 aa, Mycobacterium bovis
GEGPDDLA

SEQ ID NO: 151163 - protein, 7 aa, Mycobacterium bovis
GEHGGLS

SEQ ID NO: 151164 - protein, 7 aa, Mycobacterium bovis
GEHRDGG

SEQ ID NO: 151165 - protein, 5 aa, Mycobacterium bovis
GEIDD

SEQ ID NO: 151166 - protein, 7 aa, Mycobacterium bovis
GEKSDMA

SEQ ID NO: 151167 - protein, 16 aa, Mycobacterium bovis
GELDSGTSTPATNYGS

SEQ ID NO: 151168 - protein, 7 aa, Mycobacterium bovis
GELPPGA

SEQ ID NO: 151169 - protein, 9 aa, Mycobacterium bovis
GELSTSDDH

SEQ ID NO: 151170 - protein, 6 aa, Mycobacterium bovis
GENPVA

SEQ ID NO: 151171 - protein, 11 aa, Mycobacterium bovis
GEPPFTGDSPV

SEQ ID NO: 151172 - protein, 7 aa, Mycobacterium bovis
GEPQNMP

SEQ ID NO: 151173 - protein, 12 aa, Mycobacterium bovis
GEPWPQPVPEPA

SEQ ID NO: 151174 - protein, 7 aa, Mycobacterium bovis
GEQAAAA

SEQ ID NO: 151175 - protein, 11 aa, Mycobacterium bovis
GEQIDNAGNAA

SEQ ID NO: 151176 - protein, 8 aa, Mycobacterium bovis
GERADRTD

SEQ ID NO: 151177 - protein, 16 aa, Mycobacterium bovis
GERAKREKRDSSGSFG

SEQ ID NO: 151178 - protein, 5 aa, Mycobacterium bovis
GERAS

SEQ ID NO: 151179 - protein, 6 aa, Mycobacterium bovis
GERISA

SEQ ID NO: 151180 - protein, 4 aa, Mycobacterium bovis
GERK

SEQ ID NO: 151181 - protein, 5 aa, Mycobacterium bovis
GERLA

SEQ ID NO: 151182 - protein, 10 aa, Mycobacterium bovis
GERRRAERER

SEQ ID NO: 151183 - protein, 9 aa, Mycobacterium bovis
GESGPSGRH

SEQ ID NO: 151184 - protein, 23 aa, Mycobacterium bovis
GESGSEPAGERSADPGEERTESY

SEQ ID NO: 151185 - protein, 5 aa, Mycobacterium bovis
GETDA

SEQ ID NO: 151186 - protein, 4 aa, Mycobacterium bovis
GEVP

SEQ ID NO: 151187 - protein, 5 aa, Mycobacterium bovis
GFEDG

SEQ ID NO: 151188 - protein, 6 aa, Mycobacterium bovis
GFGNTT

SEQ ID NO: 151189 - protein, 24 aa, Mycobacterium bovis
GFKEQYAKSSADLARRGVTAQAAT

SEQ ID NO: 151190 - protein, 5 aa, Mycobacterium bovis
GFSGK

SEQ ID NO: 151191 - protein, 4 aa, Mycobacterium bovis
GFSR

SEQ ID NO: 151192 - protein, 4 aa, Mycobacterium bovis
GGAA

SEQ ID NO: 151193 - protein, 8 aa, Mycobacterium bovis
GGAFNNDT

SEQ ID NO: 151194 - protein, 13 aa, Mycobacterium bovis
GGAGDPDDTRVSQ

SEQ ID NO: 151195 - protein, 8 aa, Mycobacterium bovis
GGAGGPAL

SEQ ID NO: 151196 - protein, 15 aa, Mycobacterium bovis
GGAGTLPPEKKPQVG

SEQ ID NO: 151197 - protein, 7 aa, Mycobacterium bovis
GGANIPA

SEQ ID NO: 151198 - protein, 16 aa, Mycobacterium bovis
GGAPIAPADAARNRAR

SEQ ID NO: 151199 - protein, 10 aa, Mycobacterium bovis
GGAPNPYTYP

SEQ ID NO: 151200 - protein, 8 aa, Mycobacterium bovis
GGAPRLPS

SEQ ID NO: 151201 - protein, 9 aa, Mycobacterium bovis
GGCNSAGGR

SEQ ID NO: 151202 - protein, 9 aa, Mycobacterium bovis
GGDDAATLA

SEQ ID NO: 151203 - protein, 11 aa, Mycobacterium bovis
GGDGASRTDEA

SEQ ID NO: 151204 - protein, 8 aa, Mycobacterium bovis
GGDGLSDC

SEQ ID NO: 151205 - protein, 4 aa, Mycobacterium bovis
GGDT

SEQ ID NO: 151206 - protein, 6 aa, Mycobacterium bovis
GGDTTL

SEQ ID NO: 151207 - protein, 12 aa, Mycobacterium bovis
GGEAGPVPDDGF

SEQ ID NO: 151208 - protein, 12 aa, Mycobacterium bovis
GGEGLGLRSPGP

SEQ ID NO: 151209 - protein, 8 aa, Mycobacterium bovis
GGELDPPK

SEQ ID NO: 151210 - protein, 9 aa, Mycobacterium bovis
GGEVTPDSA

SEQ ID NO: 151211 - protein, 7 aa, Mycobacterium bovis
GGFSGGT

SEQ ID NO: 151212 - protein, 4 aa, Mycobacterium bovis
GGGA

SEQ ID NO: 151213 - protein, 6 aa, Mycobacterium bovis
GGGARG

SEQ ID NO: 151214 - protein, 4 aa, Mycobacterium bovis
GGGD

SEQ ID NO: 151215 - protein, 9 aa, Mycobacterium bovis
GGGDTPPPA

SEQ ID NO: 151216 - protein, 7 aa, Mycobacterium bovis
GGGGRLG

SEQ ID NO: 151217 - protein, 6 aa, Mycobacterium bovis
GGGGTL

SEQ ID NO: 151218 - protein, 7 aa, Mycobacterium bovis
GGGLRPA

SEQ ID NO: 151219 - protein, 10 aa, Mycobacterium bovis
GGGQQQMSRP

SEQ ID NO: 151220 - protein, 11 aa, Mycobacterium bovis
GGGQRDPQTPI

SEQ ID NO: 151221 - protein, 8 aa, Mycobacterium bovis
GGGSEGLA

SEQ ID NO: 151222 - protein, 7 aa, Mycobacterium bovis
GGHPTEE

SEQ ID NO: 151223 - protein, 6 aa, Mycobacterium bovis
GGIPGM

SEQ ID NO: 151224 - protein, 13 aa, Mycobacterium bovis
GGKAGFPPDGRAG

SEQ ID NO: 151225 - protein, 7 aa, Mycobacterium bovis
GGKEFGR

SEQ ID NO: 151226 - protein, 9 aa, Mycobacterium bovis
GGLAGEPED

SEQ ID NO: 151227 - protein, 6 aa, Mycobacterium bovis
GGLASP

SEQ ID NO: 151228 - protein, 4 aa, Mycobacterium bovis
GGLG

SEQ ID NO: 151229 - protein, 4 aa, Mycobacterium bovis
GGMD

SEQ ID NO: 151230 - protein, 8 aa, Mycobacterium bovis
GGNAEDAL

SEQ ID NO: 151231 - protein, 8 aa, Mycobacterium bovis
GGNKTFNE

SEQ ID NO: 151232 - protein, 9 aa, Mycobacterium bovis
GGPDGEGFN

SEQ ID NO: 151233 - protein, 5 aa, Mycobacterium bovis
GGPDI

SEQ ID NO: 151234 - protein, 6 aa, Mycobacterium bovis
GGPGFC

SEQ ID NO: 151235 - protein, 15 aa, Mycobacterium bovis
GGPGNTGPDFGKASP

SEQ ID NO: 151236 - protein, 4 aa, Mycobacterium bovis
GGPI

SEQ ID NO: 151237 - protein, 10 aa, Mycobacterium bovis
GGPKSGKSTA

SEQ ID NO: 151238 - protein, 4 aa, Mycobacterium bovis
GGPL

SEQ ID NO: 151239 - protein, 11 aa, Mycobacterium bovis
GGPPDGNGGTP

SEQ ID NO: 151240 - protein, 34 aa, Mycobacterium bovis
GGPPPPGMGPGFPGGPGGPAVGPTGPGPTTAPAR

SEQ ID NO: 151241 - protein, 8 aa, Mycobacterium bovis
GGPQAVAD

SEQ ID NO: 151242 - protein, 7 aa, Mycobacterium bovis
GGPRRKG

SEQ ID NO: 151243 - protein, 5 aa, Mycobacterium bovis
GGPTR

SEQ ID NO: 151244 - protein, 4 aa, Mycobacterium bovis
GGPV

SEQ ID NO: 151245 - protein, 14 aa, Mycobacterium bovis
GGQPDPSKGRCAFA

SEQ ID NO: 151246 - protein, 6 aa, Mycobacterium bovis
GGQRTA

SEQ ID NO: 151247 - protein, 4 aa, Mycobacterium bovis
GGQT

SEQ ID NO: 151248 - protein, 6 aa, Mycobacterium bovis
GGSAGG

SEQ ID NO: 151249 - protein, 8 aa, Mycobacterium bovis
GGSAGGHL

SEQ ID NO: 151250 - protein, 13 aa, Mycobacterium bovis
GGSAPVLEGPSSV

SEQ ID NO: 151251 - protein, 53 aa, Mycobacterium bovis
GGSGDWGPSLGPTVGGRGGIKAPAATVPAAAAAAATRGQSRARRRRRSELRDY

SEQ ID NO: 151252 - protein, 7 aa, Mycobacterium bovis
GGSGSVV

SEQ ID NO: 151253 - protein, 7 aa, Mycobacterium bovis
GGSGTGI

SEQ ID NO: 151254 - protein, 9 aa, Mycobacterium bovis
GGSKPYGYA

SEQ ID NO: 151255 - protein, 9 aa, Mycobacterium bovis
GGSNNTGSV

SEQ ID NO: 151256 - protein, 7 aa, Mycobacterium bovis
GGSPRGA

SEQ ID NO: 151257 - protein, 6 aa, Mycobacterium bovis
GGTGAL

SEQ ID NO: 151258 - protein, 7 aa, Mycobacterium bovis
GGTGKVV

SEQ ID NO: 151259 - protein, 8 aa, Mycobacterium bovis
GGTGMAGS

SEQ ID NO: 151260 - protein, 6 aa, Mycobacterium bovis
GGTHGS

SEQ ID NO: 151261 - protein, 6 aa, Mycobacterium bovis
GGTLRQ

SEQ ID NO: 151262 - protein, 4 aa, Mycobacterium bovis
GGTR

SEQ ID NO: 151263 - protein, 11 aa, Mycobacterium bovis
GGTSLARTGRQ

SEQ ID NO: 151264 - protein, 5 aa, Mycobacterium bovis
GGTST

SEQ ID NO: 151265 - protein, 6 aa, Mycobacterium bovis
GGTTGP

SEQ ID NO: 151266 - protein, 14 aa, Mycobacterium bovis
GGTTVSFPRGSTQV

SEQ ID NO: 151267 - protein, 4 aa, Mycobacterium bovis
GGTV

SEQ ID NO: 151268 - protein, 5 aa, Mycobacterium bovis
GGVPA

SEQ ID NO: 151269 - protein, 7 aa, Mycobacterium bovis
GGVPSAY

SEQ ID NO: 151270 - protein, 6 aa, Mycobacterium bovis
GGWEPG

SEQ ID NO: 151271 - protein, 24 aa, Mycobacterium bovis
GGWGAPPSGGPSPWAQTPRKTNPW

SEQ ID NO: 151272 - protein, 34 aa, Mycobacterium bovis
GGYSASGSEDYPDIPPRPDWEPTGAEPIAAAPPP

SEQ ID NO: 151273 - protein, 10 aa, Mycobacterium bovis
GHDASPASDV

SEQ ID NO: 151274 - protein, 6 aa, Mycobacterium bovis
GHDPAT

SEQ ID NO: 151275 - protein, 13 aa, Mycobacterium bovis
GHGEHQDGDDVGE

SEQ ID NO: 151276 - protein, 4 aa, Mycobacterium bovis
GHGG

SEQ ID NO: 151277 - protein, 12 aa, Mycobacterium bovis
GHGTGTTLGDPI

SEQ ID NO: 151278 - protein, 7 aa, Mycobacterium bovis
GHKKDSL

SEQ ID NO: 151279 - protein, 7 aa, Mycobacterium bovis
GHNLDTT

SEQ ID NO: 151280 - protein, 5 aa, Mycobacterium bovis
GHPPG

SEQ ID NO: 151281 - protein, 8 aa, Mycobacterium bovis
GHRQAKDP

SEQ ID NO: 151282 - protein, 6 aa, Mycobacterium bovis
GHTGPF

SEQ ID NO: 151283 - protein, 5 aa, Mycobacterium bovis
GIAAG

SEQ ID NO: 151284 - protein, 9 aa, Mycobacterium bovis
GIASPESYS

SEQ ID NO: 151285 - protein, 5 aa, Mycobacterium bovis
GIGQA

SEQ ID NO: 151286 - protein, 8 aa, Mycobacterium bovis
GINDGPAL

SEQ ID NO: 151287 - protein, 9 aa, Mycobacterium bovis
GINDGPALA

SEQ ID NO: 151288 - protein, 7 aa, Mycobacterium bovis
GIPDPGD

SEQ ID NO: 151289 - protein, 12 aa, Mycobacterium bovis
GIPPGTLRRSAT

SEQ ID NO: 151290 - protein, 4 aa, Mycobacterium bovis
GISA

SEQ ID NO: 151291 - protein, 5 aa, Mycobacterium bovis
GISGT

SEQ ID NO: 151292 - protein, 15 aa, Mycobacterium bovis
GITDQNGDEPPRTSD

SEQ ID NO: 151293 - protein, 4 aa, Mycobacterium bovis
GITT

SEQ ID NO: 151294 - protein, 4 aa, Mycobacterium bovis
GKAH

SEQ ID NO: 151295 - protein, 6 aa, Mycobacterium bovis
GKAQAI

SEQ ID NO: 151296 - protein, 8 aa, Mycobacterium bovis
GKDGHGGL

SEQ ID NO: 151297 - protein, 8 aa, Mycobacterium bovis
GKEANGSR

SEQ ID NO: 151298 - protein, 9 aa, Mycobacterium bovis
GKEEESAQT

SEQ ID NO: 151299 - protein, 4 aa, Mycobacterium bovis
GKEG

SEQ ID NO: 151300 - protein, 6 aa, Mycobacterium bovis
GKEVPA

SEQ ID NO: 151301 - protein, 5 aa, Mycobacterium bovis
GKFGP

SEQ ID NO: 151302 - protein, 4 aa, Mycobacterium bovis
GKGS

SEQ ID NO: 151303 - protein, 6 aa, Mycobacterium bovis
GKIAGN

SEQ ID NO: 151304 - protein, 7 aa, Mycobacterium bovis
GKPVPTV

SEQ ID NO: 151305 - protein, 7 aa, Mycobacterium bovis
GKQALSA

SEQ ID NO: 151306 - protein, 11 aa, Mycobacterium bovis
GKQYSSGGGAV

SEQ ID NO: 151307 - protein, 18 aa, Mycobacterium bovis
GKRAATPKECRSKDPYVP

SEQ ID NO: 151308 - protein, 7 aa, Mycobacterium bovis
GKSPGGI

SEQ ID NO: 151309 - protein, 10 aa, Mycobacterium bovis
GKTEPVDSEA

SEQ ID NO: 151310 - protein, 4 aa, Mycobacterium bovis
GKTG

SEQ ID NO: 151311 - protein, 12 aa, Mycobacterium bovis
GKTVTVTNKAKT

SEQ ID NO: 151312 - protein, 5 aa, Mycobacterium bovis
GKYTG

SEQ ID NO: 151313 - protein, 12 aa, Mycobacterium bovis
GLAGKGKQINTT

SEQ ID NO: 151314 - protein, 36 aa, Mycobacterium bovis
GLAPPGVSSGPKAGTKSPDTAADTLATAGAARPGLA

SEQ ID NO: 151315 - protein, 9 aa, Mycobacterium bovis
GLASSSVGA

SEQ ID NO: 151316 - protein, 4 aa, Mycobacterium bovis
GLAT

SEQ ID NO: 151317 - protein, 5 aa, Mycobacterium bovis
GLDPG

SEQ ID NO: 151318 - protein, 11 aa, Mycobacterium bovis
GLETRARRQSV

SEQ ID NO: 151319 - protein, 10 aa, Mycobacterium bovis
GLGAGSVRQH

SEQ ID NO: 151320 - protein, 6 aa, Mycobacterium bovis
GLGGGN

SEQ ID NO: 151321 - protein, 7 aa, Mycobacterium bovis
GLGMTDA

SEQ ID NO: 151322 - protein, 4 aa, Mycobacterium bovis
GLGP

SEQ ID NO: 151323 - protein, 6 aa, Mycobacterium bovis
GLGPPI

SEQ ID NO: 151324 - protein, 7 aa, Mycobacterium bovis
GLGPPIG

SEQ ID NO: 151325 - protein, 5 aa, Mycobacterium bovis
GLGRP

SEQ ID NO: 151326 - protein, 9 aa, Mycobacterium bovis
GLKRQPDHQ

SEQ ID NO: 151327 - protein, 7 aa, Mycobacterium bovis
GLPAGTL

SEQ ID NO: 151328 - protein, 13 aa, Mycobacterium bovis
GLPDTGPGSLAPM

SEQ ID NO: 151329 - protein, 8 aa, Mycobacterium bovis
GLPGGITK

SEQ ID NO: 151330 - protein, 6 aa, Mycobacterium bovis
GLPPAA

SEQ ID NO: 151331 - protein, 6 aa, Mycobacterium bovis
GLPQRT

SEQ ID NO: 151332 - protein, 6 aa, Mycobacterium bovis
GLQAER

SEQ ID NO: 151333 - protein, 8 aa, Mycobacterium bovis
GLQPGGPV

SEQ ID NO: 151334 - protein, 6 aa, Mycobacterium bovis
GLQTGS

SEQ ID NO: 151335 - protein, 10 aa, Mycobacterium bovis
GLQTNPNSLS

SEQ ID NO: 151336 - protein, 6 aa, Mycobacterium bovis
GLRGGS

SEQ ID NO: 151337 - protein, 6 aa, Mycobacterium bovis
GLRPRY

SEQ ID NO: 151338 - protein, 4 aa, Mycobacterium bovis
GLST

SEQ ID NO: 151339 - protein, 16 aa, Mycobacterium bovis
GLTGEFNSDANAIARG

SEQ ID NO: 151340 - protein, 8 aa, Mycobacterium bovis
GLTPGSAD

SEQ ID NO: 151341 - protein, 8 aa, Mycobacterium bovis
GMAGARAS

SEQ ID NO: 151342 - protein, 5 aa, Mycobacterium bovis
GMAPQ

SEQ ID NO: 151343 - protein, 6 aa, Mycobacterium bovis
GMGPGP

SEQ ID NO: 151344 - protein, 12 aa, Mycobacterium bovis
GMGSGTETYLAG

SEQ ID NO: 151345 - protein, 7 aa, Mycobacterium bovis
GMSATGP

SEQ ID NO: 151346 - protein, 4 aa, Mycobacterium bovis
GNAG

SEQ ID NO: 151347 - protein, 8 aa, Mycobacterium bovis
GNANTDGT

SEQ ID NO: 151348 - protein, 10 aa, Mycobacterium bovis
GNAPNDDPYR

SEQ ID NO: 151349 - protein, 9 aa, Mycobacterium bovis
GNDDPANRK

SEQ ID NO: 151350 - protein, 17 aa, Mycobacterium bovis
GNDVANSFGTSVGAGTL

SEQ ID NO: 151351 - protein, 7 aa, Mycobacterium bovis
GNGPRTD

SEQ ID NO: 151352 - protein, 8 aa, Mycobacterium bovis
GNGSGKST

SEQ ID NO: 151353 - protein, 10 aa, Mycobacterium bovis
GNIAGNPSQY

SEQ ID NO: 151354 - protein, 10 aa, Mycobacterium bovis
GNNETDGSEK

SEQ ID NO: 151355 - protein, 10 aa, Mycobacterium bovis
GNNPGAQTSE

SEQ ID NO: 151356 - protein, 11 aa, Mycobacterium bovis
GNPADSGKIRG

SEQ ID NO: 151357 - protein, 7 aa, Mycobacterium bovis
GNPDGPA

SEQ ID NO: 151358 - protein, 4 aa, Mycobacterium bovis
GNPH

SEQ ID NO: 151359 - protein, 5 aa, Mycobacterium bovis
GNQDT

SEQ ID NO: 151360 - protein, 5 aa, Mycobacterium bovis
GNQTT

SEQ ID NO: 151361 - protein, 8 aa, Mycobacterium bovis
GNRDNANP

SEQ ID NO: 151362 - protein, 7 aa, Mycobacterium bovis
GNRETPA

SEQ ID NO: 151363 - protein, 5 aa, Mycobacterium bovis
GNRPR

SEQ ID NO: 151364 - protein, 6 aa, Mycobacterium bovis
GNRSER

SEQ ID NO: 151365 - protein, 7 aa, Mycobacterium bovis
GNTGGDC

SEQ ID NO: 151366 - protein, 4 aa, Mycobacterium bovis
GPAA

SEQ ID NO: 151367 - protein, 5 aa, Mycobacterium bovis
GPAAA

SEQ ID NO: 151368 - protein, 32 aa, Mycobacterium bovis
GPAAPIPDSTATPDASSTTPSRPQPPQDNNDD

SEQ ID NO: 151369 - protein, 10 aa, Mycobacterium bovis
GPAASREHRR

SEQ ID NO: 151370 - protein, 7 aa, Mycobacterium bovis
GPAATAS

SEQ ID NO: 151371 - protein, 10 aa, Mycobacterium bovis
GPAEDSSAQV

SEQ ID NO: 151372 - protein, 7 aa, Mycobacterium bovis
GPAGMTA

SEQ ID NO: 151373 - protein, 5 aa, Mycobacterium bovis
GPAIG

SEQ ID NO: 151374 - protein, 6 aa, Mycobacterium bovis
GPALSR

SEQ ID NO: 151375 - protein, 5 aa, Mycobacterium bovis
GPANA

SEQ ID NO: 151376 - protein, 6 aa, Mycobacterium bovis
GPAPEG

SEQ ID NO: 151377 - protein, 5 aa, Mycobacterium bovis
GPATG

SEQ ID NO: 151378 - protein, 5 aa, Mycobacterium bovis
GPATS

SEQ ID NO: 151379 - protein, 4 aa, Mycobacterium bovis
GPAY

SEQ ID NO: 151380 - protein, 8 aa, Mycobacterium bovis
GPDDCASV

SEQ ID NO: 151381 - protein, 9 aa, Mycobacterium bovis
GPDDTERAI

SEQ ID NO: 151382 - protein, 17 aa, Mycobacterium bovis
GPDGQNPPDEVTDRLEN

SEQ ID NO: 151383 - protein, 4 aa, Mycobacterium bovis
GPEA

SEQ ID NO: 151384 - protein, 5 aa, Mycobacterium bovis
GPGAD

SEQ ID NO: 151385 - protein, 46 aa, Mycobacterium bovis
GPGAGATATGIAPTEAAVPPSPAANPPPPASGPQPPPVTAAPPVPV

SEQ ID NO: 151386 - protein, 4 aa, Mycobacterium bovis
GPGD

SEQ ID NO: 151387 - protein, 9 aa, Mycobacterium bovis
GPGPGGLAS

SEQ ID NO: 151388 - protein, 9 aa, Mycobacterium bovis
GPGRTSGGW

SEQ ID NO: 151389 - protein, 6 aa, Mycobacterium bovis
GPGRYG

SEQ ID NO: 151390 - protein, 4 aa, Mycobacterium bovis
GPGT

SEQ ID NO: 151391 - protein, 54 aa, Mycobacterium bovis
GPGTGRVATAPGGDAASAPPPGAGGPAPPQAVPPPRTTQPPAAPPRGPDVPPAT

SEQ ID NO: 151392 - protein, 5 aa, Mycobacterium bovis
GPHPG

SEQ ID NO: 151393 - protein, 12 aa, Mycobacterium bovis
GPHTDQTLDGPG

SEQ ID NO: 151394 - protein, 13 aa, Mycobacterium bovis
GPITGGGRATHLR

SEQ ID NO: 151395 - protein, 27 aa, Mycobacterium bovis
GPKGTDGQPSKQAISDSAVSETWGGQI

SEQ ID NO: 151396 - protein, 7 aa, Mycobacterium bovis
GPLAPPR

SEQ ID NO: 151397 - protein, 5 aa, Mycobacterium bovis
GPLSD

SEQ ID NO: 151398 - protein, 7 aa, Mycobacterium bovis
GPLTPKD

SEQ ID NO: 151399 - protein, 5 aa, Mycobacterium bovis
GPMPT

SEQ ID NO: 151400 - protein, 19 aa, Mycobacterium bovis
GPNAEHPGAPLRGERSGYD

SEQ ID NO: 151401 - protein, 9 aa, Mycobacterium bovis
GPNAPSPSQ

SEQ ID NO: 151402 - protein, 5 aa, Mycobacterium bovis
GPNER

SEQ ID NO: 151403 - protein, 12 aa, Mycobacterium bovis
GPNGSPSTQATT

SEQ ID NO: 151404 - protein, 6 aa, Mycobacterium bovis
GPPGLR

SEQ ID NO: 151405 - protein, 8 aa, Mycobacterium bovis
GPPGTGKT

SEQ ID NO: 151406 - protein, 4 aa, Mycobacterium bovis
GPPL

SEQ ID NO: 151407 - protein, 34 aa, Mycobacterium bovis
GPPPPGQVAGPGPAPHQPAQPAPPPNDNGPPPPF

SEQ ID NO: 151408 - protein, 5 aa, Mycobacterium bovis
GPPTT

SEQ ID NO: 151409 - protein, 8 aa, Mycobacterium bovis
GPQNMPKF

SEQ ID NO: 151410 - protein, 19 aa, Mycobacterium bovis
GPRAPGSSYGSRENGPPVN

SEQ ID NO: 151411 - protein, 16 aa, Mycobacterium bovis
GPRRTTALSAERAALL

SEQ ID NO: 151412 - protein, 15 aa, Mycobacterium bovis
GPRTQSDRFSGCSIS

SEQ ID NO: 151413 - protein, 4 aa, Mycobacterium bovis
GPSA

SEQ ID NO: 151414 - protein, 10 aa, Mycobacterium bovis
GPSGAGKSTL

SEQ ID NO: 151415 - protein, 8 aa, Mycobacterium bovis
GPSGCGKS

SEQ ID NO: 151416 - protein, 10 aa, Mycobacterium bovis
GPSGSGKSTL

SEQ ID NO: 151417 - protein, 5 aa, Mycobacterium bovis
GPSPY

SEQ ID NO: 151418 - protein, 7 aa, Mycobacterium bovis
GPSSPLS

SEQ ID NO: 151419 - protein, 9 aa, Mycobacterium bovis
GPTGAGKTT

SEQ ID NO: 151420 - protein, 5 aa, Mycobacterium bovis
GPTGI

SEQ ID NO: 151421 - protein, 6 aa, Mycobacterium bovis
GPTGVE

SEQ ID NO: 151422 - protein, 4 aa, Mycobacterium bovis
GPTI

SEQ ID NO: 151423 - protein, 12 aa, Mycobacterium bovis
GPTPEQPKGPFG

SEQ ID NO: 151424 - protein, 5 aa, Mycobacterium bovis
GPVDS

SEQ ID NO: 151425 - protein, 5 aa, Mycobacterium bovis
GPVFN

SEQ ID NO: 151426 - protein, 8 aa, Mycobacterium bovis
GPVGNPNA

SEQ ID NO: 151427 - protein, 13 aa, Mycobacterium bovis
GPVTGEQGTGTTA

SEQ ID NO: 151428 - protein, 7 aa, Mycobacterium bovis
GPVTSEF

SEQ ID NO: 151429 - protein, 6 aa, Mycobacterium bovis
GPVTTG

SEQ ID NO: 151430 - protein, 4 aa, Mycobacterium bovis
GPWG

SEQ ID NO: 151431 - protein, 8 aa, Mycobacterium bovis
GPYAKEGW

SEQ ID NO: 151432 - protein, 8 aa, Mycobacterium bovis
GPYRESNL

SEQ ID NO: 151433 - protein, 8 aa, Mycobacterium bovis
GQASSTHM

SEQ ID NO: 151434 - protein, 12 aa, Mycobacterium bovis
GQDGPLASTAGH

SEQ ID NO: 151435 - protein, 6 aa, Mycobacterium bovis
GQEERE

SEQ ID NO: 151436 - protein, 9 aa, Mycobacterium bovis
GQGAGRSRA

SEQ ID NO: 151437 - protein, 6 aa, Mycobacterium bovis
GQGGPL

SEQ ID NO: 151438 - protein, 13 aa, Mycobacterium bovis
GQGLPGGTSPASW

SEQ ID NO: 151439 - protein, 6 aa, Mycobacterium bovis
GQGSAN

SEQ ID NO: 151440 - protein, 10 aa, Mycobacterium bovis
GQGSYAAANS

SEQ ID NO: 151441 - protein, 7 aa, Mycobacterium bovis
GQHAPGV

SEQ ID NO: 151442 - protein, 5 aa, Mycobacterium bovis
GQIPN

SEQ ID NO: 151443 - protein, 9 aa, Mycobacterium bovis
GQLPPDGDY

SEQ ID NO: 151444 - protein, 5 aa, Mycobacterium bovis
GQLQR

SEQ ID NO: 151445 - protein, 7 aa, Mycobacterium bovis
GQNDPKL

SEQ ID NO: 151446 - protein, 12 aa, Mycobacterium bovis
GQPASGRTDNLG

SEQ ID NO: 151447 - protein, 6 aa, Mycobacterium bovis
GQPDDG

SEQ ID NO: 151448 - protein, 34 aa, Mycobacterium bovis
GQPDRADLDRPDLPTGKHAPQRRAVASRDDEKHR

SEQ ID NO: 151449 - protein, 7 aa, Mycobacterium bovis
GQPDRAV

SEQ ID NO: 151450 - protein, 12 aa, Mycobacterium bovis
GQPQAEKLASQW

SEQ ID NO: 151451 - protein, 39 aa, Mycobacterium bovis
GQPQGGSYPPAYPPQQYPPGWPAGPYPPGPPPPGPGSKT

SEQ ID NO: 151452 - protein, 8 aa, Mycobacterium bovis
GQPSTDTP

SEQ ID NO: 151453 - protein, 29 aa, Mycobacterium bovis
GQQDRAGKSWPGSTPKPQEDPVGVAPSAS

SEQ ID NO: 151454 - protein, 6 aa, Mycobacterium bovis
GQQRGE

SEQ ID NO: 151455 - protein, 4 aa, Mycobacterium bovis
GQRE

SEQ ID NO: 151456 - protein, 7 aa, Mycobacterium bovis
GQRPADR

SEQ ID NO: 151457 - protein, 8 aa, Mycobacterium bovis
GQRRQPNQ

SEQ ID NO: 151458 - protein, 4 aa, Mycobacterium bovis
GQRS

SEQ ID NO: 151459 - protein, 16 aa, Mycobacterium bovis
GQSCAARPVTADELTE

SEQ ID NO: 151460 - protein, 8 aa, Mycobacterium bovis
GQSTAQAS

SEQ ID NO: 151461 - protein, 6 aa, Mycobacterium bovis
GQTPGN

SEQ ID NO: 151462 - protein, 9 aa, Mycobacterium bovis
GQVNGPKLA

SEQ ID NO: 151463 - protein, 6 aa, Mycobacterium bovis
GQVQSS

SEQ ID NO: 151464 - protein, 4 aa, Mycobacterium bovis
GRAA

SEQ ID NO: 151465 - protein, 7 aa, Mycobacterium bovis
GRAAAAT

SEQ ID NO: 151466 - protein, 5 aa, Mycobacterium bovis
GRAGN

SEQ ID NO: 151467 - protein, 14 aa, Mycobacterium bovis
GRAHRPAAQNAGER

SEQ ID NO: 151468 - protein, 7 aa, Mycobacterium bovis
GRAQTVG

SEQ ID NO: 151469 - protein, 5 aa, Mycobacterium bovis
GRASQ

SEQ ID NO: 151470 - protein, 6 aa, Mycobacterium bovis
GRATGS

SEQ ID NO: 151471 - protein, 7 aa, Mycobacterium bovis
GRDDGGV

SEQ ID NO: 151472 - protein, 6 aa, Mycobacterium bovis
GRDGEL

SEQ ID NO: 151473 - protein, 70 aa, Mycobacterium bovis
GRDKSGQPNPQPPETDALSRDASPGAPPGPRRRRRATARRKAPVKAPSATRQTTKPKGPPAHRSSSTYPR

SEQ ID NO: 151474 - protein, 7 aa, Mycobacterium bovis
GRDPKTD

SEQ ID NO: 151475 - protein, 11 aa, Mycobacterium bovis
GRDPSTPPTKA

SEQ ID NO: 151476 - protein, 5 aa, Mycobacterium bovis
GRDVG

SEQ ID NO: 151477 - protein, 26 aa, Mycobacterium bovis
GREGRTEVPAGPLADPVNGQPRPAAL

SEQ ID NO: 151478 - protein, 5 aa, Mycobacterium bovis
GRFGT

SEQ ID NO: 151479 - protein, 4 aa, Mycobacterium bovis
GRGA

SEQ ID NO: 151480 - protein, 5 aa, Mycobacterium bovis
GRGAQ

SEQ ID NO: 151481 - protein, 5 aa, Mycobacterium bovis
GRGEC

SEQ ID NO: 151482 - protein, 10 aa, Mycobacterium bovis
GRGGTEVAKD

SEQ ID NO: 151483 - protein, 6 aa, Mycobacterium bovis
GRGVPA

SEQ ID NO: 151484 - protein, 21 aa, Mycobacterium bovis
GRIADEATGARSKGAVSGRGA

SEQ ID NO: 151485 - protein, 13 aa, Mycobacterium bovis
GRIPGTAAGPSRR

SEQ ID NO: 151486 - protein, 15 aa, Mycobacterium bovis
GRIPSDKPPIKTPGE

SEQ ID NO: 151487 - protein, 13 aa, Mycobacterium bovis
GRITPEEAHSHPQ

SEQ ID NO: 151488 - protein, 11 aa, Mycobacterium bovis
GRKAYDVERRG

SEQ ID NO: 151489 - protein, 10 aa, Mycobacterium bovis
GRKPTREEER

SEQ ID NO: 151490 - protein, 8 aa, Mycobacterium bovis
GRKQDNPA

SEQ ID NO: 151491 - protein, 8 aa, Mycobacterium bovis
GRKVQGSA

SEQ ID NO: 151492 - protein, 11 aa, Mycobacterium bovis
GRNGAGKSTTL

SEQ ID NO: 151493 - protein, 8 aa, Mycobacterium bovis
GRPAPTDG

SEQ ID NO: 151494 - protein, 9 aa, Mycobacterium bovis
GRPDLPEGR

SEQ ID NO: 151495 - protein, 9 aa, Mycobacterium bovis
GRPEATTDE

SEQ ID NO: 151496 - protein, 20 aa, Mycobacterium bovis
GRPGDDAGRPAARAGAGCSH

SEQ ID NO: 151497 - protein, 6 aa, Mycobacterium bovis
GRPGFA

SEQ ID NO: 151498 - protein, 8 aa, Mycobacterium bovis
GRPPSHTV

SEQ ID NO: 151499 - protein, 6 aa, Mycobacterium bovis
GRPRGY

SEQ ID NO: 151500 - protein, 8 aa, Mycobacterium bovis
GRPRRAGV

SEQ ID NO: 151501 - protein, 8 aa, Mycobacterium bovis
GRPSAGLA

SEQ ID NO: 151502 - protein, 8 aa, Mycobacterium bovis
GRRPPDAV

SEQ ID NO: 151503 - protein, 24 aa, Mycobacterium bovis
GRRPPSGSPDERCADPGSKGGSRR

SEQ ID NO: 151504 - protein, 5 aa, Mycobacterium bovis
GRRPV

SEQ ID NO: 151505 - protein, 21 aa, Mycobacterium bovis
GRRQQGVGNQVPPSPRGEGAE

SEQ ID NO: 151506 - protein, 9 aa, Mycobacterium bovis
GRSGAGKTT

SEQ ID NO: 151507 - protein, 5 aa, Mycobacterium bovis
GRSQM

SEQ ID NO: 151508 - protein, 7 aa, Mycobacterium bovis
GRSSERL

SEQ ID NO: 151509 - protein, 5 aa, Mycobacterium bovis
GRSTQ

SEQ ID NO: 151510 - protein, 6 aa, Mycobacterium bovis
GRTGGH

SEQ ID NO: 151511 - protein, 22 aa, Mycobacterium bovis
GRTVSGAATATTAAAGAVGGAA

SEQ ID NO: 151512 - protein, 14 aa, Mycobacterium bovis
GRVGPGGETPVGST

SEQ ID NO: 151513 - protein, 6 aa, Mycobacterium bovis
GRVTRA

SEQ ID NO: 151514 - protein, 4 aa, Mycobacterium bovis
GSAA

SEQ ID NO: 151515 - protein, 5 aa, Mycobacterium bovis
GSAAR

SEQ ID NO: 151516 - protein, 6 aa, Mycobacterium bovis
GSAASA

SEQ ID NO: 151517 - protein, 5 aa, Mycobacterium bovis
GSAGG

SEQ ID NO: 151518 - protein, 12 aa, Mycobacterium bovis
GSAHGGHGHDAS

SEQ ID NO: 151519 - protein, 7 aa, Mycobacterium bovis
GSAPRFT

SEQ ID NO: 151520 - protein, 23 aa, Mycobacterium bovis
GSDAGDHASAPQPSGSGSVPASV

SEQ ID NO: 151521 - protein, 14 aa, Mycobacterium bovis
GSDAGHSAAPTYRD

SEQ ID NO: 151522 - protein, 10 aa, Mycobacterium bovis
GSDAVAGSAQ

SEQ ID NO: 151523 - protein, 7 aa, Mycobacterium bovis
GSDPARV

SEQ ID NO: 151524 - protein, 27 aa, Mycobacterium bovis
GSEEPSEEASEATEESAVSADRSDDSA

SEQ ID NO: 151525 - protein, 4 aa, Mycobacterium bovis
GSEP

SEQ ID NO: 151526 - protein, 7 aa, Mycobacterium bovis
GSEPAAT

SEQ ID NO: 151527 - protein, 5 aa, Mycobacterium bovis
GSEPQ

SEQ ID NO: 151528 - protein, 13 aa, Mycobacterium bovis
GSEWGDDGAQRAR

SEQ ID NO: 151529 - protein, 6 aa, Mycobacterium bovis
GSFGGE

SEQ ID NO: 151530 - protein, 18 aa, Mycobacterium bovis
GSFTPRHASSSAQTPTPH

SEQ ID NO: 151531 - protein, 10 aa, Mycobacterium bovis
GSGAADPARL

SEQ ID NO: 151532 - protein, 5 aa, Mycobacterium bovis
GSGAN

SEQ ID NO: 151533 - protein, 5 aa, Mycobacterium bovis
GSGGM

SEQ ID NO: 151534 - protein, 7 aa, Mycobacterium bovis
GSGKSQT

SEQ ID NO: 151535 - protein, 6 aa, Mycobacterium bovis
GSGPLT

SEQ ID NO: 151536 - protein, 8 aa, Mycobacterium bovis
GSGPPVPL

SEQ ID NO: 151537 - protein, 9 aa, Mycobacterium bovis
GSGSPASRA

SEQ ID NO: 151538 - protein, 7 aa, Mycobacterium bovis
GSGSQRG

SEQ ID NO: 151539 - protein, 10 aa, Mycobacterium bovis
GSGVGKPGAE

SEQ ID NO: 151540 - protein, 7 aa, Mycobacterium bovis
GSGVRAY

SEQ ID NO: 151541 - protein, 13 aa, Mycobacterium bovis
GSHNESPDGMTPP

SEQ ID NO: 151542 - protein, 5 aa, Mycobacterium bovis
GSHNG

SEQ ID NO: 151543 - protein, 9 aa, Mycobacterium bovis
GSIEERAQQ

SEQ ID NO: 151544 - protein, 6 aa, Mycobacterium bovis
GSKDGK

SEQ ID NO: 151545 - protein, 6 aa, Mycobacterium bovis
GSKVTY

SEQ ID NO: 151546 - protein, 4 aa, Mycobacterium bovis
GSLT

SEQ ID NO: 151547 - protein, 6 aa, Mycobacterium bovis
GSNDIA

SEQ ID NO: 151548 - protein, 13 aa, Mycobacterium bovis
GSNRVRETESTVS

SEQ ID NO: 151549 - protein, 14 aa, Mycobacterium bovis
GSPAVMGGDTNHRA

SEQ ID NO: 151550 - protein, 18 aa, Mycobacterium bovis
GSPDAPHDHHDRHDDHLG

SEQ ID NO: 151551 - protein, 10 aa, Mycobacterium bovis
GSPENAAGTV

SEQ ID NO: 151552 - protein, 33 aa, Mycobacterium bovis
GSPHGGPAAVRPGPGPGGPGQVPSSVSPPATPA

SEQ ID NO: 151553 - protein, 8 aa, Mycobacterium bovis
GSPPYQGD

SEQ ID NO: 151554 - protein, 6 aa, Mycobacterium bovis
GSPQPG

SEQ ID NO: 151555 - protein, 7 aa, Mycobacterium bovis
GSPYSTP

SEQ ID NO: 151556 - protein, 4 aa, Mycobacterium bovis
GSQA

SEQ ID NO: 151557 - protein, 9 aa, Mycobacterium bovis
GSQRGADAA

SEQ ID NO: 151558 - protein, 5 aa, Mycobacterium bovis
GSQTG

SEQ ID NO: 151559 - protein, 8 aa, Mycobacterium bovis
GSRQGVTR

SEQ ID NO: 151560 - protein, 6 aa, Mycobacterium bovis
GSRTPL

SEQ ID NO: 151561 - protein, 12 aa, Mycobacterium bovis
GSSAIAKASLDA

SEQ ID NO: 151562 - protein, 12 aa, Mycobacterium bovis
GSSALPTIAVPG

SEQ ID NO: 151563 - protein, 8 aa, Mycobacterium bovis
GSSGGPFA

SEQ ID NO: 151564 - protein, 6 aa, Mycobacterium bovis
GSSIPG

SEQ ID NO: 151565 - protein, 13 aa, Mycobacterium bovis
GSSQFEEPTGSIA

SEQ ID NO: 151566 - protein, 11 aa, Mycobacterium bovis
GSSTEPPTTRL

SEQ ID NO: 151567 - protein, 9 aa, Mycobacterium bovis
GSTADGNIT

SEQ ID NO: 151568 - protein, 7 aa, Mycobacterium bovis
GSTGGVI

SEQ ID NO: 151569 - protein, 10 aa, Mycobacterium bovis
GSTGSGKSSF

SEQ ID NO: 151570 - protein, 9 aa, Mycobacterium bovis
GSTGSGKST

SEQ ID NO: 151571 - protein, 17 aa, Mycobacterium bovis
GSTHPVRPKIYRPPDHS

SEQ ID NO: 151572 - protein, 4 aa, Mycobacterium bovis
GSTL

SEQ ID NO: 151573 - protein, 12 aa, Mycobacterium bovis
GSTLEPQDQPYY

SEQ ID NO: 151574 - protein, 7 aa, Mycobacterium bovis
GSTNGTY

SEQ ID NO: 151575 - protein, 6 aa, Mycobacterium bovis
GSTTST

SEQ ID NO: 151576 - protein, 7 aa, Mycobacterium bovis
GSVATYS

SEQ ID NO: 151577 - protein, 5 aa, Mycobacterium bovis
GSVYR

SEQ ID NO: 151578 - protein, 22 aa, Mycobacterium bovis
GSYDYPGVDQPDDGPLSSEGHY

SEQ ID NO: 151579 - protein, 5 aa, Mycobacterium bovis
GSYTG

SEQ ID NO: 151580 - protein, 5 aa, Mycobacterium bovis
GTAAT

SEQ ID NO: 151581 - protein, 6 aa, Mycobacterium bovis
GTAETG

SEQ ID NO: 151582 - protein, 8 aa, Mycobacterium bovis
GTAIPSNV

SEQ ID NO: 151583 - protein, 11 aa, Mycobacterium bovis
GTAPAQPPKPR

SEQ ID NO: 151584 - protein, 12 aa, Mycobacterium bovis
GTAPGAPGSDFP

SEQ ID NO: 151585 - protein, 5 aa, Mycobacterium bovis
GTAPI

SEQ ID NO: 151586 - protein, 11 aa, Mycobacterium bovis
GTAPTTSGAAA

SEQ ID NO: 151587 - protein, 31 aa, Mycobacterium bovis
GTARDDLGGYPAVDPSSNARTEALETPQAPV

SEQ ID NO: 151588 - protein, 4 aa, Mycobacterium bovis
GTAT

SEQ ID NO: 151589 - protein, 6 aa, Mycobacterium bovis
GTATRG

SEQ ID NO: 151590 - protein, 17 aa, Mycobacterium bovis
GTATRSGLWSPGKIRIG

SEQ ID NO: 151591 - protein, 5 aa, Mycobacterium bovis
GTDAG

SEQ ID NO: 151592 - protein, 7 aa, Mycobacterium bovis
GTDDQKK

SEQ ID NO: 151593 - protein, 10 aa, Mycobacterium bovis
GTDESPITEQ

SEQ ID NO: 151594 - protein, 12 aa, Mycobacterium bovis
GTDQEQAAATLG

SEQ ID NO: 151595 - protein, 8 aa, Mycobacterium bovis
GTDRYPPF

SEQ ID NO: 151596 - protein, 7 aa, Mycobacterium bovis
GTDYVPT

SEQ ID NO: 151597 - protein, 18 aa, Mycobacterium bovis
GTEDLSASVGSTHPPGTP

SEQ ID NO: 151598 - protein, 6 aa, Mycobacterium bovis
GTEPST

SEQ ID NO: 151599 - protein, 7 aa, Mycobacterium bovis
GTERTDH

SEQ ID NO: 151600 - protein, 8 aa, Mycobacterium bovis
GTETAPLQ

SEQ ID NO: 151601 - protein, 11 aa, Mycobacterium bovis
GTFSPDPRPNA

SEQ ID NO: 151602 - protein, 11 aa, Mycobacterium bovis
GTGCGPASSEV

SEQ ID NO: 151603 - protein, 5 aa, Mycobacterium bovis
GTGGV

SEQ ID NO: 151604 - protein, 4 aa, Mycobacterium bovis
GTGT

SEQ ID NO: 151605 - protein, 4 aa, Mycobacterium bovis
GTGY

SEQ ID NO: 151606 - protein, 5 aa, Mycobacterium bovis
GTHGP

SEQ ID NO: 151607 - protein, 37 aa, Mycobacterium bovis
GTHRATEPAATEPEVGAAPQPESAVPAPARGSWRAQA

SEQ ID NO: 151608 - protein, 8 aa, Mycobacterium bovis
GTIATDQR

SEQ ID NO: 151609 - protein, 5 aa, Mycobacterium bovis
GTITL

SEQ ID NO: 151610 - protein, 25 aa, Mycobacterium bovis
GTKAAQHTNVHNPGPHDHPPGPDPL

SEQ ID NO: 151611 - protein, 8 aa, Mycobacterium bovis
GTKGKTAV

SEQ ID NO: 151612 - protein, 6 aa, Mycobacterium bovis
GTKPLS

SEQ ID NO: 151613 - protein, 5 aa, Mycobacterium bovis
GTLTE

SEQ ID NO: 151614 - protein, 14 aa, Mycobacterium bovis
GTLTYDGADPERKR

SEQ ID NO: 151615 - protein, 18 aa, Mycobacterium bovis
GTNGPAPYPEPSSHEPQA

SEQ ID NO: 151616 - protein, 5 aa, Mycobacterium bovis
GTNTT

SEQ ID NO: 151617 - protein, 9 aa, Mycobacterium bovis
GTPAQGNYA

SEQ ID NO: 151618 - protein, 5 aa, Mycobacterium bovis
GTPDE

SEQ ID NO: 151619 - protein, 7 aa, Mycobacterium bovis
GTPDLTG

SEQ ID NO: 151620 - protein, 11 aa, Mycobacterium bovis
GTPDYGAPARL

SEQ ID NO: 151621 - protein, 7 aa, Mycobacterium bovis
GTPGDAR

SEQ ID NO: 151622 - protein, 13 aa, Mycobacterium bovis
GTPGQVTGPTGPI

SEQ ID NO: 151623 - protein, 12 aa, Mycobacterium bovis
GTPRGATGLAEG

SEQ ID NO: 151624 - protein, 10 aa, Mycobacterium bovis
GTPRPAPRTT

SEQ ID NO: 151625 - protein, 5 aa, Mycobacterium bovis
GTPTR

SEQ ID NO: 151626 - protein, 4 aa, Mycobacterium bovis
GTQP

SEQ ID NO: 151627 - protein, 7 aa, Mycobacterium bovis
GTQPDYS

SEQ ID NO: 151628 - protein, 6 aa, Mycobacterium bovis
GTQQGV

SEQ ID NO: 151629 - protein, 6 aa, Mycobacterium bovis
GTRDFS

SEQ ID NO: 151630 - protein, 8 aa, Mycobacterium bovis
GTREQCEA

SEQ ID NO: 151631 - protein, 9 aa, Mycobacterium bovis
GTRHRSNKE

SEQ ID NO: 151632 - protein, 5 aa, Mycobacterium bovis
GTRQL

SEQ ID NO: 151633 - protein, 13 aa, Mycobacterium bovis
GTRRAEAAAESAR

SEQ ID NO: 151634 - protein, 7 aa, Mycobacterium bovis
GTSGRSV

SEQ ID NO: 151635 - protein, 6 aa, Mycobacterium bovis
GTSQAD

SEQ ID NO: 151636 - protein, 13 aa, Mycobacterium bovis
GTSQKLTEKYNQD

SEQ ID NO: 151637 - protein, 8 aa, Mycobacterium bovis
GTSSTYKD

SEQ ID NO: 151638 - protein, 5 aa, Mycobacterium bovis
GTSTF

SEQ ID NO: 151639 - protein, 7 aa, Mycobacterium bovis
GTSYAAG

SEQ ID NO: 151640 - protein, 4 aa, Mycobacterium bovis
GTTA

SEQ ID NO: 151641 - protein, 7 aa, Mycobacterium bovis
GTTGHPK

SEQ ID NO: 151642 - protein, 8 aa, Mycobacterium bovis
GTTGRTVA

SEQ ID NO: 151643 - protein, 18 aa, Mycobacterium bovis
GTTGTPKGANRNTPPTLA

SEQ ID NO: 151644 - protein, 9 aa, Mycobacterium bovis
GTTPQVGQG

SEQ ID NO: 151645 - protein, 12 aa, Mycobacterium bovis
GTVKSEDQIPDE

SEQ ID NO: 151646 - protein, 8 aa, Mycobacterium bovis
GTVSTAPA

SEQ ID NO: 151647 - protein, 13 aa, Mycobacterium bovis
GTVVSDGPAPLDQ

SEQ ID NO: 151648 - protein, 12 aa, Mycobacterium bovis
GTYTTGAQQQST

SEQ ID NO: 151649 - protein, 8 aa, Mycobacterium bovis
GVAATGNL

SEQ ID NO: 151650 - protein, 9 aa, Mycobacterium bovis
GVAKGDTAT

SEQ ID NO: 151651 - protein, 6 aa, Mycobacterium bovis
GVDDPV

SEQ ID NO: 151652 - protein, 8 aa, Mycobacterium bovis
GVEDNPGY

SEQ ID NO: 151653 - protein, 12 aa, Mycobacterium bovis
GVEPTERGARAT

SEQ ID NO: 151654 - protein, 10 aa, Mycobacterium bovis
GVGDANVPAP

SEQ ID NO: 151655 - protein, 9 aa, Mycobacterium bovis
GVGGPSSRV

SEQ ID NO: 151656 - protein, 8 aa, Mycobacterium bovis
GVGPATRD

SEQ ID NO: 151657 - protein, 7 aa, Mycobacterium bovis
GVNDAPA

SEQ ID NO: 151658 - protein, 9 aa, Mycobacterium bovis
GVNDAPALA

SEQ ID NO: 151659 - protein, 7 aa, Mycobacterium bovis
GVPDHGP

SEQ ID NO: 151660 - protein, 13 aa, Mycobacterium bovis
GVPGRGPETRTAN

SEQ ID NO: 151661 - protein, 5 aa, Mycobacterium bovis
GVPGV

SEQ ID NO: 151662 - protein, 4 aa, Mycobacterium bovis
GVPH

SEQ ID NO: 151663 - protein, 11 aa, Mycobacterium bovis
GVPRDDEPPLD

SEQ ID NO: 151664 - protein, 10 aa, Mycobacterium bovis
GVPSQNPNLI

SEQ ID NO: 151665 - protein, 7 aa, Mycobacterium bovis
GVRPSHG

SEQ ID NO: 151666 - protein, 13 aa, Mycobacterium bovis
GVRRASGRSDPSA

SEQ ID NO: 151667 - protein, 7 aa, Mycobacterium bovis
GVSDHSA

SEQ ID NO: 151668 - protein, 4 aa, Mycobacterium bovis
GVSQ

SEQ ID NO: 151669 - protein, 16 aa, Mycobacterium bovis
GVSTATRAKDSDRQDA

SEQ ID NO: 151670 - protein, 13 aa, Mycobacterium bovis
GWGDATSSAKSIA

SEQ ID NO: 151671 - protein, 16 aa, Mycobacterium bovis
GWPPGLSGATPWSPQQ

SEQ ID NO: 151672 - protein, 52 aa, Mycobacterium bovis
GWPPRSSHRPSYSGEPAPTYPGQPYPTGQADPGSDESSAEQDDEVSRTKPAH

SEQ ID NO: 151673 - protein, 10 aa, Mycobacterium bovis
GWVPPSPAPH

SEQ ID NO: 151674 - protein, 7 aa, Mycobacterium bovis
GYAARDG

SEQ ID NO: 151675 - protein, 5 aa, Mycobacterium bovis
GYEPE

SEQ ID NO: 151676 - protein, 9 aa, Mycobacterium bovis
GYGPSQPGM

SEQ ID NO: 151677 - protein, 6 aa, Mycobacterium bovis
GYGPTV

SEQ ID NO: 151678 - protein, 7 aa, Mycobacterium bovis
GYKTSYD

SEQ ID NO: 151679 - protein, 9 aa, Mycobacterium bovis
GYKTSYNDR

SEQ ID NO: 151680 - protein, 7 aa, Mycobacterium bovis
GYRPGYN

SEQ ID NO: 151681 - protein, 6 aa, Mycobacterium bovis
GYRSDR

SEQ ID NO: 151682 - protein, 9 aa, Mycobacterium bovis
GYTGGGGKQ

SEQ ID NO: 151683 - protein, 6 aa, Mycobacterium bovis
GYTPEG

SEQ ID NO: 151684 - protein, 6 aa, Mycobacterium bovis
GYTPSV

SEQ ID NO: 151685 - protein, 11 aa, Mycobacterium bovis
GYYGSDSAGTF

SEQ ID NO: 151686 - protein, 12 aa, Mycobacterium bovis
HAAGATHRDVKP

SEQ ID NO: 151687 - protein, 9 aa, Mycobacterium bovis
HAAGEPLER

SEQ ID NO: 151688 - protein, 9 aa, Mycobacterium bovis
HAAPHTETT

SEQ ID NO: 151689 - protein, 9 aa, Mycobacterium bovis
HAASETERA

SEQ ID NO: 151690 - protein, 8 aa, Mycobacterium bovis
HADEGASK

SEQ ID NO: 151691 - protein, 5 aa, Mycobacterium bovis
HAEAN

SEQ ID NO: 151692 - protein, 9 aa, Mycobacterium bovis
HAGAQAGGD

SEQ ID NO: 151693 - protein, 12 aa, Mycobacterium bovis
HAGNASAAGATG

SEQ ID NO: 151694 - protein, 5 aa, Mycobacterium bovis
HAGSV

SEQ ID NO: 151695 - protein, 4 aa, Mycobacterium bovis
HAHP

SEQ ID NO: 151696 - protein, 5 aa, Mycobacterium bovis
HAKPG

SEQ ID NO: 151697 - protein, 16 aa, Mycobacterium bovis
HAPGTDEEKIDGRRGQ

SEQ ID NO: 151698 - protein, 6 aa, Mycobacterium bovis
HARQRD

SEQ ID NO: 151699 - protein, 6 aa, Mycobacterium bovis
HATGGR

SEQ ID NO: 151700 - protein, 22 aa, Mycobacterium bovis
HDAEPAAHGAPRDDEVAPLSFA

SEQ ID NO: 151701 - protein, 6 aa, Mycobacterium bovis
HDDNDT

SEQ ID NO: 151702 - protein, 6 aa, Mycobacterium bovis
HDGKTQ

SEQ ID NO: 151703 - protein, 5 aa, Mycobacterium bovis
HDMRN

SEQ ID NO: 151704 - protein, 5 aa, Mycobacterium bovis
HDPGQ

SEQ ID NO: 151705 - protein, 4 aa, Mycobacterium bovis
HDQP

SEQ ID NO: 151706 - protein, 7 aa, Mycobacterium bovis
HDQTPLR

SEQ ID NO: 151707 - protein, 9 aa, Mycobacterium bovis
HDSAATAAK

SEQ ID NO: 151708 - protein, 7 aa, Mycobacterium bovis
HDTGNAM

SEQ ID NO: 151709 - protein, 11 aa, Mycobacterium bovis
HDTTSTAGGVA

SEQ ID NO: 151710 - protein, 4 aa, Mycobacterium bovis
HEGD

SEQ ID NO: 151711 - protein, 20 aa, Mycobacterium bovis
HEIRTGAAAAAQALGPGALG

SEQ ID NO: 151712 - protein, 4 aa, Mycobacterium bovis
HELR

SEQ ID NO: 151713 - protein, 5 aa, Mycobacterium bovis
HEPPG

SEQ ID NO: 151714 - protein, 6 aa, Mycobacterium bovis
HESGSE

SEQ ID NO: 151715 - protein, 6 aa, Mycobacterium bovis
HETPER

SEQ ID NO: 151716 - protein, 5 aa, Mycobacterium bovis
HETRG

SEQ ID NO: 151717 - protein, 6 aa, Mycobacterium bovis
HETTAT

SEQ ID NO: 151718 - protein, 7 aa, Mycobacterium bovis
HFPNPGS

SEQ ID NO: 151719 - protein, 24 aa, Mycobacterium bovis
HGAATAVKAGRDGADADDDQRPAP

SEQ ID NO: 151720 - protein, 6 aa, Mycobacterium bovis
HGAGRA

SEQ ID NO: 151721 - protein, 9 aa, Mycobacterium bovis
HGDHPGYEL

SEQ ID NO: 151722 - protein, 7 aa, Mycobacterium bovis
HGDYTLP

SEQ ID NO: 151723 - protein, 6 aa, Mycobacterium bovis
HGEGQS

SEQ ID NO: 151724 - protein, 6 aa, Mycobacterium bovis
HGESPT

SEQ ID NO: 151725 - protein, 13 aa, Mycobacterium bovis
HGGELDQLTGGAH

SEQ ID NO: 151726 - protein, 6 aa, Mycobacterium bovis
HGGGLD

SEQ ID NO: 151727 - protein, 7 aa, Mycobacterium bovis
HGGGTTA

SEQ ID NO: 151728 - protein, 6 aa, Mycobacterium bovis
HGNPSA

SEQ ID NO: 151729 - protein, 6 aa, Mycobacterium bovis
HGNTAI

SEQ ID NO: 151730 - protein, 6 aa, Mycobacterium bovis
HGPRTD

SEQ ID NO: 151731 - protein, 4 aa, Mycobacterium bovis
HGPT

SEQ ID NO: 151732 - protein, 5 aa, Mycobacterium bovis
HGPVS

SEQ ID NO: 151733 - protein, 10 aa, Mycobacterium bovis
HGRPTADGTT

SEQ ID NO: 151734 - protein, 8 aa, Mycobacterium bovis
HGSAAQRQ

SEQ ID NO: 151735 - protein, 4 aa, Mycobacterium bovis
HGSG

SEQ ID NO: 151736 - protein, 5 aa, Mycobacterium bovis
HGSQT

SEQ ID NO: 151737 - protein, 4 aa, Mycobacterium bovis
HGST

SEQ ID NO: 151738 - protein, 5 aa, Mycobacterium bovis
HGTGT

SEQ ID NO: 151739 - protein, 9 aa, Mycobacterium bovis
HGTNDAQKT

SEQ ID NO: 151740 - protein, 19 aa, Mycobacterium bovis
HHAGPDAHASQSPAANGRV

SEQ ID NO: 151741 - protein, 4 aa, Mycobacterium bovis
HHSA

SEQ ID NO: 151742 - protein, 4 aa, Mycobacterium bovis
HKAT

SEQ ID NO: 151743 - protein, 9 aa, Mycobacterium bovis
HKQTAASSN

SEQ ID NO: 151744 - protein, 8 aa, Mycobacterium bovis
HLPSKENG

SEQ ID NO: 151745 - protein, 41 aa, Mycobacterium bovis
HLPTQAGPQLPGPVPIPGAPGPMPAPPLGAVPSPAPAENPV

SEQ ID NO: 151746 - protein, 26 aa, Mycobacterium bovis
HNAQRLGNTPSTPPTTTKKAPQAGLT

SEQ ID NO: 151747 - protein, 8 aa, Mycobacterium bovis
HNGGGPLG

SEQ ID NO: 151748 - protein, 26 aa, Mycobacterium bovis
HNLAGGRDSAAKTGTTQFGDTTANKD

SEQ ID NO: 151749 - protein, 4 aa, Mycobacterium bovis
HNPA

SEQ ID NO: 151750 - protein, 13 aa, Mycobacterium bovis
HNPDTSRRLTGEQ

SEQ ID NO: 151751 - protein, 9 aa, Mycobacterium bovis
HNSSPPPPR

SEQ ID NO: 151752 - protein, 4 aa, Mycobacterium bovis
HNTN

SEQ ID NO: 151753 - protein, 6 aa, Mycobacterium bovis
HPDKTA

SEQ ID NO: 151754 - protein, 34 aa, Mycobacterium bovis
HPDQPGAAATPPPAGLTTRSAPTAAPPSTLQSPD

SEQ ID NO: 151755 - protein, 5 aa, Mycobacterium bovis
HPDSE

SEQ ID NO: 151756 - protein, 9 aa, Mycobacterium bovis
HPEAPSPVS

SEQ ID NO: 151757 - protein, 6 aa, Mycobacterium bovis
HPGSGG

SEQ ID NO: 151758 - protein, 8 aa, Mycobacterium bovis
HPGVGSAS

SEQ ID NO: 151759 - protein, 5 aa, Mycobacterium bovis
HPPIE

SEQ ID NO: 151760 - protein, 4 aa, Mycobacterium bovis
HPPT

SEQ ID NO: 151761 - protein, 6 aa, Mycobacterium bovis
HPQRHT

SEQ ID NO: 151762 - protein, 12 aa, Mycobacterium bovis
HPREPLDGEAPA

SEQ ID NO: 151763 - protein, 11 aa, Mycobacterium bovis
HPRPPSGPSHR

SEQ ID NO: 151764 - protein, 10 aa, Mycobacterium bovis
HPRSKVGPLR

SEQ ID NO: 151765 - protein, 12 aa, Mycobacterium bovis
HPTTPFVAVDYD

SEQ ID NO: 151766 - protein, 16 aa, Mycobacterium bovis
HPVTGQPFSDKSKTVA

SEQ ID NO: 151767 - protein, 7 aa, Mycobacterium bovis
HQAAQRE

SEQ ID NO: 151768 - protein, 12 aa, Mycobacterium bovis
HQANPTNPGDSL

SEQ ID NO: 151769 - protein, 9 aa, Mycobacterium bovis
HQESQSIAR

SEQ ID NO: 151770 - protein, 11 aa, Mycobacterium bovis
HQKTQTAEEIA

SEQ ID NO: 151771 - protein, 11 aa, Mycobacterium bovis
HRADSEREKTS

SEQ ID NO: 151772 - protein, 4 aa, Mycobacterium bovis
HRDD

SEQ ID NO: 151773 - protein, 5 aa, Mycobacterium bovis
HRGAE

SEQ ID NO: 151774 - protein, 5 aa, Mycobacterium bovis
HRGSA

SEQ ID NO: 151775 - protein, 13 aa, Mycobacterium bovis
HRGSAGRPPQTTS

SEQ ID NO: 151776 - protein, 5 aa, Mycobacterium bovis
HRHRP

SEQ ID NO: 151777 - protein, 9 aa, Mycobacterium bovis
HRPGTPSGF

SEQ ID NO: 151778 - protein, 12 aa, Mycobacterium bovis
HRPPPLPPQQER

SEQ ID NO: 151779 - protein, 15 aa, Mycobacterium bovis
HRQQRTDADAATQTT

SEQ ID NO: 151780 - protein, 16 aa, Mycobacterium bovis
HRRKAPIPAPKPPHTK

SEQ ID NO: 151781 - protein, 11 aa, Mycobacterium bovis
HRRKRSESGVG

SEQ ID NO: 151782 - protein, 11 aa, Mycobacterium bovis
HRSENPPPPQL

SEQ ID NO: 151783 - protein, 4 aa, Mycobacterium bovis
HRTG

SEQ ID NO: 151784 - protein, 9 aa, Mycobacterium bovis
HSAAPQRAA

SEQ ID NO: 151785 - protein, 8 aa, Mycobacterium bovis
HSDADLSN

SEQ ID NO: 151786 - protein, 14 aa, Mycobacterium bovis
HSDGPSRQSWPAAT

SEQ ID NO: 151787 - protein, 8 aa, Mycobacterium bovis
HSDPANYG

SEQ ID NO: 151788 - protein, 7 aa, Mycobacterium bovis
HSDPPGL

SEQ ID NO: 151789 - protein, 22 aa, Mycobacterium bovis
HSDRAPAGPPSGAEHMSPDPVE

SEQ ID NO: 151790 - protein, 6 aa, Mycobacterium bovis
HSGDRS

SEQ ID NO: 151791 - protein, 7 aa, Mycobacterium bovis
HSGSTAR

SEQ ID NO: 151792 - protein, 4 aa, Mycobacterium bovis
HSIT

SEQ ID NO: 151793 - protein, 12 aa, Mycobacterium bovis
HSKGPAAARNTG

SEQ ID NO: 151794 - protein, 14 aa, Mycobacterium bovis
HSNDDEQDPDTFAS

SEQ ID NO: 151795 - protein, 4 aa, Mycobacterium bovis
HSPD

SEQ ID NO: 151796 - protein, 7 aa, Mycobacterium bovis
HSPGAGG

SEQ ID NO: 151797 - protein, 8 aa, Mycobacterium bovis
HSQAPAPV

SEQ ID NO: 151798 - protein, 5 aa, Mycobacterium bovis
HSQGE

SEQ ID NO: 151799 - protein, 8 aa, Mycobacterium bovis
HSSDQRGT

SEQ ID NO: 151800 - protein, 6 aa, Mycobacterium bovis
HSVKTY

SEQ ID NO: 151801 - protein, 10 aa, Mycobacterium bovis
HTEVKDNRRN

SEQ ID NO: 151802 - protein, 13 aa, Mycobacterium bovis
HTNTPGSKNPKRW

SEQ ID NO: 151803 - protein, 8 aa, Mycobacterium bovis
HTPPPAGV

SEQ ID NO: 151804 - protein, 4 aa, Mycobacterium bovis
HTPQ

SEQ ID NO: 151805 - protein, 5 aa, Mycobacterium bovis
HTSRT

SEQ ID NO: 151806 - protein, 7 aa, Mycobacterium bovis
HVAGPDH

SEQ ID NO: 151807 - protein, 7 aa, Mycobacterium bovis
HYPDDIE

SEQ ID NO: 151808 - protein, 8 aa, Mycobacterium bovis
HYPDRGAP

SEQ ID NO: 151809 - protein, 11 aa, Mycobacterium bovis
IAAETQDEPDV

SEQ ID NO: 151810 - protein, 14 aa, Mycobacterium bovis
IAAGGNTAAESFGE

SEQ ID NO: 151811 - protein, 7 aa, Mycobacterium bovis
IAATGPE

SEQ ID NO: 151812 - protein, 12 aa, Mycobacterium bovis
IAGAPTTSPTAL

SEQ ID NO: 151813 - protein, 12 aa, Mycobacterium bovis
IAGPGGDKLPTP

SEQ ID NO: 151814 - protein, 26 aa, Mycobacterium bovis
IAPIDNPRNPHPSAPSPALGPPPDAF

SEQ ID NO: 151815 - protein, 4 aa, Mycobacterium bovis
IAPK

SEQ ID NO: 151816 - protein, 9 aa, Mycobacterium bovis
IASGGTSTV

SEQ ID NO: 151817 - protein, 14 aa, Mycobacterium bovis
IDEDQEADDARRRG

SEQ ID NO: 151818 - protein, 4 aa, Mycobacterium bovis
IDGA

SEQ ID NO: 151819 - protein, 6 aa, Mycobacterium bovis
IDGAGE

SEQ ID NO: 151820 - protein, 7 aa, Mycobacterium bovis
IDGEEAP

SEQ ID NO: 151821 - protein, 4 aa, Mycobacterium bovis
IDGF

SEQ ID NO: 151822 - protein, 9 aa, Mycobacterium bovis
IDGKTNAEA

SEQ ID NO: 151823 - protein, 5 aa, Mycobacterium bovis
IDGPT

SEQ ID NO: 151824 - protein, 7 aa, Mycobacterium bovis
IDGQETG

SEQ ID NO: 151825 - protein, 9 aa, Mycobacterium bovis
IDNPDQRIQ

SEQ ID NO: 151826 - protein, 12 aa, Mycobacterium bovis
IDPQAQRAAEKA

SEQ ID NO: 151827 - protein, 9 aa, Mycobacterium bovis
IDQGPAAGT

SEQ ID NO: 151828 - protein, 9 aa, Mycobacterium bovis
IDRSGAQAG

SEQ ID NO: 151829 - protein, 4 aa, Mycobacterium bovis
IDTA

SEQ ID NO: 151830 - protein, 13 aa, Mycobacterium bovis
IDTAKGSRAGPVE

SEQ ID NO: 151831 - protein, 7 aa, Mycobacterium bovis
IDTSEAV

SEQ ID NO: 151832 - protein, 4 aa, Mycobacterium bovis
IEPG

SEQ ID NO: 151833 - protein, 6 aa, Mycobacterium bovis
IEPRTS

SEQ ID NO: 151834 - protein, 4 aa, Mycobacterium bovis
IESG

SEQ ID NO: 151835 - protein, 42 aa, Mycobacterium bovis
IETNGQLAAAAKDAAAQAKSTVEGANDALARNASVPAPSHSP

SEQ ID NO: 151836 - protein, 6 aa, Mycobacterium bovis
IETRSD

SEQ ID NO: 151837 - protein, 8 aa, Mycobacterium bovis
IETTGRQQ

SEQ ID NO: 151838 - protein, 10 aa, Mycobacterium bovis
IETVGSNIGG

SEQ ID NO: 151839 - protein, 4 aa, Mycobacterium bovis
IGAG

SEQ ID NO: 151840 - protein, 8 aa, Mycobacterium bovis
IGAGATAQ

SEQ ID NO: 151841 - protein, 7 aa, Mycobacterium bovis
IGDQPAV

SEQ ID NO: 151842 - protein, 8 aa, Mycobacterium bovis
IGDRDSGA

SEQ ID NO: 151843 - protein, 5 aa, Mycobacterium bovis
IGDRS

SEQ ID NO: 151844 - protein, 10 aa, Mycobacterium bovis
IGEKTKGRNW

SEQ ID NO: 151845 - protein, 7 aa, Mycobacterium bovis
IGESSPT

SEQ ID NO: 151846 - protein, 8 aa, Mycobacterium bovis
IGGPPEQV

SEQ ID NO: 151847 - protein, 6 aa, Mycobacterium bovis
IGNGAR

SEQ ID NO: 151848 - protein, 7 aa, Mycobacterium bovis
IGNGSSY

SEQ ID NO: 151849 - protein, 6 aa, Mycobacterium bovis
IGPTQQ

SEQ ID NO: 151850 - protein, 6 aa, Mycobacterium bovis
IGQNGL

SEQ ID NO: 151851 - protein, 6 aa, Mycobacterium bovis
IGQNRE

SEQ ID NO: 151852 - protein, 8 aa, Mycobacterium bovis
IGQTGMPS

SEQ ID NO: 151853 - protein, 5 aa, Mycobacterium bovis
IGRQG

SEQ ID NO: 151854 - protein, 16 aa, Mycobacterium bovis
IGRSGRSSHAIGAADD

SEQ ID NO: 151855 - protein, 5 aa, Mycobacterium bovis
IGSEG

SEQ ID NO: 151856 - protein, 5 aa, Mycobacterium bovis
IGSES

SEQ ID NO: 151857 - protein, 16 aa, Mycobacterium bovis
IGSGGSGGREGPTAQI

SEQ ID NO: 151858 - protein, 6 aa, Mycobacterium bovis
IGSSMD

SEQ ID NO: 151859 - protein, 10 aa, Mycobacterium bovis
IGTGGSGGLF

SEQ ID NO: 151860 - protein, 10 aa, Mycobacterium bovis
IGTPPYAGRR

SEQ ID NO: 151861 - protein, 9 aa, Mycobacterium bovis
IGTTTGPTL

SEQ ID NO: 151862 - protein, 10 aa, Mycobacterium bovis
IHNPDRPPSR

SEQ ID NO: 151863 - protein, 8 aa, Mycobacterium bovis
IKPGGEPI

SEQ ID NO: 151864 - protein, 6 aa, Mycobacterium bovis
IKPSNV

SEQ ID NO: 151865 - protein, 7 aa, Mycobacterium bovis
IKPTSPT

SEQ ID NO: 151866 - protein, 8 aa, Mycobacterium bovis
IKSNSDIT

SEQ ID NO: 151867 - protein, 6 aa, Mycobacterium bovis
INDAPA

SEQ ID NO: 151868 - protein, 7 aa, Mycobacterium bovis
INDAPAL

SEQ ID NO: 151869 - protein, 4 aa, Mycobacterium bovis
INTI

SEQ ID NO: 151870 - protein, 12 aa, Mycobacterium bovis
IPAAGAPNSLGL

SEQ ID NO: 151871 - protein, 6 aa, Mycobacterium bovis
IPAEGQ

SEQ ID NO: 151872 - protein, 4 aa, Mycobacterium bovis
IPAL

SEQ ID NO: 151873 - protein, 11 aa, Mycobacterium bovis
IPAPSAAAIAT

SEQ ID NO: 151874 - protein, 4 aa, Mycobacterium bovis
IPDP

SEQ ID NO: 151875 - protein, 16 aa, Mycobacterium bovis
IPGAPYATPVSAGSTS

SEQ ID NO: 151876 - protein, 12 aa, Mycobacterium bovis
IPGGAQDGVKRV

SEQ ID NO: 151877 - protein, 7 aa, Mycobacterium bovis
IPGGPVA

SEQ ID NO: 151878 - protein, 6 aa, Mycobacterium bovis
IPGKSA

SEQ ID NO: 151879 - protein, 9 aa, Mycobacterium bovis
IPGPEPTSV

SEQ ID NO: 151880 - protein, 4 aa, Mycobacterium bovis
IPGV

SEQ ID NO: 151881 - protein, 12 aa, Mycobacterium bovis
IPKSAPGSATGL

SEQ ID NO: 151882 - protein, 11 aa, Mycobacterium bovis
IPPEDIPGQFS

SEQ ID NO: 151883 - protein, 11 aa, Mycobacterium bovis
IPPGADPDPGV

SEQ ID NO: 151884 - protein, 6 aa, Mycobacterium bovis
IPPSGV

SEQ ID NO: 151885 - protein, 19 aa, Mycobacterium bovis
IPQNPGAGEPQNPFGSLGS

SEQ ID NO: 151886 - protein, 11 aa, Mycobacterium bovis
IPQPSAIRPGI

SEQ ID NO: 151887 - protein, 7 aa, Mycobacterium bovis
IPQQSRT

SEQ ID NO: 151888 - protein, 10 aa, Mycobacterium bovis
IPRPSTVRPG

SEQ ID NO: 151889 - protein, 9 aa, Mycobacterium bovis
IPRSPNDQD

SEQ ID NO: 151890 - protein, 6 aa, Mycobacterium bovis
IPTGAE

SEQ ID NO: 151891 - protein, 5 aa, Mycobacterium bovis
IPTRD

SEQ ID NO: 151892 - protein, 13 aa, Mycobacterium bovis
IPTTETPPPPQTV

SEQ ID NO: 151893 - protein, 24 aa, Mycobacterium bovis
IQNEDEVTSDQGNNGGPNGGGRLA

SEQ ID NO: 151894 - protein, 6 aa, Mycobacterium bovis
IQPAEL

SEQ ID NO: 151895 - protein, 4 aa, Mycobacterium bovis
IQPY

SEQ ID NO: 151896 - protein, 4 aa, Mycobacterium bovis
IQRN

SEQ ID NO: 151897 - protein, 6 aa, Mycobacterium bovis
IQSGPR

SEQ ID NO: 151898 - protein, 14 aa, Mycobacterium bovis
IRESGGDRSAVTGG

SEQ ID NO: 151899 - protein, 9 aa, Mycobacterium bovis
IRGSAGEDM

SEQ ID NO: 151900 - protein, 6 aa, Mycobacterium bovis
IRNPAG

SEQ ID NO: 151901 - protein, 5 aa, Mycobacterium bovis
IRTGL

SEQ ID NO: 151902 - protein, 11 aa, Mycobacterium bovis
ISATDTPGGGL

SEQ ID NO: 151903 - protein, 6 aa, Mycobacterium bovis
ISDDPN

SEQ ID NO: 151904 - protein, 12 aa, Mycobacterium bovis
ISERDDAENARV

SEQ ID NO: 151905 - protein, 12 aa, Mycobacterium bovis
ISESRAEGAPDD

SEQ ID NO: 151906 - protein, 5 aa, Mycobacterium bovis
ISGEP

SEQ ID NO: 151907 - protein, 17 aa, Mycobacterium bovis
ISGGVQAAPLPPEPQLA

SEQ ID NO: 151908 - protein, 6 aa, Mycobacterium bovis
ISGTGA

SEQ ID NO: 151909 - protein, 4 aa, Mycobacterium bovis
ISPD

SEQ ID NO: 151910 - protein, 4 aa, Mycobacterium bovis
ISPG

SEQ ID NO: 151911 - protein, 15 aa, Mycobacterium bovis
ISRRPKRLRPAPPVE

SEQ ID NO: 151912 - protein, 12 aa, Mycobacterium bovis
ISSDEELEPVTG

SEQ ID NO: 151913 - protein, 4 aa, Mycobacterium bovis
ISSE

SEQ ID NO: 151914 - protein, 8 aa, Mycobacterium bovis
ISSGGGTP

SEQ ID NO: 151915 - protein, 11 aa, Mycobacterium bovis
ISTSPSSSTFP

SEQ ID NO: 151916 - protein, 6 aa, Mycobacterium bovis
ITAESR

SEQ ID NO: 151917 - protein, 24 aa, Mycobacterium bovis
ITAPAPRPKFDPYGQYGRYGQYGQ

SEQ ID NO: 151918 - protein, 7 aa, Mycobacterium bovis
ITARRQD

SEQ ID NO: 151919 - protein, 5 aa, Mycobacterium bovis
ITGES

SEQ ID NO: 151920 - protein, 24 aa, Mycobacterium bovis
ITGSEPGTEGGTTAAPGINGSRAR

SEQ ID NO: 151921 - protein, 9 aa, Mycobacterium bovis
ITGTSPLNT

SEQ ID NO: 151922 - protein, 7 aa, Mycobacterium bovis
ITGTSSS

SEQ ID NO: 151923 - protein, 8 aa, Mycobacterium bovis
ITNKESGV

SEQ ID NO: 151924 - protein, 4 aa, Mycobacterium bovis
ITPE

SEQ ID NO: 151925 - protein, 8 aa, Mycobacterium bovis
ITPGGAAD

SEQ ID NO: 151926 - protein, 6 aa, Mycobacterium bovis
ITPPKG

SEQ ID NO: 151927 - protein, 9 aa, Mycobacterium bovis
ITRDHREPV

SEQ ID NO: 151928 - protein, 11 aa, Mycobacterium bovis
ITRPDGKPIEH

SEQ ID NO: 151929 - protein, 14 aa, Mycobacterium bovis
ITSGSADGQRRSPR

SEQ ID NO: 151930 - protein, 20 aa, Mycobacterium bovis
ITTSDGTVLSSNSNDGPQTS

SEQ ID NO: 151931 - protein, 13 aa, Mycobacterium bovis
ITTTTVPSQIGPA

SEQ ID NO: 151932 - protein, 7 aa, Mycobacterium bovis
IVGTGTH

SEQ ID NO: 151933 - protein, 7 aa, Mycobacterium bovis
IYGSGLP

SEQ ID NO: 151934 - protein, 13 aa, Mycobacterium bovis
KAAAKDRQRGAGP

SEQ ID NO: 151935 - protein, 9 aa, Mycobacterium bovis
KADNRLDGG

SEQ ID NO: 151936 - protein, 9 aa, Mycobacterium bovis
KAEGQTGAA

SEQ ID NO: 151937 - protein, 4 aa, Mycobacterium bovis
KAET

SEQ ID NO: 151938 - protein, 6 aa, Mycobacterium bovis
KAEYPA

SEQ ID NO: 151939 - protein, 6 aa, Mycobacterium bovis
KAGESP

SEQ ID NO: 151940 - protein, 11 aa, Mycobacterium bovis
KAGGDTSTLGV

SEQ ID NO: 151941 - protein, 8 aa, Mycobacterium bovis
KAGTDYAD

SEQ ID NO: 151942 - protein, 24 aa, Mycobacterium bovis
KAGVAGGGEDGKPATEVTITSVLL

SEQ ID NO: 151943 - protein, 6 aa, Mycobacterium bovis
KAKEDV

SEQ ID NO: 151944 - protein, 5 aa, Mycobacterium bovis
KALKR

SEQ ID NO: 151945 - protein, 4 aa, Mycobacterium bovis
KAPG

SEQ ID NO: 151946 - protein, 5 aa, Mycobacterium bovis
KAQQP

SEQ ID NO: 151947 - protein, 5 aa, Mycobacterium bovis
KARAA

SEQ ID NO: 151948 - protein, 6 aa, Mycobacterium bovis
KARGDE

SEQ ID NO: 151949 - protein, 7 aa, Mycobacterium bovis
KARLGDP

SEQ ID NO: 151950 - protein, 9 aa, Mycobacterium bovis
KASTGPQAR

SEQ ID NO: 151951 - protein, 10 aa, Mycobacterium bovis
KAVRGPAKDT

SEQ ID NO: 151952 - protein, 4 aa, Mycobacterium bovis
KAYF

SEQ ID NO: 151953 - protein, 14 aa, Mycobacterium bovis
KCNNGSDPTVKKGA

SEQ ID NO: 151954 - protein, 12 aa, Mycobacterium bovis
KDASAGGEAGHQ

SEQ ID NO: 151955 - protein, 6 aa, Mycobacterium bovis
KDATGI

SEQ ID NO: 151956 - protein, 6 aa, Mycobacterium bovis
KDATGT

SEQ ID NO: 151957 - protein, 4 aa, Mycobacterium bovis
KDDS

SEQ ID NO: 151958 - protein, 8 aa, Mycobacterium bovis
KDESPNVY

SEQ ID NO: 151959 - protein, 6 aa, Mycobacterium bovis
KDFPDN

SEQ ID NO: 151960 - protein, 7 aa, Mycobacterium bovis
KDFSRET

SEQ ID NO: 151961 - protein, 5 aa, Mycobacterium bovis
KDGAK

SEQ ID NO: 151962 - protein, 4 aa, Mycobacterium bovis
KDGP

SEQ ID NO: 151963 - protein, 5 aa, Mycobacterium bovis
KDPAY

SEQ ID NO: 151964 - protein, 7 aa, Mycobacterium bovis
KDPDLGT

SEQ ID NO: 151965 - protein, 17 aa, Mycobacterium bovis
KDPSGAPLRSGFPDPNL

SEQ ID NO: 151966 - protein, 4 aa, Mycobacterium bovis
KDRA

SEQ ID NO: 151967 - protein, 7 aa, Mycobacterium bovis
KDSAAAA

SEQ ID NO: 151968 - protein, 6 aa, Mycobacterium bovis
KEDKQN

SEQ ID NO: 151969 - protein, 6 aa, Mycobacterium bovis
KEFDET

SEQ ID NO: 151970 - protein, 4 aa, Mycobacterium bovis
KEFG

SEQ ID NO: 151971 - protein, 4 aa, Mycobacterium bovis
KEFT

SEQ ID NO: 151972 - protein, 8 aa, Mycobacterium bovis
KEGNTDQR

SEQ ID NO: 151973 - protein, 12 aa, Mycobacterium bovis
KEGQAGQSKMTQ

SEQ ID NO: 151974 - protein, 9 aa, Mycobacterium bovis
KEKDGGERR

SEQ ID NO: 151975 - protein, 9 aa, Mycobacterium bovis
KELNEESNF

SEQ ID NO: 151976 - protein, 12 aa, Mycobacterium bovis
KENSNDVAAGRR

SEQ ID NO: 151977 - protein, 6 aa, Mycobacterium bovis
KEPKRE

SEQ ID NO: 151978 - protein, 15 aa, Mycobacterium bovis
KEPLPESDGDADDDD

SEQ ID NO: 151979 - protein, 14 aa, Mycobacterium bovis
KEPPPPLPPDLPPN

SEQ ID NO: 151980 - protein, 30 aa, Mycobacterium bovis
KEQAEPEYTEGVTTAKPTAERTDVDPDIGD

SEQ ID NO: 151981 - protein, 7 aa, Mycobacterium bovis
KERLSTD

SEQ ID NO: 151982 - protein, 6 aa, Mycobacterium bovis
KETERA

SEQ ID NO: 151983 - protein, 28 aa, Mycobacterium bovis
KETMPTNPDNPKGAYTAARTAKDQGVPI

SEQ ID NO: 151984 - protein, 33 aa, Mycobacterium bovis
KETRTALTPGHDKTPVTPKPVTSDRATPVDPSG

SEQ ID NO: 151985 - protein, 5 aa, Mycobacterium bovis
KEVAR

SEQ ID NO: 151986 - protein, 5 aa, Mycobacterium bovis
KEYEE

SEQ ID NO: 151987 - protein, 10 aa, Mycobacterium bovis
KFAGSGNGPV

SEQ ID NO: 151988 - protein, 15 aa, Mycobacterium bovis
KFSPRTSGGDPQLAQ

SEQ ID NO: 151989 - protein, 4 aa, Mycobacterium bovis
KGAP

SEQ ID NO: 151990 - protein, 6 aa, Mycobacterium bovis
KGATGF

SEQ ID NO: 151991 - protein, 17 aa, Mycobacterium bovis
KGAVEDDSHADPPSTRA

SEQ ID NO: 151992 - protein, 5 aa, Mycobacterium bovis
KGDAS

SEQ ID NO: 151993 - protein, 8 aa, Mycobacterium bovis
KGDDDDTI

SEQ ID NO: 151994 - protein, 8 aa, Mycobacterium bovis
KGDEPLVT

SEQ ID NO: 151995 - protein, 9 aa, Mycobacterium bovis
KGEAGADSF

SEQ ID NO: 151996 - protein, 15 aa, Mycobacterium bovis
KGGENDAQNHAQTLS

SEQ ID NO: 151997 - protein, 6 aa, Mycobacterium bovis
KGGGLS

SEQ ID NO: 151998 - protein, 11 aa, Mycobacterium bovis
KGGPKGVGNAV

SEQ ID NO: 151999 - protein, 8 aa, Mycobacterium bovis
KGGPLPRG

SEQ ID NO: 152000 - protein, 8 aa, Mycobacterium bovis
KGGPTQGA

SEQ ID NO: 152001 - protein, 8 aa, Mycobacterium bovis
KGGSAVKP

SEQ ID NO: 152002 - protein, 14 aa, Mycobacterium bovis
KGKEARGTGNAAAT

SEQ ID NO: 152003 - protein, 10 aa, Mycobacterium bovis
KGKPGDPRRL

SEQ ID NO: 152004 - protein, 8 aa, Mycobacterium bovis
KGLGAADE

SEQ ID NO: 152005 - protein, 12 aa, Mycobacterium bovis
KGLGAADERSYK

SEQ ID NO: 152006 - protein, 8 aa, Mycobacterium bovis
KGPHPATY

SEQ ID NO: 152007 - protein, 19 aa, Mycobacterium bovis
KGPLPTTAKMRSVQRTVRR

SEQ ID NO: 152008 - protein, 12 aa, Mycobacterium bovis
KGREAPGALRGS

SEQ ID NO: 152009 - protein, 5 aa, Mycobacterium bovis
KGRRR

SEQ ID NO: 152010 - protein, 7 aa, Mycobacterium bovis
KGSPPTI

SEQ ID NO: 152011 - protein, 10 aa, Mycobacterium bovis
KGVSPTGNAA

SEQ ID NO: 152012 - protein, 8 aa, Mycobacterium bovis
KHDQPPWT

SEQ ID NO: 152013 - protein, 5 aa, Mycobacterium bovis
KHGGA

SEQ ID NO: 152014 - protein, 11 aa, Mycobacterium bovis
KHSKMSQEDQV

SEQ ID NO: 152015 - protein, 6 aa, Mycobacterium bovis
KHTAPK

SEQ ID NO: 152016 - protein, 18 aa, Mycobacterium bovis
KIAGRSDGQTIPASLTRN

SEQ ID NO: 152017 - protein, 8 aa, Mycobacterium bovis
KIEPAGDK

SEQ ID NO: 152018 - protein, 7 aa, Mycobacterium bovis
KIGPSQA

SEQ ID NO: 152019 - protein, 12 aa, Mycobacterium bovis
KKDESDDEAAER

SEQ ID NO: 152020 - protein, 8 aa, Mycobacterium bovis
KKDQLGEG

SEQ ID NO: 152021 - protein, 11 aa, Mycobacterium bovis
KKGEVEQPGDT

SEQ ID NO: 152022 - protein, 5 aa, Mycobacterium bovis
KKGLT

SEQ ID NO: 152023 - protein, 6 aa, Mycobacterium bovis
KKHVQS

SEQ ID NO: 152024 - protein, 9 aa, Mycobacterium bovis
KKKPIRPVA

SEQ ID NO: 152025 - protein, 7 aa, Mycobacterium bovis
KKLKRAD

SEQ ID NO: 152026 - protein, 9 aa, Mycobacterium bovis
KKLRQSTNQ

SEQ ID NO: 152027 - protein, 9 aa, Mycobacterium bovis
KKNTDTELP

SEQ ID NO: 152028 - protein, 13 aa, Mycobacterium bovis
KKSVTEVSEELKA

SEQ ID NO: 152029 - protein, 6 aa, Mycobacterium bovis
KLAGGA

SEQ ID NO: 152030 - protein, 7 aa, Mycobacterium bovis
KLAPSRP

SEQ ID NO: 152031 - protein, 8 aa, Mycobacterium bovis
KLGSSGGV

SEQ ID NO: 152032 - protein, 10 aa, Mycobacterium bovis
KLPDAARSLG

SEQ ID NO: 152033 - protein, 15 aa, Mycobacterium bovis
KLPEDPPPPPKPAAV

SEQ ID NO: 152034 - protein, 7 aa, Mycobacterium bovis
KLPPGGT

SEQ ID NO: 152035 - protein, 5 aa, Mycobacterium bovis
KLPPQ

SEQ ID NO: 152036 - protein, 6 aa, Mycobacterium bovis
KLPPSI

SEQ ID NO: 152037 - protein, 14 aa, Mycobacterium bovis
KLPRTGKVPTDPAQ

SEQ ID NO: 152038 - protein, 11 aa, Mycobacterium bovis
KLSGGQRKRAS

SEQ ID NO: 152039 - protein, 11 aa, Mycobacterium bovis
KNAKTSRENQQ

SEQ ID NO: 152040 - protein, 14 aa, Mycobacterium bovis
KPAVPAKPDRDEAL

SEQ ID NO: 152041 - protein, 6 aa, Mycobacterium bovis
KPDDGH

SEQ ID NO: 152042 - protein, 51 aa, Mycobacterium bovis
KPEGVGEDLKSDPVVSKPGLVNSDASPNKPNAAITDSAGTAGGKGPVGING

SEQ ID NO: 152043 - protein, 7 aa, Mycobacterium bovis
KPELGTP

SEQ ID NO: 152044 - protein, 7 aa, Mycobacterium bovis
KPEPDGL

SEQ ID NO: 152045 - protein, 6 aa, Mycobacterium bovis
KPFNPK

SEQ ID NO: 152046 - protein, 4 aa, Mycobacterium bovis
KPGE

SEQ ID NO: 152047 - protein, 12 aa, Mycobacterium bovis
KPIYPKDSLTKE

SEQ ID NO: 152048 - protein, 12 aa, Mycobacterium bovis
KPNAAQKESEYI

SEQ ID NO: 152049 - protein, 5 aa, Mycobacterium bovis
KPPGL

SEQ ID NO: 152050 - protein, 13 aa, Mycobacterium bovis
KPPQGMAAESSSA

SEQ ID NO: 152051 - protein, 6 aa, Mycobacterium bovis
KPPVIK

SEQ ID NO: 152052 - protein, 6 aa, Mycobacterium bovis
KPRSDI

SEQ ID NO: 152053 - protein, 7 aa, Mycobacterium bovis
KPSAEPY

SEQ ID NO: 152054 - protein, 5 aa, Mycobacterium bovis
KPSKS

SEQ ID NO: 152055 - protein, 5 aa, Mycobacterium bovis
KPSTL

SEQ ID NO: 152056 - protein, 6 aa, Mycobacterium bovis
KPSWIG

SEQ ID NO: 152057 - protein, 5 aa, Mycobacterium bovis
KPSYG

SEQ ID NO: 152058 - protein, 8 aa, Mycobacterium bovis
KPTAGTGA

SEQ ID NO: 152059 - protein, 5 aa, Mycobacterium bovis
KPTRH

SEQ ID NO: 152060 - protein, 7 aa, Mycobacterium bovis
KPTSPPV

SEQ ID NO: 152061 - protein, 8 aa, Mycobacterium bovis
KPTSTVKD

SEQ ID NO: 152062 - protein, 6 aa, Mycobacterium bovis
KPVERP

SEQ ID NO: 152063 - protein, 5 aa, Mycobacterium bovis
KPYTE

SEQ ID NO: 152064 - protein, 6 aa, Mycobacterium bovis
KQDEVS

SEQ ID NO: 152065 - protein, 5 aa, Mycobacterium bovis
KQGQT

SEQ ID NO: 152066 - protein, 12 aa, Mycobacterium bovis
KQLPPSDPSSVG

SEQ ID NO: 152067 - protein, 13 aa, Mycobacterium bovis
KQQASHRRAPLLS

SEQ ID NO: 152068 - protein, 8 aa, Mycobacterium bovis
KQQITPAG

SEQ ID NO: 152069 - protein, 6 aa, Mycobacterium bovis
KQSRDR

SEQ ID NO: 152070 - protein, 8 aa, Mycobacterium bovis
KQTREEGY

SEQ ID NO: 152071 - protein, 8 aa, Mycobacterium bovis
KQVEPTPG

SEQ ID NO: 152072 - protein, 14 aa, Mycobacterium bovis
KQYGANKLQRVATF

SEQ ID NO: 152073 - protein, 6 aa, Mycobacterium bovis
KRASTL

SEQ ID NO: 152074 - protein, 7 aa, Mycobacterium bovis
KRATTKR

SEQ ID NO: 152075 - protein, 5 aa, Mycobacterium bovis
KRDPN

SEQ ID NO: 152076 - protein, 17 aa, Mycobacterium bovis
KRGAWTPPTVASPTAMG

SEQ ID NO: 152077 - protein, 4 aa, Mycobacterium bovis
KRGS

SEQ ID NO: 152078 - protein, 15 aa, Mycobacterium bovis
KRKAKREAAIPDDEA

SEQ ID NO: 152079 - protein, 34 aa, Mycobacterium bovis
KRLSAQSDTFTSTAVTDPSGPRESAQPRALSAAE

SEQ ID NO: 152080 - protein, 4 aa, Mycobacterium bovis
KRPR

SEQ ID NO: 152081 - protein, 18 aa, Mycobacterium bovis
KRQLEAAHDRKSSNPTEA

SEQ ID NO: 152082 - protein, 9 aa, Mycobacterium bovis
KRSINARKP

SEQ ID NO: 152083 - protein, 11 aa, Mycobacterium bovis
KRTKDPDGAHA

SEQ ID NO: 152084 - protein, 13 aa, Mycobacterium bovis
KRYTYTGSGGVPL

SEQ ID NO: 152085 - protein, 18 aa, Mycobacterium bovis
KSAGELVPATTAPAGLAY

SEQ ID NO: 152086 - protein, 8 aa, Mycobacterium bovis
KSANGRYE

SEQ ID NO: 152087 - protein, 12 aa, Mycobacterium bovis
KSASVDDANLLK

SEQ ID NO: 152088 - protein, 6 aa, Mycobacterium bovis
KSGVPY

SEQ ID NO: 152089 - protein, 6 aa, Mycobacterium bovis
KSMSGP

SEQ ID NO: 152090 - protein, 7 aa, Mycobacterium bovis
KSRPGKL

SEQ ID NO: 152091 - protein, 7 aa, Mycobacterium bovis
KSSPDCR

SEQ ID NO: 152092 - protein, 6 aa, Mycobacterium bovis
KTEDIA

SEQ ID NO: 152093 - protein, 8 aa, Mycobacterium bovis
KTGTLTAN

SEQ ID NO: 152094 - protein, 8 aa, Mycobacterium bovis
KTGTLTEN

SEQ ID NO: 152095 - protein, 8 aa, Mycobacterium bovis
KTGTLTES

SEQ ID NO: 152096 - protein, 7 aa, Mycobacterium bovis
KTGTLTR

SEQ ID NO: 152097 - protein, 6 aa, Mycobacterium bovis
KTGVPY

SEQ ID NO: 152098 - protein, 27 aa, Mycobacterium bovis
KTNTTATEVARPPTSGSAVPSAPTTTV

SEQ ID NO: 152099 - protein, 6 aa, Mycobacterium bovis
KTPPTL

SEQ ID NO: 152100 - protein, 5 aa, Mycobacterium bovis
KTQPQ

SEQ ID NO: 152101 - protein, 7 aa, Mycobacterium bovis
KTSEEDM

SEQ ID NO: 152102 - protein, 7 aa, Mycobacterium bovis
KTSRAAA

SEQ ID NO: 152103 - protein, 8 aa, Mycobacterium bovis
KTSRVQKK

SEQ ID NO: 152104 - protein, 4 aa, Mycobacterium bovis
KTYP

SEQ ID NO: 152105 - protein, 6 aa, Mycobacterium bovis
KVPANA

SEQ ID NO: 152106 - protein, 19 aa, Mycobacterium bovis
KVRSGAITAPLGSQREYRP

SEQ ID NO: 152107 - protein, 5 aa, Mycobacterium bovis
KWNNS

SEQ ID NO: 152108 - protein, 8 aa, Mycobacterium bovis
KWSPPGGH

SEQ ID NO: 152109 - protein, 12 aa, Mycobacterium bovis
KYRERGADLPPL

SEQ ID NO: 152110 - protein, 6 aa, Mycobacterium bovis
KYVSDT

SEQ ID NO: 152111 - protein, 6 aa, Mycobacterium bovis
LAAEAS

SEQ ID NO: 152112 - protein, 46 aa, Mycobacterium bovis
LAAEKDGAGPDEPDDPWRDPAAAAALGTPALAAPAPHGALAGSGKL

SEQ ID NO: 152113 - protein, 5 aa, Mycobacterium bovis
LAAPG

SEQ ID NO: 152114 - protein, 41 aa, Mycobacterium bovis
LAAPPGKPPRGDQLGGRRRPPGPPGPPGSSGQPAGRLPQPR

SEQ ID NO: 152115 - protein, 9 aa, Mycobacterium bovis
LAATRPPAE

SEQ ID NO: 152116 - protein, 9 aa, Mycobacterium bovis
LADETPEGR

SEQ ID NO: 152117 - protein, 12 aa, Mycobacterium bovis
LADNKKSDEQFA

SEQ ID NO: 152118 - protein, 9 aa, Mycobacterium bovis
LADTGLPAA

SEQ ID NO: 152119 - protein, 11 aa, Mycobacterium bovis
LAEEAGQAEAI

SEQ ID NO: 152120 - protein, 9 aa, Mycobacterium bovis
LAEQAEEAE

SEQ ID NO: 152121 - protein, 4 aa, Mycobacterium bovis
LAGA

SEQ ID NO: 152122 - protein, 5 aa, Mycobacterium bovis
LAGAE

SEQ ID NO: 152123 - protein, 7 aa, Mycobacterium bovis
LAGAGAA

SEQ ID NO: 152124 - protein, 11 aa, Mycobacterium bovis
LAGANPAEREP

SEQ ID NO: 152125 - protein, 5 aa, Mycobacterium bovis
LAGAT

SEQ ID NO: 152126 - protein, 6 aa, Mycobacterium bovis
LAGKGA

SEQ ID NO: 152127 - protein, 13 aa, Mycobacterium bovis
LAGPNATHDADKP

SEQ ID NO: 152128 - protein, 13 aa, Mycobacterium bovis
LAGPPKTPDRTIP

SEQ ID NO: 152129 - protein, 15 aa, Mycobacterium bovis
LAKAAAGGGNGYSLR

SEQ ID NO: 152130 - protein, 11 aa, Mycobacterium bovis
LAKDAAGDKWS

SEQ ID NO: 152131 - protein, 7 aa, Mycobacterium bovis
LAKTTTN

SEQ ID NO: 152132 - protein, 8 aa, Mycobacterium bovis
LANERPPS

SEQ ID NO: 152133 - protein, 4 aa, Mycobacterium bovis
LANT

SEQ ID NO: 152134 - protein, 7 aa, Mycobacterium bovis
LAPDERL

SEQ ID NO: 152135 - protein, 5 aa, Mycobacterium bovis
LAPEH

SEQ ID NO: 152136 - protein, 4 aa, Mycobacterium bovis
LAPN

SEQ ID NO: 152137 - protein, 8 aa, Mycobacterium bovis
LAPPRGKS

SEQ ID NO: 152138 - protein, 9 aa, Mycobacterium bovis
LAPPSSHQG

SEQ ID NO: 152139 - protein, 4 aa, Mycobacterium bovis
LAPQ

SEQ ID NO: 152140 - protein, 4 aa, Mycobacterium bovis
LAQQ

SEQ ID NO: 152141 - protein, 5 aa, Mycobacterium bovis
LAQSR

SEQ ID NO: 152142 - protein, 6 aa, Mycobacterium bovis
LAQTGY

SEQ ID NO: 152143 - protein, 5 aa, Mycobacterium bovis
LARGH

SEQ ID NO: 152144 - protein, 11 aa, Mycobacterium bovis
LARKGTTPVTA

SEQ ID NO: 152145 - protein, 5 aa, Mycobacterium bovis
LARRE

SEQ ID NO: 152146 - protein, 5 aa, Mycobacterium bovis
LASDD

SEQ ID NO: 152147 - protein, 5 aa, Mycobacterium bovis
LASGP

SEQ ID NO: 152148 - protein, 17 aa, Mycobacterium bovis
LATAPSTIRQGTSARNV

SEQ ID NO: 152149 - protein, 6 aa, Mycobacterium bovis
LATATD

SEQ ID NO: 152150 - protein, 7 aa, Mycobacterium bovis
LATDATA

SEQ ID NO: 152151 - protein, 11 aa, Mycobacterium bovis
LATGTAGQPTW

SEQ ID NO: 152152 - protein, 24 aa, Mycobacterium bovis
LATPPGHGWPPGLPPLPRRPRRYR

SEQ ID NO: 152153 - protein, 4 aa, Mycobacterium bovis
LATT

SEQ ID NO: 152154 - protein, 5 aa, Mycobacterium bovis
LDAQG

SEQ ID NO: 152155 - protein, 8 aa, Mycobacterium bovis
LDAQTNPV

SEQ ID NO: 152156 - protein, 5 aa, Mycobacterium bovis
LDDEG

SEQ ID NO: 152157 - protein, 11 aa, Mycobacterium bovis
LDDGASGSLDE

SEQ ID NO: 152158 - protein, 11 aa, Mycobacterium bovis
LDEGGDGPHGV

SEQ ID NO: 152159 - protein, 11 aa, Mycobacterium bovis
LDEPSGDNCDL

SEQ ID NO: 152160 - protein, 15 aa, Mycobacterium bovis
LDGAPPMPPPRDPLE

SEQ ID NO: 152161 - protein, 14 aa, Mycobacterium bovis
LDGDSGSWGPLGPL

SEQ ID NO: 152162 - protein, 8 aa, Mycobacterium bovis
LDGESRGE

SEQ ID NO: 152163 - protein, 5 aa, Mycobacterium bovis
LDGGT

SEQ ID NO: 152164 - protein, 7 aa, Mycobacterium bovis
LDGRADQ

SEQ ID NO: 152165 - protein, 7 aa, Mycobacterium bovis
LDGRTNE

SEQ ID NO: 152166 - protein, 7 aa, Mycobacterium bovis
LDGTAKG

SEQ ID NO: 152167 - protein, 7 aa, Mycobacterium bovis
LDGVSTG

SEQ ID NO: 152168 - protein, 8 aa, Mycobacterium bovis
LDNPDAAR

SEQ ID NO: 152169 - protein, 6 aa, Mycobacterium bovis
LDPATE

SEQ ID NO: 152170 - protein, 9 aa, Mycobacterium bovis
LDPDERDRA

SEQ ID NO: 152171 - protein, 10 aa, Mycobacterium bovis
LDPETSRSAR

SEQ ID NO: 152172 - protein, 9 aa, Mycobacterium bovis
LDPPPGDDV

SEQ ID NO: 152173 - protein, 19 aa, Mycobacterium bovis
LDPQPGKLPDWSPTSSRTW

SEQ ID NO: 152174 - protein, 4 aa, Mycobacterium bovis
LDPR

SEQ ID NO: 152175 - protein, 18 aa, Mycobacterium bovis
LDPRSTRRLDGHTDAPAD

SEQ ID NO: 152176 - protein, 8 aa, Mycobacterium bovis
LDRGQEAG

SEQ ID NO: 152177 - protein, 9 aa, Mycobacterium bovis
LDRRATPDQ

SEQ ID NO: 152178 - protein, 11 aa, Mycobacterium bovis
LDTQSGAARPV

SEQ ID NO: 152179 - protein, 39 aa, Mycobacterium bovis
LEAGAQPLADQRPPVPAPPAPTPPPNHRAPQFGVTTRNA

SEQ ID NO: 152180 - protein, 10 aa, Mycobacterium bovis
LEAGPPPRRL

SEQ ID NO: 152181 - protein, 10 aa, Mycobacterium bovis
LEAGRPPRRF

SEQ ID NO: 152182 - protein, 15 aa, Mycobacterium bovis
LEDTGARAAALGPGQ

SEQ ID NO: 152183 - protein, 5 aa, Mycobacterium bovis
LEEDP

SEQ ID NO: 152184 - protein, 4 aa, Mycobacterium bovis
LEGR

SEQ ID NO: 152185 - protein, 4 aa, Mycobacterium bovis
LERD

SEQ ID NO: 152186 - protein, 4 aa, Mycobacterium bovis
LERG

SEQ ID NO: 152187 - protein, 10 aa, Mycobacterium bovis
LETGELSPYP

SEQ ID NO: 152188 - protein, 5 aa, Mycobacterium bovis
LETGQ

SEQ ID NO: 152189 - protein, 9 aa, Mycobacterium bovis
LGAGAGGRM

SEQ ID NO: 152190 - protein, 11 aa, Mycobacterium bovis
LGAGGRCDSAS

SEQ ID NO: 152191 - protein, 12 aa, Mycobacterium bovis
LGAGSPDTKNLQ

SEQ ID NO: 152192 - protein, 12 aa, Mycobacterium bovis
LGAPASASVAAP

SEQ ID NO: 152193 - protein, 13 aa, Mycobacterium bovis
LGAPDFPSPGYPL

SEQ ID NO: 152194 - protein, 6 aa, Mycobacterium bovis
LGATAG

SEQ ID NO: 152195 - protein, 5 aa, Mycobacterium bovis
LGATG

SEQ ID NO: 152196 - protein, 7 aa, Mycobacterium bovis
LGDPADS

SEQ ID NO: 152197 - protein, 4 aa, Mycobacterium bovis
LGDT

SEQ ID NO: 152198 - protein, 5 aa, Mycobacterium bovis
LGEAA

SEQ ID NO: 152199 - protein, 25 aa, Mycobacterium bovis
LGEASGDLASDSPAMPRPTTVENDA

SEQ ID NO: 152200 - protein, 5 aa, Mycobacterium bovis
LGEDR

SEQ ID NO: 152201 - protein, 6 aa, Mycobacterium bovis
LGESAQ

SEQ ID NO: 152202 - protein, 10 aa, Mycobacterium bovis
LGGEAKTPKA

SEQ ID NO: 152203 - protein, 21 aa, Mycobacterium bovis
LGGGGPGSARQDGSPKVPGIG

SEQ ID NO: 152204 - protein, 12 aa, Mycobacterium bovis
LGGGNFASSMSN

SEQ ID NO: 152205 - protein, 4 aa, Mycobacterium bovis
LGGI

SEQ ID NO: 152206 - protein, 13 aa, Mycobacterium bovis
LGGPQGRGAPEDA

SEQ ID NO: 152207 - protein, 23 aa, Mycobacterium bovis
LGGRDTRVATPSGLDGPGMSTSA

SEQ ID NO: 152208 - protein, 6 aa, Mycobacterium bovis
LGHGDP

SEQ ID NO: 152209 - protein, 12 aa, Mycobacterium bovis
LGKGEDDATPAF

SEQ ID NO: 152210 - protein, 7 aa, Mycobacterium bovis
LGKRGRG

SEQ ID NO: 152211 - protein, 4 aa, Mycobacterium bovis
LGLS

SEQ ID NO: 152212 - protein, 13 aa, Mycobacterium bovis
LGNGQPDTVPAAS

SEQ ID NO: 152213 - protein, 5 aa, Mycobacterium bovis
LGPAG

SEQ ID NO: 152214 - protein, 12 aa, Mycobacterium bovis
LGPARNLSTDPD

SEQ ID NO: 152215 - protein, 4 aa, Mycobacterium bovis
LGPE

SEQ ID NO: 152216 - protein, 7 aa, Mycobacterium bovis
LGPGDQW

SEQ ID NO: 152217 - protein, 12 aa, Mycobacterium bovis
LGPGPVTTGAAA

SEQ ID NO: 152218 - protein, 5 aa, Mycobacterium bovis
LGPGR

SEQ ID NO: 152219 - protein, 6 aa, Mycobacterium bovis
LGPRPD

SEQ ID NO: 152220 - protein, 5 aa, Mycobacterium bovis
LGPRS

SEQ ID NO: 152221 - protein, 4 aa, Mycobacterium bovis
LGQG

SEQ ID NO: 152222 - protein, 6 aa, Mycobacterium bovis
LGQPAN

SEQ ID NO: 152223 - protein, 6 aa, Mycobacterium bovis
LGQRAA

SEQ ID NO: 152224 - protein, 15 aa, Mycobacterium bovis
LGQSGQRPGRRHVPA

SEQ ID NO: 152225 - protein, 7 aa, Mycobacterium bovis
LGRREPA

SEQ ID NO: 152226 - protein, 8 aa, Mycobacterium bovis
LGRSSSVD

SEQ ID NO: 152227 - protein, 11 aa, Mycobacterium bovis
LGSAGSPGSGS

SEQ ID NO: 152228 - protein, 4 aa, Mycobacterium bovis
LGSP

SEQ ID NO: 152229 - protein, 9 aa, Mycobacterium bovis
LGSRAGAGV

SEQ ID NO: 152230 - protein, 13 aa, Mycobacterium bovis
LGSSLTSHTAANQ

SEQ ID NO: 152231 - protein, 4 aa, Mycobacterium bovis
LGTE

SEQ ID NO: 152232 - protein, 6 aa, Mycobacterium bovis
LGTNGG

SEQ ID NO: 152233 - protein, 5 aa, Mycobacterium bovis
LGTPI

SEQ ID NO: 152234 - protein, 8 aa, Mycobacterium bovis
LGTTPSGT

SEQ ID NO: 152235 - protein, 5 aa, Mycobacterium bovis
LGVSG

SEQ ID NO: 152236 - protein, 4 aa, Mycobacterium bovis
LHPD

SEQ ID NO: 152237 - protein, 9 aa, Mycobacterium bovis
LHRPGGENE

SEQ ID NO: 152238 - protein, 21 aa, Mycobacterium bovis
LKAPTADDEALPLSDEPPPRA

SEQ ID NO: 152239 - protein, 5 aa, Mycobacterium bovis
LKASA

SEQ ID NO: 152240 - protein, 9 aa, Mycobacterium bovis
LKDPRGNPV

SEQ ID NO: 152241 - protein, 11 aa, Mycobacterium bovis
LKDSGKTISDT

SEQ ID NO: 152242 - protein, 7 aa, Mycobacterium bovis
LKEPERN

SEQ ID NO: 152243 - protein, 7 aa, Mycobacterium bovis
LKEPRES

SEQ ID NO: 152244 - protein, 4 aa, Mycobacterium bovis
LKEQ

SEQ ID NO: 152245 - protein, 9 aa, Mycobacterium bovis
LKNKTTELS

SEQ ID NO: 152246 - protein, 4 aa, Mycobacterium bovis
LKPE

SEQ ID NO: 152247 - protein, 4 aa, Mycobacterium bovis
LKPR

SEQ ID NO: 152248 - protein, 6 aa, Mycobacterium bovis
LKPTEA

SEQ ID NO: 152249 - protein, 12 aa, Mycobacterium bovis
LKQNERLKRENR

SEQ ID NO: 152250 - protein, 7 aa, Mycobacterium bovis
LKRERDA

SEQ ID NO: 152251 - protein, 9 aa, Mycobacterium bovis
LKTGPQTQN

SEQ ID NO: 152252 - protein, 5 aa, Mycobacterium bovis
LLPPR

SEQ ID NO: 152253 - protein, 17 aa, Mycobacterium bovis
LNAHPDGLNQRPPGGWC

SEQ ID NO: 152254 - protein, 6 aa, Mycobacterium bovis
LNEGRG

SEQ ID NO: 152255 - protein, 5 aa, Mycobacterium bovis
LNGGG

SEQ ID NO: 152256 - protein, 4 aa, Mycobacterium bovis
LNPD

SEQ ID NO: 152257 - protein, 6 aa, Mycobacterium bovis
LNPDEY

SEQ ID NO: 152258 - protein, 5 aa, Mycobacterium bovis
LNPDH

SEQ ID NO: 152259 - protein, 6 aa, Mycobacterium bovis
LNPNGV

SEQ ID NO: 152260 - protein, 7 aa, Mycobacterium bovis
LNTDQNI

SEQ ID NO: 152261 - protein, 6 aa, Mycobacterium bovis
LNTEDR

SEQ ID NO: 152262 - protein, 8 aa, Mycobacterium bovis
LPAAGAAG

SEQ ID NO: 152263 - protein, 16 aa, Mycobacterium bovis
LPADDGAPLAAAGGSR

SEQ ID NO: 152264 - protein, 17 aa, Mycobacterium bovis
LPADPSPRKVPAGASGA

SEQ ID NO: 152265 - protein, 16 aa, Mycobacterium bovis
LPAGATRDVKFAKQIG

SEQ ID NO: 152266 - protein, 5 aa, Mycobacterium bovis
LPAGN

SEQ ID NO: 152267 - protein, 5 aa, Mycobacterium bovis
LPAGS

SEQ ID NO: 152268 - protein, 8 aa, Mycobacterium bovis
LPANEGYA

SEQ ID NO: 152269 - protein, 5 aa, Mycobacterium bovis
LPANG

SEQ ID NO: 152270 - protein, 5 aa, Mycobacterium bovis
LPCPE

SEQ ID NO: 152271 - protein, 6 aa, Mycobacterium bovis
LPDAPP

SEQ ID NO: 152272 - protein, 8 aa, Mycobacterium bovis
LPDDQRKE

SEQ ID NO: 152273 - protein, 11 aa, Mycobacterium bovis
LPDRARELGSL

SEQ ID NO: 152274 - protein, 14 aa, Mycobacterium bovis
LPDSGAASHPSTGL

SEQ ID NO: 152275 - protein, 7 aa, Mycobacterium bovis
LPEGSEV

SEQ ID NO: 152276 - protein, 9 aa, Mycobacterium bovis
LPEGTPVAD

SEQ ID NO: 152277 - protein, 7 aa, Mycobacterium bovis
LPEPLGS

SEQ ID NO: 152278 - protein, 7 aa, Mycobacterium bovis
LPGAGDA

SEQ ID NO: 152279 - protein, 6 aa, Mycobacterium bovis
LPGARD

SEQ ID NO: 152280 - protein, 6 aa, Mycobacterium bovis
LPGFPG

SEQ ID NO: 152281 - protein, 5 aa, Mycobacterium bovis
LPGGP

SEQ ID NO: 152282 - protein, 9 aa, Mycobacterium bovis
LPGSAPRPA

SEQ ID NO: 152283 - protein, 8 aa, Mycobacterium bovis
LPGTDRRN

SEQ ID NO: 152284 - protein, 17 aa, Mycobacterium bovis
LPGTGAFDPAGTSAIGS

SEQ ID NO: 152285 - protein, 20 aa, Mycobacterium bovis
LPGVTEAPNPTQRPPQPDRP

SEQ ID NO: 152286 - protein, 17 aa, Mycobacterium bovis
LPNRRRRGRGRASRARL

SEQ ID NO: 152287 - protein, 12 aa, Mycobacterium bovis
LPPDTTKDDRTQ

SEQ ID NO: 152288 - protein, 8 aa, Mycobacterium bovis
LPPGIPQV

SEQ ID NO: 152289 - protein, 114 aa, Mycobacterium bovis
LPPPPPKPLKPKKPKQRRLRRKKTAKGDEAEPEAAEEAENTELAAQEDEEAVEAPPESIESPGGEPESATREAPAAETATAEEPRGGLRNRRPTGKTSHRRRRTRSGVQVAKVD

SEQ ID NO: 152290 - protein, 15 aa, Mycobacterium bovis
LPPPPPQPGIDCRAA

SEQ ID NO: 152291 - protein, 7 aa, Mycobacterium bovis
LPPSEGL

SEQ ID NO: 152292 - protein, 6 aa, Mycobacterium bovis
LPQTPM

SEQ ID NO: 152293 - protein, 6 aa, Mycobacterium bovis
LPRDAK

SEQ ID NO: 152294 - protein, 7 aa, Mycobacterium bovis
LPRPPTL

SEQ ID NO: 152295 - protein, 6 aa, Mycobacterium bovis
LPRRAS

SEQ ID NO: 152296 - protein, 10 aa, Mycobacterium bovis
LPRSASARQV

SEQ ID NO: 152297 - protein, 8 aa, Mycobacterium bovis
LPSASAGG

SEQ ID NO: 152298 - protein, 5 aa, Mycobacterium bovis
LPTGD

SEQ ID NO: 152299 - protein, 7 aa, Mycobacterium bovis
LPTRATG

SEQ ID NO: 152300 - protein, 6 aa, Mycobacterium bovis
LPTSGS

SEQ ID NO: 152301 - protein, 8 aa, Mycobacterium bovis
LPTSTKDG

SEQ ID NO: 152302 - protein, 7 aa, Mycobacterium bovis
LPTTRTA

SEQ ID NO: 152303 - protein, 7 aa, Mycobacterium bovis
LPVPPSM

SEQ ID NO: 152304 - protein, 9 aa, Mycobacterium bovis
LQGGSTITQ

SEQ ID NO: 152305 - protein, 6 aa, Mycobacterium bovis
LQGSAG

SEQ ID NO: 152306 - protein, 13 aa, Mycobacterium bovis
LQPGERVHTTSGL

SEQ ID NO: 152307 - protein, 7 aa, Mycobacterium bovis
LQPPPEV

SEQ ID NO: 152308 - protein, 6 aa, Mycobacterium bovis
LQRDTD

SEQ ID NO: 152309 - protein, 9 aa, Mycobacterium bovis
LQSASERLR

SEQ ID NO: 152310 - protein, 10 aa, Mycobacterium bovis
LQSTRSPQTV

SEQ ID NO: 152311 - protein, 4 aa, Mycobacterium bovis
LQTK

SEQ ID NO: 152312 - protein, 5 aa, Mycobacterium bovis
LRAES

SEQ ID NO: 152313 - protein, 8 aa, Mycobacterium bovis
LRAPAADE

SEQ ID NO: 152314 - protein, 6 aa, Mycobacterium bovis
LRARTT

SEQ ID NO: 152315 - protein, 10 aa, Mycobacterium bovis
LRDDADLRDK

SEQ ID NO: 152316 - protein, 8 aa, Mycobacterium bovis
LRDDETSG

SEQ ID NO: 152317 - protein, 7 aa, Mycobacterium bovis
LRDKRTG

SEQ ID NO: 152318 - protein, 8 aa, Mycobacterium bovis
LRETNKER

SEQ ID NO: 152319 - protein, 5 aa, Mycobacterium bovis
LRGDN

SEQ ID NO: 152320 - protein, 20 aa, Mycobacterium bovis
LRGPNGKLGAPVGDQTVDGD

SEQ ID NO: 152321 - protein, 23 aa, Mycobacterium bovis
LRGTPAGETASFPTGWRGLRFST

SEQ ID NO: 152322 - protein, 15 aa, Mycobacterium bovis
LRGTRKAEEAAESAR

SEQ ID NO: 152323 - protein, 6 aa, Mycobacterium bovis
LRNGEA

SEQ ID NO: 152324 - protein, 6 aa, Mycobacterium bovis
LRPDAV

SEQ ID NO: 152325 - protein, 4 aa, Mycobacterium bovis
LRPE

SEQ ID NO: 152326 - protein, 7 aa, Mycobacterium bovis
LRPEAAA

SEQ ID NO: 152327 - protein, 6 aa, Mycobacterium bovis
LRPEDK

SEQ ID NO: 152328 - protein, 6 aa, Mycobacterium bovis
LRPGEE

SEQ ID NO: 152329 - protein, 8 aa, Mycobacterium bovis
LRPPERAQ

SEQ ID NO: 152330 - protein, 14 aa, Mycobacterium bovis
LRPSPEPVPAPQKQ

SEQ ID NO: 152331 - protein, 4 aa, Mycobacterium bovis
LRRP

SEQ ID NO: 152332 - protein, 8 aa, Mycobacterium bovis
LRRQGAGR

SEQ ID NO: 152333 - protein, 10 aa, Mycobacterium bovis
LRSGKAGTDA

SEQ ID NO: 152334 - protein, 14 aa, Mycobacterium bovis
LRSGVGSPTVFATS

SEQ ID NO: 152335 - protein, 5 aa, Mycobacterium bovis
LRSSG

SEQ ID NO: 152336 - protein, 6 aa, Mycobacterium bovis
LRSSPP

SEQ ID NO: 152337 - protein, 6 aa, Mycobacterium bovis
LRTPRG

SEQ ID NO: 152338 - protein, 14 aa, Mycobacterium bovis
LSAAAAANTKHDIA

SEQ ID NO: 152339 - protein, 6 aa, Mycobacterium bovis
LSAGDT

SEQ ID NO: 152340 - protein, 27 aa, Mycobacterium bovis
LSAPGARASARQRGDEGTSPEPAFPTP

SEQ ID NO: 152341 - protein, 6 aa, Mycobacterium bovis
LSDAGR

SEQ ID NO: 152342 - protein, 5 aa, Mycobacterium bovis
LSDCD

SEQ ID NO: 152343 - protein, 8 aa, Mycobacterium bovis
LSDPVSDE

SEQ ID NO: 152344 - protein, 9 aa, Mycobacterium bovis
LSDSPDNTD

SEQ ID NO: 152345 - protein, 13 aa, Mycobacterium bovis
LSEATAAAAIPTT

SEQ ID NO: 152346 - protein, 13 aa, Mycobacterium bovis
LSEDGKGGPPNNG

SEQ ID NO: 152347 - protein, 6 aa, Mycobacterium bovis
LSEQNG

SEQ ID NO: 152348 - protein, 11 aa, Mycobacterium bovis
LSERAEGPITA

SEQ ID NO: 152349 - protein, 5 aa, Mycobacterium bovis
LSEVG

SEQ ID NO: 152350 - protein, 10 aa, Mycobacterium bovis
LSGEGSDTDT

SEQ ID NO: 152351 - protein, 5 aa, Mycobacterium bovis
LSGGQ

SEQ ID NO: 152352 - protein, 8 aa, Mycobacterium bovis
LSGGQRQR

SEQ ID NO: 152353 - protein, 25 aa, Mycobacterium bovis
LSGGSYQNLETSASPDLATAVNIFL

SEQ ID NO: 152354 - protein, 25 aa, Mycobacterium bovis
LSGPSNVGVEEEDTDAVDTTPTPVV

SEQ ID NO: 152355 - protein, 6 aa, Mycobacterium bovis
LSGQGG

SEQ ID NO: 152356 - protein, 8 aa, Mycobacterium bovis
LSHPEDAA

SEQ ID NO: 152357 - protein, 9 aa, Mycobacterium bovis
LSIGPESAT

SEQ ID NO: 152358 - protein, 16 aa, Mycobacterium bovis
LSPEQARGDSVDARSD

SEQ ID NO: 152359 - protein, 8 aa, Mycobacterium bovis
LSPFGDGT

SEQ ID NO: 152360 - protein, 6 aa, Mycobacterium bovis
LSPGEP

SEQ ID NO: 152361 - protein, 7 aa, Mycobacterium bovis
LSPRDDG

SEQ ID NO: 152362 - protein, 9 aa, Mycobacterium bovis
LSPRPERGV

SEQ ID NO: 152363 - protein, 8 aa, Mycobacterium bovis
LSRPAGAH

SEQ ID NO: 152364 - protein, 29 aa, Mycobacterium bovis
LSRSDHARARPDIARPGAGGSRVSRADVT

SEQ ID NO: 152365 - protein, 5 aa, Mycobacterium bovis
LSSAE

SEQ ID NO: 152366 - protein, 10 aa, Mycobacterium bovis
LSSATADSNE

SEQ ID NO: 152367 - protein, 4 aa, Mycobacterium bovis
LSSG

SEQ ID NO: 152368 - protein, 15 aa, Mycobacterium bovis
LSSSPSDSASSLNEH

SEQ ID NO: 152369 - protein, 19 aa, Mycobacterium bovis
LSTATPAPAVAATDANDVP

SEQ ID NO: 152370 - protein, 7 aa, Mycobacterium bovis
LSTDGKS

SEQ ID NO: 152371 - protein, 8 aa, Mycobacterium bovis
LSTGADRI

SEQ ID NO: 152372 - protein, 6 aa, Mycobacterium bovis
LSTGPT

SEQ ID NO: 152373 - protein, 8 aa, Mycobacterium bovis
LSTGSGTD

SEQ ID NO: 152374 - protein, 4 aa, Mycobacterium bovis
LSTL

SEQ ID NO: 152375 - protein, 10 aa, Mycobacterium bovis
LSTTLPGGPV

SEQ ID NO: 152376 - protein, 9 aa, Mycobacterium bovis
LTAPSSGRI

SEQ ID NO: 152377 - protein, 7 aa, Mycobacterium bovis
LTAQPGY

SEQ ID NO: 152378 - protein, 4 aa, Mycobacterium bovis
LTDA

SEQ ID NO: 152379 - protein, 8 aa, Mycobacterium bovis
LTDAGTPI

SEQ ID NO: 152380 - protein, 12 aa, Mycobacterium bovis
LTDDTERMDTTQ

SEQ ID NO: 152381 - protein, 16 aa, Mycobacterium bovis
LTEDTPAPTGRSSGAG

SEQ ID NO: 152382 - protein, 12 aa, Mycobacterium bovis
LTEPDPAATELA

SEQ ID NO: 152383 - protein, 5 aa, Mycobacterium bovis
LTGLP

SEQ ID NO: 152384 - protein, 9 aa, Mycobacterium bovis
LTGPAGQDA

SEQ ID NO: 152385 - protein, 18 aa, Mycobacterium bovis
LTGSGSRAALTSTGRSQL

SEQ ID NO: 152386 - protein, 4 aa, Mycobacterium bovis
LTGT

SEQ ID NO: 152387 - protein, 9 aa, Mycobacterium bovis
LTKSAVPKR

SEQ ID NO: 152388 - protein, 9 aa, Mycobacterium bovis
LTMPNTPEM

SEQ ID NO: 152389 - protein, 6 aa, Mycobacterium bovis
LTNAPQ

SEQ ID NO: 152390 - protein, 10 aa, Mycobacterium bovis
LTNPKGWTHN

SEQ ID NO: 152391 - protein, 6 aa, Mycobacterium bovis
LTPAEG

SEQ ID NO: 152392 - protein, 6 aa, Mycobacterium bovis
LTPATR

SEQ ID NO: 152393 - protein, 8 aa, Mycobacterium bovis
LTPDDTGR

SEQ ID NO: 152394 - protein, 5 aa, Mycobacterium bovis
LTPDR

SEQ ID NO: 152395 - protein, 11 aa, Mycobacterium bovis
LTPNDPRFQPG

SEQ ID NO: 152396 - protein, 6 aa, Mycobacterium bovis
LTPPDD

SEQ ID NO: 152397 - protein, 4 aa, Mycobacterium bovis
LTPR

SEQ ID NO: 152398 - protein, 7 aa, Mycobacterium bovis
LTPRTPT

SEQ ID NO: 152399 - protein, 4 aa, Mycobacterium bovis
LTPS

SEQ ID NO: 152400 - protein, 6 aa, Mycobacterium bovis
LTQTKG

SEQ ID NO: 152401 - protein, 14 aa, Mycobacterium bovis
LTRQDSSDLPPTTE

SEQ ID NO: 152402 - protein, 22 aa, Mycobacterium bovis
LTRQPGDCSEPASGSEPEHEPI

SEQ ID NO: 152403 - protein, 5 aa, Mycobacterium bovis
LTRRS

SEQ ID NO: 152404 - protein, 10 aa, Mycobacterium bovis
LTRTDNSGWG

SEQ ID NO: 152405 - protein, 5 aa, Mycobacterium bovis
LTSSN

SEQ ID NO: 152406 - protein, 10 aa, Mycobacterium bovis
LTSVSDPDAD

SEQ ID NO: 152407 - protein, 18 aa, Mycobacterium bovis
LTTDNQMSYNDSRAEGTR

SEQ ID NO: 152408 - protein, 14 aa, Mycobacterium bovis
LTTPKNPTKRRITP

SEQ ID NO: 152409 - protein, 4 aa, Mycobacterium bovis
LTTR

SEQ ID NO: 152410 - protein, 10 aa, Mycobacterium bovis
LTTREPSSLK

SEQ ID NO: 152411 - protein, 6 aa, Mycobacterium bovis
LYGGAT

SEQ ID NO: 152412 - protein, 6 aa, Mycobacterium bovis
MAPETA

SEQ ID NO: 152413 - protein, 20 aa, Mycobacterium bovis
MAPTPGRRTRNGSVNGHPGM

SEQ ID NO: 152414 - protein, 9 aa, Mycobacterium bovis
MARASAESH

SEQ ID NO: 152415 - protein, 6 aa, Mycobacterium bovis
MDADPE

SEQ ID NO: 152416 - protein, 7 aa, Mycobacterium bovis
MEGPTPV

SEQ ID NO: 152417 - protein, 4 aa, Mycobacterium bovis
MGAG

SEQ ID NO: 152418 - protein, 9 aa, Mycobacterium bovis
MGDAPNEPG

SEQ ID NO: 152419 - protein, 9 aa, Mycobacterium bovis
MGGHAAGEV

SEQ ID NO: 152420 - protein, 4 aa, Mycobacterium bovis
MGRP

SEQ ID NO: 152421 - protein, 7 aa, Mycobacterium bovis
MGSGLNE

SEQ ID NO: 152422 - protein, 5 aa, Mycobacterium bovis
MHSGE

SEQ ID NO: 152423 - protein, 10 aa, Mycobacterium bovis
MNGEAGSYLE

SEQ ID NO: 152424 - protein, 12 aa, Mycobacterium bovis
MNPGGGAASTVG

SEQ ID NO: 152425 - protein, 5 aa, Mycobacterium bovis
MNPNG

SEQ ID NO: 152426 - protein, 4 aa, Mycobacterium bovis
MPAD

SEQ ID NO: 152427 - protein, 80 aa, Mycobacterium bovis
MPAQPAAEEPQPAPSAEPQPPGQPAAPPPAQSGAPASPQPGAQPRPYPQDPAPSPNPTSPASPPPAPPAEAPATDPRKDL

SEQ ID NO: 152428 - protein, 4 aa, Mycobacterium bovis
MPLP

SEQ ID NO: 152429 - protein, 11 aa, Mycobacterium bovis
MPNDEGGNSRL

SEQ ID NO: 152430 - protein, 24 aa, Mycobacterium bovis
MPPAAGVETNGEAGGPGQQTTRQA

SEQ ID NO: 152431 - protein, 8 aa, Mycobacterium bovis
MPPNSGSP

SEQ ID NO: 152432 - protein, 7 aa, Mycobacterium bovis
MPPTGGL

SEQ ID NO: 152433 - protein, 7 aa, Mycobacterium bovis
MPSGTAR

SEQ ID NO: 152434 - protein, 13 aa, Mycobacterium bovis
MPSNVGDAAAGRH

SEQ ID NO: 152435 - protein, 5 aa, Mycobacterium bovis
MPTES

SEQ ID NO: 152436 - protein, 6 aa, Mycobacterium bovis
MPTPAE

SEQ ID NO: 152437 - protein, 5 aa, Mycobacterium bovis
MQGTG

SEQ ID NO: 152438 - protein, 7 aa, Mycobacterium bovis
MQPGQDD

SEQ ID NO: 152439 - protein, 15 aa, Mycobacterium bovis
MQQGANALADGSAAL

SEQ ID NO: 152440 - protein, 9 aa, Mycobacterium bovis
MRATDVEPS

SEQ ID NO: 152441 - protein, 13 aa, Mycobacterium bovis
MRSGGDDPDGASG

SEQ ID NO: 152442 - protein, 6 aa, Mycobacterium bovis
MRSRRN

SEQ ID NO: 152443 - protein, 8 aa, Mycobacterium bovis
MRTNRGGD

SEQ ID NO: 152444 - protein, 11 aa, Mycobacterium bovis
MSDPPRAAAAS

SEQ ID NO: 152445 - protein, 4 aa, Mycobacterium bovis
MSGG

SEQ ID NO: 152446 - protein, 6 aa, Mycobacterium bovis
MSGSNI

SEQ ID NO: 152447 - protein, 8 aa, Mycobacterium bovis
MSPDAAPS

SEQ ID NO: 152448 - protein, 6 aa, Mycobacterium bovis
MSRGEL

SEQ ID NO: 152449 - protein, 8 aa, Mycobacterium bovis
MSSPGGVR

SEQ ID NO: 152450 - protein, 22 aa, Mycobacterium bovis
MSTDRNPADRQRVDPQAAARIS

SEQ ID NO: 152451 - protein, 8 aa, Mycobacterium bovis
MTGASSAE

SEQ ID NO: 152452 - protein, 7 aa, Mycobacterium bovis
MTPLSPD

SEQ ID NO: 152453 - protein, 7 aa, Mycobacterium bovis
NAASTLA

SEQ ID NO: 152454 - protein, 7 aa, Mycobacterium bovis
NADAGLS

SEQ ID NO: 152455 - protein, 6 aa, Mycobacterium bovis
NADPRT

SEQ ID NO: 152456 - protein, 21 aa, Mycobacterium bovis
NADVQSAQRAYTRRGGNNAGA

SEQ ID NO: 152457 - protein, 48 aa, Mycobacterium bovis
NAEGSDPNDQPPLESHSPAAPAESNPIASSDSARRSRLATNDDHPPLA

SEQ ID NO: 152458 - protein, 7 aa, Mycobacterium bovis
NAGGGNL

SEQ ID NO: 152459 - protein, 8 aa, Mycobacterium bovis
NAGMQPSE

SEQ ID NO: 152460 - protein, 9 aa, Mycobacterium bovis
NAGPNTNSS

SEQ ID NO: 152461 - protein, 4 aa, Mycobacterium bovis
NAGR

SEQ ID NO: 152462 - protein, 16 aa, Mycobacterium bovis
NAGSAGNTKPLTVEPS

SEQ ID NO: 152463 - protein, 8 aa, Mycobacterium bovis
NAGSLDNP

SEQ ID NO: 152464 - protein, 6 aa, Mycobacterium bovis
NAKAAL

SEQ ID NO: 152465 - protein, 7 aa, Mycobacterium bovis
NANGNVE

SEQ ID NO: 152466 - protein, 6 aa, Mycobacterium bovis
NANYPQ

SEQ ID NO: 152467 - protein, 11 aa, Mycobacterium bovis
NAPSRGGADGV

SEQ ID NO: 152468 - protein, 8 aa, Mycobacterium bovis
NAQGEPSA

SEQ ID NO: 152469 - protein, 14 aa, Mycobacterium bovis
NAQLSNCSDGAAQL

SEQ ID NO: 152470 - protein, 7 aa, Mycobacterium bovis
NAQQAEL

SEQ ID NO: 152471 - protein, 11 aa, Mycobacterium bovis
NARGGPGGAPG

SEQ ID NO: 152472 - protein, 8 aa, Mycobacterium bovis
NARGTPLS

SEQ ID NO: 152473 - protein, 7 aa, Mycobacterium bovis
NARPEKP

SEQ ID NO: 152474 - protein, 8 aa, Mycobacterium bovis
NARRAPNR

SEQ ID NO: 152475 - protein, 8 aa, Mycobacterium bovis
NASGGSVG

SEQ ID NO: 152476 - protein, 5 aa, Mycobacterium bovis
NASGR

SEQ ID NO: 152477 - protein, 5 aa, Mycobacterium bovis
NASGT

SEQ ID NO: 152478 - protein, 9 aa, Mycobacterium bovis
NATAGAPLV

SEQ ID NO: 152479 - protein, 7 aa, Mycobacterium bovis
NATGATR

SEQ ID NO: 152480 - protein, 7 aa, Mycobacterium bovis
NATTAAA

SEQ ID NO: 152481 - protein, 6 aa, Mycobacterium bovis
NAYSGS

SEQ ID NO: 152482 - protein, 4 aa, Mycobacterium bovis
NDAA

SEQ ID NO: 152483 - protein, 4 aa, Mycobacterium bovis
NDAK

SEQ ID NO: 152484 - protein, 8 aa, Mycobacterium bovis
NDDRTGAA

SEQ ID NO: 152485 - protein, 4 aa, Mycobacterium bovis
NDEV

SEQ ID NO: 152486 - protein, 11 aa, Mycobacterium bovis
NDLADGSRQLA

SEQ ID NO: 152487 - protein, 6 aa, Mycobacterium bovis
NDPAAL

SEQ ID NO: 152488 - protein, 5 aa, Mycobacterium bovis
NDPAT

SEQ ID NO: 152489 - protein, 13 aa, Mycobacterium bovis
NDPDGVAVDNSGN

SEQ ID NO: 152490 - protein, 4 aa, Mycobacterium bovis
NDPR

SEQ ID NO: 152491 - protein, 6 aa, Mycobacterium bovis
NDQDRA

SEQ ID NO: 152492 - protein, 16 aa, Mycobacterium bovis
NDYSDGIRGTDDDRVG

SEQ ID NO: 152493 - protein, 6 aa, Mycobacterium bovis
NECGQQ

SEQ ID NO: 152494 - protein, 4 aa, Mycobacterium bovis
NEES

SEQ ID NO: 152495 - protein, 4 aa, Mycobacterium bovis
NEGR

SEQ ID NO: 152496 - protein, 7 aa, Mycobacterium bovis
NELGAQG

SEQ ID NO: 152497 - protein, 22 aa, Mycobacterium bovis
NEMNPDSAPPKTPLRSGGPGSL

SEQ ID NO: 152498 - protein, 4 aa, Mycobacterium bovis
NEQA

SEQ ID NO: 152499 - protein, 8 aa, Mycobacterium bovis
NEQRKEND

SEQ ID NO: 152500 - protein, 5 aa, Mycobacterium bovis
NERGD

SEQ ID NO: 152501 - protein, 6 aa, Mycobacterium bovis
NESPCT

SEQ ID NO: 152502 - protein, 4 aa, Mycobacterium bovis
NESV

SEQ ID NO: 152503 - protein, 11 aa, Mycobacterium bovis
NETDGGFGPSS

SEQ ID NO: 152504 - protein, 7 aa, Mycobacterium bovis
NETEAYD

SEQ ID NO: 152505 - protein, 7 aa, Mycobacterium bovis
NGAGPEL

SEQ ID NO: 152506 - protein, 14 aa, Mycobacterium bovis
NGANDLASAGRQVA

SEQ ID NO: 152507 - protein, 4 aa, Mycobacterium bovis
NGAP

SEQ ID NO: 152508 - protein, 7 aa, Mycobacterium bovis
NGDGEVP

SEQ ID NO: 152509 - protein, 15 aa, Mycobacterium bovis
NGDNVKSAQIDDREQ

SEQ ID NO: 152510 - protein, 10 aa, Mycobacterium bovis
NGEETRSLDS

SEQ ID NO: 152511 - protein, 9 aa, Mycobacterium bovis
NGEPPEAPK

SEQ ID NO: 152512 - protein, 4 aa, Mycobacterium bovis
NGER

SEQ ID NO: 152513 - protein, 6 aa, Mycobacterium bovis
NGGAGA

SEQ ID NO: 152514 - protein, 4 aa, Mycobacterium bovis
NGHA

SEQ ID NO: 152515 - protein, 14 aa, Mycobacterium bovis
NGITVKDSDGTVRR

SEQ ID NO: 152516 - protein, 16 aa, Mycobacterium bovis
NGKRVTSEPEGLATGN

SEQ ID NO: 152517 - protein, 8 aa, Mycobacterium bovis
NGLGPADE

SEQ ID NO: 152518 - protein, 6 aa, Mycobacterium bovis
NGNITD

SEQ ID NO: 152519 - protein, 6 aa, Mycobacterium bovis
NGPAGS

SEQ ID NO: 152520 - protein, 7 aa, Mycobacterium bovis
NGPGIPA

SEQ ID NO: 152521 - protein, 7 aa, Mycobacterium bovis
NGQPTIS

SEQ ID NO: 152522 - protein, 10 aa, Mycobacterium bovis
NGSEPVSPAS

SEQ ID NO: 152523 - protein, 9 aa, Mycobacterium bovis
NGSGPRFTA

SEQ ID NO: 152524 - protein, 6 aa, Mycobacterium bovis
NGSTTL

SEQ ID NO: 152525 - protein, 6 aa, Mycobacterium bovis
NGTGHL

SEQ ID NO: 152526 - protein, 10 aa, Mycobacterium bovis
NGTGKTTTVG

SEQ ID NO: 152527 - protein, 13 aa, Mycobacterium bovis
NGTITVSSSPGYT

SEQ ID NO: 152528 - protein, 8 aa, Mycobacterium bovis
NGTPAVEP

SEQ ID NO: 152529 - protein, 12 aa, Mycobacterium bovis
NGTPSDLGGDNI

SEQ ID NO: 152530 - protein, 7 aa, Mycobacterium bovis
NGTSTAN

SEQ ID NO: 152531 - protein, 7 aa, Mycobacterium bovis
NHQPVTE

SEQ ID NO: 152532 - protein, 8 aa, Mycobacterium bovis
NHSPDDIE

SEQ ID NO: 152533 - protein, 4 aa, Mycobacterium bovis
NHYP

SEQ ID NO: 152534 - protein, 11 aa, Mycobacterium bovis
NIGHTSAAAGV

SEQ ID NO: 152535 - protein, 8 aa, Mycobacterium bovis
NKPSAYST

SEQ ID NO: 152536 - protein, 10 aa, Mycobacterium bovis
NKTAKTVGQI

SEQ ID NO: 152537 - protein, 8 aa, Mycobacterium bovis
NLATPNDT

SEQ ID NO: 152538 - protein, 8 aa, Mycobacterium bovis
NLGHTEAA

SEQ ID NO: 152539 - protein, 8 aa, Mycobacterium bovis
NLGKDERH

SEQ ID NO: 152540 - protein, 7 aa, Mycobacterium bovis
NLPGTSQ

SEQ ID NO: 152541 - protein, 10 aa, Mycobacterium bovis
NLSGTVTDAE

SEQ ID NO: 152542 - protein, 12 aa, Mycobacterium bovis
NNAITTDPAVSQ

SEQ ID NO: 152543 - protein, 6 aa, Mycobacterium bovis
NNASGL

SEQ ID NO: 152544 - protein, 8 aa, Mycobacterium bovis
NNPTSSPY

SEQ ID NO: 152545 - protein, 10 aa, Mycobacterium bovis
NNRSGGGVRV

SEQ ID NO: 152546 - protein, 4 aa, Mycobacterium bovis
NNSP

SEQ ID NO: 152547 - protein, 6 aa, Mycobacterium bovis
NNTPEG

SEQ ID NO: 152548 - protein, 11 aa, Mycobacterium bovis
NPAAGTTRAPF

SEQ ID NO: 152549 - protein, 10 aa, Mycobacterium bovis
NPADASKKLT

SEQ ID NO: 152550 - protein, 5 aa, Mycobacterium bovis
NPADE

SEQ ID NO: 152551 - protein, 5 aa, Mycobacterium bovis
NPALR

SEQ ID NO: 152552 - protein, 14 aa, Mycobacterium bovis
NPANPATVKSSELS

SEQ ID NO: 152553 - protein, 8 aa, Mycobacterium bovis
NPATTEAM

SEQ ID NO: 152554 - protein, 5 aa, Mycobacterium bovis
NPAVP

SEQ ID NO: 152555 - protein, 15 aa, Mycobacterium bovis
NPCRDVDSADTAIEV

SEQ ID NO: 152556 - protein, 9 aa, Mycobacterium bovis
NPDERADEM

SEQ ID NO: 152557 - protein, 4 aa, Mycobacterium bovis
NPDF

SEQ ID NO: 152558 - protein, 8 aa, Mycobacterium bovis
NPDLPRSE

SEQ ID NO: 152559 - protein, 7 aa, Mycobacterium bovis
NPDSPDR

SEQ ID NO: 152560 - protein, 11 aa, Mycobacterium bovis
NPETGKYGPIY

SEQ ID NO: 152561 - protein, 7 aa, Mycobacterium bovis
NPGGSYT

SEQ ID NO: 152562 - protein, 6 aa, Mycobacterium bovis
NPKATL

SEQ ID NO: 152563 - protein, 6 aa, Mycobacterium bovis
NPKRNV

SEQ ID NO: 152564 - protein, 8 aa, Mycobacterium bovis
NPNNPNGG

SEQ ID NO: 152565 - protein, 8 aa, Mycobacterium bovis
NPNPDGKH

SEQ ID NO: 152566 - protein, 5 aa, Mycobacterium bovis
NPPAA

SEQ ID NO: 152567 - protein, 8 aa, Mycobacterium bovis
NPPNDTPL

SEQ ID NO: 152568 - protein, 6 aa, Mycobacterium bovis
NPPPVP

SEQ ID NO: 152569 - protein, 4 aa, Mycobacterium bovis
NPPT

SEQ ID NO: 152570 - protein, 6 aa, Mycobacterium bovis
NPPVSA

SEQ ID NO: 152571 - protein, 8 aa, Mycobacterium bovis
NPQVNEPL

SEQ ID NO: 152572 - protein, 5 aa, Mycobacterium bovis
NPRTM

SEQ ID NO: 152573 - protein, 8 aa, Mycobacterium bovis
NPSAPRPW

SEQ ID NO: 152574 - protein, 11 aa, Mycobacterium bovis
NPSEGTPAGPW

SEQ ID NO: 152575 - protein, 7 aa, Mycobacterium bovis
NPSRSLP

SEQ ID NO: 152576 - protein, 6 aa, Mycobacterium bovis
NPSRYQ

SEQ ID NO: 152577 - protein, 6 aa, Mycobacterium bovis
NPSWRP

SEQ ID NO: 152578 - protein, 19 aa, Mycobacterium bovis
NPTAAMSQDELSGRVAALT

SEQ ID NO: 152579 - protein, 9 aa, Mycobacterium bovis
NPTDKPAVT

SEQ ID NO: 152580 - protein, 6 aa, Mycobacterium bovis
NPTGDQ

SEQ ID NO: 152581 - protein, 6 aa, Mycobacterium bovis
NPTSRM

SEQ ID NO: 152582 - protein, 5 aa, Mycobacterium bovis
NPVAN

SEQ ID NO: 152583 - protein, 5 aa, Mycobacterium bovis
NQAGQ

SEQ ID NO: 152584 - protein, 14 aa, Mycobacterium bovis
NQAKLTSGALSTAA

SEQ ID NO: 152585 - protein, 35 aa, Mycobacterium bovis
NQAPTTPPRMPTGMPPKTAVPQSIPPRTEATSVRQ

SEQ ID NO: 152586 - protein, 5 aa, Mycobacterium bovis
NQATA

SEQ ID NO: 152587 - protein, 6 aa, Mycobacterium bovis
NQDQGV

SEQ ID NO: 152588 - protein, 6 aa, Mycobacterium bovis
NQGEAL

SEQ ID NO: 152589 - protein, 6 aa, Mycobacterium bovis
NQGYAA

SEQ ID NO: 152590 - protein, 5 aa, Mycobacterium bovis
NQLQS

SEQ ID NO: 152591 - protein, 7 aa, Mycobacterium bovis
NQPLGDA

SEQ ID NO: 152592 - protein, 5 aa, Mycobacterium bovis
NQPPP

SEQ ID NO: 152593 - protein, 6 aa, Mycobacterium bovis
NQSTAL

SEQ ID NO: 152594 - protein, 4 aa, Mycobacterium bovis
NRAD

SEQ ID NO: 152595 - protein, 7 aa, Mycobacterium bovis
NRADPLA

SEQ ID NO: 152596 - protein, 10 aa, Mycobacterium bovis
NRDGSDAMST

SEQ ID NO: 152597 - protein, 14 aa, Mycobacterium bovis
NRGVGRSSVPKPIS

SEQ ID NO: 152598 - protein, 18 aa, Mycobacterium bovis
NRLGGQHGSIPISGTSYA

SEQ ID NO: 152599 - protein, 5 aa, Mycobacterium bovis
NRPDI

SEQ ID NO: 152600 - protein, 7 aa, Mycobacterium bovis
NRPPQYE

SEQ ID NO: 152601 - protein, 8 aa, Mycobacterium bovis
NRQEKRDR

SEQ ID NO: 152602 - protein, 11 aa, Mycobacterium bovis
NRQGHPGTRDR

SEQ ID NO: 152603 - protein, 6 aa, Mycobacterium bovis
NRQNKD

SEQ ID NO: 152604 - protein, 7 aa, Mycobacterium bovis
NRQPPER

SEQ ID NO: 152605 - protein, 17 aa, Mycobacterium bovis
NRQTAEAERGGSDRPTT

SEQ ID NO: 152606 - protein, 8 aa, Mycobacterium bovis
NRRRRADE

SEQ ID NO: 152607 - protein, 9 aa, Mycobacterium bovis
NRTHSADSR

SEQ ID NO: 152608 - protein, 4 aa, Mycobacterium bovis
NSAD

SEQ ID NO: 152609 - protein, 6 aa, Mycobacterium bovis
NSDAAG

SEQ ID NO: 152610 - protein, 5 aa, Mycobacterium bovis
NSDGS

SEQ ID NO: 152611 - protein, 17 aa, Mycobacterium bovis
NSGNRANRRIADSDDLA

SEQ ID NO: 152612 - protein, 5 aa, Mycobacterium bovis
NSGPI

SEQ ID NO: 152613 - protein, 7 aa, Mycobacterium bovis
NSLANGG

SEQ ID NO: 152614 - protein, 13 aa, Mycobacterium bovis
NSPGMGDDATRVT

SEQ ID NO: 152615 - protein, 5 aa, Mycobacterium bovis
NSPRQ

SEQ ID NO: 152616 - protein, 4 aa, Mycobacterium bovis
NSQR

SEQ ID NO: 152617 - protein, 8 aa, Mycobacterium bovis
NSRQLGTA

SEQ ID NO: 152618 - protein, 6 aa, Mycobacterium bovis
NSSDID

SEQ ID NO: 152619 - protein, 6 aa, Mycobacterium bovis
NSSHDY

SEQ ID NO: 152620 - protein, 8 aa, Mycobacterium bovis
NSTPPEGI

SEQ ID NO: 152621 - protein, 10 aa, Mycobacterium bovis
NSVTADSVDT

SEQ ID NO: 152622 - protein, 13 aa, Mycobacterium bovis
NSYGLQQPPRLGA

SEQ ID NO: 152623 - protein, 5 aa, Mycobacterium bovis
NTAQA

SEQ ID NO: 152624 - protein, 19 aa, Mycobacterium bovis
NTDAAAGPLRRHGPAAARR

SEQ ID NO: 152625 - protein, 9 aa, Mycobacterium bovis
NTEPAAGSV

SEQ ID NO: 152626 - protein, 10 aa, Mycobacterium bovis
NTFTTDPANL

SEQ ID NO: 152627 - protein, 11 aa, Mycobacterium bovis
NTGTQAAREAG

SEQ ID NO: 152628 - protein, 28 aa, Mycobacterium bovis
NTNGHASKAATKSVPNGKPADLAEGNGE

SEQ ID NO: 152629 - protein, 6 aa, Mycobacterium bovis
NTNPYN

SEQ ID NO: 152630 - protein, 5 aa, Mycobacterium bovis
NTPAD

SEQ ID NO: 152631 - protein, 7 aa, Mycobacterium bovis
NTPAGTQ

SEQ ID NO: 152632 - protein, 8 aa, Mycobacterium bovis
NTPGNKPI

SEQ ID NO: 152633 - protein, 9 aa, Mycobacterium bovis
NTPRPSPET

SEQ ID NO: 152634 - protein, 6 aa, Mycobacterium bovis
NTRIGQ

SEQ ID NO: 152635 - protein, 7 aa, Mycobacterium bovis
NTRSPLD

SEQ ID NO: 152636 - protein, 4 aa, Mycobacterium bovis
NTSA

SEQ ID NO: 152637 - protein, 6 aa, Mycobacterium bovis
NTSDDG

SEQ ID NO: 152638 - protein, 5 aa, Mycobacterium bovis
NTTRK

SEQ ID NO: 152639 - protein, 11 aa, Mycobacterium bovis
NTTTTSPVTKN

SEQ ID NO: 152640 - protein, 4 aa, Mycobacterium bovis
NTVP

SEQ ID NO: 152641 - protein, 6 aa, Mycobacterium bovis
NVEGSM

SEQ ID NO: 152642 - protein, 9 aa, Mycobacterium bovis
NVTGPAATV

SEQ ID NO: 152643 - protein, 15 aa, Mycobacterium bovis
NVTHTGDRQPGPGRA

SEQ ID NO: 152644 - protein, 6 aa, Mycobacterium bovis
NVTTAT

SEQ ID NO: 152645 - protein, 4 aa, Mycobacterium bovis
NVYP

SEQ ID NO: 152646 - protein, 10 aa, Mycobacterium bovis
PAAGASGFGK

SEQ ID NO: 152647 - protein, 11 aa, Mycobacterium bovis
PAAGGPPRGQV

SEQ ID NO: 152648 - protein, 16 aa, Mycobacterium bovis
PAAGRTANELASDAGE

SEQ ID NO: 152649 - protein, 19 aa, Mycobacterium bovis
PAAHGSTLGSRVAGTQPAP

SEQ ID NO: 152650 - protein, 12 aa, Mycobacterium bovis
PAAKQKSLKTTA

SEQ ID NO: 152651 - protein, 17 aa, Mycobacterium bovis
PAALGNPDNPKFPTDGV

SEQ ID NO: 152652 - protein, 12 aa, Mycobacterium bovis
PAAPPPPPDHRA

SEQ ID NO: 152653 - protein, 8 aa, Mycobacterium bovis
PAARSARV

SEQ ID NO: 152654 - protein, 4 aa, Mycobacterium bovis
PAAS

SEQ ID NO: 152655 - protein, 10 aa, Mycobacterium bovis
PAASSAGQDY

SEQ ID NO: 152656 - protein, 9 aa, Mycobacterium bovis
PACASARTE

SEQ ID NO: 152657 - protein, 11 aa, Mycobacterium bovis
PADATKRRANL

SEQ ID NO: 152658 - protein, 10 aa, Mycobacterium bovis
PAEDENVPEE

SEQ ID NO: 152659 - protein, 13 aa, Mycobacterium bovis
PAEELRSARTPQE

SEQ ID NO: 152660 - protein, 26 aa, Mycobacterium bovis
PAEGDAPVPITPAGRPRSGQRSYPDR

SEQ ID NO: 152661 - protein, 15 aa, Mycobacterium bovis
PAEPDGADDEEADHP

SEQ ID NO: 152662 - protein, 29 aa, Mycobacterium bovis
PAEPGGGAAPAKPVADPPVPAPKDTTPRN

SEQ ID NO: 152663 - protein, 5 aa, Mycobacterium bovis
PAERA

SEQ ID NO: 152664 - protein, 5 aa, Mycobacterium bovis
PAERR

SEQ ID NO: 152665 - protein, 18 aa, Mycobacterium bovis
PAEVAEAGPESPADPEIE

SEQ ID NO: 152666 - protein, 10 aa, Mycobacterium bovis
PAFTGQPTDA

SEQ ID NO: 152667 - protein, 4 aa, Mycobacterium bovis
PAGA

SEQ ID NO: 152668 - protein, 7 aa, Mycobacterium bovis
PAGAEEV

SEQ ID NO: 152669 - protein, 19 aa, Mycobacterium bovis
PAGGLSNDAVRQAAAKVGQ

SEQ ID NO: 152670 - protein, 10 aa, Mycobacterium bovis
PAGGVDTGKA

SEQ ID NO: 152671 - protein, 11 aa, Mycobacterium bovis
PAGKTVDDPAW

SEQ ID NO: 152672 - protein, 9 aa, Mycobacterium bovis
PAGPAAPGI

SEQ ID NO: 152673 - protein, 8 aa, Mycobacterium bovis
PAGPRPWQ

SEQ ID NO: 152674 - protein, 4 aa, Mycobacterium bovis
PAGQ

SEQ ID NO: 152675 - protein, 7 aa, Mycobacterium bovis
PAGSANL

SEQ ID NO: 152676 - protein, 16 aa, Mycobacterium bovis
PAGTLPDGGPFTEAGD

SEQ ID NO: 152677 - protein, 14 aa, Mycobacterium bovis
PAKSQQPTGTGGQR

SEQ ID NO: 152678 - protein, 10 aa, Mycobacterium bovis
PALESTRATL

SEQ ID NO: 152679 - protein, 9 aa, Mycobacterium bovis
PALGSTPDN

SEQ ID NO: 152680 - protein, 7 aa, Mycobacterium bovis
PALTRSG

SEQ ID NO: 152681 - protein, 7 aa, Mycobacterium bovis
PANGAVP

SEQ ID NO: 152682 - protein, 7 aa, Mycobacterium bovis
PANPGMA

SEQ ID NO: 152683 - protein, 23 aa, Mycobacterium bovis
PANRVNAAARDAENISDSNSGYP

SEQ ID NO: 152684 - protein, 12 aa, Mycobacterium bovis
PAPAGADGSGAN

SEQ ID NO: 152685 - protein, 8 aa, Mycobacterium bovis
PAPATDND

SEQ ID NO: 152686 - protein, 5 aa, Mycobacterium bovis
PAPDL

SEQ ID NO: 152687 - protein, 48 aa, Mycobacterium bovis
PAPPPEEGVPPGAPVPGPEPPPAPGPQPPAVDRGGGTVTVPSYSGGRK

SEQ ID NO: 152688 - protein, 10 aa, Mycobacterium bovis
PAPQATGPGC

SEQ ID NO: 152689 - protein, 11 aa, Mycobacterium bovis
PAPRNSAQHRS

SEQ ID NO: 152690 - protein, 46 aa, Mycobacterium bovis
PAPSVNNGINPLPADQLPGTPPPVNDPLQRPGSGTVQCNGQQPNPC

SEQ ID NO: 152691 - protein, 13 aa, Mycobacterium bovis
PAQGPSATPAQGL

SEQ ID NO: 152692 - protein, 7 aa, Mycobacterium bovis
PAQPGAA

SEQ ID NO: 152693 - protein, 5 aa, Mycobacterium bovis
PAQRV

SEQ ID NO: 152694 - protein, 19 aa, Mycobacterium bovis
PAQVQPEGAVEPREKRATP

SEQ ID NO: 152695 - protein, 8 aa, Mycobacterium bovis
PARERPGA

SEQ ID NO: 152696 - protein, 4 aa, Mycobacterium bovis
PARG

SEQ ID NO: 152697 - protein, 5 aa, Mycobacterium bovis
PARRG

SEQ ID NO: 152698 - protein, 15 aa, Mycobacterium bovis
PARRSAESAGYPEAD

SEQ ID NO: 152699 - protein, 5 aa, Mycobacterium bovis
PASRS

SEQ ID NO: 152700 - protein, 8 aa, Mycobacterium bovis
PASSLRGQ

SEQ ID NO: 152701 - protein, 8 aa, Mycobacterium bovis
PASSPGGM

SEQ ID NO: 152702 - protein, 36 aa, Mycobacterium bovis
PATAAVPGGSPPTSNPAPAAPSSNSVGSASAAPGIS

SEQ ID NO: 152703 - protein, 6 aa, Mycobacterium bovis
PATEPL

SEQ ID NO: 152704 - protein, 9 aa, Mycobacterium bovis
PATGANAVE

SEQ ID NO: 152705 - protein, 61 aa, Mycobacterium bovis
PAVPPPPTVTPPVPARAPRPAAQHEPPARVTSGEALTEPNPPEEQPNASAPQQDRNDSQPI

SEQ ID NO: 152706 - protein, 14 aa, Mycobacterium bovis
PAYASRSASNRKAG

SEQ ID NO: 152707 - protein, 74 aa, Mycobacterium bovis
PCPAPRATSPPGRPAPPTTSETTEPNVTSSPAAPSPTTSASAPTGTTPAIPTSASPAAPASPPTPWPVTSSPTM

SEQ ID NO: 152708 - protein, 14 aa, Mycobacterium bovis
PCPEPAAADPTDVP

SEQ ID NO: 152709 - protein, 4 aa, Mycobacterium bovis
PDAA

SEQ ID NO: 152710 - protein, 10 aa, Mycobacterium bovis
PDAGNPASFG

SEQ ID NO: 152711 - protein, 9 aa, Mycobacterium bovis
PDAGQRISA

SEQ ID NO: 152712 - protein, 8 aa, Mycobacterium bovis
PDAPAEQV

SEQ ID NO: 152713 - protein, 7 aa, Mycobacterium bovis
PDATKAA

SEQ ID NO: 152714 - protein, 9 aa, Mycobacterium bovis
PDDASSFGD

SEQ ID NO: 152715 - protein, 5 aa, Mycobacterium bovis
PDDTT

SEQ ID NO: 152716 - protein, 5 aa, Mycobacterium bovis
PDEAR

SEQ ID NO: 152717 - protein, 5 aa, Mycobacterium bovis
PDEND

SEQ ID NO: 152718 - protein, 7 aa, Mycobacterium bovis
PDENQMQ

SEQ ID NO: 152719 - protein, 8 aa, Mycobacterium bovis
PDFGERGR

SEQ ID NO: 152720 - protein, 7 aa, Mycobacterium bovis
PDGANTI

SEQ ID NO: 152721 - protein, 4 aa, Mycobacterium bovis
PDGH

SEQ ID NO: 152722 - protein, 5 aa, Mycobacterium bovis
PDGKA

SEQ ID NO: 152723 - protein, 12 aa, Mycobacterium bovis
PDGPGGQSGLAG

SEQ ID NO: 152724 - protein, 7 aa, Mycobacterium bovis
PDGPLTG

SEQ ID NO: 152725 - protein, 38 aa, Mycobacterium bovis
PDGQSYTALNDNTAIPAVPANNDVGRHPTTLPSIGGSK

SEQ ID NO: 152726 - protein, 4 aa, Mycobacterium bovis
PDGR

SEQ ID NO: 152727 - protein, 6 aa, Mycobacterium bovis
PDGSIA

SEQ ID NO: 152728 - protein, 7 aa, Mycobacterium bovis
PDGSYSE

SEQ ID NO: 152729 - protein, 7 aa, Mycobacterium bovis
PDGYQTA

SEQ ID NO: 152730 - protein, 21 aa, Mycobacterium bovis
PDIAPPSSGLQTPPGPPNAYD

SEQ ID NO: 152731 - protein, 11 aa, Mycobacterium bovis
PDIYGDPEPVT

SEQ ID NO: 152732 - protein, 7 aa, Mycobacterium bovis
PDKVNSI

SEQ ID NO: 152733 - protein, 5 aa, Mycobacterium bovis
PDLPR

SEQ ID NO: 152734 - protein, 5 aa, Mycobacterium bovis
PDLPT

SEQ ID NO: 152735 - protein, 5 aa, Mycobacterium bovis
PDLSA

SEQ ID NO: 152736 - protein, 8 aa, Mycobacterium bovis
PDNDPANM

SEQ ID NO: 152737 - protein, 7 aa, Mycobacterium bovis
PDPAGQP

SEQ ID NO: 152738 - protein, 6 aa, Mycobacterium bovis
PDPLDG

SEQ ID NO: 152739 - protein, 6 aa, Mycobacterium bovis
PDPNRA

SEQ ID NO: 152740 - protein, 8 aa, Mycobacterium bovis
PDPTPQPL

SEQ ID NO: 152741 - protein, 5 aa, Mycobacterium bovis
PDPVM

SEQ ID NO: 152742 - protein, 5 aa, Mycobacterium bovis
PDPYP

SEQ ID NO: 152743 - protein, 6 aa, Mycobacterium bovis
PDQIST

SEQ ID NO: 152744 - protein, 23 aa, Mycobacterium bovis
PDRGAEPELGPQPDLPSRRGRRL

SEQ ID NO: 152745 - protein, 5 aa, Mycobacterium bovis
PDRPE

SEQ ID NO: 152746 - protein, 16 aa, Mycobacterium bovis
PDRPPTPVDGSPGRAV

SEQ ID NO: 152747 - protein, 15 aa, Mycobacterium bovis
PDSRPARPVSAEGGY

SEQ ID NO: 152748 - protein, 4 aa, Mycobacterium bovis
PDTD

SEQ ID NO: 152749 - protein, 5 aa, Mycobacterium bovis
PDTGA

SEQ ID NO: 152750 - protein, 8 aa, Mycobacterium bovis
PDTGLQPP

SEQ ID NO: 152751 - protein, 6 aa, Mycobacterium bovis
PDYDLG

SEQ ID NO: 152752 - protein, 4 aa, Mycobacterium bovis
PEAD

SEQ ID NO: 152753 - protein, 10 aa, Mycobacterium bovis
PEAGTPSTWV

SEQ ID NO: 152754 - protein, 6 aa, Mycobacterium bovis
PEAPAI

SEQ ID NO: 152755 - protein, 7 aa, Mycobacterium bovis
PEAPRIT

SEQ ID NO: 152756 - protein, 7 aa, Mycobacterium bovis
PEATERT

SEQ ID NO: 152757 - protein, 8 aa, Mycobacterium bovis
PEAVPPDV

SEQ ID NO: 152758 - protein, 8 aa, Mycobacterium bovis
PEDDPEAR

SEQ ID NO: 152759 - protein, 4 aa, Mycobacterium bovis
PEDP

SEQ ID NO: 152760 - protein, 9 aa, Mycobacterium bovis
PEDPTYDPT

SEQ ID NO: 152761 - protein, 4 aa, Mycobacterium bovis
PEDS

SEQ ID NO: 152762 - protein, 7 aa, Mycobacterium bovis
PEERAEL

SEQ ID NO: 152763 - protein, 5 aa, Mycobacterium bovis
PEEYR

SEQ ID NO: 152764 - protein, 5 aa, Mycobacterium bovis
PEGIN

SEQ ID NO: 152765 - protein, 5 aa, Mycobacterium bovis
PEGLP

SEQ ID NO: 152766 - protein, 4 aa, Mycobacterium bovis
PEGY

SEQ ID NO: 152767 - protein, 8 aa, Mycobacterium bovis
PEHGPGMP

SEQ ID NO: 152768 - protein, 9 aa, Mycobacterium bovis
PEHGTAEEA

SEQ ID NO: 152769 - protein, 11 aa, Mycobacterium bovis
PEIEQPPSRRN

SEQ ID NO: 152770 - protein, 4 aa, Mycobacterium bovis
PEKG

SEQ ID NO: 152771 - protein, 14 aa, Mycobacterium bovis
PENDPQDSGYQARQ

SEQ ID NO: 152772 - protein, 13 aa, Mycobacterium bovis
PEPDANPSTEVGQ

SEQ ID NO: 152773 - protein, 25 aa, Mycobacterium bovis
PEPDPPPQAAPWPQQAPDGPGFSPP

SEQ ID NO: 152774 - protein, 10 aa, Mycobacterium bovis
PEPDSPRRMP

SEQ ID NO: 152775 - protein, 4 aa, Mycobacterium bovis
PEPE

SEQ ID NO: 152776 - protein, 4 aa, Mycobacterium bovis
PEQR

SEQ ID NO: 152777 - protein, 4 aa, Mycobacterium bovis
PEQV

SEQ ID NO: 152778 - protein, 10 aa, Mycobacterium bovis
PEQVSQARPM

SEQ ID NO: 152779 - protein, 5 aa, Mycobacterium bovis
PERDK

SEQ ID NO: 152780 - protein, 5 aa, Mycobacterium bovis
PEREP

SEQ ID NO: 152781 - protein, 15 aa, Mycobacterium bovis
PERPKPAQQPPDDPV

SEQ ID NO: 152782 - protein, 6 aa, Mycobacterium bovis
PERRSA

SEQ ID NO: 152783 - protein, 9 aa, Mycobacterium bovis
PERRSGIPA

SEQ ID NO: 152784 - protein, 6 aa, Mycobacterium bovis
PESQRP

SEQ ID NO: 152785 - protein, 8 aa, Mycobacterium bovis
PETKGRKL

SEQ ID NO: 152786 - protein, 5 aa, Mycobacterium bovis
PFATR

SEQ ID NO: 152787 - protein, 9 aa, Mycobacterium bovis
PFGNRSDNG

SEQ ID NO: 152788 - protein, 9 aa, Mycobacterium bovis
PFPQSPPRY

SEQ ID NO: 152789 - protein, 7 aa, Mycobacterium bovis
PFTSDQD

SEQ ID NO: 152790 - protein, 7 aa, Mycobacterium bovis
PGAPAAM

SEQ ID NO: 152791 - protein, 5 aa, Mycobacterium bovis
PGAPE

SEQ ID NO: 152792 - protein, 8 aa, Mycobacterium bovis
PGAPRLPK

SEQ ID NO: 152793 - protein, 16 aa, Mycobacterium bovis
PGAPSRPASAVSRPSY

SEQ ID NO: 152794 - protein, 15 aa, Mycobacterium bovis
PGAPSSFSPKSPPAS

SEQ ID NO: 152795 - protein, 10 aa, Mycobacterium bovis
PGARCDQPVK

SEQ ID NO: 152796 - protein, 4 aa, Mycobacterium bovis
PGAT

SEQ ID NO: 152797 - protein, 20 aa, Mycobacterium bovis
PGATAGARSTDIENSRGSAN

SEQ ID NO: 152798 - protein, 10 aa, Mycobacterium bovis
PGCAPGPDGV

SEQ ID NO: 152799 - protein, 21 aa, Mycobacterium bovis
PGDPASPPHGEAEQPLPGPRW

SEQ ID NO: 152800 - protein, 8 aa, Mycobacterium bovis
PGDPNEQI

SEQ ID NO: 152801 - protein, 7 aa, Mycobacterium bovis
PGDVATA

SEQ ID NO: 152802 - protein, 18 aa, Mycobacterium bovis
PGEKIPVDGEVTDGRAAV

SEQ ID NO: 152803 - protein, 10 aa, Mycobacterium bovis
PGEMNTPEQT

SEQ ID NO: 152804 - protein, 4 aa, Mycobacterium bovis
PGER

SEQ ID NO: 152805 - protein, 9 aa, Mycobacterium bovis
PGGGELGVD

SEQ ID NO: 152806 - protein, 12 aa, Mycobacterium bovis
PGGGNFTATPAR

SEQ ID NO: 152807 - protein, 6 aa, Mycobacterium bovis
PGGKTA

SEQ ID NO: 152808 - protein, 10 aa, Mycobacterium bovis
PGGLTMPSED

SEQ ID NO: 152809 - protein, 5 aa, Mycobacterium bovis
PGGSR

SEQ ID NO: 152810 - protein, 4 aa, Mycobacterium bovis
PGGV

SEQ ID NO: 152811 - protein, 8 aa, Mycobacterium bovis
PGGVDSPE

SEQ ID NO: 152812 - protein, 8 aa, Mycobacterium bovis
PGGVGPGG

SEQ ID NO: 152813 - protein, 4 aa, Mycobacterium bovis
PGHD

SEQ ID NO: 152814 - protein, 6 aa, Mycobacterium bovis
PGHRPA

SEQ ID NO: 152815 - protein, 15 aa, Mycobacterium bovis
PGHTATPAGSISTPV

SEQ ID NO: 152816 - protein, 12 aa, Mycobacterium bovis
PGIGTKQPRDVP

SEQ ID NO: 152817 - protein, 8 aa, Mycobacterium bovis
PGITPFDT

SEQ ID NO: 152818 - protein, 9 aa, Mycobacterium bovis
PGKEDDEPI

SEQ ID NO: 152819 - protein, 8 aa, Mycobacterium bovis
PGKQFEAG

SEQ ID NO: 152820 - protein, 14 aa, Mycobacterium bovis
PGKRAATPRECRSN

SEQ ID NO: 152821 - protein, 7 aa, Mycobacterium bovis
PGKRAPT

SEQ ID NO: 152822 - protein, 4 aa, Mycobacterium bovis
PGKY

SEQ ID NO: 152823 - protein, 4 aa, Mycobacterium bovis
PGLA

SEQ ID NO: 152824 - protein, 16 aa, Mycobacterium bovis
PGLAGPDSRVSTFSAA

SEQ ID NO: 152825 - protein, 8 aa, Mycobacterium bovis
PGLGGNRP

SEQ ID NO: 152826 - protein, 4 aa, Mycobacterium bovis
PGLP

SEQ ID NO: 152827 - protein, 8 aa, Mycobacterium bovis
PGLPGLPS

SEQ ID NO: 152828 - protein, 9 aa, Mycobacterium bovis
PGLTQGKPF

SEQ ID NO: 152829 - protein, 4 aa, Mycobacterium bovis
PGMA

SEQ ID NO: 152830 - protein, 4 aa, Mycobacterium bovis
PGMD

SEQ ID NO: 152831 - protein, 13 aa, Mycobacterium bovis
PGNDGSEARNLGQ

SEQ ID NO: 152832 - protein, 8 aa, Mycobacterium bovis
PGNEQAAA

SEQ ID NO: 152833 - protein, 6 aa, Mycobacterium bovis
PGNGTG

SEQ ID NO: 152834 - protein, 10 aa, Mycobacterium bovis
PGNVAKGAAN

SEQ ID NO: 152835 - protein, 10 aa, Mycobacterium bovis
PGPDGRPTTS

SEQ ID NO: 152836 - protein, 5 aa, Mycobacterium bovis
PGPGA

SEQ ID NO: 152837 - protein, 14 aa, Mycobacterium bovis
PGPLPQPDVGTTDD

SEQ ID NO: 152838 - protein, 9 aa, Mycobacterium bovis
PGPPPGSAI

SEQ ID NO: 152839 - protein, 22 aa, Mycobacterium bovis
PGPVPPTPAPVGAPLPAEAGGG

SEQ ID NO: 152840 - protein, 14 aa, Mycobacterium bovis
PGQAFGPDGPLGGI

SEQ ID NO: 152841 - protein, 9 aa, Mycobacterium bovis
PGQGSERRT

SEQ ID NO: 152842 - protein, 6 aa, Mycobacterium bovis
PGRDLA

SEQ ID NO: 152843 - protein, 12 aa, Mycobacterium bovis
PGRGVSGTVSGR

SEQ ID NO: 152844 - protein, 11 aa, Mycobacterium bovis
PGRPRENPEWT

SEQ ID NO: 152845 - protein, 7 aa, Mycobacterium bovis
PGRRFRE

SEQ ID NO: 152846 - protein, 6 aa, Mycobacterium bovis
PGSDPF

SEQ ID NO: 152847 - protein, 8 aa, Mycobacterium bovis
PGSPPAGA

SEQ ID NO: 152848 - protein, 9 aa, Mycobacterium bovis
PGSSTIANQ

SEQ ID NO: 152849 - protein, 4 aa, Mycobacterium bovis
PGTA

SEQ ID NO: 152850 - protein, 17 aa, Mycobacterium bovis
PGTATRVGAGGGEETVN

SEQ ID NO: 152851 - protein, 4 aa, Mycobacterium bovis
PGTG

SEQ ID NO: 152852 - protein, 10 aa, Mycobacterium bovis
PGTGPADRHD

SEQ ID NO: 152853 - protein, 5 aa, Mycobacterium bovis
PGTGR

SEQ ID NO: 152854 - protein, 9 aa, Mycobacterium bovis
PGTRSANRE

SEQ ID NO: 152855 - protein, 6 aa, Mycobacterium bovis
PGTTTA

SEQ ID NO: 152856 - protein, 4 aa, Mycobacterium bovis
PGTV

SEQ ID NO: 152857 - protein, 10 aa, Mycobacterium bovis
PGVGGLGQPH

SEQ ID NO: 152858 - protein, 9 aa, Mycobacterium bovis
PGVSEGQVD

SEQ ID NO: 152859 - protein, 20 aa, Mycobacterium bovis
PGWEPRTIDKSNAAASLVTS

SEQ ID NO: 152860 - protein, 13 aa, Mycobacterium bovis
PGYPPEPPQVPYP

SEQ ID NO: 152861 - protein, 13 aa, Mycobacterium bovis
PHAAPGDTRRGIF

SEQ ID NO: 152862 - protein, 11 aa, Mycobacterium bovis
PHAGPAEPSIG

SEQ ID NO: 152863 - protein, 13 aa, Mycobacterium bovis
PHAGRRRGGGSGA

SEQ ID NO: 152864 - protein, 7 aa, Mycobacterium bovis
PHGSGAA

SEQ ID NO: 152865 - protein, 30 aa, Mycobacterium bovis
PHLPPAAPPAPEPGRPGPLPPASPNPEQPG

SEQ ID NO: 152866 - protein, 19 aa, Mycobacterium bovis
PHNDTGTAKHGAHKPTPRI

SEQ ID NO: 152867 - protein, 7 aa, Mycobacterium bovis
PHNSNSL

SEQ ID NO: 152868 - protein, 4 aa, Mycobacterium bovis
PHPE

SEQ ID NO: 152869 - protein, 7 aa, Mycobacterium bovis
PHPSTLA

SEQ ID NO: 152870 - protein, 8 aa, Mycobacterium bovis
PHQSGGGA

SEQ ID NO: 152871 - protein, 5 aa, Mycobacterium bovis
PHRPR

SEQ ID NO: 152872 - protein, 4 aa, Mycobacterium bovis
PHTG

SEQ ID NO: 152873 - protein, 51 aa, Mycobacterium bovis
PHTSKLATGDTTSSAPPVQDEITTTKPAPPPPPPAPPPTTEIPTATETQTV

SEQ ID NO: 152874 - protein, 9 aa, Mycobacterium bovis
PIAEGNERI

SEQ ID NO: 152875 - protein, 15 aa, Mycobacterium bovis
PIAGETFASDKGSPL

SEQ ID NO: 152876 - protein, 10 aa, Mycobacterium bovis
PIGDATSRAT

SEQ ID NO: 152877 - protein, 11 aa, Mycobacterium bovis
PISQSDVGSVE

SEQ ID NO: 152878 - protein, 6 aa, Mycobacterium bovis
PKAKRV

SEQ ID NO: 152879 - protein, 5 aa, Mycobacterium bovis
PKERV

SEQ ID NO: 152880 - protein, 4 aa, Mycobacterium bovis
PKET

SEQ ID NO: 152881 - protein, 11 aa, Mycobacterium bovis
PKGPAEPPKQL

SEQ ID NO: 152882 - protein, 8 aa, Mycobacterium bovis
PKLADDSL

SEQ ID NO: 152883 - protein, 9 aa, Mycobacterium bovis
PKPGDIRTN

SEQ ID NO: 152884 - protein, 15 aa, Mycobacterium bovis
PKPGTGPSAAARERG

SEQ ID NO: 152885 - protein, 5 aa, Mycobacterium bovis
PKPVT

SEQ ID NO: 152886 - protein, 9 aa, Mycobacterium bovis
PKQAPKAVD

SEQ ID NO: 152887 - protein, 22 aa, Mycobacterium bovis
PKQRGGYAQFGTGTAQQGFPAD

SEQ ID NO: 152888 - protein, 15 aa, Mycobacterium bovis
PKRMPPSRKARRQRH

SEQ ID NO: 152889 - protein, 6 aa, Mycobacterium bovis
PKTPEF

SEQ ID NO: 152890 - protein, 19 aa, Mycobacterium bovis
PLAATDRRVRARRDRKRQW

SEQ ID NO: 152891 - protein, 6 aa, Mycobacterium bovis
PLADRS

SEQ ID NO: 152892 - protein, 13 aa, Mycobacterium bovis
PLAGPEGLVPGTA

SEQ ID NO: 152893 - protein, 9 aa, Mycobacterium bovis
PLASTTTDL

SEQ ID NO: 152894 - protein, 6 aa, Mycobacterium bovis
PLATEL

SEQ ID NO: 152895 - protein, 4 aa, Mycobacterium bovis
PLDP

SEQ ID NO: 152896 - protein, 9 aa, Mycobacterium bovis
PLDPSDPRD

SEQ ID NO: 152897 - protein, 5 aa, Mycobacterium bovis
PLGED

SEQ ID NO: 152898 - protein, 24 aa, Mycobacterium bovis
PLGEQPEPERSRVPPRTTRAGERI

SEQ ID NO: 152899 - protein, 13 aa, Mycobacterium bovis
PLGSRSPAEPAHP

SEQ ID NO: 152900 - protein, 5 aa, Mycobacterium bovis
PLHTP

SEQ ID NO: 152901 - protein, 4 aa, Mycobacterium bovis
PLND

SEQ ID NO: 152902 - protein, 13 aa, Mycobacterium bovis
PLPGTTQQIAGTG

SEQ ID NO: 152903 - protein, 7 aa, Mycobacterium bovis
PLPLEND

SEQ ID NO: 152904 - protein, 14 aa, Mycobacterium bovis
PLRATQSLTEQDVY

SEQ ID NO: 152905 - protein, 7 aa, Mycobacterium bovis
PLTPPQT

SEQ ID NO: 152906 - protein, 6 aa, Mycobacterium bovis
PLTPPR

SEQ ID NO: 152907 - protein, 13 aa, Mycobacterium bovis
PLTRPHRSKRGVA

SEQ ID NO: 152908 - protein, 4 aa, Mycobacterium bovis
PLTT

SEQ ID NO: 152909 - protein, 4 aa, Mycobacterium bovis
PLWG

SEQ ID NO: 152910 - protein, 4 aa, Mycobacterium bovis
PMDE

SEQ ID NO: 152911 - protein, 8 aa, Mycobacterium bovis
PMKTTGTT

SEQ ID NO: 152912 - protein, 4 aa, Mycobacterium bovis
PMPP

SEQ ID NO: 152913 - protein, 46 aa, Mycobacterium bovis
PMPPGSVVPSSRAPTPPPPPSTVAPLPSAAPAPTTVAPAPPPPTQV

SEQ ID NO: 152914 - protein, 7 aa, Mycobacterium bovis
PNAAPRT

SEQ ID NO: 152915 - protein, 16 aa, Mycobacterium bovis
PNAGGPATFPGAPGPI

SEQ ID NO: 152916 - protein, 7 aa, Mycobacterium bovis
PNAPPID

SEQ ID NO: 152917 - protein, 4 aa, Mycobacterium bovis
PNGK

SEQ ID NO: 152918 - protein, 26 aa, Mycobacterium bovis
PNGPRRPGPPGQPRRVRQGGTAITPP

SEQ ID NO: 152919 - protein, 9 aa, Mycobacterium bovis
PNGQAGSNA

SEQ ID NO: 152920 - protein, 12 aa, Mycobacterium bovis
PNGQGGELQPAT

SEQ ID NO: 152921 - protein, 4 aa, Mycobacterium bovis
PNLR

SEQ ID NO: 152922 - protein, 5 aa, Mycobacterium bovis
PNLSP

SEQ ID NO: 152923 - protein, 7 aa, Mycobacterium bovis
PNNERAY

SEQ ID NO: 152924 - protein, 8 aa, Mycobacterium bovis
PNPPTVAQ

SEQ ID NO: 152925 - protein, 4 aa, Mycobacterium bovis
PNPR

SEQ ID NO: 152926 - protein, 8 aa, Mycobacterium bovis
PNQPGTDY

SEQ ID NO: 152927 - protein, 5 aa, Mycobacterium bovis
PNTDR

SEQ ID NO: 152928 - protein, 9 aa, Mycobacterium bovis
PPAGAQPPF

SEQ ID NO: 152929 - protein, 4 aa, Mycobacterium bovis
PPAH

SEQ ID NO: 152930 - protein, 7 aa, Mycobacterium bovis
PPAHGGR

SEQ ID NO: 152931 - protein, 7 aa, Mycobacterium bovis
PPASDTN

SEQ ID NO: 152932 - protein, 8 aa, Mycobacterium bovis
PPASTPLA

SEQ ID NO: 152933 - protein, 4 aa, Mycobacterium bovis
PPDA

SEQ ID NO: 152934 - protein, 4 aa, Mycobacterium bovis
PPDV

SEQ ID NO: 152935 - protein, 5 aa, Mycobacterium bovis
PPEAD

SEQ ID NO: 152936 - protein, 5 aa, Mycobacterium bovis
PPEHT

SEQ ID NO: 152937 - protein, 11 aa, Mycobacterium bovis
PPENPSSTKLR

SEQ ID NO: 152938 - protein, 4 aa, Mycobacterium bovis
PPEV

SEQ ID NO: 152939 - protein, 35 aa, Mycobacterium bovis
PPFGPGTTTPTPPAPLPQPGPGPTAGTYPKSEPPT

SEQ ID NO: 152940 - protein, 4 aa, Mycobacterium bovis
PPGA

SEQ ID NO: 152941 - protein, 4 aa, Mycobacterium bovis
PPGF

SEQ ID NO: 152942 - protein, 7 aa, Mycobacterium bovis
PPGPAAV

SEQ ID NO: 152943 - protein, 10 aa, Mycobacterium bovis
PPGPASAPYN

SEQ ID NO: 152944 - protein, 5 aa, Mycobacterium bovis
PPGQP

SEQ ID NO: 152945 - protein, 5 aa, Mycobacterium bovis
PPGRS

SEQ ID NO: 152946 - protein, 7 aa, Mycobacterium bovis
PPGSELT

SEQ ID NO: 152947 - protein, 4 aa, Mycobacterium bovis
PPGV

SEQ ID NO: 152948 - protein, 18 aa, Mycobacterium bovis
PPHTPHPPEPHPPIPTTP

SEQ ID NO: 152949 - protein, 5 aa, Mycobacterium bovis
PPLDE

SEQ ID NO: 152950 - protein, 4 aa, Mycobacterium bovis
PPLP

SEQ ID NO: 152951 - protein, 5 aa, Mycobacterium bovis
PPLTS

SEQ ID NO: 152952 - protein, 6 aa, Mycobacterium bovis
PPNGTH

SEQ ID NO: 152953 - protein, 4 aa, Mycobacterium bovis
PPPA

SEQ ID NO: 152954 - protein, 10 aa, Mycobacterium bovis
PPPGAGAPPW

SEQ ID NO: 152955 - protein, 5 aa, Mycobacterium bovis
PPPNA

SEQ ID NO: 152956 - protein, 68 aa, Mycobacterium bovis
PPPPPPPGPSGGHEPPPAAPPGGSGYAPPPPPSSGSGYPPPPPPPGGGAYPPPPPSAGGYAPPPPGPA

SEQ ID NO: 152957 - protein, 9 aa, Mycobacterium bovis
PPPPPPQPA

SEQ ID NO: 152958 - protein, 5 aa, Mycobacterium bovis
PPQDN

SEQ ID NO: 152959 - protein, 11 aa, Mycobacterium bovis
PPRFADDNGSA

SEQ ID NO: 152960 - protein, 7 aa, Mycobacterium bovis
PPRSPDR

SEQ ID NO: 152961 - protein, 18 aa, Mycobacterium bovis
PPRSRGVPALTDAAANQA

SEQ ID NO: 152962 - protein, 13 aa, Mycobacterium bovis
PPRVAAEPPSPGS

SEQ ID NO: 152963 - protein, 5 aa, Mycobacterium bovis
PPRVP

SEQ ID NO: 152964 - protein, 10 aa, Mycobacterium bovis
PPSHAGRATT

SEQ ID NO: 152965 - protein, 8 aa, Mycobacterium bovis
PPTPGSPL

SEQ ID NO: 152966 - protein, 13 aa, Mycobacterium bovis
PPVVEPGPDRRPI

SEQ ID NO: 152967 - protein, 15 aa, Mycobacterium bovis
PPYDAASSGVGNSGY

SEQ ID NO: 152968 - protein, 9 aa, Mycobacterium bovis
PQDFDTPTE

SEQ ID NO: 152969 - protein, 7 aa, Mycobacterium bovis
PQEDGPK

SEQ ID NO: 152970 - protein, 81 aa, Mycobacterium bovis
PQEMPQQTGVGPRGAAPGRPVAPGGPAELPPRRAQPDPATTVLPDPARRAPEPIRRDEGRSEGVRRPPPAGRNGQQATNYQ

SEQ ID NO: 152971 - protein, 10 aa, Mycobacterium bovis
PQGGAHDERT

SEQ ID NO: 152972 - protein, 15 aa, Mycobacterium bovis
PQNAEKARDLLARLA

SEQ ID NO: 152973 - protein, 5 aa, Mycobacterium bovis
PQNGT

SEQ ID NO: 152974 - protein, 4 aa, Mycobacterium bovis
PQPA

SEQ ID NO: 152975 - protein, 6 aa, Mycobacterium bovis
PQPAAS

SEQ ID NO: 152976 - protein, 6 aa, Mycobacterium bovis
PQPGKH

SEQ ID NO: 152977 - protein, 8 aa, Mycobacterium bovis
PQPPAPRD

SEQ ID NO: 152978 - protein, 17 aa, Mycobacterium bovis
PQPPHTPALSRPAGSPR

SEQ ID NO: 152979 - protein, 5 aa, Mycobacterium bovis
PQPPT

SEQ ID NO: 152980 - protein, 11 aa, Mycobacterium bovis
PQQDSSAPDAQ

SEQ ID NO: 152981 - protein, 4 aa, Mycobacterium bovis
PQRR

SEQ ID NO: 152982 - protein, 8 aa, Mycobacterium bovis
PQSPPATG

SEQ ID NO: 152983 - protein, 10 aa, Mycobacterium bovis
PQTPNGSINP

SEQ ID NO: 152984 - protein, 19 aa, Mycobacterium bovis
PQTVPDATHPGAEQVTHPG

SEQ ID NO: 152985 - protein, 8 aa, Mycobacterium bovis
PQWGPPAG

SEQ ID NO: 152986 - protein, 9 aa, Mycobacterium bovis
PRAEPGLGT

SEQ ID NO: 152987 - protein, 8 aa, Mycobacterium bovis
PRAGQDAL

SEQ ID NO: 152988 - protein, 6 aa, Mycobacterium bovis
PRAPGP

SEQ ID NO: 152989 - protein, 10 aa, Mycobacterium bovis
PRDDHATPAE

SEQ ID NO: 152990 - protein, 6 aa, Mycobacterium bovis
PRDGNV

SEQ ID NO: 152991 - protein, 4 aa, Mycobacterium bovis
PRDL

SEQ ID NO: 152992 - protein, 4 aa, Mycobacterium bovis
PRDR

SEQ ID NO: 152993 - protein, 4 aa, Mycobacterium bovis
PRDV

SEQ ID NO: 152994 - protein, 22 aa, Mycobacterium bovis
PREQVSQPATAASDYSAGGAES

SEQ ID NO: 152995 - protein, 22 aa, Mycobacterium bovis
PRGAGAAVGDAEHLPGEEGYGS

SEQ ID NO: 152996 - protein, 7 aa, Mycobacterium bovis
PRGAKGM

SEQ ID NO: 152997 - protein, 4 aa, Mycobacterium bovis
PRGE

SEQ ID NO: 152998 - protein, 7 aa, Mycobacterium bovis
PRGWPEA

SEQ ID NO: 152999 - protein, 5 aa, Mycobacterium bovis
PRKSI

SEQ ID NO: 153000 - protein, 4 aa, Mycobacterium bovis
PRKT

SEQ ID NO: 153001 - protein, 12 aa, Mycobacterium bovis
PRLAPGAPGGTV

SEQ ID NO: 153002 - protein, 13 aa, Mycobacterium bovis
PRLPNVDAGGDFV

SEQ ID NO: 153003 - protein, 28 aa, Mycobacterium bovis
PRLPPALNPDDADALPTTDRLTTRANRA

SEQ ID NO: 153004 - protein, 5 aa, Mycobacterium bovis
PRNEL

SEQ ID NO: 153005 - protein, 7 aa, Mycobacterium bovis
PRNPTGK

SEQ ID NO: 153006 - protein, 15 aa, Mycobacterium bovis
PRNPTGKVLKRELRK

SEQ ID NO: 153007 - protein, 13 aa, Mycobacterium bovis
PRNRRSRVNPDAT

SEQ ID NO: 153008 - protein, 12 aa, Mycobacterium bovis
PRPARSTQPVQR

SEQ ID NO: 153009 - protein, 5 aa, Mycobacterium bovis
PRPAS

SEQ ID NO: 153010 - protein, 7 aa, Mycobacterium bovis
PRPESYE

SEQ ID NO: 153011 - protein, 23 aa, Mycobacterium bovis
PRPGTSPGVGGTPASPAPEAPAV

SEQ ID NO: 153012 - protein, 8 aa, Mycobacterium bovis
PRQQDEGD

SEQ ID NO: 153013 - protein, 12 aa, Mycobacterium bovis
PRRSTPGPSDRR

SEQ ID NO: 153014 - protein, 7 aa, Mycobacterium bovis
PRSASVR

SEQ ID NO: 153015 - protein, 5 aa, Mycobacterium bovis
PRSAT

SEQ ID NO: 153016 - protein, 6 aa, Mycobacterium bovis
PRSGGL

SEQ ID NO: 153017 - protein, 16 aa, Mycobacterium bovis
PRSTQAEAAREAPASM

SEQ ID NO: 153018 - protein, 4 aa, Mycobacterium bovis
PRSV

SEQ ID NO: 153019 - protein, 7 aa, Mycobacterium bovis
PRTKNSA

SEQ ID NO: 153020 - protein, 7 aa, Mycobacterium bovis
PRTLGRQ

SEQ ID NO: 153021 - protein, 7 aa, Mycobacterium bovis
PRTPENA

SEQ ID NO: 153022 - protein, 5 aa, Mycobacterium bovis
PRVQA

SEQ ID NO: 153023 - protein, 8 aa, Mycobacterium bovis
PSAATAAK

SEQ ID NO: 153024 - protein, 20 aa, Mycobacterium bovis
PSAATTSPPPSPQQEKPPRL

SEQ ID NO: 153025 - protein, 4 aa, Mycobacterium bovis
PSAH

SEQ ID NO: 153026 - protein, 4 aa, Mycobacterium bovis
PSAP

SEQ ID NO: 153027 - protein, 14 aa, Mycobacterium bovis
PSAPVAPRVTTEPV

SEQ ID NO: 153028 - protein, 53 aa, Mycobacterium bovis
PSDASTPPAKKLPAKKAAKKAPARKTPAKKAPAKKTPAKGAKSAPPKPAEAPV

SEQ ID NO: 153029 - protein, 14 aa, Mycobacterium bovis
PSDPTNDANATQPP

SEQ ID NO: 153030 - protein, 6 aa, Mycobacterium bovis
PSGFDV

SEQ ID NO: 153031 - protein, 7 aa, Mycobacterium bovis
PSGHRQV

SEQ ID NO: 153032 - protein, 21 aa, Mycobacterium bovis
PSGPELSRANASVARDTVAPG

SEQ ID NO: 153033 - protein, 8 aa, Mycobacterium bovis
PSGQATSF

SEQ ID NO: 153034 - protein, 8 aa, Mycobacterium bovis
PSGQLNES

SEQ ID NO: 153035 - protein, 10 aa, Mycobacterium bovis
PSGSGPTAIQ

SEQ ID NO: 153036 - protein, 9 aa, Mycobacterium bovis
PSGVAVDSA

SEQ ID NO: 153037 - protein, 23 aa, Mycobacterium bovis
PSIADQVKESADSYNASAGPVGD

SEQ ID NO: 153038 - protein, 4 aa, Mycobacterium bovis
PSLA

SEQ ID NO: 153039 - protein, 13 aa, Mycobacterium bovis
PSNNATFNKTMSE

SEQ ID NO: 153040 - protein, 4 aa, Mycobacterium bovis
PSPL

SEQ ID NO: 153041 - protein, 7 aa, Mycobacterium bovis
PSPLPDE

SEQ ID NO: 153042 - protein, 7 aa, Mycobacterium bovis
PSQRSAT

SEQ ID NO: 153043 - protein, 7 aa, Mycobacterium bovis
PSRQAKE

SEQ ID NO: 153044 - protein, 16 aa, Mycobacterium bovis
PSSGTAPGGKPAPKPQ

SEQ ID NO: 153045 - protein, 6 aa, Mycobacterium bovis
PSSSSH

SEQ ID NO: 153046 - protein, 21 aa, Mycobacterium bovis
PSSTAAERDPLPQTTDAPSAE

SEQ ID NO: 153047 - protein, 14 aa, Mycobacterium bovis
PSTLDPAVDPEGAH

SEQ ID NO: 153048 - protein, 5 aa, Mycobacterium bovis
PSVAR

SEQ ID NO: 153049 - protein, 4 aa, Mycobacterium bovis
PSVV

SEQ ID NO: 153050 - protein, 5 aa, Mycobacterium bovis
PTADK

SEQ ID NO: 153051 - protein, 7 aa, Mycobacterium bovis
PTADPTA

SEQ ID NO: 153052 - protein, 6 aa, Mycobacterium bovis
PTANGD

SEQ ID NO: 153053 - protein, 9 aa, Mycobacterium bovis
PTARPQEPL

SEQ ID NO: 153054 - protein, 4 aa, Mycobacterium bovis
PTDG

SEQ ID NO: 153055 - protein, 6 aa, Mycobacterium bovis
PTEQLD

SEQ ID NO: 153056 - protein, 5 aa, Mycobacterium bovis
PTFDG

SEQ ID NO: 153057 - protein, 6 aa, Mycobacterium bovis
PTGSGL

SEQ ID NO: 153058 - protein, 5 aa, Mycobacterium bovis
PTLSR

SEQ ID NO: 153059 - protein, 4 aa, Mycobacterium bovis
PTLV

SEQ ID NO: 153060 - protein, 6 aa, Mycobacterium bovis
PTMYGG

SEQ ID NO: 153061 - protein, 9 aa, Mycobacterium bovis
PTNEQRDRA

SEQ ID NO: 153062 - protein, 4 aa, Mycobacterium bovis
PTPA

SEQ ID NO: 153063 - protein, 7 aa, Mycobacterium bovis
PTPACPQ

SEQ ID NO: 153064 - protein, 14 aa, Mycobacterium bovis
PTPGSATTPMGRGP

SEQ ID NO: 153065 - protein, 15 aa, Mycobacterium bovis
PTPHSRASLARYEIA

SEQ ID NO: 153066 - protein, 4 aa, Mycobacterium bovis
PTPL

SEQ ID NO: 153067 - protein, 6 aa, Mycobacterium bovis
PTPSLD

SEQ ID NO: 153068 - protein, 28 aa, Mycobacterium bovis
PTPSVSRAVPTPTAQPATTLPPAGASLS

SEQ ID NO: 153069 - protein, 15 aa, Mycobacterium bovis
PTPVGEGGHRGSTGF

SEQ ID NO: 153070 - protein, 8 aa, Mycobacterium bovis
PTPVGGNA

SEQ ID NO: 153071 - protein, 5 aa, Mycobacterium bovis
PTSAV

SEQ ID NO: 153072 - protein, 8 aa, Mycobacterium bovis
PTSGLDPA

SEQ ID NO: 153073 - protein, 7 aa, Mycobacterium bovis
PTSPAQR

SEQ ID NO: 153074 - protein, 5 aa, Mycobacterium bovis
PTSWE

SEQ ID NO: 153075 - protein, 12 aa, Mycobacterium bovis
PTTGAVSDIEQA

SEQ ID NO: 153076 - protein, 8 aa, Mycobacterium bovis
PTTLPGSG

SEQ ID NO: 153077 - protein, 11 aa, Mycobacterium bovis
PTTNREATKNA

SEQ ID NO: 153078 - protein, 6 aa, Mycobacterium bovis
PTTVRG

SEQ ID NO: 153079 - protein, 6 aa, Mycobacterium bovis
PTWSRP

SEQ ID NO: 153080 - protein, 6 aa, Mycobacterium bovis
PTYSNG

SEQ ID NO: 153081 - protein, 21 aa, Mycobacterium bovis
PVAEPTTAGATAWRTGPNSTP

SEQ ID NO: 153082 - protein, 18 aa, Mycobacterium bovis
PVDPASRQAFGRPSGVQG

SEQ ID NO: 153083 - protein, 8 aa, Mycobacterium bovis
PVENDSST

SEQ ID NO: 153084 - protein, 8 aa, Mycobacterium bovis
PVGAATSS

SEQ ID NO: 153085 - protein, 12 aa, Mycobacterium bovis
PVGDETYDGEVT

SEQ ID NO: 153086 - protein, 9 aa, Mycobacterium bovis
PVGGEQSKR

SEQ ID NO: 153087 - protein, 6 aa, Mycobacterium bovis
PVGGPT

SEQ ID NO: 153088 - protein, 7 aa, Mycobacterium bovis
PVKPGRG

SEQ ID NO: 153089 - protein, 5 aa, Mycobacterium bovis
PVNEA

SEQ ID NO: 153090 - protein, 4 aa, Mycobacterium bovis
PVNQ

SEQ ID NO: 153091 - protein, 6 aa, Mycobacterium bovis
PVPPQT

SEQ ID NO: 153092 - protein, 39 aa, Mycobacterium bovis
PVPSTHPVSPGTRWPQPTPWAGGAPPWGPPSSPLPRSAR

SEQ ID NO: 153093 - protein, 15 aa, Mycobacterium bovis
PVRGEPARKSLQCRP

SEQ ID NO: 153094 - protein, 5 aa, Mycobacterium bovis
PVRRP

SEQ ID NO: 153095 - protein, 7 aa, Mycobacterium bovis
PVSGANN

SEQ ID NO: 153096 - protein, 16 aa, Mycobacterium bovis
PVSGAPVASGASGNLK

SEQ ID NO: 153097 - protein, 22 aa, Mycobacterium bovis
PVSVRPNRHRRTRVSRAQRRHA

SEQ ID NO: 153098 - protein, 4 aa, Mycobacterium bovis
PVVP

SEQ ID NO: 153099 - protein, 19 aa, Mycobacterium bovis
PWQPPGQGADHSSDPTVAA

SEQ ID NO: 153100 - protein, 18 aa, Mycobacterium bovis
PYAQRSSLEGPVTSPTGI

SEQ ID NO: 153101 - protein, 11 aa, Mycobacterium bovis
PYPARTGPKGS

SEQ ID NO: 153102 - protein, 10 aa, Mycobacterium bovis
QAAEEGGESS

SEQ ID NO: 153103 - protein, 8 aa, Mycobacterium bovis
QAAHDSTA

SEQ ID NO: 153104 - protein, 7 aa, Mycobacterium bovis
QAANGSL

SEQ ID NO: 153105 - protein, 8 aa, Mycobacterium bovis
QAAPSRGR

SEQ ID NO: 153106 - protein, 8 aa, Mycobacterium bovis
QAAPTADE

SEQ ID NO: 153107 - protein, 4 aa, Mycobacterium bovis
QAAY

SEQ ID NO: 153108 - protein, 9 aa, Mycobacterium bovis
QADGRGPAL

SEQ ID NO: 153109 - protein, 8 aa, Mycobacterium bovis
QADPATAD

SEQ ID NO: 153110 - protein, 5 aa, Mycobacterium bovis
QADPD

SEQ ID NO: 153111 - protein, 4 aa, Mycobacterium bovis
QAEG

SEQ ID NO: 153112 - protein, 6 aa, Mycobacterium bovis
QAEHPG

SEQ ID NO: 153113 - protein, 12 aa, Mycobacterium bovis
QAERSSDPERRA

SEQ ID NO: 153114 - protein, 11 aa, Mycobacterium bovis
QAFSPANLPTT

SEQ ID NO: 153115 - protein, 5 aa, Mycobacterium bovis
QAGGA

SEQ ID NO: 153116 - protein, 8 aa, Mycobacterium bovis
QAGNGLSD

SEQ ID NO: 153117 - protein, 6 aa, Mycobacterium bovis
QAHTDD

SEQ ID NO: 153118 - protein, 5 aa, Mycobacterium bovis
QAIPG

SEQ ID NO: 153119 - protein, 7 aa, Mycobacterium bovis
QAKADEL

SEQ ID NO: 153120 - protein, 10 aa, Mycobacterium bovis
QALAARPGVQ

SEQ ID NO: 153121 - protein, 5 aa, Mycobacterium bovis
QALAP

SEQ ID NO: 153122 - protein, 8 aa, Mycobacterium bovis
QAPNRAGT

SEQ ID NO: 153123 - protein, 7 aa, Mycobacterium bovis
QAPRSRG

SEQ ID NO: 153124 - protein, 20 aa, Mycobacterium bovis
QAQGALAAAEQAEHAEQEAA

SEQ ID NO: 153125 - protein, 11 aa, Mycobacterium bovis
QAQGDKAPVQR

SEQ ID NO: 153126 - protein, 11 aa, Mycobacterium bovis
QAQQPQTGRTG

SEQ ID NO: 153127 - protein, 5 aa, Mycobacterium bovis
QARAG

SEQ ID NO: 153128 - protein, 13 aa, Mycobacterium bovis
QARYTDPNTRSFT

SEQ ID NO: 153129 - protein, 16 aa, Mycobacterium bovis
QASGNTDQAALESAQA

SEQ ID NO: 153130 - protein, 9 aa, Mycobacterium bovis
QASQTKART

SEQ ID NO: 153131 - protein, 12 aa, Mycobacterium bovis
QASSGGSAHPVY

SEQ ID NO: 153132 - protein, 40 aa, Mycobacterium bovis
QASSQSAPRAAQGSSKPAPGARPVRPVGTRRPPGKRNAGR

SEQ ID NO: 153133 - protein, 46 aa, Mycobacterium bovis
QATQAAEAARSDAGQTGHGANGSPAGTHRSGDRQYGSTQPDYGAPA

SEQ ID NO: 153134 - protein, 13 aa, Mycobacterium bovis
QAVASARARGDNT

SEQ ID NO: 153135 - protein, 12 aa, Mycobacterium bovis
QAVDAASEEERA

SEQ ID NO: 153136 - protein, 5 aa, Mycobacterium bovis
QAVGR

SEQ ID NO: 153137 - protein, 11 aa, Mycobacterium bovis
QAVTDGSRRQD

SEQ ID NO: 153138 - protein, 4 aa, Mycobacterium bovis
QAYD

SEQ ID NO: 153139 - protein, 18 aa, Mycobacterium bovis
QCRSDTGLTVNGRPLKEP

SEQ ID NO: 153140 - protein, 10 aa, Mycobacterium bovis
QCTGPGPAAL

SEQ ID NO: 153141 - protein, 9 aa, Mycobacterium bovis
QDDGTQPAY

SEQ ID NO: 153142 - protein, 7 aa, Mycobacterium bovis
QDEKDPV

SEQ ID NO: 153143 - protein, 5 aa, Mycobacterium bovis
QDGAT

SEQ ID NO: 153144 - protein, 9 aa, Mycobacterium bovis
QDGDPGYKA

SEQ ID NO: 153145 - protein, 10 aa, Mycobacterium bovis
QDGGEQQGMP

SEQ ID NO: 153146 - protein, 7 aa, Mycobacterium bovis
QDGLPDD

SEQ ID NO: 153147 - protein, 5 aa, Mycobacterium bovis
QDHPD

SEQ ID NO: 153148 - protein, 4 aa, Mycobacterium bovis
QDLA

SEQ ID NO: 153149 - protein, 6 aa, Mycobacterium bovis
QDMRNP

SEQ ID NO: 153150 - protein, 12 aa, Mycobacterium bovis
QDNKGTYEVGRP

SEQ ID NO: 153151 - protein, 5 aa, Mycobacterium bovis
QDPTA

SEQ ID NO: 153152 - protein, 5 aa, Mycobacterium bovis
QDPYV

SEQ ID NO: 153153 - protein, 12 aa, Mycobacterium bovis
QDSAGRTGPLSA

SEQ ID NO: 153154 - protein, 9 aa, Mycobacterium bovis
QEANTQDFP

SEQ ID NO: 153155 - protein, 6 aa, Mycobacterium bovis
QEAPAQ

SEQ ID NO: 153156 - protein, 8 aa, Mycobacterium bovis
QEATAGLA

SEQ ID NO: 153157 - protein, 27 aa, Mycobacterium bovis
QEDAEDDSRPDAAEAAAAEPKSSAGPM

SEQ ID NO: 153158 - protein, 10 aa, Mycobacterium bovis
QEEEDRRRAA

SEQ ID NO: 153159 - protein, 5 aa, Mycobacterium bovis
QEGRG

SEQ ID NO: 153160 - protein, 9 aa, Mycobacterium bovis
QEQEQASTA

SEQ ID NO: 153161 - protein, 9 aa, Mycobacterium bovis
QEQTSAASA

SEQ ID NO: 153162 - protein, 22 aa, Mycobacterium bovis
QETDYPSVGPDRPEYEPRGCPR

SEQ ID NO: 153163 - protein, 14 aa, Mycobacterium bovis
QEVRPAPGQGLSPA

SEQ ID NO: 153164 - protein, 23 aa, Mycobacterium bovis
QFAEPDDAEYPTDDAAERAQREH

SEQ ID NO: 153165 - protein, 10 aa, Mycobacterium bovis
QFPGPGRTEH

SEQ ID NO: 153166 - protein, 6 aa, Mycobacterium bovis
QFSADE

SEQ ID NO: 153167 - protein, 5 aa, Mycobacterium bovis
QGAAR

SEQ ID NO: 153168 - protein, 10 aa, Mycobacterium bovis
QGADSDQAVK

SEQ ID NO: 153169 - protein, 6 aa, Mycobacterium bovis
QGAIQG

SEQ ID NO: 153170 - protein, 15 aa, Mycobacterium bovis
QGAPGATANALAAPQ

SEQ ID NO: 153171 - protein, 8 aa, Mycobacterium bovis
QGASTGET

SEQ ID NO: 153172 - protein, 4 aa, Mycobacterium bovis
QGAT

SEQ ID NO: 153173 - protein, 11 aa, Mycobacterium bovis
QGATSDGNDAA

SEQ ID NO: 153174 - protein, 9 aa, Mycobacterium bovis
QGDEPGWDD

SEQ ID NO: 153175 - protein, 8 aa, Mycobacterium bovis
QGDGSERV

SEQ ID NO: 153176 - protein, 7 aa, Mycobacterium bovis
QGDSNSI

SEQ ID NO: 153177 - protein, 6 aa, Mycobacterium bovis
QGFDGR

SEQ ID NO: 153178 - protein, 5 aa, Mycobacterium bovis
QGGGP

SEQ ID NO: 153179 - protein, 15 aa, Mycobacterium bovis
QGGTINDTLDQTAQL

SEQ ID NO: 153180 - protein, 5 aa, Mycobacterium bovis
QGGTT

SEQ ID NO: 153181 - protein, 6 aa, Mycobacterium bovis
QGIANN

SEQ ID NO: 153182 - protein, 7 aa, Mycobacterium bovis
QGKDGRH

SEQ ID NO: 153183 - protein, 8 aa, Mycobacterium bovis
QGKLGGTS

SEQ ID NO: 153184 - protein, 5 aa, Mycobacterium bovis
QGKSQ

SEQ ID NO: 153185 - protein, 7 aa, Mycobacterium bovis
QGPTLSR

SEQ ID NO: 153186 - protein, 6 aa, Mycobacterium bovis
QGQSAN

SEQ ID NO: 153187 - protein, 7 aa, Mycobacterium bovis
QGQSGST

SEQ ID NO: 153188 - protein, 8 aa, Mycobacterium bovis
QGREGPVP

SEQ ID NO: 153189 - protein, 10 aa, Mycobacterium bovis
QGRQSKSEHT

SEQ ID NO: 153190 - protein, 6 aa, Mycobacterium bovis
QGRRGV

SEQ ID NO: 153191 - protein, 5 aa, Mycobacterium bovis
QGTNT

SEQ ID NO: 153192 - protein, 31 aa, Mycobacterium bovis
QGTPCDDPVETTPQGPAPTPDLRPEGGETPP

SEQ ID NO: 153193 - protein, 12 aa, Mycobacterium bovis
QGVGSAIASPTG

SEQ ID NO: 153194 - protein, 17 aa, Mycobacterium bovis
QHAGETAFGSATNADEI

SEQ ID NO: 153195 - protein, 13 aa, Mycobacterium bovis
QHAGSEPGPAVAI

SEQ ID NO: 153196 - protein, 9 aa, Mycobacterium bovis
QHDPAPSVA

SEQ ID NO: 153197 - protein, 10 aa, Mycobacterium bovis
QHDPATVARA

SEQ ID NO: 153198 - protein, 14 aa, Mycobacterium bovis
QHEVDTAEVPSAAW

SEQ ID NO: 153199 - protein, 4 aa, Mycobacterium bovis
QHGI

SEQ ID NO: 153200 - protein, 35 aa, Mycobacterium bovis
QHPAATGANRAAYTTPRRTTSCGSPERALEPTTPR

SEQ ID NO: 153201 - protein, 7 aa, Mycobacterium bovis
QHPTGAG

SEQ ID NO: 153202 - protein, 14 aa, Mycobacterium bovis
QHQTRVASQRTTPE

SEQ ID NO: 153203 - protein, 4 aa, Mycobacterium bovis
QHRG

SEQ ID NO: 153204 - protein, 12 aa, Mycobacterium bovis
QHRHERSRATVG

SEQ ID NO: 153205 - protein, 4 aa, Mycobacterium bovis
QHSS

SEQ ID NO: 153206 - protein, 8 aa, Mycobacterium bovis
QHTPESAD

SEQ ID NO: 153207 - protein, 6 aa, Mycobacterium bovis
QIPPNQ

SEQ ID NO: 153208 - protein, 7 aa, Mycobacterium bovis
QISGPQQ

SEQ ID NO: 153209 - protein, 7 aa, Mycobacterium bovis
QKEKIPD

SEQ ID NO: 153210 - protein, 8 aa, Mycobacterium bovis
QKFSGGEV

SEQ ID NO: 153211 - protein, 19 aa, Mycobacterium bovis
QKLPDGQAERTESDGGTPL

SEQ ID NO: 153212 - protein, 8 aa, Mycobacterium bovis
QKRPQPGK

SEQ ID NO: 153213 - protein, 7 aa, Mycobacterium bovis
QLATRGP

SEQ ID NO: 153214 - protein, 9 aa, Mycobacterium bovis
QLDDTTDMK

SEQ ID NO: 153215 - protein, 5 aa, Mycobacterium bovis
QLGAE

SEQ ID NO: 153216 - protein, 7 aa, Mycobacterium bovis
QLGDNTA

SEQ ID NO: 153217 - protein, 13 aa, Mycobacterium bovis
QLGDSSEPRVSKT

SEQ ID NO: 153218 - protein, 8 aa, Mycobacterium bovis
QLGQQAGS

SEQ ID NO: 153219 - protein, 26 aa, Mycobacterium bovis
QLHGGTASLENSPLGGARLVLRLPGP

SEQ ID NO: 153220 - protein, 7 aa, Mycobacterium bovis
QLKPAPR

SEQ ID NO: 153221 - protein, 10 aa, Mycobacterium bovis
QLNQQRAQTS

SEQ ID NO: 153222 - protein, 8 aa, Mycobacterium bovis
QLPETPAY

SEQ ID NO: 153223 - protein, 26 aa, Mycobacterium bovis
QLPPATTRIPAAPPSGPQPRYPTGGQ

SEQ ID NO: 153224 - protein, 8 aa, Mycobacterium bovis
QLPPGFDS

SEQ ID NO: 153225 - protein, 11 aa, Mycobacterium bovis
QLSGGNSYNAA

SEQ ID NO: 153226 - protein, 8 aa, Mycobacterium bovis
QLSPSARF

SEQ ID NO: 153227 - protein, 25 aa, Mycobacterium bovis
QLSTPGAGLSSATVTSAETGAWGPT

SEQ ID NO: 153228 - protein, 10 aa, Mycobacterium bovis
QNAAPPSPAR

SEQ ID NO: 153229 - protein, 7 aa, Mycobacterium bovis
QNEVSEQ

SEQ ID NO: 153230 - protein, 16 aa, Mycobacterium bovis
QNPAPDPSTPGDPRGW

SEQ ID NO: 153231 - protein, 10 aa, Mycobacterium bovis
QNPDEPGRST

SEQ ID NO: 153232 - protein, 11 aa, Mycobacterium bovis
QNRTKEALASA

SEQ ID NO: 153233 - protein, 9 aa, Mycobacterium bovis
QNTSTAGVG

SEQ ID NO: 153234 - protein, 8 aa, Mycobacterium bovis
QNTSTDAN

SEQ ID NO: 153235 - protein, 4 aa, Mycobacterium bovis
QNTT

SEQ ID NO: 153236 - protein, 12 aa, Mycobacterium bovis
QPAGPATEATER

SEQ ID NO: 153237 - protein, 5 aa, Mycobacterium bovis
QPAGR

SEQ ID NO: 153238 - protein, 9 aa, Mycobacterium bovis
QPALSAPPQ

SEQ ID NO: 153239 - protein, 15 aa, Mycobacterium bovis
QPALTGATTDEGSHS

SEQ ID NO: 153240 - protein, 17 aa, Mycobacterium bovis
QPASGNAAAASARAKVA

SEQ ID NO: 153241 - protein, 8 aa, Mycobacterium bovis
QPASTPAE

SEQ ID NO: 153242 - protein, 7 aa, Mycobacterium bovis
QPDDPRA

SEQ ID NO: 153243 - protein, 15 aa, Mycobacterium bovis
QPDERPDDAEDSDAG

SEQ ID NO: 153244 - protein, 8 aa, Mycobacterium bovis
QPEAQTAA

SEQ ID NO: 153245 - protein, 25 aa, Mycobacterium bovis
QPEPRWPKSPPQDRRESGPELSEYP

SEQ ID NO: 153246 - protein, 19 aa, Mycobacterium bovis
QPEPTFTTSPQDADRFSDA

SEQ ID NO: 153247 - protein, 17 aa, Mycobacterium bovis
QPGPAEPELSSRDPDIA

SEQ ID NO: 153248 - protein, 16 aa, Mycobacterium bovis
QPGRTYDVSSPDLPTV

SEQ ID NO: 153249 - protein, 6 aa, Mycobacterium bovis
QPIPPW

SEQ ID NO: 153250 - protein, 5 aa, Mycobacterium bovis
QPKDE

SEQ ID NO: 153251 - protein, 7 aa, Mycobacterium bovis
QPKKAAA

SEQ ID NO: 153252 - protein, 6 aa, Mycobacterium bovis
QPNGEM

SEQ ID NO: 153253 - protein, 4 aa, Mycobacterium bovis
QPPF

SEQ ID NO: 153254 - protein, 6 aa, Mycobacterium bovis
QPPGTK

SEQ ID NO: 153255 - protein, 4 aa, Mycobacterium bovis
QPPL

SEQ ID NO: 153256 - protein, 13 aa, Mycobacterium bovis
QPPPTVSDRVPGL

SEQ ID NO: 153257 - protein, 11 aa, Mycobacterium bovis
QPPVPPPDIPE

SEQ ID NO: 153258 - protein, 4 aa, Mycobacterium bovis
QPPW

SEQ ID NO: 153259 - protein, 6 aa, Mycobacterium bovis
QPQHAP

SEQ ID NO: 153260 - protein, 5 aa, Mycobacterium bovis
QPQLA

SEQ ID NO: 153261 - protein, 9 aa, Mycobacterium bovis
QPQPGQNAP

SEQ ID NO: 153262 - protein, 33 aa, Mycobacterium bovis
QPQPGRQVPAGSAGIDMDDDERVRAAGRRGTQN

SEQ ID NO: 153263 - protein, 5 aa, Mycobacterium bovis
QPRRT

SEQ ID NO: 153264 - protein, 7 aa, Mycobacterium bovis
QPRTANM

SEQ ID NO: 153265 - protein, 4 aa, Mycobacterium bovis
QPSE

SEQ ID NO: 153266 - protein, 10 aa, Mycobacterium bovis
QPSKSAQDLS

SEQ ID NO: 153267 - protein, 11 aa, Mycobacterium bovis
QPSQSNGQNYT

SEQ ID NO: 153268 - protein, 6 aa, Mycobacterium bovis
QPTDLV

SEQ ID NO: 153269 - protein, 23 aa, Mycobacterium bovis
QPTDPDVAQPRVADEAEQHAKKS

SEQ ID NO: 153270 - protein, 4 aa, Mycobacterium bovis
QPTR

SEQ ID NO: 153271 - protein, 31 aa, Mycobacterium bovis
QQAAPAPRFSRTPAGPVRPPPAAATPIDEIN

SEQ ID NO: 153272 - protein, 6 aa, Mycobacterium bovis
QQASAR

SEQ ID NO: 153273 - protein, 29 aa, Mycobacterium bovis
QQEPKQPPAPEPRPAPPPAKPAPPAGPVD

SEQ ID NO: 153274 - protein, 12 aa, Mycobacterium bovis
QQERNNKDPGAM

SEQ ID NO: 153275 - protein, 5 aa, Mycobacterium bovis
QQGPG

SEQ ID NO: 153276 - protein, 5 aa, Mycobacterium bovis
QQGRD

SEQ ID NO: 153277 - protein, 10 aa, Mycobacterium bovis
QQISTGTEIR

SEQ ID NO: 153278 - protein, 7 aa, Mycobacterium bovis
QQPLDTR

SEQ ID NO: 153279 - protein, 23 aa, Mycobacterium bovis
QQQAPVPPPPPDDPTAGFQGGTI

SEQ ID NO: 153280 - protein, 6 aa, Mycobacterium bovis
QQQPGW

SEQ ID NO: 153281 - protein, 8 aa, Mycobacterium bovis
QQSAQPSF

SEQ ID NO: 153282 - protein, 5 aa, Mycobacterium bovis
QRDRA

SEQ ID NO: 153283 - protein, 7 aa, Mycobacterium bovis
QRDRAND

SEQ ID NO: 153284 - protein, 5 aa, Mycobacterium bovis
QREAT

SEQ ID NO: 153285 - protein, 9 aa, Mycobacterium bovis
QRFGPNDYR

SEQ ID NO: 153286 - protein, 7 aa, Mycobacterium bovis
QRGGAFG

SEQ ID NO: 153287 - protein, 5 aa, Mycobacterium bovis
QRGNY

SEQ ID NO: 153288 - protein, 6 aa, Mycobacterium bovis
QRITDP

SEQ ID NO: 153289 - protein, 5 aa, Mycobacterium bovis
QRNNG

SEQ ID NO: 153290 - protein, 6 aa, Mycobacterium bovis
QRPALQ

SEQ ID NO: 153291 - protein, 7 aa, Mycobacterium bovis
QRPDSGG

SEQ ID NO: 153292 - protein, 7 aa, Mycobacterium bovis
QRPKLER

SEQ ID NO: 153293 - protein, 6 aa, Mycobacterium bovis
QRPLGD

SEQ ID NO: 153294 - protein, 5 aa, Mycobacterium bovis
QRPPG

SEQ ID NO: 153295 - protein, 10 aa, Mycobacterium bovis
QRPPSESSRA

SEQ ID NO: 153296 - protein, 5 aa, Mycobacterium bovis
QRPSV

SEQ ID NO: 153297 - protein, 5 aa, Mycobacterium bovis
QRPVI

SEQ ID NO: 153298 - protein, 4 aa, Mycobacterium bovis
QRPY

SEQ ID NO: 153299 - protein, 11 aa, Mycobacterium bovis
QRQPVPVDDET

SEQ ID NO: 153300 - protein, 4 aa, Mycobacterium bovis
QRRA

SEQ ID NO: 153301 - protein, 8 aa, Mycobacterium bovis
QRRASPAR

SEQ ID NO: 153302 - protein, 4 aa, Mycobacterium bovis
QRRH

SEQ ID NO: 153303 - protein, 22 aa, Mycobacterium bovis
QRSHDRPASLDNPRSPRRRAGM

SEQ ID NO: 153304 - protein, 10 aa, Mycobacterium bovis
QRSIGDVPTG

SEQ ID NO: 153305 - protein, 9 aa, Mycobacterium bovis
QRSKADPPF

SEQ ID NO: 153306 - protein, 12 aa, Mycobacterium bovis
QRTAEAQAKANE

SEQ ID NO: 153307 - protein, 7 aa, Mycobacterium bovis
QRTGWSG

SEQ ID NO: 153308 - protein, 10 aa, Mycobacterium bovis
QRTKTREEVE

SEQ ID NO: 153309 - protein, 4 aa, Mycobacterium bovis
QSAG

SEQ ID NO: 153310 - protein, 5 aa, Mycobacterium bovis
QSALG

SEQ ID NO: 153311 - protein, 11 aa, Mycobacterium bovis
QSARADISADG

SEQ ID NO: 153312 - protein, 4 aa, Mycobacterium bovis
QSDV

SEQ ID NO: 153313 - protein, 8 aa, Mycobacterium bovis
QSDVDQAR

SEQ ID NO: 153314 - protein, 4 aa, Mycobacterium bovis
QSEV

SEQ ID NO: 153315 - protein, 14 aa, Mycobacterium bovis
QSGFYDDGSQSVQA

SEQ ID NO: 153316 - protein, 5 aa, Mycobacterium bovis
QSGVQ

SEQ ID NO: 153317 - protein, 11 aa, Mycobacterium bovis
QSHSKNYSTRA

SEQ ID NO: 153318 - protein, 13 aa, Mycobacterium bovis
QSIADTDEPTTRL

SEQ ID NO: 153319 - protein, 9 aa, Mycobacterium bovis
QSKEQPELA

SEQ ID NO: 153320 - protein, 10 aa, Mycobacterium bovis
QSLSDAENTL

SEQ ID NO: 153321 - protein, 11 aa, Mycobacterium bovis
QSMGGNGLTKE

SEQ ID NO: 153322 - protein, 14 aa, Mycobacterium bovis
QSPAAAGEHRGPAR

SEQ ID NO: 153323 - protein, 7 aa, Mycobacterium bovis
QSPARAT

SEQ ID NO: 153324 - protein, 9 aa, Mycobacterium bovis
QSPGPNNQQ

SEQ ID NO: 153325 - protein, 12 aa, Mycobacterium bovis
QSPGQVSPDTKL

SEQ ID NO: 153326 - protein, 11 aa, Mycobacterium bovis
QSSRPGPVTYP

SEQ ID NO: 153327 - protein, 20 aa, Mycobacterium bovis
QSSSKFAPVGDPSSTGVGDV

SEQ ID NO: 153328 - protein, 12 aa, Mycobacterium bovis
QSSSPALGDRTT

SEQ ID NO: 153329 - protein, 8 aa, Mycobacterium bovis
QSSSTGGP

SEQ ID NO: 153330 - protein, 11 aa, Mycobacterium bovis
QSTGTGPGDQR

SEQ ID NO: 153331 - protein, 15 aa, Mycobacterium bovis
QSVDAAQVAKPEGAV

SEQ ID NO: 153332 - protein, 8 aa, Mycobacterium bovis
QSYSGEAT

SEQ ID NO: 153333 - protein, 20 aa, Mycobacterium bovis
QTAGSDAKREAAYSDDRRVR

SEQ ID NO: 153334 - protein, 4 aa, Mycobacterium bovis
QTAS

SEQ ID NO: 153335 - protein, 16 aa, Mycobacterium bovis
QTASASGYNEPRGYDR

SEQ ID NO: 153336 - protein, 15 aa, Mycobacterium bovis
QTDSEAGTTPDRGTD

SEQ ID NO: 153337 - protein, 7 aa, Mycobacterium bovis
QTESKDL

SEQ ID NO: 153338 - protein, 10 aa, Mycobacterium bovis
QTETDAAGST

SEQ ID NO: 153339 - protein, 14 aa, Mycobacterium bovis
QTEWPATGHPRRAG

SEQ ID NO: 153340 - protein, 9 aa, Mycobacterium bovis
QTGADQIKA

SEQ ID NO: 153341 - protein, 16 aa, Mycobacterium bovis
QTGDPNICDTFSAADL

SEQ ID NO: 153342 - protein, 9 aa, Mycobacterium bovis
QTGGEASAR

SEQ ID NO: 153343 - protein, 5 aa, Mycobacterium bovis
QTLNT

SEQ ID NO: 153344 - protein, 22 aa, Mycobacterium bovis
QTLTTTPHPDTDAPLPVPPTDD

SEQ ID NO: 153345 - protein, 5 aa, Mycobacterium bovis
QTPDF

SEQ ID NO: 153346 - protein, 5 aa, Mycobacterium bovis
QTPSA

SEQ ID NO: 153347 - protein, 6 aa, Mycobacterium bovis
QTQEYQ

SEQ ID NO: 153348 - protein, 6 aa, Mycobacterium bovis
QTQPAV

SEQ ID NO: 153349 - protein, 8 aa, Mycobacterium bovis
QTRHPATA

SEQ ID NO: 153350 - protein, 31 aa, Mycobacterium bovis
QTRRRRPTAAATPEDDSTRPERSSVAPGHPG

SEQ ID NO: 153351 - protein, 6 aa, Mycobacterium bovis
QTSAGY

SEQ ID NO: 153352 - protein, 7 aa, Mycobacterium bovis
QTSGQNL

SEQ ID NO: 153353 - protein, 4 aa, Mycobacterium bovis
QTVT

SEQ ID NO: 153354 - protein, 6 aa, Mycobacterium bovis
QVGGSI

SEQ ID NO: 153355 - protein, 6 aa, Mycobacterium bovis
QVNGGP

SEQ ID NO: 153356 - protein, 12 aa, Mycobacterium bovis
QVPDSPAMTGPY

SEQ ID NO: 153357 - protein, 4 aa, Mycobacterium bovis
QVPT

SEQ ID NO: 153358 - protein, 9 aa, Mycobacterium bovis
QVRKGASQR

SEQ ID NO: 153359 - protein, 5 aa, Mycobacterium bovis
QVSGD

SEQ ID NO: 153360 - protein, 12 aa, Mycobacterium bovis
QVTTESNGDYGR

SEQ ID NO: 153361 - protein, 11 aa, Mycobacterium bovis
QVTTTSPKEVT

SEQ ID NO: 153362 - protein, 8 aa, Mycobacterium bovis
QWSRPANA

SEQ ID NO: 153363 - protein, 62 aa, Mycobacterium bovis
QYGESGRRSRHSAEHRDHDIGGSGAGTGERPPSPPMAPPPPAEPTRRHRTADTPPDDSGGLH

SEQ ID NO: 153364 - protein, 13 aa, Mycobacterium bovis
QYGGAAARGLDEA

SEQ ID NO: 153365 - protein, 11 aa, Mycobacterium bovis
QYPPSPDKAVK

SEQ ID NO: 153366 - protein, 15 aa, Mycobacterium bovis
QYQARQSARESSSEQ

SEQ ID NO: 153367 - protein, 36 aa, Mycobacterium bovis
RAAGDPRPPHDPTHPLAESPRPARSSPASSPELTPA

SEQ ID NO: 153368 - protein, 6 aa, Mycobacterium bovis
RAAGLP

SEQ ID NO: 153369 - protein, 8 aa, Mycobacterium bovis
RAAGRAGY

SEQ ID NO: 153370 - protein, 9 aa, Mycobacterium bovis
RAAGRRRVP

SEQ ID NO: 153371 - protein, 7 aa, Mycobacterium bovis
RAAGTHK

SEQ ID NO: 153372 - protein, 4 aa, Mycobacterium bovis
RAAH

SEQ ID NO: 153373 - protein, 7 aa, Mycobacterium bovis
RAAPTQL

SEQ ID NO: 153374 - protein, 7 aa, Mycobacterium bovis
RAASESA

SEQ ID NO: 153375 - protein, 14 aa, Mycobacterium bovis
RADAKASPDPDRRQ

SEQ ID NO: 153376 - protein, 53 aa, Mycobacterium bovis
RADDERAAQPARTRTTTSAGTTTSVAPASTTRPAPTTPTTTGAADTATASPTA

SEQ ID NO: 153377 - protein, 10 aa, Mycobacterium bovis
RADEESGRAE

SEQ ID NO: 153378 - protein, 8 aa, Mycobacterium bovis
RADPLTAA

SEQ ID NO: 153379 - protein, 8 aa, Mycobacterium bovis
RADPRLGE

SEQ ID NO: 153380 - protein, 11 aa, Mycobacterium bovis
RADTNGPQSGA

SEQ ID NO: 153381 - protein, 8 aa, Mycobacterium bovis
RADTQDKI

SEQ ID NO: 153382 - protein, 6 aa, Mycobacterium bovis
RAEQQV

SEQ ID NO: 153383 - protein, 5 aa, Mycobacterium bovis
RAEQR

SEQ ID NO: 153384 - protein, 12 aa, Mycobacterium bovis
RAGCSRVDAIDE

SEQ ID NO: 153385 - protein, 5 aa, Mycobacterium bovis
RAGDR

SEQ ID NO: 153386 - protein, 7 aa, Mycobacterium bovis
RAGGDAR

SEQ ID NO: 153387 - protein, 8 aa, Mycobacterium bovis
RAGRDDKV

SEQ ID NO: 153388 - protein, 12 aa, Mycobacterium bovis
RAGRPPRAHRPH

SEQ ID NO: 153389 - protein, 10 aa, Mycobacterium bovis
RAGRQADAQL

SEQ ID NO: 153390 - protein, 8 aa, Mycobacterium bovis
RAGSESVL

SEQ ID NO: 153391 - protein, 7 aa, Mycobacterium bovis
RAGVGPR

SEQ ID NO: 153392 - protein, 6 aa, Mycobacterium bovis
RAHHTA

SEQ ID NO: 153393 - protein, 10 aa, Mycobacterium bovis
RAKSKAGSAL

SEQ ID NO: 153394 - protein, 10 aa, Mycobacterium bovis
RAKSQAGSAL

SEQ ID NO: 153395 - protein, 4 aa, Mycobacterium bovis
RAND

SEQ ID NO: 153396 - protein, 7 aa, Mycobacterium bovis
RANGTYG

SEQ ID NO: 153397 - protein, 9 aa, Mycobacterium bovis
RAPHSAEIR

SEQ ID NO: 153398 - protein, 10 aa, Mycobacterium bovis
RAPSQADGRN

SEQ ID NO: 153399 - protein, 14 aa, Mycobacterium bovis
RAPTSGTVDRPGTV

SEQ ID NO: 153400 - protein, 8 aa, Mycobacterium bovis
RAQIPERT

SEQ ID NO: 153401 - protein, 11 aa, Mycobacterium bovis
RAQPPASTGPV

SEQ ID NO: 153402 - protein, 6 aa, Mycobacterium bovis
RARGSP

SEQ ID NO: 153403 - protein, 6 aa, Mycobacterium bovis
RARPDS

SEQ ID NO: 153404 - protein, 6 aa, Mycobacterium bovis
RARTTV

SEQ ID NO: 153405 - protein, 21 aa, Mycobacterium bovis
RASGAVNAAEYESKRAQIISE

SEQ ID NO: 153406 - protein, 6 aa, Mycobacterium bovis
RASGDE

SEQ ID NO: 153407 - protein, 9 aa, Mycobacterium bovis
RASGPEQRI

SEQ ID NO: 153408 - protein, 8 aa, Mycobacterium bovis
RASGRRRM

SEQ ID NO: 153409 - protein, 11 aa, Mycobacterium bovis
RASRRAHPYRP

SEQ ID NO: 153410 - protein, 4 aa, Mycobacterium bovis
RATE

SEQ ID NO: 153411 - protein, 8 aa, Mycobacterium bovis
RATGTGYA

SEQ ID NO: 153412 - protein, 7 aa, Mycobacterium bovis
RATISRP

SEQ ID NO: 153413 - protein, 4 aa, Mycobacterium bovis
RATQ

SEQ ID NO: 153414 - protein, 6 aa, Mycobacterium bovis
RATQID

SEQ ID NO: 153415 - protein, 5 aa, Mycobacterium bovis
RATRL

SEQ ID NO: 153416 - protein, 6 aa, Mycobacterium bovis
RATRPD

SEQ ID NO: 153417 - protein, 13 aa, Mycobacterium bovis
RATTVTGSVTVES

SEQ ID NO: 153418 - protein, 6 aa, Mycobacterium bovis
RAVADS

SEQ ID NO: 153419 - protein, 11 aa, Mycobacterium bovis
RCDQPVKPGQV

SEQ ID NO: 153420 - protein, 4 aa, Mycobacterium bovis
RCES

SEQ ID NO: 153421 - protein, 4 aa, Mycobacterium bovis
RDAA

SEQ ID NO: 153422 - protein, 14 aa, Mycobacterium bovis
RDAAANPGNQAAAA

SEQ ID NO: 153423 - protein, 5 aa, Mycobacterium bovis
RDDEL

SEQ ID NO: 153424 - protein, 7 aa, Mycobacterium bovis
RDDGTLA

SEQ ID NO: 153425 - protein, 17 aa, Mycobacterium bovis
RDDKKDGVAGPGDAVRV

SEQ ID NO: 153426 - protein, 8 aa, Mycobacterium bovis
RDDSGERT

SEQ ID NO: 153427 - protein, 4 aa, Mycobacterium bovis
RDEG

SEQ ID NO: 153428 - protein, 6 aa, Mycobacterium bovis
RDEGTA

SEQ ID NO: 153429 - protein, 11 aa, Mycobacterium bovis
RDEHDDATPDV

SEQ ID NO: 153430 - protein, 6 aa, Mycobacterium bovis
RDESAL

SEQ ID NO: 153431 - protein, 4 aa, Mycobacterium bovis
RDGE

SEQ ID NO: 153432 - protein, 10 aa, Mycobacterium bovis
RDGITDLPDG

SEQ ID NO: 153433 - protein, 11 aa, Mycobacterium bovis
RDGKATTLGAA

SEQ ID NO: 153434 - protein, 7 aa, Mycobacterium bovis
RDGREDV

SEQ ID NO: 153435 - protein, 7 aa, Mycobacterium bovis
RDGSQTR

SEQ ID NO: 153436 - protein, 4 aa, Mycobacterium bovis
RDGT

SEQ ID NO: 153437 - protein, 4 aa, Mycobacterium bovis
RDHT

SEQ ID NO: 153438 - protein, 9 aa, Mycobacterium bovis
RDIEPGHRR

SEQ ID NO: 153439 - protein, 6 aa, Mycobacterium bovis
RDLRDP

SEQ ID NO: 153440 - protein, 8 aa, Mycobacterium bovis
RDLRTPGA

SEQ ID NO: 153441 - protein, 6 aa, Mycobacterium bovis
RDNQNR

SEQ ID NO: 153442 - protein, 10 aa, Mycobacterium bovis
RDNTDQFNTR

SEQ ID NO: 153443 - protein, 12 aa, Mycobacterium bovis
RDPAQLGGPGLT

SEQ ID NO: 153444 - protein, 9 aa, Mycobacterium bovis
RDPHGRHRP

SEQ ID NO: 153445 - protein, 9 aa, Mycobacterium bovis
RDPLTGGQS

SEQ ID NO: 153446 - protein, 6 aa, Mycobacterium bovis
RDPQFG

SEQ ID NO: 153447 - protein, 11 aa, Mycobacterium bovis
RDPVSDTGSAQ

SEQ ID NO: 153448 - protein, 14 aa, Mycobacterium bovis
RDQRKRRAYTPDEV

SEQ ID NO: 153449 - protein, 9 aa, Mycobacterium bovis
RDRDGAAPI

SEQ ID NO: 153450 - protein, 6 aa, Mycobacterium bovis
RDREVR

SEQ ID NO: 153451 - protein, 12 aa, Mycobacterium bovis
RDSEPSVAGKDP

SEQ ID NO: 153452 - protein, 7 aa, Mycobacterium bovis
RDSPSWS

SEQ ID NO: 153453 - protein, 11 aa, Mycobacterium bovis
RDTAPAAGPEL

SEQ ID NO: 153454 - protein, 6 aa, Mycobacterium bovis
RDVAER

SEQ ID NO: 153455 - protein, 15 aa, Mycobacterium bovis
REAASAPALAEAARR

SEQ ID NO: 153456 - protein, 6 aa, Mycobacterium bovis
READAA

SEQ ID NO: 153457 - protein, 14 aa, Mycobacterium bovis
REAPPPATDSTSPE

SEQ ID NO: 153458 - protein, 13 aa, Mycobacterium bovis
REAREAIKGTPLQ

SEQ ID NO: 153459 - protein, 6 aa, Mycobacterium bovis
REARIR

SEQ ID NO: 153460 - protein, 10 aa, Mycobacterium bovis
REARTAGRLQ

SEQ ID NO: 153461 - protein, 10 aa, Mycobacterium bovis
REDGAGELTD

SEQ ID NO: 153462 - protein, 18 aa, Mycobacterium bovis
REDGPPSHHTKRGTPSMG

SEQ ID NO: 153463 - protein, 6 aa, Mycobacterium bovis
REDPAT

SEQ ID NO: 153464 - protein, 4 aa, Mycobacterium bovis
REED

SEQ ID NO: 153465 - protein, 8 aa, Mycobacterium bovis
REEETRIS

SEQ ID NO: 153466 - protein, 8 aa, Mycobacterium bovis
REFADESD

SEQ ID NO: 153467 - protein, 4 aa, Mycobacterium bovis
REGA

SEQ ID NO: 153468 - protein, 12 aa, Mycobacterium bovis
REGADDDAEPIG

SEQ ID NO: 153469 - protein, 29 aa, Mycobacterium bovis
REGDAEAVDPLGQQQLDQSGAVGVSPSAV

SEQ ID NO: 153470 - protein, 7 aa, Mycobacterium bovis
REGYERD

SEQ ID NO: 153471 - protein, 19 aa, Mycobacterium bovis
REHPNWDEDGVKDSGTNAS

SEQ ID NO: 153472 - protein, 6 aa, Mycobacterium bovis
REIGRS

SEQ ID NO: 153473 - protein, 14 aa, Mycobacterium bovis
REPDRESSAPPDDV

SEQ ID NO: 153474 - protein, 7 aa, Mycobacterium bovis
REQQGGR

SEQ ID NO: 153475 - protein, 8 aa, Mycobacterium bovis
RERASGTL

SEQ ID NO: 153476 - protein, 8 aa, Mycobacterium bovis
RERGMSTQ

SEQ ID NO: 153477 - protein, 7 aa, Mycobacterium bovis
RERSGVG

SEQ ID NO: 153478 - protein, 7 aa, Mycobacterium bovis
RESAAGV

SEQ ID NO: 153479 - protein, 7 aa, Mycobacterium bovis
RESQKRA

SEQ ID NO: 153480 - protein, 9 aa, Mycobacterium bovis
RETASPTAN

SEQ ID NO: 153481 - protein, 4 aa, Mycobacterium bovis
RETE

SEQ ID NO: 153482 - protein, 15 aa, Mycobacterium bovis
RETEEAAASLGANGA

SEQ ID NO: 153483 - protein, 8 aa, Mycobacterium bovis
REVSDSAR

SEQ ID NO: 153484 - protein, 6 aa, Mycobacterium bovis
RFAPAK

SEQ ID NO: 153485 - protein, 4 aa, Mycobacterium bovis
RFDS

SEQ ID NO: 153486 - protein, 13 aa, Mycobacterium bovis
RFGVEDSKEARDA

SEQ ID NO: 153487 - protein, 5 aa, Mycobacterium bovis
RFQGT

SEQ ID NO: 153488 - protein, 15 aa, Mycobacterium bovis
RFRPGGHPTPLPNPG

SEQ ID NO: 153489 - protein, 7 aa, Mycobacterium bovis
RGAGEGR

SEQ ID NO: 153490 - protein, 12 aa, Mycobacterium bovis
RGANGSTPDDGF

SEQ ID NO: 153491 - protein, 7 aa, Mycobacterium bovis
RGARNNP

SEQ ID NO: 153492 - protein, 7 aa, Mycobacterium bovis
RGATGEP

SEQ ID NO: 153493 - protein, 7 aa, Mycobacterium bovis
RGDCPDD

SEQ ID NO: 153494 - protein, 4 aa, Mycobacterium bovis
RGDD

SEQ ID NO: 153495 - protein, 10 aa, Mycobacterium bovis
RGDPASAEGI

SEQ ID NO: 153496 - protein, 15 aa, Mycobacterium bovis
RGDTSRSRQAGSTGL

SEQ ID NO: 153497 - protein, 5 aa, Mycobacterium bovis
RGEDD

SEQ ID NO: 153498 - protein, 4 aa, Mycobacterium bovis
RGEF

SEQ ID NO: 153499 - protein, 4 aa, Mycobacterium bovis
RGEG

SEQ ID NO: 153500 - protein, 13 aa, Mycobacterium bovis
RGEGKGANDLLPP

SEQ ID NO: 153501 - protein, 4 aa, Mycobacterium bovis
RGEL

SEQ ID NO: 153502 - protein, 6 aa, Mycobacterium bovis
RGESLS

SEQ ID NO: 153503 - protein, 12 aa, Mycobacterium bovis
RGGERDSRTRTS

SEQ ID NO: 153504 - protein, 8 aa, Mycobacterium bovis
RGGGPDNV

SEQ ID NO: 153505 - protein, 5 aa, Mycobacterium bovis
RGGHD

SEQ ID NO: 153506 - protein, 10 aa, Mycobacterium bovis
RGGPEGTGTT

SEQ ID NO: 153507 - protein, 6 aa, Mycobacterium bovis
RGGPYL

SEQ ID NO: 153508 - protein, 8 aa, Mycobacterium bovis
RGGSGQEG

SEQ ID NO: 153509 - protein, 11 aa, Mycobacterium bovis
RGGSKGLGTAV

SEQ ID NO: 153510 - protein, 10 aa, Mycobacterium bovis
RGHDAAPQVA

SEQ ID NO: 153511 - protein, 12 aa, Mycobacterium bovis
RGHEQPTRLAVP

SEQ ID NO: 153512 - protein, 7 aa, Mycobacterium bovis
RGHGAGA

SEQ ID NO: 153513 - protein, 13 aa, Mycobacterium bovis
RGHSGQRLAPGAT

SEQ ID NO: 153514 - protein, 9 aa, Mycobacterium bovis
RGKRTQSTL

SEQ ID NO: 153515 - protein, 5 aa, Mycobacterium bovis
RGMRD

SEQ ID NO: 153516 - protein, 5 aa, Mycobacterium bovis
RGNSW

SEQ ID NO: 153517 - protein, 4 aa, Mycobacterium bovis
RGPA

SEQ ID NO: 153518 - protein, 5 aa, Mycobacterium bovis
RGPAE

SEQ ID NO: 153519 - protein, 6 aa, Mycobacterium bovis
RGPART

SEQ ID NO: 153520 - protein, 11 aa, Mycobacterium bovis
RGPEGADPASV

SEQ ID NO: 153521 - protein, 7 aa, Mycobacterium bovis
RGPGDWQ

SEQ ID NO: 153522 - protein, 4 aa, Mycobacterium bovis
RGPQ

SEQ ID NO: 153523 - protein, 8 aa, Mycobacterium bovis
RGPRLTPG

SEQ ID NO: 153524 - protein, 6 aa, Mycobacterium bovis
RGQIGS

SEQ ID NO: 153525 - protein, 6 aa, Mycobacterium bovis
RGQLGS

SEQ ID NO: 153526 - protein, 17 aa, Mycobacterium bovis
RGQTGDRRRQATHPAAV

SEQ ID NO: 153527 - protein, 4 aa, Mycobacterium bovis
RGQW

SEQ ID NO: 153528 - protein, 7 aa, Mycobacterium bovis
RGRAQNA

SEQ ID NO: 153529 - protein, 10 aa, Mycobacterium bovis
RGRDGRAPYD

SEQ ID NO: 153530 - protein, 10 aa, Mycobacterium bovis
RGRGDTASIE

SEQ ID NO: 153531 - protein, 9 aa, Mycobacterium bovis
RGRPADRPA

SEQ ID NO: 153532 - protein, 8 aa, Mycobacterium bovis
RGRPEDSP

SEQ ID NO: 153533 - protein, 12 aa, Mycobacterium bovis
RGRRGDFGGLKG

SEQ ID NO: 153534 - protein, 5 aa, Mycobacterium bovis
RGRSL

SEQ ID NO: 153535 - protein, 6 aa, Mycobacterium bovis
RGRSRP

SEQ ID NO: 153536 - protein, 39 aa, Mycobacterium bovis
RGSATRDARRDNYREEQRFDRRDRSRAPRRPPAESWEYD

SEQ ID NO: 153537 - protein, 6 aa, Mycobacterium bovis
RGSGSI

SEQ ID NO: 153538 - protein, 6 aa, Mycobacterium bovis
RGSQWA

SEQ ID NO: 153539 - protein, 6 aa, Mycobacterium bovis
RGSSGN

SEQ ID NO: 153540 - protein, 12 aa, Mycobacterium bovis
RGSTASHSGSGL

SEQ ID NO: 153541 - protein, 13 aa, Mycobacterium bovis
RGSVTAESGNGQT

SEQ ID NO: 153542 - protein, 8 aa, Mycobacterium bovis
RGTYGPKV

SEQ ID NO: 153543 - protein, 13 aa, Mycobacterium bovis
RGVAEKRTERGFR

SEQ ID NO: 153544 - protein, 7 aa, Mycobacterium bovis
RHAESLG

SEQ ID NO: 153545 - protein, 11 aa, Mycobacterium bovis
RHATRTATVSA

SEQ ID NO: 153546 - protein, 7 aa, Mycobacterium bovis
RHPGGAS

SEQ ID NO: 153547 - protein, 6 aa, Mycobacterium bovis
RHPTPG

SEQ ID NO: 153548 - protein, 6 aa, Mycobacterium bovis
RHRTTS

SEQ ID NO: 153549 - protein, 17 aa, Mycobacterium bovis
RHSAQGLRQARESATRR

SEQ ID NO: 153550 - protein, 7 aa, Mycobacterium bovis
RHTAESV

SEQ ID NO: 153551 - protein, 7 aa, Mycobacterium bovis
RHTGPTG

SEQ ID NO: 153552 - protein, 5 aa, Mycobacterium bovis
RHTRS

SEQ ID NO: 153553 - protein, 8 aa, Mycobacterium bovis
RIASKSSA

SEQ ID NO: 153554 - protein, 8 aa, Mycobacterium bovis
RIGDDPEA

SEQ ID NO: 153555 - protein, 11 aa, Mycobacterium bovis
RIRGGGRASVG

SEQ ID NO: 153556 - protein, 5 aa, Mycobacterium bovis
RITPR

SEQ ID NO: 153557 - protein, 8 aa, Mycobacterium bovis
RKAGQPPK

SEQ ID NO: 153558 - protein, 9 aa, Mycobacterium bovis
RKAGSAGRA

SEQ ID NO: 153559 - protein, 8 aa, Mycobacterium bovis
RKDPAYSH

SEQ ID NO: 153560 - protein, 22 aa, Mycobacterium bovis
RKEHADEPEVQEQPTLAPQVEP

SEQ ID NO: 153561 - protein, 7 aa, Mycobacterium bovis
RKGQESF

SEQ ID NO: 153562 - protein, 6 aa, Mycobacterium bovis
RKHEHT

SEQ ID NO: 153563 - protein, 8 aa, Mycobacterium bovis
RKKAAAAE

SEQ ID NO: 153564 - protein, 14 aa, Mycobacterium bovis
RKNGDDGKSEGSGV

SEQ ID NO: 153565 - protein, 8 aa, Mycobacterium bovis
RKPDGKDL

SEQ ID NO: 153566 - protein, 12 aa, Mycobacterium bovis
RKPGETGGTFSA

SEQ ID NO: 153567 - protein, 7 aa, Mycobacterium bovis
RKRFGDT

SEQ ID NO: 153568 - protein, 6 aa, Mycobacterium bovis
RKSHGS

SEQ ID NO: 153569 - protein, 6 aa, Mycobacterium bovis
RLAEGK

SEQ ID NO: 153570 - protein, 7 aa, Mycobacterium bovis
RLAKAGP

SEQ ID NO: 153571 - protein, 7 aa, Mycobacterium bovis
RLASAGP

SEQ ID NO: 153572 - protein, 13 aa, Mycobacterium bovis
RLDGERAPVPSAR

SEQ ID NO: 153573 - protein, 9 aa, Mycobacterium bovis
RLDRPEDAA

SEQ ID NO: 153574 - protein, 10 aa, Mycobacterium bovis
RLGEPTGEGA

SEQ ID NO: 153575 - protein, 9 aa, Mycobacterium bovis
RLGRDDSEV

SEQ ID NO: 153576 - protein, 13 aa, Mycobacterium bovis
RLPPPGSAARPAM

SEQ ID NO: 153577 - protein, 5 aa, Mycobacterium bovis
RLPRQ

SEQ ID NO: 153578 - protein, 8 aa, Mycobacterium bovis
RLPVDNPA

SEQ ID NO: 153579 - protein, 5 aa, Mycobacterium bovis
RLQSG

SEQ ID NO: 153580 - protein, 5 aa, Mycobacterium bovis
RLRSG

SEQ ID NO: 153581 - protein, 4 aa, Mycobacterium bovis
RLSQ

SEQ ID NO: 153582 - protein, 14 aa, Mycobacterium bovis
RLTGAAGSQAISDS

SEQ ID NO: 153583 - protein, 4 aa, Mycobacterium bovis
RMAR

SEQ ID NO: 153584 - protein, 10 aa, Mycobacterium bovis
RMESTDSVGQ

SEQ ID NO: 153585 - protein, 8 aa, Mycobacterium bovis
RMSQGRTL

SEQ ID NO: 153586 - protein, 10 aa, Mycobacterium bovis
RNAAADDTPA

SEQ ID NO: 153587 - protein, 5 aa, Mycobacterium bovis
RNAQA

SEQ ID NO: 153588 - protein, 4 aa, Mycobacterium bovis
RNDA

SEQ ID NO: 153589 - protein, 6 aa, Mycobacterium bovis
RNDSEA

SEQ ID NO: 153590 - protein, 16 aa, Mycobacterium bovis
RNEPISVGELQADAIA

SEQ ID NO: 153591 - protein, 15 aa, Mycobacterium bovis
RNGDDREYDYETNID

SEQ ID NO: 153592 - protein, 6 aa, Mycobacterium bovis
RNGDRA

SEQ ID NO: 153593 - protein, 8 aa, Mycobacterium bovis
RNGESDPR

SEQ ID NO: 153594 - protein, 11 aa, Mycobacterium bovis
RNGGQTALSAA

SEQ ID NO: 153595 - protein, 4 aa, Mycobacterium bovis
RNGN

SEQ ID NO: 153596 - protein, 5 aa, Mycobacterium bovis
RNRAV

SEQ ID NO: 153597 - protein, 4 aa, Mycobacterium bovis
RNTD

SEQ ID NO: 153598 - protein, 15 aa, Mycobacterium bovis
RPADAVPHDQPGRGL

SEQ ID NO: 153599 - protein, 4 aa, Mycobacterium bovis
RPAG

SEQ ID NO: 153600 - protein, 14 aa, Mycobacterium bovis
RPAGGGTAKTPGPL

SEQ ID NO: 153601 - protein, 8 aa, Mycobacterium bovis
RPAGPGPL

SEQ ID NO: 153602 - protein, 8 aa, Mycobacterium bovis
RPAGREHR

SEQ ID NO: 153603 - protein, 27 aa, Mycobacterium bovis
RPALGTGEKEARAARALDGESPPADWV

SEQ ID NO: 153604 - protein, 6 aa, Mycobacterium bovis
RPAPAR

SEQ ID NO: 153605 - protein, 14 aa, Mycobacterium bovis
RPAPPVGWPPGPQL

SEQ ID NO: 153606 - protein, 6 aa, Mycobacterium bovis
RPASTQ

SEQ ID NO: 153607 - protein, 11 aa, Mycobacterium bovis
RPDAYTAADKL

SEQ ID NO: 153608 - protein, 6 aa, Mycobacterium bovis
RPDGGQ

SEQ ID NO: 153609 - protein, 5 aa, Mycobacterium bovis
RPDLQ

SEQ ID NO: 153610 - protein, 8 aa, Mycobacterium bovis
RPDNPQTL

SEQ ID NO: 153611 - protein, 7 aa, Mycobacterium bovis
RPDPVHK

SEQ ID NO: 153612 - protein, 22 aa, Mycobacterium bovis
RPDQQTDSGAARAAGAAASDGT

SEQ ID NO: 153613 - protein, 6 aa, Mycobacterium bovis
RPDTQQ

SEQ ID NO: 153614 - protein, 6 aa, Mycobacterium bovis
RPDTSH

SEQ ID NO: 153615 - protein, 8 aa, Mycobacterium bovis
RPEATRDA

SEQ ID NO: 153616 - protein, 11 aa, Mycobacterium bovis
RPETQRALAPA

SEQ ID NO: 153617 - protein, 8 aa, Mycobacterium bovis
RPGASDRV

SEQ ID NO: 153618 - protein, 11 aa, Mycobacterium bovis
RPGDHDNTTGV

SEQ ID NO: 153619 - protein, 11 aa, Mycobacterium bovis
RPGDTDPDNEV

SEQ ID NO: 153620 - protein, 7 aa, Mycobacterium bovis
RPGETIA

SEQ ID NO: 153621 - protein, 15 aa, Mycobacterium bovis
RPGPNRVGPKGALQS

SEQ ID NO: 153622 - protein, 7 aa, Mycobacterium bovis
RPGRPTA

SEQ ID NO: 153623 - protein, 12 aa, Mycobacterium bovis
RPGTSLSESDRH

SEQ ID NO: 153624 - protein, 6 aa, Mycobacterium bovis
RPHQDA

SEQ ID NO: 153625 - protein, 4 aa, Mycobacterium bovis
RPLG

SEQ ID NO: 153626 - protein, 9 aa, Mycobacterium bovis
RPNAADVER

SEQ ID NO: 153627 - protein, 7 aa, Mycobacterium bovis
RPPAPLT

SEQ ID NO: 153628 - protein, 15 aa, Mycobacterium bovis
RPPDLPPGTHDAQTD

SEQ ID NO: 153629 - protein, 17 aa, Mycobacterium bovis
RPPEVGVPSENPRLDEP

SEQ ID NO: 153630 - protein, 38 aa, Mycobacterium bovis
RPPGVDKPLKASRCGGRPRGPVRGSASWPGEQNRRERR

SEQ ID NO: 153631 - protein, 22 aa, Mycobacterium bovis
RPPTAAPPPAGARGGTEAGNLA

SEQ ID NO: 153632 - protein, 15 aa, Mycobacterium bovis
RPQAPGPGDSPPTQV

SEQ ID NO: 153633 - protein, 17 aa, Mycobacterium bovis
RPQKYQDQSDFTPNDQL

SEQ ID NO: 153634 - protein, 7 aa, Mycobacterium bovis
RPQPQGD

SEQ ID NO: 153635 - protein, 8 aa, Mycobacterium bovis
RPQQPPPA

SEQ ID NO: 153636 - protein, 64 aa, Mycobacterium bovis
RPQRPTGKRSRSRAAGADADVDVEEPSTAASEATGVAKDDSTTKAVSKAARAKKASKPKARSVN

SEQ ID NO: 153637 - protein, 4 aa, Mycobacterium bovis
RPRD

SEQ ID NO: 153638 - protein, 4 aa, Mycobacterium bovis
RPRE

SEQ ID NO: 153639 - protein, 6 aa, Mycobacterium bovis
RPRPAS

SEQ ID NO: 153640 - protein, 76 aa, Mycobacterium bovis
RPRRSEPKGENDDSDAPPGRSEASGPPALSESDDELIQPEQGGRHSSGFGRHRATSRSYMTTGQPAPPAPGNRPSQ

SEQ ID NO: 153641 - protein, 13 aa, Mycobacterium bovis
RPRTDKGSDGTRH

SEQ ID NO: 153642 - protein, 11 aa, Mycobacterium bovis
RPRTGAPSTAT

SEQ ID NO: 153643 - protein, 12 aa, Mycobacterium bovis
RPRTLDPSTLDN

SEQ ID NO: 153644 - protein, 6 aa, Mycobacterium bovis
RPRTLP

SEQ ID NO: 153645 - protein, 9 aa, Mycobacterium bovis
RPSPPPTVA

SEQ ID NO: 153646 - protein, 19 aa, Mycobacterium bovis
RPTAASKPVEGHQNAQPGK

SEQ ID NO: 153647 - protein, 5 aa, Mycobacterium bovis
RPTGV

SEQ ID NO: 153648 - protein, 6 aa, Mycobacterium bovis
RPTHEQ

SEQ ID NO: 153649 - protein, 22 aa, Mycobacterium bovis
RPTVPEAHTRQGARRIQPHLHR

SEQ ID NO: 153650 - protein, 18 aa, Mycobacterium bovis
RPVPQPWPSPASARTFAL

SEQ ID NO: 153651 - protein, 5 aa, Mycobacterium bovis
RQAET

SEQ ID NO: 153652 - protein, 5 aa, Mycobacterium bovis
RQAGR

SEQ ID NO: 153653 - protein, 4 aa, Mycobacterium bovis
RQAL

SEQ ID NO: 153654 - protein, 6 aa, Mycobacterium bovis
RQDGYG

SEQ ID NO: 153655 - protein, 13 aa, Mycobacterium bovis
RQEATQSRLPGSI

SEQ ID NO: 153656 - protein, 6 aa, Mycobacterium bovis
RQETPT

SEQ ID NO: 153657 - protein, 6 aa, Mycobacterium bovis
RQGPKL

SEQ ID NO: 153658 - protein, 6 aa, Mycobacterium bovis
RQGTET

SEQ ID NO: 153659 - protein, 11 aa, Mycobacterium bovis
RQGTTGSSIGK

SEQ ID NO: 153660 - protein, 13 aa, Mycobacterium bovis
RQLADRPTPPWRP

SEQ ID NO: 153661 - protein, 10 aa, Mycobacterium bovis
RQLPDGYQTV

SEQ ID NO: 153662 - protein, 11 aa, Mycobacterium bovis
RQMRDNANELR

SEQ ID NO: 153663 - protein, 6 aa, Mycobacterium bovis
RQNNCD

SEQ ID NO: 153664 - protein, 8 aa, Mycobacterium bovis
RQPDGGWG

SEQ ID NO: 153665 - protein, 12 aa, Mycobacterium bovis
RQPKQHQYAQPV

SEQ ID NO: 153666 - protein, 8 aa, Mycobacterium bovis
RQQDRWSS

SEQ ID NO: 153667 - protein, 7 aa, Mycobacterium bovis
RQRPDHP

SEQ ID NO: 153668 - protein, 7 aa, Mycobacterium bovis
RQSDSEA

SEQ ID NO: 153669 - protein, 14 aa, Mycobacterium bovis
RQTDSGDSLETARP

SEQ ID NO: 153670 - protein, 15 aa, Mycobacterium bovis
RQTLADKIMTTVCVP

SEQ ID NO: 153671 - protein, 5 aa, Mycobacterium bovis
RRADR

SEQ ID NO: 153672 - protein, 14 aa, Mycobacterium bovis
RRADTAADKANTAL

SEQ ID NO: 153673 - protein, 9 aa, Mycobacterium bovis
RRAGRASAR

SEQ ID NO: 153674 - protein, 12 aa, Mycobacterium bovis
RRARDRAADALR

SEQ ID NO: 153675 - protein, 6 aa, Mycobacterium bovis
RRASGG

SEQ ID NO: 153676 - protein, 5 aa, Mycobacterium bovis
RRATD

SEQ ID NO: 153677 - protein, 7 aa, Mycobacterium bovis
RRDAAEA

SEQ ID NO: 153678 - protein, 19 aa, Mycobacterium bovis
RRDPLPVAGRRSRTSGGIG

SEQ ID NO: 153679 - protein, 5 aa, Mycobacterium bovis
RREPR

SEQ ID NO: 153680 - protein, 17 aa, Mycobacterium bovis
RRGARGAQAGLETYLDP

SEQ ID NO: 153681 - protein, 7 aa, Mycobacterium bovis
RRGARNR

SEQ ID NO: 153682 - protein, 6 aa, Mycobacterium bovis
RRGDDM

SEQ ID NO: 153683 - protein, 5 aa, Mycobacterium bovis
RRGEM

SEQ ID NO: 153684 - protein, 4 aa, Mycobacterium bovis
RRGF

SEQ ID NO: 153685 - protein, 4 aa, Mycobacterium bovis
RRGP

SEQ ID NO: 153686 - protein, 16 aa, Mycobacterium bovis
RRGPATSRNAPPPSTA

SEQ ID NO: 153687 - protein, 4 aa, Mycobacterium bovis
RRGQ

SEQ ID NO: 153688 - protein, 27 aa, Mycobacterium bovis
RRGRAQRTKRKPLLPKEEEEQSPPDDD

SEQ ID NO: 153689 - protein, 7 aa, Mycobacterium bovis
RRGRGDD

SEQ ID NO: 153690 - protein, 8 aa, Mycobacterium bovis
RRGRGTPT

SEQ ID NO: 153691 - protein, 6 aa, Mycobacterium bovis
RRGRRA

SEQ ID NO: 153692 - protein, 10 aa, Mycobacterium bovis
RRGRSGPMTR

SEQ ID NO: 153693 - protein, 13 aa, Mycobacterium bovis
RRGSIGPEARTRL

SEQ ID NO: 153694 - protein, 34 aa, Mycobacterium bovis
RRGYDAAAYDDDRAGDVEYGTAADGDWPPDEDFG

SEQ ID NO: 153695 - protein, 5 aa, Mycobacterium bovis
RRGYR

SEQ ID NO: 153696 - protein, 15 aa, Mycobacterium bovis
RRHADGDTVGRRKAD

SEQ ID NO: 153697 - protein, 5 aa, Mycobacterium bovis
RRLKT

SEQ ID NO: 153698 - protein, 10 aa, Mycobacterium bovis
RRLQGQPPLG

SEQ ID NO: 153699 - protein, 4 aa, Mycobacterium bovis
RRMN

SEQ ID NO: 153700 - protein, 15 aa, Mycobacterium bovis
RRNAPQSDPDPLVLP

SEQ ID NO: 153701 - protein, 28 aa, Mycobacterium bovis
RRNSGSPAGSEDASTDGGEQPAAADEQS

SEQ ID NO: 153702 - protein, 9 aa, Mycobacterium bovis
RRPGDTSAT

SEQ ID NO: 153703 - protein, 5 aa, Mycobacterium bovis
RRPLE

SEQ ID NO: 153704 - protein, 8 aa, Mycobacterium bovis
RRPPAGMS

SEQ ID NO: 153705 - protein, 12 aa, Mycobacterium bovis
RRPPDSSSEPVV

SEQ ID NO: 153706 - protein, 40 aa, Mycobacterium bovis
RRPPEQVARAGRAKGPEVIDRPSENASFGAASGAELPRPV

SEQ ID NO: 153707 - protein, 9 aa, Mycobacterium bovis
RRPSPLPTP

SEQ ID NO: 153708 - protein, 6 aa, Mycobacterium bovis
RRPSRL

SEQ ID NO: 153709 - protein, 23 aa, Mycobacterium bovis
RRQHSNAAGRAAPQDDGPDMGPR

SEQ ID NO: 153710 - protein, 13 aa, Mycobacterium bovis
RRQSGTRTRSTNE

SEQ ID NO: 153711 - protein, 6 aa, Mycobacterium bovis
RRQSRR

SEQ ID NO: 153712 - protein, 6 aa, Mycobacterium bovis
RRRDEE

SEQ ID NO: 153713 - protein, 12 aa, Mycobacterium bovis
RRRGRSRRRKSW

SEQ ID NO: 153714 - protein, 4 aa, Mycobacterium bovis
RRRI

SEQ ID NO: 153715 - protein, 9 aa, Mycobacterium bovis
RRRNPGPDV

SEQ ID NO: 153716 - protein, 8 aa, Mycobacterium bovis
RRRRPSSA

SEQ ID NO: 153717 - protein, 4 aa, Mycobacterium bovis
RRRT

SEQ ID NO: 153718 - protein, 5 aa, Mycobacterium bovis
RRSAE

SEQ ID NO: 153719 - protein, 7 aa, Mycobacterium bovis
RRSARSR

SEQ ID NO: 153720 - protein, 20 aa, Mycobacterium bovis
RRSATSTDAAPGAGDDLNQG

SEQ ID NO: 153721 - protein, 9 aa, Mycobacterium bovis
RRSRIEPTN

SEQ ID NO: 153722 - protein, 22 aa, Mycobacterium bovis
RRTPGSSGIADVPAQPMQQRRR

SEQ ID NO: 153723 - protein, 9 aa, Mycobacterium bovis
RRTTPNPDC

SEQ ID NO: 153724 - protein, 6 aa, Mycobacterium bovis
RRVDPT

SEQ ID NO: 153725 - protein, 6 aa, Mycobacterium bovis
RRVESD

SEQ ID NO: 153726 - protein, 12 aa, Mycobacterium bovis
RRYAEAGNPYPG

SEQ ID NO: 153727 - protein, 7 aa, Mycobacterium bovis
RRYPSEP

SEQ ID NO: 153728 - protein, 9 aa, Mycobacterium bovis
RSAASGAAL

SEQ ID NO: 153729 - protein, 12 aa, Mycobacterium bovis
RSADNRDCPSRT

SEQ ID NO: 153730 - protein, 15 aa, Mycobacterium bovis
RSAGTEPAGQVNPTA

SEQ ID NO: 153731 - protein, 6 aa, Mycobacterium bovis
RSAKMN

SEQ ID NO: 153732 - protein, 10 aa, Mycobacterium bovis
RSAKQSEATV

SEQ ID NO: 153733 - protein, 10 aa, Mycobacterium bovis
RSAVTGAHAP

SEQ ID NO: 153734 - protein, 4 aa, Mycobacterium bovis
RSDA

SEQ ID NO: 153735 - protein, 4 aa, Mycobacterium bovis
RSDR

SEQ ID NO: 153736 - protein, 5 aa, Mycobacterium bovis
RSDTR

SEQ ID NO: 153737 - protein, 10 aa, Mycobacterium bovis
RSEATKHRQA

SEQ ID NO: 153738 - protein, 6 aa, Mycobacterium bovis
RSERQA

SEQ ID NO: 153739 - protein, 13 aa, Mycobacterium bovis
RSFSASVSGTELT

SEQ ID NO: 153740 - protein, 10 aa, Mycobacterium bovis
RSGEQADRAA

SEQ ID NO: 153741 - protein, 8 aa, Mycobacterium bovis
RSGGDDEL

SEQ ID NO: 153742 - protein, 7 aa, Mycobacterium bovis
RSGGPFA

SEQ ID NO: 153743 - protein, 5 aa, Mycobacterium bovis
RSGIR

SEQ ID NO: 153744 - protein, 6 aa, Mycobacterium bovis
RSGSLA

SEQ ID NO: 153745 - protein, 6 aa, Mycobacterium bovis
RSHAEG

SEQ ID NO: 153746 - protein, 5 aa, Mycobacterium bovis
RSIDS

SEQ ID NO: 153747 - protein, 5 aa, Mycobacterium bovis
RSITG

SEQ ID NO: 153748 - protein, 10 aa, Mycobacterium bovis
RSPADESVRE

SEQ ID NO: 153749 - protein, 42 aa, Mycobacterium bovis
RSPASRPGKAGDSVRGGRATKPSAKPSTPAPHASRKTTRTPH

SEQ ID NO: 153750 - protein, 5 aa, Mycobacterium bovis
RSPID

SEQ ID NO: 153751 - protein, 9 aa, Mycobacterium bovis
RSPQSPNGT

SEQ ID NO: 153752 - protein, 8 aa, Mycobacterium bovis
RSPRPPQA

SEQ ID NO: 153753 - protein, 6 aa, Mycobacterium bovis
RSPSSV

SEQ ID NO: 153754 - protein, 9 aa, Mycobacterium bovis
RSQIDPTNR

SEQ ID NO: 153755 - protein, 10 aa, Mycobacterium bovis
RSQKAASGAD

SEQ ID NO: 153756 - protein, 32 aa, Mycobacterium bovis
RSQTTRATRATGLQRDQPTTEGGPADSINPRK

SEQ ID NO: 153757 - protein, 8 aa, Mycobacterium bovis
RSREGQAL

SEQ ID NO: 153758 - protein, 5 aa, Mycobacterium bovis
RSREM

SEQ ID NO: 153759 - protein, 7 aa, Mycobacterium bovis
RSRPAQE

SEQ ID NO: 153760 - protein, 7 aa, Mycobacterium bovis
RSRQPKF

SEQ ID NO: 153761 - protein, 4 aa, Mycobacterium bovis
RSRS

SEQ ID NO: 153762 - protein, 6 aa, Mycobacterium bovis
RSRSPA

SEQ ID NO: 153763 - protein, 5 aa, Mycobacterium bovis
RSSAG

SEQ ID NO: 153764 - protein, 6 aa, Mycobacterium bovis
RSSEGE

SEQ ID NO: 153765 - protein, 18 aa, Mycobacterium bovis
RSSGPRTSAPPPPPPADA

SEQ ID NO: 153766 - protein, 13 aa, Mycobacterium bovis
RSTARATSPQSSG

SEQ ID NO: 153767 - protein, 14 aa, Mycobacterium bovis
RSTDVAPPRGETPD

SEQ ID NO: 153768 - protein, 5 aa, Mycobacterium bovis
RSTND

SEQ ID NO: 153769 - protein, 20 aa, Mycobacterium bovis
RSTQAAATTLAQRRSTLSAK

SEQ ID NO: 153770 - protein, 8 aa, Mycobacterium bovis
RSTSPIDS

SEQ ID NO: 153771 - protein, 15 aa, Mycobacterium bovis
RSTVEANARGGTSRD

SEQ ID NO: 153772 - protein, 5 aa, Mycobacterium bovis
RTAAD

SEQ ID NO: 153773 - protein, 5 aa, Mycobacterium bovis
RTAAP

SEQ ID NO: 153774 - protein, 6 aa, Mycobacterium bovis
RTADSV

SEQ ID NO: 153775 - protein, 13 aa, Mycobacterium bovis
RTAGAAQAAGVPN

SEQ ID NO: 153776 - protein, 9 aa, Mycobacterium bovis
RTAHDDDGI

SEQ ID NO: 153777 - protein, 5 aa, Mycobacterium bovis
RTAPP

SEQ ID NO: 153778 - protein, 11 aa, Mycobacterium bovis
RTASSDPEARR

SEQ ID NO: 153779 - protein, 27 aa, Mycobacterium bovis
RTATEEPVATYSSNGQTGGSEGRSASD

SEQ ID NO: 153780 - protein, 8 aa, Mycobacterium bovis
RTDTMGRS

SEQ ID NO: 153781 - protein, 8 aa, Mycobacterium bovis
RTEHGPDK

SEQ ID NO: 153782 - protein, 5 aa, Mycobacterium bovis
RTESG

SEQ ID NO: 153783 - protein, 6 aa, Mycobacterium bovis
RTGAAI

SEQ ID NO: 153784 - protein, 13 aa, Mycobacterium bovis
RTGFSREEQQRLA

SEQ ID NO: 153785 - protein, 4 aa, Mycobacterium bovis
RTGG

SEQ ID NO: 153786 - protein, 10 aa, Mycobacterium bovis
RTGGPGALPA

SEQ ID NO: 153787 - protein, 10 aa, Mycobacterium bovis
RTGPAGDDNI

SEQ ID NO: 153788 - protein, 7 aa, Mycobacterium bovis
RTGPNAP

SEQ ID NO: 153789 - protein, 22 aa, Mycobacterium bovis
RTGPTPPPPPVEQPAELGDPAH

SEQ ID NO: 153790 - protein, 16 aa, Mycobacterium bovis
RTGRSHARESSQGPNQ

SEQ ID NO: 153791 - protein, 10 aa, Mycobacterium bovis
RTGYADVPTP

SEQ ID NO: 153792 - protein, 6 aa, Mycobacterium bovis
RTKEST

SEQ ID NO: 153793 - protein, 17 aa, Mycobacterium bovis
RTNRNPVQMPAPEPAIA

SEQ ID NO: 153794 - protein, 7 aa, Mycobacterium bovis
RTNYNDR

SEQ ID NO: 153795 - protein, 6 aa, Mycobacterium bovis
RTPAGD

SEQ ID NO: 153796 - protein, 6 aa, Mycobacterium bovis
RTPDGV

SEQ ID NO: 153797 - protein, 11 aa, Mycobacterium bovis
RTPEVAAPPVK

SEQ ID NO: 153798 - protein, 6 aa, Mycobacterium bovis
RTPGES

SEQ ID NO: 153799 - protein, 11 aa, Mycobacterium bovis
RTPTPAPTPPS

SEQ ID NO: 153800 - protein, 6 aa, Mycobacterium bovis
RTQELT

SEQ ID NO: 153801 - protein, 4 aa, Mycobacterium bovis
RTQS

SEQ ID NO: 153802 - protein, 15 aa, Mycobacterium bovis
RTRAGIERGIAGELD

SEQ ID NO: 153803 - protein, 5 aa, Mycobacterium bovis
RTRPE

SEQ ID NO: 153804 - protein, 8 aa, Mycobacterium bovis
RTRSAQAA

SEQ ID NO: 153805 - protein, 5 aa, Mycobacterium bovis
RTRTA

SEQ ID NO: 153806 - protein, 6 aa, Mycobacterium bovis
RTSPAL

SEQ ID NO: 153807 - protein, 16 aa, Mycobacterium bovis
RTSPAPAKPAPNSGRR

SEQ ID NO: 153808 - protein, 4 aa, Mycobacterium bovis
RTSQ

SEQ ID NO: 153809 - protein, 7 aa, Mycobacterium bovis
RTSSNDI

SEQ ID NO: 153810 - protein, 8 aa, Mycobacterium bovis
RTSTGARL

SEQ ID NO: 153811 - protein, 6 aa, Mycobacterium bovis
RTTADQ

SEQ ID NO: 153812 - protein, 5 aa, Mycobacterium bovis
RTTAK

SEQ ID NO: 153813 - protein, 5 aa, Mycobacterium bovis
RTTEP

SEQ ID NO: 153814 - protein, 10 aa, Mycobacterium bovis
RTTRTSELGN

SEQ ID NO: 153815 - protein, 25 aa, Mycobacterium bovis
RTTTPTVGAATTATGWRPDPTGRHE

SEQ ID NO: 153816 - protein, 13 aa, Mycobacterium bovis
RTWSATAEHRAQR

SEQ ID NO: 153817 - protein, 14 aa, Mycobacterium bovis
RVAEGKSNDIPERV

SEQ ID NO: 153818 - protein, 5 aa, Mycobacterium bovis
RVASE

SEQ ID NO: 153819 - protein, 5 aa, Mycobacterium bovis
RVDAA

SEQ ID NO: 153820 - protein, 6 aa, Mycobacterium bovis
RVDGGP

SEQ ID NO: 153821 - protein, 8 aa, Mycobacterium bovis
RVDPADDR

SEQ ID NO: 153822 - protein, 6 aa, Mycobacterium bovis
RVEPAR

SEQ ID NO: 153823 - protein, 7 aa, Mycobacterium bovis
RVGDDEA

SEQ ID NO: 153824 - protein, 6 aa, Mycobacterium bovis
RVGTAT

SEQ ID NO: 153825 - protein, 5 aa, Mycobacterium bovis
RVGTD

SEQ ID NO: 153826 - protein, 11 aa, Mycobacterium bovis
RVKPSNRGLQS

SEQ ID NO: 153827 - protein, 14 aa, Mycobacterium bovis
RVPGHGPEQATRPL

SEQ ID NO: 153828 - protein, 5 aa, Mycobacterium bovis
RVSAT

SEQ ID NO: 153829 - protein, 4 aa, Mycobacterium bovis
RVSD

SEQ ID NO: 153830 - protein, 5 aa, Mycobacterium bovis
RVSKT

SEQ ID NO: 153831 - protein, 9 aa, Mycobacterium bovis
RVTSSATSQ

SEQ ID NO: 153832 - protein, 12 aa, Mycobacterium bovis
RWPAERSPAADE

SEQ ID NO: 153833 - protein, 10 aa, Mycobacterium bovis
RYGGGPDQVV

SEQ ID NO: 153834 - protein, 6 aa, Mycobacterium bovis
RYGPRA

SEQ ID NO: 153835 - protein, 4 aa, Mycobacterium bovis
RYGR

SEQ ID NO: 153836 - protein, 8 aa, Mycobacterium bovis
RYPASGGT

SEQ ID NO: 153837 - protein, 16 aa, Mycobacterium bovis
RYRDSAQTSTPTGNLP

SEQ ID NO: 153838 - protein, 14 aa, Mycobacterium bovis
SAAADEPAVECGGD

SEQ ID NO: 153839 - protein, 8 aa, Mycobacterium bovis
SAAASSAA

SEQ ID NO: 153840 - protein, 7 aa, Mycobacterium bovis
SAAGAAS

SEQ ID NO: 153841 - protein, 6 aa, Mycobacterium bovis
SAAGST

SEQ ID NO: 153842 - protein, 6 aa, Mycobacterium bovis
SAAGTL

SEQ ID NO: 153843 - protein, 7 aa, Mycobacterium bovis
SAAPGTV

SEQ ID NO: 153844 - protein, 15 aa, Mycobacterium bovis
SAAPHALAGEPSPTP

SEQ ID NO: 153845 - protein, 8 aa, Mycobacterium bovis
SAAPSNIG

SEQ ID NO: 153846 - protein, 6 aa, Mycobacterium bovis
SAARDL

SEQ ID NO: 153847 - protein, 4 aa, Mycobacterium bovis
SAAS

SEQ ID NO: 153848 - protein, 14 aa, Mycobacterium bovis
SAASSAASISFPDP

SEQ ID NO: 153849 - protein, 8 aa, Mycobacterium bovis
SAASSWAS

SEQ ID NO: 153850 - protein, 6 aa, Mycobacterium bovis
SAATDI

SEQ ID NO: 153851 - protein, 5 aa, Mycobacterium bovis
SAATR

SEQ ID NO: 153852 - protein, 8 aa, Mycobacterium bovis
SAATRGAS

SEQ ID NO: 153853 - protein, 4 aa, Mycobacterium bovis
SAAW

SEQ ID NO: 153854 - protein, 6 aa, Mycobacterium bovis
SACPVE

SEQ ID NO: 153855 - protein, 14 aa, Mycobacterium bovis
SADADGYTRSEGGG

SEQ ID NO: 153856 - protein, 25 aa, Mycobacterium bovis
SADATPAAVQASASLQQARNARTAL

SEQ ID NO: 153857 - protein, 6 aa, Mycobacterium bovis
SADGSF

SEQ ID NO: 153858 - protein, 8 aa, Mycobacterium bovis
SADPAKPI

SEQ ID NO: 153859 - protein, 6 aa, Mycobacterium bovis
SADTRR

SEQ ID NO: 153860 - protein, 7 aa, Mycobacterium bovis
SAEDKIN

SEQ ID NO: 153861 - protein, 12 aa, Mycobacterium bovis
SAESLKETLRGQ

SEQ ID NO: 153862 - protein, 9 aa, Mycobacterium bovis
SAFGTPPAR

SEQ ID NO: 153863 - protein, 6 aa, Mycobacterium bovis
SAGATV

SEQ ID NO: 153864 - protein, 11 aa, Mycobacterium bovis
SAGDQSPQSTV

SEQ ID NO: 153865 - protein, 26 aa, Mycobacterium bovis
SAGEPGARRSAKSVRKLASDDSQSAH

SEQ ID NO: 153866 - protein, 6 aa, Mycobacterium bovis
SAGKVG

SEQ ID NO: 153867 - protein, 7 aa, Mycobacterium bovis
SAGPRRS

SEQ ID NO: 153868 - protein, 10 aa, Mycobacterium bovis
SAGSPRDTDA

SEQ ID NO: 153869 - protein, 13 aa, Mycobacterium bovis
SAGVDDAKEYNSV

SEQ ID NO: 153870 - protein, 5 aa, Mycobacterium bovis
SAHQP

SEQ ID NO: 153871 - protein, 8 aa, Mycobacterium bovis
SAIGTPTE

SEQ ID NO: 153872 - protein, 7 aa, Mycobacterium bovis
SAKAGLT

SEQ ID NO: 153873 - protein, 7 aa, Mycobacterium bovis
SAKERPR

SEQ ID NO: 153874 - protein, 10 aa, Mycobacterium bovis
SALSSSAGSV

SEQ ID NO: 153875 - protein, 8 aa, Mycobacterium bovis
SALTSGAV

SEQ ID NO: 153876 - protein, 8 aa, Mycobacterium bovis
SAMTDSTN

SEQ ID NO: 153877 - protein, 7 aa, Mycobacterium bovis
SAPAAVR

SEQ ID NO: 153878 - protein, 6 aa, Mycobacterium bovis
SAPGTD

SEQ ID NO: 153879 - protein, 14 aa, Mycobacterium bovis
SAPHREQYSDPEKP

SEQ ID NO: 153880 - protein, 7 aa, Mycobacterium bovis
SAPLTQQ

SEQ ID NO: 153881 - protein, 9 aa, Mycobacterium bovis
SAPPAATPG

SEQ ID NO: 153882 - protein, 4 aa, Mycobacterium bovis
SAPQ

SEQ ID NO: 153883 - protein, 5 aa, Mycobacterium bovis
SAPRA

SEQ ID NO: 153884 - protein, 6 aa, Mycobacterium bovis
SAPRCP

SEQ ID NO: 153885 - protein, 6 aa, Mycobacterium bovis
SAPSLN

SEQ ID NO: 153886 - protein, 4 aa, Mycobacterium bovis
SAPV

SEQ ID NO: 153887 - protein, 6 aa, Mycobacterium bovis
SAPVVG

SEQ ID NO: 153888 - protein, 8 aa, Mycobacterium bovis
SAQALTNQ

SEQ ID NO: 153889 - protein, 4 aa, Mycobacterium bovis
SAQH

SEQ ID NO: 153890 - protein, 15 aa, Mycobacterium bovis
SAQNGDGGQADSGAA

SEQ ID NO: 153891 - protein, 9 aa, Mycobacterium bovis
SAQPGARYT

SEQ ID NO: 153892 - protein, 6 aa, Mycobacterium bovis
SAQPSA

SEQ ID NO: 153893 - protein, 5 aa, Mycobacterium bovis
SAQPV

SEQ ID NO: 153894 - protein, 4 aa, Mycobacterium bovis
SAQV

SEQ ID NO: 153895 - protein, 9 aa, Mycobacterium bovis
SARALPGSG

SEQ ID NO: 153896 - protein, 11 aa, Mycobacterium bovis
SARGKDRGSAS

SEQ ID NO: 153897 - protein, 19 aa, Mycobacterium bovis
SARNGFSTTSADPLQSVYH

SEQ ID NO: 153898 - protein, 9 aa, Mycobacterium bovis
SARPNTELE

SEQ ID NO: 153899 - protein, 9 aa, Mycobacterium bovis
SARQASETR

SEQ ID NO: 153900 - protein, 8 aa, Mycobacterium bovis
SARQVTAE

SEQ ID NO: 153901 - protein, 4 aa, Mycobacterium bovis
SARR

SEQ ID NO: 153902 - protein, 4 aa, Mycobacterium bovis
SART

SEQ ID NO: 153903 - protein, 6 aa, Mycobacterium bovis
SARTIT

SEQ ID NO: 153904 - protein, 4 aa, Mycobacterium bovis
SARV

SEQ ID NO: 153905 - protein, 6 aa, Mycobacterium bovis
SASLNS

SEQ ID NO: 153906 - protein, 6 aa, Mycobacterium bovis
SASMGR

SEQ ID NO: 153907 - protein, 14 aa, Mycobacterium bovis
SATATAPADAPASV

SEQ ID NO: 153908 - protein, 4 aa, Mycobacterium bovis
SATE

SEQ ID NO: 153909 - protein, 8 aa, Mycobacterium bovis
SATEGASV

SEQ ID NO: 153910 - protein, 7 aa, Mycobacterium bovis
SATGNPV

SEQ ID NO: 153911 - protein, 14 aa, Mycobacterium bovis
SATGYRAPDGPYET

SEQ ID NO: 153912 - protein, 6 aa, Mycobacterium bovis
SATPAQ

SEQ ID NO: 153913 - protein, 10 aa, Mycobacterium bovis
SATTDEKLTQ

SEQ ID NO: 153914 - protein, 13 aa, Mycobacterium bovis
SATTDEKLTQLGN

SEQ ID NO: 153915 - protein, 6 aa, Mycobacterium bovis
SATVTT

SEQ ID NO: 153916 - protein, 7 aa, Mycobacterium bovis
SCPPPRH

SEQ ID NO: 153917 - protein, 7 aa, Mycobacterium bovis
SCQPGAS

SEQ ID NO: 153918 - protein, 13 aa, Mycobacterium bovis
SDAGATAQERERA

SEQ ID NO: 153919 - protein, 4 aa, Mycobacterium bovis
SDDG

SEQ ID NO: 153920 - protein, 9 aa, Mycobacterium bovis
SDDGGPERF

SEQ ID NO: 153921 - protein, 6 aa, Mycobacterium bovis
SDDKEP

SEQ ID NO: 153922 - protein, 8 aa, Mycobacterium bovis
SDDQNPNL

SEQ ID NO: 153923 - protein, 25 aa, Mycobacterium bovis
SDDTHTGGAVQKPRGLNDENPPTAI

SEQ ID NO: 153924 - protein, 11 aa, Mycobacterium bovis
SDDTTRSRAKT

SEQ ID NO: 153925 - protein, 8 aa, Mycobacterium bovis
SDELPDTR

SEQ ID NO: 153926 - protein, 8 aa, Mycobacterium bovis
SDFDEDEL

SEQ ID NO: 153927 - protein, 5 aa, Mycobacterium bovis
SDGAR

SEQ ID NO: 153928 - protein, 43 aa, Mycobacterium bovis
SDGDDSEAATEQLNARGTSDKTRQRRRGGGALSAQDLLRREGR

SEQ ID NO: 153929 - protein, 8 aa, Mycobacterium bovis
SDGEPATE

SEQ ID NO: 153930 - protein, 5 aa, Mycobacterium bovis
SDGNT

SEQ ID NO: 153931 - protein, 4 aa, Mycobacterium bovis
SDGP

SEQ ID NO: 153932 - protein, 8 aa, Mycobacterium bovis
SDGPERKV

SEQ ID NO: 153933 - protein, 6 aa, Mycobacterium bovis
SDGSEI

SEQ ID NO: 153934 - protein, 13 aa, Mycobacterium bovis
SDGTGTALDSASL

SEQ ID NO: 153935 - protein, 4 aa, Mycobacterium bovis
SDHA

SEQ ID NO: 153936 - protein, 11 aa, Mycobacterium bovis
SDIGNGRGPVD

SEQ ID NO: 153937 - protein, 4 aa, Mycobacterium bovis
SDLG

SEQ ID NO: 153938 - protein, 8 aa, Mycobacterium bovis
SDNGGSTT

SEQ ID NO: 153939 - protein, 10 aa, Mycobacterium bovis
SDPAGADETD

SEQ ID NO: 153940 - protein, 5 aa, Mycobacterium bovis
SDPRE

SEQ ID NO: 153941 - protein, 4 aa, Mycobacterium bovis
SDPS

SEQ ID NO: 153942 - protein, 8 aa, Mycobacterium bovis
SDQEGMQG

SEQ ID NO: 153943 - protein, 5 aa, Mycobacterium bovis
SDQLA

SEQ ID NO: 153944 - protein, 4 aa, Mycobacterium bovis
SDRF

SEQ ID NO: 153945 - protein, 4 aa, Mycobacterium bovis
SDRS

SEQ ID NO: 153946 - protein, 6 aa, Mycobacterium bovis
SDSEVS

SEQ ID NO: 153947 - protein, 23 aa, Mycobacterium bovis
SDSGFGPSTGDHGAQASERGAGT

SEQ ID NO: 153948 - protein, 5 aa, Mycobacterium bovis
SDSGS

SEQ ID NO: 153949 - protein, 26 aa, Mycobacterium bovis
SDSPDGAAQLPGTPTHPGTGQAAASS

SEQ ID NO: 153950 - protein, 5 aa, Mycobacterium bovis
SDYGG

SEQ ID NO: 153951 - protein, 9 aa, Mycobacterium bovis
SEADPAAGR

SEQ ID NO: 153952 - protein, 7 aa, Mycobacterium bovis
SEAERRD

SEQ ID NO: 153953 - protein, 6 aa, Mycobacterium bovis
SEAKAN

SEQ ID NO: 153954 - protein, 9 aa, Mycobacterium bovis
SEAVGGLGS

SEQ ID NO: 153955 - protein, 11 aa, Mycobacterium bovis
SEDGARPAPPD

SEQ ID NO: 153956 - protein, 13 aa, Mycobacterium bovis
SEDGPALPGSDLS

SEQ ID NO: 153957 - protein, 9 aa, Mycobacterium bovis
SEEAKTGKL

SEQ ID NO: 153958 - protein, 7 aa, Mycobacterium bovis
SEFPADR

SEQ ID NO: 153959 - protein, 10 aa, Mycobacterium bovis
SEGEDLETED

SEQ ID NO: 153960 - protein, 15 aa, Mycobacterium bovis
SEQAEGKDTAAESVP

SEQ ID NO: 153961 - protein, 7 aa, Mycobacterium bovis
SEQEKKI

SEQ ID NO: 153962 - protein, 12 aa, Mycobacterium bovis
SEQNPAKPAARG

SEQ ID NO: 153963 - protein, 4 aa, Mycobacterium bovis
SERP

SEQ ID NO: 153964 - protein, 5 aa, Mycobacterium bovis
SERVQ

SEQ ID NO: 153965 - protein, 7 aa, Mycobacterium bovis
SESAPTV

SEQ ID NO: 153966 - protein, 6 aa, Mycobacterium bovis
SESPRM

SEQ ID NO: 153967 - protein, 6 aa, Mycobacterium bovis
SESPSR

SEQ ID NO: 153968 - protein, 7 aa, Mycobacterium bovis
SESQRRR

SEQ ID NO: 153969 - protein, 5 aa, Mycobacterium bovis
SETAG

SEQ ID NO: 153970 - protein, 21 aa, Mycobacterium bovis
SETMANRRTAAGNIESVPSSR

SEQ ID NO: 153971 - protein, 8 aa, Mycobacterium bovis
SETTGQPI

SEQ ID NO: 153972 - protein, 7 aa, Mycobacterium bovis
SEYGGDP

SEQ ID NO: 153973 - protein, 7 aa, Mycobacterium bovis
SEYQSSS

SEQ ID NO: 153974 - protein, 14 aa, Mycobacterium bovis
SFASRTPVNNNPDK

SEQ ID NO: 153975 - protein, 11 aa, Mycobacterium bovis
SFPTSAAPGWS

SEQ ID NO: 153976 - protein, 7 aa, Mycobacterium bovis
SFQPNDK

SEQ ID NO: 153977 - protein, 4 aa, Mycobacterium bovis
SGAA

SEQ ID NO: 153978 - protein, 14 aa, Mycobacterium bovis
SGAAVGTAATLPGI

SEQ ID NO: 153979 - protein, 5 aa, Mycobacterium bovis
SGADT

SEQ ID NO: 153980 - protein, 4 aa, Mycobacterium bovis
SGAG

SEQ ID NO: 153981 - protein, 10 aa, Mycobacterium bovis
SGANNNGSAF

SEQ ID NO: 153982 - protein, 14 aa, Mycobacterium bovis
SGAPFDGASLQGKP

SEQ ID NO: 153983 - protein, 6 aa, Mycobacterium bovis
SGAPRA

SEQ ID NO: 153984 - protein, 16 aa, Mycobacterium bovis
SGASDVDQRSITGESM

SEQ ID NO: 153985 - protein, 9 aa, Mycobacterium bovis
SGATPATQA

SEQ ID NO: 153986 - protein, 7 aa, Mycobacterium bovis
SGATTAS

SEQ ID NO: 153987 - protein, 10 aa, Mycobacterium bovis
SGDDDERKKR

SEQ ID NO: 153988 - protein, 7 aa, Mycobacterium bovis
SGDEGAS

SEQ ID NO: 153989 - protein, 6 aa, Mycobacterium bovis
SGDGIT

SEQ ID NO: 153990 - protein, 9 aa, Mycobacterium bovis
SGDGSTYMP

SEQ ID NO: 153991 - protein, 5 aa, Mycobacterium bovis
SGEEI

SEQ ID NO: 153992 - protein, 5 aa, Mycobacterium bovis
SGESP

SEQ ID NO: 153993 - protein, 6 aa, Mycobacterium bovis
SGEVPA

SEQ ID NO: 153994 - protein, 6 aa, Mycobacterium bovis
SGEWSK

SEQ ID NO: 153995 - protein, 4 aa, Mycobacterium bovis
SGFS

SEQ ID NO: 153996 - protein, 5 aa, Mycobacterium bovis
SGGGQ

SEQ ID NO: 153997 - protein, 4 aa, Mycobacterium bovis
SGGI

SEQ ID NO: 153998 - protein, 4 aa, Mycobacterium bovis
SGGQ

SEQ ID NO: 153999 - protein, 6 aa, Mycobacterium bovis
SGGRSN

SEQ ID NO: 154000 - protein, 8 aa, Mycobacterium bovis
SGGTRGGL

SEQ ID NO: 154001 - protein, 7 aa, Mycobacterium bovis
SGHQPRV

SEQ ID NO: 154002 - protein, 6 aa, Mycobacterium bovis
SGKPNF

SEQ ID NO: 154003 - protein, 10 aa, Mycobacterium bovis
SGKRPFAGDG

SEQ ID NO: 154004 - protein, 8 aa, Mycobacterium bovis
SGKSRKSP

SEQ ID NO: 154005 - protein, 8 aa, Mycobacterium bovis
SGLDAAGV

SEQ ID NO: 154006 - protein, 12 aa, Mycobacterium bovis
SGLGPDRRTASA

SEQ ID NO: 154007 - protein, 5 aa, Mycobacterium bovis
SGLGT

SEQ ID NO: 154008 - protein, 9 aa, Mycobacterium bovis
SGLNGKRPK

SEQ ID NO: 154009 - protein, 11 aa, Mycobacterium bovis
SGLPTPGVPPV

SEQ ID NO: 154010 - protein, 4 aa, Mycobacterium bovis
SGMP

SEQ ID NO: 154011 - protein, 8 aa, Mycobacterium bovis
SGNLTGGG

SEQ ID NO: 154012 - protein, 4 aa, Mycobacterium bovis
SGNY

SEQ ID NO: 154013 - protein, 6 aa, Mycobacterium bovis
SGPEMR

SEQ ID NO: 154014 - protein, 6 aa, Mycobacterium bovis
SGPIRD

SEQ ID NO: 154015 - protein, 9 aa, Mycobacterium bovis
SGPLAEGRT

SEQ ID NO: 154016 - protein, 6 aa, Mycobacterium bovis
SGQGGA

SEQ ID NO: 154017 - protein, 4 aa, Mycobacterium bovis
SGQM

SEQ ID NO: 154018 - protein, 4 aa, Mycobacterium bovis
SGQS

SEQ ID NO: 154019 - protein, 9 aa, Mycobacterium bovis
SGRAPSGAL

SEQ ID NO: 154020 - protein, 8 aa, Mycobacterium bovis
SGRGNSAV

SEQ ID NO: 154021 - protein, 12 aa, Mycobacterium bovis
SGRKEPTFTGAG

SEQ ID NO: 154022 - protein, 9 aa, Mycobacterium bovis
SGRPLERGP

SEQ ID NO: 154023 - protein, 10 aa, Mycobacterium bovis
SGRTGALSRS

SEQ ID NO: 154024 - protein, 7 aa, Mycobacterium bovis
SGRTSLR

SEQ ID NO: 154025 - protein, 5 aa, Mycobacterium bovis
SGRTT

SEQ ID NO: 154026 - protein, 28 aa, Mycobacterium bovis
SGSGCSGSAGYADIDRGTQVTVKNGQGD

SEQ ID NO: 154027 - protein, 8 aa, Mycobacterium bovis
SGSGTADV

SEQ ID NO: 154028 - protein, 8 aa, Mycobacterium bovis
SGSPQPGI

SEQ ID NO: 154029 - protein, 5 aa, Mycobacterium bovis
SGSPS

SEQ ID NO: 154030 - protein, 6 aa, Mycobacterium bovis
SGSPVR

SEQ ID NO: 154031 - protein, 9 aa, Mycobacterium bovis
SGSTRIPSG

SEQ ID NO: 154032 - protein, 9 aa, Mycobacterium bovis
SGSTRTPAG

SEQ ID NO: 154033 - protein, 13 aa, Mycobacterium bovis
SGTAVAIESLILH

SEQ ID NO: 154034 - protein, 4 aa, Mycobacterium bovis
SGTE

SEQ ID NO: 154035 - protein, 10 aa, Mycobacterium bovis
SGTTGSGKST

SEQ ID NO: 154036 - protein, 6 aa, Mycobacterium bovis
SGTWRD

SEQ ID NO: 154037 - protein, 6 aa, Mycobacterium bovis
SGVASA

SEQ ID NO: 154038 - protein, 5 aa, Mycobacterium bovis
SGVAV

SEQ ID NO: 154039 - protein, 4 aa, Mycobacterium bovis
SGVL

SEQ ID NO: 154040 - protein, 4 aa, Mycobacterium bovis
SGVP

SEQ ID NO: 154041 - protein, 9 aa, Mycobacterium bovis
SGVPENVNA

SEQ ID NO: 154042 - protein, 6 aa, Mycobacterium bovis
SGVTTQ

SEQ ID NO: 154043 - protein, 42 aa, Mycobacterium bovis
SGYPPAYQPGYPTDYPPPMPPGGYAPPGYPPPGTSSAGYGDI

SEQ ID NO: 154044 - protein, 21 aa, Mycobacterium bovis
SHALSPPVEVSRQPEPEVDTA

SEQ ID NO: 154045 - protein, 10 aa, Mycobacterium bovis
SHDRRSDLDR

SEQ ID NO: 154046 - protein, 10 aa, Mycobacterium bovis
SHDRSTEPER

SEQ ID NO: 154047 - protein, 6 aa, Mycobacterium bovis
SHEEAT

SEQ ID NO: 154048 - protein, 7 aa, Mycobacterium bovis
SHLEQAG

SEQ ID NO: 154049 - protein, 4 aa, Mycobacterium bovis
SHPG

SEQ ID NO: 154050 - protein, 29 aa, Mycobacterium bovis
SHQPRTATPPSAAALSPTSSSTTPPQPPI

SEQ ID NO: 154051 - protein, 5 aa, Mycobacterium bovis
SHSAQ

SEQ ID NO: 154052 - protein, 7 aa, Mycobacterium bovis
SHSTSTT

SEQ ID NO: 154053 - protein, 42 aa, Mycobacterium bovis
SINTGLNPAPADQVQGTPPPVSDPLQRPGSGTVQCNGQQPNP

SEQ ID NO: 154054 - protein, 12 aa, Mycobacterium bovis
SIPGQPTSQAAR

SEQ ID NO: 154055 - protein, 10 aa, Mycobacterium bovis
SIPITTSGKI

SEQ ID NO: 154056 - protein, 8 aa, Mycobacterium bovis
SIPPPEGK

SEQ ID NO: 154057 - protein, 6 aa, Mycobacterium bovis
SITPGG

SEQ ID NO: 154058 - protein, 7 aa, Mycobacterium bovis
SKAELGK

SEQ ID NO: 154059 - protein, 4 aa, Mycobacterium bovis
SKDN

SEQ ID NO: 154060 - protein, 7 aa, Mycobacterium bovis
SKESPRT

SEQ ID NO: 154061 - protein, 8 aa, Mycobacterium bovis
SKETRPDV

SEQ ID NO: 154062 - protein, 7 aa, Mycobacterium bovis
SKPLRRG

SEQ ID NO: 154063 - protein, 16 aa, Mycobacterium bovis
SKQTYDYTPTPQPPDV

SEQ ID NO: 154064 - protein, 6 aa, Mycobacterium bovis
SKSPVA

SEQ ID NO: 154065 - protein, 11 aa, Mycobacterium bovis
SKSRSNGSGHG

SEQ ID NO: 154066 - protein, 16 aa, Mycobacterium bovis
SLAADPGKAIEGTAYS

SEQ ID NO: 154067 - protein, 8 aa, Mycobacterium bovis
SLAGGDRT

SEQ ID NO: 154068 - protein, 6 aa, Mycobacterium bovis
SLEATR

SEQ ID NO: 154069 - protein, 4 aa, Mycobacterium bovis
SLGG

SEQ ID NO: 154070 - protein, 8 aa, Mycobacterium bovis
SLGGPVSS

SEQ ID NO: 154071 - protein, 6 aa, Mycobacterium bovis
SLGSGR

SEQ ID NO: 154072 - protein, 11 aa, Mycobacterium bovis
SLKADGEVTEP

SEQ ID NO: 154073 - protein, 7 aa, Mycobacterium bovis
SLPAPTH

SEQ ID NO: 154074 - protein, 5 aa, Mycobacterium bovis
SLPEA

SEQ ID NO: 154075 - protein, 4 aa, Mycobacterium bovis
SLPP

SEQ ID NO: 154076 - protein, 11 aa, Mycobacterium bovis
SLPPDTRNGLA

SEQ ID NO: 154077 - protein, 5 aa, Mycobacterium bovis
SLPQT

SEQ ID NO: 154078 - protein, 25 aa, Mycobacterium bovis
SLQPPEEIEGPAIPPASSQLVCVAP

SEQ ID NO: 154079 - protein, 4 aa, Mycobacterium bovis
SLQR

SEQ ID NO: 154080 - protein, 6 aa, Mycobacterium bovis
SLQTGG

SEQ ID NO: 154081 - protein, 6 aa, Mycobacterium bovis
SLRDQR

SEQ ID NO: 154082 - protein, 12 aa, Mycobacterium bovis
SLRRTDKQKDSG

SEQ ID NO: 154083 - protein, 6 aa, Mycobacterium bovis
SLSGAE

SEQ ID NO: 154084 - protein, 13 aa, Mycobacterium bovis
SLSGDSSAFDTRG

SEQ ID NO: 154085 - protein, 10 aa, Mycobacterium bovis
SLSGGGTGTR

SEQ ID NO: 154086 - protein, 16 aa, Mycobacterium bovis
SLSPGGFQDPRSESAR

SEQ ID NO: 154087 - protein, 9 aa, Mycobacterium bovis
SLSSAAGRL

SEQ ID NO: 154088 - protein, 7 aa, Mycobacterium bovis
SNAAQAD

SEQ ID NO: 154089 - protein, 10 aa, Mycobacterium bovis
SNAIASGAQV

SEQ ID NO: 154090 - protein, 7 aa, Mycobacterium bovis
SNARERT

SEQ ID NO: 154091 - protein, 8 aa, Mycobacterium bovis
SNDNLQDL

SEQ ID NO: 154092 - protein, 6 aa, Mycobacterium bovis
SNDTKH

SEQ ID NO: 154093 - protein, 8 aa, Mycobacterium bovis
SNEDGRTA

SEQ ID NO: 154094 - protein, 7 aa, Mycobacterium bovis
SNGAGTV

SEQ ID NO: 154095 - protein, 4 aa, Mycobacterium bovis
SNGD

SEQ ID NO: 154096 - protein, 9 aa, Mycobacterium bovis
SNGPGPGSL

SEQ ID NO: 154097 - protein, 8 aa, Mycobacterium bovis
SNIELGPG

SEQ ID NO: 154098 - protein, 10 aa, Mycobacterium bovis
SNPITAASQA

SEQ ID NO: 154099 - protein, 12 aa, Mycobacterium bovis
SNRDRLAARASR

SEQ ID NO: 154100 - protein, 7 aa, Mycobacterium bovis
SNRSHTA

SEQ ID NO: 154101 - protein, 14 aa, Mycobacterium bovis
SNSPPTGQLTDSPV

SEQ ID NO: 154102 - protein, 19 aa, Mycobacterium bovis
SNSTGQAGLATTATDQLKR

SEQ ID NO: 154103 - protein, 6 aa, Mycobacterium bovis
SNTAAT

SEQ ID NO: 154104 - protein, 9 aa, Mycobacterium bovis
SNTDSDAHE

SEQ ID NO: 154105 - protein, 10 aa, Mycobacterium bovis
SNYDSDGYVG

SEQ ID NO: 154106 - protein, 8 aa, Mycobacterium bovis
SPANTVRG

SEQ ID NO: 154107 - protein, 6 aa, Mycobacterium bovis
SPAQRA

SEQ ID NO: 154108 - protein, 6 aa, Mycobacterium bovis
SPARAV

SEQ ID NO: 154109 - protein, 8 aa, Mycobacterium bovis
SPDGSVHD

SEQ ID NO: 154110 - protein, 7 aa, Mycobacterium bovis
SPDPRYT

SEQ ID NO: 154111 - protein, 6 aa, Mycobacterium bovis
SPDTLD

SEQ ID NO: 154112 - protein, 8 aa, Mycobacterium bovis
SPEAPESR

SEQ ID NO: 154113 - protein, 4 aa, Mycobacterium bovis
SPEQ

SEQ ID NO: 154114 - protein, 5 aa, Mycobacterium bovis
SPEQK

SEQ ID NO: 154115 - protein, 16 aa, Mycobacterium bovis
SPEQVRDGNADPRSDV

SEQ ID NO: 154116 - protein, 8 aa, Mycobacterium bovis
SPFNSQPN

SEQ ID NO: 154117 - protein, 5 aa, Mycobacterium bovis
SPGDF

SEQ ID NO: 154118 - protein, 7 aa, Mycobacterium bovis
SPGEQQR

SEQ ID NO: 154119 - protein, 15 aa, Mycobacterium bovis
SPGPPSPDNAVADTT

SEQ ID NO: 154120 - protein, 16 aa, Mycobacterium bovis
SPGSPGPGGTPVTAAG

SEQ ID NO: 154121 - protein, 8 aa, Mycobacterium bovis
SPGTGFGR

SEQ ID NO: 154122 - protein, 5 aa, Mycobacterium bovis
SPIER

SEQ ID NO: 154123 - protein, 9 aa, Mycobacterium bovis
SPKKSWEGF

SEQ ID NO: 154124 - protein, 11 aa, Mycobacterium bovis
SPKSLTGNQTD

SEQ ID NO: 154125 - protein, 4 aa, Mycobacterium bovis
SPMC

SEQ ID NO: 154126 - protein, 8 aa, Mycobacterium bovis
SPNPDSRP

SEQ ID NO: 154127 - protein, 6 aa, Mycobacterium bovis
SPNRVR

SEQ ID NO: 154128 - protein, 6 aa, Mycobacterium bovis
SPPFQH

SEQ ID NO: 154129 - protein, 12 aa, Mycobacterium bovis
SPPGWTQQKTER

SEQ ID NO: 154130 - protein, 21 aa, Mycobacterium bovis
SPPTIDPGALPPDGPPGPLAP

SEQ ID NO: 154131 - protein, 7 aa, Mycobacterium bovis
SPPTRAA

SEQ ID NO: 154132 - protein, 13 aa, Mycobacterium bovis
SPQDPTEHADGAE

SEQ ID NO: 154133 - protein, 20 aa, Mycobacterium bovis
SPQGGGPVNAYPPSRPGEKN

SEQ ID NO: 154134 - protein, 5 aa, Mycobacterium bovis
SPQQA

SEQ ID NO: 154135 - protein, 9 aa, Mycobacterium bovis
SPQSYRGAP

SEQ ID NO: 154136 - protein, 6 aa, Mycobacterium bovis
SPRNTW

SEQ ID NO: 154137 - protein, 7 aa, Mycobacterium bovis
SPRRASA

SEQ ID NO: 154138 - protein, 6 aa, Mycobacterium bovis
SPRSGI

SEQ ID NO: 154139 - protein, 11 aa, Mycobacterium bovis
SPRSPAAPSLR

SEQ ID NO: 154140 - protein, 4 aa, Mycobacterium bovis
SPRT

SEQ ID NO: 154141 - protein, 11 aa, Mycobacterium bovis
SPSEADKMDPQ

SEQ ID NO: 154142 - protein, 5 aa, Mycobacterium bovis
SPSQS

SEQ ID NO: 154143 - protein, 12 aa, Mycobacterium bovis
SPSVPTANVALI

SEQ ID NO: 154144 - protein, 7 aa, Mycobacterium bovis
SPTDAAA

SEQ ID NO: 154145 - protein, 7 aa, Mycobacterium bovis
SPTPRPA

SEQ ID NO: 154146 - protein, 6 aa, Mycobacterium bovis
SQAETR

SEQ ID NO: 154147 - protein, 6 aa, Mycobacterium bovis
SQAGDL

SEQ ID NO: 154148 - protein, 10 aa, Mycobacterium bovis
SQAQQGGQQH

SEQ ID NO: 154149 - protein, 11 aa, Mycobacterium bovis
SQATGMATADK

SEQ ID NO: 154150 - protein, 4 aa, Mycobacterium bovis
SQDE

SEQ ID NO: 154151 - protein, 11 aa, Mycobacterium bovis
SQDPVYAGTGY

SEQ ID NO: 154152 - protein, 6 aa, Mycobacterium bovis
SQDTTH

SEQ ID NO: 154153 - protein, 7 aa, Mycobacterium bovis
SQDYNGD

SEQ ID NO: 154154 - protein, 58 aa, Mycobacterium bovis
SQESTLPGTAAVTAQPPTMPTVTPPPIQAAPTGQPSWAPNSGPMPASGPTPTPQYYQG

SEQ ID NO: 154155 - protein, 10 aa, Mycobacterium bovis
SQGSRSQKIR

SEQ ID NO: 154156 - protein, 5 aa, Mycobacterium bovis
SQGTT

SEQ ID NO: 154157 - protein, 4 aa, Mycobacterium bovis
SQHT

SEQ ID NO: 154158 - protein, 10 aa, Mycobacterium bovis
SQIAERDQAI

SEQ ID NO: 154159 - protein, 4 aa, Mycobacterium bovis
SQPD

SEQ ID NO: 154160 - protein, 4 aa, Mycobacterium bovis
SQPL

SEQ ID NO: 154161 - protein, 22 aa, Mycobacterium bovis
SQPSYPAPELSAGADVDGRADQ

SEQ ID NO: 154162 - protein, 7 aa, Mycobacterium bovis
SQSAGDQ

SEQ ID NO: 154163 - protein, 7 aa, Mycobacterium bovis
SQSAPGV

SEQ ID NO: 154164 - protein, 12 aa, Mycobacterium bovis
SQTLRGASENEC

SEQ ID NO: 154165 - protein, 34 aa, Mycobacterium bovis
SQTPTTQPAERIDTSGLPAVGDDATVPRDAPKRT

SEQ ID NO: 154166 - protein, 7 aa, Mycobacterium bovis
SQTQGLK

SEQ ID NO: 154167 - protein, 7 aa, Mycobacterium bovis
SQTSNRL

SEQ ID NO: 154168 - protein, 23 aa, Mycobacterium bovis
SRAGANANIGAGDAEDAGGARSD

SEQ ID NO: 154169 - protein, 14 aa, Mycobacterium bovis
SRAKQLSKDMPKTT

SEQ ID NO: 154170 - protein, 7 aa, Mycobacterium bovis
SRAKRTE

SEQ ID NO: 154171 - protein, 5 aa, Mycobacterium bovis
SRDDT

SEQ ID NO: 154172 - protein, 7 aa, Mycobacterium bovis
SRDEIGD

SEQ ID NO: 154173 - protein, 9 aa, Mycobacterium bovis
SRDITPSEA

SEQ ID NO: 154174 - protein, 13 aa, Mycobacterium bovis
SREYQADESGAVL

SEQ ID NO: 154175 - protein, 10 aa, Mycobacterium bovis
SRFNRSKQAA

SEQ ID NO: 154176 - protein, 7 aa, Mycobacterium bovis
SRGDAGE

SEQ ID NO: 154177 - protein, 4 aa, Mycobacterium bovis
SRGL

SEQ ID NO: 154178 - protein, 5 aa, Mycobacterium bovis
SRGRT

SEQ ID NO: 154179 - protein, 9 aa, Mycobacterium bovis
SRIQGPAAQ

SEQ ID NO: 154180 - protein, 9 aa, Mycobacterium bovis
SRKDQERAV

SEQ ID NO: 154181 - protein, 10 aa, Mycobacterium bovis
SRKTKDEDME

SEQ ID NO: 154182 - protein, 8 aa, Mycobacterium bovis
SRLKAGQK

SEQ ID NO: 154183 - protein, 6 aa, Mycobacterium bovis
SRLPTG

SEQ ID NO: 154184 - protein, 5 aa, Mycobacterium bovis
SRMGA

SEQ ID NO: 154185 - protein, 7 aa, Mycobacterium bovis
SRMPQSR

SEQ ID NO: 154186 - protein, 13 aa, Mycobacterium bovis
SRNSSSPPTKLPE

SEQ ID NO: 154187 - protein, 6 aa, Mycobacterium bovis
SRPARH

SEQ ID NO: 154188 - protein, 27 aa, Mycobacterium bovis
SRPARTPTVPSETQPAGRPLAMSSDRL

SEQ ID NO: 154189 - protein, 4 aa, Mycobacterium bovis
SRPG

SEQ ID NO: 154190 - protein, 28 aa, Mycobacterium bovis
SRPGAPPHAGLPSRRTAGDQDHRADPKV

SEQ ID NO: 154191 - protein, 8 aa, Mycobacterium bovis
SRPLGAGT

SEQ ID NO: 154192 - protein, 6 aa, Mycobacterium bovis
SRPQDP

SEQ ID NO: 154193 - protein, 6 aa, Mycobacterium bovis
SRQSLR

SEQ ID NO: 154194 - protein, 9 aa, Mycobacterium bovis
SRRHDAAGN

SEQ ID NO: 154195 - protein, 8 aa, Mycobacterium bovis
SRRNHGRS

SEQ ID NO: 154196 - protein, 5 aa, Mycobacterium bovis
SRRPL

SEQ ID NO: 154197 - protein, 5 aa, Mycobacterium bovis
SRSAD

SEQ ID NO: 154198 - protein, 11 aa, Mycobacterium bovis
SRSGDLPPAVT

SEQ ID NO: 154199 - protein, 8 aa, Mycobacterium bovis
SRSHPAPL

SEQ ID NO: 154200 - protein, 6 aa, Mycobacterium bovis
SRSRRD

SEQ ID NO: 154201 - protein, 5 aa, Mycobacterium bovis
SRSSI

SEQ ID NO: 154202 - protein, 8 aa, Mycobacterium bovis
SRTGAGFG

SEQ ID NO: 154203 - protein, 8 aa, Mycobacterium bovis
SRTGGAPT

SEQ ID NO: 154204 - protein, 9 aa, Mycobacterium bovis
SRTGTVGDY

SEQ ID NO: 154205 - protein, 6 aa, Mycobacterium bovis
SRTRDE

SEQ ID NO: 154206 - protein, 15 aa, Mycobacterium bovis
SRVTNSAGAKDEPRA

SEQ ID NO: 154207 - protein, 10 aa, Mycobacterium bovis
SRYAGEDRET

SEQ ID NO: 154208 - protein, 6 aa, Mycobacterium bovis
SSAAGT

SEQ ID NO: 154209 - protein, 9 aa, Mycobacterium bovis
SSAASNIGS

SEQ ID NO: 154210 - protein, 63 aa, Mycobacterium bovis
SSAGAKPVSADKPASAQSHPGSPAPQAPQPAGQTEGNAAAAPPQGQNPETPTPTAAVQPPPVL

SEQ ID NO: 154211 - protein, 5 aa, Mycobacterium bovis
SSAGV

SEQ ID NO: 154212 - protein, 17 aa, Mycobacterium bovis
SSANGAGGAGPGQQRYR

SEQ ID NO: 154213 - protein, 4 aa, Mycobacterium bovis
SSAP

SEQ ID NO: 154214 - protein, 7 aa, Mycobacterium bovis
SSAPAGA

SEQ ID NO: 154215 - protein, 7 aa, Mycobacterium bovis
SSAPPFE

SEQ ID NO: 154216 - protein, 10 aa, Mycobacterium bovis
SSAQPPTPRC

SEQ ID NO: 154217 - protein, 10 aa, Mycobacterium bovis
SSARSGALDD

SEQ ID NO: 154218 - protein, 9 aa, Mycobacterium bovis
SSCGPTDHI

SEQ ID NO: 154219 - protein, 4 aa, Mycobacterium bovis
SSDA

SEQ ID NO: 154220 - protein, 5 aa, Mycobacterium bovis
SSDGH

SEQ ID NO: 154221 - protein, 6 aa, Mycobacterium bovis
SSDGTA

SEQ ID NO: 154222 - protein, 18 aa, Mycobacterium bovis
SSDSIPQAGTATSDPAPV

SEQ ID NO: 154223 - protein, 8 aa, Mycobacterium bovis
SSEAATDV

SEQ ID NO: 154224 - protein, 8 aa, Mycobacterium bovis
SSEPGDNY

SEQ ID NO: 154225 - protein, 4 aa, Mycobacterium bovis
SSFE

SEQ ID NO: 154226 - protein, 7 aa, Mycobacterium bovis
SSGLSGN

SEQ ID NO: 154227 - protein, 8 aa, Mycobacterium bovis
SSGRGQAA

SEQ ID NO: 154228 - protein, 10 aa, Mycobacterium bovis
SSISQVPPQR

SEQ ID NO: 154229 - protein, 12 aa, Mycobacterium bovis
SSLLAKPAYNGL

SEQ ID NO: 154230 - protein, 5 aa, Mycobacterium bovis
SSLTD

SEQ ID NO: 154231 - protein, 18 aa, Mycobacterium bovis
SSMQPGKPITSMDSSPVT

SEQ ID NO: 154232 - protein, 5 aa, Mycobacterium bovis
SSNPM

SEQ ID NO: 154233 - protein, 8 aa, Mycobacterium bovis
SSNSAQRA

SEQ ID NO: 154234 - protein, 8 aa, Mycobacterium bovis
SSPARGTM

SEQ ID NO: 154235 - protein, 7 aa, Mycobacterium bovis
SSPDTNT

SEQ ID NO: 154236 - protein, 6 aa, Mycobacterium bovis
SSPEPY

SEQ ID NO: 154237 - protein, 5 aa, Mycobacterium bovis
SSPLT

SEQ ID NO: 154238 - protein, 5 aa, Mycobacterium bovis
SSPTG

SEQ ID NO: 154239 - protein, 15 aa, Mycobacterium bovis
SSPVCNSDPACRTSR

SEQ ID NO: 154240 - protein, 5 aa, Mycobacterium bovis
SSQAF

SEQ ID NO: 154241 - protein, 27 aa, Mycobacterium bovis
SSRAFEPVNPSSAGPNSDEKVKAGTLD

SEQ ID NO: 154242 - protein, 5 aa, Mycobacterium bovis
SSRAG

SEQ ID NO: 154243 - protein, 5 aa, Mycobacterium bovis
SSRGN

SEQ ID NO: 154244 - protein, 5 aa, Mycobacterium bovis
SSRIA

SEQ ID NO: 154245 - protein, 9 aa, Mycobacterium bovis
SSSDQQSLA

SEQ ID NO: 154246 - protein, 7 aa, Mycobacterium bovis
SSSDREF

SEQ ID NO: 154247 - protein, 5 aa, Mycobacterium bovis
SSSFR

SEQ ID NO: 154248 - protein, 8 aa, Mycobacterium bovis
SSSRRGRA

SEQ ID NO: 154249 - protein, 12 aa, Mycobacterium bovis
SSTAPAPKASRR

SEQ ID NO: 154250 - protein, 7 aa, Mycobacterium bovis
SSTAQEN

SEQ ID NO: 154251 - protein, 7 aa, Mycobacterium bovis
SSTGEFR

SEQ ID NO: 154252 - protein, 16 aa, Mycobacterium bovis
SSTGHDVEGAQKNFTA

SEQ ID NO: 154253 - protein, 5 aa, Mycobacterium bovis
SSTND

SEQ ID NO: 154254 - protein, 8 aa, Mycobacterium bovis
SSTRGATV

SEQ ID NO: 154255 - protein, 7 aa, Mycobacterium bovis
SSTVSSY

SEQ ID NO: 154256 - protein, 9 aa, Mycobacterium bovis
SSVGQDLTR

SEQ ID NO: 154257 - protein, 7 aa, Mycobacterium bovis
SSWDGPA

SEQ ID NO: 154258 - protein, 8 aa, Mycobacterium bovis
SSWQGPSA

SEQ ID NO: 154259 - protein, 9 aa, Mycobacterium bovis
SSWQGTAAT

SEQ ID NO: 154260 - protein, 13 aa, Mycobacterium bovis
STADNTGDQRIPK

SEQ ID NO: 154261 - protein, 15 aa, Mycobacterium bovis
STAGDEVKDPQKTMP

SEQ ID NO: 154262 - protein, 8 aa, Mycobacterium bovis
STAGDITG

SEQ ID NO: 154263 - protein, 7 aa, Mycobacterium bovis
STAGWRD

SEQ ID NO: 154264 - protein, 4 aa, Mycobacterium bovis
STAS

SEQ ID NO: 154265 - protein, 8 aa, Mycobacterium bovis
STASTLPK

SEQ ID NO: 154266 - protein, 15 aa, Mycobacterium bovis
STATKAPASPTRRRP

SEQ ID NO: 154267 - protein, 6 aa, Mycobacterium bovis
STEERR

SEQ ID NO: 154268 - protein, 4 aa, Mycobacterium bovis
STFP

SEQ ID NO: 154269 - protein, 72 aa, Mycobacterium bovis
STGDQPTAPGTPQRPGVTTTAAPPPSPAPASDGPTTEPAPPVQAPATGGPAPPLQQPLPPPPTTTNTQPAVT

SEQ ID NO: 154270 - protein, 5 aa, Mycobacterium bovis
STGGV

SEQ ID NO: 154271 - protein, 14 aa, Mycobacterium bovis
STGLSETGTRINDQ

SEQ ID NO: 154272 - protein, 4 aa, Mycobacterium bovis
STGR

SEQ ID NO: 154273 - protein, 8 aa, Mycobacterium bovis
STGSGKST

SEQ ID NO: 154274 - protein, 9 aa, Mycobacterium bovis
STGTPRPPF

SEQ ID NO: 154275 - protein, 11 aa, Mycobacterium bovis
STGTTKTGATA

SEQ ID NO: 154276 - protein, 5 aa, Mycobacterium bovis
STHAG

SEQ ID NO: 154277 - protein, 16 aa, Mycobacterium bovis
STHAGADGWKVMLAPT

SEQ ID NO: 154278 - protein, 5 aa, Mycobacterium bovis
STHKS

SEQ ID NO: 154279 - protein, 6 aa, Mycobacterium bovis
STIAAG

SEQ ID NO: 154280 - protein, 20 aa, Mycobacterium bovis
STIDGSTGRRGAARSGYADP

SEQ ID NO: 154281 - protein, 5 aa, Mycobacterium bovis
STLDG

SEQ ID NO: 154282 - protein, 7 aa, Mycobacterium bovis
STLGRNL

SEQ ID NO: 154283 - protein, 9 aa, Mycobacterium bovis
STNGGRETT

SEQ ID NO: 154284 - protein, 9 aa, Mycobacterium bovis
STNPRAGTL

SEQ ID NO: 154285 - protein, 8 aa, Mycobacterium bovis
STPAPPGI

SEQ ID NO: 154286 - protein, 6 aa, Mycobacterium bovis
STPARI

SEQ ID NO: 154287 - protein, 11 aa, Mycobacterium bovis
STPEDPASARF

SEQ ID NO: 154288 - protein, 21 aa, Mycobacterium bovis
STPLAPPQPGSDAATATNNEP

SEQ ID NO: 154289 - protein, 19 aa, Mycobacterium bovis
STPPAVDSSEVPAAGEPPL

SEQ ID NO: 154290 - protein, 6 aa, Mycobacterium bovis
STPRSY

SEQ ID NO: 154291 - protein, 9 aa, Mycobacterium bovis
STPSTAGRI

SEQ ID NO: 154292 - protein, 6 aa, Mycobacterium bovis
STPTAI

SEQ ID NO: 154293 - protein, 6 aa, Mycobacterium bovis
STQDTN

SEQ ID NO: 154294 - protein, 9 aa, Mycobacterium bovis
STRASPDGP

SEQ ID NO: 154295 - protein, 6 aa, Mycobacterium bovis
STRPTT

SEQ ID NO: 154296 - protein, 7 aa, Mycobacterium bovis
STSALDT

SEQ ID NO: 154297 - protein, 7 aa, Mycobacterium bovis
STSGTFQ

SEQ ID NO: 154298 - protein, 7 aa, Mycobacterium bovis
STSTFQG

SEQ ID NO: 154299 - protein, 5 aa, Mycobacterium bovis
STSYA

SEQ ID NO: 154300 - protein, 16 aa, Mycobacterium bovis
STTASRSAKDTAAESL

SEQ ID NO: 154301 - protein, 7 aa, Mycobacterium bovis
STTGYGD

SEQ ID NO: 154302 - protein, 12 aa, Mycobacterium bovis
STTHADSDTQAM

SEQ ID NO: 154303 - protein, 5 aa, Mycobacterium bovis
STTQS

SEQ ID NO: 154304 - protein, 13 aa, Mycobacterium bovis
STTSKDSPNPSMA

SEQ ID NO: 154305 - protein, 13 aa, Mycobacterium bovis
STTSTSGSGGGRR

SEQ ID NO: 154306 - protein, 4 aa, Mycobacterium bovis
SVAA

SEQ ID NO: 154307 - protein, 6 aa, Mycobacterium bovis
SVAEGA

SEQ ID NO: 154308 - protein, 25 aa, Mycobacterium bovis
SVAGTADDAAVEGTKVGVNTGGTYT

SEQ ID NO: 154309 - protein, 7 aa, Mycobacterium bovis
SVAPSAL

SEQ ID NO: 154310 - protein, 14 aa, Mycobacterium bovis
SVDDLSDGHAAEQQ

SEQ ID NO: 154311 - protein, 8 aa, Mycobacterium bovis
SVGDDSMR

SEQ ID NO: 154312 - protein, 5 aa, Mycobacterium bovis
SVGEY

SEQ ID NO: 154313 - protein, 29 aa, Mycobacterium bovis
SVGSTGELTQREGPHELRSPDGPRQLPPP

SEQ ID NO: 154314 - protein, 10 aa, Mycobacterium bovis
SVHGDPRAIR

SEQ ID NO: 154315 - protein, 8 aa, Mycobacterium bovis
SVPPSGTH

SEQ ID NO: 154316 - protein, 64 aa, Mycobacterium bovis
SVRGSSAKSKPPTARKPAVKSGTKREESPTAKTKVATESAAEQIPVAGEPAAEPIPVAGEPAAR

SEQ ID NO: 154317 - protein, 8 aa, Mycobacterium bovis
SVSGPSQD

SEQ ID NO: 154318 - protein, 7 aa, Mycobacterium bovis
SVTGRGR

SEQ ID NO: 154319 - protein, 10 aa, Mycobacterium bovis
SWRDTETERG

SEQ ID NO: 154320 - protein, 7 aa, Mycobacterium bovis
SYGEYGR

SEQ ID NO: 154321 - protein, 11 aa, Mycobacterium bovis
SYGGQGRVPGD

SEQ ID NO: 154322 - protein, 9 aa, Mycobacterium bovis
SYGQSGGPL

SEQ ID NO: 154323 - protein, 5 aa, Mycobacterium bovis
SYPSR

SEQ ID NO: 154324 - protein, 8 aa, Mycobacterium bovis
SYPTYAEA

SEQ ID NO: 154325 - protein, 16 aa, Mycobacterium bovis
SYQPSEPSGPAEPVNR

SEQ ID NO: 154326 - protein, 7 aa, Mycobacterium bovis
SYSTQYP

SEQ ID NO: 154327 - protein, 13 aa, Mycobacterium bovis
TAAAATAAVAPPR

SEQ ID NO: 154328 - protein, 7 aa, Mycobacterium bovis
TAAAQEA

SEQ ID NO: 154329 - protein, 7 aa, Mycobacterium bovis
TAAATAA

SEQ ID NO: 154330 - protein, 4 aa, Mycobacterium bovis
TAAE

SEQ ID NO: 154331 - protein, 13 aa, Mycobacterium bovis
TAAEESLKGTPLE

SEQ ID NO: 154332 - protein, 13 aa, Mycobacterium bovis
TAAEQRAVPGDGA

SEQ ID NO: 154333 - protein, 8 aa, Mycobacterium bovis
TAAGRKGY

SEQ ID NO: 154334 - protein, 12 aa, Mycobacterium bovis
TAAGSQSADDRA

SEQ ID NO: 154335 - protein, 13 aa, Mycobacterium bovis
TAAGSQSADGKAA

SEQ ID NO: 154336 - protein, 13 aa, Mycobacterium bovis
TAAGSQSTDGKAA

SEQ ID NO: 154337 - protein, 14 aa, Mycobacterium bovis
TAAKEAIKGTPLEG

SEQ ID NO: 154338 - protein, 15 aa, Mycobacterium bovis
TAAPNAFATGRNPRN

SEQ ID NO: 154339 - protein, 5 aa, Mycobacterium bovis
TAAQE

SEQ ID NO: 154340 - protein, 10 aa, Mycobacterium bovis
TAASSDLSSV

SEQ ID NO: 154341 - protein, 4 aa, Mycobacterium bovis
TAAT

SEQ ID NO: 154342 - protein, 8 aa, Mycobacterium bovis
TAATETTR

SEQ ID NO: 154343 - protein, 15 aa, Mycobacterium bovis
TAATGASELGSGGRT

SEQ ID NO: 154344 - protein, 6 aa, Mycobacterium bovis
TAEPDR

SEQ ID NO: 154345 - protein, 7 aa, Mycobacterium bovis
TAGATAV

SEQ ID NO: 154346 - protein, 7 aa, Mycobacterium bovis
TAGIDSS

SEQ ID NO: 154347 - protein, 4 aa, Mycobacterium bovis
TAGM

SEQ ID NO: 154348 - protein, 6 aa, Mycobacterium bovis
TAGQAE

SEQ ID NO: 154349 - protein, 10 aa, Mycobacterium bovis
TAGQGEDPRY

SEQ ID NO: 154350 - protein, 12 aa, Mycobacterium bovis
TAGRPRSADKPV

SEQ ID NO: 154351 - protein, 5 aa, Mycobacterium bovis
TAGRT

SEQ ID NO: 154352 - protein, 8 aa, Mycobacterium bovis
TAHHPPAG

SEQ ID NO: 154353 - protein, 13 aa, Mycobacterium bovis
TAHRGARESSNIV

SEQ ID NO: 154354 - protein, 9 aa, Mycobacterium bovis
TAKGGEVAA

SEQ ID NO: 154355 - protein, 11 aa, Mycobacterium bovis
TAKRGAQITQA

SEQ ID NO: 154356 - protein, 5 aa, Mycobacterium bovis
TALAP

SEQ ID NO: 154357 - protein, 5 aa, Mycobacterium bovis
TALGS

SEQ ID NO: 154358 - protein, 4 aa, Mycobacterium bovis
TALT

SEQ ID NO: 154359 - protein, 5 aa, Mycobacterium bovis
TALTE

SEQ ID NO: 154360 - protein, 6 aa, Mycobacterium bovis
TANGAL

SEQ ID NO: 154361 - protein, 6 aa, Mycobacterium bovis
TANTYS

SEQ ID NO: 154362 - protein, 5 aa, Mycobacterium bovis
TAPAN

SEQ ID NO: 154363 - protein, 10 aa, Mycobacterium bovis
TAPKQGKDAN

SEQ ID NO: 154364 - protein, 14 aa, Mycobacterium bovis
TAPLGTSPDGRSAT

SEQ ID NO: 154365 - protein, 7 aa, Mycobacterium bovis
TAPPDPL

SEQ ID NO: 154366 - protein, 10 aa, Mycobacterium bovis
TAQESADSMD

SEQ ID NO: 154367 - protein, 8 aa, Mycobacterium bovis
TAQESTKA

SEQ ID NO: 154368 - protein, 13 aa, Mycobacterium bovis
TAQNDPSTVRGAR

SEQ ID NO: 154369 - protein, 8 aa, Mycobacterium bovis
TAQPHTAP

SEQ ID NO: 154370 - protein, 14 aa, Mycobacterium bovis
TAQQAQSVVDDPDE

SEQ ID NO: 154371 - protein, 13 aa, Mycobacterium bovis
TAQQPGQTLPVGA

SEQ ID NO: 154372 - protein, 8 aa, Mycobacterium bovis
TARDNGTL

SEQ ID NO: 154373 - protein, 9 aa, Mycobacterium bovis
TARGGERGM

SEQ ID NO: 154374 - protein, 17 aa, Mycobacterium bovis
TARGGTGQLSAHPGRPK

SEQ ID NO: 154375 - protein, 9 aa, Mycobacterium bovis
TARPGTTTA

SEQ ID NO: 154376 - protein, 7 aa, Mycobacterium bovis
TARRPLA

SEQ ID NO: 154377 - protein, 4 aa, Mycobacterium bovis
TASA

SEQ ID NO: 154378 - protein, 7 aa, Mycobacterium bovis
TASDGSV

SEQ ID NO: 154379 - protein, 9 aa, Mycobacterium bovis
TASGGPVGV

SEQ ID NO: 154380 - protein, 13 aa, Mycobacterium bovis
TASGSDQQSLSDR

SEQ ID NO: 154381 - protein, 12 aa, Mycobacterium bovis
TASNDPDARRQL

SEQ ID NO: 154382 - protein, 8 aa, Mycobacterium bovis
TATAGASG

SEQ ID NO: 154383 - protein, 13 aa, Mycobacterium bovis
TATGAQSSDGKAA

SEQ ID NO: 154384 - protein, 11 aa, Mycobacterium bovis
TATGGRALPGS

SEQ ID NO: 154385 - protein, 5 aa, Mycobacterium bovis
TATGL

SEQ ID NO: 154386 - protein, 4 aa, Mycobacterium bovis
TATI

SEQ ID NO: 154387 - protein, 8 aa, Mycobacterium bovis
TATRQAYG

SEQ ID NO: 154388 - protein, 6 aa, Mycobacterium bovis
TATTPA

SEQ ID NO: 154389 - protein, 6 aa, Mycobacterium bovis
TAYGTA

SEQ ID NO: 154390 - protein, 14 aa, Mycobacterium bovis
TAYNPLPNGTGNGL

SEQ ID NO: 154391 - protein, 6 aa, Mycobacterium bovis
TDADRR

SEQ ID NO: 154392 - protein, 10 aa, Mycobacterium bovis
TDAGARDRAS

SEQ ID NO: 154393 - protein, 8 aa, Mycobacterium bovis
TDAQRDGD

SEQ ID NO: 154394 - protein, 9 aa, Mycobacterium bovis
TDDGPDIDP

SEQ ID NO: 154395 - protein, 15 aa, Mycobacterium bovis
TDDGRSASDPDADHA

SEQ ID NO: 154396 - protein, 21 aa, Mycobacterium bovis
TDFPSEAPARFEGDSYNEGGP

SEQ ID NO: 154397 - protein, 5 aa, Mycobacterium bovis
TDGAI

SEQ ID NO: 154398 - protein, 11 aa, Mycobacterium bovis
TDGDEAVANET

SEQ ID NO: 154399 - protein, 7 aa, Mycobacterium bovis
TDGYRRG

SEQ ID NO: 154400 - protein, 8 aa, Mycobacterium bovis
TDHGAGLS

SEQ ID NO: 154401 - protein, 4 aa, Mycobacterium bovis
TDHK

SEQ ID NO: 154402 - protein, 5 aa, Mycobacterium bovis
TDHTR

SEQ ID NO: 154403 - protein, 12 aa, Mycobacterium bovis
TDIRDGQTVAER

SEQ ID NO: 154404 - protein, 8 aa, Mycobacterium bovis
TDLRTPKA

SEQ ID NO: 154405 - protein, 8 aa, Mycobacterium bovis
TDNSSARA

SEQ ID NO: 154406 - protein, 8 aa, Mycobacterium bovis
TDPAPANR

SEQ ID NO: 154407 - protein, 6 aa, Mycobacterium bovis
TDPDAA

SEQ ID NO: 154408 - protein, 21 aa, Mycobacterium bovis
TDPGASPNLSDVSKQRVSGSQ

SEQ ID NO: 154409 - protein, 6 aa, Mycobacterium bovis
TDPHNR

SEQ ID NO: 154410 - protein, 9 aa, Mycobacterium bovis
TDRSLAGEN

SEQ ID NO: 154411 - protein, 4 aa, Mycobacterium bovis
TDSD

SEQ ID NO: 154412 - protein, 6 aa, Mycobacterium bovis
TDSQDP

SEQ ID NO: 154413 - protein, 7 aa, Mycobacterium bovis
TDTDNNR

SEQ ID NO: 154414 - protein, 16 aa, Mycobacterium bovis
TDTEADQTKPGDEPKK

SEQ ID NO: 154415 - protein, 12 aa, Mycobacterium bovis
TDVGTDSATYAR

SEQ ID NO: 154416 - protein, 12 aa, Mycobacterium bovis
TDVRRAPHAGGR

SEQ ID NO: 154417 - protein, 6 aa, Mycobacterium bovis
TDWPRY

SEQ ID NO: 154418 - protein, 10 aa, Mycobacterium bovis
TEADNIDPQQ

SEQ ID NO: 154419 - protein, 8 aa, Mycobacterium bovis
TEARQPGG

SEQ ID NO: 154420 - protein, 12 aa, Mycobacterium bovis
TEASSGRVPNPY

SEQ ID NO: 154421 - protein, 23 aa, Mycobacterium bovis
TEATESAVARTDGDSTTDTASKL

SEQ ID NO: 154422 - protein, 14 aa, Mycobacterium bovis
TEDAERQIDSCDPT

SEQ ID NO: 154423 - protein, 9 aa, Mycobacterium bovis
TEDSSPTRV

SEQ ID NO: 154424 - protein, 15 aa, Mycobacterium bovis
TEEGGQYKMSKVEFV

SEQ ID NO: 154425 - protein, 4 aa, Mycobacterium bovis
TEFD

SEQ ID NO: 154426 - protein, 8 aa, Mycobacterium bovis
TEFPGQAG

SEQ ID NO: 154427 - protein, 6 aa, Mycobacterium bovis
TEGFSG

SEQ ID NO: 154428 - protein, 7 aa, Mycobacterium bovis
TELGGQP

SEQ ID NO: 154429 - protein, 12 aa, Mycobacterium bovis
TEPDSGSDAFGG

SEQ ID NO: 154430 - protein, 6 aa, Mycobacterium bovis
TERDGV

SEQ ID NO: 154431 - protein, 7 aa, Mycobacterium bovis
TERPHPY

SEQ ID NO: 154432 - protein, 5 aa, Mycobacterium bovis
TERQV

SEQ ID NO: 154433 - protein, 5 aa, Mycobacterium bovis
TERRS

SEQ ID NO: 154434 - protein, 7 aa, Mycobacterium bovis
TESAERD

SEQ ID NO: 154435 - protein, 11 aa, Mycobacterium bovis
TESVEKRSEQR

SEQ ID NO: 154436 - protein, 7 aa, Mycobacterium bovis
TETETAT

SEQ ID NO: 154437 - protein, 4 aa, Mycobacterium bovis
TETT

SEQ ID NO: 154438 - protein, 21 aa, Mycobacterium bovis
TGAAKGIQKGLSSGSKSTAAA

SEQ ID NO: 154439 - protein, 10 aa, Mycobacterium bovis
TGAGSGIGRE

SEQ ID NO: 154440 - protein, 32 aa, Mycobacterium bovis
TGAGTAGAATPAAGAAPSAGAAPAPAAPATAS

SEQ ID NO: 154441 - protein, 5 aa, Mycobacterium bovis
TGAHS

SEQ ID NO: 154442 - protein, 4 aa, Mycobacterium bovis
TGAN

SEQ ID NO: 154443 - protein, 34 aa, Mycobacterium bovis
TGAPGKYFSSGQTITKGTVPSEIGPALDNSNRGL

SEQ ID NO: 154444 - protein, 9 aa, Mycobacterium bovis
TGASGAGKT

SEQ ID NO: 154445 - protein, 8 aa, Mycobacterium bovis
TGATSVPA

SEQ ID NO: 154446 - protein, 9 aa, Mycobacterium bovis
TGAYGPASI

SEQ ID NO: 154447 - protein, 10 aa, Mycobacterium bovis
TGCTRGPTVT

SEQ ID NO: 154448 - protein, 7 aa, Mycobacterium bovis
TGDFGAQ

SEQ ID NO: 154449 - protein, 5 aa, Mycobacterium bovis
TGDGL

SEQ ID NO: 154450 - protein, 10 aa, Mycobacterium bovis
TGDGRPPGAR

SEQ ID NO: 154451 - protein, 4 aa, Mycobacterium bovis
TGDP

SEQ ID NO: 154452 - protein, 13 aa, Mycobacterium bovis
TGDQGGSQANESV

SEQ ID NO: 154453 - protein, 67 aa, Mycobacterium bovis
TGDSDDDGGRRSAQRPARTRSRHARPPSEDNREPIAERRSRRRPRPQNDPHPRRNAHERPAPRSSRF

SEQ ID NO: 154454 - protein, 11 aa, Mycobacterium bovis
TGEAETPAGPL

SEQ ID NO: 154455 - protein, 13 aa, Mycobacterium bovis
TGEAKPTRVRPGG

SEQ ID NO: 154456 - protein, 10 aa, Mycobacterium bovis
TGEAKPVRAY

SEQ ID NO: 154457 - protein, 5 aa, Mycobacterium bovis
TGEAV

SEQ ID NO: 154458 - protein, 5 aa, Mycobacterium bovis
TGEFE

SEQ ID NO: 154459 - protein, 7 aa, Mycobacterium bovis
TGEPAGA

SEQ ID NO: 154460 - protein, 8 aa, Mycobacterium bovis
TGEPDELT

SEQ ID NO: 154461 - protein, 10 aa, Mycobacterium bovis
TGESDGPPRA

SEQ ID NO: 154462 - protein, 13 aa, Mycobacterium bovis
TGESVKAETMPSE

SEQ ID NO: 154463 - protein, 7 aa, Mycobacterium bovis
TGETADR

SEQ ID NO: 154464 - protein, 10 aa, Mycobacterium bovis
TGETSPGVAG

SEQ ID NO: 154465 - protein, 11 aa, Mycobacterium bovis
TGGAARSIGRA

SEQ ID NO: 154466 - protein, 6 aa, Mycobacterium bovis
TGGAGA

SEQ ID NO: 154467 - protein, 12 aa, Mycobacterium bovis
TGGGLPAAAVAS

SEQ ID NO: 154468 - protein, 10 aa, Mycobacterium bovis
TGGGPQGSTD

SEQ ID NO: 154469 - protein, 9 aa, Mycobacterium bovis
TGGNTGTQI

SEQ ID NO: 154470 - protein, 9 aa, Mycobacterium bovis
TGGPESETL

SEQ ID NO: 154471 - protein, 10 aa, Mycobacterium bovis
TGGQGDAPPA

SEQ ID NO: 154472 - protein, 7 aa, Mycobacterium bovis
TGGRTAQ

SEQ ID NO: 154473 - protein, 6 aa, Mycobacterium bovis
TGHSLG

SEQ ID NO: 154474 - protein, 7 aa, Mycobacterium bovis
TGKEEPL

SEQ ID NO: 154475 - protein, 22 aa, Mycobacterium bovis
TGKGGALSSGKYAPDLAPANEQ

SEQ ID NO: 154476 - protein, 7 aa, Mycobacterium bovis
TGKPLSP

SEQ ID NO: 154477 - protein, 7 aa, Mycobacterium bovis
TGKRRDR

SEQ ID NO: 154478 - protein, 6 aa, Mycobacterium bovis
TGKTRS

SEQ ID NO: 154479 - protein, 5 aa, Mycobacterium bovis
TGNSV

SEQ ID NO: 154480 - protein, 18 aa, Mycobacterium bovis
TGPAALNADQAEAGDKSI

SEQ ID NO: 154481 - protein, 9 aa, Mycobacterium bovis
TGPAPPGLA

SEQ ID NO: 154482 - protein, 8 aa, Mycobacterium bovis
TGPDGRIQ

SEQ ID NO: 154483 - protein, 4 aa, Mycobacterium bovis
TGPG

SEQ ID NO: 154484 - protein, 8 aa, Mycobacterium bovis
TGPGPLGA

SEQ ID NO: 154485 - protein, 8 aa, Mycobacterium bovis
TGPKTAVR

SEQ ID NO: 154486 - protein, 10 aa, Mycobacterium bovis
TGPQGGPARL

SEQ ID NO: 154487 - protein, 9 aa, Mycobacterium bovis
TGPRPGGFG

SEQ ID NO: 154488 - protein, 5 aa, Mycobacterium bovis
TGPSA

SEQ ID NO: 154489 - protein, 9 aa, Mycobacterium bovis
TGQEARGEA

SEQ ID NO: 154490 - protein, 16 aa, Mycobacterium bovis
TGQGSRVAVAAAQDGT

SEQ ID NO: 154491 - protein, 8 aa, Mycobacterium bovis
TGQRDRSR

SEQ ID NO: 154492 - protein, 7 aa, Mycobacterium bovis
TGQTRDA

SEQ ID NO: 154493 - protein, 18 aa, Mycobacterium bovis
TGQTRRECREEIRRSNGW

SEQ ID NO: 154494 - protein, 4 aa, Mycobacterium bovis
TGQY

SEQ ID NO: 154495 - protein, 6 aa, Mycobacterium bovis
TGRGAE

SEQ ID NO: 154496 - protein, 8 aa, Mycobacterium bovis
TGRPDNPH

SEQ ID NO: 154497 - protein, 12 aa, Mycobacterium bovis
TGRPTVGRAGPV

SEQ ID NO: 154498 - protein, 9 aa, Mycobacterium bovis
TGSPIPTPS

SEQ ID NO: 154499 - protein, 9 aa, Mycobacterium bovis
TGSPLDPSA

SEQ ID NO: 154500 - protein, 6 aa, Mycobacterium bovis
TGSPVA

SEQ ID NO: 154501 - protein, 9 aa, Mycobacterium bovis
TGSPVTPDH

SEQ ID NO: 154502 - protein, 4 aa, Mycobacterium bovis
TGSV

SEQ ID NO: 154503 - protein, 5 aa, Mycobacterium bovis
TGSVG

SEQ ID NO: 154504 - protein, 5 aa, Mycobacterium bovis
TGTGE

SEQ ID NO: 154505 - protein, 7 aa, Mycobacterium bovis
TGTLSEN

SEQ ID NO: 154506 - protein, 5 aa, Mycobacterium bovis
TGTLT

SEQ ID NO: 154507 - protein, 10 aa, Mycobacterium bovis
TGTLTRGTPE

SEQ ID NO: 154508 - protein, 7 aa, Mycobacterium bovis
TGTLTTG

SEQ ID NO: 154509 - protein, 19 aa, Mycobacterium bovis
TGTSTPRPAAAQTVRDSPA

SEQ ID NO: 154510 - protein, 5 aa, Mycobacterium bovis
THAQR

SEQ ID NO: 154511 - protein, 4 aa, Mycobacterium bovis
THDD

SEQ ID NO: 154512 - protein, 8 aa, Mycobacterium bovis
THGRNKTA

SEQ ID NO: 154513 - protein, 4 aa, Mycobacterium bovis
THGT

SEQ ID NO: 154514 - protein, 8 aa, Mycobacterium bovis
THPTDGTV

SEQ ID NO: 154515 - protein, 17 aa, Mycobacterium bovis
THRAGPGYRRRSPVETT

SEQ ID NO: 154516 - protein, 6 aa, Mycobacterium bovis
TIESRA

SEQ ID NO: 154517 - protein, 10 aa, Mycobacterium bovis
TIGGGFTDAG

SEQ ID NO: 154518 - protein, 30 aa, Mycobacterium bovis
TIPPPPPPEGTGPPPGPAPGPQPQASGPAY

SEQ ID NO: 154519 - protein, 13 aa, Mycobacterium bovis
TIPRTSSGKIGRR

SEQ ID NO: 154520 - protein, 138 aa, Mycobacterium bovis
TIPTAPPTTPVTTSATTPPTTPPTTPVTTPPTTPPTTPVTTPPTTPPTTPVTTPPTTVAPTTVAPTTVAPTTVAPTTVAPATATPTTVAPQPTQQPTQQPTQQMPTQQQTVAPQTVAPAPQPPSGGRNGSGGGDLFGG

SEQ ID NO: 154521 - protein, 4 aa, Mycobacterium bovis
TIRQ

SEQ ID NO: 154522 - protein, 7 aa, Mycobacterium bovis
TISPAQQ

SEQ ID NO: 154523 - protein, 10 aa, Mycobacterium bovis
TITGTSVEGN

SEQ ID NO: 154524 - protein, 6 aa, Mycobacterium bovis
TKAAIT

SEQ ID NO: 154525 - protein, 13 aa, Mycobacterium bovis
TKAGSPPTSTEFD

SEQ ID NO: 154526 - protein, 9 aa, Mycobacterium bovis
TKPEVRRQS

SEQ ID NO: 154527 - protein, 4 aa, Mycobacterium bovis
TKRG

SEQ ID NO: 154528 - protein, 16 aa, Mycobacterium bovis
TKSDSRTSDFQPVSAT

SEQ ID NO: 154529 - protein, 7 aa, Mycobacterium bovis
TKTTPTA

SEQ ID NO: 154530 - protein, 10 aa, Mycobacterium bovis
TLAKTGVGTG

SEQ ID NO: 154531 - protein, 7 aa, Mycobacterium bovis
TLEQPAA

SEQ ID NO: 154532 - protein, 11 aa, Mycobacterium bovis
TLGDGRSPKVA

SEQ ID NO: 154533 - protein, 6 aa, Mycobacterium bovis
TLGNGG

SEQ ID NO: 154534 - protein, 7 aa, Mycobacterium bovis
TLGTSTE

SEQ ID NO: 154535 - protein, 5 aa, Mycobacterium bovis
TLPAA

SEQ ID NO: 154536 - protein, 10 aa, Mycobacterium bovis
TLPPAGQAPW

SEQ ID NO: 154537 - protein, 13 aa, Mycobacterium bovis
TLPTEPMRSRGRN

SEQ ID NO: 154538 - protein, 15 aa, Mycobacterium bovis
TLSPRTGRRPETPAY

SEQ ID NO: 154539 - protein, 14 aa, Mycobacterium bovis
TLSTTGNAQEPAGR

SEQ ID NO: 154540 - protein, 15 aa, Mycobacterium bovis
TLTSKTDPASGAGLA

SEQ ID NO: 154541 - protein, 10 aa, Mycobacterium bovis
TMGDPSPGFP

SEQ ID NO: 154542 - protein, 19 aa, Mycobacterium bovis
TNANPQPVSESELGHTKRG

SEQ ID NO: 154543 - protein, 4 aa, Mycobacterium bovis
TNGA

SEQ ID NO: 154544 - protein, 20 aa, Mycobacterium bovis
TNGANTAGTFSEGPAKTAIQ

SEQ ID NO: 154545 - protein, 10 aa, Mycobacterium bovis
TNGDGVERRL

SEQ ID NO: 154546 - protein, 7 aa, Mycobacterium bovis
TNGYTAE

SEQ ID NO: 154547 - protein, 8 aa, Mycobacterium bovis
TNNARGEV

SEQ ID NO: 154548 - protein, 5 aa, Mycobacterium bovis
TNPEH

SEQ ID NO: 154549 - protein, 19 aa, Mycobacterium bovis
TNPWRGPPIPYGTEVTDGR

SEQ ID NO: 154550 - protein, 6 aa, Mycobacterium bovis
TNRDEI

SEQ ID NO: 154551 - protein, 10 aa, Mycobacterium bovis
TNSAGNYHPW

SEQ ID NO: 154552 - protein, 12 aa, Mycobacterium bovis
TNVTRYSDATAG

SEQ ID NO: 154553 - protein, 9 aa, Mycobacterium bovis
TPAAGAPAI

SEQ ID NO: 154554 - protein, 5 aa, Mycobacterium bovis
TPAEQ

SEQ ID NO: 154555 - protein, 4 aa, Mycobacterium bovis
TPAL

SEQ ID NO: 154556 - protein, 9 aa, Mycobacterium bovis
TPAPGAAEE

SEQ ID NO: 154557 - protein, 37 aa, Mycobacterium bovis
TPAPTTPASAPPATTQPPATTQPPATTSPSPPPIPPI

SEQ ID NO: 154558 - protein, 6 aa, Mycobacterium bovis
TPAPYG

SEQ ID NO: 154559 - protein, 5 aa, Mycobacterium bovis
TPAQI

SEQ ID NO: 154560 - protein, 4 aa, Mycobacterium bovis
TPAT

SEQ ID NO: 154561 - protein, 8 aa, Mycobacterium bovis
TPDEVDPD

SEQ ID NO: 154562 - protein, 10 aa, Mycobacterium bovis
TPDGTATLGG

SEQ ID NO: 154563 - protein, 11 aa, Mycobacterium bovis
TPDRDFNRDSR

SEQ ID NO: 154564 - protein, 9 aa, Mycobacterium bovis
TPDTSRGQQ

SEQ ID NO: 154565 - protein, 21 aa, Mycobacterium bovis
TPDYSAKKLDTDTWEDGTNGG

SEQ ID NO: 154566 - protein, 4 aa, Mycobacterium bovis
TPEA

SEQ ID NO: 154567 - protein, 8 aa, Mycobacterium bovis
TPERRQRE

SEQ ID NO: 154568 - protein, 4 aa, Mycobacterium bovis
TPEY

SEQ ID NO: 154569 - protein, 7 aa, Mycobacterium bovis
TPFTGDS

SEQ ID NO: 154570 - protein, 5 aa, Mycobacterium bovis
TPGAV

SEQ ID NO: 154571 - protein, 15 aa, Mycobacterium bovis
TPGPDDPAPPARSGP

SEQ ID NO: 154572 - protein, 10 aa, Mycobacterium bovis
TPGTERRTAT

SEQ ID NO: 154573 - protein, 7 aa, Mycobacterium bovis
TPKAPGL

SEQ ID NO: 154574 - protein, 15 aa, Mycobacterium bovis
TPKPADGVPPPPLNT

SEQ ID NO: 154575 - protein, 17 aa, Mycobacterium bovis
TPKPGTGPSRKTQERGH

SEQ ID NO: 154576 - protein, 7 aa, Mycobacterium bovis
TPLPPRR

SEQ ID NO: 154577 - protein, 8 aa, Mycobacterium bovis
TPNDPRFQ

SEQ ID NO: 154578 - protein, 12 aa, Mycobacterium bovis
TPPATRPSYAGA

SEQ ID NO: 154579 - protein, 10 aa, Mycobacterium bovis
TPPNSGSPEW

SEQ ID NO: 154580 - protein, 11 aa, Mycobacterium bovis
TPPQSTPLPQT

SEQ ID NO: 154581 - protein, 15 aa, Mycobacterium bovis
TPPQTPGGTAPRART

SEQ ID NO: 154582 - protein, 5 aa, Mycobacterium bovis
TPPVP

SEQ ID NO: 154583 - protein, 6 aa, Mycobacterium bovis
TPRAVA

SEQ ID NO: 154584 - protein, 7 aa, Mycobacterium bovis
TPRMPDE

SEQ ID NO: 154585 - protein, 6 aa, Mycobacterium bovis
TPRPQL

SEQ ID NO: 154586 - protein, 23 aa, Mycobacterium bovis
TPRTSRTLAPRLDPEAVGRTTES

SEQ ID NO: 154587 - protein, 5 aa, Mycobacterium bovis
TPRYQ

SEQ ID NO: 154588 - protein, 8 aa, Mycobacterium bovis
TPSATAVG

SEQ ID NO: 154589 - protein, 7 aa, Mycobacterium bovis
TPSGALT

SEQ ID NO: 154590 - protein, 6 aa, Mycobacterium bovis
TPSSQT

SEQ ID NO: 154591 - protein, 17 aa, Mycobacterium bovis
TPTAGAHRAPLTNAVSR

SEQ ID NO: 154592 - protein, 5 aa, Mycobacterium bovis
TPTAL

SEQ ID NO: 154593 - protein, 6 aa, Mycobacterium bovis
TPTARG

SEQ ID NO: 154594 - protein, 13 aa, Mycobacterium bovis
TPTKRTWSSGSLP

SEQ ID NO: 154595 - protein, 5 aa, Mycobacterium bovis
TPTPA

SEQ ID NO: 154596 - protein, 8 aa, Mycobacterium bovis
TPTPGAAQ

SEQ ID NO: 154597 - protein, 5 aa, Mycobacterium bovis
TPTPQ

SEQ ID NO: 154598 - protein, 6 aa, Mycobacterium bovis
TPTPRM

SEQ ID NO: 154599 - protein, 22 aa, Mycobacterium bovis
TPTSGPSAVYSPASGELVGPDG

SEQ ID NO: 154600 - protein, 5 aa, Mycobacterium bovis
TPTTA

SEQ ID NO: 154601 - protein, 7 aa, Mycobacterium bovis
TPTTAGT

SEQ ID NO: 154602 - protein, 4 aa, Mycobacterium bovis
TPTV

SEQ ID NO: 154603 - protein, 8 aa, Mycobacterium bovis
TPVNRGYA

SEQ ID NO: 154604 - protein, 6 aa, Mycobacterium bovis
TQASYA

SEQ ID NO: 154605 - protein, 15 aa, Mycobacterium bovis
TQATTAASDVQAVPG

SEQ ID NO: 154606 - protein, 8 aa, Mycobacterium bovis
TQEGAEGW

SEQ ID NO: 154607 - protein, 6 aa, Mycobacterium bovis
TQEGLQ

SEQ ID NO: 154608 - protein, 10 aa, Mycobacterium bovis
TQGAPPSPLQ

SEQ ID NO: 154609 - protein, 4 aa, Mycobacterium bovis
TQHA

SEQ ID NO: 154610 - protein, 4 aa, Mycobacterium bovis
TQIG

SEQ ID NO: 154611 - protein, 5 aa, Mycobacterium bovis
TQITK

SEQ ID NO: 154612 - protein, 8 aa, Mycobacterium bovis
TQKISAGD

SEQ ID NO: 154613 - protein, 66 aa, Mycobacterium bovis
TQKSVANGESTDTASAATEGHRGEIDAAGEPDERGAAVADSQADEDDSAATAARGGKTRARRSRGR

SEQ ID NO: 154614 - protein, 5 aa, Mycobacterium bovis
TQPGC

SEQ ID NO: 154615 - protein, 6 aa, Mycobacterium bovis
TQPMPG

SEQ ID NO: 154616 - protein, 6 aa, Mycobacterium bovis
TQPTVA

SEQ ID NO: 154617 - protein, 4 aa, Mycobacterium bovis
TQQQ

SEQ ID NO: 154618 - protein, 16 aa, Mycobacterium bovis
TQQTTVDQSGGNLEGK

SEQ ID NO: 154619 - protein, 7 aa, Mycobacterium bovis
TQRADAP

SEQ ID NO: 154620 - protein, 4 aa, Mycobacterium bovis
TQSR

SEQ ID NO: 154621 - protein, 5 aa, Mycobacterium bovis
TRAGA

SEQ ID NO: 154622 - protein, 11 aa, Mycobacterium bovis
TRAGRSAFSPD

SEQ ID NO: 154623 - protein, 5 aa, Mycobacterium bovis
TRAQW

SEQ ID NO: 154624 - protein, 6 aa, Mycobacterium bovis
TRARRA

SEQ ID NO: 154625 - protein, 10 aa, Mycobacterium bovis
TRASSGLTDE

SEQ ID NO: 154626 - protein, 4 aa, Mycobacterium bovis
TRDA

SEQ ID NO: 154627 - protein, 4 aa, Mycobacterium bovis
TRDS

SEQ ID NO: 154628 - protein, 6 aa, Mycobacterium bovis
TRDYSD

SEQ ID NO: 154629 - protein, 4 aa, Mycobacterium bovis
TREP

SEQ ID NO: 154630 - protein, 7 aa, Mycobacterium bovis
TRGDGGF

SEQ ID NO: 154631 - protein, 12 aa, Mycobacterium bovis
TRGGKPFTGAGY

SEQ ID NO: 154632 - protein, 5 aa, Mycobacterium bovis
TRGLP

SEQ ID NO: 154633 - protein, 19 aa, Mycobacterium bovis
TRGTASGPARGRAGVTGRA

SEQ ID NO: 154634 - protein, 9 aa, Mycobacterium bovis
TRGTKRKPV

SEQ ID NO: 154635 - protein, 4 aa, Mycobacterium bovis
TRIE

SEQ ID NO: 154636 - protein, 9 aa, Mycobacterium bovis
TRLPGSQNA

SEQ ID NO: 154637 - protein, 6 aa, Mycobacterium bovis
TRLPKE

SEQ ID NO: 154638 - protein, 6 aa, Mycobacterium bovis
TRPAGG

SEQ ID NO: 154639 - protein, 37 aa, Mycobacterium bovis
TRPAGRSLEQARTSWQAGEVGSKLDEGSKQIAAHTGD

SEQ ID NO: 154640 - protein, 9 aa, Mycobacterium bovis
TRPEGTTMD

SEQ ID NO: 154641 - protein, 4 aa, Mycobacterium bovis
TRPG

SEQ ID NO: 154642 - protein, 6 aa, Mycobacterium bovis
TRPLAG

SEQ ID NO: 154643 - protein, 11 aa, Mycobacterium bovis
TRPNGEPLKET

SEQ ID NO: 154644 - protein, 27 aa, Mycobacterium bovis
TRPNGETLEQARATYQAGQVGNRLGGA

SEQ ID NO: 154645 - protein, 10 aa, Mycobacterium bovis
TRPPRDPDQP

SEQ ID NO: 154646 - protein, 8 aa, Mycobacterium bovis
TRPPSTSA

SEQ ID NO: 154647 - protein, 4 aa, Mycobacterium bovis
TRPQ

SEQ ID NO: 154648 - protein, 6 aa, Mycobacterium bovis
TRPQGV

SEQ ID NO: 154649 - protein, 10 aa, Mycobacterium bovis
TRPSDDESVE

SEQ ID NO: 154650 - protein, 9 aa, Mycobacterium bovis
TRQPDPAGA

SEQ ID NO: 154651 - protein, 14 aa, Mycobacterium bovis
TRQQGDSVEVSAEK

SEQ ID NO: 154652 - protein, 13 aa, Mycobacterium bovis
TRQSGRLPETPAY

SEQ ID NO: 154653 - protein, 8 aa, Mycobacterium bovis
TRRGETEY

SEQ ID NO: 154654 - protein, 8 aa, Mycobacterium bovis
TRRGGRDG

SEQ ID NO: 154655 - protein, 4 aa, Mycobacterium bovis
TRRR

SEQ ID NO: 154656 - protein, 7 aa, Mycobacterium bovis
TRSTDYS

SEQ ID NO: 154657 - protein, 4 aa, Mycobacterium bovis
TRSV

SEQ ID NO: 154658 - protein, 14 aa, Mycobacterium bovis
TRTPSSPAARPVGT

SEQ ID NO: 154659 - protein, 7 aa, Mycobacterium bovis
TRTSGPY

SEQ ID NO: 154660 - protein, 4 aa, Mycobacterium bovis
TRVA

SEQ ID NO: 154661 - protein, 6 aa, Mycobacterium bovis
TSAAAG

SEQ ID NO: 154662 - protein, 11 aa, Mycobacterium bovis
TSAGQPSKFSM

SEQ ID NO: 154663 - protein, 7 aa, Mycobacterium bovis
TSAGSDA

SEQ ID NO: 154664 - protein, 9 aa, Mycobacterium bovis
TSAISKSHG

SEQ ID NO: 154665 - protein, 10 aa, Mycobacterium bovis
TSALDAENEA

SEQ ID NO: 154666 - protein, 10 aa, Mycobacterium bovis
TSAPRATPQD

SEQ ID NO: 154667 - protein, 9 aa, Mycobacterium bovis
TSAQAPPVR

SEQ ID NO: 154668 - protein, 27 aa, Mycobacterium bovis
TSAQGMPPGPPGRRAWQADTESTAPSA

SEQ ID NO: 154669 - protein, 9 aa, Mycobacterium bovis
TSAQTPREA

SEQ ID NO: 154670 - protein, 16 aa, Mycobacterium bovis
TSARVDRETTASTQIP

SEQ ID NO: 154671 - protein, 5 aa, Mycobacterium bovis
TSDGK

SEQ ID NO: 154672 - protein, 18 aa, Mycobacterium bovis
TSDNDAAVTQPEAQRERR

SEQ ID NO: 154673 - protein, 26 aa, Mycobacterium bovis
TSEAFEPVGSQANPNDPNATPAAGSI

SEQ ID NO: 154674 - protein, 4 aa, Mycobacterium bovis
TSGA

SEQ ID NO: 154675 - protein, 24 aa, Mycobacterium bovis
TSGGGVAREDPLEPDPLAPIIDDS

SEQ ID NO: 154676 - protein, 7 aa, Mycobacterium bovis
TSGPGEL

SEQ ID NO: 154677 - protein, 13 aa, Mycobacterium bovis
TSGPLPDQADQAA

SEQ ID NO: 154678 - protein, 11 aa, Mycobacterium bovis
TSGRAVEAAGD

SEQ ID NO: 154679 - protein, 8 aa, Mycobacterium bovis
TSGSGKSE

SEQ ID NO: 154680 - protein, 10 aa, Mycobacterium bovis
TSGSTANPRG

SEQ ID NO: 154681 - protein, 7 aa, Mycobacterium bovis
TSGTATS

SEQ ID NO: 154682 - protein, 6 aa, Mycobacterium bovis
TSHDEP

SEQ ID NO: 154683 - protein, 6 aa, Mycobacterium bovis
TSHSSA

SEQ ID NO: 154684 - protein, 8 aa, Mycobacterium bovis
TSIPSSAY

SEQ ID NO: 154685 - protein, 11 aa, Mycobacterium bovis
TSPADEGPTQA

SEQ ID NO: 154686 - protein, 5 aa, Mycobacterium bovis
TSPVC

SEQ ID NO: 154687 - protein, 8 aa, Mycobacterium bovis
TSQAETRV

SEQ ID NO: 154688 - protein, 10 aa, Mycobacterium bovis
TSQAGESITA

SEQ ID NO: 154689 - protein, 7 aa, Mycobacterium bovis
TSQEFTE

SEQ ID NO: 154690 - protein, 4 aa, Mycobacterium bovis
TSRA

SEQ ID NO: 154691 - protein, 5 aa, Mycobacterium bovis
TSRPA

SEQ ID NO: 154692 - protein, 7 aa, Mycobacterium bovis
TSRPPAD

SEQ ID NO: 154693 - protein, 5 aa, Mycobacterium bovis
TSRRS

SEQ ID NO: 154694 - protein, 7 aa, Mycobacterium bovis
TSRSEWP

SEQ ID NO: 154695 - protein, 8 aa, Mycobacterium bovis
TSRTRTAL

SEQ ID NO: 154696 - protein, 7 aa, Mycobacterium bovis
TSTDVPG

SEQ ID NO: 154697 - protein, 19 aa, Mycobacterium bovis
TSTEETVESQVNAARDERD

SEQ ID NO: 154698 - protein, 4 aa, Mycobacterium bovis
TSTG

SEQ ID NO: 154699 - protein, 7 aa, Mycobacterium bovis
TSTGTGW

SEQ ID NO: 154700 - protein, 8 aa, Mycobacterium bovis
TSTSPNQQ

SEQ ID NO: 154701 - protein, 8 aa, Mycobacterium bovis
TSTTSGGL

SEQ ID NO: 154702 - protein, 6 aa, Mycobacterium bovis
TSTVTA

SEQ ID NO: 154703 - protein, 7 aa, Mycobacterium bovis
TSYADNP

SEQ ID NO: 154704 - protein, 4 aa, Mycobacterium bovis
TTAD

SEQ ID NO: 154705 - protein, 7 aa, Mycobacterium bovis
TTAPLRT

SEQ ID NO: 154706 - protein, 6 aa, Mycobacterium bovis
TTATGI

SEQ ID NO: 154707 - protein, 8 aa, Mycobacterium bovis
TTDATEVA

SEQ ID NO: 154708 - protein, 6 aa, Mycobacterium bovis
TTDDGS

SEQ ID NO: 154709 - protein, 5 aa, Mycobacterium bovis
TTDTV

SEQ ID NO: 154710 - protein, 12 aa, Mycobacterium bovis
TTEDDDIAAATE

SEQ ID NO: 154711 - protein, 10 aa, Mycobacterium bovis
TTESDTPTEV

SEQ ID NO: 154712 - protein, 4 aa, Mycobacterium bovis
TTGR

SEQ ID NO: 154713 - protein, 8 aa, Mycobacterium bovis
TTGSGKSE

SEQ ID NO: 154714 - protein, 13 aa, Mycobacterium bovis
TTKGGPKGVGTAV

SEQ ID NO: 154715 - protein, 7 aa, Mycobacterium bovis
TTLATPG

SEQ ID NO: 154716 - protein, 8 aa, Mycobacterium bovis
TTLTGGDL

SEQ ID NO: 154717 - protein, 8 aa, Mycobacterium bovis
TTNGATRE

SEQ ID NO: 154718 - protein, 13 aa, Mycobacterium bovis
TTNPPADGPTDTV

SEQ ID NO: 154719 - protein, 8 aa, Mycobacterium bovis
TTNPSAAA

SEQ ID NO: 154720 - protein, 10 aa, Mycobacterium bovis
TTNSGAPFPD

SEQ ID NO: 154721 - protein, 26 aa, Mycobacterium bovis
TTPAPAPTTSAAPTAPSTPGSSAAQG

SEQ ID NO: 154722 - protein, 8 aa, Mycobacterium bovis
TTPGKPPS

SEQ ID NO: 154723 - protein, 5 aa, Mycobacterium bovis
TTPKM

SEQ ID NO: 154724 - protein, 4 aa, Mycobacterium bovis
TTPL

SEQ ID NO: 154725 - protein, 7 aa, Mycobacterium bovis
TTPPPHG

SEQ ID NO: 154726 - protein, 12 aa, Mycobacterium bovis
TTREIKATTSEL

SEQ ID NO: 154727 - protein, 11 aa, Mycobacterium bovis
TTSQSGPELSP

SEQ ID NO: 154728 - protein, 4 aa, Mycobacterium bovis
TTSS

SEQ ID NO: 154729 - protein, 9 aa, Mycobacterium bovis
TTSSHESKA

SEQ ID NO: 154730 - protein, 5 aa, Mycobacterium bovis
TTTPS

SEQ ID NO: 154731 - protein, 9 aa, Mycobacterium bovis
TTTTTGARY

SEQ ID NO: 154732 - protein, 4 aa, Mycobacterium bovis
TVAP

SEQ ID NO: 154733 - protein, 23 aa, Mycobacterium bovis
TVASPTVTATADPTEAPLPIEQE

SEQ ID NO: 154734 - protein, 23 aa, Mycobacterium bovis
TVDAATDVPAPANAAGSQGAGTL

SEQ ID NO: 154735 - protein, 4 aa, Mycobacterium bovis
TVDS

SEQ ID NO: 154736 - protein, 8 aa, Mycobacterium bovis
TVESPANA

SEQ ID NO: 154737 - protein, 8 aa, Mycobacterium bovis
TVKDDAAD

SEQ ID NO: 154738 - protein, 11 aa, Mycobacterium bovis
TVKPKSDIAPE

SEQ ID NO: 154739 - protein, 5 aa, Mycobacterium bovis
TVNGS

SEQ ID NO: 154740 - protein, 7 aa, Mycobacterium bovis
TVNGTGA

SEQ ID NO: 154741 - protein, 4 aa, Mycobacterium bovis
TVPA

SEQ ID NO: 154742 - protein, 19 aa, Mycobacterium bovis
TVPPDLARAENQTKGPNGL

SEQ ID NO: 154743 - protein, 7 aa, Mycobacterium bovis
TVPPTAA

SEQ ID NO: 154744 - protein, 4 aa, Mycobacterium bovis
TVPT

SEQ ID NO: 154745 - protein, 9 aa, Mycobacterium bovis
TVRAGGSAM

SEQ ID NO: 154746 - protein, 6 aa, Mycobacterium bovis
TVSPAR

SEQ ID NO: 154747 - protein, 5 aa, Mycobacterium bovis
TVSPR

SEQ ID NO: 154748 - protein, 5 aa, Mycobacterium bovis
TVTGD

SEQ ID NO: 154749 - protein, 11 aa, Mycobacterium bovis
TVTPEGDTKTI

SEQ ID NO: 154750 - protein, 17 aa, Mycobacterium bovis
TWDNGTTHDDETDADAV

SEQ ID NO: 154751 - protein, 12 aa, Mycobacterium bovis
TWESSPQQNPLN

SEQ ID NO: 154752 - protein, 20 aa, Mycobacterium bovis
TYAPHRERGESEHSIPAGPH

SEQ ID NO: 154753 - protein, 6 aa, Mycobacterium bovis
TYGPDR

SEQ ID NO: 154754 - protein, 5 aa, Mycobacterium bovis
TYRGP

SEQ ID NO: 154755 - protein, 6 aa, Mycobacterium bovis
VAAAGD

SEQ ID NO: 154756 - protein, 13 aa, Mycobacterium bovis
VAAAGSDRQPPID

SEQ ID NO: 154757 - protein, 7 aa, Mycobacterium bovis
VAAPTGT

SEQ ID NO: 154758 - protein, 26 aa, Mycobacterium bovis
VAAQPSGETSDACCDGEDNEDREPEQ

SEQ ID NO: 154759 - protein, 11 aa, Mycobacterium bovis
VAARQAERIGA

SEQ ID NO: 154760 - protein, 13 aa, Mycobacterium bovis
VAATPSTPPAPQI

SEQ ID NO: 154761 - protein, 18 aa, Mycobacterium bovis
VADGAENADSRGSGGRTA

SEQ ID NO: 154762 - protein, 12 aa, Mycobacterium bovis
VADPAESSAAAA

SEQ ID NO: 154763 - protein, 12 aa, Mycobacterium bovis
VADTRAQPCDPD

SEQ ID NO: 154764 - protein, 12 aa, Mycobacterium bovis
VADVNGDDAGPA

SEQ ID NO: 154765 - protein, 7 aa, Mycobacterium bovis
VAEEPTR

SEQ ID NO: 154766 - protein, 8 aa, Mycobacterium bovis
VAENTADA

SEQ ID NO: 154767 - protein, 10 aa, Mycobacterium bovis
VAETERDNRI

SEQ ID NO: 154768 - protein, 11 aa, Mycobacterium bovis
VAGAADAGRTL

SEQ ID NO: 154769 - protein, 4 aa, Mycobacterium bovis
VAGC

SEQ ID NO: 154770 - protein, 7 aa, Mycobacterium bovis
VAGGALP

SEQ ID NO: 154771 - protein, 23 aa, Mycobacterium bovis
VAGPGDDPAEPDGIRRQDDFSSR

SEQ ID NO: 154772 - protein, 10 aa, Mycobacterium bovis
VAGPTDPYGV

SEQ ID NO: 154773 - protein, 4 aa, Mycobacterium bovis
VAGT

SEQ ID NO: 154774 - protein, 8 aa, Mycobacterium bovis
VAHDRDGV

SEQ ID NO: 154775 - protein, 12 aa, Mycobacterium bovis
VAKGGSYATSSA

SEQ ID NO: 154776 - protein, 6 aa, Mycobacterium bovis
VAPAGS

SEQ ID NO: 154777 - protein, 18 aa, Mycobacterium bovis
VAPASAPAAAVDGDPATA

SEQ ID NO: 154778 - protein, 9 aa, Mycobacterium bovis
VAPDDAQSM

SEQ ID NO: 154779 - protein, 7 aa, Mycobacterium bovis
VAPETTA

SEQ ID NO: 154780 - protein, 6 aa, Mycobacterium bovis
VAPGPG

SEQ ID NO: 154781 - protein, 7 aa, Mycobacterium bovis
VAPPGST

SEQ ID NO: 154782 - protein, 7 aa, Mycobacterium bovis
VAPPGTF

SEQ ID NO: 154783 - protein, 42 aa, Mycobacterium bovis
VAPPPPPPEDAGAMAPSNGPPDPQTEDEPAVPPPPPGAPDGV

SEQ ID NO: 154784 - protein, 12 aa, Mycobacterium bovis
VAPSRRSTTSVG

SEQ ID NO: 154785 - protein, 5 aa, Mycobacterium bovis
VAPTT

SEQ ID NO: 154786 - protein, 5 aa, Mycobacterium bovis
VAQGA

SEQ ID NO: 154787 - protein, 12 aa, Mycobacterium bovis
VAQSSPDDPSLQ

SEQ ID NO: 154788 - protein, 4 aa, Mycobacterium bovis
VAQT

SEQ ID NO: 154789 - protein, 23 aa, Mycobacterium bovis
VASAASAVGPVGPGEPNQPDDVA

SEQ ID NO: 154790 - protein, 19 aa, Mycobacterium bovis
VATGDGRQVDGRDPATGES

SEQ ID NO: 154791 - protein, 11 aa, Mycobacterium bovis
VDAAKASASLQ

SEQ ID NO: 154792 - protein, 6 aa, Mycobacterium bovis
VDAPRT

SEQ ID NO: 154793 - protein, 14 aa, Mycobacterium bovis
VDASPRVPAEPGGD

SEQ ID NO: 154794 - protein, 5 aa, Mycobacterium bovis
VDDAE

SEQ ID NO: 154795 - protein, 7 aa, Mycobacterium bovis
VDDEPER

SEQ ID NO: 154796 - protein, 10 aa, Mycobacterium bovis
VDDPSSALRT

SEQ ID NO: 154797 - protein, 10 aa, Mycobacterium bovis
VDEPAPPARA

SEQ ID NO: 154798 - protein, 8 aa, Mycobacterium bovis
VDERGGGI

SEQ ID NO: 154799 - protein, 5 aa, Mycobacterium bovis
VDETP

SEQ ID NO: 154800 - protein, 6 aa, Mycobacterium bovis
VDGASA

SEQ ID NO: 154801 - protein, 6 aa, Mycobacterium bovis
VDGHST

SEQ ID NO: 154802 - protein, 7 aa, Mycobacterium bovis
VDPEAGR

SEQ ID NO: 154803 - protein, 4 aa, Mycobacterium bovis
VDPG

SEQ ID NO: 154804 - protein, 16 aa, Mycobacterium bovis
VDPGRVDRDGLDRAER

SEQ ID NO: 154805 - protein, 4 aa, Mycobacterium bovis
VDPS

SEQ ID NO: 154806 - protein, 5 aa, Mycobacterium bovis
VDSGH

SEQ ID NO: 154807 - protein, 6 aa, Mycobacterium bovis
VDTAGD

SEQ ID NO: 154808 - protein, 5 aa, Mycobacterium bovis
VDTNT

SEQ ID NO: 154809 - protein, 12 aa, Mycobacterium bovis
VDTRYSSSPTPL

SEQ ID NO: 154810 - protein, 7 aa, Mycobacterium bovis
VDVGGPT

SEQ ID NO: 154811 - protein, 10 aa, Mycobacterium bovis
VEADREHPTK

SEQ ID NO: 154812 - protein, 8 aa, Mycobacterium bovis
VEDGTGEL

SEQ ID NO: 154813 - protein, 6 aa, Mycobacterium bovis
VEDSGG

SEQ ID NO: 154814 - protein, 6 aa, Mycobacterium bovis
VEEGRG

SEQ ID NO: 154815 - protein, 6 aa, Mycobacterium bovis
VEEITP

SEQ ID NO: 154816 - protein, 7 aa, Mycobacterium bovis
VEESYGS

SEQ ID NO: 154817 - protein, 7 aa, Mycobacterium bovis
VEGEGCG

SEQ ID NO: 154818 - protein, 5 aa, Mycobacterium bovis
VEGTQ

SEQ ID NO: 154819 - protein, 8 aa, Mycobacterium bovis
VEPDPGTV

SEQ ID NO: 154820 - protein, 32 aa, Mycobacterium bovis
VEPETTPAAPPPGRRRRARHASPADQAYNPPA

SEQ ID NO: 154821 - protein, 8 aa, Mycobacterium bovis
VEPPKGPA

SEQ ID NO: 154822 - protein, 11 aa, Mycobacterium bovis
VEPPPGPPVAP

SEQ ID NO: 154823 - protein, 8 aa, Mycobacterium bovis
VEQEERGR

SEQ ID NO: 154824 - protein, 6 aa, Mycobacterium bovis
VEQGDL

SEQ ID NO: 154825 - protein, 7 aa, Mycobacterium bovis
VEQGDLS

SEQ ID NO: 154826 - protein, 10 aa, Mycobacterium bovis
VEQGDSGGPL

SEQ ID NO: 154827 - protein, 7 aa, Mycobacterium bovis
VEQSGTR

SEQ ID NO: 154828 - protein, 8 aa, Mycobacterium bovis
VERARGRL

SEQ ID NO: 154829 - protein, 7 aa, Mycobacterium bovis
VESASEH

SEQ ID NO: 154830 - protein, 9 aa, Mycobacterium bovis
VESGSEHPI

SEQ ID NO: 154831 - protein, 7 aa, Mycobacterium bovis
VESTPAT

SEQ ID NO: 154832 - protein, 27 aa, Mycobacterium bovis
VETRDPNATLRPGSPSNPAAPGSVGNS

SEQ ID NO: 154833 - protein, 8 aa, Mycobacterium bovis
VEVGPGDE

SEQ ID NO: 154834 - protein, 7 aa, Mycobacterium bovis
VFEPGDS

SEQ ID NO: 154835 - protein, 6 aa, Mycobacterium bovis
VGADTQ

SEQ ID NO: 154836 - protein, 6 aa, Mycobacterium bovis
VGAEPT

SEQ ID NO: 154837 - protein, 8 aa, Mycobacterium bovis
VGAGATAE

SEQ ID NO: 154838 - protein, 8 aa, Mycobacterium bovis
VGAGATAQ

SEQ ID NO: 154839 - protein, 6 aa, Mycobacterium bovis
VGARGQ

SEQ ID NO: 154840 - protein, 13 aa, Mycobacterium bovis
VGASGPQEAAARA

SEQ ID NO: 154841 - protein, 9 aa, Mycobacterium bovis
VGASKDPSV

SEQ ID NO: 154842 - protein, 7 aa, Mycobacterium bovis
VGATPRS

SEQ ID NO: 154843 - protein, 4 aa, Mycobacterium bovis
VGDP

SEQ ID NO: 154844 - protein, 5 aa, Mycobacterium bovis
VGDPP

SEQ ID NO: 154845 - protein, 15 aa, Mycobacterium bovis
VGEAGSALSGGERQR

SEQ ID NO: 154846 - protein, 5 aa, Mycobacterium bovis
VGERL

SEQ ID NO: 154847 - protein, 12 aa, Mycobacterium bovis
VGESSQTSDRPD

SEQ ID NO: 154848 - protein, 4 aa, Mycobacterium bovis
VGGA

SEQ ID NO: 154849 - protein, 5 aa, Mycobacterium bovis
VGGDL

SEQ ID NO: 154850 - protein, 4 aa, Mycobacterium bovis
VGGG

SEQ ID NO: 154851 - protein, 11 aa, Mycobacterium bovis
VGGGPDAPGAG

SEQ ID NO: 154852 - protein, 5 aa, Mycobacterium bovis
VGGKD

SEQ ID NO: 154853 - protein, 6 aa, Mycobacterium bovis
VGGQPF

SEQ ID NO: 154854 - protein, 14 aa, Mycobacterium bovis
VGGSPVQVSGPAAG

SEQ ID NO: 154855 - protein, 11 aa, Mycobacterium bovis
VGKAPDSIDES

SEQ ID NO: 154856 - protein, 8 aa, Mycobacterium bovis
VGNTAAPD

SEQ ID NO: 154857 - protein, 10 aa, Mycobacterium bovis
VGPDTQERRA

SEQ ID NO: 154858 - protein, 4 aa, Mycobacterium bovis
VGPG

SEQ ID NO: 154859 - protein, 10 aa, Mycobacterium bovis
VGPSEGSKAR

SEQ ID NO: 154860 - protein, 17 aa, Mycobacterium bovis
VGQERSVSLSPKDAPSF

SEQ ID NO: 154861 - protein, 4 aa, Mycobacterium bovis
VGQL

SEQ ID NO: 154862 - protein, 7 aa, Mycobacterium bovis
VGQTATS

SEQ ID NO: 154863 - protein, 4 aa, Mycobacterium bovis
VGRG

SEQ ID NO: 154864 - protein, 19 aa, Mycobacterium bovis
VGRQRGAGLGGGHDEREQT

SEQ ID NO: 154865 - protein, 9 aa, Mycobacterium bovis
VGSGPTIGG

SEQ ID NO: 154866 - protein, 10 aa, Mycobacterium bovis
VGSKGTAKVT

SEQ ID NO: 154867 - protein, 6 aa, Mycobacterium bovis
VGSPAL

SEQ ID NO: 154868 - protein, 5 aa, Mycobacterium bovis
VGSYR

SEQ ID NO: 154869 - protein, 5 aa, Mycobacterium bovis
VGTAA

SEQ ID NO: 154870 - protein, 7 aa, Mycobacterium bovis
VGTDNEQ

SEQ ID NO: 154871 - protein, 10 aa, Mycobacterium bovis
VGTEEQGGVI

SEQ ID NO: 154872 - protein, 7 aa, Mycobacterium bovis
VGTEGDD

SEQ ID NO: 154873 - protein, 4 aa, Mycobacterium bovis
VGTQ

SEQ ID NO: 154874 - protein, 20 aa, Mycobacterium bovis
VGTTTYSSTAQHSAVAAEPP

SEQ ID NO: 154875 - protein, 5 aa, Mycobacterium bovis
VHHPT

SEQ ID NO: 154876 - protein, 20 aa, Mycobacterium bovis
VIDPPSPVPAPSVIGSHDDV

SEQ ID NO: 154877 - protein, 7 aa, Mycobacterium bovis
VIGTPEA

SEQ ID NO: 154878 - protein, 12 aa, Mycobacterium bovis
VKAGSPAQKGGI

SEQ ID NO: 154879 - protein, 8 aa, Mycobacterium bovis
VKDSARDA

SEQ ID NO: 154880 - protein, 13 aa, Mycobacterium bovis
VKGDQSGQTANGK

SEQ ID NO: 154881 - protein, 7 aa, Mycobacterium bovis
VKGGGSG

SEQ ID NO: 154882 - protein, 5 aa, Mycobacterium bovis
VKPGD

SEQ ID NO: 154883 - protein, 10 aa, Mycobacterium bovis
VKPPSSPVTS

SEQ ID NO: 154884 - protein, 8 aa, Mycobacterium bovis
VKQESTGV

SEQ ID NO: 154885 - protein, 11 aa, Mycobacterium bovis
VLTSSGRTAVT

SEQ ID NO: 154886 - protein, 9 aa, Mycobacterium bovis
VMERPGDRS

SEQ ID NO: 154887 - protein, 13 aa, Mycobacterium bovis
VMPQGSQSLAGTP

SEQ ID NO: 154888 - protein, 8 aa, Mycobacterium bovis
VNDAPAMA

SEQ ID NO: 154889 - protein, 7 aa, Mycobacterium bovis
VNDPDRA

SEQ ID NO: 154890 - protein, 13 aa, Mycobacterium bovis
VNDRQEEAGRSGV

SEQ ID NO: 154891 - protein, 9 aa, Mycobacterium bovis
VNFSGGQRQ

SEQ ID NO: 154892 - protein, 9 aa, Mycobacterium bovis
VNHDGRSNG

SEQ ID NO: 154893 - protein, 10 aa, Mycobacterium bovis
VNKTAAAAGI

SEQ ID NO: 154894 - protein, 12 aa, Mycobacterium bovis
VNPAEGSPGPGT

SEQ ID NO: 154895 - protein, 16 aa, Mycobacterium bovis
VNPDDDKPSGSSDETL

SEQ ID NO: 154896 - protein, 13 aa, Mycobacterium bovis
VNPDRGLRKEASV

SEQ ID NO: 154897 - protein, 12 aa, Mycobacterium bovis
VNPGEATLSRRG

SEQ ID NO: 154898 - protein, 10 aa, Mycobacterium bovis
VNPSGQHGDE

SEQ ID NO: 154899 - protein, 5 aa, Mycobacterium bovis
VNQVG

SEQ ID NO: 154900 - protein, 7 aa, Mycobacterium bovis
VNRDQPD

SEQ ID NO: 154901 - protein, 9 aa, Mycobacterium bovis
VNRDSVDAV

SEQ ID NO: 154902 - protein, 7 aa, Mycobacterium bovis
VNSGNEI

SEQ ID NO: 154903 - protein, 6 aa, Mycobacterium bovis
VNSSEQ

SEQ ID NO: 154904 - protein, 5 aa, Mycobacterium bovis
VPAAT

SEQ ID NO: 154905 - protein, 14 aa, Mycobacterium bovis
VPAFQKPKSRNAAT

SEQ ID NO: 154906 - protein, 4 aa, Mycobacterium bovis
VPAP

SEQ ID NO: 154907 - protein, 10 aa, Mycobacterium bovis
VPAPQPPTPV

SEQ ID NO: 154908 - protein, 6 aa, Mycobacterium bovis
VPARPA

SEQ ID NO: 154909 - protein, 6 aa, Mycobacterium bovis
VPAVPS

SEQ ID NO: 154910 - protein, 4 aa, Mycobacterium bovis
VPDP

SEQ ID NO: 154911 - protein, 30 aa, Mycobacterium bovis
VPDPATIPDTPDTTSTATLTPPTTTAPGPG

SEQ ID NO: 154912 - protein, 6 aa, Mycobacterium bovis
VPEAGP

SEQ ID NO: 154913 - protein, 11 aa, Mycobacterium bovis
VPEEDKGLRTR

SEQ ID NO: 154914 - protein, 4 aa, Mycobacterium bovis
VPEH

SEQ ID NO: 154915 - protein, 7 aa, Mycobacterium bovis
VPESATS

SEQ ID NO: 154916 - protein, 8 aa, Mycobacterium bovis
VPGDQPDE

SEQ ID NO: 154917 - protein, 9 aa, Mycobacterium bovis
VPGEDAHAR

SEQ ID NO: 154918 - protein, 8 aa, Mycobacterium bovis
VPGKTEVS

SEQ ID NO: 154919 - protein, 9 aa, Mycobacterium bovis
VPGRGPANL

SEQ ID NO: 154920 - protein, 13 aa, Mycobacterium bovis
VPIPPPPPGPDVI

SEQ ID NO: 154921 - protein, 7 aa, Mycobacterium bovis
VPISGSA

SEQ ID NO: 154922 - protein, 35 aa, Mycobacterium bovis
VPKSFDRDHPELDQAADEGTDRDGPARPPGPPHES

SEQ ID NO: 154923 - protein, 4 aa, Mycobacterium bovis
VPLD

SEQ ID NO: 154924 - protein, 19 aa, Mycobacterium bovis
VPNAETAKSLGLSSPQNAP

SEQ ID NO: 154925 - protein, 5 aa, Mycobacterium bovis
VPPAG

SEQ ID NO: 154926 - protein, 10 aa, Mycobacterium bovis
VPPDQATDFG

SEQ ID NO: 154927 - protein, 7 aa, Mycobacterium bovis
VPPEGNR

SEQ ID NO: 154928 - protein, 7 aa, Mycobacterium bovis
VPPGDRA

SEQ ID NO: 154929 - protein, 5 aa, Mycobacterium bovis
VPPGS

SEQ ID NO: 154930 - protein, 5 aa, Mycobacterium bovis
VPPNY

SEQ ID NO: 154931 - protein, 7 aa, Mycobacterium bovis
VPPPPGI

SEQ ID NO: 154932 - protein, 4 aa, Mycobacterium bovis
VPPQ

SEQ ID NO: 154933 - protein, 14 aa, Mycobacterium bovis
VPPQADTFSRPRWS

SEQ ID NO: 154934 - protein, 5 aa, Mycobacterium bovis
VPPRD

SEQ ID NO: 154935 - protein, 8 aa, Mycobacterium bovis
VPPRDAAE

SEQ ID NO: 154936 - protein, 21 aa, Mycobacterium bovis
VPPVSGGPRHYEAPPPPQPEP

SEQ ID NO: 154937 - protein, 6 aa, Mycobacterium bovis
VPPYKT

SEQ ID NO: 154938 - protein, 9 aa, Mycobacterium bovis
VPRAESPED

SEQ ID NO: 154939 - protein, 7 aa, Mycobacterium bovis
VPRGPIP

SEQ ID NO: 154940 - protein, 10 aa, Mycobacterium bovis
VPRPRPDHTQ

SEQ ID NO: 154941 - protein, 9 aa, Mycobacterium bovis
VPSESGPAA

SEQ ID NO: 154942 - protein, 8 aa, Mycobacterium bovis
VPSPEAGQ

SEQ ID NO: 154943 - protein, 7 aa, Mycobacterium bovis
VPTAEGK

SEQ ID NO: 154944 - protein, 11 aa, Mycobacterium bovis
VPTDPDDRSVD

SEQ ID NO: 154945 - protein, 21 aa, Mycobacterium bovis
VPTEVSQRSEGQGPQPTRIPA

SEQ ID NO: 154946 - protein, 12 aa, Mycobacterium bovis
VPTPAPAREVPT

SEQ ID NO: 154947 - protein, 16 aa, Mycobacterium bovis
VPTPGGTEIRDNRSIN

SEQ ID NO: 154948 - protein, 4 aa, Mycobacterium bovis
VPTR

SEQ ID NO: 154949 - protein, 8 aa, Mycobacterium bovis
VPTSADLG

SEQ ID NO: 154950 - protein, 8 aa, Mycobacterium bovis
VPTSYREA

SEQ ID NO: 154951 - protein, 6 aa, Mycobacterium bovis
VPTTGP

SEQ ID NO: 154952 - protein, 6 aa, Mycobacterium bovis
VQHAPD

SEQ ID NO: 154953 - protein, 8 aa, Mycobacterium bovis
VQNTRDRE

SEQ ID NO: 154954 - protein, 5 aa, Mycobacterium bovis
VQPAA

SEQ ID NO: 154955 - protein, 34 aa, Mycobacterium bovis
VQPPTVKATPTTTSSTPPVSPPETTTDSAVPPPF

SEQ ID NO: 154956 - protein, 6 aa, Mycobacterium bovis
VQRQYP

SEQ ID NO: 154957 - protein, 7 aa, Mycobacterium bovis
VQSNPST

SEQ ID NO: 154958 - protein, 6 aa, Mycobacterium bovis
VQSPPA

SEQ ID NO: 154959 - protein, 10 aa, Mycobacterium bovis
VQSSLSGSTV

SEQ ID NO: 154960 - protein, 8 aa, Mycobacterium bovis
VQTPDDPT

SEQ ID NO: 154961 - protein, 9 aa, Mycobacterium bovis
VRAAGRTPL

SEQ ID NO: 154962 - protein, 5 aa, Mycobacterium bovis
VRAES

SEQ ID NO: 154963 - protein, 8 aa, Mycobacterium bovis
VRAGNSAI

SEQ ID NO: 154964 - protein, 11 aa, Mycobacterium bovis
VRDKRSDQALA

SEQ ID NO: 154965 - protein, 8 aa, Mycobacterium bovis
VRDPDAVR

SEQ ID NO: 154966 - protein, 5 aa, Mycobacterium bovis
VREPG

SEQ ID NO: 154967 - protein, 15 aa, Mycobacterium bovis
VRERASGLRSDARTT

SEQ ID NO: 154968 - protein, 11 aa, Mycobacterium bovis
VRGASGSGKTT

SEQ ID NO: 154969 - protein, 11 aa, Mycobacterium bovis
VRGRPADAGLP

SEQ ID NO: 154970 - protein, 5 aa, Mycobacterium bovis
VRPAT

SEQ ID NO: 154971 - protein, 7 aa, Mycobacterium bovis
VRPDARE

SEQ ID NO: 154972 - protein, 6 aa, Mycobacterium bovis
VRPDQK

SEQ ID NO: 154973 - protein, 11 aa, Mycobacterium bovis
VRRNPDHELRR

SEQ ID NO: 154974 - protein, 6 aa, Mycobacterium bovis
VRSELE

SEQ ID NO: 154975 - protein, 5 aa, Mycobacterium bovis
VRSTR

SEQ ID NO: 154976 - protein, 8 aa, Mycobacterium bovis
VRSYDDDG

SEQ ID NO: 154977 - protein, 7 aa, Mycobacterium bovis
VRTPSAA

SEQ ID NO: 154978 - protein, 25 aa, Mycobacterium bovis
VSAAEDRGGRHAAAEPPEPPSAGVR

SEQ ID NO: 154979 - protein, 8 aa, Mycobacterium bovis
VSADGEYR

SEQ ID NO: 154980 - protein, 12 aa, Mycobacterium bovis
VSANDSSCDTTA

SEQ ID NO: 154981 - protein, 18 aa, Mycobacterium bovis
VSARTRRRGQAVGQTERD

SEQ ID NO: 154982 - protein, 10 aa, Mycobacterium bovis
VSASGSDSAV

SEQ ID NO: 154983 - protein, 8 aa, Mycobacterium bovis
VSASPPSH

SEQ ID NO: 154984 - protein, 9 aa, Mycobacterium bovis
VSDDERADI

SEQ ID NO: 154985 - protein, 12 aa, Mycobacterium bovis
VSDPTSAPPDWP

SEQ ID NO: 154986 - protein, 20 aa, Mycobacterium bovis
VSEGRSPSKPDEVAASSTMG

SEQ ID NO: 154987 - protein, 11 aa, Mycobacterium bovis
VSENAGAKPQT

SEQ ID NO: 154988 - protein, 24 aa, Mycobacterium bovis
VSGDDDQLTLPNTAAGRASAISQR

SEQ ID NO: 154989 - protein, 6 aa, Mycobacterium bovis
VSGEVG

SEQ ID NO: 154990 - protein, 17 aa, Mycobacterium bovis
VSGQNQPSTSAMPPPGK

SEQ ID NO: 154991 - protein, 13 aa, Mycobacterium bovis
VSGRGSSAARGAA

SEQ ID NO: 154992 - protein, 8 aa, Mycobacterium bovis
VSKKASEW

SEQ ID NO: 154993 - protein, 13 aa, Mycobacterium bovis
VSKPEGKDKYGEE

SEQ ID NO: 154994 - protein, 21 aa, Mycobacterium bovis
VSKPNGDGAHIGKEPVDHLLG

SEQ ID NO: 154995 - protein, 18 aa, Mycobacterium bovis
VSKPSDPVTPATRGPDQR

SEQ ID NO: 154996 - protein, 7 aa, Mycobacterium bovis
VSLAGGG

SEQ ID NO: 154997 - protein, 11 aa, Mycobacterium bovis
VSMSPSDAASI

SEQ ID NO: 154998 - protein, 9 aa, Mycobacterium bovis
VSNPDLAGR

SEQ ID NO: 154999 - protein, 7 aa, Mycobacterium bovis
VSPEQTS

SEQ ID NO: 155000 - protein, 8 aa, Mycobacterium bovis
VSPGGTGV

SEQ ID NO: 155001 - protein, 6 aa, Mycobacterium bovis
VSPGTE

SEQ ID NO: 155002 - protein, 14 aa, Mycobacterium bovis
VSPPEESRYQMALP

SEQ ID NO: 155003 - protein, 7 aa, Mycobacterium bovis
VSPPPID

SEQ ID NO: 155004 - protein, 4 aa, Mycobacterium bovis
VSPR

SEQ ID NO: 155005 - protein, 21 aa, Mycobacterium bovis
VSPSPPEASQPAPGPRDPNRP

SEQ ID NO: 155006 - protein, 14 aa, Mycobacterium bovis
VSPTTVKSTELDQF

SEQ ID NO: 155007 - protein, 15 aa, Mycobacterium bovis
VSQPTVAPRRSRHYA

SEQ ID NO: 155008 - protein, 8 aa, Mycobacterium bovis
VSRRTTTV

SEQ ID NO: 155009 - protein, 9 aa, Mycobacterium bovis
VSRSGSTIS

SEQ ID NO: 155010 - protein, 9 aa, Mycobacterium bovis
VSSASALGT

SEQ ID NO: 155011 - protein, 15 aa, Mycobacterium bovis
VSSPNSAPFADPGNP

SEQ ID NO: 155012 - protein, 4 aa, Mycobacterium bovis
VSSR

SEQ ID NO: 155013 - protein, 12 aa, Mycobacterium bovis
VSSSSADATAMP

SEQ ID NO: 155014 - protein, 10 aa, Mycobacterium bovis
VSSSSSRTAL

SEQ ID NO: 155015 - protein, 7 aa, Mycobacterium bovis
VSTDPVG

SEQ ID NO: 155016 - protein, 15 aa, Mycobacterium bovis
VSTGYHNADDALNRD

SEQ ID NO: 155017 - protein, 7 aa, Mycobacterium bovis
VSTTASV

SEQ ID NO: 155018 - protein, 5 aa, Mycobacterium bovis
VSTTR

SEQ ID NO: 155019 - protein, 18 aa, Mycobacterium bovis
VTAESGRAFGRAERSAQL

SEQ ID NO: 155020 - protein, 7 aa, Mycobacterium bovis
VTASGDC

SEQ ID NO: 155021 - protein, 11 aa, Mycobacterium bovis
VTDKTRQPLYD

SEQ ID NO: 155022 - protein, 4 aa, Mycobacterium bovis
VTDL

SEQ ID NO: 155023 - protein, 10 aa, Mycobacterium bovis
VTEGTVNATA

SEQ ID NO: 155024 - protein, 15 aa, Mycobacterium bovis
VTGNPGQGPDHDYAT

SEQ ID NO: 155025 - protein, 8 aa, Mycobacterium bovis
VTGPRSSV

SEQ ID NO: 155026 - protein, 8 aa, Mycobacterium bovis
VTGPTPKP

SEQ ID NO: 155027 - protein, 9 aa, Mycobacterium bovis
VTGTKAPGD

SEQ ID NO: 155028 - protein, 9 aa, Mycobacterium bovis
VTPGDERVG

SEQ ID NO: 155029 - protein, 5 aa, Mycobacterium bovis
VTPHP

SEQ ID NO: 155030 - protein, 39 aa, Mycobacterium bovis
VTPPPPPPPATTTAPPPATTTTAAAPPPTTTTPTGPRQV

SEQ ID NO: 155031 - protein, 5 aa, Mycobacterium bovis
VTPRR

SEQ ID NO: 155032 - protein, 10 aa, Mycobacterium bovis
VTPSESPVSL

SEQ ID NO: 155033 - protein, 10 aa, Mycobacterium bovis
VTQDGRSNGL

SEQ ID NO: 155034 - protein, 6 aa, Mycobacterium bovis
VTQPGD

SEQ ID NO: 155035 - protein, 11 aa, Mycobacterium bovis
VTQPGTSNPKA

SEQ ID NO: 155036 - protein, 6 aa, Mycobacterium bovis
VTRDGE

SEQ ID NO: 155037 - protein, 6 aa, Mycobacterium bovis
VTRNPD

SEQ ID NO: 155038 - protein, 16 aa, Mycobacterium bovis
VTRPTTGGAPSPGNYL

SEQ ID NO: 155039 - protein, 10 aa, Mycobacterium bovis
VTSTNGDRIE

SEQ ID NO: 155040 - protein, 7 aa, Mycobacterium bovis
VTTARTI

SEQ ID NO: 155041 - protein, 9 aa, Mycobacterium bovis
VTTASSAGA

SEQ ID NO: 155042 - protein, 5 aa, Mycobacterium bovis
VTTPR

SEQ ID NO: 155043 - protein, 6 aa, Mycobacterium bovis
VTTSPL

SEQ ID NO: 155044 - protein, 10 aa, Mycobacterium bovis
VTTSSEPHVT

SEQ ID NO: 155045 - protein, 6 aa, Mycobacterium bovis
VTVGGA

SEQ ID NO: 155046 - protein, 12 aa, Mycobacterium bovis
VTVGTDDDAPGL

SEQ ID NO: 155047 - protein, 4 aa, Mycobacterium bovis
VTVP

SEQ ID NO: 155048 - protein, 4 aa, Mycobacterium bovis
VVAP

SEQ ID NO: 155049 - protein, 6 aa, Mycobacterium bovis
VVEDGS

SEQ ID NO: 155050 - protein, 7 aa, Mycobacterium bovis
VYGGTTH

SEQ ID NO: 155051 - protein, 11 aa, Mycobacterium bovis
VYPDRSARAAA

SEQ ID NO: 155052 - protein, 8 aa, Mycobacterium bovis
WARAGNAV

SEQ ID NO: 155053 - protein, 4 aa, Mycobacterium bovis
WDTH

SEQ ID NO: 155054 - protein, 17 aa, Mycobacterium bovis
WEPSPSSAAALAAGDTL

SEQ ID NO: 155055 - protein, 7 aa, Mycobacterium bovis
WGEPGEG

SEQ ID NO: 155056 - protein, 12 aa, Mycobacterium bovis
WGPSSDPAWKRN

SEQ ID NO: 155057 - protein, 7 aa, Mycobacterium bovis
WKGTTTY

SEQ ID NO: 155058 - protein, 7 aa, Mycobacterium bovis
WKSRPET

SEQ ID NO: 155059 - protein, 10 aa, Mycobacterium bovis
WNPGNTYGET

SEQ ID NO: 155060 - protein, 11 aa, Mycobacterium bovis
WPPSGPQRAPQ

SEQ ID NO: 155061 - protein, 15 aa, Mycobacterium bovis
WPVEGTKAEKRAERS

SEQ ID NO: 155062 - protein, 10 aa, Mycobacterium bovis
WQQPEANEET

SEQ ID NO: 155063 - protein, 10 aa, Mycobacterium bovis
WQQQPTQEAT

SEQ ID NO: 155064 - protein, 9 aa, Mycobacterium bovis
WRPGGTAPV

SEQ ID NO: 155065 - protein, 4 aa, Mycobacterium bovis
WRPT

SEQ ID NO: 155066 - protein, 5 aa, Mycobacterium bovis
WRQAG

SEQ ID NO: 155067 - protein, 15 aa, Mycobacterium bovis
WRSPADTSPRPLPSG

SEQ ID NO: 155068 - protein, 15 aa, Mycobacterium bovis
WRSPADTSTAPLPKG

SEQ ID NO: 155069 - protein, 4 aa, Mycobacterium bovis
WSAG

SEQ ID NO: 155070 - protein, 11 aa, Mycobacterium bovis
WSHGTSSTAQP

SEQ ID NO: 155071 - protein, 10 aa, Mycobacterium bovis
WSPDSGETIA

SEQ ID NO: 155072 - protein, 10 aa, Mycobacterium bovis
WSPTQASGQT

SEQ ID NO: 155073 - protein, 17 aa, Mycobacterium bovis
WSPTSRSEVTDSTSGAA

SEQ ID NO: 155074 - protein, 8 aa, Mycobacterium bovis
WSSAGSDP

SEQ ID NO: 155075 - protein, 4 aa, Mycobacterium bovis
WTGP

SEQ ID NO: 155076 - protein, 10 aa, Mycobacterium bovis
WTPGAHPHEA

SEQ ID NO: 155077 - protein, 8 aa, Mycobacterium bovis
YAADGGRN

SEQ ID NO: 155078 - protein, 8 aa, Mycobacterium bovis
YAAQDRET

SEQ ID NO: 155079 - protein, 4 aa, Mycobacterium bovis
YADR

SEQ ID NO: 155080 - protein, 4 aa, Mycobacterium bovis
YAGD

SEQ ID NO: 155081 - protein, 11 aa, Mycobacterium bovis
YAGDRRRAREA

SEQ ID NO: 155082 - protein, 7 aa, Mycobacterium bovis
YAPDDAA

SEQ ID NO: 155083 - protein, 4 aa, Mycobacterium bovis
YAPT

SEQ ID NO: 155084 - protein, 9 aa, Mycobacterium bovis
YASGTPWAK

SEQ ID NO: 155085 - protein, 4 aa, Mycobacterium bovis
YASH

SEQ ID NO: 155086 - protein, 6 aa, Mycobacterium bovis
YASTRH

SEQ ID NO: 155087 - protein, 14 aa, Mycobacterium bovis
YDDRKTLPASVESS

SEQ ID NO: 155088 - protein, 9 aa, Mycobacterium bovis
YDGGSGPVL

SEQ ID NO: 155089 - protein, 4 aa, Mycobacterium bovis
YDPS

SEQ ID NO: 155090 - protein, 7 aa, Mycobacterium bovis
YDPVDND

SEQ ID NO: 155091 - protein, 10 aa, Mycobacterium bovis
YDQSTEDKIN

SEQ ID NO: 155092 - protein, 5 aa, Mycobacterium bovis
YDSGT

SEQ ID NO: 155093 - protein, 7 aa, Mycobacterium bovis
YEPPQTA

SEQ ID NO: 155094 - protein, 10 aa, Mycobacterium bovis
YERRGARYQP

SEQ ID NO: 155095 - protein, 14 aa, Mycobacterium bovis
YGAKTAAKTAALER

SEQ ID NO: 155096 - protein, 9 aa, Mycobacterium bovis
YGATSGQAL

SEQ ID NO: 155097 - protein, 7 aa, Mycobacterium bovis
YGEQPKA

SEQ ID NO: 155098 - protein, 10 aa, Mycobacterium bovis
YGERPGTQGA

SEQ ID NO: 155099 - protein, 12 aa, Mycobacterium bovis
YGESQMNGEGRT

SEQ ID NO: 155100 - protein, 9 aa, Mycobacterium bovis
YGGDNANGF

SEQ ID NO: 155101 - protein, 11 aa, Mycobacterium bovis
YGGGGAYDEGS

SEQ ID NO: 155102 - protein, 6 aa, Mycobacterium bovis
YGGSAA

SEQ ID NO: 155103 - protein, 5 aa, Mycobacterium bovis
YGGTA

SEQ ID NO: 155104 - protein, 9 aa, Mycobacterium bovis
YGPATGSQI

SEQ ID NO: 155105 - protein, 6 aa, Mycobacterium bovis
YGPDKV

SEQ ID NO: 155106 - protein, 6 aa, Mycobacterium bovis
YGPPQR

SEQ ID NO: 155107 - protein, 5 aa, Mycobacterium bovis
YGPRP

SEQ ID NO: 155108 - protein, 6 aa, Mycobacterium bovis
YGQTQP

SEQ ID NO: 155109 - protein, 6 aa, Mycobacterium bovis
YGRDRS

SEQ ID NO: 155110 - protein, 17 aa, Mycobacterium bovis
YGRPDATDAQVERAARE

SEQ ID NO: 155111 - protein, 13 aa, Mycobacterium bovis
YGRPDATPEQIAT

SEQ ID NO: 155112 - protein, 8 aa, Mycobacterium bovis
YGSEHGDP

SEQ ID NO: 155113 - protein, 5 aa, Mycobacterium bovis
YGSGP

SEQ ID NO: 155114 - protein, 5 aa, Mycobacterium bovis
YGSRE

SEQ ID NO: 155115 - protein, 120 aa, Mycobacterium bovis
YGVQPGGYYGQQGAQQAAGLQSPGPQQSPQPPGYGSQYGGYSSSPSQSGSGYTAQPPAQPPAQSGSQQSHQGPSTPPTGFPSFSPPPPVSAGTGSQAGSAPVNYSNPSGGEQSSSPGGAP

SEQ ID NO: 155116 - protein, 5 aa, Mycobacterium bovis
YGYGP

SEQ ID NO: 155117 - protein, 19 aa, Mycobacterium bovis
YHSGSPKISNAGGSNSVQQ

SEQ ID NO: 155118 - protein, 12 aa, Mycobacterium bovis
YKPSQVSAGSQP

SEQ ID NO: 155119 - protein, 6 aa, Mycobacterium bovis
YKSAQT

SEQ ID NO: 155120 - protein, 14 aa, Mycobacterium bovis
YLPPTNSVRQAQEE

SEQ ID NO: 155121 - protein, 7 aa, Mycobacterium bovis
YNGQPNI

SEQ ID NO: 155122 - protein, 9 aa, Mycobacterium bovis
YNPTTGRAE

SEQ ID NO: 155123 - protein, 14 aa, Mycobacterium bovis
YPAGSVGSAPRAGT

SEQ ID NO: 155124 - protein, 9 aa, Mycobacterium bovis
YPDAQPADL

SEQ ID NO: 155125 - protein, 8 aa, Mycobacterium bovis
YPDPSGAG

SEQ ID NO: 155126 - protein, 5 aa, Mycobacterium bovis
YPGLN

SEQ ID NO: 155127 - protein, 10 aa, Mycobacterium bovis
YPNAGNKTQT

SEQ ID NO: 155128 - protein, 9 aa, Mycobacterium bovis
YPNGMPGPE

SEQ ID NO: 155129 - protein, 7 aa, Mycobacterium bovis
YPNQPNV

SEQ ID NO: 155130 - protein, 20 aa, Mycobacterium bovis
YPPMPPPYGGSPGGYYPEPG

SEQ ID NO: 155131 - protein, 4 aa, Mycobacterium bovis
YPRE

SEQ ID NO: 155132 - protein, 4 aa, Mycobacterium bovis
YPTG

SEQ ID NO: 155133 - protein, 11 aa, Mycobacterium bovis
YPVADRDGSIT

SEQ ID NO: 155134 - protein, 9 aa, Mycobacterium bovis
YPYGPNTYG

SEQ ID NO: 155135 - protein, 11 aa, Mycobacterium bovis
YQIPTDASANV

SEQ ID NO: 155136 - protein, 5 aa, Mycobacterium bovis
YQPQL

SEQ ID NO: 155137 - protein, 9 aa, Mycobacterium bovis
YQTNKSDQI

SEQ ID NO: 155138 - protein, 5 aa, Mycobacterium bovis
YQTNY

SEQ ID NO: 155139 - protein, 5 aa, Mycobacterium bovis
YQTPY

SEQ ID NO: 155140 - protein, 10 aa, Mycobacterium bovis
YRADKKITAT

SEQ ID NO: 155141 - protein, 4 aa, Mycobacterium bovis
YRDY

SEQ ID NO: 155142 - protein, 18 aa, Mycobacterium bovis
YRGNDKKMRTEEVDAERA

SEQ ID NO: 155143 - protein, 7 aa, Mycobacterium bovis
YRRPPAE

SEQ ID NO: 155144 - protein, 6 aa, Mycobacterium bovis
YRTATE

SEQ ID NO: 155145 - protein, 4 aa, Mycobacterium bovis
YRTT

SEQ ID NO: 155146 - protein, 6 aa, Mycobacterium bovis
YSQASD

SEQ ID NO: 155147 - protein, 21 aa, Mycobacterium bovis
YSRGGEKPDGRLYPEDQPERV

SEQ ID NO: 155148 - protein, 8 aa, Mycobacterium bovis
YSSPTTPV

SEQ ID NO: 155149 - protein, 20 aa, Mycobacterium bovis
YTGPERCSGDGQVRAAGDRY

SEQ ID NO: 155150 - protein, 4 aa, Mycobacterium bovis
YTGS

SEQ ID NO: 155151 - protein, 5 aa, Mycobacterium bovis
YTPGQ

SEQ ID NO: 155152 - protein, 8 aa, Mycobacterium bovis
YTTTTTGA

SEQ ID NO: 155153 - protein, 6 aa, Mycobacterium bovis
AAARPD

SEQ ID NO: 155154 - protein, 5 aa, Mycobacterium bovis
AADSG

SEQ ID NO: 155155 - protein, 9 aa, Mycobacterium bovis
AAGADPAAV

SEQ ID NO: 155156 - protein, 6 aa, Mycobacterium bovis
AAIPDA

SEQ ID NO: 155157 - protein, 6 aa, Mycobacterium bovis
AAQTGG

SEQ ID NO: 155158 - protein, 9 aa, Mycobacterium bovis
AARARARAA

SEQ ID NO: 155159 - protein, 8 aa, Mycobacterium bovis
ADESSSAL

SEQ ID NO: 155160 - protein, 12 aa, Mycobacterium bovis
AEEMDAPDRNLP

SEQ ID NO: 155161 - protein, 4 aa, Mycobacterium bovis
AENP

SEQ ID NO: 155162 - protein, 7 aa, Mycobacterium bovis
AEPATCT

SEQ ID NO: 155163 - protein, 6 aa, Mycobacterium bovis
AESLNA

SEQ ID NO: 155164 - protein, 11 aa, Mycobacterium bovis
AETAADPVAKL

SEQ ID NO: 155165 - protein, 9 aa, Mycobacterium bovis
AGAAGTAAA

SEQ ID NO: 155166 - protein, 6 aa, Mycobacterium bovis
AGARPV

SEQ ID NO: 155167 - protein, 13 aa, Mycobacterium bovis
AGDYTTAAEDKPA

SEQ ID NO: 155168 - protein, 22 aa, Mycobacterium bovis
AGGAAGPLGAKKGGQYPISGDG

SEQ ID NO: 155169 - protein, 14 aa, Mycobacterium bovis
AGGGTALDDVDGTD

SEQ ID NO: 155170 - protein, 5 aa, Mycobacterium bovis
AGGRL

SEQ ID NO: 155171 - protein, 13 aa, Mycobacterium bovis
AGSAGSWSRTRST

SEQ ID NO: 155172 - protein, 20 aa, Mycobacterium bovis
AGVPPPPPPPPPSEVPPSET

SEQ ID NO: 155173 - protein, 12 aa, Mycobacterium bovis
AHTRRSGRQAAH

SEQ ID NO: 155174 - protein, 11 aa, Mycobacterium bovis
ALPDDVRRDRA

SEQ ID NO: 155175 - protein, 22 aa, Mycobacterium bovis
ANYPPDDANYRRSRRPPPMPSA

SEQ ID NO: 155176 - protein, 6 aa, Mycobacterium bovis
APAKRS

SEQ ID NO: 155177 - protein, 7 aa, Mycobacterium bovis
APEEGQM

SEQ ID NO: 155178 - protein, 4 aa, Mycobacterium bovis
AQAL

SEQ ID NO: 155179 - protein, 5 aa, Mycobacterium bovis
AQNAA

SEQ ID NO: 155180 - protein, 4 aa, Mycobacterium bovis
AQSD

SEQ ID NO: 155181 - protein, 5 aa, Mycobacterium bovis
ARAQQ

SEQ ID NO: 155182 - protein, 9 aa, Mycobacterium bovis
ARRSRGPVR

SEQ ID NO: 155183 - protein, 12 aa, Mycobacterium bovis
ASATQSQPPLPA

SEQ ID NO: 155184 - protein, 25 aa, Mycobacterium bovis
ASDISAPAQPARGKPQQRPPSWSPR

SEQ ID NO: 155185 - protein, 69 aa, Mycobacterium bovis
ASGDRDDHDYRRGGFEEPVPGAEAETEKLPTQRPDFPREPSGSDPPRLGSAQPPPPPDAGHPDPGPPER

SEQ ID NO: 155186 - protein, 15 aa, Mycobacterium bovis
ASGPQDYANIPPTRF

SEQ ID NO: 155187 - protein, 4 aa, Mycobacterium bovis
ASLA

SEQ ID NO: 155188 - protein, 7 aa, Mycobacterium bovis
ASPWATP

SEQ ID NO: 155189 - protein, 7 aa, Mycobacterium bovis
ASREPSR

SEQ ID NO: 155190 - protein, 6 aa, Mycobacterium bovis
ASTGRA

SEQ ID NO: 155191 - protein, 6 aa, Mycobacterium bovis
ATVDAY

SEQ ID NO: 155192 - protein, 4 aa, Mycobacterium bovis
AWDP

SEQ ID NO: 155193 - protein, 7 aa, Mycobacterium bovis
CAPPGAL

SEQ ID NO: 155194 - protein, 9 aa, Mycobacterium bovis
CEQPNAGAC

SEQ ID NO: 155195 - protein, 5 aa, Mycobacterium bovis
DAAEP

SEQ ID NO: 155196 - protein, 15 aa, Mycobacterium bovis
DAAIPTGIQNPCFSH

SEQ ID NO: 155197 - protein, 8 aa, Mycobacterium bovis
DATPQVRG

SEQ ID NO: 155198 - protein, 65 aa, Mycobacterium bovis
DDAADEEAVTEPLATESKDEPAEHPEFEGPRRRARRERAERRAAQARATAIEQARRAAKRRARGQ

SEQ ID NO: 155199 - protein, 7 aa, Mycobacterium bovis
DDVPDEV

SEQ ID NO: 155200 - protein, 5 aa, Mycobacterium bovis
DDYAD

SEQ ID NO: 155201 - protein, 22 aa, Mycobacterium bovis
DEHARERTPDAGRDRTFSGQHR

SEQ ID NO: 155202 - protein, 14 aa, Mycobacterium bovis
DELTAAPDSDDLGE

SEQ ID NO: 155203 - protein, 60 aa, Mycobacterium bovis
DEPESEPVSDTGDERASGNHLPPVAGGGDKLPSDQTGETDAYSRAYSAPESEHVTGGPYV

SEQ ID NO: 155204 - protein, 9 aa, Mycobacterium bovis
DGAGPIPEL

SEQ ID NO: 155205 - protein, 14 aa, Mycobacterium bovis
DGSGVNSQRIISVS

SEQ ID NO: 155206 - protein, 8 aa, Mycobacterium bovis
DISDGKRP

SEQ ID NO: 155207 - protein, 9 aa, Mycobacterium bovis
DLQRPDAPW

SEQ ID NO: 155208 - protein, 4 aa, Mycobacterium bovis
DPAA

SEQ ID NO: 155209 - protein, 11 aa, Mycobacterium bovis
DPTYADPSQSM

SEQ ID NO: 155210 - protein, 4 aa, Mycobacterium bovis
DQPP

SEQ ID NO: 155211 - protein, 21 aa, Mycobacterium bovis
DQRCRRRGTNSSDNNTNASAK

SEQ ID NO: 155212 - protein, 6 aa, Mycobacterium bovis
DRIGGG

SEQ ID NO: 155213 - protein, 7 aa, Mycobacterium bovis
DSGPQTF

SEQ ID NO: 155214 - protein, 25 aa, Mycobacterium bovis
DTAVTEPPGFGGPSEPSGAPRTSRT

SEQ ID NO: 155215 - protein, 6 aa, Mycobacterium bovis
DTTHDV

SEQ ID NO: 155216 - protein, 5 aa, Mycobacterium bovis
EATRV

SEQ ID NO: 155217 - protein, 13 aa, Mycobacterium bovis
EATVKDTAAEIAA

SEQ ID NO: 155218 - protein, 17 aa, Mycobacterium bovis
EEHDEYGAAADRSAPLS

SEQ ID NO: 155219 - protein, 13 aa, Mycobacterium bovis
EGERATADAVGRT

SEQ ID NO: 155220 - protein, 7 aa, Mycobacterium bovis
EGIKESV

SEQ ID NO: 155221 - protein, 9 aa, Mycobacterium bovis
EINGNGSRI

SEQ ID NO: 155222 - protein, 23 aa, Mycobacterium bovis
EKSDVTAAPDTVEGDSHTAMTPR

SEQ ID NO: 155223 - protein, 10 aa, Mycobacterium bovis
ELGPQQDTDE

SEQ ID NO: 155224 - protein, 10 aa, Mycobacterium bovis
ELGTHPRART

SEQ ID NO: 155225 - protein, 7 aa, Mycobacterium bovis
ENAANGY

SEQ ID NO: 155226 - protein, 20 aa, Mycobacterium bovis
ENRPSYSDTNLENSKPFNPK

SEQ ID NO: 155227 - protein, 17 aa, Mycobacterium bovis
EPGGTGEPAETPGRGRL

SEQ ID NO: 155228 - protein, 15 aa, Mycobacterium bovis
EPPVEDGEYRQTPAE

SEQ ID NO: 155229 - protein, 5 aa, Mycobacterium bovis
ERAEQ

SEQ ID NO: 155230 - protein, 8 aa, Mycobacterium bovis
ERDRARMT

SEQ ID NO: 155231 - protein, 10 aa, Mycobacterium bovis
ERGTPPSQRY

SEQ ID NO: 155232 - protein, 4 aa, Mycobacterium bovis
ESAA

SEQ ID NO: 155233 - protein, 9 aa, Mycobacterium bovis
ESFEPQYES

SEQ ID NO: 155234 - protein, 11 aa, Mycobacterium bovis
ETAGNQIRDAK

SEQ ID NO: 155235 - protein, 15 aa, Mycobacterium bovis
FEDDTQGGAVNGEDW

SEQ ID NO: 155236 - protein, 12 aa, Mycobacterium bovis
GAEGAAARTADR

SEQ ID NO: 155237 - protein, 23 aa, Mycobacterium bovis
GAGQRYAGQRRTRRVRALEGQRY

SEQ ID NO: 155238 - protein, 4 aa, Mycobacterium bovis
GAGS

SEQ ID NO: 155239 - protein, 7 aa, Mycobacterium bovis
GAHTPAA

SEQ ID NO: 155240 - protein, 53 aa, Mycobacterium bovis
GAKRPGAKKTPPPAPGLAEPAAQPQPEAKPQPEPAAPPKPQTDGDPAAPAAPV

SEQ ID NO: 155241 - protein, 13 aa, Mycobacterium bovis
GALGGLSTTSPAW

SEQ ID NO: 155242 - protein, 6 aa, Mycobacterium bovis
GANSGA

SEQ ID NO: 155243 - protein, 5 aa, Mycobacterium bovis
GARRQ

SEQ ID NO: 155244 - protein, 11 aa, Mycobacterium bovis
GCSADTGDRHP

SEQ ID NO: 155245 - protein, 8 aa, Mycobacterium bovis
GDRLDDSL

SEQ ID NO: 155246 - protein, 8 aa, Mycobacterium bovis
GGITPGNS

SEQ ID NO: 155247 - protein, 30 aa, Mycobacterium bovis
GGWTPNSGGRGGIENGRADPATGQRRNAAT

SEQ ID NO: 155248 - protein, 5 aa, Mycobacterium bovis
GHGKL

SEQ ID NO: 155249 - protein, 8 aa, Mycobacterium bovis
GHSSGVGG

SEQ ID NO: 155250 - protein, 5 aa, Mycobacterium bovis
GKGTF

SEQ ID NO: 155251 - protein, 7 aa, Mycobacterium bovis
GKLPDSL

SEQ ID NO: 155252 - protein, 10 aa, Mycobacterium bovis
GLSDGEAAQR

SEQ ID NO: 155253 - protein, 6 aa, Mycobacterium bovis
GPAGVD

SEQ ID NO: 155254 - protein, 6 aa, Mycobacterium bovis
GPHDAP

SEQ ID NO: 155255 - protein, 5 aa, Mycobacterium bovis
GPTEQ

SEQ ID NO: 155256 - protein, 14 aa, Mycobacterium bovis
GPVRASSERTLQPV

SEQ ID NO: 155257 - protein, 7 aa, Mycobacterium bovis
GQISGSV

SEQ ID NO: 155258 - protein, 11 aa, Mycobacterium bovis
GQTSGASSARL

SEQ ID NO: 155259 - protein, 7 aa, Mycobacterium bovis
GRAAAAG

SEQ ID NO: 155260 - protein, 7 aa, Mycobacterium bovis
GRAPERL

SEQ ID NO: 155261 - protein, 6 aa, Mycobacterium bovis
GRDGGD

SEQ ID NO: 155262 - protein, 27 aa, Mycobacterium bovis
GRMDRGGSAAGASRQRRTKGAGGSFTS

SEQ ID NO: 155263 - protein, 12 aa, Mycobacterium bovis
GRNANDLNRPQF

SEQ ID NO: 155264 - protein, 29 aa, Mycobacterium bovis
GRSAGKTSEPTCPTEPIDAADSSTTPDPS

SEQ ID NO: 155265 - protein, 8 aa, Mycobacterium bovis
GSDENGAV

SEQ ID NO: 155266 - protein, 9 aa, Mycobacterium bovis
GSEQVQPNT

SEQ ID NO: 155267 - protein, 6 aa, Mycobacterium bovis
GSGPGF

SEQ ID NO: 155268 - protein, 4 aa, Mycobacterium bovis
GSGV

SEQ ID NO: 155269 - protein, 7 aa, Mycobacterium bovis
GSPEAAL

SEQ ID NO: 155270 - protein, 10 aa, Mycobacterium bovis
GSRSIADYGG

SEQ ID NO: 155271 - protein, 16 aa, Mycobacterium bovis
GSSGASGGAIASGSVA

SEQ ID NO: 155272 - protein, 35 aa, Mycobacterium bovis
GSSPNSEDDSSAISTMTTTTAAPTSTSVKPAAPRA

SEQ ID NO: 155273 - protein, 15 aa, Mycobacterium bovis
GSTGEFKDKYGKSSA

SEQ ID NO: 155274 - protein, 25 aa, Mycobacterium bovis
GSTPAAAGAGRRGVPALPTPPKGWP

SEQ ID NO: 155275 - protein, 7 aa, Mycobacterium bovis
GSTPDSE

SEQ ID NO: 155276 - protein, 11 aa, Mycobacterium bovis
GTKRGPIPSYD

SEQ ID NO: 155277 - protein, 5 aa, Mycobacterium bovis
GVQDG

SEQ ID NO: 155278 - protein, 8 aa, Mycobacterium bovis
GVSAPQLG

SEQ ID NO: 155279 - protein, 14 aa, Mycobacterium bovis
GWYTDPDGSAGQRY

SEQ ID NO: 155280 - protein, 19 aa, Mycobacterium bovis
GYDPNAGYSAHAGAQPQRI

SEQ ID NO: 155281 - protein, 17 aa, Mycobacterium bovis
HAPDALGGPPGLPAPRG

SEQ ID NO: 155282 - protein, 12 aa, Mycobacterium bovis
HHPLPDPGESVP

SEQ ID NO: 155283 - protein, 4 aa, Mycobacterium bovis
HHRN

SEQ ID NO: 155284 - protein, 24 aa, Mycobacterium bovis
HPAAKRARAQPRRPVKRADETETV

SEQ ID NO: 155285 - protein, 7 aa, Mycobacterium bovis
HPADGTV

SEQ ID NO: 155286 - protein, 6 aa, Mycobacterium bovis
HPDPAA

SEQ ID NO: 155287 - protein, 12 aa, Mycobacterium bovis
HRANGQPPERAH

SEQ ID NO: 155288 - protein, 8 aa, Mycobacterium bovis
HSEQSASI

SEQ ID NO: 155289 - protein, 6 aa, Mycobacterium bovis
HTGPGT

SEQ ID NO: 155290 - protein, 7 aa, Mycobacterium bovis
IAASGDT

SEQ ID NO: 155291 - protein, 12 aa, Mycobacterium bovis
IASGDGTVKRSG

SEQ ID NO: 155292 - protein, 9 aa, Mycobacterium bovis
IDPSASAET

SEQ ID NO: 155293 - protein, 7 aa, Mycobacterium bovis
IEERSGH

SEQ ID NO: 155294 - protein, 7 aa, Mycobacterium bovis
IGPGPHA

SEQ ID NO: 155295 - protein, 10 aa, Mycobacterium bovis
IGSGGHGAAG

SEQ ID NO: 155296 - protein, 4 aa, Mycobacterium bovis
IPNP

SEQ ID NO: 155297 - protein, 9 aa, Mycobacterium bovis
ITDSPVPAA

SEQ ID NO: 155298 - protein, 6 aa, Mycobacterium bovis
KETVQS

SEQ ID NO: 155299 - protein, 7 aa, Mycobacterium bovis
KNRDPIA

SEQ ID NO: 155300 - protein, 11 aa, Mycobacterium bovis
KNTPNSRGTIG

SEQ ID NO: 155301 - protein, 7 aa, Mycobacterium bovis
KPPQHKR

SEQ ID NO: 155302 - protein, 12 aa, Mycobacterium bovis
KPVQPPQPVAEE

SEQ ID NO: 155303 - protein, 7 aa, Mycobacterium bovis
KRKLERQ

SEQ ID NO: 155304 - protein, 6 aa, Mycobacterium bovis
LAEQSR

SEQ ID NO: 155305 - protein, 7 aa, Mycobacterium bovis
LAGNSAK

SEQ ID NO: 155306 - protein, 18 aa, Mycobacterium bovis
LASVPGSRRQWERDPHDP

SEQ ID NO: 155307 - protein, 4 aa, Mycobacterium bovis
LDGL

SEQ ID NO: 155308 - protein, 6 aa, Mycobacterium bovis
LDPTSV

SEQ ID NO: 155309 - protein, 12 aa, Mycobacterium bovis
LDSRDQGAADRR

SEQ ID NO: 155310 - protein, 15 aa, Mycobacterium bovis
LDTTARPQCQRTTRL

SEQ ID NO: 155311 - protein, 4 aa, Mycobacterium bovis
LGRL

SEQ ID NO: 155312 - protein, 50 aa, Mycobacterium bovis
LPDLSGPTPRAPQRNPAPARPAEGGAGSRGDSAAGSSGGRSITAESRDAR

SEQ ID NO: 155313 - protein, 16 aa, Mycobacterium bovis
LPPRPGSPRTADPPVR

SEQ ID NO: 155314 - protein, 11 aa, Mycobacterium bovis
LPQATPNGAAP

SEQ ID NO: 155315 - protein, 4 aa, Mycobacterium bovis
LRES

SEQ ID NO: 155316 - protein, 6 aa, Mycobacterium bovis
LSDPRN

SEQ ID NO: 155317 - protein, 13 aa, Mycobacterium bovis
LSDQPPGVIVVVT

SEQ ID NO: 155318 - protein, 9 aa, Mycobacterium bovis
LSHRNTQPG

SEQ ID NO: 155319 - protein, 6 aa, Mycobacterium bovis
LTDPKR

SEQ ID NO: 155320 - protein, 9 aa, Mycobacterium bovis
LTGPGGATQ

SEQ ID NO: 155321 - protein, 11 aa, Mycobacterium bovis
LTPGRGFRNGP

SEQ ID NO: 155322 - protein, 5 aa, Mycobacterium bovis
MPPAG

SEQ ID NO: 155323 - protein, 9 aa, Mycobacterium bovis
MPRGGPDAS

SEQ ID NO: 155324 - protein, 7 aa, Mycobacterium bovis
MTINGDP

SEQ ID NO: 155325 - protein, 5 aa, Mycobacterium bovis
NEHSD

SEQ ID NO: 155326 - protein, 7 aa, Mycobacterium bovis
NGTSTVG

SEQ ID NO: 155327 - protein, 6 aa, Mycobacterium bovis
NNGKEF

SEQ ID NO: 155328 - protein, 12 aa, Mycobacterium bovis
NPEGQASSLESI

SEQ ID NO: 155329 - protein, 8 aa, Mycobacterium bovis
NPEQHKDF

SEQ ID NO: 155330 - protein, 6 aa, Mycobacterium bovis
NRRDEA

SEQ ID NO: 155331 - protein, 22 aa, Mycobacterium bovis
NYSGDSPATAEQVAADRATTSN

SEQ ID NO: 155332 - protein, 4 aa, Mycobacterium bovis
PAAF

SEQ ID NO: 155333 - protein, 4 aa, Mycobacterium bovis
PAGS

SEQ ID NO: 155334 - protein, 4 aa, Mycobacterium bovis
PAQA

SEQ ID NO: 155335 - protein, 5 aa, Mycobacterium bovis
PEANS

SEQ ID NO: 155336 - protein, 20 aa, Mycobacterium bovis
PGAAPPPRHGPRLRGPTPHY

SEQ ID NO: 155337 - protein, 9 aa, Mycobacterium bovis
PGADLDEDT

SEQ ID NO: 155338 - protein, 13 aa, Mycobacterium bovis
PGNVAANVSSGAQ

SEQ ID NO: 155339 - protein, 22 aa, Mycobacterium bovis
PGWQSAPPGYPPPYPQYPGPGS

SEQ ID NO: 155340 - protein, 5 aa, Mycobacterium bovis
PHQTP

SEQ ID NO: 155341 - protein, 15 aa, Mycobacterium bovis
PIATGDHKAPAAKEG

SEQ ID NO: 155342 - protein, 8 aa, Mycobacterium bovis
PIDETSLG

SEQ ID NO: 155343 - protein, 8 aa, Mycobacterium bovis
PIDPRSYS

SEQ ID NO: 155344 - protein, 12 aa, Mycobacterium bovis
PLPPSPSGSFAS

SEQ ID NO: 155345 - protein, 5 aa, Mycobacterium bovis
PLPSL

SEQ ID NO: 155346 - protein, 8 aa, Mycobacterium bovis
PLSGSGYS

SEQ ID NO: 155347 - protein, 25 aa, Mycobacterium bovis
PPEGQGDDPDWKPEEDWRDDPVEDG

SEQ ID NO: 155348 - protein, 5 aa, Mycobacterium bovis
PPGTV

SEQ ID NO: 155349 - protein, 7 aa, Mycobacterium bovis
PQPRPSS

SEQ ID NO: 155350 - protein, 5 aa, Mycobacterium bovis
PREFR

SEQ ID NO: 155351 - protein, 4 aa, Mycobacterium bovis
PRLS

SEQ ID NO: 155352 - protein, 6 aa, Mycobacterium bovis
PRLTTK

SEQ ID NO: 155353 - protein, 9 aa, Mycobacterium bovis
PSSGNGDAA

SEQ ID NO: 155354 - protein, 5 aa, Mycobacterium bovis
PSVPR

SEQ ID NO: 155355 - protein, 8 aa, Mycobacterium bovis
PTGTVDVG

SEQ ID NO: 155356 - protein, 9 aa, Mycobacterium bovis
PVPSTGAKI

SEQ ID NO: 155357 - protein, 16 aa, Mycobacterium bovis
PVSEADADDEDNELTD

SEQ ID NO: 155358 - protein, 7 aa, Mycobacterium bovis
QADYDEA

SEQ ID NO: 155359 - protein, 6 aa, Mycobacterium bovis
QALRAD

SEQ ID NO: 155360 - protein, 17 aa, Mycobacterium bovis
QAPVPASAKAGPSPAAV

SEQ ID NO: 155361 - protein, 13 aa, Mycobacterium bovis
QAQPAGSYGGVTP

SEQ ID NO: 155362 - protein, 6 aa, Mycobacterium bovis
QATASF

SEQ ID NO: 155363 - protein, 5 aa, Mycobacterium bovis
QDPDG

SEQ ID NO: 155364 - protein, 18 aa, Mycobacterium bovis
QEEEPAAVKTKRRARRDP

SEQ ID NO: 155365 - protein, 7 aa, Mycobacterium bovis
QGNSDSI

SEQ ID NO: 155366 - protein, 10 aa, Mycobacterium bovis
QPDASVRSDA

SEQ ID NO: 155367 - protein, 25 aa, Mycobacterium bovis
QPPPPGPVPAPGPAQAPPPESPAQG

SEQ ID NO: 155368 - protein, 8 aa, Mycobacterium bovis
QPWPEPGD

SEQ ID NO: 155369 - protein, 5 aa, Mycobacterium bovis
QRELD

SEQ ID NO: 155370 - protein, 5 aa, Mycobacterium bovis
QRNRA

SEQ ID NO: 155371 - protein, 16 aa, Mycobacterium bovis
QRRRPREPREQTQNRM

SEQ ID NO: 155372 - protein, 8 aa, Mycobacterium bovis
QSNADEDK

SEQ ID NO: 155373 - protein, 28 aa, Mycobacterium bovis
QTNGDSPGRHGGRGTPSPTDGPLASTES

SEQ ID NO: 155374 - protein, 5 aa, Mycobacterium bovis
QTTGR

SEQ ID NO: 155375 - protein, 8 aa, Mycobacterium bovis
QVNTGDQI

SEQ ID NO: 155376 - protein, 5 aa, Mycobacterium bovis
QVTST

SEQ ID NO: 155377 - protein, 22 aa, Mycobacterium bovis
RAAQRGQTGTVTSTDYTGSREL

SEQ ID NO: 155378 - protein, 13 aa, Mycobacterium bovis
RADGVDRAQYPQA

SEQ ID NO: 155379 - protein, 8 aa, Mycobacterium bovis
RAPHSAGV

SEQ ID NO: 155380 - protein, 8 aa, Mycobacterium bovis
RATPVAAP

SEQ ID NO: 155381 - protein, 4 aa, Mycobacterium bovis
RDPL

SEQ ID NO: 155382 - protein, 7 aa, Mycobacterium bovis
RGGPAAG

SEQ ID NO: 155383 - protein, 7 aa, Mycobacterium bovis
RGPRQTI

SEQ ID NO: 155384 - protein, 16 aa, Mycobacterium bovis
RGSKVGELAQDTRTSL

SEQ ID NO: 155385 - protein, 14 aa, Mycobacterium bovis
RHRRPNPSAPRSPL

SEQ ID NO: 155386 - protein, 14 aa, Mycobacterium bovis
RHTPEPARLRPAVG

SEQ ID NO: 155387 - protein, 15 aa, Mycobacterium bovis
RIEAPAPSARSESLA

SEQ ID NO: 155388 - protein, 5 aa, Mycobacterium bovis
RKEDK

SEQ ID NO: 155389 - protein, 7 aa, Mycobacterium bovis
RKEFGPA

SEQ ID NO: 155390 - protein, 6 aa, Mycobacterium bovis
RKNQYD

SEQ ID NO: 155391 - protein, 28 aa, Mycobacterium bovis
RKPGESRGTEPNMRPDRNTNARRTAPDT

SEQ ID NO: 155392 - protein, 28 aa, Mycobacterium bovis
RKRANPQPAQTQPARKTPRTAPGQPARQ

SEQ ID NO: 155393 - protein, 31 aa, Mycobacterium bovis
RKSGTKKGAGVGSGGQRRRGLEGRGPTPPAH

SEQ ID NO: 155394 - protein, 4 aa, Mycobacterium bovis
RLDQ

SEQ ID NO: 155395 - protein, 10 aa, Mycobacterium bovis
RPGPTPPATI

SEQ ID NO: 155396 - protein, 7 aa, Mycobacterium bovis
RPTDRAR

SEQ ID NO: 155397 - protein, 6 aa, Mycobacterium bovis
RRSASV

SEQ ID NO: 155398 - protein, 5 aa, Mycobacterium bovis
RSGTP

SEQ ID NO: 155399 - protein, 4 aa, Mycobacterium bovis
RTGR

SEQ ID NO: 155400 - protein, 9 aa, Mycobacterium bovis
RTNGASYAY

SEQ ID NO: 155401 - protein, 4 aa, Mycobacterium bovis
RTTS

SEQ ID NO: 155402 - protein, 7 aa, Mycobacterium bovis
RTTTPYT

SEQ ID NO: 155403 - protein, 4 aa, Mycobacterium bovis
RTVD

SEQ ID NO: 155404 - protein, 4 aa, Mycobacterium bovis
SALS

SEQ ID NO: 155405 - protein, 4 aa, Mycobacterium bovis
SAPR

SEQ ID NO: 155406 - protein, 4 aa, Mycobacterium bovis
SAPT

SEQ ID NO: 155407 - protein, 5 aa, Mycobacterium bovis
SAQGR

SEQ ID NO: 155408 - protein, 6 aa, Mycobacterium bovis
SASRLG

SEQ ID NO: 155409 - protein, 6 aa, Mycobacterium bovis
SDSPTY

SEQ ID NO: 155410 - protein, 6 aa, Mycobacterium bovis
SEGKGL

SEQ ID NO: 155411 - protein, 7 aa, Mycobacterium bovis
SEPQRVD

SEQ ID NO: 155412 - protein, 6 aa, Mycobacterium bovis
SGATPV

SEQ ID NO: 155413 - protein, 4 aa, Mycobacterium bovis
SHPR

SEQ ID NO: 155414 - protein, 4 aa, Mycobacterium bovis
SIAP

SEQ ID NO: 155415 - protein, 8 aa, Mycobacterium bovis
SKAEAALQ

SEQ ID NO: 155416 - protein, 5 aa, Mycobacterium bovis
SLTGE

SEQ ID NO: 155417 - protein, 15 aa, Mycobacterium bovis
SPPTLTSGRPSGNLP

SEQ ID NO: 155418 - protein, 17 aa, Mycobacterium bovis
SRQRKAKVTQDDTGTYR

SEQ ID NO: 155419 - protein, 8 aa, Mycobacterium bovis
SSNSPISG

SEQ ID NO: 155420 - protein, 18 aa, Mycobacterium bovis
SSSAPTESSECSADRQPG

SEQ ID NO: 155421 - protein, 4 aa, Mycobacterium bovis
STEG

SEQ ID NO: 155422 - protein, 8 aa, Mycobacterium bovis
STSFPSGH

SEQ ID NO: 155423 - protein, 13 aa, Mycobacterium bovis
SYGENNLAATATS

SEQ ID NO: 155424 - protein, 13 aa, Mycobacterium bovis
TAAGEPNAAPAAC

SEQ ID NO: 155425 - protein, 13 aa, Mycobacterium bovis
TACPKGVDPAGAI

SEQ ID NO: 155426 - protein, 7 aa, Mycobacterium bovis
TAEAEAM

SEQ ID NO: 155427 - protein, 10 aa, Mycobacterium bovis
TAKAWGGGDL

SEQ ID NO: 155428 - protein, 10 aa, Mycobacterium bovis
TDVAAGQALQ

SEQ ID NO: 155429 - protein, 6 aa, Mycobacterium bovis
TEADER

SEQ ID NO: 155430 - protein, 4 aa, Mycobacterium bovis
TGGI

SEQ ID NO: 155431 - protein, 14 aa, Mycobacterium bovis
TGPARSAGCNPGGQ

SEQ ID NO: 155432 - protein, 6 aa, Mycobacterium bovis
THSSGR

SEQ ID NO: 155433 - protein, 18 aa, Mycobacterium bovis
TKSHSRPHTSNDNPLSEA

SEQ ID NO: 155434 - protein, 8 aa, Mycobacterium bovis
TLKDGTEL

SEQ ID NO: 155435 - protein, 6 aa, Mycobacterium bovis
TLSSDP

SEQ ID NO: 155436 - protein, 15 aa, Mycobacterium bovis
TLTTDRGAEPELGAQ

SEQ ID NO: 155437 - protein, 5 aa, Mycobacterium bovis
TPQRS

SEQ ID NO: 155438 - protein, 22 aa, Mycobacterium bovis
TPRPAPPAQQLPSTPPGTQHLP

SEQ ID NO: 155439 - protein, 8 aa, Mycobacterium bovis
TQQGQLGA

SEQ ID NO: 155440 - protein, 6 aa, Mycobacterium bovis
TQVATG

SEQ ID NO: 155441 - protein, 8 aa, Mycobacterium bovis
TSAGAAAR

SEQ ID NO: 155442 - protein, 4 aa, Mycobacterium bovis
TSPA

SEQ ID NO: 155443 - protein, 16 aa, Mycobacterium bovis
TSRRQRKSAPARISGD

SEQ ID NO: 155444 - protein, 10 aa, Mycobacterium bovis
TTAAGSAALG

SEQ ID NO: 155445 - protein, 8 aa, Mycobacterium bovis
TTADPDIP

SEQ ID NO: 155446 - protein, 13 aa, Mycobacterium bovis
TTARAARRYGAGN

SEQ ID NO: 155447 - protein, 49 aa, Mycobacterium bovis
TTTAPPVTTTPRPSPTTTTTTAPPSTTTTTELPVTTTSTIPTIPTTTTT

SEQ ID NO: 155448 - protein, 9 aa, Mycobacterium bovis
TTTDSAEGV

SEQ ID NO: 155449 - protein, 10 aa, Mycobacterium bovis
TVTNTGDRPV

SEQ ID NO: 155450 - protein, 13 aa, Mycobacterium bovis
VAEEPEPELPGVT

SEQ ID NO: 155451 - protein, 7 aa, Mycobacterium bovis
VKSATTN

SEQ ID NO: 155452 - protein, 7 aa, Mycobacterium bovis
VPDSSGL

SEQ ID NO: 155453 - protein, 7 aa, Mycobacterium bovis
VPEEQPA

SEQ ID NO: 155454 - protein, 9 aa, Mycobacterium bovis
VRAERVSNE

SEQ ID NO: 155455 - protein, 5 aa, Mycobacterium bovis
VRAGE

SEQ ID NO: 155456 - protein, 7 aa, Mycobacterium bovis
VSLRPNR

SEQ ID NO: 155457 - protein, 13 aa, Mycobacterium bovis
VSNRNSPTPQIDR

SEQ ID NO: 155458 - protein, 15 aa, Mycobacterium bovis
VSPAGSGKSTTIPLS

SEQ ID NO: 155459 - protein, 50 aa, Mycobacterium bovis
VVTPTRPPESHAPASAAPAETQPPPPDAGAPPATQSPEATPPGPAEPAPA

SEQ ID NO: 155460 - protein, 23 aa, Mycobacterium bovis
WRTPARPQVPTASDTRRTPPRLP

SEQ ID NO: 155461 - protein, 12 aa, Mycobacterium bovis
YDAAATQSGGVC

SEQ ID NO: 155462 - protein, 21 aa, Mycobacterium bovis
YPESDTADRQVETPPSPPADA

SEQ ID NO: 155463 - protein, 6 aa, Mycobacterium bovis
YSATPY

SEQ ID NO: 155464 - protein, 6 aa, Mycobacterium bovis
YSEHPA

SEQ ID NO: 155465 - protein, 6 aa, Mycobacterium bovis
YSPSAL

SEQ ID NO: 155466 - protein, 5 aa, Mycobacterium bovis
YTSDQ

SEQ ID NO: 155467 - protein, 10 aa, Mycobacterium bovis
AAAEQPGLPG

SEQ ID NO: 155468 - protein, 7 aa, Mycobacterium bovis
AAAIPDA

SEQ ID NO: 155469 - protein, 5 aa, Mycobacterium bovis
AAASG

SEQ ID NO: 155470 - protein, 8 aa, Mycobacterium bovis
AAATSAPR

SEQ ID NO: 155471 - protein, 7 aa, Mycobacterium bovis
AADGTRH

SEQ ID NO: 155472 - protein, 6 aa, Mycobacterium bovis
AADPGM

SEQ ID NO: 155473 - protein, 9 aa, Mycobacterium bovis
AADRATTSN

SEQ ID NO: 155474 - protein, 7 aa, Mycobacterium bovis
AAEQGMG

SEQ ID NO: 155475 - protein, 11 aa, Mycobacterium bovis
AAGGAVDGADT

SEQ ID NO: 155476 - protein, 9 aa, Mycobacterium bovis
AANTDDGRS

SEQ ID NO: 155477 - protein, 7 aa, Mycobacterium bovis
AAPAKRS

SEQ ID NO: 155478 - protein, 17 aa, Mycobacterium bovis
AAPDTVEGDSHTAMTPR

SEQ ID NO: 155479 - protein, 21 aa, Mycobacterium bovis
AAQRGQTGTVTSTDYTGSREL

SEQ ID NO: 155480 - protein, 7 aa, Mycobacterium bovis
AAQTGGV

SEQ ID NO: 155481 - protein, 4 aa, Mycobacterium bovis
AAQV

SEQ ID NO: 155482 - protein, 10 aa, Mycobacterium bovis
AARARARAAR

SEQ ID NO: 155483 - protein, 4 aa, Mycobacterium bovis
AARG

SEQ ID NO: 155484 - protein, 6 aa, Mycobacterium bovis
AARGRS

SEQ ID NO: 155485 - protein, 4 aa, Mycobacterium bovis
AATD

SEQ ID NO: 155486 - protein, 9 aa, Mycobacterium bovis
ADESSSALL

SEQ ID NO: 155487 - protein, 9 aa, Mycobacterium bovis
ADGKKMENA

SEQ ID NO: 155488 - protein, 5 aa, Mycobacterium bovis
ADGNL

SEQ ID NO: 155489 - protein, 16 aa, Mycobacterium bovis
AEIPATAKSAALGRQL

SEQ ID NO: 155490 - protein, 9 aa, Mycobacterium bovis
AEPATPAEL

SEQ ID NO: 155491 - protein, 14 aa, Mycobacterium bovis
AEPQPTPRPAKPRL

SEQ ID NO: 155492 - protein, 5 aa, Mycobacterium bovis
AEQSR

SEQ ID NO: 155493 - protein, 10 aa, Mycobacterium bovis
AEVDASDDRM

SEQ ID NO: 155494 - protein, 10 aa, Mycobacterium bovis
AGAAGTAAAL

SEQ ID NO: 155495 - protein, 7 aa, Mycobacterium bovis
AGARPVV

SEQ ID NO: 155496 - protein, 5 aa, Mycobacterium bovis
AGEPH

SEQ ID NO: 155497 - protein, 22 aa, Mycobacterium bovis
AGGAAGPLGAKKGGQYPIGGDG

SEQ ID NO: 155498 - protein, 6 aa, Mycobacterium bovis
AGPSAQ

SEQ ID NO: 155499 - protein, 6 aa, Mycobacterium bovis
AGPTEQ

SEQ ID NO: 155500 - protein, 13 aa, Mycobacterium bovis
AGSAASWSRTRST

SEQ ID NO: 155501 - protein, 8 aa, Mycobacterium bovis
AGSADGAG

SEQ ID NO: 155502 - protein, 10 aa, Mycobacterium bovis
AGSGPLPQVR

SEQ ID NO: 155503 - protein, 19 aa, Mycobacterium bovis
AGVPPPPPPPPSEVPPSET

SEQ ID NO: 155504 - protein, 8 aa, Mycobacterium bovis
AKNRDPIA

SEQ ID NO: 155505 - protein, 7 aa, Mycobacterium bovis
AKSAAES

SEQ ID NO: 155506 - protein, 8 aa, Mycobacterium bovis
ALRESAGR

SEQ ID NO: 155507 - protein, 11 aa, Mycobacterium bovis
AMSDAQDSRVG

SEQ ID NO: 155508 - protein, 22 aa, Mycobacterium bovis
ANYPPGDANYRRSRRPPPMPSA

SEQ ID NO: 155509 - protein, 8 aa, Mycobacterium bovis
APEEGQMS

SEQ ID NO: 155510 - protein, 5 aa, Mycobacterium bovis
APGMT

SEQ ID NO: 155511 - protein, 9 aa, Mycobacterium bovis
APPSGQPRV

SEQ ID NO: 155512 - protein, 17 aa, Mycobacterium bovis
APVTAGPVGGTAEVPTP

SEQ ID NO: 155513 - protein, 6 aa, Mycobacterium bovis
AQNAAA

SEQ ID NO: 155514 - protein, 5 aa, Mycobacterium bovis
ARAAG

SEQ ID NO: 155515 - protein, 9 aa, Mycobacterium bovis
ARAPHSAGV

SEQ ID NO: 155516 - protein, 6 aa, Mycobacterium bovis
ARGGIK

SEQ ID NO: 155517 - protein, 8 aa, Mycobacterium bovis
ARRDGAPP

SEQ ID NO: 155518 - protein, 8 aa, Mycobacterium bovis
ARYSDDQS

SEQ ID NO: 155519 - protein, 36 aa, Mycobacterium bovis
ASAPVTGPAAAVRTPQPDPDASLGCGDGSPAEAYAS

SEQ ID NO: 155520 - protein, 69 aa, Mycobacterium bovis
ASGDRDDHDYRRGGFEEPVPGAEAETEKLPTQRPDFPREPNGSDPPRLGSAQPPPPPDAGHPDPGPPER

SEQ ID NO: 155521 - protein, 8 aa, Mycobacterium bovis
ASGGPNCR

SEQ ID NO: 155522 - protein, 8 aa, Mycobacterium bovis
ASGPQDYA

SEQ ID NO: 155523 - protein, 6 aa, Mycobacterium bovis
ASKPPL

SEQ ID NO: 155524 - protein, 28 aa, Mycobacterium bovis
ASSEDAEAESDASNPSRGETVVHYRSDP

SEQ ID NO: 155525 - protein, 14 aa, Mycobacterium bovis
ASVADPASPHRNAG

SEQ ID NO: 155526 - protein, 4 aa, Mycobacterium bovis
ATGR

SEQ ID NO: 155527 - protein, 8 aa, Mycobacterium bovis
ATGSGKSE

SEQ ID NO: 155528 - protein, 9 aa, Mycobacterium bovis
ATLKDGTEL

SEQ ID NO: 155529 - protein, 4 aa, Mycobacterium bovis
ATMP

SEQ ID NO: 155530 - protein, 12 aa, Mycobacterium bovis
ATPEATSEETPT

SEQ ID NO: 155531 - protein, 7 aa, Mycobacterium bovis
ATPVAAP

SEQ ID NO: 155532 - protein, 31 aa, Mycobacterium bovis
ATRQSQAGHRQPPPVSHPEGRPTNPPAAADA

SEQ ID NO: 155533 - protein, 10 aa, Mycobacterium bovis
ATTDPSPFDP

SEQ ID NO: 155534 - protein, 14 aa, Mycobacterium bovis
CASDPSSDSASTAT

SEQ ID NO: 155535 - protein, 7 aa, Mycobacterium bovis
CDPDGNR

SEQ ID NO: 155536 - protein, 10 aa, Mycobacterium bovis
CEQPNAGACS

SEQ ID NO: 155537 - protein, 5 aa, Mycobacterium bovis
CGAPA

SEQ ID NO: 155538 - protein, 4 aa, Mycobacterium bovis
DAAE

SEQ ID NO: 155539 - protein, 6 aa, Mycobacterium bovis
DAAGDL

SEQ ID NO: 155540 - protein, 8 aa, Mycobacterium bovis
DAEPAQAE

SEQ ID NO: 155541 - protein, 6 aa, Mycobacterium bovis
DARAQQ

SEQ ID NO: 155542 - protein, 8 aa, Mycobacterium bovis
DDAPQTTI

SEQ ID NO: 155543 - protein, 4 aa, Mycobacterium bovis
DDYA

SEQ ID NO: 155544 - protein, 7 aa, Mycobacterium bovis
DEARRPG

SEQ ID NO: 155545 - protein, 4 aa, Mycobacterium bovis
DELT

SEQ ID NO: 155546 - protein, 15 aa, Mycobacterium bovis
DELTAAPDSDDLGEG

SEQ ID NO: 155547 - protein, 4 aa, Mycobacterium bovis
DEPP

SEQ ID NO: 155548 - protein, 4 aa, Mycobacterium bovis
DFGG

SEQ ID NO: 155549 - protein, 8 aa, Mycobacterium bovis
DGAGPIPE

SEQ ID NO: 155550 - protein, 5 aa, Mycobacterium bovis
DGGNT

SEQ ID NO: 155551 - protein, 5 aa, Mycobacterium bovis
DGHDH

SEQ ID NO: 155552 - protein, 5 aa, Mycobacterium bovis
DGHGH

SEQ ID NO: 155553 - protein, 4 aa, Mycobacterium bovis
DGHR

SEQ ID NO: 155554 - protein, 8 aa, Mycobacterium bovis
DGSPDAAL

SEQ ID NO: 155555 - protein, 4 aa, Mycobacterium bovis
DHRP

SEQ ID NO: 155556 - protein, 5 aa, Mycobacterium bovis
DITPV

SEQ ID NO: 155557 - protein, 7 aa, Mycobacterium bovis
DKSGDAE

SEQ ID NO: 155558 - protein, 4 aa, Mycobacterium bovis
DLAG

SEQ ID NO: 155559 - protein, 11 aa, Mycobacterium bovis
DLQRPDAPWGR

SEQ ID NO: 155560 - protein, 8 aa, Mycobacterium bovis
DNGDPANR

SEQ ID NO: 155561 - protein, 15 aa, Mycobacterium bovis
DPADSELDRRQAQRV

SEQ ID NO: 155562 - protein, 10 aa, Mycobacterium bovis
DPLPPTPRRE

SEQ ID NO: 155563 - protein, 7 aa, Mycobacterium bovis
DPNDPTP

SEQ ID NO: 155564 - protein, 8 aa, Mycobacterium bovis
DPSASAET

SEQ ID NO: 155565 - protein, 12 aa, Mycobacterium bovis
DPTYADPSQSML

SEQ ID NO: 155566 - protein, 31 aa, Mycobacterium bovis
DPVAPAARGPPAAQGSVRTGQDLLTRFCLVR

SEQ ID NO: 155567 - protein, 7 aa, Mycobacterium bovis
DQKDNLN

SEQ ID NO: 155568 - protein, 5 aa, Mycobacterium bovis
DRDGG

SEQ ID NO: 155569 - protein, 10 aa, Mycobacterium bovis
DRGAGGSPAH

SEQ ID NO: 155570 - protein, 26 aa, Mycobacterium bovis
DRGGAHRAATGPGRIPDAGDPPPWQR

SEQ ID NO: 155571 - protein, 15 aa, Mycobacterium bovis
DRHTPEPARLRPAVG

SEQ ID NO: 155572 - protein, 7 aa, Mycobacterium bovis
DRIGGGR

SEQ ID NO: 155573 - protein, 4 aa, Mycobacterium bovis
DRNR

SEQ ID NO: 155574 - protein, 14 aa, Mycobacterium bovis
DRYGGGTARRLERT

SEQ ID NO: 155575 - protein, 7 aa, Mycobacterium bovis
DSDSPTY

SEQ ID NO: 155576 - protein, 21 aa, Mycobacterium bovis
DSNSWVPNKPDAATPVIPGPV

SEQ ID NO: 155577 - protein, 9 aa, Mycobacterium bovis
DSRSIADYG

SEQ ID NO: 155578 - protein, 8 aa, Mycobacterium bovis
DTSRGQGW

SEQ ID NO: 155579 - protein, 14 aa, Mycobacterium bovis
DTTARPQCQRTTRL

SEQ ID NO: 155580 - protein, 8 aa, Mycobacterium bovis
DVPEEQPA

SEQ ID NO: 155581 - protein, 11 aa, Mycobacterium bovis
DYSRRKHTEAG

SEQ ID NO: 155582 - protein, 7 aa, Mycobacterium bovis
EAAARPD

SEQ ID NO: 155583 - protein, 14 aa, Mycobacterium bovis
EATVKDTAAEIAAR

SEQ ID NO: 155584 - protein, 6 aa, Mycobacterium bovis
EDTPAD

SEQ ID NO: 155585 - protein, 18 aa, Mycobacterium bovis
EEHDEYGAAADRSAPLSR

SEQ ID NO: 155586 - protein, 5 aa, Mycobacterium bovis
EGKPA

SEQ ID NO: 155587 - protein, 8 aa, Mycobacterium bovis
ENAANGYA

SEQ ID NO: 155588 - protein, 15 aa, Mycobacterium bovis
ENAVPTAELVKVAGR

SEQ ID NO: 155589 - protein, 6 aa, Mycobacterium bovis
EPATCT

SEQ ID NO: 155590 - protein, 11 aa, Mycobacterium bovis
EPDVDCPSTNL

SEQ ID NO: 155591 - protein, 6 aa, Mycobacterium bovis
EPFTPE

SEQ ID NO: 155592 - protein, 7 aa, Mycobacterium bovis
EPGGSTI

SEQ ID NO: 155593 - protein, 7 aa, Mycobacterium bovis
EPPEAPK

SEQ ID NO: 155594 - protein, 13 aa, Mycobacterium bovis
EPPSAVRATPGTS

SEQ ID NO: 155595 - protein, 6 aa, Mycobacterium bovis
EQSGTA

SEQ ID NO: 155596 - protein, 7 aa, Mycobacterium bovis
EQVQPNT

SEQ ID NO: 155597 - protein, 9 aa, Mycobacterium bovis
ERDRARMTQ

SEQ ID NO: 155598 - protein, 9 aa, Mycobacterium bovis
ERGTPPNQR

SEQ ID NO: 155599 - protein, 6 aa, Mycobacterium bovis
ERRGQP

SEQ ID NO: 155600 - protein, 5 aa, Mycobacterium bovis
ERSGH

SEQ ID NO: 155601 - protein, 4 aa, Mycobacterium bovis
ERSK

SEQ ID NO: 155602 - protein, 5 aa, Mycobacterium bovis
ERTVD

SEQ ID NO: 155603 - protein, 7 aa, Mycobacterium bovis
ESPEFDR

SEQ ID NO: 155604 - protein, 5 aa, Mycobacterium bovis
ESQEA

SEQ ID NO: 155605 - protein, 14 aa, Mycobacterium bovis
ESTEQARAELANEP

SEQ ID NO: 155606 - protein, 8 aa, Mycobacterium bovis
ETLAPAEQ

SEQ ID NO: 155607 - protein, 10 aa, Mycobacterium bovis
EVSGSPPPRL

SEQ ID NO: 155608 - protein, 14 aa, Mycobacterium bovis
FEDDTQGGAVNGED

SEQ ID NO: 155609 - protein, 14 aa, Mycobacterium bovis
FTSTDTVTVSSPRA

SEQ ID NO: 155610 - protein, 5 aa, Mycobacterium bovis
GAAGN

SEQ ID NO: 155611 - protein, 9 aa, Mycobacterium bovis
GADQATLGS

SEQ ID NO: 155612 - protein, 29 aa, Mycobacterium bovis
GADQTGPQVKAADSAESDAGELGEDACPE

SEQ ID NO: 155613 - protein, 5 aa, Mycobacterium bovis
GAESG

SEQ ID NO: 155614 - protein, 7 aa, Mycobacterium bovis
GAGAGAA

SEQ ID NO: 155615 - protein, 15 aa, Mycobacterium bovis
GAGDEQLVQVAWSPP

SEQ ID NO: 155616 - protein, 54 aa, Mycobacterium bovis
GAKRPGAKKTPPPAPGLAEPAAQPQPEAKPQPEPAAPPKPQTDGDPAAPAAPVK

SEQ ID NO: 155617 - protein, 6 aa, Mycobacterium bovis
GAPDSV

SEQ ID NO: 155618 - protein, 10 aa, Mycobacterium bovis
GAPQTGKSTA

SEQ ID NO: 155619 - protein, 23 aa, Mycobacterium bovis
GDEHARERTPDAGRDRTFSGQHR

SEQ ID NO: 155620 - protein, 10 aa, Mycobacterium bovis
GDPSGTGRTL

SEQ ID NO: 155621 - protein, 23 aa, Mycobacterium bovis
GDTASPVGSSGASGGAIASGSVA

SEQ ID NO: 155622 - protein, 10 aa, Mycobacterium bovis
GELGEDACPE

SEQ ID NO: 155623 - protein, 5 aa, Mycobacterium bovis
GEMSR

SEQ ID NO: 155624 - protein, 7 aa, Mycobacterium bovis
GGGGRMS

SEQ ID NO: 155625 - protein, 12 aa, Mycobacterium bovis
GGQTSGASSARL

SEQ ID NO: 155626 - protein, 4 aa, Mycobacterium bovis
GGTF

SEQ ID NO: 155627 - protein, 6 aa, Mycobacterium bovis
GHRGGV

SEQ ID NO: 155628 - protein, 4 aa, Mycobacterium bovis
GIGP

SEQ ID NO: 155629 - protein, 15 aa, Mycobacterium bovis
GIGPARLDKLRNLVR

SEQ ID NO: 155630 - protein, 7 aa, Mycobacterium bovis
GKDGNAG

SEQ ID NO: 155631 - protein, 5 aa, Mycobacterium bovis
GKPYD

SEQ ID NO: 155632 - protein, 8 aa, Mycobacterium bovis
GLRGHGDD

SEQ ID NO: 155633 - protein, 11 aa, Mycobacterium bovis
GLRPLSGSGYS

SEQ ID NO: 155634 - protein, 6 aa, Mycobacterium bovis
GPEANS

SEQ ID NO: 155635 - protein, 4 aa, Mycobacterium bovis
GPHA

SEQ ID NO: 155636 - protein, 13 aa, Mycobacterium bovis
GPVRASSERTLQP

SEQ ID NO: 155637 - protein, 6 aa, Mycobacterium bovis
GQRPRN

SEQ ID NO: 155638 - protein, 6 aa, Mycobacterium bovis
GRAPER

SEQ ID NO: 155639 - protein, 7 aa, Mycobacterium bovis
GRAQPQL

SEQ ID NO: 155640 - protein, 4 aa, Mycobacterium bovis
GRGD

SEQ ID NO: 155641 - protein, 8 aa, Mycobacterium bovis
GRPDEGAL

SEQ ID NO: 155642 - protein, 5 aa, Mycobacterium bovis
GRTGR

SEQ ID NO: 155643 - protein, 5 aa, Mycobacterium bovis
GSGVV

SEQ ID NO: 155644 - protein, 9 aa, Mycobacterium bovis
GSSNSPISG

SEQ ID NO: 155645 - protein, 10 aa, Mycobacterium bovis
GTEDQPVAAE
